United States Patent 11,640,849 (METHODS FOR HISTOLOGICAL DIAGNOSIS AND TREATMENT OF DISEASES) - sequence listing, part 5

SEQ ID NO: 155646 - protein, 10 aa, Mycobacterium bovis
GTPPGRGGSA

SEQ ID NO: 155647 - protein, 6 aa, Mycobacterium bovis
GTRASV

SEQ ID NO: 155648 - protein, 21 aa, Mycobacterium bovis
GTRRIGRGRAGGGETRGADHL

SEQ ID NO: 155649 - protein, 11 aa, Mycobacterium bovis
GTVTNTGDRPV

SEQ ID NO: 155650 - protein, 17 aa, Mycobacterium bovis
GVPARNEPPSDPSAPIP

SEQ ID NO: 155651 - protein, 7 aa, Mycobacterium bovis
GVSAPQL

SEQ ID NO: 155652 - protein, 21 aa, Mycobacterium bovis
GWQSAPPGYPPPYPQYPGPGS

SEQ ID NO: 155653 - protein, 20 aa, Mycobacterium bovis
GYDPNAGYSAHAGAQPQRIP

SEQ ID NO: 155654 - protein, 4 aa, Mycobacterium bovis
HDAG

SEQ ID NO: 155655 - protein, 4 aa, Mycobacterium bovis
HGPA

SEQ ID NO: 155656 - protein, 8 aa, Mycobacterium bovis
HGPTTPPF

SEQ ID NO: 155657 - protein, 7 aa, Mycobacterium bovis
HKSPRDH

SEQ ID NO: 155658 - protein, 4 aa, Mycobacterium bovis
HPDP

SEQ ID NO: 155659 - protein, 24 aa, Mycobacterium bovis
HPDPTALASVPGSRRQWERDPHDP

SEQ ID NO: 155660 - protein, 9 aa, Mycobacterium bovis
HPIDPRSYS

SEQ ID NO: 155661 - protein, 11 aa, Mycobacterium bovis
HPLPDPGESVP

SEQ ID NO: 155662 - protein, 6 aa, Mycobacterium bovis
HPLTTS

SEQ ID NO: 155663 - protein, 11 aa, Mycobacterium bovis
HRANGQPPERA

SEQ ID NO: 155664 - protein, 9 aa, Mycobacterium bovis
HRQRRPRRR

SEQ ID NO: 155665 - protein, 4 aa, Mycobacterium bovis
HRQT

SEQ ID NO: 155666 - protein, 10 aa, Mycobacterium bovis
HVQNDGGGRH

SEQ ID NO: 155667 - protein, 14 aa, Mycobacterium bovis
IASGDGTVKRSGAR

SEQ ID NO: 155668 - protein, 8 aa, Mycobacterium bovis
IDGDPTKV

SEQ ID NO: 155669 - protein, 7 aa, Mycobacterium bovis
IEGVASP

SEQ ID NO: 155670 - protein, 5 aa, Mycobacterium bovis
IGPPI

SEQ ID NO: 155671 - protein, 8 aa, Mycobacterium bovis
INGVARDD

SEQ ID NO: 155672 - protein, 11 aa, Mycobacterium bovis
IPPAPTGGDAV

SEQ ID NO: 155673 - protein, 8 aa, Mycobacterium bovis
ISYSGNQA

SEQ ID NO: 155674 - protein, 10 aa, Mycobacterium bovis
KGDGPNADGL

SEQ ID NO: 155675 - protein, 8 aa, Mycobacterium bovis
KGKPMAAD

SEQ ID NO: 155676 - protein, 10 aa, Mycobacterium bovis
KGKPMAADAD

SEQ ID NO: 155677 - protein, 14 aa, Mycobacterium bovis
KGKPMAADADLDGL

SEQ ID NO: 155678 - protein, 12 aa, Mycobacterium bovis
KMPSQTPPEPPT

SEQ ID NO: 155679 - protein, 6 aa, Mycobacterium bovis
KPPQHK

SEQ ID NO: 155680 - protein, 6 aa, Mycobacterium bovis
KRPPRF

SEQ ID NO: 155681 - protein, 17 aa, Mycobacterium bovis
KSHSHPHTSNDNPLSEA

SEQ ID NO: 155682 - protein, 4 aa, Mycobacterium bovis
LAGK

SEQ ID NO: 155683 - protein, 7 aa, Mycobacterium bovis
LAQDPDG

SEQ ID NO: 155684 - protein, 6 aa, Mycobacterium bovis
LDDAGV

SEQ ID NO: 155685 - protein, 23 aa, Mycobacterium bovis
LEPQAAPAPFEPPTAGSSLPTRI

SEQ ID NO: 155686 - protein, 6 aa, Mycobacterium bovis
LETNAT

SEQ ID NO: 155687 - protein, 9 aa, Mycobacterium bovis
LGAPQVAGA

SEQ ID NO: 155688 - protein, 5 aa, Mycobacterium bovis
LGDGE

SEQ ID NO: 155689 - protein, 6 aa, Mycobacterium bovis
LGPART

SEQ ID NO: 155690 - protein, 7 aa, Mycobacterium bovis
LNPRTRE

SEQ ID NO: 155691 - protein, 6 aa, Mycobacterium bovis
LPGGDT

SEQ ID NO: 155692 - protein, 11 aa, Mycobacterium bovis
LPPAQRADPVT

SEQ ID NO: 155693 - protein, 9 aa, Mycobacterium bovis
LRRASPSAV

SEQ ID NO: 155694 - protein, 8 aa, Mycobacterium bovis
LTAPRPAT

SEQ ID NO: 155695 - protein, 12 aa, Mycobacterium bovis
LTPGRGFRNGPF

SEQ ID NO: 155696 - protein, 14 aa, Mycobacterium bovis
LTTDRGAEPELGAQ

SEQ ID NO: 155697 - protein, 5 aa, Mycobacterium bovis
MPPCP

SEQ ID NO: 155698 - protein, 15 aa, Mycobacterium bovis
NAQRRATAKRKLERQ

SEQ ID NO: 155699 - protein, 5 aa, Mycobacterium bovis
NAQSD

SEQ ID NO: 155700 - protein, 7 aa, Mycobacterium bovis
NECGKTA

SEQ ID NO: 155701 - protein, 5 aa, Mycobacterium bovis
NGRFT

SEQ ID NO: 155702 - protein, 7 aa, Mycobacterium bovis
NIPPTRF

SEQ ID NO: 155703 - protein, 7 aa, Mycobacterium bovis
NPEQHKD

SEQ ID NO: 155704 - protein, 10 aa, Mycobacterium bovis
NPVPSTGAKI

SEQ ID NO: 155705 - protein, 6 aa, Mycobacterium bovis
NSLPES

SEQ ID NO: 155706 - protein, 4 aa, Mycobacterium bovis
NSPE

SEQ ID NO: 155707 - protein, 8 aa, Mycobacterium bovis
NTPTDTIS

SEQ ID NO: 155708 - protein, 6 aa, Mycobacterium bovis
NVDTSE

SEQ ID NO: 155709 - protein, 13 aa, Mycobacterium bovis
NYSGDSPATAQQV

SEQ ID NO: 155710 - protein, 51 aa, Mycobacterium bovis
PADANKSSSTEVKAADSAESDAGADQTGPQVKAADSAESDAGELGEDACPE

SEQ ID NO: 155711 - protein, 10 aa, Mycobacterium bovis
PADPRPKRQR

SEQ ID NO: 155712 - protein, 22 aa, Mycobacterium bovis
PAGTTAATAVGEAGLPRRGTPD

SEQ ID NO: 155713 - protein, 9 aa, Mycobacterium bovis
PAHRPSSQA

SEQ ID NO: 155714 - protein, 9 aa, Mycobacterium bovis
PAPDVSQAQ

SEQ ID NO: 155715 - protein, 11 aa, Mycobacterium bovis
PARPNRPEADR

SEQ ID NO: 155716 - protein, 8 aa, Mycobacterium bovis
PASPWATP

SEQ ID NO: 155717 - protein, 15 aa, Mycobacterium bovis
PCSGDAANAPPPPSA

SEQ ID NO: 155718 - protein, 12 aa, Mycobacterium bovis
PDIPTKQTGGSF

SEQ ID NO: 155719 - protein, 15 aa, Mycobacterium bovis
PDRRGVQAATPVVNT

SEQ ID NO: 155720 - protein, 20 aa, Mycobacterium bovis
PESDTADRQVETPPSPPADA

SEQ ID NO: 155721 - protein, 26 aa, Mycobacterium bovis
PETWRRRKRRQSQKIRRSVQKQRRST

SEQ ID NO: 155722 - protein, 10 aa, Mycobacterium bovis
PGADLDEDTI

SEQ ID NO: 155723 - protein, 10 aa, Mycobacterium bovis
PGARNAAPLQ

SEQ ID NO: 155724 - protein, 5 aa, Mycobacterium bovis
PGFVG

SEQ ID NO: 155725 - protein, 15 aa, Mycobacterium bovis
PGLSQPSDVLPADDG

SEQ ID NO: 155726 - protein, 4 aa, Mycobacterium bovis
PGNA

SEQ ID NO: 155727 - protein, 8 aa, Mycobacterium bovis
PGTPRAPA

SEQ ID NO: 155728 - protein, 25 aa, Mycobacterium bovis
PHDKPSPAPSAPTFTSQQISDAKEN

SEQ ID NO: 155729 - protein, 4 aa, Mycobacterium bovis
PHIP

SEQ ID NO: 155730 - protein, 14 aa, Mycobacterium bovis
PIATGDHKAPAAKE

SEQ ID NO: 155731 - protein, 8 aa, Mycobacterium bovis
PKNARTQD

SEQ ID NO: 155732 - protein, 13 aa, Mycobacterium bovis
PKPVQPPQPVAEE

SEQ ID NO: 155733 - protein, 6 aa, Mycobacterium bovis
PLPSLA

SEQ ID NO: 155734 - protein, 10 aa, Mycobacterium bovis
PLSHRNTQPG

SEQ ID NO: 155735 - protein, 4 aa, Mycobacterium bovis
PPAG

SEQ ID NO: 155736 - protein, 25 aa, Mycobacterium bovis
PPEGQGDDPDWKPEEDWRDDPVEGG

SEQ ID NO: 155737 - protein, 8 aa, Mycobacterium bovis
PPGQSGQL

SEQ ID NO: 155738 - protein, 14 aa, Mycobacterium bovis
PPKTPSPKPLSPNA

SEQ ID NO: 155739 - protein, 75 aa, Mycobacterium bovis
PPPVAPGYAPAGYPPYPATPPGYGPPGYGAPPSYGPPPGYGPPLGYPAAPPGCGPPPGYGPPLGYGPPLAPGAVK

SEQ ID NO: 155740 - protein, 25 aa, Mycobacterium bovis
PPVEPVSPTNPRSSASPGSPDRSGL

SEQ ID NO: 155741 - protein, 54 aa, Mycobacterium bovis
PRANPGPNPAPNPPATGPQPPNATQLTPNPAPAPDPAPAAAPDPGATLAGATTS

SEQ ID NO: 155742 - protein, 4 aa, Mycobacterium bovis
PRAP

SEQ ID NO: 155743 - protein, 6 aa, Mycobacterium bovis
PRGPLP

SEQ ID NO: 155744 - protein, 31 aa, Mycobacterium bovis
PRLSGRMDRGGSAAGASRQRRTKGAGGSFTS

SEQ ID NO: 155745 - protein, 8 aa, Mycobacterium bovis
PRRRTDRR

SEQ ID NO: 155746 - protein, 10 aa, Mycobacterium bovis
PSSGNGDAAY

SEQ ID NO: 155747 - protein, 6 aa, Mycobacterium bovis
PSVPRR

SEQ ID NO: 155748 - protein, 14 aa, Mycobacterium bovis
PTAAGEPNAAPAAC

SEQ ID NO: 155749 - protein, 18 aa, Mycobacterium bovis
PTMPEAEDIGNEAAGGRL

SEQ ID NO: 155750 - protein, 11 aa, Mycobacterium bovis
PTTAAGSAALG

SEQ ID NO: 155751 - protein, 73 aa, Mycobacterium bovis
PVAPGYAPAGYPPYPATPPGYGPPGYGAPPSYGPPPGYGPPLGYPAAPPGCGPPPGYGPPLGYGPPLAPGAVK

SEQ ID NO: 155752 - protein, 11 aa, Mycobacterium bovis
PVDRPGRGLSR

SEQ ID NO: 155753 - protein, 10 aa, Mycobacterium bovis
PVPGETVDNE

SEQ ID NO: 155754 - protein, 4 aa, Mycobacterium bovis
PVPR

SEQ ID NO: 155755 - protein, 17 aa, Mycobacterium bovis
PVSEADADDEDNELTGI

SEQ ID NO: 155756 - protein, 16 aa, Mycobacterium bovis
PVSPPTQPEQQPQTEH

SEQ ID NO: 155757 - protein, 13 aa, Mycobacterium bovis
PYHGLSDGEAAQR

SEQ ID NO: 155758 - protein, 61 aa, Mycobacterium bovis
PYPATPPGYGPPGYGAPPSYGPPPGYGPPLGYPAAPPGCGPPPGYGPPLGYGPPLAPGAVK

SEQ ID NO: 155759 - protein, 8 aa, Mycobacterium bovis
QADYDEAM

SEQ ID NO: 155760 - protein, 7 aa, Mycobacterium bovis
QAPVDPQ

SEQ ID NO: 155761 - protein, 14 aa, Mycobacterium bovis
QAQPAGSYGGVTPS

SEQ ID NO: 155762 - protein, 9 aa, Mycobacterium bovis
QATPNGAAP

SEQ ID NO: 155763 - protein, 7 aa, Mycobacterium bovis
QDRDLGN

SEQ ID NO: 155764 - protein, 4 aa, Mycobacterium bovis
QGGR

SEQ ID NO: 155765 - protein, 6 aa, Mycobacterium bovis
QGGTAG

SEQ ID NO: 155766 - protein, 5 aa, Mycobacterium bovis
QHPNA

SEQ ID NO: 155767 - protein, 5 aa, Mycobacterium bovis
QLEPQ

SEQ ID NO: 155768 - protein, 9 aa, Mycobacterium bovis
QLPNTPGAG

SEQ ID NO: 155769 - protein, 13 aa, Mycobacterium bovis
QLPPLPRATTATT

SEQ ID NO: 155770 - protein, 21 aa, Mycobacterium bovis
QPDPDASLGCGDGSPAEAYAS

SEQ ID NO: 155771 - protein, 14 aa, Mycobacterium bovis
QPPAGSFSPGGHDA

SEQ ID NO: 155772 - protein, 26 aa, Mycobacterium bovis
QPPPPPGPVPAPGPAQAPPPESPAQG

SEQ ID NO: 155773 - protein, 9 aa, Mycobacterium bovis
QPWPEPGDE

SEQ ID NO: 155774 - protein, 7 aa, Mycobacterium bovis
QQNSAGR

SEQ ID NO: 155775 - protein, 20 aa, Mycobacterium bovis
QRCRRRGTNSSDNNTNASAK

SEQ ID NO: 155776 - protein, 4 aa, Mycobacterium bovis
QREL

SEQ ID NO: 155777 - protein, 4 aa, Mycobacterium bovis
QRNR

SEQ ID NO: 155778 - protein, 6 aa, Mycobacterium bovis
QRRDHR

SEQ ID NO: 155779 - protein, 4 aa, Mycobacterium bovis
QTEH

SEQ ID NO: 155780 - protein, 5 aa, Mycobacterium bovis
QTGTG

SEQ ID NO: 155781 - protein, 28 aa, Mycobacterium bovis
QTNGDSPGRHGGRGTPSPTDGPRASTES

SEQ ID NO: 155782 - protein, 6 aa, Mycobacterium bovis
QTTGRA

SEQ ID NO: 155783 - protein, 7 aa, Mycobacterium bovis
RAADPGM

SEQ ID NO: 155784 - protein, 9 aa, Mycobacterium bovis
RADPGRAGA

SEQ ID NO: 155785 - protein, 5 aa, Mycobacterium bovis
RAGDE

SEQ ID NO: 155786 - protein, 12 aa, Mycobacterium bovis
RALPDDVRRDRA

SEQ ID NO: 155787 - protein, 7 aa, Mycobacterium bovis
RAPRGDE

SEQ ID NO: 155788 - protein, 8 aa, Mycobacterium bovis
RARQTGAQ

SEQ ID NO: 155789 - protein, 15 aa, Mycobacterium bovis
RASGPDSGGKARFVP

SEQ ID NO: 155790 - protein, 8 aa, Mycobacterium bovis
RDGEWTTN

SEQ ID NO: 155791 - protein, 9 aa, Mycobacterium bovis
RDPARPARP

SEQ ID NO: 155792 - protein, 5 aa, Mycobacterium bovis
RDVAA

SEQ ID NO: 155793 - protein, 6 aa, Mycobacterium bovis
RFPDPK

SEQ ID NO: 155794 - protein, 9 aa, Mycobacterium bovis
RGAPGGPQH

SEQ ID NO: 155795 - protein, 9 aa, Mycobacterium bovis
RGDQKNASL

SEQ ID NO: 155796 - protein, 5 aa, Mycobacterium bovis
RGGAS

SEQ ID NO: 155797 - protein, 8 aa, Mycobacterium bovis
RGGPAAGH

SEQ ID NO: 155798 - protein, 8 aa, Mycobacterium bovis
RGGPRKRH

SEQ ID NO: 155799 - protein, 4 aa, Mycobacterium bovis
RGGR

SEQ ID NO: 155800 - protein, 6 aa, Mycobacterium bovis
RGPRQT

SEQ ID NO: 155801 - protein, 4 aa, Mycobacterium bovis
RGTH

SEQ ID NO: 155802 - protein, 5 aa, Mycobacterium bovis
RHHRN

SEQ ID NO: 155803 - protein, 4 aa, Mycobacterium bovis
RIGV

SEQ ID NO: 155804 - protein, 4 aa, Mycobacterium bovis
RKED

SEQ ID NO: 155805 - protein, 26 aa, Mycobacterium bovis
RKRANPQPAQTQPARKTPARRPDSLP

SEQ ID NO: 155806 - protein, 9 aa, Mycobacterium bovis
RKVPKSRRA

SEQ ID NO: 155807 - protein, 6 aa, Mycobacterium bovis
RLDEGR

SEQ ID NO: 155808 - protein, 5 aa, Mycobacterium bovis
RLDQG

SEQ ID NO: 155809 - protein, 8 aa, Mycobacterium bovis
RPGSPPLK

SEQ ID NO: 155810 - protein, 9 aa, Mycobacterium bovis
RPIDETSLG

SEQ ID NO: 155811 - protein, 8 aa, Mycobacterium bovis
RPMPLPPG

SEQ ID NO: 155812 - protein, 8 aa, Mycobacterium bovis
RPTDRARR

SEQ ID NO: 155813 - protein, 5 aa, Mycobacterium bovis
RRPGA

SEQ ID NO: 155814 - protein, 9 aa, Mycobacterium bovis
RRRGGDPVS

SEQ ID NO: 155815 - protein, 10 aa, Mycobacterium bovis
RRSGDPVAPP

SEQ ID NO: 155816 - protein, 4 aa, Mycobacterium bovis
RSAT

SEQ ID NO: 155817 - protein, 7 aa, Mycobacterium bovis
RSGGAAR

SEQ ID NO: 155818 - protein, 9 aa, Mycobacterium bovis
RSSGGDSGA

SEQ ID NO: 155819 - protein, 4 aa, Mycobacterium bovis
RSYR

SEQ ID NO: 155820 - protein, 5 aa, Mycobacterium bovis
RTERY

SEQ ID NO: 155821 - protein, 5 aa, Mycobacterium bovis
RTPST

SEQ ID NO: 155822 - protein, 19 aa, Mycobacterium bovis
RYRRSPPAESGHHSNRRQA

SEQ ID NO: 155823 - protein, 17 aa, Mycobacterium bovis
SAAPTDPSSSSTDSPVD

SEQ ID NO: 155824 - protein, 27 aa, Mycobacterium bovis
SAHLDPEPHDPTDDGPDHDEPRDDPNS

SEQ ID NO: 155825 - protein, 5 aa, Mycobacterium bovis
SALST

SEQ ID NO: 155826 - protein, 4 aa, Mycobacterium bovis
SAPL

SEQ ID NO: 155827 - protein, 4 aa, Mycobacterium bovis
SAQG

SEQ ID NO: 155828 - protein, 11 aa, Mycobacterium bovis
SASESRNVLGT

SEQ ID NO: 155829 - protein, 5 aa, Mycobacterium bovis
SDDTS

SEQ ID NO: 155830 - protein, 7 aa, Mycobacterium bovis
SGPAGVD

SEQ ID NO: 155831 - protein, 8 aa, Mycobacterium bovis
SGRAAAAG

SEQ ID NO: 155832 - protein, 11 aa, Mycobacterium bovis
SIATSSPGRCD

SEQ ID NO: 155833 - protein, 7 aa, Mycobacterium bovis
SKAEAAL

SEQ ID NO: 155834 - protein, 11 aa, Mycobacterium bovis
SKGEPLSDHSP

SEQ ID NO: 155835 - protein, 4 aa, Mycobacterium bovis
SMEP

SEQ ID NO: 155836 - protein, 4 aa, Mycobacterium bovis
SNDG

SEQ ID NO: 155837 - protein, 5 aa, Mycobacterium bovis
SPAAF

SEQ ID NO: 155838 - protein, 6 aa, Mycobacterium bovis
SPATRH

SEQ ID NO: 155839 - protein, 12 aa, Mycobacterium bovis
SPEGQASSLESI

SEQ ID NO: 155840 - protein, 20 aa, Mycobacterium bovis
SPLGGSASSLAAIPGASVPQ

SEQ ID NO: 155841 - protein, 34 aa, Mycobacterium bovis
SPWARPGDQGPLARPPASSEASTGRLRPGEPAGH

SEQ ID NO: 155842 - protein, 18 aa, Mycobacterium bovis
SRQRKAKVTQDDTGTYRI

SEQ ID NO: 155843 - protein, 6 aa, Mycobacterium bovis
SSLTGE

SEQ ID NO: 155844 - protein, 5 aa, Mycobacterium bovis
SSNQL

SEQ ID NO: 155845 - protein, 9 aa, Mycobacterium bovis
SSPAALGAK

SEQ ID NO: 155846 - protein, 8 aa, Mycobacterium bovis
SSPTTSAA

SEQ ID NO: 155847 - protein, 9 aa, Mycobacterium bovis
STAAPMSTT

SEQ ID NO: 155848 - protein, 7 aa, Mycobacterium bovis
STQDRRV

SEQ ID NO: 155849 - protein, 7 aa, Mycobacterium bovis
STSFPSG

SEQ ID NO: 155850 - protein, 27 aa, Mycobacterium bovis
SVGAGTPGPAGTSGTATTGPKTAPKTA

SEQ ID NO: 155851 - protein, 5 aa, Mycobacterium bovis
SYTYP

SEQ ID NO: 155852 - protein, 8 aa, Mycobacterium bovis
TAEAEAMR

SEQ ID NO: 155853 - protein, 5 aa, Mycobacterium bovis
TAENP

SEQ ID NO: 155854 - protein, 9 aa, Mycobacterium bovis
TAERGNGAI

SEQ ID NO: 155855 - protein, 10 aa, Mycobacterium bovis
TAPAPQGPWS

SEQ ID NO: 155856 - protein, 9 aa, Mycobacterium bovis
TATASQRYH

SEQ ID NO: 155857 - protein, 35 aa, Mycobacterium bovis
TDPGATALGPVRPGHGPIPTGRKPRGANDRAPLPK

SEQ ID NO: 155858 - protein, 23 aa, Mycobacterium bovis
TDPMSAPAQPAPGVDGGDPSQAR

SEQ ID NO: 155859 - protein, 56 aa, Mycobacterium bovis
TEPLATESKDEPAEHPEFEGPRRRARRERAERRAAQARATAIEQARRAAKRRARGQ

SEQ ID NO: 155860 - protein, 4 aa, Mycobacterium bovis
TEPV

SEQ ID NO: 155861 - protein, 6 aa, Mycobacterium bovis
TETDDR

SEQ ID NO: 155862 - protein, 8 aa, Mycobacterium bovis
TGATARES

SEQ ID NO: 155863 - protein, 8 aa, Mycobacterium bovis
TGDRKPIR

SEQ ID NO: 155864 - protein, 21 aa, Mycobacterium bovis
TGEGHGQPAGRRARGNGAPAR

SEQ ID NO: 155865 - protein, 4 aa, Mycobacterium bovis
TGEQ

SEQ ID NO: 155866 - protein, 11 aa, Mycobacterium bovis
TGGPRVGTDRV

SEQ ID NO: 155867 - protein, 9 aa, Mycobacterium bovis
TGHSSGVGG

SEQ ID NO: 155868 - protein, 10 aa, Mycobacterium bovis
TGPDSPNKTL

SEQ ID NO: 155869 - protein, 6 aa, Mycobacterium bovis
TGRGRR

SEQ ID NO: 155870 - protein, 10 aa, Mycobacterium bovis
TGSTPGAFDS

SEQ ID NO: 155871 - protein, 7 aa, Mycobacterium bovis
THSSGRI

SEQ ID NO: 155872 - protein, 7 aa, Mycobacterium bovis
TKDPEKF

SEQ ID NO: 155873 - protein, 7 aa, Mycobacterium bovis
TLPPDAI

SEQ ID NO: 155874 - protein, 9 aa, Mycobacterium bovis
TLSSDPDFR

SEQ ID NO: 155875 - protein, 15 aa, Mycobacterium bovis
TNQANPVPGDPTGDL

SEQ ID NO: 155876 - protein, 12 aa, Mycobacterium bovis
TNTGGGPTTNAN

SEQ ID NO: 155877 - protein, 38 aa, Mycobacterium bovis
TPFAEPYPEQRPPWGVPPPGWDGSSRPAPSTTPRSPGR

SEQ ID NO: 155878 - protein, 5 aa, Mycobacterium bovis
TPGAT

SEQ ID NO: 155879 - protein, 8 aa, Mycobacterium bovis
TPPPHQTP

SEQ ID NO: 155880 - protein, 16 aa, Mycobacterium bovis
TPQRSLTRGLTPAPTA

SEQ ID NO: 155881 - protein, 33 aa, Mycobacterium bovis
TPRPAPPGSAAAKYPTRHSAPPCPTASGYAHPA

SEQ ID NO: 155882 - protein, 18 aa, Mycobacterium bovis
TPVANPQQVSVPEGGTVG

SEQ ID NO: 155883 - protein, 6 aa, Mycobacterium bovis
TPWQQT

SEQ ID NO: 155884 - protein, 9 aa, Mycobacterium bovis
TQQGQLGAK

SEQ ID NO: 155885 - protein, 8 aa, Mycobacterium bovis
TQVATGSV

SEQ ID NO: 155886 - protein, 5 aa, Mycobacterium bovis
TRDAV

SEQ ID NO: 155887 - protein, 8 aa, Mycobacterium bovis
TREDTGYH

SEQ ID NO: 155888 - protein, 5 aa, Mycobacterium bovis
TRPWT

SEQ ID NO: 155889 - protein, 10 aa, Mycobacterium bovis
TRQANPKLPA

SEQ ID NO: 155890 - protein, 6 aa, Mycobacterium bovis
TRRPSR

SEQ ID NO: 155891 - protein, 5 aa, Mycobacterium bovis
TSPAK

SEQ ID NO: 155892 - protein, 31 aa, Mycobacterium bovis
TSRRQRKSAPARISGDRIESPAPSARSESLA

SEQ ID NO: 155893 - protein, 8 aa, Mycobacterium bovis
TSVSGAVG

SEQ ID NO: 155894 - protein, 14 aa, Mycobacterium bovis
TTARAARRYGAGNR

SEQ ID NO: 155895 - protein, 8 aa, Mycobacterium bovis
TTDSAEGV

SEQ ID NO: 155896 - protein, 5 aa, Mycobacterium bovis
TTHDV

SEQ ID NO: 155897 - protein, 50 aa, Mycobacterium bovis
TTTAPPVTTTPRPSPTTTTTTAPPSTTTTTELPVTTTSTIPTIPTTTTTV

SEQ ID NO: 155898 - protein, 12 aa, Mycobacterium bovis
VAEEPEPELPGV

SEQ ID NO: 155899 - protein, 8 aa, Mycobacterium bovis
VAPPSVRP

SEQ ID NO: 155900 - protein, 9 aa, Mycobacterium bovis
VAPTSSSVA

SEQ ID NO: 155901 - protein, 8 aa, Mycobacterium bovis
VDPGSIPD

SEQ ID NO: 155902 - protein, 12 aa, Mycobacterium bovis
VGLGASARERNI

SEQ ID NO: 155903 - protein, 25 aa, Mycobacterium bovis
VGSTGRDPATATRRRSAAGDPITRG

SEQ ID NO: 155904 - protein, 7 aa, Mycobacterium bovis
VHTGPGT

SEQ ID NO: 155905 - protein, 7 aa, Mycobacterium bovis
VNTGDQI

SEQ ID NO: 155906 - protein, 9 aa, Mycobacterium bovis
VPDPGGAAF

SEQ ID NO: 155907 - protein, 5 aa, Mycobacterium bovis
VRAGD

SEQ ID NO: 155908 - protein, 8 aa, Mycobacterium bovis
VSKDNGQT

SEQ ID NO: 155909 - protein, 7 aa, Mycobacterium bovis
VTPDGTA

SEQ ID NO: 155910 - protein, 7 aa, Mycobacterium bovis
VTQTAAA

SEQ ID NO: 155911 - protein, 20 aa, Mycobacterium bovis
VTSGDASNRYSGSPVRQPGF

SEQ ID NO: 155912 - protein, 8 aa, Mycobacterium bovis
WRTGRQAT

SEQ ID NO: 155913 - protein, 8 aa, Mycobacterium bovis
YDQPATTV

SEQ ID NO: 155914 - protein, 12 aa, Mycobacterium bovis
YGENNLAATATS

SEQ ID NO: 155915 - protein, 7 aa, Mycobacterium bovis
YGNEAPK

SEQ ID NO: 155916 - protein, 13 aa, Mycobacterium bovis
YNADGSLRKPGQD

SEQ ID NO: 155917 - protein, 6 aa, Mycobacterium bovis
YPRTAA

SEQ ID NO: 155918 - protein, 7 aa, Mycobacterium bovis
YSEHPAA

SEQ ID NO: 155919 - protein, 8 aa, Mycobacterium bovis
YTPPEAEE

SEQ ID NO: 155920 - protein, 24 aa, Mycobacterium bovis
LASDRGAGALGFVGTAGKESVGQP

SEQ ID NO: 155921 - protein, 24 aa, Mycobacterium bovis
WSEGPRYQRLMLWIIGSVFLLLMV

SEQ ID NO: 155922 - protein, 17 aa, Mycobacterium bovis
ALLYKPFVRQIRTTRQM

SEQ ID NO: 155923 - protein, 19 aa, Mycobacterium bovis
GAVAFSIVRRSSRPEPSPR

SEQ ID NO: 155924 - protein, 17 aa, Mycobacterium bovis
IILYWFSNNIWTFGQQH

SEQ ID NO: 155925 - protein, 19 aa, Mycobacterium bovis
KPFVRQIRTTRQMQELQPQ

SEQ ID NO: 155926 - protein, 21 aa, Mycobacterium bovis
PSNFFAWALSVMFLVFTLRAL

SEQ ID NO: 155927 - protein, 23 aa, Mycobacterium bovis
PVPMLPGSWGPDLVGVAGDGGLV

SEQ ID NO: 155928 - protein, 24 aa, Mycobacterium bovis
QFVMPDLSGMFWVDAEPRLRALGW

SEQ ID NO: 155929 - protein, 19 aa, Mycobacterium bovis
QLLLLPVAWYLIVGSHQPA

SEQ ID NO: 155930 - protein, 24 aa, Mycobacterium bovis
RGLLELGVGLGLQSARSTAAGLRR

SEQ ID NO: 155931 - protein, 26 aa, Mycobacterium bovis
RPALIAVGVPVMILAGIATYFNSRAS

SEQ ID NO: 155932 - protein, 17 aa, Mycobacterium bovis
SLDFIYYPVSWIMWVWY

SEQ ID NO: 155933 - protein, 19 aa, Mycobacterium bovis
SPPSIRWAAGRDQRGAASA

SEQ ID NO: 155934 - protein, 24 aa, Mycobacterium bovis
TQRRSKHHLWIFAGIAAAILAGGA

SEQ ID NO: 155935 - protein, 22 aa, Mycobacterium bovis
WIMWVWYRLFAFVLGPSNFFAW

SEQ ID NO: 155936 - protein, 17 aa, Mycobacterium bovis
YVFPLGVVVGGPFLPLA

SEQ ID NO: 155937 - protein, 21 aa, Mycobacterium bovis
AAAHRRVWRDREPALASPRRP

SEQ ID NO: 155938 - protein, 18 aa, Mycobacterium bovis
AAAIGARYQQAFALMYGE

SEQ ID NO: 155939 - protein, 21 aa, Mycobacterium bovis
AAAKRSALVHWSRRPASTQSW

SEQ ID NO: 155940 - protein, 25 aa, Mycobacterium bovis
AAALAVAVLARWRFRRRPAPARLPL

SEQ ID NO: 155941 - protein, 22 aa, Mycobacterium bovis
AAALGLRGTRKAEEAAESARLK

SEQ ID NO: 155942 - protein, 18 aa, Mycobacterium bovis
AAALIIIVGVVFVEQGQR

SEQ ID NO: 155943 - protein, 17 aa, Mycobacterium bovis
AAANAFLDGLVAYRRSR

SEQ ID NO: 155944 - protein, 20 aa, Mycobacterium bovis
AAAPCALAIAVPVTVVASIG

SEQ ID NO: 155945 - protein, 27 aa, Mycobacterium bovis
AAAPRCWQARAVSWMWQALAATLVAAV

SEQ ID NO: 155946 - protein, 17 aa, Mycobacterium bovis
AAARGLYMAFTVLAAAG

SEQ ID NO: 155947 - protein, 29 aa, Mycobacterium bovis
AAARSSALPAYWERLAVCWQLGSDHGLAI

SEQ ID NO: 155948 - protein, 19 aa, Mycobacterium bovis
AAAVGARLMQLRGRRSATS

SEQ ID NO: 155949 - protein, 20 aa, Mycobacterium bovis
AAAVLTWKVYDRRTVTDMGM

SEQ ID NO: 155950 - protein, 25 aa, Mycobacterium bovis
AAAWAFSLAMIDGWQRGFAGRLTTR

SEQ ID NO: 155951 - protein, 23 aa, Mycobacterium bovis
AADELYTRVGFVLQEAQLVHGTA

SEQ ID NO: 155952 - protein, 18 aa, Mycobacterium bovis
AADGDWPPDEDFGSEHFG

SEQ ID NO: 155953 - protein, 27 aa, Mycobacterium bovis
AADPVFLDWLVGLAFPCQRPFGHQYGV

SEQ ID NO: 155954 - protein, 19 aa, Mycobacterium bovis
AAEGNWAAAIRHRLQAVAR

SEQ ID NO: 155955 - protein, 18 aa, Mycobacterium bovis
AAELSRWTFAGHTHYLII

SEQ ID NO: 155956 - protein, 22 aa, Mycobacterium bovis
AAEPKSSAGPMFSTYGIASTLL

SEQ ID NO: 155957 - protein, 20 aa, Mycobacterium bovis
AAFCYAAAVVTELGGPMSHA

SEQ ID NO: 155958 - protein, 23 aa, Mycobacterium bovis
AAGARPARDLVRVAFGPGVVALG

SEQ ID NO: 155959 - protein, 18 aa, Mycobacterium bovis
AAGCMPVMIGWSAITGTI

SEQ ID NO: 155960 - protein, 23 aa, Mycobacterium bovis
AAGDLRRYAVLAATLGLLVGLIC

SEQ ID NO: 155961 - protein, 18 aa, Mycobacterium bovis
AAGIPAVAAVAILTGQDF

SEQ ID NO: 155962 - protein, 26 aa, Mycobacterium bovis
AAGIVLACPVWFYQLWAFITPGLYQR

SEQ ID NO: 155963 - protein, 26 aa, Mycobacterium bovis
AAGLGVLWLPAGWLAHRLLSVPVTTC

SEQ ID NO: 155964 - protein, 18 aa, Mycobacterium bovis
AAGNGWRVSGLLRIDEVA

SEQ ID NO: 155965 - protein, 25 aa, Mycobacterium bovis
AAGNLRAAIELPLAATIGLAALGGM

SEQ ID NO: 155966 - protein, 25 aa, Mycobacterium bovis
AAGNRGLDALGFAGTIPKSAPGSAT

SEQ ID NO: 155967 - protein, 17 aa, Mycobacterium bovis
AAGPFLGSIPFPDVDLA

SEQ ID NO: 155968 - protein, 18 aa, Mycobacterium bovis
AAGSVWPAVSMAVTGAGT

SEQ ID NO: 155969 - protein, 20 aa, Mycobacterium bovis
AAHGPYLAWLEQTAINSAVT

SEQ ID NO: 155970 - protein, 24 aa, Mycobacterium bovis
AAHRFRFVLDHGLQLGRFDRVIAL

SEQ ID NO: 155971 - protein, 26 aa, Mycobacterium bovis
AAIPGRWRPAWIGWWVSLGLATATIG

SEQ ID NO: 155972 - protein, 27 aa, Mycobacterium bovis
AAISGWRAGALGSMLSFGGVLLGATAG

SEQ ID NO: 155973 - protein, 22 aa, Mycobacterium bovis
AAKEGFVSFLLLSLSVAIVIGV

SEQ ID NO: 155974 - protein, 20 aa, Mycobacterium bovis
AAKLYPLLFLYPLLLLGIRA

SEQ ID NO: 155975 - protein, 19 aa, Mycobacterium bovis
AALAGPRVAVAIATVNAVA

SEQ ID NO: 155976 - protein, 26 aa, Mycobacterium bovis
AALDPYVRDGWAFVAIRLTSTDLIVG

SEQ ID NO: 155977 - protein, 30 aa, Mycobacterium bovis
AALFGEAPQRAWLWLGWLSAATVAGWVLDA

SEQ ID NO: 155978 - protein, 18 aa, Mycobacterium bovis
AALPHFLGSAGVRLLLVS

SEQ ID NO: 155979 - protein, 28 aa, Mycobacterium bovis
AALQRLPGRCWPVAATATATWAALGGTS

SEQ ID NO: 155980 - protein, 23 aa, Mycobacterium bovis
AALRSRGLRTILLTGDNRAAADA

SEQ ID NO: 155981 - protein, 29 aa, Mycobacterium bovis
AALTGTPAWEMFKPWAITSMAIAVAVALV

SEQ ID NO: 155982 - protein, 35 aa, Mycobacterium bovis
AANAPFKSATKWSGVSFRDHGNWVIGAPDVLLDPA

SEQ ID NO: 155983 - protein, 19 aa, Mycobacterium bovis
AAPAKRSLLRTAVIVPAVL

SEQ ID NO: 155984 - protein, 17 aa, Mycobacterium bovis
AAPEVLAGQGFDGRADL

SEQ ID NO: 155985 - protein, 17 aa, Mycobacterium bovis
AAPGWEADQVLALAATV

SEQ ID NO: 155986 - protein, 26 aa, Mycobacterium bovis
AAPLLGVLCSISWQRPVPVIQVHGDP

SEQ ID NO: 155987 - protein, 24 aa, Mycobacterium bovis
AAPVVTWAAWPFHSVALRNARHRT

SEQ ID NO: 155988 - protein, 25 aa, Mycobacterium bovis
AAPWHVRAGAFAIDVLPGLAVAATM

SEQ ID NO: 155989 - protein, 27 aa, Mycobacterium bovis
AAQEWLKSILPFGGFPWGSVAFGQAEG

SEQ ID NO: 155990 - protein, 25 aa, Mycobacterium bovis
AAQHWLERFSWIALVIAVIAGITAA

SEQ ID NO: 155991 - protein, 29 aa, Mycobacterium bovis
AARGEHYWLKLFVFFFPFTDQIAAFKIIM

SEQ ID NO: 155992 - protein, 17 aa, Mycobacterium bovis
AARLKREALAMAPAEDE

SEQ ID NO: 155993 - protein, 24 aa, Mycobacterium bovis
AARLRASTGLGEVWRCLRCGDFAL

SEQ ID NO: 155994 - protein, 23 aa, Mycobacterium bovis
AASLDHPGTLYGYVYADQTPDFP

SEQ ID NO: 155995 - protein, 22 aa, Mycobacterium bovis
AASYRWGHHVGRLVTHPDSEQL

SEQ ID NO: 155996 - protein, 35 aa, Mycobacterium bovis
AATPILAVAMPWLFLRLRFCRRKWTVTTLAATPAG

SEQ ID NO: 155997 - protein, 25 aa, Mycobacterium bovis
AATTLPRRLAIAAMGAVLVYGLVGT

SEQ ID NO: 155998 - protein, 18 aa, Mycobacterium bovis
AATVAWVMAGFTGLPRRA

SEQ ID NO: 155999 - protein, 17 aa, Mycobacterium bovis
AAVCVRYALELSSPLAV

SEQ ID NO: 156000 - protein, 24 aa, Mycobacterium bovis
AAVFFFLGCFTIVGTRQFAIMTTF

SEQ ID NO: 156001 - protein, 21 aa, Mycobacterium bovis
AAVGCALFVWLERRSSNPMMD

SEQ ID NO: 156002 - protein, 21 aa, Mycobacterium bovis
AAVQLPAVWLLSAVTVGLFGL

SEQ ID NO: 156003 - protein, 19 aa, Mycobacterium bovis
AAVSLARYWGAEVFVTASR

SEQ ID NO: 156004 - protein, 25 aa, Mycobacterium bovis
AAVVCVLTLTIARPVRTYFAQRAEM

SEQ ID NO: 156005 - protein, 25 aa, Mycobacterium bovis
AAVVLACTLVGFAVAVLGDPVMLRA

SEQ ID NO: 156006 - protein, 17 aa, Mycobacterium bovis
AAWYHFRMDYAGHTEVK

SEQ ID NO: 156007 - protein, 21 aa, Mycobacterium bovis
AAYTRRTEIGIMRLVGASRWY

SEQ ID NO: 156008 - protein, 20 aa, Mycobacterium bovis
ACGVAVATVWFALRDTARAE

SEQ ID NO: 156009 - protein, 17 aa, Mycobacterium bovis
ACISFFFIGGLLALLMR

SEQ ID NO: 156010 - protein, 20 aa, Mycobacterium bovis
ACYKVSRPIDETSLGASIDY

SEQ ID NO: 156011 - protein, 26 aa, Mycobacterium bovis
ADAAASLWHPHIVAVHDRGEFDGQLW

SEQ ID NO: 156012 - protein, 22 aa, Mycobacterium bovis
ADAARGPIAFDALREPDRESSA

SEQ ID NO: 156013 - protein, 18 aa, Mycobacterium bovis
ADALLAHDTLVPDSRPAR

SEQ ID NO: 156014 - protein, 19 aa, Mycobacterium bovis
ADAPSSVAVRQMAEAFHES

SEQ ID NO: 156015 - protein, 19 aa, Mycobacterium bovis
ADARAVLRDVLINELQPGM

SEQ ID NO: 156016 - protein, 17 aa, Mycobacterium bovis
ADGESDFIYSLTTPLYG

SEQ ID NO: 156017 - protein, 17 aa, Mycobacterium bovis
ADGRCKAYAGAADGTAF

SEQ ID NO: 156018 - protein, 25 aa, Mycobacterium bovis
ADHPRSKVGPLRRTRLTEILRGGRS

SEQ ID NO: 156019 - protein, 17 aa, Mycobacterium bovis
ADIMLMSAIMPVTVAAA

SEQ ID NO: 156020 - protein, 20 aa, Mycobacterium bovis
ADIRGAIGFSSFGVLVYYAI

SEQ ID NO: 156021 - protein, 17 aa, Mycobacterium bovis
ADLFAVVGLLFLGTVAL

SEQ ID NO: 156022 - protein, 23 aa, Mycobacterium bovis
ADLPEYRTGLIIVGLARCIAMVI

SEQ ID NO: 156023 - protein, 21 aa, Mycobacterium bovis
ADLSFLPALALIFLNCVWVSL

SEQ ID NO: 156024 - protein, 19 aa, Mycobacterium bovis
ADLSTLFAIVPSARVPGWG

SEQ ID NO: 156025 - protein, 19 aa, Mycobacterium bovis
ADPAAGRFAVDVVLHDPAG

SEQ ID NO: 156026 - protein, 20 aa, Mycobacterium bovis
ADRGPVLLITAVHRDFASTD

SEQ ID NO: 156027 - protein, 22 aa, Mycobacterium bovis
ADRPRYVNLVVLLRTSCEITAT

SEQ ID NO: 156028 - protein, 21 aa, Mycobacterium bovis
ADTADGLGCYGPPQRALAVMR

SEQ ID NO: 156029 - protein, 22 aa, Mycobacterium bovis
ADVGAAPAWRNLRAPLSAIPST

SEQ ID NO: 156030 - protein, 18 aa, Mycobacterium bovis
ADVKPVWQSLRHADTWIM

SEQ ID NO: 156031 - protein, 22 aa, Mycobacterium bovis
ADVVGCSMRLPFLYAPLPYGGT

SEQ ID NO: 156032 - protein, 20 aa, Mycobacterium bovis
ADWLADRGAHRLVLTGRTPL

SEQ ID NO: 156033 - protein, 18 aa, Mycobacterium bovis
ADYAAKALGGWAGFSVGW

SEQ ID NO: 156034 - protein, 22 aa, Mycobacterium bovis
ADYPTVLLSGAWLSQEQTSAAS

SEQ ID NO: 156035 - protein, 25 aa, Mycobacterium bovis
AEAEPAAWLRFWFPDPNGSNTEFQR

SEQ ID NO: 156036 - protein, 19 aa, Mycobacterium bovis
AEALCWDVGEVVELRGRAA

SEQ ID NO: 156037 - protein, 17 aa, Mycobacterium bovis
AEAVARFLSWVYATNPP

SEQ ID NO: 156038 - protein, 19 aa, Mycobacterium bovis
AEDAYGFPAGLWRWLQRHP

SEQ ID NO: 156039 - protein, 17 aa, Mycobacterium bovis
AEFVAGGLVGGVWLAFI

SEQ ID NO: 156040 - protein, 22 aa, Mycobacterium bovis
AEGQRLLARLDVLSLAAASAPV

SEQ ID NO: 156041 - protein, 21 aa, Mycobacterium bovis
AEIGTQFGAFVVFTLLVLAVI

SEQ ID NO: 156042 - protein, 21 aa, Mycobacterium bovis
AEILITAGFFFGREVPDNAAA

SEQ ID NO: 156043 - protein, 24 aa, Mycobacterium bovis
AELFVAAYVPYVAWLVQASADSAA

SEQ ID NO: 156044 - protein, 21 aa, Mycobacterium bovis
AELPLREILPAVQRLVVPSAQ

SEQ ID NO: 156045 - protein, 18 aa, Mycobacterium bovis
AELSAPLIEVHISNVHAR

SEQ ID NO: 156046 - protein, 24 aa, Mycobacterium bovis
AELSVWPPVGARAMDVADGYQVLA

SEQ ID NO: 156047 - protein, 17 aa, Mycobacterium bovis
AEMLHRVVGGVGLKAFW

SEQ ID NO: 156048 - protein, 19 aa, Mycobacterium bovis
AEPLYRSVLIVYFVVMSCF

SEQ ID NO: 156049 - protein, 22 aa, Mycobacterium bovis
AERSVAVWLLLGGVFGLALLLI

SEQ ID NO: 156050 - protein, 21 aa, Mycobacterium bovis
AESRLNRLLAQQIPPARKVLA

SEQ ID NO: 156051 - protein, 21 aa, Mycobacterium bovis
AEVPSAAWGRSRIDHRTWHIV

SEQ ID NO: 156052 - protein, 27 aa, Mycobacterium bovis
AEYRFEKAWPLLWFVVIGLIAAAVGYL

SEQ ID NO: 156053 - protein, 17 aa, Mycobacterium bovis
AFDLFVGAIQAFIFALL

SEQ ID NO: 156054 - protein, 18 aa, Mycobacterium bovis
AFDNGWFRTGDIGEIDDE

SEQ ID NO: 156055 - protein, 26 aa, Mycobacterium bovis
AFELPFYRLMLSYMLVSVFLAFVANL

SEQ ID NO: 156056 - protein, 24 aa, Mycobacterium bovis
AFFNIYFCSVTIKINGPAGSDILL

SEQ ID NO: 156057 - protein, 24 aa, Mycobacterium bovis
AFHNEFTQRLAAAANAFVNAEATN

SEQ ID NO: 156058 - protein, 19 aa, Mycobacterium bovis
AFHSPPGWVVAANAPFKSA

SEQ ID NO: 156059 - protein, 19 aa, Mycobacterium bovis
AFIQLLADRAFQWSLNAGV

SEQ ID NO: 156060 - protein, 23 aa, Mycobacterium bovis
AFRTSCTPTECLAAATMLDDNDH

SEQ ID NO: 156061 - protein, 19 aa, Mycobacterium bovis
AFSLLGLRQLYFLIDGLLD

SEQ ID NO: 156062 - protein, 21 aa, Mycobacterium bovis
AFTAWDVFLGYELPQPPTIAR

SEQ ID NO: 156063 - protein, 17 aa, Mycobacterium bovis
AFTAWRFGDHDVAVRGY

SEQ ID NO: 156064 - protein, 19 aa, Mycobacterium bovis
AGAAGPFLGSTPFAQIDLP

SEQ ID NO: 156065 - protein, 24 aa, Mycobacterium bovis
AGAAICLLALMATLATASRRLRPG

SEQ ID NO: 156066 - protein, 24 aa, Mycobacterium bovis
AGAAMAFSSFFVVSNSLRLRNFGA

SEQ ID NO: 156067 - protein, 21 aa, Mycobacterium bovis
AGAFSRPGLPVEYLQVPSASM

SEQ ID NO: 156068 - protein, 19 aa, Mycobacterium bovis
AGAPPWYADVLLPDLGAAW

SEQ ID NO: 156069 - protein, 19 aa, Mycobacterium bovis
AGAQLLWQLPLLSIGCGLI

SEQ ID NO: 156070 - protein, 19 aa, Mycobacterium bovis
AGAVFAILPRVTWAGIEAR

SEQ ID NO: 156071 - protein, 48 aa, Mycobacterium bovis
AGCLPAVIWWACHRPNRLWWRYTAWWLLAMALATLWWVMALTQLHGVS

SEQ ID NO: 156072 - protein, 26 aa, Mycobacterium bovis
AGEETRLRLLVNEMFETMSRRSRSLV

SEQ ID NO: 156073 - protein, 25 aa, Mycobacterium bovis
AGFALGVAMLLGGTWLTCVLAAVTS

SEQ ID NO: 156074 - protein, 35 aa, Mycobacterium bovis
AGGLFDRIGNFVVRWPLIVIGCWIAVAAALTLLLP

SEQ ID NO: 156075 - protein, 27 aa, Mycobacterium bovis
AGGLRLRSRGKLAWSAFAFSLPIPPVV

SEQ ID NO: 156076 - protein, 21 aa, Mycobacterium bovis
AGICVVCAVPLAIGYRRASTH

SEQ ID NO: 156077 - protein, 19 aa, Mycobacterium bovis
AGIILNLVTGPGFYDIALR

SEQ ID NO: 156078 - protein, 23 aa, Mycobacterium bovis
AGKDSFPASFIVKLENPEQHKDF

SEQ ID NO: 156079 - protein, 23 aa, Mycobacterium bovis
AGLAAICYAELASAVPISGSAYS

SEQ ID NO: 156080 - protein, 20 aa, Mycobacterium bovis
AGLAFTLGMVLTSTLMVRPV

SEQ ID NO: 156081 - protein, 23 aa, Mycobacterium bovis
AGLKEFVDAAVIFGVVVINAIVG

SEQ ID NO: 156082 - protein, 26 aa, Mycobacterium bovis
AGLQTGSSFKVFALVAALEQGIGLGY

SEQ ID NO: 156083 - protein, 20 aa, Mycobacterium bovis
AGLTFNDFMLHLTPLVVIVL

SEQ ID NO: 156084 - protein, 17 aa, Mycobacterium bovis
AGLVGFIGNEWVALYRI

SEQ ID NO: 156085 - protein, 25 aa, Mycobacterium bovis
AGLVGGIVWNLLTWLLGIPSSSSHA

SEQ ID NO: 156086 - protein, 23 aa, Mycobacterium bovis
AGNGGPPVTRRAVLTLYPHCAPK

SEQ ID NO: 156087 - protein, 23 aa, Mycobacterium bovis
AGNWATSIWCFRGDAEATMETSV

SEQ ID NO: 156088 - protein, 23 aa, Mycobacterium bovis
AGPLPYIVMEYVDGVTLRDIVHT

SEQ ID NO: 156089 - protein, 17 aa, Mycobacterium bovis
AGPYPPGPPPPGPGSKT

SEQ ID NO: 156090 - protein, 24 aa, Mycobacterium bovis
AGQLHRVRMLLLTNCTFDGVVYNP

SEQ ID NO: 156091 - protein, 22 aa, Mycobacterium bovis
AGRDLRAAIVVGLSIGLVLIAV

SEQ ID NO: 156092 - protein, 18 aa, Mycobacterium bovis
AGSLARKGTTPVTAATFP

SEQ ID NO: 156093 - protein, 18 aa, Mycobacterium bovis
AGSWLPALLWGVAFAILV

SEQ ID NO: 156094 - protein, 17 aa, Mycobacterium bovis
AGTKLLVVFGISVLLTF

SEQ ID NO: 156095 - protein, 22 aa, Mycobacterium bovis
AGVAFGTFLMRNHFLSLPAEII

SEQ ID NO: 156096 - protein, 19 aa, Mycobacterium bovis
AGVFQILFGACRLGSLIRY

SEQ ID NO: 156097 - protein, 28 aa, Mycobacterium bovis
AGVIAAEHPELWGGLVDLAINDDLGEFG

SEQ ID NO: 156098 - protein, 20 aa, Mycobacterium bovis
AGVLGALAGVLAKRQHQTRV

SEQ ID NO: 156099 - protein, 25 aa, Mycobacterium bovis
AGYAKIVGCALGFPVINIARSSAKL

SEQ ID NO: 156100 - protein, 17 aa, Mycobacterium bovis
AGYLEWIDGCRELIQNA

SEQ ID NO: 156101 - protein, 18 aa, Mycobacterium bovis
AGYRIERMLGAGGMGTVY

SEQ ID NO: 156102 - protein, 17 aa, Mycobacterium bovis
AHGGRYHGIWSMAVAAS

SEQ ID NO: 156103 - protein, 25 aa, Mycobacterium bovis
AHLQRARVPMPIIAVSSLLRSHAVT

SEQ ID NO: 156104 - protein, 17 aa, Mycobacterium bovis
AHLRARHDLVLEAFTAV

SEQ ID NO: 156105 - protein, 20 aa, Mycobacterium bovis
AHRLIELALRGGGPDNVTVV

SEQ ID NO: 156106 - protein, 25 aa, Mycobacterium bovis
AHRRKRSESGVGIRGYRDEFLDATA

SEQ ID NO: 156107 - protein, 24 aa, Mycobacterium bovis
AIAAPRRIIGFAVFVFIAAAVFGV

SEQ ID NO: 156108 - protein, 23 aa, Mycobacterium bovis
AIAHYCHYWRAFQPIPQWTLALI

SEQ ID NO: 156109 - protein, 26 aa, Mycobacterium bovis
AIAIRVDWPRFWALITTPSSQTALLL

SEQ ID NO: 156110 - protein, 25 aa, Mycobacterium bovis
AIALICAAAVFSAIALRDLRIPAIG

SEQ ID NO: 156111 - protein, 18 aa, Mycobacterium bovis
AIALRDLRIPAIGLVLLL

SEQ ID NO: 156112 - protein, 17 aa, Mycobacterium bovis
AIARVEWPAFPSSNQLH

SEQ ID NO: 156113 - protein, 26 aa, Mycobacterium bovis
AIAVAAAWTFLKILGPILRGIADAAV

SEQ ID NO: 156114 - protein, 23 aa, Mycobacterium bovis
AIDPSAAINMAWRAAGGAAGPLG

SEQ ID NO: 156115 - protein, 24 aa, Mycobacterium bovis
AIEIAEAMRGMLQRIWNEQNRTKE

SEQ ID NO: 156116 - protein, 21 aa, Mycobacterium bovis
AIGALCFPLGSTGTTKTGATA

SEQ ID NO: 156117 - protein, 18 aa, Mycobacterium bovis
AIGAPILIGTLMDVPGRP

SEQ ID NO: 156118 - protein, 18 aa, Mycobacterium bovis
AIGLGAALLIAALLLSTY

SEQ ID NO: 156119 - protein, 27 aa, Mycobacterium bovis
AIGVLIITVMVCWLLLAVLRGRLHPIG

SEQ ID NO: 156120 - protein, 24 aa, Mycobacterium bovis
AIHLLASMTMVWLAVLLYVKIGQP

SEQ ID NO: 156121 - protein, 29 aa, Mycobacterium bovis
AILQRMSPFWQRMFLTIGILIAVFGMRLV

SEQ ID NO: 156122 - protein, 18 aa, Mycobacterium bovis
AINKGISPLGCWPGSSAL

SEQ ID NO: 156123 - protein, 17 aa, Mycobacterium bovis
AIPAPWPVLATLPSGPE

SEQ ID NO: 156124 - protein, 18 aa, Mycobacterium bovis
AIPVIGPPLAALVEPNLE

SEQ ID NO: 156125 - protein, 22 aa, Mycobacterium bovis
AIPVLIVGTVVWVGITNDRKER

SEQ ID NO: 156126 - protein, 24 aa, Mycobacterium bovis
AIRVTPKFTRMVVAALFGVLVLML

SEQ ID NO: 156127 - protein, 23 aa, Mycobacterium bovis
AISRGVLHYCERLATHDTALRAA

SEQ ID NO: 156128 - protein, 24 aa, Mycobacterium bovis
AISRRSGCHLLLLAVLAAIALADL

SEQ ID NO: 156129 - protein, 17 aa, Mycobacterium bovis
AISSARLAARYPASGGT

SEQ ID NO: 156130 - protein, 20 aa, Mycobacterium bovis
AITGTIAWPALAMFAIIFFW

SEQ ID NO: 156131 - protein, 18 aa, Mycobacterium bovis
AIVAPLYLVGSVVISYMS

SEQ ID NO: 156132 - protein, 25 aa, Mycobacterium bovis
AIVPARSLLGLAVGWLVGALVVLVV

SEQ ID NO: 156133 - protein, 19 aa, Mycobacterium bovis
AIWLRSRRAPIDHTNVNAD

SEQ ID NO: 156134 - protein, 18 aa, Mycobacterium bovis
AKADVLLDCFRPGTCERL

SEQ ID NO: 156135 - protein, 17 aa, Mycobacterium bovis
AKAGLFPFHTWLADAHS

SEQ ID NO: 156136 - protein, 22 aa, Mycobacterium bovis
AKALGGWAGFSVGWLYWYFWVI

SEQ ID NO: 156137 - protein, 26 aa, Mycobacterium bovis
AKARKAKAPKLVRPTPMERLAARLTS

SEQ ID NO: 156138 - protein, 20 aa, Mycobacterium bovis
AKELVIATKMSGEWSKDDVL

SEQ ID NO: 156139 - protein, 22 aa, Mycobacterium bovis
AKFPELTAYQVINRIVQSAHNP

SEQ ID NO: 156140 - protein, 24 aa, Mycobacterium bovis
AKGLSRPRVVTVHILRNSLIPVVT

SEQ ID NO: 156141 - protein, 23 aa, Mycobacterium bovis
AKHPRLRVRWVMRRDEKSLAEAI

SEQ ID NO: 156142 - protein, 19 aa, Mycobacterium bovis
AKLAADMQVFARVSPEQKV

SEQ ID NO: 156143 - protein, 17 aa, Mycobacterium bovis
AKNIEVVQGYALTESCG

SEQ ID NO: 156144 - protein, 19 aa, Mycobacterium bovis
AKQAKRRRILTIVGGSLAA

SEQ ID NO: 156145 - protein, 26 aa, Mycobacterium bovis
AKRARGSPLRIMILLVLVSALASALL

SEQ ID NO: 156146 - protein, 17 aa, Mycobacterium bovis
AKRLPRRALTVLRGESL

SEQ ID NO: 156147 - protein, 22 aa, Mycobacterium bovis
AKSLGAWFPLAFLLVHTVVTVP

SEQ ID NO: 156148 - protein, 24 aa, Mycobacterium bovis
AKTGKLRPALFVVPTDAPGFSYTP

SEQ ID NO: 156149 - protein, 20 aa, Mycobacterium bovis
AKTPKAAFRIAFAGPATSLA

SEQ ID NO: 156150 - protein, 22 aa, Mycobacterium bovis
AKTYRWTFADVKGSPPTITVID

SEQ ID NO: 156151 - protein, 25 aa, Mycobacterium bovis
AKVVNLRSAPGFSFVSEDLDRVRSL

SEQ ID NO: 156152 - protein, 20 aa, Mycobacterium bovis
ALAAAIAWAGAQVFGPSSPL

SEQ ID NO: 156153 - protein, 34 aa, Mycobacterium bovis
ALAAIGVLLGWPLWWVSTCSVLVLLVVEGVAINF

SEQ ID NO: 156154 - protein, 19 aa, Mycobacterium bovis
ALACAELGQLLGEVQASSW

SEQ ID NO: 156155 - protein, 24 aa, Mycobacterium bovis
ALADRLRRILPFVNRISGALLVVV

SEQ ID NO: 156156 - protein, 31 aa, Mycobacterium bovis
ALARAGVGPRQWRWPLGEIDRPFEMRRDPLV

SEQ ID NO: 156157 - protein, 17 aa, Mycobacterium bovis
ALASCASLAHFNYDDRK

SEQ ID NO: 156158 - protein, 18 aa, Mycobacterium bovis
ALAVSRWPAVTVAAGVLL

SEQ ID NO: 156159 - protein, 19 aa, Mycobacterium bovis
ALDDPRGATPWTADLITGT

SEQ ID NO: 156160 - protein, 20 aa, Mycobacterium bovis
ALFALWPFTRLVHAFSAPIG

SEQ ID NO: 156161 - protein, 20 aa, Mycobacterium bovis
ALFVLWPFTRLVHAFSAPIA

SEQ ID NO: 156162 - protein, 18 aa, Mycobacterium bovis
ALGFLQDFFATAVFLGIT

SEQ ID NO: 156163 - protein, 18 aa, Mycobacterium bovis
ALGGLMVDGLGWRSVFLV

SEQ ID NO: 156164 - protein, 25 aa, Mycobacterium bovis
ALGQMAVFALGGWMAAQGSITVGTF

SEQ ID NO: 156165 - protein, 17 aa, Mycobacterium bovis
ALGYMHAALAMFLGSTL

SEQ ID NO: 156166 - protein, 17 aa, Mycobacterium bovis
ALHFLRITALSVVLLAL

SEQ ID NO: 156167 - protein, 21 aa, Mycobacterium bovis
ALIAVPVGLLIGHTGRGTLLV

SEQ ID NO: 156168 - protein, 23 aa, Mycobacterium bovis
ALIEREAAELGLKAVVRQSDSEA

SEQ ID NO: 156169 - protein, 26 aa, Mycobacterium bovis
ALKAAECRAGARAWRRHEPQLALHAD

SEQ ID NO: 156170 - protein, 24 aa, Mycobacterium bovis
ALLAGTLPLLWSRGLSALPVTYVG

SEQ ID NO: 156171 - protein, 19 aa, Mycobacterium bovis
ALLANMLPASIAERLKEPE

SEQ ID NO: 156172 - protein, 18 aa, Mycobacterium bovis
ALLDGFLTFFVVAAFGAL

SEQ ID NO: 156173 - protein, 17 aa, Mycobacterium bovis
ALLERMAPLGPRSRALV

SEQ ID NO: 156174 - protein, 25 aa, Mycobacterium bovis
ALLGFPLLLVVGVSLAYLYVVLLFA

SEQ ID NO: 156175 - protein, 23 aa, Mycobacterium bovis
ALLIKPLLAHAAIAFIAVEAVLG

SEQ ID NO: 156176 - protein, 24 aa, Mycobacterium bovis
ALLMIGWWSGFPYWTTAAVCALGG

SEQ ID NO: 156177 - protein, 20 aa, Mycobacterium bovis
ALLRRASLRQAVADGVAIAV

SEQ ID NO: 156178 - protein, 19 aa, Mycobacterium bovis
ALLSAIGIAGMDRLVQHNV

SEQ ID NO: 156179 - protein, 19 aa, Mycobacterium bovis
ALLTIAIQPQTRWEAFANQ

SEQ ID NO: 156180 - protein, 18 aa, Mycobacterium bovis
ALLTRRWALAWVALAGSA

SEQ ID NO: 156181 - protein, 31 aa, Mycobacterium bovis
ALLVAVFVVVDWRIHAAVLPPSVFGSGPLKW

SEQ ID NO: 156182 - protein, 18 aa, Mycobacterium bovis
ALMSSCIVAAQVVMVPVA

SEQ ID NO: 156183 - protein, 22 aa, Mycobacterium bovis
ALPRRIHAFVRWVVRTPWPLFS

SEQ ID NO: 156184 - protein, 22 aa, Mycobacterium bovis
ALRHRWALAAICFVAVGIGALS

SEQ ID NO: 156185 - protein, 22 aa, Mycobacterium bovis
ALRIRTRLVADVAVPLVNIRAV

SEQ ID NO: 156186 - protein, 24 aa, Mycobacterium bovis
ALRNGLRTHVGFVRSGMAPRLVSD

SEQ ID NO: 156187 - protein, 26 aa, Mycobacterium bovis
ALRYYRKETLRLIAQIGMGTGAMAVV

SEQ ID NO: 156188 - protein, 28 aa, Mycobacterium bovis
ALSAFFTPRFVRWFGLFTTHAIVAAALA

SEQ ID NO: 156189 - protein, 17 aa, Mycobacterium bovis
ALSWAWGWLPLDAGSGI

SEQ ID NO: 156190 - protein, 24 aa, Mycobacterium bovis
ALTARKRIAWLVLLANMVLAAVVN

SEQ ID NO: 156191 - protein, 23 aa, Mycobacterium bovis
ALTVWVVGYALRPLRRVAATAAE

SEQ ID NO: 156192 - protein, 22 aa, Mycobacterium bovis
ALVAVGIGLRLVFGEMSLTAGL

SEQ ID NO: 156193 - protein, 20 aa, Mycobacterium bovis
ALVEPTILLAVFALSIPAGS

SEQ ID NO: 156194 - protein, 18 aa, Mycobacterium bovis
ALVLELLATLGVALVAVG

SEQ ID NO: 156195 - protein, 18 aa, Mycobacterium bovis
ALVLYVSMLSKWPVGWVV

SEQ ID NO: 156196 - protein, 31 aa, Mycobacterium bovis
ALVVMNWLGLSWRWLFGLSIIPALISLIIRY

SEQ ID NO: 156197 - protein, 26 aa, Mycobacterium bovis
ALWACADGLVGFWKLSIMQVANTFAA

SEQ ID NO: 156198 - protein, 24 aa, Mycobacterium bovis
ALWKGRRIGPLVAEELPVVIRASE

SEQ ID NO: 156199 - protein, 23 aa, Mycobacterium bovis
AMAAGLLLGRWIPGLHTALEGVQ

SEQ ID NO: 156200 - protein, 23 aa, Mycobacterium bovis
AMGAIRLNGLHFFTATEWNPGNT

SEQ ID NO: 156201 - protein, 22 aa, Mycobacterium bovis
AMGATVTGWVARLPAAPQTTRA

SEQ ID NO: 156202 - protein, 22 aa, Mycobacterium bovis
AMGGRAAEELVFREPTTGAVSD

SEQ ID NO: 156203 - protein, 23 aa, Mycobacterium bovis
AMKRIGKVFHEFDSDSAAMIVLE

SEQ ID NO: 156204 - protein, 19 aa, Mycobacterium bovis
AMLIPMYFLIGGFGQGAGR

SEQ ID NO: 156205 - protein, 19 aa, Mycobacterium bovis
AMLVAAAWLALLGLPLLLV

SEQ ID NO: 156206 - protein, 26 aa, Mycobacterium bovis
AMNLAGNRPRLVWYAPDHIEGEMSSP

SEQ ID NO: 156207 - protein, 20 aa, Mycobacterium bovis
ANAILRLVGVQPKDELDIAV

SEQ ID NO: 156208 - protein, 21 aa, Mycobacterium bovis
ANALCALGRANGIYCAVVPQP

SEQ ID NO: 156209 - protein, 19 aa, Mycobacterium bovis
ANDLLPPGGLIPLSRTSPA

SEQ ID NO: 156210 - protein, 21 aa, Mycobacterium bovis
ANILREFKEPKREALLTLLPL

SEQ ID NO: 156211 - protein, 19 aa, Mycobacterium bovis
ANLACVVCAIGLGSVAGLS

SEQ ID NO: 156212 - protein, 20 aa, Mycobacterium bovis
ANLADIWRRRDLPRDAKAPV

SEQ ID NO: 156213 - protein, 17 aa, Mycobacterium bovis
ANLMLGFAAIFVGTVCA

SEQ ID NO: 156214 - protein, 19 aa, Mycobacterium bovis
ANQLGWQGPFWDWLGGLDL

SEQ ID NO: 156215 - protein, 24 aa, Mycobacterium bovis
ANRCADVLTALGIAKGDRVALLMP

SEQ ID NO: 156216 - protein, 18 aa, Mycobacterium bovis
APAARLLSIRAMSTKFSP

SEQ ID NO: 156217 - protein, 19 aa, Mycobacterium bovis
APAMYRIVRELATSAHQPM

SEQ ID NO: 156218 - protein, 24 aa, Mycobacterium bovis
APARLDNARFLLPVVGVPPDQATD

SEQ ID NO: 156219 - protein, 18 aa, Mycobacterium bovis
APARLPLWACGAADLTVR

SEQ ID NO: 156220 - protein, 17 aa, Mycobacterium bovis
APASMRAGMAIAAGACL

SEQ ID NO: 156221 - protein, 19 aa, Mycobacterium bovis
APDAQWRRVTATGQYLPDV

SEQ ID NO: 156222 - protein, 17 aa, Mycobacterium bovis
APDDALWVRTGDYGTYF

SEQ ID NO: 156223 - protein, 24 aa, Mycobacterium bovis
APERVSVTFVDRLPGWNVDISGVG

SEQ ID NO: 156224 - protein, 18 aa, Mycobacterium bovis
APFPDRNLIIFVVSVVIL

SEQ ID NO: 156225 - protein, 17 aa, Mycobacterium bovis
APFVLPLAVTIFVFILI

SEQ ID NO: 156226 - protein, 21 aa, Mycobacterium bovis
APGYTAARPSLSFDHDAHAEP

SEQ ID NO: 156227 - protein, 25 aa, Mycobacterium bovis
APLDGGRLVRAYLWRRHGDSVRAGI

SEQ ID NO: 156228 - protein, 21 aa, Mycobacterium bovis
APLLRARGTFFAHADQLSIHR

SEQ ID NO: 156229 - protein, 21 aa, Mycobacterium bovis
APLPKGTYCRIPMDASNVVRG

SEQ ID NO: 156230 - protein, 27 aa, Mycobacterium bovis
APMGRRLAALLIDWLIAYGLALLGVEF

SEQ ID NO: 156231 - protein, 26 aa, Mycobacterium bovis
APPGRLPSWLRPRLGDEHARERTPDA

SEQ ID NO: 156232 - protein, 27 aa, Mycobacterium bovis
APQQSWRKRLPAIFVDVARFALIGIGL

SEQ ID NO: 156233 - protein, 18 aa, Mycobacterium bovis
APRTTVGVVEYVRRRKNG

SEQ ID NO: 156234 - protein, 17 aa, Mycobacterium bovis
APSCMRIDYELITQNHR

SEQ ID NO: 156235 - protein, 19 aa, Mycobacterium bovis
APSRGRVAAVVAMCVASAG

SEQ ID NO: 156236 - protein, 17 aa, Mycobacterium bovis
APTVRLGSMYGYGISYA

SEQ ID NO: 156237 - protein, 18 aa, Mycobacterium bovis
APVILVVATTVVFGAFAH

SEQ ID NO: 156238 - protein, 23 aa, Mycobacterium bovis
APYHLRLDWLMWFAAISPGYALP

SEQ ID NO: 156239 - protein, 17 aa, Mycobacterium bovis
AQAAFWSALSLPPLLLG

SEQ ID NO: 156240 - protein, 19 aa, Mycobacterium bovis
AQARLAALSILVGAVGATG

SEQ ID NO: 156241 - protein, 18 aa, Mycobacterium bovis
AQGLRVLLLAAGSVAVDH

SEQ ID NO: 156242 - protein, 22 aa, Mycobacterium bovis
AQLDGWRYGWVLNIGAAITGGV

SEQ ID NO: 156243 - protein, 24 aa, Mycobacterium bovis
AQLRVARLNAHFGPLLQTLPALGQ

SEQ ID NO: 156244 - protein, 25 aa, Mycobacterium bovis
AQMLKVELPLSIPVLVAGLRVVAVT

SEQ ID NO: 156245 - protein, 17 aa, Mycobacterium bovis
AQPPFRLSNYVTDNAGV

SEQ ID NO: 156246 - protein, 25 aa, Mycobacterium bovis
AQRHLADLASIWRRCGGRTVTLFRS

SEQ ID NO: 156247 - protein, 24 aa, Mycobacterium bovis
AQRRELLTRVIVSAAHADRELASQ

SEQ ID NO: 156248 - protein, 28 aa, Mycobacterium bovis
AQRWASPFWQTWDLLLLWLAQLHGGNGL

SEQ ID NO: 156249 - protein, 25 aa, Mycobacterium bovis
AQTRLRSGSPILFYPAGALAITVLA

SEQ ID NO: 156250 - protein, 17 aa, Mycobacterium bovis
ARAAAPLSEAMRVAGVN

SEQ ID NO: 156251 - protein, 17 aa, Mycobacterium bovis
ARAALDAVRARIRSRRL

SEQ ID NO: 156252 - protein, 21 aa, Mycobacterium bovis
ARADLGMAIGRGTDVAIGAAD

SEQ ID NO: 156253 - protein, 20 aa, Mycobacterium bovis
ARARRYATAYLDLHYETESA

SEQ ID NO: 156254 - protein, 23 aa, Mycobacterium bovis
ARDRASIELAIAVMLLVILMVIY

SEQ ID NO: 156255 - protein, 19 aa, Mycobacterium bovis
ARETLDYFAVQNVSVKVIS

SEQ ID NO: 156256 - protein, 27 aa, Mycobacterium bovis
ARFALGVAEGGFFPGVIAYLTVWFPCA

SEQ ID NO: 156257 - protein, 23 aa, Mycobacterium bovis
ARFRRSELMLALATTAAVLGLGV

SEQ ID NO: 156258 - protein, 17 aa, Mycobacterium bovis
ARGPAWRLMGVIFGTMF

SEQ ID NO: 156259 - protein, 17 aa, Mycobacterium bovis
ARHDLVLEAFTAVHAAF

SEQ ID NO: 156260 - protein, 31 aa, Mycobacterium bovis
ARHMGLFVVGRLAGRHGIRVGLRGPVTGEQG

SEQ ID NO: 156261 - protein, 33 aa, Mycobacterium bovis
ARIKYKVGPTIAWYQDFLRYYFLTVESNVEGSM

SEQ ID NO: 156262 - protein, 23 aa, Mycobacterium bovis
ARILAWRPLVWLGTISYGVYLWH

SEQ ID NO: 156263 - protein, 21 aa, Mycobacterium bovis
ARIREAIRLSGPDIYGDPEPV

SEQ ID NO: 156264 - protein, 19 aa, Mycobacterium bovis
ARLAYWAQAEIVAMATDVA

SEQ ID NO: 156265 - protein, 22 aa, Mycobacterium bovis
ARLELTLLVGEWLNQIPDFELA

SEQ ID NO: 156266 - protein, 25 aa, Mycobacterium bovis
ARLISSLCGLLCTFTVSRVIVGVVL

SEQ ID NO: 156267 - protein, 19 aa, Mycobacterium bovis
ARLLHRLLGLTVLRVGTGQ

SEQ ID NO: 156268 - protein, 21 aa, Mycobacterium bovis
ARLLYQWRWSLATLWFTTVFL

SEQ ID NO: 156269 - protein, 19 aa, Mycobacterium bovis
ARLRRARAGLNAHPDGLNQ

SEQ ID NO: 156270 - protein, 20 aa, Mycobacterium bovis
ARLVTMVPAGWSLVEAAAVP

SEQ ID NO: 156271 - protein, 24 aa, Mycobacterium bovis
ARLWLPTYLAWFVGGMMLAVLAAM

SEQ ID NO: 156272 - protein, 20 aa, Mycobacterium bovis
ARPADLLVLLDSLRQREATL

SEQ ID NO: 156273 - protein, 27 aa, Mycobacterium bovis
ARPGTVWWRVTLPLLLPGVVSGSVLAF

SEQ ID NO: 156274 - protein, 17 aa, Mycobacterium bovis
ARPMAAVLRWLEIPQFS

SEQ ID NO: 156275 - protein, 19 aa, Mycobacterium bovis
ARQGFKRWWTRFVPPSIER

SEQ ID NO: 156276 - protein, 19 aa, Mycobacterium bovis
ARQPGGYLLGGFGPAPEGM

SEQ ID NO: 156277 - protein, 23 aa, Mycobacterium bovis
ARRLLRRLLVAAVLFVPLADLST

SEQ ID NO: 156278 - protein, 21 aa, Mycobacterium bovis
ARRLSHFGALVRIPRSVEALG

SEQ ID NO: 156279 - protein, 28 aa, Mycobacterium bovis
ARRQRVLTITAWLAVVVTGSFALMQLAT

SEQ ID NO: 156280 - protein, 25 aa, Mycobacterium bovis
ARRRELSQLPVLRWVDNSGNRANRR

SEQ ID NO: 156281 - protein, 19 aa, Mycobacterium bovis
ARSRALRMPLYRTLISLAV

SEQ ID NO: 156282 - protein, 20 aa, Mycobacterium bovis
ARSRGRLVRSLRPLILLPLV

SEQ ID NO: 156283 - protein, 21 aa, Mycobacterium bovis
ARSVNPIAFVYNYLKQVVAEM

SEQ ID NO: 156284 - protein, 17 aa, Mycobacterium bovis
ARTLPGKQFEAGRQLRV

SEQ ID NO: 156285 - protein, 23 aa, Mycobacterium bovis
ARVFHASVAITRRLPGGPVLKPA

SEQ ID NO: 156286 - protein, 26 aa, Mycobacterium bovis
ARVPILAGLCMLMLGLLMLIFSEHRS

SEQ ID NO: 156287 - protein, 24 aa, Mycobacterium bovis
ARYNVPWQPAFVFYRADGTSTFVN

SEQ ID NO: 156288 - protein, 25 aa, Mycobacterium bovis
ASANTGWWPLIWFTAKVWGFLFIYF

SEQ ID NO: 156289 - protein, 20 aa, Mycobacterium bovis
ASCITAGGGLMLVRNALGTN

SEQ ID NO: 156290 - protein, 26 aa, Mycobacterium bovis
ASCQPGASHLGVWFGHFPGWIPLGAM

SEQ ID NO: 156291 - protein, 21 aa, Mycobacterium bovis
ASDPIAWWTPRLLFREPDWLR

SEQ ID NO: 156292 - protein, 24 aa, Mycobacterium bovis
ASEEERARWSLGRHVKLRGHDQPV

SEQ ID NO: 156293 - protein, 24 aa, Mycobacterium bovis
ASEMARGWIVAAICALVVATALRL

SEQ ID NO: 156294 - protein, 18 aa, Mycobacterium bovis
ASEMPECQAGIGVAAGQV

SEQ ID NO: 156295 - protein, 25 aa, Mycobacterium bovis
ASFGASLLVSWLAGVLLSGMLTVIV

SEQ ID NO: 156296 - protein, 20 aa, Mycobacterium bovis
ASGDCRTWVGLTVVADDNLA

SEQ ID NO: 156297 - protein, 18 aa, Mycobacterium bovis
ASGFSRFPVVEGDLDATV

SEQ ID NO: 156298 - protein, 23 aa, Mycobacterium bovis
ASGKSRKSPVIWWTVVTAAALGA

SEQ ID NO: 156299 - protein, 17 aa, Mycobacterium bovis
ASGRVAYVLGLQGPAVS

SEQ ID NO: 156300 - protein, 26 aa, Mycobacterium bovis
ASGSFMLCAAFNVLLRGLCGRDTAPA

SEQ ID NO: 156301 - protein, 23 aa, Mycobacterium bovis
ASHELRTPLAAIRGYTELTQRIG

SEQ ID NO: 156302 - protein, 19 aa, Mycobacterium bovis
ASISMSGYPVMLRDIRDYY

SEQ ID NO: 156303 - protein, 21 aa, Mycobacterium bovis
ASLCLIFIIMLGITRSVVASA

SEQ ID NO: 156304 - protein, 20 aa, Mycobacterium bovis
ASLFAAIIGSISFWGSIVAF

SEQ ID NO: 156305 - protein, 19 aa, Mycobacterium bovis
ASLILAVLAFRHFGDAVLL

SEQ ID NO: 156306 - protein, 24 aa, Mycobacterium bovis
ASLLAGRAVNKWGPQLPVLTCLAA

SEQ ID NO: 156307 - protein, 17 aa, Mycobacterium bovis
ASLQEWEPQGWKSEERA

SEQ ID NO: 156308 - protein, 21 aa, Mycobacterium bovis
ASMTWEILWALILGFALSAVV

SEQ ID NO: 156309 - protein, 18 aa, Mycobacterium bovis
ASQIRRLRAPRPQVERGG

SEQ ID NO: 156310 - protein, 24 aa, Mycobacterium bovis
ASRERVVAVSFPRDLAITPIQCEA

SEQ ID NO: 156311 - protein, 23 aa, Mycobacterium bovis
ASRPELIEGIGRRVLSWANSVRG

SEQ ID NO: 156312 - protein, 18 aa, Mycobacterium bovis
ASVISWVSIVLIYVVVVY

SEQ ID NO: 156313 - protein, 31 aa, Mycobacterium bovis
ASVSPLIRWIIKVPREFINDYLFNFPDTNFA

SEQ ID NO: 156314 - protein, 24 aa, Mycobacterium bovis
ASVSSWLLAWPMWADGAVFLLVSV

SEQ ID NO: 156315 - protein, 18 aa, Mycobacterium bovis
ASVVFWAFGPWLIPPLVA

SEQ ID NO: 156316 - protein, 20 aa, Mycobacterium bovis
ASYLKDDWFRDWGALQRLTP

SEQ ID NO: 156317 - protein, 18 aa, Mycobacterium bovis
ATAFPWVFLFPASILVLI

SEQ ID NO: 156318 - protein, 18 aa, Mycobacterium bovis
ATAIRSGLAVPRPLPVVI

SEQ ID NO: 156319 - protein, 18 aa, Mycobacterium bovis
ATALPDWLHDSMRAAAAG

SEQ ID NO: 156320 - protein, 25 aa, Mycobacterium bovis
ATALPLRLISWLLMPISRLLVLLGN

SEQ ID NO: 156321 - protein, 22 aa, Mycobacterium bovis
ATARRRPLLVAVSWAIFALVLA

SEQ ID NO: 156322 - protein, 26 aa, Mycobacterium bovis
ATCALAALCYAEFASTLPVAGSAYTF

SEQ ID NO: 156323 - protein, 25 aa, Mycobacterium bovis
ATGRGRWALCLVDGAPLRATQSLTE

SEQ ID NO: 156324 - protein, 19 aa, Mycobacterium bovis
ATIMVCFHLGILTAIPMGV

SEQ ID NO: 156325 - protein, 21 aa, Mycobacterium bovis
ATKRRYRFARGLMAGLLGTMA

SEQ ID NO: 156326 - protein, 17 aa, Mycobacterium bovis
ATKVWSLIVEERVCIGG

SEQ ID NO: 156327 - protein, 26 aa, Mycobacterium bovis
ATLEAFLKRRVRTHGLLTASIAAAVH

SEQ ID NO: 156328 - protein, 26 aa, Mycobacterium bovis
ATLGLRVYLAWITRTGYTYGALATPI

SEQ ID NO: 156329 - protein, 28 aa, Mycobacterium bovis
ATLIRTPELYAWILVLPIGLMLQQSSLR

SEQ ID NO: 156330 - protein, 25 aa, Mycobacterium bovis
ATLRPYRVIGGLVLSFGMVTLLGSA

SEQ ID NO: 156331 - protein, 26 aa, Mycobacterium bovis
ATLVGACLRFPYTFATAKFGGRNWTI

SEQ ID NO: 156332 - protein, 18 aa, Mycobacterium bovis
ATLWSVVFPLGMYGVGAY

SEQ ID NO: 156333 - protein, 25 aa, Mycobacterium bovis
ATMRTVKLNMVWAFGYNIAAIPVAA

SEQ ID NO: 156334 - protein, 21 aa, Mycobacterium bovis
ATPPGHGWPPGLPPLPRRPRR

SEQ ID NO: 156335 - protein, 29 aa, Mycobacterium bovis
ATPYELAATIARRLGLTGALGTVAESVDG

SEQ ID NO: 156336 - protein, 27 aa, Mycobacterium bovis
ATREAYRIGGDWVQYRSYPGIGTKQPR

SEQ ID NO: 156337 - protein, 23 aa, Mycobacterium bovis
ATRLRDRLGYVFGPPGWEPRTID

SEQ ID NO: 156338 - protein, 17 aa, Mycobacterium bovis
ATTLPQVAAIPFSSERQ

SEQ ID NO: 156339 - protein, 25 aa, Mycobacterium bovis
ATTVLACAVAMGFWMGSGAQFGLGG

SEQ ID NO: 156340 - protein, 26 aa, Mycobacterium bovis
ATTVVFGAFAHRWLARRTRRRINPGL

SEQ ID NO: 156341 - protein, 19 aa, Mycobacterium bovis
ATVAITFLGMVFTQLGILK

SEQ ID NO: 156342 - protein, 23 aa, Mycobacterium bovis
ATVIGLLTILGFSLYDTVIVFDK

SEQ ID NO: 156343 - protein, 23 aa, Mycobacterium bovis
ATVVIRWVVQWGSAMVAGYTGEQ

SEQ ID NO: 156344 - protein, 18 aa, Mycobacterium bovis
AVAAGRIRSLLSTRTPSS

SEQ ID NO: 156345 - protein, 22 aa, Mycobacterium bovis
AVAAVFWACRFVMERRQEATQS

SEQ ID NO: 156346 - protein, 26 aa, Mycobacterium bovis
AVADRLKFGAWLLFAGLWATFVYFPV

SEQ ID NO: 156347 - protein, 20 aa, Mycobacterium bovis
AVAFFAVVVLIGFWVAGSHE

SEQ ID NO: 156348 - protein, 29 aa, Mycobacterium bovis
AVAPETTAPVWITMLWPLADRPRLAPGAP

SEQ ID NO: 156349 - protein, 31 aa, Mycobacterium bovis
AVASRTGNLVTWWTGDALLVFDAGNLTQRYT

SEQ ID NO: 156350 - protein, 18 aa, Mycobacterium bovis
AVCGIRVVKAFGQEERET

SEQ ID NO: 156351 - protein, 25 aa, Mycobacterium bovis
AVDAWLRLCQTYGWAPGVMGASSQG

SEQ ID NO: 156352 - protein, 17 aa, Mycobacterium bovis
AVDRCFTGLVISLVCGY

SEQ ID NO: 156353 - protein, 18 aa, Mycobacterium bovis
AVDRIWLRGTVVLTSAIG

SEQ ID NO: 156354 - protein, 23 aa, Mycobacterium bovis
AVEAPEFHSAVLAELTLIGHRGP

SEQ ID NO: 156355 - protein, 18 aa, Mycobacterium bovis
AVGAGVWQGPSAELFVAA

SEQ ID NO: 156356 - protein, 24 aa, Mycobacterium bovis
AVGAICIAGAWLYTGGSKPYGYAG

SEQ ID NO: 156357 - protein, 20 aa, Mycobacterium bovis
AVGLRWDPYPFILLNLAFST

SEQ ID NO: 156358 - protein, 24 aa, Mycobacterium bovis
AVGSWWRYRYDKFGWTTRSSQLYE

SEQ ID NO: 156359 - protein, 18 aa, Mycobacterium bovis
AVGVIVWGLIFWSAVFHR

SEQ ID NO: 156360 - protein, 31 aa, Mycobacterium bovis
AVGYLLVAVLYRWFPPITVWTGLSLLAVAVA

SEQ ID NO: 156361 - protein, 25 aa, Mycobacterium bovis
AVIGVAVATFAGWTLIAANPVAGMT

SEQ ID NO: 156362 - protein, 21 aa, Mycobacterium bovis
AVIVALHLVGWLTVTLLVEPA

SEQ ID NO: 156363 - protein, 24 aa, Mycobacterium bovis
AVKGSLWWDIWSLGLLVLIPAVVY

SEQ ID NO: 156364 - protein, 24 aa, Mycobacterium bovis
AVLALATPVVREWLFGTQQQPGWV

SEQ ID NO: 156365 - protein, 19 aa, Mycobacterium bovis
AVLFLPYSLLGPFAGALMD

SEQ ID NO: 156366 - protein, 20 aa, Mycobacterium bovis
AVLGFFGFYLSFVAELPPPP

SEQ ID NO: 156367 - protein, 20 aa, Mycobacterium bovis
AVLRLARRSAASGAALADGI

SEQ ID NO: 156368 - protein, 25 aa, Mycobacterium bovis
AVLSGRVTAVLVCRRSVPAAHGSTL

SEQ ID NO: 156369 - protein, 17 aa, Mycobacterium bovis
AVLTSPIGFLQRPARWI

SEQ ID NO: 156370 - protein, 27 aa, Mycobacterium bovis
AVLVGELLCFVGMLIGIPVAALIHVYT

SEQ ID NO: 156371 - protein, 23 aa, Mycobacterium bovis
AVLVTLAGRRLWHRFRGQPDRAD

SEQ ID NO: 156372 - protein, 24 aa, Mycobacterium bovis
AVMVLCGLVVWQIYRPGRDLVRTG

SEQ ID NO: 156373 - protein, 19 aa, Mycobacterium bovis
AVNPWQWLLALLQQLWNAY

SEQ ID NO: 156374 - protein, 17 aa, Mycobacterium bovis
AVPGWAWQGPSAEWYVA

SEQ ID NO: 156375 - protein, 22 aa, Mycobacterium bovis
AVPTRNALALGLTLTVISFFWL

SEQ ID NO: 156376 - protein, 30 aa, Mycobacterium bovis
AVQTCAGLLPPLLIRHGIDVGIRRHVLSAL

SEQ ID NO: 156377 - protein, 23 aa, Mycobacterium bovis
AVRPEALSVVGWYLVAATAAAAT

SEQ ID NO: 156378 - protein, 17 aa, Mycobacterium bovis
AVRPELQQALANQNWAA

SEQ ID NO: 156379 - protein, 17 aa, Mycobacterium bovis
AVRRAGYQADLCTDDGR

SEQ ID NO: 156380 - protein, 17 aa, Mycobacterium bovis
AVSPPPIDERWLPESAL

SEQ ID NO: 156381 - protein, 20 aa, Mycobacterium bovis
AVSRTHWLASHLAMALAGSA

SEQ ID NO: 156382 - protein, 20 aa, Mycobacterium bovis
AVTGCTRGPTVTRYEVELGP

SEQ ID NO: 156383 - protein, 18 aa, Mycobacterium bovis
AVTLTASWQKIFSADPSV

SEQ ID NO: 156384 - protein, 19 aa, Mycobacterium bovis
AVVEGCLMAVFFVTDGGEV

SEQ ID NO: 156385 - protein, 28 aa, Mycobacterium bovis
AVVNLKLLMPVFRWQRRDNLLTEPDPAA

SEQ ID NO: 156386 - protein, 17 aa, Mycobacterium bovis
AVVPLRTILPGSPPAGA

SEQ ID NO: 156387 - protein, 24 aa, Mycobacterium bovis
AVVPQPGKHDWPFADRVFAAALPW

SEQ ID NO: 156388 - protein, 17 aa, Mycobacterium bovis
AVVPRIEFDDVAFGYDG

SEQ ID NO: 156389 - protein, 19 aa, Mycobacterium bovis
AWGVLVGFIALYLLGSLAG

SEQ ID NO: 156390 - protein, 22 aa, Mycobacterium bovis
AWLMSVVLWGGLIAVFGPALIP

SEQ ID NO: 156391 - protein, 17 aa, Mycobacterium bovis
AWWLFEALRHPVRSRLA

SEQ ID NO: 156392 - protein, 25 aa, Mycobacterium bovis
AYDIGLFYRYAWQNPVFADIVATRT

SEQ ID NO: 156393 - protein, 31 aa, Mycobacterium bovis; identical to SEQ ID NO: 10665

SEQ ID NO: 156394 - protein, 25 aa, Mycobacterium bovis
AYLLLVLVCRRRWQPRLLLATMAGL

SEQ ID NO: 156395 - protein, 29 aa, Mycobacterium bovis
AYMTYRRGRPLSVRWLLEPVVGRGRVEGA

SEQ ID NO: 156396 - protein, 20 aa, Mycobacterium bovis
AYRREALEAIDLDGVDSKGY

SEQ ID NO: 156397 - protein, 19 aa, Mycobacterium bovis
AYRTRPVFVPDADNDPVAR

SEQ ID NO: 156398 - protein, 25 aa, Mycobacterium bovis
AYSEPRLQPPNGYKDTTVPGIWVPD

SEQ ID NO: 156399 - protein, 27 aa, Mycobacterium bovis
AYSWYLWHWPLLIFWLSYTGHRHANFV

SEQ ID NO: 156400 - protein, 18 aa, Mycobacterium bovis
CAAAASALFGSWSLFHTP

SEQ ID NO: 156401 - protein, 20 aa, Mycobacterium bovis
CAAAMGALLLANRGGERDSR

SEQ ID NO: 156402 - protein, 20 aa, Mycobacterium bovis
CAACGLVYELALLTLAASLN

SEQ ID NO: 156403 - protein, 19 aa, Mycobacterium bovis
CAAGLWAFLRTYRVWRAEG

SEQ ID NO: 156404 - protein, 26 aa, Mycobacterium bovis
CAIAVWCVTAIIGAFAARHGYRQWRA

SEQ ID NO: 156405 - protein, 18 aa, Mycobacterium bovis
CAIFTPYRWMIEHVTTKR

SEQ ID NO: 156406 - protein, 18 aa, Mycobacterium bovis
CASAEWRAAGAAGTAAAL

SEQ ID NO: 156407 - protein, 25 aa, Mycobacterium bovis
CDAAGVPYRTQWDAGAVVLELYEHL

SEQ ID NO: 156408 - protein, 20 aa, Mycobacterium bovis
CDTALLVRRAWAIPSVALGW

SEQ ID NO: 156409 - protein, 18 aa, Mycobacterium bovis
CFGVEVWFLAALAAPLLT

SEQ ID NO: 156410 - protein, 21 aa, Mycobacterium bovis
CGFAMLPAYLLLVVHGQDSAG

SEQ ID NO: 156411 - protein, 18 aa, Mycobacterium bovis
CGLAGLVFLAVPALLPAA

SEQ ID NO: 156412 - protein, 17 aa, Mycobacterium bovis
CHADLRVADGSVDATLL

SEQ ID NO: 156413 - protein, 25 aa, Mycobacterium bovis
CHTMSLDWVAWRGLGLAADAQLVSE

SEQ ID NO: 156414 - protein, 18 aa, Mycobacterium bovis
CIGASVLGVALLIVDALR

SEQ ID NO: 156415 - protein, 17 aa, Mycobacterium bovis
CIKEASAGEAGQIYSLI

SEQ ID NO: 156416 - protein, 24 aa, Mycobacterium bovis
CILLLEVLFLRWLLDGRASRQWCG

SEQ ID NO: 156417 - protein, 18 aa, Mycobacterium bovis
CITDRFDGLLARNYGMAT

SEQ ID NO: 156418 - protein, 24 aa, Mycobacterium bovis
CLALLHYRAWAIPVAFVIAQGTAT

SEQ ID NO: 156419 - protein, 22 aa, Mycobacterium bovis
CLGLWQKIVFGRRVAETVIADP

SEQ ID NO: 156420 - protein, 19 aa, Mycobacterium bovis
CLVSVWRSVPFATVVLLAA

SEQ ID NO: 156421 - protein, 24 aa, Mycobacterium bovis
CPEALWDFLCERRSSISQVPPQRW

SEQ ID NO: 156422 - protein, 18 aa, Mycobacterium bovis
CSALHIWADTGGAGADFM

SEQ ID NO: 156423 - protein, 18 aa, Mycobacterium bovis
CVDYAKTRTLWGRNIGQF

SEQ ID NO: 156424 - protein, 20 aa, Mycobacterium bovis
CVLLGVPMALVLARSRGRLV

SEQ ID NO: 156425 - protein, 18 aa, Mycobacterium bovis
CVLNPLVLIHLMGGVHNE

SEQ ID NO: 156426 - protein, 21 aa, Mycobacterium bovis
CYHTAGIWRRGIVGHPIKLLK

SEQ ID NO: 156427 - protein, 25 aa, Mycobacterium bovis
CYLFTEFALRPVAAKALEAGRPPRR

SEQ ID NO: 156428 - protein, 25 aa, Mycobacterium bovis
DAADEYRPVAATVRHQAFSGDLIDQ

SEQ ID NO: 156429 - protein, 19 aa, Mycobacterium bovis
DAAEAVGFYRGERVEGTQL

SEQ ID NO: 156430 - protein, 17 aa, Mycobacterium bovis
DAAVCGIRVVKAFGQEE

SEQ ID NO: 156431 - protein, 24 aa, Mycobacterium bovis
DADSHLLGVIAFRALVLANPEQRV

SEQ ID NO: 156432 - protein, 18 aa, Mycobacterium bovis
DAGFRRAAVVTALMTAVI

SEQ ID NO: 156433 - protein, 21 aa, Mycobacterium bovis
DAGLAVGMFLTFSTFGTLSYA

SEQ ID NO: 156434 - protein, 18 aa, Mycobacterium bovis
DAGLPKWRETLMQLESVS

SEQ ID NO: 156435 - protein, 20 aa, Mycobacterium bovis
DALGAMLWRSLEPNAAPRTQ

SEQ ID NO: 156436 - protein, 25 aa, Mycobacterium bovis
DALRTATLQRLRPRLGVGAGAPAPA

SEQ ID NO: 156437 - protein, 24 aa, Mycobacterium bovis
DALTAVPLWIAFALGAKPATRRYT

SEQ ID NO: 156438 - protein, 20 aa, Mycobacterium bovis
DAPLWLASLCLMMMMTATNL

SEQ ID NO: 156439 - protein, 19 aa, Mycobacterium bovis
DAPYACMGGACGTCRAKLI

SEQ ID NO: 156440 - protein, 24 aa, Mycobacterium bovis
DATMLQMLIIFGIVTVIALVAATT

SEQ ID NO: 156441 - protein, 22 aa, Mycobacterium bovis
DATRAICSRSHLMGEGEAMLFG

SEQ ID NO: 156442 - protein, 21 aa, Mycobacterium bovis
DAVACAIPLPPIARLLDDLDV

SEQ ID NO: 156443 - protein, 26 aa, Mycobacterium bovis
DAVSEFPADRGWDVAGLFDPDPDAVG

SEQ ID NO: 156444 - protein, 25 aa, Mycobacterium bovis
DAVTARIGIELGFAVLNHTQHDVAD

SEQ ID NO: 156445 - protein, 24 aa, Mycobacterium bovis
DAYLKALGANAVDFTWITDFKPYQ

SEQ ID NO: 156446 - protein, 23 aa, Mycobacterium bovis
DCFRPGTCERLGIGPDDCASVNP

SEQ ID NO: 156447 - protein, 21 aa, Mycobacterium bovis
DCPGCGSLRIQCSLIHADLLA

SEQ ID NO: 156448 - protein, 25 aa, Mycobacterium bovis
DDALELRGRILGAFEAAEVSTDHAE

SEQ ID NO: 156449 - protein, 25 aa, Mycobacterium bovis
DDDERKKRLGVMLATGLIVGESLYG

SEQ ID NO: 156450 - protein, 17 aa, Mycobacterium bovis
DDFAYLVDFGIASATTD

SEQ ID NO: 156451 - protein, 23 aa, Mycobacterium bovis
DDLWFNPVMFWFRGHPVTAAMQL

SEQ ID NO: 156452 - protein, 24 aa, Mycobacterium bovis
DDPKWRTGADFGIAAGSWLPALLW

SEQ ID NO: 156453 - protein, 26 aa, Mycobacterium bovis
DDQKKRWLPGIADGSLTMAFAITEPD

SEQ ID NO: 156454 - protein, 21 aa, Mycobacterium bovis
DDVFWSFLEALIITAIVMVSH

SEQ ID NO: 156455 - protein, 22 aa, Mycobacterium bovis
DDYRRLGVRGQRLLALYYPFVA

SEQ ID NO: 156456 - protein, 23 aa, Mycobacterium bovis
DEDELRSAVSFFAEDAHIFATTV

SEQ ID NO: 156457 - protein, 25 aa, Mycobacterium bovis
DEGRPRRLIPLVGLIGCVVLAFALP

SEQ ID NO: 156458 - protein, 21 aa, Mycobacterium bovis
DEMEAVIALAFFIPLLIGTGG

SEQ ID NO: 156459 - protein, 23 aa, Mycobacterium bovis
DEPRAWRLKVTVTEEGGQYKMSK

SEQ ID NO: 156460 - protein, 23 aa, Mycobacterium bovis
DEPREFFTTNAFWSVPSDPTNDA

SEQ ID NO: 156461 - protein, 17 aa, Mycobacterium bovis
DFGRLKALGRMESKPLR

SEQ ID NO: 156462 - protein, 22 aa, Mycobacterium bovis
DFLSVGWWPVFNVADPSVVGGA

SEQ ID NO: 156463 - protein, 19 aa, Mycobacterium bovis
DFSEFDLAFRPDDASSFGD

SEQ ID NO: 156464 - protein, 18 aa, Mycobacterium bovis
DFWPWALQFVATLWVSTF

SEQ ID NO: 156465 - protein, 31 aa, Mycobacterium bovis
DFYQDARWALFMVTITYVWKNLGYTFVIYLA

SEQ ID NO: 156466 - protein, 18 aa, Mycobacterium bovis
DGARWWQLLLRVVLPMSR

SEQ ID NO: 156467 - protein, 21 aa, Mycobacterium bovis
DGHRPLAVGFFFSLGHSTVVF

SEQ ID NO: 156468 - protein, 24 aa, Mycobacterium bovis
DGIKERRFHIALVGAMMVAALALT

SEQ ID NO: 156469 - protein, 24 aa, Mycobacterium bovis
DGLGRYRVLAAPSRNGHDVIVTGL

SEQ ID NO: 156470 - protein, 17 aa, Mycobacterium bovis
DGLPRLATADIQVGDVL

SEQ ID NO: 156471 - protein, 17 aa, Mycobacterium bovis
DGPTVVLVHGFPDSHVL

SEQ ID NO: 156472 - protein, 17 aa, Mycobacterium bovis
DGPYVLVGWSLGGVLAY

SEQ ID NO: 156473 - protein, 23 aa, Mycobacterium bovis
DGRHPFLVMELIEGGTLRELLIE

SEQ ID NO: 156474 - protein, 25 aa, Mycobacterium bovis
DGSPMCGDASMALTMALLAAAVLYA

SEQ ID NO: 156475 - protein, 24 aa, Mycobacterium bovis
DGSQTRLATWLAEPGHTATPAGSI

SEQ ID NO: 156476 - protein, 24 aa, Mycobacterium bovis
DGSTGRRGAARSGYADPRVRLFSD

SEQ ID NO: 156477 - protein, 17 aa, Mycobacterium bovis
DGVIWARYNVPWQPAFV

SEQ ID NO: 156478 - protein, 24 aa, Mycobacterium bovis
DGVKEFPGPWALVPVGATMLMILA

SEQ ID NO: 156479 - protein, 24 aa, Mycobacterium bovis
DGVVLHWIIDYWNRFSLWVQHLVS

SEQ ID NO: 156480 - protein, 36 aa, Mycobacterium bovis
DGWLGDWTIFYWGWWISWAPFVGMFIARISRGRTIR

SEQ ID NO: 156481 - protein, 18 aa, Mycobacterium bovis
DHLYIAGRIKDLVIIDGR

SEQ ID NO: 156482 - protein, 18 aa, Mycobacterium bovis
DIQLKRLHQVAGPAGRSV

SEQ ID NO: 156483 - protein, 22 aa, Mycobacterium bovis
DIREGARYDLLIAGVAAISLIL

SEQ ID NO: 156484 - protein, 24 aa, Mycobacterium bovis
DIREHPSTCWWWERTAGENRARVR

SEQ ID NO: 156485 - protein, 18 aa, Mycobacterium bovis
DISGIWPVRTVHDAISEA

SEQ ID NO: 156486 - protein, 26 aa, Mycobacterium bovis
DITPSEAFTAWEFVDGYDVAQAVVVP

SEQ ID NO: 156487 - protein, 22 aa, Mycobacterium bovis
DKLPWQPPTVFLMRHGAHNSYT

SEQ ID NO: 156488 - protein, 17 aa, Mycobacterium bovis
DKNTAYRIGLKVASPSV

SEQ ID NO: 156489 - protein, 19 aa, Mycobacterium bovis
DKRLLPYMIGAFLLIVGAS

SEQ ID NO: 156490 - protein, 18 aa, Mycobacterium bovis
DKWKNCAGKTVTVTNKAK

SEQ ID NO: 156491 - protein, 24 aa, Mycobacterium bovis
DLDLLGGLARRMPATTVFFGVAAL

SEQ ID NO: 156492 - protein, 31 aa, Mycobacterium bovis
DLDPALSRWQWLVKWFLAIPHYIVLFFLHVA

SEQ ID NO: 156493 - protein, 19 aa, Mycobacterium bovis
DLDQVWRLTRGAGQRVAVI

SEQ ID NO: 156494 - protein, 23 aa, Mycobacterium bovis
DLDRPDLPTGKHAPQRRAVASRD

SEQ ID NO: 156495 - protein, 26 aa, Mycobacterium bovis
DLEPTWSRPGWRHLKHFNGYATSFWV

SEQ ID NO: 156496 - protein, 19 aa, Mycobacterium bovis
DLFLRIAPELYLKRLCVGG

SEQ ID NO: 156497 - protein, 18 aa, Mycobacterium bovis
DLMLYALVMAFSFTTLST

SEQ ID NO: 156498 - protein, 26 aa, Mycobacterium bovis
DLPFYRSVLNWLFVAVVLAFLASLLT

SEQ ID NO: 156499 - protein, 24 aa, Mycobacterium bovis
DLQFKGPAANIWADYTAAHIGTQT

SEQ ID NO: 156500 - protein, 18 aa, Mycobacterium bovis
DLQIKWNGFQAGGPVRTV

SEQ ID NO: 156501 - protein, 24 aa, Mycobacterium bovis
DLYSLGCALFRLLTGEAPFAAGAG

SEQ ID NO: 156502 - protein, 17 aa, Mycobacterium bovis
DMARLAVSFNDMAESLS

SEQ ID NO: 156503 - protein, 18 aa, Mycobacterium bovis
DMIEVLTGMCARLYGRRG

SEQ ID NO: 156504 - protein, 17 aa, Mycobacterium bovis
DNAEFQQGMKLFLSPNG

SEQ ID NO: 156505 - protein, 26 aa, Mycobacterium bovis
DNGLRPEPIIALGILLTWCSVERAVA

SEQ ID NO: 156506 - protein, 17 aa, Mycobacterium bovis
DNVRRYQIEPALHDGDY

SEQ ID NO: 156507 - protein, 31 aa, Mycobacterium bovis
DPAKPLPASIPWTALWLSQAWQQRVLEEELD

SEQ ID NO: 156508 - protein, 19 aa, Mycobacterium bovis
DPARWPWPTFTVNVVGAFL

SEQ ID NO: 156509 - protein, 17 aa, Mycobacterium bovis
DPCHVRAVVDWELSTLG

SEQ ID NO: 156510 - protein, 18 aa, Mycobacterium bovis
DPDRRQDLAMTWLLAGLV

SEQ ID NO: 156511 - protein, 19 aa, Mycobacterium bovis
DPFVRDGFQQVYSINTGQV

SEQ ID NO: 156512 - protein, 21 aa, Mycobacterium bovis
DPKETVSFVAWVVYAAYLHAR

SEQ ID NO: 156513 - protein, 21 aa, Mycobacterium bovis
DPPFVAYHLFGPAPATDNDLL

SEQ ID NO: 156514 - protein, 25 aa, Mycobacterium bovis
DPQQRLLLEVAWEALEHAGIPPGTL

SEQ ID NO: 156515 - protein, 25 aa, Mycobacterium bovis
DPQQRLLLEVSWEALERAGIDPITL

SEQ ID NO: 156516 - protein, 26 aa, Mycobacterium bovis
DPQQRMALELTWEALEHARIPASSLR

SEQ ID NO: 156517 - protein, 23 aa, Mycobacterium bovis
DPSRVRRSGGTGLGLAISVEDAR

SEQ ID NO: 156518 - protein, 20 aa, Mycobacterium bovis
DPSYRHVRESMFSSDGTATR

SEQ ID NO: 156519 - protein, 26 aa, Mycobacterium bovis
DPVPFPSFKNGVGLMLQLPQATVVGT

SEQ ID NO: 156520 - protein, 20 aa, Mycobacterium bovis
DQALLLRVIDQFGYGDDVDP

SEQ ID NO: 156521 - protein, 24 aa, Mycobacterium bovis
DQAQAAGMLLWFLIALPIGAVTGG

SEQ ID NO: 156522 - protein, 20 aa, Mycobacterium bovis
DQASSILLTLALTVSIVNAM

SEQ ID NO: 156523 - protein, 18 aa, Mycobacterium bovis
DQIERWARKLNNLAAQTA

SEQ ID NO: 156524 - protein, 21 aa, Mycobacterium bovis
DQPLLTGWLVRRTLLVSTLLV

SEQ ID NO: 156525 - protein, 19 aa, Mycobacterium bovis
DQRALGAAVHYAAVDKDAV

SEQ ID NO: 156526 - protein, 24 aa, Mycobacterium bovis
DRAGELLFWLPYPSFATYLHVGCA

SEQ ID NO: 156527 - protein, 19 aa, Mycobacterium bovis
DRATLKLVFSMDLGMCLNR

SEQ ID NO: 156528 - protein, 18 aa, Mycobacterium bovis
DRDIPFQISAVAARSVQG

SEQ ID NO: 156529 - protein, 24 aa, Mycobacterium bovis
DRDRLKIPFGHELKTGNVMYLDIK

SEQ ID NO: 156530 - protein, 29 aa, Mycobacterium bovis
DRDRSIGSVGRWVAVVAVLAVLTVVVTIA

SEQ ID NO: 156531 - protein, 21 aa, Mycobacterium bovis
DREPEQLWQVAKLRRAAFSGV

SEQ ID NO: 156532 - protein, 25 aa, Mycobacterium bovis
DRFVRALSAAAGWYVDAEAANAALV

SEQ ID NO: 156533 - protein, 23 aa, Mycobacterium bovis
DRGEFDGQLWIAMDYVDGIDATQ

SEQ ID NO: 156534 - protein, 18 aa, Mycobacterium bovis
DRGGRFIGYLHIKDVLTL

SEQ ID NO: 156535 - protein, 22 aa, Mycobacterium bovis
DRGVGWKTLRDAGPVVFMNGWY

SEQ ID NO: 156536 - protein, 17 aa, Mycobacterium bovis
DRHGYRFIVGIGALIWA

SEQ ID NO: 156537 - protein, 20 aa, Mycobacterium bovis
DRISSVFVPAVLVIAALTAA

SEQ ID NO: 156538 - protein, 26 aa, Mycobacterium bovis
DRLALWSRVLPITFTAAGLVALVGGG

SEQ ID NO: 156539 - protein, 23 aa, Mycobacterium bovis
DRLGRRPILLSGIATMITADAVL

SEQ ID NO: 156540 - protein, 20 aa, Mycobacterium bovis
DRLLLPLPMFHVAALTTVIF

SEQ ID NO: 156541 - protein, 22 aa, Mycobacterium bovis
DRLLRRVCPGDIVVLDVLDLDR

SEQ ID NO: 156542 - protein, 18 aa, Mycobacterium bovis
DRLWIRFIADTERRSQVI

SEQ ID NO: 156543 - protein, 17 aa, Mycobacterium bovis
DRMTWSQLYSRVTAVSA

SEQ ID NO: 156544 - protein, 19 aa, Mycobacterium bovis
DRPTPPWRPGAWAAAGVLA

SEQ ID NO: 156545 - protein, 21 aa, Mycobacterium bovis
DRRLTARGGERGMTYDIALWA

SEQ ID NO: 156546 - protein, 19 aa, Mycobacterium bovis
DRRVLAYTYRGGWGDATSS

SEQ ID NO: 156547 - protein, 24 aa, Mycobacterium bovis
DRSRIEFAITILLLVILLIIYRNP

SEQ ID NO: 156548 - protein, 28 aa, Mycobacterium bovis
DRVELLKLAVLLALWAAVAGAFVSVLYR

SEQ ID NO: 156549 - protein, 21 aa, Mycobacterium bovis
DRYADAIAMGADLEAIAEELA

SEQ ID NO: 156550 - protein, 24 aa, Mycobacterium bovis
DRYELGEILGFGGMSEVHLARDLR

SEQ ID NO: 156551 - protein, 20 aa, Mycobacterium bovis
DRYVTCGDLSAAAHAALATA

SEQ ID NO: 156552 - protein, 19 aa, Mycobacterium bovis
DRYVVSVSRRGEMSYSFAD

SEQ ID NO: 156553 - protein, 18 aa, Mycobacterium bovis
DRYYLRAGTPVNRGYAAA

SEQ ID NO: 156554 - protein, 23 aa, Mycobacterium bovis
DSAACKAWLLAQPYLVAGVLLVF

SEQ ID NO: 156555 - protein, 23 aa, Mycobacterium bovis
DSARRSGNEFLFQQLAQQAVETL

SEQ ID NO: 156556 - protein, 19 aa, Mycobacterium bovis
DSDLHWSILATRNDSEAFA

SEQ ID NO: 156557 - protein, 19 aa, Mycobacterium bovis
DSRGYLLRDGELTQITKDD

SEQ ID NO: 156558 - protein, 31 aa, Mycobacterium bovis
DSVYKMPGGVVMCWAVLVFFAFVIWTLTTET

SEQ ID NO: 156559 - protein, 18 aa, Mycobacterium bovis
DTAIAIKRAEVRRAAEIM

SEQ ID NO: 156560 - protein, 19 aa, Mycobacterium bovis
DTARAAFRRPFQFREFLDQ

SEQ ID NO: 156561 - protein, 31 aa, Mycobacterium bovis
DTELPRQFGYNMPLELVLTVIPFLIISVLFY

SEQ ID NO: 156562 - protein, 23 aa, Mycobacterium bovis
DTGIDWDVIFLLVGMMIIVGVLR

SEQ ID NO: 156563 - protein, 23 aa, Mycobacterium bovis
DTLARQGISYVLVRNDLDPETSR

SEQ ID NO: 156564 - protein, 23 aa, Mycobacterium bovis
DTMGRSRLRAPFGNRSDNGELLF

SEQ ID NO: 156565 - protein, 24 aa, Mycobacterium bovis
DTQYTRHVEWFFAESWARLTAGRT

SEQ ID NO: 156566 - protein, 17 aa, Mycobacterium bovis
DTRDVVMLQDFVTTPPL

SEQ ID NO: 156567 - protein, 24 aa, Mycobacterium bovis
DTRHVGSVLDWWSDPVTAPLGTSP

SEQ ID NO: 156568 - protein, 17 aa, Mycobacterium bovis
DTRMFDDPLQFYSRSIA

SEQ ID NO: 156569 - protein, 22 aa, Mycobacterium bovis
DTRVQAAVPFYGVYDFTRLQDA

SEQ ID NO: 156570 - protein, 25 aa, Mycobacterium bovis
DTSPRPLPSGTYCKIPQDAQLQVRG

SEQ ID NO: 156571 - protein, 19 aa, Mycobacterium bovis
DTTIGVAMLIGRFFLIIPV

SEQ ID NO: 156572 - protein, 17 aa, Mycobacterium bovis
DVADGYQVLAARGYGYG

SEQ ID NO: 156573 - protein, 18 aa, Mycobacterium bovis
DVDIKLIARTTHHLFQPL

SEQ ID NO: 156574 - protein, 25 aa, Mycobacterium bovis
DVEKRPRLTMFDDFGGRIPSDKPPI

SEQ ID NO: 156575 - protein, 23 aa, Mycobacterium bovis
DVFDRSAGLYRLRLLETSYGVGV

SEQ ID NO: 156576 - protein, 23 aa, Mycobacterium bovis
DVIHAFWVPEFLFKRDVMPNPVA

SEQ ID NO: 156577 - protein, 18 aa, Mycobacterium bovis
DVKLADFGLVRAVAAASI

SEQ ID NO: 156578 - protein, 17 aa, Mycobacterium bovis
DVLLPDLGAAWRVLHAI

SEQ ID NO: 156579 - protein, 25 aa, Mycobacterium bovis
DVLPQTRWIPVVTFVQVSADMAVAT

SEQ ID NO: 156580 - protein, 19 aa, Mycobacterium bovis
DVLVALALTNYGAKTAAKT

SEQ ID NO: 156581 - protein, 24 aa, Mycobacterium bovis
DVPAPRIIASGLFNAIPEAPPLTA

SEQ ID NO: 156582 - protein, 19 aa, Mycobacterium bovis
DVPTWPFVVGTVAAVAVAA

SEQ ID NO: 156583 - protein, 24 aa, Mycobacterium bovis
DVRIPRNRAVVMLVIDVSQSMRAT

SEQ ID NO: 156584 - protein, 23 aa, Mycobacterium bovis
DVRLDRGGSLVITGRSGAGKTTL

SEQ ID NO: 156585 - protein, 22 aa, Mycobacterium bovis
DVRRAPHAGGREVLRVEVGAPS

SEQ ID NO: 156586 - protein, 31 aa, Mycobacterium bovis
DVRVAHPLISRAHLLLRFDQGRWVAIDNGSL

SEQ ID NO: 156587 - protein, 29 aa, Mycobacterium bovis
DVSAEAWLVADLDSGAVIAARDPHGRHRP

SEQ ID NO: 156588 - protein, 39 aa, Mycobacterium bovis
DVVELRLPQELPMLAPGQEWRMVWDSALDRAEIGRGIES

SEQ ID NO: 156589 - protein, 26 aa, Mycobacterium bovis
DVVLRPHWTPLFAYAAAFLIAVAHVA

SEQ ID NO: 156590 - protein, 18 aa, Mycobacterium bovis
DVWRSVRSLPDFWRLLQV

SEQ ID NO: 156591 - protein, 25 aa, Mycobacterium bovis
DWDRHLRPMLARRFEIATGHRQAKD

SEQ ID NO: 156592 - protein, 22 aa, Mycobacterium bovis
DYLRMWIQAATVMSHYQAVAHE

SEQ ID NO: 156593 - protein, 29 aa, Mycobacterium bovis
DYSDHDLRLIIAMTVCIVLLILIVLLRAI

SEQ ID NO: 156594 - protein, 17 aa, Mycobacterium bovis
DYVRMWLQAAAVMGLYQ

SEQ ID NO: 156595 - protein, 20 aa, Mycobacterium bovis
EAAMKYFLLGAFSSAFFLYG

SEQ ID NO: 156596 - protein, 18 aa, Mycobacterium bovis
EAASAYFAGGLSLRDATR

SEQ ID NO: 156597 - protein, 23 aa, Mycobacterium bovis
EADGWRWVFLVNLPLGVFAVLAA

SEQ ID NO: 156598 - protein, 20 aa, Mycobacterium bovis
EAEGGMGPHGLMIGMTGSGK

SEQ ID NO: 156599 - protein, 21 aa, Mycobacterium bovis
EAFAAVASFSRALVLVTVGII

SEQ ID NO: 156600 - protein, 18 aa, Mycobacterium bovis
EAIEQGWFITSVSLLPTL

SEQ ID NO: 156601 - protein, 17 aa, Mycobacterium bovis
EAIKGLRAVAAGKQAPN

SEQ ID NO: 156602 - protein, 32 aa, Mycobacterium bovis
EAITRSFALVRHGFWRVLGIRLLTVLVVGVVG

SEQ ID NO: 156603 - protein, 22 aa, Mycobacterium bovis
EALDRVGLCGWLAGLPEGLSTV

SEQ ID NO: 156604 - protein, 22 aa, Mycobacterium bovis
EALFRPMHDRLASAVVAEAHRT

SEQ ID NO: 156605 - protein, 18 aa, Mycobacterium bovis
EALIKIYAAKNIEVVQGY

SEQ ID NO: 156606 - protein, 20 aa, Mycobacterium bovis
EALTGDMFLLMLGGGALAAS

SEQ ID NO: 156607 - protein, 21 aa, Mycobacterium bovis
EAPAVPGVVPAPVPIPVPIII

SEQ ID NO: 156608 - protein, 24 aa, Mycobacterium bovis
EAPTLAGHALRFDEFGNIITDSAV

SEQ ID NO: 156609 - protein, 21 aa, Mycobacterium bovis
EARLSWVLAALAGILGATAFT

SEQ ID NO: 156610 - protein, 21 aa, Mycobacterium bovis
EASVRGWPVLSFSRPVSLRDR

SEQ ID NO: 156611 - protein, 17 aa, Mycobacterium bovis
EATRDAFDNGWFRTGDI

SEQ ID NO: 156612 - protein, 25 aa, Mycobacterium bovis
EAVMNKLRWVLLIVGGIGVAVAAVA

SEQ ID NO: 156613 - protein, 19 aa, Mycobacterium bovis
EAWQVIAVALIVYSAYANW

SEQ ID NO: 156614 - protein, 18 aa, Mycobacterium bovis
ECDSVVAAVSRLTSAQAP

SEQ ID NO: 156615 - protein, 23 aa, Mycobacterium bovis
EDGARPAPPDVIRAIEAQVWDGG

SEQ ID NO: 156616 - protein, 17 aa, Mycobacterium bovis
EDMDLSAFVVFSSMAGI

SEQ ID NO: 156617 - protein, 25 aa, Mycobacterium bovis
EDSKEARDALGLTLTPSLAPWVALR

SEQ ID NO: 156618 - protein, 26 aa, Mycobacterium bovis
EEDKGLRTRSEMIAQLVFAMGGRAAE

SEQ ID NO: 156619 - protein, 25 aa, Mycobacterium bovis
EEIRKRWDRYAAFAEKTFNVTIPAI

SEQ ID NO: 156620 - protein, 25 aa, Mycobacterium bovis
EELGPRPHLAVVAGRVGALSGLAPE

SEQ ID NO: 156621 - protein, 22 aa, Mycobacterium bovis
EELLRINLSFADGLPRLATADI

SEQ ID NO: 156622 - protein, 25 aa, Mycobacterium bovis
EELRKAGEVFTAIARMYSDADVRAA

SEQ ID NO: 156623 - protein, 19 aa, Mycobacterium bovis
EEPLAMVGDGFRFASQPLG

SEQ ID NO: 156624 - protein, 23 aa, Mycobacterium bovis
EESNFPAIVKFLSEQVLSRATER

SEQ ID NO: 156625 - protein, 17 aa, Mycobacterium bovis
EEVLRCAAHAAPASNGP

SEQ ID NO: 156626 - protein, 18 aa, Mycobacterium bovis
EFVWCMQGLPSPYLTIAF

SEQ ID NO: 156627 - protein, 22 aa, Mycobacterium bovis
EGAATIGTWVRMVINYLVPFLV

SEQ ID NO: 156628 - protein, 25 aa, Mycobacterium bovis
EGALVLGVLFWFTFVGWVTVVIAGG

SEQ ID NO: 156629 - protein, 25 aa, Mycobacterium bovis
EGEAMLFGEYIRLMALVEYSADEIR

SEQ ID NO: 156630 - protein, 19 aa, Mycobacterium bovis
EGEIAPPTRVVLRKQRNVQ

SEQ ID NO: 156631 - protein, 19 aa, Mycobacterium bovis
EGFALPLVHTAWLTALVFT

SEQ ID NO: 156632 - protein, 26 aa, Mycobacterium bovis
EGKEVRFGVGASGLWAASTTGTSNGS

SEQ ID NO: 156633 - protein, 23 aa, Mycobacterium bovis
EGKKAVLWTSGWTPRYQGETIYL

SEQ ID NO: 156634 - protein, 20 aa, Mycobacterium bovis
EGPMTPKRAIEVIADACQAL

SEQ ID NO: 156635 - protein, 21 aa, Mycobacterium bovis
EGRGANVFFMLGGQRLDLSSL

SEQ ID NO: 156636 - protein, 20 aa, Mycobacterium bovis
EGRTAYLVMELVNGEPLNSV

SEQ ID NO: 156637 - protein, 22 aa, Mycobacterium bovis
EGSFWRRLLSPPGFTSIAHVFV

SEQ ID NO: 156638 - protein, 17 aa, Mycobacterium bovis
EGTQFGPYRLRRLVGRG

SEQ ID NO: 156639 - protein, 19 aa, Mycobacterium bovis
EGTWWGWHGAGWFLLTLMV

SEQ ID NO: 156640 - protein, 22 aa, Mycobacterium bovis
EGVELVQAIAIFFSTGLVPLNS

SEQ ID NO: 156641 - protein, 18 aa, Mycobacterium bovis
EGYLVWAAAAAMCAPLTL

SEQ ID NO: 156642 - protein, 24 aa, Mycobacterium bovis
EHAPELRVAGALRNVIADSQRRQH

SEQ ID NO: 156643 - protein, 20 aa, Mycobacterium bovis
EHRDGGAFIPKVAVTGSLAL

SEQ ID NO: 156644 - protein, 26 aa, Mycobacterium bovis
EHTTHWGLQIDHFWWTAIWAAILLSI

SEQ ID NO: 156645 - protein, 25 aa, Mycobacterium bovis
EHVGFSVWMLWSIVVVQMTAAAPGH

SEQ ID NO: 156646 - protein, 20 aa, Mycobacterium bovis
EIAFSFKRTHKVTVNAEGSD

SEQ ID NO: 156647 - protein, 25 aa, Mycobacterium bovis
EIELTGQEAFVWIGLHEPDENQMQD

SEQ ID NO: 156648 - protein, 24 aa, Mycobacterium bovis
EIGQFIRWLFRFLVGQVDRIAPFR

SEQ ID NO: 156649 - protein, 18 aa, Mycobacterium bovis
EIGVPIFFVLSGFLLFRP

SEQ ID NO: 156650 - protein, 20 aa, Mycobacterium bovis
EIKQRYELFKSVGARDANDY

SEQ ID NO: 156651 - protein, 25 aa, Mycobacterium bovis
EILRGGRSRLVFGTLAILLCLVLGV

SEQ ID NO: 156652 - protein, 26 aa, Mycobacterium bovis
EIPGCLVALYLVARLRHRGMNEAGYM

SEQ ID NO: 156653 - protein, 20 aa, Mycobacterium bovis
EIRALTGLRIVAAVWVVLFH

SEQ ID NO: 156654 - protein, 20 aa, Mycobacterium bovis
EIVLAVANLMWFVFAGFGAL

SEQ ID NO: 156655 - protein, 26 aa, Mycobacterium bovis
EKHCYGIPICWSFRSIFDALDGIDKL

SEQ ID NO: 156656 - protein, 18 aa, Mycobacterium bovis
EKIEQRYSLGMVAATLAL

SEQ ID NO: 156657 - protein, 26 aa, Mycobacterium bovis
EKPPRLYRAAAWVVIVAGIVFTVAVI

SEQ ID NO: 156658 - protein, 19 aa, Mycobacterium bovis
ELAFRGVLHGALNRAWGFR

SEQ ID NO: 156659 - protein, 18 aa, Mycobacterium bovis
ELAVFVFFGPVAVLGTQY

SEQ ID NO: 156660 - protein, 24 aa, Mycobacterium bovis
ELDAELWIAALIFPAFTAGGAIGN

SEQ ID NO: 156661 - protein, 19 aa, Mycobacterium bovis
ELFCTIRNFYDADPLAKAA

SEQ ID NO: 156662 - protein, 20 aa, Mycobacterium bovis
ELGIILALLMGWQFTAAEFV

SEQ ID NO: 156663 - protein, 19 aa, Mycobacterium bovis
ELGVTVLRLAVIRRGVIPA

SEQ ID NO: 156664 - protein, 17 aa, Mycobacterium bovis
ELIEITLVKNPAMRYRS

SEQ ID NO: 156665 - protein, 18 aa, Mycobacterium bovis
ELIKFAIVGGTTFIIDTA

SEQ ID NO: 156666 - protein, 19 aa, Mycobacterium bovis
ELIPARAPHSAEIRNTDVL

SEQ ID NO: 156667 - protein, 20 aa, Mycobacterium bovis
ELLDRLGAHLTRHVGPGVEY

SEQ ID NO: 156668 - protein, 18 aa, Mycobacterium bovis
ELLVVMLPLIGVLYVGIK

SEQ ID NO: 156669 - protein, 22 aa, Mycobacterium bovis
ELRPEDKAHLVAQLRARQPTAM

SEQ ID NO: 156670 - protein, 20 aa, Mycobacterium bovis
ELRVPIGVTGTGEPLMFDLK

SEQ ID NO: 156671 - protein, 21 aa, Mycobacterium bovis
ELSGLLGAVPGWAWQGPSAEW

SEQ ID NO: 156672 - protein, 26 aa, Mycobacterium bovis
ELTFRRIAAALGRPMVPIGSPVLRRV

SEQ ID NO: 156673 - protein, 17 aa, Mycobacterium bovis
EMRQWLRNWVGKAVGKA

SEQ ID NO: 156674 - protein, 23 aa, Mycobacterium bovis
ENFNSAFYLFGLVLLVMAGNLAR

SEQ ID NO: 156675 - protein, 40 aa, Mycobacterium bovis
ENLPRVNARGGPGGAPGCWQPITRDLWPAPYLVMDTGASL

SEQ ID NO: 156676 - protein, 23 aa, Mycobacterium bovis
ENLSCSVIKCVALTFDDGPGPYT

SEQ ID NO: 156677 - protein, 17 aa, Mycobacterium bovis
ENPDFKRGLKMFLSPDG

SEQ ID NO: 156678 - protein, 26 aa, Mycobacterium bovis
EPASDWRNRPVLVFVLDAGMPGLTQG

SEQ ID NO: 156679 - protein, 21 aa, Mycobacterium bovis
EPDYRFTLANERTFLAWQRTA

SEQ ID NO: 156680 - protein, 25 aa, Mycobacterium bovis
EPEPELPNLTGRVEFEHVNFAYLPG

SEQ ID NO: 156681 - protein, 24 aa, Mycobacterium bovis
EPGIPAWRRILDDLSYEPVMAPLR

SEQ ID NO: 156682 - protein, 19 aa, Mycobacterium bovis
EPRNIWVMIGVPALIVALI

SEQ ID NO: 156683 - protein, 20 aa, Mycobacterium bovis
EPVAVVGMGCRYPGGVDSPE

SEQ ID NO: 156684 - protein, 19 aa, Mycobacterium bovis
EQDLGFKIIFGLPGIVLAS

SEQ ID NO: 156685 - protein, 20 aa, Mycobacterium bovis
EQIMPLLVVAVMSQLVFSGG

SEQ ID NO: 156686 - protein, 26 aa, Mycobacterium bovis
EQTRKRFGDTMGYRLVIYPEYASLDR

SEQ ID NO: 156687 - protein, 23 aa, Mycobacterium bovis
ERDSRTRTSIGLATAAAAGTSVI

SEQ ID NO: 156688 - protein, 20 aa, Mycobacterium bovis
ERGEPWPQPVPEPAFKAAIA

SEQ ID NO: 156689 - protein, 20 aa, Mycobacterium bovis
ERGIGNGMSLLIFVGIAARI

SEQ ID NO: 156690 - protein, 29 aa, Mycobacterium bovis
ERGPRLGPPPVMPPSLAWWASSLQLSGLT

SEQ ID NO: 156691 - protein, 25 aa, Mycobacterium bovis
ERIFDPKVFVVSFVFNVLVAALIVY

SEQ ID NO: 156692 - protein, 21 aa, Mycobacterium bovis
ERKIEAFAMFNVFYQSGILLG

SEQ ID NO: 156693 - protein, 20 aa, Mycobacterium bovis
ERLFNRWGVRAVFLGRFIAL

SEQ ID NO: 156694 - protein, 26 aa, Mycobacterium bovis
ERLPKRLAEAVGIVLELLAGIPSVVV

SEQ ID NO: 156695 - protein, 24 aa, Mycobacterium bovis
ERNLSVALNEVFAGFNPLDPRNLD

SEQ ID NO: 156696 - protein, 19 aa, Mycobacterium bovis
ERQVRRWGSQWELVRLPDD

SEQ ID NO: 156697 - protein, 27 aa, Mycobacterium bovis
ERRTWLPRVWLALPLGLLALGSSMFFG

SEQ ID NO: 156698 - protein, 20 aa, Mycobacterium bovis
ERYMTISAITAMLFDLTVTA

SEQ ID NO: 156699 - protein, 19 aa, Mycobacterium bovis
ESAAWPAGVPWTDASLSSA

SEQ ID NO: 156700 - protein, 25 aa, Mycobacterium bovis
ESAELCAQYLAPVLDAIKFNYFPFG

SEQ ID NO: 156701 - protein, 20 aa, Mycobacterium bovis
ESLAELMGGPDIAPPSSGLQ

SEQ ID NO: 156702 - protein, 27 aa, Mycobacterium bovis
ESLIDVVHWPGYLLIVAGVVGGVGALA

SEQ ID NO: 156703 - protein, 28 aa, Mycobacterium bovis
ESPDGMTPPVRWRSGRRVHFDLDPLLPF

SEQ ID NO: 156704 - protein, 19 aa, Mycobacterium bovis
ESRLLRIASPMFHFGILVV

SEQ ID NO: 156705 - protein, 23 aa, Mycobacterium bovis
ESSRGYAAAIGRVGTDGIPMLML

SEQ ID NO: 156706 - protein, 17 aa, Mycobacterium bovis
ESVRMLAPIPGKSAVGI

SEQ ID NO: 156707 - protein, 23 aa, Mycobacterium bovis
ESYTSTYLRFVWTLSATAVVLCY

SEQ ID NO: 156708 - protein, 17 aa, Mycobacterium bovis
ETARFGAPTLLTRSTND

SEQ ID NO: 156709 - protein, 26 aa, Mycobacterium bovis
ETATALAWFPLWFVLLAVGWLVTQRR

SEQ ID NO: 156710 - protein, 30 aa, Mycobacterium bovis
ETDVDFAVRICTEITGLVRTLAERDADKPA

SEQ ID NO: 156711 - protein, 25 aa, Mycobacterium bovis
ETEHLPLLAPLRAIPVIGPPLAALV

SEQ ID NO: 156712 - protein, 22 aa, Mycobacterium bovis
ETERGFSMALGRLGDPADSDCL

SEQ ID NO: 156713 - protein, 20 aa, Mycobacterium bovis
ETERIWLPFTIWLTAAPALL

SEQ ID NO: 156714 - protein, 17 aa, Mycobacterium bovis
ETFNVIFVDMKFESAAQ

SEQ ID NO: 156715 - protein, 29 aa, Mycobacterium bovis
ETIKGDASVGWLRLGALALALAALAALLI

SEQ ID NO: 156716 - protein, 21 aa, Mycobacterium bovis
ETPDFLPVVLEFAATVDPEAG

SEQ ID NO: 156717 - protein, 18 aa, Mycobacterium bovis
ETRLPLIVQNTHRYFFYI

SEQ ID NO: 156718 - protein, 22 aa, Mycobacterium bovis
ETRSDVKAVRFLNRQQAYDDAI

SEQ ID NO: 156719 - protein, 24 aa, Mycobacterium bovis
ETVNRCPVYMPFDDVDIALNLGDA

SEQ ID NO: 156720 - protein, 25 aa, Mycobacterium bovis
ETVSVWFRSVWVLQPRGDLMAEAPL

SEQ ID NO: 156721 - protein, 20 aa, Mycobacterium bovis
ETYTRRRRNLLIGIGAGAAV

SEQ ID NO: 156722 - protein, 18 aa, Mycobacterium bovis
EVAHDGRLLAAHMVNGIV

SEQ ID NO: 156723 - protein, 20 aa, Mycobacterium bovis
EVIQPYLPIAVVAALDAVFG

SEQ ID NO: 156724 - protein, 21 aa, Mycobacterium bovis
EVIRLIRRLLPALVVVLAGCA

SEQ ID NO: 156725 - protein, 27 aa, Mycobacterium bovis
EVIVNLGYGDPRFGYSTSPANVPTPFG

SEQ ID NO: 156726 - protein, 19 aa, Mycobacterium bovis
EVLKCGAQVVLPADADGHA

SEQ ID NO: 156727 - protein, 21 aa, Mycobacterium bovis
EVPDAMRAMFGTRLLPREYAD

SEQ ID NO: 156728 - protein, 18 aa, Mycobacterium bovis
EVPYVLPFLAEGRISGVT

SEQ ID NO: 156729 - protein, 20 aa, Mycobacterium bovis
EVRRQSRWRTAAFASAAAIA

SEQ ID NO: 156730 - protein, 27 aa, Mycobacterium bovis
EVRWGVAGRMVVAWLVTLPLAGLVGAF

SEQ ID NO: 156731 - protein, 23 aa, Mycobacterium bovis
EVVGRRRLWFGVSGAIVAVAIAS

SEQ ID NO: 156732 - protein, 21 aa, Mycobacterium bovis
EVVLLLFLPAILYWESMNTSF

SEQ ID NO: 156733 - protein, 17 aa, Mycobacterium bovis
EVYWPLRRVGVQFHAAA

SEQ ID NO: 156734 - protein, 19 aa, Mycobacterium bovis
EWDTLLFFAGLFVMVGALV

SEQ ID NO: 156735 - protein, 22 aa, Mycobacterium bovis
EWFGELEFWAALIKVLALMAFL

SEQ ID NO: 156736 - protein, 20 aa, Mycobacterium bovis
EWNHAYGIAALRAALIALAL

SEQ ID NO: 156737 - protein, 18 aa, Mycobacterium bovis
EYAGPRLALVEWAAGMRL

SEQ ID NO: 156738 - protein, 24 aa, Mycobacterium bovis
EYLCLMPIFPLALWLMNVYAAIRY

SEQ ID NO: 156739 - protein, 25 aa, Mycobacterium bovis
EYWYRSIRQPVQFERAVRNAFDGGY

SEQ ID NO: 156740 - protein, 18 aa, Mycobacterium bovis
FAAFPGWYATVFSALYLP

SEQ ID NO: 156741 - protein, 17 aa, Mycobacterium bovis
FAAGRLYTTLSVADAAA

SEQ ID NO: 156742 - protein, 29 aa, Mycobacterium bovis
FADFPKYPLNILADVNALLGIYYSHSLYY

SEQ ID NO: 156743 - protein, 22 aa, Mycobacterium bovis
FADPGNPLAILVPLTAAAMDLV

SEQ ID NO: 156744 - protein, 19 aa, Mycobacterium bovis
FADRRGRRAALTFSVSLMA

SEQ ID NO: 156745 - protein, 21 aa, Mycobacterium bovis
FAEARWLSVALLSIGLAGFCL

SEQ ID NO: 156746 - protein, 17 aa, Mycobacterium bovis
FAELYRQGAARDVGMLL

SEQ ID NO: 156747 - protein, 17 aa, Mycobacterium bovis
FAFFGGFAIMLGAELNA

SEQ ID NO: 156748 - protein, 26 aa, Mycobacterium bovis
FAFFGWRWSLPLGVAILLAAVGGGLI

SEQ ID NO: 156749 - protein, 22 aa, Mycobacterium bovis
FAGGCRRPVWVTLIGNLLSLGV

SEQ ID NO: 156750 - protein, 29 aa, Mycobacterium bovis
FAGLLAWLYQRTRVTASYRLAAPAGSSKP

SEQ ID NO: 156751 - protein, 18 aa, Mycobacterium bovis
FAGYFAMLALPAMVQVAG

SEQ ID NO: 156752 - protein, 17 aa, Mycobacterium bovis
FAHIPRVGGGDFTAVPL

SEQ ID NO: 156753 - protein, 17 aa, Mycobacterium bovis
FAIGRRIGRYNVVDVVW

SEQ ID NO: 156754 - protein, 23 aa, Mycobacterium bovis
FAIPCFLLLLILEWTAARKLESI

SEQ ID NO: 156755 - protein, 24 aa, Mycobacterium bovis
FAIVPLLHRFGGLVAPLTFIGTAY

SEQ ID NO: 156756 - protein, 18 aa, Mycobacterium bovis
FAKMPLMVVILLTTTIVL

SEQ ID NO: 156757 - protein, 17 aa, Mycobacterium bovis
FALFLYVVMLVFLVATA

SEQ ID NO: 156758 - protein, 25 aa, Mycobacterium bovis
FALKRGALMFGKLVPMGIGAIIGAI

SEQ ID NO: 156759 - protein, 17 aa, Mycobacterium bovis
FAMFLIGRYHERRRQHI

SEQ ID NO: 156760 - protein, 18 aa, Mycobacterium bovis
FAPRGAGEGRLIRALTTA

SEQ ID NO: 156761 - protein, 26 aa, Mycobacterium bovis
FARLQFRGRDALFWVYVATLMVPGTV

SEQ ID NO: 156762 - protein, 24 aa, Mycobacterium bovis
FASLAVAVAVTIRPTAASKPVEGH

SEQ ID NO: 156763 - protein, 24 aa, Mycobacterium bovis
FATARSHLAGDFLSYYDQFTQQIV

SEQ ID NO: 156764 - protein, 19 aa, Mycobacterium bovis
FAVGGEWAGSALLSAEYAP

SEQ ID NO: 156765 - protein, 18 aa, Mycobacterium bovis
FAVGVVRLGQRQCLVQEL

SEQ ID NO: 156766 - protein, 17 aa, Mycobacterium bovis
FAVLAVIAVVLYYVMLT

SEQ ID NO: 156767 - protein, 23 aa, Mycobacterium bovis
FAVLCGAASYIAVPAVQRLAIPE

SEQ ID NO: 156768 - protein, 17 aa, Mycobacterium bovis
FAVSGFLLWRGHAAAAR

SEQ ID NO: 156769 - protein, 19 aa, Mycobacterium bovis
FAWGLSREYSVLVEMDADG

SEQ ID NO: 156770 - protein, 21 aa, Mycobacterium bovis
FCAALGLPIVPLFAYSRTAAM

SEQ ID NO: 156771 - protein, 21 aa, Mycobacterium bovis
FCGVAVCALIAYLVGQSKGYF

SEQ ID NO: 156772 - protein, 18 aa, Mycobacterium bovis
FDHYRSGPITVQLYRGAA

SEQ ID NO: 156773 - protein, 18 aa, Mycobacterium bovis
FDIPLCSATRSLFDTLDG

SEQ ID NO: 156774 - protein, 19 aa, Mycobacterium bovis
FDLAVAVFFAVSGFLLWRG

SEQ ID NO: 156775 - protein, 18 aa, Mycobacterium bovis
FDLGICLVLITLPTLALF

SEQ ID NO: 156776 - protein, 25 aa, Mycobacterium bovis
FDLRGRATLYLTYWTAGDTRNRGRE

SEQ ID NO: 156777 - protein, 19 aa, Mycobacterium bovis
FDPLRRFVAAIPECRANPV

SEQ ID NO: 156778 - protein, 31 aa, Mycobacterium bovis
FDPNSKFTISMLWPGDRAWRQAGERRMLCGL

SEQ ID NO: 156779 - protein, 18 aa, Mycobacterium bovis
FDRLPRRLVERVTPKPGT

SEQ ID NO: 156780 - protein, 25 aa, Mycobacterium bovis
FDYAARSQLWLSLLSWAVVVGCYLV

SEQ ID NO: 156781 - protein, 29 aa, Mycobacterium bovis
FEAHLAGCPECRGAVTELCGVPALLSQLD

SEQ ID NO: 156782 - protein, 17 aa, Mycobacterium bovis
FEAMGRIGMVFKEGDSD

SEQ ID NO: 156783 - protein, 19 aa, Mycobacterium bovis
FEAVGDWQLWVFKSDPANR

SEQ ID NO: 156784 - protein, 26 aa, Mycobacterium bovis
FEKYGKWTIILARFVPIARTFVPVIA

SEQ ID NO: 156785 - protein, 22 aa, Mycobacterium bovis
FEVRGGLFVRQIHHWAALMFAA

SEQ ID NO: 156786 - protein, 20 aa, Mycobacterium bovis
FFAESWARLTAGRTARVVLL

SEQ ID NO: 156787 - protein, 17 aa, Mycobacterium bovis
FFIPLLIGTGGNTGTQI

SEQ ID NO: 156788 - protein, 19 aa, Mycobacterium bovis
FFNFYLCDISLKVNGLQPG

SEQ ID NO: 156789 - protein, 20 aa, Mycobacterium bovis
FFPLMGIGAFSMLAFSGRFG

SEQ ID NO: 156790 - protein, 18 aa, Mycobacterium bovis
FFSPHSWWPIMVALSGSV

SEQ ID NO: 156791 - protein, 17 aa, Mycobacterium bovis
FFTAIFLRDLRIPAMAA

SEQ ID NO: 156792 - protein, 31 aa, Mycobacterium bovis
FFVAELLDTWIWRWVAFLLVFAIMVVVTAVL

SEQ ID NO: 156793 - protein, 22 aa, Mycobacterium bovis
FFWLWCATNLLAGVLALVTVAF

SEQ ID NO: 156794 - protein, 21 aa, Mycobacterium bovis
FGADLRPVLLRAMTFMIVASP

SEQ ID NO: 156795 - protein, 17 aa, Mycobacterium bovis
FGAPGTVATINYLDVDA

SEQ ID NO: 156796 - protein, 19 aa, Mycobacterium bovis
FGARLRAFVVKKPGADLDE

SEQ ID NO: 156797 - protein, 18 aa, Mycobacterium bovis
FGEFEFWFAGVKVATIVG

SEQ ID NO: 156798 - protein, 17 aa, Mycobacterium bovis
FGEFFAFTKVCSHLGCP

SEQ ID NO: 156799 - protein, 24 aa, Mycobacterium bovis
FGFAALRIASYALWPFGRTIVEKP

SEQ ID NO: 156800 - protein, 19 aa, Mycobacterium bovis
FGGIGSIFPLFMMVGIMMM

SEQ ID NO: 156801 - protein, 39 aa, Mycobacterium bovis
FGGKVSYLALGILVAIALVIGGIGGVIGRKTAEVVDAFT

SEQ ID NO: 156802 - protein, 17 aa, Mycobacterium bovis
FGGLMLLGGRLGDTIGR

SEQ ID NO: 156803 - protein, 24 aa, Mycobacterium bovis
FGHMLSGMAIRIVDVFRITRKVGV

SEQ ID NO: 156804 - protein, 17 aa, Mycobacterium bovis
FGIAGWVDDPSGLTATN

SEQ ID NO: 156805 - protein, 20 aa, Mycobacterium bovis
FGMLRYCLQLFPDPSTYFRP

SEQ ID NO: 156806 - protein, 25 aa, Mycobacterium bovis
FGPAPEGMAMWIIGMVAAIGLALWI

SEQ ID NO: 156807 - protein, 21 aa, Mycobacterium bovis
FGPYRLRRLVGRGGMGDVYEA

SEQ ID NO: 156808 - protein, 20 aa, Mycobacterium bovis
FGRDLGFYAFELPFYRLMLS

SEQ ID NO: 156809 - protein, 26 aa, Mycobacterium bovis
FGSSALLCPLLVYGWLGLPRWGLTGS

SEQ ID NO: 156810 - protein, 27 aa, Mycobacterium bovis
FGVALCAGLWFIGRRVIATVGHNLTTM

SEQ ID NO: 156811 - protein, 17 aa, Mycobacterium bovis
FGVARQADYLPILPTGL

SEQ ID NO: 156812 - protein, 17 aa, Mycobacterium bovis
FGVAVAVMALVLSASLL

SEQ ID NO: 156813 - protein, 18 aa, Mycobacterium bovis
FGVPRLAQQKVLLFGIAF

SEQ ID NO: 156814 - protein, 30 aa, Mycobacterium bovis
FGVPWSNSFPKWRWSLTTALLELTVLVLLL

SEQ ID NO: 156815 - protein, 18 aa, Mycobacterium bovis
FGVRDLFMVTALSSITAL

SEQ ID NO: 156816 - protein, 25 aa, Mycobacterium bovis
FGVSIPRAMFWTVLVYVFVATVISF

SEQ ID NO: 156817 - protein, 20 aa, Mycobacterium bovis
FGYASALAWVMFAILLVLTV

SEQ ID NO: 156818 - protein, 17 aa, Mycobacterium bovis
FGYWSWANLACVVCAIG

SEQ ID NO: 156819 - protein, 17 aa, Mycobacterium bovis
FHDPPWSNTYLGVADAH

SEQ ID NO: 156820 - protein, 28 aa, Mycobacterium bovis
FIAFDQLWRWNSIVALVLSVMVILGLVV

SEQ ID NO: 156821 - protein, 24 aa, Mycobacterium bovis
FIDAIICFVGFLFPLWDAKRQTLA

SEQ ID NO: 156822 - protein, 18 aa, Mycobacterium bovis
FIDYCVNMLLSTAATYAP

SEQ ID NO: 156823 - protein, 22 aa, Mycobacterium bovis
FIEGRSVAELVALGEEIYDEII

SEQ ID NO: 156824 - protein, 24 aa, Mycobacterium bovis
FIGGLLCVIPGLIFGFVAQFAVAF

SEQ ID NO: 156825 - protein, 20 aa, Mycobacterium bovis
FIGLWIFGWNRLPRLVHLAC

SEQ ID NO: 156826 - protein, 17 aa, Mycobacterium bovis
FIIGHGRLFGFYVAFYC

SEQ ID NO: 156827 - protein, 17 aa, Mycobacterium bovis
FILLVAIGADYNMLLIS

SEQ ID NO: 156828 - protein, 17 aa, Mycobacterium bovis
FISEFLVLLGTFSRYWL

SEQ ID NO: 156829 - protein, 30 aa, Mycobacterium bovis
FIVGIGALIWAASLLWYLKVVGSQPDFLGE

SEQ ID NO: 156830 - protein, 17 aa, Mycobacterium bovis
FKDHLYIAGRIKDLVII

SEQ ID NO: 156831 - protein, 17 aa, Mycobacterium bovis
FKEPKREALLTLLPLER

SEQ ID NO: 156832 - protein, 19 aa, Mycobacterium bovis
FKGTTCHRLTTSPMLAVLQ

SEQ ID NO: 156833 - protein, 22 aa, Mycobacterium bovis
FKLSGPEMRGVRQAVTRARRAG

SEQ ID NO: 156834 - protein, 18 aa, Mycobacterium bovis
FKRWWTRFVPPSIERSTY

SEQ ID NO: 156835 - protein, 30 aa, Mycobacterium bovis
FLAKLRLFRVPELLAGSFLLALLAVTAANF

SEQ ID NO: 156836 - protein, 25 aa, Mycobacterium bovis
FLAVPEMKELLASKDNKAWNLPITF

SEQ ID NO: 156837 - protein, 20 aa, Mycobacterium bovis
FLEEPRLAARVAGARTRGGY

SEQ ID NO: 156838 - protein, 18 aa, Mycobacterium bovis
FLEFGYASALAWVMFAIL

SEQ ID NO: 156839 - protein, 18 aa, Mycobacterium bovis
FLEKRFTGDYAHHNLLQR

SEQ ID NO: 156840 - protein, 19 aa, Mycobacterium bovis
FLETRYWWAGIALASLGVI

SEQ ID NO: 156841 - protein, 31 aa, Mycobacterium bovis
FLITALCLFTAVFIMLRRKRIPSVARGPAWR

SEQ ID NO: 156842 - protein, 18 aa, Mycobacterium bovis
FLLGQEMHWSIPGLTFVI

SEQ ID NO: 156843 - protein, 19 aa, Mycobacterium bovis
FLLIITIPFGFAALRIASY

SEQ ID NO: 156844 - protein, 20 aa, Mycobacterium bovis
FLLLPRLTTVLSKLPEGSEV

SEQ ID NO: 156845 - protein, 17 aa, Mycobacterium bovis
FLMFSWMQVFTASGFAF

SEQ ID NO: 156846 - protein, 21 aa, Mycobacterium bovis
FLNRKIKGISLFRTVVFLPLA

SEQ ID NO: 156847 - protein, 21 aa, Mycobacterium bovis
FLRRFRPYNLMPAAVKPSYGM

SEQ ID NO: 156848 - protein, 21 aa, Mycobacterium bovis
FLRVWLPGQLLQGIGVGATLP

SEQ ID NO: 156849 - protein, 32 aa, Mycobacterium bovis
FLSEGELFIMGRIKDLLIVYGRNHSPDDIEAT

SEQ ID NO: 156850 - protein, 17 aa, Mycobacterium bovis
FLSHPITAFVLFVASPY

SEQ ID NO: 156851 - protein, 23 aa, Mycobacterium bovis
FLSRPFGAAVFGYFGDRLGRKKT

SEQ ID NO: 156852 - protein, 17 aa, Mycobacterium bovis
FLTFFVVAAFGALIVDR

SEQ ID NO: 156853 - protein, 18 aa, Mycobacterium bovis
FLTRLRVGEKLVDAKAVA

SEQ ID NO: 156854 - protein, 18 aa, Mycobacterium bovis
FLVGRSAEHTTVLADQLR

SEQ ID NO: 156855 - protein, 18 aa, Mycobacterium bovis
FLVLIWVFGGLLAAGLPM

SEQ ID NO: 156856 - protein, 17 aa, Mycobacterium bovis
FLVTLGGTVAFYTYSVN

SEQ ID NO: 156857 - protein, 17 aa, Mycobacterium bovis
FLYELIWNVLVFVALIY

SEQ ID NO: 156858 - protein, 18 aa, Mycobacterium bovis
FMLHLTPLVVIVLIALIA

SEQ ID NO: 156859 - protein, 19 aa, Mycobacterium bovis
FMLRLKVGMAAGIVLACPV

SEQ ID NO: 156860 - protein, 31 aa, Mycobacterium bovis
FMTPSIAVLLGRWFWWPQRVRPRPASRMLRP

SEQ ID NO: 156861 - protein, 19 aa, Mycobacterium bovis
FNFGFGSLVWVYAAESFPS

SEQ ID NO: 156862 - protein, 23 aa, Mycobacterium bovis
FNLSRLNNVVNMFIGNSYVDNVK

SEQ ID NO: 156863 - protein, 32 aa, Mycobacterium bovis
FNLVGWPTWGMILSSPFLLPAGLGLGLAAIAF

SEQ ID NO: 156864 - protein, 33 aa, Mycobacterium bovis
FNNGLRPEPLIALGVLVTWVLVERSIALGRLAP

SEQ ID NO: 156865 - protein, 23 aa, Mycobacterium bovis
FPAGLWRWLQRHPPPALHRLTRF

SEQ ID NO: 156866 - protein, 23 aa, Mycobacterium bovis
FPDLEVCVYAAPTQTVIGGPPEQ

SEQ ID NO: 156867 - protein, 19 aa, Mycobacterium bovis
FPGGSRWARIDLADDEYIP

SEQ ID NO: 156868 - protein, 25 aa, Mycobacterium bovis
FPGKRAPTVQLCRDPRGYVPVGTNP

SEQ ID NO: 156869 - protein, 19 aa, Mycobacterium bovis
FPGQAGLGVGGLALNQPPP

SEQ ID NO: 156870 - protein, 17 aa, Mycobacterium bovis
FPIDIGPQPAWRNLRFP

SEQ ID NO: 156871 - protein, 19 aa, Mycobacterium bovis
FPMNAMTPMVLFIKSPRDL

SEQ ID NO: 156872 - protein, 22 aa, Mycobacterium bovis
FPPDGRAGVTVITLGNHRGSAY

SEQ ID NO: 156873 - protein, 19 aa, Mycobacterium bovis
FPRGNLIGIPGAPERMVQN

SEQ ID NO: 156874 - protein, 19 aa, Mycobacterium bovis
FPSNLIIPEYLFIQSSTDL

SEQ ID NO: 156875 - protein, 20 aa, Mycobacterium bovis
FPSVAFRPVRLFFINVGLAA

SEQ ID NO: 156876 - protein, 17 aa, Mycobacterium bovis
FPVIGAFPFTGRMPTVL

SEQ ID NO: 156877 - protein, 20 aa, Mycobacterium bovis
FPVVVATLFGLIIAMPLGIW

SEQ ID NO: 156878 - protein, 17 aa, Mycobacterium bovis
FQDASCPDVQMISVPGT

SEQ ID NO: 156879 - protein, 18 aa, Mycobacterium bovis
FRAAAVWLAGAVVGIVAS

SEQ ID NO: 156880 - protein, 30 aa, Mycobacterium bovis
FRAESASAMLRRNLLIYGLGGLVVPFIGIK

SEQ ID NO: 156881 - protein, 25 aa, Mycobacterium bovis
FRAIDRLGPELSVRQIAEEAGTAKP

SEQ ID NO: 156882 - protein, 18 aa, Mycobacterium bovis
FREAVGILAGGRLHIVIG

SEQ ID NO: 156883 - protein, 23 aa, Mycobacterium bovis
FRLNCASCHNFTGKGGALSSGKY

SEQ ID NO: 156884 - protein, 17 aa, Mycobacterium bovis
FRPIAAGVVPEWLAYTV

SEQ ID NO: 156885 - protein, 23 aa, Mycobacterium bovis
FRPIRSYFYWEKHCYDIPVCWSL

SEQ ID NO: 156886 - protein, 17 aa, Mycobacterium bovis
FRPQPVSVWASATATLL

SEQ ID NO: 156887 - protein, 24 aa, Mycobacterium bovis
FRQRCVTSWAGFRGAVSLAAALAV

SEQ ID NO: 156888 - protein, 20 aa, Mycobacterium bovis
FRSIWMLAPRGDLMAQATLY

SEQ ID NO: 156889 - protein, 20 aa, Mycobacterium bovis
FRSVWITVLLTRLAIVAAVA

SEQ ID NO: 156890 - protein, 19 aa, Mycobacterium bovis
FRTLDAFRIFDNIYVLTGG

SEQ ID NO: 156891 - protein, 17 aa, Mycobacterium bovis
FRVPALILAAIAYGAWH

SEQ ID NO: 156892 - protein, 21 aa, Mycobacterium bovis
FSGQSALNWAQRTTRTSELGN

SEQ ID NO: 156893 - protein, 27 aa, Mycobacterium bovis
FSLLGAICLLGTLWLVMRARSSAPAGA

SEQ ID NO: 156894 - protein, 19 aa, Mycobacterium bovis
FSNVSGLRQGQFVRASGVE

SEQ ID NO: 156895 - protein, 20 aa, Mycobacterium bovis
FSRDEFKKGAQIFLSADGHA

SEQ ID NO: 156896 - protein, 18 aa, Mycobacterium bovis
FSSFFVVSNSLRLRKFGR

SEQ ID NO: 156897 - protein, 21 aa, Mycobacterium bovis
FSVMSFLLLYGIARFQGVLPF

SEQ ID NO: 156898 - protein, 17 aa, Mycobacterium bovis
FTAAGLVALVGGGLFAS

SEQ ID NO: 156899 - protein, 18 aa, Mycobacterium bovis
FTAVPLLWLLAIDAALIT

SEQ ID NO: 156900 - protein, 18 aa, Mycobacterium bovis
FTDAAAWYAEPIVFEKVV

SEQ ID NO: 156901 - protein, 20 aa, Mycobacterium bovis
FTDLRMKVVDTQTEWPATGH

SEQ ID NO: 156902 - protein, 17 aa, Mycobacterium bovis
FTEVIVIANGVRAGRIK

SEQ ID NO: 156903 - protein, 25 aa, Mycobacterium bovis
FTGPEVWWVLRVAHWASGVPAATVP

SEQ ID NO: 156904 - protein, 24 aa, Mycobacterium bovis
FTISSVLCAVAWDEATLVIARLSQ

SEQ ID NO: 156905 - protein, 26 aa, Mycobacterium bovis
FTLGVLSAFGLVFVRFPGRTAVFLVI

SEQ ID NO: 156906 - protein, 25 aa, Mycobacterium bovis
FTLTDAVVIFGFLLWHVIGANSSDD

SEQ ID NO: 156907 - protein, 22 aa, Mycobacterium bovis
FTMMMRLPWLYRVPVHTIHKFG

SEQ ID NO: 156908 - protein, 18 aa, Mycobacterium bovis
FTPFSWVIEHAVLPYFTA

SEQ ID NO: 156909 - protein, 18 aa, Mycobacterium bovis
FTPVAWGVLVGFIALYLL

SEQ ID NO: 156910 - protein, 17 aa, Mycobacterium bovis
FTVMIIVVFGQVRFHHT

SEQ ID NO: 156911 - protein, 18 aa, Mycobacterium bovis
FVAQFAVAFAVDRSTSPI

SEQ ID NO: 156912 - protein, 32 aa, Mycobacterium bovis
FVFSWLRRRSGSLIAPIALHWSLNGMGALAAA

SEQ ID NO: 156913 - protein, 17 aa, Mycobacterium bovis
FVFVCYHTAGIWRRGIV

SEQ ID NO: 156914 - protein, 17 aa, Mycobacterium bovis
FVIAGLAGAAWLVSGAG

SEQ ID NO: 156915 - protein, 18 aa, Mycobacterium bovis
FVLGLALALVMHRTLIGK

SEQ ID NO: 156916 - protein, 34 aa, Mycobacterium bovis
FVQWWGQPAWSWAVLGLRGRRPVKWNDPITLANN

SEQ ID NO: 156917 - protein, 18 aa, Mycobacterium bovis
FVREADVAAGLDHPNIVA

SEQ ID NO: 156918 - protein, 21 aa, Mycobacterium bovis
FVRGEGAGVVVLKRLTDAQRD

SEQ ID NO: 156919 - protein, 26 aa, Mycobacterium bovis
FVTRPVGSWFFGRFADRRGRRAALTF

SEQ ID NO: 156920 - protein, 23 aa, Mycobacterium bovis
FVVDWRVALVLFGPVLVYLTITS

SEQ ID NO: 156921 - protein, 22 aa, Mycobacterium bovis
FVVGDLMFVPGVPGVAQGAIQG

SEQ ID NO: 156922 - protein, 22 aa, Mycobacterium bovis
FVVGELAALVMFSGAIDRRLDE

SEQ ID NO: 156923 - protein, 18 aa, Mycobacterium bovis
FVVKAGAAGPFLGSTPFA

SEQ ID NO: 156924 - protein, 18 aa, Mycobacterium bovis
FVVNVHWSVLVILWLFTW

SEQ ID NO: 156925 - protein, 24 aa, Mycobacterium bovis
FVVPYPPGFPVLVPGQLVSKEIIY

SEQ ID NO: 156926 - protein, 23 aa, Mycobacterium bovis
FVWNVFKSWRYGEVVTVDDPWGY

SEQ ID NO: 156927 - protein, 22 aa, Mycobacterium bovis
FVYEHKVLFAVGAIVLIMAMNL

SEQ ID NO: 156928 - protein, 19 aa, Mycobacterium bovis
FWAALIKVLALMAFLVVGT

SEQ ID NO: 156929 - protein, 17 aa, Mycobacterium bovis
FWASLIKVIALVTFLIV

SEQ ID NO: 156930 - protein, 17 aa, Mycobacterium bovis
FWINVPLTAIAMVMIHF

SEQ ID NO: 156931 - protein, 30 aa, Mycobacterium bovis
FWVDLARTVLRIMFPLSFVVAILLVSQGVI

SEQ ID NO: 156932 - protein, 24 aa, Mycobacterium bovis
FYFVLPRWPELMGDTGHSLGTGLR

SEQ ID NO: 156933 - protein, 17 aa, Mycobacterium bovis
FYLALKYTSEFLLGYLA

SEQ ID NO: 156934 - protein, 21 aa, Mycobacterium bovis
FYLPPEVFDNPDFQRGLEQFL

SEQ ID NO: 156935 - protein, 18 aa, Mycobacterium bovis
FYLPPEVFKNKDFQRAMK

SEQ ID NO: 156936 - protein, 19 aa, Mycobacterium bovis
FYNRRLRAATTRFSVRMKH

SEQ ID NO: 156937 - protein, 20 aa, Mycobacterium bovis
FYSNPGFSFTGFARAVKNNL

SEQ ID NO: 156938 - protein, 22 aa, Mycobacterium bovis
FYTLLRITRLIGIVIIAVSLPL

SEQ ID NO: 156939 - protein, 22 aa, Mycobacterium bovis
FYWAVGIAIGLPAGLIVLTELH

SEQ ID NO: 156940 - protein, 26 aa, Mycobacterium bovis
GAAARRRLVKLGAWVAAQLPTTRTAV

SEQ ID NO: 156941 - protein, 31 aa, Mycobacterium bovis
GAAAWLHAAVWWKALLALAVAVALVIGVNYA

SEQ ID NO: 156942 - protein, 24 aa, Mycobacterium bovis
GAALAAHCVHRFGGVTGDVLGSAI

SEQ ID NO: 156943 - protein, 18 aa, Mycobacterium bovis
GAAMAFSSFFVVSNSLRL

SEQ ID NO: 156944 - protein, 22 aa, Mycobacterium bovis
GAAQLPLAPAINYPPPCLTGFL

SEQ ID NO: 156945 - protein, 19 aa, Mycobacterium bovis
GAASLGLYVLFLFTQTVRH

SEQ ID NO: 156946 - protein, 30 aa, Mycobacterium bovis
GAAWALTVVHLRLSLLPVLIGLMSAVPLGL

SEQ ID NO: 156947 - protein, 29 aa, Mycobacterium bovis
GADANRFVQCRVVATGNSVDAVWKPLLPG

SEQ ID NO: 156948 - protein, 17 aa, Mycobacterium bovis
GADRLFVGVSLSLANQI

SEQ ID NO: 156949 - protein, 18 aa, Mycobacterium bovis
GAEAISIDGVRIGPNVTI

SEQ ID NO: 156950 - protein, 17 aa, Mycobacterium bovis
GAEFERLTGRLLAGFEA

SEQ ID NO: 156951 - protein, 21 aa, Mycobacterium bovis
GAEGWECQRAMSVANNVVVDV

SEQ ID NO: 156952 - protein, 19 aa, Mycobacterium bovis
GAEKVCGVIGGRGHDAAPQ

SEQ ID NO: 156953 - protein, 17 aa, Mycobacterium bovis
GAFFAAIVGVLGLMGGL

SEQ ID NO: 156954 - protein, 18 aa, Mycobacterium bovis
GAGVLYFYFVLPRWPELM

SEQ ID NO: 156955 - protein, 17 aa, Mycobacterium bovis
GAIASMWLGVHLVPISI

SEQ ID NO: 156956 - protein, 18 aa, Mycobacterium bovis
GAILGFALLWLTATAIWL

SEQ ID NO: 156957 - protein, 19 aa, Mycobacterium bovis
GALKKAVMLLGVLAVLVAM

SEQ ID NO: 156958 - protein, 20 aa, Mycobacterium bovis
GALLIGWAAYRGIPHWQSIP

SEQ ID NO: 156959 - protein, 18 aa, Mycobacterium bovis
GALLIVIFATSGALEALV

SEQ ID NO: 156960 - protein, 17 aa, Mycobacterium bovis
GALLKLTVFAVGVMPYI

SEQ ID NO: 156961 - protein, 19 aa, Mycobacterium bovis
GALRVNWAVGIQLFDYTGE

SEQ ID NO: 156962 - protein, 23 aa, Mycobacterium bovis
GALVWAGSLVWYLQRVGSEPDFL

SEQ ID NO: 156963 - protein, 29 aa, Mycobacterium bovis
GALYVRVGDRLYPALNLASARLITGRPDN

SEQ ID NO: 156964 - protein, 31 aa, Mycobacterium bovis
GAMLYGSFFMHRGVPYFPNLVMPIVVGGIGI

SEQ ID NO: 156965 - protein, 25 aa, Mycobacterium bovis
GAMYCLGFTRLPYFNTLASPCAIGL

SEQ ID NO: 156966 - protein, 24 aa, Mycobacterium bovis
GAMYCLSFARLPYFETLGAPIAIG

SEQ ID NO: 156967 - protein, 23 aa, Mycobacterium bovis
GANFWRRGALLIGIGVGVAAVLR

SEQ ID NO: 156968 - protein, 29 aa, Mycobacterium bovis
GAPIGRAWLRLFGVLPFDYDRLSIAELEP

SEQ ID NO: 156969 - protein, 22 aa, Mycobacterium bovis
GAPRLPSSVVSWLPLYHDMGLM

SEQ ID NO: 156970 - protein, 28 aa, Mycobacterium bovis
GAQLVKLAHIKLAWRTGNFVIYAITIVC

SEQ ID NO: 156971 - protein, 30 aa, Mycobacterium bovis
GAQWPILAGVNFWRRGALLIGIGVGVAAVL

SEQ ID NO: 156972 - protein, 26 aa, Mycobacterium bovis
GASAWRRLTKVILPMIKPAIVVALLF

SEQ ID NO: 156973 - protein, 24 aa, Mycobacterium bovis
GASKLPMYLNIAVAVLGLAAYFAS

SEQ ID NO: 156974 - protein, 17 aa, Mycobacterium bovis
GATMVGYFVCFVALFVL

SEQ ID NO: 156975 - protein, 26 aa, Mycobacterium bovis
GATYCLSFARLTLFHTMGPPLAIGML

SEQ ID NO: 156976 - protein, 23 aa, Mycobacterium bovis
GAVIGTAWGYRWGGLGAGVIGAV

SEQ ID NO: 156977 - protein, 25 aa, Mycobacterium bovis
GAVNGLRALPTLGVLLLGVLLFGLG

SEQ ID NO: 156978 - protein, 17 aa, Mycobacterium bovis
GCAIGSAIVLASIVAGV

SEQ ID NO: 156979 - protein, 21 aa, Mycobacterium bovis
GCAQAAATVLVWRRVSDGWAF

SEQ ID NO: 156980 - protein, 21 aa, Mycobacterium bovis
GCGLTAIALEIEKWWRTGGQG

SEQ ID NO: 156981 - protein, 22 aa, Mycobacterium bovis
GCRRCGIPLPVLLDAVAPGVVL

SEQ ID NO: 156982 - protein, 22 aa, Mycobacterium bovis
GCSLRLPGIYPPQVYNGRLHVD

SEQ ID NO: 156983 - protein, 22 aa, Mycobacterium bovis
GDACPYFPGASYRNWKLPDPAG

SEQ ID NO: 156984 - protein, 25 aa, Mycobacterium bovis
GDDLRLYLDGGLQFCTRDEYRYTES

SEQ ID NO: 156985 - protein, 20 aa, Mycobacterium bovis
GDGFALDFAGGKMFFTPATG

SEQ ID NO: 156986 - protein, 23 aa, Mycobacterium bovis
GDHFGEACLLGGMRRIATVRACE

SEQ ID NO: 156987 - protein, 26 aa, Mycobacterium bovis
GDIFGLRRWYVITFLMGLFFVLGQAY

SEQ ID NO: 156988 - protein, 17 aa, Mycobacterium bovis
GDIPFQVQLPSTPLAPP

SEQ ID NO: 156989 - protein, 17 aa, Mycobacterium bovis
GDLFRIEGPPGLRRAVG

SEQ ID NO: 156990 - protein, 21 aa, Mycobacterium bovis
GDNGRAAWRVARNAGITDVRA

SEQ ID NO: 156991 - protein, 21 aa, Mycobacterium bovis
GDQAFEVLAPFVVDGGPTVLV

SEQ ID NO: 156992 - protein, 24 aa, Mycobacterium bovis
GDQRVLGAALWYAATVKDAVIVAA

SEQ ID NO: 156993 - protein, 22 aa, Mycobacterium bovis
GDRLAFSNGILFLAAAAIGAVV

SEQ ID NO: 156994 - protein, 19 aa, Mycobacterium bovis
GDTGLPVGVALLAALLAGV

SEQ ID NO: 156995 - protein, 19 aa, Mycobacterium bovis
GDVVWPAFVVGVASSAPPF

SEQ ID NO: 156996 - protein, 22 aa, Mycobacterium bovis
GDWLLAIPWWTWAFVFGLGAFL

SEQ ID NO: 156997 - protein, 19 aa, Mycobacterium bovis
GEAIFGYNGFGWRFTGALL

SEQ ID NO: 156998 - protein, 24 aa, Mycobacterium bovis
GEDMARYAAPRARRSIARRQHSNA

SEQ ID NO: 156999 - protein, 26 aa, Mycobacterium bovis
GEGACFRLTLPLVRGHKVTTSPLPMK

SEQ ID NO: 157000 - protein, 19 aa, Mycobacterium bovis
GEHCIGWLILALLGAIALP

SEQ ID NO: 157001 - protein, 23 aa, Mycobacterium bovis
GELGEAATLAFLFSISEGLEEYA

SEQ ID NO: 157002 - protein, 18 aa, Mycobacterium bovis
GELQRLALAAALAREPAM

SEQ ID NO: 157003 - protein, 20 aa, Mycobacterium bovis
GEMVRRPYLRATLFVIALGF

SEQ ID NO: 157004 - protein, 20 aa, Mycobacterium bovis
GERRAWIEVRGLRSGGDDEL

SEQ ID NO: 157005 - protein, 29 aa, Mycobacterium bovis
GESSPTFMQWGWRIPFLVSAALIAVALYV

SEQ ID NO: 157006 - protein, 20 aa, Mycobacterium bovis
GETLWEFLPRSVIGGLRSAV

SEQ ID NO: 157007 - protein, 21 aa, Mycobacterium bovis
GEVASLGFLISLWAGSSAISA

SEQ ID NO: 157008 - protein, 18 aa, Mycobacterium bovis
GEVLPHLAGELTQAATAF

SEQ ID NO: 157009 - protein, 25 aa, Mycobacterium bovis
GEWLPGQILQGIGVGATFPLLGSAA

SEQ ID NO: 157010 - protein, 23 aa, Mycobacterium bovis
GEYTRLGLCTVPAALAMAVLALW

SEQ ID NO: 157011 - protein, 33 aa, Mycobacterium bovis
GFADFPRYPLNVLSDINAVFGILTVHTTYADLT

SEQ ID NO: 157012 - protein, 25 aa, Mycobacterium bovis
GFGGMVVVCMIWRLFMQDSVTRPTT

SEQ ID NO: 157013 - protein, 18 aa, Mycobacterium bovis
GFHHGFFIFAIVLTALSI

SEQ ID NO: 157014 - protein, 18 aa, Mycobacterium bovis
GFIGVLFAALWVLIAYLR

SEQ ID NO: 157015 - protein, 23 aa, Mycobacterium bovis
GFLGALCAGWAPVPLPEPLGSLR

SEQ ID NO: 157016 - protein, 20 aa, Mycobacterium bovis
GFNLSWRVRYALEPAAGASG

SEQ ID NO: 157017 - protein, 24 aa, Mycobacterium bovis
GFSVGWLYWYFWVIVVGFEAVAGG

SEQ ID NO: 157018 - protein, 20 aa, Mycobacterium bovis
GFSVWSLWSVMVLFMPTSVY

SEQ ID NO: 157019 - protein, 19 aa, Mycobacterium bovis
GFTGLPRRASTVALVALVA

SEQ ID NO: 157020 - protein, 19 aa, Mycobacterium bovis
GFYSTFFFFFFVAELLDTW

SEQ ID NO: 157021 - protein, 34 aa, Mycobacterium bovis
GGAAGRPNWRVLLLGLGTILAWLLIAILLARLFV

SEQ ID NO: 157022 - protein, 25 aa, Mycobacterium bovis
GGAIAGILLKMCWPAAPRSVGVPLY

SEQ ID NO: 157023 - protein, 27 aa, Mycobacterium bovis
GGALTEVSWRWAFLVNVPIGLVMIYLA

SEQ ID NO: 157024 - protein, 19 aa, Mycobacterium bovis
GGARGFAHLGVLDELERVG

SEQ ID NO: 157025 - protein, 45 aa, Mycobacterium bovis
GGFFRMCVLTGKALFRWPFQWREFILQCWFIMRVGFLPTIMVSIP

SEQ ID NO: 157026 - protein, 28 aa, Mycobacterium bovis
GGGRASVGLPGFLVGGVVRITRASGDEY

SEQ ID NO: 157027 - protein, 21 aa, Mycobacterium bovis
GGGSMLVLLGIVVALYERERS

SEQ ID NO: 157028 - protein, 17 aa, Mycobacterium bovis
GGILGVMYSIPLRRALV

SEQ ID NO: 157029 - protein, 22 aa, Mycobacterium bovis
GGIRLSGRTGALSRSARVQLVS

SEQ ID NO: 157030 - protein, 19 aa, Mycobacterium bovis
GGKILRAALNPDLSLSPIA

SEQ ID NO: 157031 - protein, 27 aa, Mycobacterium bovis
GGLFAQLGLWRWAFGVMTLLTALMAML

SEQ ID NO: 157032 - protein, 21 aa, Mycobacterium bovis
GGLSRIGDWWTQPIVYQKVIV

SEQ ID NO: 157033 - protein, 25 aa, Mycobacterium bovis
GGLVGGVWLAFIGWFIFAAAREEET

SEQ ID NO: 157034 - protein, 18 aa, Mycobacterium bovis
GGNRPRWLGADIGQRQFY

SEQ ID NO: 157035 - protein, 24 aa, Mycobacterium bovis
GGPARLGFAGAVLITAGGLGAGSV

SEQ ID NO: 157036 - protein, 21 aa, Mycobacterium bovis
GGPRRKGRIISEQEKKITAYH

SEQ ID NO: 157037 - protein, 25 aa, Mycobacterium bovis
GGQLRITRWFAVRWGAERSLVVGAT

SEQ ID NO: 157038 - protein, 30 aa, Mycobacterium bovis; identical to SEQ ID NO: 10389

SEQ ID NO: 157039 - protein, 25 aa, Mycobacterium bovis
GGRPMLRILVRRHRLVGTLPLVSPM

SEQ ID NO: 157040 - protein, 19 aa, Mycobacterium bovis
GGTLRHWLQPVVGSHEEAT

SEQ ID NO: 157041 - protein, 25 aa, Mycobacterium bovis
GGTPAILFCFGFFLLVFTGGGIYSI

SEQ ID NO: 157042 - protein, 19 aa, Mycobacterium bovis
GGTTVSFPRGSTQVAQVED

SEQ ID NO: 157043 - protein, 23 aa, Mycobacterium bovis
GGVDPRRCLAVSLDVGTDNEQLL

SEQ ID NO: 157044 - protein, 27 aa, Mycobacterium bovis
GGVGLKAFWYHFAIMFEALFILTTVDA

SEQ ID NO: 157045 - protein, 17 aa, Mycobacterium bovis
GGVGLSLGQRQRLGLAR

SEQ ID NO: 157046 - protein, 23 aa, Mycobacterium bovis
GGVRASWPWALVVFLVVVFVAPL

SEQ ID NO: 157047 - protein, 18 aa, Mycobacterium bovis
GGVTRLIPLTGLTTPWMS

SEQ ID NO: 157048 - protein, 18 aa, Mycobacterium bovis
GHLWSWELAIPMSGIAMA

SEQ ID NO: 157049 - protein, 21 aa, Mycobacterium bovis
GHPGPGIGLIVAWITAIVLTF

SEQ ID NO: 157050 - protein, 18 aa, Mycobacterium bovis
GHRIEWLTDPGLALPVVS

SEQ ID NO: 157051 - protein, 39 aa, Mycobacterium bovis
GHVHMAGLPGWRAMFVIEALPALLLAPLLRRLLPDNPQR

SEQ ID NO: 157052 - protein, 24 aa, Mycobacterium bovis
GIAERLRPSGVIQREIAMRTVAVF

SEQ ID NO: 157053 - protein, 25 aa, Mycobacterium bovis
GIERPAGTIGEIWVHGDNVAIGYWQ

SEQ ID NO: 157054 - protein, 20 aa, Mycobacterium bovis
GIESRFPGTVTYYDRPEQPR

SEQ ID NO: 157055 - protein, 19 aa, Mycobacterium bovis
GIFIKGYRALETIRSIDTV

SEQ ID NO: 157056 - protein, 20 aa, Mycobacterium bovis
GIGPIPWLIEPRWAMVSLCL

SEQ ID NO: 157057 - protein, 21 aa, Mycobacterium bovis
GILAAMPAFWSRCTAALAGPR

SEQ ID NO: 157058 - protein, 18 aa, Mycobacterium bovis
GILAIRWRLPSGTEIDVG

SEQ ID NO: 157059 - protein, 17 aa, Mycobacterium bovis
GILCSIGVLAVGLAALT

SEQ ID NO: 157060 - protein, 24 aa, Mycobacterium bovis
GILILVAVGMFDWHAMRKAHVSPR

SEQ ID NO: 157061 - protein, 24 aa, Mycobacterium bovis
GILTWIFVDGHFSKWLNFTPTPLT

SEQ ID NO: 157062 - protein, 22 aa, Mycobacterium bovis
GILVGVAFVHWLIFQSLYRIGA

SEQ ID NO: 157063 - protein, 26 aa, Mycobacterium bovis
GIMPMLPGLAVFRAVFAFAVNDTPDG

SEQ ID NO: 157064 - protein, 24 aa, Mycobacterium bovis
GIMQRPRFRMPFSPYSGYLTLLFL

SEQ ID NO: 157065 - protein, 22 aa, Mycobacterium bovis
GISALCLIFIIMLIITRSVVAA

SEQ ID NO: 157066 - protein, 18 aa, Mycobacterium bovis
GISLPIALGLLIMMYPVL

SEQ ID NO: 157067 - protein, 21 aa, Mycobacterium bovis
GISVLLTFYPGWVTIGMMAAL

SEQ ID NO: 157068 - protein, 18 aa, Mycobacterium bovis
GIVSGILLSIARVVGETA

SEQ ID NO: 157069 - protein, 23 aa, Mycobacterium bovis
GIVTIPFGIGMIFYGNIAGGIFV

SEQ ID NO: 157070 - protein, 18 aa, Mycobacterium bovis
GKDVRFVGLIDAVRAGEE

SEQ ID NO: 157071 - protein, 22 aa, Mycobacterium bovis
GKGDFLLGLLLPHGLLELTAVF

SEQ ID NO: 157072 - protein, 32 aa, Mycobacterium bovis
GKPAVLWFWTPWCPFCNAEAPSLSQVAAANPA

SEQ ID NO: 157073 - protein, 19 aa, Mycobacterium bovis
GKSTLAWIMAGLTIPTTGA

SEQ ID NO: 157074 - protein, 19 aa, Mycobacterium bovis
GKTGIGWLGYIVIGGIAGW

SEQ ID NO: 157075 - protein, 24 aa, Mycobacterium bovis
GKVEDWLGYFLLHASFVLGAAAGG

SEQ ID NO: 157076 - protein, 17 aa, Mycobacterium bovis
GLAGAAWLVSGAGADRA

SEQ ID NO: 157077 - protein, 17 aa, Mycobacterium bovis
GLAHPLAQCHIEVELAK

SEQ ID NO: 157078 - protein, 18 aa, Mycobacterium bovis
GLALAYRTRPVFVPDADN

SEQ ID NO: 157079 - protein, 21 aa, Mycobacterium bovis
GLANGLGFLAGTIVGYYILRR

SEQ ID NO: 157080 - protein, 26 aa, Mycobacterium bovis
GLARKRASTLGNFWVDLARTVLRIMF

SEQ ID NO: 157081 - protein, 24 aa, Mycobacterium bovis
GLASRYIRLLPRGLVKRVVPKPGT

SEQ ID NO: 157082 - protein, 18 aa, Mycobacterium bovis
GLASWRPVTVAGLATGLL

SEQ ID NO: 157083 - protein, 20 aa, Mycobacterium bovis
GLAVILSYIWGVRVGGLFAA

SEQ ID NO: 157084 - protein, 17 aa, Mycobacterium bovis
GLAVNMQAIVFMSAVMI

SEQ ID NO: 157085 - protein, 18 aa, Mycobacterium bovis
GLCRAAKALFGRYVVQRS

SEQ ID NO: 157086 - protein, 24 aa, Mycobacterium bovis
GLDPRYPLKGVFHAAGVLDDAVIT

SEQ ID NO: 157087 - protein, 25 aa, Mycobacterium bovis
GLDRELAARFGFLLAIPAVFASGLF

SEQ ID NO: 157088 - protein, 17 aa, Mycobacterium bovis
GLFAVGIVIGRKTNTTA

SEQ ID NO: 157089 - protein, 17 aa, Mycobacterium bovis
GLGAVLIAHGLQKLFGW

SEQ ID NO: 157090 - protein, 18 aa, Mycobacterium bovis
GLGAVVFYLALKYTSEFL

SEQ ID NO: 157091 - protein, 19 aa, Mycobacterium bovis
GLGGLRTGLLAARHLQVTL

SEQ ID NO: 157092 - protein, 20 aa, Mycobacterium bovis
GLIFGWLAFLLVFGLFVRKG

SEQ ID NO: 157093 - protein, 19 aa, Mycobacterium bovis
GLIGIAWCALFPIIWALSG

SEQ ID NO: 157094 - protein, 19 aa, Mycobacterium bovis
GLIGSFVFSLIRPNGQAGS

SEQ ID NO: 157095 - protein, 18 aa, Mycobacterium bovis
GLLALAGWVSVPGTGRMR

SEQ ID NO: 157096 - protein, 20 aa, Mycobacterium bovis
GLLARLWVLPVHRASGLISR

SEQ ID NO: 157097 - protein, 17 aa, Mycobacterium bovis
GLLHWSVPMLVRRLITL

SEQ ID NO: 157098 - protein, 29 aa, Mycobacterium bovis
GLLNRRAVLKSSYAQFIFLLSGADHDQMD

SEQ ID NO: 157099 - protein, 25 aa, Mycobacterium bovis
GLLVSLLVRRRRVWARITPTTAGTV

SEQ ID NO: 157100 - protein, 17 aa, Mycobacterium bovis
GLMAYRFRGHFWLATIV

SEQ ID NO: 157101 - protein, 17 aa, Mycobacterium bovis
GLNPPPVPIPWSVLSLF

SEQ ID NO: 157102 - protein, 20 aa, Mycobacterium bovis
GLNSLMAMAIRREAEQFVGI

SEQ ID NO: 157103 - protein, 25 aa, Mycobacterium bovis
GLPGFPEFPAIPGFPALPGLPSIPN

SEQ ID NO: 157104 - protein, 24 aa, Mycobacterium bovis
GLPLGAGFVSEWLLVQSLIHAAPG

SEQ ID NO: 157105 - protein, 23 aa, Mycobacterium bovis
GLPLWPYLVCAALTGLGGGNFAS

SEQ ID NO: 157106 - protein, 31 aa, Mycobacterium bovis
GLPVMVGGLCIAGALGIMRFLAIFGPVHYFA

SEQ ID NO: 157107 - protein, 23 aa, Mycobacterium bovis
GLQPPWAMSVSFVLTTVSACGVA

SEQ ID NO: 157108 - protein, 24 aa, Mycobacterium bovis
GLQVLCAIGAVYLGSRTGAGFGRD

SEQ ID NO: 157109 - protein, 22 aa, Mycobacterium bovis
GLRPGEEKLVFSRFWRSDPSRV

SEQ ID NO: 157110 - protein, 23 aa, Mycobacterium bovis
GLRRPWRPRTFLRAISQTLRLSY

SEQ ID NO: 157111 - protein, 22 aa, Mycobacterium bovis
GLSAAGGWFYWDRVQTGGEASA

SEQ ID NO: 157112 - protein, 19 aa, Mycobacterium bovis
GLSCKELTGDIARRPIADA

SEQ ID NO: 157113 - protein, 25 aa, Mycobacterium bovis
GLSSLRAGMIAGAIGLLLVLVYSLL

SEQ ID NO: 157114 - protein, 17 aa, Mycobacterium bovis
GLTFNDFLIHMAPAVLV

SEQ ID NO: 157115 - protein, 19 aa, Mycobacterium bovis
GLTTYRFTQNVGYTPEGKL

SEQ ID NO: 157116 - protein, 17 aa, Mycobacterium bovis
GLVALYILMQLARQRRM

SEQ ID NO: 157117 - protein, 26 aa, Mycobacterium bovis
GLVTALLAAWGWFTSLLVITGTIAVT

SEQ ID NO: 157118 - protein, 18 aa, Mycobacterium bovis
GLVVAAVWAVGLVAGLVA

SEQ ID NO: 157119 - protein, 25 aa, Mycobacterium bovis
GLYTPAQFQPWTGIPSLTYDQSVAE

SEQ ID NO: 157120 - protein, 27 aa, Mycobacterium bovis
GMAGLRRWLGPLSILLVLWGLRASIQW

SEQ ID NO: 157121 - protein, 23 aa, Mycobacterium bovis
GMALGFLTVFGIFGALTISAATA

SEQ ID NO: 157122 - protein, 19 aa, Mycobacterium bovis
GMGEVYLARHPRLPRQDAL

SEQ ID NO: 157123 - protein, 25 aa, Mycobacterium bovis
GMLPVPRYLAGQSFWRTPSIFHFRY

SEQ ID NO: 157124 - protein, 23 aa, Mycobacterium bovis
GMSEVHLARDLRLHRDVAVKVLR

SEQ ID NO: 157125 - protein, 26 aa, Mycobacterium bovis
GMSNWECVRRVTLPWVSSGIVGAVVL

SEQ ID NO: 157126 - protein, 19 aa, Mycobacterium bovis
GMVTRAGLRPVGRLTEAAE

SEQ ID NO: 157127 - protein, 23 aa, Mycobacterium bovis
GNEALAVPIWWSYAAAEILITAG

SEQ ID NO: 157128 - protein, 18 aa, Mycobacterium bovis
GNFVENWAILIIPFALCF

SEQ ID NO: 157129 - protein, 22 aa, Mycobacterium bovis
GNRSERRIMLALLVPVLPFAFS

SEQ ID NO: 157130 - protein, 33 aa, Mycobacterium bovis
GNSVDAVWKPLLPGYTRPHMRLFSGQVGTGCGP

SEQ ID NO: 157131 - protein, 17 aa, Mycobacterium bovis
GNVEMDHNFALRKAELD

SEQ ID NO: 157132 - protein, 24 aa, Mycobacterium bovis
GNVFPRKISFLAAMRYYAGNWDTT

SEQ ID NO: 157133 - protein, 19 aa, Mycobacterium bovis
GNWLKARIGVGTTTYSSTA

SEQ ID NO: 157134 - protein, 17 aa, Mycobacterium bovis
GPAETPIAQVLRRQRRE

SEQ ID NO: 157135 - protein, 17 aa, Mycobacterium bovis
GPAFPDLPTHRHVAPEP

SEQ ID NO: 157136 - protein, 18 aa, Mycobacterium bovis
GPALDAVYLPPGRSAYVA

SEQ ID NO: 157137 - protein, 23 aa, Mycobacterium bovis
GPDAPGAGSLFWVSDTGVRYGID

SEQ ID NO: 157138 - protein, 23 aa, Mycobacterium bovis
GPDRIAAMLSEVVGLLAAGVLAR

SEQ ID NO: 157139 - protein, 21 aa, Mycobacterium bovis
GPDRRPITAVALVAVGLTLAL

SEQ ID NO: 157140 - protein, 21 aa, Mycobacterium bovis
GPERFRQALFRALASVVEIWM

SEQ ID NO: 157141 - protein, 19 aa, Mycobacterium bovis
GPGSWAEYVRLMFTNPAAS

SEQ ID NO: 157142 - protein, 19 aa, Mycobacterium bovis
GPKCLVKVIQKLSGLSINR

SEQ ID NO: 157143 - protein, 18 aa, Mycobacterium bovis
GPKIHYRASALLCDPPLH

SEQ ID NO: 157144 - protein, 19 aa, Mycobacterium bovis
GPKRLGRVMAVVGIPMLLG

SEQ ID NO: 157145 - protein, 18 aa, Mycobacterium bovis
GPLSWFFHHLPKPLHRIE

SEQ ID NO: 157146 - protein, 19 aa, Mycobacterium bovis
GPMSHAAVVAREFGFPCVV

SEQ ID NO: 157147 - protein, 19 aa, Mycobacterium bovis
GPQQYSLVLGDGVQTLPPL

SEQ ID NO: 157148 - protein, 27 aa, Mycobacterium bovis
GPTAFWACGLLLCVFIGPAQSSARALL

SEQ ID NO: 157149 - protein, 17 aa, Mycobacterium bovis
GPVAPGPGMGWVFGFPG

SEQ ID NO: 157150 - protein, 24 aa, Mycobacterium bovis
GPYETIGGLVLRELGHIPVAGETV

SEQ ID NO: 157151 - protein, 19 aa, Mycobacterium bovis
GQFAGIAIEEFIWARQHAR

SEQ ID NO: 157152 - protein, 23 aa, Mycobacterium bovis
GQGGAALRMVQWDQIGQIVVSWV

SEQ ID NO: 157153 - protein, 24 aa, Mycobacterium bovis
GQGGRFLCTFPFSFEITEGEDRYV

SEQ ID NO: 157154 - protein, 28 aa, Mycobacterium bovis
GQIPNQRWFSWLALLTMPAPFLANSAGW

SEQ ID NO: 157155 - protein, 18 aa, Mycobacterium bovis
GQLLQGIGVGATLPVLSS

SEQ ID NO: 157156 - protein, 17 aa, Mycobacterium bovis
GQNWLVEMEMFRAENRY

SEQ ID NO: 157157 - protein, 24 aa, Mycobacterium bovis
GQPSKFSMPGPWVGIAAPGENIAS

SEQ ID NO: 157158 - protein, 24 aa, Mycobacterium bovis
GQRPADRPLWLGSIKSNIGHTSAA

SEQ ID NO: 157159 - protein, 22 aa, Mycobacterium bovis
GQRRIPVQYAKRMVGRRMYGGT

SEQ ID NO: 157160 - protein, 25 aa, Mycobacterium bovis
GQSGGPLDCHLMKLEDLRPPERAQV

SEQ ID NO: 157161 - protein, 22 aa, Mycobacterium bovis
GQTLVDSHAWLVVLTALGSLAA

SEQ ID NO: 157162 - protein, 24 aa, Mycobacterium bovis
GQTVLPFTGIDFRLSPSGVAVDSA

SEQ ID NO: 157163 - protein, 18 aa, Mycobacterium bovis
GQYGRYGQYGQYGVQPGG

SEQ ID NO: 157164 - protein, 20 aa, Mycobacterium bovis
GRAGPAIRWLGGIGAVIPLL

SEQ ID NO: 157165 - protein, 22 aa, Mycobacterium bovis
GRANWLPTFVLLILLAAVTAVY

SEQ ID NO: 157166 - protein, 22 aa, Mycobacterium bovis
GRDRSGHIVAIFQAPAGKTVDD

SEQ ID NO: 157167 - protein, 29 aa, Mycobacterium bovis
GRGLAARHYFTYRDVLGFLYAQAKFQLLG

SEQ ID NO: 157168 - protein, 19 aa, Mycobacterium bovis
GRGRVTLVLLAVVPVALAY

SEQ ID NO: 157169 - protein, 24 aa, Mycobacterium bovis
GRHFSRARLNPEVLLIETDHDMRN

SEQ ID NO: 157170 - protein, 31 aa, Mycobacterium bovis
GRIDLSGFWIRRARRLLPALVLMVLTVSAAR

SEQ ID NO: 157171 - protein, 19 aa, Mycobacterium bovis
GRIKDLVIIDGRNHYPQDL

SEQ ID NO: 157172 - protein, 18 aa, Mycobacterium bovis
GRLFTPFFITVGLVEAAY

SEQ ID NO: 157173 - protein, 17 aa, Mycobacterium bovis
GRMKDLIIQDGVNHYPD

SEQ ID NO: 157174 - protein, 23 aa, Mycobacterium bovis
GRMLFGDELWEWVNPNNVTHTGD

SEQ ID NO: 157175 - protein, 28 aa, Mycobacterium bovis
GRMRLGDFWGYLAGWGFVVGKTASCAAM

SEQ ID NO: 157176 - protein, 28 aa, Mycobacterium bovis
GRPGCAPGPDGVRCAASMALAPEEPANL

SEQ ID NO: 157177 - protein, 20 aa, Mycobacterium bovis
GRPKLADWVTLAITAMASGT

SEQ ID NO: 157178 - protein, 24 aa, Mycobacterium bovis
GRPPGAREWLTWLLHSRVTTFLSH

SEQ ID NO: 157179 - protein, 21 aa, Mycobacterium bovis
GRPRGPVRGSASWPGEQNRRE

SEQ ID NO: 157180 - protein, 17 aa, Mycobacterium bovis
GRQAGLVDAVRAAESAL

SEQ ID NO: 157181 - protein, 17 aa, Mycobacterium bovis
GRRDLGVAFGWSLFNWI

SEQ ID NO: 157182 - protein, 20 aa, Mycobacterium bovis
GRSATAMVWLRGEAGTTQAA

SEQ ID NO: 157183 - protein, 19 aa, Mycobacterium bovis
GRSVGKIVMGLRVVSDDGG

SEQ ID NO: 157184 - protein, 30 aa, Mycobacterium bovis
GRTIQKFIVIGAFLGFFAMMVLSACDHRYG

SEQ ID NO: 157185 - protein, 23 aa, Mycobacterium bovis
GRVTELLARLCLGQSAREAFLPH

SEQ ID NO: 157186 - protein, 30 aa, Mycobacterium bovis
GRYRLLIFHGGVPPLQFWQALDTALDRQVA

SEQ ID NO: 157187 - protein, 27 aa, Mycobacterium bovis
GRYTYLKWWKFVLVVLGVWIGAGEVGL

SEQ ID NO: 157188 - protein, 17 aa, Mycobacterium bovis
GSALGRRHAQIGIEALL

SEQ ID NO: 157189 - protein, 26 aa, Mycobacterium bovis
GSAQRWKAIRGEAGWMTTYAYPAEAI

SEQ ID NO: 157190 - protein, 23 aa, Mycobacterium bovis
GSGLPSDIWKATMDGALKGTSNE

SEQ ID NO: 157191 - protein, 19 aa, Mycobacterium bovis
GSIVWSLPIGREIDAFHGI

SEQ ID NO: 157192 - protein, 18 aa, Mycobacterium bovis
GSKTPWLILAGLAVLGVI

SEQ ID NO: 157193 - protein, 24 aa, Mycobacterium bovis
GSLAAVAVIVAVVFTVVVNKDDHQ

SEQ ID NO: 157194 - protein, 18 aa, Mycobacterium bovis
GSLGRLVVELEPDVDSDI

SEQ ID NO: 157195 - protein, 23 aa, Mycobacterium bovis
GSMVFAILVLLGRYINYTLDLAG

SEQ ID NO: 157196 - protein, 26 aa, Mycobacterium bovis
GSPLTAAMSLMWGWRLAAVCVTGAAA

SEQ ID NO: 157197 - protein, 23 aa, Mycobacterium bovis
GSQIPALVAYTVFTAALVFGVAT

SEQ ID NO: 157198 - protein, 17 aa, Mycobacterium bovis
GSQWELVRLPDDHRDAD

SEQ ID NO: 157199 - protein, 19 aa, Mycobacterium bovis
GSYTGLSGWFAISSPGPPS

SEQ ID NO: 157200 - protein, 17 aa, Mycobacterium bovis
GTALSWVKLSPIWHVFS

SEQ ID NO: 157201 - protein, 24 aa, Mycobacterium bovis
GTAPRARTAAFFDLDKTIIAKPST

SEQ ID NO: 157202 - protein, 24 aa, Mycobacterium bovis
GTDGIPMLMLKGAPETILPRCRLA

SEQ ID NO: 157203 - protein, 23 aa, Mycobacterium bovis
GTEYEWSTPAALVAKIKEIVGDV

SEQ ID NO: 157204 - protein, 20 aa, Mycobacterium bovis
GTMRRFSWSGSAPVLDPLPR

SEQ ID NO: 157205 - protein, 23 aa, Mycobacterium bovis
GTPELAGIWVYERRFTDDELLRL

SEQ ID NO: 157206 - protein, 21 aa, Mycobacterium bovis
GTPQLALSMRIWSIMAHVLAG

SEQ ID NO: 157207 - protein, 23 aa, Mycobacterium bovis
GTRDRYLLMPSFTFVGVAQAALW

SEQ ID NO: 157208 - protein, 19 aa, Mycobacterium bovis
GTRRIPLLRRRFQEEEDRR

SEQ ID NO: 157209 - protein, 22 aa, Mycobacterium bovis
GTSLPTVVRWARMPEDVAHANE

SEQ ID NO: 157210 - protein, 27 aa, Mycobacterium bovis
GTVIAILLMWSKLPAKVRIIPGPLVAI

SEQ ID NO: 157211 - protein, 24 aa, Mycobacterium bovis
GTVRNWPWRRLVLSKTANTYSRLA

SEQ ID NO: 157212 - protein, 18 aa, Mycobacterium bovis
GTVVRFDGAVPFVNLQVS

SEQ ID NO: 157213 - protein, 18 aa, Mycobacterium bovis
GVAIGLVVAIVFLLVRVV

SEQ ID NO: 157214 - protein, 20 aa, Mycobacterium bovis
GVEHLRWYDYPLAAALSLVV

SEQ ID NO: 157215 - protein, 23 aa, Mycobacterium bovis
GVGIGAAILLGWFTLAHRHPDQP

SEQ ID NO: 157216 - protein, 19 aa, Mycobacterium bovis
GVGLLGMFGPVRVVHVGWL

SEQ ID NO: 157217 - protein, 21 aa, Mycobacterium bovis
GVIDIVVEWVIGNLFGVVPLL

SEQ ID NO: 157218 - protein, 17 aa, Mycobacterium bovis
GVILLFAGLAGRGVPAL

SEQ ID NO: 157219 - protein, 21 aa, Mycobacterium bovis
GVMRRSRLIGVSFAVGLIVLL

SEQ ID NO: 157220 - protein, 17 aa, Mycobacterium bovis
GVMRTWYLIGRKVAADP

SEQ ID NO: 157221 - protein, 24 aa, Mycobacterium bovis
GVMSHARFVPFTAETRMSGVDLAE

SEQ ID NO: 157222 - protein, 25 aa, Mycobacterium bovis
GVPKWKTIVRIVAPIAMPGIVSGIL

SEQ ID NO: 157223 - protein, 17 aa, Mycobacterium bovis
GVRLRYEQAITDASVAV

SEQ ID NO: 157224 - protein, 23 aa, Mycobacterium bovis
GVSSFGFGGANAHVVVREVLPRD

SEQ ID NO: 157225 - protein, 26 aa, Mycobacterium bovis
GVTGRASVAVAVGFVVGELAALVMFS

SEQ ID NO: 157226 - protein, 18 aa, Mycobacterium bovis
GWAADRFGTRRLFMGSVL

SEQ ID NO: 157227 - protein, 17 aa, Mycobacterium bovis
GWAPVPLPEPLGSLRDK

SEQ ID NO: 157228 - protein, 18 aa, Mycobacterium bovis
GWATIVLCQLRLHKLANA

SEQ ID NO: 157229 - protein, 25 aa, Mycobacterium bovis
GWAVGQLLCGWLVDRVGARVTLVST

SEQ ID NO: 157230 - protein, 29 aa, Mycobacterium bovis
GWAWQGPSAEWYVAAHLPYVAWLTQASAD

SEQ ID NO: 157231 - protein, 21 aa, Mycobacterium bovis
GWLVKGRSDTRLYYTPEDPTY

SEQ ID NO: 157232 - protein, 26 aa, Mycobacterium bovis
GWPPGLPPLPRRPRRYRRGVAAVAAV

SEQ ID NO: 157233 - protein, 20 aa, Mycobacterium bovis
GWQGPFWDWLGGLDLNTVGF

SEQ ID NO: 157234 - protein, 20 aa, Mycobacterium bovis
GWRWFPRDVQTAGSDAKREA

SEQ ID NO: 157235 - protein, 17 aa, Mycobacterium bovis
GWSAITGTIAWPALAMF

SEQ ID NO: 157236 - protein, 17 aa, Mycobacterium bovis
GWVNLPAVILIGLCALL

SEQ ID NO: 157237 - protein, 18 aa, Mycobacterium bovis
GWVPPSPAPHVISQGAVP

SEQ ID NO: 157238 - protein, 32 aa, Mycobacterium bovis
GWVRSGHRRLWWALAGVVAFLGLVGAGVVGTL

SEQ ID NO: 157239 - protein, 18 aa, Mycobacterium bovis
GWYRRYLLVQVLFGSVVL

SEQ ID NO: 157240 - protein, 19 aa, Mycobacterium bovis
GYFRKSLEDIIRFQAEFLW

SEQ ID NO: 157241 - protein, 18 aa, Mycobacterium bovis
GYFVCFVALFVLSGLGNG

SEQ ID NO: 157242 - protein, 18 aa, Mycobacterium bovis
GYGPAFRGLQALWRRGAE

SEQ ID NO: 157243 - protein, 17 aa, Mycobacterium bovis
GYLFYWAIIGIDPGPRR

SEQ ID NO: 157244 - protein, 25 aa, Mycobacterium bovis
GYLYIKDRLKDMIISGGENVYPAEI

SEQ ID NO: 157245 - protein, 20 aa, Mycobacterium bovis
GYSLIERFPLMLGTAAGVLL

SEQ ID NO: 157246 - protein, 17 aa, Mycobacterium bovis
HAAFKSLAFMAAGSVLA

SEQ ID NO: 157247 - protein, 21 aa, Mycobacterium bovis
HAAVVAREFGFPCVVDAQGAT

SEQ ID NO: 157248 - protein, 17 aa, Mycobacterium bovis
HALALTASMTWEILWAL

SEQ ID NO: 157249 - protein, 18 aa, Mycobacterium bovis
HALNKVWRRHMLRVHNLD

SEQ ID NO: 157250 - protein, 24 aa, Mycobacterium bovis
HANDLRPSWLPKLMAHGGGTTAEF

SEQ ID NO: 157251 - protein, 17 aa, Mycobacterium bovis
HAVLPLRPESLRRLDRV

SEQ ID NO: 157252 - protein, 23 aa, Mycobacterium bovis
HAYPRTGSVVVWYSPRRADRAAV

SEQ ID NO: 157253 - protein, 24 aa, Mycobacterium bovis
HDAVWPVMIVLLLNLTAAYSATRF

SEQ ID NO: 157254 - protein, 33 aa, Mycobacterium bovis
HDEARSAFLVPLRVALAVLFLWGAAAALWTIIY

SEQ ID NO: 157255 - protein, 17 aa, Mycobacterium bovis
HDLPLRSRDRVPLMTTL

SEQ ID NO: 157256 - protein, 23 aa, Mycobacterium bovis
HDPGQSWVLVFAITMMAGLLVSL

SEQ ID NO: 157257 - protein, 23 aa, Mycobacterium bovis
HDRGEFDGQLWIDMDFVDGTDTV

SEQ ID NO: 157258 - protein, 24 aa, Mycobacterium bovis
HEAGIDWDVIFLLLGMMIIVSVLR

SEQ ID NO: 157259 - protein, 20 aa, Mycobacterium bovis
HELADPLTPILAVGAAASAI

SEQ ID NO: 157260 - protein, 21 aa, Mycobacterium bovis
HELKTGNVMYLDIKEGAEFGA

SEQ ID NO: 157261 - protein, 20 aa, Mycobacterium bovis
HELRRSATRFLFDFADDLQH

SEQ ID NO: 157262 - protein, 20 aa, Mycobacterium bovis
HELRTPLTTIRGFAELYRQG

SEQ ID NO: 157263 - protein, 21 aa, Mycobacterium bovis
HELRTPLTTVRMAADLIYDHS

SEQ ID NO: 157264 - protein, 21 aa, Mycobacterium bovis
HEVGHAIGYLRHEPCDQQGGL

SEQ ID NO: 157265 - protein, 24 aa, Mycobacterium bovis
HFFGCTPLGPVAWTGVFSATAGAT

SEQ ID NO: 157266 - protein, 17 aa, Mycobacterium bovis
HGLHFAMAVAMAVMAWP

SEQ ID NO: 157267 - protein, 18 aa, Mycobacterium bovis
HGLVLSSILLWTGVGVML

SEQ ID NO: 157268 - protein, 17 aa, Mycobacterium bovis
HGPVVAVAGRFVHTSIR

SEQ ID NO: 157269 - protein, 20 aa, Mycobacterium bovis
HHSAARVVAWAIFATACITD

SEQ ID NO: 157270 - protein, 17 aa, Mycobacterium bovis
HHTIPAPVWVAVIMGLV

SEQ ID NO: 157271 - protein, 22 aa, Mycobacterium bovis
HIAGVFVPVVFVIAGLAGAAWL

SEQ ID NO: 157272 - protein, 24 aa, Mycobacterium bovis
HIIDVKRALAWVKAHISEYGGDPD

SEQ ID NO: 157273 - protein, 20 aa, Mycobacterium bovis
HILLLPGIILALIGLHLALV

SEQ ID NO: 157274 - protein, 24 aa, Mycobacterium bovis
HIVDVKRALAWVKENIAAYGGDPN

SEQ ID NO: 157275 - protein, 20 aa, Mycobacterium bovis
HKATSMVVVPVMLSRILDQL

SEQ ID NO: 157276 - protein, 17 aa, Mycobacterium bovis
HKLCGRDVVVVSASGEE

SEQ ID NO: 157277 - protein, 19 aa, Mycobacterium bovis
HLAVDIGFALSVAATGALV

SEQ ID NO: 157278 - protein, 18 aa, Mycobacterium bovis
HLDVRWVVALIVINLAFT

SEQ ID NO: 157279 - protein, 20 aa, Mycobacterium bovis
HLLGRPLGRLVDRDNAVEDE

SEQ ID NO: 157280 - protein, 27 aa, Mycobacterium bovis
HLVDTLSLFVGWLWPLWDSRRRTFADL

SEQ ID NO: 157281 - protein, 22 aa, Mycobacterium bovis
HLYDRSSFHRIPGAVEMAIAVE

SEQ ID NO: 157282 - protein, 24 aa, Mycobacterium bovis
HMEVGSPYAVEYVWGRQVGDNTIN

SEQ ID NO: 157283 - protein, 24 aa, Mycobacterium bovis
HMGRQAFAAVLGRGLANTGQLVLD

SEQ ID NO: 157284 - protein, 22 aa, Mycobacterium bovis
HNLFKPLLLFFYFGFLIPIFKV

SEQ ID NO: 157285 - protein, 29 aa, Mycobacterium bovis
HNSSPPPPRWAWPPLIAVGAVGMVGMAVQ

SEQ ID NO: 157286 - protein, 24 aa, Mycobacterium bovis
HNVAVRWVQNALSFIGFVPPDEND

SEQ ID NO: 157287 - protein, 31 aa, Mycobacterium bovis
HPARYLSVFLVMLIGIYLLVFFTGDKHTAPK

SEQ ID NO: 157288 - protein, 35 aa, Mycobacterium bovis
HPIIPRTIRLAAIPILLCWLGFTVFVSVVVPPLEA

SEQ ID NO: 157289 - protein, 19 aa, Mycobacterium bovis
HPITAFVLFVASPYIVYFT

SEQ ID NO: 157290 - protein, 26 aa, Mycobacterium bovis
HPLMSHLAELGWICVAINYRHSPRNT

SEQ ID NO: 157291 - protein, 21 aa, Mycobacterium bovis
HPPGALLTFVWLDRIGLRGGG

SEQ ID NO: 157292 - protein, 18 aa, Mycobacterium bovis
HPPIPTTPWQHTRHWITT

SEQ ID NO: 157293 - protein, 20 aa, Mycobacterium bovis
HPVTVWRKRLAVALDALQTT

SEQ ID NO: 157294 - protein, 40 aa, Mycobacterium bovis
HQPNSVWSWDITKLRGPAKWSYYYLYVILDIFSRYVVGWM

SEQ ID NO: 157295 - protein, 25 aa, Mycobacterium bovis
HQVTGWRFVMRRIAAGIALHDTRML

SEQ ID NO: 157296 - protein, 18 aa, Mycobacterium bovis
HRALMAIAFGDLGMANTT

SEQ ID NO: 157297 - protein, 26 aa, Mycobacterium bovis
HRCERALREHVEWSLLDVLRGAPGAP

SEQ ID NO: 157298 - protein, 17 aa, Mycobacterium bovis
HRILAWIAAGAMASVVA

SEQ ID NO: 157299 - protein, 18 aa, Mycobacterium bovis
HRIVPRVHAAPGLHKLVY

SEQ ID NO: 157300 - protein, 19 aa, Mycobacterium bovis
HRLSPRMLLVHPVHEMLRQ

SEQ ID NO: 157301 - protein, 19 aa, Mycobacterium bovis
HRLVVPRVVAATIVAALLN

SEQ ID NO: 157302 - protein, 17 aa, Mycobacterium bovis
HRRSAMATLRIAFLSAL

SEQ ID NO: 157303 - protein, 34 aa, Mycobacterium bovis
HRRTRTALEATWKYVVICSVGIAVAFLGTVLLYF

SEQ ID NO: 157304 - protein, 19 aa, Mycobacterium bovis
HRYAIWIVGVWALAAIIGN

SEQ ID NO: 157305 - protein, 24 aa, Mycobacterium bovis
HSAERLIVIYADFKGEAGADSFRD

SEQ ID NO: 157306 - protein, 17 aa, Mycobacterium bovis
HSAIRFAVVAAVVGVGF

SEQ ID NO: 157307 - protein, 19 aa, Mycobacterium bovis
HSGRVCAMVGDGSNDAAAI

SEQ ID NO: 157308 - protein, 23 aa, Mycobacterium bovis
HSHRRVVLIIYLWVGIGAFGAAS

SEQ ID NO: 157309 - protein, 26 aa, Mycobacterium bovis
HSPDLDWKSVWDHGWSAAAEAADKPV

SEQ ID NO: 157310 - protein, 24 aa, Mycobacterium bovis
HSSDPTVAAGYPWQQQPTQEATWQ

SEQ ID NO: 157311 - protein, 23 aa, Mycobacterium bovis
HTRAGGLVVAEWIRGGSLQEVAD

SEQ ID NO: 157312 - protein, 18 aa, Mycobacterium bovis
HTRALLLAGEETRLRLLV

SEQ ID NO: 157313 - protein, 18 aa, Mycobacterium bovis
HTSIPFLISMQGTSQKLT

SEQ ID NO: 157314 - protein, 17 aa, Mycobacterium bovis
HTVPKLTTALIHAYPAE

SEQ ID NO: 157315 - protein, 17 aa, Mycobacterium bovis
HVAPGFDLSQCRTGADA

SEQ ID NO: 157316 - protein, 39 aa, Mycobacterium bovis
HVCRGLSGLTSWLTGMFGRDAWRPAGVVVVGSDSEVSEF

SEQ ID NO: 157317 - protein, 18 aa, Mycobacterium bovis
HVGSRFGLFDPKRLLKVR

SEQ ID NO: 157318 - protein, 23 aa, Mycobacterium bovis
HVHPDTFWWALALSADFGGNLTA

SEQ ID NO: 157319 - protein, 20 aa, Mycobacterium bovis
HVIEVVDWWGTPAIAEVARS

SEQ ID NO: 157320 - protein, 20 aa, Mycobacterium bovis
HVLIALALFVLWPFTRLVHA

SEQ ID NO: 157321 - protein, 20 aa, Mycobacterium bovis
HVREDPIPPSARHEGLSADL

SEQ ID NO: 157322 - protein, 23 aa, Mycobacterium bovis
HVSDELFATIGVTFFGAGVISTG

SEQ ID NO: 157323 - protein, 22 aa, Mycobacterium bovis
HVSGLRAGQFVRAAGVEVGKVA

SEQ ID NO: 157324 - protein, 18 aa, Mycobacterium bovis
HVTFGYRPGVPVIQDVSL

SEQ ID NO: 157325 - protein, 17 aa, Mycobacterium bovis
HVVSLAGVLAFVALVIV

SEQ ID NO: 157326 - protein, 24 aa, Mycobacterium bovis
HWPGYLFGRIRTSTLVLIAAFLAV

SEQ ID NO: 157327 - protein, 22 aa, Mycobacterium bovis
HYFPRHRFLFGDKYDSVMIDQK

SEQ ID NO: 157328 - protein, 25 aa, Mycobacterium bovis
IAAAPPPLFRFGHRGPGDWQAGHRS

SEQ ID NO: 157329 - protein, 18 aa, Mycobacterium bovis
IAAFKIIMLCLWWGAATS

SEQ ID NO: 157330 - protein, 24 aa, Mycobacterium bovis
IAAKRVDCPLTWVERWARTKAAMT

SEQ ID NO: 157331 - protein, 25 aa, Mycobacterium bovis
IAALLGKWFWWPQVVRQRPVPQPWP

SEQ ID NO: 157332 - protein, 18 aa, Mycobacterium bovis
IAAVCLVFIVMLMITQSL

SEQ ID NO: 157333 - protein, 27 aa, Mycobacterium bovis
IAAVGLRGVIWSGVVSKVIVPAVVAAL

SEQ ID NO: 157334 - protein, 20 aa, Mycobacterium bovis
IACWLIVSRFVLRRLGPGPG

SEQ ID NO: 157335 - protein, 25 aa, Mycobacterium bovis
IAEEMFFRGALYTALGRRYPVTIST

SEQ ID NO: 157336 - protein, 22 aa, Mycobacterium bovis
IAFLPIVLAPAVIPPASTPLAA

SEQ ID NO: 157337 - protein, 17 aa, Mycobacterium bovis
IAFLSALVLELLATLGV

SEQ ID NO: 157338 - protein, 32 aa, Mycobacterium bovis
IAGPLGLCFLPAFLCVGIVPLVVGLAGDVLQF

SEQ ID NO: 157339 - protein, 27 aa, Mycobacterium bovis
IAHGLGMPIPLGWQVWLYGVFAIIAVG

SEQ ID NO: 157340 - protein, 18 aa, Mycobacterium bovis
IAIIFPKPWSWADLSFLP

SEQ ID NO: 157341 - protein, 19 aa, Mycobacterium bovis
IAIVAMGGFFMMMKLIHRH

SEQ ID NO: 157342 - protein, 17 aa, Mycobacterium bovis
IALGGWLLLGRGLTALT

SEQ ID NO: 157343 - protein, 20 aa, Mycobacterium bovis
IALPFLVWVWLRHLRERRGY

SEQ ID NO: 157344 - protein, 18 aa, Mycobacterium bovis
IAMRTVAVFAHRLYGAIT

SEQ ID NO: 157345 - protein, 22 aa, Mycobacterium bovis
IANETDGGFGPSSRIVRFSAAD

SEQ ID NO: 157346 - protein, 23 aa, Mycobacterium bovis
IANRVSYFYDFHGPSVTIDTACS

SEQ ID NO: 157347 - protein, 20 aa, Mycobacterium bovis
IAPELYLKRLCVGGVERVFE

SEQ ID NO: 157348 - protein, 18 aa, Mycobacterium bovis
IAPGVVTTWMKLAIRDRI

SEQ ID NO: 157349 - protein, 17 aa, Mycobacterium bovis
IAPKAKIVASIREAENQ

SEQ ID NO: 157350 - protein, 21 aa, Mycobacterium bovis
IATKMSGEWSKDDVLQAYLNI

SEQ ID NO: 157351 - protein, 20 aa, Mycobacterium bovis
IATYLRGDWYRDWGSVEQYH

SEQ ID NO: 157352 - protein, 25 aa, Mycobacterium bovis
IAVFGMRLVFPLAIIWTTAGLDPVR

SEQ ID NO: 157353 - protein, 23 aa, Mycobacterium bovis
IAVLPRLFGSITVEADRIADVMA

SEQ ID NO: 157354 - protein, 23 aa, Mycobacterium bovis
IAVSLPLLWWRFRRDDRAALTGV

SEQ ID NO: 157355 - protein, 17 aa, Mycobacterium bovis
IAYCLGLGIPFVLLAFG

SEQ ID NO: 157356 - protein, 19 aa, Mycobacterium bovis
ICEPVRIGLVVLMLNRRRP

SEQ ID NO: 157357 - protein, 27 aa, Mycobacterium bovis
ICFLWDEAWYAFATAVPWARQRTAMIA

SEQ ID NO: 157358 - protein, 17 aa, Mycobacterium bovis
ICLGALLWSFISPSGQL

SEQ ID NO: 157359 - protein, 26 aa, Mycobacterium bovis
ICLLAGTARLGFLASLLSRPVLVGYM

SEQ ID NO: 157360 - protein, 19 aa, Mycobacterium bovis
ICVTDPLAFTGCGCDGKAL

SEQ ID NO: 157361 - protein, 26 aa, Mycobacterium bovis
IDDALELRGRILSAFEQAERSSDPER

SEQ ID NO: 157362 - protein, 22 aa, Mycobacterium bovis
IDGLPFSWTVASWTQHSSNLTV

SEQ ID NO: 157363 - protein, 22 aa, Mycobacterium bovis
IDGRLYPALNLTSARLATGTAG

SEQ ID NO: 157364 - protein, 25 aa, Mycobacterium bovis
IDGYRRLQVRSGHTLFRQGERADHF

SEQ ID NO: 157365 - protein, 27 aa, Mycobacterium bovis
IDHLRRHSLPLFGYAAMPAYDVVDGVS

SEQ ID NO: 157366 - protein, 17 aa, Mycobacterium bovis
IDHTVIGCSLVRGTPYR

SEQ ID NO: 157367 - protein, 30 aa, Mycobacterium bovis
IDIGPQPAWRNLRFPLAWAPPEADVARIVA

SEQ ID NO: 157368 - protein, 29 aa, Mycobacterium bovis
IDLHDPPPCMTGFLPPPLVRSPADESVRE

SEQ ID NO: 157369 - protein, 23 aa, Mycobacterium bovis
IDRAREAGRIAAREALPQIMELV

SEQ ID NO: 157370 - protein, 19 aa, Mycobacterium bovis
IDRILVGACAAVWLVFTGV

SEQ ID NO: 157371 - protein, 26 aa, Mycobacterium bovis
IDRSHPLCVLGFGFSVLAIAMTWLLC

SEQ ID NO: 157372 - protein, 25 aa, Mycobacterium bovis
IDWAPYVVLVGIGWVIMLVTQTSSC

SEQ ID NO: 157373 - protein, 18 aa, Mycobacterium bovis
IEALGRVDTICFDKTGTL

SEQ ID NO: 157374 - protein, 17 aa, Mycobacterium bovis
IEGGTLRELLIERGPMP

SEQ ID NO: 157375 - protein, 20 aa, Mycobacterium bovis
IEGLLTWLGGGHWRELGERH

SEQ ID NO: 157376 - protein, 23 aa, Mycobacterium bovis
IEGPPGLRRAVGRVVRLQPAKSQ

SEQ ID NO: 157377 - protein, 19 aa, Mycobacterium bovis
IELLALILHDRRLVLAGSG

SEQ ID NO: 157378 - protein, 23 aa, Mycobacterium bovis
IELPPGYLPLRVPIEVNFTQRVA

SEQ ID NO: 157379 - protein, 24 aa, Mycobacterium bovis
IEPDLRAIIELGYDRTGYADVPTP

SEQ ID NO: 157380 - protein, 22 aa, Mycobacterium bovis
IETESRFTLIYGNRTKESTMFR

SEQ ID NO: 157381 - protein, 23 aa, Mycobacterium bovis
IFGCVAVIAFIFIKLFGAAAPGG

SEQ ID NO: 157382 - protein, 21 aa, Mycobacterium bovis
IFGWHGMGEWMVRGISTQDTN

SEQ ID NO: 157383 - protein, 17 aa, Mycobacterium bovis
IFLMRSSPFTALELAQT

SEQ ID NO: 157384 - protein, 25 aa, Mycobacterium bovis
IFMVGFYIPFAIPWNQFVGGASSGV

SEQ ID NO: 157385 - protein, 20 aa, Mycobacterium bovis
IFNVIWTYVLVRGSAVNNGT

SEQ ID NO: 157386 - protein, 17 aa, Mycobacterium bovis
IFSEHRSSALVLVGLGL

SEQ ID NO: 157387 - protein, 19 aa, Mycobacterium bovis
IFTGYPFLRGALRSLRSGK

SEQ ID NO: 157388 - protein, 25 aa, Mycobacterium bovis
IFVITPLRIAFLILLVGTTLEVLTE

SEQ ID NO: 157389 - protein, 26 aa, Mycobacterium bovis
IGAFLGRIYDSWARWSGDDDERKKRL

SEQ ID NO: 157390 - protein, 33 aa, Mycobacterium bovis
IGAIGVAGLVDWPILLAVGGGALLLRKLNRTPE

SEQ ID NO: 157391 - protein, 26 aa, Mycobacterium bovis
IGALFFPWNLYFGFRIPDSSKTVFGL

SEQ ID NO: 157392 - protein, 27 aa, Mycobacterium bovis
IGEPGLDWRWLVLWWESHAPHIANNLM

SEQ ID NO: 157393 - protein, 20 aa, Mycobacterium bovis
IGFALGWRPALTALTLGAGI

SEQ ID NO: 157394 - protein, 24 aa, Mycobacterium bovis
IGFKTKITTLLSWTVTFLSTRRGQ

SEQ ID NO: 157395 - protein, 24 aa, Mycobacterium bovis
IGFLQRPARWIQMLASNTLAFTAA

SEQ ID NO: 157396 - protein, 27 aa, Mycobacterium bovis
IGGAIALRIMFNLPLPIGGIITGVVSL

SEQ ID NO: 157397 - protein, 20 aa, Mycobacterium bovis
IGGFKPVFRALDPAKVNNIA

SEQ ID NO: 157398 - protein, 28 aa, Mycobacterium bovis
IGGFYRTCVLTGKALVRRPFHWREAIEQ

SEQ ID NO: 157399 - protein, 24 aa, Mycobacterium bovis
IGGITVRTGLLWWTVAIHLLASMT

SEQ ID NO: 157400 - protein, 18 aa, Mycobacterium bovis
IGGVALALLGVRRYVFAR

SEQ ID NO: 157401 - protein, 17 aa, Mycobacterium bovis
IGIGGGQTIDLNVLLSA

SEQ ID NO: 157402 - protein, 17 aa, Mycobacterium bovis
IGLHSRRNLTLYVTALL

SEQ ID NO: 157403 - protein, 17 aa, Mycobacterium bovis
IGLVGIYVSKVFIETKQ

SEQ ID NO: 157404 - protein, 20 aa, Mycobacterium bovis
IGLVIATAVAVSWTARALGM

SEQ ID NO: 157405 - protein, 23 aa, Mycobacterium bovis
IGPDWRLVLRGGPAEVVLDRATL

SEQ ID NO: 157406 - protein, 19 aa, Mycobacterium bovis
IGPEKGWMSGITIGSGLVA

SEQ ID NO: 157407 - protein, 18 aa, Mycobacterium bovis
IGPSQAWYTENLRYYYLI

SEQ ID NO: 157408 - protein, 18 aa, Mycobacterium bovis
IGQLVQWLLSVGGLAYLV

SEQ ID NO: 157409 - protein, 17 aa, Mycobacterium bovis
IGRPWYLAWAGLVYVVA

SEQ ID NO: 157410 - protein, 18 aa, Mycobacterium bovis
IGSFPILSVFGFVVMFGG

SEQ ID NO: 157411 - protein, 17 aa, Mycobacterium bovis
IGSGRILIDGVDIASVS

SEQ ID NO: 157412 - protein, 21 aa, Mycobacterium bovis
IGSVLRFLVDRSVARRLARTF

SEQ ID NO: 157413 - protein, 17 aa, Mycobacterium bovis
IGTAFTALVTKFTDSII

SEQ ID NO: 157414 - protein, 25 aa, Mycobacterium bovis
IGTIPICILGLFFKDDIRSGVRNLW

SEQ ID NO: 157415 - protein, 19 aa, Mycobacterium bovis
IGTPLFFQRVFGAGIATLV

SEQ ID NO: 157416 - protein, 17 aa, Mycobacterium bovis
IGVEAFTGFFAALINVR

SEQ ID NO: 157417 - protein, 19 aa, Mycobacterium bovis
IGVGATFPLLGSAALARLA

SEQ ID NO: 157418 - protein, 20 aa, Mycobacterium bovis
IGVGEARTALVTVAASLLAG

SEQ ID NO: 157419 - protein, 25 aa, Mycobacterium bovis
IGVVPLWRYRVHRWEISPQAVFTRT

SEQ ID NO: 157420 - protein, 32 aa, Mycobacterium bovis
IGYRSPRYLRFGWAAARLDDWANYVGARATAV

SEQ ID NO: 157421 - protein, 17 aa, Mycobacterium bovis
IHAQAYWNAGRAMGTHR

SEQ ID NO: 157422 - protein, 19 aa, Mycobacterium bovis
IHFLVVGYLFYWAIIGIDP

SEQ ID NO: 157423 - protein, 24 aa, Mycobacterium bovis
IHLLNLPPAGLLPIAAALGPGDQW

SEQ ID NO: 157424 - protein, 23 aa, Mycobacterium bovis
IHRAYRYARAMARWSPTSRSEVT

SEQ ID NO: 157425 - protein, 18 aa, Mycobacterium bovis
IIAGRPAPTDGFVGVAPD

SEQ ID NO: 157426 - protein, 17 aa, Mycobacterium bovis
IIGFRFYARLIEMKVVR

SEQ ID NO: 157427 - protein, 23 aa, Mycobacterium bovis
IIGSISFWGSIVAFGKLQEIISG

SEQ ID NO: 157428 - protein, 18 aa, Mycobacterium bovis
IILGWLVTIAVLNVTVPQ

SEQ ID NO: 157429 - protein, 26 aa, Mycobacterium bovis
IKAMPPSSVVGLWTFDGREGRTEVPA

SEQ ID NO: 157430 - protein, 17 aa, Mycobacterium bovis
IKGLRAVAAGKQAPNVF

SEQ ID NO: 157431 - protein, 19 aa, Mycobacterium bovis
IKYYLPRGRSRPVIEVAET

SEQ ID NO: 157432 - protein, 35 aa, Mycobacterium bovis
ILDAPHWVSFGIVPGYCVLAFILGTYWLTRQTARA

SEQ ID NO: 157433 - protein, 25 aa, Mycobacterium bovis
ILDIFSRYVVGWMVASRESKVLAER

SEQ ID NO: 157434 - protein, 17 aa, Mycobacterium bovis
ILEGFDFGVGMLMAPFA

SEQ ID NO: 157435 - protein, 28 aa, Mycobacterium bovis
ILFGACRLGSLIRYVPHPVISGFMGGIA

SEQ ID NO: 157436 - protein, 30 aa, Mycobacterium bovis
ILGGWLIGAYGWRWIFLVNLPVGLSALVLA

SEQ ID NO: 157437 - protein, 21 aa, Mycobacterium bovis
ILHRRSRRFGVLPLVAPILAA

SEQ ID NO: 157438 - protein, 19 aa, Mycobacterium bovis
ILIDRYWWTALAVTLAITA

SEQ ID NO: 157439 - protein, 19 aa, Mycobacterium bovis
ILLCLVLGVAIVTQVRQTD

SEQ ID NO: 157440 - protein, 20 aa, Mycobacterium bovis
ILLILCRLVQGFATGGEYGT

SEQ ID NO: 157441 - protein, 25 aa, Mycobacterium bovis
ILLVKKIWWPLAVWLLLIVMNVDAG

SEQ ID NO: 157442 - protein, 27 aa, Mycobacterium bovis
ILLVLWGLRASIQWLQARLAQRGASAV

SEQ ID NO: 157443 - protein, 25 aa, Mycobacterium bovis
ILNERELRAVLGHELSHVYNRDILI

SEQ ID NO: 157444 - protein, 17 aa, Mycobacterium bovis
ILQDWRVVVRNRPFLTL

SEQ ID NO: 157445 - protein, 24 aa, Mycobacterium bovis
ILRSAARPGTWSLFDGGYTFASKI

SEQ ID NO: 157446 - protein, 21 aa, Mycobacterium bovis
ILSRRCRRVVLIAAVVDGVVD

SEQ ID NO: 157447 - protein, 20 aa, Mycobacterium bovis
ILTDPNMRAVLDYFVSPNGH

SEQ ID NO: 157448 - protein, 17 aa, Mycobacterium bovis
ILTGCLDIADGKPVTIA

SEQ ID NO: 157449 - protein, 26 aa, Mycobacterium bovis
ILTLLRLVMVPVFLLALFYGGGHHSA

SEQ ID NO: 157450 - protein, 20 aa, Mycobacterium bovis
ILVGGLWPLLMEQFSVRPNA

SEQ ID NO: 157451 - protein, 21 aa, Mycobacterium bovis
ILVPRDARLNSALMLLSVFAG

SEQ ID NO: 157452 - protein, 19 aa, Mycobacterium bovis
ILYIISFSLFIYGLMGLTG

SEQ ID NO: 157453 - protein, 24 aa, Mycobacterium bovis
IMAQLRIGYATVVWVTSAYLLAYA

SEQ ID NO: 157454 - protein, 20 aa, Mycobacterium bovis
IMYCVACISFFFIGGLLALL

SEQ ID NO: 157455 - protein, 17 aa, Mycobacterium bovis
INAILGVLLLIVLATGS

SEQ ID NO: 157456 - protein, 17 aa, Mycobacterium bovis
INAVPLRVAVFYIGALL

SEQ ID NO: 157457 - protein, 17 aa, Mycobacterium bovis
INAYRPLARNGFASLWS

SEQ ID NO: 157458 - protein, 25 aa, Mycobacterium bovis
INCQRAIPHVVGWYQAYKDSGLAVI

SEQ ID NO: 157459 - protein, 20 aa, Mycobacterium bovis
INECHRLCVDYAKTRTLWGR

SEQ ID NO: 157460 - protein, 23 aa, Mycobacterium bovis
INPAECWPAVGGGVPSAYDLGTV

SEQ ID NO: 157461 - protein, 17 aa, Mycobacterium bovis
INSVVLRIACFYVGSTV

SEQ ID NO: 157462 - protein, 19 aa, Mycobacterium bovis
IPAALSAPSLNRGVGFTHA

SEQ ID NO: 157463 - protein, 21 aa, Mycobacterium bovis
IPADVCRRTESGLRACTAMSK

SEQ ID NO: 157464 - protein, 24 aa, Mycobacterium bovis
IPDVLRPDLTIAYTDTDGYGQRGD

SEQ ID NO: 157465 - protein, 25 aa, Mycobacterium bovis
IPIAIFMGCYLRFLRPGRVSEVSLI

SEQ ID NO: 157466 - protein, 18 aa, Mycobacterium bovis
IPIHIVAMVVLLSLIPIG

SEQ ID NO: 157467 - protein, 23 aa, Mycobacterium bovis
IPLAAWATRPGFRVAAILATLIV

SEQ ID NO: 157468 - protein, 17 aa, Mycobacterium bovis
IPLALGSYWAMFILVPG

SEQ ID NO: 157469 - protein, 18 aa, Mycobacterium bovis
IPLLGHLWSWELAIPMSG

SEQ ID NO: 157470 - protein, 23 aa, Mycobacterium bovis
IPPPEGKPWWLIVVGVVVVGLLG

SEQ ID NO: 157471 - protein, 17 aa, Mycobacterium bovis
IPQRRASPARVISRRVV

SEQ ID NO: 157472 - protein, 21 aa, Mycobacterium bovis
IPRTVDFALEMRRIVDRFNCQ

SEQ ID NO: 157473 - protein, 19 aa, Mycobacterium bovis
IPVAALIHVYTYRKLSGGQ

SEQ ID NO: 157474 - protein, 24 aa, Mycobacterium bovis
IPVDEWAVALALALRAFPMLIDEF

SEQ ID NO: 157475 - protein, 17 aa, Mycobacterium bovis
IQKSAWLTRSIVAVVLV

SEQ ID NO: 157476 - protein, 17 aa, Mycobacterium bovis
IQLLRTAVVVGLVLLQT

SEQ ID NO: 157477 - protein, 20 aa, Mycobacterium bovis
IQPQTRWEAFANQSLASLGY

SEQ ID NO: 157478 - protein, 20 aa, Mycobacterium bovis
IRDGTKYDILIVGIAAVCLV

SEQ ID NO: 157479 - protein, 29 aa, Mycobacterium bovis
IRGKMKGGPLPRGRGLLMAEDTGVFVQVA

SEQ ID NO: 157480 - protein, 19 aa, Mycobacterium bovis
IRHVIGIGTPKAVDLWLDV

SEQ ID NO: 157481 - protein, 20 aa, Mycobacterium bovis
IRIVDVFRITRKVGVEESYG

SEQ ID NO: 157482 - protein, 25 aa, Mycobacterium bovis
IRKGAAAAVMKWVRDHGGHPTEEVG

SEQ ID NO: 157483 - protein, 17 aa, Mycobacterium bovis
IRPRQWVKNVLVLAAPL

SEQ ID NO: 157484 - protein, 23 aa, Mycobacterium bovis
IRPSYGMAEATVYVATRKAGQPP

SEQ ID NO: 157485 - protein, 25 aa, Mycobacterium bovis
IRPVAPEAYALYGISRVLPQALRST

SEQ ID NO: 157486 - protein, 27 aa, Mycobacterium bovis
IRSGLAVPRPLPVVIADAAARTEPPEP

SEQ ID NO: 157487 - protein, 19 aa, Mycobacterium bovis
IRSLARAVVHAANLGVGVI

SEQ ID NO: 157488 - protein, 18 aa, Mycobacterium bovis
IRSYFYWEKHCFDVPLCW

SEQ ID NO: 157489 - protein, 20 aa, Mycobacterium bovis
IRSYFYWEKHCYDIPSCWAL

SEQ ID NO: 157490 - protein, 19 aa, Mycobacterium bovis
IRTAELVAIVSVGGGANIP

SEQ ID NO: 157491 - protein, 17 aa, Mycobacterium bovis
IRVHPLLAVGLNIVAVS

SEQ ID NO: 157492 - protein, 26 aa, Mycobacterium bovis
ISDGAVFCGLLWWIAFHMRDRPLVIA

SEQ ID NO: 157493 - protein, 17 aa, Mycobacterium bovis
ISFEVRGGLFVRQIHHW

SEQ ID NO: 157494 - protein, 26 aa, Mycobacterium bovis
ISFIIGRPLIWLSFRNEKLNAAFRYA

SEQ ID NO: 157495 - protein, 22 aa, Mycobacterium bovis
ISFPDPTKLILQLLKDFLELLR

SEQ ID NO: 157496 - protein, 32 aa, Mycobacterium bovis
ISGEPWGTFINLRCVCLAPPYASHDTLAMVVV

SEQ ID NO: 157497 - protein, 17 aa, Mycobacterium bovis
ISGFGWASGYVGSVALL

SEQ ID NO: 157498 - protein, 21 aa, Mycobacterium bovis
ISGFMGGIAILIIMTQLDQVR

SEQ ID NO: 157499 - protein, 34 aa, Mycobacterium bovis
ISGLVGRSSVVYDMWGAAVSLAYQMHSGSPQPGI

SEQ ID NO: 157500 - protein, 21 aa, Mycobacterium bovis
ISHMLPLFRRMQSLIDGINRV

SEQ ID NO: 157501 - protein, 20 aa, Mycobacterium bovis
ISIDGVRIGPNVTIRQAGGA

SEQ ID NO: 157502 - protein, 18 aa, Mycobacterium bovis
ISPKKSWEGFAGSLVCGI

SEQ ID NO: 157503 - protein, 25 aa, Mycobacterium bovis
ISPTPRPASVITIARPGTSLSESDR

SEQ ID NO: 157504 - protein, 21 aa, Mycobacterium bovis
ISQVPPQRWQPFEGGPPEVAA

SEQ ID NO: 157505 - protein, 22 aa, Mycobacterium bovis
ISRFRTLLVKWAVMVVLALLTS

SEQ ID NO: 157506 - protein, 24 aa, Mycobacterium bovis
ITDLPDGRWSEFLEEPRLAARVAG

SEQ ID NO: 157507 - protein, 21 aa, Mycobacterium bovis
ITFGALWLLYRYYRTGDPLFW

SEQ ID NO: 157508 - protein, 17 aa, Mycobacterium bovis
ITFTAAGLVALVGGGLF

SEQ ID NO: 157509 - protein, 19 aa, Mycobacterium bovis
ITGAEAWLVSSYALCTQVL

SEQ ID NO: 157510 - protein, 24 aa, Mycobacterium bovis
ITGFARIVLLAAILGAALASSFSV

SEQ ID NO: 157511 - protein, 18 aa, Mycobacterium bovis
ITHWDPEDLGAWEAGNKG

SEQ ID NO: 157512 - protein, 21 aa, Mycobacterium bovis
ITLAIGMARMAKRRAVIRRLP

SEQ ID NO: 157513 - protein, 25 aa, Mycobacterium bovis
ITLKRAKGPLVFDLGICLVLITLPT

SEQ ID NO: 157514 - protein, 30 aa, Mycobacterium bovis
ITLSVMAIFYLRLPATFGIGTYGVSADFVA

SEQ ID NO: 157515 - protein, 23 aa, Mycobacterium bovis
ITPFPFGELAKFLEMAAQAFTEV

SEQ ID NO: 157516 - protein, 17 aa, Mycobacterium bovis
ITSGHKWRVLTVATADL

SEQ ID NO: 157517 - protein, 28 aa, Mycobacterium bovis
ITTPTDWPRYGGYALGGVSSFGFGGANA

SEQ ID NO: 157518 - protein, 31 aa, Mycobacterium bovis
ITVGEAWAKVRGRLLALFGLALLEAAGVVAV

SEQ ID NO: 157519 - protein, 19 aa, Mycobacterium bovis
ITVLILWAPLLIFGFILMW

SEQ ID NO: 157520 - protein, 17 aa, Mycobacterium bovis
ITYRVEVGVCLASGDPV

SEQ ID NO: 157521 - protein, 18 aa, Mycobacterium bovis
IVAATAWSLSSVFGDQPP

SEQ ID NO: 157522 - protein, 19 aa, Mycobacterium bovis
IVAEARRRGIAIPPAKDFR

SEQ ID NO: 157523 - protein, 41 aa, Mycobacterium bovis
IVAGLLLYASFPPRNCWWAAVVALALLAWVLTHRATTPVGG

SEQ ID NO: 157524 - protein, 23 aa, Mycobacterium bovis
IVATARPSALWNQATWWQSIAVW

SEQ ID NO: 157525 - protein, 18 aa, Mycobacterium bovis
IVDDIRAAIAVGHGVTVR

SEQ ID NO: 157526 - protein, 25 aa, Mycobacterium bovis
IVFDIEIVFLYPWAVSYDSLGTFAL

SEQ ID NO: 157527 - protein, 25 aa, Mycobacterium bovis
IVFGLSGIVPWWFVLTLLTRDALLA

SEQ ID NO: 157528 - protein, 17 aa, Mycobacterium bovis
IVFVLIFQRRIVAGLTS

SEQ ID NO: 157529 - protein, 17 aa, Mycobacterium bovis
IVGGVAWGAGVTLAGYF

SEQ ID NO: 157530 - protein, 22 aa, Mycobacterium bovis
IVGYYILRRALRPDGGQLIGVG

SEQ ID NO: 157531 - protein, 24 aa, Mycobacterium bovis
IVIIKRALAPLRRVAQTASEVVDL

SEQ ID NO: 157532 - protein, 17 aa, Mycobacterium bovis
IVLLVRWLVARRAAAFM

SEQ ID NO: 157533 - protein, 18 aa, Mycobacterium bovis
IVQSMFIGPVFNPLLKML

SEQ ID NO: 157534 - protein, 22 aa, Mycobacterium bovis
IVSALHRPVPLSGEGSDTDTVI

SEQ ID NO: 157535 - protein, 17 aa, Mycobacterium bovis
IVSEIFPVFSRKPIFGY

SEQ ID NO: 157536 - protein, 31 aa, Mycobacterium bovis
IVSGWRLIGKCLRPLPNKWKGLLDPEARVRT

SEQ ID NO: 157537 - protein, 20 aa, Mycobacterium bovis
IVTRSRLPGLLPPLDDVKNF

SEQ ID NO: 157538 - protein, 24 aa, Mycobacterium bovis
IVTVVASYSWYYAWTPGTGYLANL

SEQ ID NO: 157539 - protein, 26 aa, Mycobacterium bovis
IVVICVASMLIAHAMVRPIRRLEVGT

SEQ ID NO: 157540 - protein, 20 aa, Mycobacterium bovis
IVVTCPHCFNTIGKEYRQLG

SEQ ID NO: 157541 - protein, 22 aa, Mycobacterium bovis
IWAEEAWGRYWGWDPKETVSFV

SEQ ID NO: 157542 - protein, 24 aa, Mycobacterium bovis
IWRRCGGRTVTLFRSEWRRPVELS

SEQ ID NO: 157543 - protein, 24 aa, Mycobacterium bovis
IYAQPTSWWPLRWYPQNYRTATEQ

SEQ ID NO: 157544 - protein, 19 aa, Mycobacterium bovis
IYLTQRFIIAWRVWLTHHL

SEQ ID NO: 157545 - protein, 17 aa, Mycobacterium bovis
IYQEMLANYHVGQANSV

SEQ ID NO: 157546 - protein, 22 aa, Mycobacterium bovis
IYQTSRISSDFTFGNAPNDDPY

SEQ ID NO: 157547 - protein, 18 aa, Mycobacterium bovis
IYYPRYLILTAPAAAVIL

SEQ ID NO: 157548 - protein, 18 aa, Mycobacterium bovis
IYYPVSWIMWVWYRLFAF

SEQ ID NO: 157549 - protein, 27 aa, Mycobacterium bovis
IYYSPRLFAAMGFAGYFAMLALPAMVQ

SEQ ID NO: 157550 - protein, 18 aa, Mycobacterium bovis
KALFLGFMFAFAIKAPLW

SEQ ID NO: 157551 - protein, 18 aa, Mycobacterium bovis
KANGYRLVTVSELLGPRA

SEQ ID NO: 157552 - protein, 24 aa, Mycobacterium bovis
KANVRRFVDDISFVVSKQSRDRLK

SEQ ID NO: 157553 - protein, 23 aa, Mycobacterium bovis
KAPLWPFHRWLPDAAVESTPATA

SEQ ID NO: 157554 - protein, 19 aa, Mycobacterium bovis
KASAWVGALVTGWWIGVLA

SEQ ID NO: 157555 - protein, 19 aa, Mycobacterium bovis
KAVASWVANYGHEYYLDKA

SEQ ID NO: 157556 - protein, 24 aa, Mycobacterium bovis
KDFLELLRYLAVELLPGPLGDLIA

SEQ ID NO: 157557 - protein, 18 aa, Mycobacterium bovis
KDPAYSHVSDELFATIGV

SEQ ID NO: 157558 - protein, 18 aa, Mycobacterium bovis
KDRIYDILVQVAAMNTSI

SEQ ID NO: 157559 - protein, 17 aa, Mycobacterium bovis
KERPRVIAVDAVPTEVA

SEQ ID NO: 157560 - protein, 20 aa, Mycobacterium bovis
KFPELSAYQIINRLIHTARP

SEQ ID NO: 157561 - protein, 17 aa, Mycobacterium bovis
KGGSAVKPFAGVPHVSR

SEQ ID NO: 157562 - protein, 19 aa, Mycobacterium bovis
KGRALPAVLTRPSDDESVE

SEQ ID NO: 157563 - protein, 24 aa, Mycobacterium bovis
KHRGELVYLPPAWFDREHRSENPP

SEQ ID NO: 157564 - protein, 17 aa, Mycobacterium bovis
KIGRKPLLLWFGVGGLI

SEQ ID NO: 157565 - protein, 20 aa, Mycobacterium bovis
KIIMLCLWWGAATSKLNHHF

SEQ ID NO: 157566 - protein, 17 aa, Mycobacterium bovis
KIVGKLAQFGSGMLQQV

SEQ ID NO: 157567 - protein, 21 aa, Mycobacterium bovis
KKPKQRRLRRKKTAKGDEAEP

SEQ ID NO: 157568 - protein, 17 aa, Mycobacterium bovis
KKVATDWHQLVGAQSVE

SEQ ID NO: 157569 - protein, 24 aa, Mycobacterium bovis
KLAMQEIPQVFGYDYQTVERSLTA

SEQ ID NO: 157570 - protein, 18 aa, Mycobacterium bovis
KLLLSSLLLNWVLGPALM

SEQ ID NO: 157571 - protein, 23 aa, Mycobacterium bovis
KLRIECRKAKERLSSSTVTTLTD

SEQ ID NO: 157572 - protein, 23 aa, Mycobacterium bovis
KLSEISAAIGLRQLVGLDRRLAS

SEQ ID NO: 157573 - protein, 23 aa, Mycobacterium bovis
KLSFPTSAAPGWSAFSDDQNPNL

SEQ ID NO: 157574 - protein, 25 aa, Mycobacterium bovis
KLSTLDRFLPVWIGSAMAAGLLLGR

SEQ ID NO: 157575 - protein, 20 aa, Mycobacterium bovis
KLVAPLKYPSLYAGDEDGKV

SEQ ID NO: 157576 - protein, 25 aa, Mycobacterium bovis
KMGFGLGEASAFLLAMKDTATTPAM

SEQ ID NO: 157577 - protein, 17 aa, Mycobacterium bovis
KNFFSFAEILDIDRYRI

SEQ ID NO: 157578 - protein, 18 aa, Mycobacterium bovis
KPDICFLWDEAWYAFATA

SEQ ID NO: 157579 - protein, 20 aa, Mycobacterium bovis
KPFFAQGLLNRRAVLKSSYA

SEQ ID NO: 157580 - protein, 18 aa, Mycobacterium bovis
KPKARSVNPIAFVYNYLK

SEQ ID NO: 157581 - protein, 18 aa, Mycobacterium bovis
KPLLLWFGVGGLIYTYVL

SEQ ID NO: 157582 - protein, 20 aa, Mycobacterium bovis
KPQTVHWNLRLDVSDVDGKL

SEQ ID NO: 157583 - protein, 31 aa, Mycobacterium bovis
KPSAYSTGWALWVVLAFIVFQAVAAVLALLV

SEQ ID NO: 157584 - protein, 24 aa, Mycobacterium bovis
KPSYGMAEAVVYLATTKAGSPPTS

SEQ ID NO: 157585 - protein, 21 aa, Mycobacterium bovis
KPVERPAHRWVVVNTDGRSAP

SEQ ID NO: 157586 - protein, 20 aa, Mycobacterium bovis
KPVTIATFFRPRNLGLVLVT

SEQ ID NO: 157587 - protein, 18 aa, Mycobacterium bovis
KPWLIAGVVFLLAAAAFP

SEQ ID NO: 157588 - protein, 27 aa, Mycobacterium bovis
KQTWLGRFVSTYGWRAYALPVLMVLTT

SEQ ID NO: 157589 - protein, 21 aa, Mycobacterium bovis
KRERDAVELDLRAHVGTMSAT

SEQ ID NO: 157590 - protein, 23 aa, Mycobacterium bovis
KREVVELRRCVNPLSTAFQRMQT

SEQ ID NO: 157591 - protein, 17 aa, Mycobacterium bovis
KRIPSVARGPAWRLMGV

SEQ ID NO: 157592 - protein, 22 aa, Mycobacterium bovis
KRRGWPATLFRPHNLPFVMLGA

SEQ ID NO: 157593 - protein, 20 aa, Mycobacterium bovis
KRSLLRTAVIVPAVLAMLLV

SEQ ID NO: 157594 - protein, 18 aa, Mycobacterium bovis
KRTARLVGDVPIYDIIVG

SEQ ID NO: 157595 - protein, 23 aa, Mycobacterium bovis
KRTWSSGSLPGVFPVPLTISGDP

SEQ ID NO: 157596 - protein, 22 aa, Mycobacterium bovis
KSGLTALTWPVMANFAVDSAMA

SEQ ID NO: 157597 - protein, 21 aa, Mycobacterium bovis
KSLADGLARFTWQLRAADPRL

SEQ ID NO: 157598 - protein, 20 aa, Mycobacterium bovis
KSLHDMGEFYGRNIFMAETS

SEQ ID NO: 157599 - protein, 24 aa, Mycobacterium bovis
KSLYLRNEVFAAWIEKVDALVQDE

SEQ ID NO: 157600 - protein, 19 aa, Mycobacterium bovis
KSNIAFRIALRAESGDDSR

SEQ ID NO: 157601 - protein, 19 aa, Mycobacterium bovis
KTAEVVDAFTTSKVTLSTT

SEQ ID NO: 157602 - protein, 17 aa, Mycobacterium bovis
KTAYFDTDFFQVLVTQF

SEQ ID NO: 157603 - protein, 19 aa, Mycobacterium bovis
KTPWWEDRFQQEPKQPPAP

SEQ ID NO: 157604 - protein, 23 aa, Mycobacterium bovis
KTVAGLLQLLGLFGIAGIGRIYL

SEQ ID NO: 157605 - protein, 20 aa, Mycobacterium bovis
KVAFVAGWMYFLNWAMTGIV

SEQ ID NO: 157606 - protein, 22 aa, Mycobacterium bovis
KVDWVRCDSRRAVAVEEAVAKQ

SEQ ID NO: 157607 - protein, 23 aa, Mycobacterium bovis
KVHRHWGFGGGPHRCLGSHLARL

SEQ ID NO: 157608 - protein, 24 aa, Mycobacterium bovis
KVLDLTIRLAEVMLSSGSGTADVV

SEQ ID NO: 157609 - protein, 18 aa, Mycobacterium bovis
KVLECYRTGMADAGVRFQ

SEQ ID NO: 157610 - protein, 24 aa, Mycobacterium bovis
KVNQAGVIPVIFASSLIYIPHLIT

SEQ ID NO: 157611 - protein, 18 aa, Mycobacterium bovis
KVVLDWDALPPVARIELM

SEQ ID NO: 157612 - protein, 22 aa, Mycobacterium bovis
KVVYRRGFVTRHQVTGWRFVMR

SEQ ID NO: 157613 - protein, 17 aa, Mycobacterium bovis
KVWAVVGAAAIVLVAIV

SEQ ID NO: 157614 - protein, 18 aa, Mycobacterium bovis
KYRPDFPKRFESIEAARV

SEQ ID NO: 157615 - protein, 24 aa, Mycobacterium bovis
KYTFRKRALIVMAVILVGSAAAAF

SEQ ID NO: 157616 - protein, 26 aa, Mycobacterium bovis
LAALLFAVIACRTYRDPIAGLTLSVI

SEQ ID NO: 157617 - protein, 17 aa, Mycobacterium bovis
LAALSILVGAVGATGPG

SEQ ID NO: 157618 - protein, 21 aa, Mycobacterium bovis
LAAMVRLRHLIFKVMTANVDG

SEQ ID NO: 157619 - protein, 20 aa, Mycobacterium bovis
LAATIGFGWTLLVLLATFVL

SEQ ID NO: 157620 - protein, 18 aa, Mycobacterium bovis
LAAVAMFLGFVAPALSLS

SEQ ID NO: 157621 - protein, 20 aa, Mycobacterium bovis
LAAWAVWEFRGARGAIQATL

SEQ ID NO: 157622 - protein, 19 aa, Mycobacterium bovis
LACATKWSGVYFVLFFGAM

SEQ ID NO: 157623 - protein, 24 aa, Mycobacterium bovis
LADDAKTRVIAFLRKPIVTVSLVG

SEQ ID NO: 157624 - protein, 22 aa, Mycobacterium bovis
LADHAVGPVVLFPGTGFVELAL

SEQ ID NO: 157625 - protein, 23 aa, Mycobacterium bovis
LADQLRAASTMRVQTPDDPTFAL

SEQ ID NO: 157626 - protein, 26 aa, Mycobacterium bovis
LAEAFLPRRWRYGAQVTLALGGSAVA

SEQ ID NO: 157627 - protein, 20 aa, Mycobacterium bovis
LAEQGLRVLAVAQRTWDNGT

SEQ ID NO: 157628 - protein, 20 aa, Mycobacterium bovis
LAERGVHAGLMFPAVVCTLA

SEQ ID NO: 157629 - protein, 19 aa, Mycobacterium bovis
LAFLLVFGLFVRKGWDIVI

SEQ ID NO: 157630 - protein, 30 aa, Mycobacterium bovis
LAGENHRLVATRLCWPDQAKADELQHALQD

SEQ ID NO: 157631 - protein, 20 aa, Mycobacterium bovis
LAGFCLHATLLGMLAGTNRW

SEQ ID NO: 157632 - protein, 25 aa, Mycobacterium bovis
LAGFNASGTPFVWDGSMVVNYQDPS

SEQ ID NO: 157633 - protein, 24 aa, Mycobacterium bovis
LAGGLGIALAHPWRSSGPRTSAPP

SEQ ID NO: 157634 - protein, 18 aa, Mycobacterium bovis
LAGIACWLIVSRFVLRRL

SEQ ID NO: 157635 - protein, 17 aa, Mycobacterium bovis
LAGLLIVIGAQLVKLAH

SEQ ID NO: 157636 - protein, 25 aa, Mycobacterium bovis
LAGLSRFVWATAIIWILGGLGTWLI

SEQ ID NO: 157637 - protein, 20 aa, Mycobacterium bovis
LAGVVLMRWTPIDLLPQHRE

SEQ ID NO: 157638 - protein, 18 aa, Mycobacterium bovis
LAHLCFIGALLPLARQAA

SEQ ID NO: 157639 - protein, 23 aa, Mycobacterium bovis
LAHLEFARAPLLVVVAIPIALAR

SEQ ID NO: 157640 - protein, 21 aa, Mycobacterium bovis
LAIGIAVSFLAAVTLLPAILV

SEQ ID NO: 157641 - protein, 17 aa, Mycobacterium bovis
LAILMLLPLSAFEATVA

SEQ ID NO: 157642 - protein, 18 aa, Mycobacterium bovis
LAITGLVASAAWTIGSNL

SEQ ID NO: 157643 - protein, 29 aa, Mycobacterium bovis
LALGGRALRWPRFPLVIEAAVAAVDHQPL

SEQ ID NO: 157644 - protein, 17 aa, Mycobacterium bovis
LALGIGIHDITAGYRAY

SEQ ID NO: 157645 - protein, 18 aa, Mycobacterium bovis
LALGSYWAMFILVPGTLV

SEQ ID NO: 157646 - protein, 24 aa, Mycobacterium bovis
LALLPLLALLAFWRTGRRQLADRP

SEQ ID NO: 157647 - protein, 17 aa, Mycobacterium bovis
LALPFVILIGLIVSRQW

SEQ ID NO: 157648 - protein, 19 aa, Mycobacterium bovis
LALPGYRPGYNDRYYLRAG

SEQ ID NO: 157649 - protein, 25 aa, Mycobacterium bovis
LALPRPTVVTGLRLAASRSMLPAHP

SEQ ID NO: 157650 - protein, 25 aa, Mycobacterium bovis
LALSWPRVTAVFLVDVLILAVASHC

SEQ ID NO: 157651 - protein, 17 aa, Mycobacterium bovis
LALTASMTWEILWALIL

SEQ ID NO: 157652 - protein, 18 aa, Mycobacterium bovis
LALVGLLALPGYRPGYND

SEQ ID NO: 157653 - protein, 19 aa, Mycobacterium bovis
LALVGLLTLPGYRTNYNDR

SEQ ID NO: 157654 - protein, 17 aa, Mycobacterium bovis
LAMMVFSKSFSVLRSAV

SEQ ID NO: 157655 - protein, 23 aa, Mycobacterium bovis
LANLFPFQLFLVLYGLPLEDRDR

SEQ ID NO: 157656 - protein, 28 aa, Mycobacterium bovis
LAPAAWWRQLSWLPQRPVLVPGTVRHNL

SEQ ID NO: 157657 - protein, 20 aa, Mycobacterium bovis
LAPDAICVTDPLAFTGCGCD

SEQ ID NO: 157658 - protein, 20 aa, Mycobacterium bovis
LAPDAKPYQGGHRFHQVEVV

SEQ ID NO: 157659 - protein, 25 aa, Mycobacterium bovis
LAPNGFSVFGVFWGAFGLVTGAANG

SEQ ID NO: 157660 - protein, 17 aa, Mycobacterium bovis
LAPNLFATLGIIVAHGY

SEQ ID NO: 157661 - protein, 17 aa, Mycobacterium bovis
LAPTLWGWRRTPVLRWF

SEQ ID NO: 157662 - protein, 18 aa, Mycobacterium bovis
LARATWPLRAPRAAMVLW

SEQ ID NO: 157663 - protein, 19 aa, Mycobacterium bovis
LARHPRLPRQDALKVLRAD

SEQ ID NO: 157664 - protein, 18 aa, Mycobacterium bovis
LARLMMRGWRRRSERQAE

SEQ ID NO: 157665 - protein, 18 aa, Mycobacterium bovis
LARYGPRAPQLWLPPLDE

SEQ ID NO: 157666 - protein, 27 aa, Mycobacterium bovis
LASALAPPCIIAFLETRYWWAGIALAS

SEQ ID NO: 157667 - protein, 19 aa, Mycobacterium bovis
LASMPSWGLVVTMFAWGYL

SEQ ID NO: 157668 - protein, 24 aa, Mycobacterium bovis
LATAAWVGLGWMWHLREALSQMWA

SEQ ID NO: 157669 - protein, 17 aa, Mycobacterium bovis
LATAVLAIWLRFNMATE

SEQ ID NO: 157670 - protein, 27 aa, Mycobacterium bovis
LATHYWKPLLLCFLVTLGGTVAFYTYS

SEQ ID NO: 157671 - protein, 17 aa, Mycobacterium bovis
LATRCYDVTQGAVRIGG

SEQ ID NO: 157672 - protein, 24 aa, Mycobacterium bovis
LATRGGVAFLGFHRIIGLSTFATN

SEQ ID NO: 157673 - protein, 21 aa, Mycobacterium bovis
LATRPATFLWLIAATGTLLVA

SEQ ID NO: 157674 - protein, 18 aa, Mycobacterium bovis
LAVAAAVCAFLFMNNLTE

SEQ ID NO: 157675 - protein, 21 aa, Mycobacterium bovis
LAVATRGLWAAALQLASAICR

SEQ ID NO: 157676 - protein, 36 aa, Mycobacterium bovis
LAVIAVVVLGWYFLRIPSLVGIGRYTLYAELPRSGG

SEQ ID NO: 157677 - protein, 18 aa, Mycobacterium bovis
LAVIRRGVIPASWGGKLK

SEQ ID NO: 157678 - protein, 21 aa, Mycobacterium bovis
LAVVFALAATIGFGWTLLVLL

SEQ ID NO: 157679 - protein, 17 aa, Mycobacterium bovis
LAWELMAIASLILVLSE

SEQ ID NO: 157680 - protein, 18 aa, Mycobacterium bovis
LAYFFGPVVVFWVLAGMA

SEQ ID NO: 157681 - protein, 26 aa, Mycobacterium bovis
LCALAVGLKFKLGFDDSLDVVGVHLV

SEQ ID NO: 157682 - protein, 26 aa, Mycobacterium bovis
LCAVAPNILLLIIFRVVQGFGGGMLT

SEQ ID NO: 157683 - protein, 17 aa, Mycobacterium bovis
LCIVFTALSSALCDQLG

SEQ ID NO: 157684 - protein, 18 aa, Mycobacterium bovis
LCLIFIIMLIITRAFIAA

SEQ ID NO: 157685 - protein, 17 aa, Mycobacterium bovis
LCSARADVLAAVRDILA

SEQ ID NO: 157686 - protein, 19 aa, Mycobacterium bovis
LCVIMAWVSPATVFVFLLN

SEQ ID NO: 157687 - protein, 17 aa, Mycobacterium bovis
LDALIGGFKPVFRALDP

SEQ ID NO: 157688 - protein, 18 aa, Mycobacterium bovis
LDAQMIAFFTMVVAACEV

SEQ ID NO: 157689 - protein, 26 aa, Mycobacterium bovis
LDATVVRMFLVPSVMKLLGDDCWWAP

SEQ ID NO: 157690 - protein, 20 aa, Mycobacterium bovis
LDAVAALTWQLPAEPGGGAA

SEQ ID NO: 157691 - protein, 26 aa, Mycobacterium bovis
LDELQAFDVFSSFWFTAIYVLLFVSL

SEQ ID NO: 157692 - protein, 21 aa, Mycobacterium bovis
LDGAPPMPPPRDPLEEVTAAL

SEQ ID NO: 157693 - protein, 26 aa, Mycobacterium bovis
LDGFRPDRWDVIGALGCMAGVAVIMY

SEQ ID NO: 157694 - protein, 17 aa, Mycobacterium bovis
LDGLRPYFTGYLPTLLL

SEQ ID NO: 157695 - protein, 18 aa, Mycobacterium bovis
LDGRVVRLGRPGWLDAAE

SEQ ID NO: 157696 - protein, 18 aa, Mycobacterium bovis
LDLLLAIVRRTRAGRSAF

SEQ ID NO: 157697 - protein, 17 aa, Mycobacterium bovis
LDNGAGLHEARTAALNL

SEQ ID NO: 157698 - protein, 18 aa, Mycobacterium bovis
LDQMSWVTPARWGFAASA

SEQ ID NO: 157699 - protein, 18 aa, Mycobacterium bovis
LDQWDWVKWLPHFGDSRR

SEQ ID NO: 157700 - protein, 18 aa, Mycobacterium bovis
LDRLRTLVHRTCVTPLPF

SEQ ID NO: 157701 - protein, 21 aa, Mycobacterium bovis
LDRPAEFVVGSAIQVVDRVQW

SEQ ID NO: 157702 - protein, 17 aa, Mycobacterium bovis
LDRVDAIVIDPRVLCTD

SEQ ID NO: 157703 - protein, 17 aa, Mycobacterium bovis
LDRVRVVVIDGAALRGD

SEQ ID NO: 157704 - protein, 22 aa, Mycobacterium bovis
LDRWLLFNWMRWGRALEYLKIT

SEQ ID NO: 157705 - protein, 22 aa, Mycobacterium bovis
LDVRAGEHLAIIGANGSGKTTL

SEQ ID NO: 157706 - protein, 21 aa, Mycobacterium bovis
LDWFISFVSGPVFTFLAYLVL

SEQ ID NO: 157707 - protein, 23 aa, Mycobacterium bovis
LEAGRPPRRFAPGIMGRTMTVWS

SEQ ID NO: 157708 - protein, 22 aa, Mycobacterium bovis
LEAPLKFRAAGVTLQIGLGIGR

SEQ ID NO: 157709 - protein, 19 aa, Mycobacterium bovis
LEHGPWIAALTAMLAAVAM

SEQ ID NO: 157710 - protein, 17 aa, Mycobacterium bovis
LEIAPGVVTTWMKLAIR

SEQ ID NO: 157711 - protein, 17 aa, Mycobacterium bovis
LELRLHDARDSNVRVVG

SEQ ID NO: 157712 - protein, 21 aa, Mycobacterium bovis
LEMRHLASLPAGVAPSPDQLS

SEQ ID NO: 157713 - protein, 24 aa, Mycobacterium bovis
LEPFRCFYLSAPFVVPKKKEVART

SEQ ID NO: 157714 - protein, 19 aa, Mycobacterium bovis
LEPKRMARVRGWRKVGAAI

SEQ ID NO: 157715 - protein, 18 aa, Mycobacterium bovis
LEPPIPQPAAAPIEHWAA

SEQ ID NO: 157716 - protein, 24 aa, Mycobacterium bovis
LEPPYRGGPVLADNAVIPVERTQV

SEQ ID NO: 157717 - protein, 17 aa, Mycobacterium bovis
LERPLADVARASELGGS

SEQ ID NO: 157718 - protein, 23 aa, Mycobacterium bovis
LEVSARMAVLLAGLSPRLPPALN

SEQ ID NO: 157719 - protein, 17 aa, Mycobacterium bovis
LEYELDAAKLLDFPVMT

SEQ ID NO: 157720 - protein, 31 aa, Mycobacterium bovis
LFAGPGMNLAICLVLIYAIALVWGLPNLHPP

SEQ ID NO: 157721 - protein, 18 aa, Mycobacterium bovis
LFAVVGLLFLGTVALTLA

SEQ ID NO: 157722 - protein, 17 aa, Mycobacterium bovis
LFDFNVGVMRWRWRVAF

SEQ ID NO: 157723 - protein, 45 aa, Mycobacterium bovis
LFDPKRLLKVRGWRRVGTVVVRWPLPVLVATCAIALVGLLALPGY

SEQ ID NO: 157724 - protein, 25 aa, Mycobacterium bovis
LFHLSLRHALWWLGSLAAVASFTLQ

SEQ ID NO: 157725 - protein, 26 aa, Mycobacterium bovis
LFIGAVLILGFWAPGFFVTTKLDVIK

SEQ ID NO: 157726 - protein, 24 aa, Mycobacterium bovis
LFITAVDWTRWWVMITLDVAIVYI

SEQ ID NO: 157727 - protein, 17 aa, Mycobacterium bovis
LFLGAISFVLANFTVAS

SEQ ID NO: 157728 - protein, 19 aa, Mycobacterium bovis
LFMMVGIMMMMFRGMGGGQ

SEQ ID NO: 157729 - protein, 21 aa, Mycobacterium bovis
LFPVVQPWYLLWAIIPLAAWA

SEQ ID NO: 157730 - protein, 23 aa, Mycobacterium bovis
LFRGPRAPYLRTMFVVLLSTLTL

SEQ ID NO: 157731 - protein, 20 aa, Mycobacterium bovis
LFRPRFIKRMFFKKFPGDLR

SEQ ID NO: 157732 - protein, 17 aa, Mycobacterium bovis
LFTAITFGALWLLYRYY

SEQ ID NO: 157733 - protein, 25 aa, Mycobacterium bovis
LFVPAALPWYYSWPLAVAAPLAQSR

SEQ ID NO: 157734 - protein, 18 aa, Mycobacterium bovis
LFVVAGLVALYILMQLAR

SEQ ID NO: 157735 - protein, 18 aa, Mycobacterium bovis
LGAAIAVALGLWPRLKEY

SEQ ID NO: 157736 - protein, 17 aa, Mycobacterium bovis
LGAAWRVLHAIPAARAA

SEQ ID NO: 157737 - protein, 20 aa, Mycobacterium bovis
LGAIVFAGLLAWLYQRTRVT

SEQ ID NO: 157738 - protein, 17 aa, Mycobacterium bovis
LGALAFVAGCSVLVRPE

SEQ ID NO: 157739 - protein, 20 aa, Mycobacterium bovis
LGALLMLPGVRGLGPGPVTT

SEQ ID NO: 157740 - protein, 18 aa, Mycobacterium bovis
LGALLWSFISPSGQLNES

SEQ ID NO: 157741 - protein, 17 aa, Mycobacterium bovis
LGAVIWGVIDALLILTD

SEQ ID NO: 157742 - protein, 22 aa, Mycobacterium bovis
LGECSACRAWFTQVASQAGDLR

SEQ ID NO: 157743 - protein, 26 aa, Mycobacterium bovis
LGEDYLRLSALGSYGAFFNIYFCSVT

SEQ ID NO: 157744 - protein, 27 aa, Mycobacterium bovis
LGEVWRCLRCGDFALGGPQGRGAPEDA

SEQ ID NO: 157745 - protein, 22 aa, Mycobacterium bovis
LGFAVARPRGWPEAAAAVPAAV

SEQ ID NO: 157746 - protein, 23 aa, Mycobacterium bovis
LGFDGALSWAGKLGVALSVGVLG

SEQ ID NO: 157747 - protein, 18 aa, Mycobacterium bovis
LGFGCGSGPLTGRFWPPI

SEQ ID NO: 157748 - protein, 19 aa, Mycobacterium bovis
LGFVMPGDIPFQVQLPSTP

SEQ ID NO: 157749 - protein, 17 aa, Mycobacterium bovis
LGGMVAMVFASGSHVFG

SEQ ID NO: 157750 - protein, 20 aa, Mycobacterium bovis
LGHRVADGWLVARAGSLQRR

SEQ ID NO: 157751 - protein, 21 aa, Mycobacterium bovis
LGIALTLSRLVAGLTPGLAAS

SEQ ID NO: 157752 - protein, 26 aa, Mycobacterium bovis
LGIARRAGAPISFWEFTRKGAVVTAV

SEQ ID NO: 157753 - protein, 24 aa, Mycobacterium bovis
LGITRISLNFAVFRAAFEQGAQLG

SEQ ID NO: 157754 - protein, 20 aa, Mycobacterium bovis
LGLFPLFVMFVITAITMQRE

SEQ ID NO: 157755 - protein, 18 aa, Mycobacterium bovis
LGLLWPHIDLPEAWQVIA

SEQ ID NO: 157756 - protein, 24 aa, Mycobacterium bovis
LGLLWWMMVCWSQPLRARPDSQMF

SEQ ID NO: 157757 - protein, 23 aa, Mycobacterium bovis
LGLMRAIICQLAFSHGPDHVQMI

SEQ ID NO: 157758 - protein, 17 aa, Mycobacterium bovis
LGLRLELRLHDARDSNV

SEQ ID NO: 157759 - protein, 21 aa, Mycobacterium bovis
LGLSRQHWKSGLVYALAAVAL

SEQ ID NO: 157760 - protein, 19 aa, Mycobacterium bovis
LGLYVLFLFTQTVRHRDFF

SEQ ID NO: 157761 - protein, 27 aa, Mycobacterium bovis
LGMSLHQPYLMGCLSPRNELSQISYGQ

SEQ ID NO: 157762 - protein, 29 aa, Mycobacterium bovis
LGPAAGFFVGWSYWFAWVVTGIADLVAIT

SEQ ID NO: 157763 - protein, 24 aa, Mycobacterium bovis
LGPDRRTASAGLWRRPAGGGTAKT

SEQ ID NO: 157764 - protein, 32 aa, Mycobacterium bovis
LGPPIGGLLVEWAGWRWVLLVNVPLGIVAAIA

SEQ ID NO: 157765 - protein, 23 aa, Mycobacterium bovis
LGPRLDALDVRRLVRRLLGRPDP

SEQ ID NO: 157766 - protein, 18 aa, Mycobacterium bovis
LGQPHLSATLGLLPEADA

SEQ ID NO: 157767 - protein, 17 aa, Mycobacterium bovis
LGRVPMAVVPLFVAAML

SEQ ID NO: 157768 - protein, 26 aa, Mycobacterium bovis
LGSALALAGVSAWLITRAWQMPPVLD

SEQ ID NO: 157769 - protein, 43 aa, Mycobacterium bovis
LGSSMFFGAYPWAGWLAFAATLPVQFVAGWPILRGAVQQARAL

SEQ ID NO: 157770 - protein, 25 aa, Mycobacterium bovis
LGSTLVLRRRFKPALVLEDIEKHKA

SEQ ID NO: 157771 - protein, 18 aa, Mycobacterium bovis
LGTFAFGVARQADYLPIL

SEQ ID NO: 157772 - protein, 22 aa, Mycobacterium bovis
LGTFGSFIGFSFVFGQVLQTNF

SEQ ID NO: 157773 - protein, 18 aa, Mycobacterium bovis
LGVHRIFLITVALALLTA

SEQ ID NO: 157774 - protein, 18 aa, Mycobacterium bovis
LGVIVLLLAGPRLIDAYV

SEQ ID NO: 157775 - protein, 18 aa, Mycobacterium bovis
LGVMPLLPVLLMVWATAR

SEQ ID NO: 157776 - protein, 27 aa, Mycobacterium bovis
LGVPHLDPGPFLSYGIQWISFGILAPI

SEQ ID NO: 157777 - protein, 19 aa, Mycobacterium bovis
LGVPTAWLVAPVEAGGKTQ

SEQ ID NO: 157778 - protein, 29 aa, Mycobacterium bovis
LGYLYFLVCLCVFRPPSIFGAQRASHALS

SEQ ID NO: 157779 - protein, 25 aa, Mycobacterium bovis
LHDELFDACGWRRLIFATPEELEAA

SEQ ID NO: 157780 - protein, 22 aa, Mycobacterium bovis
LHEVPVLSGLGLTMTGPRPGGF

SEQ ID NO: 157781 - protein, 35 aa, Mycobacterium bovis
LIAGLPCLPWFISSNWNLAFGVLPPYWAAKAFWVA

SEQ ID NO: 157782 - protein, 20 aa, Mycobacterium bovis
LIAKVCVYTVLAVVQSAIVT

SEQ ID NO: 157783 - protein, 19 aa, Mycobacterium bovis
LIALWRLDQLDGRGSIAQL

SEQ ID NO: 157784 - protein, 20 aa, Mycobacterium bovis
LIAQVLDWFISFVSGPVFTF

SEQ ID NO: 157785 - protein, 26 aa, Mycobacterium bovis
LIDELGWPMLCLMTIAAGALQIVFGL

SEQ ID NO: 157786 - protein, 20 aa, Mycobacterium bovis
LIERRCMLYAGTTVVSGTAV

SEQ ID NO: 157787 - protein, 25 aa, Mycobacterium bovis
LIGLSFLGLCHLWAGSPEAPESRLR

SEQ ID NO: 157788 - protein, 28 aa, Mycobacterium bovis
LIGLSMLGDLPWWVTVLILTRELGVTVL

SEQ ID NO: 157789 - protein, 27 aa, Mycobacterium bovis
LIHDCPKLLQLRTFPTIAIGGDLAGAA

SEQ ID NO: 157790 - protein, 21 aa, Mycobacterium bovis
LILALILKFTIGLRLDAEQES

SEQ ID NO: 157791 - protein, 24 aa, Mycobacterium bovis
LIMIAVFCGFAFAGMPLVAEIGVA

SEQ ID NO: 157792 - protein, 18 aa, Mycobacterium bovis
LIPLTGLTTPWMSYGGSS

SEQ ID NO: 157793 - protein, 19 aa, Mycobacterium bovis
LIVGGLTFFPALALGPIVE

SEQ ID NO: 157794 - protein, 19 aa, Mycobacterium bovis
LIVITGLIGSFVFSLIRPN

SEQ ID NO: 157795 - protein, 18 aa, Mycobacterium bovis
LIVSRQWKLLGAYAAAGL

SEQ ID NO: 157796 - protein, 20 aa, Mycobacterium bovis
LIVVCCYVALVVTNFAWLYP

SEQ ID NO: 157797 - protein, 32 aa, Mycobacterium bovis
LKAAARLPVTWEMSFLYAIVFGGFVAFSNYLP

SEQ ID NO: 157798 - protein, 26 aa, Mycobacterium bovis
LKAVAYWLDRYELLSSGRKEPTFTGA

SEQ ID NO: 157799 - protein, 19 aa, Mycobacterium bovis
LKDDFVLRERGHINVKGKG

SEQ ID NO: 157800 - protein, 26 aa, Mycobacterium bovis
LKLTGGRTAQAWARRHQQLRAALTPL

SEQ ID NO: 157801 - protein, 21 aa, Mycobacterium bovis
LKLVFSMDLGMCLNRFTYDSK

SEQ ID NO: 157802 - protein, 19 aa, Mycobacterium bovis
LKMPYPRFLAANVTGGICW

SEQ ID NO: 157803 - protein, 18 aa, Mycobacterium bovis
LKTGQLVGATPWKQQVAL

SEQ ID NO: 157804 - protein, 21 aa, Mycobacterium bovis
LKVLRERDAMVAKTLADNKKS

SEQ ID NO: 157805 - protein, 19 aa, Mycobacterium bovis
LLACGWAFLIWGMYAYLWA

SEQ ID NO: 157806 - protein, 18 aa, Mycobacterium bovis
LLAGAVSRTHWLASHLAM

SEQ ID NO: 157807 - protein, 21 aa, Mycobacterium bovis
LLAGIALLVSRQVVVPVRSAS

SEQ ID NO: 157808 - protein, 28 aa, Mycobacterium bovis
LLAGPRLIDAYVDWLWFGELGYRSVFTT

SEQ ID NO: 157809 - protein, 21 aa, Mycobacterium bovis
LLAGSHGWRAMFGLAAAPATL

SEQ ID NO: 157810 - protein, 18 aa, Mycobacterium bovis
LLALFAGSVLRGADLATL

SEQ ID NO: 157811 - protein, 26 aa, Mycobacterium bovis
LLALLANLFLPWGIAGAAPTALDVLT

SEQ ID NO: 157812 - protein, 26 aa, Mycobacterium bovis
LLAVLRGRLHPIGGLGVALAVTVLLF

SEQ ID NO: 157813 - protein, 24 aa, Mycobacterium bovis
LLDRELNALVPLVSFAVLASCGVP

SEQ ID NO: 157814 - protein, 26 aa, Mycobacterium bovis
LLDSSRLAAGVIRPQLRRAYLEEAVQ

SEQ ID NO: 157815 - protein, 21 aa, Mycobacterium bovis
LLELATPYALNAVSDDERADI

SEQ ID NO: 157816 - protein, 17 aa, Mycobacterium bovis
LLERAAAIGARYQQAFA

SEQ ID NO: 157817 - protein, 21 aa, Mycobacterium bovis
LLFARPRLRVGSAGLSVRNLL

SEQ ID NO: 157818 - protein, 18 aa, Mycobacterium bovis
LLFVYRSVVTMVLVLITV

SEQ ID NO: 157819 - protein, 17 aa, Mycobacterium bovis
LLGACAKSAQVPLQAWL

SEQ ID NO: 157820 - protein, 24 aa, Mycobacterium bovis
LLGADRPLLHSSFGHLEGIQQPLI

SEQ ID NO: 157821 - protein, 32 aa, Mycobacterium bovis
LLGDDCWWAPRWARRLQTRIGLGEIHLPDERK

SEQ ID NO: 157822 - protein, 18 aa, Mycobacterium bovis
LLGGLPITGVIVRSSANV

SEQ ID NO: 157823 - protein, 24 aa, Mycobacterium bovis
LLGPGPRWWGLALLAVGGTSALYG

SEQ ID NO: 157824 - protein, 22 aa, Mycobacterium bovis
LLGPRLPRILAAVALGVLSLGS

SEQ ID NO: 157825 - protein, 18 aa, Mycobacterium bovis
LLGTGLCGGLTTFSTMQV

SEQ ID NO: 157826 - protein, 18 aa, Mycobacterium bovis
LLHGLLMHSGNDAAYALA

SEQ ID NO: 157827 - protein, 19 aa, Mycobacterium bovis
LLHRDVKPANILIANPDSP

SEQ ID NO: 157828 - protein, 19 aa, Mycobacterium bovis
LLIRLAIAAVLFVPVADLS

SEQ ID NO: 157829 - protein, 23 aa, Mycobacterium bovis
LLLARAVLSPARIVLLDEPVEHL

SEQ ID NO: 157830 - protein, 36 aa, Mycobacterium bovis
LLLFGPRLVDIYVDWLWFGEVGFRSVWITVLLTRLA

SEQ ID NO: 157831 - protein, 19 aa, Mycobacterium bovis
LLLGMLVTACFTRPARWTL

SEQ ID NO: 157832 - protein, 21 aa, Mycobacterium bovis
LLLIFLFWPWEFKAADGESDF

SEQ ID NO: 157833 - protein, 21 aa, Mycobacterium bovis
LLLLYWQWRTMPAVIWDVRQP

SEQ ID NO: 157834 - protein, 20 aa, Mycobacterium bovis
LLLRARLSVRAAAIVLLTAD

SEQ ID NO: 157835 - protein, 20 aa, Mycobacterium bovis
LLNGVVLKFAMNSMNSTFAA

SEQ ID NO: 157836 - protein, 18 aa, Mycobacterium bovis
LLPAILVLASPRGWVAPR

SEQ ID NO: 157837 - protein, 25 aa, Mycobacterium bovis
LLPGRRMPIPQLPGATAGARSTDIE

SEQ ID NO: 157838 - protein, 22 aa, Mycobacterium bovis
LLPLLNRQWRALVAAVVVPVVV

SEQ ID NO: 157839 - protein, 21 aa, Mycobacterium bovis
LLPPRSHRLWLAVNAAGALLL

SEQ ID NO: 157840 - protein, 29 aa, Mycobacterium bovis
LLQGHWSLLVGYGCLPWVATAMLTMRTTV

SEQ ID NO: 157841 - protein, 22 aa, Mycobacterium bovis
LLRDRWGFQPAWNAEECLEDFT

SEQ ID NO: 157842 - protein, 18 aa, Mycobacterium bovis
LLRRIGVGVPDFYQDARW

SEQ ID NO: 157843 - protein, 17 aa, Mycobacterium bovis
LLRSLGISDPRELDVDR

SEQ ID NO: 157844 - protein, 25 aa, Mycobacterium bovis
LLRVEVPNALPLMLGGLRSATLQVV

SEQ ID NO: 157845 - protein, 20 aa, Mycobacterium bovis
LLSIGCGLIVAALLVTIQAA

SEQ ID NO: 157846 - protein, 18 aa, Mycobacterium bovis
LLSQLVPWLLTPLLMLGA

SEQ ID NO: 157847 - protein, 24 aa, Mycobacterium bovis
LLSSLIVGAGWPLIVEQISVKPNA

SEQ ID NO: 157848 - protein, 24 aa, Mycobacterium bovis
LLTDFKGGSTFLGMEKLPHTAAVV

SEQ ID NO: 157849 - protein, 26 aa, Mycobacterium bovis
LLTHPQHWNMYLAGWINDLVPGTADQ

SEQ ID NO: 157850 - protein, 18 aa, Mycobacterium bovis
LLVAVSWAIFALVLAVVI

SEQ ID NO: 157851 - protein, 17 aa, Mycobacterium bovis
LLVCDRLGVNSTPFLVA

SEQ ID NO: 157852 - protein, 18 aa, Mycobacterium bovis
LLVEALDAMVLTAGADAS

SEQ ID NO: 157853 - protein, 34 aa, Mycobacterium bovis
LLVGIECLIAIPLRRDPLLFPFQPIHVTIAAWFT

SEQ ID NO: 157854 - protein, 25 aa, Mycobacterium bovis
LLVSIPFTVLVAFTLNILLREIGAA

SEQ ID NO: 157855 - protein, 20 aa, Mycobacterium bovis
LLVVFGISVLLTFYPGWVTI

SEQ ID NO: 157856 - protein, 28 aa, Mycobacterium bovis
LLVYVLPLLLLVGLFVMFSRMQGGARMG

SEQ ID NO: 157857 - protein, 20 aa, Mycobacterium bovis
LLWDGKRSPIDLADHAVTSG

SEQ ID NO: 157858 - protein, 20 aa, Mycobacterium bovis
LLWSGPGRWSLDRRLSKRAT

SEQ ID NO: 157859 - protein, 24 aa, Mycobacterium bovis
LLWTVGLCLYGLVMGSVVHGIGDQ

SEQ ID NO: 157860 - protein, 24 aa, Mycobacterium bovis
LLYLLPLILRLWRGDTTHDRHAAA

SEQ ID NO: 157861 - protein, 19 aa, Mycobacterium bovis
LLYRYYRTGDPLFWFTTSS

SEQ ID NO: 157862 - protein, 18 aa, Mycobacterium bovis
LMAIASLILVLSEHARPQ

SEQ ID NO: 157863 - protein, 18 aa, Mycobacterium bovis
LMENMGYRLVLKARTAGA

SEQ ID NO: 157864 - protein, 20 aa, Mycobacterium bovis
LMIANPFRAGERIGSLFSTH

SEQ ID NO: 157865 - protein, 23 aa, Mycobacterium bovis
LMLISGGATGWLYLEQYRPDQQT

SEQ ID NO: 157866 - protein, 22 aa, Mycobacterium bovis
LMPLKLFPHWIHPFVRNQPISQ

SEQ ID NO: 157867 - protein, 17 aa, Mycobacterium bovis
LMSLGIINECHRLCVDY

SEQ ID NO: 157868 - protein, 25 aa, Mycobacterium bovis
LMVDGLGWRSVFLVNVPLGAIVWLL

SEQ ID NO: 157869 - protein, 23 aa, Mycobacterium bovis
LMYGEIFTITAIVCVFGAVLGLL

SEQ ID NO: 157870 - protein, 26 aa, Mycobacterium bovis
LNAAFRYALVRLRDAAEAVGFYRGER

SEQ ID NO: 157871 - protein, 29 aa, Mycobacterium bovis
LNGAPEAMWWTLYLACYLAGGWGSAWAGA

SEQ ID NO: 157872 - protein, 17 aa, Mycobacterium bovis
LNGWFFGVVYWLFDLSG

SEQ ID NO: 157873 - protein, 24 aa, Mycobacterium bovis
LNKFEVIVVPVLLALMLSALLVPP

SEQ ID NO: 157874 - protein, 19 aa, Mycobacterium bovis
LNMWASANTGWWPLIWFTA

SEQ ID NO: 157875 - protein, 29 aa, Mycobacterium bovis
LNSLPMLAALAWVCADAILLVRTGNHRYA

SEQ ID NO: 157876 - protein, 23 aa, Mycobacterium bovis
LNVDKSRSVIVLKRSMNSGFAGI

SEQ ID NO: 157877 - protein, 19 aa, Mycobacterium bovis
LPAGSPVRLCMAAVNRDGS

SEQ ID NO: 157878 - protein, 18 aa, Mycobacterium bovis
LPAPLSVHVYRLVWRQMI

SEQ ID NO: 157879 - protein, 17 aa, Mycobacterium bovis
LPAVQRLVVPSAQNGDG

SEQ ID NO: 157880 - protein, 23 aa, Mycobacterium bovis
LPDDLLSGLGLRAALSSITLGMP

SEQ ID NO: 157881 - protein, 20 aa, Mycobacterium bovis
LPDDSMRWLATVIQMDGRRI

SEQ ID NO: 157882 - protein, 18 aa, Mycobacterium bovis
LPDGRHVWEYAPRDGNVD

SEQ ID NO: 157883 - protein, 27 aa, Mycobacterium bovis
LPDTRGRIVLRWLRIAVLIVTGLVTLQ

SEQ ID NO: 157884 - protein, 18 aa, Mycobacterium bovis
LPDWSPTSSRTWATKVLA

SEQ ID NO: 157885 - protein, 29 aa, Mycobacterium bovis
LPFLLGFRLTCYYYRKAYYRSVWQSPTSC

SEQ ID NO: 157886 - protein, 22 aa, Mycobacterium bovis
LPFVILIGLIVSRQWKLLGAYA

SEQ ID NO: 157887 - protein, 24 aa, Mycobacterium bovis
LPFYHDMGFVLGLILPILAGIPAV

SEQ ID NO: 157888 - protein, 18 aa, Mycobacterium bovis
LPGVFPVPLTISGDPANW

SEQ ID NO: 157889 - protein, 17 aa, Mycobacterium bovis
LPIALGLLIMMYPVLAK

SEQ ID NO: 157890 - protein, 19 aa, Mycobacterium bovis
LPKRARLLVTAGMGMLALL

SEQ ID NO: 157891 - protein, 17 aa, Mycobacterium bovis
LPLLFFALAGQRIAERV

SEQ ID NO: 157892 - protein, 22 aa, Mycobacterium bovis
LPLWACGAADLTVRMQYTATSF

SEQ ID NO: 157893 - protein, 32 aa, Mycobacterium bovis
LPPILPRLIRRFAVVIVLLWLGFTAFVNLAVP

SEQ ID NO: 157894 - protein, 17 aa, Mycobacterium bovis
LPPPGAGAPPWYADVLL

SEQ ID NO: 157895 - protein, 18 aa, Mycobacterium bovis
LPPSINFAGPSPYIDFDA

SEQ ID NO: 157896 - protein, 23 aa, Mycobacterium bovis
LPPSVFGSGPLKWIYLTMSVQMI

SEQ ID NO: 157897 - protein, 19 aa, Mycobacterium bovis
LPRRRREWLVAGAGAFVAH

SEQ ID NO: 157898 - protein, 22 aa, Mycobacterium bovis
LPRSEALKVLAAELSRDLDFRA

SEQ ID NO: 157899 - protein, 17 aa, Mycobacterium bovis
LPTDGFQGLNVVSTIGA

SEQ ID NO: 157900 - protein, 25 aa, Mycobacterium bovis
LPTYAFARQRFWLDGLGAVGGDLGG

SEQ ID NO: 157901 - protein, 17 aa, Mycobacterium bovis
LPVPLPTHRLVLGAVLA

SEQ ID NO: 157902 - protein, 18 aa, Mycobacterium bovis
LPVVGAVALALTFAQSPG

SEQ ID NO: 157903 - protein, 28 aa, Mycobacterium bovis
LPVVTWAAWPFHRVAMRNARHHAASMET

SEQ ID NO: 157904 - protein, 26 aa, Mycobacterium bovis
LPWYAILCLPVLFAAGMCLLDTIDGS

SEQ ID NO: 157905 - protein, 22 aa, Mycobacterium bovis
LPYVMGGAMLGMIAIMVAGGTR

SEQ ID NO: 157906 - protein, 25 aa, Mycobacterium bovis
LQADRAVVVAARLDRAALAGAGAAL

SEQ ID NO: 157907 - protein, 17 aa, Mycobacterium bovis
LQGQPPLGPVLMTADAR

SEQ ID NO: 157908 - protein, 28 aa, Mycobacterium bovis
LQLASAICRHYWPLALLAAILSRRCRRV

SEQ ID NO: 157909 - protein, 17 aa, Mycobacterium bovis
LQLWGLLALVLDSLAIA

SEQ ID NO: 157910 - protein, 17 aa, Mycobacterium bovis
LQPAFKASMAVLLAAAA

SEQ ID NO: 157911 - protein, 18 aa, Mycobacterium bovis
LRAGFAYQRLARLIAEDG

SEQ ID NO: 157912 - protein, 28 aa, Mycobacterium bovis
LRAHVMATYLSRDWARDWGSLRKFDTLV

SEQ ID NO: 157913 - protein, 18 aa, Mycobacterium bovis
LRALVAPIYLIGSVLISY

SEQ ID NO: 157914 - protein, 22 aa, Mycobacterium bovis
LRALVLPWLLARAVGAEAAAQR

SEQ ID NO: 157915 - protein, 19 aa, Mycobacterium bovis
LRDAFRFEPGQHVTVRTDL

SEQ ID NO: 157916 - protein, 17 aa, Mycobacterium bovis
LRDFAVFKAIGTPTRSI

SEQ ID NO: 157917 - protein, 24 aa, Mycobacterium bovis
LRDLRIPAMAAALLVLSAILVGGL

SEQ ID NO: 157918 - protein, 24 aa, Mycobacterium bovis
LREEAAKFGVEWLPAKGFITDRLP

SEQ ID NO: 157919 - protein, 27 aa, Mycobacterium bovis
LRFMLREISCIFVAWFVLYLVLVLRAV

SEQ ID NO: 157920 - protein, 19 aa, Mycobacterium bovis
LRGNLALPVLASALLVPLF

SEQ ID NO: 157921 - protein, 22 aa, Mycobacterium bovis
LRHVLTLLLGVAVMTWLSVPLA

SEQ ID NO: 157922 - protein, 20 aa, Mycobacterium bovis
LRIASPMFHFGILVVIVGHG

SEQ ID NO: 157923 - protein, 19 aa, Mycobacterium bovis
LRIASRVGTGVGFAEDQVF

SEQ ID NO: 157924 - protein, 23 aa, Mycobacterium bovis
LRKAAMSYRGNWRDIVLLVCVLL

SEQ ID NO: 157925 - protein, 18 aa, Mycobacterium bovis
LRKIVLKTAMPGIVTGML

SEQ ID NO: 157926 - protein, 26 aa, Mycobacterium bovis
LRLLSKLSRLPLGWFTSRGSGSIKKL

SEQ ID NO: 157927 - protein, 19 aa, Mycobacterium bovis
LRLSRIDKPGVARVLDVVH

SEQ ID NO: 157928 - protein, 19 aa, Mycobacterium bovis
LRLTVAFVVGHIGATLLVA

SEQ ID NO: 157929 - protein, 17 aa, Mycobacterium bovis
LRPLAEFEQTAAAIGAG

SEQ ID NO: 157930 - protein, 19 aa, Mycobacterium bovis
LRPLRRVAATAAEVATMPL

SEQ ID NO: 157931 - protein, 18 aa, Mycobacterium bovis
LRPRLGVGAGAPAPAVVT

SEQ ID NO: 157932 - protein, 17 aa, Mycobacterium bovis
LRPTTFFLSITVLINSL

SEQ ID NO: 157933 - protein, 17 aa, Mycobacterium bovis
LRQLPVLIGSVVLGSAT

SEQ ID NO: 157934 - protein, 20 aa, Mycobacterium bovis
LRQLRWALSEVQRGNYNAHM

SEQ ID NO: 157935 - protein, 17 aa, Mycobacterium bovis
LRQLWLKLTLRGTETAP

SEQ ID NO: 157936 - protein, 23 aa, Mycobacterium bovis
LRRDRTSFIIAHRLSTIRDADHI

SEQ ID NO: 157937 - protein, 17 aa, Mycobacterium bovis
LRREPREAIIACYVAME

SEQ ID NO: 157938 - protein, 19 aa, Mycobacterium bovis
LRRFRSMGRLEPFAFTAVD

SEQ ID NO: 157939 - protein, 17 aa, Mycobacterium bovis
LRRGELDSGTSTPATNY

SEQ ID NO: 157940 - protein, 25 aa, Mycobacterium bovis
LRRGLRIALRGRRDPLPVAGRRSRT

SEQ ID NO: 157941 - protein, 17 aa, Mycobacterium bovis
LRRGQKMIIGMRGSYGG

SEQ ID NO: 157942 - protein, 24 aa, Mycobacterium bovis
LRRGWAMAAICFIAVAVAAAVLGR

SEQ ID NO: 157943 - protein, 17 aa, Mycobacterium bovis
LRRTRRAISELLRGNQD

SEQ ID NO: 157944 - protein, 26 aa, Mycobacterium bovis
LRSLAELWPYASGTLHRPGGENETMF

SEQ ID NO: 157945 - protein, 17 aa, Mycobacterium bovis
LRSLFRVGLDPRNVAVI

SEQ ID NO: 157946 - protein, 20 aa, Mycobacterium bovis
LRSPGPLGIIFSLVCIGIAA

SEQ ID NO: 157947 - protein, 24 aa, Mycobacterium bovis
LRTELLRRGIVFAMARVKQDLRES

SEQ ID NO: 157948 - protein, 25 aa, Mycobacterium bovis
LRTNSEILSGIGISLLSPLALATNG

SEQ ID NO: 157949 - protein, 17 aa, Mycobacterium bovis
LRTPLAAIQGYAELTRQ

SEQ ID NO: 157950 - protein, 17 aa, Mycobacterium bovis
LRVFERFYRADSSRARA

SEQ ID NO: 157951 - protein, 18 aa, Mycobacterium bovis
LRWRASQLTLAIATCAGV

SEQ ID NO: 157952 - protein, 22 aa, Mycobacterium bovis
LRYFPDLVVVLALLAAVALQAP

SEQ ID NO: 157953 - protein, 21 aa, Mycobacterium bovis
LSAAALWLLFANRMGYPVSTT

SEQ ID NO: 157954 - protein, 19 aa, Mycobacterium bovis
LSAFVVFSSMAGIVGTPAQ

SEQ ID NO: 157955 - protein, 23 aa, Mycobacterium bovis
LSAGCGPGSLLVAAQQWQELSDQ

SEQ ID NO: 157956 - protein, 26 aa, Mycobacterium bovis
LSALSRAVAVAWRRSLQLRVVALTLG

SEQ ID NO: 157957 - protein, 28 aa, Mycobacterium bovis
LSAPLIEHQRHWSLRRGVGASGPQEAAA

SEQ ID NO: 157958 - protein, 25 aa, Mycobacterium bovis
LSAVSSRAGVEIAIDDNGSGVPEGE

SEQ ID NO: 157959 - protein, 18 aa, Mycobacterium bovis
LSDAALVSHSWAMAFATL

SEQ ID NO: 157960 - protein, 18 aa, Mycobacterium bovis
LSDRLATLLAQFLDDPRW

SEQ ID NO: 157961 - protein, 19 aa, Mycobacterium bovis
LSGAVAWLISLFYKAIYTG

SEQ ID NO: 157962 - protein, 24 aa, Mycobacterium bovis
LSGFAHSWFFLFLFVVAGLVALYI

SEQ ID NO: 157963 - protein, 20 aa, Mycobacterium bovis
LSGLAEFGLAVNMQAIVFMS

SEQ ID NO: 157964 - protein, 20 aa, Mycobacterium bovis
LSGLDLPAWGSLRLAMPSSG

SEQ ID NO: 157965 - protein, 22 aa, Mycobacterium bovis
LSGLSINRFIAIDFVGFARMVE

SEQ ID NO: 157966 - protein, 23 aa, Mycobacterium bovis
LSGYVMRHRRDLLLGFGAALAGT

SEQ ID NO: 157967 - protein, 20 aa, Mycobacterium bovis
LSLTAAFGALVWIFQEGHFG

SEQ ID NO: 157968 - protein, 19 aa, Mycobacterium bovis
LSMAPLWFSSYILQLRVPT

SEQ ID NO: 157969 - protein, 19 aa, Mycobacterium bovis
LSMTLPILIPFVYFSHALN

SEQ ID NO: 157970 - protein, 34 aa, Mycobacterium bovis
LSNLPMGVPLEWNVFFIFSLCYLFGHYGAITATD

SEQ ID NO: 157971 - protein, 19 aa, Mycobacterium bovis
LSPEQWFAFTPPRVPVLES

SEQ ID NO: 157972 - protein, 17 aa, Mycobacterium bovis
LSPRTGRRPETPAYGSW

SEQ ID NO: 157973 - protein, 24 aa, Mycobacterium bovis
LSPYMLMMPLMMIVMMVGGLAGST

SEQ ID NO: 157974 - protein, 18 aa, Mycobacterium bovis
LSQCRTGADANRFVQCRV

SEQ ID NO: 157975 - protein, 23 aa, Mycobacterium bovis
LSRLPLLSIDGYRRLQVRSGHTL

SEQ ID NO: 157976 - protein, 26 aa, Mycobacterium bovis
LSTPEFPWSALTIVLLIGVLAAAVGA

SEQ ID NO: 157977 - protein, 36 aa, Mycobacterium bovis
LSVLACGYILASLHWYTWLAFSGWVAVAVIFYLMWG

SEQ ID NO: 157978 - protein, 20 aa, Mycobacterium bovis
LSVLMLVGGILFQIVTGVLN

SEQ ID NO: 157979 - protein, 24 aa, Mycobacterium bovis
LSVTAVAVLFGWGSWQRRWIADDG

SEQ ID NO: 157980 - protein, 22 aa, Mycobacterium bovis
LSYGLAVILGFIGVKLMLEALH

SEQ ID NO: 157981 - protein, 18 aa, Mycobacterium bovis
LSYMALFSVPVVAPLLLR

SEQ ID NO: 157982 - protein, 22 aa, Mycobacterium bovis
LTALTWIRFGIWLVAGTAIYVG

SEQ ID NO: 157983 - protein, 19 aa, Mycobacterium bovis
LTARPGMLTAVIGPSGAGK

SEQ ID NO: 157984 - protein, 20 aa, Mycobacterium bovis
LTDRAADVVVLIDMYRQPAG

SEQ ID NO: 157985 - protein, 17 aa, Mycobacterium bovis
LTDVAGFDAEFFGIAPS

SEQ ID NO: 157986 - protein, 23 aa, Mycobacterium bovis
LTELPVIMVIVALVTQWARQDRR

SEQ ID NO: 157987 - protein, 18 aa, Mycobacterium bovis
LTEPRPWHVPGRPRRAGV

SEQ ID NO: 157988 - protein, 17 aa, Mycobacterium bovis
LTFGGLMLLGGRLGDTI

SEQ ID NO: 157989 - protein, 19 aa, Mycobacterium bovis
LTFLDCLYYAAVTLSTTGY

SEQ ID NO: 157990 - protein, 20 aa, Mycobacterium bovis
LTGGAWQWSASKNSRLNMVS

SEQ ID NO: 157991 - protein, 24 aa, Mycobacterium bovis
LTGRTPLPPRRDWQLDTLDTELRR

SEQ ID NO: 157992 - protein, 22 aa, Mycobacterium bovis
LTHGFFKAGLFLGSGAVIHAMH

SEQ ID NO: 157993 - protein, 25 aa, Mycobacterium bovis
LTINASSVALIWFGGLRIDSGQMQV

SEQ ID NO: 157994 - protein, 22 aa, Mycobacterium bovis
LTKHYPGRVVFLGVNLAIALIL

SEQ ID NO: 157995 - protein, 17 aa, Mycobacterium bovis
LTLAAWGAWRPHYRAAS

SEQ ID NO: 157996 - protein, 29 aa, Mycobacterium bovis
LTLLLARWLLFRVEFGAGLIKMRGDSCWR

SEQ ID NO: 157997 - protein, 17 aa, Mycobacterium bovis
LTLPGIRDALAARTDDS

SEQ ID NO: 157998 - protein, 25 aa, Mycobacterium bovis
LTLWLHVIDARFARALRLRLLSKLS

SEQ ID NO: 157999 - protein, 19 aa, Mycobacterium bovis
LTMLTRWAPRAPGPIIAVL

SEQ ID NO: 158000 - protein, 27 aa, Mycobacterium bovis
LTMTGPRPGGFGALDGRTNEICAQGDL

SEQ ID NO: 158001 - protein, 17 aa, Mycobacterium bovis
LTPAVFLLYFLLRRDGR

SEQ ID NO: 158002 - protein, 17 aa, Mycobacterium bovis
LTPEERAELSARLTEDT

SEQ ID NO: 158003 - protein, 23 aa, Mycobacterium bovis
LTPSLAPWVALRLLPQGPTLSRA

SEQ ID NO: 158004 - protein, 31 aa, Mycobacterium bovis
LTQLCGAPQWVRWALFLACYATGGWEPGLAG

SEQ ID NO: 158005 - protein, 17 aa, Mycobacterium bovis
LTRTFIRFWTVSFPVVA

SEQ ID NO: 158006 - protein, 19 aa, Mycobacterium bovis
LTRVIEVPYVLPFLAEGRI

SEQ ID NO: 158007 - protein, 23 aa, Mycobacterium bovis
LTRYRPRVRVGFASRLADAAVIA

SEQ ID NO: 158008 - protein, 22 aa, Mycobacterium bovis
LTSCYGGALVRFRAEGRTITVV

SEQ ID NO: 158009 - protein, 18 aa, Mycobacterium bovis
LTSGFVSKFAVFRAAASA

SEQ ID NO: 158010 - protein, 18 aa, Mycobacterium bovis
LTTGRGMLTQAARVQLAV

SEQ ID NO: 158011 - protein, 25 aa, Mycobacterium bovis
LTTPLRRLDLLAGYGTAFSIAAAAQ

SEQ ID NO: 158012 - protein, 17 aa, Mycobacterium bovis
LTTVLSKLPEGSEVTLN

SEQ ID NO: 158013 - protein, 20 aa, Mycobacterium bovis
LTVTLVWLYIEILRLLSYLQ

SEQ ID NO: 158014 - protein, 19 aa, Mycobacterium bovis
LTWLFAFVVILALSSTIVL

SEQ ID NO: 158015 - protein, 20 aa, Mycobacterium bovis
LTYLDVCDQVLLLAPGGKTA

SEQ ID NO: 158016 - protein, 18 aa, Mycobacterium bovis
LVAAAGFYCYGLTHVLYL

SEQ ID NO: 158017 - protein, 20 aa, Mycobacterium bovis
LVAGALSGAVAWLISLFYKA

SEQ ID NO: 158018 - protein, 17 aa, Mycobacterium bovis
LVAIAGLAGLGIANQSI

SEQ ID NO: 158019 - protein, 18 aa, Mycobacterium bovis
LVAIGAGLIFPRFEQLLE

SEQ ID NO: 158020 - protein, 30 aa, Mycobacterium bovis
LVAIPVSIALLWSLRFGPRVLGPDDTERAI

SEQ ID NO: 158021 - protein, 30 aa, Mycobacterium bovis
LVAIVAAAGYLVLRPSWSPTQASGQTVLPF

SEQ ID NO: 158022 - protein, 18 aa, Mycobacterium bovis
LVALPLSLGIAIASGAPI

SEQ ID NO: 158023 - protein, 17 aa, Mycobacterium bovis
LVASRWLLRPTAAEALS

SEQ ID NO: 158024 - protein, 29 aa, Mycobacterium bovis
LVAVAPRIGAWVVAAWLAGIILNLVTGPG

SEQ ID NO: 158025 - protein, 24 aa, Mycobacterium bovis
LVCAIGLSGGYAFSVFLQGVNPGA

SEQ ID NO: 158026 - protein, 30 aa, Mycobacterium bovis
LVDVDFWLRLMLRSAVCFVPHELSVRRHTA

SEQ ID NO: 158027 - protein, 18 aa, Mycobacterium bovis
LVDVIGCSLRLPGIYPPQ

SEQ ID NO: 158028 - protein, 25 aa, Mycobacterium bovis
LVFGLFVRKGWDIVIGLVVLFVYGG

SEQ ID NO: 158029 - protein, 20 aa, Mycobacterium bovis
LVGACAAVWLVFTGVSVAAA

SEQ ID NO: 158030 - protein, 26 aa, Mycobacterium bovis
LVGAVVPHVRWPMWLRTAVATAALAA

SEQ ID NO: 158031 - protein, 17 aa, Mycobacterium bovis
LVGCGLTAIALEIEKWW

SEQ ID NO: 158032 - protein, 24 aa, Mycobacterium bovis
LVGGGLFASFSLRTEGALMAASGD

SEQ ID NO: 158033 - protein, 21 aa, Mycobacterium bovis
LVGGLAWPFLLLPQLGMIRGA

SEQ ID NO: 158034 - protein, 29 aa, Mycobacterium bovis
LVGVLVLLKAVAYWLDRYELLSHTRGGKP

SEQ ID NO: 158035 - protein, 24 aa, Mycobacterium bovis
LVHAFSAPIAYLFRPYIVYRSREV

SEQ ID NO: 158036 - protein, 36 aa, Mycobacterium bovis
LVHWSRRPASTQSWFWSRWVGWVMRRPWITALAAST

SEQ ID NO: 158037 - protein, 18 aa, Mycobacterium bovis
LVIATLFLVRSMNQQLKK

SEQ ID NO: 158038 - protein, 17 aa, Mycobacterium bovis
LVICLGALLWSFISPSG

SEQ ID NO: 158039 - protein, 23 aa, Mycobacterium bovis
LVIPCLLLAWAVSHPSLPFAVLV

SEQ ID NO: 158040 - protein, 17 aa, Mycobacterium bovis
LVISPVLLAVRPELQQA

SEQ ID NO: 158041 - protein, 26 aa, Mycobacterium bovis
LVIVGWLTLWPFLSWLTTHFVVTNRR

SEQ ID NO: 158042 - protein, 24 aa, Mycobacterium bovis
LVKRGWMVLVAVAVVAVAGFSVYR

SEQ ID NO: 158043 - protein, 27 aa, Mycobacterium bovis
LVLTESGLRPGWHRVPGVSASGSDSAV

SEQ ID NO: 158044 - protein, 17 aa, Mycobacterium bovis
LVLTWIVLNLFAVGLRW

SEQ ID NO: 158045 - protein, 26 aa, Mycobacterium bovis
LVLYRRRRISLSPRPERGVVDRSGGY

SEQ ID NO: 158046 - protein, 27 aa, Mycobacterium bovis
LVNRVMKRPVLFAAPIVIIMILLIIPV

SEQ ID NO: 158047 - protein, 17 aa, Mycobacterium bovis
LVPAPARLRRLWLAVLI

SEQ ID NO: 158048 - protein, 20 aa, Mycobacterium bovis
LVQYLRYLGGILHGDLGRAY

SEQ ID NO: 158049 - protein, 18 aa, Mycobacterium bovis
LVRELRADRGPVLLITAV

SEQ ID NO: 158050 - protein, 21 aa, Mycobacterium bovis
LVRHVEKWAKVRGDKLAYRFL

SEQ ID NO: 158051 - protein, 17 aa, Mycobacterium bovis
LVSDAIAALTAVNSELG

SEQ ID NO: 158052 - protein, 32 aa, Mycobacterium bovis
LVSGICGAFGYGLGVFAVWLVRYMRSHNSSPP

SEQ ID NO: 158053 - protein, 17 aa, Mycobacterium bovis
LVTRAAILVGLFLAAVA

SEQ ID NO: 158054 - protein, 19 aa, Mycobacterium bovis
LVVAIVFLLVRVVRAPVEV

SEQ ID NO: 158055 - protein, 18 aa, Mycobacterium bovis
LVVFPALFAAIITSAGGV

SEQ ID NO: 158056 - protein, 20 aa, Mycobacterium bovis
LVVSTSLAWTGRVAPPGTFG

SEQ ID NO: 158057 - protein, 22 aa, Mycobacterium bovis
LVYVRLARPFIAFYNNCANAIL

SEQ ID NO: 158058 - protein, 19 aa, Mycobacterium bovis
LWAGYACSTLIIFPLVVYG

SEQ ID NO: 158059 - protein, 18 aa, Mycobacterium bovis
LWGAMTFGPFIAHHIAPV

SEQ ID NO: 158060 - protein, 17 aa, Mycobacterium bovis
LWGLLALVLDSLAIAAQ

SEQ ID NO: 158061 - protein, 18 aa, Mycobacterium bovis
LWISLVVLWLFVLVPMLI

SEQ ID NO: 158062 - protein, 25 aa, Mycobacterium bovis
LWNRVRERFGLVGLFVGSALVSIAA

SEQ ID NO: 158063 - protein, 18 aa, Mycobacterium bovis
LWQARLAPDAKPYQGGHR

SEQ ID NO: 158064 - protein, 24 aa, Mycobacterium bovis
LWQHILAIHLHWLVLAMSVIVLLA

SEQ ID NO: 158065 - protein, 19 aa, Mycobacterium bovis
LWTANWRFVAQNTDYFTQG

SEQ ID NO: 158066 - protein, 17 aa, Mycobacterium bovis
LWVAFWFFLAQLNLILA

SEQ ID NO: 158067 - protein, 21 aa, Mycobacterium bovis
LYAFLCATALMVVRIEERHTR

SEQ ID NO: 158068 - protein, 25 aa, Mycobacterium bovis
LYFWLPCLACLLAVAELQLRSLRLT

SEQ ID NO: 158069 - protein, 23 aa, Mycobacterium bovis
LYGIARFQGVLPFNPTDKPAVTD

SEQ ID NO: 158070 - protein, 30 aa, Mycobacterium bovis
LYGIFIVWLLHDWRDVFWINVPLTAIAMVM

SEQ ID NO: 158071 - protein, 18 aa, Mycobacterium bovis
LYGRRGARNRAMRAVTEA

SEQ ID NO: 158072 - protein, 20 aa, Mycobacterium bovis
LYLAAALMIWAQARLLNLTV

SEQ ID NO: 158073 - protein, 23 aa, Mycobacterium bovis
LYLNYVWHYSLLKAGFAIAPAAV

SEQ ID NO: 158074 - protein, 22 aa, Mycobacterium bovis
LYPPCLFKLLTGWNCPACGGLR

SEQ ID NO: 158075 - protein, 20 aa, Mycobacterium bovis
LYRIRVGHRIGSAALIADGL

SEQ ID NO: 158076 - protein, 19 aa, Mycobacterium bovis
LYTGTGAFEVVGRRRLWFG

SEQ ID NO: 158077 - protein, 26 aa, Mycobacterium bovis
LYVISSWRPVLLIPLTFALFTPLAVP

SEQ ID NO: 158078 - protein, 17 aa, Mycobacterium bovis
LYYPPAVISVVLAGACL

SEQ ID NO: 158079 - protein, 25 aa, Mycobacterium bovis
MAILGWASGLGFGWINTLGTANVVR

SEQ ID NO: 158080 - protein, 18 aa, Mycobacterium bovis
MAIRREAEQFVGIELSAT

SEQ ID NO: 158081 - protein, 19 aa, Mycobacterium bovis
MALRRMKVVAVGFLVGATG

SEQ ID NO: 158082 - protein, 30 aa, Mycobacterium bovis
MAMFDRWNWWLPRWLAHILPSVDFDRPLPK

SEQ ID NO: 158083 - protein, 19 aa, Mycobacterium bovis
MAPTLTWLFAFVVILALSS

SEQ ID NO: 158084 - protein, 21 aa, Mycobacterium bovis
MCVLAALIRGLARKRASTLGN

SEQ ID NO: 158085 - protein, 19 aa, Mycobacterium bovis
MDAFQALLRWDGRQQDRWS

SEQ ID NO: 158086 - protein, 29 aa, Mycobacterium bovis
MDHNFALRKAELDAGYILTCQSHPTTPFV

SEQ ID NO: 158087 - protein, 17 aa, Mycobacterium bovis
MDLGMCLNRFTYDSKLA

SEQ ID NO: 158088 - protein, 24 aa, Mycobacterium bovis
MDRIGAYERYWLYPGAQNLATFRA

SEQ ID NO: 158089 - protein, 21 aa, Mycobacterium bovis
MEEVLAIKPDICFLWDEAWYA

SEQ ID NO: 158090 - protein, 24 aa, Mycobacterium bovis
MEFICSSIQAGSRLGYQESAELCA

SEQ ID NO: 158091 - protein, 25 aa, Mycobacterium bovis
MELNRAALELAAFAAFGSAASATEW

SEQ ID NO: 158092 - protein, 24 aa, Mycobacterium bovis
MESEFPSELSVLFKNLETKGNPWG

SEQ ID NO: 158093 - protein, 21 aa, Mycobacterium bovis
MGAQLCATAPVFAEHIHRCER

SEQ ID NO: 158094 - protein, 18 aa, Mycobacterium bovis
MGGACGTCRAKLIEGNVE

SEQ ID NO: 158095 - protein, 17 aa, Mycobacterium bovis
MGGGFIGVDAFFVLSGF

SEQ ID NO: 158096 - protein, 18 aa, Mycobacterium bovis
MGGTCAVDLTVMHPTLFS

SEQ ID NO: 158097 - protein, 25 aa, Mycobacterium bovis
MGKLFAGACVVWFFVLFDMLDGAMA

SEQ ID NO: 158098 - protein, 17 aa, Mycobacterium bovis
MGLLGLVGSEAVVDARL

SEQ ID NO: 158099 - protein, 19 aa, Mycobacterium bovis
MGLMVGLFIPLFVGCPVIL

SEQ ID NO: 158100 - protein, 17 aa, Mycobacterium bovis
MGRDGLLPARFAKVNPR

SEQ ID NO: 158101 - protein, 18 aa, Mycobacterium bovis
MIAGIYGMNFHFMPELDS

SEQ ID NO: 158102 - protein, 17 aa, Mycobacterium bovis
MIAQLVFAMGGRAAEEL

SEQ ID NO: 158103 - protein, 19 aa, Mycobacterium bovis
MIEHGHWGLAAAYSVVSIT

SEQ ID NO: 158104 - protein, 24 aa, Mycobacterium bovis
MIFSTSRLKPWGIAHIQRGALAAV

SEQ ID NO: 158105 - protein, 18 aa, Mycobacterium bovis
MIPLIGVRAACAATGRAP

SEQ ID NO: 158106 - protein, 20 aa, Mycobacterium bovis
MKILRPGRLTGELPPGAVRI

SEQ ID NO: 158107 - protein, 24 aa, Mycobacterium bovis
MKSAEAWAVGFVELITGLVNFEPW

SEQ ID NO: 158108 - protein, 17 aa, Mycobacterium bovis
MKVTFHYQNKYKVPANA

SEQ ID NO: 158109 - protein, 21 aa, Mycobacterium bovis
MKYQPEWVPRYACYEDARVIP

SEQ ID NO: 158110 - protein, 29 aa, Mycobacterium bovis
MLAALWAVYTPRWWLSGLLVGVASGVKLT

SEQ ID NO: 158111 - protein, 18 aa, Mycobacterium bovis
MLALLLFGPRLVDIYVDW

SEQ ID NO: 158112 - protein, 19 aa, Mycobacterium bovis
MLHRVVGGVGLKAFWYHFA

SEQ ID NO: 158113 - protein, 24 aa, Mycobacterium bovis
MLSVIRLALIPAFVYVVLSAHANG

SEQ ID NO: 158114 - protein, 21 aa, Mycobacterium bovis
MLTTLPKFPGLPGLPSLPDII

SEQ ID NO: 158115 - protein, 17 aa, Mycobacterium bovis
MMAGLLVSLLVRRRRVW

SEQ ID NO: 158116 - protein, 18 aa, Mycobacterium bovis
MMLLNVLKPTGIVGDSAI

SEQ ID NO: 158117 - protein, 23 aa, Mycobacterium bovis
MNNRCPLTSYVLIGFSQGAVIAG

SEQ ID NO: 158118 - protein, 17 aa, Mycobacterium bovis
MPAFPPYVPTLLPPPPP

SEQ ID NO: 158119 - protein, 17 aa, Mycobacterium bovis
MPEPVVERYRLGEQTIA

SEQ ID NO: 158120 - protein, 17 aa, Mycobacterium bovis
MPGDIPFQVQLPSTPLA

SEQ ID NO: 158121 - protein, 23 aa, Mycobacterium bovis
MPGPEVTEIITAVAEALDYAHER

SEQ ID NO: 158122 - protein, 23 aa, Mycobacterium bovis
MPLLGRASDRFGRKLMLQVSLAG

SEQ ID NO: 158123 - protein, 18 aa, Mycobacterium bovis
MPLWAFVIAMVLLRSSLA

SEQ ID NO: 158124 - protein, 17 aa, Mycobacterium bovis
MPRAMPATAAFPPPAGP

SEQ ID NO: 158125 - protein, 17 aa, Mycobacterium bovis
MPVLALATWQFRRASNW

SEQ ID NO: 158126 - protein, 27 aa, Mycobacterium bovis
MPVLLFCIAFGLSMDYEVFLVSRIREY

SEQ ID NO: 158127 - protein, 17 aa, Mycobacterium bovis
MQHLISLGPNAPSPSQL

SEQ ID NO: 158128 - protein, 22 aa, Mycobacterium bovis
MQWRKRRLVITIISTGLIFGMT

SEQ ID NO: 158129 - protein, 26 aa, Mycobacterium bovis
MRAMRRAGKVFNEFDSNSIAMVVLES

SEQ ID NO: 158130 - protein, 21 aa, Mycobacterium bovis
MREIAYGVARTRLMHAGASES

SEQ ID NO: 158131 - protein, 18 aa, Mycobacterium bovis
MRLRDMLWAAIFPSLDLA

SEQ ID NO: 158132 - protein, 17 aa, Mycobacterium bovis
MRRSLQFGALTAEELMT

SEQ ID NO: 158133 - protein, 19 aa, Mycobacterium bovis
MRSAFYAGYEEADREYVQI

SEQ ID NO: 158134 - protein, 19 aa, Mycobacterium bovis
MRYRSGGPFADAVAAVRAG

SEQ ID NO: 158135 - protein, 26 aa, Mycobacterium bovis
MSATALFPMYFLKSFAYAGVATVAFV

SEQ ID NO: 158136 - protein, 25 aa, Mycobacterium bovis
MSGPLHLGGICWRGRNQRPVITGTT

SEQ ID NO: 158137 - protein, 20 aa, Mycobacterium bovis
MSLNTSYYRLMLKLNGGPQA

SEQ ID NO: 158138 - protein, 23 aa, Mycobacterium bovis
MSRGELDRTLLLWMLPLLIAPPM

SEQ ID NO: 158139 - protein, 32 aa, Mycobacterium bovis
MSRRFAVLVLLFCLFGVLFVLLRRGRVAGLAS

SEQ ID NO: 158140 - protein, 24 aa, Mycobacterium bovis
MTASCKHPMIFPLSNPTSRMEAIP

SEQ ID NO: 158141 - protein, 26 aa, Mycobacterium bovis
MTLPRPRDLAPLLAAWVISVGVMVFE

SEQ ID NO: 158142 - protein, 19 aa, Mycobacterium bovis
MTLVLTGLVNGFRVEAERT

SEQ ID NO: 158143 - protein, 33 aa, Mycobacterium bovis
MTPALATLLGRWFWWPRRVDRLARQPQVLGPRR

SEQ ID NO: 158144 - protein, 30 aa, Mycobacterium bovis
MTPSIAALLGRWFWWPLRVRPRPASQMLRP

SEQ ID NO: 158145 - protein, 29 aa, Mycobacterium bovis
MTPSIAALLGRWFWWPLRVRSRPARTPTV

SEQ ID NO: 158146 - protein, 28 aa, Mycobacterium bovis
MTPSIAALLGRWFWWPNMIHSRPTVPEA

SEQ ID NO: 158147 - protein, 18 aa, Mycobacterium bovis
MTRYYAAQRTFWVDPVSG

SEQ ID NO: 158148 - protein, 20 aa, Mycobacterium bovis
MTSARLARIAPISREMVLNF

SEQ ID NO: 158149 - protein, 21 aa, Mycobacterium bovis
MTWSQLYSRVTAVSAYLISYG

SEQ ID NO: 158150 - protein, 27 aa, Mycobacterium bovis
MVARIAQLRWPVAIAVGPALTYGVVAL

SEQ ID NO: 158151 - protein, 20 aa, Mycobacterium bovis
MVFGELVPKYLAVARPLRTA

SEQ ID NO: 158152 - protein, 17 aa, Mycobacterium bovis
MVNSCLGLWQKIVFGRR

SEQ ID NO: 158153 - protein, 21 aa, Mycobacterium bovis
MVPLTAWLCGAYSAVRHLDLT

SEQ ID NO: 158154 - protein, 36 aa, Mycobacterium bovis
MVVVPAFMHVTGRWNWWAPRPLAWLHERFGVSEAAE

SEQ ID NO: 158155 - protein, 25 aa, Mycobacterium bovis
MWLGRLRFGALYAVSALGGSVLVYL

SEQ ID NO: 158156 - protein, 20 aa, Mycobacterium bovis
MYKQATWKRVAVLFAGPGMN

SEQ ID NO: 158157 - protein, 27 aa, Mycobacterium bovis
NAAMVARRAPRRWGVRSTVRDLDQQAV

SEQ ID NO: 158158 - protein, 21 aa, Mycobacterium bovis
NAAPLRIMILLVLVTALGSAL

SEQ ID NO: 158159 - protein, 22 aa, Mycobacterium bovis
NAELLLLCFAAVITFAALLVVQ

SEQ ID NO: 158160 - protein, 17 aa, Mycobacterium bovis
NAIWKAFDLFVGAIQAF

SEQ ID NO: 158161 - protein, 25 aa, Mycobacterium bovis
NALNEGRGDFFAVVRSLALFVNALH

SEQ ID NO: 158162 - protein, 31 aa, Mycobacterium bovis
NAVEPPKGPAWRRIRVSQLLIGVSAVVAMTA

SEQ ID NO: 158163 - protein, 19 aa, Mycobacterium bovis
NAVVAFAVIGFASLAVAVA

SEQ ID NO: 158164 - protein, 18 aa, Mycobacterium bovis
NDAALVRDGTRWQIVGDP

SEQ ID NO: 158165 - protein, 24 aa, Mycobacterium bovis
NDGKEVPANLVGRDPKTDLAVLKV

SEQ ID NO: 158166 - protein, 28 aa, Mycobacterium bovis
NDHRARLIGFALLAFCSVVARAVGTVLL

SEQ ID NO: 158167 - protein, 19 aa, Mycobacterium bovis
NDPVAVPWVLSARSAQALT

SEQ ID NO: 158168 - protein, 43 aa, Mycobacterium bovis
NDYRPNLFVTYWSFRMMIGLMAIPVLFALIALWLTRGGQIPNQ

SEQ ID NO: 158169 - protein, 17 aa, Mycobacterium bovis
NEARWVRGAVPFEGDVG

SEQ ID NO: 158170 - protein, 18 aa, Mycobacterium bovis
NEDLPLLQPLRGIVPEPL

SEQ ID NO: 158171 - protein, 24 aa, Mycobacterium bovis
NERAYPGFVRRVMTSAVPFGLVIG

SEQ ID NO: 158172 - protein, 17 aa, Mycobacterium bovis
NFPDTNFAWSFVLALLA

SEQ ID NO: 158173 - protein, 18 aa, Mycobacterium bovis
NGGAWLVLLMIFNVIWTY

SEQ ID NO: 158174 - protein, 24 aa, Mycobacterium bovis
NGGISFGGVIAFIFADLLILPILN

SEQ ID NO: 158175 - protein, 18 aa, Mycobacterium bovis
NGPRMPMVPGTWEQGSNE

SEQ ID NO: 158176 - protein, 18 aa, Mycobacterium bovis
NGQTVFRVRLPMIEQQIA

SEQ ID NO: 158177 - protein, 23 aa, Mycobacterium bovis
NGSGPRFTAPMSKTGVPYGGILL

SEQ ID NO: 158178 - protein, 17 aa, Mycobacterium bovis
NHYFARDPLKPEVTFAD

SEQ ID NO: 158179 - protein, 26 aa, Mycobacterium bovis
NIGIMIVSLIGWWALSRLLERMRGIP

SEQ ID NO: 158180 - protein, 21 aa, Mycobacterium bovis
NIVAAVLCHRLVVLIGVTLIV

SEQ ID NO: 158181 - protein, 23 aa, Mycobacterium bovis
NKAWKGTTTYTFRRKVATLVDNV

SEQ ID NO: 158182 - protein, 26 aa, Mycobacterium bovis
NLGQTARLYIRPVLNSMPAQPAAEEP

SEQ ID NO: 158183 - protein, 19 aa, Mycobacterium bovis
NLPLRTAMARRRYVETTNV

SEQ ID NO: 158184 - protein, 18 aa, Mycobacterium bovis
NLRGKWRVTPGVAATGNL

SEQ ID NO: 158185 - protein, 26 aa, Mycobacterium bovis
NNAFIPRFLFAVSFCGVLVATATYLH

SEQ ID NO: 158186 - protein, 27 aa, Mycobacterium bovis
NNHGGLFPTSWLPLLIVTSGVVFAYSA

SEQ ID NO: 158187 - protein, 17 aa, Mycobacterium bovis
NPETGKYGPIYDEKTGT

SEQ ID NO: 158188 - protein, 18 aa, Mycobacterium bovis
NPEVWAWMVWLPHNLHDE

SEQ ID NO: 158189 - protein, 26 aa, Mycobacterium bovis
NPPPVPIPWSVLSLFVPGPTLSRADA

SEQ ID NO: 158190 - protein, 18 aa, Mycobacterium bovis
NPQFAFVRIDSGKPNFRI

SEQ ID NO: 158191 - protein, 19 aa, Mycobacterium bovis
NPRKSCLRNVDRFRPGLLD

SEQ ID NO: 158192 - protein, 20 aa, Mycobacterium bovis
NPSQYWGLKGLIGVNAVAAD

SEQ ID NO: 158193 - protein, 17 aa, Mycobacterium bovis
NPVIFWTPEHGAFVVRG

SEQ ID NO: 158194 - protein, 23 aa, Mycobacterium bovis
NQNRIRWGNLLTLPVAQGGLLYV

SEQ ID NO: 158195 - protein, 17 aa, Mycobacterium bovis
NQQMLWTLVGVAAFALV

SEQ ID NO: 158196 - protein, 25 aa, Mycobacterium bovis
NRLFIPRFLFSMGVIGVVAATSCYL

SEQ ID NO: 158197 - protein, 18 aa, Mycobacterium bovis
NRNLGWLFLFKQGNVSLA

SEQ ID NO: 158198 - protein, 21 aa, Mycobacterium bovis
NRVGAEWLFTPVLLSQNYHLV

SEQ ID NO: 158199 - protein, 25 aa, Mycobacterium bovis
NRWWTWTLLAGPGWVAFGATKQIIG

SEQ ID NO: 158200 - protein, 24 aa, Mycobacterium bovis
NSFALRGRWALDYQGATSDGNDAA

SEQ ID NO: 158201 - protein, 19 aa, Mycobacterium bovis
NSVEFCCLFYGAAKLGAVA

SEQ ID NO: 158202 - protein, 23 aa, Mycobacterium bovis
NTQPGWVVAPGMQGVQVGPITQG

SEQ ID NO: 158203 - protein, 23 aa, Mycobacterium bovis
NTRNVFGPPAWAPVVNNVVAIAT

SEQ ID NO: 158204 - protein, 19 aa, Mycobacterium bovis
NTYSRLALGIGIHDITAGY

SEQ ID NO: 158205 - protein, 18 aa, Mycobacterium bovis
NVDLAALVRAAAAHVLPD

SEQ ID NO: 158206 - protein, 18 aa, Mycobacterium bovis
NVFTRINAILGVLLLIVL

SEQ ID NO: 158207 - protein, 19 aa, Mycobacterium bovis
NVKDVKCNNGSDPTVKKGA

SEQ ID NO: 158208 - protein, 25 aa, Mycobacterium bovis
NVLRVWPEIVGAIVLLVIAAMGIGH

SEQ ID NO: 158209 - protein, 18 aa, Mycobacterium bovis
NVRMAMLVAAAWLALLGL

SEQ ID NO: 158210 - protein, 19 aa, Mycobacterium bovis
NVVIGWPFVGLLALGLVYV

SEQ ID NO: 158211 - protein, 28 aa, Mycobacterium bovis
NWAILIIPFALCFAFGKMVHDRRQGWAV

SEQ ID NO: 158212 - protein, 24 aa, Mycobacterium bovis
NWIVRRLGIEPAEELRSARTPQEL

SEQ ID NO: 158213 - protein, 26 aa, Mycobacterium bovis
NYFLTEPRYTWTIAEPDAAVTEFVLL

SEQ ID NO: 158214 - protein, 24 aa, Mycobacterium bovis
NYPPPCLTGFLPASEWRSPADTSP

SEQ ID NO: 158215 - protein, 19 aa, Mycobacterium bovis
PAAAPIEHWAAGDADPLGN

SEQ ID NO: 158216 - protein, 18 aa, Mycobacterium bovis
PAAGLWASIAPLAIYALL

SEQ ID NO: 158217 - protein, 23 aa, Mycobacterium bovis
PAAHLPFRSGRSFSASVSGTELT

SEQ ID NO: 158218 - protein, 18 aa, Mycobacterium bovis
PAAVPLEVPVRVTPGPDD

SEQ ID NO: 158219 - protein, 20 aa, Mycobacterium bovis
PADLRLVRQTGLSVNESALT

SEQ ID NO: 158220 - protein, 18 aa, Mycobacterium bovis
PAGALGLTVQVLWGQLTA

SEQ ID NO: 158221 - protein, 20 aa, Mycobacterium bovis
PAGPWLRTGDSGFLSEGELF

SEQ ID NO: 158222 - protein, 17 aa, Mycobacterium bovis
PAGVHFRPFLSALGASV

SEQ ID NO: 158223 - protein, 18 aa, Mycobacterium bovis
PAHLRTAILDATKPEVRR

SEQ ID NO: 158224 - protein, 22 aa, Mycobacterium bovis
PAHRRGVALGAWGTVASVASLV

SEQ ID NO: 158225 - protein, 19 aa, Mycobacterium bovis
PAKPIAVNIIDFGADPDRA

SEQ ID NO: 158226 - protein, 17 aa, Mycobacterium bovis
PALAIGIAVSFLAAVTL

SEQ ID NO: 158227 - protein, 26 aa, Mycobacterium bovis
PALSAWRFVTVFGVVGLLADVVYEGA

SEQ ID NO: 158228 - protein, 32 aa, Mycobacterium bovis
PAMATLLGRASWWPGHPWQRCAPEEGQMSARM

SEQ ID NO: 158229 - protein, 19 aa, Mycobacterium bovis
PAMMLRPGSPHGGPAAVRP

SEQ ID NO: 158230 - protein, 17 aa, Mycobacterium bovis
PANADFYAATRIGIGDQ

SEQ ID NO: 158231 - protein, 27 aa, Mycobacterium bovis
PAPDSLIRMCLFLGALTFMYISARAVD

SEQ ID NO: 158232 - protein, 17 aa, Mycobacterium bovis
PARGRLVTMLLVGVVLL

SEQ ID NO: 158233 - protein, 18 aa, Mycobacterium bovis
PASRMLRPYGPRPVVREL

SEQ ID NO: 158234 - protein, 22 aa, Mycobacterium bovis
PATGARLRWAPAQGPSATPAQG

SEQ ID NO: 158235 - protein, 25 aa, Mycobacterium bovis
PATLLLLRYRWLRSEPLPVRRPASV

SEQ ID NO: 158236 - protein, 30 aa, Mycobacterium bovis
PATRFRPIIRLTVEWLEVLAMIALLPAAAA

SEQ ID NO: 158237 - protein, 22 aa, Mycobacterium bovis
PATRRYTYGFGRVEDLAGSFVV

SEQ ID NO: 158238 - protein, 18 aa, Mycobacterium bovis
PAVFKALFLGFMFAFAIK

SEQ ID NO: 158239 - protein, 18 aa, Mycobacterium bovis
PAVLSVLVLEDFAMAAYL

SEQ ID NO: 158240 - protein, 23 aa, Mycobacterium bovis
PAVVSWAAFLGWINLHGTWASWM

SEQ ID NO: 158241 - protein, 19 aa, Mycobacterium bovis
PCAQRARAVATFLLAIPVA

SEQ ID NO: 158242 - protein, 23 aa, Mycobacterium bovis
PDDPDWSWLKWLPHVQHQTETDA

SEQ ID NO: 158243 - protein, 25 aa, Mycobacterium bovis
PDFGERGRRDLYHFTHLAVEHPVFT

SEQ ID NO: 158244 - protein, 28 aa, Mycobacterium bovis
PDFIGLFDRICRVGRSLRVHLLLATQSL

SEQ ID NO: 158245 - protein, 27 aa, Mycobacterium bovis
PDGAVGRALCLAIDPDLLITVNAMTGG

SEQ ID NO: 158246 - protein, 25 aa, Mycobacterium bovis
PDGDYAVAVARIFSTDVRFIGAGAI

SEQ ID NO: 158247 - protein, 21 aa, Mycobacterium bovis
PDGGAAFVRRLVTLATTLLLG

SEQ ID NO: 158248 - protein, 17 aa, Mycobacterium bovis
PDGLHVFVTGPGATIVD

SEQ ID NO: 158249 - protein, 24 aa, Mycobacterium bovis
PDGSHGMYSWLHFWIATACALTAW

SEQ ID NO: 158250 - protein, 17 aa, Mycobacterium bovis
PDHSIDVAFAIDRSYTL

SEQ ID NO: 158251 - protein, 18 aa, Mycobacterium bovis
PDIARPGAGGSRVSRADV

SEQ ID NO: 158252 - protein, 25 aa, Mycobacterium bovis
PDILDPALLRPGRFDRQIPVSNPDL

SEQ ID NO: 158253 - protein, 24 aa, Mycobacterium bovis
PDLQGADQLLVRWRQANDRINSYI

SEQ ID NO: 158254 - protein, 20 aa, Mycobacterium bovis
PDMRAAVVSIDPHNGAVRAY

SEQ ID NO: 158255 - protein, 21 aa, Mycobacterium bovis
PDPNLRPQIVGVFTDLTGPAP

SEQ ID NO: 158256 - protein, 23 aa, Mycobacterium bovis
PDQRELWRAVGIRGATTAAAATV

SEQ ID NO: 158257 - protein, 18 aa, Mycobacterium bovis
PDQVLGWAGYLRASQATG

SEQ ID NO: 158258 - protein, 24 aa, Mycobacterium bovis
PDSRPRLILGASLIGLSFLGLCHL

SEQ ID NO: 158259 - protein, 24 aa, Mycobacterium bovis
PDSWQADHHVAWWVGVGVAAVVTL

SEQ ID NO: 158260 - protein, 21 aa, Mycobacterium bovis
PDTNFAWSFVLALLAAALTAR

SEQ ID NO: 158261 - protein, 25 aa, Mycobacterium bovis
PEAAALKCVRVRLRDEFGFPKSEIH

SEQ ID NO: 158262 - protein, 23 aa, Mycobacterium bovis
PEAFIRKPARWMQLLAKHQAPFS

SEQ ID NO: 158263 - protein, 24 aa, Mycobacterium bovis
PEAKEKARAIGIWTAIASIGTTTG

SEQ ID NO: 158264 - protein, 22 aa, Mycobacterium bovis
PEAPRITAPRIRGGGRASVGLP

SEQ ID NO: 158265 - protein, 17 aa, Mycobacterium bovis
PEARAALDAVRARIRSR

SEQ ID NO: 158266 - protein, 18 aa, Mycobacterium bovis
PEDLGAWEAGNKGIARRN

SEQ ID NO: 158267 - protein, 27 aa, Mycobacterium bovis
PEDSVAWEAGNKFIARRNLIWSVAAEH

SEQ ID NO: 158268 - protein, 20 aa, Mycobacterium bovis
PEGRSIVVLAKDEFGLRARD

SEQ ID NO: 158269 - protein, 22 aa, Mycobacterium bovis
PEKISFLPAMRYYAGNWATSIW

SEQ ID NO: 158270 - protein, 18 aa, Mycobacterium bovis
PELDRGQEAGFTLSAPLR

SEQ ID NO: 158271 - protein, 25 aa, Mycobacterium bovis
PELDSRWGYPTVIGGMVLICLFLYH

SEQ ID NO: 158272 - protein, 20 aa, Mycobacterium bovis
PELLPSLLAAVHRRRRRTRL

SEQ ID NO: 158273 - protein, 35 aa, Mycobacterium bovis
PELPRVIPPSLLRRALPYLIGILIVGMIVALVATG

SEQ ID NO: 158274 - protein, 21 aa, Mycobacterium bovis
PENGSGWVFCMMIAVIASDVG

SEQ ID NO: 158275 - protein, 20 aa, Mycobacterium bovis
PENVHWTIWQLWLVVLLVAL

SEQ ID NO: 158276 - protein, 17 aa, Mycobacterium bovis
PEPRWPKSPPQDRRESG

SEQ ID NO: 158277 - protein, 17 aa, Mycobacterium bovis
PERAQVRAGLPAGTLDD

SEQ ID NO: 158278 - protein, 21 aa, Mycobacterium bovis
PESLRRLDRVDAIVIDPRVLC

SEQ ID NO: 158279 - protein, 24 aa, Mycobacterium bovis
PESRLRAAGFIGFAIGGPLSDGLT

SEQ ID NO: 158280 - protein, 24 aa, Mycobacterium bovis
PESYSLPLRRLLGLVAAGLDVSLI

SEQ ID NO: 158281 - protein, 20 aa, Mycobacterium bovis
PEVLAGQGFDGRADLYSLGC

SEQ ID NO: 158282 - protein, 19 aa, Mycobacterium bovis
PFAELGLNSLMAMAIRREA

SEQ ID NO: 158283 - protein, 30 aa, Mycobacterium bovis
PFAGALMDRWDRRWVLVGANTGRLALIAGV

SEQ ID NO: 158284 - protein, 23 aa, Mycobacterium bovis
PFGWYYDLLALWAHVSTASIWMR

SEQ ID NO: 158285 - protein, 24 aa, Mycobacterium bovis
PFIALGVAGAFVWSPLTVTATRNL

SEQ ID NO: 158286 - protein, 19 aa, Mycobacterium bovis
PFLGRWLLLTAVAFGISAA

SEQ ID NO: 158287 - protein, 21 aa, Mycobacterium bovis
PFLLIMGGFMYFASRRQRRAM

SEQ ID NO: 158288 - protein, 32 aa, Mycobacterium bovis
PFMFGSPYAIFLLREHFRLIPDDLINAARLDG

SEQ ID NO: 158289 - protein, 20 aa, Mycobacterium bovis
PFNNGLRPEGIIALGSLVTY

SEQ ID NO: 158290 - protein, 19 aa, Mycobacterium bovis
PFRAGERIGSLFSTHPPIE

SEQ ID NO: 158291 - protein, 21 aa, Mycobacterium bovis
PFTDITAPWGIAVDEAGTVYV

SEQ ID NO: 158292 - protein, 25 aa, Mycobacterium bovis
PFVMLGAALLWFGWYGFNAGSATTA

SEQ ID NO: 158293 - protein, 19 aa, Mycobacterium bovis
PFYPPGWFWIGGRAAALTG

SEQ ID NO: 158294 - protein, 26 aa, Mycobacterium bovis
PGAAVQAPWPLLRTFAAGPALSRDAA

SEQ ID NO: 158295 - protein, 18 aa, Mycobacterium bovis
PGDGARLVTTMTRHPGGA

SEQ ID NO: 158296 - protein, 31 aa, Mycobacterium bovis
PGDVGWLRLPAFTWPTRPSWLYRLTQGLHVG

SEQ ID NO: 158297 - protein, 17 aa, Mycobacterium bovis
PGDVMPATYVGIWQTFA

SEQ ID NO: 158298 - protein, 17 aa, Mycobacterium bovis
PGIPGYIDQQWVTQAEA

SEQ ID NO: 158299 - protein, 17 aa, Mycobacterium bovis
PGISDAFASYAFGTFGV

SEQ ID NO: 158300 - protein, 18 aa, Mycobacterium bovis
PGKFMPLLPTQQQAPVPP

SEQ ID NO: 158301 - protein, 25 aa, Mycobacterium bovis
PGKKFTWHWWWLGAAALGVLLVVMV

SEQ ID NO: 158302 - protein, 18 aa, Mycobacterium bovis
PGLLDLPAPAPVDLRRLL

SEQ ID NO: 158303 - protein, 30 aa, Mycobacterium bovis
PGLPDIPGLPDFKWPPTPGSPLFPDLPSFP

SEQ ID NO: 158304 - protein, 24 aa, Mycobacterium bovis
PGLPLWPYLVCGALAGLGGGNFAA

SEQ ID NO: 158305 - protein, 17 aa, Mycobacterium bovis
PGPMPAPPLGAVPSPAP

SEQ ID NO: 158306 - protein, 18 aa, Mycobacterium bovis
PGQILVLLNVGAVFMGTA

SEQ ID NO: 158307 - protein, 22 aa, Mycobacterium bovis
PGSGGVALWWMIGLLVAAGVLG

SEQ ID NO: 158308 - protein, 25 aa, Mycobacterium bovis
PGSVTVTYPAHWGPAAVAALDSALR

SEQ ID NO: 158309 - protein, 22 aa, Mycobacterium bovis
PGTGQAAASSWLDRLRTLVHRT

SEQ ID NO: 158310 - protein, 19 aa, Mycobacterium bovis
PGTILIPRLYALHILLLPG

SEQ ID NO: 158311 - protein, 21 aa, Mycobacterium bovis
PGTPIWRLVLPFIALGVAGAF

SEQ ID NO: 158312 - protein, 19 aa, Mycobacterium bovis
PGTPLLKLVRELRADRGPV

SEQ ID NO: 158313 - protein, 24 aa, Mycobacterium bovis
PGVTVTIGITCHRTGPNAPCVELS

SEQ ID NO: 158314 - protein, 24 aa, Mycobacterium bovis
PHEECEVLVGLGMRTWADGRTLLL

SEQ ID NO: 158315 - protein, 21 aa, Mycobacterium bovis
PHHPHRFDWFGVGLSGAGMFL

SEQ ID NO: 158316 - protein, 20 aa, Mycobacterium bovis
PHIDLPEAWQVIAVALIVYS

SEQ ID NO: 158317 - protein, 19 aa, Mycobacterium bovis
PHIPFTDLRMKVVDTQTEW

SEQ ID NO: 158318 - protein, 17 aa, Mycobacterium bovis
PHLPPPPLVFAAEPAKT

SEQ ID NO: 158319 - protein, 21 aa, Mycobacterium bovis
PHPRLPRLIPGGDYVMAGGDG

SEQ ID NO: 158320 - protein, 22 aa, Mycobacterium bovis
PHTIYSPLFRKFVEWIEYLCLM

SEQ ID NO: 158321 - protein, 18 aa, Mycobacterium bovis
PIADAVIFGTAFSAEDFK

SEQ ID NO: 158322 - protein, 20 aa, Mycobacterium bovis
PIEVVREGRHVTLTVKPDPD

SEQ ID NO: 158323 - protein, 20 aa, Mycobacterium bovis
PIFFVLSGFLLFRPWVKSAA

SEQ ID NO: 158324 - protein, 21 aa, Mycobacterium bovis
PILARYANWVSHAVRGDFGTT

SEQ ID NO: 158325 - protein, 21 aa, Mycobacterium bovis
PIVCAAGLCRAAKALFGRYVV

SEQ ID NO: 158326 - protein, 19 aa, Mycobacterium bovis
PIVGYLWSWLSGRDRAWRD

SEQ ID NO: 158327 - protein, 17 aa, Mycobacterium bovis
PKATLGLTAMVVVTLQI

SEQ ID NO: 158328 - protein, 18 aa, Mycobacterium bovis
PKAVVSFYEDFLCPACGI

SEQ ID NO: 158329 - protein, 21 aa, Mycobacterium bovis
PKEFRCVSVDLLARRPVVHRR

SEQ ID NO: 158330 - protein, 21 aa, Mycobacterium bovis
PKHFRCVSVDLLARRPVVHRQ

SEQ ID NO: 158331 - protein, 20 aa, Mycobacterium bovis
PKLFRSLSIAFMSSADPIPA

SEQ ID NO: 158332 - protein, 26 aa, Mycobacterium bovis
PKRRHKRLLIGIVVALALVSAMTAAI

SEQ ID NO: 158333 - protein, 28 aa, Mycobacterium bovis
PKSPPIPWYRLPAVIITGTTVAVLLVGA

SEQ ID NO: 158334 - protein, 23 aa, Mycobacterium bovis
PKTPEFRRGMLYAINPVGFGSLL

SEQ ID NO: 158335 - protein, 19 aa, Mycobacterium bovis
PKVGPWALYGLLFTIVILF

SEQ ID NO: 158336 - protein, 21 aa, Mycobacterium bovis
PLALPLASLVFFGAFIPLIGA

SEQ ID NO: 158337 - protein, 30 aa, Mycobacterium bovis
PLARNGFASLWSWFIGLVVTEFPLPTLASQ

SEQ ID NO: 158338 - protein, 24 aa, Mycobacterium bovis
PLDQPRIYFGPVISNTSADYAIVG

SEQ ID NO: 158339 - protein, 23 aa, Mycobacterium bovis
PLGGWQLGRRLLWLRSGLAEPRS

SEQ ID NO: 158340 - protein, 18 aa, Mycobacterium bovis
PLGRAIVAEARRRGIAIP

SEQ ID NO: 158341 - protein, 27 aa, Mycobacterium bovis
PLGVVVGGPFLPLAIILYWFSNNIWTF

SEQ ID NO: 158342 - protein, 30 aa, Mycobacterium bovis
PLLPIAAVCACLWLMLNLTALTWIRFGIWL

SEQ ID NO: 158343 - protein, 28 aa, Mycobacterium bovis
PLMGLPPWMVFCSWSLNLIYQFWVHTER

SEQ ID NO: 158344 - protein, 26 aa, Mycobacterium bovis
PLMSHLAARGWVCVSLNYRVSPRHTW

SEQ ID NO: 158345 - protein, 18 aa, Mycobacterium bovis
PLRFLARATNLWNSDLPF

SEQ ID NO: 158346 - protein, 27 aa, Mycobacterium bovis
PLRVRPRPASQMLRPFAPRRLVRALLL

SEQ ID NO: 158347 - protein, 18 aa, Mycobacterium bovis
PLRYGAGRIGDLFRIEGP

SEQ ID NO: 158348 - protein, 22 aa, Mycobacterium bovis
PLTAKLAWFSKFLTIAILGLAA

SEQ ID NO: 158349 - protein, 24 aa, Mycobacterium bovis
PLTPPRAVAIITQIASALDAAHAD

SEQ ID NO: 158350 - protein, 19 aa, Mycobacterium bovis
PLTWPPAFFSWFAAGMLLA

SEQ ID NO: 158351 - protein, 25 aa, Mycobacterium bovis
PLVAEIGVACAVAIAVDATVVRLVL

SEQ ID NO: 158352 - protein, 20 aa, Mycobacterium bovis
PLWTDILLPIVMWALYAWSW

SEQ ID NO: 158353 - protein, 18 aa, Mycobacterium bovis
PLYHDMGLMVGLFIPLFV

SEQ ID NO: 158354 - protein, 31 aa, Mycobacterium bovis
PLYSLSVLAAFFAARFTTVFVNGQSAGLYDH

SEQ ID NO: 158355 - protein, 21 aa, Mycobacterium bovis
PMGVPLEWNVFMIFGVLSLFV

SEQ ID NO: 158356 - protein, 26 aa, Mycobacterium bovis
PMIKPAIVVALLFRTLDAFRIFDNIY

SEQ ID NO: 158357 - protein, 23 aa, Mycobacterium bovis
PMIVAVPVGAYLALPVAAIVIGL

SEQ ID NO: 158358 - protein, 17 aa, Mycobacterium bovis
PMLAQIPVFLGLYHVLR

SEQ ID NO: 158359 - protein, 21 aa, Mycobacterium bovis
PMLPGRGWSIFVGVISLIAGI

SEQ ID NO: 158360 - protein, 20 aa, Mycobacterium bovis
PMLVAGRLGDRFGPKNLYLI

SEQ ID NO: 158361 - protein, 17 aa, Mycobacterium bovis
PMMLPLLERMVVKQPRT

SEQ ID NO: 158362 - protein, 20 aa, Mycobacterium bovis
PNAADWPLILADASQPLTLE

SEQ ID NO: 158363 - protein, 26 aa, Mycobacterium bovis
PNGGGRLAPRPVFRPPVDPASRQAFG

SEQ ID NO: 158364 - protein, 21 aa, Mycobacterium bovis
PNLFATLGIIVAHGYAYVTNN

SEQ ID NO: 158365 - protein, 31 aa, Mycobacterium bovis
PNNPNGGILARFPGLYLQSLGLTFNGATPDT

SEQ ID NO: 158366 - protein, 19 aa, Mycobacterium bovis
PNPWQYIRYCYGARLPDSM

SEQ ID NO: 158367 - protein, 25 aa, Mycobacterium bovis
PNSGRRPMVLAARSLAALFAALALA

SEQ ID NO: 158368 - protein, 17 aa, Mycobacterium bovis
PNVRELIEITLVKNPAM

SEQ ID NO: 158369 - protein, 26 aa, Mycobacterium bovis
PNYFGDACVWWGLWLITINDWAPLAT

SEQ ID NO: 158370 - protein, 18 aa, Mycobacterium bovis
PPAFFSWFAAGMLLAEWA

SEQ ID NO: 158371 - protein, 24 aa, Mycobacterium bovis
PPAPEPRPAPPPAKPAPPAGPVDD

SEQ ID NO: 158372 - protein, 18 aa, Mycobacterium bovis
PPARSGPEVLVRTPDGTA

SEQ ID NO: 158373 - protein, 21 aa, Mycobacterium bovis
PPCLTGFLPASEWRSPADTST

SEQ ID NO: 158374 - protein, 19 aa, Mycobacterium bovis
PPEELQFVLADLKGGSAVK

SEQ ID NO: 158375 - protein, 22 aa, Mycobacterium bovis
PPEPPGAYSAARGRFNDDITTQ

SEQ ID NO: 158376 - protein, 17 aa, Mycobacterium bovis
PPFGTWYAAMLFAVVPL

SEQ ID NO: 158377 - protein, 19 aa, Mycobacterium bovis
PPGPPGRRAWQADTESTAP

SEQ ID NO: 158378 - protein, 25 aa, Mycobacterium bovis
PPGRRRLAKWAGMVVSVLTLAVSIV

SEQ ID NO: 158379 - protein, 19 aa, Mycobacterium bovis
PPGRRRRARHASPADQAYN

SEQ ID NO: 158380 - protein, 17 aa, Mycobacterium bovis
PPGTLRRSATGVFAGAC

SEQ ID NO: 158381 - protein, 21 aa, Mycobacterium bovis
PPLHDQWRPVLWAIAILTMTV

SEQ ID NO: 158382 - protein, 20 aa, Mycobacterium bovis
PPLLKKLRIDPAIVSGPMIA

SEQ ID NO: 158383 - protein, 19 aa, Mycobacterium bovis
PPLLREWTHYDSMTTTVLG

SEQ ID NO: 158384 - protein, 21 aa, Mycobacterium bovis
PPPAPGRPSAQVWLVDPRRQL

SEQ ID NO: 158385 - protein, 17 aa, Mycobacterium bovis
PPPARIVLFSDGKETMP

SEQ ID NO: 158386 - protein, 21 aa, Mycobacterium bovis
PPPIDERWLPESALPAPPRPT

SEQ ID NO: 158387 - protein, 26 aa, Mycobacterium bovis
PPPPDHRARNIAIGFVGAVATGVLAM

SEQ ID NO: 158388 - protein, 19 aa, Mycobacterium bovis
PPPPFTSWMPPGYPPEPPQ

SEQ ID NO: 158389 - protein, 26 aa, Mycobacterium bovis
PPPSLSRYAWHRVRRIMPAYTVTVLL

SEQ ID NO: 158390 - protein, 22 aa, Mycobacterium bovis
PPRVESLGSLGAYQVDSSAAGA

SEQ ID NO: 158391 - protein, 17 aa, Mycobacterium bovis
PPRVHRRVGGQRTALTA

SEQ ID NO: 158392 - protein, 25 aa, Mycobacterium bovis
PPSRPGEKNMPFWGTSFSAAYVSGV

SEQ ID NO: 158393 - protein, 23 aa, Mycobacterium bovis
PQAKRVPGLVVYRYDAPLCFANA

SEQ ID NO: 158394 - protein, 24 aa, Mycobacterium bovis
PQFFARRIGRNEAFNHAGNASAAG

SEQ ID NO: 158395 - protein, 17 aa, Mycobacterium bovis
PQFGRDLGFYAFELPFY

SEQ ID NO: 158396 - protein, 27 aa, Mycobacterium bovis
PQGAVGRIFVGNAFPFEGYTGGGGKQI

SEQ ID NO: 158397 - protein, 25 aa, Mycobacterium bovis
PQLSRASVVIGSLVVVLALAAGIVG

SEQ ID NO: 158398 - protein, 24 aa, Mycobacterium bovis
PQPPDVNTWWAFRTSCTPTECLAA

SEQ ID NO: 158399 - protein, 18 aa, Mycobacterium bovis
PQRVRPRPASRMLRPYGP

SEQ ID NO: 158400 - protein, 20 aa, Mycobacterium bovis
PRALAAFGRNDIRGTYRDPL

SEQ ID NO: 158401 - protein, 19 aa, Mycobacterium bovis
PRAPQLWLPPLDETIPLSA

SEQ ID NO: 158402 - protein, 23 aa, Mycobacterium bovis
PRCPLPRPAIGPGTYNLVVQLGN

SEQ ID NO: 158403 - protein, 27 aa, Mycobacterium bovis
PRELEIWKRTLFRFVQQVYFRRRKTVI

SEQ ID NO: 158404 - protein, 26 aa, Mycobacterium bovis
PRERHIASWLAALVVPSVICAITVAW

SEQ ID NO: 158405 - protein, 24 aa, Mycobacterium bovis
PRESDIWLLGAIGPRMVYSTNLDA

SEQ ID NO: 158406 - protein, 20 aa, Mycobacterium bovis
PRPAPAHEWHAMSVEQVRKA

SEQ ID NO: 158407 - protein, 20 aa, Mycobacterium bovis
PRPVVRELLLREGNDDPRTQ

SEQ ID NO: 158408 - protein, 30 aa, Mycobacterium bovis
PRRQHSPMTWRRWALLCVGIAQIALGTVQG

SEQ ID NO: 158409 - protein, 24 aa, Mycobacterium bovis
PRSVGVPLYLLLGWVAVWYTATIL

SEQ ID NO: 158410 - protein, 33 aa, Mycobacterium bovis
PRTDLRLRWSWRGLRLGLMFGFGGMLVTIPASL

SEQ ID NO: 158411 - protein, 17 aa, Mycobacterium bovis
PRTLPNAIAPVVAGTGA

SEQ ID NO: 158412 - protein, 29 aa, Mycobacterium bovis
PRVLCTDDLRVARIRGCGADELSTAWNRA

SEQ ID NO: 158413 - protein, 24 aa, Mycobacterium bovis
PRVLEAIQVLRIRYILTSTPTVRG

SEQ ID NO: 158414 - protein, 20 aa, Mycobacterium bovis
PRWLTFGVVPGYVLLALALG

SEQ ID NO: 158415 - protein, 20 aa, Mycobacterium bovis
PRYLWAGLVLLAATAASSDL

SEQ ID NO: 158416 - protein, 19 aa, Mycobacterium bovis
PSAAAWLGAAARRRLVKLG

SEQ ID NO: 158417 - protein, 27 aa, Mycobacterium bovis
PSAELFVAAYVPYVAWLVQASADSAAA

SEQ ID NO: 158418 - protein, 19 aa, Mycobacterium bovis
PSAGVRPAIHLPLEDPYQM

SEQ ID NO: 158419 - protein, 18 aa, Mycobacterium bovis
PSAIRPGIPKAFDAVVAR

SEQ ID NO: 158420 - protein, 24 aa, Mycobacterium bovis
PSAYDLGTVIGFYGLTIDEPPTGT

SEQ ID NO: 158421 - protein, 17 aa, Mycobacterium bovis
PSGFGFGLGNVILTINV

SEQ ID NO: 158422 - protein, 24 aa, Mycobacterium bovis
PSGMTRWSPDSGETIAERLGLIVG

SEQ ID NO: 158423 - protein, 20 aa, Mycobacterium bovis
PSLLPRGPLFQGLVSGICGA

SEQ ID NO: 158424 - protein, 23 aa, Mycobacterium bovis
PSPTCIIVGLPAGLRLAVDNAIA

SEQ ID NO: 158425 - protein, 24 aa, Mycobacterium bovis
PSRGTVYQMWLLGGAKGPRSAETM

SEQ ID NO: 158426 - protein, 24 aa, Mycobacterium bovis
PSRQSWPAATGVTLVGTNPAALVT

SEQ ID NO: 158427 - protein, 24 aa, Mycobacterium bovis
PSSTKLRNGFRIQRQNTRIGQDVA

SEQ ID NO: 158428 - protein, 18 aa, Mycobacterium bovis
PSTLWIWVALTGAAATVL

SEQ ID NO: 158429 - protein, 25 aa, Mycobacterium bovis
PSTVRPGIPVAFDAVIARGMAKNPE

SEQ ID NO: 158430 - protein, 39 aa, Mycobacterium bovis
PSVLTMRGRCRRLWPRSAPMLAAWAVVEGCLMAVFFVTD

SEQ ID NO: 158431 - protein, 19 aa, Mycobacterium bovis
PSVPFYRYLRTWRRNEEAY

SEQ ID NO: 158432 - protein, 18 aa, Mycobacterium bovis
PTALAPTGVIVWLCTIVV

SEQ ID NO: 158433 - protein, 24 aa, Mycobacterium bovis
PTAWALCGVFPLAAVPLVPVRLLP

SEQ ID NO: 158434 - protein, 18 aa, Mycobacterium bovis
PTFALARGAAMAAGAATM

SEQ ID NO: 158435 - protein, 19 aa, Mycobacterium bovis
PTFGDWGFALARLTDIAPT

SEQ ID NO: 158436 - protein, 24 aa, Mycobacterium bovis
PTGSGLPALLGIAALASVLANVVN

SEQ ID NO: 158437 - protein, 18 aa, Mycobacterium bovis
PTIWTAVGAVCFAASDSM

SEQ ID NO: 158438 - protein, 18 aa, Mycobacterium bovis
PTLSRADALLAHDTLVPD

SEQ ID NO: 158439 - protein, 22 aa, Mycobacterium bovis
PTPAALFPVHIDPIAVPPQIGA

SEQ ID NO: 158440 - protein, 18 aa, Mycobacterium bovis
PTPGFRFIDHTVIGCSLV

SEQ ID NO: 158441 - protein, 23 aa, Mycobacterium bovis
PTRFKRKEHWLPAHFSGDGSTYM

SEQ ID NO: 158442 - protein, 24 aa, Mycobacterium bovis
PTRRRPRRILVGAVAVLLLAGLFA

SEQ ID NO: 158443 - protein, 22 aa, Mycobacterium bovis
PTTAGATAWRTGPNSTPVILRC

SEQ ID NO: 158444 - protein, 24 aa, Mycobacterium bovis
PTWPQCFPGSFTPVVVAEVPRVHQ

SEQ ID NO: 158445 - protein, 18 aa, Mycobacterium bovis
PVALFGRAAAKLEQITYR

SEQ ID NO: 158446 - protein, 31 aa, Mycobacterium bovis
PVARLWRGLLVFFSRWWQLETLYRSNMKYQP

SEQ ID NO: 158447 - protein, 34 aa, Mycobacterium bovis
PVEFSGFIAWLIWLVLHLAYLIGFKTKITTLLSW

SEQ ID NO: 158448 - protein, 24 aa, Mycobacterium bovis
PVFGFGVIFGAIWAEEAWGRYWGW

SEQ ID NO: 158449 - protein, 17 aa, Mycobacterium bovis
PVGFLTVVAVDLFIDGL

SEQ ID NO: 158450 - protein, 18 aa, Mycobacterium bovis
PVIASVLGITVLDEVLHT

SEQ ID NO: 158451 - protein, 24 aa, Mycobacterium bovis
PVKFTRAAAVWSALIVGFLILILL

SEQ ID NO: 158452 - protein, 26 aa, Mycobacterium bovis
PVLLEVWPVIAVGALAWLVAAVAAFV

SEQ ID NO: 158453 - protein, 18 aa, Mycobacterium bovis
PVLQEAFGRPFAGAESLQ

SEQ ID NO: 158454 - protein, 25 aa, Mycobacterium bovis
PVLTLMVVAVWLLGVGTLKDLALVQ

SEQ ID NO: 158455 - protein, 29 aa, Mycobacterium bovis
PVNANAALRWSLLAGACSNDAALVRDGTR

SEQ ID NO: 158456 - protein, 19 aa, Mycobacterium bovis
PVPGDWLYFVTIDSQGTTL

SEQ ID NO: 158457 - protein, 25 aa, Mycobacterium bovis
PVQRSVARFALIQALSAVLVGAGTR

SEQ ID NO: 158458 - protein, 27 aa, Mycobacterium bovis
PVRMTFRSSRLVYPMRLSVAAQEPQHV

SEQ ID NO: 158459 - protein, 22 aa, Mycobacterium bovis
PVSYAIAAMRGFAMGGPVLSPM

SEQ ID NO: 158460 - protein, 24 aa, Mycobacterium bovis
PVTLKRFIDRFAPFNLDPKAIRPS

SEQ ID NO: 158461 - protein, 20 aa, Mycobacterium bovis
PVVIGAVLAIMVWRSASGPR

SEQ ID NO: 158462 - protein, 19 aa, Mycobacterium bovis
PVWQSLRHADTWIMSLLYI

SEQ ID NO: 158463 - protein, 30 aa, Mycobacterium bovis
PWLPHTIRRLSLPILLFWVGVAAITNAAVP

SEQ ID NO: 158464 - protein, 24 aa, Mycobacterium bovis
PWQLSAHRWYTWVIAIVGVDLLYY

SEQ ID NO: 158465 - protein, 17 aa, Mycobacterium bovis
PWRGPPIPYGTEVTDGR

SEQ ID NO: 158466 - protein, 18 aa, Mycobacterium bovis
PWWVTFGVAPAYATLALA

SEQ ID NO: 158467 - protein, 28 aa, Mycobacterium bovis
PYKYFLEFFEQFGFSPAVTVVLALVALQ

SEQ ID NO: 158468 - protein, 19 aa, Mycobacterium bovis
PYMRERMADMLTMSDEMLV

SEQ ID NO: 158469 - protein, 24 aa, Mycobacterium bovis
PYPARTGPKGSLVYKLITTTDHKM

SEQ ID NO: 158470 - protein, 21 aa, Mycobacterium bovis
PYVLVGWSLGGVLAYACAIGL

SEQ ID NO: 158471 - protein, 24 aa, Mycobacterium bovis
QADGRNTLLLPFRVAAVHLILWDI

SEQ ID NO: 158472 - protein, 25 aa, Mycobacterium bovis
QAGPQLPGPVPIPGAPGPMPAPPLG

SEQ ID NO: 158473 - protein, 23 aa, Mycobacterium bovis
QAIKRVGQVFGEFDSDNAVTIVL

SEQ ID NO: 158474 - protein, 25 aa, Mycobacterium bovis
QAMYRPATILGCWVALAATAGLLFT

SEQ ID NO: 158475 - protein, 18 aa, Mycobacterium bovis
QASILMPRNQYLLIAAMF

SEQ ID NO: 158476 - protein, 17 aa, Mycobacterium bovis
QAVAAVLALLVETGAIT

SEQ ID NO: 158477 - protein, 32 aa, Mycobacterium bovis
QAVEGVGLWLLKRWGEYFAVVATSIFLPLEVH

SEQ ID NO: 158478 - protein, 22 aa, Mycobacterium bovis
QEAALTWLLLVSVPILAVANYW

SEQ ID NO: 158479 - protein, 21 aa, Mycobacterium bovis
QEERGRTAVFVGQDGQVVGVL

SEQ ID NO: 158480 - protein, 26 aa, Mycobacterium bovis
QEGDRGVSWLPFFHDMGLITVLLASV

SEQ ID NO: 158481 - protein, 22 aa, Mycobacterium bovis
QELRHWLVVLVLTVVGWMLAAF

SEQ ID NO: 158482 - protein, 20 aa, Mycobacterium bovis
QFDALHFAKPIFGPAARALA

SEQ ID NO: 158483 - protein, 18 aa, Mycobacterium bovis
QFMLRTAPFSHDGWLGDW

SEQ ID NO: 158484 - protein, 24 aa, Mycobacterium bovis
QFWLYCGFTAITMLGFGTFGLLSF

SEQ ID NO: 158485 - protein, 26 aa, Mycobacterium bovis
QGAGRSRAAVKFLLYNLFGGLIMLAA

SEQ ID NO: 158486 - protein, 18 aa, Mycobacterium bovis
QGAVIRIPAVASRSGDLP

SEQ ID NO: 158487 - protein, 20 aa, Mycobacterium bovis
QGAVPGSPWWQHPVGSVTAL

SEQ ID NO: 158488 - protein, 23 aa, Mycobacterium bovis
QGGARMGFGFGKSRAKQLSKDMP

SEQ ID NO: 158489 - protein, 18 aa, Mycobacterium bovis
QGLIPSLMWISVPVILGI

SEQ ID NO: 158490 - protein, 30 aa, Mycobacterium bovis
QGRGLIRLARRVWPDSGWEELGPRPHLAVV

SEQ ID NO: 158491 - protein, 19 aa, Mycobacterium bovis
QGVLCLFLLEMGMTASRKL

SEQ ID NO: 158492 - protein, 20 aa, Mycobacterium bovis
QHGAWPWAVLLVVLVVGAFA

SEQ ID NO: 158493 - protein, 23 aa, Mycobacterium bovis
QHGDENFLLVGMDSRAGANANIG

SEQ ID NO: 158494 - protein, 18 aa, Mycobacterium bovis
QHGRRVALALSFGLRTAL

SEQ ID NO: 158495 - protein, 21 aa, Mycobacterium bovis
QHPGFPGWQALKVLSPAMAAD

SEQ ID NO: 158496 - protein, 17 aa, Mycobacterium bovis
QIHHWAALMFAAAIMVH

SEQ ID NO: 158497 - protein, 34 aa, Mycobacterium bovis
QIQHARVKLSYFARNRCSLLRVELQEHVAGLSRK

SEQ ID NO: 158498 - protein, 26 aa, Mycobacterium bovis
QIRRRRRVAGGFALSLLVVVVVVAVV

SEQ ID NO: 158499 - protein, 17 aa, Mycobacterium bovis
QKNLNVYGFTKFSQASV

SEQ ID NO: 158500 - protein, 24 aa, Mycobacterium bovis
QKQLGCVRFALIFGLTVINPATFV

SEQ ID NO: 158501 - protein, 24 aa, Mycobacterium bovis
QLAKLARAGFRVSDVKPPSSPVTS

SEQ ID NO: 158502 - protein, 24 aa, Mycobacterium bovis
QLALTELWCSYGVQPDLVIGHSMG

SEQ ID NO: 158503 - protein, 18 aa, Mycobacterium bovis
QLILFAIVSVVAIVVLGW

SEQ ID NO: 158504 - protein, 24 aa, Mycobacterium bovis
QLLVLLCGGLVGPIFLVVYFTLGL

SEQ ID NO: 158505 - protein, 23 aa, Mycobacterium bovis
QLMTGRLSSLVARARSAVTGAHA

SEQ ID NO: 158506 - protein, 23 aa, Mycobacterium bovis
QLPVLTCLAAMFIGLAIFAISMD

SEQ ID NO: 158507 - protein, 19 aa, Mycobacterium bovis
QLSMCFVLLISGVGSLIHI

SEQ ID NO: 158508 - protein, 22 aa, Mycobacterium bovis
QLTVKHALMYAAELRLPPDTTK

SEQ ID NO: 158509 - protein, 23 aa, Mycobacterium bovis
QMQVGSLIAFLSYFAQILMAVLM

SEQ ID NO: 158510 - protein, 17 aa, Mycobacterium bovis
QNAQPGKFMPLLPTQQQ

SEQ ID NO: 158511 - protein, 24 aa, Mycobacterium bovis
QNAYCTEVGVLPGTDFQLQPKYME

SEQ ID NO: 158512 - protein, 30 aa, Mycobacterium bovis
QPFGEYLPMPWLFRHLSGYADRAGHFVPGN

SEQ ID NO: 158513 - protein, 28 aa, Mycobacterium bovis
QPFLEPVSHMWVVKFLRTHGLIHDCPKL

SEQ ID NO: 158514 - protein, 21 aa, Mycobacterium bovis
QPIGFGMSVVRQLAHFIDAII

SEQ ID NO: 158515 - protein, 20 aa, Mycobacterium bovis
QPIRSTWWIRHYTFTGTAMG

SEQ ID NO: 158516 - protein, 28 aa, Mycobacterium bovis
QPKDRYQRCVDFARALGHRLGGAGDPDD

SEQ ID NO: 158517 - protein, 23 aa, Mycobacterium bovis
QPKKAAAALAWLVDEMEQRYQDM

SEQ ID NO: 158518 - protein, 23 aa, Mycobacterium bovis
QPLSKMSIAGPWVSISAPGTDVV

SEQ ID NO: 158519 - protein, 23 aa, Mycobacterium bovis
QPPPEVWSAATFITLAVCLGVGT

SEQ ID NO: 158520 - protein, 18 aa, Mycobacterium bovis
QPQSLWPRPARSTQPVQR

SEQ ID NO: 158521 - protein, 17 aa, Mycobacterium bovis
QPSMIGQLVQWLLSVGG

SEQ ID NO: 158522 - protein, 17 aa, Mycobacterium bovis
QPVSVWASATATLLIGA

SEQ ID NO: 158523 - protein, 19 aa, Mycobacterium bovis
QPYLVAGVLLVFYTTTGRY

SEQ ID NO: 158524 - protein, 26 aa, Mycobacterium bovis
QQLWNAYTGFYGWMLQLIWQFLQDPI

SEQ ID NO: 158525 - protein, 24 aa, Mycobacterium bovis
QQQMSRPKLDAMRAQFMLMLDMLR

SEQ ID NO: 158526 - protein, 28 aa, Mycobacterium bovis
QQTMLPFSWQGVCLHASGAARVRVRLAP

SEQ ID NO: 158527 - protein, 22 aa, Mycobacterium bovis
QRADAPVGIIALWALALLIIGT

SEQ ID NO: 158528 - protein, 20 aa, Mycobacterium bovis
QRARGKGGLVRVSWAEATEM

SEQ ID NO: 158529 - protein, 17 aa, Mycobacterium bovis
QRCLRHVHIGFERTLQQ

SEQ ID NO: 158530 - protein, 17 aa, Mycobacterium bovis
QRFFALFLYVVMLVFLV

SEQ ID NO: 158531 - protein, 18 aa, Mycobacterium bovis
QRLAIARAVIRRPAIYVF

SEQ ID NO: 158532 - protein, 17 aa, Mycobacterium bovis
QRLALAAALAREPAMLI

SEQ ID NO: 158533 - protein, 25 aa, Mycobacterium bovis
QRLFPRAILHFEDFGPANARKILDT

SEQ ID NO: 158534 - protein, 21 aa, Mycobacterium bovis
QRLTARGALVRSPRTIEALGR

SEQ ID NO: 158535 - protein, 33 aa, Mycobacterium bovis
QRQFRRLGTHVARWPAPILVASGVFVLIMMIAL

SEQ ID NO: 158536 - protein, 34 aa, Mycobacterium bovis
QRRLLKWSIPGLAHFFTMWGFFILLTVYIEAYGL

SEQ ID NO: 158537 - protein, 18 aa, Mycobacterium bovis
QRRMEVLALPLVAVVLFF

SEQ ID NO: 158538 - protein, 24 aa, Mycobacterium bovis
QRRRDCIACTGIIGWTVRQTLFQR

SEQ ID NO: 158539 - protein, 26 aa, Mycobacterium bovis
QRSEALADDVARSFADAGLDSVLSAE

SEQ ID NO: 158540 - protein, 28 aa, Mycobacterium bovis
QSALRLKGRLLFMPGVMVTSVPWQLTSS

SEQ ID NO: 158541 - protein, 19 aa, Mycobacterium bovis
QSLKLQWGVTGPDGRIQPL

SEQ ID NO: 158542 - protein, 19 aa, Mycobacterium bovis
QSMLLPAFVALFGIVAALF

SEQ ID NO: 158543 - protein, 26 aa, Mycobacterium bovis
QSSGFSVGDAISWSWNRFTQNAVTLV

SEQ ID NO: 158544 - protein, 25 aa, Mycobacterium bovis
QSTALADVSIRWQLKQAAAPELFQQ

SEQ ID NO: 158545 - protein, 20 aa, Mycobacterium bovis
QSVTTEFPGQAGLGVGGLAL

SEQ ID NO: 158546 - protein, 24 aa, Mycobacterium bovis
QTGMPSSFSMHGPWVDVAAPAENI

SEQ ID NO: 158547 - protein, 22 aa, Mycobacterium bovis
QTHGAHVCSLCLSTDKQAEHVL

SEQ ID NO: 158548 - protein, 23 aa, Mycobacterium bovis
QTISPGRCAAIAVSEHGAEKLVA

SEQ ID NO: 158549 - protein, 21 aa, Mycobacterium bovis
QTLFFPFVLLLAATALYRGND

SEQ ID NO: 158550 - protein, 24 aa, Mycobacterium bovis
QTLRTIYQNLGWAFGYNTAAIPLA

SEQ ID NO: 158551 - protein, 25 aa, Mycobacterium bovis
QTPKVFKAAAWVAIAAGTVFIVAVI

SEQ ID NO: 158552 - protein, 17 aa, Mycobacterium bovis
QTSWGIVGWSMGGTCAV

SEQ ID NO: 158553 - protein, 25 aa, Mycobacterium bovis
QVFFCSLAGYAFARLQFRGRDTLFV

SEQ ID NO: 158554 - protein, 50 aa, Mycobacterium bovis
QVGKLEFAGYFAWLAWLVLHLVYLVGYRNRIAALFAWGISFMGRARGQMA

SEQ ID NO: 158555 - protein, 24 aa, Mycobacterium bovis
QVGMCVGVSLVLPAAVWGVLTPRQ

SEQ ID NO: 158556 - protein, 20 aa, Mycobacterium bovis
QVLDTTLPWSYTITTTLPAV

SEQ ID NO: 158557 - protein, 24 aa, Mycobacterium bovis
QVNSGNEIARWAANLNTLAAQTAQ

SEQ ID NO: 158558 - protein, 23 aa, Mycobacterium bovis
QVPGGAWVLGWRRPQAYPLMSHL

SEQ ID NO: 158559 - protein, 23 aa, Mycobacterium bovis
QVPVLPREGAIALGMSNWECVRR

SEQ ID NO: 158560 - protein, 21 aa, Mycobacterium bovis
QWNNFMWPLVITSGHKWRVLT

SEQ ID NO: 158561 - protein, 25 aa, Mycobacterium bovis
QWRDDLRWPPASALVSQDEAVAALR

SEQ ID NO: 158562 - protein, 24 aa, Mycobacterium bovis
QYALALTAIHLFAGAPPVDRSHTG

SEQ ID NO: 158563 - protein, 17 aa, Mycobacterium bovis
RAAACLLEAIPRPGQTL

SEQ ID NO: 158564 - protein, 24 aa, Mycobacterium bovis
RAAGRARTLIYHRLAHGPAAAAVG

SEQ ID NO: 158565 - protein, 18 aa, Mycobacterium bovis
RAAILAAVVCVLTLTIAR

SEQ ID NO: 158566 - protein, 20 aa, Mycobacterium bovis
RAATTRFSVRMKHDDRKQTA

SEQ ID NO: 158567 - protein, 21 aa, Mycobacterium bovis
RADAWGRKPIFLVGFAVLTAR

SEQ ID NO: 158568 - protein, 20 aa, Mycobacterium bovis
RADETLSLIRRGDEEVRKQA

SEQ ID NO: 158569 - protein, 22 aa, Mycobacterium bovis
RAEELRPGDIIEVRTHEVVPAD

SEQ ID NO: 158570 - protein, 21 aa, Mycobacterium bovis
RAGLMAAVGFELFKQVGAIYL

SEQ ID NO: 158571 - protein, 18 aa, Mycobacterium bovis
RAGWSLDRINGAYEAILN

SEQ ID NO: 158572 - protein, 27 aa, Mycobacterium bovis
RAIGLFDTWPGLILPYITFALPLAIYT

SEQ ID NO: 158573 - protein, 27 aa, Mycobacterium bovis
RAIGWPETIFRFALYAFLCATALMVVR

SEQ ID NO: 158574 - protein, 24 aa, Mycobacterium bovis
RALEYLKITYGWSLLLIVTFTVLY

SEQ ID NO: 158575 - protein, 20 aa, Mycobacterium bovis
RANGIRRIVMLTGDHPEIAQ

SEQ ID NO: 158576 - protein, 18 aa, Mycobacterium bovis
RAPFSTWAVVAVVVVPAV

SEQ ID NO: 158577 - protein, 18 aa, Mycobacterium bovis
RAQFMLMLDMLRETAQES

SEQ ID NO: 158578 - protein, 24 aa, Mycobacterium bovis
RAQIPMYLGYAFRAMNSHGRALFT

SEQ ID NO: 158579 - protein, 20 aa, Mycobacterium bovis
RARKITWGELEKGRRRYLRD

SEQ ID NO: 158580 - protein, 24 aa, Mycobacterium bovis
RARRTRPELARMLLLGTLIGLVWE

SEQ ID NO: 158581 - protein, 24 aa, Mycobacterium bovis
RARSRLQAHAFWDIATFLINGSLW

SEQ ID NO: 158582 - protein, 20 aa, Mycobacterium bovis
RASRQWCGGLAIGLTLVLKP

SEQ ID NO: 158583 - protein, 17 aa, Mycobacterium bovis
RASTVALVALVAAQLGQ

SEQ ID NO: 158584 - protein, 18 aa, Mycobacterium bovis
RATISRPAAVAVPTPAPA

SEQ ID NO: 158585 - protein, 37 aa, Mycobacterium bovis
RATLPRLRYDQFMALGWKLLIPVSLVWVMVAAIIRSL

SEQ ID NO: 158586 - protein, 27 aa, Mycobacterium bovis
RATMRTIRMNMIWAFGYNVAAIPIAAA

SEQ ID NO: 158587 - protein, 18 aa, Mycobacterium bovis
RAVAIEWRGKIDDPKWRT

SEQ ID NO: 158588 - protein, 22 aa, Mycobacterium bovis
RAWESRLLMVARRFDGDAQSAG

SEQ ID NO: 158589 - protein, 23 aa, Mycobacterium bovis
RAYAESLTQVFLCAVSVTVVGFI

SEQ ID NO: 158590 - protein, 18 aa, Mycobacterium bovis
RCAATVVLAGASWWLIEQ

SEQ ID NO: 158591 - protein, 27 aa, Mycobacterium bovis
RCGACGAYKIGSTWHRTTTPTVGAATT

SEQ ID NO: 158592 - protein, 23 aa, Mycobacterium bovis
RDADKPAALWILTRGVHESVAPS

SEQ ID NO: 158593 - protein, 24 aa, Mycobacterium bovis
RDDAYRFAVWLSLPVAGLVAGFGL

SEQ ID NO: 158594 - protein, 28 aa, Mycobacterium bovis
RDDELPEFSFWAWLAMLFSAGMGIGLVF

SEQ ID NO: 158595 - protein, 23 aa, Mycobacterium bovis
RDGLLPARFAKVNPRTMTPVHNT

SEQ ID NO: 158596 - protein, 17 aa, Mycobacterium bovis
RDKRVAVAVVALTALVV

SEQ ID NO: 158597 - protein, 21 aa, Mycobacterium bovis
RDLGVAFGWSLFNWIADVACL

SEQ ID NO: 158598 - protein, 27 aa, Mycobacterium bovis
RDLIPDLAELLAMRGIDGLPFSWTVAS

SEQ ID NO: 158599 - protein, 22 aa, Mycobacterium bovis
RDLRIPAIGLVLLLLSSLIVGA

SEQ ID NO: 158600 - protein, 18 aa, Mycobacterium bovis
RDMVPIWVAAGGLAGALL

SEQ ID NO: 158601 - protein, 19 aa, Mycobacterium bovis
RDQLSGVRVVRAFTREGYE

SEQ ID NO: 158602 - protein, 24 aa, Mycobacterium bovis
RDRHLPRWLAAVHPRFKVPFRAEL

SEQ ID NO: 158603 - protein, 23 aa, Mycobacterium bovis
RDRLAARASRYARVPWVGAAAAP

SEQ ID NO: 158604 - protein, 23 aa, Mycobacterium bovis
RDRNRLVTFSAILLAGGVMFSLT

SEQ ID NO: 158605 - protein, 19 aa, Mycobacterium bovis
RDSRHVIEVVDWWGTPAIA

SEQ ID NO: 158606 - protein, 31 aa, Mycobacterium bovis
RDTDLCGVTWVYHYAVAVYRYDRGCGQVSTI

SEQ ID NO: 158607 - protein, 18 aa, Mycobacterium bovis
RDTWLLSLLYLGTFGSFI

SEQ ID NO: 158608 - protein, 20 aa, Mycobacterium bovis
RDWNWLKWLPHVDIPGRLDA

SEQ ID NO: 158609 - protein, 17 aa, Mycobacterium bovis
READAAASLWHPHIVAV

SEQ ID NO: 158610 - protein, 17 aa, Mycobacterium bovis
REAIKGTPLQGAAIYLG

SEQ ID NO: 158611 - protein, 21 aa, Mycobacterium bovis
REITRPVLDYVKRVSKESPRT

SEQ ID NO: 158612 - protein, 25 aa, Mycobacterium bovis
RELLQEVFLNPGLVLLFGGIVIGLI

SEQ ID NO: 158613 - protein, 27 aa, Mycobacterium bovis
RELPASVPVWLVWHIPGGTVWAEEAAF

SEQ ID NO: 158614 - protein, 18 aa, Mycobacterium bovis
RENPEWTNTAIVWNPGTG

SEQ ID NO: 158615 - protein, 18 aa, Mycobacterium bovis
RENVVALTVLWLLNIGEY

SEQ ID NO: 158616 - protein, 19 aa, Mycobacterium bovis
REPDLPRGFKVPGYPVTPV

SEQ ID NO: 158617 - protein, 26 aa, Mycobacterium bovis
REQVHEFGWRIGFAVGGGAAIVVFWL

SEQ ID NO: 158618 - protein, 20 aa, Mycobacterium bovis
RETTMPWGLEIFYRRDPSGF

SEQ ID NO: 158619 - protein, 18 aa, Mycobacterium bovis
RETWLIMRLPVIGNTQAL

SEQ ID NO: 158620 - protein, 25 aa, Mycobacterium bovis
REVLGSKDGKAWILPIGLAGDLGTP

SEQ ID NO: 158621 - protein, 20 aa, Mycobacterium bovis
REVLPRDVVEKEPEPEPEPK

SEQ ID NO: 158622 - protein, 21 aa, Mycobacterium bovis
REVLPRLGPAVAASKPAYWAA

SEQ ID NO: 158623 - protein, 25 aa, Mycobacterium bovis
REYHTERLWSAIGLVPQRSYLFSGT

SEQ ID NO: 158624 - protein, 18 aa, Mycobacterium bovis
RFGFLITALCLFTAVFIM

SEQ ID NO: 158625 - protein, 17 aa, Mycobacterium bovis
RFGPLTPPRAVAIITQI

SEQ ID NO: 158626 - protein, 21 aa, Mycobacterium bovis
RFKDLELRYARIARALALEGA

SEQ ID NO: 158627 - protein, 18 aa, Mycobacterium bovis
RFPGRTAVFLVIIAALMV

SEQ ID NO: 158628 - protein, 18 aa, Mycobacterium bovis
RFPVVDRGGRFIGYLHIK

SEQ ID NO: 158629 - protein, 17 aa, Mycobacterium bovis
RFQPGFEEADTRVQAAV

SEQ ID NO: 158630 - protein, 17 aa, Mycobacterium bovis
RFRGHFWLATIVVLTIQ

SEQ ID NO: 158631 - protein, 21 aa, Mycobacterium bovis
RFRLEARAVARLNNRALVAVY

SEQ ID NO: 158632 - protein, 18 aa, Mycobacterium bovis
RFTGWQWVLSALALPVVT

SEQ ID NO: 158633 - protein, 23 aa, Mycobacterium bovis
RGACEIFSFHATKPFAVGEGGAL

SEQ ID NO: 158634 - protein, 20 aa, Mycobacterium bovis
RGAGEGRLIRALTTAPVPIV

SEQ ID NO: 158635 - protein, 19 aa, Mycobacterium bovis
RGALATVIRAMGSLGMSSP

SEQ ID NO: 158636 - protein, 27 aa, Mycobacterium bovis
RGALPSVPRWLWIVLAIGFLTAALAGG

SEQ ID NO: 158637 - protein, 18 aa, Mycobacterium bovis
RGAPALALVAAPRPDASY

SEQ ID NO: 158638 - protein, 17 aa, Mycobacterium bovis
RGAVSLAAALAVPMTTN

SEQ ID NO: 158639 - protein, 21 aa, Mycobacterium bovis
RGDQLGGRRRPPGPPGPPGSS

SEQ ID NO: 158640 - protein, 32 aa, Mycobacterium bovis
RGFVLPALMVLLGRWLWWPRRSVSNRQVPEPS

SEQ ID NO: 158641 - protein, 32 aa, Mycobacterium bovis
RGGKTRARRSRGRRLAITVGVAAALFVGSAAF

SEQ ID NO: 158642 - protein, 19 aa, Mycobacterium bovis
RGGPAAGHRWGYLPPEGQG

SEQ ID NO: 158643 - protein, 22 aa, Mycobacterium bovis
RGHTSVLRIARAVNVSFLVFVL

SEQ ID NO: 158644 - protein, 17 aa, Mycobacterium bovis
RGIPRLASVAPLDPNVV

SEQ ID NO: 158645 - protein, 22 aa, Mycobacterium bovis
RGIVGRTMLVWLLCSGVPNVGV

SEQ ID NO: 158646 - protein, 19 aa, Mycobacterium bovis
RGLGSRWVAMNDLTLASAG

SEQ ID NO: 158647 - protein, 24 aa, Mycobacterium bovis
RGLPRAVAVTLVLLSGFAVLGGIL

SEQ ID NO: 158648 - protein, 26 aa, Mycobacterium bovis
RGLQALWRRGAEVFADVTLPEGVPIR

SEQ ID NO: 158649 - protein, 20 aa, Mycobacterium bovis
RGNSWPVGRLIAWLTGCAAL

SEQ ID NO: 158650 - protein, 24 aa, Mycobacterium bovis
RGPMPPHAVVAVLRPVLGGLAAAH

SEQ ID NO: 158651 - protein, 18 aa, Mycobacterium bovis
RGPYRWMRHPNYVAVVAE

SEQ ID NO: 158652 - protein, 25 aa, Mycobacterium bovis
RGQFEGRLWIAMQFVDGGNAEDALR

SEQ ID NO: 158653 - protein, 17 aa, Mycobacterium bovis
RGQKMIIGMRGSYGGVV

SEQ ID NO: 158654 - protein, 25 aa, Mycobacterium bovis
RGRLPLLCCLVAFVLTFLVTRSFVR

SEQ ID NO: 158655 - protein, 20 aa, Mycobacterium bovis
RGRLVTMLLVGVVLLAVGHR

SEQ ID NO: 158656 - protein, 19 aa, Mycobacterium bovis
RGSQWAGMGRQLLADEPAF

SEQ ID NO: 158657 - protein, 18 aa, Mycobacterium bovis
RGSTGFARPWAIPLVTTG

SEQ ID NO: 158658 - protein, 18 aa, Mycobacterium bovis
RGSYGGVVMIGMLSSVVG

SEQ ID NO: 158659 - protein, 23 aa, Mycobacterium bovis
RGTIAFLGYHGMVGLSTFVVNIL

SEQ ID NO: 158660 - protein, 22 aa, Mycobacterium bovis
RGVGVCGGRVRGRVRIVRPETI

SEQ ID NO: 158661 - protein, 21 aa, Mycobacterium bovis
RHFPQARMEPEVLMVEADHDL

SEQ ID NO: 158662 - protein, 35 aa, Mycobacterium bovis
RHRDLWRMQVTLKPVPVILILLMLISGGATGWLYL

SEQ ID NO: 158663 - protein, 19 aa, Mycobacterium bovis
RIAAPRWHFDLSDRLATLL

SEQ ID NO: 158664 - protein, 17 aa, Mycobacterium bovis
RIAGFVVNVHWSVLVIL

SEQ ID NO: 158665 - protein, 20 aa, Mycobacterium bovis
RIAIGSVRNKLLLILPGALL

SEQ ID NO: 158666 - protein, 25 aa, Mycobacterium bovis
RIALPLLAYFAIMWVGGYLLGAALR

SEQ ID NO: 158667 - protein, 17 aa, Mycobacterium bovis
RIARYVAVVAGLLGAVL

SEQ ID NO: 158668 - protein, 18 aa, Mycobacterium bovis
RIDRVPRYELVRCGLDVP

SEQ ID NO: 158669 - protein, 21 aa, Mycobacterium bovis
RIECACKVWAAGVAASPLGKM

SEQ ID NO: 158670 - protein, 17 aa, Mycobacterium bovis
RIGLRGGGWAGLVCLLV

SEQ ID NO: 158671 - protein, 25 aa, Mycobacterium bovis
RILEKGSSIPGGWFTITVLLILLMI

SEQ ID NO: 158672 - protein, 23 aa, Mycobacterium bovis
RILGHATDLLFNGVIGRGLPGGI

SEQ ID NO: 158673 - protein, 19 aa, Mycobacterium bovis
RILIMIALGVIVLLLAGPR

SEQ ID NO: 158674 - protein, 19 aa, Mycobacterium bovis
RIRELERPLADVARASELG

SEQ ID NO: 158675 - protein, 22 aa, Mycobacterium bovis
RIRELQRQLGILSQVNDNLAGL

SEQ ID NO: 158676 - protein, 18 aa, Mycobacterium bovis
RITGWVAAVYAWLRRRRR

SEQ ID NO: 158677 - protein, 18 aa, Mycobacterium bovis
RKDIARFAAYTRGRVQEV

SEQ ID NO: 158678 - protein, 18 aa, Mycobacterium bovis
RKEPTFTGAGYTDIHAEL

SEQ ID NO: 158679 - protein, 20 aa, Mycobacterium bovis
RKEYLRYLAGLRTRVTSSAT

SEQ ID NO: 158680 - protein, 22 aa, Mycobacterium bovis
RKGQESFNFGEFFAFTKVCSHL

SEQ ID NO: 158681 - protein, 17 aa, Mycobacterium bovis
RKLAPRVQARNPVMLVV

SEQ ID NO: 158682 - protein, 21 aa, Mycobacterium bovis
RKLQNPSWRPGAWACSLVVVA

SEQ ID NO: 158683 - protein, 19 aa, Mycobacterium bovis
RLAIGGGLGGLLVVVVAML

SEQ ID NO: 158684 - protein, 19 aa, Mycobacterium bovis
RLAQQKVLLFGIAFALVTR

SEQ ID NO: 158685 - protein, 25 aa, Mycobacterium bovis
RLARTELDGLIVLPDRTRAGIERGI

SEQ ID NO: 158686 - protein, 17 aa, Mycobacterium bovis
RLCELAKSYPSRLLASS

SEQ ID NO: 158687 - protein, 26 aa, Mycobacterium bovis
RLDRRLDEAAGFAIPFVPRGLDEIPR

SEQ ID NO: 158688 - protein, 26 aa, Mycobacterium bovis
RLEFPGKRLLIGAALLITMFPSISLV

SEQ ID NO: 158689 - protein, 23 aa, Mycobacterium bovis
RLELWRSDMVRMLAYGEIDARVK

SEQ ID NO: 158690 - protein, 20 aa, Mycobacterium bovis
RLETSCYNPSFGGMDRQSRV

SEQ ID NO: 158691 - protein, 22 aa, Mycobacterium bovis
RLFGELEFWASLIKVIALVTFL

SEQ ID NO: 158692 - protein, 17 aa, Mycobacterium bovis
RLFRALRRGELDSGTST

SEQ ID NO: 158693 - protein, 23 aa, Mycobacterium bovis
RLGATPLPVWGIIAGKSLAVVAV

SEQ ID NO: 158694 - protein, 23 aa, Mycobacterium bovis
RLGKLHFWLTFIGFHTTFLVQHW

SEQ ID NO: 158695 - protein, 18 aa, Mycobacterium bovis
RLGWYVIIGTIPICILGL

SEQ ID NO: 158696 - protein, 19 aa, Mycobacterium bovis
RLHIVIGVIMLLLAARMVA

SEQ ID NO: 158697 - protein, 18 aa, Mycobacterium bovis
RLHQVAGPAGRSVVMAGV

SEQ ID NO: 158698 - protein, 19 aa, Mycobacterium bovis
RLIATGGMGQVWEAVDNRL

SEQ ID NO: 158699 - protein, 18 aa, Mycobacterium bovis
RLIWPVVVLVLLTGLAAF

SEQ ID NO: 158700 - protein, 22 aa, Mycobacterium bovis
RLKTFLLLVGMSALIVAVGALF

SEQ ID NO: 158701 - protein, 26 aa, Mycobacterium bovis
RLLAPLKLPLVLSGVLAALVTLAQLA

SEQ ID NO: 158702 - protein, 21 aa, Mycobacterium bovis
RLLEDLRRARGLTVVVVSHDF

SEQ ID NO: 158703 - protein, 18 aa, Mycobacterium bovis
RLLGRGGMGEVYEAEHTV

SEQ ID NO: 158704 - protein, 17 aa, Mycobacterium bovis
RLLQGFAVGGEWAGSAL

SEQ ID NO: 158705 - protein, 26 aa, Mycobacterium bovis
RLLRVTRWDVGLAMLIAGGVNAAMLL

SEQ ID NO: 158706 - protein, 17 aa, Mycobacterium bovis
RLMGVIFGTMFFLMFTP

SEQ ID NO: 158707 - protein, 26 aa, Mycobacterium bovis
RLMTPLRVMFAIALVFLALGWSTKAA

SEQ ID NO: 158708 - protein, 19 aa, Mycobacterium bovis
RLMVFGGQISFCLYMVHEL

SEQ ID NO: 158709 - protein, 18 aa, Mycobacterium bovis
RLNAFSFWLFVFGATIGA

SEQ ID NO: 158710 - protein, 19 aa, Mycobacterium bovis
RLPAPWRIPLQAGLGSVLV

SEQ ID NO: 158711 - protein, 29 aa, Mycobacterium bovis
RLPDLAAGLVCWLLLSREVLPRLGPAVAA

SEQ ID NO: 158712 - protein, 18 aa, Mycobacterium bovis
RLPLAMVFLLAIAGAFVV

SEQ ID NO: 158713 - protein, 18 aa, Mycobacterium bovis
RLPPLAVGMGMYLPAALT

SEQ ID NO: 158714 - protein, 20 aa, Mycobacterium bovis
RLPRLCRKYLLTPSRQAKER

SEQ ID NO: 158715 - protein, 20 aa, Mycobacterium bovis
RLPRQDALKVLRADVSADGE

SEQ ID NO: 158716 - protein, 29 aa, Mycobacterium bovis
RLPTLAMALTCWWVISREVIPRLGHAVKT

SEQ ID NO: 158717 - protein, 26 aa, Mycobacterium bovis
RLPYPGRIGLLFAVMPFHAFFGIALM

SEQ ID NO: 158718 - protein, 18 aa, Mycobacterium bovis
RLQLGRPAVLVVRCTVLV

SEQ ID NO: 158719 - protein, 19 aa, Mycobacterium bovis
RLREVHALLYHKVFDTLGS

SEQ ID NO: 158720 - protein, 22 aa, Mycobacterium bovis
RLRRLWLAVLIVAPATIWLEPI

SEQ ID NO: 158721 - protein, 20 aa, Mycobacterium bovis
RLRRRLRQHRFEFLADDGRL

SEQ ID NO: 158722 - protein, 17 aa, Mycobacterium bovis
RLSIAVITLGIAGTTIG

SEQ ID NO: 158723 - protein, 20 aa, Mycobacterium bovis
RLSYFLDLRGPSVAVDTACS

SEQ ID NO: 158724 - protein, 19 aa, Mycobacterium bovis
RLTGELPPGAVRIGRANDN

SEQ ID NO: 158725 - protein, 28 aa, Mycobacterium bovis
RLTHHRCTPREWMWAVLLAGAVAVIVMS

SEQ ID NO: 158726 - protein, 20 aa, Mycobacterium bovis
RLVEDLLLLARLDSGRPLER

SEQ ID NO: 158727 - protein, 26 aa, Mycobacterium bovis
RLVHAFSAPIGYLFRPYIIYRSREEL

SEQ ID NO: 158728 - protein, 20 aa, Mycobacterium bovis
RLVRSLRPLILLPLVLPPVV

SEQ ID NO: 158729 - protein, 19 aa, Mycobacterium bovis
RLYALHILLLPGIILALIG

SEQ ID NO: 158730 - protein, 20 aa, Mycobacterium bovis
RMAPFHHHFELVGWAETTVI

SEQ ID NO: 158731 - protein, 36 aa, Mycobacterium bovis
RMARVRGWRKVGAAIVRWPGPILVGAVALALVGLLT

SEQ ID NO: 158732 - protein, 27 aa, Mycobacterium bovis
RMIHAFAVPIILGWLAVCVVVTVFVPS

SEQ ID NO: 158733 - protein, 20 aa, Mycobacterium bovis
RMQFATGVLIISMVTLVFGF

SEQ ID NO: 158734 - protein, 17 aa, Mycobacterium bovis
RNLIIFVVSVVILVTVL

SEQ ID NO: 158735 - protein, 18 aa, Mycobacterium bovis
RNTDYRLGWYVIIGTIPI

SEQ ID NO: 158736 - protein, 17 aa, Mycobacterium bovis
RNTFWALVLPFMFGSPY

SEQ ID NO: 158737 - protein, 20 aa, Mycobacterium bovis
RPAGLGVVFGLAFFQVLLVA

SEQ ID NO: 158738 - protein, 20 aa, Mycobacterium bovis
RPAPTDGFVGVAPDARLLSL

SEQ ID NO: 158739 - protein, 21 aa, Mycobacterium bovis
RPAQETWIALEIAYAAGSSTR

SEQ ID NO: 158740 - protein, 19 aa, Mycobacterium bovis
RPASAVSRPSYRQCVQASA

SEQ ID NO: 158741 - protein, 24 aa, Mycobacterium bovis
RPDLARLDGVLSRALATAPADRFG

SEQ ID NO: 158742 - protein, 20 aa, Mycobacterium bovis
RPEGIIALGSLVTYVLIERS

SEQ ID NO: 158743 - protein, 22 aa, Mycobacterium bovis
RPEKPFIARMIHAFAVPIILGW

SEQ ID NO: 158744 - protein, 18 aa, Mycobacterium bovis
RPFAPRRLVRALLLPSGQ

SEQ ID NO: 158745 - protein, 20 aa, Mycobacterium bovis
RPFHWREAIEQGWFITSVSL

SEQ ID NO: 158746 - protein, 19 aa, Mycobacterium bovis
RPGARILGWGWLVLTIVGV

SEQ ID NO: 158747 - protein, 19 aa, Mycobacterium bovis
RPGDIVLIDRNCHKSHHYG

SEQ ID NO: 158748 - protein, 20 aa, Mycobacterium bovis
RPGWLALALVVVAFTYLCFT

SEQ ID NO: 158749 - protein, 22 aa, Mycobacterium bovis
RPHPYPRWLATAGAAGFALGVA

SEQ ID NO: 158750 - protein, 19 aa, Mycobacterium bovis
RPIANSVMFGATFSAEDFK

SEQ ID NO: 158751 - protein, 18 aa, Mycobacterium bovis
RPLDVGWSLVNTRSLFDH

SEQ ID NO: 158752 - protein, 17 aa, Mycobacterium bovis
RPLETKVVLDWDALPPV

SEQ ID NO: 158753 - protein, 19 aa, Mycobacterium bovis
RPLILLPLVLPPVVGGIAL

SEQ ID NO: 158754 - protein, 19 aa, Mycobacterium bovis
RPPVTAGLVAARAAGDPRP

SEQ ID NO: 158755 - protein, 23 aa, Mycobacterium bovis
RPQDPALCWSWQRSAGDQSPQST

SEQ ID NO: 158756 - protein, 19 aa, Mycobacterium bovis
RPRDVPVRTAIGAMAIAFY

SEQ ID NO: 158757 - protein, 24 aa, Mycobacterium bovis
RPRWSGRRLAFVVALVTVLMTAGL

SEQ ID NO: 158758 - protein, 18 aa, Mycobacterium bovis
RPTGASVRGGRSIGSGHP

SEQ ID NO: 158759 - protein, 19 aa, Mycobacterium bovis
RPVSVTPMVWVRPRQGPKL

SEQ ID NO: 158760 - protein, 20 aa, Mycobacterium bovis
RPWALPAQFWLYCGFTAITM

SEQ ID NO: 158761 - protein, 27 aa, Mycobacterium bovis
RPWHVPGRPRRAGVSSFGISGTNAHVI

SEQ ID NO: 158762 - protein, 22 aa, Mycobacterium bovis
RPWMAVMFFAGFLILYGLGVME

SEQ ID NO: 158763 - protein, 17 aa, Mycobacterium bovis
RPWNIKPGDVMPATYVG

SEQ ID NO: 158764 - protein, 20 aa, Mycobacterium bovis
RPWYLAWAGLVYVVATLATL

SEQ ID NO: 158765 - protein, 20 aa, Mycobacterium bovis
RPYAGERWWVLLLSLATAAV

SEQ ID NO: 158766 - protein, 19 aa, Mycobacterium bovis
RPYGPRPVVRELLLREGND

SEQ ID NO: 158767 - protein, 19 aa, Mycobacterium bovis
RQAETPLLLAVDGTLVGLI

SEQ ID NO: 158768 - protein, 21 aa, Mycobacterium bovis
RQAFGRPSGVQGSFVAERVRP

SEQ ID NO: 158769 - protein, 18 aa, Mycobacterium bovis
RQARRVVTVNLAIAATFI

SEQ ID NO: 158770 - protein, 18 aa, Mycobacterium bovis
RQFHHPLIYVLLVAGTIT

SEQ ID NO: 158771 - protein, 25 aa, Mycobacterium bovis
RQGWAVLAIMGIIWIGMSVAAMSFE

SEQ ID NO: 158772 - protein, 27 aa, Mycobacterium bovis
RQLPAPTTGAGWTGRLSLPVSSASALG

SEQ ID NO: 158773 - protein, 24 aa, Mycobacterium bovis
RQVTRELLELFNIDEQTLNTQGLV

SEQ ID NO: 158774 - protein, 18 aa, Mycobacterium bovis
RQWAPYHLRLDWLMWFAA

SEQ ID NO: 158775 - protein, 18 aa, Mycobacterium bovis
RRADRAAVLAAIKGAAHV

SEQ ID NO: 158776 - protein, 17 aa, Mycobacterium bovis
RRAQLWQAFTLQRKEDK

SEQ ID NO: 158777 - protein, 17 aa, Mycobacterium bovis
RRASAYGVFAAGLGAAT

SEQ ID NO: 158778 - protein, 18 aa, Mycobacterium bovis
RRAVEHRALMAIAFGDLG

SEQ ID NO: 158779 - protein, 23 aa, Mycobacterium bovis
RRCRWLVFTGWLLALVPAVYLAM

SEQ ID NO: 158780 - protein, 18 aa, Mycobacterium bovis
RRDIKAGHFSPMSHPQVM

SEQ ID NO: 158781 - protein, 36 aa, Mycobacterium bovis
RREHISLRPLWGIDQRLKRFGAMAAAMVLYVLISQL

SEQ ID NO: 158782 - protein, 24 aa, Mycobacterium bovis
RRFLPARWWSIGGLDTLVIAVLVW

SEQ ID NO: 158783 - protein, 21 aa, Mycobacterium bovis
RRFVAAIPECRANPVCSVAQE

SEQ ID NO: 158784 - protein, 20 aa, Mycobacterium bovis
RRGLALRGTLLGARQRRHAA

SEQ ID NO: 158785 - protein, 35 aa, Mycobacterium bovis
RRGLRRPWLYFVSSLFTSFAFAFAFYFATIERQHR

SEQ ID NO: 158786 - protein, 17 aa, Mycobacterium bovis
RRICTALAIGPGTVSVL

SEQ ID NO: 158787 - protein, 17 aa, Mycobacterium bovis
RRIEGLIAPGTFNIDPS

SEQ ID NO: 158788 - protein, 18 aa, Mycobacterium bovis
RRLLAWVGADENVRPLDV

SEQ ID NO: 158789 - protein, 26 aa, Mycobacterium bovis
RRLLPLLFVLYVINFVDRANISVAAL

SEQ ID NO: 158790 - protein, 25 aa, Mycobacterium bovis
RRLLREFRGPLALSLLLVAVQTCAG

SEQ ID NO: 158791 - protein, 18 aa, Mycobacterium bovis
RRLPGGPVLKPAIGGLLV

SEQ ID NO: 158792 - protein, 19 aa, Mycobacterium bovis
RRLRWRLMAVLAIAVGTYG

SEQ ID NO: 158793 - protein, 17 aa, Mycobacterium bovis
RRLTATAHRGARESSNI

SEQ ID NO: 158794 - protein, 17 aa, Mycobacterium bovis
RRMALRRMKVVAVGFLV

SEQ ID NO: 158795 - protein, 18 aa, Mycobacterium bovis
RRMLRLIRRYGPIMTMPI

SEQ ID NO: 158796 - protein, 20 aa, Mycobacterium bovis
RRNVQVFVCVVLVLAVIPTG

SEQ ID NO: 158797 - protein, 21 aa, Mycobacterium bovis
RRPKRLRPAPPVELDADESSP

SEQ ID NO: 158798 - protein, 21 aa, Mycobacterium bovis
RRQDLAMTWLLAGLVAGALSG

SEQ ID NO: 158799 - protein, 29 aa, Mycobacterium bovis
RRQLRLIVSDRGYFVFLALLPFIMGALSM

SEQ ID NO: 158800 - protein, 20 aa, Mycobacterium bovis
RRQVDIEGFELVRHVYNMAL

SEQ ID NO: 158801 - protein, 17 aa, Mycobacterium bovis
RRRALVVSLVCLTVSQL

SEQ ID NO: 158802 - protein, 24 aa, Mycobacterium bovis
RRRCRRATVGGVRFAAFLIASLGT

SEQ ID NO: 158803 - protein, 19 aa, Mycobacterium bovis
RRRFFGYLNLFLASMLLLV

SEQ ID NO: 158804 - protein, 21 aa, Mycobacterium bovis
RRRLAPPSSHQGTIIIEAPPE

SEQ ID NO: 158805 - protein, 26 aa, Mycobacterium bovis
RRRMPDLRGALLLAVTLGLVTLGLVK

SEQ ID NO: 158806 - protein, 20 aa, Mycobacterium bovis
RRRPMLNLFAFWVGGMVAGV

SEQ ID NO: 158807 - protein, 21 aa, Mycobacterium bovis
RRRRATARRKAPVKAPSATRQ

SEQ ID NO: 158808 - protein, 27 aa, Mycobacterium bovis
RRRRRALRWGLVFTAGCLLWGLVTALL

SEQ ID NO: 158809 - protein, 18 aa, Mycobacterium bovis
RRRSMLTLADRVAVLDSG

SEQ ID NO: 158810 - protein, 21 aa, Mycobacterium bovis
RRRTEVLAYAWLMPVSTVVQA

SEQ ID NO: 158811 - protein, 26 aa, Mycobacterium bovis
RRRTQHNVYIPWSMTVTPISQSDVGS

SEQ ID NO: 158812 - protein, 20 aa, Mycobacterium bovis
RRSAEPFLWLLFSAGGMVTA

SEQ ID NO: 158813 - protein, 22 aa, Mycobacterium bovis
RRSRGLAGLSVAWGLWEQASAM

SEQ ID NO: 158814 - protein, 28 aa, Mycobacterium bovis
RRTFLAPWRVAVGHLMFWGVGTALLTTL

SEQ ID NO: 158815 - protein, 19 aa, Mycobacterium bovis
RRTTLIVAHGLAIAEHADR

SEQ ID NO: 158816 - protein, 20 aa, Mycobacterium bovis
RRVALALSFGLRTALAVVLI

SEQ ID NO: 158817 - protein, 24 aa, Mycobacterium bovis
RRVPDVRGAVLLAFALGLLTLGLI

SEQ ID NO: 158818 - protein, 18 aa, Mycobacterium bovis
RRYADYLPTDGFQGLNVV

SEQ ID NO: 158819 - protein, 26 aa, Mycobacterium bovis
RRYGGLRAALPVTFATFGLAYLAIIG

SEQ ID NO: 158820 - protein, 17 aa, Mycobacterium bovis
RRYGPIMTMPILSLGDV

SEQ ID NO: 158821 - protein, 24 aa, Mycobacterium bovis
RSADGRRGVSIGVIVALVAVVVMV

SEQ ID NO: 158822 - protein, 18 aa, Mycobacterium bovis
RSAILSAVIFNALVIVAL

SEQ ID NO: 158823 - protein, 21 aa, Mycobacterium bovis
RSALPQSLRKLAPRVQARNPV

SEQ ID NO: 158824 - protein, 23 aa, Mycobacterium bovis
RSAMATLRIAFLSALVLELLATL

SEQ ID NO: 158825 - protein, 25 aa, Mycobacterium bovis
RSAPLSRRSLLIGNAVVAFAVIGFA

SEQ ID NO: 158826 - protein, 24 aa, Mycobacterium bovis
RSARSRAWVKVGYVLFVLAGIYAV

SEQ ID NO: 158827 - protein, 27 aa, Mycobacterium bovis
RSASWRRRLRVRLPRLSTIAMAAAVVI

SEQ ID NO: 158828 - protein, 21 aa, Mycobacterium bovis
RSGKTTLLRHIIRTVREHSTA

SEQ ID NO: 158829 - protein, 22 aa, Mycobacterium bovis
RSIDSARRWLIEGPAHLRGEQI

SEQ ID NO: 158830 - protein, 32 aa, Mycobacterium bovis
RSIPDATKAAARWIRPLVPPFVARMLDNTTAP

SEQ ID NO: 158831 - protein, 17 aa, Mycobacterium bovis
RSLAALFAALALALTGG

SEQ ID NO: 158832 - protein, 20 aa, Mycobacterium bovis
RSPAAPSLRRLGGSRHITHW

SEQ ID NO: 158833 - protein, 22 aa, Mycobacterium bovis
RSPITLRHKIFFVAVAVIGALA

SEQ ID NO: 158834 - protein, 20 aa, Mycobacterium bovis
RSPSRTVPRLKVEITTLVHM

SEQ ID NO: 158835 - protein, 23 aa, Mycobacterium bovis
RSPWLRTGDLGFIVGDEFYIVGR

SEQ ID NO: 158836 - protein, 21 aa, Mycobacterium bovis
RSRGPLWLIVVGFSAGVAVLV

SEQ ID NO: 158837 - protein, 17 aa, Mycobacterium bovis
RSRVARIMPAYVVAVVV

SEQ ID NO: 158838 - protein, 22 aa, Mycobacterium bovis
RSSKFVMRRWLPVGTAVVALLV

SEQ ID NO: 158839 - protein, 20 aa, Mycobacterium bovis
RSVIIRLADRFLRTSQDYNG

SEQ ID NO: 158840 - protein, 23 aa, Mycobacterium bovis
RSVRSLPDFWRLLQVRVASQFGD

SEQ ID NO: 158841 - protein, 18 aa, Mycobacterium bovis
RSWPRHRCCGWIMARIGF

SEQ ID NO: 158842 - protein, 24 aa, Mycobacterium bovis
RTAAQRLLAGWGIVLGLIGLVAVW

SEQ ID NO: 158843 - protein, 19 aa, Mycobacterium bovis
RTAFTLAAGLLFGSVVGVF

SEQ ID NO: 158844 - protein, 23 aa, Mycobacterium bovis
RTDDLRPIPVFGSDELARLTEAF

SEQ ID NO: 158845 - protein, 18 aa, Mycobacterium bovis
RTDLSMLLGLIFLLWSGP

SEQ ID NO: 158846 - protein, 20 aa, Mycobacterium bovis
RTFADLLLRTEVRRVEPVQR

SEQ ID NO: 158847 - protein, 20 aa, Mycobacterium bovis
RTGMKVRRYFVGFGPTLWST

SEQ ID NO: 158848 - protein, 20 aa, Mycobacterium bovis
RTGPFKWVRHPIYTAMMAFG

SEQ ID NO: 158849 - protein, 18 aa, Mycobacterium bovis
RTIREFIGAVLLVPTVIA

SEQ ID NO: 158850 - protein, 17 aa, Mycobacterium bovis
RTLGLIVVCCYVALVVT

SEQ ID NO: 158851 - protein, 23 aa, Mycobacterium bovis
RTLPRWQRIVALTMIGISTALIG

SEQ ID NO: 158852 - protein, 24 aa, Mycobacterium bovis
RTLPRWQRIVALTMIGISTALIGG

SEQ ID NO: 158853 - protein, 23 aa, Mycobacterium bovis
RTLRTDLWWLPPLLTNLGLLAFI

SEQ ID NO: 158854 - protein, 22 aa, Mycobacterium bovis
RTPAIVISVAWWLATVNLLLGL

SEQ ID NO: 158855 - protein, 22 aa, Mycobacterium bovis
RTPGESSFYWLTLALAAVWIAG

SEQ ID NO: 158856 - protein, 24 aa, Mycobacterium bovis
RTQSRAVLMGVLIVITGLIGSFVF

SEQ ID NO: 158857 - protein, 22 aa, Mycobacterium bovis
RTREVPALAGINLRIPAGQTVV

SEQ ID NO: 158858 - protein, 19 aa, Mycobacterium bovis
RTRMSTILHGVWILLFASL

SEQ ID NO: 158859 - protein, 21 aa, Mycobacterium bovis
RTSDMKALFTAIIDDDPLPLE

SEQ ID NO: 158860 - protein, 19 aa, Mycobacterium bovis
RTSTLVLIAAFLAVWWIYE

SEQ ID NO: 158861 - protein, 19 aa, Mycobacterium bovis
RTTLAWTRTAFALLVNGVL

SEQ ID NO: 158862 - protein, 19 aa, Mycobacterium bovis
RTVDLRRKILFTLGIVILY

SEQ ID NO: 158863 - protein, 23 aa, Mycobacterium bovis
RVADGLITFFALVIVTSLSMVFG

SEQ ID NO: 158864 - protein, 18 aa, Mycobacterium bovis
RVANLFLTKTVYSVLLAL

SEQ ID NO: 158865 - protein, 20 aa, Mycobacterium bovis
RVARIMPAYVVAVVVILSLL

SEQ ID NO: 158866 - protein, 18 aa, Mycobacterium bovis
RVDMVCFDKTGTLSENRL

SEQ ID NO: 158867 - protein, 21 aa, Mycobacterium bovis
RVDTVLRAKVDGAWNLHELTE

SEQ ID NO: 158868 - protein, 20 aa, Mycobacterium bovis
RVGARIILLNSEFSGPQIKE

SEQ ID NO: 158869 - protein, 28 aa, Mycobacterium bovis
RVGQINWKWIRRSLYLTAAVVILLLMVT

SEQ ID NO: 158870 - protein, 20 aa, Mycobacterium bovis
RVHAAPGLHKLVYVGWTAIR

SEQ ID NO: 158871 - protein, 18 aa, Mycobacterium bovis
RVHVVIDDAMSWLRGAAV

SEQ ID NO: 158872 - protein, 17 aa, Mycobacterium bovis
RVIPRVGVASVIAEGFL

SEQ ID NO: 158873 - protein, 18 aa, Mycobacterium bovis
RVLTKPRFRGWIHVYSAG

SEQ ID NO: 158874 - protein, 17 aa, Mycobacterium bovis
RVNLRAGQQVRIDQGPA

SEQ ID NO: 158875 - protein, 28 aa, Mycobacterium bovis
RVPLPGSAPRPAWLRAFAHPERDKRVAV

SEQ ID NO: 158876 - protein, 18 aa, Mycobacterium bovis
RVRAKIGPSQAWYTENLR

SEQ ID NO: 158877 - protein, 20 aa, Mycobacterium bovis
RVSLVPTLLVSIPFTVLVAF

SEQ ID NO: 158878 - protein, 22 aa, Mycobacterium bovis
RVTDVFLGLPLLLAAIVLMQVM

SEQ ID NO: 158879 - protein, 26 aa, Mycobacterium bovis
RVVGRGRPADRPALLGAVKTNVGHLE

SEQ ID NO: 158880 - protein, 20 aa, Mycobacterium bovis
RVVTIAGLVFAFTMGSMVAS

SEQ ID NO: 158881 - protein, 18 aa, Mycobacterium bovis
RVYAARLAPVAAGLTLPS

SEQ ID NO: 158882 - protein, 22 aa, Mycobacterium bovis
RWRVDIDGTLSFLLLPRLTTVL

SEQ ID NO: 158883 - protein, 24 aa, Mycobacterium bovis
RWVRIKRIVTVYIMTANLTGIVVA

SEQ ID NO: 158884 - protein, 17 aa, Mycobacterium bovis
RWYWIGLAVGILVGVAF

SEQ ID NO: 158885 - protein, 26 aa, Mycobacterium bovis
RYFAEGLQYWPWVLLGYFNIGIMIVS

SEQ ID NO: 158886 - protein, 24 aa, Mycobacterium bovis
RYGGDAWVIREGRRSRIEPTNRAV

SEQ ID NO: 158887 - protein, 24 aa, Mycobacterium bovis
RYGSREPLVLTALLQLLSAVAQNC

SEQ ID NO: 158888 - protein, 20 aa, Mycobacterium bovis
RYIAPHYLGYAFSGLYTPAQ

SEQ ID NO: 158889 - protein, 18 aa, Mycobacterium bovis
RYLEAAGISIAFSTAAVV

SEQ ID NO: 158890 - protein, 21 aa, Mycobacterium bovis
RYPASGGTYVYGRMRLGDFWG

SEQ ID NO: 158891 - protein, 19 aa, Mycobacterium bovis
RYRALDFGLDVGRAQPPAS

SEQ ID NO: 158892 - protein, 19 aa, Mycobacterium bovis
SAAPNFAFDLAVAKTSEED

SEQ ID NO: 158893 - protein, 20 aa, Mycobacterium bovis
SADAPPFFVLHGRNDSLVPV

SEQ ID NO: 158894 - protein, 23 aa, Mycobacterium bovis
SADSRAHCPLLCTNDPLPGTVPV

SEQ ID NO: 158895 - protein, 20 aa, Mycobacterium bovis
SADTRRSLVFAICGITTVAT

SEQ ID NO: 158896 - protein, 19 aa, Mycobacterium bovis
SADVRMVLKSAAKLKRLAP

SEQ ID NO: 158897 - protein, 19 aa, Mycobacterium bovis
SAGDVFDIFDPLRRFVAAI

SEQ ID NO: 158898 - protein, 23 aa, Mycobacterium bovis
SAGYLRKWFLLGITIGVIAGLGA

SEQ ID NO: 158899 - protein, 24 aa, Mycobacterium bovis
SAIAFLIFAVWVWREDTASDSETS

SEQ ID NO: 158900 - protein, 36 aa, Mycobacterium bovis
SAISAMLIYRLISWLLIAAIGWVVFFFMFRTESTAD

SEQ ID NO: 158901 - protein, 22 aa, Mycobacterium bovis
SAITGGVGWWYILVATGFVVFA

SEQ ID NO: 158902 - protein, 19 aa, Mycobacterium bovis
SALATVWRAGVRLWTPSLA

SEQ ID NO: 158903 - protein, 20 aa, Mycobacterium bovis
SALCFVGAVVLLYVDIDRRR

SEQ ID NO: 158904 - protein, 27 aa, Mycobacterium bovis
SALLSELPAVAWVWFQLFVDILGFNII

SEQ ID NO: 158905 - protein, 26 aa, Mycobacterium bovis
SALMWQWREHRGPQMVAGLSIGLTTA

SEQ ID NO: 158906 - protein, 29 aa, Mycobacterium bovis
SALRAGVGFIPFVIAMGIGLGVSSQLVSR

SEQ ID NO: 158907 - protein, 30 aa, Mycobacterium bovis
SALVGVLCCIGSIVGIVFGAIAINQIKQTR

SEQ ID NO: 158908 - protein, 21 aa, Mycobacterium bovis
SAMNRFKRDYLAAYISASSDP

SEQ ID NO: 158909 - protein, 25 aa, Mycobacterium bovis
SAPPLRLLEDLPRRVRVSDAHQSGF

SEQ ID NO: 158910 - protein, 18 aa, Mycobacterium bovis
SAPPQWFAGLVVVFTAAV

SEQ ID NO: 158911 - protein, 17 aa, Mycobacterium bovis
SAPRAGTLLGQHTTVAT

SEQ ID NO: 158912 - protein, 24 aa, Mycobacterium bovis
SAPRLRLAKRSLFDPMIVRSALPQ

SEQ ID NO: 158913 - protein, 17 aa, Mycobacterium bovis
SARAKVANREWVARSAR

SEQ ID NO: 158914 - protein, 26 aa, Mycobacterium bovis
SARLKATMLAHWAWLSMLLVGGAGAA

SEQ ID NO: 158915 - protein, 18 aa, Mycobacterium bovis
SASGLGFAIPVNEMKLVA

SEQ ID NO: 158916 - protein, 17 aa, Mycobacterium bovis
SATEWWLGPEPDSPRRM

SEQ ID NO: 158917 - protein, 18 aa, Mycobacterium bovis
SATFLLRQQRIWGASTVV

SEQ ID NO: 158918 - protein, 28 aa, Mycobacterium bovis
SAVAAVYVVFRWFFARDLRVVPDRQQLK

SEQ ID NO: 158919 - protein, 26 aa, Mycobacterium bovis
SAVGMGRFALGRAVDYVKTRKVWSTP

SEQ ID NO: 158920 - protein, 23 aa, Mycobacterium bovis
SAVYMLWLYQRVMTGPIAEGNER

SEQ ID NO: 158921 - protein, 29 aa, Mycobacterium bovis
SAWAVAGLGWLRRHTRAIQIFGGALLIAV

SEQ ID NO: 158922 - protein, 37 aa, Mycobacterium bovis
SCEITATALLVVFIRYHFSMVWGLYLAAGIMVLASFV

SEQ ID NO: 158923 - protein, 18 aa, Mycobacterium bovis
SCSWKIYVKDGIITWETQ

SEQ ID NO: 158924 - protein, 21 aa, Mycobacterium bovis
SDAIAAFLWTANWRFVAQNTD

SEQ ID NO: 158925 - protein, 23 aa, Mycobacterium bovis
SDFARLGLLAGVILTSVWLFDCW

SEQ ID NO: 158926 - protein, 24 aa, Mycobacterium bovis
SDGEPATEWTLNWAHQLIENAPHP

SEQ ID NO: 158927 - protein, 18 aa, Mycobacterium bovis
SDILLKEYWNRPEATRDA

SEQ ID NO: 158928 - protein, 18 aa, Mycobacterium bovis
SDLLWSFMQAIAMSIAVM

SEQ ID NO: 158929 - protein, 19 aa, Mycobacterium bovis
SEALVADALLALAYTATGG

SEQ ID NO: 158930 - protein, 30 aa, Mycobacterium bovis
SEFLVLLGTFSRYWLAAAFGVTALVLSAVY

SEQ ID NO: 158931 - protein, 18 aa, Mycobacterium bovis
SEGLRASIVVPAITNDMP

SEQ ID NO: 158932 - protein, 21 aa, Mycobacterium bovis
SEGWWPTLIGLAMNDSGGYNA

SEQ ID NO: 158933 - protein, 21 aa, Mycobacterium bovis
SELHPDSAVVLVFVDQSTTSK

SEQ ID NO: 158934 - protein, 21 aa, Mycobacterium bovis
SELPDCIVVSVSHRPALERLH

SEQ ID NO: 158935 - protein, 17 aa, Mycobacterium bovis
SELPDLRAANYPRADHA

SEQ ID NO: 158936 - protein, 20 aa, Mycobacterium bovis
SELRPPVRSGFGSRIELRLA

SEQ ID NO: 158937 - protein, 23 aa, Mycobacterium bovis
SELWAEAGKLGFLGVNLPEEYGG

SEQ ID NO: 158938 - protein, 24 aa, Mycobacterium bovis
SENECARWSLGETVTLRGHDQPIR

SEQ ID NO: 158939 - protein, 17 aa, Mycobacterium bovis
SENFDYMGLLLLSPGLA

SEQ ID NO: 158940 - protein, 21 aa, Mycobacterium bovis
SEPFGLAWRLNRGSLLLWTVG

SEQ ID NO: 158941 - protein, 17 aa, Mycobacterium bovis
SEPLPVRRPASVRRLPP

SEQ ID NO: 158942 - protein, 19 aa, Mycobacterium bovis
SERQRLRDLFGRYVGEDVA

SEQ ID NO: 158943 - protein, 25 aa, Mycobacterium bovis
SEYQSSSALLAWLTAAAVAIAMLTL

SEQ ID NO: 158944 - protein, 23 aa, Mycobacterium bovis
SFDGYEYLFWVGCAGAYDDKAKK

SEQ ID NO: 158945 - protein, 17 aa, Mycobacterium bovis
SFEAKKDIIAYVKVATE

SEQ ID NO: 158946 - protein, 19 aa, Mycobacterium bovis
SFGDMRSAFYAGYEEADRE

SEQ ID NO: 158947 - protein, 23 aa, Mycobacterium bovis
SFMNFAYGWAFSSPVRKIYYNIT

SEQ ID NO: 158948 - protein, 27 aa, Mycobacterium bovis
SFRRRLDEYIGFLVAWQRPLAGKKTLM

SEQ ID NO: 158949 - protein, 35 aa, Mycobacterium bovis
SFTFMTPAAFVRRPGRWIRELARKPGETGGTFSAA

SEQ ID NO: 158950 - protein, 20 aa, Mycobacterium bovis
SFTTLRLIYQEMLANYHVGQ

SEQ ID NO: 158951 - protein, 18 aa, Mycobacterium bovis
SFVTARTALLDGFLTFFV

SEQ ID NO: 158952 - protein, 19 aa, Mycobacterium bovis
SGAARPARRSVAEVHAAND

SEQ ID NO: 158953 - protein, 24 aa, Mycobacterium bovis
SGCSWSEALGIGWPEGITPEAHLN

SEQ ID NO: 158954 - protein, 17 aa, Mycobacterium bovis
SGGPFADAVAAVRAGRR

SEQ ID NO: 158955 - protein, 25 aa, Mycobacterium bovis
SGGVPLGGWLARSVFAAKFAERNFL

SEQ ID NO: 158956 - protein, 31 aa, Mycobacterium bovis
SGIAEGLRFVWNLRVLRTLGMIDLTVTALYL

SEQ ID NO: 158957 - protein, 17 aa, Mycobacterium bovis
SGIEGLLTWLGGGHWRE

SEQ ID NO: 158958 - protein, 17 aa, Mycobacterium bovis
SGIPMKKMHAVSVPPNY

SEQ ID NO: 158959 - protein, 23 aa, Mycobacterium bovis
SGKSEFLRTLILSLVAMTHPDQV

SEQ ID NO: 158960 - protein, 20 aa, Mycobacterium bovis
SGLAGRRIWDAALVAASPLV

SEQ ID NO: 158961 - protein, 20 aa, Mycobacterium bovis
SGLMRKAKELVIATKMSGEW

SEQ ID NO: 158962 - protein, 22 aa, Mycobacterium bovis
SGLRTLPMVIGLLIASTGTGVL

SEQ ID NO: 158963 - protein, 21 aa, Mycobacterium bovis
SGLWLGIAGWSLWAANSPGMG

SEQ ID NO: 158964 - protein, 20 aa, Mycobacterium bovis
SGNFSWLNWLTILLACSAID

SEQ ID NO: 158965 - protein, 18 aa, Mycobacterium bovis
SGPAWRLIGTTAVGLLLL

SEQ ID NO: 158966 - protein, 25 aa, Mycobacterium bovis
SGPLADRSRRFWAWTIAGYTLTVVT

SEQ ID NO: 158967 - protein, 26 aa, Mycobacterium bovis
SGPLTGRFWPPIGGFLYWLRPNTIRL

SEQ ID NO: 158968 - protein, 21 aa, Mycobacterium bovis
SGQLHPVYNLTSARLVLGNPA

SEQ ID NO: 158969 - protein, 24 aa, Mycobacterium bovis
SGQRFPIKYYLTAMLFIVFDIEIV

SEQ ID NO: 158970 - protein, 19 aa, Mycobacterium bovis
SGRACITYRVEVGVCLASG

SEQ ID NO: 158971 - protein, 34 aa, Mycobacterium bovis
SGRRVHFDLDPLLPFPRWHEHAAMVEEPVRRIPG

SEQ ID NO: 158972 - protein, 20 aa, Mycobacterium bovis
SGSAPRFTARMSKSGVPYGG

SEQ ID NO: 158973 - protein, 26 aa, Mycobacterium bovis
SGTLSWCSPLGWSLQVRPYAGERWWV

SEQ ID NO: 158974 - protein, 18 aa, Mycobacterium bovis
SGYDFRPQIVGVFTDLAG

SEQ ID NO: 158975 - protein, 19 aa, Mycobacterium bovis
SHHYGLVLAGAYPMYLDAY

SEQ ID NO: 158976 - protein, 19 aa, Mycobacterium bovis
SHPMLSLGLPMLFIALGGI

SEQ ID NO: 158977 - protein, 19 aa, Mycobacterium bovis
SHSRWLRATQFLGYASMLG

SEQ ID NO: 158978 - protein, 23 aa, Mycobacterium bovis
SHSWAMAFATLISRITGFARIVL

SEQ ID NO: 158979 - protein, 17 aa, Mycobacterium bovis
SHVPFKAGEVTLLPSPM

SEQ ID NO: 158980 - protein, 24 aa, Mycobacterium bovis
SISREVFRQTPLIQIEAALALGAT

SEQ ID NO: 158981 - protein, 18 aa, Mycobacterium bovis
SIVAALFVFSLWIATLGF

SEQ ID NO: 158982 - protein, 20 aa, Mycobacterium bovis
SIYTDAPWWVTFGVAPAYAT

SEQ ID NO: 158983 - protein, 20 aa, Mycobacterium bovis
SKGLKWLSNINMALAAALAL

SEQ ID NO: 158984 - protein, 19 aa, Mycobacterium bovis
SKKDCKQNPIFDPLQPDDP

SEQ ID NO: 158985 - protein, 21 aa, Mycobacterium bovis
SKLMQCVADGPGYAGSSPTLG

SEQ ID NO: 158986 - protein, 21 aa, Mycobacterium bovis
SKSRVALYLLITIAPFAVIAP

SEQ ID NO: 158987 - protein, 20 aa, Mycobacterium bovis
SKWPVGWVVVLLYAVCVVLR

SEQ ID NO: 158988 - protein, 17 aa, Mycobacterium bovis
SLAFVALVLTWGKQIGP

SEQ ID NO: 158989 - protein, 25 aa, Mycobacterium bovis
SLANLLRYGYYPALILGLTVGVILL

SEQ ID NO: 158990 - protein, 25 aa, Mycobacterium bovis
SLAPRCQKVLEGTGFVISPDRVMTN

SEQ ID NO: 158991 - protein, 18 aa, Mycobacterium bovis
SLAPSVLILGSRFGCFEP

SEQ ID NO: 158992 - protein, 34 aa, Mycobacterium bovis
SLARERGWEIRDFRIARKAARIGVPSALALGAAG

SEQ ID NO: 158993 - protein, 24 aa, Mycobacterium bovis
SLCAAQLVGLGIMRYGVRSEPLHS

SEQ ID NO: 158994 - protein, 20 aa, Mycobacterium bovis
SLDAPLLRQIVNRGVVTAAG

SEQ ID NO: 158995 - protein, 27 aa, Mycobacterium bovis
SLDEPIAVVGMGCRFPGGISCPEALWD

SEQ ID NO: 158996 - protein, 24 aa, Mycobacterium bovis
SLEARLSLEFQRVSFGYVADRPVL

SEQ ID NO: 158997 - protein, 27 aa, Mycobacterium bovis
SLEDIIRFQAEFLWRDYFQPGVSIDGE

SEQ ID NO: 158998 - protein, 26 aa, Mycobacterium bovis
SLGGVLAYACAIGLRRLGKDVRFVGL

SEQ ID NO: 158999 - protein, 17 aa, Mycobacterium bovis
SLIPVVTFLGADLGALM

SEQ ID NO: 159000 - protein, 26 aa, Mycobacterium bovis
SLNNGFHGKWPWQMTHPMDGAVQIDK

SEQ ID NO: 159001 - protein, 17 aa, Mycobacterium bovis
SLQCRPDAAYLITGGLG

SEQ ID NO: 159002 - protein, 19 aa, Mycobacterium bovis
SLQRCGRVTAMVGDGANDA

SEQ ID NO: 159003 - protein, 19 aa, Mycobacterium bovis
SLRDKRTGLAVLDCAADVV

SEQ ID NO: 159004 - protein, 20 aa, Mycobacterium bovis
SLRLRKFGRYPLGCGTVGGP

SEQ ID NO: 159005 - protein, 26 aa, Mycobacterium bovis
SLRSRIGMVLQDTWLYDGTIAENIAY

SEQ ID NO: 159006 - protein, 18 aa, Mycobacterium bovis
SLTMAFAITEPDAGSNSH

SEQ ID NO: 159007 - protein, 25 aa, Mycobacterium bovis
SLYRIGALCPYCMVVWAVIATLLVV

SEQ ID NO: 159008 - protein, 20 aa, Mycobacterium bovis
SMDANYRWFHPAPNTLAAAV

SEQ ID NO: 159009 - protein, 19 aa, Mycobacterium bovis
SMFPFVWNVFKSWRYGEVV

SEQ ID NO: 159010 - protein, 25 aa, Mycobacterium bovis
SMLQRKLRVGFAKAGRLMDLMETRG

SEQ ID NO: 159011 - protein, 17 aa, Mycobacterium bovis
SMMLFPFLMTVVLPNSV

SEQ ID NO: 159012 - protein, 22 aa, Mycobacterium bovis
SMRKFFEAFAPYGLKQTAVKPS

SEQ ID NO: 159013 - protein, 17 aa, Mycobacterium bovis
SMVNLCLVTLVLTIPLA

SEQ ID NO: 159014 - protein, 18 aa, Mycobacterium bovis
SNEDGRTAVALGIGAGIG

SEQ ID NO: 159015 - protein, 17 aa, Mycobacterium bovis
SNRKAGVVQKIIDWSTR

SEQ ID NO: 159016 - protein, 24 aa, Mycobacterium bovis
SNTESRWRLGLYAAGRASQIRRLR

SEQ ID NO: 159017 - protein, 20 aa, Mycobacterium bovis
SNVIPTAFKWVARVTPSGAL

SEQ ID NO: 159018 - protein, 31 aa, Mycobacterium bovis
SNYREVFALMPFWRMFFNTVLYAGCVTAGQV

SEQ ID NO: 159019 - protein, 19 aa, Mycobacterium bovis
SPASRAVAQIVLLNNRFAT

SEQ ID NO: 159020 - protein, 23 aa, Mycobacterium bovis
SPCILPVLPVIFFSGAQSVDAAQ

SEQ ID NO: 159021 - protein, 22 aa, Mycobacterium bovis
SPDRRIMLADFGIAGWVDDPSG

SEQ ID NO: 159022 - protein, 23 aa, Mycobacterium bovis
SPETWRLGPATIRASRRPELGAS

SEQ ID NO: 159023 - protein, 19 aa, Mycobacterium bovis
SPFESIWILALVVGIWLVV

SEQ ID NO: 159024 - protein, 31 aa, Mycobacterium bovis
SPGEPVHVLAHDWGSVGVWEYLRRPGASDRV

SEQ ID NO: 159025 - protein, 23 aa, Mycobacterium bovis
SPGEWPWAYAMLLGIHVVLLFTC

SEQ ID NO: 159026 - protein, 26 aa, Mycobacterium bovis
SPLFPDLPSFPGFPGFPSLPGFPGLP

SEQ ID NO: 159027 - protein, 18 aa, Mycobacterium bovis
SPLWSGRVFAEARWLSVA

SEQ ID NO: 159028 - protein, 23 aa, Mycobacterium bovis
SPRLTNLLVVAAWVAAAVIANLL

SEQ ID NO: 159029 - protein, 23 aa, Mycobacterium bovis
SPRMRRVRIQGMLTVAILVTNVI

SEQ ID NO: 159030 - protein, 27 aa, Mycobacterium bovis
SPRSARRVAGVWTVFVLASAGWALGGQ

SEQ ID NO: 159031 - protein, 25 aa, Mycobacterium bovis
SPRSSSGNRAWWILAAVVVVGVLVL

SEQ ID NO: 159032 - protein, 19 aa, Mycobacterium bovis
SPRVPAEPGGDFVDQAGNG

SEQ ID NO: 159033 - protein, 38 aa, Mycobacterium bovis
SPSVLRWSRNRMAFLAALFFLLALCWATTNGWWYVSSY

SEQ ID NO: 159034 - protein, 24 aa, Mycobacterium bovis
SPVGLPHRWARRRVAMAVTALLGY

SEQ ID NO: 159035 - protein, 26 aa, Mycobacterium bovis
SPVSLGRGRLMFRATVQRLRDDETSG

SEQ ID NO: 159036 - protein, 19 aa, Mycobacterium bovis
SPVTLCWLLISYGFAASVL

SEQ ID NO: 159037 - protein, 20 aa, Mycobacterium bovis
SPWQIYWRILLPHSRPAVLV

SEQ ID NO: 159038 - protein, 17 aa, Mycobacterium bovis
SPYPARALAGGLHTAKR

SEQ ID NO: 159039 - protein, 17 aa, Mycobacterium bovis
SQARMKPEILMIESDHD

SEQ ID NO: 159040 - protein, 18 aa, Mycobacterium bovis
SQIWPLDRPGLLFDDMDD

SEQ ID NO: 159041 - protein, 21 aa, Mycobacterium bovis
SQLRTANWWWALLGLAVSALT

SEQ ID NO: 159042 - protein, 18 aa, Mycobacterium bovis
SQMAAGLLTHLAGDRIEV

SEQ ID NO: 159043 - protein, 20 aa, Mycobacterium bovis
SQTLRLSYMALFSVPVVAPL

SEQ ID NO: 159044 - protein, 21 aa, Mycobacterium bovis
SQVKLPSLLAMGFVTTVLAYR

SEQ ID NO: 159045 - protein, 23 aa, Mycobacterium bovis
SQVPGVAMVRGITRPAGRSLEQA

SEQ ID NO: 159046 - protein, 26 aa, Mycobacterium bovis
SRAKWDTLRAMGFDDIHISDSRSLEF

SEQ ID NO: 159047 - protein, 19 aa, Mycobacterium bovis
SRAVRWDDIDGLRFHRGSW

SEQ ID NO: 159048 - protein, 19 aa, Mycobacterium bovis
SRESLFWVSGNGVRFGIAN

SEQ ID NO: 159049 - protein, 23 aa, Mycobacterium bovis
SRETLGRNCWRGERRAWIEVRGL

SEQ ID NO: 159050 - protein, 20 aa, Mycobacterium bovis
SRLDVPALWAPRRRDEELRV

SEQ ID NO: 159051 - protein, 21 aa, Mycobacterium bovis
SRLNMVSALDPHSGDIVNPSG

SEQ ID NO: 159052 - protein, 18 aa, Mycobacterium bovis
SRMARAALAIAPVVVHAM

SEQ ID NO: 159053 - protein, 27 aa, Mycobacterium bovis
SRMWRRSGVRIVRRPTIHLVGSLIVLV

SEQ ID NO: 159054 - protein, 20 aa, Mycobacterium bovis
SRPAAEVVMLLNRFFTVIVD

SEQ ID NO: 159055 - protein, 19 aa, Mycobacterium bovis
SRPAVLVLGVLTWVNVWND

SEQ ID NO: 159056 - protein, 23 aa, Mycobacterium bovis
SRPHAPWARWRYTRHPEKMRRAL

SEQ ID NO: 159057 - protein, 17 aa, Mycobacterium bovis
SRRGRRLAPELAGVWTA

SEQ ID NO: 159058 - protein, 20 aa, Mycobacterium bovis
SRRLEIRLTTLLGAGFGLGI

SEQ ID NO: 159059 - protein, 17 aa, Mycobacterium bovis
SRRSFGFHCQVVGVRQQ

SEQ ID NO: 159060 - protein, 18 aa, Mycobacterium bovis
SRSWCGRAGTATIAAVLL

SEQ ID NO: 159061 - protein, 24 aa, Mycobacterium bovis
SRTLPELWSLLGHIDAVHGLYYLL

SEQ ID NO: 159062 - protein, 17 aa, Mycobacterium bovis
SRWAVFRRVLLPQLRPT

SEQ ID NO: 159063 - protein, 19 aa, Mycobacterium bovis
SSHELRTPLTAMRTNLEVL

SEQ ID NO: 159064 - protein, 19 aa, Mycobacterium bovis
SSLLLNWVLGPALMFALAW

SEQ ID NO: 159065 - protein, 19 aa, Mycobacterium bovis
SSLVEVLRGTDSWTPFVAP

SEQ ID NO: 159066 - protein, 27 aa, Mycobacterium bovis
SSPLPRSARQPWLWVGVAVAVVVALAG

SEQ ID NO: 159067 - protein, 27 aa, Mycobacterium bovis
SSQFSVRLLRTFLRDVPNQVVLAIFAC

SEQ ID NO: 159068 - protein, 23 aa, Mycobacterium bovis
SSSCSYAAVALARSLFRKGANFT

SEQ ID NO: 159069 - protein, 33 aa, Mycobacterium bovis
SSSEIAIAVPAHWKPGAVHALRNGLRTHVGFVR

SEQ ID NO: 159070 - protein, 19 aa, Mycobacterium bovis
SSSLVAIHLACQSLRTQDC

SEQ ID NO: 159071 - protein, 25 aa, Mycobacterium bovis
SSVDAFRALQNWVPLVAAAGSMIIV

SEQ ID NO: 159072 - protein, 26 aa, Mycobacterium bovis
SSWFDAARPLGAWVDALLRTFIGSAV

SEQ ID NO: 159073 - protein, 25 aa, Mycobacterium bovis
SSYFRNPWPALWAMMVGFFMIMLDS

SEQ ID NO: 159074 - protein, 25 aa, Mycobacterium bovis
SSYPRLIRVAMMYNDKVGYGPTVRD

SEQ ID NO: 159075 - protein, 20 aa, Mycobacterium bovis
STEILKRWTRGVMSTVGDVA

SEQ ID NO: 159076 - protein, 24 aa, Mycobacterium bovis
STGTPRPPFDYMQQVYDRYIAPHY

SEQ ID NO: 159077 - protein, 17 aa, Mycobacterium bovis
STIARRQLRLIVSDRGY

SEQ ID NO: 159078 - protein, 24 aa, Mycobacterium bovis
STIRRRKLIGLSFGVGMGAFGLGT

SEQ ID NO: 159079 - protein, 20 aa, Mycobacterium bovis
STPGPSDRRALHTAFAGAAI

SEQ ID NO: 159080 - protein, 21 aa, Mycobacterium bovis
STPRVSWPRGAGAAVGDAEHL

SEQ ID NO: 159081 - protein, 18 aa, Mycobacterium bovis
STVPPLVLAMTFGLSMDY

SEQ ID NO: 159082 - protein, 23 aa, Mycobacterium bovis
STVRGARNYPCQEFPGKRAPTVQ

SEQ ID NO: 159083 - protein, 17 aa, Mycobacterium bovis
SVAQEVVQWANTVTESC

SEQ ID NO: 159084 - protein, 23 aa, Mycobacterium bovis
SVGNSWTPLAPVVEPPTPPTPAS

SEQ ID NO: 159085 - protein, 26 aa, Mycobacterium bovis
SVIRNWPAWLGVYGFMTLDRWLLFNW

SEQ ID NO: 159086 - protein, 19 aa, Mycobacterium bovis
SVLILGSRFGCFEPKRRMR

SEQ ID NO: 159087 - protein, 19 aa, Mycobacterium bovis
SVLIVWRRDLRAIVRLLAW

SEQ ID NO: 159088 - protein, 17 aa, Mycobacterium bovis
SVLPIAFVLLISVGSAY

SEQ ID NO: 159089 - protein, 20 aa, Mycobacterium bovis
SVNLSKDWARAVVDIPVPTS

SEQ ID NO: 159090 - protein, 18 aa, Mycobacterium bovis
SVTIEFVLGLALALVMHR

SEQ ID NO: 159091 - protein, 20 aa, Mycobacterium bovis
SVVGFLCVIMAWVSPATVFV

SEQ ID NO: 159092 - protein, 19 aa, Mycobacterium bovis
SVVVGLWGAMTFGPFIAHH

SEQ ID NO: 159093 - protein, 21 aa, Mycobacterium bovis
SWTHHWVWLVPLMIWLIDGPA

SEQ ID NO: 159094 - protein, 22 aa, Mycobacterium bovis
SWVKLSPIWHVFSFAVDTRPIA

SEQ ID NO: 159095 - protein, 20 aa, Mycobacterium bovis
SWVTPARWGFAASAATVDLI

SEQ ID NO: 159096 - protein, 25 aa, Mycobacterium bovis
SYGFAASVLPVWLLLAPRDYLSTFM

SEQ ID NO: 159097 - protein, 26 aa, Mycobacterium bovis
SYNEGGPCWSMRLNAVEPPKGPAWRR

SEQ ID NO: 159098 - protein, 24 aa, Mycobacterium bovis
TAAALPWLRIAILGTPAILVSLAG

SEQ ID NO: 159099 - protein, 24 aa, Mycobacterium bovis
TAAEPRLALFTVVSSFALAELGDK

SEQ ID NO: 159100 - protein, 27 aa, Mycobacterium bovis
TAAEWWRLGLMFAVIVALHLVGWLTVT

SEQ ID NO: 159101 - protein, 17 aa, Mycobacterium bovis
TAALYVRVGEQLHPVLN

SEQ ID NO: 159102 - protein, 28 aa, Mycobacterium bovis
TADLSLAVAWPLAAVVRGHDWGTDSVFS

SEQ ID NO: 159103 - protein, 24 aa, Mycobacterium bovis
TAGAARPGLARAHRRKRSESGVGI

SEQ ID NO: 159104 - protein, 21 aa, Mycobacterium bovis
TAGLLIGRAIIRSNYYVADYA

SEQ ID NO: 159105 - protein, 22 aa, Mycobacterium bovis
TAGMPVIEWLYSRQLRRVVAPQ

SEQ ID NO: 159106 - protein, 24 aa, Mycobacterium bovis
TAGWYLVRKRVMAVARERLGHTGP

SEQ ID NO: 159107 - protein, 17 aa, Mycobacterium bovis
TAHAGSVGSLLRLSVLA

SEQ ID NO: 159108 - protein, 26 aa, Mycobacterium bovis
TAIATACPFCRVMVTDGVNDRQEEAG

SEQ ID NO: 159109 - protein, 19 aa, Mycobacterium bovis
TAILMLYTIVIIRGLRTAI

SEQ ID NO: 159110 - protein, 17 aa, Mycobacterium bovis
TAIPMGVPLEWNVFMIF

SEQ ID NO: 159111 - protein, 18 aa, Mycobacterium bovis
TAIRRWGRYATANGALAA

SEQ ID NO: 159112 - protein, 22 aa, Mycobacterium bovis
TAKGGIVFRVQQELGVPVKLVG

SEQ ID NO: 159113 - protein, 17 aa, Mycobacterium bovis
TALIQLYIVGVFISFTM

SEQ ID NO: 159114 - protein, 17 aa, Mycobacterium bovis
TALQLPLSVVLIDAGER

SEQ ID NO: 159115 - protein, 23 aa, Mycobacterium bovis
TALREIALLWLADQVDAALEKYR

SEQ ID NO: 159116 - protein, 24 aa, Mycobacterium bovis
TAPADRFGSCREFADAMNEQAGVA

SEQ ID NO: 159117 - protein, 19 aa, Mycobacterium bovis
TAPLVPLAVSAFLTSRKKA

SEQ ID NO: 159118 - protein, 27 aa, Mycobacterium bovis
TASLVAAWAYPLWPVVLGLKALALAVG

SEQ ID NO: 159119 - protein, 24 aa, Mycobacterium bovis
TATDLRSPLLLAIVIAVVAVVIMG

SEQ ID NO: 159120 - protein, 18 aa, Mycobacterium bovis
TAVALGIGAGIGAIFAAP

SEQ ID NO: 159121 - protein, 18 aa, Mycobacterium bovis
TAVAVSWTARALGMESHA

SEQ ID NO: 159122 - protein, 25 aa, Mycobacterium bovis
TAVFLAAAIGMRLGWSVISAGNRPR

SEQ ID NO: 159123 - protein, 18 aa, Mycobacterium bovis
TAVIFTRRRSMLTLADRV

SEQ ID NO: 159124 - protein, 17 aa, Mycobacterium bovis
TAVVLCYGLWAFERDGY

SEQ ID NO: 159125 - protein, 17 aa, Mycobacterium bovis
TAVVVGLVLLQTGCGVG

SEQ ID NO: 159126 - protein, 19 aa, Mycobacterium bovis
TAWLMRRSLQFGALTAEEL

SEQ ID NO: 159127 - protein, 20 aa, Mycobacterium bovis
TCAIALVGLLALPGYKTSYN

SEQ ID NO: 159128 - protein, 23 aa, Mycobacterium bovis
TDAEAILGIGDWGVGGIQIAVGK

SEQ ID NO: 159129 - protein, 19 aa, Mycobacterium bovis
TDAGARFGVEDSKEARDAL

SEQ ID NO: 159130 - protein, 29 aa, Mycobacterium bovis
TDEPRPAKRSTLREFAVLAVIAVVLYYVM

SEQ ID NO: 159131 - protein, 21 aa, Mycobacterium bovis
TDHRGRVRIGTVLLSPAEPDG

SEQ ID NO: 159132 - protein, 24 aa, Mycobacterium bovis
TDKSDLLEAIGMRLRDMLWAAIFP

SEQ ID NO: 159133 - protein, 24 aa, Mycobacterium bovis
TDMFPALAVAVTSQFAEPDDAEYP

SEQ ID NO: 159134 - protein, 23 aa, Mycobacterium bovis
TDPDELIALLGPVLADRPAFTGQ

SEQ ID NO: 159135 - protein, 19 aa, Mycobacterium bovis
TDRVARLALVDSAAPGTVI

SEQ ID NO: 159136 - protein, 17 aa, Mycobacterium bovis
TEATSVRQRTWGWALAV

SEQ ID NO: 159137 - protein, 21 aa, Mycobacterium bovis
TEFALRPFAAQALEAGPPPRR

SEQ ID NO: 159138 - protein, 21 aa, Mycobacterium bovis
TEFALRPMAAQALEVGATPRS

SEQ ID NO: 159139 - protein, 17 aa, Mycobacterium bovis
TEFPVVVATLFGLIIAM

SEQ ID NO: 159140 - protein, 25 aa, Mycobacterium bovis
TELQADCYAGVWAYYASTVKQESTG

SEQ ID NO: 159141 - protein, 20 aa, Mycobacterium bovis
TELRTRLLISLAAILVTTIF

SEQ ID NO: 159142 - protein, 24 aa, Mycobacterium bovis
TELWSRLPSCLAIGAAAAGVVVFA

SEQ ID NO: 159143 - protein, 22 aa, Mycobacterium bovis
TENRLRVVCALPSSTAAERDPL

SEQ ID NO: 159144 - protein, 24 aa, Mycobacterium bovis
TESPIPRWLRFVLTSDRAGSAWYI

SEQ ID NO: 159145 - protein, 22 aa, Mycobacterium bovis
TETIRLAEIVKIYPEADGRETS

SEQ ID NO: 159146 - protein, 30 aa, Mycobacterium bovis
TFAGRRSQLRLGLNVPYLLLVLAFVVFDAI

SEQ ID NO: 159147 - protein, 24 aa, Mycobacterium bovis
TFAIGAAAVFAWLLAAFAVRPFKQ

SEQ ID NO: 159148 - protein, 26 aa, Mycobacterium bovis
TFCLSFTRLPYFQTLGVPLAIGMVIV

SEQ ID NO: 159149 - protein, 24 aa, Mycobacterium bovis
TFDVVLCGLALSILAAAIVIGRLR

SEQ ID NO: 159150 - protein, 20 aa, Mycobacterium bovis
TFFAELRGNLALPVLASALL

SEQ ID NO: 159151 - protein, 41 aa, Mycobacterium bovis
TFFVIGHLLGVPGWVTQRLWWAVLLTVGFWGLLRVAEALGV

SEQ ID NO: 159152 - protein, 21 aa, Mycobacterium bovis
TFGEFLAWVIGWNLVLELAMG

SEQ ID NO: 159153 - protein, 22 aa, Mycobacterium bovis
TFGIDFKGGTTVSFPRGSTQVA

SEQ ID NO: 159154 - protein, 33 aa, Mycobacterium bovis
TFIAVLVLWDLFGQLPLPLGVVGHEGSTVLVAL

SEQ ID NO: 159155 - protein, 22 aa, Mycobacterium bovis
TFLGMRFAKLGVFSTVGPALAI

SEQ ID NO: 159156 - protein, 23 aa, Mycobacterium bovis
TFLTREMPAWLQANKGVSPTGNA

SEQ ID NO: 159157 - protein, 30 aa, Mycobacterium bovis
TFVAFWACLTLLARPACDLAGMLTIAQQAR

SEQ ID NO: 159158 - protein, 21 aa, Mycobacterium bovis
TGAETLRFKGYLIMSRNSSHD

SEQ ID NO: 159159 - protein, 17 aa, Mycobacterium bovis
TGFVELALRAGDEVGCS

SEQ ID NO: 159160 - protein, 21 aa, Mycobacterium bovis
TGGAALVMWMGELITERGIGN

SEQ ID NO: 159161 - protein, 17 aa, Mycobacterium bovis
TGGICWAGGTTALVYFA

SEQ ID NO: 159162 - protein, 26 aa, Mycobacterium bovis
TGHPRRAGVSSFGFGGTNAHVVIEQG

SEQ ID NO: 159163 - protein, 20 aa, Mycobacterium bovis
TGIAGWMFGWLADRSGSLAA

SEQ ID NO: 159164 - protein, 21 aa, Mycobacterium bovis
TGIGIAWPHLTVRAMDSVADP

SEQ ID NO: 159165 - protein, 24 aa, Mycobacterium bovis
TGLATSGLLAWARRRPVLAGVLIG

SEQ ID NO: 159166 - protein, 19 aa, Mycobacterium bovis
TGLPLPVVLVPPMALSRIL

SEQ ID NO: 159167 - protein, 32 aa, Mycobacterium bovis
TGLVNFEPWLVLTGMIDMFFATVGFALGVFVL

SEQ ID NO: 159168 - protein, 24 aa, Mycobacterium bovis
TGPGCKALLAALPQRLGEYRRAPV

SEQ ID NO: 159169 - protein, 18 aa, Mycobacterium bovis
TGPNSTPVILRCGLDRPA

SEQ ID NO: 159170 - protein, 26 aa, Mycobacterium bovis
TGRVLARWQSSWLRYAPLSFSGLVMI

SEQ ID NO: 159171 - protein, 19 aa, Mycobacterium bovis
TGTMGPRLVYTETKLNSAF

SEQ ID NO: 159172 - protein, 24 aa, Mycobacterium bovis
TGTYRIDGPLSFLSVDGVFGSLRD

SEQ ID NO: 159173 - protein, 23 aa, Mycobacterium bovis
TGVFAGACLSEYGAMASADLSQV

SEQ ID NO: 159174 - protein, 25 aa, Mycobacterium bovis
TGVGLGMSVARGFVEAMGGTISATD

SEQ ID NO: 159175 - protein, 20 aa, Mycobacterium bovis
TGYECLAPHHFLLTEWFAPY

SEQ ID NO: 159176 - protein, 25 aa, Mycobacterium bovis
THRWVKNLPDEPVWVNGDHARLHQL

SEQ ID NO: 159177 - protein, 24 aa, Mycobacterium bovis
TIALASLWLSGPLQLGLGAIQLVL

SEQ ID NO: 159178 - protein, 18 aa, Mycobacterium bovis
TICTVFFAVYGMLLLTTQ

SEQ ID NO: 159179 - protein, 21 aa, Mycobacterium bovis
TIEAMWWIRSRMLGVKPRVWR

SEQ ID NO: 159180 - protein, 18 aa, Mycobacterium bovis
TIGGGYLLFGAMLYGSFF

SEQ ID NO: 159181 - protein, 18 aa, Mycobacterium bovis
TIGLFLMVVAGSLITSRR

SEQ ID NO: 159182 - protein, 28 aa, Mycobacterium bovis
TIQAAQLSALWARFPLPVIPAPGDPTPS

SEQ ID NO: 159183 - protein, 25 aa, Mycobacterium bovis
TIRSPRSGIALSIAALVPIGAALAL

SEQ ID NO: 159184 - protein, 19 aa, Mycobacterium bovis
TITPFPWHEIVQFLEETFA

SEQ ID NO: 159185 - protein, 17 aa, Mycobacterium bovis
TIVGLSAAGGWFYWDRV

SEQ ID NO: 159186 - protein, 21 aa, Mycobacterium bovis
TIVPLPWVIQAPRLFAGQIDF

SEQ ID NO: 159187 - protein, 23 aa, Mycobacterium bovis
TKALRVGYVAAFSVPANQLPQTV

SEQ ID NO: 159188 - protein, 22 aa, Mycobacterium bovis
TKFTLLMALPWLSAVAAVYVVF

SEQ ID NO: 159189 - protein, 18 aa, Mycobacterium bovis
TKIARSMVTEFGMSSKLG

SEQ ID NO: 159190 - protein, 21 aa, Mycobacterium bovis
TKVCSHLGCPSSLYEQQSYRI

SEQ ID NO: 159191 - protein, 19 aa, Mycobacterium bovis
TLAARRTTLIVAHGLAIAE

SEQ ID NO: 159192 - protein, 21 aa, Mycobacterium bovis
TLADLYGRRRWYLIGVSLFTL

SEQ ID NO: 159193 - protein, 17 aa, Mycobacterium bovis
TLFQGAPQQSWRKRLPA

SEQ ID NO: 159194 - protein, 32 aa, Mycobacterium bovis
TLFRVPFLANWKISAAYLNWLADRLQRTKTRE

SEQ ID NO: 159195 - protein, 32 aa, Mycobacterium bovis
TLLPAILTLTGRRGWIKPRRDLTSRMWRRSGV

SEQ ID NO: 159196 - protein, 23 aa, Mycobacterium bovis
TLLSIPLWIVIVLPIAKILATSL

SEQ ID NO: 159197 - protein, 26 aa, Mycobacterium bovis
TLLVASAWWLFAWELDNGAGLHEART

SEQ ID NO: 159198 - protein, 20 aa, Mycobacterium bovis
TLPATVFVAFQLMFAIITVA

SEQ ID NO: 159199 - protein, 22 aa, Mycobacterium bovis
TLPGIGTLAAWFAAAGEVVVFL

SEQ ID NO: 159200 - protein, 17 aa, Mycobacterium bovis
TLSTWATAAAWAFSLAM

SEQ ID NO: 159201 - protein, 25 aa, Mycobacterium bovis
TLVHRTCVTPLPFAQADLDALQRVN

SEQ ID NO: 159202 - protein, 23 aa, Mycobacterium bovis
TLVIAVLVWWHFVGANTSDDGYI

SEQ ID NO: 159203 - protein, 22 aa, Mycobacterium bovis
TLVLCVIALFATNVVLTTIGVR

SEQ ID NO: 159204 - protein, 20 aa, Mycobacterium bovis
TLVVRRFLRNRAAVASLAAL

SEQ ID NO: 159205 - protein, 26 aa, Mycobacterium bovis
TMGLWPPRLWAGLRLGWAAGAAAATA

SEQ ID NO: 159206 - protein, 28 aa, Mycobacterium bovis
TMLLRVGARSSYLMGLAVFGLASLVCAA

SEQ ID NO: 159207 - protein, 26 aa, Mycobacterium bovis
TMLSVPRWAVGPVMELGTDHRRIEGL

SEQ ID NO: 159208 - protein, 18 aa, Mycobacterium bovis
TMPSEYRDLLGGLNVDQL

SEQ ID NO: 159209 - protein, 23 aa, Mycobacterium bovis
TMPTESYTPWITRVLAAFIDWAP

SEQ ID NO: 159210 - protein, 25 aa, Mycobacterium bovis
TMREARAGDRYLLCSDGLSDPVSDE

SEQ ID NO: 159211 - protein, 26 aa, Mycobacterium bovis
TMTGRAVSFLGPWLFSVFVDVFHTVR

SEQ ID NO: 159212 - protein, 25 aa, Mycobacterium bovis
TMTYTLRYRWWVVLTGVAIAAFTVH

SEQ ID NO: 159213 - protein, 17 aa, Mycobacterium bovis
TNQARRLLAWVGADENV

SEQ ID NO: 159214 - protein, 17 aa, Mycobacterium bovis
TPAELAANHAIHGVLIA

SEQ ID NO: 159215 - protein, 18 aa, Mycobacterium bovis
TPAPYGPLFLWIGRGISS

SEQ ID NO: 159216 - protein, 18 aa, Mycobacterium bovis
TPIAQVLRRQRREIVLAA

SEQ ID NO: 159217 - protein, 17 aa, Mycobacterium bovis
TPLLLAVDGTLVGLISL

SEQ ID NO: 159218 - protein, 27 aa, Mycobacterium bovis
TPMVWVRPRQGPKLADLIAAPSTTRAS

SEQ ID NO: 159219 - protein, 17 aa, Mycobacterium bovis
TPNDPRFQPGFEEADTR

SEQ ID NO: 159220 - protein, 18 aa, Mycobacterium bovis
TPPARWPVTLHVLPTVRD

SEQ ID NO: 159221 - protein, 17 aa, Mycobacterium bovis
TPSECRVILLDAAPAVL

SEQ ID NO: 159222 - protein, 23 aa, Mycobacterium bovis
TPTKWTHHFGVFAGLAGSLGALA

SEQ ID NO: 159223 - protein, 19 aa, Mycobacterium bovis
TPTLYRPAGGLSNDAVRQA

SEQ ID NO: 159224 - protein, 20 aa, Mycobacterium bovis
TPVLIRLFTKQGFGHQIRED

SEQ ID NO: 159225 - protein, 30 aa, Mycobacterium bovis
TPVYRFPSYLGFRIVERWQFHYSQVVKSTR

SEQ ID NO: 159226 - protein, 17 aa, Mycobacterium bovis
TQACPAVHVLVVDDSSP

SEQ ID NO: 159227 - protein, 25 aa, Mycobacterium bovis
TQATFLRWVWYAARREGLHLDEADD

SEQ ID NO: 159228 - protein, 17 aa, Mycobacterium bovis
TQIPAPVILVVATTVVF

SEQ ID NO: 159229 - protein, 20 aa, Mycobacterium bovis
TQLHPPDGLHVFVTGPGATI

SEQ ID NO: 159230 - protein, 26 aa, Mycobacterium bovis
TQPVLLDWAVGLAFPCQQPMLHANGI

SEQ ID NO: 159231 - protein, 22 aa, Mycobacterium bovis
TQQYLIDWERSALVNGLVPAQF

SEQ ID NO: 159232 - protein, 23 aa, Mycobacterium bovis
TQTELFPLAMLSVGGMMVFPASN

SEQ ID NO: 159233 - protein, 18 aa, Mycobacterium bovis
TQTVLPFTGLNDPDGVAV

SEQ ID NO: 159234 - protein, 23 aa, Mycobacterium bovis
TRAGFLMLLWVFIWSVLRILKTD

SEQ ID NO: 159235 - protein, 20 aa, Mycobacterium bovis
TRDRTVLVIAHRLHTITRAD

SEQ ID NO: 159236 - protein, 34 aa, Mycobacterium bovis
TRGWRRIGTAIVRWPGPILAVACAIAVVGLLALP

SEQ ID NO: 159237 - protein, 30 aa, Mycobacterium bovis
TRGWRRVGTAVVRWPGPILATSVALALVGL

SEQ ID NO: 159238 - protein, 20 aa, Mycobacterium bovis
TRHHELRMVIIGSGATAVTL

SEQ ID NO: 159239 - protein, 19 aa, Mycobacterium bovis
TRIVVCLVAGVVVGGIVFG

SEQ ID NO: 159240 - protein, 22 aa, Mycobacterium bovis
TRRFWRSSGVHIVRRPKTHLLA

SEQ ID NO: 159241 - protein, 23 aa, Mycobacterium bovis
TRRIAEIPLDIDATLISDGTGTA

SEQ ID NO: 159242 - protein, 28 aa, Mycobacterium bovis
TRRWRRVGTAIVRWPGPVLAATCLVASI

SEQ ID NO: 159243 - protein, 22 aa, Mycobacterium bovis
TRSEGGGMLVLKRVDDARRDGD

SEQ ID NO: 159244 - protein, 23 aa, Mycobacterium bovis
TRVQRIYCRLVLRLFGVRITVSG

SEQ ID NO: 159245 - protein, 20 aa, Mycobacterium bovis
TSAFWAFGVFYLVASVLTWA

SEQ ID NO: 159246 - protein, 22 aa, Mycobacterium bovis
TSFQWNWKFGYQRVNFKDGTLT

SEQ ID NO: 159247 - protein, 30 aa, Mycobacterium bovis
TSFREIRWNLRVIVMFSIGLVIATAVAVSW

SEQ ID NO: 159248 - protein, 18 aa, Mycobacterium bovis
TSLEILFDADLEHRPALG

SEQ ID NO: 159249 - protein, 23 aa, Mycobacterium bovis
TSLPVEYYPAGRLNFVDTAADPT

SEQ ID NO: 159250 - protein, 30 aa, Mycobacterium bovis
TSLWGNCTIKVMVGFLFLYPAFVAKAHEAN

SEQ ID NO: 159251 - protein, 22 aa, Mycobacterium bovis
TSRQAYKIQRWRSRVRNHTVVI

SEQ ID NO: 159252 - protein, 24 aa, Mycobacterium bovis
TSRSEWPQQIVLIGVYAVAALWAL

SEQ ID NO: 159253 - protein, 23 aa, Mycobacterium bovis
TSSGVLLLWSWLVMSLAQGYYSM

SEQ ID NO: 159254 - protein, 17 aa, Mycobacterium bovis
TSVIRAFAATGMVVTAA

SEQ ID NO: 159255 - protein, 23 aa, Mycobacterium bovis
TSVVAGLAWYLTHDVFNHPQAFF

SEQ ID NO: 159256 - protein, 32 aa, Mycobacterium bovis
TSYREAAEALGLPAGWALRKIVLKTAMPGIVT

SEQ ID NO: 159257 - protein, 26 aa, Mycobacterium bovis
TTCALFPGIFGLFAVVVRLLPGWPIW

SEQ ID NO: 159258 - protein, 25 aa, Mycobacterium bovis
TTGTTIKLGIVWLVLSVFTVMIIVV

SEQ ID NO: 159259 - protein, 18 aa, Mycobacterium bovis
TTLCVTWTPAQPGAARVA

SEQ ID NO: 159260 - protein, 25 aa, Mycobacterium bovis
TTLVNLLMRFYEIGSGRILIDGVDI

SEQ ID NO: 159261 - protein, 23 aa, Mycobacterium bovis
TTMIGRANWWPSELGRDPSTPPT

SEQ ID NO: 159262 - protein, 30 aa, Mycobacterium bovis
TTQIGGQVARLWKLTSALTIDDRTGLTGVQ

SEQ ID NO: 159263 - protein, 18 aa, Mycobacterium bovis
TTSLALGCVLAIVAAMGC

SEQ ID NO: 159264 - protein, 23 aa, Mycobacterium bovis
TTTGARYRATFAHNVDAYKSTAV

SEQ ID NO: 159265 - protein, 41 aa, Mycobacterium bovis
TTTLSGRFCVPVVRTPRPQLTAAFGGALWAARRPGDTSATV

SEQ ID NO: 159266 - protein, 18 aa, Mycobacterium bovis
TTVGAGWFGLFGLAFWVA

SEQ ID NO: 159267 - protein, 24 aa, Mycobacterium bovis
TTVIIRFWLLTAITCGLGVALFYG

SEQ ID NO: 159268 - protein, 30 aa, Mycobacterium bovis
TVAGAVYCLSFTRLPYFQSLGIPASIGVMI

SEQ ID NO: 159269 - protein, 17 aa, Mycobacterium bovis
TVAQVWFQDEESAARAF

SEQ ID NO: 159270 - protein, 25 aa, Mycobacterium bovis
TVFGRGDIALGWAFLGAGIGSLVRP

SEQ ID NO: 159271 - protein, 18 aa, Mycobacterium bovis
TVGITFLGMRFAKLGVFS

SEQ ID NO: 159272 - protein, 26 aa, Mycobacterium bovis
TVGPMLGISVAVVFFAAVTLLPALMV

SEQ ID NO: 159273 - protein, 18 aa, Mycobacterium bovis
TVHLGYSVWTLWPVLELL

SEQ ID NO: 159274 - protein, 19 aa, Mycobacterium bovis
TVIASLWFTIFGDSALLRQ

SEQ ID NO: 159275 - protein, 17 aa, Mycobacterium bovis
TVLGRGGVGLSLGQRQR

SEQ ID NO: 159276 - protein, 33 aa, Mycobacterium bovis
TVLILGWRSARWWRRGASLLAVPLCLLSATLTL

SEQ ID NO: 159277 - protein, 24 aa, Mycobacterium bovis
TVLVGARLAVAVVRVATATRRRRA

SEQ ID NO: 159278 - protein, 18 aa, Mycobacterium bovis
TVPGRYTYLKWWKFVLVV

SEQ ID NO: 159279 - protein, 26 aa, Mycobacterium bovis
TVPLVRWTAHWPRRRALVVSLVCLTV

SEQ ID NO: 159280 - protein, 17 aa, Mycobacterium bovis
TVRERIVALKLMSETLS

SEQ ID NO: 159281 - protein, 32 aa, Mycobacterium bovis
TVSFPVVAYRTWRWWLATAVAFFAVVVLIGFW

SEQ ID NO: 159282 - protein, 21 aa, Mycobacterium bovis
TVSVDWFGIVVLAVWGALAAL

SEQ ID NO: 159283 - protein, 20 aa, Mycobacterium bovis
TVTFYGRRITGWVAAVYAWL

SEQ ID NO: 159284 - protein, 18 aa, Mycobacterium bovis
TVTVTFMLVWLINHHGWS

SEQ ID NO: 159285 - protein, 22 aa, Mycobacterium bovis
TVVLCVIALFAVNVILTTIGVR

SEQ ID NO: 159286 - protein, 18 aa, Mycobacterium bovis
TVVSWLPFYHDMGFVLGL

SEQ ID NO: 159287 - protein, 23 aa, Mycobacterium bovis
TVVVSSLIGGFVFGAAMVGMLAA

SEQ ID NO: 159288 - protein, 18 aa, Mycobacterium bovis
TWGLRLSWHMYRKTAGQG

SEQ ID NO: 159289 - protein, 39 aa, Mycobacterium bovis
TWNYLDRMGRSWSVRANLHFLWLRLARVWPVYLVTLHLA

SEQ ID NO: 159290 - protein, 27 aa, Mycobacterium bovis
TWRRPVVRIKLWLQYVIAGTPRMPDER

SEQ ID NO: 159291 - protein, 21 aa, Mycobacterium bovis
TWSGLGARDRQGWAAVVGAGV

SEQ ID NO: 159292 - protein, 23 aa, Mycobacterium bovis
TWTLPVLGVWVIFSPWVLPGVAV

SEQ ID NO: 159293 - protein, 17 aa, Mycobacterium bovis
TYCRIPMDASNVVRGAR

SEQ ID NO: 159294 - protein, 17 aa, Mycobacterium bovis
TYFKDHLYIAGRIKDLV

SEQ ID NO: 159295 - protein, 25 aa, Mycobacterium bovis
TYLGGWRIIRTLGKGLVEIKPPQGM

SEQ ID NO: 159296 - protein, 19 aa, Mycobacterium bovis
TYLLTYVRRYYGGRIAHLV

SEQ ID NO: 159297 - protein, 22 aa, Mycobacterium bovis
TYLQRWTIFTVVPQWILALIAL

SEQ ID NO: 159298 - protein, 19 aa, Mycobacterium bovis
TYLTRVMLTAAEWTAVLIN

SEQ ID NO: 159299 - protein, 24 aa, Mycobacterium bovis
TYSQRAVTMLRVRQGASTGETVAC

SEQ ID NO: 159300 - protein, 26 aa, Mycobacterium bovis
VAAALARTTRWGSFLPDIDAFDAEFF

SEQ ID NO: 159301 - protein, 23 aa, Mycobacterium bovis
VAAGRRKALAFIEGRSVAELVAL

SEQ ID NO: 159302 - protein, 19 aa, Mycobacterium bovis
VAALPCEREPIALPAGQQE

SEQ ID NO: 159303 - protein, 18 aa, Mycobacterium bovis
VAALSAWGLYRFNQILAG

SEQ ID NO: 159304 - protein, 24 aa, Mycobacterium bovis
VAAMGCAFVALLRPQSALGQAPIV

SEQ ID NO: 159305 - protein, 26 aa, Mycobacterium bovis
VAARVGEPFGSLVLAVAVTTIEVALI

SEQ ID NO: 159306 - protein, 24 aa, Mycobacterium bovis
VAAVAFFGWERFARTRLIDPAGVH

SEQ ID NO: 159307 - protein, 23 aa, Mycobacterium bovis
VAAVPRRHRLFIIVSCLAVLAGV

SEQ ID NO: 159308 - protein, 21 aa, Mycobacterium bovis
VACQVPIFLMRSSPFTALELA

SEQ ID NO: 159309 - protein, 25 aa, Mycobacterium bovis
VADGHPWRWFLIGFMVLFHLNILSN

SEQ ID NO: 159310 - protein, 24 aa, Mycobacterium bovis
VADRLPVVRLDWFTAENTATARQA

SEQ ID NO: 159311 - protein, 22 aa, Mycobacterium bovis
VAEERLSALLLNSSEVNAVMGS

SEQ ID NO: 159312 - protein, 17 aa, Mycobacterium bovis
VAFAGLLIAAYGYWLIS

SEQ ID NO: 159313 - protein, 19 aa, Mycobacterium bovis
VAFVLTFLVTRSFVRFIHR

SEQ ID NO: 159314 - protein, 17 aa, Mycobacterium bovis
VAFYCYGEGKAQAIREL

SEQ ID NO: 159315 - protein, 21 aa, Mycobacterium bovis
VAGCAYLLRRLFRGPRAPYLR

SEQ ID NO: 159316 - protein, 24 aa, Mycobacterium bovis
VAGFSVYRLHGIFGSHDTTSTAGG

SEQ ID NO: 159317 - protein, 21 aa, Mycobacterium bovis
VAGRMPGHMNVLLAEAEVDYD

SEQ ID NO: 159318 - protein, 28 aa, Mycobacterium bovis
VAGTMLLRLCMLPGLALLVWATPRLASH

SEQ ID NO: 159319 - protein, 24 aa, Mycobacterium bovis
VAGVGVDWRAAFADLGGRRVELPT

SEQ ID NO: 159320 - protein, 23 aa, Mycobacterium bovis
VAHDLELIGYVGLADTARPSSRP

SEQ ID NO: 159321 - protein, 19 aa, Mycobacterium bovis
VAHVAGGLLLKVGSSGVVF

SEQ ID NO: 159322 - protein, 19 aa, Mycobacterium bovis
VAIACIIGALTLFSGPTGI

SEQ ID NO: 159323 - protein, 30 aa, Mycobacterium bovis
VAIVVLGWYYLRIPSLVGIGQYTLKADLPA

SEQ ID NO: 159324 - protein, 18 aa, Mycobacterium bovis
VALACLVGSAIEFYDFLI

SEQ ID NO: 159325 - protein, 18 aa, Mycobacterium bovis
VALGLTVTLVWLYIEILR

SEQ ID NO: 159326 - protein, 21 aa, Mycobacterium bovis
VALLAIRARLVLLIFTTMPVL

SEQ ID NO: 159327 - protein, 19 aa, Mycobacterium bovis
VALLMPNSVEFCCLFYGAA

SEQ ID NO: 159328 - protein, 20 aa, Mycobacterium bovis
VALPLASLVGWLVSQISSGR

SEQ ID NO: 159329 - protein, 25 aa, Mycobacterium bovis
VALPSRVFAWLALVFGVGFSMLALL

SEQ ID NO: 159330 - protein, 22 aa, Mycobacterium bovis
VALTVAAIVVWSSLVAAVLPPL

SEQ ID NO: 159331 - protein, 26 aa, Mycobacterium bovis
VALTVLWLLNIGEYLQDLTLRRTRRA

SEQ ID NO: 159332 - protein, 21 aa, Mycobacterium bovis
VAMLIGRFFLIIPVLAIAGSL

SEQ ID NO: 159333 - protein, 28 aa, Mycobacterium bovis
VAMPGAGRPRWQCGVAALGSALVGALPW

SEQ ID NO: 159334 - protein, 23 aa, Mycobacterium bovis
VANLELYLIFPLASEQATITLVR

SEQ ID NO: 159335 - protein, 29 aa, Mycobacterium bovis
VAPKRPSRWRHVPAILLVLSLLLFTIAMA

SEQ ID NO: 159336 - protein, 33 aa, Mycobacterium bovis
VAPLVRKTAAWAWRFLVILAAMVALLWVLNKFE

SEQ ID NO: 159337 - protein, 18 aa, Mycobacterium bovis
VAPMVRRAAATLPAAQAV

SEQ ID NO: 159338 - protein, 25 aa, Mycobacterium bovis
VAPSALRQSFLWGLAGVIAAEHPEL

SEQ ID NO: 159339 - protein, 20 aa, Mycobacterium bovis
VAPSHRWGLGAFLVVELVFL

SEQ ID NO: 159340 - protein, 20 aa, Mycobacterium bovis
VAQRRRARRSLAAVGSVAAA

SEQ ID NO: 159341 - protein, 31 aa, Mycobacterium bovis
VAQRWGRYPIRARVAVVARGGLLMGAGTVDA

SEQ ID NO: 159342 - protein, 20 aa, Mycobacterium bovis
VARLRHRGMNEAGYMADEPG

SEQ ID NO: 159343 - protein, 27 aa, Mycobacterium bovis
VARRGQLRAGTALVARGEFSLIIIGLA

SEQ ID NO: 159344 - protein, 19 aa, Mycobacterium bovis
VARRLARTFPYGTLTVNIT

SEQ ID NO: 159345 - protein, 17 aa, Mycobacterium bovis
VASAGLLVWFWPHLGKD

SEQ ID NO: 159346 - protein, 18 aa, Mycobacterium bovis
VASPRRASAYGVFAAGLG

SEQ ID NO: 159347 - protein, 23 aa, Mycobacterium bovis
VAVAFVWLGMVVAISFLEAPLKF

SEQ ID NO: 159348 - protein, 18 aa, Mycobacterium bovis
VAVAGRFVHTSIRTTVGA

SEQ ID NO: 159349 - protein, 26 aa, Mycobacterium bovis
VAVALVLWWRMIRFEYALLVTVATAA

SEQ ID NO: 159350 - protein, 28 aa, Mycobacterium bovis
VAVGQQCARRALPFVAAMAKLLVAAVAG

SEQ ID NO: 159351 - protein, 18 aa, Mycobacterium bovis
VAVGVCLLAGLVSFASPC

SEQ ID NO: 159352 - protein, 25 aa, Mycobacterium bovis
VAVLCARGLVAQGLMFINQAAVSAV

SEQ ID NO: 159353 - protein, 20 aa, Mycobacterium bovis
VAVMVPVFLGATLLIYGMVF

SEQ ID NO: 159354 - protein, 17 aa, Mycobacterium bovis
VAVSFWLTAPYLVAESI

SEQ ID NO: 159355 - protein, 21 aa, Mycobacterium bovis
VAVTAGMMWSHIIAGAVVAVL

SEQ ID NO: 159356 - protein, 17 aa, Mycobacterium bovis
VAVVGFRALFGAFLLGL

SEQ ID NO: 159357 - protein, 17 aa, Mycobacterium bovis
VAVVLFFVFGGVIAAGL

SEQ ID NO: 159358 - protein, 26 aa, Mycobacterium bovis
VAWLLRFLVRHNMYWFVGYRVLVGTG

SEQ ID NO: 159359 - protein, 17 aa, Mycobacterium bovis
VCGHSSCAAMTALLEDD

SEQ ID NO: 159360 - protein, 26 aa, Mycobacterium bovis
VCGQRLPGKYTYAAALREVREIELTG

SEQ ID NO: 159361 - protein, 17 aa, Mycobacterium bovis
VCGYVIGFRFHRGALYI

SEQ ID NO: 159362 - protein, 25 aa, Mycobacterium bovis
VCPPDACPLVPFGVNYYIYPVMWGG

SEQ ID NO: 159363 - protein, 24 aa, Mycobacterium bovis
VCYVSAAAVAARFGAAALAAHQVV

SEQ ID NO: 159364 - protein, 25 aa, Mycobacterium bovis
VDAEPRLRALGWTGMLDKGADVDAG

SEQ ID NO: 159365 - protein, 17 aa, Mycobacterium bovis
VDLCWRLIEAGARLRYE

SEQ ID NO: 159366 - protein, 24 aa, Mycobacterium bovis
VDNKLGYGLVDPVAALTFNIPSGD

SEQ ID NO: 159367 - protein, 26 aa, Mycobacterium bovis
VDNTAGWRPGPIRALLATRPAAFRSL

SEQ ID NO: 159368 - protein, 26 aa, Mycobacterium bovis
VDPEGAHARWNWVLDGMVETKALSPN

SEQ ID NO: 159369 - protein, 20 aa, Mycobacterium bovis
VDPVAALTWDVPKGPAEPPK

SEQ ID NO: 159370 - protein, 27 aa, Mycobacterium bovis
VDQRRWSSDLSMTWDLLCRSVTHGIVP

SEQ ID NO: 159371 - protein, 24 aa, Mycobacterium bovis
VDQWGWRSIFYVNLPMGALVLFLT

SEQ ID NO: 159372 - protein, 29 aa, Mycobacterium bovis
VDRLYADRRIRLWVVYVENFSGQSALNWA

SEQ ID NO: 159373 - protein, 20 aa, Mycobacterium bovis
VDSMGWEWIFFVNVPVGVIG

SEQ ID NO: 159374 - protein, 20 aa, Mycobacterium bovis
VDSMLGYVPAEFGPVYRFAE

SEQ ID NO: 159375 - protein, 18 aa, Mycobacterium bovis
VDVFVVRSGAAGPFLGSI

SEQ ID NO: 159376 - protein, 22 aa, Mycobacterium bovis
VEAGIWGKLVNRVMKRPVLFAA

SEQ ID NO: 159377 - protein, 23 aa, Mycobacterium bovis
VEGLAALIFSRYLWAFELTSALL

SEQ ID NO: 159378 - protein, 17 aa, Mycobacterium bovis
VEHRALMAIAFGDLGMA

SEQ ID NO: 159379 - protein, 24 aa, Mycobacterium bovis
VEIGKVKALHLVDGGRRVRVEFNI

SEQ ID NO: 159380 - protein, 27 aa, Mycobacterium bovis
VEKRSEQRLGFTARRAAILAAVVCVLT

SEQ ID NO: 159381 - protein, 20 aa, Mycobacterium bovis
VELRNRLKTATGLTLSPTLI

SEQ ID NO: 159382 - protein, 33 aa, Mycobacterium bovis
VEQMLADCGLEWVAVRCALIFGRNVDNWVQRLF

SEQ ID NO: 159383 - protein, 21 aa, Mycobacterium bovis
VERDSPSWSPRFIDHLVGDRI

SEQ ID NO: 159384 - protein, 23 aa, Mycobacterium bovis
VESRLAALGSRAGAGVMPKGPLP

SEQ ID NO: 159385 - protein, 17 aa, Mycobacterium bovis
VEVAFYLALPALAYLLL

SEQ ID NO: 159386 - protein, 20 aa, Mycobacterium bovis
VEWDTLLFFAGLFIMVGALV

SEQ ID NO: 159387 - protein, 19 aa, Mycobacterium bovis
VFASDAMSSIAYAPEEIFL

SEQ ID NO: 159388 - protein, 18 aa, Mycobacterium bovis
VFDNPDFQRGLEQFLSPD

SEQ ID NO: 159389 - protein, 17 aa, Mycobacterium bovis
VFGESLGSFGGEAPFMN

SEQ ID NO: 159390 - protein, 18 aa, Mycobacterium bovis
VFGVLRWFFTTYRIDDEN

SEQ ID NO: 159391 - protein, 26 aa, Mycobacterium bovis
VFNFPPNGTHSWPYWNEQLVAMKADI

SEQ ID NO: 159392 - protein, 17 aa, Mycobacterium bovis
VFRGFTFGIDFKGGTTV

SEQ ID NO: 159393 - protein, 20 aa, Mycobacterium bovis
VFRGPPSWNVGYKSIRSHNV

SEQ ID NO: 159394 - protein, 19 aa, Mycobacterium bovis
VFSPLRRRATAALAVAGER

SEQ ID NO: 159395 - protein, 22 aa, Mycobacterium bovis
VFTKLEVFSAVGPAIAVAITVS

SEQ ID NO: 159396 - protein, 26 aa, Mycobacterium bovis
VGAFLRLPYTFAIPIFGGRNWTTVSA

SEQ ID NO: 159397 - protein, 21 aa, Mycobacterium bovis
VGALADWFAVTALFKHPLGIP

SEQ ID NO: 159398 - protein, 20 aa, Mycobacterium bovis
VGALFGRTALMLAALFAVGM

SEQ ID NO: 159399 - protein, 24 aa, Mycobacterium bovis
VGALGILVMVVWVGTALTISTTAS

SEQ ID NO: 159400 - protein, 18 aa, Mycobacterium bovis
VGASRWYTQLPFLVEAML

SEQ ID NO: 159401 - protein, 40 aa, Mycobacterium bovis
VGCLAGLVGIGWLWRHGRFRRLARLGGLVLVSAFTVVTLG

SEQ ID NO: 159402 - protein, 18 aa, Mycobacterium bovis
VGEVLAIVTAVAGALDYA

SEQ ID NO: 159403 - protein, 17 aa, Mycobacterium bovis
VGFALNFVIGTLAYFLL

SEQ ID NO: 159404 - protein, 33 aa, Mycobacterium bovis
VGFRRIAADLARPAETVRGWLRRFAERAEAVRS

SEQ ID NO: 159405 - protein, 19 aa, Mycobacterium bovis
VGGALAWLAGETVQPLAYA

SEQ ID NO: 159406 - protein, 19 aa, Mycobacterium bovis
VGGFAVWFSLFFAMATDGC

SEQ ID NO: 159407 - protein, 23 aa, Mycobacterium bovis
VGGRLFGRFDLAVAVFFAVSGFL

SEQ ID NO: 159408 - protein, 18 aa, Mycobacterium bovis
VGGSGDWGPSLGPTVGGR

SEQ ID NO: 159409 - protein, 23 aa, Mycobacterium bovis
VGIALWLPWLIAAGVAFILASAA

SEQ ID NO: 159410 - protein, 20 aa, Mycobacterium bovis
VGIGRLVVRGLLIGLVVPPL

SEQ ID NO: 159411 - protein, 23 aa, Mycobacterium bovis
VGIMWPSLLVILLLVAVVALLFT

SEQ ID NO: 159412 - protein, 23 aa, Mycobacterium bovis
VGIWKAGMFHTLIAVAVILTVIR

SEQ ID NO: 159413 - protein, 20 aa, Mycobacterium bovis
VGLASYLLIGFWYHKPSAAT

SEQ ID NO: 159414 - protein, 17 aa, Mycobacterium bovis
VGLCVVGVVALALVVAK

SEQ ID NO: 159415 - protein, 18 aa, Mycobacterium bovis
VGNYRAATQVALGKGEDD

SEQ ID NO: 159416 - protein, 25 aa, Mycobacterium bovis
VGPVIRLPLVLGLAQLLSRVPLPGS

SEQ ID NO: 159417 - protein, 20 aa, Mycobacterium bovis
VGPVTSEFSGKVHFVEQDRN

SEQ ID NO: 159418 - protein, 26 aa, Mycobacterium bovis
VGQAEILWDVIPFDWINDSNTAATRH

SEQ ID NO: 159419 - protein, 36 aa, Mycobacterium bovis
VGQANWWLPSSWRPATWWPLGRRRGRAQRTKRKPLL

SEQ ID NO: 159420 - protein, 17 aa, Mycobacterium bovis
VGSAIEFYDFLIYGTAA

SEQ ID NO: 159421 - protein, 19 aa, Mycobacterium bovis
VGSEPDFLRVWLPGQLLQG

SEQ ID NO: 159422 - protein, 25 aa, Mycobacterium bovis
VGSLLRLSVLALIMLPILAAVTLCA

SEQ ID NO: 159423 - protein, 18 aa, Mycobacterium bovis
VGSYRKTRLVPFGEYVPL

SEQ ID NO: 159424 - protein, 17 aa, Mycobacterium bovis
VGTGGVFAWVARRAPAA

SEQ ID NO: 159425 - protein, 19 aa, Mycobacterium bovis
VGTNPWRGPPIPYGTEVTD

SEQ ID NO: 159426 - protein, 40 aa, Mycobacterium bovis
VGTPAMWWLAVPVLAYAGWRMFVRRDWRYAVVLVGYCAGW

SEQ ID NO: 159427 - protein, 22 aa, Mycobacterium bovis
VGTSRRSRWARLFDEGIGARTV

SEQ ID NO: 159428 - protein, 24 aa, Mycobacterium bovis
VGVAQAALWTGYRPWFIDIDANTW

SEQ ID NO: 159429 - protein, 18 aa, Mycobacterium bovis
VGVASVIAEGFLVLPFSR

SEQ ID NO: 159430 - protein, 19 aa, Mycobacterium bovis
VGVATCWEVIFDRAPRKSI

SEQ ID NO: 159431 - protein, 19 aa, Mycobacterium bovis
VGVAVGRWLVDRQLAKAPV

SEQ ID NO: 159432 - protein, 19 aa, Mycobacterium bovis
VGVLLSMAPLWFSSYILQL

SEQ ID NO: 159433 - protein, 18 aa, Mycobacterium bovis
VGVLVYLFVVDWRVALVL

SEQ ID NO: 159434 - protein, 24 aa, Mycobacterium bovis
VGVPRGRVGIGLKLTGGRTAQAWA

SEQ ID NO: 159435 - protein, 24 aa, Mycobacterium bovis
VGVRVMPVFAFKSGAFFAAIVGVL

SEQ ID NO: 159436 - protein, 21 aa, Mycobacterium bovis
VGVRWWRFGAGVLLGLACATK

SEQ ID NO: 159437 - protein, 24 aa, Mycobacterium bovis
VGYLALVVYFDWGFSLAAGVLVLS

SEQ ID NO: 159438 - protein, 19 aa, Mycobacterium bovis
VHAGLMFPAVVCTLAAVAS

SEQ ID NO: 159439 - protein, 25 aa, Mycobacterium bovis
VHAYPRTASIVIWYSRAICDTAAIL

SEQ ID NO: 159440 - protein, 24 aa, Mycobacterium bovis
VHAYPRTASVVIWYSPELGDTAAV

SEQ ID NO: 159441 - protein, 20 aa, Mycobacterium bovis
VHCDRFFGWYNHEHKHSGIG

SEQ ID NO: 159442 - protein, 17 aa, Mycobacterium bovis
VHHFGLFAAVGAAMAAL

SEQ ID NO: 159443 - protein, 24 aa, Mycobacterium bovis
VHLARIFFTGAFRRPRETNWVIGS

SEQ ID NO: 159444 - protein, 17 aa, Mycobacterium bovis
VHPRFKVPFRAELVVGA

SEQ ID NO: 159445 - protein, 18 aa, Mycobacterium bovis
VHVYRLVWRQMIFFAHNI

SEQ ID NO: 159446 - protein, 25 aa, Mycobacterium bovis
VHYLLDVLRRVAIDLDRSQKAASGA

SEQ ID NO: 159447 - protein, 24 aa, Mycobacterium bovis
VIAEVWKTTPFMSLLLLAGLALVP

SEQ ID NO: 159448 - protein, 31 aa, Mycobacterium bovis
VIARPYQWWRLALVLASGLAYVVIFSLPLAR

SEQ ID NO: 159449 - protein, 21 aa, Mycobacterium bovis
VIASLEMQHLISLGPNAPSPS

SEQ ID NO: 159450 - protein, 22 aa, Mycobacterium bovis
VIASVCRRHFWAAHPHGPTVLT

SEQ ID NO: 159451 - protein, 22 aa, Mycobacterium bovis
VIDEFYEWFRIMPTAVDVLDSI

SEQ ID NO: 159452 - protein, 19 aa, Mycobacterium bovis
VIDGEIKQRYELFKSVGAR

SEQ ID NO: 159453 - protein, 18 aa, Mycobacterium bovis
VIDVLPVPVGALVGPAAV

SEQ ID NO: 159454 - protein, 18 aa, Mycobacterium bovis
VIGCAGLGPASYLLGSVP

SEQ ID NO: 159455 - protein, 24 aa, Mycobacterium bovis
VIGLGCGFGPLNNRFFPPMGSILY

SEQ ID NO: 159456 - protein, 18 aa, Mycobacterium bovis
VIGRWDALGFLQDFFATA

SEQ ID NO: 159457 - protein, 17 aa, Mycobacterium bovis
VIGTWLHWALFGGDFPG

SEQ ID NO: 159458 - protein, 26 aa, Mycobacterium bovis
VIICGFTGLSGYIVWQHHEATERQQR

SEQ ID NO: 159459 - protein, 18 aa, Mycobacterium bovis
VILLRALVAPIYLIGSVL

SEQ ID NO: 159460 - protein, 18 aa, Mycobacterium bovis
VILPPFVYFITYRWCIGL

SEQ ID NO: 159461 - protein, 31 aa, Mycobacterium bovis
VILSGPGRYGLDAARGWAHRPFIGSFVALLG

SEQ ID NO: 159462 - protein, 26 aa, Mycobacterium bovis
VILTSVWLFDCWRLLVRPPHAGRRRG

SEQ ID NO: 159463 - protein, 17 aa, Mycobacterium bovis
VINELRAAGAEAIQIND

SEQ ID NO: 159464 - protein, 22 aa, Mycobacterium bovis
VIPFLIISVLFYFTVVVQEKML

SEQ ID NO: 159465 - protein, 17 aa, Mycobacterium bovis
VIPRLFVWPPARSIAQV

SEQ ID NO: 159466 - protein, 18 aa, Mycobacterium bovis
VIQKLSGLSINRFIAIDF

SEQ ID NO: 159467 - protein, 22 aa, Mycobacterium bovis
VIVAGVAALFWRLPSDDTTRSR

SEQ ID NO: 159468 - protein, 20 aa, Mycobacterium bovis
VKAEMLVGTPAMWWLAVPVL

SEQ ID NO: 159469 - protein, 17 aa, Mycobacterium bovis
VKDGQPFIPADCLAKGG

SEQ ID NO: 159470 - protein, 17 aa, Mycobacterium bovis
VKGLGIAAGAKRPGAKK

SEQ ID NO: 159471 - protein, 27 aa, Mycobacterium bovis
VKMTTEWLHVPFLPVPIPVPIPQNPGA

SEQ ID NO: 159472 - protein, 20 aa, Mycobacterium bovis
VKPRPEWGPLAMLLAGSILI

SEQ ID NO: 159473 - protein, 17 aa, Mycobacterium bovis
VKRKGQESFNFGEFFAF

SEQ ID NO: 159474 - protein, 27 aa, Mycobacterium bovis
VLAAGWRSRHWQRRWLPTAAAIGATLA

SEQ ID NO: 159475 - protein, 23 aa, Mycobacterium bovis
VLAARFVTWLANRVTRRLDLGFT

SEQ ID NO: 159476 - protein, 28 aa, Mycobacterium bovis
VLAFRHFGDAVLLLAIWIGIGFIFRGVA

SEQ ID NO: 159477 - protein, 25 aa, Mycobacterium bovis
VLAICMLPIIGMRWGVAENPTRQGG

SEQ ID NO: 159478 - protein, 20 aa, Mycobacterium bovis
VLAILAWRALDRSDRLGKLL

SEQ ID NO: 159479 - protein, 24 aa, Mycobacterium bovis
VLALSFASVNGWWYVSNFGVPWSN

SEQ ID NO: 159480 - protein, 24 aa, Mycobacterium bovis
VLAWATSGINGWFYVGNYGVPWYD

SEQ ID NO: 159481 - protein, 21 aa, Mycobacterium bovis
VLAWRDSWEYWTHTLHHTDRI

SEQ ID NO: 159482 - protein, 18 aa, Mycobacterium bovis
VLCCAAIAYIALTAPHRP

SEQ ID NO: 159483 - protein, 32 aa, Mycobacterium bovis
VLCSAGGVALGFPLADPIVGLLITAAILAVLR

SEQ ID NO: 159484 - protein, 26 aa, Mycobacterium bovis
VLDRLRARFGWLDHVVRAFTRFNDRN

SEQ ID NO: 159485 - protein, 25 aa, Mycobacterium bovis
VLDVAQPLAYCLPGVRSRVVVSEGT

SEQ ID NO: 159486 - protein, 28 aa, Mycobacterium bovis
VLGAVARRFALSPIPVYLLAGLSLGNGG

SEQ ID NO: 159487 - protein, 35 aa, Mycobacterium bovis
VLGKLPDAYRIIGRAGGIYGDFFNFYLCDISLKVN

SEQ ID NO: 159488 - protein, 25 aa, Mycobacterium bovis
VLGLAAYFASFGPMFTLSTELGGGD

SEQ ID NO: 159489 - protein, 27 aa, Mycobacterium bovis
VLIAAFLAVWWIYETYRPQAPGPGDSP

SEQ ID NO: 159490 - protein, 18 aa, Mycobacterium bovis
VLIAYVFSLLGYDWLAHT

SEQ ID NO: 159491 - protein, 19 aa, Mycobacterium bovis
VLIGLALFALWPFTRLVHA

SEQ ID NO: 159492 - protein, 25 aa, Mycobacterium bovis
VLKRTGRLSLRHALDMLEQTGRALQ

SEQ ID NO: 159493 - protein, 18 aa, Mycobacterium bovis
VLLFTIIWWNVNHGRANW

SEQ ID NO: 159494 - protein, 23 aa, Mycobacterium bovis
VLLIGLVRWYLGTALFDSIARKL

SEQ ID NO: 159495 - protein, 17 aa, Mycobacterium bovis
VLLLAGFGWMISSRMVR

SEQ ID NO: 159496 - protein, 17 aa, Mycobacterium bovis
VLLPQLRPTTFFLSITV

SEQ ID NO: 159497 - protein, 17 aa, Mycobacterium bovis
VLLRRGRVAGLASGPAW

SEQ ID NO: 159498 - protein, 17 aa, Mycobacterium bovis
VLLTRLAIVAAVALVVA

SEQ ID NO: 159499 - protein, 17 aa, Mycobacterium bovis
VLLWLFVRHEHRAAFPL

SEQ ID NO: 159500 - protein, 25 aa, Mycobacterium bovis
VLLWQHLFWFFGHPEVYIIALPFFG

SEQ ID NO: 159501 - protein, 23 aa, Mycobacterium bovis
VLMLGQCRVLFAMARDGLVPRQL

SEQ ID NO: 159502 - protein, 18 aa, Mycobacterium bovis
VLMPLALFGILGLAAVVL

SEQ ID NO: 159503 - protein, 19 aa, Mycobacterium bovis
VLPFTGLNTPLAVAVDSDR

SEQ ID NO: 159504 - protein, 26 aa, Mycobacterium bovis
VLPLAAPWLRDLRAGPVSINRTVDYI

SEQ ID NO: 159505 - protein, 17 aa, Mycobacterium bovis
VLSAAPWDTHPGWVNLP

SEQ ID NO: 159506 - protein, 25 aa, Mycobacterium bovis
VLSLPLYLMCGLARNRRLLSQEAAM

SEQ ID NO: 159507 - protein, 23 aa, Mycobacterium bovis
VLTFHWAQVVWSRTIVQLAAEER

SEQ ID NO: 159508 - protein, 26 aa, Mycobacterium bovis
VLTGLRLLAGLIWLYNVVWKVPPDFG

SEQ ID NO: 159509 - protein, 20 aa, Mycobacterium bovis
VLTLRRWLRPATAAVVCCLA

SEQ ID NO: 159510 - protein, 18 aa, Mycobacterium bovis
VLTVWRFDSLIGAAGVVL

SEQ ID NO: 159511 - protein, 27 aa, Mycobacterium bovis
VLVAIAVLCAVSFFTAIFLRDLRIPAM

SEQ ID NO: 159512 - protein, 21 aa, Mycobacterium bovis
VLVFVPRVWVAIVAVATLVAT

SEQ ID NO: 159513 - protein, 18 aa, Mycobacterium bovis
VLVHEFTEVIVIANGVRA

SEQ ID NO: 159514 - protein, 22 aa, Mycobacterium bovis
VLVLRRRVGLVAQAPVVLTDAV

SEQ ID NO: 159515 - protein, 18 aa, Mycobacterium bovis
VLVPGQLVSKEIIYFLAQ

SEQ ID NO: 159516 - protein, 26 aa, Mycobacterium bovis
VLVWQHLLGIQLYWIVLALAVILLLA

SEQ ID NO: 159517 - protein, 26 aa, Mycobacterium bovis
VLVWRRVSDGWAFMCTLIVVAAVVVL

SEQ ID NO: 159518 - protein, 19 aa, Mycobacterium bovis
VLVYTELWVGFTAVSALLI

SEQ ID NO: 159519 - protein, 20 aa, Mycobacterium bovis
VMLTAAEWTAVLINMNADNI

SEQ ID NO: 159520 - protein, 18 aa, Mycobacterium bovis
VMPFHAFFGIALMTMSST

SEQ ID NO: 159521 - protein, 24 aa, Mycobacterium bovis
VMVFASGLLAMFPIAALGALVVYA

SEQ ID NO: 159522 - protein, 23 aa, Mycobacterium bovis
VMVSLAELWRSVGVVPDAVIGHS

SEQ ID NO: 159523 - protein, 18 aa, Mycobacterium bovis
VNALLGIYYSHSLYYGLT

SEQ ID NO: 159524 - protein, 26 aa, Mycobacterium bovis
VNAPGVILRLMLAWIPSTGVPLLAIV

SEQ ID NO: 159525 - protein, 22 aa, Mycobacterium bovis
VNDPRLSAIATISPADIVDRIL

SEQ ID NO: 159526 - protein, 23 aa, Mycobacterium bovis
VNFRDVLVALGMYPGGGELGVDG

SEQ ID NO: 159527 - protein, 18 aa, Mycobacterium bovis
VNGKIRFPANTNLVRHVE

SEQ ID NO: 159528 - protein, 23 aa, Mycobacterium bovis
VNLLLSPAVFRGFDQVGALSPTG

SEQ ID NO: 159529 - protein, 18 aa, Mycobacterium bovis
VNVPGLVVAAVWAVGLVA

SEQ ID NO: 159530 - protein, 31 aa, Mycobacterium bovis
VPALAGGPWDWARWAPASPWATPPAVVMVLG

SEQ ID NO: 159531 - protein, 21 aa, Mycobacterium bovis
VPEAIALIVVMVRYLEPFTAV

SEQ ID NO: 159532 - protein, 19 aa, Mycobacterium bovis
VPGFAWWAAALNSLPMLAA

SEQ ID NO: 159533 - protein, 19 aa, Mycobacterium bovis
VPKLRRWLATAVRPKLREV

SEQ ID NO: 159534 - protein, 17 aa, Mycobacterium bovis
VPKLTTALIHAYPAEHG

SEQ ID NO: 159535 - protein, 23 aa, Mycobacterium bovis
VPLEAVPAFFRWLAQFEPMHQVF

SEQ ID NO: 159536 - protein, 20 aa, Mycobacterium bovis
VPLFCSFGAMLVYPENGSGW

SEQ ID NO: 159537 - protein, 18 aa, Mycobacterium bovis
VPLGLLLMTARRRPSFLR

SEQ ID NO: 159538 - protein, 26 aa, Mycobacterium bovis
VPLLLGALWASAAFARRADTAADKAN

SEQ ID NO: 159539 - protein, 20 aa, Mycobacterium bovis
VPLSLLVTRAITRRSQPLFV

SEQ ID NO: 159540 - protein, 24 aa, Mycobacterium bovis
VPPARLTKMTAMPQLVAFFNGVGG

SEQ ID NO: 159541 - protein, 23 aa, Mycobacterium bovis
VPPEVPSAWLSTGMGPGPLLAAQ

SEQ ID NO: 159542 - protein, 24 aa, Mycobacterium bovis
VPPIPWRLRLRRPTIVLGSVVALL

SEQ ID NO: 159543 - protein, 23 aa, Mycobacterium bovis
VPPPFELPPPFGPGTTTPTPPAP

SEQ ID NO: 159544 - protein, 17 aa, Mycobacterium bovis
VPPYKTAGLGLVLVFAL

SEQ ID NO: 159545 - protein, 17 aa, Mycobacterium bovis
VPRIEFDDVAFGYDGGS

SEQ ID NO: 159546 - protein, 30 aa, Mycobacterium bovis
VPSVICAITVAWLDRFMGIGGESALFFIGV

SEQ ID NO: 159547 - protein, 24 aa, Mycobacterium bovis
VPTGIKFFNWIGTMWKGQLTFETP

SEQ ID NO: 159548 - protein, 23 aa, Mycobacterium bovis
VQERRLVFERFYRSASARALPGS

SEQ ID NO: 159549 - protein, 19 aa, Mycobacterium bovis
VQIPRLVANNTRIWVYCGN

SEQ ID NO: 159550 - protein, 25 aa, Mycobacterium bovis
VQNVVPRPGTSPGVGGTPASPAPEA

SEQ ID NO: 159551 - protein, 22 aa, Mycobacterium bovis
VQTEGFSGPALIIGTPTLSRVA

SEQ ID NO: 159552 - protein, 20 aa, Mycobacterium bovis
VQTGLLWPAIFVAAFAALGL

SEQ ID NO: 159553 - protein, 23 aa, Mycobacterium bovis
VQWRKRRLVIAIVSTGLVFAMTL

SEQ ID NO: 159554 - protein, 18 aa, Mycobacterium bovis
VRDLMGVEHLRWYDYPLA

SEQ ID NO: 159555 - protein, 19 aa, Mycobacterium bovis
VRGAMVAAWDKLRGPNGKL

SEQ ID NO: 159556 - protein, 21 aa, Mycobacterium bovis
VRGARNIPCVDVPGKRAATPK

SEQ ID NO: 159557 - protein, 24 aa, Mycobacterium bovis
VRHFGELEFWFALIKVAAIVCLIA

SEQ ID NO: 159558 - protein, 21 aa, Mycobacterium bovis
VRHPIMLGFVVAFWATPMMTA

SEQ ID NO: 159559 - protein, 26 aa, Mycobacterium bovis
VRIPRSVEALGRVDMVCFDKTGTLSE

SEQ ID NO: 159560 - protein, 22 aa, Mycobacterium bovis
VRKYLTLMAFRVPALILAAIAY

SEQ ID NO: 159561 - protein, 19 aa, Mycobacterium bovis
VRLGSMYGYGISYAVASLS

SEQ ID NO: 159562 - protein, 20 aa, Mycobacterium bovis
VRPAPGQGLSPAVSTLVVAG

SEQ ID NO: 159563 - protein, 29 aa, Mycobacterium bovis
VRPLRSYFYWEHHCFDIPLCSATRSLFDT

SEQ ID NO: 159564 - protein, 20 aa, Mycobacterium bovis
VRPYGYDQTARWVPRLWRRD

SEQ ID NO: 159565 - protein, 24 aa, Mycobacterium bovis
VRQRTWGWALAVVVIVLALAAIAI

SEQ ID NO: 159566 - protein, 24 aa, Mycobacterium bovis
VRSAAALWWIPAWLAMIVEVAVLG

SEQ ID NO: 159567 - protein, 20 aa, Mycobacterium bovis
VRSAGLWYAVMTQLGFIAIL

SEQ ID NO: 159568 - protein, 22 aa, Mycobacterium bovis
VRWQGEFLVAVIELIPRPFTPT

SEQ ID NO: 159569 - protein, 17 aa, Mycobacterium bovis
VRWVVRTPWPLFSLSML

SEQ ID NO: 159570 - protein, 26 aa, Mycobacterium bovis
VRYALRRLGALRVWPARARANTEIDD

SEQ ID NO: 159571 - protein, 18 aa, Mycobacterium bovis
VRYRDRLLLPLPMFHVAA

SEQ ID NO: 159572 - protein, 20 aa, Mycobacterium bovis
VSAKSLRVGDVIDLAAPEVV

SEQ ID NO: 159573 - protein, 19 aa, Mycobacterium bovis
VSATVFLAVWVPLFCSFGA

SEQ ID NO: 159574 - protein, 19 aa, Mycobacterium bovis
VSGLARVVAFLGAVLVLAK

SEQ ID NO: 159575 - protein, 29 aa, Mycobacterium bovis
VSGWRFLLRRLEHAIVRRDTRMFDDPLQF

SEQ ID NO: 159576 - protein, 22 aa, Mycobacterium bovis
VSHPSLPFAVLVVIAATAGFGG

SEQ ID NO: 159577 - protein, 22 aa, Mycobacterium bovis
VSIPLTVLIIFTLNILLAEFGA

SEQ ID NO: 159578 - protein, 20 aa, Mycobacterium bovis
VSKEIIYFLAQLDVKEIHGY

SEQ ID NO: 159579 - protein, 22 aa, Mycobacterium bovis
VSLPDCQGALYTSQDPVYAGTG

SEQ ID NO: 159580 - protein, 21 aa, Mycobacterium bovis
VSLRLLVVGSVFGTVAGVVIG

SEQ ID NO: 159581 - protein, 19 aa, Mycobacterium bovis
VSMLSKWPVGWVVVLLYAV

SEQ ID NO: 159582 - protein, 24 aa, Mycobacterium bovis
VSNASGRMRVCVTGFNVDAVRAVA

SEQ ID NO: 159583 - protein, 19 aa, Mycobacterium bovis
VSPASMRKFFEAFAPYGLK

SEQ ID NO: 159584 - protein, 26 aa, Mycobacterium bovis
VSPGTRWPQPTPWAGGAPPWGPPSSP

SEQ ID NO: 159585 - protein, 20 aa, Mycobacterium bovis
VSPLPSLAKRAADILRQDVG

SEQ ID NO: 159586 - protein, 18 aa, Mycobacterium bovis
VSQPVAVAAPAKRSLLRT

SEQ ID NO: 159587 - protein, 21 aa, Mycobacterium bovis
VSRRGEMSYSFADLKANGLSL

SEQ ID NO: 159588 - protein, 23 aa, Mycobacterium bovis
VSTRTSGPYLRHGQTITTTTVPS

SEQ ID NO: 159589 - protein, 21 aa, Mycobacterium bovis
VSVESVTLWLFGGVTALGGEA

SEQ ID NO: 159590 - protein, 18 aa, Mycobacterium bovis
VSWSHHWVWMLPAVLVIG

SEQ ID NO: 159591 - protein, 26 aa, Mycobacterium bovis
VSYMRYPVFLGFDIVGGVAWGAGVTL

SEQ ID NO: 159592 - protein, 26 aa, Mycobacterium bovis
VTAAGATAAWAIGRWTPGTERRTATM

SEQ ID NO: 159593 - protein, 18 aa, Mycobacterium bovis
VTAALRFGGMVGTSQAGE

SEQ ID NO: 159594 - protein, 24 aa, Mycobacterium bovis
VTACIAVSLIVYVFFIKNKADTYL

SEQ ID NO: 159595 - protein, 28 aa, Mycobacterium bovis
VTAGGLLGWCWRRGTAPGAPGSDFPQRC

SEQ ID NO: 159596 - protein, 19 aa, Mycobacterium bovis
VTCGLGAVIWGVIDALLIL

SEQ ID NO: 159597 - protein, 24 aa, Mycobacterium bovis
VTEQEMWEALRVAAADGFVQTDGL

SEQ ID NO: 159598 - protein, 19 aa, Mycobacterium bovis
VTFMLVWLINHHGWSVAQA

SEQ ID NO: 159599 - protein, 17 aa, Mycobacterium bovis
VTGKALQEFGRYQSVVY

SEQ ID NO: 159600 - protein, 17 aa, Mycobacterium bovis
VTIRLALIALAVEAVLG

SEQ ID NO: 159601 - protein, 17 aa, Mycobacterium bovis
VTLAKVDGNWLITKFTP

SEQ ID NO: 159602 - protein, 17 aa, Mycobacterium bovis
VTLEVFGAPGTVATINY

SEQ ID NO: 159603 - protein, 22 aa, Mycobacterium bovis
VTLFRSEWRRPVELSTSVPEVV

SEQ ID NO: 159604 - protein, 29 aa, Mycobacterium bovis
VTLLPALMVLTGRRGWIAPRRDLTRRFWR

SEQ ID NO: 159605 - protein, 25 aa, Mycobacterium bovis
VTLQIGLGIGRLVFRALNTVEVGFA

SEQ ID NO: 159606 - protein, 19 aa, Mycobacterium bovis
VTMGVAWSVLYIPVGGVGT

SEQ ID NO: 159607 - protein, 17 aa, Mycobacterium bovis
VTPEELYPITGVKSLPF

SEQ ID NO: 159608 - protein, 19 aa, Mycobacterium bovis
VTRSGWWTHSLRGVLPEQF

SEQ ID NO: 159609 - protein, 24 aa, Mycobacterium bovis
VTSNQLVAWVCIGASVLGVALLIV

SEQ ID NO: 159610 - protein, 31 aa, Mycobacterium bovis
VVADARPGDLLYGLHAMMFNRSRVSDDQIVL

SEQ ID NO: 159611 - protein, 17 aa, Mycobacterium bovis
VVAELIDELGWPMLCLM

SEQ ID NO: 159612 - protein, 21 aa, Mycobacterium bovis
VVAEMRKVIWPNRKQMLTYTS

SEQ ID NO: 159613 - protein, 27 aa, Mycobacterium bovis
VVALIPLVWLLWVVIARGWFAVTRSGW

SEQ ID NO: 159614 - protein, 22 aa, Mycobacterium bovis
VVALRSRLLVRLGGAGGMVSLA

SEQ ID NO: 159615 - protein, 33 aa, Mycobacterium bovis
VVARCEYHPTPACPQTRITGVPGRGPETRTANQ

SEQ ID NO: 159616 - protein, 23 aa, Mycobacterium bovis
VVATALRLYTRWLGHVVLLVPTV

SEQ ID NO: 159617 - protein, 17 aa, Mycobacterium bovis
VVCAIGLGSVAGLSRVF

SEQ ID NO: 159618 - protein, 17 aa, Mycobacterium bovis
VVDARLVTMVPAGWSLV

SEQ ID NO: 159619 - protein, 27 aa, Mycobacterium bovis
VVDLADPAVVWALRLQGRVPHVVAQSL

SEQ ID NO: 159620 - protein, 20 aa, Mycobacterium bovis
VVEIGKQLLITRGALTTFSI

SEQ ID NO: 159621 - protein, 25 aa, Mycobacterium bovis
VVFGDFRFGPTTVYHATFTDASRLK

SEQ ID NO: 159622 - protein, 18 aa, Mycobacterium bovis
VVFPLGMYGVGAYRLGLA

SEQ ID NO: 159623 - protein, 18 aa, Mycobacterium bovis
VVGAVAFALSPRVLTTLG

SEQ ID NO: 159624 - protein, 18 aa, Mycobacterium bovis
VVGGTVRTVGRTVSGAAT

SEQ ID NO: 159625 - protein, 18 aa, Mycobacterium bovis
VVGLGLFNPLSVGAGLIL

SEQ ID NO: 159626 - protein, 19 aa, Mycobacterium bovis
VVGTVAAVAVAALWAVRRG

SEQ ID NO: 159627 - protein, 19 aa, Mycobacterium bovis
VVGTWWRYRYDKFGWTTRS

SEQ ID NO: 159628 - protein, 26 aa, Mycobacterium bovis
VVGVFALRRVWWLYKLVMSGQPASGR

SEQ ID NO: 159629 - protein, 21 aa, Mycobacterium bovis
VVIDDAMSWLRGAAVPPAGFD

SEQ ID NO: 159630 - protein, 24 aa, Mycobacterium bovis
VVLAVRLNVLFSYQGNDMYTALQK

SEQ ID NO: 159631 - protein, 21 aa, Mycobacterium bovis
VVLGFRFRQGLIPSLMWISVP

SEQ ID NO: 159632 - protein, 25 aa, Mycobacterium bovis
VVLRRARYRPLWVFLLVPVLILLTV

SEQ ID NO: 159633 - protein, 25 aa, Mycobacterium bovis
VVLTGRISVVAAPWLADHAVGPVVL

SEQ ID NO: 159634 - protein, 25 aa, Mycobacterium bovis
VVLVGYCAGWLPWFADIDRQMYFFY

SEQ ID NO: 159635 - protein, 18 aa, Mycobacterium bovis
VVMSCFFGTLMVITQHFQ

SEQ ID NO: 159636 - protein, 20 aa, Mycobacterium bovis
VVMVALVVFGLRRRRRGYDA

SEQ ID NO: 159637 - protein, 36 aa, Mycobacterium bovis
VVPAPVPIPVPIIIPPFPGWQPGMPTIPTAPPTTPV

SEQ ID NO: 159638 - protein, 25 aa, Mycobacterium bovis
VVPPPWWWGVVFENWIVVASINGYA

SEQ ID NO: 159639 - protein, 21 aa, Mycobacterium bovis
VVPTLWRGALVVLQSILAVAF

SEQ ID NO: 159640 - protein, 17 aa, Mycobacterium bovis
VVRLRYGALDFDTVPLS

SEQ ID NO: 159641 - protein, 19 aa, Mycobacterium bovis
VVRRGRVYAARLAPVAAGL

SEQ ID NO: 159642 - protein, 18 aa, Mycobacterium bovis
VVRRSLRPLAEFEQTAAA

SEQ ID NO: 159643 - protein, 22 aa, Mycobacterium bovis
VVTAGSLVVHWATMQELYGITD

SEQ ID NO: 159644 - protein, 19 aa, Mycobacterium bovis
VVTPAWYAPLVLSVGGIGQ

SEQ ID NO: 159645 - protein, 19 aa, Mycobacterium bovis
VVVAQRLVAIAGLAGLGIA

SEQ ID NO: 159646 - protein, 22 aa, Mycobacterium bovis
VVVAVAASLIWWTSDARATISR

SEQ ID NO: 159647 - protein, 17 aa, Mycobacterium bovis
VVVDAAPGLGVLRDGQK

SEQ ID NO: 159648 - protein, 40 aa, Mycobacterium bovis
VVVEAFYLFSCRSLTRSAWRLGMFANRWIILGVSAQAIAQ

SEQ ID NO: 159649 - protein, 21 aa, Mycobacterium bovis
VVVFLVTWPLVYLASKSSLLA

SEQ ID NO: 159650 - protein, 37 aa, Mycobacterium bovis
VVVIKKGRLKWAWIPGIPLLWDLAVTLTASWQKIFSA

SEQ ID NO: 159651 - protein, 17 aa, Mycobacterium bovis
VVVLIGFWVAGSHEVQS

SEQ ID NO: 159652 - protein, 18 aa, Mycobacterium bovis
VVVLMSFAVYAVISAALY

SEQ ID NO: 159653 - protein, 30 aa, Mycobacterium bovis
VVVMVAGVILWCFFGDALSNRSHTAAARCV

SEQ ID NO: 159654 - protein, 29 aa, Mycobacterium bovis
VVVRLLPGWPIWFAVGWAAQEWLKSILPF

SEQ ID NO: 159655 - protein, 19 aa, Mycobacterium bovis
VWDRLGDRLQHLILPSLTL

SEQ ID NO: 159656 - protein, 19 aa, Mycobacterium bovis
VWFGHFPGWIPLGAMVLPF

SEQ ID NO: 159657 - protein, 26 aa, Mycobacterium bovis
VWRDREPALASPRRPQAPVVPIISSA

SEQ ID NO: 159658 - protein, 28 aa, Mycobacterium bovis
VWRRDLRAIVRLLAWQGAALAAIPLLRG

SEQ ID NO: 159659 - protein, 25 aa, Mycobacterium bovis
VWTVIAILALFGWPQVARIARGAVL

SEQ ID NO: 159660 - protein, 17 aa, Mycobacterium bovis
VYATLTVTFLFGRLNGI

SEQ ID NO: 159661 - protein, 27 aa, Mycobacterium bovis
VYAVLAVIWCWLLKRYIVEGPLEHDAE

SEQ ID NO: 159662 - protein, 23 aa, Mycobacterium bovis
VYFITYRWCIGLQRSDRSVLEHG

SEQ ID NO: 159663 - protein, 18 aa, Mycobacterium bovis
VYFSHALNKVWRRHMLRV

SEQ ID NO: 159664 - protein, 28 aa, Mycobacterium bovis
VYFTLGLGSLMSWMFYVGLIITVADVLV

SEQ ID NO: 159665 - protein, 24 aa, Mycobacterium bovis
VYKVCKGLEKIPLLGHLWSWELAI

SEQ ID NO: 159666 - protein, 19 aa, Mycobacterium bovis
VYNMALVFRHRVRKDRLIS

SEQ ID NO: 159667 - protein, 26 aa, Mycobacterium bovis
VYTETKLNSAFSFGGPKCLVKVIQKL

SEQ ID NO: 159668 - protein, 22 aa, Mycobacterium bovis
WAAGVLGALAIIIAVLLVIKAP

SEQ ID NO: 159669 - protein, 17 aa, Mycobacterium bovis
WAAKRARGSPLRIMILL

SEQ ID NO: 159670 - protein, 19 aa, Mycobacterium bovis
WAFLIWGMYAYLWAFVLYA

SEQ ID NO: 159671 - protein, 29 aa, Mycobacterium bovis
WAGVTSVSIPSWWQPYVLSVASLTSAGQP

SEQ ID NO: 159672 - protein, 19 aa, Mycobacterium bovis
WAIALLVWHYGRVEERWTP

SEQ ID NO: 159673 - protein, 18 aa, Mycobacterium bovis
WAILAVVVIVLFGAKKLP

SEQ ID NO: 159674 - protein, 21 aa, Mycobacterium bovis
WAISELDLAPVYLNFAENSHL

SEQ ID NO: 159675 - protein, 21 aa, Mycobacterium bovis
WAIYVRRGLKSAGELVPATTA

SEQ ID NO: 159676 - protein, 18 aa, Mycobacterium bovis
WAMVSLCLVSVWRSVPFA

SEQ ID NO: 159677 - protein, 17 aa, Mycobacterium bovis
WAPGFFVTTKLDVIKAQ

SEQ ID NO: 159678 - protein, 25 aa, Mycobacterium bovis
WARQHARRMVLVWVSVVLAITGLVA

SEQ ID NO: 159679 - protein, 21 aa, Mycobacterium bovis
WARQRTAMIAAERLEQMLSTA

SEQ ID NO: 159680 - protein, 20 aa, Mycobacterium bovis
WAVRAYAWTDWRFTQLREWF

SEQ ID NO: 159681 - protein, 18 aa, Mycobacterium bovis
WCALFPIIWALSGSLKAD

SEQ ID NO: 159682 - protein, 18 aa, Mycobacterium bovis
WCGGLAIGLTLVLKPLLG

SEQ ID NO: 159683 - protein, 25 aa, Mycobacterium bovis
WCMQGLPSPYLTIAFPNRPPQYEEY

SEQ ID NO: 159684 - protein, 17 aa, Mycobacterium bovis
WDGPAWSISAEWLAYLL

SEQ ID NO: 159685 - protein, 17 aa, Mycobacterium bovis
WDQIGQIVVSWVLSPVL

SEQ ID NO: 159686 - protein, 18 aa, Mycobacterium bovis
WEALEHAGIPPGTLRRSA

SEQ ID NO: 159687 - protein, 20 aa, Mycobacterium bovis
WEALEHARIPASSLRGQAVG

SEQ ID NO: 159688 - protein, 20 aa, Mycobacterium bovis
WEALERAGIDPITLRGSQTG

SEQ ID NO: 159689 - protein, 21 aa, Mycobacterium bovis
WEAVDNRLGRRVAVKVLKSEF

SEQ ID NO: 159690 - protein, 28 aa, Mycobacterium bovis
WEKHCFDVPLCWSIRSIFDMFDSVDQLS

SEQ ID NO: 159691 - protein, 22 aa, Mycobacterium bovis
WETIGRPIARRNLIFSIFAEHV

SEQ ID NO: 159692 - protein, 23 aa, Mycobacterium bovis
WFGELGYRSVFTTMLATRIVVCL

SEQ ID NO: 159693 - protein, 18 aa, Mycobacterium bovis
WFICGPLAMATAVRETLI

SEQ ID NO: 159694 - protein, 17 aa, Mycobacterium bovis
WFLAAVIPLAIMLAPPV

SEQ ID NO: 159695 - protein, 19 aa, Mycobacterium bovis
WFMVVQLPFAGIVFAVDGV

SEQ ID NO: 159696 - protein, 20 aa, Mycobacterium bovis
WFSLPECVYYVVGIASIALG

SEQ ID NO: 159697 - protein, 17 aa, Mycobacterium bovis
WFSLSPVTLCWLLISYG

SEQ ID NO: 159698 - protein, 25 aa, Mycobacterium bovis
WGAVDRRWGRWAALVVTTVVFALAH

SEQ ID NO: 159699 - protein, 26 aa, Mycobacterium bovis
WGTANALCGIAIFALVVFVTGLPLAY

SEQ ID NO: 159700 - protein, 21 aa, Mycobacterium bovis
WGTDSVFSWTLAAVLTIGTIT

SEQ ID NO: 159701 - protein, 19 aa, Mycobacterium bovis
WHAPWPLNMWASANTGWWP

SEQ ID NO: 159702 - protein, 26 aa, Mycobacterium bovis
WHKEYGSACNLVFPIGIIDRPYKHDQ

SEQ ID NO: 159703 - protein, 17 aa, Mycobacterium bovis
WIGTMWKGQLTFETPML

SEQ ID NO: 159704 - protein, 19 aa, Mycobacterium bovis
WILNRGLRIVMLLIAAVLA

SEQ ID NO: 159705 - protein, 23 aa, Mycobacterium bovis
WIRELRPHIDLYLLTDESIAAET

SEQ ID NO: 159706 - protein, 26 aa, Mycobacterium bovis
WITTRIVRASIRWAIEERAPSQADGR

SEQ ID NO: 159707 - protein, 18 aa, Mycobacterium bovis
WKGLSEEMLTRAIKTQLV

SEQ ID NO: 159708 - protein, 23 aa, Mycobacterium bovis
WKKGLRHSVYFTHGIRNAVDSGH

SEQ ID NO: 159709 - protein, 19 aa, Mycobacterium bovis
WKRVAVLFAGPGMNLAICL

SEQ ID NO: 159710 - protein, 21 aa, Mycobacterium bovis
WKVYDRRTVTDMGMLQAALVR

SEQ ID NO: 159711 - protein, 17 aa, Mycobacterium bovis
WKWNVVGLLAIALGAAI

SEQ ID NO: 159712 - protein, 18 aa, Mycobacterium bovis
WLAALLFAGALLAERVSL

SEQ ID NO: 159713 - protein, 27 aa, Mycobacterium bovis
WLAILSLRLIPVVPFAAINYAAGASGV

SEQ ID NO: 159714 - protein, 26 aa, Mycobacterium bovis
WLAQFEPMHQVFLGVRSLLYLNGNAD

SEQ ID NO: 159715 - protein, 17 aa, Mycobacterium bovis
WLFMRFSGVVLVFLAIG

SEQ ID NO: 159716 - protein, 26 aa, Mycobacterium bovis
WLFVRHEHRAAFPLVDLKLFAEPLYR

SEQ ID NO: 159717 - protein, 17 aa, Mycobacterium bovis
WLIEPRWAMVSLCLVSV

SEQ ID NO: 159718 - protein, 17 aa, Mycobacterium bovis
WLLDGRASRQWCGGLAI

SEQ ID NO: 159719 - protein, 18 aa, Mycobacterium bovis
WLLHSRVTTFLSHPITAF

SEQ ID NO: 159720 - protein, 17 aa, Mycobacterium bovis
WLPESALPAPPRPTVQR

SEQ ID NO: 159721 - protein, 27 aa, Mycobacterium bovis
WLSSELMFFAGLFAFYFSARAQAGGNW

SEQ ID NO: 159722 - protein, 21 aa, Mycobacterium bovis
WLVFGGLWLALGYLLASLVCF

SEQ ID NO: 159723 - protein, 22 aa, Mycobacterium bovis
WMAARLPWVVIGSFDELGPPKE

SEQ ID NO: 159724 - protein, 20 aa, Mycobacterium bovis
WMMQAEVAITNFVTTMDVAA

SEQ ID NO: 159725 - protein, 22 aa, Mycobacterium bovis
WMTIDALVWVPRMYYLYGNPSR

SEQ ID NO: 159726 - protein, 18 aa, Mycobacterium bovis
WMVARVSLVPTLLVSIPF

SEQ ID NO: 159727 - protein, 23 aa, Mycobacterium bovis
WNCPACGGLRMIHDLLHGELAAS

SEQ ID NO: 159728 - protein, 17 aa, Mycobacterium bovis
WNDFLWPLLMIQRNSLA

SEQ ID NO: 159729 - protein, 17 aa, Mycobacterium bovis
WNEYLWPFLMSDDESVA

SEQ ID NO: 159730 - protein, 17 aa, Mycobacterium bovis
WNVFMIFGVLSLFVGHA

SEQ ID NO: 159731 - protein, 17 aa, Mycobacterium bovis
WPLRAPRAAMVLWQAIA

SEQ ID NO: 159732 - protein, 20 aa, Mycobacterium bovis
WPQPVPEPAFKAAIAQATQA

SEQ ID NO: 159733 - protein, 36 aa, Mycobacterium bovis
WPSLNRGWCLIRTRWGRRIARLLPFVGLAGLAVTTH

SEQ ID NO: 159734 - protein, 18 aa, Mycobacterium bovis
WPTSRLVPAPARLRRLWL

SEQ ID NO: 159735 - protein, 17 aa, Mycobacterium bovis
WPVMANFAVDSAMAVAL

SEQ ID NO: 159736 - protein, 20 aa, Mycobacterium bovis
WQAAGGGWRAFWLAVSSHAA

SEQ ID NO: 159737 - protein, 22 aa, Mycobacterium bovis
WQHILGIELHWLVLAMAVIILL

SEQ ID NO: 159738 - protein, 19 aa, Mycobacterium bovis
WQIAKSVLIFLGIPLLAGY

SEQ ID NO: 159739 - protein, 25 aa, Mycobacterium bovis
WQRNVRWARWLAWVSLAVLLTEGAV

SEQ ID NO: 159740 - protein, 22 aa, Mycobacterium bovis
WRAYALPVLMVLTTVVVYQTVT

SEQ ID NO: 159741 - protein, 19 aa, Mycobacterium bovis
WRDFCLRVADRIVLVAGDP

SEQ ID NO: 159742 - protein, 21 aa, Mycobacterium bovis
WRGEIGDWILNRGLRIVMLLI

SEQ ID NO: 159743 - protein, 19 aa, Mycobacterium bovis
WRGHAAAARDLRSHPRTGP

SEQ ID NO: 159744 - protein, 22 aa, Mycobacterium bovis
WRILLPHSRPAVLVLGVLTWVN

SEQ ID NO: 159745 - protein, 20 aa, Mycobacterium bovis
WRLDQLDGRGSIAQLLLRPF

SEQ ID NO: 159746 - protein, 17 aa, Mycobacterium bovis
WRNLRFARAKMPADAVA

SEQ ID NO: 159747 - protein, 18 aa, Mycobacterium bovis
WRPALTALTLGAGIIALG

SEQ ID NO: 159748 - protein, 20 aa, Mycobacterium bovis
WRPGAWACSLVVVAAWGSIL

SEQ ID NO: 159749 - protein, 22 aa, Mycobacterium bovis
WRPIRSYFYWEKHCYGIPICWS

SEQ ID NO: 159750 - protein, 22 aa, Mycobacterium bovis
WRQLAGMSYVWWALAVIVVAGL

SEQ ID NO: 159751 - protein, 17 aa, Mycobacterium bovis
WRRGRRPLETKVVLDWD

SEQ ID NO: 159752 - protein, 18 aa, Mycobacterium bovis
WRTMPAVIWDVRQPAGRV

SEQ ID NO: 159753 - protein, 18 aa, Mycobacterium bovis
WRVARNAGITDVRAALLP

SEQ ID NO: 159754 - protein, 20 aa, Mycobacterium bovis
WSLVSPRLPAPWRIPLQAGL

SEQ ID NO: 159755 - protein, 19 aa, Mycobacterium bovis
WSPTSSRTWATKVLAAHPG

SEQ ID NO: 159756 - protein, 17 aa, Mycobacterium bovis
WSRCTAALAGPRVAVAI

SEQ ID NO: 159757 - protein, 22 aa, Mycobacterium bovis
WSRLCDLEQMIPLMPGAQLIGH

SEQ ID NO: 159758 - protein, 17 aa, Mycobacterium bovis
WSWADLSFLPALALIFL

SEQ ID NO: 159759 - protein, 26 aa, Mycobacterium bovis
WTIWQLWLVVLLVALWKGRRIGPLVA

SEQ ID NO: 159760 - protein, 19 aa, Mycobacterium bovis
WTLYAHRPARGIGISECTK

SEQ ID NO: 159761 - protein, 17 aa, Mycobacterium bovis
WTVCDGLNAPSRGGADG

SEQ ID NO: 159762 - protein, 17 aa, Mycobacterium bovis
WVANYGHEYYLDKARKH

SEQ ID NO: 159763 - protein, 35 aa, Mycobacterium bovis
WVAPRGERMATFWRRAGTRIVRRPKAYLGASLIGL

SEQ ID NO: 159764 - protein, 19 aa, Mycobacterium bovis
WVAVAVIFYLMWGRHHSAL

SEQ ID NO: 159765 - protein, 17 aa, Mycobacterium bovis
WVFLFPASILVLILVCA

SEQ ID NO: 159766 - protein, 19 aa, Mycobacterium bovis
WVIQAPRLFAGQIDFGDVG

SEQ ID NO: 159767 - protein, 17 aa, Mycobacterium bovis
WVLPVHRASGLISRILA

SEQ ID NO: 159768 - protein, 24 aa, Mycobacterium bovis
WVNGLFGRLAWLFVGPVVAFPAFG

SEQ ID NO: 159769 - protein, 24 aa, Mycobacterium bovis
WVSLYRAKWWWLLAAVAAAGASMH

SEQ ID NO: 159770 - protein, 20 aa, Mycobacterium bovis
WWCVARRSWHAPRLGSISAG

SEQ ID NO: 159771 - protein, 19 aa, Mycobacterium bovis
WWQLLLRVVLPMSRPTMVA

SEQ ID NO: 159772 - protein, 32 aa, Mycobacterium bovis
WWQTFWRITLPSIRWGLTYGIVLTVARTLGEY

SEQ ID NO: 159773 - protein, 19 aa, Mycobacterium bovis
WYAAMLFAVIPLRNALPDA

SEQ ID NO: 159774 - protein, 18 aa, Mycobacterium bovis
WYAAMLFAVVPLRTILPG

SEQ ID NO: 159775 - protein, 18 aa, Mycobacterium bovis
WYADLPVASPQVFGDQTD

SEQ ID NO: 159776 - protein, 17 aa, Mycobacterium bovis
WYLQRVGSEPDFLRVWL

SEQ ID NO: 159777 - protein, 22 aa, Mycobacterium bovis
WYSRAICDTAAILSAIIDAETV

SEQ ID NO: 159778 - protein, 22 aa, Mycobacterium bovis
WYTENLRYYYLILPTVDGSLSR

SEQ ID NO: 159779 - protein, 20 aa, Mycobacterium bovis
YAANRVVGFALADPDLFTGR

SEQ ID NO: 159780 - protein, 18 aa, Mycobacterium bovis
YADRLEILHVLSSEPLHT

SEQ ID NO: 159781 - protein, 31 aa, Mycobacterium bovis
YAIRADPGIPARGIVAVCDFGGSGTGITLVD

SEQ ID NO: 159782 - protein, 28 aa, Mycobacterium bovis
YALLVNRWPLPEAGVRSGLAPAERDTAG

SEQ ID NO: 159783 - protein, 24 aa, Mycobacterium bovis
YAPEEIFLVLSVAGLAAYSMAPLI

SEQ ID NO: 159784 - protein, 24 aa, Mycobacterium bovis
YAVRWPDPWPTTFGYHEFFHACTA

SEQ ID NO: 159785 - protein, 19 aa, Mycobacterium bovis
YAWTDWRFTQLREWFHRQV

SEQ ID NO: 159786 - protein, 20 aa, Mycobacterium bovis
YCLGLGIPFVLLAFGSAWAV

SEQ ID NO: 159787 - protein, 17 aa, Mycobacterium bovis
YDYPLAAALSLVVLFTL

SEQ ID NO: 159788 - protein, 21 aa, Mycobacterium bovis
YELDAAKLLDFPVMTDMRDPL

SEQ ID NO: 159789 - protein, 20 aa, Mycobacterium bovis
YERDMRLIVAVTVVVVILIL

SEQ ID NO: 159790 - protein, 25 aa, Mycobacterium bovis
YERLKSWRRGLIFAMFVFAAIFTPG

SEQ ID NO: 159791 - protein, 17 aa, Mycobacterium bovis
YFIGRRIGPALFKKEDS

SEQ ID NO: 159792 - protein, 17 aa, Mycobacterium bovis
YFLIGGFGQGAGRSRAA

SEQ ID NO: 159793 - protein, 19 aa, Mycobacterium bovis
YFLLAPMLIVFSVAVAGVL

SEQ ID NO: 159794 - protein, 17 aa, Mycobacterium bovis
YFNIRFVQQYAHGAANP

SEQ ID NO: 159795 - protein, 26 aa, Mycobacterium bovis
YFNTLASPCAIGLVTVMLASLTLAPA

SEQ ID NO: 159796 - protein, 26 aa, Mycobacterium bovis
YFQTLGIPCAVGMLVAVAVALTLGPA

SEQ ID NO: 159797 - protein, 19 aa, Mycobacterium bovis
YGAPAGWHAPGWPPRSSHR

SEQ ID NO: 159798 - protein, 18 aa, Mycobacterium bovis
YGQYGQYGVQPGGYYGQQ

SEQ ID NO: 159799 - protein, 32 aa, Mycobacterium bovis
YGSLVMVFQWGWARGLGFPALHSIDSTVPPLV

SEQ ID NO: 159800 - protein, 26 aa, Mycobacterium bovis
YGVYLWHWPIFLALNGQRTGWSGPAL

SEQ ID NO: 159801 - protein, 26 aa, Mycobacterium bovis
YHIAKPWRWGYLGVLLVIFGFPLIAM

SEQ ID NO: 159802 - protein, 17 aa, Mycobacterium bovis
YHLLPLVAGIVLGTLLM

SEQ ID NO: 159803 - protein, 19 aa, Mycobacterium bovis
YIAGCVGAVLAVRQSDLFT

SEQ ID NO: 159804 - protein, 34 aa, Mycobacterium bovis
YIFGFSFYTGHYFGAWVFIAGFLLHIVVKIPHMV

SEQ ID NO: 159805 - protein, 24 aa, Mycobacterium bovis
YIVGFCLLVIAIGAVLSFAADLVG

SEQ ID NO: 159806 - protein, 22 aa, Mycobacterium bovis
YKLSEPWTHPPILWAATDEVVG

SEQ ID NO: 159807 - protein, 18 aa, Mycobacterium bovis
YKVPREVIFLDELPRNPT

SEQ ID NO: 159808 - protein, 18 aa, Mycobacterium bovis
YLAGFAWGLSREYSVLVE

SEQ ID NO: 159809 - protein, 17 aa, Mycobacterium bovis
YLERIFDPKVFVVSFVF

SEQ ID NO: 159810 - protein, 31 aa, Mycobacterium bovis
YLGSRTGAGFGRDLRSAMFEHIITFSERETA

SEQ ID NO: 159811 - protein, 17 aa, Mycobacterium bovis
YLISFFGALYSGRIAVP

SEQ ID NO: 159812 - protein, 17 aa, Mycobacterium bovis
YLLPARNWSVMAATEVR

SEQ ID NO: 159813 - protein, 17 aa, Mycobacterium bovis
YLLWAIIPLAAWATRPG

SEQ ID NO: 159814 - protein, 18 aa, Mycobacterium bovis
YLPPEAFDNPDFQRGLKL

SEQ ID NO: 159815 - protein, 20 aa, Mycobacterium bovis
YLRFRREAQNAAALNHPAIV

SEQ ID NO: 159816 - protein, 22 aa, Mycobacterium bovis
YLSALERLRDFAVFKAIGTPTR

SEQ ID NO: 159817 - protein, 25 aa, Mycobacterium bovis
YLSALERLRDFAVFKAIGVPTRSIL

SEQ ID NO: 159818 - protein, 18 aa, Mycobacterium bovis
YLTAPRPGGAMAPASTSS

SEQ ID NO: 159819 - protein, 24 aa, Mycobacterium bovis
YLWAFELTSALLITAAVGAMVLAH

SEQ ID NO: 159820 - protein, 25 aa, Mycobacterium bovis
YMEMLNLNEAWQFGRGDGVKVAVID

SEQ ID NO: 159821 - protein, 31 aa, Mycobacterium bovis
YMMWTEGLARIWPPWEFYFWHHTIPAPVWVA

SEQ ID NO: 159822 - protein, 17 aa, Mycobacterium bovis
YNPSFGGMDRQSRVFIN

SEQ ID NO: 159823 - protein, 23 aa, Mycobacterium bovis
YNVRRLPPPVVEPGPDRRPITAV

SEQ ID NO: 159824 - protein, 21 aa, Mycobacterium bovis
YPDIPPRPDWEPTGAEPIAAA

SEQ ID NO: 159825 - protein, 20 aa, Mycobacterium bovis
YPEDLFKVQRMLLAKYHVND

SEQ ID NO: 159826 - protein, 20 aa, Mycobacterium bovis
YPERRRLAPPRGKSVVHEPI

SEQ ID NO: 159827 - protein, 20 aa, Mycobacterium bovis
YPIRSGIDPIVFGVVRELLS

SEQ ID NO: 159828 - protein, 26 aa, Mycobacterium bovis
YPPQQYPPGWPAGPYPPGPPPPGPGS

SEQ ID NO: 159829 - protein, 17 aa, Mycobacterium bovis
YPTGYAVDLFNALSAKN

SEQ ID NO: 159830 - protein, 17 aa, Mycobacterium bovis
YPVVVNGRIVWIVDAYT

SEQ ID NO: 159831 - protein, 17 aa, Mycobacterium bovis
YQAHAGYLEWIDGCREL

SEQ ID NO: 159832 - protein, 24 aa, Mycobacterium bovis
YQALGAKIPKGVLLYGPPGTGKTL

SEQ ID NO: 159833 - protein, 18 aa, Mycobacterium bovis
YQIEPALHDGDYSGAAVA

SEQ ID NO: 159834 - protein, 23 aa, Mycobacterium bovis
YQRERRFAVAFVIPAAVLFVAGA

SEQ ID NO: 159835 - protein, 21 aa, Mycobacterium bovis
YRAVLNFRRGWDIYNEHFDYV

SEQ ID NO: 159836 - protein, 29 aa, Mycobacterium bovis
YRAVVLARLRLVGIGIPAAIGLLAGIVAQ

SEQ ID NO: 159837 - protein, 23 aa, Mycobacterium bovis
YREAKARLGDPVAAWADIQADPR

SEQ ID NO: 159838 - protein, 21 aa, Mycobacterium bovis
YRNPVTMLLPLVTIGASLMTA

SEQ ID NO: 159839 - protein, 19 aa, Mycobacterium bovis
YRPGYNDRYYLRAGTPVNR

SEQ ID NO: 159840 - protein, 24 aa, Mycobacterium bovis
YRTIELLECLALIAMVPLTAWLCG

SEQ ID NO: 159841 - protein, 17 aa, Mycobacterium bovis
YRVLGLLTALSLVASGS

SEQ ID NO: 159842 - protein, 17 aa, Mycobacterium bovis
YRVVAALGDTPVPVART

SEQ ID NO: 159843 - protein, 21 aa, Mycobacterium bovis
YSADHLKDFVPFGVAGIGSAA

SEQ ID NO: 159844 - protein, 18 aa, Mycobacterium bovis
YSFLPSWLSFLVDKENAR

SEQ ID NO: 159845 - protein, 20 aa, Mycobacterium bovis
YSIGGILYAVRWPDPWPTTF

SEQ ID NO: 159846 - protein, 19 aa, Mycobacterium bovis
YSIPLRRALVTGSDLPYPE

SEQ ID NO: 159847 - protein, 22 aa, Mycobacterium bovis
YSLDNKRLWSNLDCAPSNETLV

SEQ ID NO: 159848 - protein, 17 aa, Mycobacterium bovis
YSLLYYRVLGLLTALSL

SEQ ID NO: 159849 - protein, 40 aa, Mycobacterium bovis
YSLVSGQPLGHWEFYMALAYFKLAIIAAGIDYRRRMSEQA

SEQ ID NO: 159850 - protein, 19 aa, Mycobacterium bovis
YSTVLAFWLGWPTSEVPGV

SEQ ID NO: 159851 - protein, 23 aa, Mycobacterium bovis
YSVIGFLCAFAPNFTVLVILRLL

SEQ ID NO: 159852 - protein, 19 aa, Mycobacterium bovis
YSYGGPFGGPSPRSSSGNR

SEQ ID NO: 159853 - protein, 19 aa, Mycobacterium bovis
YTAIWAAKRARGSPLRIMI

SEQ ID NO: 159854 - protein, 24 aa, Mycobacterium bovis
YTFTGTAMGLVFVWFSMTPSLLPR

SEQ ID NO: 159855 - protein, 24 aa, Mycobacterium bovis
YTLKADLPASGGLYPTANVTYRGI

SEQ ID NO: 159856 - protein, 27 aa, Mycobacterium bovis
YTLYAELPRSGGLYRTANVTYRGITIG

SEQ ID NO: 159857 - protein, 22 aa, Mycobacterium bovis
YTPWSWLPRIVTQFAAGALACA

SEQ ID NO: 159858 - protein, 25 aa, Mycobacterium bovis
YTRLRRPIVVWWIVWIVSNAISMFA

SEQ ID NO: 159859 - protein, 17 aa, Mycobacterium bovis
YTSEFLLGYLADYQIPT

SEQ ID NO: 159860 - protein, 24 aa, Mycobacterium bovis
YVCLRMSVRFMRRIAFSGFAITIV

SEQ ID NO: 159861 - protein, 19 aa, Mycobacterium bovis
YVFARPPLLGTTGRTVATG

SEQ ID NO: 159862 - protein, 20 aa, Mycobacterium bovis
YVPCAGPILAAIVVAGATAT

SEQ ID NO: 159863 - protein, 28 aa, Mycobacterium bovis
YWEKHCYDIPSCWALRSVFDTIDGIDQL

SEQ ID NO: 159864 - protein, 27 aa, Mycobacterium bovis
YWEKHCYDIPVCWSLRSVFDTLDGIDV

SEQ ID NO: 159865 - protein, 17 aa, Mycobacterium bovis
YWLESGAARPARRSVAE

SEQ ID NO: 159866 - protein, 17 aa, Mycobacterium bovis
YWLGRLALERGTAIIYL

SEQ ID NO: 159867 - protein, 21 aa, Mycobacterium bovis
YYGARMMLVLLGTFYASMVVA

SEQ ID NO: 159868 - protein, 18 aa, Mycobacterium bovis
YYRLMLKLNGGPQAVADA

SEQ ID NO: 159869 - protein, 25 aa, Mycobacterium bovis
AAAAEYPSEHPLGAAIVKAAQSRRI

SEQ ID NO: 159870 - protein, 23 aa, Mycobacterium bovis
AADALPVRVGVAVIGALIVFGLI

SEQ ID NO: 159871 - protein, 24 aa, Mycobacterium bovis
AAEQRASALWSHPDPAALASVPGS

SEQ ID NO: 159872 - protein, 18 aa, Mycobacterium bovis
AAFGRRIGIYVGVTHAIT

SEQ ID NO: 159873 - protein, 18 aa, Mycobacterium bovis
AAGSWIYTAFFAMLAAST

SEQ ID NO: 159874 - protein, 22 aa, Mycobacterium bovis
AARRAWRPVALIPSGATPVRLA

SEQ ID NO: 159875 - protein, 20 aa, Mycobacterium bovis
ACSIGATLGNGGWATLVNSA

SEQ ID NO: 159876 - protein, 18 aa, Mycobacterium bovis
ADIHMLWWMVLIVGVVSI

SEQ ID NO: 159877 - protein, 17 aa, Mycobacterium bovis
ADTGARIILACGFDSIP

SEQ ID NO: 159878 - protein, 24 aa, Mycobacterium bovis
AEATRVGKRFLIIDLKRQKPLSFT

SEQ ID NO: 159879 - protein, 20 aa, Mycobacterium bovis
AEKLAALLTQPGRTYDVSSP

SEQ ID NO: 159880 - protein, 17 aa, Mycobacterium bovis
AELFLACAALAGSAGSW

SEQ ID NO: 159881 - protein, 18 aa, Mycobacterium bovis
AEMIPAITKYMSALDVAV

SEQ ID NO: 159882 - protein, 24 aa, Mycobacterium bovis
AEQPLPGPRWPRALRASATRRALL

SEQ ID NO: 159883 - protein, 19 aa, Mycobacterium bovis
AFALSAFIVGGLWIITTQH

SEQ ID NO: 159884 - protein, 17 aa, Mycobacterium bovis
AGGLGRLGDTAVTEPPG

SEQ ID NO: 159885 - protein, 23 aa, Mycobacterium bovis
AGIFAGVVAIVFATAARYVRTNG

SEQ ID NO: 159886 - protein, 21 aa, Mycobacterium bovis
AGITMFGPWGIIIGPVLMILI

SEQ ID NO: 159887 - protein, 18 aa, Mycobacterium bovis
AGVDEWFICGPLAMATAV

SEQ ID NO: 159888 - protein, 20 aa, Mycobacterium bovis
AGVVAVLAWIDRDRSPRLTA

SEQ ID NO: 159889 - protein, 19 aa, Mycobacterium bovis
AGVVPEWLAYTVAVVLGVT

SEQ ID NO: 159890 - protein, 22 aa, Mycobacterium bovis
AHRPLELCRVDLLALASDAAHD

SEQ ID NO: 159891 - protein, 23 aa, Mycobacterium bovis
AIDPARLGLAVVMLSRRRPMLNL

SEQ ID NO: 159892 - protein, 18 aa, Mycobacterium bovis
AIGPWRLLVRDLAHLVDT

SEQ ID NO: 159893 - protein, 18 aa, Mycobacterium bovis
AILCGRLPVATGLAVFVG

SEQ ID NO: 159894 - protein, 27 aa, Mycobacterium bovis
AKGVRAGEGVAILARNHRWFVIANYGA

SEQ ID NO: 159895 - protein, 24 aa, Mycobacterium bovis
ALGEGCCFRVSLPRVSDVDQLSLT

SEQ ID NO: 159896 - protein, 26 aa, Mycobacterium bovis
ALPTGCILAWILVRIINVRSFGWTLQ

SEQ ID NO: 159897 - protein, 29 aa, Mycobacterium bovis
ALTVPPGSAWRWLCACLLGLTILLLAVNR

SEQ ID NO: 159898 - protein, 23 aa, Mycobacterium bovis
AMDPKRRITLEVLDGPGTPEVLG

SEQ ID NO: 159899 - protein, 20 aa, Mycobacterium bovis
AMSAREIVIIGIGAVSREEV

SEQ ID NO: 159900 - protein, 19 aa, Mycobacterium bovis
APFYRCYETSDGKYMAVGA

SEQ ID NO: 159901 - protein, 23 aa, Mycobacterium bovis
APGLRLAVVFLCAAAISAAVVTG

SEQ ID NO: 159902 - protein, 17 aa, Mycobacterium bovis
APLLLWQVATRHFTNIS

SEQ ID NO: 159903 - protein, 26 aa, Mycobacterium bovis
APPVRRLPARFGVEQVRELASRDTRQ

SEQ ID NO: 159904 - protein, 26 aa, Mycobacterium bovis
ARDLQRPDAPWGRLRVVYLQHASDPI

SEQ ID NO: 159905 - protein, 17 aa, Mycobacterium bovis
ARPSLSFDHDAHAEPEP

SEQ ID NO: 159906 - protein, 18 aa, Mycobacterium bovis
ARRAQQMIVGVALGIVLG

SEQ ID NO: 159907 - protein, 17 aa, Mycobacterium bovis
ARSGIRTAELVAIVSVG

SEQ ID NO: 159908 - protein, 23 aa, Mycobacterium bovis
ARTADRLKAAGFTVTDVGNLSLP

SEQ ID NO: 159909 - protein, 23 aa, Mycobacterium bovis
ARYSSVFAPDWGREVELMAVSGD

SEQ ID NO: 159910 - protein, 20 aa, Mycobacterium bovis
ASFGAPRLWTALADSGVLPT

SEQ ID NO: 159911 - protein, 21 aa, Mycobacterium bovis
ASGTGLLAVWSRQTVAAGHPG

SEQ ID NO: 159912 - protein, 22 aa, Mycobacterium bovis
ASHELRTPLALLTTELELRCAG

SEQ ID NO: 159913 - protein, 18 aa, Mycobacterium bovis
ASIAWGVLASFFVSTLLR

SEQ ID NO: 159914 - protein, 18 aa, Mycobacterium bovis
ATAVPWARQRTAMIAAER

SEQ ID NO: 159915 - protein, 24 aa, Mycobacterium bovis
ATGVLVGGLWAWIAPPIHAVVAIT

SEQ ID NO: 159916 - protein, 27 aa, Mycobacterium bovis
ATVFTVAQWRWRWFRAAMCKTMAVAVI

SEQ ID NO: 159917 - protein, 19 aa, Mycobacterium bovis
AVRMFRPVSMQVLAICVLV

SEQ ID NO: 159918 - protein, 20 aa, Mycobacterium bovis
AVVCAAVALVAFVILVQPTA

SEQ ID NO: 159919 - protein, 20 aa, Mycobacterium bovis
AYFRMGWWSIIGYAAAAIIG

SEQ ID NO: 159920 - protein, 28 aa, Mycobacterium bovis
CALLGDRYGRRRSFVFGVTLFVVSSIVC

SEQ ID NO: 159921 - protein, 25 aa, Mycobacterium bovis
CGTAPDLKGITGWLNTPGNKPIDLK

SEQ ID NO: 159922 - protein, 31 aa, Mycobacterium bovis
CICRGDYRLRHFGVRITRILALLLAVLLAVS

SEQ ID NO: 159923 - protein, 20 aa, Mycobacterium bovis
CLALGWWQWTRFQSTSGTFQ

SEQ ID NO: 159924 - protein, 18 aa, Mycobacterium bovis
CTYIIGFRFYARLIEMKV

SEQ ID NO: 159925 - protein, 19 aa, Mycobacterium bovis
DAARVRPATPLLQIDTQQV

SEQ ID NO: 159926 - protein, 19 aa, Mycobacterium bovis
DAVPLLAPHSGYLQTVDVD

SEQ ID NO: 159927 - protein, 17 aa, Mycobacterium bovis
DAVRNISKWPGVRDAVM

SEQ ID NO: 159928 - protein, 30 aa, Mycobacterium bovis
DDELAAPRWPWVVGVAAIIAAVALVVSVSL

SEQ ID NO: 159929 - protein, 20 aa, Mycobacterium bovis
DEFQVLYAARRLRPKRMPPS

SEQ ID NO: 159930 - protein, 23 aa, Mycobacterium bovis
DIHAELPAKLVLVAIAVLCAVSF

SEQ ID NO: 159931 - protein, 25 aa, Mycobacterium bovis
DLKSLRGKVVLIDFWAYSCINCQRA

SEQ ID NO: 159932 - protein, 24 aa, Mycobacterium bovis
DLVRELVTILPIVLVIAAVAAYLL

SEQ ID NO: 159933 - protein, 21 aa, Mycobacterium bovis
DRLEAVVMLLAVTVSLLTIPF

SEQ ID NO: 159934 - protein, 21 aa, Mycobacterium bovis
DTARWYLLKGRIADARSALRR

SEQ ID NO: 159935 - protein, 24 aa, Mycobacterium bovis
DTLWPRFLAGKGVMLSEPMVSRQH

SEQ ID NO: 159936 - protein, 24 aa, Mycobacterium bovis
DVAKYFAIIPAMFVGLYPVLDKLN

SEQ ID NO: 159937 - protein, 22 aa, Mycobacterium bovis
EASRRIELHVGRDLQFIRINGT

SEQ ID NO: 159938 - protein, 19 aa, Mycobacterium bovis
EDFTWKGMLDFATCTECGR

SEQ ID NO: 159939 - protein, 20 aa, Mycobacterium bovis
EGATMITFRLRLPCRTILRV

SEQ ID NO: 159940 - protein, 27 aa, Mycobacterium bovis
EGFTRLWPTVGCLVGYGIAFALLALSI

SEQ ID NO: 159941 - protein, 18 aa, Mycobacterium bovis
EIESAPTFQAYEVPLTRE

SEQ ID NO: 159942 - protein, 20 aa, Mycobacterium bovis
EKYARIALKLVSDIPNPRIL

SEQ ID NO: 159943 - protein, 24 aa, Mycobacterium bovis
EPTTRLRKDLTWWDLVVFGVSVVI

SEQ ID NO: 159944 - protein, 26 aa, Mycobacterium bovis
ERDPLRTGIFGLVLVICVVLIAFGYS

SEQ ID NO: 159945 - protein, 21 aa, Mycobacterium bovis
EVAMGLSFATVFLMAGTMSTS

SEQ ID NO: 159946 - protein, 18 aa, Mycobacterium bovis
EVLALPLVAVVLFFVFGG

SEQ ID NO: 159947 - protein, 34 aa, Mycobacterium bovis
EVPYLRASPWLLWRKRVVWLLVLFAAEAYTGSVL

SEQ ID NO: 159948 - protein, 26 aa, Mycobacterium bovis
EVSEFSWQLERVLPVPVFAQTMAQVT

SEQ ID NO: 159949 - protein, 20 aa, Mycobacterium bovis
FAALDARRAALSALISGIDD

SEQ ID NO: 159950 - protein, 23 aa, Mycobacterium bovis
FAALRAGQLVAAWTTTADPDIPA

SEQ ID NO: 159951 - protein, 21 aa, Mycobacterium bovis
FARTEFQAVQFIPLVMVPQLL

SEQ ID NO: 159952 - protein, 17 aa, Mycobacterium bovis
FEAPPVRRRWLPRRGPA

SEQ ID NO: 159953 - protein, 18 aa, Mycobacterium bovis
FGELMVGQPVQFRARISR

SEQ ID NO: 159954 - protein, 20 aa, Mycobacterium bovis
FGNDHFAEFAPGMKSIDDAL

SEQ ID NO: 159955 - protein, 17 aa, Mycobacterium bovis
FGVLMLWLPGNNLVVAF

SEQ ID NO: 159956 - protein, 18 aa, Mycobacterium bovis
FLACFTLIAAIGAQNAFV

SEQ ID NO: 159957 - protein, 21 aa, Mycobacterium bovis
FLCPACGIFERGFGPTVSKLV

SEQ ID NO: 159958 - protein, 22 aa, Mycobacterium bovis
FLTGTGIGWVLARGWRRPTALA

SEQ ID NO: 159959 - protein, 25 aa, Mycobacterium bovis
FNEPICPPCGSFIRSYASDIDTAVA

SEQ ID NO: 159960 - protein, 21 aa, Mycobacterium bovis
FPGDLRPGLLSRIVAHVSTVI

SEQ ID NO: 159961 - protein, 19 aa, Mycobacterium bovis
FPSATSRWVFEARPDLPTT

SEQ ID NO: 159962 - protein, 25 aa, Mycobacterium bovis
FRKGANFTAAMAFEIGSTNLVVELG

SEQ ID NO: 159963 - protein, 18 aa, Mycobacterium bovis
FYGEKVAFVAGWMYFLNW

SEQ ID NO: 159964 - protein, 18 aa, Mycobacterium bovis
GAAAPRVVTPDVLVHTPQ

SEQ ID NO: 159965 - protein, 23 aa, Mycobacterium bovis
GAALCLPLARVLAAASCGPLSSK

SEQ ID NO: 159966 - protein, 27 aa, Mycobacterium bovis
GAANRDGRRLMTVLLHGTRQPIPPWEQ

SEQ ID NO: 159967 - protein, 21 aa, Mycobacterium bovis
GALDATITWSSEGIKESVQNA

SEQ ID NO: 159968 - protein, 19 aa, Mycobacterium bovis
GALLAILAVVPWRQFASGE

SEQ ID NO: 159969 - protein, 17 aa, Mycobacterium bovis
GALLLSQLVPWLLTPLL

SEQ ID NO: 159970 - protein, 17 aa, Mycobacterium bovis
GALWWCVARRSWHAPRL

SEQ ID NO: 159971 - protein, 24 aa, Mycobacterium bovis
GARFPELDVEAVLRRHPQVVLVDE

SEQ ID NO: 159972 - protein, 19 aa, Mycobacterium bovis
GGPDASWLDRRFQTDALEY

SEQ ID NO: 159973 - protein, 26 aa, Mycobacterium bovis
GGPPGLPAPRGFRAAFAAAYAVAYLA

SEQ ID NO: 159974 - protein, 19 aa, Mycobacterium bovis
GGVKRCLGANFSMRELITV

SEQ ID NO: 159975 - protein, 26 aa, Mycobacterium bovis
GIARRSGTPISFWKFTRKGAVVTAVS

SEQ ID NO: 159976 - protein, 17 aa, Mycobacterium bovis
GILRIGIGGGQTIDLNV

SEQ ID NO: 159977 - protein, 26 aa, Mycobacterium bovis
GIVDPEFGYDIGFFVFDLPFYRSVLN

SEQ ID NO: 159978 - protein, 17 aa, Mycobacterium bovis
GLAGPFAPMAYVLAGIF

SEQ ID NO: 159979 - protein, 24 aa, Mycobacterium bovis
GLGVAELWALLRIYQYQRLFEAVR

SEQ ID NO: 159980 - protein, 17 aa, Mycobacterium bovis
GLVGAVLVVVRPEVLII

SEQ ID NO: 159981 - protein, 28 aa, Mycobacterium bovis
GNLLQMAFRFWAFRRWVFPDEFARNPDK

SEQ ID NO: 159982 - protein, 18 aa, Mycobacterium bovis
GRGMARLAMKIHARPKLR

SEQ ID NO: 159983 - protein, 24 aa, Mycobacterium bovis
GRGRLTRSVIGWVGAVAVVVSLAG

SEQ ID NO: 159984 - protein, 17 aa, Mycobacterium bovis
GSVPIVVERDGTAIVTY

SEQ ID NO: 159985 - protein, 17 aa, Mycobacterium bovis
GSWPGWYAGVIELVAGL

SEQ ID NO: 159986 - protein, 19 aa, Mycobacterium bovis
GVLGWWRWHHNTWLTTIYT

SEQ ID NO: 159987 - protein, 19 aa, Mycobacterium bovis
GVLRDGQKWVALAVPGYTL

SEQ ID NO: 159988 - protein, 22 aa, Mycobacterium bovis
GVRVGGLFAALGVTSVVIGLML

SEQ ID NO: 159989 - protein, 24 aa, Mycobacterium bovis
GYIVIGGIAGWLASKIVKGGGSGI

SEQ ID NO: 159990 - protein, 23 aa, Mycobacterium bovis
GYLREFGNLVFHFALLGLLVAVA

SEQ ID NO: 159991 - protein, 17 aa, Mycobacterium bovis
HEFTEVIVIANGVRAGR

SEQ ID NO: 159992 - protein, 24 aa, Mycobacterium bovis
HFESAHFLRALLVAVVAALAAGMY

SEQ ID NO: 159993 - protein, 18 aa, Mycobacterium bovis
HHSRWHFAVLYTFLSMVN

SEQ ID NO: 159994 - protein, 18 aa, Mycobacterium bovis
HIDAPALHPAVFATAVML

SEQ ID NO: 159995 - protein, 29 aa, Mycobacterium bovis
HLDGTLSFRWSCRMGICGSSGMTINGDPK

SEQ ID NO: 159996 - protein, 17 aa, Mycobacterium bovis
HPNVFVVGDLMFVPGVP

SEQ ID NO: 159997 - protein, 23 aa, Mycobacterium bovis
HRNPRLVKVSVLTMIAVTGHFVS

SEQ ID NO: 159998 - protein, 19 aa, Mycobacterium bovis
HTEMPGWMRAFASFTPARA

SEQ ID NO: 159999 - protein, 23 aa, Mycobacterium bovis
HWSLPGLSFILLVAIGADYNMLL

SEQ ID NO: 160000 - protein, 19 aa, Mycobacterium bovis
IAVVVFVVRYVLLVINRNT

SEQ ID NO: 160001 - protein, 19 aa, Mycobacterium bovis
IDMRTFPGMEYGQNAAPPS

SEQ ID NO: 160002 - protein, 29 aa, Mycobacterium bovis
IEPEVVQWKLKPGVVSTMSAQARYTDPNT

SEQ ID NO: 160003 - protein, 20 aa, Mycobacterium bovis
IEQPIRRWRPARVPLLPLAA

SEQ ID NO: 160004 - protein, 17 aa, Mycobacterium bovis
IFRGDLFSSALINSIGI

SEQ ID NO: 160005 - protein, 22 aa, Mycobacterium bovis
IGAGLIFPRFEQLLEKPFSRIP

SEQ ID NO: 160006 - protein, 17 aa, Mycobacterium bovis
IGVEAFTGFFAALANTR

SEQ ID NO: 160007 - protein, 24 aa, Mycobacterium bovis
IKVLLEVFPQAKFIHIVRDPYVVY

SEQ ID NO: 160008 - protein, 24 aa, Mycobacterium bovis
ILLFGGRRTDAWGHLLGCAAALAA

SEQ ID NO: 160009 - protein, 18 aa, Mycobacterium bovis
ILMLLPLSAFEATVALPA

SEQ ID NO: 160010 - protein, 17 aa, Mycobacterium bovis
IMRFLAIFGPVHYFAQP

SEQ ID NO: 160011 - protein, 21 aa, Mycobacterium bovis
IPMKKMHAVSVPPNYAAALLA

SEQ ID NO: 160012 - protein, 23 aa, Mycobacterium bovis
IRWRLTLVFSAAMALVLAAAGAV

SEQ ID NO: 160013 - protein, 19 aa, Mycobacterium bovis
ISMRAGRRVAISAGSLAVL

SEQ ID NO: 160014 - protein, 21 aa, Mycobacterium bovis
ISPARLTAWIAASALILLTGT

SEQ ID NO: 160015 - protein, 18 aa, Mycobacterium bovis
ISTISFGTPYGFVEIDDQ

SEQ ID NO: 160016 - protein, 29 aa, Mycobacterium bovis
IWQHILHMPLHWLVLPMAIIVMLAVGSDY

SEQ ID NO: 160017 - protein, 26 aa, Mycobacterium bovis
IYNYTWLVLMLPFGMIGVTVLTVVMP

SEQ ID NO: 160018 - protein, 24 aa, Mycobacterium bovis
KFKDLLINCGYSLIERFPLMLGTA

SEQ ID NO: 160019 - protein, 30 aa, Mycobacterium bovis
KGASQRLADCIARPLVPSIMIAAALIAGTG

SEQ ID NO: 160020 - protein, 17 aa, Mycobacterium bovis
KGLSRLVRQNCDEVVSI

SEQ ID NO: 160021 - protein, 20 aa, Mycobacterium bovis
KITVPARWVVNGIERSGEVN

SEQ ID NO: 160022 - protein, 17 aa, Mycobacterium bovis
KRRARRDPLTVFLVLII

SEQ ID NO: 160023 - protein, 28 aa, Mycobacterium bovis
KRRWRRIGTVVVRWPGPVLAATLLIALI

SEQ ID NO: 160024 - protein, 18 aa, Mycobacterium bovis
KRTGLAVLDCAADVVLTT

SEQ ID NO: 160025 - protein, 18 aa, Mycobacterium bovis
KSTLARLVAGYTHPTDGT

SEQ ID NO: 160026 - protein, 18 aa, Mycobacterium bovis
KVPLPRWYWIGLAVGILV

SEQ ID NO: 160027 - protein, 27 aa, Mycobacterium bovis
LAALIRARFPTLTARQVMQRIESTAHH

SEQ ID NO: 160028 - protein, 22 aa, Mycobacterium bovis
LAAPLLRPGYLLLRDAVSTPRS

SEQ ID NO: 160029 - protein, 17 aa, Mycobacterium bovis
LAAPRKTRAFMAALQSW

SEQ ID NO: 160030 - protein, 18 aa, Mycobacterium bovis
LAFGLMAALLLDATVVRM

SEQ ID NO: 160031 - protein, 17 aa, Mycobacterium bovis
LAGCLPAVLSLFRLVYG

SEQ ID NO: 160032 - protein, 19 aa, Mycobacterium bovis
LAVLAILVWWALRHRNRCS

SEQ ID NO: 160033 - protein, 21 aa, Mycobacterium bovis
LAWWFDWLPHHGLEDTQRSNR

SEQ ID NO: 160034 - protein, 18 aa, Mycobacterium bovis
LDHLAARLRRNSANLLVL

SEQ ID NO: 160035 - protein, 19 aa, Mycobacterium bovis
LEFYRRARAAADKITPDVE

SEQ ID NO: 160036 - protein, 27 aa, Mycobacterium bovis
LESIHMSWLRFGHGLVLSSILLWTGVG

SEQ ID NO: 160037 - protein, 24 aa, Mycobacterium bovis
LFALSEMRWAALALGLFSAGLLTQ

SEQ ID NO: 160038 - protein, 23 aa, Mycobacterium bovis
LGLLWYAGLPLRVFLSSLAAVVV

SEQ ID NO: 160039 - protein, 26 aa, Mycobacterium bovis
LGTTVGLLPAWQIVLILLLLGVLGLR

SEQ ID NO: 160040 - protein, 24 aa, Mycobacterium bovis
LGYVAWRLFGHTPYRIDIDIYQMG

SEQ ID NO: 160041 - protein, 18 aa, Mycobacterium bovis
LHIAPLISYEMTFSDLTR

SEQ ID NO: 160042 - protein, 20 aa, Mycobacterium bovis
LHRAKGGGLSTLFGGGVQSS

SEQ ID NO: 160043 - protein, 35 aa, Mycobacterium bovis
LHVSGYRFLLRRIECALLFGDVCAATGALRARTTS

SEQ ID NO: 160044 - protein, 24 aa, Mycobacterium bovis
LILLWGSAGALGFVEQDLGFKIIF

SEQ ID NO: 160045 - protein, 17 aa, Mycobacterium bovis
LIPLVPAAVVALALIVA

SEQ ID NO: 160046 - protein, 18 aa, Mycobacterium bovis
LKFAMFMLAEYVNMTTVS

SEQ ID NO: 160047 - protein, 24 aa, Mycobacterium bovis
LKTVPKRLSALLTTSGLPAVLEPF

SEQ ID NO: 160048 - protein, 18 aa, Mycobacterium bovis
LLDSRYLVQAKIASGGTS

SEQ ID NO: 160049 - protein, 17 aa, Mycobacterium bovis
LLLPTITGWSLGRALTG

SEQ ID NO: 160050 - protein, 23 aa, Mycobacterium bovis
LLPLHLLLLPWSSMRSSMHDGFI

SEQ ID NO: 160051 - protein, 36 aa, Mycobacterium bovis
LLVIGALVVWWGWRERRDLFSGFGWLAVVLLAVAAA

SEQ ID NO: 160052 - protein, 18 aa, Mycobacterium bovis
LLVVSALATLSGLGTPVA

SEQ ID NO: 160053 - protein, 19 aa, Mycobacterium bovis
LNNRRVPVVDIYDAQRVHI

SEQ ID NO: 160054 - protein, 19 aa, Mycobacterium bovis
LPGSWGPDLVGVAGDGGLV

SEQ ID NO: 160055 - protein, 20 aa, Mycobacterium bovis
LPLVVAMVLAGLRVEAAMAS

SEQ ID NO: 160056 - protein, 17 aa, Mycobacterium bovis
LPTPRPAPPAQQLPSTP

SEQ ID NO: 160057 - protein, 27 aa, Mycobacterium bovis
LQTNRLLTRWARDYITVIGAIVLPILF

SEQ ID NO: 160058 - protein, 26 aa, Mycobacterium bovis
LQWPLFAWFCVYAYRNFVRYEETPPQ

SEQ ID NO: 160059 - protein, 17 aa, Mycobacterium bovis
LRIGIGGGQTIDLNVLL

SEQ ID NO: 160060 - protein, 19 aa, Mycobacterium bovis
LRPWMTMSVPRGAKGMTVD

SEQ ID NO: 160061 - protein, 18 aa, Mycobacterium bovis
LRSLPVPFILNQPPPPGP

SEQ ID NO: 160062 - protein, 21 aa, Mycobacterium bovis
LRYAPDCVVRVDAGRVRERVL

SEQ ID NO: 160063 - protein, 24 aa, Mycobacterium bovis
LSELPSHCRGLLVGRVAGAHTPAA

SEQ ID NO: 160064 - protein, 17 aa, Mycobacterium bovis
LSLFRLVYGLLFAGYGS

SEQ ID NO: 160065 - protein, 19 aa, Mycobacterium bovis
LSLQPGVYAVHWYAGEHAQ

SEQ ID NO: 160066 - protein, 17 aa, Mycobacterium bovis
LSPFSGYLTLAFLAGVL

SEQ ID NO: 160067 - protein, 19 aa, Mycobacterium bovis
LSYRFPFHTEKKTYPYFDP

SEQ ID NO: 160068 - protein, 25 aa, Mycobacterium bovis
LTFSVLAAYAFARLQFRGRDALFWV

SEQ ID NO: 160069 - protein, 27 aa, Mycobacterium bovis
LTRTLKGWADRGVRVIGLDAGGGTALD

SEQ ID NO: 160070 - protein, 21 aa, Mycobacterium bovis
LTSTLRPAGVDEWFICGPLAM

SEQ ID NO: 160071 - protein, 17 aa, Mycobacterium bovis
LVAFSIFLTRAHTSRTR

SEQ ID NO: 160072 - protein, 17 aa, Mycobacterium bovis
LVVLWLFVLVPMLISKR

SEQ ID NO: 160073 - protein, 19 aa, Mycobacterium bovis
LWIFSLSLKPTSTVKDGKL

SEQ ID NO: 160074 - protein, 22 aa, Mycobacterium bovis
LWVLPLRWSMVEYFYIKYYLPR

SEQ ID NO: 160075 - protein, 17 aa, Mycobacterium bovis
LYRLRLLETSYGVGVSV

SEQ ID NO: 160076 - protein, 21 aa, Mycobacterium bovis
MAMSACASGVYLVDVRPKLLE

SEQ ID NO: 160077 - protein, 18 aa, Mycobacterium bovis
MDAFDYFLVVLVYADIAT

SEQ ID NO: 160078 - protein, 22 aa, Mycobacterium bovis
MLNRRRPLLHLLTFLCGGYTMA

SEQ ID NO: 160079 - protein, 17 aa, Mycobacterium bovis
MLTRLQRALAHEQQFVA

SEQ ID NO: 160080 - protein, 25 aa, Mycobacterium bovis
MPNGYPVKASVSFGLYYPPGSALYH

SEQ ID NO: 160081 - protein, 26 aa, Mycobacterium bovis
MQFGEGWWTSVWFLSFWVTGTSILLV

SEQ ID NO: 160082 - protein, 17 aa, Mycobacterium bovis
MSREIAELPNIVMVRGL

SEQ ID NO: 160083 - protein, 17 aa, Mycobacterium bovis
MVIGLLIASTGTGVLVG

SEQ ID NO: 160084 - protein, 18 aa, Mycobacterium bovis
MVLICLFLYHVFRNRNWL

SEQ ID NO: 160085 - protein, 17 aa, Mycobacterium bovis
NALRYAPDCVVRVDAGR

SEQ ID NO: 160086 - protein, 17 aa, Mycobacterium bovis
NGLLAKGVRAGEGVAIL

SEQ ID NO: 160087 - protein, 22 aa, Mycobacterium bovis
NPDRPPSRFYVRVISPDGQSYT

SEQ ID NO: 160088 - protein, 29 aa, Mycobacterium bovis
NPGSARPRTRFGAWLGRPMTSFHLIIAVA

SEQ ID NO: 160089 - protein, 17 aa, Mycobacterium bovis
NSLHIAPLISYEMTFSD

SEQ ID NO: 160090 - protein, 23 aa, Mycobacterium bovis
NVVQRRPFFAILRCLGVTREQLF

SEQ ID NO: 160091 - protein, 17 aa, Mycobacterium bovis
NYRRSRRPPPMPSANRY

SEQ ID NO: 160092 - protein, 24 aa, Mycobacterium bovis
PALTRSGAEWMPNFIELLQRKLSR

SEQ ID NO: 160093 - protein, 21 aa, Mycobacterium bovis
PAPSWWWLAWFGLVPLLLVVR

SEQ ID NO: 160094 - protein, 18 aa, Mycobacterium bovis
PASVIKVLVAMASINTLT

SEQ ID NO: 160095 - protein, 23 aa, Mycobacterium bovis
PDRNLPRAIPIAIFSVGAIYLLT

SEQ ID NO: 160096 - protein, 23 aa, Mycobacterium bovis
PEHLRLGPYAVMHAIADYVVDHY

SEQ ID NO: 160097 - protein, 17 aa, Mycobacterium bovis
PGGQYAIAWARRTTSRA

SEQ ID NO: 160098 - protein, 21 aa, Mycobacterium bovis
PGWPPRSSHRPSYSGEPAPTY

SEQ ID NO: 160099 - protein, 20 aa, Mycobacterium bovis
PHLFDRDGVDFATDPPPPAL

SEQ ID NO: 160100 - protein, 25 aa, Mycobacterium bovis
PIPEIPQLPPGIPQVPGIGQFSAIS

SEQ ID NO: 160101 - protein, 25 aa, Mycobacterium bovis
PIRRASVTVMEWGLRGTRRAEAAAE

SEQ ID NO: 160102 - protein, 18 aa, Mycobacterium bovis
PKAETYVRAHIVQRTSSN

SEQ ID NO: 160103 - protein, 25 aa, Mycobacterium bovis
PLATGCLRVRASITISPDDLVSGEI

SEQ ID NO: 160104 - protein, 21 aa, Mycobacterium bovis
PLDRWPKGAVIVGMTGLTAAF

SEQ ID NO: 160105 - protein, 25 aa, Mycobacterium bovis
PLPEPYLPPRLEAFRDRKRANPQPA

SEQ ID NO: 160106 - protein, 28 aa, Mycobacterium bovis
PLPTEIYWRRRGLALGIAVVVVGIAVAI

SEQ ID NO: 160107 - protein, 24 aa, Mycobacterium bovis
PMAAVLRWLEIPQFSVFDEIFRGI

SEQ ID NO: 160108 - protein, 25 aa, Mycobacterium bovis
PNTRSFTGAGIWLGIAAFAAAGVVA

SEQ ID NO: 160109 - protein, 22 aa, Mycobacterium bovis
PQDAIRWAALVALVAIGAGLIF

SEQ ID NO: 160110 - protein, 17 aa, Mycobacterium bovis
PQPPWPHLAAAALTAVA

SEQ ID NO: 160111 - protein, 18 aa, Mycobacterium bovis
PRMKARAISNWMAIGMVG

SEQ ID NO: 160112 - protein, 21 aa, Mycobacterium bovis
PRPSSLAFLGGWLLGLAVVTA

SEQ ID NO: 160113 - protein, 23 aa, Mycobacterium bovis
PSANLGANCQYPPSPDKAVKPVK

SEQ ID NO: 160114 - protein, 19 aa, Mycobacterium bovis
PSPGFPLTRAERLNVVFLL

SEQ ID NO: 160115 - protein, 21 aa, Mycobacterium bovis
PVIGCAAALVFGGLPALAFPA

SEQ ID NO: 160116 - protein, 20 aa, Mycobacterium bovis
PVIGCEQIAVCVLEHESATV

SEQ ID NO: 160117 - protein, 23 aa, Mycobacterium bovis
PVLECLRAGVPATALYVALGTEA

SEQ ID NO: 160118 - protein, 17 aa, Mycobacterium bovis
PVWSRRLVDRGCPKVLA

SEQ ID NO: 160119 - protein, 17 aa, Mycobacterium bovis
PWFNLDWITSAKLVAVV

SEQ ID NO: 160120 - protein, 19 aa, Mycobacterium bovis
QHVFEKLASILGLVAAPLM

SEQ ID NO: 160121 - protein, 18 aa, Mycobacterium bovis
QQGFFKGTTCHRLTTSPM

SEQ ID NO: 160122 - protein, 33 aa, Mycobacterium bovis
QQRPPSWSPRNWPVRWKVFTIALLPLVVAMVLA

SEQ ID NO: 160123 - protein, 18 aa, Mycobacterium bovis
QRFWRITLPMLRPTMFFV

SEQ ID NO: 160124 - protein, 19 aa, Mycobacterium bovis
QRRSASVTAVAWRTSAGAA

SEQ ID NO: 160125 - protein, 25 aa, Mycobacterium bovis
QRWASPFWQTWDLLLLWLAQLHGGN

SEQ ID NO: 160126 - protein, 19 aa, Mycobacterium bovis
QRYSLGMVAATLALIVIPL

SEQ ID NO: 160127 - protein, 19 aa, Mycobacterium bovis
RASLREMLIPLVPAAVVAL

SEQ ID NO: 160128 - protein, 22 aa, Mycobacterium bovis
REIAELPNIVMVRGLTRPNGEP

SEQ ID NO: 160129 - protein, 17 aa, Mycobacterium bovis
REQLNLGGIVNAQNAQL

SEQ ID NO: 160130 - protein, 24 aa, Mycobacterium bovis
RFSAADKPVIFWAPDHGAFVVRGA

SEQ ID NO: 160131 - protein, 17 aa, Mycobacterium bovis
RGLLPVAGHWVSVLTGL

SEQ ID NO: 160132 - protein, 18 aa, Mycobacterium bovis
RGQMAITSQMIYARLVMT

SEQ ID NO: 160133 - protein, 18 aa, Mycobacterium bovis
RIAERVYPSPLPDEPLKI

SEQ ID NO: 160134 - protein, 36 aa, Mycobacterium bovis
RIKDEIREGRSFRSAVPRGWARARKTIVSGNAVTFL

SEQ ID NO: 160135 - protein, 17 aa, Mycobacterium bovis
RIVALKLMSETLSSDPV

SEQ ID NO: 160136 - protein, 17 aa, Mycobacterium bovis
RKLDIEPIYLLKREVVE

SEQ ID NO: 160137 - protein, 19 aa, Mycobacterium bovis
RKTNPWPFVAGAAAVVLVL

SEQ ID NO: 160138 - protein, 20 aa, Mycobacterium bovis
RLATLLAQFLDDPRWIAMLA

SEQ ID NO: 160139 - protein, 21 aa, Mycobacterium bovis
RLDSLFRLDHLAARLRRNSAN

SEQ ID NO: 160140 - protein, 26 aa, Mycobacterium bovis
RLDVSGMSCAACASRVETKLNKIPGV

SEQ ID NO: 160141 - protein, 17 aa, Mycobacterium bovis
RLSRGLVLIKWWLLAIP

SEQ ID NO: 160142 - protein, 26 aa, Mycobacterium bovis
RPVFPYEPMVRVSLWLSVTAVAVLFG

SEQ ID NO: 160143 - protein, 19 aa, Mycobacterium bovis
RQGRAYWIHLMMASQTIES

SEQ ID NO: 160144 - protein, 24 aa, Mycobacterium bovis
RRDPLTVFLVLIIVFSLVLAGLIG

SEQ ID NO: 160145 - protein, 24 aa, Mycobacterium bovis
RRETLRLVAEIGMGTGAMAVVGGT

SEQ ID NO: 160146 - protein, 21 aa, Mycobacterium bovis
RREVVLVTGPWLAGVSGVRAA

SEQ ID NO: 160147 - protein, 23 aa, Mycobacterium bovis
RRIESACKVWSAGVSASRLGRDL

SEQ ID NO: 160148 - protein, 23 aa, Mycobacterium bovis
RSARELWAGCLLPMVNLLWAPLY

SEQ ID NO: 160149 - protein, 17 aa, Mycobacterium bovis
RSLGHRVADGWLVARAG

SEQ ID NO: 160150 - protein, 22 aa, Mycobacterium bovis
RVASGDCLMWPDGTPESAAIVS

SEQ ID NO: 160151 - protein, 17 aa, Mycobacterium bovis
RWLLLALVSTWGLRLSW

SEQ ID NO: 160152 - protein, 18 aa, Mycobacterium bovis
SAPFPISALISGLVNAAL

SEQ ID NO: 160153 - protein, 18 aa, Mycobacterium bovis
SATRRALLLTALGGLLIA

SEQ ID NO: 160154 - protein, 17 aa, Mycobacterium bovis
SEAMLLAAIYVAALRSY

SEQ ID NO: 160155 - protein, 17 aa, Mycobacterium bovis
SFLRPVLAPDYGRVARA

SEQ ID NO: 160156 - protein, 30 aa, Mycobacterium bovis; identical to SEQ ID NO: 14421

SEQ ID NO: 160157 - protein, 26 aa, Mycobacterium bovis
SKITKLMPWLWVAWFGLGSFGVLMLW

SEQ ID NO: 160158 - protein, 19 aa, Mycobacterium bovis
SQIPGVAMVRGVTRPNGET

SEQ ID NO: 160159 - protein, 19 aa, Mycobacterium bovis
SRAAAAAYCVADESIEAFR

SEQ ID NO: 160160 - protein, 20 aa, Mycobacterium bovis
SRGLVLIKWWLLAIPHYLIL

SEQ ID NO: 160161 - protein, 19 aa, Mycobacterium bovis
SRLRQVLRNLVANAIQHTP

SEQ ID NO: 160162 - protein, 24 aa, Mycobacterium bovis
SVLPGPLVATVFDLVFQPGKLPDS

SEQ ID NO: 160163 - protein, 20 aa, Mycobacterium bovis
TADPPVRRSVHHGAGQRYAG

SEQ ID NO: 160164 - protein, 21 aa, Mycobacterium bovis
TALCGYAVIYLAARNLAPNGF

SEQ ID NO: 160165 - protein, 20 aa, Mycobacterium bovis
TAYISGWIPFWVTIPVNAAV

SEQ ID NO: 160166 - protein, 25 aa, Mycobacterium bovis
TFRLRLPCRTILRVFSRNPLVRGTD

SEQ ID NO: 160167 - protein, 18 aa, Mycobacterium bovis
TGGPYVPADLRLYDYDDY

SEQ ID NO: 160168 - protein, 24 aa, Mycobacterium bovis
TGRYKIFPVAGMALMAVAFLLMSQ

SEQ ID NO: 160169 - protein, 18 aa, Mycobacterium bovis
TIERCLRSILEQEGVEFE

SEQ ID NO: 160170 - protein, 34 aa, Mycobacterium bovis
TILPGSPPAGAWIDRAVVIWVLIALAAAMVVYIV

SEQ ID NO: 160171 - protein, 26 aa, Mycobacterium bovis
TITAIAVVVLLGWSFFYFSDDTRGYK

SEQ ID NO: 160172 - protein, 17 aa, Mycobacterium bovis
TKWVHHFGLFAAVGAAM

SEQ ID NO: 160173 - protein, 26 aa, Mycobacterium bovis
TLSQRFSRRYTIVFCAALGLPIVPLF

SEQ ID NO: 160174 - protein, 23 aa, Mycobacterium bovis
TLTLADGRVVIWGTTDRCEEKAE

SEQ ID NO: 160175 - protein, 18 aa, Mycobacterium bovis
TNVLRARRAQQMIVGVAL

SEQ ID NO: 160176 - protein, 23 aa, Mycobacterium bovis
TPPRLPPGFRWIAVRPGAAPPPR

SEQ ID NO: 160177 - protein, 17 aa, Mycobacterium bovis
TPTKWVHHFGLFAAVGA

SEQ ID NO: 160178 - protein, 18 aa, Mycobacterium bovis
TRAERLNVVFLLAASQLV

SEQ ID NO: 160179 - protein, 20 aa, Mycobacterium bovis
TRAGLRFAAPLIAAGLRALF

SEQ ID NO: 160180 - protein, 27 aa, Mycobacterium bovis
TRFVMLRLAPGLGRLLGPIGRMAPRNI

SEQ ID NO: 160181 - protein, 26 aa, Mycobacterium bovis
TRGRRLAWCSAEFNGAIVVNVPLASN

SEQ ID NO: 160182 - protein, 22 aa, Mycobacterium bovis
TRLFPPSLAVVFSRSSSAPTES

SEQ ID NO: 160183 - protein, 23 aa, Mycobacterium bovis
TRTSLKTSWYLLGPAFVAAIAYV

SEQ ID NO: 160184 - protein, 22 aa, Mycobacterium bovis
TSREFRAAGLTHLTAVSGANVT

SEQ ID NO: 160185 - protein, 20 aa, Mycobacterium bovis
TTRQLWKLMFIETGLMGGMA

SEQ ID NO: 160186 - protein, 17 aa, Mycobacterium bovis
TVACKAIAEATRVGKRF

SEQ ID NO: 160187 - protein, 30 aa, Mycobacterium bovis
TVLVILRLLYGIGMGGEWGLGAALSMEKVP

SEQ ID NO: 160188 - protein, 23 aa, Mycobacterium bovis
TYEHYFRTFLRPEDVGWSVVEVV

SEQ ID NO: 160189 - protein, 19 aa, Mycobacterium bovis
VAQSYWARIQLFLHGGDFG

SEQ ID NO: 160190 - protein, 18 aa, Mycobacterium bovis
VAVICLLAWSLSGLVGPS

SEQ ID NO: 160191 - protein, 19 aa, Mycobacterium bovis
VDIARVPDCAVVGAAAGGV

SEQ ID NO: 160192 - protein, 21 aa, Mycobacterium bovis
VEASSLFRVSKLNCSITTSDG

SEQ ID NO: 160193 - protein, 25 aa, Mycobacterium bovis
VGATGVFLACRWAQADGADHAWLGY

SEQ ID NO: 160194 - protein, 26 aa, Mycobacterium bovis
VGSMFGPYHLKRLLGRGGMGEVYEAE

SEQ ID NO: 160195 - protein, 22 aa, Mycobacterium bovis
VGVMRWRWRVAFYALSALGTDR

SEQ ID NO: 160196 - protein, 17 aa, Mycobacterium bovis
VLAQMMWTMKGIGSLRD

SEQ ID NO: 160197 - protein, 22 aa, Mycobacterium bovis
VLTPRQPWAWLALLVAGLTVGL

SEQ ID NO: 160198 - protein, 17 aa, Mycobacterium bovis
VLVGLLVLIRMTPTVAL

SEQ ID NO: 160199 - protein, 17 aa, Mycobacterium bovis
VMSELPGTGAFDPAGTS

SEQ ID NO: 160200 - protein, 19 aa, Mycobacterium bovis
VPADLRLYDYDDYEESSDL

SEQ ID NO: 160201 - protein, 31 aa, Mycobacterium bovis
VPDSSGLPLRAMVMVLLFLGVVFLLLGWQAL

SEQ ID NO: 160202 - protein, 22 aa, Mycobacterium bovis
VPLGGFCDIAGMTPVEELDPDE

SEQ ID NO: 160203 - protein, 18 aa, Mycobacterium bovis
VPMLPGSWGPDLVGVAGD

SEQ ID NO: 160204 - protein, 18 aa, Mycobacterium bovis
VPVRRLRAIETLAQAIAP

SEQ ID NO: 160205 - protein, 21 aa, Mycobacterium bovis
VPWPAGAQVLIRFTGPEVWWV

SEQ ID NO: 160206 - protein, 20 aa, Mycobacterium bovis
VQNAIPILGAFVTSSVVTHP

SEQ ID NO: 160207 - protein, 20 aa, Mycobacterium bovis
VRARCFLQGDSLYVAGVSGL

SEQ ID NO: 160208 - protein, 17 aa, Mycobacterium bovis
VRASVNFATRVATIDAV

SEQ ID NO: 160209 - protein, 29 aa, Mycobacterium bovis
VRRSNALLDWAYGRRFCYSETMSVGSTVL

SEQ ID NO: 160210 - protein, 28 aa, Mycobacterium bovis
VSQISAPRAKLFAALFLILALVVVGEVA

SEQ ID NO: 160211 - protein, 19 aa, Mycobacterium bovis
VTLLPRRTPGSSGIADVPA

SEQ ID NO: 160212 - protein, 27 aa, Mycobacterium bovis
VTLYLRLGDWVPVTAFVVMGAGFAVFL

SEQ ID NO: 160213 - protein, 26 aa, Mycobacterium bovis
VVLGSALIVFGVLRWLTRHRHTEMPG

SEQ ID NO: 160214 - protein, 26 aa, Mycobacterium bovis
VVLLYAVCVVLRLARYNALQDDGTQP

SEQ ID NO: 160215 - protein, 27 aa, Mycobacterium bovis
VVVSLAGSGWCGWVLFEKHQTDVAAGQ

SEQ ID NO: 160216 - protein, 21 aa, Mycobacterium bovis
VWDRPERRSGIPALDGLRAIA

SEQ ID NO: 160217 - protein, 33 aa, Mycobacterium bovis
VYRYRFIVIGVMVALCLGGGVFGLSLGKHVTQS

SEQ ID NO: 160218 - protein, 26 aa, Mycobacterium bovis
WFFGAGAWAASVVWFAVLGFSAGRLQ

SEQ ID NO: 160219 - protein, 19 aa, Mycobacterium bovis
WFREGTLPVPAERVGRLIL

SEQ ID NO: 160220 - protein, 18 aa, Mycobacterium bovis
WGQRPVHPVTVWRKRLAV

SEQ ID NO: 160221 - protein, 19 aa, Mycobacterium bovis
WGVLASFFVSTLLRVAFPD

SEQ ID NO: 160222 - protein, 25 aa, Mycobacterium bovis
WHIVGLCIFGFLLAMLRGNHVGHVE

SEQ ID NO: 160223 - protein, 24 aa, Mycobacterium bovis
WIATACALTAWYVLYSVTGPARSA

SEQ ID NO: 160224 - protein, 17 aa, Mycobacterium bovis
WPEDCAAAHMVPETLTV

SEQ ID NO: 160225 - protein, 24 aa, Mycobacterium bovis
WRITLPMLRPTMFFVLVTGIISAA

SEQ ID NO: 160226 - protein, 17 aa, Mycobacterium bovis
WRLMAVLAIAVGTYGVL

SEQ ID NO: 160227 - protein, 25 aa, Mycobacterium bovis
WSTLKVSLLLSVALFFVWMITVAFL

SEQ ID NO: 160228 - protein, 20 aa, Mycobacterium bovis
YAGIPRWGLTDHVDQAPVPA

SEQ ID NO: 160229 - protein, 17 aa, Mycobacterium bovis
YAIHKLGFCSVVMLGIN

SEQ ID NO: 160230 - protein, 27 aa, Mycobacterium bovis
YAPLWRTAWRRLRQRPFQYILLVLGIA

SEQ ID NO: 160231 - protein, 21 aa, Mycobacterium bovis
YARFWWPGLPIWVPALVTVAL

SEQ ID NO: 160232 - protein, 26 aa, Mycobacterium bovis
YDVVPSRLRRPGAVVLEIDDEDPIFT

SEQ ID NO: 160233 - protein, 21 aa, Mycobacterium bovis
YDYRCIFLVRGGPNYFSIALI

SEQ ID NO: 160234 - protein, 23 aa, Mycobacterium bovis
YLPPEAFQNPDFQRGLKLFLSPD

SEQ ID NO: 160235 - protein, 17 aa, Mycobacterium bovis
YPNVFVVGDMAAVEGVP

SEQ ID NO: 160236 - protein, 18 aa, Mycobacterium bovis
YRRVDIARVPDCAVVGAA

SEQ ID NO: 160237 - protein, 30 aa, Mycobacterium bovis
YVLPWICAPLAIAVMWRWILAPTDGAISTV

SEQ ID NO: 160238 - protein, 23 aa, Mycobacterium bovis
YVLVSTWLVVWGIWHVYFVEAVF

SEQ ID NO: 160239 - protein, 17 aa, Mycobacterium bovis
YWLFHGGTIGKFKDLLI

SEQ ID NO: 160240 - protein, 27 aa, Mycobacterium bovis
YWLGAQWWHPLVVVGLIALVAIMIAAA

SEQ ID NO: 160241 - protein, 26 aa, Mycobacterium bovis
AAAAEYPSEHPLGAAIVKAAQSRRIR

SEQ ID NO: 160242 - protein, 17 aa, Mycobacterium bovis
AAAPRVVTPDVLVHTPQ

SEQ ID NO: 160243 - protein, 18 aa, Mycobacterium bovis
AADTGARIILACGFDSIP

SEQ ID NO: 160244 - protein, 23 aa, Mycobacterium bovis
AAEQRASALWSHPDPTALASVPG

SEQ ID NO: 160245 - protein, 20 aa, Mycobacterium bovis
AAGVVPEWLAYTVAVVLGVT

SEQ ID NO: 160246 - protein, 19 aa, Mycobacterium bovis
AALALRFTGRRLGIYTTIV

SEQ ID NO: 160247 - protein, 26 aa, Mycobacterium bovis
AALIRARFPTLTARQVMQRIESTAHH

SEQ ID NO: 160248 - protein, 18 aa, Mycobacterium bovis
AALPDWVPFATLFTVAAG

SEQ ID NO: 160249 - protein, 17 aa, Mycobacterium bovis
AALPLLFFALAGQRIAE

SEQ ID NO: 160250 - protein, 18 aa, Mycobacterium bovis
AARALGRKVPKSRRAVSL

SEQ ID NO: 160251 - protein, 19 aa, Mycobacterium bovis
ADIHMLWWMVLIVGVVSII

SEQ ID NO: 160252 - protein, 17 aa, Mycobacterium bovis
AELFLACAALAGSAASW

SEQ ID NO: 160253 - protein, 19 aa, Mycobacterium bovis
AEMIPAITKYMSALDVAVL

SEQ ID NO: 160254 - protein, 22 aa, Mycobacterium bovis
AFARTEFQAVQFIPLVMVPQLL

SEQ ID NO: 160255 - protein, 18 aa, Mycobacterium bovis
AFQNPDFQRGLKLFLSPD

SEQ ID NO: 160256 - protein, 19 aa, Mycobacterium bovis
AFVDFSRPALIAVGVPVMI

SEQ ID NO: 160257 - protein, 22 aa, Mycobacterium bovis
AGAVSFRFGDRTQINGVARDDA

SEQ ID NO: 160258 - protein, 17 aa, Mycobacterium bovis
AGDAVACAIPLPPIARL

SEQ ID NO: 160259 - protein, 17 aa, Mycobacterium bovis
AGLPRRGTPDAIVVVRD

SEQ ID NO: 160260 - protein, 17 aa, Mycobacterium bovis
AGVDEWFICGPLAMATA

SEQ ID NO: 160261 - protein, 17 aa, Mycobacterium bovis
AGVWAFGALVDPLEPQA

SEQ ID NO: 160262 - protein, 17 aa, Mycobacterium bovis
ALALRFTGRRLGIYTAI

SEQ ID NO: 160263 - protein, 17 aa, Mycobacterium bovis
ALALRFTGRRLGIYTTI

SEQ ID NO: 160264 - protein, 21 aa, Mycobacterium bovis
ALDRMKAIVAQAVLDHVTDEE

SEQ ID NO: 160265 - protein, 18 aa, Mycobacterium bovis
ALLAILAVVPWRQFASGE

SEQ ID NO: 160266 - protein, 27 aa, Mycobacterium bovis
ALLGDRYGRRRSFVFGVTLFVVSSIVC

SEQ ID NO: 160267 - protein, 20 aa, Mycobacterium bovis
ALPVRVGVAVIGALIVFGLI

SEQ ID NO: 160268 - protein, 30 aa, Mycobacterium bovis
ALTVPPGSAWRWLCACLLGLTILLLAVNRL

SEQ ID NO: 160269 - protein, 18 aa, Mycobacterium bovis
ALVAFSIFLTRAHTSRTR

SEQ ID NO: 160270 - protein, 20 aa, Mycobacterium bovis
AMDPKRRITLEVLDGPGTPE

SEQ ID NO: 160271 - protein, 24 aa, Mycobacterium bovis
APGLRLAVVFLCAAAISAAVVTGY

SEQ ID NO: 160272 - protein, 25 aa, Mycobacterium bovis
APIAIPLRVGGPIAIDGDPTKVRGL

SEQ ID NO: 160273 - protein, 23 aa, Mycobacterium bovis
APIPGRLFAGPGLSQPSDVLPAD

SEQ ID NO: 160274 - protein, 27 aa, Mycobacterium bovis
APLVVGCILLAGLVGMCSFQLGGTKRG

SEQ ID NO: 160275 - protein, 27 aa, Mycobacterium bovis
APPVRRLPARFGVEQVRELASRDTRQG

SEQ ID NO: 160276 - protein, 20 aa, Mycobacterium bovis
APRLACAFVPTNAQRRATAK

SEQ ID NO: 160277 - protein, 25 aa, Mycobacterium bovis
APVIGMAMRAWWETGRSLWWPLAIG

SEQ ID NO: 160278 - protein, 18 aa, Mycobacterium bovis
APVWSRRLVDRGCPKVLA

SEQ ID NO: 160279 - protein, 18 aa, Mycobacterium bovis
AQFRRIGALGGHRGGVNA

SEQ ID NO: 160280 - protein, 25 aa, Mycobacterium bovis
ARDLQRPDAPWGRPRVVYLQHASDP

SEQ ID NO: 160281 - protein, 23 aa, Mycobacterium bovis
ARFPELDVEAVLRRHPQVVLVDE

SEQ ID NO: 160282 - protein, 17 aa, Mycobacterium bovis
ARGGIKTNWVISMPPGQ

SEQ ID NO: 160283 - protein, 24 aa, Mycobacterium bovis
ARLGPARTAGICAISPALFTSFTG

SEQ ID NO: 160284 - protein, 24 aa, Mycobacterium bovis
ARVPQRFVPDLTKYQYWNGDSNSW

SEQ ID NO: 160285 - protein, 22 aa, Mycobacterium bovis
ASGTGLLAVWSRQTVAAGHPGP

SEQ ID NO: 160286 - protein, 18 aa, Mycobacterium bovis
ASLREMLIPLVPAAVVAL

SEQ ID NO: 160287 - protein, 22 aa, Mycobacterium bovis
ATAVLPRSATPVLLPDVVAAAP

SEQ ID NO: 160288 - protein, 39 aa, Mycobacterium bovis
ATTWLHVSGYRFLLRRIECALLFGDVCAATGALRARTTS

SEQ ID NO: 160289 - protein, 23 aa, Mycobacterium bovis
ATVVRWRLAWLSKPETWRRRKRR

SEQ ID NO: 160290 - protein, 22 aa, Mycobacterium bovis
AVGGRHRVVIIGSGFGGLNAAK

SEQ ID NO: 160291 - protein, 17 aa, Mycobacterium bovis
AVSYGNEAPKFFNSKGE

SEQ ID NO: 160292 - protein, 21 aa, Mycobacterium bovis
AVVCAAVALVAFVILVQPTAS

SEQ ID NO: 160293 - protein, 17 aa, Mycobacterium bovis
AVVVFVVRYVLLVINRN

SEQ ID NO: 160294 - protein, 21 aa, Mycobacterium bovis
AVVVLLGWSFFYFSDDTRGYK

SEQ ID NO: 160295 - protein, 20 aa, Mycobacterium bovis
AWWFDWLPHHGLEDTQRSNR

SEQ ID NO: 160296 - protein, 28 aa, Mycobacterium bovis
AYWLGAQWWHPLVVVGLIALVAIMIAAA

SEQ ID NO: 160297 - protein, 30 aa, Mycobacterium bovis
CGGCGAPATRWCAACAAELSVAAGEPHVVS

SEQ ID NO: 160298 - protein, 24 aa, Mycobacterium bovis
CGTAPDLKGITGWLNTPGNKPIDL

SEQ ID NO: 160299 - protein, 18 aa, Mycobacterium bovis
CLAAAVFAVGTGIGLPTA

SEQ ID NO: 160300 - protein, 25 aa, Mycobacterium bovis
CLTLKGFTYSQMRLPGGDTVDVYNL

SEQ ID NO: 160301 - protein, 18 aa, Mycobacterium bovis
CSIGATLGNGGWATLVNS

SEQ ID NO: 160302 - protein, 18 aa, Mycobacterium bovis
DAARVRPATPLLQIDTQQ

SEQ ID NO: 160303 - protein, 20 aa, Mycobacterium bovis
DANYRRSRRPPPMPSANRYL

SEQ ID NO: 160304 - protein, 24 aa, Mycobacterium bovis
DASHELRTPLALLTTELELRCAGP

SEQ ID NO: 160305 - protein, 18 aa, Mycobacterium bovis
DAVPLLAPHSGYLQTVDV

SEQ ID NO: 160306 - protein, 20 aa, Mycobacterium bovis
DDLLNALIDFLAAVRNGLVP

SEQ ID NO: 160307 - protein, 19 aa, Mycobacterium bovis
DFGELMVGQPVQFRARISR

SEQ ID NO: 160308 - protein, 22 aa, Mycobacterium bovis
DFLCPACGIFERGFGPTVSKLV

SEQ ID NO: 160309 - protein, 20 aa, Mycobacterium bovis
DGMFPPMHIDAEYNADGSLR

SEQ ID NO: 160310 - protein, 19 aa, Mycobacterium bovis
DKPVIFWTPDHGAFVVRGA

SEQ ID NO: 160311 - protein, 24 aa, Mycobacterium bovis
DLKSLRGKVVLIDFWAYSCINCQR

SEQ ID NO: 160312 - protein, 25 aa, Mycobacterium bovis
DLVRELVTILPIVLVIAAVAAYLLS

SEQ ID NO: 160313 - protein, 33 aa, Mycobacterium bovis
DMFWSLAPLVVGCILLAGLVGMCSFQLGGTKRG

SEQ ID NO: 160314 - protein, 27 aa, Mycobacterium bovis
DMSPIPRIVSVSLAWAAAIGLMVPIGL

SEQ ID NO: 160315 - protein, 17 aa, Mycobacterium bovis
DPARLDSLFRLDHLAAR

SEQ ID NO: 160316 - protein, 21 aa, Mycobacterium bovis
DPATLWTLIGGPRMWERRPGA

SEQ ID NO: 160317 - protein, 30 aa, Mycobacterium bovis
DRDRSIGSVGRWVAVVAVLAVLTVVVTIAI

SEQ ID NO: 160318 - protein, 17 aa, Mycobacterium bovis
DSARHMGLFVVGRLAGR

SEQ ID NO: 160319 - protein, 22 aa, Mycobacterium bovis
DTPADVLGGFDFTAQGVWAFAR

SEQ ID NO: 160320 - protein, 27 aa, Mycobacterium bovis
DTRGRRLAWCSAEFNGAIVVNVPLASN

SEQ ID NO: 160321 - protein, 17 aa, Mycobacterium bovis
DVDAVKFTQVLRGYKTS

SEQ ID NO: 160322 - protein, 23 aa, Mycobacterium bovis
EASRRIELHVGRDLQFIRINGTV

SEQ ID NO: 160323 - protein, 17 aa, Mycobacterium bovis
ECGTGDFGAQASLYTSM

SEQ ID NO: 160324 - protein, 20 aa, Mycobacterium bovis
EDFTWKGMLDFATCTECGRC

SEQ ID NO: 160325 - protein, 18 aa, Mycobacterium bovis
EEGLRCHFDAGNYQMAVE

SEQ ID NO: 160326 - protein, 23 aa, Mycobacterium bovis
EEYLRELTIWSGRYGSVAGVPAR

SEQ ID NO: 160327 - protein, 19 aa, Mycobacterium bovis
EFVDVFLAIGRVGRSLGMH

SEQ ID NO: 160328 - protein, 20 aa, Mycobacterium bovis
EGGTVGPVRFDACDPDGNRM

SEQ ID NO: 160329 - protein, 19 aa, Mycobacterium bovis
EIGSGLAVFHPKGGIVRRE

SEQ ID NO: 160330 - protein, 18 aa, Mycobacterium bovis
EKLAALLTQPGRTYDVSS

SEQ ID NO: 160331 - protein, 26 aa, Mycobacterium bovis
EPALTRSGAEWMPNFIELLQRKLSRI

SEQ ID NO: 160332 - protein, 28 aa, Mycobacterium bovis
EPEVVQWKLKPGVVSTMSAQARYTDPNT

SEQ ID NO: 160333 - protein, 25 aa, Mycobacterium bovis
EPPTLLWPIGVPFSDGLNTLSEFKV

SEQ ID NO: 160334 - protein, 25 aa, Mycobacterium bovis
EPTTRLRKDLTWWDLVVFGVSVVIG

SEQ ID NO: 160335 - protein, 27 aa, Mycobacterium bovis
EPYPEQRPPWGVPPPGWDGSSRPAPST

SEQ ID NO: 160336 - protein, 22 aa, Mycobacterium bovis
EQPLPGPRWPRALRASATRRAL

SEQ ID NO: 160337 - protein, 24 aa, Mycobacterium bovis
ERRPSRLRRGWLVGIAATLLALAG

SEQ ID NO: 160338 - protein, 25 aa, Mycobacterium bovis
ERRPSRLRRGWLVGIAATLLALAGG

SEQ ID NO: 160339 - protein, 17 aa, Mycobacterium bovis
ESAFRSPLWSNQNIAEL

SEQ ID NO: 160340 - protein, 24 aa, Mycobacterium bovis
ETYTRRRRNLLIGIGAGAAVLMVA

SEQ ID NO: 160341 - protein, 25 aa, Mycobacterium bovis
EVAAAGDHRLRVIGVTWNAEASAQA

SEQ ID NO: 160342 - protein, 26 aa, Mycobacterium bovis
EVAAAGDHRLRVIGVTWNAEASAQAA

SEQ ID NO: 160343 - protein, 22 aa, Mycobacterium bovis
EVAMGLSFATVFLMAGTMSTSQ

SEQ ID NO: 160344 - protein, 34 aa, Mycobacterium bovis
EVPYLRASPWLLWRKRAVWLLVLFAAEAYTGSVL

SEQ ID NO: 160345 - protein, 27 aa, Mycobacterium bovis
EVSEFSWQLERVLPVPVFAQTMAQVTV

SEQ ID NO: 160346 - protein, 19 aa, Mycobacterium bovis
EWELPIVLDSAAGFGSTYA

SEQ ID NO: 160347 - protein, 22 aa, Mycobacterium bovis
FAGITMFGPWGIIIGPVLMILI

SEQ ID NO: 160348 - protein, 17 aa, Mycobacterium bovis
FAPNFTVLVILRLLYGI

SEQ ID NO: 160349 - protein, 21 aa, Mycobacterium bovis
FAVHHSRWHFAVLYTFLSMVN

SEQ ID NO: 160350 - protein, 22 aa, Mycobacterium bovis
FESAHFLRALLVAVVAALAAGM

SEQ ID NO: 160351 - protein, 17 aa, Mycobacterium bovis
FGDRTQINGVARDDAVA

SEQ ID NO: 160352 - protein, 17 aa, Mycobacterium bovis
FGPPGTVADISYFDVNS

SEQ ID NO: 160353 - protein, 18 aa, Mycobacterium bovis
FGSWPGWYAGVIELVAGL

SEQ ID NO: 160354 - protein, 23 aa, Mycobacterium bovis
FKDLLINCGYSLIERFPLMLGTA

SEQ ID NO: 160355 - protein, 17 aa, Mycobacterium bovis
FLQGDSLYVAGVSGLGA

SEQ ID NO: 160356 - protein, 23 aa, Mycobacterium bovis
FLTGTGIGWVLARGWRRPTALAP

SEQ ID NO: 160357 - protein, 22 aa, Mycobacterium bovis
FLYGGRSIWQYVTKAFPASVRD

SEQ ID NO: 160358 - protein, 26 aa, Mycobacterium bovis
FNEPICPPCGSFIRSYASDIDTAVAD

SEQ ID NO: 160359 - protein, 22 aa, Mycobacterium bovis
FPAPSWWWLAWFGLVPLLLVVR

SEQ ID NO: 160360 - protein, 28 aa, Mycobacterium bovis
FPLGVVVGGPFLPLAIILYWFSNNIWTF

SEQ ID NO: 160361 - protein, 24 aa, Mycobacterium bovis
FRKGANFTAAMAFEIGSTNLVVEL

SEQ ID NO: 160362 - protein, 18 aa, Mycobacterium bovis
FSDGLNTLSEFKVQRLDR

SEQ ID NO: 160363 - protein, 23 aa, Mycobacterium bovis
FTRISVVQIGWALRRYRRETLRL

SEQ ID NO: 160364 - protein, 18 aa, Mycobacterium bovis
FTVAQWRLALVSRGHVQN

SEQ ID NO: 160365 - protein, 18 aa, Mycobacterium bovis
FWSLAPLVVGCILLAGLV

SEQ ID NO: 160366 - protein, 17 aa, Mycobacterium bovis
FYRRARAAADKITPDVE

SEQ ID NO: 160367 - protein, 22 aa, Mycobacterium bovis
GAALCLPLARVLAAASCGPLSS

SEQ ID NO: 160368 - protein, 26 aa, Mycobacterium bovis
GAANRDGRRLMTVLLHGTRQPIPPWE

SEQ ID NO: 160369 - protein, 18 aa, Mycobacterium bovis
GAGGYPQMLLRVGWAPIN

SEQ ID NO: 160370 - protein, 29 aa, Mycobacterium bovis
GASQRLADCIARPLVPSIMIAAALIAGTG

SEQ ID NO: 160371 - protein, 17 aa, Mycobacterium bovis
GAVALAVIAALAVLVTV

SEQ ID NO: 160372 - protein, 20 aa, Mycobacterium bovis
GDGVAILARNHRWFVIANYG

SEQ ID NO: 160373 - protein, 20 aa, Mycobacterium bovis
GGGALWWCVARRSWHAPRLG

SEQ ID NO: 160374 - protein, 20 aa, Mycobacterium bovis
GGGVKRCLGANFSMRELITV

SEQ ID NO: 160375 - protein, 17 aa, Mycobacterium bovis
GGLRVAILSGRAFGRAA

SEQ ID NO: 160376 - protein, 20 aa, Mycobacterium bovis
GGVRLLTMWSTVLVLALSVI

SEQ ID NO: 160377 - protein, 19 aa, Mycobacterium bovis
GHLDWYADGMFPPMHIDAE

SEQ ID NO: 160378 - protein, 26 aa, Mycobacterium bovis
GIARRSCTPISFWKFTRKGAVVTAVS

SEQ ID NO: 160379 - protein, 25 aa, Mycobacterium bovis
GIVDPEFGYDIGFFVFDLPFYRSVL

SEQ ID NO: 160380 - protein, 23 aa, Mycobacterium bovis
GLETHLSYRMCLKTWSASESRNV

SEQ ID NO: 160381 - protein, 20 aa, Mycobacterium bovis
GLSYRFPFHTEKKTYPYFDP

SEQ ID NO: 160382 - protein, 19 aa, Mycobacterium bovis
GNDHFAEFAPGMKSIDDAL

SEQ ID NO: 160383 - protein, 27 aa, Mycobacterium bovis
GNLLQMAFRFWAFRRWVFPDEFARNPD

SEQ ID NO: 160384 - protein, 18 aa, Mycobacterium bovis
GPLISALLNPGARNAAPL

SEQ ID NO: 160385 - protein, 17 aa, Mycobacterium bovis
GQMAITSQMIYARLVMT

SEQ ID NO: 160386 - protein, 17 aa, Mycobacterium bovis
GQRPVHPVTVWRKRLAV

SEQ ID NO: 160387 - protein, 17 aa, Mycobacterium bovis
GRFREHIDAPALHPAVF

SEQ ID NO: 160388 - protein, 17 aa, Mycobacterium bovis
GRGMARLAMKIHARPKL

SEQ ID NO: 160389 - protein, 17 aa, Mycobacterium bovis
GRLQPFFATPAAWRILD

SEQ ID NO: 160390 - protein, 19 aa, Mycobacterium bovis
GSAPFPISALISGLVNAAL

SEQ ID NO: 160391 - protein, 18 aa, Mycobacterium bovis
GSAYLARVPQRFVPDLTK

SEQ ID NO: 160392 - protein, 18 aa, Mycobacterium bovis
GSRIELRLADPADSELDR

SEQ ID NO: 160393 - protein, 21 aa, Mycobacterium bovis
GSWRELLSRYLGTSIVLAGGV

SEQ ID NO: 160394 - protein, 20 aa, Mycobacterium bovis
GVLGWWRWHHNTWLTTIYTA

SEQ ID NO: 160395 - protein, 22 aa, Mycobacterium bovis
GVLVGGLWAWIAPPIHAVVAIT

SEQ ID NO: 160396 - protein, 23 aa, Mycobacterium bovis
GVRVGGLFAALGVTSVVIGLMLQ

SEQ ID NO: 160397 - protein, 20 aa, Mycobacterium bovis
GWPPRSSHRPSYSGEPAPTY

SEQ ID NO: 160398 - protein, 22 aa, Mycobacterium bovis
GYARFWWPGLPIWVPALVTVAL

SEQ ID NO: 160399 - protein, 19 aa, Mycobacterium bovis
GYIVIGGIAGWLASKIVKG

SEQ ID NO: 160400 - protein, 24 aa, Mycobacterium bovis
GYLREFGNLVFHFALLGLLVAVAV

SEQ ID NO: 160401 - protein, 24 aa, Mycobacterium bovis
GYQDWVPAGGIAFGLFIVTNAAKL

SEQ ID NO: 160402 - protein, 17 aa, Mycobacterium bovis
HGLRLGFNGQFDDFDDF

SEQ ID NO: 160403 - protein, 21 aa, Mycobacterium bovis
HPELFGMTALVAFSIFLTRAH

SEQ ID NO: 160404 - protein, 17 aa, Mycobacterium bovis
HPHWNRLIWPVVVLVLL

SEQ ID NO: 160405 - protein, 22 aa, Mycobacterium bovis
HPRGAVLRLVVRFAEPLPPSPS

SEQ ID NO: 160406 - protein, 21 aa, Mycobacterium bovis
HRPLELCRVDLLALASDAAHD

SEQ ID NO: 160407 - protein, 18 aa, Mycobacterium bovis
IADAALAALGLWLSVAAV

SEQ ID NO: 160408 - protein, 17 aa, Mycobacterium bovis
IAERVYPSPLPDEPLKI

SEQ ID NO: 160409 - protein, 34 aa, Mycobacterium bovis
IANGRYRLLIFHGGVPPLQFWQALDTALDRQVAL

SEQ ID NO: 160410 - protein, 21 aa, Mycobacterium bovis
IDEFQVLYAARRLRPKRMPPS

SEQ ID NO: 160411 - protein, 23 aa, Mycobacterium bovis
IDRDIPFQISAVAARSVQGDGGI

SEQ ID NO: 160412 - protein, 19 aa, Mycobacterium bovis
IEMIPPRYVEYRGARFPEL

SEQ ID NO: 160413 - protein, 21 aa, Mycobacterium bovis
IGAGLIFPRFEQLLEKPFSRI

SEQ ID NO: 160414 - protein, 20 aa, Mycobacterium bovis
IGGIAGWLASKIVKGGGSGI

SEQ ID NO: 160415 - protein, 17 aa, Mycobacterium bovis
IGPWRLLVRDLAHLVDT

SEQ ID NO: 160416 - protein, 25 aa, Mycobacterium bovis
IGVMVALCLGGGVFGLSLGKHVTQS

SEQ ID NO: 160417 - protein, 22 aa, Mycobacterium bovis
IHAELPAKLVLVAIAVLCAVSF

SEQ ID NO: 160418 - protein, 19 aa, Mycobacterium bovis
IKVLLEVFPQAKFIHIVRD

SEQ ID NO: 160419 - protein, 25 aa, Mycobacterium bovis
ILLFGGRRTDAWGHLLGCAAALAAF

SEQ ID NO: 160420 - protein, 33 aa, Mycobacterium bovis
ILPGSPPAGAWIDRAVVIWVLIALAAAMVVYIV

SEQ ID NO: 160421 - protein, 18 aa, Mycobacterium bovis
IMRFLAIFGPVHYFAQPV

SEQ ID NO: 160422 - protein, 18 aa, Mycobacterium bovis
INLLPLLPFDGGHIAVAV

SEQ ID NO: 160423 - protein, 17 aa, Mycobacterium bovis
IPLSFLVLIWVFGGLLA

SEQ ID NO: 160424 - protein, 18 aa, Mycobacterium bovis
IREQLNLGGIVNAQNAQL

SEQ ID NO: 160425 - protein, 22 aa, Mycobacterium bovis
ISPARLTAWIAASALILLTGTE

SEQ ID NO: 160426 - protein, 18 aa, Mycobacterium bovis
ISTISFGTPYGFVEINDQ

SEQ ID NO: 160427 - protein, 18 aa, Mycobacterium bovis
IVLVIAAVAAYLLSRAAL

SEQ ID NO: 160428 - protein, 29 aa, Mycobacterium bovis
IVRRSNALLDWAYGRRFRYSETMSVGSTV

SEQ ID NO: 160429 - protein, 28 aa, Mycobacterium bovis
IWQHILHMPLHWLVLPMAIIVMLAVGSD

SEQ ID NO: 160430 - protein, 25 aa, Mycobacterium bovis
IYNYTWLVLMLPFGMIGVTVLTVVM

SEQ ID NO: 160431 - protein, 19 aa, Mycobacterium bovis
IYYPVSWIMWVWYRLFAFV

SEQ ID NO: 160432 - protein, 19 aa, Mycobacterium bovis
KARFVPGNENFQMGAYLKS

SEQ ID NO: 160433 - protein, 21 aa, Mycobacterium bovis
KRIGQVGALAVVLGVGAAVTT

SEQ ID NO: 160434 - protein, 21 aa, Mycobacterium bovis
KSELLRTIALGMMARNSPEVL

SEQ ID NO: 160435 - protein, 17 aa, Mycobacterium bovis
KTNPWPLVAGAAAVVLV

SEQ ID NO: 160436 - protein, 17 aa, Mycobacterium bovis
LAAGGRYCRLWDTGQGS

SEQ ID NO: 160437 - protein, 19 aa, Mycobacterium bovis
LALGWWQWTRFQSTSGTFQ

SEQ ID NO: 160438 - protein, 17 aa, Mycobacterium bovis
LALYSGGDYLLRRLTAE

SEQ ID NO: 160439 - protein, 18 aa, Mycobacterium bovis
LAVLAILVWWALRHRNRC

SEQ ID NO: 160440 - protein, 31 aa, Mycobacterium bovis
LDDELAAPRWPWVVGVAAIIAAVALVVSVSL

SEQ ID NO: 160441 - protein, 17 aa, Mycobacterium bovis
LDDPRWIAILAAVLTVS

SEQ ID NO: 160442 - protein, 20 aa, Mycobacterium bovis
LDKIFYRSGQGVTLQAVSYG

SEQ ID NO: 160443 - protein, 20 aa, Mycobacterium bovis
LDRWPKGAVIVGMTGLTAAF

SEQ ID NO: 160444 - protein, 18 aa, Mycobacterium bovis
LDRYGGGTARRLERTGTF

SEQ ID NO: 160445 - protein, 24 aa, Mycobacterium bovis
LERQWRARMAGLRTNALVATGATL

SEQ ID NO: 160446 - protein, 26 aa, Mycobacterium bovis
LESIHMSWLRFGHGLVLSSILLWTGV

SEQ ID NO: 160447 - protein, 20 aa, Mycobacterium bovis
LEVFPQAKFIHIVRDPYVVY

SEQ ID NO: 160448 - protein, 29 aa, Mycobacterium bovis
LFKGIARGVKEFAPLIGVRKAGLFTSSSF

SEQ ID NO: 160449 - protein, 19 aa, Mycobacterium bovis
LGAIGIWIAIRPKPVQPPQ

SEQ ID NO: 160450 - protein, 23 aa, Mycobacterium bovis
LGEGCCFRVSLPRVSDVDQLSLT

SEQ ID NO: 160451 - protein, 17 aa, Mycobacterium bovis
LGLSIGVTNLAAVAADH

SEQ ID NO: 160452 - protein, 23 aa, Mycobacterium bovis
LGVAELWALLRIYQYQRLFEAVR

SEQ ID NO: 160453 - protein, 20 aa, Mycobacterium bovis
LGVLRDGQKWVALAVPGYTL

SEQ ID NO: 160454 - protein, 23 aa, Mycobacterium bovis
LGYVAWRLFGHTPYRIDIDIYQM

SEQ ID NO: 160455 - protein, 21 aa, Mycobacterium bovis
LIEQPIRRWRPARVPLLPLAA

SEQ ID NO: 160456 - protein, 25 aa, Mycobacterium bovis
LILLWGSAGALGFVEQDLGFKIIFG

SEQ ID NO: 160457 - protein, 35 aa, Mycobacterium bovis
LITTVCGFRSRLYAERWCAWALLAATVAIPTGLTA

SEQ ID NO: 160458 - protein, 19 aa, Mycobacterium bovis
LKFAMFMLAEYVNMTTVSA

SEQ ID NO: 160459 - protein, 24 aa, Mycobacterium bovis
LKTVPKRLSALLNTSGLPAVLEPF

SEQ ID NO: 160460 - protein, 17 aa, Mycobacterium bovis
LLDSRYLVQAKIASGGT

SEQ ID NO: 160461 - protein, 18 aa, Mycobacterium bovis
LLEGIEMIPPRYVEYRGA

SEQ ID NO: 160462 - protein, 20 aa, Mycobacterium bovis
LLFPWGGGRMSAYRQPVERY

SEQ ID NO: 160463 - protein, 22 aa, Mycobacterium bovis
LLHRAKGGGLSTLFGGGVQSSL

SEQ ID NO: 160464 - protein, 17 aa, Mycobacterium bovis
LLHSIQITRDIAEQVIT

SEQ ID NO: 160465 - protein, 17 aa, Mycobacterium bovis
LLRAMICQLAVWHSPEE

SEQ ID NO: 160466 - protein, 17 aa, Mycobacterium bovis
LMLLPLSAFEATVALPA

SEQ ID NO: 160467 - protein, 17 aa, Mycobacterium bovis
LMSCALLGDRYGRRRSF

SEQ ID NO: 160468 - protein, 17 aa, Mycobacterium bovis
LNGKRPKLRRILSDPDA

SEQ ID NO: 160469 - protein, 20 aa, Mycobacterium bovis
LNNRRVPVVDIYDAQRVHIG

SEQ ID NO: 160470 - protein, 24 aa, Mycobacterium bovis
LPEPYLPPRLEAFRDRKRANPQPA

SEQ ID NO: 160471 - protein, 24 aa, Mycobacterium bovis
LPIVNASGGPNCRGLPDIPTKQTG

SEQ ID NO: 160472 - protein, 19 aa, Mycobacterium bovis
LPLRVRLVAATLILVATGL

SEQ ID NO: 160473 - protein, 18 aa, Mycobacterium bovis
LPMLAQIPVFLGLYHVLR

SEQ ID NO: 160474 - protein, 23 aa, Mycobacterium bovis
LPTGCILAWILVRIINVRSFGWT

SEQ ID NO: 160475 - protein, 17 aa, Mycobacterium bovis
LPVPFILNQPPPPGPVP

SEQ ID NO: 160476 - protein, 17 aa, Mycobacterium bovis
LQRALAHEQQFVADASH

SEQ ID NO: 160477 - protein, 28 aa, Mycobacterium bovis
LQTNRLLTRWARDYITVIGAIVLPILFM

SEQ ID NO: 160478 - protein, 21 aa, Mycobacterium bovis
LRFTGRRLGIYTAIVIIDALT

SEQ ID NO: 160479 - protein, 20 aa, Mycobacterium bovis
LRLLVVSALATLSGLGTPVA

SEQ ID NO: 160480 - protein, 18 aa, Mycobacterium bovis
LRPGYLLLRDAVSTPRSY

SEQ ID NO: 160481 - protein, 20 aa, Mycobacterium bovis
LRPWMTMSVPRGAKGMTVDT

SEQ ID NO: 160482 - protein, 20 aa, Mycobacterium bovis
LRRTWRFEHNIAGLGILATG

SEQ ID NO: 160483 - protein, 18 aa, Mycobacterium bovis
LRSLPVPFILNQPPPPPG

SEQ ID NO: 160484 - protein, 17 aa, Mycobacterium bovis
LRVAILSGRAFGRAASL

SEQ ID NO: 160485 - protein, 21 aa, Mycobacterium bovis
LRYAPDCVVRVNAGRVRERVL

SEQ ID NO: 160486 - protein, 22 aa, Mycobacterium bovis
LSGRYRLQRLIATGGMGQVWEA

SEQ ID NO: 160487 - protein, 18 aa, Mycobacterium bovis
LSLQPGVYAVHWYAGEHA

SEQ ID NO: 160488 - protein, 25 aa, Mycobacterium bovis
LSQRFSRRYTIVFCAALGLPIVPLF

SEQ ID NO: 160489 - protein, 17 aa, Mycobacterium bovis
LSVVDVLLGSQVVNILW

SEQ ID NO: 160490 - protein, 25 aa, Mycobacterium bovis
LTAKLIIWYPHYAWLLLSVYLTVAL

SEQ ID NO: 160491 - protein, 22 aa, Mycobacterium bovis
LTLADGRVVIWGTTDRCEEKAE

SEQ ID NO: 160492 - protein, 20 aa, Mycobacterium bovis
LTPRQPWAWLALLVAGLTVG

SEQ ID NO: 160493 - protein, 23 aa, Mycobacterium bovis
LTSREFRAAGLTHLTAVSGANVT

SEQ ID NO: 160494 - protein, 20 aa, Mycobacterium bovis
LTSTLRPAGVDEWFICGPLA

SEQ ID NO: 160495 - protein, 18 aa, Mycobacterium bovis
LVAEIGMGTGAMAVVGGT

SEQ ID NO: 160496 - protein, 26 aa, Mycobacterium bovis
LVGATGVFLACRWAQADGADHAWLGY

SEQ ID NO: 160497 - protein, 21 aa, Mycobacterium bovis
LVLGAIGIWIAIRPKPVQPPQ

SEQ ID NO: 160498 - protein, 26 aa, Mycobacterium bovis
LVSSWQMPGGIYAPMMHPWSTGKDVY

SEQ ID NO: 160499 - protein, 18 aa, Mycobacterium bovis
LVVAMVLAGLRVEAAMAS

SEQ ID NO: 160500 - protein, 17 aa, Mycobacterium bovis
LVVSVSLLVTRPHTSKL

SEQ ID NO: 160501 - protein, 18 aa, Mycobacterium bovis
LWAGCLLPMVNLLWAPLY

SEQ ID NO: 160502 - protein, 17 aa, Mycobacterium bovis
LWLAGWGAARLVATALP

SEQ ID NO: 160503 - protein, 21 aa, Mycobacterium bovis
LWVLPLRWSMVEYFYIKYYLP

SEQ ID NO: 160504 - protein, 18 aa, Mycobacterium bovis
LWYAGLPLRVFLSSLAAV

SEQ ID NO: 160505 - protein, 20 aa, Mycobacterium bovis
LYGGRSIWQYVTKAFPASVR

SEQ ID NO: 160506 - protein, 21 aa, Mycobacterium bovis
LYGGRSIWQYVTKAFPASVRD

SEQ ID NO: 160507 - protein, 22 aa, Mycobacterium bovis
MAMSACASGVYLVDVRPKLLEI

SEQ ID NO: 160508 - protein, 20 aa, Mycobacterium bovis
MAVEPIIWRTYAQTLPPDAI

SEQ ID NO: 160509 - protein, 22 aa, Mycobacterium bovis
MCINCMLCYSACPVYALDPDFL

SEQ ID NO: 160510 - protein, 23 aa, Mycobacterium bovis
MCINCMLCYSACPVYALDPDFLG

SEQ ID NO: 160511 - protein, 19 aa, Mycobacterium bovis
MEVLALPLVAVVLFFVFGG

SEQ ID NO: 160512 - protein, 17 aa, Mycobacterium bovis
MHIDAEYNADGSLRKPG

SEQ ID NO: 160513 - protein, 24 aa, Mycobacterium bovis
MHWSLPGLSFILLVAIGADYNMLL

SEQ ID NO: 160514 - protein, 17 aa, Mycobacterium bovis
MIVRSALPQSLRKLAPR

SEQ ID NO: 160515 - protein, 18 aa, Mycobacterium bovis
MLAIAMLLMLVPLATGCL

SEQ ID NO: 160516 - protein, 23 aa, Mycobacterium bovis
MLNRRRPLLHLLTFLCGGYTMAG

SEQ ID NO: 160517 - protein, 24 aa, Mycobacterium bovis
MPNGYPVKASVSFGLYYPPGSALY

SEQ ID NO: 160518 - protein, 25 aa, Mycobacterium bovis
MQFGEGWWTSVWFLSFWVTGTSILL

SEQ ID NO: 160519 - protein, 27 aa, Mycobacterium bovis
MRDELRSLLRFVLDLLADYGLTDFYLE

SEQ ID NO: 160520 - protein, 18 aa, Mycobacterium bovis
MSACLVAVRAGRPFVTPS

SEQ ID NO: 160521 - protein, 19 aa, Mycobacterium bovis
MSAREIVIIGIGAVSREEV

SEQ ID NO: 160522 - protein, 24 aa, Mycobacterium bovis
MSREIAELPNIVMVRGLTRPNGEP

SEQ ID NO: 160523 - protein, 17 aa, Mycobacterium bovis
NALRYAPDCVVRVNAGR

SEQ ID NO: 160524 - protein, 25 aa, Mycobacterium bovis
NDVAKYFAIIPAMFVGLYPVLDKLN

SEQ ID NO: 160525 - protein, 28 aa, Mycobacterium bovis
NPGSARPRTRFGAWLGRPMTSFHLIIAV

SEQ ID NO: 160526 - protein, 19 aa, Mycobacterium bovis
NPRMKARAISNWMAIGMVG

SEQ ID NO: 160527 - protein, 17 aa, Mycobacterium bovis
NPSAPRSPLALRVDGLR

SEQ ID NO: 160528 - protein, 23 aa, Mycobacterium bovis
NRFPDPKDRCHLATIGVQPLVPD

SEQ ID NO: 160529 - protein, 22 aa, Mycobacterium bovis
NRWVATRSRRHTYQWITDHKSP

SEQ ID NO: 160530 - protein, 20 aa, Mycobacterium bovis
NSLHIAPLISYEMTFSDLTR

SEQ ID NO: 160531 - protein, 23 aa, Mycobacterium bovis
NTRSFTGAGIWLGIAAFAAAGVV

SEQ ID NO: 160532 - protein, 23 aa, Mycobacterium bovis
NVGVMRWRWRVAFYALSALGTDR

SEQ ID NO: 160533 - protein, 28 aa, Mycobacterium bovis
NVTLYLRLGDWVPVTAFVVMGAGFAVFL

SEQ ID NO: 160534 - protein, 24 aa, Mycobacterium bovis
NVVQRRPFFAILRCLGVTREQLFW

SEQ ID NO: 160535 - protein, 20 aa, Mycobacterium bovis
PARLGLAVVMLSRRRPMLNL

SEQ ID NO: 160536 - protein, 24 aa, Mycobacterium bovis
PARRPDSLPGRWACPRDPARPARP

SEQ ID NO: 160537 - protein, 20 aa, Mycobacterium bovis
PCVHSACAVIERFRDRIAGI

SEQ ID NO: 160538 - protein, 20 aa, Mycobacterium bovis
PDRPPSRFYVRVISPDGQSY

SEQ ID NO: 160539 - protein, 17 aa, Mycobacterium bovis
PDVSTLTYAEAVKKLTA

SEQ ID NO: 160540 - protein, 22 aa, Mycobacterium bovis
PEHLRLGPYAVMHAIADYVVDR

SEQ ID NO: 160541 - protein, 19 aa, Mycobacterium bovis
PELFGMTALVAFSIFLTRA

SEQ ID NO: 160542 - protein, 20 aa, Mycobacterium bovis
PELFGMTALVAFSIFLTRAH

SEQ ID NO: 160543 - protein, 17 aa, Mycobacterium bovis
PEVLNLLLVDFKGGATF

SEQ ID NO: 160544 - protein, 19 aa, Mycobacterium bovis
PEVLRPVARPQPPNAHPVA

SEQ ID NO: 160545 - protein, 28 aa, Mycobacterium bovis
PFDPCRDIPFDVIQRLGLAYTPPEAEEG

SEQ ID NO: 160546 - protein, 18 aa, Mycobacterium bovis
PFYRCYETSDGKYMAVGA

SEQ ID NO: 160547 - protein, 20 aa, Mycobacterium bovis
PGDLRPGLLSRIVAHVSTVI

SEQ ID NO: 160548 - protein, 35 aa, Mycobacterium bovis
PGLPGRLAVGLGRGDRRLCCGLRRTWRFEHNIAGL

SEQ ID NO: 160549 - protein, 22 aa, Mycobacterium bovis
PHIPGVPWWAAILIAVTATAIG

SEQ ID NO: 160550 - protein, 19 aa, Mycobacterium bovis
PHLFDRDGVDFATDPPPPA

SEQ ID NO: 160551 - protein, 24 aa, Mycobacterium bovis
PIPEIPQLPPGIPQVPGIGQFSAI

SEQ ID NO: 160552 - protein, 24 aa, Mycobacterium bovis
PIRRASVTVMEWGLRGTRRAEAAA

SEQ ID NO: 160553 - protein, 20 aa, Mycobacterium bovis
PKRLSCQLRPGPTPPATITV

SEQ ID NO: 160554 - protein, 17 aa, Mycobacterium bovis
PLADLSTLFAIVPSARV

SEQ ID NO: 160555 - protein, 18 aa, Mycobacterium bovis
PLAFALAALIAFEVNLGV

SEQ ID NO: 160556 - protein, 18 aa, Mycobacterium bovis
PLALRVDGLRSRWLGMPA

SEQ ID NO: 160557 - protein, 24 aa, Mycobacterium bovis
PLATGCLRVRASITISPDDLVSGE

SEQ ID NO: 160558 - protein, 21 aa, Mycobacterium bovis
PLGGFCDIAGMTPVEELDPDE

SEQ ID NO: 160559 - protein, 23 aa, Mycobacterium bovis
PLRRASPSAVHPVAPPSVRPFTT

SEQ ID NO: 160560 - protein, 18 aa, Mycobacterium bovis
PLSPFSGYLTLAFLAGVL

SEQ ID NO: 160561 - protein, 22 aa, Mycobacterium bovis
PMAAVLRWLEIPQFSVFDEIFR

SEQ ID NO: 160562 - protein, 20 aa, Mycobacterium bovis
PMKKMHAVSVPPNYAAALLA

SEQ ID NO: 160563 - protein, 21 aa, Mycobacterium bovis
PPCPERLATAVLPRSATPVLL

SEQ ID NO: 160564 - protein, 17 aa, Mycobacterium bovis
PPMLGALLRDAEPAQAE

SEQ ID NO: 160565 - protein, 21 aa, Mycobacterium bovis
PQDAIRWAALVALVAIGAGLI

SEQ ID NO: 160566 - protein, 17 aa, Mycobacterium bovis
PQWGPPAGRVLATLLAE

SEQ ID NO: 160567 - protein, 27 aa, Mycobacterium bovis
PRAGGVVFTRVRLIGGLGALTAAVVVV

SEQ ID NO: 160568 - protein, 20 aa, Mycobacterium bovis
PRGAVLRLVVRFAEPLPPSP

SEQ ID NO: 160569 - protein, 17 aa, Mycobacterium bovis
PRRRGFLDLHGILCHVG

SEQ ID NO: 160570 - protein, 22 aa, Mycobacterium bovis
PSANLGANCQYPPSPDKAVKPV

SEQ ID NO: 160571 - protein, 20 aa, Mycobacterium bovis
PSLRVQRVIAAIVILTQGGI

SEQ ID NO: 160572 - protein, 18 aa, Mycobacterium bovis
PSPGFPLTRAERLNVVFL

SEQ ID NO: 160573 - protein, 29 aa, Mycobacterium bovis
PSSQAPVMWALSASLGWILPVIAQLVWWA

SEQ ID NO: 160574 - protein, 28 aa, Mycobacterium bovis
PSTTPRSPGRWSLVAALALAVVSLGVGI

SEQ ID NO: 160575 - protein, 18 aa, Mycobacterium bovis
PWFNLDWITSAKLVAVVG

SEQ ID NO: 160576 - protein, 18 aa, Mycobacterium bovis
PWTPRIATQLSVLACAAF

SEQ ID NO: 160577 - protein, 20 aa, Mycobacterium bovis
QEDFRKAAVVANVYADAAGD

SEQ ID NO: 160578 - protein, 17 aa, Mycobacterium bovis
QGFFKGTTCHRLTTSPM

SEQ ID NO: 160579 - protein, 19 aa, Mycobacterium bovis
QKNLNVYGFTKFSQASVDS

SEQ ID NO: 160580 - protein, 20 aa, Mycobacterium bovis
QLINSIKWARDETGIIPTAG

SEQ ID NO: 160581 - protein, 22 aa, Mycobacterium bovis
QLPCLPILFIVVDEFSELLSQH

SEQ ID NO: 160582 - protein, 26 aa, Mycobacterium bovis
QLTFSVLAAYAFARLQFRGRDALFWV

SEQ ID NO: 160583 - protein, 22 aa, Mycobacterium bovis
QPVIGCAAALVFGGLPALAFPA

SEQ ID NO: 160584 - protein, 17 aa, Mycobacterium bovis
QRFWRITLPMLRPTMFF

SEQ ID NO: 160585 - protein, 21 aa, Mycobacterium bovis
QTRAGLRFAAPLIAAGLRALF

SEQ ID NO: 160586 - protein, 37 aa, Mycobacterium bovis
RASMQIRRIDPWSTLKVSLLLSVALFFVWMITVAFLY

SEQ ID NO: 160587 - protein, 20 aa, Mycobacterium bovis
RAVIVTGDFNARYSDDQSAL

SEQ ID NO: 160588 - protein, 22 aa, Mycobacterium bovis
RDDAVAAIVAWIADRENAVPTA

SEQ ID NO: 160589 - protein, 30 aa, Mycobacterium bovis
RDDPNSLLPRWLPDTSRGQGWADRIRADPG

SEQ ID NO: 160590 - protein, 21 aa, Mycobacterium bovis
REHIDAPALHPAVFATAVMLL

SEQ ID NO: 160591 - protein, 18 aa, Mycobacterium bovis
RERSCQLVAVPADPRPKR

SEQ ID NO: 160592 - protein, 20 aa, Mycobacterium bovis
REVVLVTGPWLAGVSGVRAA

SEQ ID NO: 160593 - protein, 19 aa, Mycobacterium bovis
RFSAADKPVIFWTPDHGAF

SEQ ID NO: 160594 - protein, 17 aa, Mycobacterium bovis
RFTDDELLRLAAAAEYP

SEQ ID NO: 160595 - protein, 24 aa, Mycobacterium bovis
RHIVRLVVFAGFLVGMFYLVAATD

SEQ ID NO: 160596 - protein, 25 aa, Mycobacterium bovis
RHTAYRWFREGTLPVPAERVGRLIL

SEQ ID NO: 160597 - protein, 17 aa, Mycobacterium bovis
RIACFYVGSTVLLALLL

SEQ ID NO: 160598 - protein, 26 aa, Mycobacterium bovis
RIATQLSVLACAAFIYVTAEILPVGA

SEQ ID NO: 160599 - protein, 36 aa, Mycobacterium bovis
RIKDEIREGRSFRSAVPRGWARARKTIVSGSAVTFL

SEQ ID NO: 160600 - protein, 17 aa, Mycobacterium bovis
RIVALKLMSETLSSDPD

SEQ ID NO: 160601 - protein, 20 aa, Mycobacterium bovis
RLATLLAQFLDDPRWIAILA

SEQ ID NO: 160602 - protein, 24 aa, Mycobacterium bovis
RLAVWDRPERRSGIPALDGLRAIA

SEQ ID NO: 160603 - protein, 25 aa, Mycobacterium bovis
RLDSLFRLDHLAARLRRNSANLLVL

SEQ ID NO: 160604 - protein, 27 aa, Mycobacterium bovis
RLDVSGMSCAACASRVETKLNKIPGVR

SEQ ID NO: 160605 - protein, 18 aa, Mycobacterium bovis
RLLLPTITGWSLGRALTG

SEQ ID NO: 160606 - protein, 18 aa, Mycobacterium bovis
RLQRRLGAVPDIDSHAAS

SEQ ID NO: 160607 - protein, 17 aa, Mycobacterium bovis
RLRQVLRNLVANAIQHT

SEQ ID NO: 160608 - protein, 21 aa, Mycobacterium bovis
RLRSWALAVWHFVSNAPLTYA

SEQ ID NO: 160609 - protein, 22 aa, Mycobacterium bovis
RLSRGLVLIKWWLLAIPHYLIL

SEQ ID NO: 160610 - protein, 23 aa, Mycobacterium bovis
RLVKEGKPAFAVVGVDGGNTYWH

SEQ ID NO: 160611 - protein, 22 aa, Mycobacterium bovis
RNPRLVKVSVLTMIAVTGHFVS

SEQ ID NO: 160612 - protein, 23 aa, Mycobacterium bovis
RNYLYDAWAARFLVTARLNNSLP

SEQ ID NO: 160613 - protein, 18 aa, Mycobacterium bovis
RPATLYRLSVVDVLLGSQ

SEQ ID NO: 160614 - protein, 23 aa, Mycobacterium bovis
RPGAADFCRIRVGVGSAPLATRL

SEQ ID NO: 160615 - protein, 17 aa, Mycobacterium bovis
RPGGWLRNFGPKIHYRA

SEQ ID NO: 160616 - protein, 17 aa, Mycobacterium bovis
RQGRAYWIHLMIASQTI

SEQ ID NO: 160617 - protein, 19 aa, Mycobacterium bovis
RRALLRWGAGAGAGAAGVW

SEQ ID NO: 160618 - protein, 19 aa, Mycobacterium bovis
RRFVDQCIMELASGTRASV

SEQ ID NO: 160619 - protein, 29 aa, Mycobacterium bovis
RRIESACKVWSAGVSASWLGRDLAEQSRV

SEQ ID NO: 160620 - protein, 18 aa, Mycobacterium bovis
RRITLEVLDGPGTPEVLG

SEQ ID NO: 160621 - protein, 19 aa, Mycobacterium bovis
RRLGAVPDIDSHAASAHLD

SEQ ID NO: 160622 - protein, 20 aa, Mycobacterium bovis
RSARELWAGCLLPMVNLLWA

SEQ ID NO: 160623 - protein, 22 aa, Mycobacterium bovis
RSGLPVVVSVVGLVHTPGLVTL

SEQ ID NO: 160624 - protein, 24 aa, Mycobacterium bovis
RSSTCAPIAWSRSFRHVQALETDP

SEQ ID NO: 160625 - protein, 22 aa, Mycobacterium bovis
RTFIRGSGWAELVGIGDVAAFD

SEQ ID NO: 160626 - protein, 17 aa, Mycobacterium bovis
RTGLAVLDCAADVVLTT

SEQ ID NO: 160627 - protein, 17 aa, Mycobacterium bovis
RTSIATSSPGRCDMSPI

SEQ ID NO: 160628 - protein, 19 aa, Mycobacterium bovis
RVDGLRSRWLGMPAGLRLT

SEQ ID NO: 160629 - protein, 27 aa, Mycobacterium bovis
RVGSMFGPYHLKRLLGRGGMGEVYEAE

SEQ ID NO: 160630 - protein, 27 aa, Mycobacterium bovis
RWFFGAGAWAASVVWFAVLGFSAGRLQ

SEQ ID NO: 160631 - protein, 27 aa, Mycobacterium bovis
RWLGMPAGLRLTVPVAAVLTMVGVAVY

SEQ ID NO: 160632 - protein, 18 aa, Mycobacterium bovis
RYSLGMVAATLALIVIPL

SEQ ID NO: 160633 - protein, 18 aa, Mycobacterium bovis
SAGRAVIVTGDFNARYSD

SEQ ID NO: 160634 - protein, 17 aa, Mycobacterium bovis
SATPVLLPDVVAAAPGM

SEQ ID NO: 160635 - protein, 19 aa, Mycobacterium bovis
SAVRFREAFFRDHGIDSVA

SEQ ID NO: 160636 - protein, 18 aa, Mycobacterium bovis
SCMVTFKTSYGVIQQSLF

SEQ ID NO: 160637 - protein, 24 aa, Mycobacterium bovis
SDYSPVFGCLFKGIARGVKEFAPL

SEQ ID NO: 160638 - protein, 18 aa, Mycobacterium bovis
SFLRPVLAPDYGRVARAV

SEQ ID NO: 160639 - protein, 26 aa, Mycobacterium bovis
SGNQARLKLAIDSGEMGFIPSNATVR

SEQ ID NO: 160640 - protein, 29 aa, Mycobacterium bovis
SGPWLPARWRHWWWALLLAFVPIHLVVSA

SEQ ID NO: 160641 - protein, 33 aa, Mycobacterium bovis
SLYALLVNRWPLPEAGVRSGLAPAERDTAGQPI

SEQ ID NO: 160642 - protein, 21 aa, Mycobacterium bovis
SMQKIIECGTGDFGAQASLYT

SEQ ID NO: 160643 - protein, 25 aa, Mycobacterium bovis
SPLALRVDGLRSRWLGMPAGLRLTV

SEQ ID NO: 160644 - protein, 28 aa, Mycobacterium bovis
SPVPRWSARWCWGWRWRCCSIDRCVDET

SEQ ID NO: 160645 - protein, 18 aa, Mycobacterium bovis
SPWARPGDQGPLARPPAS

SEQ ID NO: 160646 - protein, 18 aa, Mycobacterium bovis
SQIPGVAMVRGVTRPNGE

SEQ ID NO: 160647 - protein, 27 aa, Mycobacterium bovis
SQISAPRAKLFAALFLILALVVVGEVA

SEQ ID NO: 160648 - protein, 26 aa, Mycobacterium bovis
SSLRLWPDRRLSRRGVEIISRRAPRG

SEQ ID NO: 160649 - protein, 20 aa, Mycobacterium bovis
SSRAAAAAYCVADESIEAFR

SEQ ID NO: 160650 - protein, 17 aa, Mycobacterium bovis
STLARLVAGYTHPTDGT

SEQ ID NO: 160651 - protein, 24 aa, Mycobacterium bovis
SYRELPLRLFEFGTVYRYEKSGVV

SEQ ID NO: 160652 - protein, 22 aa, Mycobacterium bovis
TALCGYAVIYLAARNLAPNGFS

SEQ ID NO: 160653 - protein, 17 aa, Mycobacterium bovis
TAPRPATLYRLSVVDVL

SEQ ID NO: 160654 - protein, 20 aa, Mycobacterium bovis
TARWYLLKGRIADARSALRR

SEQ ID NO: 160655 - protein, 17 aa, Mycobacterium bovis
TAVPWARQRTAMIAAER

SEQ ID NO: 160656 - protein, 19 aa, Mycobacterium bovis
TAYISGWIPFWVTIPVNAA

SEQ ID NO: 160657 - protein, 28 aa, Mycobacterium bovis
TDPVPFPSFKNGVGLMLQLPQATVVGTV

SEQ ID NO: 160658 - protein, 23 aa, Mycobacterium bovis
TDRLEAVVMLLAVTVSLLTIPFA

SEQ ID NO: 160659 - protein, 22 aa, Mycobacterium bovis
TGRLRPGEPAGHIQEPVSPPTQ

SEQ ID NO: 160660 - protein, 23 aa, Mycobacterium bovis
TGRYKIFPVAGMALMAVAFLLMS

SEQ ID NO: 160661 - protein, 25 aa, Mycobacterium bovis
TIHALSLPIILFWVALTIVVNVVAP

SEQ ID NO: 160662 - protein, 21 aa, Mycobacterium bovis
TKITVPARWVVNGIERSGEVN

SEQ ID NO: 160663 - protein, 29 aa, Mycobacterium bovis
TKRRWRRIGTVVVRWPGPVLAATLLIALI

SEQ ID NO: 160664 - protein, 22 aa, Mycobacterium bovis
TLRLSRIDKPGVARVLDVVHTR

SEQ ID NO: 160665 - protein, 19 aa, Mycobacterium bovis
TMDAFDYFLVVLVYADIAT

SEQ ID NO: 160666 - protein, 20 aa, Mycobacterium bovis
TMLTRLQRALAHEQQFVADA

SEQ ID NO: 160667 - protein, 24 aa, Mycobacterium bovis
TMVGLLPAWQIVLILLLLGVLGLR

SEQ ID NO: 160668 - protein, 19 aa, Mycobacterium bovis
TPTKWVHHFGLFAAVGAAM

SEQ ID NO: 160669 - protein, 18 aa, Mycobacterium bovis
TRAERLNVVFLLAALQLV

SEQ ID NO: 160670 - protein, 18 aa, Mycobacterium bovis
TSEVDWVLERLGRELEAL

SEQ ID NO: 160671 - protein, 20 aa, Mycobacterium bovis
TSSPGRCDMSPIPRIVSVSL

SEQ ID NO: 160672 - protein, 31 aa, Mycobacterium bovis
TVLVILRLLYGIGMGGEWGLGAALSMEKVPA

SEQ ID NO: 160673 - protein, 23 aa, Mycobacterium bovis
TVSSPRAGLVMEKGAKVKYRGIQ

SEQ ID NO: 160674 - protein, 18 aa, Mycobacterium bovis
TWQPCVHSACAVIERFRD

SEQ ID NO: 160675 - protein, 17 aa, Mycobacterium bovis
TYIIGFRFYARLIEMKV

SEQ ID NO: 160676 - protein, 24 aa, Mycobacterium bovis
VAAAGDHRLRVIGVTWNAEASAQA

SEQ ID NO: 160677 - protein, 19 aa, Mycobacterium bovis
VALFFVWMITVAFLYLVLG

SEQ ID NO: 160678 - protein, 18 aa, Mycobacterium bovis
VALLVLASVLSRIFGDVS

SEQ ID NO: 160679 - protein, 17 aa, Mycobacterium bovis
VAMRNARHHAASMETLI

SEQ ID NO: 160680 - protein, 20 aa, Mycobacterium bovis
VAQSYWARIQLFLHGGDFGV

SEQ ID NO: 160681 - protein, 21 aa, Mycobacterium bovis
VASELLMPWPSAAASGVVGWR

SEQ ID NO: 160682 - protein, 20 aa, Mycobacterium bovis
VASGDCLMWPDGTPESAAIV

SEQ ID NO: 160683 - protein, 19 aa, Mycobacterium bovis
VAVYAWIRPLPDDWSQLPK

SEQ ID NO: 160684 - protein, 17 aa, Mycobacterium bovis
VCTDAEAILGIGDWGVG

SEQ ID NO: 160685 - protein, 17 aa, Mycobacterium bovis
VDGQMFLEMRLVEGTDL

SEQ ID NO: 160686 - protein, 22 aa, Mycobacterium bovis
VEASSLFRVSKLNCSITTSDGT

SEQ ID NO: 160687 - protein, 22 aa, Mycobacterium bovis
VEHPVTCPVPIAHTGDRKPIRS

SEQ ID NO: 160688 - protein, 26 aa, Mycobacterium bovis
VERRPSRLRRGWLVGIAATLLALAGG

SEQ ID NO: 160689 - protein, 21 aa, Mycobacterium bovis
VFPSATSRWVFEARPDLPTTV

SEQ ID NO: 160690 - protein, 17 aa, Mycobacterium bovis
VGFAMLGALTFVPIYLG

SEQ ID NO: 160691 - protein, 18 aa, Mycobacterium bovis
VGGTRWVVYEGSDENGAV

SEQ ID NO: 160692 - protein, 27 aa, Mycobacterium bovis
VGYALLPVLWIFSLSLKPTSTVKDGKL

SEQ ID NO: 160693 - protein, 25 aa, Mycobacterium bovis
VHTRAGGLVVAEWIRGGSLQEVADT

SEQ ID NO: 160694 - protein, 24 aa, Mycobacterium bovis
VLASLRDLGCRALLMSGRPDEGAL

SEQ ID NO: 160695 - protein, 36 aa, Mycobacterium bovis
VLDLEPRGPLPTEIYWRRRGLALGIAVVVVGIAVAI

SEQ ID NO: 160696 - protein, 17 aa, Mycobacterium bovis
VLHRAWVGPMVLVVLDD

SEQ ID NO: 160697 - protein, 25 aa, Mycobacterium bovis
VLLYAVCVVLRLARYNALQDDGTQP

SEQ ID NO: 160698 - protein, 27 aa, Mycobacterium bovis
VLNLLLVDFKGGATFLDLAGAPHVAAV

SEQ ID NO: 160699 - protein, 29 aa, Mycobacterium bovis
VLPWICAPLAIAVMWRWILAPTDGAISTV

SEQ ID NO: 160700 - protein, 18 aa, Mycobacterium bovis
VNQHDRLRVPIGVTPDGT

SEQ ID NO: 160701 - protein, 23 aa, Mycobacterium bovis
VPKSRRAVSLSVLIGAVIAALAG

SEQ ID NO: 160702 - protein, 17 aa, Mycobacterium bovis
VPLPRWYWIGLAVGILV

SEQ ID NO: 160703 - protein, 19 aa, Mycobacterium bovis
VPVRRLRAIETLAQAIAPV

SEQ ID NO: 160704 - protein, 23 aa, Mycobacterium bovis
VPWPAGAQVLIRFTGPEVWWVLR

SEQ ID NO: 160705 - protein, 18 aa, Mycobacterium bovis
VPWWWWPLAFALAALIAF

SEQ ID NO: 160706 - protein, 19 aa, Mycobacterium bovis
VQEDFAYHQFLIKKSKMPS

SEQ ID NO: 160707 - protein, 22 aa, Mycobacterium bovis
VRARCFLQGDSLYVAGVSGLGA

SEQ ID NO: 160708 - protein, 43 aa, Mycobacterium bovis
VRASMQIRRIDPWSTLKVSLLLSVALFFVWMITVAFLYLVLGG

SEQ ID NO: 160709 - protein, 18 aa, Mycobacterium bovis
VRASVNFATRVATIDAVG

SEQ ID NO: 160710 - protein, 26 aa, Mycobacterium bovis
VSDRNRAHWDWLKWLPHNQHPNACDA

SEQ ID NO: 160711 - protein, 17 aa, Mycobacterium bovis
VSGRLLFALLSFSVVGA

SEQ ID NO: 160712 - protein, 22 aa, Mycobacterium bovis
VSLGVGIVGWFHRQPHDKPSPA

SEQ ID NO: 160713 - protein, 20 aa, Mycobacterium bovis
VTLLPRRTPGSSGIADVPAQ

SEQ ID NO: 160714 - protein, 17 aa, Mycobacterium bovis
VTPLRLALERDTRAVDP

SEQ ID NO: 160715 - protein, 17 aa, Mycobacterium bovis
WAAAIGLMVPIGLAPPA

SEQ ID NO: 160716 - protein, 17 aa, Mycobacterium bovis
WELPIVLDSAAGFGSTY

SEQ ID NO: 160717 - protein, 18 aa, Mycobacterium bovis
WELPIVLDSAAGFGSTYA

SEQ ID NO: 160718 - protein, 25 aa, Mycobacterium bovis
WETGRSLWWPLAIGILGIAVLVGSF

SEQ ID NO: 160719 - protein, 24 aa, Mycobacterium bovis
WHIVGLCIFGFLLAMLRGNHVGHV

SEQ ID NO: 160720 - protein, 23 aa, Mycobacterium bovis
WIATACALTAWYVLYRSPDRRGV

SEQ ID NO: 160721 - protein, 17 aa, Mycobacterium bovis
WLEIPQFSVFDEIFRGI

SEQ ID NO: 160722 - protein, 22 aa, Mycobacterium bovis
WLGMPAGLRLTVPVAAVLTMVG

SEQ ID NO: 160723 - protein, 18 aa, Mycobacterium bovis
WPEDCAAAHMVPETLTVR

SEQ ID NO: 160724 - protein, 23 aa, Mycobacterium bovis
WRITLPMLRPTMFFVLVTGIISA

SEQ ID NO: 160725 - protein, 27 aa, Mycobacterium bovis
WVDAEPRLRALGWTGMLDKGADVDAGG

SEQ ID NO: 160726 - protein, 22 aa, Mycobacterium bovis
YAGAFPAWLAPVQVVGIPVADE

SEQ ID NO: 160727 - protein, 28 aa, Mycobacterium bovis
YALQWPLFAWFCVYAYRNFVRYEETPPQ

SEQ ID NO: 160728 - protein, 28 aa, Mycobacterium bovis
YAPLWRTAWRRLRQRPFQYILLVLGIAL

SEQ ID NO: 160729 - protein, 25 aa, Mycobacterium bovis
YDVVPSRLRRPGAVVLEIDDEDPIF

SEQ ID NO: 160730 - protein, 22 aa, Mycobacterium bovis
YEHYFRTFLRPEDVGWSVVEVV

SEQ ID NO: 160731 - protein, 18 aa, Mycobacterium bovis
YFRMGWWSIIGYAAAAII

SEQ ID NO: 160732 - protein, 17 aa, Mycobacterium bovis
YGEKVAFVAGWMYFLNW

SEQ ID NO: 160733 - protein, 21 aa, Mycobacterium bovis
YGNEAPKFFNSKGEPLSDHSP

SEQ ID NO: 160734 - protein, 21 aa, Mycobacterium bovis
YKADFDPYQFLLIPLARITGI

SEQ ID NO: 160735 - protein, 19 aa, Mycobacterium bovis
YLAAPRKTRAFMAALQSWL

SEQ ID NO: 160736 - protein, 19 aa, Mycobacterium bovis
YLAFGLMAALLLDATVVRM

SEQ ID NO: 160737 - protein, 24 aa, Mycobacterium bovis
YLLSRAALRPVDRIRAAAQTLTTT

SEQ ID NO: 160738 - protein, 19 aa, Mycobacterium bovis
YLPPEAFQNPDFQRGLKLF

SEQ ID NO: 160739 - protein, 40 aa, Mycobacterium bovis
YNIAGLPFPLSSAILPRFFYTKEIGKRLNAYYVANVQEDF

SEQ ID NO: 160740 - protein, 19 aa, Mycobacterium bovis
YPQMLLRVGWAPINADPLP

SEQ ID NO: 160741 - protein, 23 aa, Mycobacterium bovis
YRRVDIARVPDCAVVGAAAGGVI

SEQ ID NO: 160742 - protein, 17 aa, Mycobacterium bovis
YSCWPVPGGDIALMAAR

SEQ ID NO: 160743 - protein, 24 aa, Mycobacterium bovis
YVLVSTWLVVWGIWHVYFVEAVFP

SEQ ID NO: 160744 - protein, 18 aa, Mycobacterium bovis
YWLFHGGTIGKFKDLLIN

SEQ ID NO: 160745 - protein, 22 aa, Mycobacterium bovis
RTLPRWQRIVALTMIGISTALI

SEQ ID NO: 160746 - protein, 25 aa, Mycobacterium bovis
LGVVVGGPFLPLAIILYWFSNNIWT

SEQ ID NO: 160747 - protein, 19 aa, Mycobacterium bovis
SKHHLWIFAGIAAAILAGG

SEQ ID NO: 160748 - protein, 21 aa, Mycobacterium bovis
AAEHPELWGGLVDLAINDDLG

SEQ ID NO: 160749 - protein, 25 aa, Mycobacterium bovis
AAEWWRLGLMFAVIVALHLVGWLTV

SEQ ID NO: 160750 - protein, 19 aa, Mycobacterium bovis
AAKFGVEWLPAKGFITDRL

SEQ ID NO: 160751 - protein, 18 aa, Mycobacterium bovis
AALELAAFAAFGSAASAT

SEQ ID NO: 160752 - protein, 25 aa, Mycobacterium bovis
AAPLLGVLCSISWQRPVPVIQVHGD

SEQ ID NO: 160753 - protein, 23 aa, Mycobacterium bovis
AAPRCWQARAVSWMWQALAATLV

SEQ ID NO: 160754 - protein, 17 aa, Mycobacterium bovis
AASLLWYLKVVGSQPDF

SEQ ID NO: 160755 - protein, 20 aa, Mycobacterium bovis
AASVLPVWLLLAPRDYLSTF

SEQ ID NO: 160756 - protein, 18 aa, Mycobacterium bovis
AATIARRLGLTGALGTVA

SEQ ID NO: 160757 - protein, 18 aa, Mycobacterium bovis
ADEYRPVAATVRHQAFSG

SEQ ID NO: 160758 - protein, 20 aa, Mycobacterium bovis
ADKPAALWILTRGVHESVAP

SEQ ID NO: 160759 - protein, 18 aa, Mycobacterium bovis
ADLASIWRRCGGRTVTLF

SEQ ID NO: 160760 - protein, 22 aa, Mycobacterium bovis
ADRLPVVRLDWFTAENTATARQ

SEQ ID NO: 160761 - protein, 24 aa, Mycobacterium bovis
AEAFLPRRWRYGAQVTLALGGSAV

SEQ ID NO: 160762 - protein, 17 aa, Mycobacterium bovis
AELCAQYLAPVLDAIKF

SEQ ID NO: 160763 - protein, 17 aa, Mycobacterium bovis
AEPRLALFTVVSSFALA

SEQ ID NO: 160764 - protein, 19 aa, Mycobacterium bovis
AFFGWRWSLPLGVAILLAA

SEQ ID NO: 160765 - protein, 23 aa, Mycobacterium bovis
AFIPRFLFAVSFCGVLVATATYL

SEQ ID NO: 160766 - protein, 22 aa, Mycobacterium bovis
AFWACGLLLCVFIGPAQSSARA

SEQ ID NO: 160767 - protein, 19 aa, Mycobacterium bovis
AGAARPGLARAHRRKRSES

SEQ ID NO: 160768 - protein, 19 aa, Mycobacterium bovis
AGATAAWAIGRWTPGTERR

SEQ ID NO: 160769 - protein, 17 aa, Mycobacterium bovis
AGMLLWFLIALPIGAVT

SEQ ID NO: 160770 - protein, 18 aa, Mycobacterium bovis
AGNLRAAIELPLAATIGL

SEQ ID NO: 160771 - protein, 20 aa, Mycobacterium bovis
AGNRPRLVWYAPDHIEGEMS

SEQ ID NO: 160772 - protein, 24 aa, Mycobacterium bovis
AGPRLIDAYVDWLWFGELGYRSVF

SEQ ID NO: 160773 - protein, 18 aa, Mycobacterium bovis
AGTARLGFLASLLSRPVL

SEQ ID NO: 160774 - protein, 21 aa, Mycobacterium bovis
AGVILWCFFGDALSNRSHTAA

SEQ ID NO: 160775 - protein, 18 aa, Mycobacterium bovis
AHCVHRFGGVTGDVLGSA

SEQ ID NO: 160776 - protein, 24 aa, Mycobacterium bovis
AHGLGMPIPLGWQVWLYGVFAIIA

SEQ ID NO: 160777 - protein, 18 aa, Mycobacterium bovis
AHIKLAWRTGNFVIYAIT

SEQ ID NO: 160778 - protein, 17 aa, Mycobacterium bovis
AHRRVWRDREPALASPR

SEQ ID NO: 160779 - protein, 24 aa, Mycobacterium bovis
AIAIRVDWPRFWALITTPSSQTAL

SEQ ID NO: 160780 - protein, 20 aa, Mycobacterium bovis
AIGVLLGWPLWWVSTCSVLV

SEQ ID NO: 160781 - protein, 19 aa, Mycobacterium bovis
AILSLRLIPVVPFAAINYA

SEQ ID NO: 160782 - protein, 21 aa, Mycobacterium bovis
AILTLTGRRGWIKPRRDLTSR

SEQ ID NO: 160783 - protein, 19 aa, Mycobacterium bovis
AIPGRWRPAWIGWWVSLGL

SEQ ID NO: 160784 - protein, 19 aa, Mycobacterium bovis
AKGPLVFDLGICLVLITLP

SEQ ID NO: 160785 - protein, 22 aa, Mycobacterium bovis
ALAVGLKFKLGFDDSLDVVGVH

SEQ ID NO: 160786 - protein, 17 aa, Mycobacterium bovis
ALELTWEALEHARIPAS

SEQ ID NO: 160787 - protein, 20 aa, Mycobacterium bovis
ALFFPWNLYFGFRIPDSSKT

SEQ ID NO: 160788 - protein, 17 aa, Mycobacterium bovis
ALFPGIFGLFAVVVRLL

SEQ ID NO: 160789 - protein, 24 aa, Mycobacterium bovis
ALIRARFPTLTARQVMQRIESTAH

SEQ ID NO: 160790 - protein, 20 aa, Mycobacterium bovis
ALLAAWGWFTSLLVITGTIA

SEQ ID NO: 160791 - protein, 20 aa, Mycobacterium bovis
ALLGKWFWWPQVVRQRPVPQ

SEQ ID NO: 160792 - protein, 24 aa, Mycobacterium bovis
ALSAWRFVTVFGVVGLLADVVYEG

SEQ ID NO: 160793 - protein, 17 aa, Mycobacterium bovis
ALTELWCSYGVQPDLVI

SEQ ID NO: 160794 - protein, 17 aa, Mycobacterium bovis
ALWVVLAFIVFQAVAAV

SEQ ID NO: 160795 - protein, 24 aa, Mycobacterium bovis
AMFDRWNWWLPRWLAHILPSVDFD

SEQ ID NO: 160796 - protein, 17 aa, Mycobacterium bovis
AMGCAFVALLRPQSALG

SEQ ID NO: 160797 - protein, 23 aa, Mycobacterium bovis
AMPPSSVVGLWTFDGREGRTEVP

SEQ ID NO: 160798 - protein, 17 aa, Mycobacterium bovis
AMQEIPQVFGYDYQTVE

SEQ ID NO: 160799 - protein, 23 aa, Mycobacterium bovis
AMVARRAPRRWGVRSTVRDLDQQ

SEQ ID NO: 160800 - protein, 18 aa, Mycobacterium bovis
ANLLRYGYYPALILGLTV

SEQ ID NO: 160801 - protein, 23 aa, Mycobacterium bovis
APEAMWWTLYLACYLAGGWGSAW

SEQ ID NO: 160802 - protein, 20 aa, Mycobacterium bovis
APQWVRWALFLACYATGGWE

SEQ ID NO: 160803 - protein, 20 aa, Mycobacterium bovis
APRLRLAKRSLFDPMIVRSA

SEQ ID NO: 160804 - protein, 23 aa, Mycobacterium bovis
APSALRQSFLWGLAGVIAAEHPE

SEQ ID NO: 160805 - protein, 18 aa, Mycobacterium bovis
APWHVRAGAFAIDVLPGL

SEQ ID NO: 160806 - protein, 24 aa, Mycobacterium bovis
AQEWLKSILPFGGFPWGSVAFGQA

SEQ ID NO: 160807 - protein, 21 aa, Mycobacterium bovis
AQIPMYLGYAFRAMNSHGRAL

SEQ ID NO: 160808 - protein, 19 aa, Mycobacterium bovis
AQLRIGYATVVWVTSAYLL

SEQ ID NO: 160809 - protein, 18 aa, Mycobacterium bovis
AREAGRIAAREALPQIME

SEQ ID NO: 160810 - protein, 23 aa, Mycobacterium bovis
ARKRASTLGNFWVDLARTVLRIM

SEQ ID NO: 160811 - protein, 19 aa, Mycobacterium bovis
ARKRIAWLVLLANMVLAAV

SEQ ID NO: 160812 - protein, 17 aa, Mycobacterium bovis
ARLDGVLSRALATAPAD

SEQ ID NO: 160813 - protein, 26 aa, Mycobacterium bovis
ARPYQWWRLALVLASGLAYVVIFSLP

SEQ ID NO: 160814 - protein, 21 aa, Mycobacterium bovis
ARQHARRMVLVWVSVVLAITG

SEQ ID NO: 160815 - protein, 22 aa, Mycobacterium bovis
ARRRLVKLGAWVAAQLPTTRTA

SEQ ID NO: 160816 - protein, 28 aa, Mycobacterium bovis
ARSAFLVPLRVALAVLFLWGAAAALWTI

SEQ ID NO: 160817 - protein, 20 aa, Mycobacterium bovis
ARSQLWLSLLSWAVVVGCYL

SEQ ID NO: 160818 - protein, 18 aa, Mycobacterium bovis
ARVGEPFGSLVLAVAVTT

SEQ ID NO: 160819 - protein, 24 aa, Mycobacterium bovis
ASALAPPCIIAFLETRYWWAGIAL

SEQ ID NO: 160820 - protein, 19 aa, Mycobacterium bovis
ASAMLRRNLLIYGLGGLVV

SEQ ID NO: 160821 - protein, 22 aa, Mycobacterium bovis
ASQRLADCIARPLVPSIMIAAA

SEQ ID NO: 160822 - protein, 19 aa, Mycobacterium bovis
ASVALELLTGPSLLILDEP

SEQ ID NO: 160823 - protein, 20 aa, Mycobacterium bovis
ASVGLPGFLVGGVVRITRAS

SEQ ID NO: 160824 - protein, 18 aa, Mycobacterium bovis
ATALAWFPLWFVLLAVGW

SEQ ID NO: 160825 - protein, 21 aa, Mycobacterium bovis
ATALFPMYFLKSFAYAGVATV

SEQ ID NO: 160826 - protein, 20 aa, Mycobacterium bovis
ATDLRSPLLLAIVIAVVAVV

SEQ ID NO: 160827 - protein, 18 aa, Mycobacterium bovis
ATHYWKPLLLCFLVTLGG

SEQ ID NO: 160828 - protein, 17 aa, Mycobacterium bovis
ATIGTWVRMVINYLVPF

SEQ ID NO: 160829 - protein, 27 aa, Mycobacterium bovis
ATLLGRASWWPGHPWQRCAPEEGQMSA

SEQ ID NO: 160830 - protein, 19 aa, Mycobacterium bovis
ATLPVQFVAGWPILRGAVQ

SEQ ID NO: 160831 - protein, 20 aa, Mycobacterium bovis
AVLAVIWCWLLKRYIVEGPL

SEQ ID NO: 160832 - protein, 23 aa, Mycobacterium bovis
AVLCARGLVAQGLMFINQAAVSA

SEQ ID NO: 160833 - protein, 19 aa, Mycobacterium bovis
AVLGLRGRRPVKWNDPITL

SEQ ID NO: 160834 - protein, 19 aa, Mycobacterium bovis
AVQAPWPLLRTFAAGPALS

SEQ ID NO: 160835 - protein, 18 aa, Mycobacterium bovis
AVSSRAGVEIAIDDNGSG

SEQ ID NO: 160836 - protein, 18 aa, Mycobacterium bovis
AVTARIGIELGFAVLNHT

SEQ ID NO: 160837 - protein, 17 aa, Mycobacterium bovis
AVVAREFGFPCVVDAQG

SEQ ID NO: 160838 - protein, 18 aa, Mycobacterium bovis
AVVIFGFLLWHVIGANSS

SEQ ID NO: 160839 - protein, 20 aa, Mycobacterium bovis
AVVPHVRWPMWLRTAVATAA

SEQ ID NO: 160840 - protein, 19 aa, Mycobacterium bovis
AVYTPRWWLSGLLVGVASG

SEQ ID NO: 160841 - protein, 17 aa, Mycobacterium bovis
AWLRLCQTYGWAPGVMG

SEQ ID NO: 160842 - protein, 22 aa, Mycobacterium bovis
AWLVLHLVYLVGYRNRIAALFA

SEQ ID NO: 160843 - protein, 21 aa, Mycobacterium bovis
AWRNLRFPLAWAPPEADVARI

SEQ ID NO: 160844 - protein, 19 aa, Mycobacterium bovis
AWWLLAMALATLWWVMALT

SEQ ID NO: 160845 - protein, 21 aa, Mycobacterium bovis
CAGLLPPLLIRHGIDVGIRRH

SEQ ID NO: 160846 - protein, 19 aa, Mycobacterium bovis
CAPLAIAVMWRWILAPTDG

SEQ ID NO: 160847 - protein, 23 aa, Mycobacterium bovis
CERALREHVEWSLLDVLRGAPGA

SEQ ID NO: 160848 - protein, 18 aa, Mycobacterium bovis
CGAYKIGSTWHRTTTPTV

SEQ ID NO: 160849 - protein, 18 aa, Mycobacterium bovis
CGFTGLSGYIVWQHHEAT

SEQ ID NO: 160850 - protein, 17 aa, Mycobacterium bovis
CKGLEKIPLLGHLWSWE

SEQ ID NO: 160851 - protein, 19 aa, Mycobacterium bovis
CLGFTRLPYFNTLASPCAI

SEQ ID NO: 160852 - protein, 22 aa, Mycobacterium bovis
CLIAIPLRRDPLLFPFQPIHVT

SEQ ID NO: 160853 - protein, 20 aa, Mycobacterium bovis
CLSFARLTLFHTMGPPLAIG

SEQ ID NO: 160854 - protein, 20 aa, Mycobacterium bovis
CLSFTRLPYFQTLGVPLAIG

SEQ ID NO: 160855 - protein, 18 aa, Mycobacterium bovis
CPQTRITGVPGRGPETRT

SEQ ID NO: 160856 - protein, 19 aa, Mycobacterium bovis
CWWAPRWARRLQTRIGLGE

SEQ ID NO: 160857 - protein, 22 aa, Mycobacterium bovis
DALELRGRILGAFEAAEVSTDH

SEQ ID NO: 160858 - protein, 22 aa, Mycobacterium bovis
DATKAAARWIRPLVPPFVARML

SEQ ID NO: 160859 - protein, 18 aa, Mycobacterium bovis
DDVARSFADAGLDSVLSA

SEQ ID NO: 160860 - protein, 28 aa, Mycobacterium bovis
DELAAPRWPWVVGVAAIIAAVALVVSVS

SEQ ID NO: 160861 - protein, 22 aa, Mycobacterium bovis
DERKKRLGVMLATGLIVGESLY

SEQ ID NO: 160862 - protein, 21 aa, Mycobacterium bovis
DFLELLRYLAVELLPGPLGDL

SEQ ID NO: 160863 - protein, 19 aa, Mycobacterium bovis
DGDYAVAVARIFSTDVRFI

SEQ ID NO: 160864 - protein, 18 aa, Mycobacterium bovis
DGHPWRWFLIGFMVLFHL

SEQ ID NO: 160865 - protein, 22 aa, Mycobacterium bovis
DLAAGLVCWLLLSREVLPRLGP

SEQ ID NO: 160866 - protein, 23 aa, Mycobacterium bovis
DLADPAVVWALRLQGRVPHVVAQ

SEQ ID NO: 160867 - protein, 33 aa, Mycobacterium bovis
DPKRLLKVRGWRRVGTVVVRWPLPVLVATCAIA

SEQ ID NO: 160868 - protein, 24 aa, Mycobacterium bovis
DPVFLDWLVGLAFPCQRPFGHQYG

SEQ ID NO: 160869 - protein, 20 aa, Mycobacterium bovis
DRLKIPFGHELKTGNVMYLD

SEQ ID NO: 160870 - protein, 25 aa, Mycobacterium bovis
DRLYADRRIRLWVVYVENFSGQSAL

SEQ ID NO: 160871 - protein, 21 aa, Mycobacterium bovis
DRYQRCVDFARALGHRLGGAG

SEQ ID NO: 160872 - protein, 21 aa, Mycobacterium bovis
DVAQPLAYCLPGVRSRVVVSE

SEQ ID NO: 160873 - protein, 21 aa, Mycobacterium bovis
EAEPAAWLRFWFPDPNGSNTE

SEQ ID NO: 160874 - protein, 18 aa, Mycobacterium bovis
EAWYAFATAVPWARQRTA

SEQ ID NO: 160875 - protein, 24 aa, Mycobacterium bovis
EDIIRFQAEFLWRDYFQPGVSIDG

SEQ ID NO: 160876 - protein, 23 aa, Mycobacterium bovis
EDYLRLSALGSYGAFFNIYFCSV

SEQ ID NO: 160877 - protein, 20 aa, Mycobacterium bovis
EEERARWSLGRHVKLRGHDQ

SEQ ID NO: 160878 - protein, 20 aa, Mycobacterium bovis
EFAGYFAWLAWLVLHLVYLV

SEQ ID NO: 160879 - protein, 17 aa, Mycobacterium bovis
EFRCVSVDLLARRPVVH

SEQ ID NO: 160880 - protein, 18 aa, Mycobacterium bovis
EGRSFRSAVPRGWARARK

SEQ ID NO: 160881 - protein, 22 aa, Mycobacterium bovis
EIRKRWDRYAAFAEKTFNVTIP

SEQ ID NO: 160882 - protein, 22 aa, Mycobacterium bovis
EIRWNLRVIVMFSIGLVIATAV

SEQ ID NO: 160883 - protein, 24 aa, Mycobacterium bovis
EKHCYDIPSCWALRSVFDTIDGID

SEQ ID NO: 160884 - protein, 24 aa, Mycobacterium bovis
EKHCYDIPVCWSLRSVFDTLDGID

SEQ ID NO: 160885 - protein, 18 aa, Mycobacterium bovis
EKRPRLTMFDDFGGRIPS

SEQ ID NO: 160886 - protein, 22 aa, Mycobacterium bovis
ELTGQEAFVWIGLHEPDENQMQ

SEQ ID NO: 160887 - protein, 19 aa, Mycobacterium bovis
ENECARWSLGETVTLRGHD

SEQ ID NO: 160888 - protein, 18 aa, Mycobacterium bovis
EPDLRAIIELGYDRTGYA

SEQ ID NO: 160889 - protein, 23 aa, Mycobacterium bovis
EPICPPCGSFIRSYASDIDTAVA

SEQ ID NO: 160890 - protein, 18 aa, Mycobacterium bovis
EPPYRGGPVLADNAVIPV

SEQ ID NO: 160891 - protein, 21 aa, Mycobacterium bovis
ERPAGTIGEIWVHGDNVAIGY

SEQ ID NO: 160892 - protein, 19 aa, Mycobacterium bovis
ERRFHIALVGAMMVAALAL

SEQ ID NO: 160893 - protein, 19 aa, Mycobacterium bovis
ESGLRPGWHRVPGVSASGS

SEQ ID NO: 160894 - protein, 18 aa, Mycobacterium bovis
ESRLRAAGFIGFAIGGPL

SEQ ID NO: 160895 - protein, 23 aa, Mycobacterium bovis
ETTAPVWITMLWPLADRPRLAPG

SEQ ID NO: 160896 - protein, 20 aa, Mycobacterium bovis
EVWRCLRCGDFALGGPQGRG

SEQ ID NO: 160897 - protein, 19 aa, Mycobacterium bovis
EYLPMPWLFRHLSGYADRA

SEQ ID NO: 160898 - protein, 18 aa, Mycobacterium bovis
FAALRIASYALWPFGRTI

SEQ ID NO: 160899 - protein, 22 aa, Mycobacterium bovis
FAEGLQYWPWVLLGYFNIGIMI

SEQ ID NO: 160900 - protein, 20 aa, Mycobacterium bovis
FALRGRWALDYQGATSDGND

SEQ ID NO: 160901 - protein, 18 aa, Mycobacterium bovis
FASVNGWWYVSNFGVPWS

SEQ ID NO: 160902 - protein, 17 aa, Mycobacterium bovis
FCGLLWWIAFHMRDRPL

SEQ ID NO: 160903 - protein, 17 aa, Mycobacterium bovis
FDACGWRRLIFATPEEL

SEQ ID NO: 160904 - protein, 19 aa, Mycobacterium bovis
FDQLWRWNSIVALVLSVMV

SEQ ID NO: 160905 - protein, 17 aa, Mycobacterium bovis
FFARRIGRNEAFNHAGN

SEQ ID NO: 160906 - protein, 32 aa, Mycobacterium bovis
FFRMCVLTGKALFRWPFQWREFILQCWFIMRV

SEQ ID NO: 160907 - protein, 17 aa, Mycobacterium bovis
FFTMWGFFILLTVYIEA

SEQ ID NO: 160908 - protein, 19 aa, Mycobacterium bovis
FGAFAHRWLARRTRRRINP

SEQ ID NO: 160909 - protein, 17 aa, Mycobacterium bovis
FGAWLLFAGLWATFVYF

SEQ ID NO: 160910 - protein, 20 aa, Mycobacterium bovis
FGPYHLKRLLGRGGMGEVYE

SEQ ID NO: 160911 - protein, 18 aa, Mycobacterium bovis
FIRKPARWMQLLAKHQAP

SEQ ID NO: 160912 - protein, 19 aa, Mycobacterium bovis
FKGGSTFLGMEKLPHTAAV

SEQ ID NO: 160913 - protein, 17 aa, Mycobacterium bovis
FLLALCWATTNGWWYVS

SEQ ID NO: 160914 - protein, 21 aa, Mycobacterium bovis
FLTEPRYTWTIAEPDAAVTEF

SEQ ID NO: 160915 - protein, 19 aa, Mycobacterium bovis
FLVCLCVFRPPSIFGAQRA

SEQ ID NO: 160916 - protein, 17 aa, Mycobacterium bovis
FLWLRLARVWPVYLVTL

SEQ ID NO: 160917 - protein, 23 aa, Mycobacterium bovis
FMLREISCIFVAWFVLYLVLVLR

SEQ ID NO: 160918 - protein, 17 aa, Mycobacterium bovis
FPADRGWDVAGLFDPDP

SEQ ID NO: 160919 - protein, 20 aa, Mycobacterium bovis
FPGKRLLIGAALLITMFPSI

SEQ ID NO: 160920 - protein, 17 aa, Mycobacterium bovis
FRCFYLSAPFVVPKKKE

SEQ ID NO: 160921 - protein, 21 aa, Mycobacterium bovis
FRRIAAALGRPMVPIGSPVLR

SEQ ID NO: 160922 - protein, 17 aa, Mycobacterium bovis
FRRSELMLALATTAAVL

SEQ ID NO: 160923 - protein, 18 aa, Mycobacterium bovis
FRVPELLAGSFLLALLAV

SEQ ID NO: 160924 - protein, 18 aa, Mycobacterium bovis
FSVFGVFWGAFGLVTGAA

SEQ ID NO: 160925 - protein, 20 aa, Mycobacterium bovis
FSVWMLWSIVVVQMTAAAPG

SEQ ID NO: 160926 - protein, 17 aa, Mycobacterium bovis
FSVYRLHGIFGSHDTTS

SEQ ID NO: 160927 - protein, 18 aa, Mycobacterium bovis
FTQRLAAAANAFVNAEAT

SEQ ID NO: 160928 - protein, 17 aa, Mycobacterium bovis
FVQCRVVATGNSVDAVW

SEQ ID NO: 160929 - protein, 18 aa, Mycobacterium bovis
FVRHEHRAAFPLVDLKLF

SEQ ID NO: 160930 - protein, 17 aa, Mycobacterium bovis
FVSTYGWRAYALPVLMV

SEQ ID NO: 160931 - protein, 17 aa, Mycobacterium bovis
FWLPCLACLLAVAELQL

SEQ ID NO: 160932 - protein, 21 aa, Mycobacterium bovis
FWLRLMLRSAVCFVPHELSVR

SEQ ID NO: 160933 - protein, 19 aa, Mycobacterium bovis
FWRRAGTRIVRRPKAYLGA

SEQ ID NO: 160934 - protein, 18 aa, Mycobacterium bovis
FYRTCVLTGKALVRRPFH

SEQ ID NO: 160935 - protein, 18 aa, Mycobacterium bovis
GAAICLLALMATLATASR

SEQ ID NO: 160936 - protein, 22 aa, Mycobacterium bovis
GAALCLPLARALRRPTPSAMTT

SEQ ID NO: 160937 - protein, 17 aa, Mycobacterium bovis
GAAWALTVVHLRLSLLP

SEQ ID NO: 160938 - protein, 22 aa, Mycobacterium bovis
GACFRLTLPLVRGHKVTTSPLP

SEQ ID NO: 160939 - protein, 24 aa, Mycobacterium bovis
GAFLRLPYTFAIPIFGGRNWTTVS

SEQ ID NO: 160940 - protein, 17 aa, Mycobacterium bovis
GAGALGFVGTAGKESVG

SEQ ID NO: 160941 - protein, 25 aa, Mycobacterium bovis
GALPSVPRWLWIVLAIGFLTAALAG

SEQ ID NO: 160942 - protein, 23 aa, Mycobacterium bovis
GALTEVSWRWAFLVNVPIGLVMI

SEQ ID NO: 160943 - protein, 22 aa, Mycobacterium bovis
GATGVFLACRWAQADGADHAWL

SEQ ID NO: 160944 - protein, 18 aa, Mycobacterium bovis
GAVGRIFVGNAFPFEGYT

SEQ ID NO: 160945 - protein, 18 aa, Mycobacterium bovis
GDHRLRVIGVTWNAEASA

SEQ ID NO: 160946 - protein, 22 aa, Mycobacterium bovis
GDRGVSWLPFFHDMGLITVLLA

SEQ ID NO: 160947 - protein, 24 aa, Mycobacterium bovis
GEAPQRAWLWLGWLSAATVAGWVL

SEQ ID NO: 160948 - protein, 19 aa, Mycobacterium bovis
GFASLWSWFIGLVVTEFPL

SEQ ID NO: 160949 - protein, 22 aa, Mycobacterium bovis
GFFVGWSYWFAWVVTGIADLVA

SEQ ID NO: 160950 - protein, 20 aa, Mycobacterium bovis
GFWIRRARRLLPALVLMVLT

SEQ ID NO: 160951 - protein, 18 aa, Mycobacterium bovis
GGAPGCWQPITRDLWPAP

SEQ ID NO: 160952 - protein, 22 aa, Mycobacterium bovis
GGGRLAPRPVFRPPVDPASRQA

SEQ ID NO: 160953 - protein, 19 aa, Mycobacterium bovis
GGPLPRGRGLLMAEDTGVF

SEQ ID NO: 160954 - protein, 24 aa, Mycobacterium bovis
GGRALRWPRFPLVIEAAVAAVDHQ

SEQ ID NO: 160955 - protein, 24 aa, Mycobacterium bovis
GIARRAGAPISFWEFTRKGAVVTA

SEQ ID NO: 160956 - protein, 18 aa, Mycobacterium bovis
GIVPWWFVLTLLTRDALL

SEQ ID NO: 160957 - protein, 18 aa, Mycobacterium bovis
GKLFAGACVVWFFVLFDM

SEQ ID NO: 160958 - protein, 19 aa, Mycobacterium bovis
GKLPDAYRIIGRAGGIYGD

SEQ ID NO: 160959 - protein, 25 aa, Mycobacterium bovis
GLFDRIGNFVVRWPLIVIGCWIAVA

SEQ ID NO: 160960 - protein, 21 aa, Mycobacterium bovis
GLFDTWPGLILPYITFALPLA

SEQ ID NO: 160961 - protein, 18 aa, Mycobacterium bovis
GLFPTSWLPLLIVTSGVV

SEQ ID NO: 160962 - protein, 19 aa, Mycobacterium bovis
GLFYRYAWQNPVFADIVAT

SEQ ID NO: 160963 - protein, 19 aa, Mycobacterium bovis
GLGIALAHPWRSSGPRTSA

SEQ ID NO: 160964 - protein, 20 aa, Mycobacterium bovis
GLLGWCWRRGTAPGAPGSDF

SEQ ID NO: 160965 - protein, 20 aa, Mycobacterium bovis
GLRTRSEMIAQLVFAMGGRA

SEQ ID NO: 160966 - protein, 18 aa, Mycobacterium bovis
GLVGRSSVVYDMWGAAVS

SEQ ID NO: 160967 - protein, 19 aa, Mycobacterium bovis
GLWPPRLWAGLRLGWAAGA

SEQ ID NO: 160968 - protein, 18 aa, Mycobacterium bovis
GNEIARWAANLNTLAAQT

SEQ ID NO: 160969 - protein, 17 aa, Mycobacterium bovis
GNLVTWWTGDALLVFDA

SEQ ID NO: 160970 - protein, 25 aa, Mycobacterium bovis
GPGRYGLDAARGWAHRPFIGSFVAL

SEQ ID NO: 160971 - protein, 22 aa, Mycobacterium bovis
GPLADRSRRFWAWTIAGYTLTV

SEQ ID NO: 160972 - protein, 23 aa, Mycobacterium bovis
GPMLGISVAVVFFAAVTLLPALM

SEQ ID NO: 160973 - protein, 17 aa, Mycobacterium bovis
GPPPVMPPSLAWWASSL

SEQ ID NO: 160974 - protein, 21 aa, Mycobacterium bovis
GPQLPGPVPIPGAPGPMPAPP

SEQ ID NO: 160975 - protein, 17 aa, Mycobacterium bovis
GQANWWLPSSWRPATWW

SEQ ID NO: 160976 - protein, 20 aa, Mycobacterium bovis
GQEWRMVWDSALDRAEIGRG

SEQ ID NO: 160977 - protein, 24 aa, Mycobacterium bovis
GQFEGRLWIAMQFVDGGNAEDALR

SEQ ID NO: 160978 - protein, 17 aa, Mycobacterium bovis
GQTARLYIRPVLNSMPA

SEQ ID NO: 160979 - protein, 17 aa, Mycobacterium bovis
GRIGLLFAVMPFHAFFG

SEQ ID NO: 160980 - protein, 19 aa, Mycobacterium bovis
GRNTLLLPFRVAAVHLILW

SEQ ID NO: 160981 - protein, 19 aa, Mycobacterium bovis
GRTAQAWARRHQQLRAALT

SEQ ID NO: 160982 - protein, 19 aa, Mycobacterium bovis
GRTPLPPRRDWQLDTLDTE

SEQ ID NO: 160983 - protein, 20 aa, Mycobacterium bovis
GSALALAGVSAWLITRAWQM

SEQ ID NO: 160984 - protein, 20 aa, Mycobacterium bovis
GSFMLCAAFNVLLRGLCGRD

SEQ ID NO: 160985 - protein, 18 aa, Mycobacterium bovis
GSSFKVFALVAALEQGIG

SEQ ID NO: 160986 - protein, 18 aa, Mycobacterium bovis
GTFSRYWLAAAFGVTALV

SEQ ID NO: 160987 - protein, 24 aa, Mycobacterium bovis
GTMLLRLCMLPGLALLVWATPRLA

SEQ ID NO: 160988 - protein, 18 aa, Mycobacterium bovis
GTTIKLGIVWLVLSVFTV

SEQ ID NO: 160989 - protein, 27 aa, Mycobacterium bovis
GVAGLVDWPILLAVGGGALLLRKLNRT

SEQ ID NO: 160990 - protein, 22 aa, Mycobacterium bovis
GVALCAGLWFIGRRVIATVGHN

SEQ ID NO: 160991 - protein, 17 aa, Mycobacterium bovis
GVIWSGVVSKVIVPAVV

SEQ ID NO: 160992 - protein, 19 aa, Mycobacterium bovis
GVMRWRWRVAFYALSALGT

SEQ ID NO: 160993 - protein, 19 aa, Mycobacterium bovis
GVPLEWNVFFIFSLCYLFG

SEQ ID NO: 160994 - protein, 18 aa, Mycobacterium bovis
GWYYLRIPSLVGIGQYTL

SEQ ID NO: 160995 - protein, 23 aa, Mycobacterium bovis
GYAKIVGCALGFPVINIARSSAK

SEQ ID NO: 160996 - protein, 28 aa, Mycobacterium bovis
GYILASLHWYTWLAFSGWVAVAVIFYLM

SEQ ID NO: 160997 - protein, 20 aa, Mycobacterium bovis
GYLVLRPSWSPTQASGQTVL

SEQ ID NO: 160998 - protein, 20 aa, Mycobacterium bovis
HAAVWWKALLALAVAVALVI

SEQ ID NO: 160999 - protein, 22 aa, Mycobacterium bovis
HEGGHTLAAWAMPDIEPIYKVT

SEQ ID NO: 161000 - protein, 17 aa, Mycobacterium bovis
HFGELEFWFALIKVAAI

SEQ ID NO: 161001 - protein, 17 aa, Mycobacterium bovis
HFRCVSVDLLARRPVVH

SEQ ID NO: 161002 - protein, 17 aa, Mycobacterium bovis
HGKWPWQMTHPMDGAVQ

SEQ ID NO: 161003 - protein, 24 aa, Mycobacterium bovis
HKEYGSACNLVFPIGIIDRPYKHD

SEQ ID NO: 161004 - protein, 21 aa, Mycobacterium bovis
HLDPGPFLSYGIQWISFGILA

SEQ ID NO: 161005 - protein, 21 aa, Mycobacterium bovis
HMAGLPGWRAMFVIEALPALL

SEQ ID NO: 161006 - protein, 18 aa, Mycobacterium bovis
HRAAFPLVDLKLFAEPLY

SEQ ID NO: 161007 - protein, 22 aa, Mycobacterium bovis
HRRLWWALAGVVAFLGLVGAGV

SEQ ID NO: 161008 - protein, 18 aa, Mycobacterium bovis
HRYAIWIVGVWALAAIIG

SEQ ID NO: 161009 - protein, 20 aa, Mycobacterium bovis
HWPGYLFGRIRTSTLVLIAA

SEQ ID NO: 161010 - protein, 17 aa, Mycobacterium bovis
IAADLARPAETVRGWLR

SEQ ID NO: 161011 - protein, 22 aa, Mycobacterium bovis
IAALLGRWFWWPLRVRPRPASQ

SEQ ID NO: 161012 - protein, 22 aa, Mycobacterium bovis
IAALLGRWFWWPLRVRSRPART

SEQ ID NO: 161013 - protein, 21 aa, Mycobacterium bovis
IAALLGRWFWWPNMIHSRPTV

SEQ ID NO: 161014 - protein, 27 aa, Mycobacterium bovis
IAEGLRFVWNLRVLRTLGMIDLTVTAL

SEQ ID NO: 161015 - protein, 22 aa, Mycobacterium bovis
IAIAVPAHWKPGAVHALRNGLR

SEQ ID NO: 161016 - protein, 22 aa, Mycobacterium bovis
IATACPFCRVMVTDGVNDRQEE

SEQ ID NO: 161017 - protein, 20 aa, Mycobacterium bovis
IAVFCGFAFAGMPLVAEIGV

SEQ ID NO: 161018 - protein, 23 aa, Mycobacterium bovis
IAVLLGRWFWWPQRVRPRPASRM

SEQ ID NO: 161019 - protein, 19 aa, Mycobacterium bovis
IAVSLIVYVFFIKNKADTY

SEQ ID NO: 161020 - protein, 27 aa, Mycobacterium bovis
ICGAFGYGLGVFAVWLVRYMRSHNSSP

SEQ ID NO: 161021 - protein, 18 aa, Mycobacterium bovis
IDGPLSFLSVDGVFGSLR

SEQ ID NO: 161022 - protein, 19 aa, Mycobacterium bovis
IDQRLKRFGAMAAAMVLYV

SEQ ID NO: 161023 - protein, 22 aa, Mycobacterium bovis
IDVVHWPGYLLIVAGVVGGVGA

SEQ ID NO: 161024 - protein, 19 aa, Mycobacterium bovis
IEHQRHWSLRRGVGASGPQ

SEQ ID NO: 161025 - protein, 20 aa, Mycobacterium bovis
IGGLLVEWAGWRWVLLVNVP

SEQ ID NO: 161026 - protein, 18 aa, Mycobacterium bovis
IGIAWPHLTVRAMDSVAD

SEQ ID NO: 161027 - protein, 22 aa, Mycobacterium bovis
IGLSFLGLCHLWAGSPEAPESR

SEQ ID NO: 161028 - protein, 18 aa, Mycobacterium bovis
IGLVRWYLGTALFDSIAR

SEQ ID NO: 161029 - protein, 19 aa, Mycobacterium bovis
IGSVGRWVAVVAVLAVLTV

SEQ ID NO: 161030 - protein, 23 aa, Mycobacterium bovis
IGWPETIFRFALYAFLCATALMV

SEQ ID NO: 161031 - protein, 24 aa, Mycobacterium bovis
IHAFAVPIILGWLAVCVVVTVFVP

SEQ ID NO: 161032 - protein, 17 aa, Mycobacterium bovis
IILGWLVTIAVLNVTVP

SEQ ID NO: 161033 - protein, 17 aa, Mycobacterium bovis
IKFFNWIGTMWKGQLTF

SEQ ID NO: 161034 - protein, 17 aa, Mycobacterium bovis
IKLGIVWLVLSVFTVMI

SEQ ID NO: 161035 - protein, 17 aa, Mycobacterium bovis
IKPAIVVALLFRTLDAF

SEQ ID NO: 161036 - protein, 17 aa, Mycobacterium bovis
IKYKVGPTIAWYQDFLR

SEQ ID NO: 161037 - protein, 17 aa, Mycobacterium bovis
ILARFPGLYLQSLGLTF

SEQ ID NO: 161038 - protein, 21 aa, Mycobacterium bovis
ILGWASGLGFGWINTLGTANV

SEQ ID NO: 161039 - protein, 17 aa, Mycobacterium bovis
ILLPHSRPAVLVLGVLT

SEQ ID NO: 161040 - protein, 18 aa, Mycobacterium bovis
ILPVLPVIFFSGAQSVDA

SEQ ID NO: 161041 - protein, 24 aa, Mycobacterium bovis
ILTSVWLFDCWRLLVRPPHAGRRR

SEQ ID NO: 161042 - protein, 18 aa, Mycobacterium bovis
ILYIISFSLFIYGLMGLT

SEQ ID NO: 161043 - protein, 19 aa, Mycobacterium bovis
IPGLAHFFTMWGFFILLTV

SEQ ID NO: 161044 - protein, 25 aa, Mycobacterium bovis
IPVPIIIPPFPGWQPGMPTIPTAPP

SEQ ID NO: 161045 - protein, 27 aa, Mycobacterium bovis
IRLAAIPILLCWLGFTVFVSVVVPPLE

SEQ ID NO: 161046 - protein, 22 aa, Mycobacterium bovis
IRNWPAWLGVYGFMTLDRWLLF

SEQ ID NO: 161047 - protein, 22 aa, Mycobacterium bovis
IRRLSLPILLFWVGVAAITNAA

SEQ ID NO: 161048 - protein, 23 aa, Mycobacterium bovis
ISGWRAGALGSMLSFGGVLLGAT

SEQ ID NO: 161049 - protein, 18 aa, Mycobacterium bovis
ITLPMLRPTMFFVLVTGI

SEQ ID NO: 161050 - protein, 17 aa, Mycobacterium bovis
ITPLRIAFLILLVGTTL

SEQ ID NO: 161051 - protein, 23 aa, Mycobacterium bovis
ITPSEAFTAWEFVDGYDVAQAVV

SEQ ID NO: 161052 - protein, 25 aa, Mycobacterium bovis
ITRSFALVRHGFWRVLGIRLLTVLV

SEQ ID NO: 161053 - protein, 19 aa, Mycobacterium bovis
IVDPEFGYDIGFFVFDLPF

SEQ ID NO: 161054 - protein, 18 aa, Mycobacterium bovis
IVRLLAWQGAALAAIPLL

SEQ ID NO: 161055 - protein, 19 aa, Mycobacterium bovis
KDSFPASFIVKLENPEQHK

SEQ ID NO: 161056 - protein, 21 aa, Mycobacterium bovis
KEVRFGVGASGLWAASTTGTS

SEQ ID NO: 161057 - protein, 18 aa, Mycobacterium bovis
KFTWHWWWLGAAALGVLL

SEQ ID NO: 161058 - protein, 19 aa, Mycobacterium bovis
KGANFTAAMAFEIGSTNLV

SEQ ID NO: 161059 - protein, 24 aa, Mycobacterium bovis
KHCFDVPLCWSIRSIFDMFDSVDQ

SEQ ID NO: 161060 - protein, 18 aa, Mycobacterium bovis
KHCYGIPICWSFRSIFDA

SEQ ID NO: 161061 - protein, 20 aa, Mycobacterium bovis
KHPRLRVRWVMRRDEKSLAE

SEQ ID NO: 161062 - protein, 26 aa, Mycobacterium bovis
KKGRLKWAWIPGIPLLWDLAVTLTAS

SEQ ID NO: 161063 - protein, 18 aa, Mycobacterium bovis
KMTTEWLHVPFLPVPIPV

SEQ ID NO: 161064 - protein, 18 aa, Mycobacterium bovis
KPLLLCFLVTLGGTVAFY

SEQ ID NO: 161065 - protein, 22 aa, Mycobacterium bovis
KPPRLYRAAAWVVIVAGIVFTV

SEQ ID NO: 161066 - protein, 18 aa, Mycobacterium bovis
KPVPVILILLMLISGGAT

SEQ ID NO: 161067 - protein, 17 aa, Mycobacterium bovis
KRLAEAVGIVLELLAGI

SEQ ID NO: 161068 - protein, 25 aa, Mycobacterium bovis
KRPSRWRHVPAILLVLSLLLFTIAM

SEQ ID NO: 161069 - protein, 19 aa, Mycobacterium bovis
KRWGEYFAVVATSIFLPLE

SEQ ID NO: 161070 - protein, 19 aa, Mycobacterium bovis
KVGPTIAWYQDFLRYYFLT

SEQ ID NO: 161071 - protein, 20 aa, Mycobacterium bovis
KVSLLLSVALFFVWMITVAF

SEQ ID NO: 161072 - protein, 19 aa, Mycobacterium bovis
KVVNLRSAPGFSFVSEDLD

SEQ ID NO: 161073 - protein, 17 aa, Mycobacterium bovis
KYGKWTIILARFVPIAR

SEQ ID NO: 161074 - protein, 17 aa, Mycobacterium bovis
LAARFGFLLAIPAVFAS

SEQ ID NO: 161075 - protein, 18 aa, Mycobacterium bovis
LAAVAVIVAVVFTVVVNK

SEQ ID NO: 161076 - protein, 17 aa, Mycobacterium bovis
LAEAVGIVLELLAGIPS

SEQ ID NO: 161077 - protein, 18 aa, Mycobacterium bovis
LAELGWICVAINYRHSPR

SEQ ID NO: 161078 - protein, 18 aa, Mycobacterium bovis
LAELLAMRGIDGLPFSWT

SEQ ID NO: 161079 - protein, 23 aa, Mycobacterium bovis
LAGGPWDWARWAPASPWATPPAV

SEQ ID NO: 161080 - protein, 17 aa, Mycobacterium bovis
LAGVSAWLITRAWQMPP

SEQ ID NO: 161081 - protein, 19 aa, Mycobacterium bovis
LAKLARAGFRVSDVKPPSS

SEQ ID NO: 161082 - protein, 17 aa, Mycobacterium bovis
LALIPAFVYVVLSAHAN

SEQ ID NO: 161083 - protein, 17 aa, Mycobacterium bovis
LALSFASVNGWWYVSNF

SEQ ID NO: 161084 - protein, 17 aa, Mycobacterium bovis
LAMALATLWWVMALTQL

SEQ ID NO: 161085 - protein, 21 aa, Mycobacterium bovis
LAMALTCWWVISREVIPRLGH

SEQ ID NO: 161086 - protein, 23 aa, Mycobacterium bovis
LANWKISAAYLNWLADRLQRTKT

SEQ ID NO: 161087 - protein, 17 aa, Mycobacterium bovis
LARIWPPWEFYFWHHTI

SEQ ID NO: 161088 - protein, 21 aa, Mycobacterium bovis
LAVAVLARWRFRRRPAPARLP

SEQ ID NO: 161089 - protein, 18 aa, Mycobacterium bovis
LAVAWPLAAVVRGHDWGT

SEQ ID NO: 161090 - protein, 19 aa, Mycobacterium bovis
LCTDDLRVARIRGCGADEL

SEQ ID NO: 161091 - protein, 17 aa, Mycobacterium bovis
LDALGFAGTIPKSAPGS

SEQ ID NO: 161092 - protein, 17 aa, Mycobacterium bovis
LDGVLSRALATAPADRF

SEQ ID NO: 161093 - protein, 22 aa, Mycobacterium bovis
LDPLLPFPRWHEHAAMVEEPVR

SEQ ID NO: 161094 - protein, 18 aa, Mycobacterium bovis
LDQPRIYFGPVISNTSAD

SEQ ID NO: 161095 - protein, 19 aa, Mycobacterium bovis
LDVLRRVAIDLDRSQKAAS

SEQ ID NO: 161096 - protein, 18 aa, Mycobacterium bovis
LDWVAWRGLGLAADAQLV

SEQ ID NO: 161097 - protein, 20 aa, Mycobacterium bovis
LEAFLKRRVRTHGLLTASIA

SEQ ID NO: 161098 - protein, 17 aa, Mycobacterium bovis
LELATPYALNAVSDDER

SEQ ID NO: 161099 - protein, 26 aa, Mycobacterium bovis
LFGPRLVDIYVDWLWFGEVGFRSVWI

SEQ ID NO: 161100 - protein, 19 aa, Mycobacterium bovis
LFGQLPLPLGVVGHEGSTV

SEQ ID NO: 161101 - protein, 18 aa, Mycobacterium bovis
LFIPRFLFSMGVIGVVAA

SEQ ID NO: 161102 - protein, 18 aa, Mycobacterium bovis
LFVAAYVPYVAWLVQASA

SEQ ID NO: 161103 - protein, 18 aa, Mycobacterium bovis
LFVGWLWPLWDSRRRTFA

SEQ ID NO: 161104 - protein, 17 aa, Mycobacterium bovis
LFWFFGHPEVYIIALPF

SEQ ID NO: 161105 - protein, 22 aa, Mycobacterium bovis
LGDFWGYLAGWGFVVGKTASCA

SEQ ID NO: 161106 - protein, 23 aa, Mycobacterium bovis
LGDWTIFYWGWWISWAPFVGMFI

SEQ ID NO: 161107 - protein, 17 aa, Mycobacterium bovis
LGEILGFGGMSEVHLAR

SEQ ID NO: 161108 - protein, 18 aa, Mycobacterium bovis
LGGWRIIRTLGKGLVEIK

SEQ ID NO: 161109 - protein, 20 aa, Mycobacterium bovis
LGIPCAVGMLVAVAVALTLG

SEQ ID NO: 161110 - protein, 20 aa, Mycobacterium bovis
LGRLRFGALYAVSALGGSVL

SEQ ID NO: 161111 - protein, 17 aa, Mycobacterium bovis
LGTVIGFYGLTIDEPPT

SEQ ID NO: 161112 - protein, 17 aa, Mycobacterium bovis
LGWYFLRIPSLVGIGRY

SEQ ID NO: 161113 - protein, 21 aa, Mycobacterium bovis
LGYGDPRFGYSTSPANVPTPF

SEQ ID NO: 161114 - protein, 19 aa, Mycobacterium bovis
LHLGGICWRGRNQRPVITG

SEQ ID NO: 161115 - protein, 19 aa, Mycobacterium bovis
LHQPYLMGCLSPRNELSQI

SEQ ID NO: 161116 - protein, 24 aa, Mycobacterium bovis
LIRTPELYAWILVLPIGLMLQQSS

SEQ ID NO: 161117 - protein, 19 aa, Mycobacterium bovis
LKAAECRAGARAWRRHEPQ

SEQ ID NO: 161118 - protein, 21 aa, Mycobacterium bovis
LLANLFLPWGIAGAAPTALDV

SEQ ID NO: 161119 - protein, 24 aa, Mycobacterium bovis
LLDTWIWRWVAFLLVFAIMVVVTA

SEQ ID NO: 161120 - protein, 19 aa, Mycobacterium bovis
LLGAICLLGTLWLVMRARS

SEQ ID NO: 161121 - protein, 20 aa, Mycobacterium bovis
LLGDRYGRRRSFVFGVTLFV

SEQ ID NO: 161122 - protein, 21 aa, Mycobacterium bovis
LLGFRLTCYYYRKAYYRSVWQ

SEQ ID NO: 161123 - protein, 17 aa, Mycobacterium bovis
LLGTLWLVMRARSSAPA

SEQ ID NO: 161124 - protein, 18 aa, Mycobacterium bovis
LLGVIAFRALVLANPEQR

SEQ ID NO: 161125 - protein, 18 aa, Mycobacterium bovis
LLGVPGWVTQRLWWAVLL

SEQ ID NO: 161126 - protein, 18 aa, Mycobacterium bovis
LLHDWRDVFWINVPLTAI

SEQ ID NO: 161127 - protein, 18 aa, Mycobacterium bovis
LLLARWLLFRVEFGAGLI

SEQ ID NO: 161128 - protein, 18 aa, Mycobacterium bovis
LLLEVAWEALEHAGIPPG

SEQ ID NO: 161129 - protein, 19 aa, Mycobacterium bovis
LLLEVSWEALERAGIDPIT

SEQ ID NO: 161130 - protein, 17 aa, Mycobacterium bovis
LLLVVGVSLAYLYVVLL

SEQ ID NO: 161131 - protein, 22 aa, Mycobacterium bovis
LLQMAFRFWAFRRWVFPDEFAR

SEQ ID NO: 161132 - protein, 23 aa, Mycobacterium bovis
LLSELPAVAWVWFQLFVDILGFN

SEQ ID NO: 161133 - protein, 17 aa, Mycobacterium bovis
LNSAFSFGGPKCLVKVI

SEQ ID NO: 161134 - protein, 17 aa, Mycobacterium bovis
LPARFGVEQVRELASRD

SEQ ID NO: 161135 - protein, 21 aa, Mycobacterium bovis
LPASVPVWLVWHIPGGTVWAE

SEQ ID NO: 161136 - protein, 19 aa, Mycobacterium bovis
LPAVIWWACHRPNRLWWRY

SEQ ID NO: 161137 - protein, 17 aa, Mycobacterium bovis
LPEFSFWAWLAMLFSAG

SEQ ID NO: 161138 - protein, 21 aa, Mycobacterium bovis
LPFYRLMLSYMLVSVFLAFVA

SEQ ID NO: 161139 - protein, 23 aa, Mycobacterium bovis
LPGSAPRPAWLRAFAHPERDKRV

SEQ ID NO: 161140 - protein, 18 aa, Mycobacterium bovis
LPQTRWIPVVTFVQVSAD

SEQ ID NO: 161141 - protein, 24 aa, Mycobacterium bovis
LPVTWEMSFLYAIVFGGFVAFSNY

SEQ ID NO: 161142 - protein, 17 aa, Mycobacterium bovis
LPWLRIAILGTPAILVS

SEQ ID NO: 161143 - protein, 22 aa, Mycobacterium bovis
LQADCYAGVWAYYASTVKQEST

SEQ ID NO: 161144 - protein, 17 aa, Mycobacterium bovis
LQGADQLLVRWRQANDR

SEQ ID NO: 161145 - protein, 22 aa, Mycobacterium bovis
LQRLPGRCWPVAATATATWAAL

SEQ ID NO: 161146 - protein, 20 aa, Mycobacterium bovis
LRAAIELPLAATIGLAALGG

SEQ ID NO: 161147 - protein, 18 aa, Mycobacterium bovis
LRGRATLYLTYWTAGDTR

SEQ ID NO: 161148 - protein, 19 aa, Mycobacterium bovis
LRITRWFAVRWGAERSLVV

SEQ ID NO: 161149 - protein, 18 aa, Mycobacterium bovis
LRKDLTWWDLVVFGVSVV

SEQ ID NO: 161150 - protein, 18 aa, Mycobacterium bovis
LRLCQTYGWAPGVMGASS

SEQ ID NO: 161151 - protein, 17 aa, Mycobacterium bovis
LRLPATFGIGTYGVSAD

SEQ ID NO: 161152 - protein, 19 aa, Mycobacterium bovis
LRLRWSWRGLRLGLMFGFG

SEQ ID NO: 161153 - protein, 19 aa, Mycobacterium bovis
LRSGSPILFYPAGALAITV

SEQ ID NO: 161154 - protein, 17 aa, Mycobacterium bovis
LRVAGALRNVIADSQRR

SEQ ID NO: 161155 - protein, 18 aa, Mycobacterium bovis
LRVTRWDVGLAMLIAGGV

SEQ ID NO: 161156 - protein, 18 aa, Mycobacterium bovis
LSAAAGWYVDAEAANAAL

SEQ ID NO: 161157 - protein, 26 aa, Mycobacterium bovis
LSAFFTPRFVRWFGLFTTHAIVAAAL

SEQ ID NO: 161158 - protein, 19 aa, Mycobacterium bovis
LSFTRLPYFQSLGIPASIG

SEQ ID NO: 161159 - protein, 21 aa, Mycobacterium bovis
LSGRFCVPVVRTPRPQLTAAF

SEQ ID NO: 161160 - protein, 18 aa, Mycobacterium bovis
LSQLPVLRWVDNSGNRAN

SEQ ID NO: 161161 - protein, 18 aa, Mycobacterium bovis
LTAIHLFAGAPPVDRSHT

SEQ ID NO: 161162 - protein, 18 aa, Mycobacterium bovis
LTALTWPVMANFAVDSAM

SEQ ID NO: 161163 - protein, 18 aa, Mycobacterium bovis
LTAVPLWIAFALGAKPAT

SEQ ID NO: 161164 - protein, 20 aa, Mycobacterium bovis
LTVVHLRLSLLPVLIGLMSA

SEQ ID NO: 161165 - protein, 19 aa, Mycobacterium bovis
LVAEIGVACAVAIAVDATV

SEQ ID NO: 161166 - protein, 24 aa, Mycobacterium bovis
LVAIAVLCAVSFFTAIFLRDLRIP

SEQ ID NO: 161167 - protein, 18 aa, Mycobacterium bovis
LVASAWWLFAWELDNGAG

SEQ ID NO: 161168 - protein, 22 aa, Mycobacterium bovis
LVAVLYRWFPPITVWTGLSLLA

SEQ ID NO: 161169 - protein, 22 aa, Mycobacterium bovis
LVGACLRFPYTFATAKFGGRNW

SEQ ID NO: 161170 - protein, 23 aa, Mycobacterium bovis
LVGELLCFVGMLIGIPVAALIHV

SEQ ID NO: 161171 - protein, 19 aa, Mycobacterium bovis
LVLRRRFKPALVLEDIEKH

SEQ ID NO: 161172 - protein, 19 aa, Mycobacterium bovis
LVWLLWVVIARGWFAVTRS

SEQ ID NO: 161173 - protein, 18 aa, Mycobacterium bovis
LVWRRVSDGWAFMCTLIV

SEQ ID NO: 161174 - protein, 17 aa, Mycobacterium bovis
LWLPTYLAWFVGGMMLA

SEQ ID NO: 161175 - protein, 23 aa, Mycobacterium bovis
LWRGLLVFFSRWWQLETLYRSNM

SEQ ID NO: 161176 - protein, 19 aa, Mycobacterium bovis
LWSRLPSCLAIGAAAAGVV

SEQ ID NO: 161177 - protein, 18 aa, Mycobacterium bovis
LYLDGGLQFCTRDEYRYT

SEQ ID NO: 161178 - protein, 22 aa, Mycobacterium bovis
LYLRLGDWVPVTAFVVMGAGFA

SEQ ID NO: 161179 - protein, 26 aa, Mycobacterium bovis
LYRLLTCWLPVFAGWQVMHWLTRHEM

SEQ ID NO: 161180 - protein, 19 aa, Mycobacterium bovis
MAGLRRWLGPLSILLVLWG

SEQ ID NO: 161181 - protein, 20 aa, Mycobacterium bovis
MAIFYLRLPATFGIGTYGVS

SEQ ID NO: 161182 - protein, 17 aa, Mycobacterium bovis
MATLRIAFLSALVLELL

SEQ ID NO: 161183 - protein, 18 aa, Mycobacterium bovis
MDRWDRRWVLVGANTGRL

SEQ ID NO: 161184 - protein, 18 aa, Mycobacterium bovis
MFFRGALYTALGRRYPVT

SEQ ID NO: 161185 - protein, 20 aa, Mycobacterium bovis
MFPALAVAVTSQFAEPDDAE

SEQ ID NO: 161186 - protein, 24 aa, Mycobacterium bovis
MGLPPWMVFCSWSLNLIYQFWVHT

SEQ ID NO: 161187 - protein, 21 aa, Mycobacterium bovis
MGRIKDLLIVYGRNHSPDDIE

SEQ ID NO: 161188 - protein, 25 aa, Mycobacterium bovis
MHVTGRWNWWAPRPLAWLHERFGVS

SEQ ID NO: 161189 - protein, 18 aa, Mycobacterium bovis
MKELLASKDNKAWNLPIT

SEQ ID NO: 161190 - protein, 21 aa, Mycobacterium bovis
MLGDLPWWVTVLILTRELGVT

SEQ ID NO: 161191 - protein, 17 aa, Mycobacterium bovis
MLPFSWQGVCLHASGAA

SEQ ID NO: 161192 - protein, 23 aa, Mycobacterium bovis
MLSVPRWAVGPVMELGTDHRRIE

SEQ ID NO: 161193 - protein, 17 aa, Mycobacterium bovis
MLWLYQRVMTGPIAEGN

SEQ ID NO: 161194 - protein, 18 aa, Mycobacterium bovis
MPSSFSMHGPWVDVAAPA

SEQ ID NO: 161195 - protein, 19 aa, Mycobacterium bovis
MQGLPSPYLTIAFPNRPPQ

SEQ ID NO: 161196 - protein, 18 aa, Mycobacterium bovis
MQWRKRRLVITIISTGLI

SEQ ID NO: 161197 - protein, 23 aa, Mycobacterium bovis
MSNWECVRRVTLPWVSSGIVGAV

SEQ ID NO: 161198 - protein, 17 aa, Mycobacterium bovis
MVALCLGGGVFGLSLGK

SEQ ID NO: 161199 - protein, 20 aa, Mycobacterium bovis
MWQWREHRGPQMVAGLSIGL

SEQ ID NO: 161200 - protein, 20 aa, Mycobacterium bovis
NASSVALIWFGGLRIDSGQM

SEQ ID NO: 161201 - protein, 23 aa, Mycobacterium bovis
NCQRAIPHVVGWYQAYKDSGLAV

SEQ ID NO: 161202 - protein, 22 aa, Mycobacterium bovis
NEGGPCWSMRLNAVEPPKGPAW

SEQ ID NO: 161203 - protein, 20 aa, Mycobacterium bovis
NEGRGDFFAVVRSLALFVNA

SEQ ID NO: 161204 - protein, 24 aa, Mycobacterium bovis
NGLRPEPIIALGILLTWCSVERAV

SEQ ID NO: 161205 - protein, 25 aa, Mycobacterium bovis
NGLRPEPLIALGVLVTWVLVERSIA

SEQ ID NO: 161206 - protein, 23 aa, Mycobacterium bovis
NLKLLMPVFRWQRRDNLLTEPDP

SEQ ID NO: 161207 - protein, 19 aa, Mycobacterium bovis
NLRCVCLAPPYASHDTLAM

SEQ ID NO: 161208 - protein, 17 aa, Mycobacterium bovis
NRFVQCRVVATGNSVDA

SEQ ID NO: 161209 - protein, 21 aa, Mycobacterium bovis
NRLLTRWARDYITVIGAIVLP

SEQ ID NO: 161210 - protein, 21 aa, Mycobacterium bovis
NRLWWRYTAWWLLAMALATLW

SEQ ID NO: 161211 - protein, 21 aa, Mycobacterium bovis
NSFPKWRWSLTTALLELTVLV

SEQ ID NO: 161212 - protein, 19 aa, Mycobacterium bovis
NSVDAVWKPLLPGYTRPHM

SEQ ID NO: 161213 - protein, 21 aa, Mycobacterium bovis
NTAGWRPGPIRALLATRPAAF

SEQ ID NO: 161214 - protein, 18 aa, Mycobacterium bovis
NVVPRPGTSPGVGGTPAS

SEQ ID NO: 161215 - protein, 24 aa, Mycobacterium bovis
NYFGDACVWWGLWLITINDWAPLA

SEQ ID NO: 161216 - protein, 19 aa, Mycobacterium bovis
PAILFCFGFFLLVFTGGGI

SEQ ID NO: 161217 - protein, 18 aa, Mycobacterium bovis
PAKWSYYYLYVILDIFSR

SEQ ID NO: 161218 - protein, 18 aa, Mycobacterium bovis
PASQMLRPFAPRRLVRAL

SEQ ID NO: 161219 - protein, 19 aa, Mycobacterium bovis
PATILGCWVALAATAGLLF

SEQ ID NO: 161220 - protein, 18 aa, Mycobacterium bovis
PCMTGFLPPPLVRSPADE

SEQ ID NO: 161221 - protein, 23 aa, Mycobacterium bovis
PDSLIRMCLFLGALTFMYISARA

SEQ ID NO: 161222 - protein, 18 aa, Mycobacterium bovis
PDVLRPDLTIAYTDTDGY

SEQ ID NO: 161223 - protein, 21 aa, Mycobacterium bovis
PEGAHARWNWVLDGMVETKAL

SEQ ID NO: 161224 - protein, 19 aa, Mycobacterium bovis
PEVPSAWLSTGMGPGPLLA

SEQ ID NO: 161225 - protein, 18 aa, Mycobacterium bovis
PGCAPGPDGVRCAASMAL

SEQ ID NO: 161226 - protein, 21 aa, Mycobacterium bovis
PGLDWRWLVLWWESHAPHIAN

SEQ ID NO: 161227 - protein, 19 aa, Mycobacterium bovis
PHAPWARWRYTRHPEKMRR

SEQ ID NO: 161228 - protein, 17 aa, Mycobacterium bovis
PICWSFRSIFDALDGID

SEQ ID NO: 161229 - protein, 17 aa, Mycobacterium bovis
PILAGLCMLMLGLLMLI

SEQ ID NO: 161230 - protein, 26 aa, Mycobacterium bovis
PILPRLIRRFAVVIVLLWLGFTAFVN

SEQ ID NO: 161231 - protein, 18 aa, Mycobacterium bovis
PIPRWLRFVLTSDRAGSA

SEQ ID NO: 161232 - protein, 21 aa, Mycobacterium bovis
PLGHWEFYMALAYFKLAIIAA

SEQ ID NO: 161233 - protein, 20 aa, Mycobacterium bovis
PLLLLVGLFVMFSRMQGGAR

SEQ ID NO: 161234 - protein, 26 aa, Mycobacterium bovis
PLLPIAAVCACLWLMLNLTALTWIRF

SEQ ID NO: 161235 - protein, 25 aa, Mycobacterium bovis
PLVRKTAAWAWRFLVILAAMVALLW

SEQ ID NO: 161236 - protein, 25 aa, Mycobacterium bovis
PMGRRLAALLIDWLIAYGLALLGVE

SEQ ID NO: 161237 - protein, 19 aa, Mycobacterium bovis
PNGTHSWPYWNEQLVAMKA

SEQ ID NO: 161238 - protein, 18 aa, Mycobacterium bovis
PNSVWSWDITKLRGPAKW

SEQ ID NO: 161239 - protein, 17 aa, Mycobacterium bovis
PPCLFKLLTGWNCPACG

SEQ ID NO: 161240 - protein, 19 aa, Mycobacterium bovis
PPGSAWRWLCACLLGLTIL

SEQ ID NO: 161241 - protein, 17 aa, Mycobacterium bovis
PPLFRFGHRGPGDWQAG

SEQ ID NO: 161242 - protein, 20 aa, Mycobacterium bovis
PPRNCWWAAVVALALLAWVL

SEQ ID NO: 161243 - protein, 19 aa, Mycobacterium bovis
PPVPIPWSVLSLFVPGPTL

SEQ ID NO: 161244 - protein, 17 aa, Mycobacterium bovis
PQQRLLLEVAWEALEHA

SEQ ID NO: 161245 - protein, 18 aa, Mycobacterium bovis
PRDLAPLLAAWVISVGVM

SEQ ID NO: 161246 - protein, 17 aa, Mycobacterium bovis
PRFLFSMGVIGVVAATS

SEQ ID NO: 161247 - protein, 19 aa, Mycobacterium bovis
PRLALFTVVSSFALAELGD

SEQ ID NO: 161248 - protein, 17 aa, Mycobacterium bovis
PRLPRLIPGGDYVMAGG

SEQ ID NO: 161249 - protein, 17 aa, Mycobacterium bovis
PRPASVITIARPGTSLS

SEQ ID NO: 161250 - protein, 17 aa, Mycobacterium bovis
PRPPFDYMQQVYDRYIA

SEQ ID NO: 161251 - protein, 20 aa, Mycobacterium bovis
PRTASIVIWYSRAICDTAAI

SEQ ID NO: 161252 - protein, 17 aa, Mycobacterium bovis
PRWARAVGRSCWRRSPT

SEQ ID NO: 161253 - protein, 25 aa, Mycobacterium bovis
PRYLRFGWAAARLDDWANYVGARAT

SEQ ID NO: 161254 - protein, 17 aa, Mycobacterium bovis
PSLSRYAWHRVRRIMPA

SEQ ID NO: 161255 - protein, 17 aa, Mycobacterium bovis
PTPRPASVITIARPGTS

SEQ ID NO: 161256 - protein, 19 aa, Mycobacterium bovis
PTVVTGLRLAASRSMLPAH

SEQ ID NO: 161257 - protein, 19 aa, Mycobacterium bovis
PVAPEAYALYGISRVLPQA

SEQ ID NO: 161258 - protein, 19 aa, Mycobacterium bovis
PVSIALLWSLRFGPRVLGP

SEQ ID NO: 161259 - protein, 23 aa, Mycobacterium bovis
PWLPARWRHWWWALLLAFVPIHL

SEQ ID NO: 161260 - protein, 23 aa, Mycobacterium bovis
QAAQLSALWARFPLPVIPAPGDP

SEQ ID NO: 161261 - protein, 18 aa, Mycobacterium bovis
QADRAVVVAARLDRAALA

SEQ ID NO: 161262 - protein, 20 aa, Mycobacterium bovis
QATFLRWVWYAARREGLHLD

SEQ ID NO: 161263 - protein, 19 aa, Mycobacterium bovis
QINWKWIRRSLYLTAAVVI

SEQ ID NO: 161264 - protein, 24 aa, Mycobacterium bovis
QISAPRAKLFAALFLILALVVVGE

SEQ ID NO: 161265 - protein, 19 aa, Mycobacterium bovis
QPVLLDWAVGLAFPCQQPM

SEQ ID NO: 161266 - protein, 21 aa, Mycobacterium bovis
QRVLGAALWYAATVKDAVIVA

SEQ ID NO: 161267 - protein, 18 aa, Mycobacterium bovis
QRWFSWLALLTMPAPFLA

SEQ ID NO: 161268 - protein, 18 aa, Mycobacterium bovis
QRWKAIRGEAGWMTTYAY

SEQ ID NO: 161269 - protein, 27 aa, Mycobacterium bovis
QTFWRITLPSIRWGLTYGIVLTVARTL

SEQ ID NO: 161270 - protein, 19 aa, Mycobacterium bovis
QVARLWKLTSALTIDDRTG

SEQ ID NO: 161271 - protein, 18 aa, Mycobacterium bovis
QVTRELLELFNIDEQTLN

SEQ ID NO: 161272 - protein, 23 aa, Mycobacterium bovis
QWPLFAWFCVYAYRNFVRYEETP

SEQ ID NO: 161273 - protein, 25 aa, Mycobacterium bovis
RADPGIPARGIVAVCDFGGSGTGIT

SEQ ID NO: 161274 - protein, 24 aa, Mycobacterium bovis
RAMRRAGKVFNEFDSNSIAMVVLE

SEQ ID NO: 161275 - protein, 18 aa, Mycobacterium bovis
RASWPWALVVFLVVVFVA

SEQ ID NO: 161276 - protein, 17 aa, Mycobacterium bovis
RAVVVAARLDRAALAGA

SEQ ID NO: 161277 - protein, 17 aa, Mycobacterium bovis
RAYPGFVRRVMTSAVPF

SEQ ID NO: 161278 - protein, 20 aa, Mycobacterium bovis
RDDLRWPPASALVSQDEAVA

SEQ ID NO: 161279 - protein, 18 aa, Mycobacterium bovis
RDLRAIVRLLAWQGAALA

SEQ ID NO: 161280 - protein, 27 aa, Mycobacterium bovis
REAAEALGLPAGWALRKIVLKTAMPGI

SEQ ID NO: 161281 - protein, 24 aa, Mycobacterium bovis
RELEIWKRTLFRFVQQVYFRRRKT

SEQ ID NO: 161282 - protein, 19 aa, Mycobacterium bovis
RFEKAWPLLWFVVIGLIAA

SEQ ID NO: 161283 - protein, 17 aa, Mycobacterium bovis
RFVMRRIAAGIALHDTR

SEQ ID NO: 161284 - protein, 20 aa, Mycobacterium bovis
RFVRALSAAAGWYVDAEAAN

SEQ ID NO: 161285 - protein, 18 aa, Mycobacterium bovis
RGALMFGKLVPMGIGAII

SEQ ID NO: 161286 - protein, 24 aa, Mycobacterium bovis
RGLIRLARRVWPDSGWEELGPRPH

SEQ ID NO: 161287 - protein, 30 aa, Mycobacterium bovis
RGRCRRLWPRSAPMLAAWAVVEGCLMAVFF

SEQ ID NO: 161288 - protein, 27 aa, Mycobacterium bovis
RGWRRIGTAIVRWPGPILAVACAIAVV

SEQ ID NO: 161289 - protein, 21 aa, Mycobacterium bovis
RHFGDAVLLLAIWIGIGFIFR

SEQ ID NO: 161290 - protein, 19 aa, Mycobacterium bovis
RHIASWLAALVVPSVICAI

SEQ ID NO: 161291 - protein, 19 aa, Mycobacterium bovis
RIAEIPLDIDATLISDGTG

SEQ ID NO: 161292 - protein, 19 aa, Mycobacterium bovis
RIAQLRWPVAIAVGPALTY

SEQ ID NO: 161293 - protein, 17 aa, Mycobacterium bovis
RKAELDAGYILTCQSHP

SEQ ID NO: 161294 - protein, 19 aa, Mycobacterium bovis
RKETLRLIAQIGMGTGAMA

SEQ ID NO: 161295 - protein, 18 aa, Mycobacterium bovis
RKFFEAFAPYGLKQTAVK

SEQ ID NO: 161296 - protein, 20 aa, Mycobacterium bovis
RKRLPAIFVDVARFALIGIG

SEQ ID NO: 161297 - protein, 24 aa, Mycobacterium bovis
RKVGAAIVRWPGPILVGAVALALV

SEQ ID NO: 161298 - protein, 17 aa, Mycobacterium bovis
RLAIAAMGAVLVYGLVG

SEQ ID NO: 161299 - protein, 20 aa, Mycobacterium bovis
RLFAAMGFAGYFAMLALPAM

SEQ ID NO: 161300 - protein, 20 aa, Mycobacterium bovis
RLKATMLAHWAWLSMLLVGG

SEQ ID NO: 161301 - protein, 18 aa, Mycobacterium bovis
RLLIGIVVALALVSAMTA

SEQ ID NO: 161302 - protein, 23 aa, Mycobacterium bovis
RLLREFRGPLALSLLLVAVQTCA

SEQ ID NO: 161303 - protein, 20 aa, Mycobacterium bovis
RLLYGIGMGGEWGLGAALSM

SEQ ID NO: 161304 - protein, 19 aa, Mycobacterium bovis
RLRRPIVVWWIVWIVSNAI

SEQ ID NO: 161305 - protein, 18 aa, Mycobacterium bovis
RLRYDQFMALGWKLLIPV

SEQ ID NO: 161306 - protein, 18 aa, Mycobacterium bovis
RMQVTLKPVPVILILLML

SEQ ID NO: 161307 - protein, 21 aa, Mycobacterium bovis
RMSPFWQRMFLTIGILIAVFG

SEQ ID NO: 161308 - protein, 20 aa, Mycobacterium bovis
RNRCSLLRVELQEHVAGLSR

SEQ ID NO: 161309 - protein, 17 aa, Mycobacterium bovis
RPLPVVIADAAARTEPP

SEQ ID NO: 161310 - protein, 18 aa, Mycobacterium bovis
RPRRAGVSSFGISGTNAH

SEQ ID NO: 161311 - protein, 17 aa, Mycobacterium bovis
RPRVVTVHILRNSLIPV

SEQ ID NO: 161312 - protein, 17 aa, Mycobacterium bovis
RPSWLPKLMAHGGGTTA

SEQ ID NO: 161313 - protein, 27 aa, Mycobacterium bovis
RQFRRLGTHVARWPAPILVASGVFVLI

SEQ ID NO: 161314 - protein, 22 aa, Mycobacterium bovis
RQHSPMTWRRWALLCVGIAQIA

SEQ ID NO: 161315 - protein, 17 aa, Mycobacterium bovis
RRCRWLVFTGWLLALVP

SEQ ID NO: 161316 - protein, 19 aa, Mycobacterium bovis
RRDPLLFPFQPIHVTIAAW

SEQ ID NO: 161317 - protein, 18 aa, Mycobacterium bovis
RRELSQLPVLRWVDNSGN

SEQ ID NO: 161318 - protein, 18 aa, Mycobacterium bovis
RRGAEVFADVTLPEGVPI

SEQ ID NO: 161319 - protein, 17 aa, Mycobacterium bovis
RRIAADLARPAETVRGW

SEQ ID NO: 161320 - protein, 21 aa, Mycobacterium bovis
RRLDEAAGFAIPFVPRGLDEI

SEQ ID NO: 161321 - protein, 21 aa, Mycobacterium bovis
RRLDEYIGFLVAWQRPLAGKK

SEQ ID NO: 161322 - protein, 23 aa, Mycobacterium bovis
RRMPDLRGALLLAVTLGLVTLGL

SEQ ID NO: 161323 - protein, 28 aa, Mycobacterium bovis
RRPASTQSWFWSRWVGWVMRRPWITALA

SEQ ID NO: 161324 - protein, 24 aa, Mycobacterium bovis
RRSQLRLGLNVPYLLLVLAFVVFD

SEQ ID NO: 161325 - protein, 21 aa, Mycobacterium bovis
RRVGTAIVRWPGPVLAATCLV

SEQ ID NO: 161326 - protein, 25 aa, Mycobacterium bovis
RRWRRIGTVVVRWPGPVLAATLLIA

SEQ ID NO: 161327 - protein, 17 aa, Mycobacterium bovis
RSAARPGTWSLFDGGYT

SEQ ID NO: 161328 - protein, 19 aa, Mycobacterium bovis
RSGIALSIAALVPIGAALA

SEQ ID NO: 161329 - protein, 17 aa, Mycobacterium bovis
RSLPDFWRLLQVRVASQ

SEQ ID NO: 161330 - protein, 28 aa, Mycobacterium bovis
RSLTRSAWRLGMFANRWIILGVSAQAIA

SEQ ID NO: 161331 - protein, 22 aa, Mycobacterium bovis
RSRIGMVLQDTWLYDGTIAENI

SEQ ID NO: 161332 - protein, 17 aa, Mycobacterium bovis
RSWSVRANLHFLWLRLA

SEQ ID NO: 161333 - protein, 19 aa, Mycobacterium bovis
RSYFYWEHHCFDIPLCSAT

SEQ ID NO: 161334 - protein, 24 aa, Mycobacterium bovis
RTWLPRVWLALPLGLLALGSSMFF

SEQ ID NO: 161335 - protein, 22 aa, Mycobacterium bovis
RVEVPNALPLMLGGLRSATLQV

SEQ ID NO: 161336 - protein, 21 aa, Mycobacterium bovis
RVIPPSLLRRALPYLIGILIV

SEQ ID NO: 161337 - protein, 18 aa, Mycobacterium bovis
RVLARWQSSWLRYAPLSF

SEQ ID NO: 161338 - protein, 22 aa, Mycobacterium bovis
RVMKRPVLFAAPIVIIMILLII

SEQ ID NO: 161339 - protein, 20 aa, Mycobacterium bovis
RVSDGWAFMCTLIVVAAVVV

SEQ ID NO: 161340 - protein, 19 aa, Mycobacterium bovis
RWALFMVTITYVWKNLGYT

SEQ ID NO: 161341 - protein, 19 aa, Mycobacterium bovis
RWGRRIARLLPFVGLAGLA

SEQ ID NO: 161342 - protein, 18 aa, Mycobacterium bovis
RWGVAGRMVVAWLVTLPL

SEQ ID NO: 161343 - protein, 18 aa, Mycobacterium bovis
RYGGYALGGVSSFGFGGA

SEQ ID NO: 161344 - protein, 19 aa, Mycobacterium bovis
RYPIRARVAVVARGGLLMG

SEQ ID NO: 161345 - protein, 18 aa, Mycobacterium bovis
SALCFVGAVVLLYVDIDR

SEQ ID NO: 161346 - protein, 18 aa, Mycobacterium bovis
SALERLRDFAVFKAIGTP

SEQ ID NO: 161347 - protein, 19 aa, Mycobacterium bovis
SALERLRDFAVFKAIGVPT

SEQ ID NO: 161348 - protein, 20 aa, Mycobacterium bovis
SALLCPLLVYGWLGLPRWGL

SEQ ID NO: 161349 - protein, 25 aa, Mycobacterium bovis
SALRLKGRLLFMPGVMVTSVPWQLT

SEQ ID NO: 161350 - protein, 17 aa, Mycobacterium bovis
SALSRAVAVAWRRSLQL

SEQ ID NO: 161351 - protein, 17 aa, Mycobacterium bovis
SAYDLGTVIGFYGLTID

SEQ ID NO: 161352 - protein, 23 aa, Mycobacterium bovis
SDHDLRLIIAMTVCIVLLILIVL

SEQ ID NO: 161353 - protein, 17 aa, Mycobacterium bovis
SEIAIAVPAHWKPGAVH

SEQ ID NO: 161354 - protein, 22 aa, Mycobacterium bovis
SELMFFAGLFAFYFSARAQAGG

SEQ ID NO: 161355 - protein, 24 aa, Mycobacterium bovis
SFIIGRPLIWLSFRNEKLNAAFRY

SEQ ID NO: 161356 - protein, 17 aa, Mycobacterium bovis
SGICGAFGYGLGVFAVW

SEQ ID NO: 161357 - protein, 19 aa, Mycobacterium bovis
SGLAVPRPLPVVIADAAAR

SEQ ID NO: 161358 - protein, 18 aa, Mycobacterium bovis
SGTPFVWDGSMVVNYQDP

SEQ ID NO: 161359 - protein, 18 aa, Mycobacterium bovis
SGVSFRDHGNWVIGAPDV

SEQ ID NO: 161360 - protein, 20 aa, Mycobacterium bovis
SHPLCVLGFGFSVLAIAMTW

SEQ ID NO: 161361 - protein, 18 aa, Mycobacterium bovis
SLAGYAFARLQFRGRDTL

SEQ ID NO: 161362 - protein, 17 aa, Mycobacterium bovis
SLLGLAVGWLVGALVVL

SEQ ID NO: 161363 - protein, 18 aa, Mycobacterium bovis
SLNRGWCLIRTRWGRRIA

SEQ ID NO: 161364 - protein, 18 aa, Mycobacterium bovis
SLPLFGYAAMPAYDVVDG

SEQ ID NO: 161365 - protein, 17 aa, Mycobacterium bovis
SLWWDIWSLGLLVLIPA

SEQ ID NO: 161366 - protein, 20 aa, Mycobacterium bovis
SLYRAKWWWLLAAVAAAGAS

SEQ ID NO: 161367 - protein, 19 aa, Mycobacterium bovis
SPGTRWPQPTPWAGGAPPW

SEQ ID NO: 161368 - protein, 17 aa, Mycobacterium bovis
SPLGWSLQVRPYAGERW

SEQ ID NO: 161369 - protein, 17 aa, Mycobacterium bovis
SPLLLAIVIAVVAVVIM

SEQ ID NO: 161370 - protein, 24 aa, Mycobacterium bovis
SPLPRSARQPWLWVGVAVAVVVAL

SEQ ID NO: 161371 - protein, 24 aa, Mycobacterium bovis
SPLTAAMSLMWGWRLAAVCVTGAA

SEQ ID NO: 161372 - protein, 23 aa, Mycobacterium bovis
SPPPPRWAWPPLIAVGAVGMVGM

SEQ ID NO: 161373 - protein, 23 aa, Mycobacterium bovis
SQFSVRLLRTFLRDVPNQVVLAI

SEQ ID NO: 161374 - protein, 21 aa, Mycobacterium bovis
SQTRLATWLAEPGHTATPAGS

SEQ ID NO: 161375 - protein, 19 aa, Mycobacterium bovis
SRIEFAITILLLVILLIIY

SEQ ID NO: 161376 - protein, 21 aa, Mycobacterium bovis
SRPGEKNMPFWGTSFSAAYVS

SEQ ID NO: 161377 - protein, 19 aa, Mycobacterium bovis
SRQSWPAATGVTLVGTNPA

SEQ ID NO: 161378 - protein, 19 aa, Mycobacterium bovis
SRRSGCHLLLLAVLAAIAL

SEQ ID NO: 161379 - protein, 20 aa, Mycobacterium bovis
SSALPAYWERLAVCWQLGSD

SEQ ID NO: 161380 - protein, 22 aa, Mycobacterium bovis
SSDPTVAAGYPWQQQPTQEATW

SEQ ID NO: 161381 - protein, 17 aa, Mycobacterium bovis
SSLRAGMIAGAIGLLLV

SEQ ID NO: 161382 - protein, 24 aa, Mycobacterium bovis
SSPTFMQWGWRIPFLVSAALIAVA

SEQ ID NO: 161383 - protein, 21 aa, Mycobacterium bovis
SVSIPSWWQPYVLSVASLTSA

SEQ ID NO: 161384 - protein, 18 aa, Mycobacterium bovis
SYSLPLRRLLGLVAAGLD

SEQ ID NO: 161385 - protein, 20 aa, Mycobacterium bovis
TALCLFTAVFIMLRRKRIPS

SEQ ID NO: 161386 - protein, 28 aa, Mycobacterium bovis
TALEATWKYVVICSVGIAVAFLGTVLLY

SEQ ID NO: 161387 - protein, 24 aa, Mycobacterium bovis
TCALAALCYAEFASTLPVAGSAYT

SEQ ID NO: 161388 - protein, 17 aa, Mycobacterium bovis
TESRFTLIYGNRTKEST

SEQ ID NO: 161389 - protein, 17 aa, Mycobacterium bovis
TESRWRLGLYAAGRASQ

SEQ ID NO: 161390 - protein, 18 aa, Mycobacterium bovis
TGAGFGRDLRSAMFEHII

SEQ ID NO: 161391 - protein, 17 aa, Mycobacterium bovis
TGFARIVLLAAILGAAL

SEQ ID NO: 161392 - protein, 23 aa, Mycobacterium bovis
TGMFGRDAWRPAGVVVVGSDSEV

SEQ ID NO: 161393 - protein, 23 aa, Mycobacterium bovis
TGRAVSFLGPWLFSVFVDVFHTV

SEQ ID NO: 161394 - protein, 25 aa, Mycobacterium bovis
TGTPAWEMFKPWAITSMAIAVAVAL

SEQ ID NO: 161395 - protein, 18 aa, Mycobacterium bovis
TGTPRPPFDYMQQVYDRY

SEQ ID NO: 161396 - protein, 17 aa, Mycobacterium bovis
TIVRIVAPIAMPGIVSG

SEQ ID NO: 161397 - protein, 17 aa, Mycobacterium bovis
TKMTAMPQLVAFFNGVG

SEQ ID NO: 161398 - protein, 18 aa, Mycobacterium bovis
TLRYRWWVVLTGVAIAAF

SEQ ID NO: 161399 - protein, 24 aa, Mycobacterium bovis
TMRTIRMNMIWAFGYNVAAIPIAA

SEQ ID NO: 161400 - protein, 19 aa, Mycobacterium bovis
TMRTVKLNMVWAFGYNIAA

SEQ ID NO: 161401 - protein, 24 aa, Mycobacterium bovis
TMTGPRPGGFGALDGRTNEICAQG

SEQ ID NO: 161402 - protein, 18 aa, Mycobacterium bovis
TPEFPWSALTIVLLIGVL

SEQ ID NO: 161403 - protein, 20 aa, Mycobacterium bovis
TPLRRLDLLAGYGTAFSIAA

SEQ ID NO: 161404 - protein, 17 aa, Mycobacterium bovis
TPPRAVAIITQIASALD

SEQ ID NO: 161405 - protein, 19 aa, Mycobacterium bovis
TPPVRWRSGRRVHFDLDPL

SEQ ID NO: 161406 - protein, 17 aa, Mycobacterium bovis
TPREWMWAVLLAGAVAV

SEQ ID NO: 161407 - protein, 25 aa, Mycobacterium bovis
TREAYRIGGDWVQYRSYPGIGTKQP

SEQ ID NO: 161408 - protein, 19 aa, Mycobacterium bovis
TRGRIVLRWLRIAVLIVTG

SEQ ID NO: 161409 - protein, 23 aa, Mycobacterium bovis
TRKRFGDTMGYRLVIYPEYASLD

SEQ ID NO: 161410 - protein, 17 aa, Mycobacterium bovis
TSGPYLRHGQTITTTTV

SEQ ID NO: 161411 - protein, 22 aa, Mycobacterium bovis
TTRIVRASIRWAIEERAPSQAD

SEQ ID NO: 161412 - protein, 19 aa, Mycobacterium bovis
TVVRMFLVPSVMKLLGDDC

SEQ ID NO: 161413 - protein, 17 aa, Mycobacterium bovis
TVYQMWLLGGAKGPRSA

SEQ ID NO: 161414 - protein, 17 aa, Mycobacterium bovis
VAAWAYPLWPVVLGLKA

SEQ ID NO: 161415 - protein, 18 aa, Mycobacterium bovis
VAGLAWYLTHDVFNHPQA

SEQ ID NO: 161416 - protein, 26 aa, Mycobacterium bovis
VAMPWLFLRLRFCRRKWTVTTLAATP

SEQ ID NO: 161417 - protein, 19 aa, Mycobacterium bovis
VAPRIGAWVVAAWLAGIIL

SEQ ID NO: 161418 - protein, 17 aa, Mycobacterium bovis
VASRTGNLVTWWTGDAL

SEQ ID NO: 161419 - protein, 19 aa, Mycobacterium bovis
VATRLCWPDQAKADELQHA

SEQ ID NO: 161420 - protein, 17 aa, Mycobacterium bovis
VAYWLDRYELLSSGRKE

SEQ ID NO: 161421 - protein, 18 aa, Mycobacterium bovis
VCVVLRLARYNALQDDGT

SEQ ID NO: 161422 - protein, 18 aa, Mycobacterium bovis
VDCPLTWVERWARTKAAM

SEQ ID NO: 161423 - protein, 17 aa, Mycobacterium bovis
VDFAVRICTEITGLVRT

SEQ ID NO: 161424 - protein, 27 aa, Mycobacterium bovis
VDLARTVLRIMFPLSFVVAILLVSQGV

SEQ ID NO: 161425 - protein, 19 aa, Mycobacterium bovis
VDTLSLFVGWLWPLWDSRR

SEQ ID NO: 161426 - protein, 24 aa, Mycobacterium bovis
VELLKLAVLLALWAAVAGAFVSVL

SEQ ID NO: 161427 - protein, 27 aa, Mycobacterium bovis
VEPPKGPAWRRIRVSQLLIGVSAVVAM

SEQ ID NO: 161428 - protein, 23 aa, Mycobacterium bovis
VFGRGDIALGWAFLGAGIGSLVR

SEQ ID NO: 161429 - protein, 17 aa, Mycobacterium bovis
VGFIPFVIAMGIGLGVS

SEQ ID NO: 161430 - protein, 22 aa, Mycobacterium bovis
VGLGMSVARGFVEAMGGTISAT

SEQ ID NO: 161431 - protein, 20 aa, Mycobacterium bovis
VGPRQWRWPLGEIDRPFEMR

SEQ ID NO: 161432 - protein, 20 aa, Mycobacterium bovis
VGQQCARRALPFVAAMAKLL

SEQ ID NO: 161433 - protein, 20 aa, Mycobacterium bovis
VGTAVVRWPGPILATSVALA

SEQ ID NO: 161434 - protein, 25 aa, Mycobacterium bovis
VGYRNRIAALFAWGISFMGRARGQM

SEQ ID NO: 161435 - protein, 22 aa, Mycobacterium bovis
VICAITVAWLDRFMGIGGESAL

SEQ ID NO: 161436 - protein, 17 aa, Mycobacterium bovis
VIVMFSIGLVIATAVAV

SEQ ID NO: 161437 - protein, 17 aa, Mycobacterium bovis
VKRALAWVKAHISEYGG

SEQ ID NO: 161438 - protein, 18 aa, Mycobacterium bovis
VLAAYAFARLQFRGRDAL

SEQ ID NO: 161439 - protein, 17 aa, Mycobacterium bovis
VLACTLVGFAVAVLGDP

SEQ ID NO: 161440 - protein, 18 aa, Mycobacterium bovis
VLCAIGAVYLGSRTGAGF

SEQ ID NO: 161441 - protein, 19 aa, Mycobacterium bovis
VLCCIGSIVGIVFGAIAIN

SEQ ID NO: 161442 - protein, 23 aa, Mycobacterium bovis
VLDRLRARFGWLDHVVRAFTRFN

SEQ ID NO: 161443 - protein, 20 aa, Mycobacterium bovis
VLLFCIAFGLSMDYEVFLVS

SEQ ID NO: 161444 - protein, 26 aa, Mycobacterium bovis
VLPALMVLLGRWLWWPRRSVSNRQVP

SEQ ID NO: 161445 - protein, 23 aa, Mycobacterium bovis
VLRRARYRPLWVFLLVPVLILLT

SEQ ID NO: 161446 - protein, 24 aa, Mycobacterium bovis
VLRWSRNRMAFLAALFFLLALCWA

SEQ ID NO: 161447 - protein, 19 aa, Mycobacterium bovis
VLVGGLWAWIAPPIHAVVA

SEQ ID NO: 161448 - protein, 18 aa, Mycobacterium bovis
VLVILRLLYGIGMGGEWG

SEQ ID NO: 161449 - protein, 17 aa, Mycobacterium bovis
VLVTWVLVERSIALGRL

SEQ ID NO: 161450 - protein, 19 aa, Mycobacterium bovis
VMNKLRWVLLIVGGIGVAV

SEQ ID NO: 161451 - protein, 25 aa, Mycobacterium bovis
VMVGGLCIAGALGIMRFLAIFGPVH

SEQ ID NO: 161452 - protein, 18 aa, Mycobacterium bovis
VPGYCVLAFILGTYWLTR

SEQ ID NO: 161453 - protein, 18 aa, Mycobacterium bovis
VQAAVPFYGVYDFTRLQD

SEQ ID NO: 161454 - protein, 19 aa, Mycobacterium bovis
VQWRKRRLVIAIVSTGLVF

SEQ ID NO: 161455 - protein, 18 aa, Mycobacterium bovis
VRAGAFAIDVLPGLAVAA

SEQ ID NO: 161456 - protein, 19 aa, Mycobacterium bovis
VRANLHFLWLRLARVWPVY

SEQ ID NO: 161457 - protein, 21 aa, Mycobacterium bovis
VRLLPGWPIWFAVGWAAQEWL

SEQ ID NO: 161458 - protein, 20 aa, Mycobacterium bovis
VSGMSCAACASRVETKLNKI

SEQ ID NO: 161459 - protein, 29 aa, Mycobacterium bovis
VSGYRFLLRRIECALLFGDVCAATGALRA

SEQ ID NO: 161460 - protein, 18 aa, Mycobacterium bovis
VSIPRAMFWTVLVYVFVA

SEQ ID NO: 161461 - protein, 18 aa, Mycobacterium bovis
VSLIGWWALSRLLERMRG

SEQ ID NO: 161462 - protein, 18 aa, Mycobacterium bovis
VSLPLLWWRFRRDDRAAL

SEQ ID NO: 161463 - protein, 26 aa, Mycobacterium bovis
VSPLIRWIIKVPREFINDYLFNFPDT

SEQ ID NO: 161464 - protein, 19 aa, Mycobacterium bovis
VVCVLTLTIARPVRTYFAQ

SEQ ID NO: 161465 - protein, 24 aa, Mycobacterium bovis
VVFIRYHFSMVWGLYLAAGIMVLA

SEQ ID NO: 161466 - protein, 19 aa, Mycobacterium bovis
VVLRPHWTPLFAYAAAFLI

SEQ ID NO: 161467 - protein, 18 aa, Mycobacterium bovis
VVRIKLWLQYVIAGTPRM

SEQ ID NO: 161468 - protein, 17 aa, Mycobacterium bovis
VVVAARLDRAALAGAGA

SEQ ID NO: 161469 - protein, 24 aa, Mycobacterium bovis
VVYDMWGAAVSLAYQMHSGSPQPG

SEQ ID NO: 161470 - protein, 22 aa, Mycobacterium bovis
VYLWHWPIFLALNGQRTGWSGP

SEQ ID NO: 161471 - protein, 17 aa, Mycobacterium bovis
VYVLPLLLLVGLFVMFS

SEQ ID NO: 161472 - protein, 20 aa, Mycobacterium bovis
WAKVRGRLLALFGLALLEAA

SEQ ID NO: 161473 - protein, 20 aa, Mycobacterium bovis
WCLIRTRWGRRIARLLPFVG

SEQ ID NO: 161474 - protein, 18 aa, Mycobacterium bovis
WDITKLRGPAKWSYYYLY

SEQ ID NO: 161475 - protein, 19 aa, Mycobacterium bovis
WEAGNKFIARRNLIWSVAA

SEQ ID NO: 161476 - protein, 17 aa, Mycobacterium bovis
WEALRVAAADGFVQTDG

SEQ ID NO: 161477 - protein, 17 aa, Mycobacterium bovis
WGLTYGIVLTVARTLGE

SEQ ID NO: 161478 - protein, 24 aa, Mycobacterium bovis
WGNCTIKVMVGFLFLYPAFVAKAH

SEQ ID NO: 161479 - protein, 19 aa, Mycobacterium bovis
WKLLIPVSLVWVMVAAIIR

SEQ ID NO: 161480 - protein, 22 aa, Mycobacterium bovis
WLGLSWRWLFGLSIIPALISLI

SEQ ID NO: 161481 - protein, 17 aa, Mycobacterium bovis
WLGRFVSTYGWRAYALP

SEQ ID NO: 161482 - protein, 22 aa, Mycobacterium bovis
WLIGAYGWRWIFLVNLPVGLSA

SEQ ID NO: 161483 - protein, 23 aa, Mycobacterium bovis
WLIWLVLHLAYLIGFKTKITTLL

SEQ ID NO: 161484 - protein, 18 aa, Mycobacterium bovis
WLLKRWGEYFAVVATSIF

SEQ ID NO: 161485 - protein, 27 aa, Mycobacterium bovis
WLPSSWRPATWWPLGRRRGRAQRTKRK

SEQ ID NO: 161486 - protein, 17 aa, Mycobacterium bovis
WLRRHTRAIQIFGGALL

SEQ ID NO: 161487 - protein, 17 aa, Mycobacterium bovis
WNLYFGFRIPDSSKTVF

SEQ ID NO: 161488 - protein, 17 aa, Mycobacterium bovis
WNVFFIFSLCYLFGHYG

SEQ ID NO: 161489 - protein, 17 aa, Mycobacterium bovis
WPAPILVASGVFVLIMM

SEQ ID NO: 161490 - protein, 17 aa, Mycobacterium bovis
WPPASALVSQDEAVAAL

SEQ ID NO: 161491 - protein, 17 aa, Mycobacterium bovis
WPWAYAMLLGIHVVLLF

SEQ ID NO: 161492 - protein, 22 aa, Mycobacterium bovis
WQRNVRWARWLAWVSLAVLLTE

SEQ ID NO: 161493 - protein, 24 aa, Mycobacterium bovis
WRFLLRRLEHAIVRRDTRMFDDPL

SEQ ID NO: 161494 - protein, 20 aa, Mycobacterium bovis
WRSRHWQRRWLPTAAAIGAT

SEQ ID NO: 161495 - protein, 18 aa, Mycobacterium bovis
WSLLVGYGCLPWVATAML

SEQ ID NO: 161496 - protein, 17 aa, Mycobacterium bovis
WSLPLGVAILLAAVGGG

SEQ ID NO: 161497 - protein, 20 aa, Mycobacterium bovis
WSSDLSMTWDLLCRSVTHGI

SEQ ID NO: 161498 - protein, 24 aa, Mycobacterium bovis
WSWRGLRLGLMFGFGGMLVTIPAS

SEQ ID NO: 161499 - protein, 19 aa, Mycobacterium bovis
WTVGLCLYGLVMGSVVHGI

SEQ ID NO: 161500 - protein, 18 aa, Mycobacterium bovis
WVTQRLWWAVLLTVGFWG

SEQ ID NO: 161501 - protein, 20 aa, Mycobacterium bovis
WWAAVVALALLAWVLTHRAT

SEQ ID NO: 161502 - protein, 23 aa, Mycobacterium bovis
WWGQPAWSWAVLGLRGRRPVKWN

SEQ ID NO: 161503 - protein, 18 aa, Mycobacterium bovis
WWLFAWELDNGAGLHEAR

SEQ ID NO: 161504 - protein, 17 aa, Mycobacterium bovis
YCVLAFILGTYWLTRQT

SEQ ID NO: 161505 - protein, 20 aa, Mycobacterium bovis
YDARWLVTRMTTITSLDLTP

SEQ ID NO: 161506 - protein, 17 aa, Mycobacterium bovis
YDLGTVIGFYGLTIDEP

SEQ ID NO: 161507 - protein, 20 aa, Mycobacterium bovis
YETIGGLVLRELGHIPVAGE

SEQ ID NO: 161508 - protein, 17 aa, Mycobacterium bovis
YFARNRCSLLRVELQEH

SEQ ID NO: 161509 - protein, 22 aa, Mycobacterium bovis
YGGLRAALPVTFATFGLAYLAI

SEQ ID NO: 161510 - protein, 20 aa, Mycobacterium bovis
YHTERLWSAIGLVPQRSYLF

SEQ ID NO: 161511 - protein, 24 aa, Mycobacterium bovis
YKYFLEFFEQFGFSPAVTVVLALV

SEQ ID NO: 161512 - protein, 22 aa, Mycobacterium bovis
YMRYPVFLGFDIVGGVAWGAGV

SEQ ID NO: 161513 - protein, 18 aa, Mycobacterium bovis
YNMPLELVLTVIPFLIIS

SEQ ID NO: 161514 - protein, 22 aa, Mycobacterium bovis
YRIGALCPYCMVVWAVIATLLV

SEQ ID NO: 161515 - protein, 25 aa, Mycobacterium bovis
YRIIGRAGGIYGDFFNFYLCDISLK

SEQ ID NO: 161516 - protein, 17 aa, Mycobacterium bovis
YRLISWLLIAAIGWVVF

SEQ ID NO: 161517 - protein, 21 aa, Mycobacterium bovis
YRPNLFVTYWSFRMMIGLMAI

SEQ ID NO: 161518 - protein, 19 aa, Mycobacterium bovis
YSEPRLQPPNGYKDTTVPG

SEQ ID NO: 161519 - protein, 18 aa, Mycobacterium bovis
YVVFRWFFARDLRVVPDR

SEQ ID NO: 161520 - protein, 22 aa, Mycobacterium bovis
YWYRSIRQPVQFERAVRNAFDG

SEQ ID NO: 161521 - protein, 21 aa, Mycobacterium bovis
AAGMYPAWRLGRMTIRTAIRE

SEQ ID NO: 161522 - protein, 19 aa, Mycobacterium bovis
ADCGLEWVAVRCALIFGRN

SEQ ID NO: 161523 - protein, 18 aa, Mycobacterium bovis
ADRFGSCREFADAMNEQA

SEQ ID NO: 161524 - protein, 17 aa, Mycobacterium bovis
ADYLRGFIQERWIIRPK

SEQ ID NO: 161525 - protein, 18 aa, Mycobacterium bovis
AGLMAAVGFELFKQVGAI

SEQ ID NO: 161526 - protein, 25 aa, Mycobacterium bovis
ALATLLGRWFWWPRRVDRLARQPQV

SEQ ID NO: 161527 - protein, 18 aa, Mycobacterium bovis
ALSEMRWAALALGLFSAG

SEQ ID NO: 161528 - protein, 17 aa, Mycobacterium bovis
ALVLPWLLARAVGAEAA

SEQ ID NO: 161529 - protein, 18 aa, Mycobacterium bovis
APLLRPGYLLLRDAVSTP

SEQ ID NO: 161530 - protein, 19 aa, Mycobacterium bovis
ATGCLRVRASITISPDDLV

SEQ ID NO: 161531 - protein, 18 aa, Mycobacterium bovis
FGVRITRILALLLAVLLA

SEQ ID NO: 161532 - protein, 19 aa, Mycobacterium bovis
FSGFIAWLIWLVLHLAYLI

SEQ ID NO: 161533 - protein, 17 aa, Mycobacterium bovis
FSWLRRRSGSLIAPIAL

SEQ ID NO: 161534 - protein, 22 aa, Mycobacterium bovis
FVVGRLAGRHGIRVGLRGPVTG

SEQ ID NO: 161535 - protein, 21 aa, Mycobacterium bovis
GLPLRAMVMVLLFLGVVFLLL

SEQ ID NO: 161536 - protein, 26 aa, Mycobacterium bovis
GLVGIGWLWRHGRFRRLARLGGLVLV

SEQ ID NO: 161537 - protein, 18 aa, Mycobacterium bovis
GRPRWQCGVAALGSALVG

SEQ ID NO: 161538 - protein, 23 aa, Mycobacterium bovis
HEVGYRLRVRMALDEGRYKIAKL

SEQ ID NO: 161539 - protein, 22 aa, Mycobacterium bovis
HIVGLCIFGFLLAMLRGNHVGH

SEQ ID NO: 161540 - protein, 17 aa, Mycobacterium bovis
HVIDARFARALRLRLLS

SEQ ID NO: 161541 - protein, 23 aa, Mycobacterium bovis
IARRSGTPISFWKFTRKGAVVTA

SEQ ID NO: 161542 - protein, 20 aa, Mycobacterium bovis
IGALVVWWGWRERRDLFSGF

SEQ ID NO: 161543 - protein, 24 aa, Mycobacterium bovis
IGRAWLRLFGVLPFDYDRLSIAEL

SEQ ID NO: 161544 - protein, 18 aa, Mycobacterium bovis
ILLAGLVGMCSFQLGGTK

SEQ ID NO: 161545 - protein, 21 aa, Mycobacterium bovis
IRWRLTLVFSAAMALVLAAAG

SEQ ID NO: 161546 - protein, 24 aa, Mycobacterium bovis
ITAIAVVVLLGWSFFYFSDDTRGY

SEQ ID NO: 161547 - protein, 20 aa, Mycobacterium bovis
KRSESGVGIRGYRDEFLDAT

SEQ ID NO: 161548 - protein, 18 aa, Mycobacterium bovis
LCLMPIFPLALWLMNVYA

SEQ ID NO: 161549 - protein, 20 aa, Mycobacterium bovis
LFPDLPSFPGFPGFPSLPGF

SEQ ID NO: 161550 - protein, 17 aa, Mycobacterium bovis
LKAFWYHFAIMFEALFI

SEQ ID NO: 161551 - protein, 18 aa, Mycobacterium bovis
LLAGLIWLYNVVWKVPPD

SEQ ID NO: 161552 - protein, 18 aa, Mycobacterium bovis
LNGLRLLRHTAWRRAAGT

SEQ ID NO: 161553 - protein, 17 aa, Mycobacterium bovis
LPNLTGRVEFEHVNFAY

SEQ ID NO: 161554 - protein, 18 aa, Mycobacterium bovis
LPSHCRGLLVGRVAGAHT

SEQ ID NO: 161555 - protein, 17 aa, Mycobacterium bovis
LQNPSWRPGAWACSLVV

SEQ ID NO: 161556 - protein, 18 aa, Mycobacterium bovis
LVTILPIVLVIAAVAAYL

SEQ ID NO: 161557 - protein, 20 aa, Mycobacterium bovis
MCVGVSLVLPAAVWGVLTPR

SEQ ID NO: 161558 - protein, 18 aa, Mycobacterium bovis
PDAPWGRLRVVYLQHASD

SEQ ID NO: 161559 - protein, 27 aa, Mycobacterium bovis
PLPTEIYWRRRGLALGIAVVVVGIAVA

SEQ ID NO: 161560 - protein, 21 aa, Mycobacterium bovis
PNSKFTISMLWPGDRAWRQAG

SEQ ID NO: 161561 - protein, 20 aa, Mycobacterium bovis
PTGCILAWILVRIINVRSFG

SEQ ID NO: 161562 - protein, 17 aa, Mycobacterium bovis
PVSHMWVVKFLRTHGLI

SEQ ID NO: 161563 - protein, 20 aa, Mycobacterium bovis
PVVRTPRPQLTAAFGGALWA

SEQ ID NO: 161564 - protein, 17 aa, Mycobacterium bovis
QKVLEGTGFVISPDRVM

SEQ ID NO: 161565 - protein, 19 aa, Mycobacterium bovis
QLGLWRWAFGVMTLLTALM

SEQ ID NO: 161566 - protein, 17 aa, Mycobacterium bovis
RAVGRSCWRRSPTGCCA

SEQ ID NO: 161567 - protein, 17 aa, Mycobacterium bovis
RERFGLVGLFVGSALVS

SEQ ID NO: 161568 - protein, 23 aa, Mycobacterium bovis
RGDYRLRHFGVRITRILALLLAV

SEQ ID NO: 161569 - protein, 17 aa, Mycobacterium bovis
RLRLPCRTILRVFSRNP

SEQ ID NO: 161570 - protein, 18 aa, Mycobacterium bovis
RLWPTVGCLVGYGIAFAL

SEQ ID NO: 161571 - protein, 21 aa, Mycobacterium bovis
RPQLTAAFGGALWAARRPGDT

SEQ ID NO: 161572 - protein, 22 aa, Mycobacterium bovis
RRPSRLRRGWLVGIAATLLALA

SEQ ID NO: 161573 - protein, 23 aa, Mycobacterium bovis
RTLKGWADRGVRVIGLDAGGGTA

SEQ ID NO: 161574 - protein, 17 aa, Mycobacterium bovis
RVRERFGLVGLFVGSAL

SEQ ID NO: 161575 - protein, 22 aa, Mycobacterium bovis
SARPRTRFGAWLGRPMTSFHLI

SEQ ID NO: 161576 - protein, 17 aa, Mycobacterium bovis
SAVPRGWARARKTIVSG

SEQ ID NO: 161577 - protein, 18 aa, Mycobacterium bovis
SGAEWMPNFIELLQRKLS

SEQ ID NO: 161578 - protein, 17 aa, Mycobacterium bovis
SLTQVFLCAVSVTVVGF

SEQ ID NO: 161579 - protein, 18 aa, Mycobacterium bovis
SNALLDWAYGRRFCYSET

SEQ ID NO: 161580 - protein, 18 aa, Mycobacterium bovis
SPCAIGLVTVMLASLTLA

SEQ ID NO: 161581 - protein, 17 aa, Mycobacterium bovis
TKLMPWLWVAWFGLGSF

SEQ ID NO: 161582 - protein, 19 aa, Mycobacterium bovis
TSLKTSWYLLGPAFVAAIA

SEQ ID NO: 161583 - protein, 21 aa, Mycobacterium bovis
VDGLGWRSVFLVNVPLGAIVW

SEQ ID NO: 161584 - protein, 22 aa, Mycobacterium bovis
VISSWRPVLLIPLTFALFTPLA

SEQ ID NO: 161585 - protein, 31 aa, Mycobacterium bovis
VPYLRASPWLLWRKRVVWLLVLFAAEAYTGS

SEQ ID NO: 161586 - protein, 24 aa, Mycobacterium bovis
VSLAGSGWCGWVLFEKHQTDVAAG

SEQ ID NO: 161587 - protein, 22 aa, Mycobacterium bovis
VVAYRTWRWWLATAVAFFAVVV

SEQ ID NO: 161588 - protein, 20 aa, Mycobacterium bovis
VVQWKLKPGVVSTMSAQARY

SEQ ID NO: 161589 - protein, 21 aa, Mycobacterium bovis
VYRYRFIVIGVMVALCLGGGV

SEQ ID NO: 161590 - protein, 18 aa, Mycobacterium bovis
WSTLKVSLLLSVALFFVW

SEQ ID NO: 161591 - protein, 19 aa, Mycobacterium bovis
YAPLWRTAWRRLRQRPFQY

SEQ ID NO: 161592 - protein, 18 aa, Mycobacterium bovis
YEPMVRVSLWLSVTAVAV

SEQ ID NO: 161593 - protein, 17 aa, Mycobacterium bovis
YGRRRSFVFGVTLFVVS

SEQ ID NO: 161594 - protein, 17 aa, Mycobacterium bovis
YLPPRLEAFRDRKRANP

SEQ ID NO: 161595 - protein, 18 aa, Mycobacterium bovis
YRVIGGLVLSFGMVTLLG

SEQ ID NO: 161596 - protein, 17 aa, Mycobacterium bovis
AALAVAVLARWRFRRRP

SEQ ID NO: 161597 - protein, 20 aa, Mycobacterium bovis
ACKVWSAGVSASWLGRDLAE

SEQ ID NO: 161598 - protein, 18 aa, Mycobacterium bovis
ADCGLEWVAVRCALIFGR

SEQ ID NO: 161599 - protein, 19 aa, Mycobacterium bovis
ADRFGSCREFADAMNEQAG

SEQ ID NO: 161600 - protein, 17 aa, Mycobacterium bovis
AFPAWLAPVQVVGIPVA

SEQ ID NO: 161601 - protein, 19 aa, Mycobacterium bovis
AGMYPAWRLGRMTIRTAIR

SEQ ID NO: 161602 - protein, 24 aa, Mycobacterium bovis
ALATLLGRWFWWPRRVDRLARQPQ

SEQ ID NO: 161603 - protein, 18 aa, Mycobacterium bovis
ALVLPWLLARAVGAEAAA

SEQ ID NO: 161604 - protein, 17 aa, Mycobacterium bovis
AQAALWTGYRPWFIDID

SEQ ID NO: 161605 - protein, 21 aa, Mycobacterium bovis
ARPRTRFGAWLGRPMTSFHLI

SEQ ID NO: 161606 - protein, 18 aa, Mycobacterium bovis
ATQLSVLACAAFIYVTAE

SEQ ID NO: 161607 - protein, 18 aa, Mycobacterium bovis
AVSFRFGDRTQINGVARD

SEQ ID NO: 161608 - protein, 20 aa, Mycobacterium bovis
AVVVLLGWSFFYFSDDTRGY

SEQ ID NO: 161609 - protein, 23 aa, Mycobacterium bovis
DRNRAHWDWLKWLPHNQHPNACD

SEQ ID NO: 161610 - protein, 19 aa, Mycobacterium bovis
DRRLCCGLRRTWRFEHNIA

SEQ ID NO: 161611 - protein, 18 aa, Mycobacterium bovis
ELPNLTGRVEFEHVNFAY

SEQ ID NO: 161612 - protein, 19 aa, Mycobacterium bovis
ELVTILPIVLVIAAVAAYL

SEQ ID NO: 161613 - protein, 19 aa, Mycobacterium bovis
ESAHFLRALLVAVVAALAA

SEQ ID NO: 161614 - protein, 20 aa, Mycobacterium bovis
ESAHFLRALLVAVVAALAAG

SEQ ID NO: 161615 - protein, 22 aa, Mycobacterium bovis
EVGYRLRVRMALDEGRYKIAKL

SEQ ID NO: 161616 - protein, 17 aa, Mycobacterium bovis
FKNGVGLMLQLPQATVV

SEQ ID NO: 161617 - protein, 18 aa, Mycobacterium bovis
FRWSCRMGICGSSGMTIN

SEQ ID NO: 161618 - protein, 18 aa, Mycobacterium bovis
FSGFIAWLIWLVLHLAYL

SEQ ID NO: 161619 - protein, 18 aa, Mycobacterium bovis
FSWLRRRSGSLIAPIALH

SEQ ID NO: 161620 - protein, 23 aa, Mycobacterium bovis
FVVGRLAGRHGIRVGLRGPVTGE

SEQ ID NO: 161621 - protein, 17 aa, Mycobacterium bovis
GLMAAVGFELFKQVGAI

SEQ ID NO: 161622 - protein, 27 aa, Mycobacterium bovis
GLVGIGWLWRHGRFRRLARLGGLVLVS

SEQ ID NO: 161623 - protein, 17 aa, Mycobacterium bovis
GRPRWQCGVAALGSALV

SEQ ID NO: 161624 - protein, 19 aa, Mycobacterium bovis
GRWALCLVDGAPLRATQSL

SEQ ID NO: 161625 - protein, 17 aa, Mycobacterium bovis
GWLTLWPFLSWLTTHFV

SEQ ID NO: 161626 - protein, 17 aa, Mycobacterium bovis
HALSLPIILFWVALTIV

SEQ ID NO: 161627 - protein, 18 aa, Mycobacterium bovis
HVIDARFARALRLRLLSK

SEQ ID NO: 161628 - protein, 25 aa, Mycobacterium bovis
IGRAWLRLFGVLPFDYDRLSIAELE

SEQ ID NO: 161629 - protein, 19 aa, Mycobacterium bovis
ITKLMPWLWVAWFGLGSFG

SEQ ID NO: 161630 - protein, 20 aa, Mycobacterium bovis
IVGLCIFGFLLAMLRGNHVG

SEQ ID NO: 161631 - protein, 18 aa, Mycobacterium bovis
KLQNPSWRPGAWACSLVV

SEQ ID NO: 161632 - protein, 17 aa, Mycobacterium bovis
LAGLIWLYNVVWKVPPD

SEQ ID NO: 161633 - protein, 17 aa, Mycobacterium bovis
LALATPVVREWLFGTQQ

SEQ ID NO: 161634 - protein, 19 aa, Mycobacterium bovis
LCLMPIFPLALWLMNVYAA

SEQ ID NO: 161635 - protein, 17 aa, Mycobacterium bovis
LDWKSVWDHGWSAAAEA

SEQ ID NO: 161636 - protein, 21 aa, Mycobacterium bovis
LFPDLPSFPGFPGFPSLPGFP

SEQ ID NO: 161637 - protein, 18 aa, Mycobacterium bovis
LGLWRWAFGVMTLLTALM

SEQ ID NO: 161638 - protein, 18 aa, Mycobacterium bovis
LLPVLWIFSLSLKPTSTV

SEQ ID NO: 161639 - protein, 19 aa, Mycobacterium bovis
LNGLRLLRHTAWRRAAGTA

SEQ ID NO: 161640 - protein, 20 aa, Mycobacterium bovis
LPFPLSSAILPRFFYTKEIG

SEQ ID NO: 161641 - protein, 18 aa, Mycobacterium bovis
LPLRVRLVAATLILVATG

SEQ ID NO: 161642 - protein, 18 aa, Mycobacterium bovis
LRSLLRFVLDLLADYGLT

SEQ ID NO: 161643 - protein, 17 aa, Mycobacterium bovis
LRTLPMVIGLLIASTGT

SEQ ID NO: 161644 - protein, 17 aa, Mycobacterium bovis
LSASLGWILPVIAQLVW

SEQ ID NO: 161645 - protein, 17 aa, Mycobacterium bovis
LVNRWPLPEAGVRSGLA

SEQ ID NO: 161646 - protein, 19 aa, Mycobacterium bovis
MPGGIYAPMMHPWSTGKDV

SEQ ID NO: 161647 - protein, 17 aa, Mycobacterium bovis
MVLICLFLYHVFRNRNW

SEQ ID NO: 161648 - protein, 22 aa, Mycobacterium bovis
PNSLLPRWLPDTSRGQGWADRI

SEQ ID NO: 161649 - protein, 20 aa, Mycobacterium bovis
PQLTAAFGGALWAARRPGDT

SEQ ID NO: 161650 - protein, 30 aa, Mycobacterium bovis
PRGPLPTEIYWRRRGLALGIAVVVVGIAVA

SEQ ID NO: 161651 - protein, 19 aa, Mycobacterium bovis
PRLRALGWTGMLDKGADVD

SEQ ID NO: 161652 - protein, 17 aa, Mycobacterium bovis
PTWSRPGWRHLKHFNGY

SEQ ID NO: 161653 - protein, 18 aa, Mycobacterium bovis
PVSHMWVVKFLRTHGLIH

SEQ ID NO: 161654 - protein, 19 aa, Mycobacterium bovis
PVVRTPRPQLTAAFGGALW

SEQ ID NO: 161655 - protein, 19 aa, Mycobacterium bovis
PWSTLKVSLLLSVALFFVW

SEQ ID NO: 161656 - protein, 26 aa, Mycobacterium bovis
PWSTLKVSLLLSVALFFVWMITVAFL

SEQ ID NO: 161657 - protein, 18 aa, Mycobacterium bovis
QRPPWGVPPPGWDGSSRP

SEQ ID NO: 161658 - protein, 17 aa, Mycobacterium bovis
QWKLKPGVVSTMSAQAR

SEQ ID NO: 161659 - protein, 18 aa, Mycobacterium bovis
RAVGRSCWRRSPTGCCAP

SEQ ID NO: 161660 - protein, 21 aa, Mycobacterium bovis
RDIPFDVIQRLGLAYTPPEAE

SEQ ID NO: 161661 - protein, 20 aa, Mycobacterium bovis
RGVKEFAPLIGVRKAGLFTS

SEQ ID NO: 161662 - protein, 21 aa, Mycobacterium bovis
RKRSESGVGIRGYRDEFLDAT

SEQ ID NO: 161663 - protein, 22 aa, Mycobacterium bovis
RLYAERWCAWALLAATVAIPTG

SEQ ID NO: 161664 - protein, 20 aa, Mycobacterium bovis
RPSRLRRGWLVGIAATLLAL

SEQ ID NO: 161665 - protein, 19 aa, Mycobacterium bovis
RSGAEWMPNFIELLQRKLS

SEQ ID NO: 161666 - protein, 19 aa, Mycobacterium bovis
RSPGRWSLVAALALAVVSL

SEQ ID NO: 161667 - protein, 18 aa, Mycobacterium bovis
RWALCLVDGAPLRATQSL

SEQ ID NO: 161668 - protein, 19 aa, Mycobacterium bovis
SAILPRFFYTKEIGKRLNA

SEQ ID NO: 161669 - protein, 18 aa, Mycobacterium bovis
SAVPRGWARARKTIVSGS

SEQ ID NO: 161670 - protein, 19 aa, Mycobacterium bovis
SFRWSCRMGICGSSGMTIN

SEQ ID NO: 161671 - protein, 21 aa, Mycobacterium bovis
SIGSVGRWVAVVAVLAVLTVV

SEQ ID NO: 161672 - protein, 18 aa, Mycobacterium bovis
SKFTISMLWPGDRAWRQA

SEQ ID NO: 161673 - protein, 20 aa, Mycobacterium bovis
SLRDLGCRALLMSGRPDEGA

SEQ ID NO: 161674 - protein, 19 aa, Mycobacterium bovis
SNALLDWAYGRRFRYSETM

SEQ ID NO: 161675 - protein, 17 aa, Mycobacterium bovis
SPCAIGLVTVMLASLTL

SEQ ID NO: 161676 - protein, 19 aa, Mycobacterium bovis
SPVFGCLFKGIARGVKEFA

SEQ ID NO: 161677 - protein, 17 aa, Mycobacterium bovis
SVIRLALIPAFVYVVLS

SEQ ID NO: 161678 - protein, 20 aa, Mycobacterium bovis
TCAPIAWSRSFRHVQALETD

SEQ ID NO: 161679 - protein, 18 aa, Mycobacterium bovis
TRAGGLVVAEWIRGGSLQ

SEQ ID NO: 161680 - protein, 19 aa, Mycobacterium bovis
VAQAALWTGYRPWFIDIDA

SEQ ID NO: 161681 - protein, 21 aa, Mycobacterium bovis
VAYRTWRWWLATAVAFFAVVV

SEQ ID NO: 161682 - protein, 20 aa, Mycobacterium bovis
VDGLGWRSVFLVNVPLGAIV

SEQ ID NO: 161683 - protein, 17 aa, Mycobacterium bovis
VGVSLVLPAAVWGVLTP

SEQ ID NO: 161684 - protein, 17 aa, Mycobacterium bovis
VIIRFWLLTAITCGLGV

SEQ ID NO: 161685 - protein, 20 aa, Mycobacterium bovis
VPFPSFKNGVGLMLQLPQAT

SEQ ID NO: 161686 - protein, 24 aa, Mycobacterium bovis
VPRWSARWCWGWRWRCCSIDRCVD

SEQ ID NO: 161687 - protein, 29 aa, Mycobacterium bovis
VPYLRASPWLLWRKRAVWLLVLFAAEAYT

SEQ ID NO: 161688 - protein, 17 aa, Mycobacterium bovis
VYIPWSMTVTPISQSDV

SEQ ID NO: 161689 - protein, 17 aa, Mycobacterium bovis
WALSASLGWILPVIAQL

SEQ ID NO: 161690 - protein, 20 aa, Mycobacterium bovis
YAPLWRTAWRRLRQRPFQYI

SEQ ID NO: 161691 - protein, 18 aa, Mycobacterium bovis
YFSLSLWSAYNVMLMHTV

SEQ ID NO: 161692 - protein, 19 aa, Mycobacterium bovis
YGRRRSFVFGVTLFVVSSI

SEQ ID NO: 161693 - protein, 17 aa, Mycobacterium bovis
YRVIGGLVLSFGMVTLL

SEQ ID NO: 161694 - protein, 23 aa, Mycobacterium bovis
YVISSWRPVLLIPLTFALFTPLA

SEQ ID NO: 161695 - protein, 18 aa, Mycobacterium bovis
GLGLLFDTLVVRSFMTPS

SEQ ID NO: 161696 - protein, 29 aa, Mycobacterium bovis
PSAELFVAAYVPYVAWLVQASADSAAAAG

SEQ ID NO: 161697 - protein, 18 aa, Mycobacterium bovis
QLLPLLDDYRHASTEYAL

SEQ ID NO: 161698 - protein, 22 aa, Mycobacterium bovis
RGFHRLKQWRGIATRYDKYALT

SEQ ID NO: 161699 - protein, 17 aa, Mycobacterium bovis
RTLPRWQRIVALTMIGI

SEQ ID NO: 161700 - protein, 19 aa, Mycobacterium bovis
YDKYALTYLGGVLLACAVI

SEQ ID NO: 161701 - protein, 24 aa, Mycobacterium bovis
ISGATIFFFLFVHVLDAAMLRVSP

SEQ ID NO: 161702 - protein, 30 aa, Mycobacterium bovis
ARTQRRSKHHLWIFAGIAAAILAGGAVAFS

SEQ ID NO: 161703 - protein, 25 aa, Mycobacterium bovis
AVFAQLLLLPVAWYLIVGSHQPAIG

SEQ ID NO: 161704 - protein, 20 aa, Mycobacterium bovis
FIGLMLIGLIWLMVFQLAAI

SEQ ID NO: 161705 - protein, 33 aa, Mycobacterium bovis
FIYYPVSWIMWVWYRLFAFVLGPSNFFAWALSV

SEQ ID NO: 161706 - protein, 25 aa, Mycobacterium bovis
GPFLPLAIILYWFSNNIWTFGQQHY

SEQ ID NO: 161707 - protein, 19 aa, Mycobacterium bovis
TAAGLRRRYREGRLAREVA

SEQ ID NO: 161708 - protein, 34 aa, Mycobacterium bovis
AAAALWTIIYGLANRLFIPRFLFSMGVIGVVAAT

SEQ ID NO: 161709 - protein, 24 aa, Mycobacterium bovis
AAALLGFPLLLVVGVSLAYLYVVL

SEQ ID NO: 161710 - protein, 25 aa, Mycobacterium bovis
AAALPWLRIAILGTPAILVSLAGNG

SEQ ID NO: 161711 - protein, 18 aa, Mycobacterium bovis
AAAMVLYVLISQLGLVVG

SEQ ID NO: 161712 - protein, 35 aa, Mycobacterium bovis
AAAPATLLLPLLWRMPDTARWYLLKGRIADARSAL

SEQ ID NO: 161713 - protein, 26 aa, Mycobacterium bovis
AAAPILGVPGWAWTLWAVLTAGCAGL

SEQ ID NO: 161714 - protein, 34 aa, Mycobacterium bovis
AAAPRCWQARAVSWMWQALAATLVAAVFAAAVAQ

SEQ ID NO: 161715 - protein, 24 aa, Mycobacterium bovis
AAAPVNYLKLLPATYVVLVLVVGY

SEQ ID NO: 161716 - protein, 34 aa, Mycobacterium bovis
AACKAWLLAQPYLVAGVLLVFYTTTGRYVAAFGA

SEQ ID NO: 161717 - protein, 25 aa, Mycobacterium bovis
AADIHMLWWMVLIVGVVSIIGAGYH

SEQ ID NO: 161718 - protein, 33 aa, Mycobacterium bovis
AAGALLIGALFFPWNLYFGFRIPDSSKTVFGLL

SEQ ID NO: 161719 - protein, 31 aa, Mycobacterium bovis
AAGLGLALGGRALRWPRFPLVIEAAVAAVDH

SEQ ID NO: 161720 - protein, 26 aa, Mycobacterium bovis
AAGLPWYAILCLPVLFAAGMCLLDTI

SEQ ID NO: 161721 - protein, 28 aa, Mycobacterium bovis
AAGLTYYTIFAIFPLLMVGFGVGGFALS

SEQ ID NO: 161722 - protein, 25 aa, Mycobacterium bovis
AAGMLLWFLIALPIGAVTGGWIATR

SEQ ID NO: 161723 - protein, 30 aa, Mycobacterium bovis
AAGMRLTVLLALLANLFLPWGIAGAAPTAL

SEQ ID NO: 161724 - protein, 25 aa, Mycobacterium bovis
AAGRARTLIYHRLAHGPAAAAVGLH

SEQ ID NO: 161725 - protein, 30 aa, Mycobacterium bovis
AAGRLGWPLWAAYITVFALTVLVGARLAVA

SEQ ID NO: 161726 - protein, 28 aa, Mycobacterium bovis
AAGVLLIGLVRWYLGTALFDSIARKLSS

SEQ ID NO: 161727 - protein, 25 aa, Mycobacterium bovis
AAGYLIIDRIFFRALQAGWASVIVS

SEQ ID NO: 161728 - protein, 19 aa, Mycobacterium bovis
AAGYLVLRPSWSPTQASGQ

SEQ ID NO: 161729 - protein, 18 aa, Mycobacterium bovis
AAIAILGTVLLTRGKHSK

SEQ ID NO: 161730 - protein, 17 aa, Mycobacterium bovis
AALAYAVDVKNAVIVAA

SEQ ID NO: 161731 - protein, 19 aa, Mycobacterium bovis
AALCLPLARVLAAASCGPL

SEQ ID NO: 161732 - protein, 20 aa, Mycobacterium bovis
AALEKINLLAAKLGGRDTRV

SEQ ID NO: 161733 - protein, 20 aa, Mycobacterium bovis
AALGAAIRYAAVDKDAVIVA

SEQ ID NO: 161734 - protein, 27 aa, Mycobacterium bovis
AALGTPALAAPAPHGALAGSGKLGVRD

SEQ ID NO: 161735 - protein, 27 aa, Mycobacterium bovis
AALIFSRYLWAFELTSALLITAAVGAM

SEQ ID NO: 161736 - protein, 24 aa, Mycobacterium bovis
AALLVIPCLLLAWAVSHPSLPFAV

SEQ ID NO: 161737 - protein, 34 aa, Mycobacterium bovis
AALPRRIHAFVRWVVRTPWPLFSLSMLQSDIIGA

SEQ ID NO: 161738 - protein, 26 aa, Mycobacterium bovis
AALSLILLIMMIITRSLVAALVIVGT

SEQ ID NO: 161739 - protein, 35 aa, Mycobacterium bovis
AALSNYFRTGNLTALREIALLWLADQVDAALEKYR

SEQ ID NO: 161740 - protein, 24 aa, Mycobacterium bovis
AALWAVYTPRWWLSGLLVGVASGV

SEQ ID NO: 161741 - protein, 42 aa, Mycobacterium bovis
AAPTYRDSLPAFALPGACVAIFTGPLLLARTPALHGVGTAGL

SEQ ID NO: 161742 - protein, 18 aa, Mycobacterium bovis
AAQIAFLGPLLGSLSRIY

SEQ ID NO: 161743 - protein, 32 aa, Mycobacterium bovis
AAQVPLWIGPILLYVLLPLLDLRFGPDGQNPP

SEQ ID NO: 161744 - protein, 18 aa, Mycobacterium bovis
AARRAHAIGLWGAAAAIA

SEQ ID NO: 161745 - protein, 24 aa, Mycobacterium bovis
AASVLPVWLLLAPRDYLSTFMKVG

SEQ ID NO: 161746 - protein, 17 aa, Mycobacterium bovis
AATAFHLLTGSPPFQHA

SEQ ID NO: 161747 - protein, 24 aa, Mycobacterium bovis
AATSFPLQVPWLPLAAPLAVLATY

SEQ ID NO: 161748 - protein, 27 aa, Mycobacterium bovis
AATVGITFLGMRFAKLGVFSTVGPALA

SEQ ID NO: 161749 - protein, 18 aa, Mycobacterium bovis
AAVAMPLFAGLYSISVLQ

SEQ ID NO: 161750 - protein, 18 aa, Mycobacterium bovis
AAVAVIVAVVFTVVVNKD

SEQ ID NO: 161751 - protein, 24 aa, Mycobacterium bovis
AAVCLVFIVMLMITQSLIASLVIV

SEQ ID NO: 161752 - protein, 28 aa, Mycobacterium bovis
AAVGIALWLPWLIAAGVAFILASAAGLV

SEQ ID NO: 161753 - protein, 28 aa, Mycobacterium bovis
AAVLAICMLPIIGMRWGVAENPTRQGGA

SEQ ID NO: 161754 - protein, 17 aa, Mycobacterium bovis
AAVLVTLAGRRLWHRFR

SEQ ID NO: 161755 - protein, 27 aa, Mycobacterium bovis
AAWTAAGMFLAVWLPLDNGLRPEPIIA

SEQ ID NO: 161756 - protein, 20 aa, Mycobacterium bovis
AAWVILAVIRYRGATTPGPV

SEQ ID NO: 161757 - protein, 20 aa, Mycobacterium bovis
ACIVAFWFLGFDTAGSPVWV

SEQ ID NO: 161758 - protein, 27 aa, Mycobacterium bovis
ADALTAVPLWIAFALGAKPATRRYTYG

SEQ ID NO: 161759 - protein, 26 aa, Mycobacterium bovis
ADAPVGIIALWALALLIIGTGIGIAW

SEQ ID NO: 161760 - protein, 17 aa, Mycobacterium bovis
ADDFAYLVDFGIASATT

SEQ ID NO: 161761 - protein, 28 aa, Mycobacterium bovis
ADFDDFFRPIRSYFYWEKHCYDIPVCWS

SEQ ID NO: 161762 - protein, 22 aa, Mycobacterium bovis
ADFEDFFRPIRSYFYWEKHCFD

SEQ ID NO: 161763 - protein, 29 aa, Mycobacterium bovis
ADGVIWARYNVPWQPAFVFYRADGTSTFV

SEQ ID NO: 161764 - protein, 31 aa, Mycobacterium bovis
ADHARQLLIRLAIAAVLFVPVADLSVMFGVV

SEQ ID NO: 161765 - protein, 23 aa, Mycobacterium bovis
ADIDRQMYFFYAATMAPFLVMGI

SEQ ID NO: 161766 - protein, 21 aa, Mycobacterium bovis
ADLLTRLHWPTPTAGAHRAPL

SEQ ID NO: 161767 - protein, 22 aa, Mycobacterium bovis
ADLRHWLIDYLVTNIGCTPDEV

SEQ ID NO: 161768 - protein, 19 aa, Mycobacterium bovis
ADLSFLPALALIFLNCVWV

SEQ ID NO: 161769 - protein, 22 aa, Mycobacterium bovis
ADNPVIFWTPEHGAFVVRGALN

SEQ ID NO: 161770 - protein, 25 aa, Mycobacterium bovis
ADPVFLDWLVGLAFPCQRPFGHQYG

SEQ ID NO: 161771 - protein, 31 aa, Mycobacterium bovis
ADRGTLLSIPLWIVIVLPIAKILATSLSIGT

SEQ ID NO: 161772 - protein, 39 aa, Mycobacterium bovis
ADRHGYRFIVGIGALIWAASLLWYLKVVGSQPDFLGEWL

SEQ ID NO: 161773 - protein, 20 aa, Mycobacterium bovis
ADSHLLGVIAFRALVLANPE

SEQ ID NO: 161774 - protein, 39 aa, Mycobacterium bovis
ADTFSRPRWSGRRLAFVVALVTVLMTAGLLIGRAIIRSN

SEQ ID NO: 161775 - protein, 52 aa, Mycobacterium bovis
ADVKRYFAEGLQYWPWVLLGYFNIGIMIVSLIGWWALSRLLERMRGIPDVHK

SEQ ID NO: 161776 - protein, 19 aa, Mycobacterium bovis
AECWPAVGGGVPSAYDLGT

SEQ ID NO: 161777 - protein, 26 aa, Mycobacterium bovis
AEELLSRSWWSGPEIFLIVDDIQQLP

SEQ ID NO: 161778 - protein, 27 aa, Mycobacterium bovis
AEPIAAAPPPLFRFGHRGPGDWQAGHR

SEQ ID NO: 161779 - protein, 19 aa, Mycobacterium bovis
AERVTFATWAIVTGKSPGG

SEQ ID NO: 161780 - protein, 25 aa, Mycobacterium bovis
AESRLNRLLAQQIPPARKVLAGADD

SEQ ID NO: 161781 - protein, 28 aa, Mycobacterium bovis
AETERIWLPFTIWLTAAPALLPPRSHRL

SEQ ID NO: 161782 - protein, 25 aa, Mycobacterium bovis
AEVIRLIRRLLPALVVVLAGCALLT

SEQ ID NO: 161783 - protein, 22 aa, Mycobacterium bovis
AFEVVGRRRLWFGVSGAIVAVA

SEQ ID NO: 161784 - protein, 19 aa, Mycobacterium bovis
AFGGYFYWDDLILVGRAGT

SEQ ID NO: 161785 - protein, 19 aa, Mycobacterium bovis
AFLILFATLMAAAGDGVSI

SEQ ID NO: 161786 - protein, 19 aa, Mycobacterium bovis
AFLPHQRSALRTALIPAID

SEQ ID NO: 161787 - protein, 22 aa, Mycobacterium bovis
AFRALQNWVPLVAAAGSMIIVA

SEQ ID NO: 161788 - protein, 25 aa, Mycobacterium bovis
AFSKPFFAQGLLNRRAVLKSSYAQF

SEQ ID NO: 161789 - protein, 27 aa, Mycobacterium bovis
AFVIDEGPLYFWLPCLACLLAVAELQL

SEQ ID NO: 161790 - protein, 21 aa, Mycobacterium bovis
AFVVFTLLVLAVIEIPLVAYL

SEQ ID NO: 161791 - protein, 36 aa, Mycobacterium bovis
AFVVQPTFLYELIWNVLVFVALIYIDRRFIIGHGRL

SEQ ID NO: 161792 - protein, 40 aa, Mycobacterium bovis
AGALTARMLAIAFFALLYLLPLILRLWRGDTTHDRHAAAR

SEQ ID NO: 161793 - protein, 34 aa, Mycobacterium bovis
AGAPPWYADVLLPDLGAAWRVLHAIPAARAARQR

SEQ ID NO: 161794 - protein, 26 aa, Mycobacterium bovis
AGAQLLWQLPLLSIGCGLIVAALLVT

SEQ ID NO: 161795 - protein, 22 aa, Mycobacterium bovis
AGAVAWVSLSSLLPAGAEEVSA

SEQ ID NO: 161796 - protein, 25 aa, Mycobacterium bovis
AGCLLPMVNLLWAPLYVIELALVED

SEQ ID NO: 161797 - protein, 24 aa, Mycobacterium bovis
AGEPPLPLVVPPTPVGGNALGGCG

SEQ ID NO: 161798 - protein, 27 aa, Mycobacterium bovis
AGEVGLSLFYWWYHTLDKTAAVFVVLV

SEQ ID NO: 161799 - protein, 26 aa, Mycobacterium bovis
AGGCRRPVWVTLIGNLLSLGVVMVYT

SEQ ID NO: 161800 - protein, 23 aa, Mycobacterium bovis
AGGIFVLLWHLLVVTNIDNVLRP

SEQ ID NO: 161801 - protein, 23 aa, Mycobacterium bovis
AGGRLHIVIGVIMLLLAARMVAR

SEQ ID NO: 161802 - protein, 20 aa, Mycobacterium bovis
AGIFGIPGQGSYAAANSYLD

SEQ ID NO: 161803 - protein, 26 aa, Mycobacterium bovis
AGIRTVKISLLVLGLTALIQIVIVVM

SEQ ID NO: 161804 - protein, 29 aa, Mycobacterium bovis
AGISALCLIFIIMLIITRSVVAAAVIVGT

SEQ ID NO: 161805 - protein, 26 aa, Mycobacterium bovis
AGKGDFLLGLLLPHGLLELTAVFLAA

SEQ ID NO: 161806 - protein, 19 aa, Mycobacterium bovis
AGLAFTLGMVLTSTLMVRP

SEQ ID NO: 161807 - protein, 17 aa, Mycobacterium bovis
AGLLSGYLLARKVVDAQ

SEQ ID NO: 161808 - protein, 18 aa, Mycobacterium bovis
AGMIAFLIAGLGGFMGVV

SEQ ID NO: 161809 - protein, 23 aa, Mycobacterium bovis
AGNGWRVSGLLRIDEVASATGYR

SEQ ID NO: 161810 - protein, 17 aa, Mycobacterium bovis
AGPPLFGSLITTAAYPT

SEQ ID NO: 161811 - protein, 34 aa, Mycobacterium bovis
AGPVARLWRGLLVFFSRWWQLETLYRSNMKYQPE

SEQ ID NO: 161812 - protein, 28 aa, Mycobacterium bovis
AGQGGRFLCTFPFSFEITEGEDRYVVSV

SEQ ID NO: 161813 - protein, 24 aa, Mycobacterium bovis
AGQRRRLLLARAVLSPARIVLLDE

SEQ ID NO: 161814 - protein, 39 aa, Mycobacterium bovis
AGRPNWRVLLLGLGTILAWLLIAILLARLFVPDDVGPAA

SEQ ID NO: 161815 - protein, 22 aa, Mycobacterium bovis
AGSLFPFLFITIACGALSGFHA

SEQ ID NO: 161816 - protein, 32 aa, Mycobacterium bovis
AGSSYFRNPWPALWAMMVGFFMIMLDSTVVAI

SEQ ID NO: 161817 - protein, 25 aa, Mycobacterium bovis
AGSVAWLIMLMTSPPTRAAARLMTP

SEQ ID NO: 161818 - protein, 23 aa, Mycobacterium bovis
AGSWLPALLWGVAFAILVRGLPV

SEQ ID NO: 161819 - protein, 25 aa, Mycobacterium bovis
AGTVFIVAVIFFTGYILGKHAGHGG

SEQ ID NO: 161820 - protein, 22 aa, Mycobacterium bovis
AGVAALFWRLPSDDTTRSRAKT

SEQ ID NO: 161821 - protein, 23 aa, Mycobacterium bovis
AGVLLFIIGFNFGFGSLVWVYAA

SEQ ID NO: 161822 - protein, 27 aa, Mycobacterium bovis
AGVNAEYWYRSIRQPVQFERAVRNAFD

SEQ ID NO: 161823 - protein, 18 aa, Mycobacterium bovis
AGVTAYEILKKAAAKAPL

SEQ ID NO: 161824 - protein, 18 aa, Mycobacterium bovis
AGVWMRLPATLAGIACWL

SEQ ID NO: 161825 - protein, 25 aa, Mycobacterium bovis
AGWASVIVSIWMLGGVTIFCIGLVG

SEQ ID NO: 161826 - protein, 17 aa, Mycobacterium bovis
AGWLPWFADIDRQMYFF

SEQ ID NO: 161827 - protein, 19 aa, Mycobacterium bovis
AGWMFGWLADRSGSLAAPL

SEQ ID NO: 161828 - protein, 20 aa, Mycobacterium bovis
AHLLLRFDQGRWVAIDNGSL

SEQ ID NO: 161829 - protein, 18 aa, Mycobacterium bovis
AHLPYVAWLTQASADAAG

SEQ ID NO: 161830 - protein, 30 aa, Mycobacterium bovis
AHPGSGGVALWWMIGLLVAAGVLGLMVVLP

SEQ ID NO: 161831 - protein, 21 aa, Mycobacterium bovis
AHQGTLLPILLITLINGIAEE

SEQ ID NO: 161832 - protein, 19 aa, Mycobacterium bovis
AHQPFRYWLTHAATVATAA

SEQ ID NO: 161833 - protein, 33 aa, Mycobacterium bovis
AHYCHYWRAFQPIPQWTLALIALLVVLSMNLIS

SEQ ID NO: 161834 - protein, 17 aa, Mycobacterium bovis
AIAFGVMLPIRTAGQLP

SEQ ID NO: 161835 - protein, 27 aa, Mycobacterium bovis
AIAGAFAVLFLPYSLLGPFAGALMDRW

SEQ ID NO: 161836 - protein, 18 aa, Mycobacterium bovis
AIALLLMPVLGWANHRVG

SEQ ID NO: 161837 - protein, 37 aa, Mycobacterium bovis
AIAMTWLLCEMAPGTPIWRLVLPFIALGVAGAFVWSP

SEQ ID NO: 161838 - protein, 23 aa, Mycobacterium bovis
AIATWLLVLFEVVSLTQAMISQY

SEQ ID NO: 161839 - protein, 37 aa, Mycobacterium bovis
AIGGLILLVKKIWWPLAVWLLLIVMNVDAGTPLGGPI

SEQ ID NO: 161840 - protein, 24 aa, Mycobacterium bovis
AIGLGAALLIAALLLSTYTTRRIA

SEQ ID NO: 161841 - protein, 24 aa, Mycobacterium bovis
AIGLVVAIVFLLVRVVRAPVEVKP

SEQ ID NO: 161842 - protein, 46 aa, Mycobacterium bovis
AIHQEAALTWLLLVSVPILAVANYWIISHMLPLFRRMQSLIDGINR

SEQ ID NO: 161843 - protein, 18 aa, Mycobacterium bovis
AIIFVYVFVALLVNREKL

SEQ ID NO: 161844 - protein, 21 aa, Mycobacterium bovis
AIIVILLIALTYTRLPWRPLA

SEQ ID NO: 161845 - protein, 22 aa, Mycobacterium bovis
AILAAVVCVLTLTIARPVRTYF

SEQ ID NO: 161846 - protein, 19 aa, Mycobacterium bovis
AILMLYTIVIIRGLRTAIA

SEQ ID NO: 161847 - protein, 20 aa, Mycobacterium bovis
AILVMGFPVLLKLTSNELGA

SEQ ID NO: 161848 - protein, 17 aa, Mycobacterium bovis
AIPVLAGPLLGALAAAV

SEQ ID NO: 161849 - protein, 23 aa, Mycobacterium bovis
AISLILIIMMIITRSVVAAVVIV

SEQ ID NO: 161850 - protein, 19 aa, Mycobacterium bovis
AISSIRWVNGLFGRLAWLF

SEQ ID NO: 161851 - protein, 29 aa, Mycobacterium bovis
AISSLCLIFIIMLIITRAFIAAAVIVGTV

SEQ ID NO: 161852 - protein, 29 aa, Mycobacterium bovis
AIVLLTADLSLAVAWPLAAVVRGHDWGTD

SEQ ID NO: 161853 - protein, 20 aa, Mycobacterium bovis
AIVVTVVGLAWLAFEHRRIR

SEQ ID NO: 161854 - protein, 22 aa, Mycobacterium bovis
AKAGLFPFHTWLADAHSQAPAP

SEQ ID NO: 161855 - protein, 21 aa, Mycobacterium bovis
AKIVGCALGFPVINIARSSAK

SEQ ID NO: 161856 - protein, 18 aa, Mycobacterium bovis
AKPSTLAFSKPFFAQGLL

SEQ ID NO: 161857 - protein, 25 aa, Mycobacterium bovis
AKTRVIAFLRKPIVTVSLVGIGSVV

SEQ ID NO: 161858 - protein, 20 aa, Mycobacterium bovis
AKVRGRLLALFGLALLEAAG

SEQ ID NO: 161859 - protein, 21 aa, Mycobacterium bovis
AKVVLALQHDKLPPSINFAGP

SEQ ID NO: 161860 - protein, 27 aa, Mycobacterium bovis
ALAAALALFVLLLGPTLFLLQSWVQNL

SEQ ID NO: 161861 - protein, 18 aa, Mycobacterium bovis
ALAERLFNRWGVRAVFLG

SEQ ID NO: 161862 - protein, 27 aa, Mycobacterium bovis
ALAFVSIAALIYFLHHLMHSIQIDTIM

SEQ ID NO: 161863 - protein, 21 aa, Mycobacterium bovis
ALAGGPWDWARWAPASPWATP

SEQ ID NO: 161864 - protein, 17 aa, Mycobacterium bovis
ALALLIIGTGIGIAWPH

SEQ ID NO: 161865 - protein, 34 aa, Mycobacterium bovis
ALALSMVLVAIAAGWMMLLNVLKPTGIVGDSAII

SEQ ID NO: 161866 - protein, 18 aa, Mycobacterium bovis
ALATLISIPVVSQLLGCT

SEQ ID NO: 161867 - protein, 31 aa, Mycobacterium bovis
ALDVLLFYVFFEAMLIPMYFLIGGFGQGAGR

SEQ ID NO: 161868 - protein, 23 aa, Mycobacterium bovis
ALGIMRFLAIFGPVHYFAQPVVS

SEQ ID NO: 161869 - protein, 23 aa, Mycobacterium bovis
ALGIPWNGWTALAALAVTCAVAT

SEQ ID NO: 161870 - protein, 27 aa, Mycobacterium bovis
ALGSYWAMFILVPGTLVLVFRILDEEK

SEQ ID NO: 161871 - protein, 30 aa, Mycobacterium bovis
ALGVERLVRALVLALAAWAVWEFRGARGAI

SEQ ID NO: 161872 - protein, 17 aa, Mycobacterium bovis
ALGVLPPPGAGAPPWYA

SEQ ID NO: 161873 - protein, 17 aa, Mycobacterium bovis
ALGVLVLLFSPPSIRWA

SEQ ID NO: 161874 - protein, 32 aa, Mycobacterium bovis
ALGVPSVLLYRLLTCWLPVFAGWQVMHWLTRH

SEQ ID NO: 161875 - protein, 25 aa, Mycobacterium bovis
ALGVRTLFRVPFLANWKISAAYLNW

SEQ ID NO: 161876 - protein, 22 aa, Mycobacterium bovis
ALGYVFVLLIVPVALILWRTFE

SEQ ID NO: 161877 - protein, 18 aa, Mycobacterium bovis
ALHFAKPIFGPAARALAQ

SEQ ID NO: 161878 - protein, 35 aa, Mycobacterium bovis
ALIEADGWRWVFLVNLPLGVFAVLAARRALVENRA

SEQ ID NO: 161879 - protein, 20 aa, Mycobacterium bovis
ALIGLLALVFAVVTSNQLVA

SEQ ID NO: 161880 - protein, 36 aa, Mycobacterium bovis
ALIHDAVLLAVILLTVVALASMWRGAVHGAAVGVGV

SEQ ID NO: 161881 - protein, 23 aa, Mycobacterium bovis
ALLAVLFSWLTYGNLLLRRGGSG

SEQ ID NO: 161882 - protein, 27 aa, Mycobacterium bovis
ALLELTVLVLLLAAWFHFVANGDGRRT

SEQ ID NO: 161883 - protein, 31 aa, Mycobacterium bovis
ALLLHIGVMLAFLILVLHSKHLHIFLAPINV

SEQ ID NO: 161884 - protein, 17 aa, Mycobacterium bovis
ALLLSTYTTRRIAEIPL

SEQ ID NO: 161885 - protein, 20 aa, Mycobacterium bovis
ALQEWAYGRRFRYSETMSLG

SEQ ID NO: 161886 - protein, 18 aa, Mycobacterium bovis
ALRAALIALALLAILAVI

SEQ ID NO: 161887 - protein, 32 aa, Mycobacterium bovis
ALRDMTYIGLPPFYPPGWFWIGGRAAALTGTP

SEQ ID NO: 161888 - protein, 19 aa, Mycobacterium bovis
ALRSRLLVRLGGAGGMVSL

SEQ ID NO: 161889 - protein, 28 aa, Mycobacterium bovis
ALSAFTLIPYALVLLQLRVFYAREQPWT

SEQ ID NO: 161890 - protein, 30 aa, Mycobacterium bovis
ALSALIHLLNLPPAGLLPIAAALGPGDQWG

SEQ ID NO: 161891 - protein, 19 aa, Mycobacterium bovis
ALSFQIYLALPMQASILMP

SEQ ID NO: 161892 - protein, 26 aa, Mycobacterium bovis
ALSRAVAVAWRRSLQLRVVALTLGLS

SEQ ID NO: 161893 - protein, 20 aa, Mycobacterium bovis
ALTMALLAAAVLYASVAVAD

SEQ ID NO: 161894 - protein, 25 aa, Mycobacterium bovis
ALVGFLPLVWLSLAYGWGLAGIWSG

SEQ ID NO: 161895 - protein, 18 aa, Mycobacterium bovis
ALVLPMAVPSLAEMAQRH

SEQ ID NO: 161896 - protein, 33 aa, Mycobacterium bovis
ALVVMNWLGLSWRWLFGLSIIPALISLIIRYRV

SEQ ID NO: 161897 - protein, 21 aa, Mycobacterium bovis
ALVYLQFRGEFTPKTQLTMLS

SEQ ID NO: 161898 - protein, 22 aa, Mycobacterium bovis
ALWARFPLPVIPAPGDPTPSAP

SEQ ID NO: 161899 - protein, 19 aa, Mycobacterium bovis
ALWNQATWWQSIAVWFVAA

SEQ ID NO: 161900 - protein, 18 aa, Mycobacterium bovis
AMALWLGAGPSVVRARAG

SEQ ID NO: 161901 - protein, 29 aa, Mycobacterium bovis
AMGYEPEDLPWEVPLIELGLDSLMAVRIK

SEQ ID NO: 161902 - protein, 26 aa, Mycobacterium bovis
AMLAAVAMFLGFVAPALSLSPVTYRT

SEQ ID NO: 161903 - protein, 17 aa, Mycobacterium bovis
AMLPILLVFIALQRQMI

SEQ ID NO: 161904 - protein, 29 aa, Mycobacterium bovis
AMLPLLSLPILIFGLLSIGLMPLKLFPHW

SEQ ID NO: 161905 - protein, 18 aa, Mycobacterium bovis
AMLYGSFFMHRGVPYFPN

SEQ ID NO: 161906 - protein, 17 aa, Mycobacterium bovis
AMPLGIWVFSPLRRRAT

SEQ ID NO: 161907 - protein, 21 aa, Mycobacterium bovis
AMRAMFGTRLLPREYADDFED

SEQ ID NO: 161908 - protein, 26 aa, Mycobacterium bovis
AMTIPIAIFMGCYLRFLRPGRVSEVS

SEQ ID NO: 161909 - protein, 19 aa, Mycobacterium bovis
ANDLLPPGGLIPLSRTSPA

SEQ ID NO: 161910 - protein, 25 aa, Mycobacterium bovis
ANFDDFFRPIRSYFYWEKHCYDIPS

SEQ ID NO: 161911 - protein, 20 aa, Mycobacterium bovis
ANHKKWIDLIIHIGQEGRGA

SEQ ID NO: 161912 - protein, 33 aa, Mycobacterium bovis
ANILTLLRLVMVPVFLLALFYGGGHHSAARVVA

SEQ ID NO: 161913 - protein, 23 aa, Mycobacterium bovis
ANNVLAFPGIGLGVIVAGARLIT

SEQ ID NO: 161914 - protein, 22 aa, Mycobacterium bovis
ANRVFVTIILFSVTICGVLVAT

SEQ ID NO: 161915 - protein, 39 aa, Mycobacterium bovis
ANTGWWPLIWFTAKVWGFLFIYFWLRATLPRLRYDQFMA

SEQ ID NO: 161916 - protein, 35 aa, Mycobacterium bovis
APAKRSLLRTAVIVPAVLAMLLVMAVAVTVREFQR

SEQ ID NO: 161917 - protein, 33 aa, Mycobacterium bovis
APASPPTPWPVTSSPTMAALPPPPPQPGIDCRA

SEQ ID NO: 161918 - protein, 17 aa, Mycobacterium bovis
APIALHWSLNGMGALAA

SEQ ID NO: 161919 - protein, 20 aa, Mycobacterium bovis
APIEQAWSRLCDLEQMIPLM

SEQ ID NO: 161920 - protein, 20 aa, Mycobacterium bovis
APLLGVLCSISWQRPVPVIQ

SEQ ID NO: 161921 - protein, 28 aa, Mycobacterium bovis
APMGRRLAALLIDWLIAYGLALLGVEFG

SEQ ID NO: 161922 - protein, 22 aa, Mycobacterium bovis
APPRLARVLRRAADLLALGADP

SEQ ID NO: 161923 - protein, 21 aa, Mycobacterium bovis
APVLLLLFGLAFPLGWLDAPD

SEQ ID NO: 161924 - protein, 24 aa, Mycobacterium bovis
APYLLIWVIIIAYMCHIPFAVRSQ

SEQ ID NO: 161925 - protein, 24 aa, Mycobacterium bovis
AQFAFFGWRWSLPLGVAILLAAVG

SEQ ID NO: 161926 - protein, 24 aa, Mycobacterium bovis
AQFGYLLLWVIVAANVMAALVQYL

SEQ ID NO: 161927 - protein, 23 aa, Mycobacterium bovis
AQGRLFTPFFITVGLVEAAYFIN

SEQ ID NO: 161928 - protein, 18 aa, Mycobacterium bovis
AQLLDWIHQAADAAEPVI

SEQ ID NO: 161929 - protein, 17 aa, Mycobacterium bovis
AQPDFLRRPGRDLAPEL

SEQ ID NO: 161930 - protein, 25 aa, Mycobacterium bovis
AQPGYALVGVLRIPQRRASPARVIS

SEQ ID NO: 161931 - protein, 48 aa, Mycobacterium bovis
AQVGKLEFAGYFAWLAWLVLHLVYLVGYRNRIAALFAWGISFMGRARG

SEQ ID NO: 161932 - protein, 23 aa, Mycobacterium bovis
ARFLNRNLGWLFLFKQGNVSLAG

SEQ ID NO: 161933 - protein, 17 aa, Mycobacterium bovis
ARLDGVLSRALATAPAD

SEQ ID NO: 161934 - protein, 21 aa, Mycobacterium bovis
ARPFIAFYNNCANAILRLVGV

SEQ ID NO: 161935 - protein, 26 aa, Mycobacterium bovis
ARRALDVVPTLWRGALVVLQSILAVA

SEQ ID NO: 161936 - protein, 26 aa, Mycobacterium bovis
ARRFALSPIPVYLLAGLSLGNGGILG

SEQ ID NO: 161937 - protein, 24 aa, Mycobacterium bovis
ARSVNPIAFVYNYLKQVVAEMRKV

SEQ ID NO: 161938 - protein, 23 aa, Mycobacterium bovis
ARTAALNLFVVVEAFYLFSCRSL

SEQ ID NO: 161939 - protein, 25 aa, Mycobacterium bovis
ARTVLRIMFPLSFVVAILLVSQGVI

SEQ ID NO: 161940 - protein, 25 aa, Mycobacterium bovis
ARWQSSWLRYAPLSFSGLVMIGAVI

SEQ ID NO: 161941 - protein, 20 aa, Mycobacterium bovis
ARWWQLLLRVVLPMSRPTMV

SEQ ID NO: 161942 - protein, 27 aa, Mycobacterium bovis
ARYGPRAPQLWLPPLDETIPLSAALAR

SEQ ID NO: 161943 - protein, 24 aa, Mycobacterium bovis
ASAAILAILPLLGVLLGQLIGARP

SEQ ID NO: 161944 - protein, 17 aa, Mycobacterium bovis
ASAIIVILLIALTYTRL

SEQ ID NO: 161945 - protein, 24 aa, Mycobacterium bovis
ASALAWVMFAILLVLTVLQLRITH

SEQ ID NO: 161946 - protein, 26 aa, Mycobacterium bovis
ASATAFPWVFLFPASILVLILVCANL

SEQ ID NO: 161947 - protein, 25 aa, Mycobacterium bovis
ASCKHPMIFPLSNPTSRMEAIPADV

SEQ ID NO: 161948 - protein, 18 aa, Mycobacterium bovis
ASFGLLEVSARMAVLLAG

SEQ ID NO: 161949 - protein, 31 aa, Mycobacterium bovis
ASFGLSVLLWQHILAIHLHWLVLAMSVIVLL

SEQ ID NO: 161950 - protein, 26 aa, Mycobacterium bovis
ASGLIFGWLAFLLVFGLFVRKGWDIV

SEQ ID NO: 161951 - protein, 32 aa, Mycobacterium bovis; identical to SEQ ID NO: 23415

SEQ ID NO: 161952 - protein, 23 aa, Mycobacterium bovis
ASGPAWRLIGTTAVGLLLLTFTP

SEQ ID NO: 161953 - protein, 26 aa, Mycobacterium bovis
ASGQTVLPFTGIDFRLSPSGVAVDSA

SEQ ID NO: 161954 - protein, 27 aa, Mycobacterium bovis
ASGSMVFAILVLLGRYINYTLDLAGIA

SEQ ID NO: 161955 - protein, 38 aa, Mycobacterium bovis
ASHGSLWVLPLRWSMVEYFYIKYYLPRGRSRPVIEVAE

SEQ ID NO: 161956 - protein, 20 aa, Mycobacterium bovis
ASLVVFLVALPLSLGIAIAS

SEQ ID NO: 161957 - protein, 24 aa, Mycobacterium bovis
ASMTMVWLAVLLYVKIGQPDDGVV

SEQ ID NO: 161958 - protein, 26 aa, Mycobacterium bovis
ASPVGLLVIVLLVIATLFLVRSMNQQ

SEQ ID NO: 161959 - protein, 23 aa, Mycobacterium bovis
ASRSQGRGLIRLARRVWPDSGWE

SEQ ID NO: 161960 - protein, 18 aa, Mycobacterium bovis
ASRWLLRPTAAEALSTVA

SEQ ID NO: 161961 - protein, 47 aa, Mycobacterium bovis
ASTAALITLLMTALWVLAVIARPYQWWRLALVLASGLAYVVIFSLPL

SEQ ID NO: 161962 - protein, 23 aa, Mycobacterium bovis
ASVGWLRLGALALALAALAALLI

SEQ ID NO: 161963 - protein, 27 aa, Mycobacterium bovis
ASVHSLLWIGVFLFLGGMAAGGCNSAG

SEQ ID NO: 161964 - protein, 30 aa, Mycobacterium bovis
ASVIFTIPSLALFVVLPLIIGTRILDEANV

SEQ ID NO: 161965 - protein, 30 aa, Mycobacterium bovis
ASVLGHSFTFMTPAAFVRRPGRWIRELARK

SEQ ID NO: 161966 - protein, 25 aa, Mycobacterium bovis
ASVPPLWVIVSCAVAMAAGTYLGGW

SEQ ID NO: 161967 - protein, 31 aa, Mycobacterium bovis
ASVSAALVICLGALLWSFISPSGQLNESPII

SEQ ID NO: 161968 - protein, 24 aa, Mycobacterium bovis
ASVSPLIRWIIKVPREFINDYLFN

SEQ ID NO: 161969 - protein, 25 aa, Mycobacterium bovis
ASVVFWAFGPWLIPPLVAASIWKHV

SEQ ID NO: 161970 - protein, 27 aa, Mycobacterium bovis
ATAGACIGFLWWNAAPAKIFMGDTGSL

SEQ ID NO: 161971 - protein, 27 aa, Mycobacterium bovis
ATALRLYTRWLGHVVLLVPTVLAVVAT

SEQ ID NO: 161972 - protein, 18 aa, Mycobacterium bovis
ATDLLFNGVIGRGLPGGI

SEQ ID NO: 161973 - protein, 17 aa, Mycobacterium bovis
ATELFAELAGCSSSIEM

SEQ ID NO: 161974 - protein, 25 aa, Mycobacterium bovis
ATFCLSFTRLPYFQTLGVPLAIGMV

SEQ ID NO: 161975 - protein, 19 aa, Mycobacterium bovis
ATFTAIFVPVLARAEQDDP

SEQ ID NO: 161976 - protein, 22 aa, Mycobacterium bovis
ATGAKYLYGPLLDKYESLGGAA

SEQ ID NO: 161977 - protein, 27 aa, Mycobacterium bovis
ATGLTLSPTLIFDYPTPATLAEHLDSR

SEQ ID NO: 161978 - protein, 17 aa, Mycobacterium bovis
ATGVVVGIFWMGRRLVS

SEQ ID NO: 161979 - protein, 17 aa, Mycobacterium bovis
ATHPAAVKPELVAHQPN

SEQ ID NO: 161980 - protein, 26 aa, Mycobacterium bovis
ATHYWKPLLLCFLVTLGGTVAFYTYS

SEQ ID NO: 161981 - protein, 21 aa, Mycobacterium bovis
ATIEAMWWIRSRMLGVKPRVW

SEQ ID NO: 161982 - protein, 25 aa, Mycobacterium bovis
ATIGFGWTLLVLLATFVLGFGLLAP

SEQ ID NO: 161983 - protein, 26 aa, Mycobacterium bovis
ATKAAARWIRPLVPPFVARMLDNTTA

SEQ ID NO: 161984 - protein, 57 aa, Mycobacterium bovis
ATLAGCLPAVIWWACHRPNRLWWRYTAWWLLAMALATLWWVMALTQLHGVSPPFLDF

SEQ ID NO: 161985 - protein, 26 aa, Mycobacterium bovis
ATLFGAFLRMPYALASAIFGGRNWAT

SEQ ID NO: 161986 - protein, 23 aa, Mycobacterium bovis
ATLKILIFSLLAGALLPGLFAVG

SEQ ID NO: 161987 - protein, 19 aa, Mycobacterium bovis
ATMPRGPLVGIPGAPSSFS

SEQ ID NO: 161988 - protein, 24 aa, Mycobacterium bovis
ATNQLYVLLSGQLHPVYNLTSARL

SEQ ID NO: 161989 - protein, 25 aa, Mycobacterium bovis
ATPIAFLLFAFFGGFAIMLGAELNA

SEQ ID NO: 161990 - protein, 35 aa, Mycobacterium bovis
ATQPLVLVFVAVIAFLMLLISIRSVFLAFKGVLMT

SEQ ID NO: 161991 - protein, 35 aa, Mycobacterium bovis
ATSLLMFTLVYAVLAVIWCWLLKRYIVEGPLEHDA

SEQ ID NO: 161992 - protein, 26 aa, Mycobacterium bovis
ATVEPIYYPRYLILTAPAAAVILAVC

SEQ ID NO: 161993 - protein, 20 aa, Mycobacterium bovis
ATYCLSFARLTLFHTMGPPL

SEQ ID NO: 161994 - protein, 20 aa, Mycobacterium bovis
AVAALTWDIPPGPASAPYNV

SEQ ID NO: 161995 - protein, 20 aa, Mycobacterium bovis
AVAFIAAISGWRAGALGSML

SEQ ID NO: 161996 - protein, 18 aa, Mycobacterium bovis
AVAIGLFVLPLSGPLHVA

SEQ ID NO: 161997 - protein, 25 aa, Mycobacterium bovis
AVALVLWWRMIRFEYALLVTVATAA

SEQ ID NO: 161998 - protein, 25 aa, Mycobacterium bovis
AVAPNILLLIIFRVVQGFGGGMLTP

SEQ ID NO: 161999 - protein, 27 aa, Mycobacterium bovis
AVARILAWRPLVWLGTISYGVYLWHWP

SEQ ID NO: 162000 - protein, 37 aa, Mycobacterium bovis
AVASAGFYAYLLTHVLFLNYVWGYTLLEAGMAVAPAA

SEQ ID NO: 162001 - protein, 26 aa, Mycobacterium bovis
AVASGFCLVLLAHSWWSLVSGSALGL

SEQ ID NO: 162002 - protein, 23 aa, Mycobacterium bovis
AVAYFWMHQPYALWPIGGPPDGN

SEQ ID NO: 162003 - protein, 48 aa, Mycobacterium bovis
AVDATVVRLVLVPALMAMFDRWNWWLPRWLAHILPSVDFDRPLPKVDL

SEQ ID NO: 162004 - protein, 19 aa, Mycobacterium bovis
AVEALFRPMHDRLASAVVA

SEQ ID NO: 162005 - protein, 20 aa, Mycobacterium bovis
AVELAFVGPLLAAVARIYGG

SEQ ID NO: 162006 - protein, 34 aa, Mycobacterium bovis
AVERTLALALALYLAAALMIWAQARLLNLTVQKT

SEQ ID NO: 162007 - protein, 17 aa, Mycobacterium bovis
AVFFAVSGFLLWRGHAA

SEQ ID NO: 162008 - protein, 25 aa, Mycobacterium bovis
AVFGGFYLGFLLIAAVTALILVLAA

SEQ ID NO: 162009 - protein, 26 aa, Mycobacterium bovis
AVFLGRFIALLRIFAGPLAGALKMPY

SEQ ID NO: 162010 - protein, 18 aa, Mycobacterium bovis
AVGLLGTGALLAAALTLW

SEQ ID NO: 162011 - protein, 22 aa, Mycobacterium bovis
AVIAFIFIKLFGAAAPGGEPSG

SEQ ID NO: 162012 - protein, 21 aa, Mycobacterium bovis
AVLAILVWWALRHRNRCSVNA

SEQ ID NO: 162013 - protein, 17 aa, Mycobacterium bovis
AVLFLTSSLYSTATFLA

SEQ ID NO: 162014 - protein, 20 aa, Mycobacterium bovis
AVLGFFGFYLSFVAELPPPP

SEQ ID NO: 162015 - protein, 17 aa, Mycobacterium bovis
AVLLILLTGLQRRPWAI

SEQ ID NO: 162016 - protein, 24 aa, Mycobacterium bovis
AVLLPFFSFMTYLIAVPTGIKFFN

SEQ ID NO: 162017 - protein, 27 aa, Mycobacterium bovis
AVLPAKLILMAIALICAAAVFSAIALR

SEQ ID NO: 162018 - protein, 17 aa, Mycobacterium bovis
AVLPTVVAPPLTSRRLE

SEQ ID NO: 162019 - protein, 24 aa, Mycobacterium bovis
AVLTSPIGFLQRPARWIQMLASNT

SEQ ID NO: 162020 - protein, 21 aa, Mycobacterium bovis
AVLVLAPFWLIPTSLDVHLSM

SEQ ID NO: 162021 - protein, 21 aa, Mycobacterium bovis
AVMAPWCRVAYIAHGQHRVCG

SEQ ID NO: 162022 - protein, 17 aa, Mycobacterium bovis
AVPLVPVRLLPPGLETR

SEQ ID NO: 162023 - protein, 22 aa, Mycobacterium bovis
AVRQVMWPKIGGSQVLHDAFPP

SEQ ID NO: 162024 - protein, 22 aa, Mycobacterium bovis
AVRSVFTVMLRAVDPDPVMPDA

SEQ ID NO: 162025 - protein, 21 aa, Mycobacterium bovis
AVSAALAVLVIACPCALGLAT

SEQ ID NO: 162026 - protein, 18 aa, Mycobacterium bovis
AVSALAPKWLASTVGVVQ

SEQ ID NO: 162027 - protein, 19 aa, Mycobacterium bovis
AVSFWLTAPYLVAESIRHL

SEQ ID NO: 162028 - protein, 29 aa, Mycobacterium bovis
AVSPPPIDERWLPESALPAPPRPTVQREV

SEQ ID NO: 162029 - protein, 22 aa, Mycobacterium bovis
AVTAVLLLGWRAAVALMAPHRA

SEQ ID NO: 162030 - protein, 28 aa, Mycobacterium bovis
AVTFAIVPLLHRFGGLVAPLTFIGTAYV

SEQ ID NO: 162031 - protein, 33 aa, Mycobacterium bovis
AVTQAIPATLLLLRYRWLRSEPLPVRRPASVRR

SEQ ID NO: 162032 - protein, 27 aa, Mycobacterium bovis
AVVAGRWQLIAFAAPLLGVLCSISWQR

SEQ ID NO: 162033 - protein, 26 aa, Mycobacterium bovis
AVVFYPLHLVPFGLIALLWQVVTMAA

SEQ ID NO: 162034 - protein, 26 aa, Mycobacterium bovis
AVVGIGLGLALYFTPAMSAREIVIIG

SEQ ID NO: 162035 - protein, 18 aa, Mycobacterium bovis
AVVLATMPPLLSAIANAG

SEQ ID NO: 162036 - protein, 27 aa, Mycobacterium bovis
AVVVAVAASLIWWTSDARATISRPAAV

SEQ ID NO: 162037 - protein, 21 aa, Mycobacterium bovis
AVVVFMLFPLGFSLYMSFQKW

SEQ ID NO: 162038 - protein, 33 aa, Mycobacterium bovis
AVVVGVALVFVQWWGQPAWSWAVLGLRGRRPVK

SEQ ID NO: 162039 - protein, 20 aa, Mycobacterium bovis
AVVVLLKGKVWTGLLGMFVV

SEQ ID NO: 162040 - protein, 27 aa, Mycobacterium bovis
AVVYGGLYFALYALQFFLPQLVASLAH

SEQ ID NO: 162041 - protein, 22 aa, Mycobacterium bovis
AVWSNGWWIDPAIGLAIAGIAV

SEQ ID NO: 162042 - protein, 25 aa, Mycobacterium bovis
AVYCLSFTRLPYFQSLGIPASIGVM

SEQ ID NO: 162043 - protein, 21 aa, Mycobacterium bovis
AVYLALLVSSVLHLARTIAGP

SEQ ID NO: 162044 - protein, 20 aa, Mycobacterium bovis
AWALSVMFLVFTLRALLYKP

SEQ ID NO: 162045 - protein, 23 aa, Mycobacterium bovis
AWCALFPIIWALSGSLKADGEVT

SEQ ID NO: 162046 - protein, 19 aa, Mycobacterium bovis
AWHYFPRHRFLFGDKYDSV

SEQ ID NO: 162047 - protein, 26 aa, Mycobacterium bovis
AWIDRAVVIWVLIALAAAMVVYIVAW

SEQ ID NO: 162048 - protein, 21 aa, Mycobacterium bovis
AWLYHAIERLILARRISTVRT

SEQ ID NO: 162049 - protein, 33 aa, Mycobacterium bovis
AWSMLIVVLFVPAALPWYYSWPLAVAAPLAQSR

SEQ ID NO: 162050 - protein, 22 aa, Mycobacterium bovis
AWTRTAFALLVNGVLLTLKDTQ

SEQ ID NO: 162051 - protein, 25 aa, Mycobacterium bovis
AWVSLYRAKWWWLLAAVAAAGASMH

SEQ ID NO: 162052 - protein, 21 aa, Mycobacterium bovis
AYAFARLQFRGRDALFWVYVA

SEQ ID NO: 162053 - protein, 21 aa, Mycobacterium bovis
AYDLTLFVNQLAAGNLRAAIE

SEQ ID NO: 162054 - protein, 21 aa, Mycobacterium bovis
AYERYWLYPGAQNLATFRAHL

SEQ ID NO: 162055 - protein, 21 aa, Mycobacterium bovis
AYGAGLWYGVVRERNIGALKP

SEQ ID NO: 162056 - protein, 25 aa, Mycobacterium bovis
AYGSLVMVFQWGWARGLGFPALHSI

SEQ ID NO: 162057 - protein, 19 aa, Mycobacterium bovis
AYLIAKVCVYTVLAVVQSA

SEQ ID NO: 162058 - protein, 19 aa, Mycobacterium bovis
AYPRTGSVVVWYSPRRADR

SEQ ID NO: 162059 - protein, 25 aa, Mycobacterium bovis
AYRTTIFAFPVFGFGVIFGAIWAEE

SEQ ID NO: 162060 - protein, 20 aa, Mycobacterium bovis
CAAVWLVFTGVSVAAAVALM

SEQ ID NO: 162061 - protein, 22 aa, Mycobacterium bovis
CAIFTPYRWMIEHVTTKRGQLR

SEQ ID NO: 162062 - protein, 18 aa, Mycobacterium bovis
CALAMMVFSKSFSVLRSA

SEQ ID NO: 162063 - protein, 32 aa, Mycobacterium bovis
CAQYLAPVLDAIKFNYFPFGLNVASTASTLPK

SEQ ID NO: 162064 - protein, 18 aa, Mycobacterium bovis
CEEIIYRGLLWGAVDRRW

SEQ ID NO: 162065 - protein, 17 aa, Mycobacterium bovis
CFGVEVWFLAALAAPLL

SEQ ID NO: 162066 - protein, 44 aa, Mycobacterium bovis
CGGLVGPIFLVVYFTLGLGSLMSWMFYVGLIITVADVLVALALT

SEQ ID NO: 162067 - protein, 17 aa, Mycobacterium bovis
CGHMWVARRTGMKVRRY

SEQ ID NO: 162068 - protein, 21 aa, Mycobacterium bovis
CGLVYELALLTLAASLNGGGI

SEQ ID NO: 162069 - protein, 20 aa, Mycobacterium bovis
CGVFVFLILRALGELVLHRP

SEQ ID NO: 162070 - protein, 24 aa, Mycobacterium bovis
CIARPLVPSIMIAAALIAGTGSVL

SEQ ID NO: 162071 - protein, 23 aa, Mycobacterium bovis
CKQNPIFDPLQPDDPRAWNAVTT

SEQ ID NO: 162072 - protein, 23 aa, Mycobacterium bovis
CSPWQIYWRILLPHSRPAVLVLG

SEQ ID NO: 162073 - protein, 17 aa, Mycobacterium bovis
CSVVFQHPYLFHGTIRD

SEQ ID NO: 162074 - protein, 17 aa, Mycobacterium bovis
CVASAMLGLALSAIAKS

SEQ ID NO: 162075 - protein, 25 aa, Mycobacterium bovis
CVASMLIAHAMVRPIRRLEVGTQKI

SEQ ID NO: 162076 - protein, 29 aa, Mycobacterium bovis
CWQPITRDLWPAPYLVMDTGASLAPYNHM

SEQ ID NO: 162077 - protein, 25 aa, Mycobacterium bovis
DAAGLHATFLALALPIVCTGLVAIR

SEQ ID NO: 162078 - protein, 20 aa, Mycobacterium bovis
DAAPAVLPPMGAKLGQRAAA

SEQ ID NO: 162079 - protein, 23 aa, Mycobacterium bovis
DAAYLITGGLGALGLLMADWLAD

SEQ ID NO: 162080 - protein, 25 aa, Mycobacterium bovis
DAENTLGSWLPPGPAAVADYPTVLL

SEQ ID NO: 162081 - protein, 26 aa, Mycobacterium bovis
DAITVVAVLLWIVAALIVGSVVYLSA

SEQ ID NO: 162082 - protein, 19 aa, Mycobacterium bovis
DALFLTAGIVVGILISLRG

SEQ ID NO: 162083 - protein, 21 aa, Mycobacterium bovis
DATAWLMRRSLQFGALTAEEL

SEQ ID NO: 162084 - protein, 21 aa, Mycobacterium bovis
DAVAALTWQLPAEPGGGAAPA

SEQ ID NO: 162085 - protein, 19 aa, Mycobacterium bovis
DAVVIFGFLLWHVIGANSS

SEQ ID NO: 162086 - protein, 26 aa, Mycobacterium bovis
DAVWPVMIVLLLNLTAAYSATRFAPA

SEQ ID NO: 162087 - protein, 20 aa, Mycobacterium bovis
DAWGHLLGCAAALAAFGVGA

SEQ ID NO: 162088 - protein, 24 aa, Mycobacterium bovis
DAYGFPAGLWRWLQRHPPPALHRL

SEQ ID NO: 162089 - protein, 21 aa, Mycobacterium bovis
DDAIMFEPRYAVRQPDGGWGE

SEQ ID NO: 162090 - protein, 25 aa, Mycobacterium bovis
DDASSWLVRRPPLHGLTPSAHDMAR

SEQ ID NO: 162091 - protein, 23 aa, Mycobacterium bovis
DDEFWMLMAGRKLAARDRRVLTA

SEQ ID NO: 162092 - protein, 24 aa, Mycobacterium bovis
DDQKKRWLPGIADGSLTMAFAITE

SEQ ID NO: 162093 - protein, 17 aa, Mycobacterium bovis
DDTLALHYLVTHAVPDA

SEQ ID NO: 162094 - protein, 27 aa, Mycobacterium bovis
DDVLQAYLNIIYFGRGAYGISAASKAY

SEQ ID NO: 162095 - protein, 20 aa, Mycobacterium bovis
DEFVVAVRQLAIGQDAPIEV

SEQ ID NO: 162096 - protein, 20 aa, Mycobacterium bovis
DELGWPMLCLMTIAAGALQI

SEQ ID NO: 162097 - protein, 17 aa, Mycobacterium bovis
DERGLLYVSGRDDEMIV

SEQ ID NO: 162098 - protein, 26 aa, Mycobacterium bovis
DESIEAFRRFHAALFSKDIQPAELGK

SEQ ID NO: 162099 - protein, 25 aa, Mycobacterium bovis
DEWTPPLLQSLYLVVLGAGIGLSMQ

SEQ ID NO: 162100 - protein, 18 aa, Mycobacterium bovis
DFMNIMLSALSAAALWLL

SEQ ID NO: 162101 - protein, 26 aa, Mycobacterium bovis
DGAALTFPMLQFSLLGAICLLGTLWL

SEQ ID NO: 162102 - protein, 26 aa, Mycobacterium bovis
DGAVFLLVSVLLLVLVRPAVRRRLTQ

SEQ ID NO: 162103 - protein, 23 aa, Mycobacterium bovis
DGLETVLHIFPTLAANINQLYHP

SEQ ID NO: 162104 - protein, 26 aa, Mycobacterium bovis
DGMRHRRFLPARWWSIGGLDTLVIAV

SEQ ID NO: 162105 - protein, 23 aa, Mycobacterium bovis
DGRHPFLVMELIEGGTLRELLIE

SEQ ID NO: 162106 - protein, 27 aa, Mycobacterium bovis
DGRNTLLLPFRVAAVHLILWDIGGALL

SEQ ID NO: 162107 - protein, 22 aa, Mycobacterium bovis
DGRTLLLGSPSLLRAEKVRVSK

SEQ ID NO: 162108 - protein, 20 aa, Mycobacterium bovis
DHQPLLRRLLEDRIGTAATA

SEQ ID NO: 162109 - protein, 27 aa, Mycobacterium bovis
DHRARLIGFALLAFCSVVARAVGTVLL

SEQ ID NO: 162110 - protein, 19 aa, Mycobacterium bovis
DIEPIYLLKREVVELRRCV

SEQ ID NO: 162111 - protein, 22 aa, Mycobacterium bovis
DIKSLADGLARFTWQLRAADPR

SEQ ID NO: 162112 - protein, 22 aa, Mycobacterium bovis
DINNLLPLMQRLDTLMPQLTAM

SEQ ID NO: 162113 - protein, 19 aa, Mycobacterium bovis
DIVLVRPGERISADATVLA

SEQ ID NO: 162114 - protein, 28 aa, Mycobacterium bovis
DIYQLVDVDFWLRLMLRSAVCFVPHELS

SEQ ID NO: 162115 - protein, 24 aa, Mycobacterium bovis
DKKRYLWLMGLIAPTALVVMLPLI

SEQ ID NO: 162116 - protein, 23 aa, Mycobacterium bovis
DKLDITALLPTSPAQRYLQAYYT

SEQ ID NO: 162117 - protein, 23 aa, Mycobacterium bovis
DKLTKPVWLVILGAAVALASILY

SEQ ID NO: 162118 - protein, 24 aa, Mycobacterium bovis
DKMDPQQRLLLEVAWEALEHAGIP

SEQ ID NO: 162119 - protein, 21 aa, Mycobacterium bovis
DLAAAVRILSALPVARAASES

SEQ ID NO: 162120 - protein, 27 aa, Mycobacterium bovis
DLAELLAMRGIDGLPFSWTVASWTQHS

SEQ ID NO: 162121 - protein, 23 aa, Mycobacterium bovis
DLAPELAGFWTGGFVQAPFNTRI

SEQ ID NO: 162122 - protein, 17 aa, Mycobacterium bovis
DLDFRARFVREADVAAG

SEQ ID NO: 162123 - protein, 37 aa, Mycobacterium bovis
DLIPENVHWTIWQLWLVVLLVALWKGRRIGPLVAEEL

SEQ ID NO: 162124 - protein, 21 aa, Mycobacterium bovis
DLSGQLLFIVAVGALVYAVIE

SEQ ID NO: 162125 - protein, 26 aa, Mycobacterium bovis
DLSMLLGLIFLLWSGPGRWSLDRRLS

SEQ ID NO: 162126 - protein, 19 aa, Mycobacterium bovis
DLTANPLRFLARATNLWNS

SEQ ID NO: 162127 - protein, 20 aa, Mycobacterium bovis
DLVMMKYLAFGLMAALLLDA

SEQ ID NO: 162128 - protein, 29 aa, Mycobacterium bovis
DLVYLGYGLAILALPFVILIGLIVSRQWK

SEQ ID NO: 162129 - protein, 24 aa, Mycobacterium bovis
DMMGELFWTVVPYVTMTIVAVGSW

SEQ ID NO: 162130 - protein, 19 aa, Mycobacterium bovis
DPAPVAVPVPRRSTPGPSD

SEQ ID NO: 162131 - protein, 20 aa, Mycobacterium bovis
DPFLVQYLRYLGGILHGDLG

SEQ ID NO: 162132 - protein, 19 aa, Mycobacterium bovis
DPGALRRLDRVRVVVIDGA

SEQ ID NO: 162133 - protein, 24 aa, Mycobacterium bovis
DPGNPLAILVPLTAAAMDLVAMGA

SEQ ID NO: 162134 - protein, 28 aa, Mycobacterium bovis
DPLTAIRYQIVVMYLLLAATAVAALTCA

SEQ ID NO: 162135 - protein, 17 aa, Mycobacterium bovis
DPPIFIVGHWRTGTTLL

SEQ ID NO: 162136 - protein, 22 aa, Mycobacterium bovis
DPQQRMALELTWEALEHARIPA

SEQ ID NO: 162137 - protein, 23 aa, Mycobacterium bovis
DPRYLWAGLVLLAATAASSDLSS

SEQ ID NO: 162138 - protein, 29 aa, Mycobacterium bovis
DPSVDVAILAVPHLPPPPLVFAAEPAKTG

SEQ ID NO: 162139 - protein, 26 aa, Mycobacterium bovis
DPVFAKALAKQPKDRYQRCVDFARAL

SEQ ID NO: 162140 - protein, 50 aa, Mycobacterium bovis
DQEAARSASWRRRLRVRLPRLSTIAMAAAVVIICGFTGLSGYIVWQHHEA

SEQ ID NO: 162141 - protein, 20 aa, Mycobacterium bovis
DQRELWRAVGIRGATTAAAA

SEQ ID NO: 162142 - protein, 21 aa, Mycobacterium bovis
DQRVLAIRLTNGSSLLISKSL

SEQ ID NO: 162143 - protein, 24 aa, Mycobacterium bovis
DQRVLGAALWYAATVKDAVIVAAA

SEQ ID NO: 162144 - protein, 23 aa, Mycobacterium bovis
DRDFIGISLFSLGLSVAVVVGAG

SEQ ID NO: 162145 - protein, 17 aa, Mycobacterium bovis
DREPYWVCAIYLVLLAV

SEQ ID NO: 162146 - protein, 21 aa, Mycobacterium bovis
DRHLRPMLARRFEIATGHRQA

SEQ ID NO: 162147 - protein, 19 aa, Mycobacterium bovis
DRIGAYERYWLYPGAQNLA

SEQ ID NO: 162148 - protein, 19 aa, Mycobacterium bovis
DRLVYLSYGLAVILGFIGV

SEQ ID NO: 162149 - protein, 20 aa, Mycobacterium bovis
DRNIDRLLRRVCPGDIVVLD

SEQ ID NO: 162150 - protein, 26 aa, Mycobacterium bovis
DRQRILTWLIVDPLSPNRVRSAAALW

SEQ ID NO: 162151 - protein, 29 aa, Mycobacterium bovis
DRSAPLSRRSLLIGNAVVAFAVIGFASLA

SEQ ID NO: 162152 - protein, 31 aa, Mycobacterium bovis
DRSQLITMTYTLRYRWWVVLTGVAIAAFTVH

SEQ ID NO: 162153 - protein, 19 aa, Mycobacterium bovis
DRTLMWVVDLLLVVPSFIL

SEQ ID NO: 162154 - protein, 20 aa, Mycobacterium bovis
DSFDGYEYLFWVGCAGAYDD

SEQ ID NO: 162155 - protein, 26 aa, Mycobacterium bovis
DSIGWTLMHYLPPTPGFRFIDHTVIG

SEQ ID NO: 162156 - protein, 17 aa, Mycobacterium bovis
DSMRWLATVIQMDGRRI

SEQ ID NO: 162157 - protein, 24 aa, Mycobacterium bovis
DSRPRLILGASLIGLSFLGLCHLW

SEQ ID NO: 162158 - protein, 24 aa, Mycobacterium bovis
DTGLPVGVALLAALLAGVALVPKA

SEQ ID NO: 162159 - protein, 25 aa, Mycobacterium bovis
DTHPGWVNLPAVILIGLCALLLIRG

SEQ ID NO: 162160 - protein, 26 aa, Mycobacterium bovis
DTKVLSPPYSILAIGDPPTLAAAMNI

SEQ ID NO: 162161 - protein, 19 aa, Mycobacterium bovis
DTPVLYWINGIGCAIFAGL

SEQ ID NO: 162162 - protein, 24 aa, Mycobacterium bovis
DTRGRIVLRWLRIAVLIVTGLVTL

SEQ ID NO: 162163 - protein, 22 aa, Mycobacterium bovis
DTRLELWRSDMVRMLAYGEIDA

SEQ ID NO: 162164 - protein, 31 aa, Mycobacterium bovis
DVAKYFAIIPAMFVGLYPVLDKLNVMALHSP

SEQ ID NO: 162165 - protein, 30 aa, Mycobacterium bovis
DVGIRRHVLSALWWAALAGTATVVIRWVVQ

SEQ ID NO: 162166 - protein, 23 aa, Mycobacterium bovis
DVIHAFWVPEFLFKRDVMPNPVA

SEQ ID NO: 162167 - protein, 36 aa, Mycobacterium bovis
DVLRMVIGGVALALLGVRRYVFARPPLLGTTGRTVA

SEQ ID NO: 162168 - protein, 23 aa, Mycobacterium bovis
DVRQILFLVQMTATVLVTAPIMC

SEQ ID NO: 162169 - protein, 19 aa, Mycobacterium bovis
DVRRLVRRLLGRPDPVHKP

SEQ ID NO: 162170 - protein, 21 aa, Mycobacterium bovis
DVSIRWQLKQAAAPELFQQYK

SEQ ID NO: 162171 - protein, 24 aa, Mycobacterium bovis
DVTPRRGWLESLLGHFCDPTVALV

SEQ ID NO: 162172 - protein, 30 aa, Mycobacterium bovis
DVVGCSMRLPFLYAPLPYGGTLHVDGGVLD

SEQ ID NO: 162173 - protein, 27 aa, Mycobacterium bovis
DVVLRPHWTPLFAYAAAFLIAVAHVAG

SEQ ID NO: 162174 - protein, 27 aa, Mycobacterium bovis
DVYSLGCVLYEVLTGEPPFTGDSPVSV

SEQ ID NO: 162175 - protein, 17 aa, Mycobacterium bovis
DYEVFLVSRIREYWLES

SEQ ID NO: 162176 - protein, 27 aa, Mycobacterium bovis
DYGTYFKDHLYIAGRIKDLVIIDGRNH

SEQ ID NO: 162177 - protein, 25 aa, Mycobacterium bovis
DYLAAHPLIGPWLDELQAFDVFSSF

SEQ ID NO: 162178 - protein, 17 aa, Mycobacterium bovis
DYPTVLLSGAWLSQEQT

SEQ ID NO: 162179 - protein, 26 aa, Mycobacterium bovis
DYSFLSYYPYWGFQGLTPHYANPLAQ

SEQ ID NO: 162180 - protein, 17 aa, Mycobacterium bovis
EAAGFAIPFVPRGLDEI

SEQ ID NO: 162181 - protein, 22 aa, Mycobacterium bovis
EAELLALFAGSVLRGADLATLL

SEQ ID NO: 162182 - protein, 19 aa, Mycobacterium bovis
EAHLNRELWIGAVIASLAV

SEQ ID NO: 162183 - protein, 24 aa, Mycobacterium bovis
EAIALIVVMVRYLEPFTAVSELAP

SEQ ID NO: 162184 - protein, 29 aa, Mycobacterium bovis
EAIGMRLRDMLWAAIFPSLDLATDSAREV

SEQ ID NO: 162185 - protein, 28 aa, Mycobacterium bovis
EALTTAFLIIFTVLALVGYPLVWETATR

SEQ ID NO: 162186 - protein, 35 aa, Mycobacterium bovis
EATSVRQRTWGWALAVVVIVLALAAIAILGTVLLT

SEQ ID NO: 162187 - protein, 27 aa, Mycobacterium bovis
EAVMNKLRWVLLIVGGIGVAVAAVAGG

SEQ ID NO: 162188 - protein, 26 aa, Mycobacterium bovis
ECLALIAMVPLTAWLCGAYSAVRHLD

SEQ ID NO: 162189 - protein, 17 aa, Mycobacterium bovis
EDAAIAHLFAGLNPERI

SEQ ID NO: 162190 - protein, 24 aa, Mycobacterium bovis
EDEFVWCMQGLPSPYLTIAFPNRP

SEQ ID NO: 162191 - protein, 18 aa, Mycobacterium bovis
EDFLCPACGIFERGFGPT

SEQ ID NO: 162192 - protein, 17 aa, Mycobacterium bovis
EEPTRTVYWSQPEPRWP

SEQ ID NO: 162193 - protein, 20 aa, Mycobacterium bovis
EFLVAVIELIPRPFTPTVIV

SEQ ID NO: 162194 - protein, 22 aa, Mycobacterium bovis
EFRPERFLGTRPQTYAWVPFGG

SEQ ID NO: 162195 - protein, 25 aa, Mycobacterium bovis
EFTEPEMWFVRQAHQICPVGAVVAT

SEQ ID NO: 162196 - protein, 23 aa, Mycobacterium bovis
EGALLAALIRRPSTLDPAVDPEG

SEQ ID NO: 162197 - protein, 30 aa, Mycobacterium bovis
EGALVLGVLFWFTFVGWVTVVIAGGISRRP

SEQ ID NO: 162198 - protein, 22 aa, Mycobacterium bovis
EGLLTWLGGGHWRELGERHERS

SEQ ID NO: 162199 - protein, 31 aa, Mycobacterium bovis
EGMFNALPDMGPWQLPPIPAAGAPNSLGLPD

SEQ ID NO: 162200 - protein, 24 aa, Mycobacterium bovis
EGMGTTLTAILFAGNRLGLVHIGD

SEQ ID NO: 162201 - protein, 22 aa, Mycobacterium bovis
EGQRLLARLDVLSLAAASAPVV

SEQ ID NO: 162202 - protein, 24 aa, Mycobacterium bovis
EGRDWNWLKWLPHVDIPGRLDALG

SEQ ID NO: 162203 - protein, 17 aa, Mycobacterium bovis
EGVPIRGFGIHPAVLDA

SEQ ID NO: 162204 - protein, 19 aa, Mycobacterium bovis
EHNALHLVYITMTGSAIAA

SEQ ID NO: 162205 - protein, 25 aa, Mycobacterium bovis
EHPSLVLQVILFVAVVFGTLNVIGG

SEQ ID NO: 162206 - protein, 23 aa, Mycobacterium bovis
EHVTPWFNLDWITSAKLVAVVGF

SEQ ID NO: 162207 - protein, 20 aa, Mycobacterium bovis
EIDGQLYVDMRLINGVDLAA

SEQ ID NO: 162208 - protein, 19 aa, Mycobacterium bovis
EIWKRTLFRFVQQVYFRRR

SEQ ID NO: 162209 - protein, 24 aa, Mycobacterium bovis
EKHCYGIPICWSFRSIFDALDGID

SEQ ID NO: 162210 - protein, 18 aa, Mycobacterium bovis
EKIPLLGHLWSWELAIPM

SEQ ID NO: 162211 - protein, 18 aa, Mycobacterium bovis
EKISFLPAMRYYAGNWAT

SEQ ID NO: 162212 - protein, 23 aa, Mycobacterium bovis
EKKTYPYFDPIAQKAFDANYEGE

SEQ ID NO: 162213 - protein, 18 aa, Mycobacterium bovis
EKQKLELLRSLLTYFHYA

SEQ ID NO: 162214 - protein, 24 aa, Mycobacterium bovis
ELAATIARRLGLTGALGTVAESVD

SEQ ID NO: 162215 - protein, 19 aa, Mycobacterium bovis
ELAGIWVYERRFTDDELLR

SEQ ID NO: 162216 - protein, 26 aa, Mycobacterium bovis
ELDAELWIAALIFPAFTAGGAIGNVV

SEQ ID NO: 162217 - protein, 28 aa, Mycobacterium bovis
ELDRTLLLWMLPLLIAPPMYSKDVYSYL

SEQ ID NO: 162218 - protein, 17 aa, Mycobacterium bovis
ELFAELAGCSSSIEMTR

SEQ ID NO: 162219 - protein, 19 aa, Mycobacterium bovis
ELFATIGVTFFGAGVISTG

SEQ ID NO: 162220 - protein, 17 aa, Mycobacterium bovis
ELGLLIDAPRSATVRAL

SEQ ID NO: 162221 - protein, 20 aa, Mycobacterium bovis
ELGWICVAINYRHSPRNTWP

SEQ ID NO: 162222 - protein, 26 aa, Mycobacterium bovis
ELLVVMLPLIGVLYVGIKALSSFTRR

SEQ ID NO: 162223 - protein, 18 aa, Mycobacterium bovis
ELTFRRIAAALGRPMVPI

SEQ ID NO: 162224 - protein, 21 aa, Mycobacterium bovis
ELTPVAWWICGSATGVTVLYL

SEQ ID NO: 162225 - protein, 23 aa, Mycobacterium bovis
EMHWSIPGLTFVILVAVGADYNM

SEQ ID NO: 162226 - protein, 18 aa, Mycobacterium bovis
EMKLVANSLIKDGKIVHP

SEQ ID NO: 162227 - protein, 29 aa, Mycobacterium bovis
EMKLVTLYILAMPIALLSFAAASVLISSA

SEQ ID NO: 162228 - protein, 30 aa, Mycobacterium bovis
ENVFNGLVAAFLWFTVLFANFAEAMAEGRG

SEQ ID NO: 162229 - protein, 24 aa, Mycobacterium bovis
EPAHPRRWFISTTPGRIMTIGIVL

SEQ ID NO: 162230 - protein, 25 aa, Mycobacterium bovis
EPDDPDWSWLKWLPHVQHQTETDAA

SEQ ID NO: 162231 - protein, 28 aa, Mycobacterium bovis
EPEPKSPPIPWYRLPAVIITGTTVAVLL

SEQ ID NO: 162232 - protein, 23 aa, Mycobacterium bovis
EPFGLAWRLNRGSLLLWTVGLCL

SEQ ID NO: 162233 - protein, 18 aa, Mycobacterium bovis
EPFLGRWLLLTAVAFGIS

SEQ ID NO: 162234 - protein, 24 aa, Mycobacterium bovis
EPIGPLTYLVLKRVDDLAYGAGLW

SEQ ID NO: 162235 - protein, 26 aa, Mycobacterium bovis
EPKREALLTLLPLERAMVLRGLLSWP

SEQ ID NO: 162236 - protein, 17 aa, Mycobacterium bovis
EPNLTYRIALRTTSSHE

SEQ ID NO: 162237 - protein, 25 aa, Mycobacterium bovis
EPPKGPAWRRIRVSQLLIGVSAVVA

SEQ ID NO: 162238 - protein, 25 aa, Mycobacterium bovis
EPSWMPLWAFVIAMVLLRSSLAGFG

SEQ ID NO: 162239 - protein, 25 aa, Mycobacterium bovis
EPVRIGLVVLMLNRRRPLLHLLTFL

SEQ ID NO: 162240 - protein, 23 aa, Mycobacterium bovis
EQAPAKAPPSPYPARALAGGLHT

SEQ ID NO: 162241 - protein, 22 aa, Mycobacterium bovis
EQIMPLLVVAVMSQLVFSGGMI

SEQ ID NO: 162242 - protein, 23 aa, Mycobacterium bovis
EQIQLGLIGMQLALTELWCSYGV

SEQ ID NO: 162243 - protein, 24 aa, Mycobacterium bovis
EQLTVRYALRRLGALRVWPARARA

SEQ ID NO: 162244 - protein, 30 aa, Mycobacterium bovis
ERLAWVLGAALLLIAIGFTALARNSGRMLL

SEQ ID NO: 162245 - protein, 19 aa, Mycobacterium bovis
ERLWSAIGLVPQRSYLFSG

SEQ ID NO: 162246 - protein, 26 aa, Mycobacterium bovis
ERPPSTLWIWVALTGAAATVLILGWR

SEQ ID NO: 162247 - protein, 26 aa, Mycobacterium bovis
ERRPSPLPTPIVPGLAPMPPGSVVPS

SEQ ID NO: 162248 - protein, 25 aa, Mycobacterium bovis
ERSFGLLARLWVLPVHRASGLISRI

SEQ ID NO: 162249 - protein, 39 aa, Mycobacterium bovis
ERSVAVWLLLGGVFGLALLLIFLFWPWEFKAADGESDFI

SEQ ID NO: 162250 - protein, 22 aa, Mycobacterium bovis
ESAAWPAGVPWTDASLSSAAGR

SEQ ID NO: 162251 - protein, 30 aa, Mycobacterium bovis
ESKSRVALYLLITIAPFAVIAPLIGPALDR

SEQ ID NO: 162252 - protein, 26 aa, Mycobacterium bovis
ESVAPSALRQSFLWGLAGVIAAEHPE

SEQ ID NO: 162253 - protein, 21 aa, Mycobacterium bovis
ESYSLPLRRLLGLVAAGLDVS

SEQ ID NO: 162254 - protein, 24 aa, Mycobacterium bovis
ETARPADLLVLLDSLRQREATLNA

SEQ ID NO: 162255 - protein, 29 aa, Mycobacterium bovis
ETATALAWFPLWFVLLAVGWLVTQRRQSR

SEQ ID NO: 162256 - protein, 29 aa, Mycobacterium bovis
ETERITRLVEDLLLLARLDSGRPLERGPV

SEQ ID NO: 162257 - protein, 31 aa, Mycobacterium bovis; identical to SEQ ID NO: 20533

SEQ ID NO: 162258 - protein, 19 aa, Mycobacterium bovis
EVRRQSRWRTAAFASAAAI

SEQ ID NO: 162259 - protein, 37 aa, Mycobacterium bovis
EVVATPLTAKLAWFSKFLTIAILGLAALTFGVGLLRR

SEQ ID NO: 162260 - protein, 21 aa, Mycobacterium bovis
EWVALYRIRVGHRIGSAALIA

SEQ ID NO: 162261 - protein, 24 aa, Mycobacterium bovis
EYIGFLVAWQRPLAGKKTLMDLAT

SEQ ID NO: 162262 - protein, 25 aa, Mycobacterium bovis
EYLCLMPIFPLALWLMNVYAAIRYR

SEQ ID NO: 162263 - protein, 18 aa, Mycobacterium bovis
FAAAYVSGLAALLRQRFP

SEQ ID NO: 162264 - protein, 19 aa, Mycobacterium bovis
FAAGRLYTTLSVADAAAAT

SEQ ID NO: 162265 - protein, 19 aa, Mycobacterium bovis
FAALIAVLLLTAPALGGYL

SEQ ID NO: 162266 - protein, 22 aa, Mycobacterium bovis
FAAMLWTAIAIWIEPLRSTFDY

SEQ ID NO: 162267 - protein, 25 aa, Mycobacterium bovis
FAEARWLSVALLSIGLAGFCLHATL

SEQ ID NO: 162268 - protein, 18 aa, Mycobacterium bovis
FAELAGCSSSIEMTREQL

SEQ ID NO: 162269 - protein, 18 aa, Mycobacterium bovis
FAFILVSAGVVVLRRTRP

SEQ ID NO: 162270 - protein, 27 aa, Mycobacterium bovis
FAIMHLLTHGFFKAGLFLGSGAVIHAM

SEQ ID NO: 162271 - protein, 41 aa, Mycobacterium bovis
FALGVFVLVPLLEFAVVLELAILSIGWIISNIFGAIPVLAG

SEQ ID NO: 162272 - protein, 28 aa, Mycobacterium bovis
FALSMAGLILLWRLLRRESARPVVAGFC

SEQ ID NO: 162273 - protein, 17 aa, Mycobacterium bovis
FAPFQRPGDHDNTTGVG

SEQ ID NO: 162274 - protein, 24 aa, Mycobacterium bovis
FARALRLRLLSKLSRLPLGWFTSR

SEQ ID NO: 162275 - protein, 24 aa, Mycobacterium bovis
FASQPLGAIVFAGLLAWLYQRTRV

SEQ ID NO: 162276 - protein, 17 aa, Mycobacterium bovis
FATFGLAYLAIIGVPPF

SEQ ID NO: 162277 - protein, 28 aa, Mycobacterium bovis
FATLISRITGFARIVLLAAILGAALASS

SEQ ID NO: 162278 - protein, 30 aa, Mycobacterium bovis
FAVGFLTLGLLVPVLTWPVSAPLLVIPVAL

SEQ ID NO: 162279 - protein, 18 aa, Mycobacterium bovis
FAVGIPFANNWYQPARRG

SEQ ID NO: 162280 - protein, 30 aa, Mycobacterium bovis
FEFPYVLYQGLTLYLLLAIGWHGGEELAKI

SEQ ID NO: 162281 - protein, 17 aa, Mycobacterium bovis
FEHVNFAYLPGTPVIRD

SEQ ID NO: 162282 - protein, 21 aa, Mycobacterium bovis
FEKLRDLVINAPARLDLLTQQ

SEQ ID NO: 162283 - protein, 22 aa, Mycobacterium bovis
FEPRHRPPPLPPQQERPVWQPV

SEQ ID NO: 162284 - protein, 28 aa, Mycobacterium bovis
FERVITALLLVIAIGFTASFFVVTPPPN

SEQ ID NO: 162285 - protein, 21 aa, Mycobacterium bovis
FESIWILALVVGIWLVVIGAC

SEQ ID NO: 162286 - protein, 17 aa, Mycobacterium bovis
FFALTDQVSIAEAEEFA

SEQ ID NO: 162287 - protein, 18 aa, Mycobacterium bovis
FFATAVFLGITTFAIIRI

SEQ ID NO: 162288 - protein, 19 aa, Mycobacterium bovis
FFAVSGFLLWRGHAAAARD

SEQ ID NO: 162289 - protein, 19 aa, Mycobacterium bovis
FFDTSALIIAFVVLGRHLE

SEQ ID NO: 162290 - protein, 30 aa, Mycobacterium bovis
FFFESTFIGLWIFGWNRLPRLVHLACIWIV

SEQ ID NO: 162291 - protein, 20 aa, Mycobacterium bovis
FFFLGCFTIVGTRQFAIMTT

SEQ ID NO: 162292 - protein, 27 aa, Mycobacterium bovis
FFVVSNSLRLRKFGRYPLGCGTVGGPQ

SEQ ID NO: 162293 - protein, 17 aa, Mycobacterium bovis
FGAFIPLIGAVVAGFLA

SEQ ID NO: 162294 - protein, 17 aa, Mycobacterium bovis
FGAFLAFLDSTIVNIAF

SEQ ID NO: 162295 - protein, 31 aa, Mycobacterium bovis
FGAGLFIAFDQLWRWNSIVALVLSVMVILGL

SEQ ID NO: 162296 - protein, 25 aa, Mycobacterium bovis
FGALLRVVYVALPPLHDQWRPVLWA

SEQ ID NO: 162297 - protein, 31 aa, Mycobacterium bovis
FGDDAWMSVTASLLILFFVAGVVIASVCRRH

SEQ ID NO: 162298 - protein, 22 aa, Mycobacterium bovis
FGELAVFVFFGPVAVLGTQYTQ

SEQ ID NO: 162299 - protein, 32 aa, Mycobacterium bovis
FGEVGFRSVWITVLLTRLAIVAAVALVVAGIV

SEQ ID NO: 162300 - protein, 25 aa, Mycobacterium bovis
FGITTVYHFIFVPLTIGLAPLIAVM

SEQ ID NO: 162301 - protein, 18 aa, Mycobacterium bovis
FGLIAGLVGCYRGLTTKG

SEQ ID NO: 162302 - protein, 38 aa, Mycobacterium bovis
FGLSVLVWQHLLGIQLYWIVLALAVILLLAVGSDYNLL

SEQ ID NO: 162303 - protein, 18 aa, Mycobacterium bovis
FGPYRLRRLVGRGGMGDV

SEQ ID NO: 162304 - protein, 23 aa, Mycobacterium bovis
FGSPYAIFLLREHFRLIPDDLIN

SEQ ID NO: 162305 - protein, 31 aa, Mycobacterium bovis
FGVPWSNSFPKWRWSLTTALLELTVLVLLLA

SEQ ID NO: 162306 - protein, 19 aa, Mycobacterium bovis
FGVVPGYVLLALALGSYAL

SEQ ID NO: 162307 - protein, 17 aa, Mycobacterium bovis
FIAGFLLHIVVKIPHMV

SEQ ID NO: 162308 - protein, 25 aa, Mycobacterium bovis
FIANPYKYFLEFFEQFGFSPAVTVV

SEQ ID NO: 162309 - protein, 34 aa, Mycobacterium bovis
FINDYLFNFPDTNFAWSFVLALLAAALTARKRIA

SEQ ID NO: 162310 - protein, 19 aa, Mycobacterium bovis
FIQYIRQFNMPLSQLAGMY

SEQ ID NO: 162311 - protein, 17 aa, Mycobacterium bovis
FISSNWNLAFGVLPPYW

SEQ ID NO: 162312 - protein, 18 aa, Mycobacterium bovis
FKVFALVAALEQGIGLGY

SEQ ID NO: 162313 - protein, 18 aa, Mycobacterium bovis
FLAMTMIILAVFYMAQDA

SEQ ID NO: 162314 - protein, 19 aa, Mycobacterium bovis
FLGPWLFSVFVDVFHTVRA

SEQ ID NO: 162315 - protein, 20 aa, Mycobacterium bovis
FLIDGLLDRLVYLSYGLAVI

SEQ ID NO: 162316 - protein, 19 aa, Mycobacterium bovis
FLTKTVYSVLLALLVGIEC

SEQ ID NO: 162317 - protein, 27 aa, Mycobacterium bovis
FLVGKTPWIGALLGVLFVLTTALGDLV

SEQ ID NO: 162318 - protein, 18 aa, Mycobacterium bovis
FLVSRIREYWLESGAARP

SEQ ID NO: 162319 - protein, 31 aa, Mycobacterium bovis
FMFAFAIKAPLWPFHRWLPDAAVESTPATAV

SEQ ID NO: 162320 - protein, 22 aa, Mycobacterium bovis
FMNGWYYLTRREDVLAALRNPK

SEQ ID NO: 162321 - protein, 23 aa, Mycobacterium bovis
FMTLDRWLLFNWMRWGRALEYLK

SEQ ID NO: 162322 - protein, 33 aa, Mycobacterium bovis
FMTPSIAALLGRWFWWPLRVRSRPARTPTVPSE

SEQ ID NO: 162323 - protein, 30 aa, Mycobacterium bovis
FMTPSIAVLLGRWFWWPQRVRPRPASRMLR

SEQ ID NO: 162324 - protein, 17 aa, Mycobacterium bovis
FNPLDPRNLDVSPLPSL

SEQ ID NO: 162325 - protein, 23 aa, Mycobacterium bovis
FNTACLVLLGLFPLFVMFVITAI

SEQ ID NO: 162326 - protein, 18 aa, Mycobacterium bovis
FPAIVKFLSEQVLSRATE

SEQ ID NO: 162327 - protein, 24 aa, Mycobacterium bovis
FPELSAYQIINRLIHTARPPARGV

SEQ ID NO: 162328 - protein, 30 aa, Mycobacterium bovis
FPLADPIVGLLITAAILAVLRTAARDVFRR

SEQ ID NO: 162329 - protein, 27 aa, Mycobacterium bovis
FPPMGSILYWMRFGTIRLPPWPDRVPW

SEQ ID NO: 162330 - protein, 17 aa, Mycobacterium bovis
FPQMLLNLEPFAHIPRV

SEQ ID NO: 162331 - protein, 25 aa, Mycobacterium bovis
FPSNLIIPEYLFIQSSTDLRTPKAL

SEQ ID NO: 162332 - protein, 19 aa, Mycobacterium bovis
FPTSWLPLLIVTSGVVFAY

SEQ ID NO: 162333 - protein, 19 aa, Mycobacterium bovis
FQAHLLYRWVRHPIMLGFV

SEQ ID NO: 162334 - protein, 19 aa, Mycobacterium bovis
FQPPMTTWYAAMLFAVIPL

SEQ ID NO: 162335 - protein, 33 aa, Mycobacterium bovis
FRPHNLPFVMLGAALLWFGWYGFNAGSATTANG

SEQ ID NO: 162336 - protein, 17 aa, Mycobacterium bovis
FRRFFSRLQRPVDNFGE

SEQ ID NO: 162337 - protein, 17 aa, Mycobacterium bovis
FRRLGTHVARWPAPILV

SEQ ID NO: 162338 - protein, 17 aa, Mycobacterium bovis
FRYFITGGAPMPEALIK

SEQ ID NO: 162339 - protein, 25 aa, Mycobacterium bovis
FSINVAAVVYLLISKRLFGVRGGRK

SEQ ID NO: 162340 - protein, 17 aa, Mycobacterium bovis
FSKDPVFRERMKREARI

SEQ ID NO: 162341 - protein, 25 aa, Mycobacterium bovis
FSRGQLIQLVLIGALVYVAYPFIST

SEQ ID NO: 162342 - protein, 19 aa, Mycobacterium bovis
FSVTLGVLVIACPCALGLA

SEQ ID NO: 162343 - protein, 17 aa, Mycobacterium bovis
FTAVTFAIVPLLHRFGG

SEQ ID NO: 162344 - protein, 33 aa, Mycobacterium bovis
FTHNLFKPLLLFFYFGFLIPIFKVRFEFPYVLY

SEQ ID NO: 162345 - protein, 18 aa, Mycobacterium bovis
FTLSILIRRPIVGYLWSW

SEQ ID NO: 162346 - protein, 19 aa, Mycobacterium bovis
FTPKTQLTMLSARAGLVMD

SEQ ID NO: 162347 - protein, 26 aa, Mycobacterium bovis
FTRINAILGVLLLIVLATGSLINGMF

SEQ ID NO: 162348 - protein, 17 aa, Mycobacterium bovis
FTTLRLIYQEMLANYHV

SEQ ID NO: 162349 - protein, 25 aa, Mycobacterium bovis
FVDGHFSKWLNFTPTPLTAPVIGLI

SEQ ID NO: 162350 - protein, 20 aa, Mycobacterium bovis
FVIYAITIVCVVFLNLLEGV

SEQ ID NO: 162351 - protein, 21 aa, Mycobacterium bovis
FVLSGFLITSLLLDELGRTGR

SEQ ID NO: 162352 - protein, 17 aa, Mycobacterium bovis
FVPILFVVFGIGALNTS

SEQ ID NO: 162353 - protein, 17 aa, Mycobacterium bovis
FVTILPAYDLTLFVNQL

SEQ ID NO: 162354 - protein, 19 aa, Mycobacterium bovis
FVVGDLMFVPGVPGVAQGA

SEQ ID NO: 162355 - protein, 17 aa, Mycobacterium bovis
FVVLLITGVYLTLFFDP

SEQ ID NO: 162356 - protein, 31 aa, Mycobacterium bovis
FVVNVHWSVLVILWLFTWSLATMLPGTVGGY

SEQ ID NO: 162357 - protein, 18 aa, Mycobacterium bovis
FWAKVRRGALFRAAAVWL

SEQ ID NO: 162358 - protein, 32 aa, Mycobacterium bovis
FYCYGLTHVLYLNYVWHYSLLKAGFAIAPAAV

SEQ ID NO: 162359 - protein, 20 aa, Mycobacterium bovis
FYWAVGIAIGLPAGLIVLTE

SEQ ID NO: 162360 - protein, 27 aa, Mycobacterium bovis
GAAAWLHAAVWWKALLALAVAVALVIG

SEQ ID NO: 162361 - protein, 24 aa, Mycobacterium bovis
GAAFVRRLVTLATTLLLGATTLSV

SEQ ID NO: 162362 - protein, 22 aa, Mycobacterium bovis
GAAIPVLIVGTVVWVGITNDRK

SEQ ID NO: 162363 - protein, 22 aa, Mycobacterium bovis
GAAVWMATFIFAKTLRGESLSR

SEQ ID NO: 162364 - protein, 22 aa, Mycobacterium bovis
GADLRPVLLRAMTFMIVASPCA

SEQ ID NO: 162365 - protein, 25 aa, Mycobacterium bovis
GAFLSQLFGAILRPLGQPANEIIET

SEQ ID NO: 162366 - protein, 24 aa, Mycobacterium bovis
GAGALLIKPLLAHAAIAFIAVEAV

SEQ ID NO: 162367 - protein, 25 aa, Mycobacterium bovis
GAGVLYFYFVLPRWPELMGDTGHSL

SEQ ID NO: 162368 - protein, 17 aa, Mycobacterium bovis
GAGWFLLTLMVLTLCIG

SEQ ID NO: 162369 - protein, 25 aa, Mycobacterium bovis
GAHRLFTVGFAAVGLLGTGALLAAA

SEQ ID NO: 162370 - protein, 25 aa, Mycobacterium bovis
GAIEPQFFAALLSGLGLSAADVPTQ

SEQ ID NO: 162371 - protein, 33 aa, Mycobacterium bovis
GAIGLLLVLVYSLLYYRVLGLLTALSLVASGSM

SEQ ID NO: 162372 - protein, 28 aa, Mycobacterium bovis
GALAYFFGPVVVFWVLAGMALISVLATL

SEQ ID NO: 162373 - protein, 19 aa, Mycobacterium bovis
GALIGWLYDISIGTLVVVV

SEQ ID NO: 162374 - protein, 24 aa, Mycobacterium bovis
GALKKAVMLLGVLAVLVAMVGLAA

SEQ ID NO: 162375 - protein, 17 aa, Mycobacterium bovis
GALLAAALTLWLHVIDA

SEQ ID NO: 162376 - protein, 18 aa, Mycobacterium bovis
GALQIVFGLSRMARAALA

SEQ ID NO: 162377 - protein, 23 aa, Mycobacterium bovis
GALSGLWLGIAGWSLWAANSPGM

SEQ ID NO: 162378 - protein, 25 aa, Mycobacterium bovis
GALVTGLGLLRRRGLRQAVASGIAV

SEQ ID NO: 162379 - protein, 21 aa, Mycobacterium bovis
GALWLLYRYYRTGDPLFWFTT

SEQ ID NO: 162380 - protein, 28 aa, Mycobacterium bovis
GALYARIDGRLYPALNLTSARLATGTAG

SEQ ID NO: 162381 - protein, 17 aa, Mycobacterium bovis
GAPARLDNARFLLPVVG

SEQ ID NO: 162382 - protein, 20 aa, Mycobacterium bovis
GAQLGIFIKGYRALETIRSI

SEQ ID NO: 162383 - protein, 21 aa, Mycobacterium bovis
GAQLGIFLKGYKSLEATRAVD

SEQ ID NO: 162384 - protein, 31 aa, Mycobacterium bovis
GAQPQRIPVPSLLRALLSEHLDAGYAAVAAE

SEQ ID NO: 162385 - protein, 23 aa, Mycobacterium bovis
GARALVVAILVFVLLGSFILPHT

SEQ ID NO: 162386 - protein, 25 aa, Mycobacterium bovis
GARLLYQWRWSLATLWFTTVFLLIM

SEQ ID NO: 162387 - protein, 26 aa, Mycobacterium bovis
GASKLPMYLNIAVAVLGLAAYFASFG

SEQ ID NO: 162388 - protein, 22 aa, Mycobacterium bovis
GASLLLYTSFLVVVYLATQRFS

SEQ ID NO: 162389 - protein, 24 aa, Mycobacterium bovis
GASLYALLVNRWPLPEAGVRSGLA

SEQ ID NO: 162390 - protein, 24 aa, Mycobacterium bovis
GATAAWAIGRWTPGTERRTATMGL

SEQ ID NO: 162391 - protein, 22 aa, Mycobacterium bovis
GAVPGSPWWQHPVGSVTALATP

SEQ ID NO: 162392 - protein, 24 aa, Mycobacterium bovis
GAVTLLPAILTLTGRRGWIKPRRD

SEQ ID NO: 162393 - protein, 25 aa, Mycobacterium bovis
GAVVPHVRWPMWLRTAVATAALAAI

SEQ ID NO: 162394 - protein, 21 aa, Mycobacterium bovis
GCGYEFRLETSCYNPSFGGMD

SEQ ID NO: 162395 - protein, 26 aa, Mycobacterium bovis
GDACVWWGLWLITINDWAPLATVGSP

SEQ ID NO: 162396 - protein, 21 aa, Mycobacterium bovis
GDDCWWAPRWARRLQTRIGLG

SEQ ID NO: 162397 - protein, 17 aa, Mycobacterium bovis
GDLRRYAVLAATLGLLV

SEQ ID NO: 162398 - protein, 17 aa, Mycobacterium bovis
GDRPPLDELARTDLLLD

SEQ ID NO: 162399 - protein, 19 aa, Mycobacterium bovis
GDVYLVIDNYRALAEENEV

SEQ ID NO: 162400 - protein, 28 aa, Mycobacterium bovis
GEAPQRAWLWLGWLSAATVAGWVLDAVT

SEQ ID NO: 162401 - protein, 24 aa, Mycobacterium bovis
GEFDGQLWIAMDYVDGIDATQHMA

SEQ ID NO: 162402 - protein, 27 aa, Mycobacterium bovis
GEHYWLKLFVFFFPFTDQIAAFKIIML

SEQ ID NO: 162403 - protein, 26 aa, Mycobacterium bovis
GELEFWAALIKVLALMAFLVVGTVFL

SEQ ID NO: 162404 - protein, 23 aa, Mycobacterium bovis
GELEFWFALIKVAAIVCLIAVGA

SEQ ID NO: 162405 - protein, 27 aa, Mycobacterium bovis
GEPGLDWRWLVLWWESHAPHIANNLMN

SEQ ID NO: 162406 - protein, 25 aa, Mycobacterium bovis
GEQQTMLPFSWQGVCLHASGAARVR

SEQ ID NO: 162407 - protein, 26 aa, Mycobacterium bovis
GESSFYWLTLALAAVWIAGALMSGPL

SEQ ID NO: 162408 - protein, 17 aa, Mycobacterium bovis
GETVAVLVILRSAARPG

SEQ ID NO: 162409 - protein, 29 aa, Mycobacterium bovis
GFADFPKYPLNILADVNALLGIYYSHSLY

SEQ ID NO: 162410 - protein, 18 aa, Mycobacterium bovis
GFAIPFVPRGLDEIPRSP

SEQ ID NO: 162411 - protein, 24 aa, Mycobacterium bovis
GFALFIFWLLLIARVVVEFIRSFS

SEQ ID NO: 162412 - protein, 27 aa, Mycobacterium bovis
GFALGVAMLLGGTWLTCVLAAVTSGVI

SEQ ID NO: 162413 - protein, 23 aa, Mycobacterium bovis
GFFPGVIAYLTVWFPCAQRARAV

SEQ ID NO: 162414 - protein, 34 aa, Mycobacterium bovis
GFGTPVLLHLFYVAKILLYVLVGWLIVLTTKGID

SEQ ID NO: 162415 - protein, 25 aa, Mycobacterium bovis
GFIGKWPTELGGQPGLWIPSSSISA

SEQ ID NO: 162416 - protein, 19 aa, Mycobacterium bovis
GFKRWWTRFVPPSIERSTY

SEQ ID NO: 162417 - protein, 17 aa, Mycobacterium bovis
GFPVLVPGQLVSKEIIY

SEQ ID NO: 162418 - protein, 28 aa, Mycobacterium bovis
GFSMLALLTRRWALAWVALAGSAMASGT

SEQ ID NO: 162419 - protein, 19 aa, Mycobacterium bovis
GFSVLAIAMTWLLCEMAPG

SEQ ID NO: 162420 - protein, 22 aa, Mycobacterium bovis
GFVLATQYWLVTSAGPMLVLLA

SEQ ID NO: 162421 - protein, 25 aa, Mycobacterium bovis
GGAAVTALALLRRASLRQAVADGVA

SEQ ID NO: 162422 - protein, 23 aa, Mycobacterium bovis
GGAIALRIMFNLPLPIGGIITGV

SEQ ID NO: 162423 - protein, 27 aa, Mycobacterium bovis
GGASALGALLMLPGVRGLGPGPVTTGA

SEQ ID NO: 162424 - protein, 33 aa, Mycobacterium bovis
GGERRMLRLIRRYGPIMTMPILSLGDVAIVSDS

SEQ ID NO: 162425 - protein, 27 aa, Mycobacterium bovis
GGESALFFIGVLIVALLGGVAPAALSA

SEQ ID NO: 162426 - protein, 30 aa, Mycobacterium bovis
GGGDFTAVPLLWLLAIDAALITLGAMAFRR

SEQ ID NO: 162427 - protein, 21 aa, Mycobacterium bovis
GGGPHAVYLLDGLRAQDDYNG

SEQ ID NO: 162428 - protein, 30 aa, Mycobacterium bovis
GGGQRVVVLVALLVCLIPTTIGALLSAIGI

SEQ ID NO: 162429 - protein, 24 aa, Mycobacterium bovis
GGGSQFYVLLPDGVQKISSFVADL

SEQ ID NO: 162430 - protein, 29 aa, Mycobacterium bovis
GGIGSIFPLFMMVGIMMMMFRGMGGGQQQ

SEQ ID NO: 162431 - protein, 27 aa, Mycobacterium bovis
GGILSLLLAPLFPMTVVVPLSAFVALP

SEQ ID NO: 162432 - protein, 29 aa, Mycobacterium bovis
GGIVVALLVSAWWLFEALRHPVRSRLADL

SEQ ID NO: 162433 - protein, 28 aa, Mycobacterium bovis
GGIYGDFFNFYLCDISLKVNGLQPGGPV

SEQ ID NO: 162434 - protein, 29 aa, Mycobacterium bovis
GGLFAQLGLWRWAFGVMTLLTALMAMLVP

SEQ ID NO: 162435 - protein, 30 aa, Mycobacterium bovis
GGLLVEWAGWRWVLLVNVPLGIVAAIATKR

SEQ ID NO: 162436 - protein, 21 aa, Mycobacterium bovis
GGPLDCHLMKLEDLRPPERAQ

SEQ ID NO: 162437 - protein, 25 aa, Mycobacterium bovis
GGQAAVWLTWPFGAVGALAGFGGMV

SEQ ID NO: 162438 - protein, 27 aa, Mycobacterium bovis
GGRLAPRPVFRPPVDPASRQAFGRPSG

SEQ ID NO: 162439 - protein, 28 aa, Mycobacterium bovis
GGTTIVVVFAVVLVFYIVTSRDDKKDGV

SEQ ID NO: 162440 - protein, 40 aa, Mycobacterium bovis
GGVIAVMAVLFIGAVLILGFWAPGFFVTTKLDVIKAQAGV

SEQ ID NO: 162441 - protein, 27 aa, Mycobacterium bovis
GGVLLWQHLFWFFGHPEVYIIALPFFG

SEQ ID NO: 162442 - protein, 28 aa, Mycobacterium bovis
GGVLSGAWLGLFIGLVLGFFSPNPWSAL

SEQ ID NO: 162443 - protein, 27 aa, Mycobacterium bovis
GGVVVKALLLLGLWLAGWGAARLVATA

SEQ ID NO: 162444 - protein, 22 aa, Mycobacterium bovis
GGYPAVVYWLLGAGGAVMLLAS

SEQ ID NO: 162445 - protein, 29 aa, Mycobacterium bovis
GGYTYPPGPPPPPYSYGGPFGGPSPRSSS

SEQ ID NO: 162446 - protein, 34 aa, Mycobacterium bovis
GHIDAVHGLYYLLMHGWFAIFPPTELWSRLPSCL

SEQ ID NO: 162447 - protein, 33 aa, Mycobacterium bovis
GHLTLFHLSLRHALWWLGSLAAVASFTLQAIAL

SEQ ID NO: 162448 - protein, 18 aa, Mycobacterium bovis
GIAAGIAVWVLLNGANPL

SEQ ID NO: 162449 - protein, 18 aa, Mycobacterium bovis
GIALTLSRLVAGLTPGLA

SEQ ID NO: 162450 - protein, 19 aa, Mycobacterium bovis
GIGLLLAALVLTTIANPPA

SEQ ID NO: 162451 - protein, 38 aa, Mycobacterium bovis
GIGTLVFQLILGQEMHWSLPGLSFILLVAIGADYNMLL

SEQ ID NO: 162452 - protein, 32 aa, Mycobacterium bovis
GILIIVFIETGLLFPLLPGESLLFTGGLLSAS

SEQ ID NO: 162453 - protein, 24 aa, Mycobacterium bovis
GINIGFYMLMPYLADYLAGPLGLA

SEQ ID NO: 162454 - protein, 23 aa, Mycobacterium bovis
GINTLFPLFGIANQLLAGIAPTV

SEQ ID NO: 162455 - protein, 33 aa, Mycobacterium bovis
GISFTKFTLLMALPWLSAVAAVYVVFRWFFARD

SEQ ID NO: 162456 - protein, 27 aa, Mycobacterium bovis
GISPCILPVLPVIFFSGAQSVDAAQVA

SEQ ID NO: 162457 - protein, 23 aa, Mycobacterium bovis
GIVFRVQQELGVPVKLVGLGEGP

SEQ ID NO: 162458 - protein, 23 aa, Mycobacterium bovis
GIVFTVAVIFFSGALVLGQGKCP

SEQ ID NO: 162459 - protein, 25 aa, Mycobacterium bovis
GIVGTFLFVPKLRRWLATAVRPKLR

SEQ ID NO: 162460 - protein, 26 aa, Mycobacterium bovis
GIVMFLGYIALFALVLYMHAGILTGC

SEQ ID NO: 162461 - protein, 18 aa, Mycobacterium bovis
GIWVFSPLRRRATAALAV

SEQ ID NO: 162462 - protein, 18 aa, Mycobacterium bovis
GKLHFWLTFIGFHTTFLV

SEQ ID NO: 162463 - protein, 23 aa, Mycobacterium bovis
GKSQLLSSLLNLPAARVGDDEAT

SEQ ID NO: 162464 - protein, 22 aa, Mycobacterium bovis
GKWTIILARFVPIARTFVPVIA

SEQ ID NO: 162465 - protein, 26 aa, Mycobacterium bovis
GLAIVFSILLFPPDPVVMLCSARADV

SEQ ID NO: 162466 - protein, 17 aa, Mycobacterium bovis
GLALAWLTTVWATSGLA

SEQ ID NO: 162467 - protein, 17 aa, Mycobacterium bovis
GLAPRFTPVAWGVLVGF

SEQ ID NO: 162468 - protein, 31 aa, Mycobacterium bovis
GLAPTLWGWRRTPVLRWFVLGAAVGVAGAWL

SEQ ID NO: 162469 - protein, 28 aa, Mycobacterium bovis
GLASMVIAFLPPLPVIMVLCAVVGLVYG

SEQ ID NO: 162470 - protein, 23 aa, Mycobacterium bovis
GLATLEAFLKRRVRTHGLLTASI

SEQ ID NO: 162471 - protein, 37 aa, Mycobacterium bovis
GLFAKMPLMVVILLTTTIVLMFLAFGSVVLPIKATLM

SEQ ID NO: 162472 - protein, 17 aa, Mycobacterium bovis
GLGIMRYGVRSEPLHSM

SEQ ID NO: 162473 - protein, 28 aa, Mycobacterium bovis
GLGLAAIAFLPIVLAPAVIPPASTPLAA

SEQ ID NO: 162474 - protein, 24 aa, Mycobacterium bovis
GLGLALLILPVIGLWAMIATLRAG

SEQ ID NO: 162475 - protein, 24 aa, Mycobacterium bovis
GLGPPLVALMLLGIPSLLASTYAG

SEQ ID NO: 162476 - protein, 77 aa, Mycobacterium bovis
GLGYGLLFGLVFYVSLLPWIGELVGPGPWLALATTCALFPGIFGLFAVVVRLLPGWPIWFAVGWAAQEWLKSILPFG

SEQ ID NO: 162477 - protein, 24 aa, Mycobacterium bovis
GLIGRLDGRVVRLGRPGWLDAAEL

SEQ ID NO: 162478 - protein, 18 aa, Mycobacterium bovis
GLLLGRWIPGLHTALEGV

SEQ ID NO: 162479 - protein, 26 aa, Mycobacterium bovis
GLLPAWQIVLILLLLGVLGLRDKVIF

SEQ ID NO: 162480 - protein, 22 aa, Mycobacterium bovis
GLPGFPEFPAIPGFPALPGLPS

SEQ ID NO: 162481 - protein, 39 aa, Mycobacterium bovis
GLPGWRAMFVIEALPALLLAPLLRRLLPDNPQRASWLTP

SEQ ID NO: 162482 - protein, 24 aa, Mycobacterium bovis
GLPTAAIPAPWPVLATLPSGPELS

SEQ ID NO: 162483 - protein, 24 aa, Mycobacterium bovis
GLQAPQVPIPPPPPGPDVIPGPVP

SEQ ID NO: 162484 - protein, 17 aa, Mycobacterium bovis
GLQDFIRKSADPAKPIA

SEQ ID NO: 162485 - protein, 25 aa, Mycobacterium bovis
GLRNTFWALVLPFMFGSPYAIFLLR

SEQ ID NO: 162486 - protein, 21 aa, Mycobacterium bovis
GLRQLYFLIDGLLDRLVYLSY

SEQ ID NO: 162487 - protein, 25 aa, Mycobacterium bovis
GLRSDAIAAFLWTANWRFVAQNTDY

SEQ ID NO: 162488 - protein, 20 aa, Mycobacterium bovis
GLTERYFYESFADREHFVRA

SEQ ID NO: 162489 - protein, 34 aa, Mycobacterium bovis
GLTFNDFMLHLTPLVVIVLIALIAVLPRLFGSIT

SEQ ID NO: 162490 - protein, 24 aa, Mycobacterium bovis
GLTSWLTGMFGRDAWRPAGVVVVG

SEQ ID NO: 162491 - protein, 24 aa, Mycobacterium bovis
GLVLAGAVLLFARPRLRVGSAGLS

SEQ ID NO: 162492 - protein, 26 aa, Mycobacterium bovis
GLVPGVVPPPWWWGVVFENWIVVASI

SEQ ID NO: 162493 - protein, 17 aa, Mycobacterium bovis
GMALIVATFFRFVARRL

SEQ ID NO: 162494 - protein, 17 aa, Mycobacterium bovis
GMMSSPTGELFFDNVRL

SEQ ID NO: 162495 - protein, 21 aa, Mycobacterium bovis
GMNLAICLVLIYAIALVWGLP

SEQ ID NO: 162496 - protein, 33 aa, Mycobacterium bovis
GMRVISPQTLFFPFVLLLAATALYRGNDKKMRT

SEQ ID NO: 162497 - protein, 18 aa, Mycobacterium bovis
GMSEVHLARDLRLHRDVA

SEQ ID NO: 162498 - protein, 29 aa, Mycobacterium bovis
GMVAATLALIVIPLMFGADLRPVLLRAMT

SEQ ID NO: 162499 - protein, 27 aa, Mycobacterium bovis
GMYLPAALTLMIPIGAFLGRIYDSWAR

SEQ ID NO: 162500 - protein, 17 aa, Mycobacterium bovis
GNEWVALYRIRVGHRIG

SEQ ID NO: 162501 - protein, 27 aa, Mycobacterium bovis
GNFVENWAILIIPFALCFAFGKMVHDR

SEQ ID NO: 162502 - protein, 19 aa, Mycobacterium bovis
GNPVWPLAALGVTVVFGVL

SEQ ID NO: 162503 - protein, 25 aa, Mycobacterium bovis
GNTVLTLVLAFAAAALLWLVVEELL

SEQ ID NO: 162504 - protein, 35 aa, Mycobacterium bovis
GPAKWSYYYLYVILDIFSRYVVGWMVASRESKVLA

SEQ ID NO: 162505 - protein, 35 aa, Mycobacterium bovis; identical to SEQ ID NO: 20695

SEQ ID NO: 162506 - protein, 29 aa, Mycobacterium bovis
GPDPLRRLLREFRGPLALSLLLVAVQTCA

SEQ ID NO: 162507 - protein, 17 aa, Mycobacterium bovis
GPGLFLVYGVCGVFVFL

SEQ ID NO: 162508 - protein, 20 aa, Mycobacterium bovis
GPKCLVKVIQKLSGLSINRF

SEQ ID NO: 162509 - protein, 21 aa, Mycobacterium bovis
GPKLFRSLSIAFMSSADPIPA

SEQ ID NO: 162510 - protein, 30 aa, Mycobacterium bovis
GPLGLCFLPAFLCVGIVPLVVGLAGDVLQF

SEQ ID NO: 162511 - protein, 31 aa, Mycobacterium bovis
GPLTGRFWPPIGGFLYWLRPNTIRLPAWPDK

SEQ ID NO: 162512 - protein, 23 aa, Mycobacterium bovis
GPLVFDLGICLVLITLPTLALFV

SEQ ID NO: 162513 - protein, 32 aa, Mycobacterium bovis
GPMLVLLAAGLGVLWLPAGWLAHRLLSVPVTT

SEQ ID NO: 162514 - protein, 29 aa, Mycobacterium bovis
GPRLGPPPVMPPSLAWWASSLQLSGLTAG

SEQ ID NO: 162515 - protein, 27 aa, Mycobacterium bovis
GPRLIDAYVDWLWFGELGYRSVFTTML

SEQ ID NO: 162516 - protein, 24 aa, Mycobacterium bovis
GPTAFWACGLLLCVFIGPAQSSAR

SEQ ID NO: 162517 - protein, 26 aa, Mycobacterium bovis
GPVLGLMVFAFVTAWLILFATAWAAT

SEQ ID NO: 162518 - protein, 19 aa, Mycobacterium bovis
GPWVKWYPGIPGYIDQQWV

SEQ ID NO: 162519 - protein, 17 aa, Mycobacterium bovis
GQAEILWDVIPFDWIND

SEQ ID NO: 162520 - protein, 25 aa, Mycobacterium bovis
GQFEGRLWIAMQFVDGGNAEDALRA

SEQ ID NO: 162521 - protein, 26 aa, Mycobacterium bovis
GQIELPPGYLPLRVPIEVNFTQRVAV

SEQ ID NO: 162522 - protein, 25 aa, Mycobacterium bovis
GQIFDGALLIVIFATSGALDDIATR

SEQ ID NO: 162523 - protein, 28 aa, Mycobacterium bovis
GQIPNQRWFSWLALLTMPAPFLANSAGW

SEQ ID NO: 162524 - protein, 33 aa, Mycobacterium bovis
GQITKKAVIALVVFLVLVALYITVRYERYMTIS

SEQ ID NO: 162525 - protein, 29 aa, Mycobacterium bovis
GRALGVMPLLPVLLMVWATARSTARATSP

SEQ ID NO: 162526 - protein, 26 aa, Mycobacterium bovis
GRANWLPTFVLLILLAAVTAVYALRG

SEQ ID NO: 162527 - protein, 43 aa, Mycobacterium bovis
GRDLGFYAFELPFYRLMLSYMLVSVFLAFVANLVAHYIFGGIR

SEQ ID NO: 162528 - protein, 17 aa, Mycobacterium bovis
GRDLPPVPVLLVIVDEY

SEQ ID NO: 162529 - protein, 18 aa, Mycobacterium bovis
GRFVVSYLGGIMAGLLVG

SEQ ID NO: 162530 - protein, 19 aa, Mycobacterium bovis
GRIGLGKRTFSLPWRLANI

SEQ ID NO: 162531 - protein, 23 aa, Mycobacterium bovis
GRISVVAAPWLADHAVGPVVLFP

SEQ ID NO: 162532 - protein, 17 aa, Mycobacterium bovis
GRKPIFLVGFAVLTARG

SEQ ID NO: 162533 - protein, 19 aa, Mycobacterium bovis
GRLAWLFVGPVVAFPAFGY

SEQ ID NO: 162534 - protein, 24 aa, Mycobacterium bovis
GRLPLLCCLVAFVLTFLVTRSFVR

SEQ ID NO: 162535 - protein, 25 aa, Mycobacterium bovis
GRMVVAWLVTLPLAGLVGAFTYGLV

SEQ ID NO: 162536 - protein, 22 aa, Mycobacterium bovis
GRWNWWAPRPLAWLHERFGVSE

SEQ ID NO: 162537 - protein, 26 aa, Mycobacterium bovis
GRWSYGLFIWHLAALAMVFPVIGAFP

SEQ ID NO: 162538 - protein, 29 aa, Mycobacterium bovis
GSAAKLYPLLFLYPLLLLGIRAGRLNALA

SEQ ID NO: 162539 - protein, 25 aa, Mycobacterium bovis
GSACNLVFPIGIIDRPYKHDQPPWT

SEQ ID NO: 162540 - protein, 19 aa, Mycobacterium bovis
GSAQRWKAIRGEAGWMTTY

SEQ ID NO: 162541 - protein, 18 aa, Mycobacterium bovis
GSDSAVEALFRPMHDRLA

SEQ ID NO: 162542 - protein, 20 aa, Mycobacterium bovis
GSFFMHRGVPYFPNLVMPIV

SEQ ID NO: 162543 - protein, 33 aa, Mycobacterium bovis
GSFLTTALISLIQRPQLRNLLHEKPELIPAGVE

SEQ ID NO: 162544 - protein, 23 aa, Mycobacterium bovis
GSFPSWVLYPCALAMMVFSKSFS

SEQ ID NO: 162545 - protein, 24 aa, Mycobacterium bovis
GSGGVPLGGWLARSVFAAKFAERN

SEQ ID NO: 162546 - protein, 17 aa, Mycobacterium bovis
GSIVLIGLGGLFAAIDA

SEQ ID NO: 162547 - protein, 25 aa, Mycobacterium bovis
GSMLVLLGIVVALYERERSGVGQVV

SEQ ID NO: 162548 - protein, 18 aa, Mycobacterium bovis
GSPLLMTYLLVDVSGARL

SEQ ID NO: 162549 - protein, 32 aa, Mycobacterium bovis
GSRPLAVEPGIPAWRRILDDLSYEPVMAPLRG

SEQ ID NO: 162550 - protein, 34 aa, Mycobacterium bovis
GSSIPGGWFTITVLLILLMIAVTAAVQIARRTMR

SEQ ID NO: 162551 - protein, 37 aa, Mycobacterium bovis
GSTVVSWLPFYHDMGFVLGLILPILAGIPAVLTSPIG

SEQ ID NO: 162552 - protein, 23 aa, Mycobacterium bovis
GSVALLALLLPYTAYKAGESPFV

SEQ ID NO: 162553 - protein, 23 aa, Mycobacterium bovis
GSVFLLTVILPWNSLELGASPYV

SEQ ID NO: 162554 - protein, 43 aa, Mycobacterium bovis
GSVRNKLLLILPGALLLSQLVPWLLTPLLMLGATYLCYEGAEK

SEQ ID NO: 162555 - protein, 24 aa, Mycobacterium bovis
GSYALLVFFGLFLGVAGTIFAVGI

SEQ ID NO: 162556 - protein, 21 aa, Mycobacterium bovis
GTGRYLLVQTLLVLTWIVLNL

SEQ ID NO: 162557 - protein, 29 aa, Mycobacterium bovis
GTISYGVYLWHWPIFLALNGQRTGWSGPA

SEQ ID NO: 162558 - protein, 26 aa, Mycobacterium bovis
GTQNLGLLILRVGLGAVLIAHGLQKL

SEQ ID NO: 162559 - protein, 27 aa, Mycobacterium bovis
GTTIGLGLLFDTLIVRSFMTPSIAALL

SEQ ID NO: 162560 - protein, 24 aa, Mycobacterium bovis
GTVRNWPWRRLVLSKTANTYSRLA

SEQ ID NO: 162561 - protein, 25 aa, Mycobacterium bovis
GTWYAAMLFAVVPLRTILPGSPPAG

SEQ ID NO: 162562 - protein, 20 aa, Mycobacterium bovis
GTYLGGWRIIRTLGKGLVEI

SEQ ID NO: 162563 - protein, 35 aa, Mycobacterium bovis
GVAGLVDWPILLAVGGGALLLRKLNRTPEVAAPPV

SEQ ID NO: 162564 - protein, 28 aa, Mycobacterium bovis
GVAILARNHRWFVIANYGAARVGARIIL

SEQ ID NO: 162565 - protein, 25 aa, Mycobacterium bovis
GVDSGTWLAWAALGLGVVALVVTKR

SEQ ID NO: 162566 - protein, 27 aa, Mycobacterium bovis
GVFDNLTKFITWTLPTNLGEGLVILAA

SEQ ID NO: 162567 - protein, 18 aa, Mycobacterium bovis
GVFVPVVFVIAGLAGAAW

SEQ ID NO: 162568 - protein, 26 aa, Mycobacterium bovis
GVGLKAFWYHFAIMFEALFILTTVDA

SEQ ID NO: 162569 - protein, 35 aa, Mycobacterium bovis
GVGNAMFGLASRYIRLLPRGLVKRVVPKPGTGPSA

SEQ ID NO: 162570 - protein, 24 aa, Mycobacterium bovis
GVIAALFLGFFILEGFDFGVGMLM

SEQ ID NO: 162571 - protein, 20 aa, Mycobacterium bovis
GVIHTPARRGFFRSNPERIQ

SEQ ID NO: 162572 - protein, 25 aa, Mycobacterium bovis
GVIVFQFLLGQEMHWSIPGLTFVIL

SEQ ID NO: 162573 - protein, 23 aa, Mycobacterium bovis
GVLVGFIALYLLGSLAGFPQMLL

SEQ ID NO: 162574 - protein, 17 aa, Mycobacterium bovis
GVLVLLFSPPSIRWAAG

SEQ ID NO: 162575 - protein, 18 aa, Mycobacterium bovis
GVMYSIPLRRALVTGSDL

SEQ ID NO: 162576 - protein, 23 aa, Mycobacterium bovis
GVNFRDVLVALGMYPGGGELGVD

SEQ ID NO: 162577 - protein, 28 aa, Mycobacterium bovis
GVPIFFVLSGFLLFRPWVKSAATGGPPP

SEQ ID NO: 162578 - protein, 25 aa, Mycobacterium bovis
GVPLEWNVFFIFSLCYLFGHYGAIT

SEQ ID NO: 162579 - protein, 17 aa, Mycobacterium bovis
GVPYFPNLVMPIVVGGI

SEQ ID NO: 162580 - protein, 21 aa, Mycobacterium bovis
GVRGPNLAWLLAAYGVAGLVS

SEQ ID NO: 162581 - protein, 24 aa, Mycobacterium bovis
GVRILSFAWATLAGLLPGTAAVVI

SEQ ID NO: 162582 - protein, 17 aa, Mycobacterium bovis
GVRPAIHLPLEDPYQMP

SEQ ID NO: 162583 - protein, 30 aa, Mycobacterium bovis
GVRSLATGFFPLMGIGAFSMLAFSGRFGRA

SEQ ID NO: 162584 - protein, 27 aa, Mycobacterium bovis
GVSAWLITRAWQMPPVLDLSVAVVAVR

SEQ ID NO: 162585 - protein, 29 aa, Mycobacterium bovis
GVSIPRAMFWTVLVYVFVATVISFIIGRP

SEQ ID NO: 162586 - protein, 27 aa, Mycobacterium bovis
GVSLAYLYVVLLFAPVLIVLERLPIVE

SEQ ID NO: 162587 - protein, 26 aa, Mycobacterium bovis
GVVHGWVYFTYLLLTLNLAVKVRWPL

SEQ ID NO: 162588 - protein, 41 aa, Mycobacterium bovis
GVVPAPVPIPVPIIIPPFPGWQPGMPTIPTAPPTTPVTTSA

SEQ ID NO: 162589 - protein, 24 aa, Mycobacterium bovis
GVVRGLKALLATVVLAVVGIGLGL

SEQ ID NO: 162590 - protein, 17 aa, Mycobacterium bovis
GVVTVLWALYGYSIAFG

SEQ ID NO: 162591 - protein, 33 aa, Mycobacterium bovis
GVVVFQVFLGQELHWSVPGLAFVVLVAVGADYN

SEQ ID NO: 162592 - protein, 31 aa, Mycobacterium bovis
GVVVGIFWMGRRLVSPWWALGLGMILGGAMG

SEQ ID NO: 162593 - protein, 19 aa, Mycobacterium bovis
GWAVLAIMGIIWIGMSVAA

SEQ ID NO: 162594 - protein, 25 aa, Mycobacterium bovis
GWEVDPYAIPLLQTAHRTGARVVLR

SEQ ID NO: 162595 - protein, 31 aa, Mycobacterium bovis
GWLGDWTIFYWGWWISWAPFVGMFIARISRG

SEQ ID NO: 162596 - protein, 21 aa, Mycobacterium bovis
GWLRLPAFTWPTRPSWLYRLT

SEQ ID NO: 162597 - protein, 18 aa, Mycobacterium bovis
GWRHLKHFNGYATSFWVT

SEQ ID NO: 162598 - protein, 22 aa, Mycobacterium bovis
GWRSVFLVNVPLGAIVWLLTLV

SEQ ID NO: 162599 - protein, 22 aa, Mycobacterium bovis
GYDRATLKLVFSMDLGMCLNRF

SEQ ID NO: 162600 - protein, 23 aa, Mycobacterium bovis
GYEFRLLQIKFATLNITGDCFLL

SEQ ID NO: 162601 - protein, 26 aa, Mycobacterium bovis
GYFTTRLLERLPLSSYRRPLLGTGLC

SEQ ID NO: 162602 - protein, 23 aa, Mycobacterium bovis
GYGYGPAFRGLQALWRRGAEVFA

SEQ ID NO: 162603 - protein, 24 aa, Mycobacterium bovis
GYLRKWFLLGITIGVIAGLGAVVF

SEQ ID NO: 162604 - protein, 33 aa, Mycobacterium bovis
GYNMPLELVLTVIPFLIISVLFYFTVVVQEKML

SEQ ID NO: 162605 - protein, 29 aa, Mycobacterium bovis
GYPGAILGFALLWLTATAIWLRSRRAPID

SEQ ID NO: 162606 - protein, 18 aa, Mycobacterium bovis
HAIGLWGAAAAIAAGLGP

SEQ ID NO: 162607 - protein, 43 aa, Mycobacterium bovis
HAPLTRTFIRFWTVSFPVVAYRTWRWWLATAVAFFAVVVLIGF

SEQ ID NO: 162608 - protein, 17 aa, Mycobacterium bovis
HAPWARWRYTRHPEKMR

SEQ ID NO: 162609 - protein, 26 aa, Mycobacterium bovis
HDELFDACGWRRLIFATPEELEAALG

SEQ ID NO: 162610 - protein, 18 aa, Mycobacterium bovis
HDLRLIIAMTVCIVLLIL

SEQ ID NO: 162611 - protein, 27 aa, Mycobacterium bovis
HFGEHCIGWLILALLGAIALPRRRREW

SEQ ID NO: 162612 - protein, 29 aa, Mycobacterium bovis
HFIDAIICFVGFLFPLWDAKRQTLADKIM

SEQ ID NO: 162613 - protein, 17 aa, Mycobacterium bovis
HGAFVVRGALNAAWDKL

SEQ ID NO: 162614 - protein, 22 aa, Mycobacterium bovis
HGMYSWLHFWIATACALTAWYV

SEQ ID NO: 162615 - protein, 17 aa, Mycobacterium bovis
HGWVLASGSFMLCAAFN

SEQ ID NO: 162616 - protein, 18 aa, Mycobacterium bovis
HHSFLSRLYTGTGAFEVV

SEQ ID NO: 162617 - protein, 27 aa, Mycobacterium bovis
HIRPYRRLVAMLMMLQLVSTLASLYLP

SEQ ID NO: 162618 - protein, 27 aa, Mycobacterium bovis
HKSIEQLLVVFPALFAAIITSAGGVPQ

SEQ ID NO: 162619 - protein, 31 aa, Mycobacterium bovis
HLARQASLLRNYLLPLGAVLLLLVKASEVPA

SEQ ID NO: 162620 - protein, 20 aa, Mycobacterium bovis
HLDVRWVVALIVINLAFTFL

SEQ ID NO: 162621 - protein, 17 aa, Mycobacterium bovis
HLHWLVLAMSVIVLLAV

SEQ ID NO: 162622 - protein, 20 aa, Mycobacterium bovis
HLILWDIGGALLATLYGLAN

SEQ ID NO: 162623 - protein, 17 aa, Mycobacterium bovis
HLLASALVLVILAGCAG

SEQ ID NO: 162624 - protein, 27 aa, Mycobacterium bovis
HLQRARVPMPIIAVSSLLRSHAVTLND

SEQ ID NO: 162625 - protein, 31 aa, Mycobacterium bovis
HLVDTLSLFVGWLWPLWDSRRRTFADLLLRT

SEQ ID NO: 162626 - protein, 20 aa, Mycobacterium bovis
HMWVARRTGMKVRRYFVGFG

SEQ ID NO: 162627 - protein, 30 aa, Mycobacterium bovis
HNGGAWLVLLMIFNVIWTYVLVRGSAVNNG

SEQ ID NO: 162628 - protein, 25 aa, Mycobacterium bovis
HNQVLAMLSLVPWGTTGVSLDLMRR

SEQ ID NO: 162629 - protein, 34 aa, Mycobacterium bovis
HPARYLSVFLVMLIGIYLLVFFTGDKHTAPKLGI

SEQ ID NO: 162630 - protein, 18 aa, Mycobacterium bovis
HPGFPGWQALKVLSPAMA

SEQ ID NO: 162631 - protein, 33 aa, Mycobacterium bovis
HPIIPRTIRLAAIPILLCWLGFTVFVSVVVPPL

SEQ ID NO: 162632 - protein, 26 aa, Mycobacterium bovis
HPMLSLGLPMLFIALGGIGLPGAAVY

SEQ ID NO: 162633 - protein, 17 aa, Mycobacterium bovis
HPVLNLTSARLIVGRPV

SEQ ID NO: 162634 - protein, 17 aa, Mycobacterium bovis
HPVSPGTRWPQPTPWAG

SEQ ID NO: 162635 - protein, 26 aa, Mycobacterium bovis
HRCTPREWMWAVLLAGAVAVIVMSGN

SEQ ID NO: 162636 - protein, 18 aa, Mycobacterium bovis
HRIRYIRLKKSSPDCRAT

SEQ ID NO: 162637 - protein, 18 aa, Mycobacterium bovis
HRRDGIALVLLGLAVVVA

SEQ ID NO: 162638 - protein, 21 aa, Mycobacterium bovis
HRWALAAICFVAVGIGALSLG

SEQ ID NO: 162639 - protein, 23 aa, Mycobacterium bovis
HRYAIWIVGVWALAAIIGNNFAP

SEQ ID NO: 162640 - protein, 17 aa, Mycobacterium bovis
HSAVYRGYTASVGRFVP

SEQ ID NO: 162641 - protein, 23 aa, Mycobacterium bovis
HSPMTWRRWALLCVGIAQIALGT

SEQ ID NO: 162642 - protein, 18 aa, Mycobacterium bovis
HSSLLVAYLALLIGLGFG

SEQ ID NO: 162643 - protein, 30 aa, Mycobacterium bovis
HTAFAGAAICLLALMATLATASRRLRPGRN

SEQ ID NO: 162644 - protein, 18 aa, Mycobacterium bovis
HTGPLQPPKLSAFRPDLA

SEQ ID NO: 162645 - protein, 29 aa, Mycobacterium bovis
HTHPALDLDALLGGFRPLFQTLDPDKVNS

SEQ ID NO: 162646 - protein, 18 aa, Mycobacterium bovis
HTRKVLDLTIRLAEVMLS

SEQ ID NO: 162647 - protein, 17 aa, Mycobacterium bovis
HVARWPAPILVASGVFV

SEQ ID NO: 162648 - protein, 22 aa, Mycobacterium bovis
HVHPDTFWWALALSADFGGNLT

SEQ ID NO: 162649 - protein, 17 aa, Mycobacterium bovis
HYVVMVILHTALLLGCV

SEQ ID NO: 162650 - protein, 25 aa, Mycobacterium bovis
IAAFKIIMLCLWWGAATSKLNHHFP

SEQ ID NO: 162651 - protein, 26 aa, Mycobacterium bovis
IAAGVNLLLSPAVFRGFDQVGALSPT

SEQ ID NO: 162652 - protein, 35 aa, Mycobacterium bovis
IAALVVIAALTLGLVLYRRRRISLSPRPERGVVDR

SEQ ID NO: 162653 - protein, 32 aa, Mycobacterium bovis
IAATFIAVLVLWDLFGQLPLPLGVVGHEGSTV

SEQ ID NO: 162654 - protein, 27 aa, Mycobacterium bovis
IAGDFWPWALQFVATLWVSTFLVVASH

SEQ ID NO: 162655 - protein, 32 aa, Mycobacterium bovis
IAHGLGMPIPLGWQVWLYGVFAIIAVGVTSSS

SEQ ID NO: 162656 - protein, 33 aa, Mycobacterium bovis
IALPLLAYFAIMWVGGYLLGAALRLGYRRTTTL

SEQ ID NO: 162657 - protein, 35 aa, Mycobacterium bovis
IALRDLRIPAIGLVLLLLSSLIVGAGWPLIVEQIS

SEQ ID NO: 162658 - protein, 18 aa, Mycobacterium bovis
IAQLRWPVAIAVGPALTY

SEQ ID NO: 162659 - protein, 51 aa, Mycobacterium bovis
IAQVLDWFISFVSGPVFTFLAYLVLDPLIYFGPFAPLTSPVLLPAGLTGLA

SEQ ID NO: 162660 - protein, 24 aa, Mycobacterium bovis
IARKPWLIAGVVFLLAAAAFPNYF

SEQ ID NO: 162661 - protein, 38 aa, Mycobacterium bovis
IARRQLRLIVSDRGYFVFLALLPFIMGALSMSVPGDVG

SEQ ID NO: 162662 - protein, 19 aa, Mycobacterium bovis
IASIIGLLFYLLRSRRSAR

SEQ ID NO: 162663 - protein, 20 aa, Mycobacterium bovis
IASLWFTIFGDSALLRQRNN

SEQ ID NO: 162664 - protein, 23 aa, Mycobacterium bovis
IASTLLGVLSVAAVVLGAMIWSA

SEQ ID NO: 162665 - protein, 17 aa, Mycobacterium bovis
IAVAFLGTVLLYFAARD

SEQ ID NO: 162666 - protein, 36 aa, Mycobacterium bovis
IAVLVGQANWWLPSSWRPATWWPLGRRRGRAQRTKR

SEQ ID NO: 162667 - protein, 31 aa, Mycobacterium bovis
IAVVLYYVMLTFVARPYLIPSESMEPTLHGC

SEQ ID NO: 162668 - protein, 24 aa, Mycobacterium bovis
ICLVLFAAIVVWPQVRHAGSGSGG

SEQ ID NO: 162669 - protein, 26 aa, Mycobacterium bovis
ICTALQLPLSVVLIDAGERMARQERL

SEQ ID NO: 162670 - protein, 32 aa, Mycobacterium bovis
IDAEYRFEKAWPLLWFVVIGLIAAAVGYLYAR

SEQ ID NO: 162671 - protein, 17 aa, Mycobacterium bovis
IDDFVRPLRSYFYWEHH

SEQ ID NO: 162672 - protein, 20 aa, Mycobacterium bovis
IDDRWGLDALTKFAGQITAA

SEQ ID NO: 162673 - protein, 19 aa, Mycobacterium bovis
IDIGVWVRIFAVATAITIV

SEQ ID NO: 162674 - protein, 17 aa, Mycobacterium bovis
IDTAIFYTLKLTVLEPK

SEQ ID NO: 162675 - protein, 18 aa, Mycobacterium bovis
IDVVHWPGYLLIVAGVVG

SEQ ID NO: 162676 - protein, 27 aa, Mycobacterium bovis
IEMQGDGPYVLVGWSLGGVLAYACAIG

SEQ ID NO: 162677 - protein, 24 aa, Mycobacterium bovis
IEPTNRAVLLPLGLTPEQVSQARP

SEQ ID NO: 162678 - protein, 26 aa, Mycobacterium bovis
IESEARRMTLLVDELLLLSRLSEGED

SEQ ID NO: 162679 - protein, 25 aa, Mycobacterium bovis
IETAQRLFPRAILHFEDFGPANARK

SEQ ID NO: 162680 - protein, 29 aa, Mycobacterium bovis
IETEHLPLLAPLRAIPVIGPPLAALVEPN

SEQ ID NO: 162681 - protein, 18 aa, Mycobacterium bovis
IFAASMSGLLFSSIGTVV

SEQ ID NO: 162682 - protein, 17 aa, Mycobacterium bovis
IFALVVFVTGLPLAYYA

SEQ ID NO: 162683 - protein, 17 aa, Mycobacterium bovis
IFGFVWYSHSIFGLDSL

SEQ ID NO: 162684 - protein, 25 aa, Mycobacterium bovis
IFGLRRWYVITFLMGLFFVLGQAYE

SEQ ID NO: 162685 - protein, 21 aa, Mycobacterium bovis
IFTVVPQWILALIALTVVLSM

SEQ ID NO: 162686 - protein, 19 aa, Mycobacterium bovis
IGAASLALVLGLLVGAVTR

SEQ ID NO: 162687 - protein, 29 aa, Mycobacterium bovis
IGDWILNRGLRIVMLLIAAVLAARFVTWL

SEQ ID NO: 162688 - protein, 23 aa, Mycobacterium bovis
IGGQVARLWKLTSALTIDDRTGL

SEQ ID NO: 162689 - protein, 25 aa, Mycobacterium bovis
IGHGRLFGFYVAFYCAGRFCVELLR

SEQ ID NO: 162690 - protein, 27 aa, Mycobacterium bovis
IGLFGFWRGLYFTTIARRGLAILRRRR

SEQ ID NO: 162691 - protein, 20 aa, Mycobacterium bovis
IGLGLLFDTLVVRAFMTPSI

SEQ ID NO: 162692 - protein, 25 aa, Mycobacterium bovis
IGMGLLFDTLIVRSFMTPSIAALLG

SEQ ID NO: 162693 - protein, 25 aa, Mycobacterium bovis
IGMVILPPFVYFITYRWCIGLQRSD

SEQ ID NO: 162694 - protein, 24 aa, Mycobacterium bovis
IGNTQALRWRTSVGAAAISVAQRV

SEQ ID NO: 162695 - protein, 17 aa, Mycobacterium bovis
IGRTLLGLAATAVTAVL

SEQ ID NO: 162696 - protein, 20 aa, Mycobacterium bovis
IGSLGVGLGLTLWLSTDAAE

SEQ ID NO: 162697 - protein, 23 aa, Mycobacterium bovis
IGTGIFFVLAQAVPEAGPGVIVS

SEQ ID NO: 162698 - protein, 24 aa, Mycobacterium bovis
IGTMLVWGLFRIFVLGNPVRAESA

SEQ ID NO: 162699 - protein, 27 aa, Mycobacterium bovis
IGTWVRMVINYLVPFLVASVGYLGARR

SEQ ID NO: 162700 - protein, 27 aa, Mycobacterium bovis
IGVAMLIGRFFLIIPVLAIAGSLARKG

SEQ ID NO: 162701 - protein, 20 aa, Mycobacterium bovis
IGVPLWTDILLPIVMWALYA

SEQ ID NO: 162702 - protein, 17 aa, Mycobacterium bovis
IGYALITVGLLIAVNQL

SEQ ID NO: 162703 - protein, 25 aa, Mycobacterium bovis
IHDCPKLLQLRTFPTIAIGGDLAGA

SEQ ID NO: 162704 - protein, 27 aa, Mycobacterium bovis
IHIVAMVVLLSLIPIGWLLADFTDGTP

SEQ ID NO: 162705 - protein, 26 aa, Mycobacterium bovis
IIAAAPLGILPMPRAMPATAAFPPPA

SEQ ID NO: 162706 - protein, 18 aa, Mycobacterium bovis
IIGLLLGGFITHLYDRSS

SEQ ID NO: 162707 - protein, 29 aa, Mycobacterium bovis
IIGNLLQMAFRFWAFRRWVFPDEFARNPD

SEQ ID NO: 162708 - protein, 17 aa, Mycobacterium bovis
IIGVPPFAGFFSKDAII

SEQ ID NO: 162709 - protein, 21 aa, Mycobacterium bovis
IILGWLVTIAVLNVTVPQLET

SEQ ID NO: 162710 - protein, 31 aa, Mycobacterium bovis
IIQTPVISHFFGCTPLGPVAWTGVFSATAGA

SEQ ID NO: 162711 - protein, 19 aa, Mycobacterium bovis
IISNIFGAIPVLAGPLLGA

SEQ ID NO: 162712 - protein, 19 aa, Mycobacterium bovis
IITLMYFMFENFPHRPGTP

SEQ ID NO: 162713 - protein, 37 aa, Mycobacterium bovis
IKAIPPSLLVLVLVSSVLPLAAPWLRDLRAGPVSINR

SEQ ID NO: 162714 - protein, 26 aa, Mycobacterium bovis
IKRQQLFLSSLLRSMISTDTLFNLSR

SEQ ID NO: 162715 - protein, 26 aa, Mycobacterium bovis
IKVSVFAVVMLLVAAGLVVVFGDFRF

SEQ ID NO: 162716 - protein, 25 aa, Mycobacterium bovis
ILAGAALLAYFKPQGKLGGTSLFTD

SEQ ID NO: 162717 - protein, 25 aa, Mycobacterium bovis
ILAPQILDYVVSFIASLQAGIVAVP

SEQ ID NO: 162718 - protein, 21 aa, Mycobacterium bovis
ILARFPGLYLQSLGLTFNGAT

SEQ ID NO: 162719 - protein, 28 aa, Mycobacterium bovis
ILLGPLVGLVLLALDFRITVLAAAGVFG

SEQ ID NO: 162720 - protein, 28 aa, Mycobacterium bovis
ILRGGRSRLVFGTLAILLCLVLGVAIVT

SEQ ID NO: 162721 - protein, 17 aa, Mycobacterium bovis
ILSLVAMTHPDQVNLLL

SEQ ID NO: 162722 - protein, 20 aa, Mycobacterium bovis
ILTHFVWGLIMVFALPPLFA

SEQ ID NO: 162723 - protein, 17 aa, Mycobacterium bovis
ILVLLPAAGMAAAAHVP

SEQ ID NO: 162724 - protein, 17 aa, Mycobacterium bovis
ILVLSGFVGFAVISKVP

SEQ ID NO: 162725 - protein, 18 aa, Mycobacterium bovis
ILVRLAVLLALVATQAAV

SEQ ID NO: 162726 - protein, 25 aa, Mycobacterium bovis
ILYIISFSLFIYGLMGLTGPKTAVR

SEQ ID NO: 162727 - protein, 18 aa, Mycobacterium bovis
IMIAVFCGFAFAGMPLVA

SEQ ID NO: 162728 - protein, 20 aa, Mycobacterium bovis
IMIGLLFDTLVVRSYMTPAL

SEQ ID NO: 162729 - protein, 24 aa, Mycobacterium bovis
IMLGWLGIGPIPWLIEPRWAMVSL

SEQ ID NO: 162730 - protein, 26 aa, Mycobacterium bovis
INPLTWPPAFFSWFAAGMLLAEWAYS

SEQ ID NO: 162731 - protein, 28 aa, Mycobacterium bovis
INRREVVLVTGPWLAGVSGVRAALAERL

SEQ ID NO: 162732 - protein, 18 aa, Mycobacterium bovis
IPELFATSYRYTGSALAA

SEQ ID NO: 162733 - protein, 26 aa, Mycobacterium bovis
IPGRWRPAWIGWWVSLGLATATIGGG

SEQ ID NO: 162734 - protein, 27 aa, Mycobacterium bovis
IPLSKWFLLIMAFGSLFMVAGKRYAEL

SEQ ID NO: 162735 - protein, 18 aa, Mycobacterium bovis
IPSLMWISVPVILGIAIA

SEQ ID NO: 162736 - protein, 20 aa, Mycobacterium bovis
IPVLFALIALWLTRGGQIPN

SEQ ID NO: 162737 - protein, 32 aa, Mycobacterium bovis
IPVQERRLVFERFYRSASARALPGSGLGLAIV

SEQ ID NO: 162738 - protein, 19 aa, Mycobacterium bovis
IQANLLKRAVGPSLKWFDE

SEQ ID NO: 162739 - protein, 18 aa, Mycobacterium bovis
IQPGFYRMRTEISAASAV

SEQ ID NO: 162740 - protein, 20 aa, Mycobacterium bovis
IRALTTAPVPIVAGFMAAVF

SEQ ID NO: 162741 - protein, 21 aa, Mycobacterium bovis
IRKRWDRYAAFAEKTFNVTIP

SEQ ID NO: 162742 - protein, 19 aa, Mycobacterium bovis
IRPVAPEAYALYGISRVLP

SEQ ID NO: 162743 - protein, 26 aa, Mycobacterium bovis
ISDGAVFCGLLWWIAFHMRDRPLVIA

SEQ ID NO: 162744 - protein, 38 aa, Mycobacterium bovis
ISEFARAINIFVITPLRIAFLILLVGTTLEVLTETSRQ

SEQ ID NO: 162745 - protein, 19 aa, Mycobacterium bovis
ISGAFLYLIGILNVIVLVG

SEQ ID NO: 162746 - protein, 36 aa, Mycobacterium bovis
ISLATALPLRLISWLLMPISRLLVLLGNALTPGRGF

SEQ ID NO: 162747 - protein, 19 aa, Mycobacterium bovis
ISLTILIGVGFLFLYQGVT

SEQ ID NO: 162748 - protein, 24 aa, Mycobacterium bovis
ISVISFTAILWNLSGTLNIFGVSI

SEQ ID NO: 162749 - protein, 26 aa, Mycobacterium bovis
ISYVRQILLVQLWFQPYFDGSSWDGP

SEQ ID NO: 162750 - protein, 34 aa, Mycobacterium bovis
ITATALLVVFIRYHFSMVWGLYLAAGIMVLASFV

SEQ ID NO: 162751 - protein, 30 aa, Mycobacterium bovis
ITATTIVVLLILLLIVYRSAITATVPLLSV

SEQ ID NO: 162752 - protein, 25 aa, Mycobacterium bovis
ITAYVLTFGGLMLLGGRLGDTIGRK

SEQ ID NO: 162753 - protein, 23 aa, Mycobacterium bovis
ITGGVGWWYILVATGFVVFALYC

SEQ ID NO: 162754 - protein, 23 aa, Mycobacterium bovis
ITGPAIWISFLIAAATCALAALC

SEQ ID NO: 162755 - protein, 27 aa, Mycobacterium bovis
ITLSVMAIFYLRLPATFGIGTYGVSAD

SEQ ID NO: 162756 - protein, 25 aa, Mycobacterium bovis
ITMMAGLLVSLLVRRRRVWARITPT

SEQ ID NO: 162757 - protein, 20 aa, Mycobacterium bovis
ITPAIFLVMVSAFVALQVKA

SEQ ID NO: 162758 - protein, 24 aa, Mycobacterium bovis
ITQAPLNALWQLTKAVRAELSDPL

SEQ ID NO: 162759 - protein, 22 aa, Mycobacterium bovis
ITRKPVLTLYRQRPPEVGVPSE

SEQ ID NO: 162760 - protein, 26 aa, Mycobacterium bovis
ITVSTIFFALFAIAAGYAAWLHFAPR

SEQ ID NO: 162761 - protein, 24 aa, Mycobacterium bovis
IVAAKLVFLVIWIGAATSKLNRHF

SEQ ID NO: 162762 - protein, 27 aa, Mycobacterium bovis
IVAAMGCAFVALLRPQSALGQAPIVMG

SEQ ID NO: 162763 - protein, 28 aa, Mycobacterium bovis
IVAGVLLVLGLFTPLAAAGALAFLINGL

SEQ ID NO: 162764 - protein, 24 aa, Mycobacterium bovis
IVALIGTIVMLYVSGVRSLATGFF

SEQ ID NO: 162765 - protein, 17 aa, Mycobacterium bovis
IVALWVSRTDGVVLHWI

SEQ ID NO: 162766 - protein, 28 aa, Mycobacterium bovis
IVASAIGLLLFPQGFLKSLTYATIASVM

SEQ ID NO: 162767 - protein, 25 aa, Mycobacterium bovis
IVAVGSWWRYRYDKFGWTTRSSQLY

SEQ ID NO: 162768 - protein, 40 aa, Mycobacterium bovis
IVAVTVVVVILILMALLRAIVAPLYLVGSVVISYMSAIGL

SEQ ID NO: 162769 - protein, 19 aa, Mycobacterium bovis
IVFGLSRMARAALAIAPVV

SEQ ID NO: 162770 - protein, 35 aa, Mycobacterium bovis
IVGGTVIAILLMWSKLPAKVRIIPGPLVAIAGATV

SEQ ID NO: 162771 - protein, 17 aa, Mycobacterium bovis
IVGTPRPAPRTTVGVVE

SEQ ID NO: 162772 - protein, 26 aa, Mycobacterium bovis
IVGVMLSMFLLAFAGIPLTSGFVSKF

SEQ ID NO: 162773 - protein, 23 aa, Mycobacterium bovis
IVGVPWLLSFAQPSIWQIGRPWY

SEQ ID NO: 162774 - protein, 22 aa, Mycobacterium bovis
IVHAQAAWTSPLLPAADELADR

SEQ ID NO: 162775 - protein, 17 aa, Mycobacterium bovis
IVLLLAGPRLIDAYVDW

SEQ ID NO: 162776 - protein, 24 aa, Mycobacterium bovis
IVPVALILWRTFEPGFGQFYAWIS

SEQ ID NO: 162777 - protein, 25 aa, Mycobacterium bovis
IVSTPLRFWEYLAAKLTVLLAISLF

SEQ ID NO: 162778 - protein, 18 aa, Mycobacterium bovis
IVTLSWLTIAVAGILAAM

SEQ ID NO: 162779 - protein, 23 aa, Mycobacterium bovis
IWGVLGLVVFGALLFGPAGTFDY

SEQ ID NO: 162780 - protein, 29 aa, Mycobacterium bovis
IWPPWEFYFWHHTIPAPVWVAVIMGLVFV

SEQ ID NO: 162781 - protein, 25 aa, Mycobacterium bovis
IWQIGRPWYLAWAGLVYVVATLATL

SEQ ID NO: 162782 - protein, 30 aa, Mycobacterium bovis
IYIAGFHHGFFIFAIVLTALSIIPLGGGIV

SEQ ID NO: 162783 - protein, 23 aa, Mycobacterium bovis
KADPPFVAYHLFGPAPATDNDLL

SEQ ID NO: 162784 - protein, 22 aa, Mycobacterium bovis
KAGEVTLLPSPMFHALGYMHAA

SEQ ID NO: 162785 - protein, 25 aa, Mycobacterium bovis
KAGLVPLHAWLPRAHPEAPSPVSAL

SEQ ID NO: 162786 - protein, 26 aa, Mycobacterium bovis
KAIRTVRFWMAPIATTLALMSALAAL

SEQ ID NO: 162787 - protein, 26 aa, Mycobacterium bovis
KAQQPINLLLLAVAVAAAVVIGLHAH

SEQ ID NO: 162788 - protein, 36 aa, Mycobacterium bovis
KARVPPYKTAGLGLVLVFALVVALVYLQFRGEFTPK

SEQ ID NO: 162789 - protein, 24 aa, Mycobacterium bovis
KATKRRYRFARGLMAGLLGTMALT

SEQ ID NO: 162790 - protein, 26 aa, Mycobacterium bovis
KATMLAHWAWLSMLLVGGAGAAGYWV

SEQ ID NO: 162791 - protein, 24 aa, Mycobacterium bovis
KDGKAWILPIGLAGDLGTPKSYHA

SEQ ID NO: 162792 - protein, 20 aa, Mycobacterium bovis
KDPVFRERMKREARIAGRLQ

SEQ ID NO: 162793 - protein, 18 aa, Mycobacterium bovis
KEHWLPAHFSGDGSTYMP

SEQ ID NO: 162794 - protein, 21 aa, Mycobacterium bovis
KEPPPPLPPDLPPNVRELIEI

SEQ ID NO: 162795 - protein, 24 aa, Mycobacterium bovis
KFSMPGPWVGIAAPGENIASVSNS

SEQ ID NO: 162796 - protein, 23 aa, Mycobacterium bovis
KGISLFRTVVFLPLAISSVVMAV

SEQ ID NO: 162797 - protein, 30 aa, Mycobacterium bovis
KGRLKWAWIPGIPLLWDLAVTLTASWQKIF

SEQ ID NO: 162798 - protein, 23 aa, Mycobacterium bovis
KGRSFRIHILFASQTLDVGKIKD

SEQ ID NO: 162799 - protein, 20 aa, Mycobacterium bovis
KGYCFQIDLTWRTVSNGFVV

SEQ ID NO: 162800 - protein, 30 aa, Mycobacterium bovis
KHDWPFADRVFAAALPWLAGQLATPGVPKI

SEQ ID NO: 162801 - protein, 20 aa, Mycobacterium bovis
KHILGDNLHWSVLPIAFVLL

SEQ ID NO: 162802 - protein, 17 aa, Mycobacterium bovis
KHLHIFLAPINVTFKRL

SEQ ID NO: 162803 - protein, 21 aa, Mycobacterium bovis
KHRGELVYLPPAWFDREHRSE

SEQ ID NO: 162804 - protein, 24 aa, Mycobacterium bovis
KIEAFAMFNVFYQSGILLGPLVGL

SEQ ID NO: 162805 - protein, 26 aa, Mycobacterium bovis
KIGRKPLLLWFGVGGLIYTYVLVTYL

SEQ ID NO: 162806 - protein, 19 aa, Mycobacterium bovis
KIPKGVLLYGPPGTGKTLL

SEQ ID NO: 162807 - protein, 17 aa, Mycobacterium bovis
KKLPAKKAAKKAPARKT

SEQ ID NO: 162808 - protein, 18 aa, Mycobacterium bovis
KLARVLVADGRRVVLGAA

SEQ ID NO: 162809 - protein, 17 aa, Mycobacterium bovis
KLFLINFAIGVATGIVQ

SEQ ID NO: 162810 - protein, 30 aa, Mycobacterium bovis
KLGIVSVVLLFFTVMIIVIFGQMRFDRTNG

SEQ ID NO: 162811 - protein, 18 aa, Mycobacterium bovis
KLVFSMDLGMCLNRFTYD

SEQ ID NO: 162812 - protein, 31 aa, Mycobacterium bovis
KMQFGEGWWTSVWFLSFWVTGTSILLVSGIP

SEQ ID NO: 162813 - protein, 20 aa, Mycobacterium bovis
KNFYYFPDQLSIDRYLDRNG

SEQ ID NO: 162814 - protein, 18 aa, Mycobacterium bovis
KPPVAARWRVAGSAALFV

SEQ ID NO: 162815 - protein, 24 aa, Mycobacterium bovis
KQFALVFLLVLFLAPTLNGWFFGV

SEQ ID NO: 162816 - protein, 18 aa, Mycobacterium bovis
KQLAVRYHLLNFLDDQSH

SEQ ID NO: 162817 - protein, 25 aa, Mycobacterium bovis
KQLITIARAFLARPQLLILDEATSS

SEQ ID NO: 162818 - protein, 27 aa, Mycobacterium bovis
KRARGSPLRIMILLVLVSALASALLDN

SEQ ID NO: 162819 - protein, 23 aa, Mycobacterium bovis
KRTFSLPWRLANIQDLPAVDSPA

SEQ ID NO: 162820 - protein, 20 aa, Mycobacterium bovis
KRVFILGVALFTVASGLCAI

SEQ ID NO: 162821 - protein, 19 aa, Mycobacterium bovis
KSMYLIVEPAKDPTTPAAL

SEQ ID NO: 162822 - protein, 23 aa, Mycobacterium bovis
KSTLAWIMAGLTIPTTGACLLDG

SEQ ID NO: 162823 - protein, 20 aa, Mycobacterium bovis
KSWHMYPVGFLFGLGFDTAT

SEQ ID NO: 162824 - protein, 23 aa, Mycobacterium bovis
KTLKYRPDFPKRFESIEAARVHC

SEQ ID NO: 162825 - protein, 26 aa, Mycobacterium bovis
KTLVSTTFVVPYPPGFPVLVPGQLVS

SEQ ID NO: 162826 - protein, 19 aa, Mycobacterium bovis
KTMGVIFLALMSYGAVSTT

SEQ ID NO: 162827 - protein, 18 aa, Mycobacterium bovis
KTSINSVLLIFTIGVTWS

SEQ ID NO: 162828 - protein, 21 aa, Mycobacterium bovis
KTTLLMTLAGLLPPVHGRVLL

SEQ ID NO: 162829 - protein, 23 aa, Mycobacterium bovis
KTTTHLFQPLLYQVATGILSEGD

SEQ ID NO: 162830 - protein, 29 aa, Mycobacterium bovis
KVDYADILFITPWLLLLGVAMSGLTAYLT

SEQ ID NO: 162831 - protein, 24 aa, Mycobacterium bovis
KVEDWLGYFLLHASFVLGAAAGGA

SEQ ID NO: 162832 - protein, 20 aa, Mycobacterium bovis
KVFGLQGLLTLFVSFPLQLS

SEQ ID NO: 162833 - protein, 21 aa, Mycobacterium bovis
KVGAAIVRWPGPILVGAVALA

SEQ ID NO: 162834 - protein, 26 aa, Mycobacterium bovis
KVTTSPLPMKPIPQPVLQPVAQPNPQ

SEQ ID NO: 162835 - protein, 19 aa, Mycobacterium bovis
KVWAVVGAAAIVLVAIVAA

SEQ ID NO: 162836 - protein, 17 aa, Mycobacterium bovis
LAALLRQRFPDLTPAQI

SEQ ID NO: 162837 - protein, 20 aa, Mycobacterium bovis
LAALSWAWGWLPLDAGSGIN

SEQ ID NO: 162838 - protein, 18 aa, Mycobacterium bovis
LAARHYFTYRDVLGFLYA

SEQ ID NO: 162839 - protein, 20 aa, Mycobacterium bovis
LAAYLIPALPHHPHRFDWFG

SEQ ID NO: 162840 - protein, 29 aa, Mycobacterium bovis
LACGWAFLIWGMYAYLWAFVLYAVQMTMV

SEQ ID NO: 162841 - protein, 25 aa, Mycobacterium bovis
LACPVWFYQLWAFITPGLYQRERRF

SEQ ID NO: 162842 - protein, 24 aa, Mycobacterium bovis
LADPAVVWALRLQGRVPHVVAQSL

SEQ ID NO: 162843 - protein, 24 aa, Mycobacterium bovis
LADQHAVLPLRPESLRRLDRVDAI

SEQ ID NO: 162844 - protein, 19 aa, Mycobacterium bovis
LAELWRSVGVVPDAVIGHS

SEQ ID NO: 162845 - protein, 20 aa, Mycobacterium bovis
LAFAIPTYAFIAGIGTMLVW

SEQ ID NO: 162846 - protein, 17 aa, Mycobacterium bovis
LAGASWWLIEQPIRRWR

SEQ ID NO: 162847 - protein, 23 aa, Mycobacterium bovis
LAGLCMLMLGLLMLIFSEHRSSA

SEQ ID NO: 162848 - protein, 27 aa, Mycobacterium bovis
LAGLVLALLSAPWLIAVGAICIAGAWL

SEQ ID NO: 162849 - protein, 25 aa, Mycobacterium bovis
LAGTIVGYYILRRALRPDGGQLIGV

SEQ ID NO: 162850 - protein, 18 aa, Mycobacterium bovis
LAGWGIVLGLIGLVAVWR

SEQ ID NO: 162851 - protein, 17 aa, Mycobacterium bovis
LAHLCFIGALLPLARQA

SEQ ID NO: 162852 - protein, 20 aa, Mycobacterium bovis
LAILLCLVLGVAIVTQVRQT

SEQ ID NO: 162853 - protein, 28 aa, Mycobacterium bovis
LAIRARLVLLIFTTMPVLALATWQFRRA

SEQ ID NO: 162854 - protein, 20 aa, Mycobacterium bovis
LAITGLVASAAWTIGSNLSG

SEQ ID NO: 162855 - protein, 20 aa, Mycobacterium bovis
LAIWLRFNMATEALPARLIS

SEQ ID NO: 162856 - protein, 17 aa, Mycobacterium bovis
LALFGLALLEAAGVVAV

SEQ ID NO: 162857 - protein, 18 aa, Mycobacterium bovis
LALLIGVVAGLRSLTAPA

SEQ ID NO: 162858 - protein, 18 aa, Mycobacterium bovis
LALLLIGANAFFVGAEFA

SEQ ID NO: 162859 - protein, 52 aa, Mycobacterium bovis
LALLRALYVISSWRPVLLIPLTFALFTPLAVPGFAWWAAALNSLPMLAALAW

SEQ ID NO: 162860 - protein, 24 aa, Mycobacterium bovis
LALPLASLVFFGAFIPLIGAVVAG

SEQ ID NO: 162861 - protein, 17 aa, Mycobacterium bovis
LALPTIGIFLATLTAFV

SEQ ID NO: 162862 - protein, 20 aa, Mycobacterium bovis
LALSWPRVTAVFLVDVLILA

SEQ ID NO: 162863 - protein, 22 aa, Mycobacterium bovis
LALVLGLLVGAVTRGTASGPAR

SEQ ID NO: 162864 - protein, 21 aa, Mycobacterium bovis
LAMALTCWWVISREVIPRLGH

SEQ ID NO: 162865 - protein, 23 aa, Mycobacterium bovis
LAMDPQQRLLLEVSWEALERAGI

SEQ ID NO: 162866 - protein, 19 aa, Mycobacterium bovis
LAMPLTLVGALGGLALVLV

SEQ ID NO: 162867 - protein, 18 aa, Mycobacterium bovis
LANERLAWVLGAALLLIA

SEQ ID NO: 162868 - protein, 25 aa, Mycobacterium bovis
LANPGLPLWPYLVCGALAGLGGGNF

SEQ ID NO: 162869 - protein, 23 aa, Mycobacterium bovis
LAPEVYWPLRRVGVQFHAAADGR

SEQ ID NO: 162870 - protein, 22 aa, Mycobacterium bovis
LAPQHWIALTPPRIPRVRTLQN

SEQ ID NO: 162871 - protein, 26 aa, Mycobacterium bovis
LAPTLNGWFFGVVYWLFDLSGVSHRL

SEQ ID NO: 162872 - protein, 18 aa, Mycobacterium bovis
LAQFLFGVQLEIAPVTVG

SEQ ID NO: 162873 - protein, 19 aa, Mycobacterium bovis
LAQTLLTRRHSPLVIATAL

SEQ ID NO: 162874 - protein, 31 aa, Mycobacterium bovis
LARILRQFHHPLIYVLLVAGTITAGLKEFVD

SEQ ID NO: 162875 - protein, 17 aa, Mycobacterium bovis
LARIRFTVGYVAALASV

SEQ ID NO: 162876 - protein, 17 aa, Mycobacterium bovis
LARLADARRLGHPVLAL

SEQ ID NO: 162877 - protein, 30 aa, Mycobacterium bovis
LASAICRHYWPLALLAAILSRRCRRVVLIA

SEQ ID NO: 162878 - protein, 25 aa, Mycobacterium bovis
LASVVEIWMLLGSPAVICSMLSPKA

SEQ ID NO: 162879 - protein, 20 aa, Mycobacterium bovis
LATDLGRNLLLEQLHYRHEV

SEQ ID NO: 162880 - protein, 24 aa, Mycobacterium bovis
LATRLTMITLIPTVAFMTVGGPAI

SEQ ID NO: 162881 - protein, 22 aa, Mycobacterium bovis
LAVANLMWFVFAGFGALTLESN

SEQ ID NO: 162882 - protein, 20 aa, Mycobacterium bovis
LAVAYLGIGLLLACVVLRGL

SEQ ID NO: 162883 - protein, 23 aa, Mycobacterium bovis
LAVFRAVFAFAVNDTPDGGLTQL

SEQ ID NO: 162884 - protein, 22 aa, Mycobacterium bovis
LAVGLAALTLTPALVALASRAN

SEQ ID NO: 162885 - protein, 26 aa, Mycobacterium bovis
LAVGVIVWGLIFWSAVFHRKKNTDTE

SEQ ID NO: 162886 - protein, 17 aa, Mycobacterium bovis
LAVGWLVGALVVLVVGT

SEQ ID NO: 162887 - protein, 24 aa, Mycobacterium bovis
LAVILSYIWGVRVGGLFAALGVTS

SEQ ID NO: 162888 - protein, 25 aa, Mycobacterium bovis
LAVLIRQWLLDHLAVAPGLKRQPDH

SEQ ID NO: 162889 - protein, 27 aa, Mycobacterium bovis
LAVSIPLTVLIIFTLNILLAEFGAADI

SEQ ID NO: 162890 - protein, 35 aa, Mycobacterium bovis
LAVTVLLFPVVQPWYLLWAIIPLAAWATRPGFRVA

SEQ ID NO: 162891 - protein, 20 aa, Mycobacterium bovis
LAYLAIIGVPPFAGFFSKDA

SEQ ID NO: 162892 - protein, 18 aa, Mycobacterium bovis
LAYLLLVLVCRRRWQPRL

SEQ ID NO: 162893 - protein, 25 aa, Mycobacterium bovis
LAYVVIFSLPLAREKFLLDASNLAT

SEQ ID NO: 162894 - protein, 18 aa, Mycobacterium bovis
LCGIAIFALVVFVTGLPL

SEQ ID NO: 162895 - protein, 22 aa, Mycobacterium bovis
LCGVTWVYHYAVAVYRYDRGCG

SEQ ID NO: 162896 - protein, 17 aa, Mycobacterium bovis
LCLPLARALRRPTPSAM

SEQ ID NO: 162897 - protein, 26 aa, Mycobacterium bovis
LCPQNLDYLISFFGALYSGRIAVPLF

SEQ ID NO: 162898 - protein, 19 aa, Mycobacterium bovis
LCSESTMYRLLRERGQTGD

SEQ ID NO: 162899 - protein, 20 aa, Mycobacterium bovis
LDAPDFRYFITGGAPMPEAL

SEQ ID NO: 162900 - protein, 24 aa, Mycobacterium bovis
LDATVVRMFLVPSVMKLLGDDCWW

SEQ ID NO: 162901 - protein, 30 aa, Mycobacterium bovis
LDGLRPYFTGYLPTLLLAAILTPATVAVIG

SEQ ID NO: 162902 - protein, 24 aa, Mycobacterium bovis
LDHAYTYGLLWVAGAAIIVGGMAL

SEQ ID NO: 162903 - protein, 18 aa, Mycobacterium bovis
LDLPPEPVVIPGDAARLH

SEQ ID NO: 162904 - protein, 21 aa, Mycobacterium bovis
LDRVRVVVIDGAALRGDNRAV

SEQ ID NO: 162905 - protein, 17 aa, Mycobacterium bovis
LDTFLVRTVTVPAIAVL

SEQ ID NO: 162906 - protein, 24 aa, Mycobacterium bovis
LDYLQGAVWVLPTFGVAIGLGSGA

SEQ ID NO: 162907 - protein, 27 aa, Mycobacterium bovis
LEDIIRFQAEFLWRDYFQPGVSIDGEE

SEQ ID NO: 162908 - protein, 26 aa, Mycobacterium bovis
LEFWASLIKVIALVTFLIVGTVFLAG

SEQ ID NO: 162909 - protein, 29 aa, Mycobacterium bovis
LEGAFFAFILAGVFQILFGACRLGSLIRY

SEQ ID NO: 162910 - protein, 21 aa, Mycobacterium bovis
LENRIKAMPPSSVVGLWTFDG

SEQ ID NO: 162911 - protein, 22 aa, Mycobacterium bovis
LEPVSHMWVVKFLRTHGLIHDC

SEQ ID NO: 162912 - protein, 27 aa, Mycobacterium bovis
LEQAVSQIWPLDRPGLLFDDMDDLRDF

SEQ ID NO: 162913 - protein, 19 aa, Mycobacterium bovis
LERLRDFAVFKAIGVPTRS

SEQ ID NO: 162914 - protein, 28 aa, Mycobacterium bovis
LFAAPIVIIMILLIIPVGKLSLGGISEK

SEQ ID NO: 162915 - protein, 19 aa, Mycobacterium bovis
LFDTFVRYHWGHEFMAIHF

SEQ ID NO: 162916 - protein, 19 aa, Mycobacterium bovis
LFILMRYREELRCGRRPPD

SEQ ID NO: 162917 - protein, 18 aa, Mycobacterium bovis
LFSGRRWVTMLGAFILAL

SEQ ID NO: 162918 - protein, 18 aa, Mycobacterium bovis
LFSLSMLQSDIIGALFVL

SEQ ID NO: 162919 - protein, 31 aa, Mycobacterium bovis
LFTLVEIGQFIRWLFRFLVGQVDRIAPFRVS

SEQ ID NO: 162920 - protein, 21 aa, Mycobacterium bovis
LFVTYWSFRMMIGLMAIPVLF

SEQ ID NO: 162921 - protein, 18 aa, Mycobacterium bovis
LFWVSYILSITVAAALIP

SEQ ID NO: 162922 - protein, 18 aa, Mycobacterium bovis
LGAFLLAHLCFIGALLPL

SEQ ID NO: 162923 - protein, 34 aa, Mycobacterium bovis
LGAMAYSWYLWHWPLLIFWLSYTGHRHANFVEGA

SEQ ID NO: 162924 - protein, 18 aa, Mycobacterium bovis
LGAMLWRSLEPNAAPRTQ

SEQ ID NO: 162925 - protein, 17 aa, Mycobacterium bovis
LGAMVLPFLLGFRLTCY

SEQ ID NO: 162926 - protein, 23 aa, Mycobacterium bovis
LGDRLQHLILPSLTLALAAAAGF

SEQ ID NO: 162927 - protein, 19 aa, Mycobacterium bovis
LGEDYLRLSALGSYGAFFN

SEQ ID NO: 162928 - protein, 19 aa, Mycobacterium bovis
LGFGGMSEVHLARDLRLHR

SEQ ID NO: 162929 - protein, 20 aa, Mycobacterium bovis
LGFLAGLALPKDAALLAGTG

SEQ ID NO: 162930 - protein, 17 aa, Mycobacterium bovis
LGIQGYLLALRYLAEHV

SEQ ID NO: 162931 - protein, 20 aa, Mycobacterium bovis
LGLLLVTPNLVALAGFILLV

SEQ ID NO: 162932 - protein, 21 aa, Mycobacterium bovis
LGLLTLGLIKGPDWGWASLPT

SEQ ID NO: 162933 - protein, 31 aa, Mycobacterium bovis
LGLNPPPVPIPWSVLSLFVPGPTLSRADALL

SEQ ID NO: 162934 - protein, 30 aa, Mycobacterium bovis
LGQLIGARPLSFLLTGRVGGWLLVVGLTLA

SEQ ID NO: 162935 - protein, 23 aa, Mycobacterium bovis
LGRRRTFLSGVLVFTIASGLCAV

SEQ ID NO: 162936 - protein, 26 aa, Mycobacterium bovis
LGSGWWQTFWRITLPSIRWGLTYGIV

SEQ ID NO: 162937 - protein, 21 aa, Mycobacterium bovis
LGSLLALILGVSRTTLAMARD

SEQ ID NO: 162938 - protein, 27 aa, Mycobacterium bovis
LGSYGAFFNIYFCSVTIKINGPAGSDI

SEQ ID NO: 162939 - protein, 17 aa, Mycobacterium bovis
LGTVPTGLLAYRYRLRV

SEQ ID NO: 162940 - protein, 29 aa, Mycobacterium bovis
LGVEEQYYVVWPLLLIGATLLLAARARRR

SEQ ID NO: 162941 - protein, 17 aa, Mycobacterium bovis
LGVGTLKDLALVQLIGI

SEQ ID NO: 162942 - protein, 26 aa, Mycobacterium bovis
LGVHRIFLITVALALLTASPASAITP

SEQ ID NO: 162943 - protein, 19 aa, Mycobacterium bovis
LGVLGMFMIIAFSAYSADH

SEQ ID NO: 162944 - protein, 32 aa, Mycobacterium bovis
LGVRGQRLLALYYPFVALLCSLATTLVLLDGA

SEQ ID NO: 162945 - protein, 28 aa, Mycobacterium bovis
LGYVGYLALVVYFDWGFSLAAGVLVLSV

SEQ ID NO: 162946 - protein, 27 aa, Mycobacterium bovis
LHDPPPCMTGFLPPPLVRSPADESVRE

SEQ ID NO: 162947 - protein, 26 aa, Mycobacterium bovis
LHLAVQSLRLGECDLALVGGVTVMAT

SEQ ID NO: 162948 - protein, 28 aa, Mycobacterium bovis
LHWSVLPIAFVLLISVGSAYNLLFALRI

SEQ ID NO: 162949 - protein, 25 aa, Mycobacterium bovis
LIAAYGYWLISHWPVDLLADRHNIL

SEQ ID NO: 162950 - protein, 22 aa, Mycobacterium bovis
LIALAIITRLRHPLPVAPSAGE

SEQ ID NO: 162951 - protein, 24 aa, Mycobacterium bovis
LIALGLVVIVMVFASGLLAMFPIA

SEQ ID NO: 162952 - protein, 18 aa, Mycobacterium bovis
LIARYLDRYGIRADTIRI

SEQ ID NO: 162953 - protein, 26 aa, Mycobacterium bovis
LIATGLGLFMIFLDALIVNVALPDIQ

SEQ ID NO: 162954 - protein, 19 aa, Mycobacterium bovis
LIEMLTTLPKFPGLPGLPS

SEQ ID NO: 162955 - protein, 19 aa, Mycobacterium bovis
LIFPRFEQLLEKPFSRIPQ

SEQ ID NO: 162956 - protein, 18 aa, Mycobacterium bovis
LIGYVGLADTARPSSRPL

SEQ ID NO: 162957 - protein, 18 aa, Mycobacterium bovis
LIIFPLVVYGMKVLSQLQ

SEQ ID NO: 162958 - protein, 32 aa, Mycobacterium bovis
LILRENVVALTVLWLLNIGEYLQDLTLRRTRR

SEQ ID NO: 162959 - protein, 35 aa, Mycobacterium bovis
LILSITTLIFGFLVMWILAWLTAAPVRVVRAALKR

SEQ ID NO: 162960 - protein, 17 aa, Mycobacterium bovis
LILVVAAFPSLFTAADP

SEQ ID NO: 162961 - protein, 19 aa, Mycobacterium bovis
LINVFTAVTFAIVPLLHRF

SEQ ID NO: 162962 - protein, 27 aa, Mycobacterium bovis
LIPRLYALHILLLPGIILALIGLHLAL

SEQ ID NO: 162963 - protein, 26 aa, Mycobacterium bovis
LIQDPLTGFIYAFDDMLARHNASWAD

SEQ ID NO: 162964 - protein, 22 aa, Mycobacterium bovis
LIRARFPTLTARQVMQRIESTA

SEQ ID NO: 162965 - protein, 30 aa, Mycobacterium bovis
LIRTPELYAWILVLPIGLMLQQSSLRVGAL

SEQ ID NO: 162966 - protein, 17 aa, Mycobacterium bovis
LISIPVVSQLLGCTPLD

SEQ ID NO: 162967 - protein, 20 aa, Mycobacterium bovis
LKGRLLFMPGVMVTSVPWQL

SEQ ID NO: 162968 - protein, 18 aa, Mycobacterium bovis
LKIMTWVTAFFAPLTVAY

SEQ ID NO: 162969 - protein, 20 aa, Mycobacterium bovis
LKVELPLSIPVLVAGLRVVA

SEQ ID NO: 162970 - protein, 19 aa, Mycobacterium bovis
LLAAAFVASVLLGVGIGWG

SEQ ID NO: 162971 - protein, 25 aa, Mycobacterium bovis
LLAAALTLWLHVIDARFARALRLRL

SEQ ID NO: 162972 - protein, 28 aa, Mycobacterium bovis
LLAGWAVALPWSLLVMPLIDSGSPSLFA

SEQ ID NO: 162973 - protein, 21 aa, Mycobacterium bovis
LLAIWIGIGFIFRGVATTVSA

SEQ ID NO: 162974 - protein, 20 aa, Mycobacterium bovis
LLASGRFIKAIPPSLLVLVL

SEQ ID NO: 162975 - protein, 23 aa, Mycobacterium bovis
LLERVLANLIDNALRYAPDCVVR

SEQ ID NO: 162976 - protein, 19 aa, Mycobacterium bovis
LLESLALLRALYVISSWRP

SEQ ID NO: 162977 - protein, 17 aa, Mycobacterium bovis
LLFLAGLVAQLNGAPEA

SEQ ID NO: 162978 - protein, 19 aa, Mycobacterium bovis
LLGHLWSWELAIPMSGIAM

SEQ ID NO: 162979 - protein, 21 aa, Mycobacterium bovis
LLGMQIPGQLLFSIASQLALI

SEQ ID NO: 162980 - protein, 17 aa, Mycobacterium bovis
LLHFLRDAAGSLAGVIT

SEQ ID NO: 162981 - protein, 17 aa, Mycobacterium bovis
LLHIVVKIPHMVTGLRS

SEQ ID NO: 162982 - protein, 17 aa, Mycobacterium bovis
LLHYRAWAIPVAFVIAQ

SEQ ID NO: 162983 - protein, 18 aa, Mycobacterium bovis
LLILCRLVQGFATGGEYG

SEQ ID NO: 162984 - protein, 19 aa, Mycobacterium bovis
LLLARWLLFRVEFGAGLIK

SEQ ID NO: 162985 - protein, 29 aa, Mycobacterium bovis
LLLGWGVFLNYGLVLIVLPGMAVLAAADW

SEQ ID NO: 162986 - protein, 26 aa, Mycobacterium bovis
LLLNMWALYVVGPPLEMWLGRLRFGA

SEQ ID NO: 162987 - protein, 18 aa, Mycobacterium bovis
LLLPLLNRQWRALVAAVV

SEQ ID NO: 162988 - protein, 20 aa, Mycobacterium bovis
LLMLGIIAVSMFMGMIVLAV

SEQ ID NO: 162989 - protein, 19 aa, Mycobacterium bovis
LLMTSPLLRRFNDLQATTL

SEQ ID NO: 162990 - protein, 26 aa, Mycobacterium bovis
LLNYLVLLALASFLTYCLTSLAFSPL

SEQ ID NO: 162991 - protein, 19 aa, Mycobacterium bovis
LLQKVLDLPAGQLPPEPPI

SEQ ID NO: 162992 - protein, 21 aa, Mycobacterium bovis
LLRIASPMFHFGILVVIVGHG

SEQ ID NO: 162993 - protein, 17 aa, Mycobacterium bovis
LLRSLLTYFHYASKETR

SEQ ID NO: 162994 - protein, 23 aa, Mycobacterium bovis
LLSISFIVLLILRVVGARAAKRE

SEQ ID NO: 162995 - protein, 19 aa, Mycobacterium bovis
LLVAIRREHISLRPLWGID

SEQ ID NO: 162996 - protein, 17 aa, Mycobacterium bovis
LLVLLTNENGLGPADEA

SEQ ID NO: 162997 - protein, 18 aa, Mycobacterium bovis
LMFALAWLLLADLPEYRT

SEQ ID NO: 162998 - protein, 18 aa, Mycobacterium bovis
LMTVLLHGTRQPIPPWEQ

SEQ ID NO: 162999 - protein, 30 aa, Mycobacterium bovis
LNGAPEAMWWTLYLACYLAGGWGSAWAGAQ

SEQ ID NO: 163000 - protein, 23 aa, Mycobacterium bovis
LNQPPPCLTGFLPASEWRSPADT

SEQ ID NO: 163001 - protein, 27 aa, Mycobacterium bovis
LNRIGTPLFFQRVFGAGIATLVAVAAY

SEQ ID NO: 163002 - protein, 18 aa, Mycobacterium bovis
LNTKLPEDPPPPPKPAAV

SEQ ID NO: 163003 - protein, 35 aa, Mycobacterium bovis
LNVRMAMLVAAAWLALLGLPLLLVAHRLPDSGAAS

SEQ ID NO: 163004 - protein, 17 aa, Mycobacterium bovis
LPAIGFALSMAGLILLW

SEQ ID NO: 163005 - protein, 25 aa, Mycobacterium bovis
LPEFSFWAWLAMLFSAGMGIGLVFY

SEQ ID NO: 163006 - protein, 35 aa, Mycobacterium bovis
LPERLLQVLTGLLFLLFGLWLLFDDALGFRSIAIA

SEQ ID NO: 163007 - protein, 20 aa, Mycobacterium bovis
LPRLVHLACIWIVAIAVNVS

SEQ ID NO: 163008 - protein, 27 aa, Mycobacterium bovis
LPSVPRWLWIVLAIGFLTAALAGGTPV

SEQ ID NO: 163009 - protein, 17 aa, Mycobacterium bovis
LPTITGWSLGRALTGIR

SEQ ID NO: 163010 - protein, 17 aa, Mycobacterium bovis
LPTLAVSIPLTVLIIFT

SEQ ID NO: 163011 - protein, 18 aa, Mycobacterium bovis
LPVAAIVIGLFASVAGLK

SEQ ID NO: 163012 - protein, 25 aa, Mycobacterium bovis
LPVLTCLAAMFIGLAIFAISMDHAH

SEQ ID NO: 163013 - protein, 19 aa, Mycobacterium bovis
LQADCYAGVWAYYASTVKQ

SEQ ID NO: 163014 - protein, 37 aa, Mycobacterium bovis
LQAFDVFSSFWFTAIYVLLFVSLVGCLAPRTIEHARS

SEQ ID NO: 163015 - protein, 18 aa, Mycobacterium bovis
LQCRPDAAYLITGGLGAL

SEQ ID NO: 163016 - protein, 25 aa, Mycobacterium bovis
LQDAMHPMMLPLLERMVVKQPRTAN

SEQ ID NO: 163017 - protein, 30 aa, Mycobacterium bovis
LQDLPPVNLLIFVSTVIILFLAGAVVNLKL

SEQ ID NO: 163018 - protein, 19 aa, Mycobacterium bovis
LQELTLQAPLVLPADGVRV

SEQ ID NO: 163019 - protein, 18 aa, Mycobacterium bovis
LQRKLRVGFAKAGRLMDL

SEQ ID NO: 163020 - protein, 26 aa, Mycobacterium bovis
LQRMSPFWQRMFLTIGILIAVFGMRL

SEQ ID NO: 163021 - protein, 25 aa, Mycobacterium bovis
LQRPARWIQMLASNTLAFTAAPNFA

SEQ ID NO: 163022 - protein, 28 aa, Mycobacterium bovis
LQSDIIGALFVLGFLRYGLPPQDNIQLQ

SEQ ID NO: 163023 - protein, 20 aa, Mycobacterium bovis
LQVRPYAGERWWVLLLSLAT

SEQ ID NO: 163024 - protein, 31 aa, Mycobacterium bovis
LRAAEHPVPGDWLYFVTIDSQGTTLFTRDYQ

SEQ ID NO: 163025 - protein, 25 aa, Mycobacterium bovis
LRADLARDPSFYLRFRREAQNAAAL

SEQ ID NO: 163026 - protein, 17 aa, Mycobacterium bovis
LRDWIARKAFYGGSAAP

SEQ ID NO: 163027 - protein, 22 aa, Mycobacterium bovis
LRGRRAIMLPAGALVYIAVPPA

SEQ ID NO: 163028 - protein, 23 aa, Mycobacterium bovis
LRSGSPILFYPAGALAITVLAFM

SEQ ID NO: 163029 - protein, 25 aa, Mycobacterium bovis
LRWRRTMWLHVPAVIWGIGIAAKRV

SEQ ID NO: 163030 - protein, 37 aa, Mycobacterium bovis
LRWSRNRMAFLAALFFLLALCWATTNGWWYVSSYGVP

SEQ ID NO: 163031 - protein, 24 aa, Mycobacterium bovis
LSAAALWLLFANRMGYPVSTTHSI

SEQ ID NO: 163032 - protein, 35 aa, Mycobacterium bovis
LSAAINFFLIAFAVYFLVVLPYNTLRKKGEVEQPG

SEQ ID NO: 163033 - protein, 45 aa, Mycobacterium bovis
LSALLSELPAVAWVWFQLFVDILGFNIIGFIITLASNAQLLTEFA

SEQ ID NO: 163034 - protein, 22 aa, Mycobacterium bovis
LSAVYMLWLYQRVMTGPIAEGN

SEQ ID NO: 163035 - protein, 25 aa, Mycobacterium bovis
LSEGELFIMGRIKDLLIVYGRNHSP

SEQ ID NO: 163036 - protein, 27 aa, Mycobacterium bovis
LSGIVPWWFVLTLLTRDALLAGTLPLL

SEQ ID NO: 163037 - protein, 20 aa, Mycobacterium bovis
LSGLGLTMTGPRPGGFGALD

SEQ ID NO: 163038 - protein, 24 aa, Mycobacterium bovis
LSINRFIAIDFVGFARMVEALGGV

SEQ ID NO: 163039 - protein, 23 aa, Mycobacterium bovis
LSLGLFGSFLLLPSYLQQVLHQS

SEQ ID NO: 163040 - protein, 27 aa, Mycobacterium bovis
LSMLGDLPWWVTVLILTRELGVTVLRL

SEQ ID NO: 163041 - protein, 19 aa, Mycobacterium bovis
LSMMPEPVVERYRLGEQTI

SEQ ID NO: 163042 - protein, 24 aa, Mycobacterium bovis
LSMTLPILIPFVYFSHALNKVWRR

SEQ ID NO: 163043 - protein, 26 aa, Mycobacterium bovis
LSMVFGELVPKYLAVARPLRTARSVV

SEQ ID NO: 163044 - protein, 44 aa, Mycobacterium bovis
LSNDQFMITVLILWAPLLIFGFILMWILAWLTATPVRVVREALN

SEQ ID NO: 163045 - protein, 28 aa, Mycobacterium bovis
LSPWPTITAVLWWIIGLAGLWLGLLGIA

SEQ ID NO: 163046 - protein, 29 aa, Mycobacterium bovis
LSQLQLWTTPLWLILMAAPFGYLVVSHPD

SEQ ID NO: 163047 - protein, 21 aa, Mycobacterium bovis
LSRFVWATAIIWILGGLGTWL

SEQ ID NO: 163048 - protein, 28 aa, Mycobacterium bovis
LSRVANLELYLIFPLASEQATITLVRGT

SEQ ID NO: 163049 - protein, 35 aa, Mycobacterium bovis
LSSIIFVLPALLMIGWWSGFPYWTTAAVCALGGIL

SEQ ID NO: 163050 - protein, 26 aa, Mycobacterium bovis
LSTRDTWLLSLLYLGTFGSFIGFSFV

SEQ ID NO: 163051 - protein, 18 aa, Mycobacterium bovis
LSTTAYLIAKVCVYTVLA

SEQ ID NO: 163052 - protein, 25 aa, Mycobacterium bovis
LSTVVLVIWLLLGVAAVRLFGFTPG

SEQ ID NO: 163053 - protein, 18 aa, Mycobacterium bovis
LSVRQLMVRPVSAAALSR

SEQ ID NO: 163054 - protein, 28 aa, Mycobacterium bovis
LSWMLNAYNIVFAAFLVAAGRLADLMGR

SEQ ID NO: 163055 - protein, 30 aa, Mycobacterium bovis
LTAFVYSTYQLFAGGPLFFDTSALIIAFVV

SEQ ID NO: 163056 - protein, 23 aa, Mycobacterium bovis
LTALIQLYIVGVFISFTMSQVGM

SEQ ID NO: 163057 - protein, 29 aa, Mycobacterium bovis
LTATFALGAALPLLFFALAGQRIAERVGA

SEQ ID NO: 163058 - protein, 26 aa, Mycobacterium bovis
LTERPHPYPRWLATAGAAGFALGVAM

SEQ ID NO: 163059 - protein, 29 aa, Mycobacterium bovis
LTEVSWRWAFLVNVPIGLVMIYLARTALR

SEQ ID NO: 163060 - protein, 38 aa, Mycobacterium bovis
LTGKALFRWPFQWREFILQCWFIMRVGFLPTIMVSIPL

SEQ ID NO: 163061 - protein, 17 aa, Mycobacterium bovis
LTGRRGWIAPRRDLTRR

SEQ ID NO: 163062 - protein, 25 aa, Mycobacterium bovis
LTIPTIALASLWLSGPLQLGLGAIQ

SEQ ID NO: 163063 - protein, 25 aa, Mycobacterium bovis
LTLGLSLAVILALGFVLTSQVTNRV

SEQ ID NO: 163064 - protein, 21 aa, Mycobacterium bovis
LTLLAVITLAVIFAIAALLLR

SEQ ID NO: 163065 - protein, 38 aa, Mycobacterium bovis
LTLLLGVAVMTWLSVPLALLAVLLVPVIGLIAHRSRRL

SEQ ID NO: 163066 - protein, 17 aa, Mycobacterium bovis
LTLYPHCAPKIGVPSQN

SEQ ID NO: 163067 - protein, 17 aa, Mycobacterium bovis
LTQRFIIAWRVWLTHHL

SEQ ID NO: 163068 - protein, 19 aa, Mycobacterium bovis
LTSPVLLPAGLTGLAGLGA

SEQ ID NO: 163069 - protein, 23 aa, Mycobacterium bovis
LTSTGSVLATLAYAAPEVLAGQG

SEQ ID NO: 163070 - protein, 29 aa, Mycobacterium bovis
LTTAFGFLVLVLLLSLLNATLFQGAPQQS

SEQ ID NO: 163071 - protein, 19 aa, Mycobacterium bovis
LTVEVLFLGLAVALRLAGS

SEQ ID NO: 163072 - protein, 21 aa, Mycobacterium bovis
LTVIIIVLLITTAASFWSARG

SEQ ID NO: 163073 - protein, 17 aa, Mycobacterium bovis
LTYVRRYYGGRIAHLVQ

SEQ ID NO: 163074 - protein, 18 aa, Mycobacterium bovis
LVAAVLPPLLKKLRIDPA

SEQ ID NO: 163075 - protein, 26 aa, Mycobacterium bovis
LVADGHPWRWFLIGFMVLFHLNILSN

SEQ ID NO: 163076 - protein, 24 aa, Mycobacterium bovis
LVAGFLMVNLLTPGDLRRLVFIDR

SEQ ID NO: 163077 - protein, 28 aa, Mycobacterium bovis
LVALIALFPPYIMWAPNAIWKAFDLFVG

SEQ ID NO: 163078 - protein, 28 aa, Mycobacterium bovis
LVASGVFVLIMMIALPRVPIGWDEAAAT

SEQ ID NO: 163079 - protein, 25 aa, Mycobacterium bovis
LVAYRRSRGLAGLSVAWGLWEQASA

SEQ ID NO: 163080 - protein, 25 aa, Mycobacterium bovis
LVDSGAGTWLLWDGKRSPIDLADHA

SEQ ID NO: 163081 - protein, 26 aa, Mycobacterium bovis
LVDSHAWLVVLTALGSLAALATLISI

SEQ ID NO: 163082 - protein, 18 aa, Mycobacterium bovis
LVELIPKAALAGLLIVIG

SEQ ID NO: 163083 - protein, 38 aa, Mycobacterium bovis
LVFGGLPALAFPAPSWWWLAWFGLVPLLLVVRAAPTSW

SEQ ID NO: 163084 - protein, 19 aa, Mycobacterium bovis
LVFTDRVELLKLAVLLALW

SEQ ID NO: 163085 - protein, 24 aa, Mycobacterium bovis
LVGATGVFLACRWAQADGADHAWL

SEQ ID NO: 163086 - protein, 28 aa, Mycobacterium bovis
LVGGIVWNLLTWLLGIPSSSSHALIGGI

SEQ ID NO: 163087 - protein, 23 aa, Mycobacterium bovis
LVGGVWLAFIGWFIFAAAREEET

SEQ ID NO: 163088 - protein, 49 aa, Mycobacterium bovis
LVGIECLIAIPLRRDPLLFPFQPIHVTIAAWFTIGIPAFILSLAPNNER

SEQ ID NO: 163089 - protein, 23 aa, Mycobacterium bovis
LVGQWLAALLFAGALLAERVSLR

SEQ ID NO: 163090 - protein, 18 aa, Mycobacterium bovis
LVHAFSAPIGYLFRPYII

SEQ ID NO: 163091 - protein, 19 aa, Mycobacterium bovis
LVIMDLRDHWMAKAPYILG

SEQ ID NO: 163092 - protein, 18 aa, Mycobacterium bovis
LVIVTSLSMVFGELVPKY

SEQ ID NO: 163093 - protein, 17 aa, Mycobacterium bovis
LVKRGWMVLVAVAVVAV

SEQ ID NO: 163094 - protein, 17 aa, Mycobacterium bovis
LVLLFSPPSIRWAAGRD

SEQ ID NO: 163095 - protein, 24 aa, Mycobacterium bovis
LVLSFGMVTLLGSALLSVLHLPQD

SEQ ID NO: 163096 - protein, 24 aa, Mycobacterium bovis
LVPSPTCIIVGLPAGLRLAVDNAI

SEQ ID NO: 163097 - protein, 24 aa, Mycobacterium bovis
LVPTLLVSIPFTVLVAFTLNILLR

SEQ ID NO: 163098 - protein, 17 aa, Mycobacterium bovis
LVQLLGRINAELAVYTG

SEQ ID NO: 163099 - protein, 26 aa, Mycobacterium bovis
LVQPPLILFCAVPGAYWLFHGGTIGK

SEQ ID NO: 163100 - protein, 19 aa, Mycobacterium bovis
LVQTLLVLTWIVLNLFAVG

SEQ ID NO: 163101 - protein, 21 aa, Mycobacterium bovis
LVRHVYNMALVFRHRVRKDRL

SEQ ID NO: 163102 - protein, 21 aa, Mycobacterium bovis
LVRWTAHWPRRRALVVSLVCL

SEQ ID NO: 163103 - protein, 22 aa, Mycobacterium bovis
LVSAWYLLPKPDDGHPLVVVTA

SEQ ID NO: 163104 - protein, 18 aa, Mycobacterium bovis
LVSTRILGGLVVIMPLYA

SEQ ID NO: 163105 - protein, 24 aa, Mycobacterium bovis
LVSVLVSWVLFTWMIGRLPREPVG

SEQ ID NO: 163106 - protein, 26 aa, Mycobacterium bovis
LVTGWWIGVLAYFLPRRSWLRAAAED

SEQ ID NO: 163107 - protein, 17 aa, Mycobacterium bovis
LVVAAGALWMAARLPWV

SEQ ID NO: 163108 - protein, 23 aa, Mycobacterium bovis
LVVAVLLNYPFSRYDSMALAAFD

SEQ ID NO: 163109 - protein, 19 aa, Mycobacterium bovis
LVVELFGLLLSPISWTHHW

SEQ ID NO: 163110 - protein, 24 aa, Mycobacterium bovis
LVVMLPLIWGMNQLGWHAAAQVPL

SEQ ID NO: 163111 - protein, 17 aa, Mycobacterium bovis
LVVRMWALQRSAMYRDM

SEQ ID NO: 163112 - protein, 39 aa, Mycobacterium bovis
LVVSIVAGLLLYASFPPRNCWWAAVVALALLAWVLTHRA

SEQ ID NO: 163113 - protein, 22 aa, Mycobacterium bovis
LVVVFGDFRFGPTTVYHATFTD

SEQ ID NO: 163114 - protein, 19 aa, Mycobacterium bovis
LVYGVCGVFVFLILRALGE

SEQ ID NO: 163115 - protein, 29 aa, Mycobacterium bovis
LVYIGIYFGLIIFFTYFYVSITFNPDERA

SEQ ID NO: 163116 - protein, 17 aa, Mycobacterium bovis
LVYLTITSSLTIQSGPR

SEQ ID NO: 163117 - protein, 26 aa, Mycobacterium bovis
LWGETLQRALLRAMTFMIVASPCAVV

SEQ ID NO: 163118 - protein, 29 aa, Mycobacterium bovis
LWISLVVLWLFVLVPMLISKRDAVRRTSD

SEQ ID NO: 163119 - protein, 19 aa, Mycobacterium bovis
LWSGRVFAEARWLSVALLS

SEQ ID NO: 163120 - protein, 25 aa, Mycobacterium bovis
LWSVIPRLFVWPPARSIAQVLERLS

SEQ ID NO: 163121 - protein, 25 aa, Mycobacterium bovis
LWTSITVWLIALAVVVWLILSTGNR

SEQ ID NO: 163122 - protein, 19 aa, Mycobacterium bovis
LWVGFTAVSALLILGLAQT

SEQ ID NO: 163123 - protein, 18 aa, Mycobacterium bovis
LWYAVMTQLGFIAILVGL

SEQ ID NO: 163124 - protein, 23 aa, Mycobacterium bovis
LYDNYAWWFRVSGLAVLAILVWW

SEQ ID NO: 163125 - protein, 31 aa, Mycobacterium bovis
LYLRRDRVSLPLWVLLLSVPLATVYIASVET

SEQ ID NO: 163126 - protein, 18 aa, Mycobacterium bovis
LYVDMRLINGVDLAAMLR

SEQ ID NO: 163127 - protein, 26 aa, Mycobacterium bovis
MAAALLVLSAILVGGLWPLLMEQFSV

SEQ ID NO: 163128 - protein, 29 aa, Mycobacterium bovis
MADLANLFPFQLFLVLYGLPLEDRDRLIG

SEQ ID NO: 163129 - protein, 40 aa, Mycobacterium bovis
MAEAPLYYQIHVLIGLALFALWPFTRLVHAFSAPIGYLFR

SEQ ID NO: 163130 - protein, 19 aa, Mycobacterium bovis
MAIAVAVALVLWWRMIRFE

SEQ ID NO: 163131 - protein, 32 aa, Mycobacterium bovis
MAIHFLVVGYLFYWAIIGIDPGPRRLPYPGRI

SEQ ID NO: 163132 - protein, 19 aa, Mycobacterium bovis
MALRRMKVVAVGFLVGATG

SEQ ID NO: 163133 - protein, 17 aa, Mycobacterium bovis
MASLPLPAISSLNSRML

SEQ ID NO: 163134 - protein, 18 aa, Mycobacterium bovis
MATYLSRDWARDWGSLRK

SEQ ID NO: 163135 - protein, 23 aa, Mycobacterium bovis
MDANYRWFHPAPNTLAAAVGSPR

SEQ ID NO: 163136 - protein, 28 aa, Mycobacterium bovis
MDLATRPATFLWLIAATGTLLVATHRMD

SEQ ID NO: 163137 - protein, 25 aa, Mycobacterium bovis
MFALTWAIALLVWHYGRVEERWTPA

SEQ ID NO: 163138 - protein, 19 aa, Mycobacterium bovis
MFDDPLQFYSRSIALGIVV

SEQ ID NO: 163139 - protein, 21 aa, Mycobacterium bovis
MFLLMLFLDFVVHDRDIKWLK

SEQ ID NO: 163140 - protein, 25 aa, Mycobacterium bovis
MGEGEAMLFGEYIRLMALVEYSADE

SEQ ID NO: 163141 - protein, 21 aa, Mycobacterium bovis
MGIKSISFLVSTRILGGLVVI

SEQ ID NO: 163142 - protein, 25 aa, Mycobacterium bovis
MIGSFPILSVFGFVVMFGGVVYAIT

SEQ ID NO: 163143 - protein, 19 aa, Mycobacterium bovis
MILVLAVLFRLFVGARLID

SEQ ID NO: 163144 - protein, 23 aa, Mycobacterium bovis
MISLTYFPPLWRKVMDHRVLEHY

SEQ ID NO: 163145 - protein, 20 aa, Mycobacterium bovis
MLLYLFIPGWAVDSDFARLG

SEQ ID NO: 163146 - protein, 27 aa, Mycobacterium bovis
MLNRRRPLLHLLTFLCGGYTMAGGVAM

SEQ ID NO: 163147 - protein, 33 aa, Mycobacterium bovis
MLRAIGWPETIFRFALYAFLCATALMVVRIEER

SEQ ID NO: 163148 - protein, 23 aa, Mycobacterium bovis
MLRPFAPRRLVRALLLPSGQHPS

SEQ ID NO: 163149 - protein, 28 aa, Mycobacterium bovis
MLSGLISLVLLLLFAIGGVVWGVMDGRA

SEQ ID NO: 163150 - protein, 27 aa, Mycobacterium bovis
MLTRAIKTQLVLLTVLAVIAVVVLGWY

SEQ ID NO: 163151 - protein, 26 aa, Mycobacterium bovis
MLVGTPAMWWLAVPVLAYAGWRMFVR

SEQ ID NO: 163152 - protein, 29 aa, Mycobacterium bovis
MNKMEALTPQFLALLPPMITTMKTMRTMM

SEQ ID NO: 163153 - protein, 18 aa, Mycobacterium bovis
MPATAAFPPPAGPPPVTA

SEQ ID NO: 163154 - protein, 22 aa, Mycobacterium bovis
MPDIEPIYKVTILARGRTGGHA

SEQ ID NO: 163155 - protein, 19 aa, Mycobacterium bovis
MPDLRGALLLAVTLGLVTL

SEQ ID NO: 163156 - protein, 26 aa, Mycobacterium bovis
MQLALTELWCSYGVQPDLVIGHSMGE

SEQ ID NO: 163157 - protein, 26 aa, Mycobacterium bovis
MQQVYDRYIAPHYLGYAFSGLYTPAQ

SEQ ID NO: 163158 - protein, 31 aa, Mycobacterium bovis
MQVGSLIAFLSYFAQILMAVLMATMTLAVLP

SEQ ID NO: 163159 - protein, 22 aa, Mycobacterium bovis
MRGVTLISMPQFDATKVWSLIV

SEQ ID NO: 163160 - protein, 23 aa, Mycobacterium bovis
MRLKMITTPTDWPRYGGYALGGV

SEQ ID NO: 163161 - protein, 19 aa, Mycobacterium bovis
MRRHLPLPRHPTPGYLAVG

SEQ ID NO: 163162 - protein, 17 aa, Mycobacterium bovis
MRRLIPASWRTFTLTDA

SEQ ID NO: 163163 - protein, 29 aa, Mycobacterium bovis
MRSHNSSPPPPRWAWPPLIAVGAVGMVGM

SEQ ID NO: 163164 - protein, 26 aa, Mycobacterium bovis
MSATALFPMYFLKSFAYAGVATVAFV

SEQ ID NO: 163165 - protein, 26 aa, Mycobacterium bovis
MSLNTSYYRLMLKLNGGPQAVADAAH

SEQ ID NO: 163166 - protein, 35 aa, Mycobacterium bovis
MSRRFAVLVLLFCLFGVLFVLLRRGRVAGLASGPA

SEQ ID NO: 163167 - protein, 24 aa, Mycobacterium bovis
MSVRFMRRIAFSGFAITIVMLVLV

SEQ ID NO: 163168 - protein, 20 aa, Mycobacterium bovis
MTDAYLAPLKLRTTTLTLIY

SEQ ID NO: 163169 - protein, 32 aa, Mycobacterium bovis
MTLSGFAHSWFFLFLFVVAGLVALYILMQLAR

SEQ ID NO: 163170 - protein, 27 aa, Mycobacterium bovis
MTTWYAAMLFAVIPLRNALPDAPPIGF

SEQ ID NO: 163171 - protein, 26 aa, Mycobacterium bovis
MVFASGLLAMFPIAALGALVVYAALR

SEQ ID NO: 163172 - protein, 32 aa, Mycobacterium bovis
MVGALADWFAVTALFKHPLGIPIPHTAIIKRK

SEQ ID NO: 163173 - protein, 25 aa, Mycobacterium bovis
MVIAAMLLVIYRSVITAVLVLIMVG

SEQ ID NO: 163174 - protein, 28 aa, Mycobacterium bovis
MVLTILAAGLLLGPPAGAQPPFRLSNYV

SEQ ID NO: 163175 - protein, 26 aa, Mycobacterium bovis
MVSIPLTVLLIFTLNILLAQFGAADI

SEQ ID NO: 163176 - protein, 25 aa, Mycobacterium bovis
MVVVLMSFAVYAVISAALYSDIDNQ

SEQ ID NO: 163177 - protein, 18 aa, Mycobacterium bovis
MWLGVHLVPISIGGRALG

SEQ ID NO: 163178 - protein, 26 aa, Mycobacterium bovis
NAERWNLPIILMVLVAVFGSLAAAAI

SEQ ID NO: 163179 - protein, 17 aa, Mycobacterium bovis
NAGVTALVLLFVGGALY

SEQ ID NO: 163180 - protein, 21 aa, Mycobacterium bovis
NAIFGLFGAFALIGAAIVLFL

SEQ ID NO: 163181 - protein, 19 aa, Mycobacterium bovis
NALLGIYYSHSLYYGLTPE

SEQ ID NO: 163182 - protein, 26 aa, Mycobacterium bovis
NANPFALLLVALLGPIAATVIRMAVS

SEQ ID NO: 163183 - protein, 23 aa, Mycobacterium bovis
NANRWWTWTLLAGPGWVAFGATK

SEQ ID NO: 163184 - protein, 28 aa, Mycobacterium bovis
NAPGVILRLMLAWIPSTGVPLLAIVLAV

SEQ ID NO: 163185 - protein, 26 aa, Mycobacterium bovis
NAVDFTWITDFKPYQPQLGVPTAWLV

SEQ ID NO: 163186 - protein, 29 aa, Mycobacterium bovis
NCTIKVMVGFLFLYPAFVAKAHEANGWVQ

SEQ ID NO: 163187 - protein, 28 aa, Mycobacterium bovis
NDNGPPPPFTSWMPPGYPPEPPQVPYPA

SEQ ID NO: 163188 - protein, 19 aa, Mycobacterium bovis
NDRLLLSMMPEPVVERYRL

SEQ ID NO: 163189 - protein, 18 aa, Mycobacterium bovis
NDYTVGLLLLVATALVAC

SEQ ID NO: 163190 - protein, 26 aa, Mycobacterium bovis
NEAWRSDQFVLDPTRLTLFIGATGMN

SEQ ID NO: 163191 - protein, 23 aa, Mycobacterium bovis
NEGRGDFFAVVRSLALFVNALHQ

SEQ ID NO: 163192 - protein, 22 aa, Mycobacterium bovis
NFEKFAWLFMRFSGVVLVFLAI

SEQ ID NO: 163193 - protein, 29 aa, Mycobacterium bovis
NFNRPYALWVPLVLSVPLGLLLMTARRRP

SEQ ID NO: 163194 - protein, 25 aa, Mycobacterium bovis
NFNSAFYLFGLVLLVMAGNLARPTG

SEQ ID NO: 163195 - protein, 21 aa, Mycobacterium bovis
NFSRRFVPTSFIVSAIALLIT

SEQ ID NO: 163196 - protein, 30 aa, Mycobacterium bovis
NFVVRWPLIVIGCWIAVAAALTLLLPTLQA

SEQ ID NO: 163197 - protein, 25 aa, Mycobacterium bovis
NGERLPLAMVFLLAIAGAFVVSKTV

SEQ ID NO: 163198 - protein, 22 aa, Mycobacterium bovis
NGFHGKWPWQMTHPMDGAVQID

SEQ ID NO: 163199 - protein, 30 aa, Mycobacterium bovis
NGINRILQFITYLLVPAGLLTIYTQLFTTH

SEQ ID NO: 163200 - protein, 27 aa, Mycobacterium bovis
NGLSAFYYALLLLLAGFTGSIVVSTLV

SEQ ID NO: 163201 - protein, 19 aa, Mycobacterium bovis
NGMFLVVLGLLWPHIDLPE

SEQ ID NO: 163202 - protein, 20 aa, Mycobacterium bovis
NGTHSWPYWNEQLVAMKADI

SEQ ID NO: 163203 - protein, 24 aa, Mycobacterium bovis
NGYEFRLLQIKFATLNITGDCFLL

SEQ ID NO: 163204 - protein, 33 aa, Mycobacterium bovis
NIEPALHFYVAFFLALLVVTWYCYLRRTTPMGQ

SEQ ID NO: 163205 - protein, 22 aa, Mycobacterium bovis
NKDAWMVGYTPSLSTAVWVGTV

SEQ ID NO: 163206 - protein, 38 aa, Mycobacterium bovis
NKDDLLVMELIAIPLSFLVLIWVFGGLLAAGLPMAQAV

SEQ ID NO: 163207 - protein, 25 aa, Mycobacterium bovis
NLAPAAWWRQLSWLPQRPVLVPGTV

SEQ ID NO: 163208 - protein, 20 aa, Mycobacterium bovis
NLIAVLHDGVVIGSAVFSED

SEQ ID NO: 163209 - protein, 17 aa, Mycobacterium bovis
NLWVGYFPTVQTAWNQL

SEQ ID NO: 163210 - protein, 24 aa, Mycobacterium bovis
NNEPWYTALWHTIADDPHLPPAAP

SEQ ID NO: 163211 - protein, 24 aa, Mycobacterium bovis
NPFSLLFTLGGFVTLLLLAQAVAS

SEQ ID NO: 163212 - protein, 24 aa, Mycobacterium bovis
NPHTTWVLYAVIVVSALVIVGAIP

SEQ ID NO: 163213 - protein, 30 aa, Mycobacterium bovis
NPSAPRPWALPAQFWLYCGFTAITMLGFGT

SEQ ID NO: 163214 - protein, 26 aa, Mycobacterium bovis
NRPDILDPALLRPGRFDRQIPVSNPD

SEQ ID NO: 163215 - protein, 65 aa, Mycobacterium bovis
NRRERRTWLPRVWLALPLGLLALGSSMFFGAYPWAGWLAFAATLPVQFVAGWPILRGAVQQARAL

SEQ ID NO: 163216 - protein, 24 aa, Mycobacterium bovis
NSANIMFLVLLLAGFGWMISSRMV

SEQ ID NO: 163217 - protein, 37 aa, Mycobacterium bovis
NSGRRPMVLAARSLAALFAALALALTGGAWQWSASKN

SEQ ID NO: 163218 - protein, 29 aa, Mycobacterium bovis
NSISIVAVLLWIVAVLIVGSVVYLSALER

SEQ ID NO: 163219 - protein, 20 aa, Mycobacterium bovis
NSYWLVGVQLLDGIGAGIFG

SEQ ID NO: 163220 - protein, 25 aa, Mycobacterium bovis
NTADAQVVPLLWAASSGVPAVLGYR

SEQ ID NO: 163221 - protein, 24 aa, Mycobacterium bovis
NTSTAWTYLLYVGGWVGGPMRLEY

SEQ ID NO: 163222 - protein, 29 aa, Mycobacterium bovis
NVDATMLQMLIIFGIVTVIALVAATTAGI

SEQ ID NO: 163223 - protein, 24 aa, Mycobacterium bovis
NVDNWVQRLFALPVLPAGYADRVV

SEQ ID NO: 163224 - protein, 25 aa, Mycobacterium bovis
NVFTMMMRLPWLYRVPVHTIHKFGH

SEQ ID NO: 163225 - protein, 35 aa, Mycobacterium bovis
NVGLSLSIITVLMPLALFGILGLAAVVLVHEFTEV

SEQ ID NO: 163226 - protein, 20 aa, Mycobacterium bovis
NVGTLFAFILVSAGVVVLRR

SEQ ID NO: 163227 - protein, 19 aa, Mycobacterium bovis
NVTTLGLPFYGATPDNPYP

SEQ ID NO: 163228 - protein, 24 aa, Mycobacterium bovis
NVVNPGIFALISRATCVDLDGTQR

SEQ ID NO: 163229 - protein, 28 aa, Mycobacterium bovis
NWGLMKPIVLAWVITLPSAAILASVGLV

SEQ ID NO: 163230 - protein, 25 aa, Mycobacterium bovis
PAAGFFVGWSYWFAWVVTGIADLVA

SEQ ID NO: 163231 - protein, 28 aa, Mycobacterium bovis
PAAIGPLPPVTLLPRRTPGSSGIADVPA

SEQ ID NO: 163232 - protein, 17 aa, Mycobacterium bovis
PAALSLSLYVSSDYGGG

SEQ ID NO: 163233 - protein, 25 aa, Mycobacterium bovis
PAEFSKILLLIFFSAVLVAKRGLFT

SEQ ID NO: 163234 - protein, 25 aa, Mycobacterium bovis
PAFYSVMTVLFLALFVLNVCTHGST

SEQ ID NO: 163235 - protein, 24 aa, Mycobacterium bovis
PAGPLPYIVMEYVDGVTLRDIVHT

SEQ ID NO: 163236 - protein, 25 aa, Mycobacterium bovis
PAGVEELLRINLSFADGLPRLATAD

SEQ ID NO: 163237 - protein, 37 aa, Mycobacterium bovis
PAIVISVAWWLATVNLLLGLFNLLPGAPLDGGRLVRA

SEQ ID NO: 163238 - protein, 20 aa, Mycobacterium bovis
PAKGFITDRLPRLCRKYLLT

SEQ ID NO: 163239 - protein, 44 aa, Mycobacterium bovis
PAKLVLVAIAVLCAVSFFTAIFLRDLRIPAMAAALLVLSAILVG

SEQ ID NO: 163240 - protein, 21 aa, Mycobacterium bovis
PALDAVYLPPGRSAYVAARSL

SEQ ID NO: 163241 - protein, 25 aa, Mycobacterium bovis
PALDLDALIGGFKPVFRALDPAKVN

SEQ ID NO: 163242 - protein, 21 aa, Mycobacterium bovis
PALDLDALLGGLRPVLKGFDA

SEQ ID NO: 163243 - protein, 22 aa, Mycobacterium bovis
PALPILAAAPTPPLGPAWVALL

SEQ ID NO: 163244 - protein, 18 aa, Mycobacterium bovis
PALWAVMVSLAELWRSVG

SEQ ID NO: 163245 - protein, 25 aa, Mycobacterium bovis
PAPALLLTAPLLLTSIPLLYAGRSV

SEQ ID NO: 163246 - protein, 24 aa, Mycobacterium bovis
PAPPVEVPPPMPPPPPVTITQTVA

SEQ ID NO: 163247 - protein, 22 aa, Mycobacterium bovis
PAPTHRPLLVIPSRNLRDHDEL

SEQ ID NO: 163248 - protein, 26 aa, Mycobacterium bovis
PARGRLVTMLLVGVVLLAVGHRGGLA

SEQ ID NO: 163249 - protein, 20 aa, Mycobacterium bovis
PASFRRWLNPVNAAAATALV

SEQ ID NO: 163250 - protein, 22 aa, Mycobacterium bovis
PASVPVWLVWHIPGGTVWAEEA

SEQ ID NO: 163251 - protein, 18 aa, Mycobacterium bovis
PATILGCWVALAATAGLL

SEQ ID NO: 163252 - protein, 24 aa, Mycobacterium bovis
PAVARRNMLRAWESRLLMVARRFD

SEQ ID NO: 163253 - protein, 18 aa, Mycobacterium bovis
PCLPWFISSNWNLAFGVL

SEQ ID NO: 163254 - protein, 25 aa, Mycobacterium bovis
PDAPPIGFWIDVTVVLWVVVALVTS

SEQ ID NO: 163255 - protein, 25 aa, Mycobacterium bovis
PDELPATGARLRWAPAQGPSATPAQ

SEQ ID NO: 163256 - protein, 19 aa, Mycobacterium bovis
PDFPLPFTYPPFAAVVFYP

SEQ ID NO: 163257 - protein, 23 aa, Mycobacterium bovis
PDFQRGLKLFLSPDGTCARFVIT

SEQ ID NO: 163258 - protein, 34 aa, Mycobacterium bovis
PDGAHARRLLRRLLVAAVLFVPLADLSTLFAIVP

SEQ ID NO: 163259 - protein, 17 aa, Mycobacterium bovis
PDGARLWLPTYLAWFVG

SEQ ID NO: 163260 - protein, 24 aa, Mycobacterium bovis
PDIDPEILPHLFDRFVRASKSRSN

SEQ ID NO: 163261 - protein, 24 aa, Mycobacterium bovis
PDIPGLPDFKWPPTPGSPLFPDLP

SEQ ID NO: 163262 - protein, 26 aa, Mycobacterium bovis
PDLAAGLVCWLLLSREVLPRLGPAVA

SEQ ID NO: 163263 - protein, 53 aa, Mycobacterium bovis
PDLQRGFTAPWVPLLPIAAVCACLWLMLNLTALTWIRFGIWLVAGTAIYVGYG

SEQ ID NO: 163264 - protein, 19 aa, Mycobacterium bovis
PDPARWPWPTFTVNVVGAF

SEQ ID NO: 163265 - protein, 40 aa, Mycobacterium bovis
PDPTKLILQLLKDFLELLRYLAVELLPGPLGDLIAQVLDW

SEQ ID NO: 163266 - protein, 17 aa, Mycobacterium bovis
PDPVVMLCSARADVLAA

SEQ ID NO: 163267 - protein, 17 aa, Mycobacterium bovis
PDQPLLTGWLVRRTLLV

SEQ ID NO: 163268 - protein, 31 aa, Mycobacterium bovis
PDRRRFFGYLNLFLASMLLLVVADNYVLLYV

SEQ ID NO: 163269 - protein, 23 aa, Mycobacterium bovis
PDSLIRMCLFLGALTFMYISARA

SEQ ID NO: 163270 - protein, 34 aa, Mycobacterium bovis
PDTNTTYILLPNEDLPLLQPLRGIVPEPLLDLIE

SEQ ID NO: 163271 - protein, 27 aa, Mycobacterium bovis
PDVAFPRLNAFSFWLFVFGATIGAAGF

SEQ ID NO: 163272 - protein, 25 aa, Mycobacterium bovis
PDVRGAVLLAFALGLLTLGLIKGPD

SEQ ID NO: 163273 - protein, 24 aa, Mycobacterium bovis
PEALFNPILMMALAALGIGSVSTL

SEQ ID NO: 163274 - protein, 22 aa, Mycobacterium bovis
PEAPPLTAPIIPDAGNPASFGV

SEQ ID NO: 163275 - protein, 42 aa, Mycobacterium bovis
PEFGYDIGFFVFDLPFYRSVLNWLFVAVVLAFLASLLTHYLF

SEQ ID NO: 163276 - protein, 20 aa, Mycobacterium bovis
PEGRLERLRGRLARSQNALG

SEQ ID NO: 163277 - protein, 24 aa, Mycobacterium bovis
PEHGHAPVFVLFGSAIYLAGLVVH

SEQ ID NO: 163278 - protein, 21 aa, Mycobacterium bovis
PELFCTIRNFYDADPLAKAAA

SEQ ID NO: 163279 - protein, 38 aa, Mycobacterium bovis
PELPRVIPPSLLRRALPYLIGILIVGMIVALVATGMRV

SEQ ID NO: 163280 - protein, 17 aa, Mycobacterium bovis
PEPLLDLIEPDLRAIIE

SEQ ID NO: 163281 - protein, 31 aa, Mycobacterium bovis
PERTAMLLVPPYLVYVRLARPFIAFYNNCAN

SEQ ID NO: 163282 - protein, 23 aa, Mycobacterium bovis
PESLANLLRYGYYPALILGLTVG

SEQ ID NO: 163283 - protein, 33 aa, Mycobacterium bovis
PETTAPVWITMLWPLADRPRLAPGAPGGTVPVR

SEQ ID NO: 163284 - protein, 34 aa, Mycobacterium bovis
PFFAILRCLGVTREQLFWLIMTESLVAGLIGTGL

SEQ ID NO: 163285 - protein, 25 aa, Mycobacterium bovis
PFGEYVPLRPLFGWITRYSKAAAKD

SEQ ID NO: 163286 - protein, 18 aa, Mycobacterium bovis
PFGLFPDVPASVVADALV

SEQ ID NO: 163287 - protein, 33 aa, Mycobacterium bovis
PFIARMIHAFAVPIILGWLAVCVVVTVFVPSLE

SEQ ID NO: 163288 - protein, 22 aa, Mycobacterium bovis
PFLLIMGGFMYFASRRQRRAMQ

SEQ ID NO: 163289 - protein, 25 aa, Mycobacterium bovis
PFLSYGIQWISFGILAPIGLGYFAY

SEQ ID NO: 163290 - protein, 19 aa, Mycobacterium bovis
PFWGTSFSAAYVSGVAALV

SEQ ID NO: 163291 - protein, 33 aa, Mycobacterium bovis
PGAAQLPLAPAINYPPPCLTGFLPASEWRSPAD

SEQ ID NO: 163292 - protein, 18 aa, Mycobacterium bovis
PGAPGPMPAPPLGAVPSP

SEQ ID NO: 163293 - protein, 24 aa, Mycobacterium bovis
PGEEKLVFSRFWRSDPSRVRRSGG

SEQ ID NO: 163294 - protein, 19 aa, Mycobacterium bovis
PGIGTLAAWFAAAGEVVVF

SEQ ID NO: 163295 - protein, 24 aa, Mycobacterium bovis
PGMAAPPVRLLPTNLAPHAVGELY

SEQ ID NO: 163296 - protein, 35 aa, Mycobacterium bovis
PGMAGLRRWLGPLSILLVLWGLRASIQWLQARLAQ

SEQ ID NO: 163297 - protein, 22 aa, Mycobacterium bovis
PGMPLPILVAVSGAALSGVCLT

SEQ ID NO: 163298 - protein, 20 aa, Mycobacterium bovis
PGNPLPVVPLAFDPPEHTRY

SEQ ID NO: 163299 - protein, 22 aa, Mycobacterium bovis
PGQSWVLVFAITMMAGLLVSLL

SEQ ID NO: 163300 - protein, 40 aa, Mycobacterium bovis
PGSAWRWLCACLLGLTILLLAVNRLLLPTITGWSLGRALT

SEQ ID NO: 163301 - protein, 23 aa, Mycobacterium bovis
PGSPLFPDLPSFPGFPGFPSLPG

SEQ ID NO: 163302 - protein, 21 aa, Mycobacterium bovis
PGTVWWRVTLPLLLPGVVSGS

SEQ ID NO: 163303 - protein, 17 aa, Mycobacterium bovis
PGYGPPPGPPPPGYPTH

SEQ ID NO: 163304 - protein, 21 aa, Mycobacterium bovis
PGYTEFAVRLPLDGWQPLESS

SEQ ID NO: 163305 - protein, 19 aa, Mycobacterium bovis
PGYVLLALALGSYALTRQT

SEQ ID NO: 163306 - protein, 24 aa, Mycobacterium bovis
PHEVSFYCLDYGGGQLRALQDLAH

SEQ ID NO: 163307 - protein, 18 aa, Mycobacterium bovis
PHVFLNAIFGLFGAFALI

SEQ ID NO: 163308 - protein, 22 aa, Mycobacterium bovis
PIGLNLPFTYPPLAAVLFSPFA

SEQ ID NO: 163309 - protein, 27 aa, Mycobacterium bovis
PIGRAWLRLFGVLPFDYDRLSIAELEP

SEQ ID NO: 163310 - protein, 20 aa, Mycobacterium bovis
PIIVFVLIFQRRIVAGLTSG

SEQ ID NO: 163311 - protein, 17 aa, Mycobacterium bovis
PILAVACAIAVVGLLAL

SEQ ID NO: 163312 - protein, 34 aa, Mycobacterium bovis
PILGGWLIGAYGWRWIFLVNLPVGLSALVLAAIV

SEQ ID NO: 163313 - protein, 17 aa, Mycobacterium bovis
PILLITLINGIAEEMFF

SEQ ID NO: 163314 - protein, 20 aa, Mycobacterium bovis
PIRGFGIHPAVLDAALHAWG

SEQ ID NO: 163315 - protein, 23 aa, Mycobacterium bovis
PIRRASVTVMEWGLRGTRRAEAA

SEQ ID NO: 163316 - protein, 31 aa, Mycobacterium bovis
PKLLFYEPGASWYWVLTGPLAAVSVLLLEIS

SEQ ID NO: 163317 - protein, 26 aa, Mycobacterium bovis
PKVGPWALYGLLFTIVILFALQGDQI

SEQ ID NO: 163318 - protein, 18 aa, Mycobacterium bovis
PLDVGWSLVNTRSLFDHR

SEQ ID NO: 163319 - protein, 20 aa, Mycobacterium bovis
PLEHCYAYSDSITDLPMLEA

SEQ ID NO: 163320 - protein, 18 aa, Mycobacterium bovis
PLHDQWRPVLWAIAILTM

SEQ ID NO: 163321 - protein, 30 aa, Mycobacterium bovis
PLKLRTTTLTLIYPTLTLPSWSAGSRVVAC

SEQ ID NO: 163322 - protein, 40 aa, Mycobacterium bovis
PLLTGWLVRRTLLVSTLLVASAWWLFAWELDNGAGLHEAR

SEQ ID NO: 163323 - protein, 26 aa, Mycobacterium bovis
PLMDVTLLRDRWGFQPAWNAEECLED

SEQ ID NO: 163324 - protein, 27 aa, Mycobacterium bovis
PLMGLPPWMVFCSWSLNLIYQFWVHTE

SEQ ID NO: 163325 - protein, 27 aa, Mycobacterium bovis
PLNTRQLLLVNMLTDALPAAALAVSKP

SEQ ID NO: 163326 - protein, 23 aa, Mycobacterium bovis
PLPTEIYWRRRGLALGIAVVVVG

SEQ ID NO: 163327 - protein, 28 aa, Mycobacterium bovis
PLTTAFAYLLLPQVLVYGLSSVFMAILN

SEQ ID NO: 163328 - protein, 31 aa, Mycobacterium bovis
PLVDLKLFAEPLYRSVLIVYFVVMSCFFGTL

SEQ ID NO: 163329 - protein, 18 aa, Mycobacterium bovis
PMLAPGQEWRMVWDSALD

SEQ ID NO: 163330 - protein, 21 aa, Mycobacterium bovis
PMLRILVRRHRLVGTLPLVSP

SEQ ID NO: 163331 - protein, 20 aa, Mycobacterium bovis
PMLRPTMFFVLVTGIISAAQ

SEQ ID NO: 163332 - protein, 24 aa, Mycobacterium bovis
PMNAMTPMVLFIKSPRDLRTPGAL

SEQ ID NO: 163333 - protein, 35 aa, Mycobacterium bovis
PNEIALNILLAGLTIIFLLAVVTLQPFAIYSGGGQ

SEQ ID NO: 163334 - protein, 30 aa, Mycobacterium bovis
PNRVRSAAALWWIPAWLAMIVEVAVLGPQR

SEQ ID NO: 163335 - protein, 27 aa, Mycobacterium bovis
PPEPHPPIPTTPWQHTRHWITTKYPAG

SEQ ID NO: 163336 - protein, 40 aa, Mycobacterium bovis
PPGPGSKTPWLILAGLAVLGVILLVVILVIGLRGDNKSTT

SEQ ID NO: 163337 - protein, 24 aa, Mycobacterium bovis
PPGSVDFFYLTASAAGIFGIPGQG

SEQ ID NO: 163338 - protein, 30 aa, Mycobacterium bovis
PPGTSIYVLLPGRRMPIPQLPGATAGARST

SEQ ID NO: 163339 - protein, 26 aa, Mycobacterium bovis
PPNAYDEYPVLPPIGLQAPQVPIPPP

SEQ ID NO: 163340 - protein, 24 aa, Mycobacterium bovis
PPPAFPVWPLWYAALAWLHVRQAG

SEQ ID NO: 163341 - protein, 22 aa, Mycobacterium bovis
PPPIQAAPTGQPSWAPNSGPMP

SEQ ID NO: 163342 - protein, 20 aa, Mycobacterium bovis
PPPPTVTPPVPARAPRPAAQ

SEQ ID NO: 163343 - protein, 27 aa, Mycobacterium bovis
PPSRGTVYQMWLLGGAKGPRSAETMGT

SEQ ID NO: 163344 - protein, 23 aa, Mycobacterium bovis
PPTPVIPLRAKPVALLAARQLRD

SEQ ID NO: 163345 - protein, 23 aa, Mycobacterium bovis
PQHLRRRKLLTPPLHGAALDRYV

SEQ ID NO: 163346 - protein, 21 aa, Mycobacterium bovis
PQPAWRNLRFPLAWAPPEADV

SEQ ID NO: 163347 - protein, 32 aa, Mycobacterium bovis
PRDDALAALLGQWRDDLRWPPASALVSQDEAV

SEQ ID NO: 163348 - protein, 24 aa, Mycobacterium bovis
PRDLEPFRCFYLSAPFVVPKKKEV

SEQ ID NO: 163349 - protein, 30 aa, Mycobacterium bovis
PRDRDTWMVIDDKAWFFALTDQVSIAEAEE

SEQ ID NO: 163350 - protein, 44 aa, Mycobacterium bovis
PRLPSSVVSWLPLYHDMGLMVGLFIPLFVGCPVILTSPEAFIRK

SEQ ID NO: 163351 - protein, 26 aa, Mycobacterium bovis
PRLVDIYVDWLWFGEVGFRSVWITVL

SEQ ID NO: 163352 - protein, 18 aa, Mycobacterium bovis
PRPLAWLHERFGVSEAAE

SEQ ID NO: 163353 - protein, 24 aa, Mycobacterium bovis
PRRIIGFAVFVFIAAAVFGVPVAD

SEQ ID NO: 163354 - protein, 31 aa, Mycobacterium bovis
PRRILVGAVAVLLLAGLFAVGIVIGRKTNTT

SEQ ID NO: 163355 - protein, 36 aa, Mycobacterium bovis
PSAISAMLIYRLISWLLIAAIGWVVFFFMFRTESTA

SEQ ID NO: 163356 - protein, 39 aa, Mycobacterium bovis
PSARVPGWGYILTALAAPVVTWAAWPFHSVALRNARHRT

SEQ ID NO: 163357 - protein, 22 aa, Mycobacterium bovis
PSGRHWHRKSPVPMLPVVAVAD

SEQ ID NO: 163358 - protein, 27 aa, Mycobacterium bovis
PSIAALLGKWFWWPQVVRQRPVPQPWP

SEQ ID NO: 163359 - protein, 17 aa, Mycobacterium bovis
PSPYLTIAFPNRPPQYE

SEQ ID NO: 163360 - protein, 20 aa, Mycobacterium bovis
PSSLLATTVFFSPGNEQAAA

SEQ ID NO: 163361 - protein, 19 aa, Mycobacterium bovis
PSTLFAPAGLIPTAAERKL

SEQ ID NO: 163362 - protein, 24 aa, Mycobacterium bovis
PSTPPTGFPSFSPPPPVSAGTGSQ

SEQ ID NO: 163363 - protein, 31 aa, Mycobacterium bovis
PSVICAITVAWLDRFMGIGGESALFFIGVLI

SEQ ID NO: 163364 - protein, 24 aa, Mycobacterium bovis
PTAIPLRHDGLSYRFPFHTEKKTY

SEQ ID NO: 163365 - protein, 18 aa, Mycobacterium bovis
PTAWALCGVFPLAAVPLV

SEQ ID NO: 163366 - protein, 25 aa, Mycobacterium bovis
PTFMQWGWRIPFLVSAALIAVALYV

SEQ ID NO: 163367 - protein, 19 aa, Mycobacterium bovis
PTGLLAYRYRLRVLAAATV

SEQ ID NO: 163368 - protein, 23 aa, Mycobacterium bovis
PTHKPLFVGLVIGVVLIVGGLTF

SEQ ID NO: 163369 - protein, 27 aa, Mycobacterium bovis
PTLGVLLLGVLLFGLGLGPPLVALMLL

SEQ ID NO: 163370 - protein, 22 aa, Mycobacterium bovis
PTMLSVPRWAVGPVMELGTDHR

SEQ ID NO: 163371 - protein, 25 aa, Mycobacterium bovis
PTPSAPPLRLLEDLPRRVRVSDAHQ

SEQ ID NO: 163372 - protein, 18 aa, Mycobacterium bovis
PTRSILAGLALQAVVVAL

SEQ ID NO: 163373 - protein, 21 aa, Mycobacterium bovis
PTRTVYWSQPEPRWPKSPPQD

SEQ ID NO: 163374 - protein, 23 aa, Mycobacterium bovis
PVKFSTFYISGPYMPPAAGVETN

SEQ ID NO: 163375 - protein, 20 aa, Mycobacterium bovis
PVLGRLYSTEFYALAARALA

SEQ ID NO: 163376 - protein, 23 aa, Mycobacterium bovis
PVLGVWVIFSPWVLPGVAVTAGM

SEQ ID NO: 163377 - protein, 19 aa, Mycobacterium bovis
PVMAPTLTWLFAFVVILAL

SEQ ID NO: 163378 - protein, 21 aa, Mycobacterium bovis
PVRMTFRSSRLVYPMRLSVAA

SEQ ID NO: 163379 - protein, 25 aa, Mycobacterium bovis
PVRRWLLLALVSTWGLRLSWHMYRK

SEQ ID NO: 163380 - protein, 34 aa, Mycobacterium bovis
PVRWRSGRRVHFDLDPLLPFPRWHEHAAMVEEPV

SEQ ID NO: 163381 - protein, 25 aa, Mycobacterium bovis
PVTTGPVWVLAGFGAQHRKMGKSLY

SEQ ID NO: 163382 - protein, 31 aa, Mycobacterium bovis; identical to SEQ ID NO: 22636

SEQ ID NO: 163383 - protein, 32 aa, Mycobacterium bovis
PWLPHTIRRLSLPILLFWVGVAAITNAAVPQL

SEQ ID NO: 163384 - protein, 28 aa, Mycobacterium bovis
PYAGRRETWLIMRLPVIGNTQALRWRTS

SEQ ID NO: 163385 - protein, 20 aa, Mycobacterium bovis
PYIDFDAMRLKMITTPTDWP

SEQ ID NO: 163386 - protein, 21 aa, Mycobacterium bovis
PYIVYFTPLFDTFVRYHWGHE

SEQ ID NO: 163387 - protein, 18 aa, Mycobacterium bovis
PYLRTMFVVLLSTLTLAS

SEQ ID NO: 163388 - protein, 19 aa, Mycobacterium bovis
PYQPQLGVPTAWLVAPVEA

SEQ ID NO: 163389 - protein, 27 aa, Mycobacterium bovis
QAEGPLLPLVQLGGVALLSTGVALVGC

SEQ ID NO: 163390 - protein, 19 aa, Mycobacterium bovis
QAFIFALLTILYFSQAMEL

SEQ ID NO: 163391 - protein, 23 aa, Mycobacterium bovis
QAHAFWDIATFLINGSLWVFVGV

SEQ ID NO: 163392 - protein, 30 aa, Mycobacterium bovis
QAILATYGQRPADRPLWLGSIKSNIGHTSA

SEQ ID NO: 163393 - protein, 17 aa, Mycobacterium bovis
QALTNQARRLLAWVGAD

SEQ ID NO: 163394 - protein, 26 aa, Mycobacterium bovis
QAMTATWINLVGLILLMMLQPIGGMI

SEQ ID NO: 163395 - protein, 26 aa, Mycobacterium bovis
QAQNQAYGYLFPHGTFFVIGHLLGVP

SEQ ID NO: 163396 - protein, 17 aa, Mycobacterium bovis
QARRLLAWVGADENVRP

SEQ ID NO: 163397 - protein, 18 aa, Mycobacterium bovis
QATLACIVAFWFLGFDTA

SEQ ID NO: 163398 - protein, 26 aa, Mycobacterium bovis
QAVEGVGLWLLKRWGEYFAVVATSIF

SEQ ID NO: 163399 - protein, 27 aa, Mycobacterium bovis
QDAEAEPAAWLRFWFPDPNGSNTEFQR

SEQ ID NO: 163400 - protein, 22 aa, Mycobacterium bovis
QDYANIPPTRFKRKEHWLPAHF

SEQ ID NO: 163401 - protein, 26 aa, Mycobacterium bovis
QEAAMKYFLLGAFSSAFFLYGVALLY

SEQ ID NO: 163402 - protein, 24 aa, Mycobacterium bovis
QEAFIQLLADRAFQWSLNAGVVIQ

SEQ ID NO: 163403 - protein, 23 aa, Mycobacterium bovis
QEAGFTLSAPLRSLTRPSLAVNQ

SEQ ID NO: 163404 - protein, 18 aa, Mycobacterium bovis
QEDGPKLFRSLSIAFMSS

SEQ ID NO: 163405 - protein, 31 aa, Mycobacterium bovis
QEGDRGVSWLPFFHDMGLITVLLASVLGHSF

SEQ ID NO: 163406 - protein, 21 aa, Mycobacterium bovis
QERWVPTLVTLEKIAAWAITE

SEQ ID NO: 163407 - protein, 24 aa, Mycobacterium bovis
QFDSLLAVARPFFAKNREVLTHDV

SEQ ID NO: 163408 - protein, 21 aa, Mycobacterium bovis
QFMALGWKLLIPVSLVWVMVA

SEQ ID NO: 163409 - protein, 18 aa, Mycobacterium bovis
QFRGRDALFWVYVATLMV

SEQ ID NO: 163410 - protein, 17 aa, Mycobacterium bovis
QFYTPWSWLPRIVTQFA

SEQ ID NO: 163411 - protein, 19 aa, Mycobacterium bovis
QGAQWLGMGAQLCATAPVF

SEQ ID NO: 163412 - protein, 25 aa, Mycobacterium bovis
QGDRLTFLDCLYYAAVTLSTTGYGD

SEQ ID NO: 163413 - protein, 19 aa, Mycobacterium bovis
QGLDYVAGFLGALCAGWAP

SEQ ID NO: 163414 - protein, 19 aa, Mycobacterium bovis
QGVLALPLPIDKINKIMTA

SEQ ID NO: 163415 - protein, 26 aa, Mycobacterium bovis
QHMADRFPAVLPVGEVLAIVTAVAGA

SEQ ID NO: 163416 - protein, 18 aa, Mycobacterium bovis
QIDHFWWTAIWAAILLSI

SEQ ID NO: 163417 - protein, 17 aa, Mycobacterium bovis
QIEPALHDGDYSGAAVA

SEQ ID NO: 163418 - protein, 21 aa, Mycobacterium bovis
QIPFWTFLRNSLIITSVLAVV

SEQ ID NO: 163419 - protein, 30 aa, Mycobacterium bovis
QISAPRAKLFAALFLILALVVVGEVAGVVL

SEQ ID NO: 163420 - protein, 22 aa, Mycobacterium bovis
QLADLDQVWRLTRGAGQRVAVI

SEQ ID NO: 163421 - protein, 31 aa, Mycobacterium bovis
QLCGAPQWVRWALFLACYATGGWEPGLAGLQ

SEQ ID NO: 163422 - protein, 39 aa, Mycobacterium bovis
QLILFAIVSVVAIVVLGWYYLRIPSLVGIGQYTLKADLP

SEQ ID NO: 163423 - protein, 25 aa, Mycobacterium bovis
QLIPATNIALLVFAAGIPAVAAVAI

SEQ ID NO: 163424 - protein, 24 aa, Mycobacterium bovis
QLQPKYMEMLNLNEAWQFGRGDGV

SEQ ID NO: 163425 - protein, 19 aa, Mycobacterium bovis
QLRHTVLVPGPPPGSAIAG

SEQ ID NO: 163426 - protein, 24 aa, Mycobacterium bovis
QLRITRWFAVRWGAERSLVVGATI

SEQ ID NO: 163427 - protein, 30 aa, Mycobacterium bovis
QLRKIKFEPYRLWQPPLTQPVAIDDLVNRF

SEQ ID NO: 163428 - protein, 30 aa, Mycobacterium bovis
QLRLGLNVPYLLLVLAFVVFDAIQTIRLGG

SEQ ID NO: 163429 - protein, 23 aa, Mycobacterium bovis
QLVKLAHIKLAWRTGNFVIYAIT

SEQ ID NO: 163430 - protein, 25 aa, Mycobacterium bovis
QLVSKEIIYFLAQLDVKEIHGYNPD

SEQ ID NO: 163431 - protein, 20 aa, Mycobacterium bovis
QMHLDAGQQVWLITATPYEL

SEQ ID NO: 163432 - protein, 30 aa, Mycobacterium bovis
QMLTYTSVVLAFLAFMVALVAGADLGLTKL

SEQ ID NO: 163433 - protein, 23 aa, Mycobacterium bovis
QMSWVTPARWGFAASAATVDLIK

SEQ ID NO: 163434 - protein, 27 aa, Mycobacterium bovis
QNAQPGKFMPLLPTQQQAPVPPPPPDD

SEQ ID NO: 163435 - protein, 32 aa, Mycobacterium bovis
QNLGYALQWPLFAWFCVYAYRNFVRYEETPPQ

SEQ ID NO: 163436 - protein, 26 aa, Mycobacterium bovis
QNYTYKWETFLTREMPAWLQANKGVS

SEQ ID NO: 163437 - protein, 25 aa, Mycobacterium bovis
QPIRSTWWIRHYTFTGTAMGLVFVW

SEQ ID NO: 163438 - protein, 31 aa, Mycobacterium bovis
QPNTITKFLRRFRPYNLMPAAVKPSYGMAEA

SEQ ID NO: 163439 - protein, 25 aa, Mycobacterium bovis
QPPDVNTWWAFRTSCTPTECLAAAT

SEQ ID NO: 163440 - protein, 25 aa, Mycobacterium bovis
QPVQRSVARFALIQALSAVLVGAGT

SEQ ID NO: 163441 - protein, 18 aa, Mycobacterium bovis
QQGKNFYYFPDQLSIDRY

SEQ ID NO: 163442 - protein, 19 aa, Mycobacterium bovis
QQVWLITATPYELAATIAR

SEQ ID NO: 163443 - protein, 23 aa, Mycobacterium bovis
QRAPQIYRPPTAAPPPAGARGGT

SEQ ID NO: 163444 - protein, 25 aa, Mycobacterium bovis
QRNVRWARWLAWVSLAVLLTEGAVG

SEQ ID NO: 163445 - protein, 35 aa, Mycobacterium bovis
QRPRFRMPFSPYSGYLTLLFLLVVLVTMASDKPIG

SEQ ID NO: 163446 - protein, 24 aa, Mycobacterium bovis
QRRAQLDGWRYGWVLNIGAAITGG

SEQ ID NO: 163447 - protein, 32 aa, Mycobacterium bovis
QRRMEVLALPLVAVVLFFVFGGVIAAGLPVMV

SEQ ID NO: 163448 - protein, 25 aa, Mycobacterium bovis
QRRRLLRVTRWDVGLAMLIAGGVNA

SEQ ID NO: 163449 - protein, 29 aa, Mycobacterium bovis
QRYLPYATVLIGLALIALGGWLLLGRGLT

SEQ ID NO: 163450 - protein, 24 aa, Mycobacterium bovis
QSKGYFLLGIWMSLLWAVVFTLSI

SEQ ID NO: 163451 - protein, 30 aa, Mycobacterium bovis
QSWFWSRWVGWVMRRPWITALAASTVLLVM

SEQ ID NO: 163452 - protein, 21 aa, Mycobacterium bovis
QTSESLWWVTDAGARFGVEDS

SEQ ID NO: 163453 - protein, 25 aa, Mycobacterium bovis
QTTHAMLRSLFRVGLDPRNVAVIGK

SEQ ID NO: 163454 - protein, 26 aa, Mycobacterium bovis
QVAMFAALGWFYLSVLPGWLGLEQTT

SEQ ID NO: 163455 - protein, 24 aa, Mycobacterium bovis
QVLAPLFPMIVAVPVGAYLALPVA

SEQ ID NO: 163456 - protein, 26 aa, Mycobacterium bovis
QVLDTTLPWSYTITTTLPAVFANVVA

SEQ ID NO: 163457 - protein, 24 aa, Mycobacterium bovis
QVMHHRTVWTVIAILALFGWPQVA

SEQ ID NO: 163458 - protein, 27 aa, Mycobacterium bovis
QVPGGAWVLGWRRPQAYPLMSHLAARG

SEQ ID NO: 163459 - protein, 18 aa, Mycobacterium bovis
QVPPQRWQPFEGGPPEVA

SEQ ID NO: 163460 - protein, 18 aa, Mycobacterium bovis
QVRVVIAGLLKQGKSQLL

SEQ ID NO: 163461 - protein, 20 aa, Mycobacterium bovis
QVTIFAIQIALGELLRHHGA

SEQ ID NO: 163462 - protein, 17 aa, Mycobacterium bovis
QVWLVDPRRQLLTALGS

SEQ ID NO: 163463 - protein, 17 aa, Mycobacterium bovis
RAAGFIGFAIGGPLSDG

SEQ ID NO: 163464 - protein, 25 aa, Mycobacterium bovis
RAAVKFLLYNLFGGLIMLAAVIGLY

SEQ ID NO: 163465 - protein, 30 aa, Mycobacterium bovis
RADLYSLGCALFRLLTGEAPFAAGAGAAVA

SEQ ID NO: 163466 - protein, 20 aa, Mycobacterium bovis
RADVRVAHPLISRAHLLLRF

SEQ ID NO: 163467 - protein, 35 aa, Mycobacterium bovis
RAGPAIRWLGGIGAVIPLLALVLVLVVLVIEAMGA

SEQ ID NO: 163468 - protein, 33 aa, Mycobacterium bovis
RAIGLFDTWPGLILPYITFALPLAIYTLSAFFR

SEQ ID NO: 163469 - protein, 25 aa, Mycobacterium bovis
RALRMPLYRTLISLAVWATGGGVFI

SEQ ID NO: 163470 - protein, 20 aa, Mycobacterium bovis
RALVLVTVGIIVVICVASML

SEQ ID NO: 163471 - protein, 26 aa, Mycobacterium bovis
RANAAPLRIMILLVLVTALGSALLDN

SEQ ID NO: 163472 - protein, 24 aa, Mycobacterium bovis
RANGIRRIVMLTGDHPEIAQVVAD

SEQ ID NO: 163473 - protein, 30 aa, Mycobacterium bovis
RAPVGTRQLLLVNLLTDMFPALAVAVTSQF

SEQ ID NO: 163474 - protein, 20 aa, Mycobacterium bovis
RAQLVLTESGLRPGWHRVPG

SEQ ID NO: 163475 - protein, 31 aa, Mycobacterium bovis
RARMVLTPLRDLFATIFFLGIGLSVDPGKLV

SEQ ID NO: 163476 - protein, 33 aa, Mycobacterium bovis
RARRQQGCHTMSLDWVAWRGLGLAADAQLVSEE

SEQ ID NO: 163477 - protein, 28 aa, Mycobacterium bovis
RASIQSKLMVLLLLTSIVSVAAIAAIVY

SEQ ID NO: 163478 - protein, 17 aa, Mycobacterium bovis
RAVLRDVLINELQPGMD

SEQ ID NO: 163479 - protein, 25 aa, Mycobacterium bovis
RDADKPAALWILTRGVHESVAPSAL

SEQ ID NO: 163480 - protein, 33 aa, Mycobacterium bovis
RDALGLTLTPSLAPWVALRLLPQGPTLSRADAL

SEQ ID NO: 163481 - protein, 34 aa, Mycobacterium bovis
RDERDRLALWSRVLPITFTAAGLVALVGGGLFAS

SEQ ID NO: 163482 - protein, 30 aa, Mycobacterium bovis
RDGLGPYLSIYLLLIHDWDQASIGFVMAVG

SEQ ID NO: 163483 - protein, 28 aa, Mycobacterium bovis
RDIVLLVCVLLFTIIWWNVNHGRANWLP

SEQ ID NO: 163484 - protein, 28 aa, Mycobacterium bovis
RDRAGELLFWLPYPSFATYLHVGCAQIR

SEQ ID NO: 163485 - protein, 41 aa, Mycobacterium bovis
RDRKRQWRKQTWLGRFVSTYGWRAYALPVLMVLTTVVVYQT

SEQ ID NO: 163486 - protein, 18 aa, Mycobacterium bovis
RDRTSFIIAHRLSTIRDA

SEQ ID NO: 163487 - protein, 23 aa, Mycobacterium bovis
RDTGLAMLVWALAVAGALAFGQL

SEQ ID NO: 163488 - protein, 34 aa, Mycobacterium bovis
RDVFALLSPFLLVVAVMFVPMLDLLLAIVRRTRA

SEQ ID NO: 163489 - protein, 25 aa, Mycobacterium bovis
REAGYLIPVIPLLIGGQAAVWLTWP

SEQ ID NO: 163490 - protein, 21 aa, Mycobacterium bovis
REGSFWRRLLSPPGFTSIAHV

SEQ ID NO: 163491 - protein, 24 aa, Mycobacterium bovis
REPRNIWVMIGVPALIVALIGTIV

SEQ ID NO: 163492 - protein, 19 aa, Mycobacterium bovis
RERRWLVPALLLSATGDWL

SEQ ID NO: 163493 - protein, 23 aa, Mycobacterium bovis
RETVSVWFRSVWVLQPRGDLMAE

SEQ ID NO: 163494 - protein, 18 aa, Mycobacterium bovis
REVFSDFPDLEVCVYAAP

SEQ ID NO: 163495 - protein, 26 aa, Mycobacterium bovis
RFALKRGALMFGKLVPMGIGAIIGAI

SEQ ID NO: 163496 - protein, 17 aa, Mycobacterium bovis
RFFPPMGSILYWMRFGT

SEQ ID NO: 163497 - protein, 24 aa, Mycobacterium bovis
RFGDTMGYRLVIYPEYASLDRVDP

SEQ ID NO: 163498 - protein, 24 aa, Mycobacterium bovis
RFGFLLAIPAVFASGLFSLPDAFH

SEQ ID NO: 163499 - protein, 19 aa, Mycobacterium bovis
RFGLLDPKRRLKTRGWRRV

SEQ ID NO: 163500 - protein, 18 aa, Mycobacterium bovis
RFGLRQMVDIALRALSPA

SEQ ID NO: 163501 - protein, 19 aa, Mycobacterium bovis
RFRQGLIPSLMWISVPVIL

SEQ ID NO: 163502 - protein, 19 aa, Mycobacterium bovis
RFRRSELMLALATTAAVLG

SEQ ID NO: 163503 - protein, 19 aa, Mycobacterium bovis
RFVLRRLGPGPGGLASNRV

SEQ ID NO: 163504 - protein, 17 aa, Mycobacterium bovis
RFWAWTIAGYTLTVVTV

SEQ ID NO: 163505 - protein, 19 aa, Mycobacterium bovis
RGADLPPLPTLFVVVDEFA

SEQ ID NO: 163506 - protein, 18 aa, Mycobacterium bovis
RGALFRAAAVWLAGAVVG

SEQ ID NO: 163507 - protein, 22 aa, Mycobacterium bovis
RGANVFFMLGGQRLDLSSLQKV

SEQ ID NO: 163508 - protein, 18 aa, Mycobacterium bovis
RGERFARLPAGRAILLTD

SEQ ID NO: 163509 - protein, 19 aa, Mycobacterium bovis
RGLLRLLEDLRRARGLTVV

SEQ ID NO: 163510 - protein, 22 aa, Mycobacterium bovis
RGRATLYLTYWTAGDTRNRGRE

SEQ ID NO: 163511 - protein, 22 aa, Mycobacterium bovis
RGRDTLFVLYLSTLMVPLTVTV

SEQ ID NO: 163512 - protein, 30 aa, Mycobacterium bovis
RGRLVRSLRPLILLPLVLPPVVGGIALLYA

SEQ ID NO: 163513 - protein, 29 aa, Mycobacterium bovis
RGTMATGGLVLLVLLAGIALLVSRQVVVP

SEQ ID NO: 163514 - protein, 17 aa, Mycobacterium bovis
RGWEIRDFRIARKAARI

SEQ ID NO: 163515 - protein, 24 aa, Mycobacterium bovis
RHADTWIMSLLYIGTFGSFIGYSA

SEQ ID NO: 163516 - protein, 22 aa, Mycobacterium bovis
RHEGRYFVAGQPTDLVREGDAE

SEQ ID NO: 163517 - protein, 24 aa, Mycobacterium bovis
RHHEALLFFAFSGVGVLLSMAPLW

SEQ ID NO: 163518 - protein, 21 aa, Mycobacterium bovis
RHIASWLAALVVPSVICAITV

SEQ ID NO: 163519 - protein, 26 aa, Mycobacterium bovis
RHPHWNRLIWPVVVLVLLTGLAAFGS

SEQ ID NO: 163520 - protein, 41 aa, Mycobacterium bovis
RHRDLWRMQVTLKPVPVILILLMLISGGATGWLYLEQYRPD

SEQ ID NO: 163521 - protein, 20 aa, Mycobacterium bovis
RHRILAWIAAGAMASVVALV

SEQ ID NO: 163522 - protein, 25 aa, Mycobacterium bovis
RHVEWFFAESWARLTAGRTARVVLL

SEQ ID NO: 163523 - protein, 28 aa, Mycobacterium bovis
RHYFTYRDVLGFLYAQAKFQLLGKENSN

SEQ ID NO: 163524 - protein, 23 aa, Mycobacterium bovis
RIALLLLACLPLNAIMTIAAKSV

SEQ ID NO: 163525 - protein, 28 aa, Mycobacterium bovis
RIESLLPAILEGRQLWQRVQAAVSVLLG

SEQ ID NO: 163526 - protein, 27 aa, Mycobacterium bovis
RILGGLVVIMPLYALALDMAFTSGQVV

SEQ ID NO: 163527 - protein, 24 aa, Mycobacterium bovis
RILGWGWLVLTIVGVPWLLSFAQP

SEQ ID NO: 163528 - protein, 25 aa, Mycobacterium bovis
RILIMIALGVIVLLLAGPRLIDAYV

SEQ ID NO: 163529 - protein, 23 aa, Mycobacterium bovis
RILTHLPVVIGAVLAIMVWRSAS

SEQ ID NO: 163530 - protein, 30 aa, Mycobacterium bovis; identical to SEQ ID NO: 24984

SEQ ID NO: 163531 - protein, 20 aa, Mycobacterium bovis
RIMTIGIVLAALGVASAFAT

SEQ ID NO: 163532 - protein, 17 aa, Mycobacterium bovis
RIPVVPYAPYGPGSARA

SEQ ID NO: 163533 - protein, 24 aa, Mycobacterium bovis
RKDLTWWDLVVFGVSVVIGAGIFT

SEQ ID NO: 163534 - protein, 30 aa, Mycobacterium bovis
RKEDKRLLPYMIGAFLLIVGASVGVGVWAG

SEQ ID NO: 163535 - protein, 18 aa, Mycobacterium bovis
RKRRIGPVWLTAAGYAVA

SEQ ID NO: 163536 - protein, 39 aa, Mycobacterium bovis
RKTAAWAWRFLVILAAMVALLWVLNKFEVIVVPVLLALM

SEQ ID NO: 163537 - protein, 25 aa, Mycobacterium bovis
RKYTFRKRALIVMAVILVGSAAAAF

SEQ ID NO: 163538 - protein, 27 aa, Mycobacterium bovis
RLAAGVIRPQLRRAYLEEAVQRALVSI

SEQ ID NO: 163539 - protein, 21 aa, Mycobacterium bovis
RLDNARFLLPVVGVPPDQATD

SEQ ID NO: 163540 - protein, 27 aa, Mycobacterium bovis
RLFRVPELLAGSFLLALLAVTAANFFT

SEQ ID NO: 163541 - protein, 19 aa, Mycobacterium bovis
RLGDFWGYLAGWGFVVGKT

SEQ ID NO: 163542 - protein, 44 aa, Mycobacterium bovis
RLIIAMTVCIVLLILIVLLRAIVAPLYLIGSVIVSYLAALGIGV

SEQ ID NO: 163543 - protein, 23 aa, Mycobacterium bovis
RLKTFLLLVGMSALIVAVGALFG

SEQ ID NO: 163544 - protein, 26 aa, Mycobacterium bovis
RLMTPLRVMFAIALVFLALGWSTKAA

SEQ ID NO: 163545 - protein, 29 aa, Mycobacterium bovis
RLRERGWLAILSLRLIPVVPFAAINYAAG

SEQ ID NO: 163546 - protein, 26 aa, Mycobacterium bovis
RLRQRPFQYILLVLGIALGVAMIVAI

SEQ ID NO: 163547 - protein, 27 aa, Mycobacterium bovis
RLRRPIVVWWIVWIVSNAISMFAFATS

SEQ ID NO: 163548 - protein, 20 aa, Mycobacterium bovis
RLSHFGALVRIPRSVEALGR

SEQ ID NO: 163549 - protein, 19 aa, Mycobacterium bovis
RLSLLPVLIGLMSAVPLGL

SEQ ID NO: 163550 - protein, 17 aa, Mycobacterium bovis
RLVDVIGCSLRLPGIYP

SEQ ID NO: 163551 - protein, 25 aa, Mycobacterium bovis
RLVLTGRTPLPPRRDWQLDTLDTEL

SEQ ID NO: 163552 - protein, 18 aa, Mycobacterium bovis
RLWLPTYLAWFVGGMMLA

SEQ ID NO: 163553 - protein, 21 aa, Mycobacterium bovis
RMAVLLAGLSPRLPPALNPDD

SEQ ID NO: 163554 - protein, 18 aa, Mycobacterium bovis
RMGGLAMFLGIVGAVFLA

SEQ ID NO: 163555 - protein, 17 aa, Mycobacterium bovis
RMLLLGTLIGLVWELPV

SEQ ID NO: 163556 - protein, 19 aa, Mycobacterium bovis
RMLRIYRDYAHDGDISYGE

SEQ ID NO: 163557 - protein, 28 aa, Mycobacterium bovis
RMMLGPNAADWPLILADASQPLTLEAMA

SEQ ID NO: 163558 - protein, 21 aa, Mycobacterium bovis
RMMTPLLLVMIAVGGTDILFA

SEQ ID NO: 163559 - protein, 35 aa, Mycobacterium bovis
RMSTILHGVWILLFASLFTNLVELIPKAALAGLLI

SEQ ID NO: 163560 - protein, 18 aa, Mycobacterium bovis
RMVLKSAAKLKRLAPDAI

SEQ ID NO: 163561 - protein, 19 aa, Mycobacterium bovis
RMWRRSGVRIVRRPTIHLV

SEQ ID NO: 163562 - protein, 28 aa, Mycobacterium bovis
RNGEQLLLTMFIPITLLVGLTLLPMGSF

SEQ ID NO: 163563 - protein, 20 aa, Mycobacterium bovis
RNLLGLFMPSALTLLFVMFA

SEQ ID NO: 163564 - protein, 33 aa, Mycobacterium bovis
RNLLLEQLHYRHEVLYFKVLADHLPELMPVVYT

SEQ ID NO: 163565 - protein, 21 aa, Mycobacterium bovis
RNWTIFSALVLLIPTVGSILL

SEQ ID NO: 163566 - protein, 18 aa, Mycobacterium bovis
RPFFVPDEPQRDPVAPLR

SEQ ID NO: 163567 - protein, 18 aa, Mycobacterium bovis
RPFLMQFGEGQWKSRPET

SEQ ID NO: 163568 - protein, 20 aa, Mycobacterium bovis
RPGWLALALVVVAFTYLCFT

SEQ ID NO: 163569 - protein, 17 aa, Mycobacterium bovis
RPHYVVMVILHTALLLG

SEQ ID NO: 163570 - protein, 17 aa, Mycobacterium bovis
RPIPVFGSDELARLTEA

SEQ ID NO: 163571 - protein, 31 aa, Mycobacterium bovis
RPLVVLRVALRVMLALLLVPGVPLVVMPLPG

SEQ ID NO: 163572 - protein, 17 aa, Mycobacterium bovis
RPRYPAIEIYRVSAPAN

SEQ ID NO: 163573 - protein, 20 aa, Mycobacterium bovis
RPVLPKRARLLVTAGMGMLA

SEQ ID NO: 163574 - protein, 19 aa, Mycobacterium bovis
RPVLWAIAILTMTVGTVTA

SEQ ID NO: 163575 - protein, 23 aa, Mycobacterium bovis
RQDLAMTWLLAGLVAGALSGAVA

SEQ ID NO: 163576 - protein, 23 aa, Mycobacterium bovis
RQFQVFLDDVRLPADALVGAEDA

SEQ ID NO: 163577 - protein, 23 aa, Mycobacterium bovis
RQHARRMVLVWVSVVLAITGLVA

SEQ ID NO: 163578 - protein, 24 aa, Mycobacterium bovis
RQPGGYLLGGFGPAPEGMAMWIIG

SEQ ID NO: 163579 - protein, 33 aa, Mycobacterium bovis
RRARYRPLWVFLLVPVLILLTVSGRWLYANAAP

SEQ ID NO: 163580 - protein, 20 aa, Mycobacterium bovis
RRASQEAELLALFAGSVLRG

SEQ ID NO: 163581 - protein, 25 aa, Mycobacterium bovis
RRCGGRTVTLFRSEWRRPVELSTSV

SEQ ID NO: 163582 - protein, 29 aa, Mycobacterium bovis
RRCRWLVFTGWLLALVPAVYLAMTQSGNL

SEQ ID NO: 163583 - protein, 28 aa, Mycobacterium bovis
RRDRMVRAIWVLRALLREYGRRLTEAGV

SEQ ID NO: 163584 - protein, 28 aa, Mycobacterium bovis
RREHISLRPLWGIDQRLKRFGAMAAAMV

SEQ ID NO: 163585 - protein, 26 aa, Mycobacterium bovis
RRGLRRPWLYFVSSLFTSFAFAFAFY

SEQ ID NO: 163586 - protein, 22 aa, Mycobacterium bovis
RRGRVYAARLAPVAAGLTLPSA

SEQ ID NO: 163587 - protein, 24 aa, Mycobacterium bovis
RRHKRLLIGIVVALALVSAMTAAI

SEQ ID NO: 163588 - protein, 17 aa, Mycobacterium bovis
RRILPFVNRISGALLVV

SEQ ID NO: 163589 - protein, 19 aa, Mycobacterium bovis
RRILQPYFSPAALSKALPS

SEQ ID NO: 163590 - protein, 20 aa, Mycobacterium bovis
RRLSPRVVAAPFDPAVGAAL

SEQ ID NO: 163591 - protein, 34 aa, Mycobacterium bovis
RRMRTRGWRRIGTAIVRWPGPILAVACAIAVVGL

SEQ ID NO: 163592 - protein, 29 aa, Mycobacterium bovis
RRQLADRPTPPWRPGAWAAAGVLAAGAVI

SEQ ID NO: 163593 - protein, 21 aa, Mycobacterium bovis
RRQRVLTITAWLAVVVTGSFA

SEQ ID NO: 163594 - protein, 23 aa, Mycobacterium bovis
RRRRALRWGLVFTAGCLLWGLVT

SEQ ID NO: 163595 - protein, 21 aa, Mycobacterium bovis
RRRTWLVLRMNPQRNVAAVAC

SEQ ID NO: 163596 - protein, 18 aa, Mycobacterium bovis
RRSQPLFVAHWTSTGRLN

SEQ ID NO: 163597 - protein, 25 aa, Mycobacterium bovis
RRTFLAPWRVAVGHLMFWGVGTALL

SEQ ID NO: 163598 - protein, 21 aa, Mycobacterium bovis
RRTLYVLITTWDAAGGGPFAA

SEQ ID NO: 163599 - protein, 22 aa, Mycobacterium bovis
RRWVTMLGAFILALAPGWFGVL

SEQ ID NO: 163600 - protein, 37 aa, Mycobacterium bovis
RRYSFPSYRRPPAEKLVFPVLLGILTLLLSACQTASA

SEQ ID NO: 163601 - protein, 18 aa, Mycobacterium bovis
RSAGLYRLRLLETSYGVG

SEQ ID NO: 163602 - protein, 25 aa, Mycobacterium bovis
RSDRLSHTLLPKRIALPVFASDAMS

SEQ ID NO: 163603 - protein, 22 aa, Mycobacterium bovis
RSDTRLYYTPEDPTYDPTVAQV

SEQ ID NO: 163604 - protein, 19 aa, Mycobacterium bovis
RSGIWQALLGSDAIYFEVA

SEQ ID NO: 163605 - protein, 19 aa, Mycobacterium bovis
RSLQLRVVALTLGLSLAVI

SEQ ID NO: 163606 - protein, 32 aa, Mycobacterium bovis
RSLTSMGTALVLLFLLALAAIPGALLPQRGLN

SEQ ID NO: 163607 - protein, 18 aa, Mycobacterium bovis
RSNALQEWAYGRRFRYSE

SEQ ID NO: 163608 - protein, 20 aa, Mycobacterium bovis
RSPLRGPWLTSVFGLVLLVA

SEQ ID NO: 163609 - protein, 18 aa, Mycobacterium bovis
RSQLWLSLLSWAVVVGCY

SEQ ID NO: 163610 - protein, 25 aa, Mycobacterium bovis
RSRGPLWLIVVGFSAGVAVLVALRR

SEQ ID NO: 163611 - protein, 42 aa, Mycobacterium bovis
RSRIEFAITILLLVILLIIYRNPITMVLPLITIGMSVVVAQR

SEQ ID NO: 163612 - protein, 41 aa, Mycobacterium bovis
RSSKFVMRRWLPVGTAVVALLVLLGLPFLSVKWGFPDDRVL

SEQ ID NO: 163613 - protein, 29 aa, Mycobacterium bovis
RSSSGNRAWWILAAVVVVGVLVLVGGIAA

SEQ ID NO: 163614 - protein, 22 aa, Mycobacterium bovis
RSTFLMFSWMQVFTASGFAFSH

SEQ ID NO: 163615 - protein, 26 aa, Mycobacterium bovis
RSVGVPLYLLLGWVAVWYTATILHNA

SEQ ID NO: 163616 - protein, 24 aa, Mycobacterium bovis
RSVSVWFRSIWMLAPRGDLMAQAT

SEQ ID NO: 163617 - protein, 28 aa, Mycobacterium bovis
RSVVAGQVLFSLLLTPAIRLTNGAANWI

SEQ ID NO: 163618 - protein, 23 aa, Mycobacterium bovis
RTDLRLRWSWRGLRLGLMFGFGG

SEQ ID NO: 163619 - protein, 18 aa, Mycobacterium bovis
RTELLRRGIVFAMARVKQ

SEQ ID NO: 163620 - protein, 20 aa, Mycobacterium bovis
RTFIGSAVVMLPLVAAAVAV

SEQ ID NO: 163621 - protein, 27 aa, Mycobacterium bovis
RTLRTDLWWLPPLLTNLGLLAFICYAT

SEQ ID NO: 163622 - protein, 24 aa, Mycobacterium bovis
RTLVHRTCVTPLPFAQADLDALQR

SEQ ID NO: 163623 - protein, 26 aa, Mycobacterium bovis
RTPRPQLTAAFGGALWAARRPGDTSA

SEQ ID NO: 163624 - protein, 19 aa, Mycobacterium bovis
RTPWNTYMAQGLPATAICS

SEQ ID NO: 163625 - protein, 18 aa, Mycobacterium bovis
RTSTLVLIAAFLAVWWIY

SEQ ID NO: 163626 - protein, 24 aa, Mycobacterium bovis
RTTHHLFQPLLYQVATGIISEGEI

SEQ ID NO: 163627 - protein, 24 aa, Mycobacterium bovis
RTVKLNMVWAFGYNIAAIPVAAAG

SEQ ID NO: 163628 - protein, 24 aa, Mycobacterium bovis
RVAGVWTVFVLASAGWALGGQLGA

SEQ ID NO: 163629 - protein, 23 aa, Mycobacterium bovis
RVAPNPPIALPEREPRNIWVMIG

SEQ ID NO: 163630 - protein, 17 aa, Mycobacterium bovis
RVDDVWHPVLNLASARL

SEQ ID NO: 163631 - protein, 28 aa, Mycobacterium bovis
RVDIDGTLSFLLLPRLTTVLSKLPEGSE

SEQ ID NO: 163632 - protein, 53 aa, Mycobacterium bovis
RVDLPRVGQINWKWIRRSLYLTAAVVILLLMVTFTMAYLIVDVPKPGDIRTNQ

SEQ ID NO: 163633 - protein, 30 aa, Mycobacterium bovis
RVELLKLAVLLALWAAVAGAFVSVLYRRQS

SEQ ID NO: 163634 - protein, 23 aa, Mycobacterium bovis
RVFAWLALVFGVGFSMLALLTRR

SEQ ID NO: 163635 - protein, 19 aa, Mycobacterium bovis
RVGDRLYPALNLASARLIT

SEQ ID NO: 163636 - protein, 23 aa, Mycobacterium bovis
RVGGWLLVVGLTLACAGLLWSDR

SEQ ID NO: 163637 - protein, 22 aa, Mycobacterium bovis
RVGTAIVRWPGPVLAATCLVAS

SEQ ID NO: 163638 - protein, 19 aa, Mycobacterium bovis
RVIVLVGALVWAGSLVWYL

SEQ ID NO: 163639 - protein, 22 aa, Mycobacterium bovis
RVPELTPLDPVFAKALAKQPKD

SEQ ID NO: 163640 - protein, 26 aa, Mycobacterium bovis
RVRKYLTLMAFRVPALILAAIAYGAW

SEQ ID NO: 163641 - protein, 24 aa, Mycobacterium bovis
RVRPLRIRRTSPAPAKPAPNSGRR

SEQ ID NO: 163642 - protein, 24 aa, Mycobacterium bovis
RVTAVFLVDVLILAVASHCPDSWQ

SEQ ID NO: 163643 - protein, 20 aa, Mycobacterium bovis
RWDALGFLQDFFATAVFLGI

SEQ ID NO: 163644 - protein, 21 aa, Mycobacterium bovis
RWDPYPFILLNLAFSTQASYA

SEQ ID NO: 163645 - protein, 19 aa, Mycobacterium bovis
RWPWPTFTVNVVGAFLVGY

SEQ ID NO: 163646 - protein, 20 aa, Mycobacterium bovis
RWQRIVALTMIGISTALIGG

SEQ ID NO: 163647 - protein, 18 aa, Mycobacterium bovis
RWTRALLVPTLAGVALIA

SEQ ID NO: 163648 - protein, 27 aa, Mycobacterium bovis
RYHAGVEQLLVFLPQGAAIAQTVLTPT

SEQ ID NO: 163649 - protein, 22 aa, Mycobacterium bovis
RYRLLIFHGGVPPLQFWQALDT

SEQ ID NO: 163650 - protein, 21 aa, Mycobacterium bovis
RYVNLVVLLRTSCEITATALL

SEQ ID NO: 163651 - protein, 27 aa, Mycobacterium bovis
SAFFTPRFVRWFGLFTTHAIVAAALAS

SEQ ID NO: 163652 - protein, 19 aa, Mycobacterium bovis
SAILSAVIFNALVIVALIP

SEQ ID NO: 163653 - protein, 17 aa, Mycobacterium bovis
SAILSITVLPACLGILG

SEQ ID NO: 163654 - protein, 30 aa, Mycobacterium bovis
SALALPVVTWAAWPFHRVAMRNARHHAASM

SEQ ID NO: 163655 - protein, 35 aa, Mycobacterium bovis
SALAPPCIIAFLETRYWWAGIALASLGVIVATVTF

SEQ ID NO: 163656 - protein, 18 aa, Mycobacterium bovis
SALLAWLTAAAVAIAMLT

SEQ ID NO: 163657 - protein, 27 aa, Mycobacterium bovis
SALLSGMLLNYFLTEPRYTWTIAEPDA

SEQ ID NO: 163658 - protein, 23 aa, Mycobacterium bovis
SAMATLRIAFLSALVLELLATLG

SEQ ID NO: 163659 - protein, 25 aa, Mycobacterium bovis
SANWQPWIWAVIVGGIGFMSLFVYW

SEQ ID NO: 163660 - protein, 26 aa, Mycobacterium bovis
SAPIGYLFRPYIIYRSREELVLTRPR

SEQ ID NO: 163661 - protein, 29 aa, Mycobacterium bovis
SASAMLRRNLLIYGLGGLVVPFIGIKLVD

SEQ ID NO: 163662 - protein, 23 aa, Mycobacterium bovis
SASGLGFAIPVNEMKLVANSLIK

SEQ ID NO: 163663 - protein, 32 aa, Mycobacterium bovis
SATGDWLLAIPWWTWAFVFGLGAFLLAHLCFI

SEQ ID NO: 163664 - protein, 27 aa, Mycobacterium bovis
SAVIFNALVIVALIPLALRGVRFRAES

SEQ ID NO: 163665 - protein, 34 aa, Mycobacterium bovis
SAVSGWVRSGHRRLWWALAGVVAFLGLVGAGVVG

SEQ ID NO: 163666 - protein, 22 aa, Mycobacterium bovis
SAWQRFWRITLPMLRPTMFFVL

SEQ ID NO: 163667 - protein, 19 aa, Mycobacterium bovis
SAWRFVTVFGVVGLLADVV

SEQ ID NO: 163668 - protein, 22 aa, Mycobacterium bovis
SAYFAGGLSLRDATRAICSRSH

SEQ ID NO: 163669 - protein, 25 aa, Mycobacterium bovis
SDFPFVPWPPALSVGMWLLAVASVI

SEQ ID NO: 163670 - protein, 38 aa, Mycobacterium bovis
SDGLTAWIAAPLLFIGALFGLLLLAGITIREVPDAMRA

SEQ ID NO: 163671 - protein, 24 aa, Mycobacterium bovis
SDLDQWDWVKWLPHFGDSRRHDAA

SEQ ID NO: 163672 - protein, 18 aa, Mycobacterium bovis
SDLLWSFMQAIAMSIAVM

SEQ ID NO: 163673 - protein, 18 aa, Mycobacterium bovis
SDRRALHTAFAGAAICLL

SEQ ID NO: 163674 - protein, 25 aa, Mycobacterium bovis
SDSLTTRYMPSGMTRWSPDSGETIA

SEQ ID NO: 163675 - protein, 17 aa, Mycobacterium bovis
SDVKSMYLIVEPAKDPT

SEQ ID NO: 163676 - protein, 26 aa, Mycobacterium bovis
SDWRNRPVLVFVLDAGMPGLTQGKPF

SEQ ID NO: 163677 - protein, 25 aa, Mycobacterium bovis
SEPHTWVISLLYIGTFGSFIGFSFA

SEQ ID NO: 163678 - protein, 26 aa, Mycobacterium bovis
SESQNFFIAPFMLLGLLSVLAVVASA

SEQ ID NO: 163679 - protein, 44 aa, Mycobacterium bovis
SEVLGQRRLLKWSIPGLAHFFTMWGFFILLTVYIEAYGLLFEER

SEQ ID NO: 163680 - protein, 18 aa, Mycobacterium bovis
SEWVDKLRRQAETPLLLA

SEQ ID NO: 163681 - protein, 27 aa, Mycobacterium bovis
SFAVGLIVLLGLPPFAMFASELAIARS

SEQ ID NO: 163682 - protein, 38 aa, Mycobacterium bovis
SFGLSVLIWQHILGIELHWLVLAMAVIILLAVGADYNL

SEQ ID NO: 163683 - protein, 30 aa, Mycobacterium bovis
SFLAAVTLLPAILVLASPRGWVAPRGERMA

SEQ ID NO: 163684 - protein, 21 aa, Mycobacterium bovis
SFLYAIVFGGFVAFSNYLPTY

SEQ ID NO: 163685 - protein, 20 aa, Mycobacterium bovis
SFTLVYDALVSRAGSESVLP

SEQ ID NO: 163686 - protein, 23 aa, Mycobacterium bovis
SGANAYLLPARNWSVMAATEVRS

SEQ ID NO: 163687 - protein, 25 aa, Mycobacterium bovis
SGAVAWLISLFYKAIYTGGPINELT

SEQ ID NO: 163688 - protein, 24 aa, Mycobacterium bovis
SGAVILFVYLLIALSQIVLRRQTS

SEQ ID NO: 163689 - protein, 25 aa, Mycobacterium bovis
SGEILMWVPLPLMGLPPWMVFCSWS

SEQ ID NO: 163690 - protein, 24 aa, Mycobacterium bovis
SGEPWGTFINLRCVCLAPPYASHD

SEQ ID NO: 163691 - protein, 28 aa, Mycobacterium bovis
SGFWIRRARRLLPALVLMVLTVSAARAL

SEQ ID NO: 163692 - protein, 30 aa, Mycobacterium bovis
SGGAIALLALTMLIAIIVALWVSRTDGVVL

SEQ ID NO: 163693 - protein, 27 aa, Mycobacterium bovis
SGGSALILAAYYPQQFPYAASLSGFLN

SEQ ID NO: 163694 - protein, 20 aa, Mycobacterium bovis
SGHTTFLELAPNPVALMQVA

SEQ ID NO: 163695 - protein, 24 aa, Mycobacterium bovis
SGKTTLMLILAGRAPTSGTVDRPG

SEQ ID NO: 163696 - protein, 18 aa, Mycobacterium bovis
SGLAVLAILVWWALRHRN

SEQ ID NO: 163697 - protein, 18 aa, Mycobacterium bovis
SGLIWLAVLLPMPVSLRP

SEQ ID NO: 163698 - protein, 19 aa, Mycobacterium bovis
SGLLGPRLPRILAAVALGV

SEQ ID NO: 163699 - protein, 17 aa, Mycobacterium bovis
SGLRRLVTSLRGLRVIV

SEQ ID NO: 163700 - protein, 23 aa, Mycobacterium bovis
SGLYTPAQFQPWTGIPSLTYDQS

SEQ ID NO: 163701 - protein, 24 aa, Mycobacterium bovis
SGNFSWLNWLTILLACSAIDTSSA

SEQ ID NO: 163702 - protein, 23 aa, Mycobacterium bovis
SGPLKWIYLTMSVQMIAAMVDTY

SEQ ID NO: 163703 - protein, 25 aa, Mycobacterium bovis
SGTLSWCSPLGWSLQVRPYAGERWW

SEQ ID NO: 163704 - protein, 26 aa, Mycobacterium bovis
SGVGAFLRLPYTFAIPIFGGRNWTTV

SEQ ID NO: 163705 - protein, 25 aa, Mycobacterium bovis
SGVPPALLHTLSLAVALAIVVALHV

SEQ ID NO: 163706 - protein, 26 aa, Mycobacterium bovis
SGYSTVLAFWLGWPTSEVPGVYLGAS

SEQ ID NO: 163707 - protein, 23 aa, Mycobacterium bovis
SHGWRAMFGLAAAPATLLLPLLW

SEQ ID NO: 163708 - protein, 25 aa, Mycobacterium bovis
SIAALLGRWFWWPNMIHSRPTVPEA

SEQ ID NO: 163709 - protein, 19 aa, Mycobacterium bovis
SIALGIVVAVLILAGAALL

SEQ ID NO: 163710 - protein, 43 aa, Mycobacterium bovis
SIELAIAVMLLVILMVIYRNPVTMLLPLVTIGASLMTAQALVA

SEQ ID NO: 163711 - protein, 18 aa, Mycobacterium bovis
SIHGLFAKMPLMVVILLT

SEQ ID NO: 163712 - protein, 25 aa, Mycobacterium bovis
SIIANRLSYFLDLRGPSVAVDTACS

SEQ ID NO: 163713 - protein, 22 aa, Mycobacterium bovis
SIIANRVSYFYDFHGPSVTIDT

SEQ ID NO: 163714 - protein, 21 aa, Mycobacterium bovis
SILIRRPIVGYLWSWLSGRDR

SEQ ID NO: 163715 - protein, 20 aa, Mycobacterium bovis
SILLTPVLIRLFTKQGFGHQ

SEQ ID NO: 163716 - protein, 31 aa, Mycobacterium bovis
SISGLLALITLLTVPLSLLVTRAITRRSQPL

SEQ ID NO: 163717 - protein, 29 aa, Mycobacterium bovis
SIVTVLVLIYLITNLLVDLLYAALDPRIR

SEQ ID NO: 163718 - protein, 17 aa, Mycobacterium bovis
SIWMRLPTLAMALTCWW

SEQ ID NO: 163719 - protein, 22 aa, Mycobacterium bovis
SIYALGVGAWLYHAIERLILAR

SEQ ID NO: 163720 - protein, 41 aa, Mycobacterium bovis
SKGNQFVMPDLSGMFWVDAEPRLRALGWTGMLDKGADVDAG

SEQ ID NO: 163721 - protein, 23 aa, Mycobacterium bovis
SKLHGLHVTDFLLVPPGALPKTT

SEQ ID NO: 163722 - protein, 18 aa, Mycobacterium bovis
SLFDHRAVVVGADRTQLM

SEQ ID NO: 163723 - protein, 23 aa, Mycobacterium bovis
SLGLYVLFLFTQTVRHRDFFLPV

SEQ ID NO: 163724 - protein, 26 aa, Mycobacterium bovis
SLIFAAVLVMLIAVLARLMMRGWRRR

SEQ ID NO: 163725 - protein, 20 aa, Mycobacterium bovis
SLIVVVVITLFISLAVYGAS

SEQ ID NO: 163726 - protein, 21 aa, Mycobacterium bovis
SLLGMSLHQPYLMGCLSPRNE

SEQ ID NO: 163727 - protein, 26 aa, Mycobacterium bovis
SLLTEPRPWHVPGRPRRAGVSSFGIS

SEQ ID NO: 163728 - protein, 25 aa, Mycobacterium bovis
SLLVLVTVVLLLASGRFIKAIPPSL

SEQ ID NO: 163729 - protein, 39 aa, Mycobacterium bovis
SLPPILPRLIRRFAVVIVLLWLGFTAFVNLAVPQLEVVG

SEQ ID NO: 163730 - protein, 19 aa, Mycobacterium bovis
SLPPIPTLFVVADEFTLML

SEQ ID NO: 163731 - protein, 28 aa, Mycobacterium bovis
SLQGKPAVLWFWTPWCPFCNAEAPSLSQ

SEQ ID NO: 163732 - protein, 21 aa, Mycobacterium bovis
SLSMRSLRYRALDFGLDVGRA

SEQ ID NO: 163733 - protein, 28 aa, Mycobacterium bovis
SLSPVTLCWLLISYGFAASVLPVWLLLA

SEQ ID NO: 163734 - protein, 29 aa, Mycobacterium bovis
SLVEAAAVPVAFLTAFYGLSVLAEVAAGQ

SEQ ID NO: 163735 - protein, 28 aa, Mycobacterium bovis
SLVSPRLPAPWRIPLQAGLGSVLVLVTR

SEQ ID NO: 163736 - protein, 25 aa, Mycobacterium bovis
SMDYEIFLLTRIRERFLQTGQTRDA

SEQ ID NO: 163737 - protein, 20 aa, Mycobacterium bovis
SMFGPYHLKRLLGRGGMGEV

SEQ ID NO: 163738 - protein, 25 aa, Mycobacterium bovis
SMGLLVSMLIFVILGLPSAGATVPL

SEQ ID NO: 163739 - protein, 22 aa, Mycobacterium bovis
SMLKGWYMSFWPIISIAVITVT

SEQ ID NO: 163740 - protein, 31 aa, Mycobacterium bovis
SMTAVVGVFALRRVWWLYKLVMSGQPASGRT

SEQ ID NO: 163741 - protein, 32 aa, Mycobacterium bovis
SMVTLVFGFILMWILAWLTATPVRVVRAALRR

SEQ ID NO: 163742 - protein, 27 aa, Mycobacterium bovis
SPASMRKFFEAFAPYGLKQTAVKPSYG

SEQ ID NO: 163743 - protein, 19 aa, Mycobacterium bovis
SPEQWFAFTPPRVPVLESL

SEQ ID NO: 163744 - protein, 25 aa, Mycobacterium bovis
SPITLRHKIFFVAVAVIGALAWTVV

SEQ ID NO: 163745 - protein, 41 aa, Mycobacterium bovis
SPMFHALGYMHAALAMFLGSTLVLRRRFKPALVLEDIEKHK

SEQ ID NO: 163746 - protein, 32 aa, Mycobacterium bovis
SPQQNPLNPVQFPKALLLKVTGPIAQQFAPAR

SEQ ID NO: 163747 - protein, 23 aa, Mycobacterium bovis
SPRLTNLLVVAAWVAAAVIANLL

SEQ ID NO: 163748 - protein, 35 aa, Mycobacterium bovis
SPVTKNIPALKYLSYRLFMKRYDARWLVTRMTTIT

SEQ ID NO: 163749 - protein, 19 aa, Mycobacterium bovis
SQQIILDRDLQLVVNSLWE

SEQ ID NO: 163750 - protein, 17 aa, Mycobacterium bovis
SQRGLLRLLEDLRRARG

SEQ ID NO: 163751 - protein, 20 aa, Mycobacterium bovis
SRAALMFIVAALAATLALIA

SEQ ID NO: 163752 - protein, 20 aa, Mycobacterium bovis
SRAGLFFVPLAVAAAVCAFL

SEQ ID NO: 163753 - protein, 18 aa, Mycobacterium bovis
SRAQLLIASGSLAADPGK

SEQ ID NO: 163754 - protein, 20 aa, Mycobacterium bovis
SRARRWLRTLRNIGVFGVNL

SEQ ID NO: 163755 - protein, 18 aa, Mycobacterium bovis
SRESLFWVSGNGVRFGIA

SEQ ID NO: 163756 - protein, 25 aa, Mycobacterium bovis
SRFRTLLVKWAVMVVLALLTSGVYL

SEQ ID NO: 163757 - protein, 24 aa, Mycobacterium bovis
SRGRRLAITVGVAAALFVGSAAFA

SEQ ID NO: 163758 - protein, 25 aa, Mycobacterium bovis
SRLCDLEQMIPLMPGAQLIGHEGDE

SEQ ID NO: 163759 - protein, 19 aa, Mycobacterium bovis
SRLYAWVTTLYLVGSVVAA

SEQ ID NO: 163760 - protein, 23 aa, Mycobacterium bovis
SRMLKYVVKRFALKRGALMFGKL

SEQ ID NO: 163761 - protein, 17 aa, Mycobacterium bovis
SRRFWAWTIAGYTLTVV

SEQ ID NO: 163762 - protein, 28 aa, Mycobacterium bovis
SRRNLTLYVTALLFVLAWATSGINGWFY

SEQ ID NO: 163763 - protein, 22 aa, Mycobacterium bovis
SRSARPILLHRSIAGSPGLAKL

SEQ ID NO: 163764 - protein, 21 aa, Mycobacterium bovis
SRWVAMNDLTLASAGALTARM

SEQ ID NO: 163765 - protein, 30 aa, Mycobacterium bovis
SSALLCPLLVYGWLGLPRWGLTGSAVANLV

SEQ ID NO: 163766 - protein, 30 aa, Mycobacterium bovis
SSETLPMMLAPWVLLPTILALRGTSGRSVR

SEQ ID NO: 163767 - protein, 35 aa, Mycobacterium bovis
SSNFLIPNGTFFVVLAIFLVVLAVIGTFVVPPILK

SEQ ID NO: 163768 - protein, 17 aa, Mycobacterium bovis
SSPTFMQWGWRIPFLVS

SEQ ID NO: 163769 - protein, 38 aa, Mycobacterium bovis
SSSSRVVLLVTVGIIVIVVAVLLVVMRHRNRRRRADEL

SEQ ID NO: 163770 - protein, 18 aa, Mycobacterium bovis
SSVHYLLDVLRRVAIDLD

SEQ ID NO: 163771 - protein, 22 aa, Mycobacterium bovis
SSWFDAARPLGAWVDALLRTFI

SEQ ID NO: 163772 - protein, 29 aa, Mycobacterium bovis
STDGIYPLLIMILLPVLVGLDVSTRRAAV

SEQ ID NO: 163773 - protein, 18 aa, Mycobacterium bovis
STEFYALAARALAPGGLM

SEQ ID NO: 163774 - protein, 24 aa, Mycobacterium bovis
STHKVPVWSLLLMGAAALAISVAA

SEQ ID NO: 163775 - protein, 21 aa, Mycobacterium bovis
STHPPGTPLLKLVRELRADRG

SEQ ID NO: 163776 - protein, 26 aa, Mycobacterium bovis
STIVIAILLIAIFLLVRAVPSLRANH

SEQ ID NO: 163777 - protein, 17 aa, Mycobacterium bovis
STLIGRTLLGLAATAVT

SEQ ID NO: 163778 - protein, 20 aa, Mycobacterium bovis
STQPDYGAPAGWHAPGWPPR

SEQ ID NO: 163779 - protein, 30 aa, Mycobacterium bovis
STSAYDIGLFYRYAWQNPVFADIVATRTFD

SEQ ID NO: 163780 - protein, 33 aa, Mycobacterium bovis
STVPTFFSQLRTANWWWALLGLAVSALTYVGAA

SEQ ID NO: 163781 - protein, 20 aa, Mycobacterium bovis
STYFRPLIVTLAIIGVIYGA

SEQ ID NO: 163782 - protein, 23 aa, Mycobacterium bovis
SVALALVGLLALPGYRPGYNDRY

SEQ ID NO: 163783 - protein, 41 aa, Mycobacterium bovis
SVATTFFFTSFVVALIPLVWLLWVVIARGWFAVTRSGWWTH

SEQ ID NO: 163784 - protein, 27 aa, Mycobacterium bovis
SVDAVWKPLLPGYTRPHMRLFSGQVGT

SEQ ID NO: 163785 - protein, 24 aa, Mycobacterium bovis
SVEWDTLLFFAGLFIMVGALVKTG

SEQ ID NO: 163786 - protein, 23 aa, Mycobacterium bovis
SVEWDTLLFFAGLFVMVGALVKT

SEQ ID NO: 163787 - protein, 28 aa, Mycobacterium bovis
SVGALVTYLLYIELLYTPIGELAQMFDD

SEQ ID NO: 163788 - protein, 23 aa, Mycobacterium bovis
SVGLQHQLSRLTNQAWPVSMTGG

SEQ ID NO: 163789 - protein, 23 aa, Mycobacterium bovis
SVGVLVYELLTGHTPFTGDSALS

SEQ ID NO: 163790 - protein, 27 aa, Mycobacterium bovis
SVLAFSVMSFLLLYGIARFQGVLPFNP

SEQ ID NO: 163791 - protein, 26 aa, Mycobacterium bovis
SVLGNPLVWIERALVVLVAAAPCALA

SEQ ID NO: 163792 - protein, 24 aa, Mycobacterium bovis
SVLLTFYPGWVTIGMMAALVLAAA

SEQ ID NO: 163793 - protein, 30 aa, Mycobacterium bovis
SVPSLWRETPAPYGPLFLWIGRGISSLTGE

SEQ ID NO: 163794 - protein, 26 aa, Mycobacterium bovis
SVRANLHFLWLRLARVWPVYLVTLHL

SEQ ID NO: 163795 - protein, 26 aa, Mycobacterium bovis
SVSSWLLAWPMWADGAVFLLVSVLLL

SEQ ID NO: 163796 - protein, 25 aa, Mycobacterium bovis
SVTVTYPAHWGPAAVAALDSALRRA

SEQ ID NO: 163797 - protein, 26 aa, Mycobacterium bovis
SVVGLGLFNPLSVGAGLILGRMAYKE

SEQ ID NO: 163798 - protein, 20 aa, Mycobacterium bovis
SVVNFWAWNLIGPLSTSYAR

SEQ ID NO: 163799 - protein, 19 aa, Mycobacterium bovis
SWLEVPLAMRDGLGLRLEL

SEQ ID NO: 163800 - protein, 25 aa, Mycobacterium bovis
SWNYTTWLNVIFLVIAAALVVRFIT

SEQ ID NO: 163801 - protein, 24 aa, Mycobacterium bovis
SWQADHHVAWWVGVGVAAVVTLLS

SEQ ID NO: 163802 - protein, 20 aa, Mycobacterium bovis
SWRAALPHFLGSAGVRLLLV

SEQ ID NO: 163803 - protein, 24 aa, Mycobacterium bovis
SWSHHWVWMLPAVLVIGLLGWRRR

SEQ ID NO: 163804 - protein, 19 aa, Mycobacterium bovis
SWVLLRRRHGDLALPIPVM

SEQ ID NO: 163805 - protein, 31 aa, Mycobacterium bovis
SYATFGEFLAWVIGWNLVLELAMGAAVVAKG

SEQ ID NO: 163806 - protein, 18 aa, Mycobacterium bovis
SYFREIVTRFDYDDAVLL

SEQ ID NO: 163807 - protein, 34 aa, Mycobacterium bovis
SYPPAYPPQQYPPGWPAGPYPPGPPPPGPGSKTP

SEQ ID NO: 163808 - protein, 24 aa, Mycobacterium bovis
SYTSTYLRFVWTLSATAVVLCYGL

SEQ ID NO: 163809 - protein, 27 aa, Mycobacterium bovis
TAALTVWVVGYALRPLRRVAATAAEVA

SEQ ID NO: 163810 - protein, 18 aa, Mycobacterium bovis
TAAVAVLIIACPCALGLA

SEQ ID NO: 163811 - protein, 30 aa, Mycobacterium bovis
TAAVDRLYADRRIRLWVVYVENFSGQSALN

SEQ ID NO: 163812 - protein, 29 aa, Mycobacterium bovis
TAAVLVLFTLIFFLYGGRSIWQYVTKAFP

SEQ ID NO: 163813 - protein, 26 aa, Mycobacterium bovis
TAGDRGLLEMIWTPVPLEGGDIGDDA

SEQ ID NO: 163814 - protein, 20 aa, Mycobacterium bovis
TAGIVIIKRALAPLRRVAQT

SEQ ID NO: 163815 - protein, 35 aa, Mycobacterium bovis
TALATPPGHGWPPGLPPLPRRPRRYRRGVAAVAAV

SEQ ID NO: 163816 - protein, 25 aa, Mycobacterium bovis
TALCLFTAVFIMLRRKRIPSVARGP

SEQ ID NO: 163817 - protein, 23 aa, Mycobacterium bovis
TALLGYRIMAWTTGLWLIALCYE

SEQ ID NO: 163818 - protein, 22 aa, Mycobacterium bovis
TAQPLSLLPDAAAALYAIRADP

SEQ ID NO: 163819 - protein, 24 aa, Mycobacterium bovis
TAQPPTMPTVTPPPIQAAPTGQPS

SEQ ID NO: 163820 - protein, 33 aa, Mycobacterium bovis
TASLVAAWAYPLWPVVLGLKALALAVGASTFVP

SEQ ID NO: 163821 - protein, 17 aa, Mycobacterium bovis
TATAIWLRSRRAPIDHT

SEQ ID NO: 163822 - protein, 17 aa, Mycobacterium bovis
TAVALVAVGLTLALGLG

SEQ ID NO: 163823 - protein, 27 aa, Mycobacterium bovis
TAVAWLLRFLVRHNMYWFVGYRVLVGT

SEQ ID NO: 163824 - protein, 17 aa, Mycobacterium bovis
TAVIAALVVIAALTLGL

SEQ ID NO: 163825 - protein, 26 aa, Mycobacterium bovis
TDAFWIFMMCYAAAAVLTWKVYDRRT

SEQ ID NO: 163826 - protein, 25 aa, Mycobacterium bovis
TDAGAQFFFLVAAALVVLLVGIEHT

SEQ ID NO: 163827 - protein, 19 aa, Mycobacterium bovis
TDDLRPIPVFGSDELARLT

SEQ ID NO: 163828 - protein, 19 aa, Mycobacterium bovis
TDFFQVLVTQFGSSGGPFA

SEQ ID NO: 163829 - protein, 23 aa, Mycobacterium bovis
TDGRNILPPNKFPYIPPGADPDP

SEQ ID NO: 163830 - protein, 18 aa, Mycobacterium bovis
TDWPRYGGYALGGVSSFG

SEQ ID NO: 163831 - protein, 17 aa, Mycobacterium bovis
TDYAVFLISRYHEYVRL

SEQ ID NO: 163832 - protein, 17 aa, Mycobacterium bovis
TEQIPFWTFLRNSLIIT

SEQ ID NO: 163833 - protein, 23 aa, Mycobacterium bovis
TEQPTFYIDFPTSVSPLTRPHRS

SEQ ID NO: 163834 - protein, 40 aa, Mycobacterium bovis
TFAVITVLLLLVYRSIATTLLILPMVFIGLGATRGTIAFL

SEQ ID NO: 163835 - protein, 19 aa, Mycobacterium bovis
TFCLSFARMPYFQTLGIPC

SEQ ID NO: 163836 - protein, 40 aa, Mycobacterium bovis
TFFVIGHLLGVPGWVTQRLWWAVLLTVGFWGLLRVAEALG

SEQ ID NO: 163837 - protein, 27 aa, Mycobacterium bovis
TFIAGLVVWDLAFTLPLPLGVARHEGS

SEQ ID NO: 163838 - protein, 38 aa, Mycobacterium bovis
TFSSGQRALLWAAGVLGALAIIIAVLLVIKAPGDNSPQ

SEQ ID NO: 163839 - protein, 17 aa, Mycobacterium bovis
TFVWLDRIGLRGGGWAG

SEQ ID NO: 163840 - protein, 19 aa, Mycobacterium bovis
TFWRRAGTRIVRRPKAYLG

SEQ ID NO: 163841 - protein, 30 aa, Mycobacterium bovis
TGDRKLLLSSLLLNWVLGPALMFALAWLLL

SEQ ID NO: 163842 - protein, 25 aa, Mycobacterium bovis
TGDVRRAMTMLLIACPCAVGLSTPT

SEQ ID NO: 163843 - protein, 23 aa, Mycobacterium bovis
TGEAVMFWVLSALALLGAVGVVL

SEQ ID NO: 163844 - protein, 19 aa, Mycobacterium bovis
TGEIMIFVGKDFVVTVRHG

SEQ ID NO: 163845 - protein, 20 aa, Mycobacterium bovis
TGELMFCRNSIDLYHKQAAD

SEQ ID NO: 163846 - protein, 26 aa, Mycobacterium bovis
TGKLRPALFVVPTDAPGFSYTPIEME

SEQ ID NO: 163847 - protein, 27 aa, Mycobacterium bovis
TGLFRTLYVLPWICAPLAIAVMWRWIL

SEQ ID NO: 163848 - protein, 24 aa, Mycobacterium bovis
TGLGLLIGIWLGEGLIGLVTQTIN

SEQ ID NO: 163849 - protein, 25 aa, Mycobacterium bovis
TGLPLPVVLVPPMALSRILLGVHYP

SEQ ID NO: 163850 - protein, 33 aa, Mycobacterium bovis
TGLVNFEPWLVLTGMIDMFFATVGFALGVFVLV

SEQ ID NO: 163851 - protein, 23 aa, Mycobacterium bovis
TGSTGTTVLPFNGLYQPQGLAVD

SEQ ID NO: 163852 - protein, 37 aa, Mycobacterium bovis
TGTAMGLVFVWFSMTPSLLPRGPLFQGLVSGICGAFG

SEQ ID NO: 163853 - protein, 28 aa, Mycobacterium bovis
TGTTIKLGIVWLVLSVFTVMIIVVFGQV

SEQ ID NO: 163854 - protein, 25 aa, Mycobacterium bovis
TGVTIFTGYPFLRGALRSLRSGKAG

SEQ ID NO: 163855 - protein, 22 aa, Mycobacterium bovis
TGVTVLYLAYLRRQTRIEEKVR

SEQ ID NO: 163856 - protein, 18 aa, Mycobacterium bovis
THGSAAQRQKWFTVGYQT

SEQ ID NO: 163857 - protein, 29 aa, Mycobacterium bovis
THINTYSMDLFLRIAPELYLKRLCVGGVE

SEQ ID NO: 163858 - protein, 28 aa, Mycobacterium bovis
THRMDPVNLLPFMFLGTTFGARLLGIAY

SEQ ID NO: 163859 - protein, 24 aa, Mycobacterium bovis
TIAHFTFGLALLAGLYVAASPWIV

SEQ ID NO: 163860 - protein, 32 aa, Mycobacterium bovis
TIGILIAVFGMRLVFPLAIIWTTAGLDPVRAM

SEQ ID NO: 163861 - protein, 18 aa, Mycobacterium bovis
TILAILALTAGTGVFVAA

SEQ ID NO: 163862 - protein, 32 aa, Mycobacterium bovis
TILDLVVVFLVTWPLVYLASKSSLLAKPAYNG

SEQ ID NO: 163863 - protein, 23 aa, Mycobacterium bovis
TINASSVALIWFGGLRIDSGQMQ

SEQ ID NO: 163864 - protein, 17 aa, Mycobacterium bovis
TIPAIPYEQLEELDDEG

SEQ ID NO: 163865 - protein, 17 aa, Mycobacterium bovis
TIPFLPSYIPQDVDMTA

SEQ ID NO: 163866 - protein, 17 aa, Mycobacterium bovis
TIPIIVFVLIFQRRIVA

SEQ ID NO: 163867 - protein, 25 aa, Mycobacterium bovis
TIYQNLGWAFGYNTAAIPLAALGAL

SEQ ID NO: 163868 - protein, 22 aa, Mycobacterium bovis
TKQILIYTWLTVAATLVLALAT

SEQ ID NO: 163869 - protein, 18 aa, Mycobacterium bovis
TLALIALAIITRLRHPLP

SEQ ID NO: 163870 - protein, 25 aa, Mycobacterium bovis
TLAQLAPFVLLVELSRLLVSGAGAH

SEQ ID NO: 163871 - protein, 26 aa, Mycobacterium bovis
TLAVIFAIAALLLRSPLAGLVVVGTI

SEQ ID NO: 163872 - protein, 21 aa, Mycobacterium bovis
TLAVVFLAGWRWFPRDVQTAG

SEQ ID NO: 163873 - protein, 20 aa, Mycobacterium bovis
TLDVDLLMVVAAIGAAAIGQ

SEQ ID NO: 163874 - protein, 26 aa, Mycobacterium bovis
TLGSTMGILTWIFVDGHFSKWLNFTP

SEQ ID NO: 163875 - protein, 23 aa, Mycobacterium bovis
TLPLIPIFMVLIGLATTNPSAAA

SEQ ID NO: 163876 - protein, 35 aa, Mycobacterium bovis
TLPQTPMPAFPPYVPTLLPPPPPPQPATLINIADT

SEQ ID NO: 163877 - protein, 21 aa, Mycobacterium bovis
TLRYFPDLVVVLALLAAVALQ

SEQ ID NO: 163878 - protein, 20 aa, Mycobacterium bovis
TLTLALPRPTVVTGLRLAAS

SEQ ID NO: 163879 - protein, 22 aa, Mycobacterium bovis
TLTVISFFWLWCATNLLAGVLA

SEQ ID NO: 163880 - protein, 27 aa, Mycobacterium bovis
TLVLIAAFLAVWWIYETYRPQAPGPGD

SEQ ID NO: 163881 - protein, 22 aa, Mycobacterium bovis
TLVLTIPLAWLLHRFTRVQGDR

SEQ ID NO: 163882 - protein, 25 aa, Mycobacterium bovis
TLWGRNIGQFQLIQLKLAKMEVARI

SEQ ID NO: 163883 - protein, 27 aa, Mycobacterium bovis
TLYGLINNAFIPRFLFAVSFCGVLVAT

SEQ ID NO: 163884 - protein, 19 aa, Mycobacterium bovis
TMFGPWGIIIGPVLMILIV

SEQ ID NO: 163885 - protein, 20 aa, Mycobacterium bovis
TMFLSQLPYVPLGTLRDVVC

SEQ ID NO: 163886 - protein, 23 aa, Mycobacterium bovis
TMGLWPPRLWAGLRLGWAAGAAA

SEQ ID NO: 163887 - protein, 24 aa, Mycobacterium bovis
TMHGTIMLLFYATPIVFGFANLVL

SEQ ID NO: 163888 - protein, 26 aa, Mycobacterium bovis
TMRTIRMNMIWAFGYNVAAIPIAAAG

SEQ ID NO: 163889 - protein, 21 aa, Mycobacterium bovis
TMVAVLAMMVSISGLLALITL

SEQ ID NO: 163890 - protein, 21 aa, Mycobacterium bovis
TPEAPFGWYYDLLALWAHVST

SEQ ID NO: 163891 - protein, 20 aa, Mycobacterium bovis
TPHPRLPRLIPGGDYVMAGG

SEQ ID NO: 163892 - protein, 30 aa, Mycobacterium bovis
TPILAVAMPWLFLRLRFCRRKWTVTTLAAT

SEQ ID NO: 163893 - protein, 23 aa, Mycobacterium bovis
TPPLGPAWVALLIVGASSGVAVG

SEQ ID NO: 163894 - protein, 25 aa, Mycobacterium bovis
TPPTLAPIGGILSHVPFKAGEVTLL

SEQ ID NO: 163895 - protein, 21 aa, Mycobacterium bovis
TPRGFARLFGGQRPALQGQHL

SEQ ID NO: 163896 - protein, 20 aa, Mycobacterium bovis
TPRSPWLRTGDLGFIVGDEF

SEQ ID NO: 163897 - protein, 30 aa, Mycobacterium bovis
TPSIAALLGRWFWWPLRVRPRPASQMLRPF

SEQ ID NO: 163898 - protein, 25 aa, Mycobacterium bovis
TPSVTGLMILPFSAAVAIVSPLVGH

SEQ ID NO: 163899 - protein, 17 aa, Mycobacterium bovis
TPTLSRVANLELYLIFP

SEQ ID NO: 163900 - protein, 18 aa, Mycobacterium bovis
TPTPGAAQLPLAPAINYP

SEQ ID NO: 163901 - protein, 23 aa, Mycobacterium bovis
TQATFLRWVWYAARREGLHLDEA

SEQ ID NO: 163902 - protein, 17 aa, Mycobacterium bovis
TQPALDLDALLGGLRPV

SEQ ID NO: 163903 - protein, 24 aa, Mycobacterium bovis
TQPAPVVAAWLAVLLAVSVPAGPR

SEQ ID NO: 163904 - protein, 19 aa, Mycobacterium bovis
TQTVLPFTGLNDPDGVAVD

SEQ ID NO: 163905 - protein, 17 aa, Mycobacterium bovis
TQYTRHVEWFFAESWAR

SEQ ID NO: 163906 - protein, 24 aa, Mycobacterium bovis
TQYVAAHGPYLAWLEQTAINSAVT

SEQ ID NO: 163907 - protein, 29 aa, Mycobacterium bovis
TRAGFLMLLWVFIWSVLRILKTDIYAPTG

SEQ ID NO: 163908 - protein, 25 aa, Mycobacterium bovis
TRDRLPLPNRLLATAPLVALGAMAY

SEQ ID NO: 163909 - protein, 24 aa, Mycobacterium bovis
TRGGLGGWIPTSFGGSSNAPGSSP

SEQ ID NO: 163910 - protein, 21 aa, Mycobacterium bovis
TRGGYLKDIKGFDSEFFAVAK

SEQ ID NO: 163911 - protein, 28 aa, Mycobacterium bovis
TRHQVTGWRFVMRRIAAGIALHDTRMLV

SEQ ID NO: 163912 - protein, 30 aa, Mycobacterium bovis
TRLTPATRWGPILQWILVGAAAAVVLVAMR

SEQ ID NO: 163913 - protein, 27 aa, Mycobacterium bovis
TRNPEVWAWMVWLPHNLHDELFDACGW

SEQ ID NO: 163914 - protein, 26 aa, Mycobacterium bovis
TRPVRAVSWLVAAFSALGLLNLSRAG

SEQ ID NO: 163915 - protein, 31 aa, Mycobacterium bovis
TRQLSPYMLMMPLMMIVMMVGGLAGSTGGGG

SEQ ID NO: 163916 - protein, 23 aa, Mycobacterium bovis
TRQPIPPWEQAAHLLDYGFNTPA

SEQ ID NO: 163917 - protein, 18 aa, Mycobacterium bovis
TRRHSPLVIATALGSAGV

SEQ ID NO: 163918 - protein, 22 aa, Mycobacterium bovis
TRSRLPGLLPPLDDVKNFVGIQ

SEQ ID NO: 163919 - protein, 20 aa, Mycobacterium bovis
TRYYAAQRTFWVDPVSGTIV

SEQ ID NO: 163920 - protein, 24 aa, Mycobacterium bovis
TSAFWAFGVFYLVASVLTWAIYVR

SEQ ID NO: 163921 - protein, 51 aa, Mycobacterium bovis
TSAMPPPGKKFTWHWWWLGAAALGVLLVVMVALVVFGLRRRRRGYDAAAYD

SEQ ID NO: 163922 - protein, 19 aa, Mycobacterium bovis
TSFQWNWKFGYQRVNFKDG

SEQ ID NO: 163923 - protein, 27 aa, Mycobacterium bovis
TSFREIRWNLRVIVMFSIGLVIATAVA

SEQ ID NO: 163924 - protein, 28 aa, Mycobacterium bovis
TSFSNKPLVFIFYLGAAIFIISSSAAGY

SEQ ID NO: 163925 - protein, 33 aa, Mycobacterium bovis
TSIDKIVYWSQYQAQVLFTMQVTPAAGGPPRGQ

SEQ ID NO: 163926 - protein, 22 aa, Mycobacterium bovis
TSMVLYILCWWWHLKPDVDETM

SEQ ID NO: 163927 - protein, 30 aa, Mycobacterium bovis
TSPSPPPIPPIPPIPEIPQLPPGIPQVPGI

SEQ ID NO: 163928 - protein, 24 aa, Mycobacterium bovis
TSTFVFIGAVVYIILAPKGREAPG

SEQ ID NO: 163929 - protein, 37 aa, Mycobacterium bovis
TSVTRVHWPTFVLAMSVLALLTMLTRWAPRAPGPIIA

SEQ ID NO: 163930 - protein, 23 aa, Mycobacterium bovis
TTAGWLAVVLALAVAATPILAVA

SEQ ID NO: 163931 - protein, 17 aa, Mycobacterium bovis
TTALLLHIGVMLAFLIL

SEQ ID NO: 163932 - protein, 25 aa, Mycobacterium bovis
TTASIRYLNLIGDRYLELGRGHSGQ

SEQ ID NO: 163933 - protein, 19 aa, Mycobacterium bovis
TTDFVAFLDSDVTPRRGWL

SEQ ID NO: 163934 - protein, 17 aa, Mycobacterium bovis
TTDPANLAPLLSGLQVS

SEQ ID NO: 163935 - protein, 23 aa, Mycobacterium bovis
TTLLSFRLQPTLSVLLVAAGAFG

SEQ ID NO: 163936 - protein, 24 aa, Mycobacterium bovis
TTMGLLLLVPPIRALARPGLTAIA

SEQ ID NO: 163937 - protein, 22 aa, Mycobacterium bovis
TTSTVLPFTGLNTPLAVAVDSD

SEQ ID NO: 163938 - protein, 17 aa, Mycobacterium bovis
TTVFFSPGNEQAAATVA

SEQ ID NO: 163939 - protein, 21 aa, Mycobacterium bovis
TVAASLLAGLLAHVADRLLGL

SEQ ID NO: 163940 - protein, 24 aa, Mycobacterium bovis
TVAITFLGMVFTQLGILKTVGPML

SEQ ID NO: 163941 - protein, 27 aa, Mycobacterium bovis
TVAPTTLAILMLLPLSAFEATVALPAA

SEQ ID NO: 163942 - protein, 23 aa, Mycobacterium bovis
TVATIMFLVLLAVTYYQVRVMDR

SEQ ID NO: 163943 - protein, 32 aa, Mycobacterium bovis
TVAVIFIMLLLVYRSIITVVLLLITVGVELTA

SEQ ID NO: 163944 - protein, 26 aa, Mycobacterium bovis
TVFSALYLPLLAILFGMILRAVAIEW

SEQ ID NO: 163945 - protein, 29 aa, Mycobacterium bovis
TVGAGWFGLFGLAFWVALAGLTPSGLLLA

SEQ ID NO: 163946 - protein, 19 aa, Mycobacterium bovis
TVGLLLLVATALVACTYTA

SEQ ID NO: 163947 - protein, 26 aa, Mycobacterium bovis
TVGTFVAFWACLTLLARPACDLAGML

SEQ ID NO: 163948 - protein, 44 aa, Mycobacterium bovis
TVLAVIAVVVLGWYFLRIPSLVGIGRYTLYAELPRSGGLYRTAN

SEQ ID NO: 163949 - protein, 21 aa, Mycobacterium bovis
TVLAYRWGGNLRALLLAAAVM

SEQ ID NO: 163950 - protein, 28 aa, Mycobacterium bovis
TVLILGWRSARWWRRGASLLAVPLCLLS

SEQ ID NO: 163951 - protein, 17 aa, Mycobacterium bovis
TVLLIAPVTLLVCDRLN

SEQ ID NO: 163952 - protein, 28 aa, Mycobacterium bovis
TVLLTHPGLPLWPYLVCAALTGLGGGNF

SEQ ID NO: 163953 - protein, 19 aa, Mycobacterium bovis
TVLLVPLMAALFGEAPQRA

SEQ ID NO: 163954 - protein, 25 aa, Mycobacterium bovis
TVMATPAMFIEFSRQRALSADGRCK

SEQ ID NO: 163955 - protein, 31 aa, Mycobacterium bovis
TVPGRYTYLKWWKFVLVVLGVWIGAGEVGLS

SEQ ID NO: 163956 - protein, 17 aa, Mycobacterium bovis
TVRGWLRRFAERAEAVR

SEQ ID NO: 163957 - protein, 24 aa, Mycobacterium bovis
TVRQFNDLLRVLPPLPQEMPQQTG

SEQ ID NO: 163958 - protein, 33 aa, Mycobacterium bovis
TVSMGIILLGLLWYAGLPLRVFLSSLAAVVVSA

SEQ ID NO: 163959 - protein, 28 aa, Mycobacterium bovis
TVSSLLFMFVWAMIIISYLVYRRRHPQR

SEQ ID NO: 163960 - protein, 17 aa, Mycobacterium bovis
TVVHLRLSLLPVLIGLM

SEQ ID NO: 163961 - protein, 25 aa, Mycobacterium bovis
TVVYEPLLGRLPADTPMYGFERVEG

SEQ ID NO: 163962 - protein, 18 aa, Mycobacterium bovis
TWRYWRTVTGVVVAGAVL

SEQ ID NO: 163963 - protein, 23 aa, Mycobacterium bovis
TYEHYFRTFLRPEDVGWSVVEVV

SEQ ID NO: 163964 - protein, 26 aa, Mycobacterium bovis
TYGDFQNFYLCDLQIKWNGFQAGGPV

SEQ ID NO: 163965 - protein, 25 aa, Mycobacterium bovis
TYRDPLLVMLVIAPVIWTTGVALLT

SEQ ID NO: 163966 - protein, 24 aa, Mycobacterium bovis
VAAAWTFLKILGPILRGIADAAVS

SEQ ID NO: 163967 - protein, 18 aa, Mycobacterium bovis
VAALLLAAGVLLWLFVRH

SEQ ID NO: 163968 - protein, 24 aa, Mycobacterium bovis
VAALRAGVAQRRRARRSLAAVGSV

SEQ ID NO: 163969 - protein, 18 aa, Mycobacterium bovis
VAAPILLILCRLVQGFAT

SEQ ID NO: 163970 - protein, 25 aa, Mycobacterium bovis
VAAVYVVFRWFFARDLRVVPDRQQL

SEQ ID NO: 163971 - protein, 30 aa, Mycobacterium bovis
VADFDDFWRPIRSYFYWEKHCYGIPICWSF

SEQ ID NO: 163972 - protein, 23 aa, Mycobacterium bovis
VADGLITFFALVIVTSLSMVFGE

SEQ ID NO: 163973 - protein, 38 aa, Mycobacterium bovis
VADRLKFGAWLLFAGLWATFVYFPVAHWVFAFDGFAAE

SEQ ID NO: 163974 - protein, 18 aa, Mycobacterium bovis
VADRRRTWLVLRMNPQRN

SEQ ID NO: 163975 - protein, 24 aa, Mycobacterium bovis
VAELWALLRIYQYQRLFEAVRLTD

SEQ ID NO: 163976 - protein, 17 aa, Mycobacterium bovis
VAEMRKVIWPNRKQMLT

SEQ ID NO: 163977 - protein, 23 aa, Mycobacterium bovis
VAERHRGVRYRAFDLVEAGPDRI

SEQ ID NO: 163978 - protein, 24 aa, Mycobacterium bovis
VAETLVMMTLFLTGLIVAIVTGNF

SEQ ID NO: 163979 - protein, 18 aa, Mycobacterium bovis
VAFARILLTKPKAVFLDE

SEQ ID NO: 163980 - protein, 19 aa, Mycobacterium bovis
VAFLDSDVTPRRGWLESLL

SEQ ID NO: 163981 - protein, 23 aa, Mycobacterium bovis
VAFRPVRLFFINVGLAAVAMLVA

SEQ ID NO: 163982 - protein, 27 aa, Mycobacterium bovis
VAGCAYLLRRLFRGPRAPYLRTMFVVL

SEQ ID NO: 163983 - protein, 24 aa, Mycobacterium bovis
VAGFVFSWLRRRSGSLIAPIALHW

SEQ ID NO: 163984 - protein, 25 aa, Mycobacterium bovis
VAGLVALYILMQLARQRRMLRFANM

SEQ ID NO: 163985 - protein, 24 aa, Mycobacterium bovis
VAGSVLFGLWHIATSLGLTSSNVG

SEQ ID NO: 163986 - protein, 26 aa, Mycobacterium bovis
VAKVPLPRWYWIGLAVGILVGVAFVH

SEQ ID NO: 163987 - protein, 25 aa, Mycobacterium bovis
VALTCAMFLIRDDPRYLWAGLVLLA

SEQ ID NO: 163988 - protein, 33 aa, Mycobacterium bovis
VALVAVVVMVAGVILWCFFGDALSNRSHTAAAR

SEQ ID NO: 163989 - protein, 22 aa, Mycobacterium bovis
VALWALFWLGWATVLTSTFMIN

SEQ ID NO: 163990 - protein, 22 aa, Mycobacterium bovis
VARLNAHFGPLLQTLPALGQMA

SEQ ID NO: 163991 - protein, 24 aa, Mycobacterium bovis
VASFLNIDVPLQALSRLPLLSIDG

SEQ ID NO: 163992 - protein, 24 aa, Mycobacterium bovis
VASGLSPELLPSLLAAVHRRRRRT

SEQ ID NO: 163993 - protein, 28 aa, Mycobacterium bovis
VASLAALLLLFVSAYALPPLLPYSYDDL

SEQ ID NO: 163994 - protein, 23 aa, Mycobacterium bovis
VASYSWYYAWTPGTGYLANLLPY

SEQ ID NO: 163995 - protein, 18 aa, Mycobacterium bovis
VATLIAFVLGLTAVAWLL

SEQ ID NO: 163996 - protein, 18 aa, Mycobacterium bovis
VAVTFLAMVFTKLEVFSA

SEQ ID NO: 163997 - protein, 18 aa, Mycobacterium bovis
VAVVAVLAVLTVVVTIAI

SEQ ID NO: 163998 - protein, 23 aa, Mycobacterium bovis
VAVWTTLWMLVGLAVHDAISIIG

SEQ ID NO: 163999 - protein, 18 aa, Mycobacterium bovis
VCFLLIITIPFGFAALRI

SEQ ID NO: 164000 - protein, 18 aa, Mycobacterium bovis
VCMIWRLFMQDSVTRPTT

SEQ ID NO: 164001 - protein, 26 aa, Mycobacterium bovis
VDARLVTMVPAGWSLVEAAAVPVAFL

SEQ ID NO: 164002 - protein, 26 aa, Mycobacterium bovis
VDFATDPPPPALPYFDVDNPGPSDPT

SEQ ID NO: 164003 - protein, 21 aa, Mycobacterium bovis
VDGQMFLEMRLVEGTDLDSVL

SEQ ID NO: 164004 - protein, 17 aa, Mycobacterium bovis
VDGRIESLLPAILEGRQ

SEQ ID NO: 164005 - protein, 22 aa, Mycobacterium bovis
VDLAAMLRRQGPLAPPRAVAIV

SEQ ID NO: 164006 - protein, 28 aa, Mycobacterium bovis
VDQWGWRSIFYVNLPMGALVLFLTLCYV

SEQ ID NO: 164007 - protein, 25 aa, Mycobacterium bovis
VDSMGWEWIFFVNVPVGVIGLILAA

SEQ ID NO: 164008 - protein, 25 aa, Mycobacterium bovis
VDVALYALLVMMLLSALFTDGAGPI

SEQ ID NO: 164009 - protein, 27 aa, Mycobacterium bovis
VDVNHGGYWFTFFVALGGAVVLLWIVG

SEQ ID NO: 164010 - protein, 25 aa, Mycobacterium bovis
VDVVYQFIPVLKANGYRLVTVSELL

SEQ ID NO: 164011 - protein, 18 aa, Mycobacterium bovis
VDWFGIVVLAVWGALAAL

SEQ ID NO: 164012 - protein, 34 aa, Mycobacterium bovis
VEIAPGITIPIGPPTTITLAPPPPAPPAATPTPP

SEQ ID NO: 164013 - protein, 19 aa, Mycobacterium bovis
VEKWAKVRGDKLAYRFLDF

SEQ ID NO: 164014 - protein, 28 aa, Mycobacterium bovis
VELPTYAFARQRFWLDGLGAVGGDLGGV

SEQ ID NO: 164015 - protein, 18 aa, Mycobacterium bovis
VEMAIFMLTVFVAYAYVW

SEQ ID NO: 164016 - protein, 17 aa, Mycobacterium bovis
VEPGPDRRPITAVALVA

SEQ ID NO: 164017 - protein, 17 aa, Mycobacterium bovis
VEPTILLAVFALSIPAG

SEQ ID NO: 164018 - protein, 25 aa, Mycobacterium bovis
VEYWKKGLRHSVYFTHGIRNAVDSG

SEQ ID NO: 164019 - protein, 24 aa, Mycobacterium bovis
VFALMPFWRMFFNTVLYAGCVTAG

SEQ ID NO: 164020 - protein, 18 aa, Mycobacterium bovis
VFDMLKRYHAGVEQLLVF

SEQ ID NO: 164021 - protein, 21 aa, Mycobacterium bovis
VFGAFAHRWLARRTRRRINPG

SEQ ID NO: 164022 - protein, 18 aa, Mycobacterium bovis
VFGGLWLALGYLLASLVC

SEQ ID NO: 164023 - protein, 18 aa, Mycobacterium bovis
VFLLYFLLRRDGRAALTA

SEQ ID NO: 164024 - protein, 18 aa, Mycobacterium bovis
VFLVAIPVSIALLWSLRF

SEQ ID NO: 164025 - protein, 19 aa, Mycobacterium bovis
VFSWTLAAVLTIGTITAAT

SEQ ID NO: 164026 - protein, 25 aa, Mycobacterium bovis
VFVAFQLMFAIITVALISGAVADRL

SEQ ID NO: 164027 - protein, 26 aa, Mycobacterium bovis
VFVMEWLAILRDLILGLLIAGAIAAW

SEQ ID NO: 164028 - protein, 17 aa, Mycobacterium bovis
VGAALWPSAAAGLAGVL

SEQ ID NO: 164029 - protein, 24 aa, Mycobacterium bovis
VGAEVPLLMTLLQRGRVAGAADAG

SEQ ID NO: 164030 - protein, 19 aa, Mycobacterium bovis
VGAEWLFTPVLLSQNYHLV

SEQ ID NO: 164031 - protein, 26 aa, Mycobacterium bovis
VGALGILVMVVWVGTALTISTTASRS

SEQ ID NO: 164032 - protein, 24 aa, Mycobacterium bovis
VGASRWYTQLPFLVEAMLAATMGV

SEQ ID NO: 164033 - protein, 47 aa, Mycobacterium bovis
VGAVNPWQWLLALLQQLWNAYTGFYGWMLQLIWQFLQDPIGNSIKII

SEQ ID NO: 164034 - protein, 18 aa, Mycobacterium bovis
VGDNFVWAYQRSEALADD

SEQ ID NO: 164035 - protein, 18 aa, Mycobacterium bovis
VGGFFRMCVLTGKALFRW

SEQ ID NO: 164036 - protein, 18 aa, Mycobacterium bovis
VGGLTFFPALALGPIVEQ

SEQ ID NO: 164037 - protein, 19 aa, Mycobacterium bovis
VGGLWAWIAPPIHAVVAIT

SEQ ID NO: 164038 - protein, 17 aa, Mycobacterium bovis
VGGLWPLLMEQFSVRPN

SEQ ID NO: 164039 - protein, 19 aa, Mycobacterium bovis
VGIGWLWRHGRFRRLARLG

SEQ ID NO: 164040 - protein, 25 aa, Mycobacterium bovis
VGLASYLLIGFWYHKPSAATAAKKA

SEQ ID NO: 164041 - protein, 20 aa, Mycobacterium bovis
VGLFVMFSRMQGGARMGFGF

SEQ ID NO: 164042 - protein, 25 aa, Mycobacterium bovis
VGLGAFDLGVLTRPSPPPTVAEQVL

SEQ ID NO: 164043 - protein, 22 aa, Mycobacterium bovis
VGLLGAALQRLPGRCWPVAATA

SEQ ID NO: 164044 - protein, 42 aa, Mycobacterium bovis
VGMGLLLDALVIRGFVLPALMVLLGRWLWWPRRSVSNRQVPE

SEQ ID NO: 164045 - protein, 25 aa, Mycobacterium bovis
VGPTIAWYQDFLRYYFLTVESNVEG

SEQ ID NO: 164046 - protein, 17 aa, Mycobacterium bovis
VGRWVAVVAVLAVLTVV

SEQ ID NO: 164047 - protein, 30 aa, Mycobacterium bovis
VGSLLRLSVLALIMLPILAAVTLCARVPEA

SEQ ID NO: 164048 - protein, 22 aa, Mycobacterium bovis
VGTAVVRWPGPILATSVALALV

SEQ ID NO: 164049 - protein, 33 aa, Mycobacterium bovis
VGTDGIPMLMLKGAPETILPRCRLADPGVDHEH

SEQ ID NO: 164050 - protein, 31 aa, Mycobacterium bovis
VGTVLGHRYRVGPPVLLILSGSLLGLIPRFG

SEQ ID NO: 164051 - protein, 17 aa, Mycobacterium bovis
VGTVLLVPLMAALFGEA

SEQ ID NO: 164052 - protein, 24 aa, Mycobacterium bovis
VGVAFVHWLIFQSLYRIGALCPYC

SEQ ID NO: 164053 - protein, 29 aa, Mycobacterium bovis
VGVGIGAAILLGWFTLAHRHPDQPGAAAT

SEQ ID NO: 164054 - protein, 20 aa, Mycobacterium bovis
VGVLVYLFVVDWRVALVLFG

SEQ ID NO: 164055 - protein, 33 aa, Mycobacterium bovis
VHELSTPEFPWSALTIVLLIGVLAAAVGARLMQ

SEQ ID NO: 164056 - protein, 23 aa, Mycobacterium bovis
VHKPVKQLFWYRSSKFVMRRWLP

SEQ ID NO: 164057 - protein, 32 aa, Mycobacterium bovis
VHKVGPVIRLPLVLGLAQLLSRVPLPGSAPRP

SEQ ID NO: 164058 - protein, 23 aa, Mycobacterium bovis
VHRRRRRTRLITWVASSAAAAVL

SEQ ID NO: 164059 - protein, 22 aa, Mycobacterium bovis
VHSIDYIRPQLFTNSFTPLEVS

SEQ ID NO: 164060 - protein, 22 aa, Mycobacterium bovis
VIALAFFIPLLIGTGGNTGTQI

SEQ ID NO: 164061 - protein, 26 aa, Mycobacterium bovis
VIAVMLLFVYRSVVTMVLVLITVLIE

SEQ ID NO: 164062 - protein, 29 aa, Mycobacterium bovis
VIDITIIFIGYILGLMLWATALTQFDEAL

SEQ ID NO: 164063 - protein, 24 aa, Mycobacterium bovis
VIFATFTFIFFALEGSIMAQGLKL

SEQ ID NO: 164064 - protein, 24 aa, Mycobacterium bovis
VIGKARLIVWPPSRWGVVRSVNPQ

SEQ ID NO: 164065 - protein, 25 aa, Mycobacterium bovis
VIGNLFGVVPLLGGPLLGALAAAVV

SEQ ID NO: 164066 - protein, 21 aa, Mycobacterium bovis
VIGSLVVVLALAAGIVGVRLY

SEQ ID NO: 164067 - protein, 22 aa, Mycobacterium bovis
VIGTFVVPPILKVLRERDAMVA

SEQ ID NO: 164068 - protein, 18 aa, Mycobacterium bovis
VIGWPFVGLLALGLVYVA

SEQ ID NO: 164069 - protein, 18 aa, Mycobacterium bovis
VIILFLAGAVVNLKLLMP

SEQ ID NO: 164070 - protein, 39 aa, Mycobacterium bovis
VILTSPEAFIRKPARWMQLLAKHQAPFSAAPNFAFDLAV

SEQ ID NO: 164071 - protein, 18 aa, Mycobacterium bovis
VINAPARLDLLTQQYVEL

SEQ ID NO: 164072 - protein, 28 aa, Mycobacterium bovis
VISFIIGRPLIWLSFRNEKLNAAFRYAL

SEQ ID NO: 164073 - protein, 24 aa, Mycobacterium bovis
VISGGALMAWILMSIGTGLGRLAS

SEQ ID NO: 164074 - protein, 33 aa, Mycobacterium bovis
VIWGIWLVIVGWLTLWPFLSWLTTHFVVTNRRV

SEQ ID NO: 164075 - protein, 32 aa, Mycobacterium bovis
VKMTTEWLHVPFLPVPIPVPIPQNPGAGEPQN

SEQ ID NO: 164076 - protein, 18 aa, Mycobacterium bovis
VKVIQKLSGLSINRFIAI

SEQ ID NO: 164077 - protein, 28 aa, Mycobacterium bovis
VLAAIGVLWWFMVVQLPFAGIVFAVDGV

SEQ ID NO: 164078 - protein, 22 aa, Mycobacterium bovis
VLAEAFLPRRWRYGAQVTLALG

SEQ ID NO: 164079 - protein, 33 aa, Mycobacterium bovis
VLAGAYPMYLDAYPLPQYAIYGAVPLRTIKQAL

SEQ ID NO: 164080 - protein, 19 aa, Mycobacterium bovis
VLALRALVLPWLLARAVGA

SEQ ID NO: 164081 - protein, 45 aa, Mycobacterium bovis
VLALVALQLYDFLWYPYYASYGLLLLPFFTPTLSALTALSALIHL

SEQ ID NO: 164082 - protein, 17 aa, Mycobacterium bovis
VLARWQSSWLRYAPLSF

SEQ ID NO: 164083 - protein, 25 aa, Mycobacterium bovis
VLAYACAIGLRRLGKDVRFVGLIDA

SEQ ID NO: 164084 - protein, 23 aa, Mycobacterium bovis
VLDTFLVRTVTVPALTTMIGRAN

SEQ ID NO: 164085 - protein, 27 aa, Mycobacterium bovis
VLFAIPCFLLLLILEWTAARKLESIET

SEQ ID NO: 164086 - protein, 18 aa, Mycobacterium bovis
VLFRLFVGARLIDAAREQ

SEQ ID NO: 164087 - protein, 21 aa, Mycobacterium bovis
VLGKLPDAYRIIGRAGGIYGD

SEQ ID NO: 164088 - protein, 21 aa, Mycobacterium bovis
VLIITVMVCWLLLAVLRGRLH

SEQ ID NO: 164089 - protein, 31 aa, Mycobacterium bovis
VLIVWRRDLRAIVRLLAWQGAALAAIPLLRG

SEQ ID NO: 164090 - protein, 25 aa, Mycobacterium bovis
VLKSSYAQFIFLLSGADHDQMDRMR

SEQ ID NO: 164091 - protein, 27 aa, Mycobacterium bovis
VLLASVALLLLYWQWRTMPAVIWDVRQ

SEQ ID NO: 164092 - protein, 17 aa, Mycobacterium bovis
VLLPMLHSRFTRHIAIT

SEQ ID NO: 164093 - protein, 17 aa, Mycobacterium bovis
VLLSMAPLWFSSYILQL

SEQ ID NO: 164094 - protein, 20 aa, Mycobacterium bovis
VLPILFMVVLNIVLGNLAYV

SEQ ID NO: 164095 - protein, 29 aa, Mycobacterium bovis
VLPVLTLMVVAVWLLGVGTLKDLALVQLI

SEQ ID NO: 164096 - protein, 20 aa, Mycobacterium bovis
VLQLWGLLALVLDSLAIAAQ

SEQ ID NO: 164097 - protein, 19 aa, Mycobacterium bovis
VLRDVLINELQPGMDRSIR

SEQ ID NO: 164098 - protein, 18 aa, Mycobacterium bovis
VLSLLGMVLLMLGTGRLY

SEQ ID NO: 164099 - protein, 36 aa, Mycobacterium bovis
VLSTPLSIPPPEGKPWWLIVVGVVVVGLLGGMVAMV

SEQ ID NO: 164100 - protein, 31 aa, Mycobacterium bovis
VLTGLRLLAGLIWLYNVVWKVPPDFGERGRR

SEQ ID NO: 164101 - protein, 24 aa, Mycobacterium bovis
VLVALNFLICLAYIFFSLTQHAAA

SEQ ID NO: 164102 - protein, 22 aa, Mycobacterium bovis
VLVGLGMRTWADGRTLLLGSPS

SEQ ID NO: 164103 - protein, 31 aa, Mycobacterium bovis
VLVIAYCLGLGIPFVLLAFGSAWAVAGLGWL

SEQ ID NO: 164104 - protein, 26 aa, Mycobacterium bovis
VLVVMIALIGLLPWLLGSVTAEPDRV

SEQ ID NO: 164105 - protein, 30 aa, Mycobacterium bovis
VLWLVPLAGAVLIILLPPGRRRLAKWAGMV

SEQ ID NO: 164106 - protein, 25 aa, Mycobacterium bovis
VMAGFTGLPRRASTVALVALVAAQL

SEQ ID NO: 164107 - protein, 18 aa, Mycobacterium bovis
VMHFAFIAYVLAGGFLAL

SEQ ID NO: 164108 - protein, 24 aa, Mycobacterium bovis
VMIRHTSQWPLIIAGLVVGVVLGV

SEQ ID NO: 164109 - protein, 24 aa, Mycobacterium bovis
VMPGDIPFQVQLPSTPLAPPQPGS

SEQ ID NO: 164110 - protein, 24 aa, Mycobacterium bovis
VNLKLLMPVFRWQRRDNLLTEPDP

SEQ ID NO: 164111 - protein, 25 aa, Mycobacterium bovis
VNLTALSLIALLVGIFLIYNTVTFN

SEQ ID NO: 164112 - protein, 34 aa, Mycobacterium bovis
VNQGSILGELLVYVLPLLLLVGLFVMFSRMQGGA

SEQ ID NO: 164113 - protein, 23 aa, Mycobacterium bovis
VNWIGTVGFAVAAVFWACRFVME

SEQ ID NO: 164114 - protein, 18 aa, Mycobacterium bovis
VNWLIPVVQIGAAVAALG

SEQ ID NO: 164115 - protein, 56 aa, Mycobacterium bovis
VNYVYGGLRRPWRPRTFLRAISQTLRLSYMALFSVPVVAPLLLRVALSSAAVRRNM

SEQ ID NO: 164116 - protein, 30 aa, Mycobacterium bovis
VPAMATLLGRASWWPGHPWQRCAPEEGQMS

SEQ ID NO: 164117 - protein, 29 aa, Mycobacterium bovis
VPAPARLRRLWLAVLIVAPATIWLEPISS

SEQ ID NO: 164118 - protein, 22 aa, Mycobacterium bovis
VPDRQQLKPAPRLPMFVLVVVA

SEQ ID NO: 164119 - protein, 25 aa, Mycobacterium bovis
VPEMRQWLRNWVGKAVGKAPDSIDE

SEQ ID NO: 164120 - protein, 27 aa, Mycobacterium bovis
VPLEAVPAFFRWLAQFEPMHQVFLGVR

SEQ ID NO: 164121 - protein, 22 aa, Mycobacterium bovis
VPLEWNVFMIFGVLSLFVGHAC

SEQ ID NO: 164122 - protein, 25 aa, Mycobacterium bovis
VPLVSFAVLASCGVPYLVAGIKAGR

SEQ ID NO: 164123 - protein, 25 aa, Mycobacterium bovis
VPLWATMLIWLTLWVLYLSIVNVGQ

SEQ ID NO: 164124 - protein, 19 aa, Mycobacterium bovis
VPMLVRRLITLGPALAILT

SEQ ID NO: 164125 - protein, 26 aa, Mycobacterium bovis
VPSIVAALFVFSLWIATLGFQQSAFA

SEQ ID NO: 164126 - protein, 27 aa, Mycobacterium bovis
VPTTGPAVFFLLAAVWFGATAVVAVRG

SEQ ID NO: 164127 - protein, 31 aa, Mycobacterium bovis
VQIDGEVVLLLFLPAILYWESMNTSFREIRW

SEQ ID NO: 164128 - protein, 28 aa, Mycobacterium bovis
VQPFGEYLPMPWLFRHLSGYADRAGHFV

SEQ ID NO: 164129 - protein, 24 aa, Mycobacterium bovis
VQSMFIGPVFNPLLKMLGADKIAI

SEQ ID NO: 164130 - protein, 25 aa, Mycobacterium bovis
VQTVVTPAWYAPLVLSVGGIGQTGM

SEQ ID NO: 164131 - protein, 18 aa, Mycobacterium bovis
VQVIVHLVLLILFSALAG

SEQ ID NO: 164132 - protein, 20 aa, Mycobacterium bovis
VQVSGWRFLLRRLEHAIVRR

SEQ ID NO: 164133 - protein, 24 aa, Mycobacterium bovis
VRASWPWALVVFLVVVFVAPLCEE

SEQ ID NO: 164134 - protein, 30 aa, Mycobacterium bovis
VRCNTQRRWLLYALVLMLSILVSINLALLV

SEQ ID NO: 164135 - protein, 18 aa, Mycobacterium bovis
VRCTVLVTVLAIAAAVAG

SEQ ID NO: 164136 - protein, 33 aa, Mycobacterium bovis
VRDVLFGGKVSYLALGILVAIALVIGGIGGVIG

SEQ ID NO: 164137 - protein, 18 aa, Mycobacterium bovis
VRELIEITLVKNPAMRYR

SEQ ID NO: 164138 - protein, 17 aa, Mycobacterium bovis
VRHGFWRVLGIRLLTVL

SEQ ID NO: 164139 - protein, 20 aa, Mycobacterium bovis
VRIKLWLQYVIAGTPRMPDE

SEQ ID NO: 164140 - protein, 28 aa, Mycobacterium bovis
VRMVVVPAFMHVTGRWNWWAPRPLAWLH

SEQ ID NO: 164141 - protein, 26 aa, Mycobacterium bovis
VRQRFFALFLYVVMLVFLVATAPVMV

SEQ ID NO: 164142 - protein, 25 aa, Mycobacterium bovis
VRSAGFGYPFLAYHVAGRGHGAGAV

SEQ ID NO: 164143 - protein, 28 aa, Mycobacterium bovis
VSAFLGANFMLLPRWLLGSGDEGASAIV

SEQ ID NO: 164144 - protein, 31 aa, Mycobacterium bovis
VSFGIVPGYCVLAFILGTYWLTRQTARALRW

SEQ ID NO: 164145 - protein, 33 aa, Mycobacterium bovis
VSGQPLGHWEFYMALAYFKLAIIAAGIDYRRRM

SEQ ID NO: 164146 - protein, 20 aa, Mycobacterium bovis
VSGWRLIGKCLRPLPNKWKG

SEQ ID NO: 164147 - protein, 18 aa, Mycobacterium bovis
VSIVLIYVVVVYEVIDVL

SEQ ID NO: 164148 - protein, 20 aa, Mycobacterium bovis
VSLLIVALTVWYYKLNVNPP

SEQ ID NO: 164149 - protein, 20 aa, Mycobacterium bovis
VSMIPFTIAILRYAVDVDGG

SEQ ID NO: 164150 - protein, 19 aa, Mycobacterium bovis
VSPIDFWEHPTINALAAYL

SEQ ID NO: 164151 - protein, 25 aa, Mycobacterium bovis
VSQTIVPLPWVIQAPRLFAGQIDFG

SEQ ID NO: 164152 - protein, 18 aa, Mycobacterium bovis
VSTASIWMRLPTLAMALT

SEQ ID NO: 164153 - protein, 28 aa, Mycobacterium bovis
VSVPAGPRPWQGPIAVLVAVTAGAALAA

SEQ ID NO: 164154 - protein, 24 aa, Mycobacterium bovis
VTAAILVFIFAWNDLLLALSLTAT

SEQ ID NO: 164155 - protein, 23 aa, Mycobacterium bovis
VTAAYVLITFWQYRNACVTAPGL

SEQ ID NO: 164156 - protein, 28 aa, Mycobacterium bovis
VTAGMGMLALLLFGPRLVDIYVDWLWFG

SEQ ID NO: 164157 - protein, 21 aa, Mycobacterium bovis
VTAPLVPLAVSAFLTSRKKAA

SEQ ID NO: 164158 - protein, 36 aa, Mycobacterium bovis
VTDRLPMVLGLIAAITYVLLFLLTGSVVLPAKALVC

SEQ ID NO: 164159 - protein, 23 aa, Mycobacterium bovis
VTFGVALCAGLWFIGRRVIATVG

SEQ ID NO: 164160 - protein, 27 aa, Mycobacterium bovis
VTFTVIIVMLLLVYRSIITSAIMLTMV

SEQ ID NO: 164161 - protein, 42 aa, Mycobacterium bovis
VTGNFWTLAIVFLIPQRIGLTVLAWWFDWLPHHGLEDTQRSN

SEQ ID NO: 164162 - protein, 24 aa, Mycobacterium bovis
VTHGLLWAVIAPIATRLVPPSHAG

SEQ ID NO: 164163 - protein, 21 aa, Mycobacterium bovis
VTIFVFILISNWLAVLPVQYT

SEQ ID NO: 164164 - protein, 19 aa, Mycobacterium bovis
VTLAGRRLWHRFRGQPDRA

SEQ ID NO: 164165 - protein, 17 aa, Mycobacterium bovis
VTLKRFIDRFAPFNLDP

SEQ ID NO: 164166 - protein, 37 aa, Mycobacterium bovis
VTPLTSAILLPAVIALALLPISWQLGVAALAGVPLLL

SEQ ID NO: 164167 - protein, 21 aa, Mycobacterium bovis
VTRAAILVGLFLAAVALVWLL

SEQ ID NO: 164168 - protein, 25 aa, Mycobacterium bovis
VTSILILIAFPLLTAALFGLAADRH

SEQ ID NO: 164169 - protein, 27 aa, Mycobacterium bovis
VTSVSIPSWWQPYVLSVASLTSAGQPS

SEQ ID NO: 164170 - protein, 24 aa, Mycobacterium bovis
VTTFLLAWELMAIASLILVLSEHA

SEQ ID NO: 164171 - protein, 19 aa, Mycobacterium bovis
VTTKLPPFATRTDSVLLVA

SEQ ID NO: 164172 - protein, 27 aa, Mycobacterium bovis
VTVAAVIAVLLLLRARLSVRAAAIVLL

SEQ ID NO: 164173 - protein, 17 aa, Mycobacterium bovis
VTWLANRVTRRLDLGFT

SEQ ID NO: 164174 - protein, 31 aa, Mycobacterium bovis
VVAGIVLAALLLAYRSRPFFVPDEPQRDPVA

SEQ ID NO: 164175 - protein, 25 aa, Mycobacterium bovis
VVAHRLPWRVLTLSTWATAAAWAFS

SEQ ID NO: 164176 - protein, 24 aa, Mycobacterium bovis
VVAVTPLLTPWLSKQLALGPRPDI

SEQ ID NO: 164177 - protein, 28 aa, Mycobacterium bovis
VVDWRVALVLFGPVLVYLTITSSLTIQS

SEQ ID NO: 164178 - protein, 17 aa, Mycobacterium bovis
VVFALYCGISRIGTIRL

SEQ ID NO: 164179 - protein, 19 aa, Mycobacterium bovis
VVFQHPYLFHGTIRDNVFA

SEQ ID NO: 164180 - protein, 42 aa, Mycobacterium bovis
VVGFYSTFFFFFFVAELLDTWIWRWVAFLLVFAIMVVVTAVL

SEQ ID NO: 164181 - protein, 29 aa, Mycobacterium bovis
VVGVALASLLWQLLLVSAGAFLRSRATAR

SEQ ID NO: 164182 - protein, 23 aa, Mycobacterium bovis
VVHIGVVPLWRYRVHRWEISPQA

SEQ ID NO: 164183 - protein, 26 aa, Mycobacterium bovis
VVLAFLASLLTHYLFGGLRLTTGRGM

SEQ ID NO: 164184 - protein, 19 aa, Mycobacterium bovis
VVLGLLWPHIDLPEAWQVI

SEQ ID NO: 164185 - protein, 22 aa, Mycobacterium bovis
VVLPAACICLVLFAAIVVWPQV

SEQ ID NO: 164186 - protein, 18 aa, Mycobacterium bovis
VVLPSLAFVALVLTWGKQ

SEQ ID NO: 164187 - protein, 18 aa, Mycobacterium bovis
VVLQLLESLALLRALYVI

SEQ ID NO: 164188 - protein, 25 aa, Mycobacterium bovis
VVLQSILAVAFGAGLFIAFDQLWRW

SEQ ID NO: 164189 - protein, 18 aa, Mycobacterium bovis
VVMVLGWLVLIAVLALSL

SEQ ID NO: 164190 - protein, 28 aa, Mycobacterium bovis
VVPATRFTGWQWVLSALALPVVTWAAWP

SEQ ID NO: 164191 - protein, 22 aa, Mycobacterium bovis
VVPVALAYPWQSTRDYVLLGVA

SEQ ID NO: 164192 - protein, 18 aa, Mycobacterium bovis
VVSIFLLRHVVSGRQLVT

SEQ ID NO: 164193 - protein, 18 aa, Mycobacterium bovis
VVSSPSWFSDYVLSVGAV

SEQ ID NO: 164194 - protein, 25 aa, Mycobacterium bovis
VVVAFTYLCFTVLAPWQLGKNAKTS

SEQ ID NO: 164195 - protein, 25 aa, Mycobacterium bovis
VVVRWPLPVLVATCAIALVGLLALP

SEQ ID NO: 164196 - protein, 25 aa, Mycobacterium bovis
VVWVTSAYLLAYAVPMLVAGRLGDR

SEQ ID NO: 164197 - protein, 22 aa, Mycobacterium bovis
VVYAFICLFVINVVMTAIGVRI

SEQ ID NO: 164198 - protein, 26 aa, Mycobacterium bovis
VVYNLPKMVSLLVEPWYALVGEREQV

SEQ ID NO: 164199 - protein, 28 aa, Mycobacterium bovis
VVYTGAVMMLFLFVLMLIGVDSAESLKE

SEQ ID NO: 164200 - protein, 29 aa, Mycobacterium bovis
VWAGGFTMLTMIPLGVLLGALVAFVIFGR

SEQ ID NO: 164201 - protein, 17 aa, Mycobacterium bovis
VWELPPHAGAQAGGDVL

SEQ ID NO: 164202 - protein, 30 aa, Mycobacterium bovis
VWQDILGIELYWMVLAMSVILLLAVGSDYN

SEQ ID NO: 164203 - protein, 19 aa, Mycobacterium bovis
VWSLWSVMVLFMPTSVYGF

SEQ ID NO: 164204 - protein, 26 aa, Mycobacterium bovis
VYGICGIFVFLILRALGELVLHRPSS

SEQ ID NO: 164205 - protein, 25 aa, Mycobacterium bovis
VYHPQPLVLTLLLATIAGVLSVVGT

SEQ ID NO: 164206 - protein, 27 aa, Mycobacterium bovis
WAAQEWLKSILPFGGFPWGSVAFGQAE

SEQ ID NO: 164207 - protein, 26 aa, Mycobacterium bovis
WAETTVIIRFWLLTAITCGLGVALFY

SEQ ID NO: 164208 - protein, 29 aa, Mycobacterium bovis
WAGFSVGWLYWYFWVIVVGFEAVAGGKVL

SEQ ID NO: 164209 - protein, 21 aa, Mycobacterium bovis
WAILAVVVIVLFGAKKLPDAA

SEQ ID NO: 164210 - protein, 28 aa, Mycobacterium bovis
WAKSLGAWFPLAFLLVHTVVTVPPFPRT

SEQ ID NO: 164211 - protein, 23 aa, Mycobacterium bovis
WALHRPFIPWLGWPMLAVVVASQ

SEQ ID NO: 164212 - protein, 17 aa, Mycobacterium bovis
WAMAAICFIAVAVAAAV

SEQ ID NO: 164213 - protein, 20 aa, Mycobacterium bovis
WAPVPLPEPLGSLRDKRTGL

SEQ ID NO: 164214 - protein, 25 aa, Mycobacterium bovis
WAPYHLRLDWLMWFAAISPGYALPW

SEQ ID NO: 164215 - protein, 24 aa, Mycobacterium bovis
WASPFWQTWDLLLLWLAQLHGGNG

SEQ ID NO: 164216 - protein, 36 aa, Mycobacterium bovis
WASTIDVRYRDRLLLPLPMFHVAALTTVIFSAMRGV

SEQ ID NO: 164217 - protein, 21 aa, Mycobacterium bovis
WAVLVFFAFVIWTLTTETETA

SEQ ID NO: 164218 - protein, 18 aa, Mycobacterium bovis
WCVTAIIGAFAARHGYRQ

SEQ ID NO: 164219 - protein, 21 aa, Mycobacterium bovis
WESKPWTWPMSLRPVLYAIDQ

SEQ ID NO: 164220 - protein, 25 aa, Mycobacterium bovis
WFTTSSGVLLLWSWLVMSLAQGYYS

SEQ ID NO: 164221 - protein, 18 aa, Mycobacterium bovis
WGAAWFSLSPVTLCWLLI

SEQ ID NO: 164222 - protein, 21 aa, Mycobacterium bovis
WGIIIGPVLMILIVTTIDVYL

SEQ ID NO: 164223 - protein, 25 aa, Mycobacterium bovis
WGMLQAAGLLFFAFAGYARIATLGE

SEQ ID NO: 164224 - protein, 23 aa, Mycobacterium bovis
WGRRIARLLPFVGLAGLAVTTHV

SEQ ID NO: 164225 - protein, 19 aa, Mycobacterium bovis
WGSFLPDIDAFDAEFFEIS

SEQ ID NO: 164226 - protein, 18 aa, Mycobacterium bovis
WHPVLNLASARLIAATNA

SEQ ID NO: 164227 - protein, 17 aa, Mycobacterium bovis
WILPVGLPGDLGSTQSK

SEQ ID NO: 164228 - protein, 24 aa, Mycobacterium bovis
WKTTPFMSLLLLAGLALVPEDLLR

SEQ ID NO: 164229 - protein, 26 aa, Mycobacterium bovis
WLADHAVGPVVLFPGTGFVELALRAG

SEQ ID NO: 164230 - protein, 27 aa, Mycobacterium bovis
WLLVNLPVMLLFPRGWSEFFRLNTRRG

SEQ ID NO: 164231 - protein, 18 aa, Mycobacterium bovis
WMRLPTLAMALTCWWVIS

SEQ ID NO: 164232 - protein, 20 aa, Mycobacterium bovis
WNNFMWPLVITSGHKWRVLT

SEQ ID NO: 164233 - protein, 27 aa, Mycobacterium bovis
WPALAMFAIIFFWTPPHTWALAMRYKQ

SEQ ID NO: 164234 - protein, 20 aa, Mycobacterium bovis
WPGYLFGRIRTSTLVLIAAF

SEQ ID NO: 164235 - protein, 28 aa, Mycobacterium bovis
WPQAVDAWLRLCQTYGWAPGVMGASSQG

SEQ ID NO: 164236 - protein, 19 aa, Mycobacterium bovis
WQRIVALTMIGISTALIGG

SEQ ID NO: 164237 - protein, 32 aa, Mycobacterium bovis
WRAQAASRLLAPLKLPLVLSGVLAALVTLAQL

SEQ ID NO: 164238 - protein, 19 aa, Mycobacterium bovis
WRRGLIFAMFVFAAIFTPG

SEQ ID NO: 164239 - protein, 18 aa, Mycobacterium bovis
WSAFAFSLPIPPVVLTVA

SEQ ID NO: 164240 - protein, 21 aa, Mycobacterium bovis
WSLLVGYGCLPWVATAMLTMR

SEQ ID NO: 164241 - protein, 25 aa, Mycobacterium bovis
WSTALLPLALLMLAAAVAALAVRGW

SEQ ID NO: 164242 - protein, 32 aa, Mycobacterium bovis
WTAIRTNGWYRRYLLVQVLFGSVVLGSSFHSI

SEQ ID NO: 164243 - protein, 27 aa, Mycobacterium bovis
WTDILLPIVMWALYAWSWHSNGDAVPK

SEQ ID NO: 164244 - protein, 24 aa, Mycobacterium bovis
WTHHWVWLVPLMIWLIDGPARERP

SEQ ID NO: 164245 - protein, 18 aa, Mycobacterium bovis
WVCAIYLVLLAVAGLGAA

SEQ ID NO: 164246 - protein, 19 aa, Mycobacterium bovis
WVDALLRTFIGSAVVMLPL

SEQ ID NO: 164247 - protein, 18 aa, Mycobacterium bovis
WVGQLTLIPAVALIAYTI

SEQ ID NO: 164248 - protein, 36 aa, Mycobacterium bovis
WVGTHAYWLGAQWWHPLVVVGLIALVAIMIAAANPG

SEQ ID NO: 164249 - protein, 17 aa, Mycobacterium bovis
WVPLFCSFGAMLVYPEN

SEQ ID NO: 164250 - protein, 17 aa, Mycobacterium bovis
WVQLGMLGLIGAAAAVG

SEQ ID NO: 164251 - protein, 19 aa, Mycobacterium bovis
WVRIFAVATAITIVVATDT

SEQ ID NO: 164252 - protein, 18 aa, Mycobacterium bovis
WWDIWSLGLLVLIPAVVY

SEQ ID NO: 164253 - protein, 17 aa, Mycobacterium bovis
WYAFLLLPSFVIYLISM

SEQ ID NO: 164254 - protein, 17 aa, Mycobacterium bovis
YAELPRSGGLYRTANVT

SEQ ID NO: 164255 - protein, 24 aa, Mycobacterium bovis
YAFGTFGVPLWQMAVGAFIGSAPR

SEQ ID NO: 164256 - protein, 24 aa, Mycobacterium bovis
YAGERWWVLLLSLATAAVLTVLAY

SEQ ID NO: 164257 - protein, 19 aa, Mycobacterium bovis
YALMVATIVGLSAAGGWFY

SEQ ID NO: 164258 - protein, 26 aa, Mycobacterium bovis
YAQPTSWWPLRWYPQNYRTATEQIPF

SEQ ID NO: 164259 - protein, 20 aa, Mycobacterium bovis
YAVFLISRYHEYVRLGEHPE

SEQ ID NO: 164260 - protein, 20 aa, Mycobacterium bovis
YDARWLVTRMTTITSLDLTP

SEQ ID NO: 164261 - protein, 26 aa, Mycobacterium bovis
YDDVALPPLLLVVVSAIAVGAAGGAV

SEQ ID NO: 164262 - protein, 23 aa, Mycobacterium bovis
YDHYFNTFLIPSDLLWSFMQAIA

SEQ ID NO: 164263 - protein, 17 aa, Mycobacterium bovis
YDVLPQTRWIPVVTFVQ

SEQ ID NO: 164264 - protein, 28 aa, Mycobacterium bovis
YECLAPHHFLLTEWFAPYVEFLVSKHRA

SEQ ID NO: 164265 - protein, 29 aa, Mycobacterium bovis
YFGLPTWLILFLRILFTAITFGALWLLYR

SEQ ID NO: 164266 - protein, 28 aa, Mycobacterium bovis
YFQTFLRPDDVFWSFLEALIITAIVMVS

SEQ ID NO: 164267 - protein, 19 aa, Mycobacterium bovis
YFTAFGWGVLFAESALAVL

SEQ ID NO: 164268 - protein, 20 aa, Mycobacterium bovis
YGFDLVGYYPLILTAFLLLT

SEQ ID NO: 164269 - protein, 35 aa, Mycobacterium bovis
YGIVRFDLQLLGPGPRWWGLALLAVGGTSALYGVL

SEQ ID NO: 164270 - protein, 22 aa, Mycobacterium bovis
YGKVLFAITLSAAAVLVTLAGR

SEQ ID NO: 164271 - protein, 17 aa, Mycobacterium bovis
YGLVHFIGGYPGAILGF

SEQ ID NO: 164272 - protein, 19 aa, Mycobacterium bovis
YGRMRLGDFWGYLAGWGFV

SEQ ID NO: 164273 - protein, 17 aa, Mycobacterium bovis
YGSTQPDYGAPAGWHAP

SEQ ID NO: 164274 - protein, 22 aa, Mycobacterium bovis
YHTILIDRYWWTALAVTLAITA

SEQ ID NO: 164275 - protein, 26 aa, Mycobacterium bovis
YIGQRPWTPLIGLLAQAGDLGLRVIV

SEQ ID NO: 164276 - protein, 20 aa, Mycobacterium bovis
YIIALPFFGIVSEIFPVFSR

SEQ ID NO: 164277 - protein, 17 aa, Mycobacterium bovis
YIRYCYGARLPDSMRDW

SEQ ID NO: 164278 - protein, 24 aa, Mycobacterium bovis
YISGWIPFWVTIPVNAAVTFVMFT

SEQ ID NO: 164279 - protein, 27 aa, Mycobacterium bovis
YLAALGVSIALWQHLLDRELNALVPLV

SEQ ID NO: 164280 - protein, 31 aa, Mycobacterium bovis
YLGALVGGLAWPFLLLPQLGMIRGAAVTGIV

SEQ ID NO: 164281 - protein, 17 aa, Mycobacterium bovis
YLGASLIGLVALASCAS

SEQ ID NO: 164282 - protein, 20 aa, Mycobacterium bovis
YLHKPEQLAKLARAGFRVSD

SEQ ID NO: 164283 - protein, 26 aa, Mycobacterium bovis
YLLVAVLYRWFPPITVWTGLSLLAVA

SEQ ID NO: 164284 - protein, 17 aa, Mycobacterium bovis
YLLYLTKIAVYVAAGAA

SEQ ID NO: 164285 - protein, 28 aa, Mycobacterium bovis
YLREFGNLVFHFALLGLLVAVAVGKLFG

SEQ ID NO: 164286 - protein, 18 aa, Mycobacterium bovis
YLVGLAVLLILLTGLQRR

SEQ ID NO: 164287 - protein, 22 aa, Mycobacterium bovis
YMANYYRWFGTPEAPFGWYYDL

SEQ ID NO: 164288 - protein, 18 aa, Mycobacterium bovis
YMMWTEGLARIWPPWEFY

SEQ ID NO: 164289 - protein, 18 aa, Mycobacterium bovis
YMTRVMLMTFFGEKRWTP

SEQ ID NO: 164290 - protein, 20 aa, Mycobacterium bovis
YPRTASIVIWYSRAICDTAA

SEQ ID NO: 164291 - protein, 18 aa, Mycobacterium bovis
YPSALRITIVERVPVVVK

SEQ ID NO: 164292 - protein, 27 aa, Mycobacterium bovis
YPVKASVSFGLYYPPGSALYHDTLAEL

SEQ ID NO: 164293 - protein, 37 aa, Mycobacterium bovis
YRASLAIGLALLPLLALLAFWRTGRRQLADRPTPPWR

SEQ ID NO: 164294 - protein, 17 aa, Mycobacterium bovis
YRLTKFFGKLFLINFAI

SEQ ID NO: 164295 - protein, 32 aa, Mycobacterium bovis
YRPLARNGFASLWSWFIGLVVTEFPLPTLASQ

SEQ ID NO: 164296 - protein, 26 aa, Mycobacterium bovis
YSGIITLILALILKFTIGLRLDAEQE

SEQ ID NO: 164297 - protein, 21 aa, Mycobacterium bovis
YSSIFFATPLLVTLRERTELV

SEQ ID NO: 164298 - protein, 30 aa, Mycobacterium bovis
YSTGWALWVVLAFIVFQAVAAVLALLVETG

SEQ ID NO: 164299 - protein, 18 aa, Mycobacterium bovis
YTDAPWWVTFGVAPAYAT

SEQ ID NO: 164300 - protein, 25 aa, Mycobacterium bovis
YTENLRYYYLILPTVDGSLSRRFGF

SEQ ID NO: 164301 - protein, 21 aa, Mycobacterium bovis
YTLPSLDLLISGDPPKKRSAA

SEQ ID NO: 164302 - protein, 26 aa, Mycobacterium bovis
YTPEGKLVAPLKYPSLYAGDEDGKVT

SEQ ID NO: 164303 - protein, 17 aa, Mycobacterium bovis
YVPKLIEMQGDGPYVLV

SEQ ID NO: 164304 - protein, 32 aa, Mycobacterium bovis
YVRPYGYDQTARWVPRLWRRDIKAGHFSPMSH

SEQ ID NO: 164305 - protein, 17 aa, Mycobacterium bovis
YVSLFFLAGLMAIPQDI

SEQ ID NO: 164306 - protein, 20 aa, Mycobacterium bovis
YVVICSVGIAVAFLGTVLLY

SEQ ID NO: 164307 - protein, 51 aa, Mycobacterium bovis
YYNSDMKFIVIATIVIVFLILVILLRALVAPIYLIGSVLISYLSALGIGTL

SEQ ID NO: 164308 - protein, 20 aa, Mycobacterium bovis
YYRYCTYIYIPFQYLSVVLG

SEQ ID NO: 164309 - protein, 26 aa, Mycobacterium bovis
AAATFVIGWQLVGFIWATVAGSVAWL

SEQ ID NO: 164310 - protein, 18 aa, Mycobacterium bovis
AAPLIAAGLRALFGHRHR

SEQ ID NO: 164311 - protein, 31 aa, Mycobacterium bovis
AAVVLVLVLGAIGIWIAIRPKPVQPPQPVAE

SEQ ID NO: 164312 - protein, 17 aa, Mycobacterium bovis
AEPLYLLFDIAVVGRLG

SEQ ID NO: 164313 - protein, 27 aa, Mycobacterium bovis
AEWMPNFIELLQRKLSRIVDPVLQKLV

SEQ ID NO: 164314 - protein, 36 aa, Mycobacterium bovis
AFYLFSCRSLTRSAWRLGMFANRWIILGVSAQAIAQ

SEQ ID NO: 164315 - protein, 22 aa, Mycobacterium bovis
AGAMYCLGFTRLPYFNTLASPC

SEQ ID NO: 164316 - protein, 26 aa, Mycobacterium bovis
AGIALPFLVWVWLRHLRERRGYRPVQ

SEQ ID NO: 164317 - protein, 20 aa, Mycobacterium bovis
AGSWIYTAFFAMLAASTVAI

SEQ ID NO: 164318 - protein, 23 aa, Mycobacterium bovis
AHSPDLDWKSVWDHGWSAAAEAA

SEQ ID NO: 164319 - protein, 18 aa, Mycobacterium bovis
AIAWARRTTSRAWWACNA

SEQ ID NO: 164320 - protein, 33 aa, Mycobacterium bovis
AITSYARFWWPGLPIWVPALVTVALILAVNLFS

SEQ ID NO: 164321 - protein, 17 aa, Mycobacterium bovis
AIVLVAVLFLGSPISVM

SEQ ID NO: 164322 - protein, 51 aa, Mycobacterium bovis
AKIGPVEFSGFIAWLIWLVLHLAYLIGFKTKITTLLSWTVTFLSTRRGQLT

SEQ ID NO: 164323 - protein, 18 aa, Mycobacterium bovis
ALLALTRAILIRVRNASW

SEQ ID NO: 164324 - protein, 19 aa, Mycobacterium bovis
ALQAARSYVVKLATMDCER

SEQ ID NO: 164325 - protein, 18 aa, Mycobacterium bovis
ALTVAMKHIKEPPPPLPP

SEQ ID NO: 164326 - protein, 26 aa, Mycobacterium bovis
ALVLVLLLAAPLLRPGYLLLRDAVST

SEQ ID NO: 164327 - protein, 17 aa, Mycobacterium bovis
ANWKISAAYLNWLADRL

SEQ ID NO: 164328 - protein, 40 aa, Mycobacterium bovis
APLEVPYLRASPWLLWRKRVVWLLVLFAAEAYTGSVLRAF

SEQ ID NO: 164329 - protein, 33 aa, Mycobacterium bovis
APPVFFARRPLQIALTLMWPAGIASLVYALLAA

SEQ ID NO: 164330 - protein, 25 aa, Mycobacterium bovis
AQPPKPRVFAIKPPCPEPAAADPTD

SEQ ID NO: 164331 - protein, 17 aa, Mycobacterium bovis
ARLTTAMLTLYFILAVG

SEQ ID NO: 164332 - protein, 31 aa, Mycobacterium bovis
ARSAFLVPLRVALAVLFLWGAAAALWTIIYG

SEQ ID NO: 164333 - protein, 22 aa, Mycobacterium bovis
ARTRRGLRALLSLVPDQATVLR

SEQ ID NO: 164334 - protein, 20 aa, Mycobacterium bovis
ASGHLVFTLIGTGTIVAVHL

SEQ ID NO: 164335 - protein, 23 aa, Mycobacterium bovis
ASPFWQTWDLLLLWLAQLHGGNG

SEQ ID NO: 164336 - protein, 26 aa, Mycobacterium bovis
ASRTGNLVTWWTGDALLVFDAGNLTQ

SEQ ID NO: 164337 - protein, 17 aa, Mycobacterium bovis
ASSLFRVSKLNCSITTS

SEQ ID NO: 164338 - protein, 21 aa, Mycobacterium bovis
ASVVWFAVLGFSAGRLQPFFA

SEQ ID NO: 164339 - protein, 27 aa, Mycobacterium bovis
ATASFGVAPLLLWQVATRHFTNISVET

SEQ ID NO: 164340 - protein, 27 aa, Mycobacterium bovis
ATMITFRLRLPCRTILRVFSRNPLVRG

SEQ ID NO: 164341 - protein, 25 aa, Mycobacterium bovis
AVLARWRFRRRPAPARLPLWACGAA

SEQ ID NO: 164342 - protein, 17 aa, Mycobacterium bovis
AVLGFSAGRLQPFFATP

SEQ ID NO: 164343 - protein, 28 aa, Mycobacterium bovis
AVLTYHIAKPWRWGYLGVLLVIFGFPLI

SEQ ID NO: 164344 - protein, 23 aa, Mycobacterium bovis
AVTAYFRMGWWSIIGYAAAAIIG

SEQ ID NO: 164345 - protein, 27 aa, Mycobacterium bovis
AVVASLCLIFIIMLGITRSVVASAVIV

SEQ ID NO: 164346 - protein, 21 aa, Mycobacterium bovis
CAVVLATMPPLLAAIANAGRH

SEQ ID NO: 164347 - protein, 30 aa, Mycobacterium bovis
CVVVALGGGALWWCVARRSWHAPRLGSISA

SEQ ID NO: 164348 - protein, 24 aa, Mycobacterium bovis
DAALAALGLWLSVAAVAGALLALT

SEQ ID NO: 164349 - protein, 19 aa, Mycobacterium bovis
DGSTYVIWGGKRSQIDPTN

SEQ ID NO: 164350 - protein, 28 aa, Mycobacterium bovis
DPAKPLPASIPWTALWLSQAWQQRVLEE

SEQ ID NO: 164351 - protein, 29 aa, Mycobacterium bovis
DPGAAVQAPWPLLRTFAAGPALSRDAALL

SEQ ID NO: 164352 - protein, 17 aa, Mycobacterium bovis
DQLGGRRRPPGPPGPPG

SEQ ID NO: 164353 - protein, 22 aa, Mycobacterium bovis
DRRLLSLILLARDHVVHGWVLA

SEQ ID NO: 164354 - protein, 27 aa, Mycobacterium bovis
DSEAMLLAAIYVAALRSYGFAAHAETA

SEQ ID NO: 164355 - protein, 44 aa, Mycobacterium bovis
DTVDHGLWVAFWFFLAQLNLILATINLLPLLPFDGGHIAVAVFE

SEQ ID NO: 164356 - protein, 19 aa, Mycobacterium bovis
DVAYALWSAIGTAAIVLVA

SEQ ID NO: 164357 - protein, 17 aa, Mycobacterium bovis
DVLAVATRGLWAAALQL

SEQ ID NO: 164358 - protein, 23 aa, Mycobacterium bovis
EAEQPLPGPRWPRALRASATRRA

SEQ ID NO: 164359 - protein, 25 aa, Mycobacterium bovis
EEAQIWAQITLPLAPDPYPIHNPDR

SEQ ID NO: 164360 - protein, 21 aa, Mycobacterium bovis
EFDGQLWIDMDFVDGTDTVSL

SEQ ID NO: 164361 - protein, 26 aa, Mycobacterium bovis
EGRPRRLIPLVGLIGCVVLAFALPLS

SEQ ID NO: 164362 - protein, 22 aa, Mycobacterium bovis
ELVTILPIVLVIAAVAAYLLSR

SEQ ID NO: 164363 - protein, 22 aa, Mycobacterium bovis
ENIVPLYRRNALTERKLLAVNE

SEQ ID NO: 164364 - protein, 23 aa, Mycobacterium bovis
EPYLLLFTLFLAPAEHWLGHLRW

SEQ ID NO: 164365 - protein, 33 aa, Mycobacterium bovis
ESEASRMGLLVDDLLLLARLDAHRPLELCRVDL

SEQ ID NO: 164366 - protein, 27 aa, Mycobacterium bovis
ESGLVLAYLGLLWWMMVCWSQPLRARP

SEQ ID NO: 164367 - protein, 35 aa, Mycobacterium bovis
ESKITKLMPWLWVAWFGLGSFGVLMLWLPGNNLVV

SEQ ID NO: 164368 - protein, 41 aa, Mycobacterium bovis
ETNNLHRRVLLICTFAIGAAAVFAWLLAAFAVRPFKQLAEQ

SEQ ID NO: 164369 - protein, 26 aa, Mycobacterium bovis
EVTAEYQSWRVVWGSAAALLAVGVGI

SEQ ID NO: 164370 - protein, 17 aa, Mycobacterium bovis
EWFRIMPTAVDVLDSIG

SEQ ID NO: 164371 - protein, 24 aa, Mycobacterium bovis
EWLEVLAMIALLPAAAALGGLFAW

SEQ ID NO: 164372 - protein, 23 aa, Mycobacterium bovis
FAAAGVVAVLAWIDRDRSPRLTA

SEQ ID NO: 164373 - protein, 21 aa, Mycobacterium bovis
FGAAMVGMLAAMVRLRHLIFK

SEQ ID NO: 164374 - protein, 22 aa, Mycobacterium bovis
FLAAAVLYFLAIGQVKGFAFTL

SEQ ID NO: 164375 - protein, 19 aa, Mycobacterium bovis
FLVGMFYLVAATDVIDVAA

SEQ ID NO: 164376 - protein, 35 aa, Mycobacterium bovis
FNLVGWPTWGMILSSPFLLPAGLGLGLAAIAFLPI

SEQ ID NO: 164377 - protein, 26 aa, Mycobacterium bovis
FRALFGAFLLGLLFFVATTSMIRYVS

SEQ ID NO: 164378 - protein, 17 aa, Mycobacterium bovis
FRVSKLNCSITTSDGTV

SEQ ID NO: 164379 - protein, 18 aa, Mycobacterium bovis
FSPNPWSALVTGLVAGVF

SEQ ID NO: 164380 - protein, 17 aa, Mycobacterium bovis
FVGPVVAFPAFGYIHIQ

SEQ ID NO: 164381 - protein, 17 aa, Mycobacterium bovis
GATFCLSFARMPYFQTL

SEQ ID NO: 164382 - protein, 31 aa, Mycobacterium bovis
GCLLWGLVTALLAAWGWFTSLLVITGTIAVT

SEQ ID NO: 164383 - protein, 29 aa, Mycobacterium bovis
GDFMHGRVLLAPLFCLLAPVGVIPILLPD

SEQ ID NO: 164384 - protein, 20 aa, Mycobacterium bovis
GDRLWIRFIADTERRSQVIE

SEQ ID NO: 164385 - protein, 17 aa, Mycobacterium bovis
GFLQDFFATAVFLGITT

SEQ ID NO: 164386 - protein, 18 aa, Mycobacterium bovis
GFVLAWRDSWEYWTHTLH

SEQ ID NO: 164387 - protein, 29 aa, Mycobacterium bovis
GGATVFTVAQWRWRWFRAAMCKTMAVAVI

SEQ ID NO: 164388 - protein, 26 aa, Mycobacterium bovis
GHVEDWFLITFAAVVLFVLARDLWGR

SEQ ID NO: 164389 - protein, 23 aa, Mycobacterium bovis
GKAFALSAFIVGGLWIITTQHVN

SEQ ID NO: 164390 - protein, 17 aa, Mycobacterium bovis
GLALGVLYVPCAGPILA

SEQ ID NO: 164391 - protein, 19 aa, Mycobacterium bovis
GLFTNPGSWRILDGLIAVM

SEQ ID NO: 164392 - protein, 17 aa, Mycobacterium bovis
GLGWRSVFLVNVPLGAI

SEQ ID NO: 164393 - protein, 22 aa, Mycobacterium bovis
GLRDRVTAYAPLLLTAQNVIDA

SEQ ID NO: 164394 - protein, 23 aa, Mycobacterium bovis
GPEVWWVLRVAHWASGVPAATVP

SEQ ID NO: 164395 - protein, 24 aa, Mycobacterium bovis
GPNYFSIALIVITFIVVPAMAYLH

SEQ ID NO: 164396 - protein, 24 aa, Mycobacterium bovis
GRLTRSVIGWVGAVAVVVSLAGSG

SEQ ID NO: 164397 - protein, 23 aa, Mycobacterium bovis
GSEPDFLRVWLPGQLLQGIGVGA

SEQ ID NO: 164398 - protein, 21 aa, Mycobacterium bovis
GSGLLLLLPLSLETRTVVALL

SEQ ID NO: 164399 - protein, 29 aa, Mycobacterium bovis
GTMLLRLCMLPGLALLVWATPRLASHLGT

SEQ ID NO: 164400 - protein, 27 aa, Mycobacterium bovis
GTRDRYLLMPSFTFVGVAQAALWTGYR

SEQ ID NO: 164401 - protein, 23 aa, Mycobacterium bovis
GTTIVLLVRWLVARRAAAFMHQG

SEQ ID NO: 164402 - protein, 24 aa, Mycobacterium bovis
GVLASFFVSTLLRVAFPDKAWADA

SEQ ID NO: 164403 - protein, 18 aa, Mycobacterium bovis
GVLMLWLPGNNLVVAFVG

SEQ ID NO: 164404 - protein, 17 aa, Mycobacterium bovis
GVRGFWMSIGVFSVMAV

SEQ ID NO: 164405 - protein, 19 aa, Mycobacterium bovis
GVRMWLFPGLSIVTVTGIV

SEQ ID NO: 164406 - protein, 19 aa, Mycobacterium bovis
GWCGWVLFEKHQTDVAAGQ

SEQ ID NO: 164407 - protein, 26 aa, Mycobacterium bovis
GWILPVIAQLVWWAVHPQPPWPHLAA

SEQ ID NO: 164408 - protein, 26 aa, Mycobacterium bovis
HASDPIAWWTPRLLFREPDWLREQRG

SEQ ID NO: 164409 - protein, 17 aa, Mycobacterium bovis
HDDRRLLSLILLARDHV

SEQ ID NO: 164410 - protein, 34 aa, Mycobacterium bovis
HERDPLRTGIFGLVLVICVVLIAFGYSGLPFWPQ

SEQ ID NO: 164411 - protein, 23 aa, Mycobacterium bovis
HHSRWHFAVLYTFLSMVNSCLGL

SEQ ID NO: 164412 - protein, 26 aa, Mycobacterium bovis
HLHQGIALQVPPYNYAHPDDLLAAAL

SEQ ID NO: 164413 - protein, 18 aa, Mycobacterium bovis
HNTWLTTIYTAVIGVLVL

SEQ ID NO: 164414 - protein, 27 aa, Mycobacterium bovis
HTGQRWLPLILAGFTSGFLLLRGRSYV

SEQ ID NO: 164415 - protein, 18 aa, Mycobacterium bovis
IAALAAIGVLLGWPLWWV

SEQ ID NO: 164416 - protein, 25 aa, Mycobacterium bovis
IAEGALLIVIFATSGALEALVTART

SEQ ID NO: 164417 - protein, 18 aa, Mycobacterium bovis
IAVLAVAFIAAISGWRAG

SEQ ID NO: 164418 - protein, 23 aa, Mycobacterium bovis
IDRSRIKVIMDKVNGRWLASKVE

SEQ ID NO: 164419 - protein, 19 aa, Mycobacterium bovis
IIGLFLAVYLMANIPGSST

SEQ ID NO: 164420 - protein, 17 aa, Mycobacterium bovis
ILPAPTRLFPPSLAVVF

SEQ ID NO: 164421 - protein, 19 aa, Mycobacterium bovis
IMLALLVPVLPFAFSYAIY

SEQ ID NO: 164422 - protein, 22 aa, Mycobacterium bovis
IMWPSLLVILLLVAVVALLFTG

SEQ ID NO: 164423 - protein, 29 aa, Mycobacterium bovis
IPINQLHRITWIVTMYLLGYIAAMPLLGR

SEQ ID NO: 164424 - protein, 22 aa, Mycobacterium bovis
IPKIPFIRPSFPGPAELAEDFV

SEQ ID NO: 164425 - protein, 26 aa, Mycobacterium bovis
IPSPPRGVWYLGPLPVRAYAVCVITG

SEQ ID NO: 164426 - protein, 23 aa, Mycobacterium bovis
IRWRLTLVFSAAMALVLAAAGAV

SEQ ID NO: 164427 - protein, 18 aa, Mycobacterium bovis
ISRALFDGLPATEPLRVP

SEQ ID NO: 164428 - protein, 23 aa, Mycobacterium bovis
IYLVLGMIILTPPLLREWTHYDS

SEQ ID NO: 164429 - protein, 27 aa, Mycobacterium bovis
KGVQTGLLWPAIFVAAFAALGLAVALV

SEQ ID NO: 164430 - protein, 25 aa, Mycobacterium bovis
KTLGFPIRLPQLPGGWTPNSGGRGG

SEQ ID NO: 164431 - protein, 24 aa, Mycobacterium bovis
LAAGVLLWLFVRHEHRAAFPLVDL

SEQ ID NO: 164432 - protein, 31 aa, Mycobacterium bovis
LAAIGVLLGWPLWWVSTCSVLVLLVVEGVAI

SEQ ID NO: 164433 - protein, 21 aa, Mycobacterium bovis
LAVTVSLLTIPFAAAAGTAVH

SEQ ID NO: 164434 - protein, 17 aa, Mycobacterium bovis
LAWAFDLLLHHPDALRR

SEQ ID NO: 164435 - protein, 21 aa, Mycobacterium bovis
LDAAPAVLPPMGPKLGLKAQR

SEQ ID NO: 164436 - protein, 31 aa, Mycobacterium bovis
LDPALSRWQWLVKWFLAIPHYIVLFFLHVAA

SEQ ID NO: 164437 - protein, 36 aa, Mycobacterium bovis
LFALSEMRWAALALGLFSAGLLTQLCGAPQWVRWAL

SEQ ID NO: 164438 - protein, 18 aa, Mycobacterium bovis
LFGWGIAVTLGVVCGLIA

SEQ ID NO: 164439 - protein, 18 aa, Mycobacterium bovis
LFSSLLWIDGRNLEPYLL

SEQ ID NO: 164440 - protein, 25 aa, Mycobacterium bovis
LFSVKTLTFLGFIGVLLAINLFGNR

SEQ ID NO: 164441 - protein, 20 aa, Mycobacterium bovis
LGGVWLTSFLLVATNTAIAS

SEQ ID NO: 164442 - protein, 28 aa, Mycobacterium bovis
LGNLRSLPVPFILNQPPPPGPVPAPGPA

SEQ ID NO: 164443 - protein, 27 aa, Mycobacterium bovis
LGPLYGIFIVWLLHDWRDVFWINVPLT

SEQ ID NO: 164444 - protein, 26 aa, Mycobacterium bovis
LGRVPMAVVPLFVAAMLLVPAAGSVT

SEQ ID NO: 164445 - protein, 24 aa, Mycobacterium bovis
LGSVAAVLVVPWPAGAQVLIRFTG

SEQ ID NO: 164446 - protein, 29 aa, Mycobacterium bovis
LGTWQVSGRLLFALLSFSVVGAVLALATP

SEQ ID NO: 164447 - protein, 25 aa, Mycobacterium bovis
LHIPLWAGYACSTLIIFPLVVYGMK

SEQ ID NO: 164448 - protein, 18 aa, Mycobacterium bovis
LHPLIFFLTVRQGANWVV

SEQ ID NO: 164449 - protein, 25 aa, Mycobacterium bovis
LHVSGYRFLLRRIECALLFGDVCAA

SEQ ID NO: 164450 - protein, 20 aa, Mycobacterium bovis
LIRFTGPEVWWVLRVAHWAS

SEQ ID NO: 164451 - protein, 18 aa, Mycobacterium bovis
LLGLAVGWLVGALVVLVV

SEQ ID NO: 164452 - protein, 18 aa, Mycobacterium bovis
LLSPLALATNGAAIGIGL

SEQ ID NO: 164453 - protein, 17 aa, Mycobacterium bovis
LLVVSALATLSGLGTPV

SEQ ID NO: 164454 - protein, 27 aa, Mycobacterium bovis
LMALPTGCILAWILVRIINVRSFGWTL

SEQ ID NO: 164455 - protein, 18 aa, Mycobacterium bovis
LMPWYIGSAPFPISALIS

SEQ ID NO: 164456 - protein, 25 aa, Mycobacterium bovis
LNVVALSFLLLHAVTWFGSAPRAMV

SEQ ID NO: 164457 - protein, 22 aa, Mycobacterium bovis
LPILVVVWLSLHRWDLLGPLRY

SEQ ID NO: 164458 - protein, 22 aa, Mycobacterium bovis
LPQDAIRWAALVALVAIGAGLI

SEQ ID NO: 164459 - protein, 20 aa, Mycobacterium bovis
LRATLFVIALGFLVQITGIN

SEQ ID NO: 164460 - protein, 18 aa, Mycobacterium bovis
LTRFRSPLRGPWLTSVFG

SEQ ID NO: 164461 - protein, 18 aa, Mycobacterium bovis
LVATGFVVFALYCGISRI

SEQ ID NO: 164462 - protein, 19 aa, Mycobacterium bovis
LVAYLALLIGLGFGLLAVG

SEQ ID NO: 164463 - protein, 20 aa, Mycobacterium bovis
LVILVVVIVGGFTVHRIRGF

SEQ ID NO: 164464 - protein, 26 aa, Mycobacterium bovis
LVLIKWWLLAIPHYLILAVFLSSGWR

SEQ ID NO: 164465 - protein, 24 aa, Mycobacterium bovis
LVVEGVAINFWLLRRDSVTVGTDD

SEQ ID NO: 164466 - protein, 21 aa, Mycobacterium bovis
LVVPTVALAVPWLTQLQRLFI

SEQ ID NO: 164467 - protein, 17 aa, Mycobacterium bovis
LWLHYYAASYEFGFVRR

SEQ ID NO: 164468 - protein, 17 aa, Mycobacterium bovis
MGLHPLIFFLTVRQGAN

SEQ ID NO: 164469 - protein, 18 aa, Mycobacterium bovis
MLVPLATGCLRVRASITI

SEQ ID NO: 164470 - protein, 40 aa, Mycobacterium bovis
NCICRGDYRLRHFGVRITRILALLLAVLLAVSGVAGCSAD

SEQ ID NO: 164471 - protein, 23 aa, Mycobacterium bovis
NGKRPKLRRILSDPDARVIVVEH

SEQ ID NO: 164472 - protein, 24 aa, Mycobacterium bovis
NSGHLFYNRRLRAATTRFSVRMKH

SEQ ID NO: 164473 - protein, 24 aa, Mycobacterium bovis
NSKFTISMLWPGDRAWRQAGERRM

SEQ ID NO: 164474 - protein, 25 aa, Mycobacterium bovis
NTNSSQFFMVYRDSKLPPQYTVFGT

SEQ ID NO: 164475 - protein, 30 aa, Mycobacterium bovis
PEERLNLPPIPLQLPTPRPAPPAQQLPSTP

SEQ ID NO: 164476 - protein, 24 aa, Mycobacterium bovis
PILPTQILWINMTTAIALGLMLAF

SEQ ID NO: 164477 - protein, 20 aa, Mycobacterium bovis
PLAPWAVVLVAAAGATYLLT

SEQ ID NO: 164478 - protein, 17 aa, Mycobacterium bovis
PLEVLFSSLLWIDGRNL

SEQ ID NO: 164479 - protein, 33 aa, Mycobacterium bovis
PLSFTLSSVLLLPLHLLLLPWSSMRSSMHDGFI

SEQ ID NO: 164480 - protein, 19 aa, Mycobacterium bovis
PNAILWLHYYAASYEFGFV

SEQ ID NO: 164481 - protein, 21 aa, Mycobacterium bovis
PNFTVLVILRLLYGIGMGGEW

SEQ ID NO: 164482 - protein, 24 aa, Mycobacterium bovis
PNVALLLLFVYRPLADNIRLSFFD

SEQ ID NO: 164483 - protein, 27 aa, Mycobacterium bovis
PPQAATAPPLPPFKPSANLGANCQYPP

SEQ ID NO: 164484 - protein, 39 aa, Mycobacterium bovis
PPSWSPRNWPVRWKVFTIALLPLVVAMVLAGLRVEAAMA

SEQ ID NO: 164485 - protein, 18 aa, Mycobacterium bovis
PQFSLWLVPLAVLALPHR

SEQ ID NO: 164486 - protein, 31 aa, Mycobacterium bovis
PRALRASATRRALLLTALGGLLIAGLVTAIP

SEQ ID NO: 164487 - protein, 17 aa, Mycobacterium bovis
PSIGGSKTLWRAVSVRA

SEQ ID NO: 164488 - protein, 20 aa, Mycobacterium bovis
PTQLDWVGQLTLIPAVALIA

SEQ ID NO: 164489 - protein, 27 aa, Mycobacterium bovis
PTTAQWVILALLAVALPLASLVGWLVS

SEQ ID NO: 164490 - protein, 20 aa, Mycobacterium bovis
PVLENLPAVLPTVVAPPLTS

SEQ ID NO: 164491 - protein, 21 aa, Mycobacterium bovis
PVTRRAVLTLYPHCAPKIGVP

SEQ ID NO: 164492 - protein, 17 aa, Mycobacterium bovis
QTYAWVPFGGGVKRCLG

SEQ ID NO: 164493 - protein, 17 aa, Mycobacterium bovis
RAGLRFAAPLIAAGLRA

SEQ ID NO: 164494 - protein, 17 aa, Mycobacterium bovis
RAIGMTTRQLWKLMFIE

SEQ ID NO: 164495 - protein, 25 aa, Mycobacterium bovis
RDLFSGFGWLAVVLLAVAAACAPPG

SEQ ID NO: 164496 - protein, 35 aa, Mycobacterium bovis
REPEQLWQVAKLRRAAFSGVLLTASLVAAWAYPLW

SEQ ID NO: 164497 - protein, 28 aa, Mycobacterium bovis
RFSAADKPVIFWAPDHGAFVVRGAMVAA

SEQ ID NO: 164498 - protein, 18 aa, Mycobacterium bovis
RGWLRRFAERAEAVRSVF

SEQ ID NO: 164499 - protein, 22 aa, Mycobacterium bovis
RHMGLFVVGRLAGRHGIRVGLR

SEQ ID NO: 164500 - protein, 18 aa, Mycobacterium bovis
RIVRRSIMLVPRRGTRVR

SEQ ID NO: 164501 - protein, 26 aa, Mycobacterium bovis
RIVRRSNALLDWAYGRRFCYSETMSV

SEQ ID NO: 164502 - protein, 18 aa, Mycobacterium bovis
RLDSLFRLDHLAARLRRN

SEQ ID NO: 164503 - protein, 19 aa, Mycobacterium bovis
RLLTVRRTLAWVRVESLQL

SEQ ID NO: 164504 - protein, 17 aa, Mycobacterium bovis
RLTLIVFVAMTLAAGLL

SEQ ID NO: 164505 - protein, 33 aa, Mycobacterium bovis
RPSRWRHVPAILLVLSLLLFTIAMAGPTHDVRI

SEQ ID NO: 164506 - protein, 17 aa, Mycobacterium bovis
RQKPLSFTLSSVLLLPL

SEQ ID NO: 164507 - protein, 17 aa, Mycobacterium bovis
RRFVYLVLLMTAFNWMS

SEQ ID NO: 164508 - protein, 17 aa, Mycobacterium bovis
RRLLPLLFVLYVINFVD

SEQ ID NO: 164509 - protein, 20 aa, Mycobacterium bovis
RSLRPLAEFEQTAAAIGAGQ

SEQ ID NO: 164510 - protein, 20 aa, Mycobacterium bovis
RSWHAPRLGSISAGLVAVGM

SEQ ID NO: 164511 - protein, 22 aa, Mycobacterium bovis
RTDYGLPVREPGARLVPGAAVP

SEQ ID NO: 164512 - protein, 27 aa, Mycobacterium bovis
RTLANKVPFVVLVIGSLGVGLGLTLWL

SEQ ID NO: 164513 - protein, 23 aa, Mycobacterium bovis
RTPPRLPPGFRWIAVRPGAAPPP

SEQ ID NO: 164514 - protein, 24 aa, Mycobacterium bovis
RVAALPLWAWLLTVAAMSFGGPGD

SEQ ID NO: 164515 - protein, 26 aa, Mycobacterium bovis
RVGKRFLIIDLKRQKPLSFTLSSVLL

SEQ ID NO: 164516 - protein, 19 aa, Mycobacterium bovis
RWRFWRRGRRPLETKVVLD

SEQ ID NO: 164517 - protein, 37 aa, Mycobacterium bovis
SAFGLSVLIWQHILHMPLHWLVLPMAIIVMLAVGSDY

SEQ ID NO: 164518 - protein, 25 aa, Mycobacterium bovis
SAGRLQPFFATPAAWRILDALVAVT

SEQ ID NO: 164519 - protein, 19 aa, Mycobacterium bovis
SAWGLYRFNQILAGLSAAI

SEQ ID NO: 164520 - protein, 18 aa, Mycobacterium bovis
SAWLPFNNGLRPEPLIAL

SEQ ID NO: 164521 - protein, 30 aa, Mycobacterium bovis
SDLDDELAAPRWPWVVGVAAIIAAVALVVS

SEQ ID NO: 164522 - protein, 28 aa, Mycobacterium bovis
SEVSEFSWQLERVLPVPVFAQTMAQVTV

SEQ ID NO: 164523 - protein, 27 aa, Mycobacterium bovis
SFTGAGIWLGIAAFAAAGVVAVLAWID

SEQ ID NO: 164524 - protein, 27 aa, Mycobacterium bovis
SHRRVVLIIYLWVGIGAFGAASSIFFN

SEQ ID NO: 164525 - protein, 37 aa, Mycobacterium bovis
SIAVIAIMLFIAYRSLSAALIMLLTVGLELLAVRGII

SEQ ID NO: 164526 - protein, 24 aa, Mycobacterium bovis
SLIERFPLMLGTAAGVLLIGLVRW

SEQ ID NO: 164527 - protein, 22 aa, Mycobacterium bovis
SLIGLSFLGLCHLWAGSPEAPE

SEQ ID NO: 164528 - protein, 27 aa, Mycobacterium bovis
SMLSKWPVGWVVVLLYAVCVVLRLARY

SEQ ID NO: 164529 - protein, 24 aa, Mycobacterium bovis
SPPSHLWQARLAPDAKPYQGGHRF

SEQ ID NO: 164530 - protein, 20 aa, Mycobacterium bovis
SVTILLAVALVFDLPAALQR

SEQ ID NO: 164531 - protein, 21 aa, Mycobacterium bovis
TAAVQLPAVWLLSAVTVGLFG

SEQ ID NO: 164532 - protein, 22 aa, Mycobacterium bovis
TAGAVFLSAWLPFNNGLRPEPL

SEQ ID NO: 164533 - protein, 25 aa, Mycobacterium bovis
TARKRIAWLVLLANMVLAAVVNAAE

SEQ ID NO: 164534 - protein, 22 aa, Mycobacterium bovis
TASLALAFPLALRFDNLHLTGL

SEQ ID NO: 164535 - protein, 32 aa, Mycobacterium bovis
TAVSVLIILILVYRNLVTMLVPLATIGASVVT

SEQ ID NO: 164536 - protein, 23 aa, Mycobacterium bovis
TCGCLALGWWQWTRFQSTSGTFQ

SEQ ID NO: 164537 - protein, 23 aa, Mycobacterium bovis
TDLDSVLKRFGPLTPPRAVAIIT

SEQ ID NO: 164538 - protein, 32 aa, Mycobacterium bovis
TITAIAVVVLLGWSFFYFSDDTRGYKPVDTSV

SEQ ID NO: 164539 - protein, 22 aa, Mycobacterium bovis
TIVAVHLLGRPLGRLVDRDNAV

SEQ ID NO: 164540 - protein, 21 aa, Mycobacterium bovis
TKPAPPPPPPAPPPTTEIPTA

SEQ ID NO: 164541 - protein, 24 aa, Mycobacterium bovis
TLAVRALPIVLLTALVFFNTYVWL

SEQ ID NO: 164542 - protein, 27 aa, Mycobacterium bovis
TLDSMIGYRSPRYLRFGWAAARLDDWA

SEQ ID NO: 164543 - protein, 17 aa, Mycobacterium bovis
TLIVFVAMTLAAGLLIS

SEQ ID NO: 164544 - protein, 18 aa, Mycobacterium bovis
TMFFVLVTGIISAAQVFD

SEQ ID NO: 164545 - protein, 37 aa, Mycobacterium bovis
TNPIQALITYGPLLFALGYQIFFNLVGWPTWGMILSS

SEQ ID NO: 164546 - protein, 24 aa, Mycobacterium bovis
TNQAGLRLVLLRPGKEDDEPIQRI

SEQ ID NO: 164547 - protein, 22 aa, Mycobacterium bovis
TPKVFKAAAWVAIAAGTVFIVA

SEQ ID NO: 164548 - protein, 22 aa, Mycobacterium bovis
TQHNVYIPWSMTVTPISQSDVG

SEQ ID NO: 164549 - protein, 25 aa, Mycobacterium bovis
TRTSLKTSWYLLGPAFVAAIAYVDP

SEQ ID NO: 164550 - protein, 24 aa, Mycobacterium bovis
TSAVTLLSSLLLICVVAYHAAPAL

SEQ ID NO: 164551 - protein, 26 aa, Mycobacterium bovis
TSPAWASWLRVVLGSALIVFGVLRWL

SEQ ID NO: 164552 - protein, 18 aa, Mycobacterium bovis
TTVIWLAPLLLSVPVFSR

SEQ ID NO: 164553 - protein, 17 aa, Mycobacterium bovis
TVAIHLLASMTMVWLAV

SEQ ID NO: 164554 - protein, 20 aa, Mycobacterium bovis
TVLTLRRWLRPATAAVVCCL

SEQ ID NO: 164555 - protein, 23 aa, Mycobacterium bovis
TVRTGLLWWTVAIHLLASMTMVW

SEQ ID NO: 164556 - protein, 21 aa, Mycobacterium bovis
TVVFGVLRWFFTTYRIDDENV

SEQ ID NO: 164557 - protein, 18 aa, Mycobacterium bovis
TWEMSFLYAIVFGGFVAF

SEQ ID NO: 164558 - protein, 21 aa, Mycobacterium bovis
TWPVDRPFAMLTVARSLMLDV

SEQ ID NO: 164559 - protein, 17 aa, Mycobacterium bovis
TYPPLAAVLFSPFAWLQ

SEQ ID NO: 164560 - protein, 19 aa, Mycobacterium bovis
VACAIPLPPIARLLDDLDV

SEQ ID NO: 164561 - protein, 17 aa, Mycobacterium bovis
VATGATLFVLYAVATED

SEQ ID NO: 164562 - protein, 25 aa, Mycobacterium bovis
VAVTLAVFAVPPLWGETLQRALLRA

SEQ ID NO: 164563 - protein, 21 aa, Mycobacterium bovis
VDWTRWWVMITLDVAIVYILY

SEQ ID NO: 164564 - protein, 23 aa, Mycobacterium bovis
VEHLRWYDYPLAAALSLVVLFTL

SEQ ID NO: 164565 - protein, 19 aa, Mycobacterium bovis
VFGVLRWLTRHRHTEMPGW

SEQ ID NO: 164566 - protein, 20 aa, Mycobacterium bovis
VFNHPQAFFAPISAVVCMSA

SEQ ID NO: 164567 - protein, 18 aa, Mycobacterium bovis
VGTLLSWYALVAAVTTVP

SEQ ID NO: 164568 - protein, 29 aa, Mycobacterium bovis
VGVQLVVVLTAAWLLAMPLTQSKEQPELA

SEQ ID NO: 164569 - protein, 24 aa, Mycobacterium bovis
VIARFVQFIIVPIALIALARSQAV

SEQ ID NO: 164570 - protein, 24 aa, Mycobacterium bovis
VIGALVVWWGWRERRDLFSGFGWL

SEQ ID NO: 164571 - protein, 28 aa, Mycobacterium bovis
VLATGVLGWWRWHHNTWLTTIYTAVIGV

SEQ ID NO: 164572 - protein, 19 aa, Mycobacterium bovis
VLAYAWLMPVSTVVQAMIG

SEQ ID NO: 164573 - protein, 18 aa, Mycobacterium bovis
VLLVIGALVVWWGWRERR

SEQ ID NO: 164574 - protein, 18 aa, Mycobacterium bovis
VLTFLVTRSFVRFIHRRA

SEQ ID NO: 164575 - protein, 22 aa, Mycobacterium bovis
VMTQLGFIAILVGLVVLAAAGG

SEQ ID NO: 164576 - protein, 20 aa, Mycobacterium bovis
VNRLLRLPLPEPYLPPRLEA

SEQ ID NO: 164577 - protein, 24 aa, Mycobacterium bovis
VPAALVSWIVTAAGIVWPIGNVCA

SEQ ID NO: 164578 - protein, 41 aa, Mycobacterium bovis
VPDSSGLPLRAMVMVLLFLGVVFLLLGWQALGSSPNSEDDS

SEQ ID NO: 164579 - protein, 33 aa, Mycobacterium bovis
VRSYMTPALATLLGRWFWWPRRVDRLARQPQVL

SEQ ID NO: 164580 - protein, 20 aa, Mycobacterium bovis
VSMQYSFLPSWLSFLVDKEN

SEQ ID NO: 164581 - protein, 24 aa, Mycobacterium bovis
VSPGTRWPQPTPWAGGAPPWGPPS

SEQ ID NO: 164582 - protein, 24 aa, Mycobacterium bovis
VSQLLGCTPLDPLGWAQATAAATA

SEQ ID NO: 164583 - protein, 17 aa, Mycobacterium bovis
VTFMLVWLINHHGWSVA

SEQ ID NO: 164584 - protein, 20 aa, Mycobacterium bovis
VVGFILALLLREVPLTDIHD

SEQ ID NO: 164585 - protein, 31 aa, Mycobacterium bovis
VWGVLTPRQPWAWLALLVAGLTVGLFITQGR

SEQ ID NO: 164586 - protein, 42 aa, Mycobacterium bovis
WAGGAPPWGPPSSPLPRSARQPWLWVGVAVAVVVALAGGLGI

SEQ ID NO: 164587 - protein, 18 aa, Mycobacterium bovis
WAIGVMLAILALISLVCT

SEQ ID NO: 164588 - protein, 18 aa, Mycobacterium bovis
WHIVGLCIFGFLLAMLRG

SEQ ID NO: 164589 - protein, 26 aa, Mycobacterium bovis
WLIEQPIRRWRPARVPLLPLAAATVA

SEQ ID NO: 164590 - protein, 23 aa, Mycobacterium bovis
YAPLWRTAWRRLRQRPFQYILLV

SEQ ID NO: 164591 - protein, 24 aa, Mycobacterium bovis
YAVAALWALLLAYSASRRFFALRR

SEQ ID NO: 164592 - protein, 17 aa, Mycobacterium bovis
YAYLAPWQLSAHRWYTW

SEQ ID NO: 164593 - protein, 20 aa, Mycobacterium bovis
YITEALKRLPTYATTLGEVV

SEQ ID NO: 164594 - protein, 18 aa, Mycobacterium bovis
YLAPWQLSAHRWYTWVIA

SEQ ID NO: 164595 - protein, 17 aa, Mycobacterium bovis
YTELWVGFTAVSALLIL

SEQ ID NO: 164596 - protein, 23 aa, Mycobacterium bovis
YTWLLVALPLAGAAILLFGGRRT

SEQ ID NO: 164597 - protein, 22 aa, Mycobacterium bovis
AAAGVVAVLAWIDRDRSPRLTA

SEQ ID NO: 164598 - protein, 27 aa, Mycobacterium bovis
AAATFVIGWQLVGFIWATVAGSVAWLI

SEQ ID NO: 164599 - protein, 23 aa, Mycobacterium bovis
AAFYRLSSLRLWPDRRLSRRGVE

SEQ ID NO: 164600 - protein, 17 aa, Mycobacterium bovis
AAIPRRRTDRRAYSCWP

SEQ ID NO: 164601 - protein, 22 aa, Mycobacterium bovis
AALAVLVTVFTLIRDRTEPVMS

SEQ ID NO: 164602 - protein, 19 aa, Mycobacterium bovis
AAMVGMLAAMVRLRHLIFK

SEQ ID NO: 164603 - protein, 19 aa, Mycobacterium bovis
AAPLIAAGLRALFGHRHRR

SEQ ID NO: 164604 - protein, 23 aa, Mycobacterium bovis
AAPTWLKTVPKRLSALLNTSGLP

SEQ ID NO: 164605 - protein, 24 aa, Mycobacterium bovis
AAPTWLKTVPKRLSALLTTSGLPA

SEQ ID NO: 164606 - protein, 32 aa, Mycobacterium bovis
AARTIHALSLPIILFWVALTIVVNVVAPQLQS

SEQ ID NO: 164607 - protein, 20 aa, Mycobacterium bovis
AAVQLPAVWLLSAVTVGLFG

SEQ ID NO: 164608 - protein, 32 aa, Mycobacterium bovis
AAVSVLIILILVYRNLVTMLVPLATIGASVVT

SEQ ID NO: 164609 - protein, 18 aa, Mycobacterium bovis
ACAIPLPPIARLLDDLDV

SEQ ID NO: 164610 - protein, 26 aa, Mycobacterium bovis
ADAALAALGLWLSVAAVAGALLALTR

SEQ ID NO: 164611 - protein, 18 aa, Mycobacterium bovis
AECLLVTTYLLIATAAAL

SEQ ID NO: 164612 - protein, 18 aa, Mycobacterium bovis
AEPLYLLFDIAVVGRLGA

SEQ ID NO: 164613 - protein, 20 aa, Mycobacterium bovis
AERLNVVFLLAALQLVEILV

SEQ ID NO: 164614 - protein, 26 aa, Mycobacterium bovis
AEWMPNFIELLQRKLSRIVDPVLQKL

SEQ ID NO: 164615 - protein, 36 aa, Mycobacterium bovis
AFGLSVLIWQHILHMPLHWLVLPMAIIVMLAVGSDY

SEQ ID NO: 164616 - protein, 23 aa, Mycobacterium bovis
AGAMYCLGFTRLPYFNTLASPCA

SEQ ID NO: 164617 - protein, 24 aa, Mycobacterium bovis
AGRLQPFFATPAAWRILDALVAVT

SEQ ID NO: 164618 - protein, 25 aa, Mycobacterium bovis
AGRNYLYDAWAARFLVTARLNNSLP

SEQ ID NO: 164619 - protein, 18 aa, Mycobacterium bovis
AIDVSRWLSTARTAVGCA

SEQ ID NO: 164620 - protein, 33 aa, Mycobacterium bovis
AITGYARFWWPGLPIWVPALVTVALILAVNLFS

SEQ ID NO: 164621 - protein, 18 aa, Mycobacterium bovis
AIWNPYVAERLLQGHWSL

SEQ ID NO: 164622 - protein, 50 aa, Mycobacterium bovis
AKIGPVEFSGFIAWLIWLVLHLAYLIGFKTKITTLLSWTVTFLSTRRGQL

SEQ ID NO: 164623 - protein, 24 aa, Mycobacterium bovis
ALAGALLMPWYIGSAPFPISALIS

SEQ ID NO: 164624 - protein, 20 aa, Mycobacterium bovis
ALDRGALTAFLSWLESRPSP

SEQ ID NO: 164625 - protein, 22 aa, Mycobacterium bovis
ALGVLVLLFSPPSIRWAAGRDQ

SEQ ID NO: 164626 - protein, 24 aa, Mycobacterium bovis
AMIAAIIPMLLWITGVYDTVRNIR

SEQ ID NO: 164627 - protein, 35 aa, Mycobacterium bovis
ANGRYRLLIFHGGVPPLQFWQALDTALDRQVALTF

SEQ ID NO: 164628 - protein, 18 aa, Mycobacterium bovis
ANWKISAAYLNWLADRLQ

SEQ ID NO: 164629 - protein, 40 aa, Mycobacterium bovis
APLEVPYLRASPWLLWRKRAVWLLVLFAAEAYTGSVLRAF

SEQ ID NO: 164630 - protein, 17 aa, Mycobacterium bovis
APRLACAFVPTNAQRRA

SEQ ID NO: 164631 - protein, 22 aa, Mycobacterium bovis
APRPATLYRLSVVDVLLGSQVV

SEQ ID NO: 164632 - protein, 19 aa, Mycobacterium bovis
APTSNLLVWISTLGTTDGK

SEQ ID NO: 164633 - protein, 22 aa, Mycobacterium bovis
AQLRARSWWSGPDIYVVVDDYD

SEQ ID NO: 164634 - protein, 24 aa, Mycobacterium bovis
ARHMGLFVVGRLAGRHGIRVGLRG

SEQ ID NO: 164635 - protein, 26 aa, Mycobacterium bovis
ARRPLQIALTLMWPAGIASLVYALLA

SEQ ID NO: 164636 - protein, 32 aa, Mycobacterium bovis
ARSAFLVPLRVALAVLFLWGAAAALWTIIYGL

SEQ ID NO: 164637 - protein, 21 aa, Mycobacterium bovis
ARTRRGLRALLSLVPDQATVL

SEQ ID NO: 164638 - protein, 23 aa, Mycobacterium bovis
ASLIGLSFLGLCHLWAGSPEAPE

SEQ ID NO: 164639 - protein, 29 aa, Mycobacterium bovis
ASRMGLLVDDLLLLARLDAHRPLELCRVD

SEQ ID NO: 164640 - protein, 23 aa, Mycobacterium bovis
ASVVWFAVLGFSAGRLQPFFATP

SEQ ID NO: 164641 - protein, 25 aa, Mycobacterium bovis
ATHALKKLLFPWGGGRMSAYRQPVE

SEQ ID NO: 164642 - protein, 29 aa, Mycobacterium bovis
ATTWLHVSGYRFLLRRIECALLFGDVCAA

SEQ ID NO: 164643 - protein, 17 aa, Mycobacterium bovis
AVKHVCRGLSGLTSWLT

SEQ ID NO: 164644 - protein, 20 aa, Mycobacterium bovis
AVLARWRFRRRPAPARLPLW

SEQ ID NO: 164645 - protein, 26 aa, Mycobacterium bovis
AVLPRSATPVLLPDVVAAAPGMTAAL

SEQ ID NO: 164646 - protein, 29 aa, Mycobacterium bovis
AVLTYHIAKPWRWGYLGVLLVIFGFPLIA

SEQ ID NO: 164647 - protein, 22 aa, Mycobacterium bovis
AVRLAARALGRKVPKSRRAVSL

SEQ ID NO: 164648 - protein, 17 aa, Mycobacterium bovis
AVTFVASLSLAVGIQLA

SEQ ID NO: 164649 - protein, 26 aa, Mycobacterium bovis
AVVLVLVLGAIGIWIANRPKPVQPPQ

SEQ ID NO: 164650 - protein, 27 aa, Mycobacterium bovis
AVVVLLGWSFFYFSDDTRGYKPVDTSV

SEQ ID NO: 164651 - protein, 25 aa, Mycobacterium bovis
AWAAAIGLMVPIGLAPPAMAAPCSG

SEQ ID NO: 164652 - protein, 21 aa, Mycobacterium bovis
AWALSVMFLVFTLRALLYKPF

SEQ ID NO: 164653 - protein, 17 aa, Mycobacterium bovis
CAFVPTNAQRRATAKRK

SEQ ID NO: 164654 - protein, 23 aa, Mycobacterium bovis
CGLRRTWRFEHNIAGLGILATGG

SEQ ID NO: 164655 - protein, 18 aa, Mycobacterium bovis
CRDIPFDVIQRLGLAYTP

SEQ ID NO: 164656 - protein, 20 aa, Mycobacterium bovis
CRLLTVRRTLAWVRVESLQL

SEQ ID NO: 164657 - protein, 31 aa, Mycobacterium bovis
CVVVALGGGALWWCVARRSWHAPRLGSISAG

SEQ ID NO: 164658 - protein, 23 aa, Mycobacterium bovis
DDKVNRLLRLPLPEPYLPPRLEA

SEQ ID NO: 164659 - protein, 17 aa, Mycobacterium bovis
DDWSQLPKRLSCQLRPG

SEQ ID NO: 164660 - protein, 27 aa, Mycobacterium bovis
DEGRPRRLIPLVGLIGCVVLAFALPLS

SEQ ID NO: 164661 - protein, 27 aa, Mycobacterium bovis
DELRSLLRFVLDLLADYGLTDFYLELS

SEQ ID NO: 164662 - protein, 26 aa, Mycobacterium bovis
DFMHGRVLLAPLFCLLAPVGVIPILL

SEQ ID NO: 164663 - protein, 21 aa, Mycobacterium bovis
DGDRLWIRFIADTERRSQVIE

SEQ ID NO: 164664 - protein, 28 aa, Mycobacterium bovis
DLDDELAAPRWPWVVGVAAIIAAVALVV

SEQ ID NO: 164665 - protein, 29 aa, Mycobacterium bovis
DLVRELVTILPIVLVIAAVAAYLLSRAAL

SEQ ID NO: 164666 - protein, 24 aa, Mycobacterium bovis
DMSPIPRIVSVSLAWAAAIGLMVP

SEQ ID NO: 164667 - protein, 29 aa, Mycobacterium bovis
DPAKPLPASIPWTALWLSQAWQQRVLEEE

SEQ ID NO: 164668 - protein, 28 aa, Mycobacterium bovis
DPGAAVQAPWPLLRTFAAGPALSRDAAL

SEQ ID NO: 164669 - protein, 30 aa, Mycobacterium bovis
DRAPLPKLGPLISALLNPGARNAAPLQQQA

SEQ ID NO: 164670 - protein, 17 aa, Mycobacterium bovis
DRLEAVVMLLAVTVSLL

SEQ ID NO: 164671 - protein, 17 aa, Mycobacterium bovis
DRRRQATHPAAVKPELV

SEQ ID NO: 164672 - protein, 18 aa, Mycobacterium bovis
DSVVTPLRLALERDTRAV

SEQ ID NO: 164673 - protein, 31 aa, Mycobacterium bovis
DTVDHGLWVAFWFFLAQLNLILAAINLLPLL

SEQ ID NO: 164674 - protein, 18 aa, Mycobacterium bovis
DVLAVATRGLWAAALQLA

SEQ ID NO: 164675 - protein, 25 aa, Mycobacterium bovis
EAAPTWLKTVPKRLSALLTTSGLPA

SEQ ID NO: 164676 - protein, 17 aa, Mycobacterium bovis
EAEQPLPGPRWPRALRA

SEQ ID NO: 164677 - protein, 37 aa, Mycobacterium bovis
EAFYLFSCRSLTRSAWRLGMFANRWIILGVSAQAIAQ

SEQ ID NO: 164678 - protein, 24 aa, Mycobacterium bovis
EAQIWAQITLPLAPDPYPIHNPDR

SEQ ID NO: 164679 - protein, 22 aa, Mycobacterium bovis
EFDGQLWIDMDFVDGTDTVSLL

SEQ ID NO: 164680 - protein, 28 aa, Mycobacterium bovis
EISCIFVAWFVLYLVLVLRAVGAGGNSY

SEQ ID NO: 164681 - protein, 29 aa, Mycobacterium bovis
EISCIFVAWFVLYLVLVLRAVGAGGNSYQ

SEQ ID NO: 164682 - protein, 19 aa, Mycobacterium bovis
ELILSCGVALHHCVVALAS

SEQ ID NO: 164683 - protein, 34 aa, Mycobacterium bovis
EPEQLWQVAKLRRAAFSGVLLTASLVAAWAYPLW

SEQ ID NO: 164684 - protein, 28 aa, Mycobacterium bovis
EPRDDPNSLLPRWLPDTSRGQGWADRIR

SEQ ID NO: 164685 - protein, 24 aa, Mycobacterium bovis
EPYLLLFTLFLAPAEHWLGHLRWL

SEQ ID NO: 164686 - protein, 20 aa, Mycobacterium bovis
EQPLPGPRWPRALRASATRR

SEQ ID NO: 164687 - protein, 42 aa, Mycobacterium bovis
ETNNLHRRVLLICTFAIGAAAVFAWLLAAFAVRPFKQLAEQT

SEQ ID NO: 164688 - protein, 26 aa, Mycobacterium bovis
EVTAEYQSWRVVWGSAAALLTVGVGI

SEQ ID NO: 164689 - protein, 23 aa, Mycobacterium bovis
EYLRELTIWSGRYGSVAGVPARN

SEQ ID NO: 164690 - protein, 18 aa, Mycobacterium bovis
FAGYLLTYTIANNGKEFA

SEQ ID NO: 164691 - protein, 17 aa, Mycobacterium bovis
FDVIQRLGLAYTPPEAE

SEQ ID NO: 164692 - protein, 18 aa, Mycobacterium bovis
FEHNIAGLGILATGGPRV

SEQ ID NO: 164693 - protein, 17 aa, Mycobacterium bovis
FEPVLASLRDLGCRALL

SEQ ID NO: 164694 - protein, 17 aa, Mycobacterium bovis
FGAAMVGMLAAMVRLRH

SEQ ID NO: 164695 - protein, 24 aa, Mycobacterium bovis
FGAKSVEFIPPKTPSPKPLSPNAH

SEQ ID NO: 164696 - protein, 23 aa, Mycobacterium bovis
FGSSRPMPLPPGRGILVTGAGDE

SEQ ID NO: 164697 - protein, 25 aa, Mycobacterium bovis
FLLLPILVVVWLSLHRWDLLGPLRY

SEQ ID NO: 164698 - protein, 19 aa, Mycobacterium bovis
FNHPQAFFAPISAVVCMSA

SEQ ID NO: 164699 - protein, 22 aa, Mycobacterium bovis
FPNAILWLHYYAASYEFGFVRR

SEQ ID NO: 164700 - protein, 17 aa, Mycobacterium bovis
FSPNPWSALVTGLVAGV

SEQ ID NO: 164701 - protein, 25 aa, Mycobacterium bovis
FTGAGIWLGIAAFAAAGVVAVLAWI

SEQ ID NO: 164702 - protein, 17 aa, Mycobacterium bovis
FVLAWRDSWEYWTHTLH

SEQ ID NO: 164703 - protein, 19 aa, Mycobacterium bovis
FVLTFLVTRSFVRFIHRRA

SEQ ID NO: 164704 - protein, 26 aa, Mycobacterium bovis
FWSLAPLVVGCILLAGLVGMCSFQLG

SEQ ID NO: 164705 - protein, 23 aa, Mycobacterium bovis
GAAVLMVALLVLASVLSRIFGDV

SEQ ID NO: 164706 - protein, 22 aa, Mycobacterium bovis
GALLALTRAILIRVRNASWQHD

SEQ ID NO: 164707 - protein, 32 aa, Mycobacterium bovis
GCLLWGLVTALLAAWGWFTSLLVITGTIAVTQ

SEQ ID NO: 164708 - protein, 19 aa, Mycobacterium bovis
GDPVAPPIPLLPARVDYDS

SEQ ID NO: 164709 - protein, 18 aa, Mycobacterium bovis
GFLQDFFATAVFLGITTF

SEQ ID NO: 164710 - protein, 27 aa, Mycobacterium bovis
GFRALFGAFLLGLLFFVATTSMIRYVS

SEQ ID NO: 164711 - protein, 34 aa, Mycobacterium bovis
GGPSPWAQTPRKTNPWPFVAGAAAVVLVLVLGAI

SEQ ID NO: 164712 - protein, 19 aa, Mycobacterium bovis
GGVVFTRVRLIGGLGALTA

SEQ ID NO: 164713 - protein, 22 aa, Mycobacterium bovis
GHLFYNRRLRAATTRFSVRMKH

SEQ ID NO: 164714 - protein, 25 aa, Mycobacterium bovis
GIALPFLVWVWLRHLRERRGYRPVQ

SEQ ID NO: 164715 - protein, 24 aa, Mycobacterium bovis
GIMWPSLLVILLLVAVVALLFTGR

SEQ ID NO: 164716 - protein, 22 aa, Mycobacterium bovis
GLFSAGLLTQLCGAPQWVRWAL

SEQ ID NO: 164717 - protein, 23 aa, Mycobacterium bovis
GLRDRVTAYAPLLLTAQNVIDAS

SEQ ID NO: 164718 - protein, 27 aa, Mycobacterium bovis
GLVLIKWWLLAIPHYLILAVFLSSGWR

SEQ ID NO: 164719 - protein, 31 aa, Mycobacterium bovis
GMAMRAWWETGRSLWWPLAIGILGIAVLVGS

SEQ ID NO: 164720 - protein, 17 aa, Mycobacterium bovis
GNGAPARRCRLAVLWFL

SEQ ID NO: 164721 - protein, 33 aa, Mycobacterium bovis
GPSPWAQTPRKTNPWPFVAGAAAVVLVLVLGAI

SEQ ID NO: 164722 - protein, 17 aa, Mycobacterium bovis
GPSPWAQTPRKTNPWPL

SEQ ID NO: 164723 - protein, 24 aa, Mycobacterium bovis
GSEPDFLRVWLPGQLLQGIGVGAT

SEQ ID NO: 164724 - protein, 22 aa, Mycobacterium bovis
GSGLLLLLPLSLETRTVVALLC

SEQ ID NO: 164725 - protein, 26 aa, Mycobacterium bovis
GSIERFFGILTEHYAGAFPAWLAPVQ

SEQ ID NO: 164726 - protein, 18 aa, Mycobacterium bovis
GSTYVIWGGKRSQIDPTN

SEQ ID NO: 164727 - protein, 24 aa, Mycobacterium bovis
GTDLDSVLKRFGPLTPPRAVAIIT

SEQ ID NO: 164728 - protein, 18 aa, Mycobacterium bovis
GTMLLRLCMLPGLALLVW

SEQ ID NO: 164729 - protein, 42 aa, Mycobacterium bovis
GTRDRYLLMPSFTFVGVAQAALWTGYRPWFIDIDANTWQPCV

SEQ ID NO: 164730 - protein, 24 aa, Mycobacterium bovis
GTTIVLLVRWLVARRAAAFMHQGL

SEQ ID NO: 164731 - protein, 28 aa, Mycobacterium bovis
GTVVVRWPGPVLAATLLIALIGLLALPK

SEQ ID NO: 164732 - protein, 24 aa, Mycobacterium bovis
GVEHLRWYDYPLAAALSLVVLFTL

SEQ ID NO: 164733 - protein, 17 aa, Mycobacterium bovis
GVGLLRRQDAVETFTAA

SEQ ID NO: 164734 - protein, 25 aa, Mycobacterium bovis
GVQTGLLWPAIFVAAFAALGLAVAL

SEQ ID NO: 164735 - protein, 20 aa, Mycobacterium bovis
GVRMWLFPGLSIVTVTGIVA

SEQ ID NO: 164736 - protein, 27 aa, Mycobacterium bovis
HASDPIAWWTPRLLFREPDWLREQRGY

SEQ ID NO: 164737 - protein, 24 aa, Mycobacterium bovis
HDDRRLLSLILLARDHVVHGWVLA

SEQ ID NO: 164738 - protein, 18 aa, Mycobacterium bovis
HHTNHKVPFMVLAGDRDV

SEQ ID NO: 164739 - protein, 24 aa, Mycobacterium bovis
HIPLWAGYACSTLIIFPLVVYGMK

SEQ ID NO: 164740 - protein, 17 aa, Mycobacterium bovis
HPEFVDVFLAIGRVGRS

SEQ ID NO: 164741 - protein, 25 aa, Mycobacterium bovis
HRRVVLIIYLWVGIGAFGAASSIFF

SEQ ID NO: 164742 - protein, 25 aa, Mycobacterium bovis
HVEDWFLITFAAVVLFVLARDLWGR

SEQ ID NO: 164743 - protein, 34 aa, Mycobacterium bovis
HVFEKLASILGLVAAPLMLLGLSACGRSAGKTSE

SEQ ID NO: 164744 - protein, 24 aa, Mycobacterium bovis
HYAGAFPAWLAPVQVVGIPVADEH

SEQ ID NO: 164745 - protein, 28 aa, Mycobacterium bovis
IAFGYSGLPFWPQGKPYDAYFTDAGGIT

SEQ ID NO: 164746 - protein, 26 aa, Mycobacterium bovis
IAFGYSGLPFWPQGKTYDAYFTDAGG

SEQ ID NO: 164747 - protein, 41 aa, Mycobacterium bovis
IDPWSTLKVSLLLSVALFFVWMITVAFLYLVLGGMGVWAKL

SEQ ID NO: 164748 - protein, 21 aa, Mycobacterium bovis
IGPPITDGFYYDFDVPEPFTP

SEQ ID NO: 164749 - protein, 18 aa, Mycobacterium bovis
IIGLFLAVYLMANIPGSS

SEQ ID NO: 164750 - protein, 17 aa, Mycobacterium bovis
ILNTRNVFGPPAWAPVV

SEQ ID NO: 164751 - protein, 20 aa, Mycobacterium bovis
IPKIPFIRPSFPGPAELAED

SEQ ID NO: 164752 - protein, 17 aa, Mycobacterium bovis
IRDAVLVLAAIATAIVV

SEQ ID NO: 164753 - protein, 29 aa, Mycobacterium bovis
IRGIGASLYALLVNRWPLPEAGVRSGLAP

SEQ ID NO: 164754 - protein, 44 aa, Mycobacterium bovis
ISGDFSMLTYNIAGLPFPLSSAILPRFFYTKEIGKRLNAYYVAN

SEQ ID NO: 164755 - protein, 17 aa, Mycobacterium bovis
ISRALFDGLPATEPLRV

SEQ ID NO: 164756 - protein, 21 aa, Mycobacterium bovis
IVSMQYSFLPSWLSFLVDKEN

SEQ ID NO: 164757 - protein, 25 aa, Mycobacterium bovis
IYTDPVPFPSFKNGVGLMLQLPQAT

SEQ ID NO: 164758 - protein, 28 aa, Mycobacterium bovis
KADFDPYQFLLIPLARITGIEDPALRES

SEQ ID NO: 164759 - protein, 17 aa, Mycobacterium bovis
KGKVWTGLLGMFVVVLL

SEQ ID NO: 164760 - protein, 21 aa, Mycobacterium bovis
KLMPWLWVAWFGLGSFGVLML

SEQ ID NO: 164761 - protein, 34 aa, Mycobacterium bovis
KRPSRWRHVPAILLVLSLLLFTIAMAGPTHDVRI

SEQ ID NO: 164762 - protein, 32 aa, Mycobacterium bovis
KVSLLLSVALFFVWMITVAFLYLVLGGMGVWA

SEQ ID NO: 164763 - protein, 21 aa, Mycobacterium bovis
LAAAVLYFLAIGQVKGFAFTL

SEQ ID NO: 164764 - protein, 23 aa, Mycobacterium bovis
LAAGVLLWLFVRHEHRAAFPLVD

SEQ ID NO: 164765 - protein, 18 aa, Mycobacterium bovis
LAGGLGAAGYFALRSHQE

SEQ ID NO: 164766 - protein, 24 aa, Mycobacterium bovis
LAHSPDLDWKSVWDHGWSAAAEAA

SEQ ID NO: 164767 - protein, 17 aa, Mycobacterium bovis
LAIVAAMGCAFVALLRP

SEQ ID NO: 164768 - protein, 20 aa, Mycobacterium bovis
LALGWWQWTRFQSTSGTFQN

SEQ ID NO: 164769 - protein, 19 aa, Mycobacterium bovis
LARLTTAMLTLYFILAVGA

SEQ ID NO: 164770 - protein, 22 aa, Mycobacterium bovis
LDAAPAVLPPMGPKLGLKAQRR

SEQ ID NO: 164771 - protein, 32 aa, Mycobacterium bovis
LDPALSRWQWLVKWFLAIPHYIVLFFLHVAAV

SEQ ID NO: 164772 - protein, 24 aa, Mycobacterium bovis
LDRLTLFVTGIWLVSIIGVALLIK

SEQ ID NO: 164773 - protein, 23 aa, Mycobacterium bovis
LERQWRARMAGLRTNALVATGAT

SEQ ID NO: 164774 - protein, 24 aa, Mycobacterium bovis
LEVNTLFQSLIDLLHKIDPLETNA

SEQ ID NO: 164775 - protein, 17 aa, Mycobacterium bovis
LFCLLAPVGVIPILLPD

SEQ ID NO: 164776 - protein, 17 aa, Mycobacterium bovis
LFGWGIAVTLGVVCGLI

SEQ ID NO: 164777 - protein, 21 aa, Mycobacterium bovis
LGGVWLTSFLLVATNTAIASV

SEQ ID NO: 164778 - protein, 17 aa, Mycobacterium bovis
LGLTLWLSTDAAERSYQ

SEQ ID NO: 164779 - protein, 29 aa, Mycobacterium bovis
LGNLRSLPVPFILNQPPPPPGPVPAPGPA

SEQ ID NO: 164780 - protein, 26 aa, Mycobacterium bovis
LGPLYGIFIVWLLHDWRDVFWINVPL

SEQ ID NO: 164781 - protein, 25 aa, Mycobacterium bovis
LGRVPMAVVPLFVAAMLLVPAAGSV

SEQ ID NO: 164782 - protein, 25 aa, Mycobacterium bovis
LGSVAAVLVVPWPAGAQVLIRFTGP

SEQ ID NO: 164783 - protein, 25 aa, Mycobacterium bovis
LIEQPIRRWRPARVPLLPLAAATVA

SEQ ID NO: 164784 - protein, 19 aa, Mycobacterium bovis
LIGGPRMWERRPGAADFCR

SEQ ID NO: 164785 - protein, 22 aa, Mycobacterium bovis
LIMGLHPLIFFLTVRQGANWVV

SEQ ID NO: 164786 - protein, 24 aa, Mycobacterium bovis
LIRFQTAFVSGPLRRASPSAVHPV

SEQ ID NO: 164787 - protein, 28 aa, Mycobacterium bovis
LIRFTGPEVWWVLRVAHWASGVPAATVP

SEQ ID NO: 164788 - protein, 17 aa, Mycobacterium bovis
LLDKIFYRSGQGVTLQA

SEQ ID NO: 164789 - protein, 19 aa, Mycobacterium bovis
LLLLFVYRPLADNIRLSFF

SEQ ID NO: 164790 - protein, 27 aa, Mycobacterium bovis
LLLSVALFFVWMITVAFLYLVLGGMGV

SEQ ID NO: 164791 - protein, 28 aa, Mycobacterium bovis
LLLSVALFFVWMITVAFLYLVLGGMGVW

SEQ ID NO: 164792 - protein, 17 aa, Mycobacterium bovis
LLNPLIAGAAMAFSSFF

SEQ ID NO: 164793 - protein, 26 aa, Mycobacterium bovis
LLRLCMLPGLALLVWATPRLASHLGT

SEQ ID NO: 164794 - protein, 19 aa, Mycobacterium bovis
LLSPLALATNGAAIGIGLV

SEQ ID NO: 164795 - protein, 17 aa, Mycobacterium bovis
LLVDFKGGATFLDLAGA

SEQ ID NO: 164796 - protein, 26 aa, Mycobacterium bovis
LLVVEGVAINFWLLRRDSVTVGTDDD

SEQ ID NO: 164797 - protein, 17 aa, Mycobacterium bovis
LMLGTAAGVLLIGLVRW

SEQ ID NO: 164798 - protein, 25 aa, Mycobacterium bovis
LMVGSAVLTYLSYTAAFTSTDTVTV

SEQ ID NO: 164799 - protein, 18 aa, Mycobacterium bovis
LPDSLADYLRGFIQERWI

SEQ ID NO: 164800 - protein, 22 aa, Mycobacterium bovis
LPLRVRLVAATLILVATGLVAS

SEQ ID NO: 164801 - protein, 21 aa, Mycobacterium bovis
LRATLFVIALGFLVQITGINA

SEQ ID NO: 164802 - protein, 19 aa, Mycobacterium bovis
LRLLVVSALATLSGLGTPV

SEQ ID NO: 164803 - protein, 26 aa, Mycobacterium bovis
LRSRWLGMPAGLRLTVPVAAVLTMVG

SEQ ID NO: 164804 - protein, 32 aa, Mycobacterium bovis
LSASLGWILPVIAQLVWWAVHPQPPWPHLAAA

SEQ ID NO: 164805 - protein, 26 aa, Mycobacterium bovis
LTARKRIAWLVLLANMVLAAVVNAAE

SEQ ID NO: 164806 - protein, 27 aa, Mycobacterium bovis
LTMVGVAVYAWIRPLPDDWSQLPKRLS

SEQ ID NO: 164807 - protein, 19 aa, Mycobacterium bovis
LTRFRSPLRGPWLTSVFGL

SEQ ID NO: 164808 - protein, 17 aa, Mycobacterium bovis
LTVAMKHIKEPPPPLPP

SEQ ID NO: 164809 - protein, 19 aa, Mycobacterium bovis
LVALPLAGAAILLFGGRRT

SEQ ID NO: 164810 - protein, 19 aa, Mycobacterium bovis
LVATGFVVFALYCGISRIG

SEQ ID NO: 164811 - protein, 20 aa, Mycobacterium bovis
LVAYLALLIGLGFGLLAVGA

SEQ ID NO: 164812 - protein, 36 aa, Mycobacterium bovis
LVERRPSRLRRGWLVGIAATLLALAGGLGAAGYFAL

SEQ ID NO: 164813 - protein, 25 aa, Mycobacterium bovis
LVPAALVSWIVTAAGIVWPIGNVCA

SEQ ID NO: 164814 - protein, 18 aa, Mycobacterium bovis
LVVAMVLAGLRVEAAMAS

SEQ ID NO: 164815 - protein, 25 aa, Mycobacterium bovis
LVVFAGFLVGMFYLVAATDVIDVAA

SEQ ID NO: 164816 - protein, 21 aa, Mycobacterium bovis
LVVLLVLLHRAKGGGLSTLFG

SEQ ID NO: 164817 - protein, 20 aa, Mycobacterium bovis
LVVPTVALAVPWLTQLQRLF

SEQ ID NO: 164818 - protein, 18 aa, Mycobacterium bovis
LVVWGIWHVYFVEAVFPN

SEQ ID NO: 164819 - protein, 25 aa, Mycobacterium bovis
MALPTGCILAWILVRIINVRSFGWT

SEQ ID NO: 164820 - protein, 25 aa, Mycobacterium bovis
MLAIAMLLMLVPLATGCLRVRASIT

SEQ ID NO: 164821 - protein, 26 aa, Mycobacterium bovis
MLSKWPVGWVVVLLYAVCVVLRLARY

SEQ ID NO: 164822 - protein, 17 aa, Mycobacterium bovis
MLSRRRPMLNLFAFWVG

SEQ ID NO: 164823 - protein, 22 aa, Mycobacterium bovis
MLVSSWQMPGGIYAPMMHPWST

SEQ ID NO: 164824 - protein, 21 aa, Mycobacterium bovis
MTQLGFIAILVGLVVLAAAGG

SEQ ID NO: 164825 - protein, 24 aa, Mycobacterium bovis
MVGVAVYAWIRPLPDDWSQLPKRL

SEQ ID NO: 164826 - protein, 17 aa, Mycobacterium bovis
NAATSIVGFISPTGRYL

SEQ ID NO: 164827 - protein, 24 aa, Mycobacterium bovis
NGKRPKLRRILSDPDARVIVVEHR

SEQ ID NO: 164828 - protein, 26 aa, Mycobacterium bovis
NLILAAINLLPLLPFDGGHIAVAVFE

SEQ ID NO: 164829 - protein, 17 aa, Mycobacterium bovis
NLLIGIGAGAAVLMVAL

SEQ ID NO: 164830 - protein, 20 aa, Mycobacterium bovis
NPLTMVPAPTRRWAARRRGG

SEQ ID NO: 164831 - protein, 24 aa, Mycobacterium bovis
NTNSSQFFMVYRDSKLPPQYTVFG

SEQ ID NO: 164832 - protein, 26 aa, Mycobacterium bovis
NVQEDFAYHQFLIKKSKMPSQTPPEP

SEQ ID NO: 164833 - protein, 23 aa, Mycobacterium bovis
NVVALSFLLLHAVTWFGSAPRAM

SEQ ID NO: 164834 - protein, 27 aa, Mycobacterium bovis
NWTHPDPATLWTLIGGPRMWERRPGAA

SEQ ID NO: 164835 - protein, 27 aa, Mycobacterium bovis
NYQMAVEPIIWRTYAQTLPPDAIETTI

SEQ ID NO: 164836 - protein, 18 aa, Mycobacterium bovis
PAFKLTRSSAAYWRGDQK

SEQ ID NO: 164837 - protein, 26 aa, Mycobacterium bovis
PAQPPKPRVFAIKPPCPEPAAADPTD

SEQ ID NO: 164838 - protein, 28 aa, Mycobacterium bovis
PATRHPTFLAFPMMMLVSLVVTAVTGRG

SEQ ID NO: 164839 - protein, 22 aa, Mycobacterium bovis
PCAVVLATMPPLLAAIANAGRH

SEQ ID NO: 164840 - protein, 24 aa, Mycobacterium bovis
PDDLLNALIDFLAAVRNGLVPIIE

SEQ ID NO: 164841 - protein, 23 aa, Mycobacterium bovis
PDDWSQLPKRLSCQLRPGPTPPA

SEQ ID NO: 164842 - protein, 29 aa, Mycobacterium bovis
PEERLNLPPIPLQLPTPRPAPPGSAAAKY

SEQ ID NO: 164843 - protein, 18 aa, Mycobacterium bovis
PEPRPAPPPAKPAPPAGP

SEQ ID NO: 164844 - protein, 21 aa, Mycobacterium bovis
PEVLNLLLVDFKGGATFLDLA

SEQ ID NO: 164845 - protein, 31 aa, Mycobacterium bovis
PGPLVATVFDLVFQPGKLPDSLADYLRGFIQ

SEQ ID NO: 164846 - protein, 36 aa, Mycobacterium bovis
PGPLVATVFDLVFQPGKLPDSLADYLRGFIQERWII

SEQ ID NO: 164847 - protein, 28 aa, Mycobacterium bovis
PHTGQRWLPLILAGFTSGFLLLRGRSYV

SEQ ID NO: 164848 - protein, 17 aa, Mycobacterium bovis
PICILGLFFKDDIRSGV

SEQ ID NO: 164849 - protein, 25 aa, Mycobacterium bovis
PILPTQILWINMTTAIALGLMLAFE

SEQ ID NO: 164850 - protein, 28 aa, Mycobacterium bovis
PINQLHRITWIVTMYLLGYIAAMPLLGR

SEQ ID NO: 164851 - protein, 19 aa, Mycobacterium bovis
PIPGRLFAGPGLSQPSDVL

SEQ ID NO: 164852 - protein, 24 aa, Mycobacterium bovis
PLDEPPMLGALLRDAEPAQAELAV

SEQ ID NO: 164853 - protein, 22 aa, Mycobacterium bovis
PLEVLFSSLLWIDGRNLEPYLL

SEQ ID NO: 164854 - protein, 18 aa, Mycobacterium bovis
PLIGVRKAGLFTSSSFVL

SEQ ID NO: 164855 - protein, 22 aa, Mycobacterium bovis
PNFTVLVILRLLYGIGMGGEWG

SEQ ID NO: 164856 - protein, 23 aa, Mycobacterium bovis
PPRGVWYLGPLPVRAYAVCVITG

SEQ ID NO: 164857 - protein, 19 aa, Mycobacterium bovis
PPVFFARRPLQIALTLMWP

SEQ ID NO: 164858 - protein, 26 aa, Mycobacterium bovis
PQAATAPPLPPFKPSANLGANCQYPP

SEQ ID NO: 164859 - protein, 19 aa, Mycobacterium bovis
PQFSLWLVPLAVLALPHRR

SEQ ID NO: 164860 - protein, 22 aa, Mycobacterium bovis
PQVPVFALGRYAGVRRQAILAM

SEQ ID NO: 164861 - protein, 21 aa, Mycobacterium bovis
PRSPLALRVDGLRSRWLGMPA

SEQ ID NO: 164862 - protein, 31 aa, Mycobacterium bovis
PSQTPPEPPTLLWPIGVPFSDGLNTLSEFKV

SEQ ID NO: 164863 - protein, 19 aa, Mycobacterium bovis
PVLENLPAVLPTVVAPPLT

SEQ ID NO: 164864 - protein, 18 aa, Mycobacterium bovis
PVMWALSASLGWILPVIA

SEQ ID NO: 164865 - protein, 22 aa, Mycobacterium bovis
PVTRRAVLTLYPHCAPKIGVPS

SEQ ID NO: 164866 - protein, 43 aa, Mycobacterium bovis
PWAGGAPPWGPPSSPLPRSARQPWLWVGVAVAVVVALAGGLGI

SEQ ID NO: 164867 - protein, 17 aa, Mycobacterium bovis
PYPEQRPPWGVPPPGWD

SEQ ID NO: 164868 - protein, 44 aa, Mycobacterium bovis
QALVERRPSRLRRGWLVGIAATLLALAGGLGAAGYFALRSHQES

SEQ ID NO: 164869 - protein, 20 aa, Mycobacterium bovis
QDAIRWAALVALVAIGAGLI

SEQ ID NO: 164870 - protein, 24 aa, Mycobacterium bovis
QFLDDPRWIAILAAVLTVSGPWLP

SEQ ID NO: 164871 - protein, 19 aa, Mycobacterium bovis
QGRAYWIHLMIASQTIESR

SEQ ID NO: 164872 - protein, 35 aa, Mycobacterium bovis
QHVFEKLASILGLVAAPLMLLGLSACGRSAGKTSE

SEQ ID NO: 164873 - protein, 26 aa, Mycobacterium bovis
QIAEGALLIVIFATSGALEALVTART

SEQ ID NO: 164874 - protein, 17 aa, Mycobacterium bovis
QLFHTSGHLDWYADGMF

SEQ ID NO: 164875 - protein, 18 aa, Mycobacterium bovis
QLPKRLSCQLRPGPTPPA

SEQ ID NO: 164876 - protein, 25 aa, Mycobacterium bovis
QMSTIQLDFNFPERFGLEYTAADGT

SEQ ID NO: 164877 - protein, 23 aa, Mycobacterium bovis
QRPPWGVPPPGWDGSSRPAPSTT

SEQ ID NO: 164878 - protein, 23 aa, Mycobacterium bovis
QTPKVFKAAAWVAIAAGTVFIVA

SEQ ID NO: 164879 - protein, 20 aa, Mycobacterium bovis
QVGLGYFRKSLEDIIRFQAE

SEQ ID NO: 164880 - protein, 21 aa, Mycobacterium bovis
QYNTYLKQYLALYTNGMNDVV

SEQ ID NO: 164881 - protein, 18 aa, Mycobacterium bovis
RAGLRFAAPLIAAGLRAL

SEQ ID NO: 164882 - protein, 30 aa, Mycobacterium bovis
RALRASATRRALLLTALGGLLIAGLVTAIP

SEQ ID NO: 164883 - protein, 33 aa, Mycobacterium bovis
RARRDPLTVFLVLIIVFSLVLAGLIGGELYARH

SEQ ID NO: 164884 - protein, 27 aa, Mycobacterium bovis
RFSAADKPVIFWTPDHGAFVVRGAMVA

SEQ ID NO: 164885 - protein, 24 aa, Mycobacterium bovis
RGLLRAMICQLAVWHSPEELLIAG

SEQ ID NO: 164886 - protein, 19 aa, Mycobacterium bovis
RGWLRRFAERAEAVRSVFT

SEQ ID NO: 164887 - protein, 19 aa, Mycobacterium bovis
RHIVRLVVFAGFLVGMFYL

SEQ ID NO: 164888 - protein, 20 aa, Mycobacterium bovis
RIMLALLVPVLPFAFSYAIY

SEQ ID NO: 164889 - protein, 25 aa, Mycobacterium bovis
RITDVLTLALVGFLGGLITGISPCI

SEQ ID NO: 164890 - protein, 27 aa, Mycobacterium bovis
RIVRRSNALLDWAYGRRFRYSETMSVG

SEQ ID NO: 164891 - protein, 19 aa, Mycobacterium bovis
RLDSLFRLDHLAARLRRNS

SEQ ID NO: 164892 - protein, 36 aa, Mycobacterium bovis
RLLQDGRDMFWSLAPLVVGCILLAGLVGMCSFQLGG

SEQ ID NO: 164893 - protein, 17 aa, Mycobacterium bovis
RLLRTFLRDVPNQVVLA

SEQ ID NO: 164894 - protein, 21 aa, Mycobacterium bovis
RLLTMWSTVLVLALSVICEPV

SEQ ID NO: 164895 - protein, 19 aa, Mycobacterium bovis
RLTLIVFVAMTLAAGLLIS

SEQ ID NO: 164896 - protein, 19 aa, Mycobacterium bovis
RLVVRFAEPLPPSPSGSFA

SEQ ID NO: 164897 - protein, 25 aa, Mycobacterium bovis
RNRAHWDWLKWLPHNQHPNACDALG

SEQ ID NO: 164898 - protein, 21 aa, Mycobacterium bovis
RPLAPWAVVLVAAAGATYLLT

SEQ ID NO: 164899 - protein, 20 aa, Mycobacterium bovis
RPSRPIVLLIPVPGSSVIHD

SEQ ID NO: 164900 - protein, 34 aa, Mycobacterium bovis
RRARRDPLTVFLVLIIVFSLVLAGLIGGELYARH

SEQ ID NO: 164901 - protein, 17 aa, Mycobacterium bovis
RRIVVANLIVAVTFIAG

SEQ ID NO: 164902 - protein, 18 aa, Mycobacterium bovis
RRLLPLLFVLYVINFVDR

SEQ ID NO: 164903 - protein, 17 aa, Mycobacterium bovis
RRRHIVRLVVFAGFLVG

SEQ ID NO: 164904 - protein, 19 aa, Mycobacterium bovis
RRRRNLLIGIGAGAAVLMV

SEQ ID NO: 164905 - protein, 22 aa, Mycobacterium bovis
RRSWHAPRLGSISAGLVAVGMV

SEQ ID NO: 164906 - protein, 20 aa, Mycobacterium bovis
RRWRFWRRGRRPLETKVVLD

SEQ ID NO: 164907 - protein, 30 aa, Mycobacterium bovis
RSIHPHIPGVPWWAAILIAVTATAIGYAID

SEQ ID NO: 164908 - protein, 19 aa, Mycobacterium bovis
RSLRPLAEFEQTAAAIGAG

SEQ ID NO: 164909 - protein, 19 aa, Mycobacterium bovis
RSPLALRVDGLRSRWLGMP

SEQ ID NO: 164910 - protein, 25 aa, Mycobacterium bovis
RSRWLGMPAGLRLTVPVAAVLTMVG

SEQ ID NO: 164911 - protein, 32 aa, Mycobacterium bovis
RSYMTPALATLLGRWFWWPRRVDRLARQPQVL

SEQ ID NO: 164912 - protein, 28 aa, Mycobacterium bovis
RTLANKVPFVVLVIGSLGVGLGLTLWLS

SEQ ID NO: 164913 - protein, 18 aa, Mycobacterium bovis
SAWGLYRFNQILAGLSAA

SEQ ID NO: 164914 - protein, 25 aa, Mycobacterium bovis
SCIFVAWFVLYLVLVLRAVGAGGNS

SEQ ID NO: 164915 - protein, 21 aa, Mycobacterium bovis
SDYSPVFGCLFKGIARGVKEF

SEQ ID NO: 164916 - protein, 29 aa, Mycobacterium bovis
SEVSEFSWQLERVLPVPVFAQTMAQVTVA

SEQ ID NO: 164917 - protein, 26 aa, Mycobacterium bovis
SGLVLAYLGLLWWMMVCWSQPLRARP

SEQ ID NO: 164918 - protein, 24 aa, Mycobacterium bovis
SGNPLMVLLEYLPHARDLSLHLVV

SEQ ID NO: 164919 - protein, 38 aa, Mycobacterium bovis
SIAVIAIMLFIAYRSLSAALIMLLTVGLELLAVRGIIS

SEQ ID NO: 164920 - protein, 23 aa, Mycobacterium bovis
SKFTISMLWPGDRAWRQAGERRM

SEQ ID NO: 164921 - protein, 21 aa, Mycobacterium bovis
SLIERFPLMLGTAAGVLLIGL

SEQ ID NO: 164922 - protein, 19 aa, Mycobacterium bovis
SLLGLAVGWLVGALVVLVV

SEQ ID NO: 164923 - protein, 25 aa, Mycobacterium bovis
SPPSHLWQARLAPDAKPYQGGHRFH

SEQ ID NO: 164924 - protein, 22 aa, Mycobacterium bovis
SPWAQTPRKTNPWPLVAGAAAV

SEQ ID NO: 164925 - protein, 23 aa, Mycobacterium bovis
SRTDYGLPVREPGARLVPGAAVP

SEQ ID NO: 164926 - protein, 25 aa, Mycobacterium bovis
SRTGNLVTWWTGDALLVFDAGNLTQ

SEQ ID NO: 164927 - protein, 25 aa, Mycobacterium bovis
SRVAALPLWAWLLTVAAMSFGGPGD

SEQ ID NO: 164928 - protein, 21 aa, Mycobacterium bovis
SRVGFLGWSMGGYGALLLGAR

SEQ ID NO: 164929 - protein, 25 aa, Mycobacterium bovis
SVGRWVAVVAVLAVLTVVVTIAINT

SEQ ID NO: 164930 - protein, 19 aa, Mycobacterium bovis
SVVGLVHTPGLVTLAPGAR

SEQ ID NO: 164931 - protein, 19 aa, Mycobacterium bovis
SWAIGVMLAILALISLVCT

SEQ ID NO: 164932 - protein, 25 aa, Mycobacterium bovis
TAGAVFLSAWLPFNNGLRPEPLIAL

SEQ ID NO: 164933 - protein, 26 aa, Mycobacterium bovis
TFVGVAQAALWTGYRPWFIDIDANTW

SEQ ID NO: 164934 - protein, 30 aa, Mycobacterium bovis
TFVGVAQAALWTGYRPWFIDIDANTWQPCV

SEQ ID NO: 164935 - protein, 24 aa, Mycobacterium bovis
TGAQLPCLPILFIVVDEFSELLSQ

SEQ ID NO: 164936 - protein, 18 aa, Mycobacterium bovis
TGATFCLSFARMPYFQTL

SEQ ID NO: 164937 - protein, 36 aa, Mycobacterium bovis
TGLTAKLIIWYPHYAWLLLSVYLTVALVALVVVGSM

SEQ ID NO: 164938 - protein, 27 aa, Mycobacterium bovis
TGRQATTLLALLAGVFGGAASCAAPIQ

SEQ ID NO: 164939 - protein, 18 aa, Mycobacterium bovis
TGYRPWFIDIDANTWQPC

SEQ ID NO: 164940 - protein, 35 aa, Mycobacterium bovis
TIAALAAIGVLLGWPLWWVSTCSVLVLLVVEGVAI

SEQ ID NO: 164941 - protein, 22 aa, Mycobacterium bovis
TLAVRALPIVLLTALVFFNTYV

SEQ ID NO: 164942 - protein, 26 aa, Mycobacterium bovis
TLDSMIGYRSPRYLRFGWAAARLDDW

SEQ ID NO: 164943 - protein, 27 aa, Mycobacterium bovis
TLVVGYALLPVLWIFSLSLKPTSTVKD

SEQ ID NO: 164944 - protein, 17 aa, Mycobacterium bovis
TMFFVLVTGIISAAQVF

SEQ ID NO: 164945 - protein, 57 aa, Mycobacterium bovis
TNPIQALITYGPLLFALGYQIFFNLVGWPTWGMILSSPFLLPAGLGLGLAAIAFLPI

SEQ ID NO: 164946 - protein, 17 aa, Mycobacterium bovis
TNPWPLVAGAAAVVLVL

SEQ ID NO: 164947 - protein, 24 aa, Mycobacterium bovis
TNQADLRLVLLRPGKEDDEPIQRI

SEQ ID NO: 164948 - protein, 26 aa, Mycobacterium bovis
TPRQPWAWLALLVAGLTVGLFITQGR

SEQ ID NO: 164949 - protein, 21 aa, Mycobacterium bovis
TPRSPGRWSLVAALALAVVSL

SEQ ID NO: 164950 - protein, 18 aa, Mycobacterium bovis
TQLDWVGQLTLIPAVALI

SEQ ID NO: 164951 - protein, 25 aa, Mycobacterium bovis
TSAVTLLSSLLLICVVAYHAAPALS

SEQ ID NO: 164952 - protein, 25 aa, Mycobacterium bovis
TTAQWVILALLAVALPLASLVGWLV

SEQ ID NO: 164953 - protein, 21 aa, Mycobacterium bovis
TVLTLRRWLRPATAAVVCCLA

SEQ ID NO: 164954 - protein, 26 aa, Mycobacterium bovis
TVRTGLLWWTVAIHLLASMTMVWLAV

SEQ ID NO: 164955 - protein, 18 aa, Mycobacterium bovis
TVTFMLVWLINHHGWSVA

SEQ ID NO: 164956 - protein, 22 aa, Mycobacterium bovis
TVVFGVLRWFFTTYRIDDENVS

SEQ ID NO: 164957 - protein, 21 aa, Mycobacterium bovis
TVVGFILALLLREVPLTDIHD

SEQ ID NO: 164958 - protein, 21 aa, Mycobacterium bovis
TVVRWRLAWLSKPETWRRRKR

SEQ ID NO: 164959 - protein, 26 aa, Mycobacterium bovis
TVVVRWPGPVLAATLLIALIGLLALP

SEQ ID NO: 164960 - protein, 27 aa, Mycobacterium bovis
TVVVRWPGPVLAATLLIALIGLLALPK

SEQ ID NO: 164961 - protein, 20 aa, Mycobacterium bovis
VASELLMPWPSAAASGVVGW

SEQ ID NO: 164962 - protein, 25 aa, Mycobacterium bovis
VAVTAYFRMGWWSIIGYAAAAIIGV

SEQ ID NO: 164963 - protein, 26 aa, Mycobacterium bovis
VAVTLAVFAVPPLWGETLQRALLRAM

SEQ ID NO: 164964 - protein, 17 aa, Mycobacterium bovis
VAYALWSAIGTAAIVLV

SEQ ID NO: 164965 - protein, 22 aa, Mycobacterium bovis
VDWTRWWVMITLDVAIVYILYA

SEQ ID NO: 164966 - protein, 31 aa, Mycobacterium bovis
VERRPSRLRRGWLVGIAATLLALAGGLGAAG

SEQ ID NO: 164967 - protein, 20 aa, Mycobacterium bovis
VGFAMLGALTFVPIYLGYVD

SEQ ID NO: 164968 - protein, 19 aa, Mycobacterium bovis
VGTLLSWYALVAAVTTVPL

SEQ ID NO: 164969 - protein, 28 aa, Mycobacterium bovis
VGVQLVVVLTAAWLLAMPLTQSKEQPEL

SEQ ID NO: 164970 - protein, 24 aa, Mycobacterium bovis
VHHSRWHFAVLYTFLSMVNSCLGL

SEQ ID NO: 164971 - protein, 18 aa, Mycobacterium bovis
VKEFAPLIGVRKAGLFTS

SEQ ID NO: 164972 - protein, 31 aa, Mycobacterium bovis
VLATGVLGWWRWHHNTWLTTIYTAVIGVLVL

SEQ ID NO: 164973 - protein, 20 aa, Mycobacterium bovis
VLAYAWLMPVSTVVQAMIGG

SEQ ID NO: 164974 - protein, 30 aa, Mycobacterium bovis
VLGTWQVSGRLLFALLSFSVVGAVLALATP

SEQ ID NO: 164975 - protein, 23 aa, Mycobacterium bovis
VNRHTAYRWFREGTLPVPAERVG

SEQ ID NO: 164976 - protein, 23 aa, Mycobacterium bovis
VPWWWWPLAFALAALIAFEVNLG

SEQ ID NO: 164977 - protein, 18 aa, Mycobacterium bovis
VRRFVYLVLLMTAFNWMS

SEQ ID NO: 164978 - protein, 42 aa, Mycobacterium bovis
VSKGNQFVMPDLSGMFWVDAEPRLRALGWTGMLDKGADVDAG

SEQ ID NO: 164979 - protein, 25 aa, Mycobacterium bovis
VSPGTRWPQPTPWAGGAPPWGPPSS

SEQ ID NO: 164980 - protein, 19 aa, Mycobacterium bovis
VTILLAVALVFDLPAALQR

SEQ ID NO: 164981 - protein, 26 aa, Mycobacterium bovis
VVASLCLIFIIMLGITRSVVASAVIV

SEQ ID NO: 164982 - protein, 17 aa, Mycobacterium bovis
VVGTSRRSRWARLFDEG

SEQ ID NO: 164983 - protein, 18 aa, Mycobacterium bovis
VVGTSRRSRWARLFDEGI

SEQ ID NO: 164984 - protein, 17 aa, Mycobacterium bovis
VVIWKHILGDNLHWSVL

SEQ ID NO: 164985 - protein, 19 aa, Mycobacterium bovis
VVLVLVAIVLFAAASLLFG

SEQ ID NO: 164986 - protein, 27 aa, Mycobacterium bovis
VVMLLAVTVSLLTIPFAAAAGTAVHDS

SEQ ID NO: 164987 - protein, 25 aa, Mycobacterium bovis
VVSQLLGCTPLDPLGWAQATAAATA

SEQ ID NO: 164988 - protein, 18 aa, Mycobacterium bovis
VYTELWVGFTAVSALLIL

SEQ ID NO: 164989 - protein, 17 aa, Mycobacterium bovis
WEMSFLYAIVFGGFVAF

SEQ ID NO: 164990 - protein, 18 aa, Mycobacterium bovis
WERRPGAADFCRIRVGVG

SEQ ID NO: 164991 - protein, 19 aa, Mycobacterium bovis
WGMLENPLTMVPAPTRRWA

SEQ ID NO: 164992 - protein, 21 aa, Mycobacterium bovis
WLDIAVLAVAFIAAISGWRAG

SEQ ID NO: 164993 - protein, 22 aa, Mycobacterium bovis
WLEVLAMIALLPAAAALGGLFA

SEQ ID NO: 164994 - protein, 17 aa, Mycobacterium bovis
WLPPLDEPPMLGALLRD

SEQ ID NO: 164995 - protein, 20 aa, Mycobacterium bovis
WPVDRPFAMLTVARSLMLDV

SEQ ID NO: 164996 - protein, 20 aa, Mycobacterium bovis
WRFRRRPAPARLPLWACGAA

SEQ ID NO: 164997 - protein, 17 aa, Mycobacterium bovis
WVALTIVVNVVAPQLQS

SEQ ID NO: 164998 - protein, 20 aa, Mycobacterium bovis
YAPMMHPWSTGKDVYFSLSL

SEQ ID NO: 164999 - protein, 25 aa, Mycobacterium bovis
YAVAALWALLLAYSASRRFFALRRF

SEQ ID NO: 165000 - protein, 20 aa, Mycobacterium bovis
YAYLAPWQLSAHRWYTWVIA

SEQ ID NO: 165001 - protein, 18 aa, Mycobacterium bovis
YEWFRIMPTAVDVLDSIG

SEQ ID NO: 165002 - protein, 22 aa, Mycobacterium bovis
YGALLLGARLGPARTAGICAIS

SEQ ID NO: 165003 - protein, 17 aa, Mycobacterium bovis
YIYIPFQYLSVVLGAYL

SEQ ID NO: 165004 - protein, 22 aa, Mycobacterium bovis
YLVLGMIILTPPLLREWTHYDS

SEQ ID NO: 165005 - protein, 17 aa, Mycobacterium bovis
YSFVVLLITGVYLTLFF

SEQ ID NO: 165006 - protein, 17 aa, Mycobacterium bovis
YWIHLMIASQTIESRAE

SEQ ID NO: 165007 - protein, 21 aa, Mycobacterium bovis
YWVRKPTYHNSFWYSSCMVTF

SEQ ID NO: 165008 - protein, 20 aa, Mycobacterium bovis
LFVAAYVPYVAWLVQASADS

SEQ ID NO: 165009 - protein, 21 aa, Mycobacterium bovis
PVSWIMWVWYRLFAFVLGPSN

SEQ ID NO: 165010 - protein, 23 aa, Mycobacterium bovis
AAALALFVLLLGPTLFLLQSWVQ

SEQ ID NO: 165011 - protein, 19 aa, Mycobacterium bovis
AAGMFLAVWLPLDNGLRPE

SEQ ID NO: 165012 - protein, 21 aa, Mycobacterium bovis
AAIAFLPIVLAPAVIPPASTP

SEQ ID NO: 165013 - protein, 21 aa, Mycobacterium bovis
AALLGRWFWWPLRVRPRPASQ

SEQ ID NO: 165014 - protein, 24 aa, Mycobacterium bovis
AAQEWLKSILPFGGFPWGSVAFGQ

SEQ ID NO: 165015 - protein, 18 aa, Mycobacterium bovis
AASLLWYLKVVGSQPDFL

SEQ ID NO: 165016 - protein, 22 aa, Mycobacterium bovis
AAVTALALLRRASLRQAVADGV

SEQ ID NO: 165017 - protein, 24 aa, Mycobacterium bovis
AAVTLLPAILVLASPRGWVAPRGE

SEQ ID NO: 165018 - protein, 20 aa, Mycobacterium bovis
AAWLALLGLPLLLVAHRLPD

SEQ ID NO: 165019 - protein, 19 aa, Mycobacterium bovis
AEKLVFPVLLGILTLLLSA

SEQ ID NO: 165020 - protein, 24 aa, Mycobacterium bovis
AGELLFWLPYPSFATYLHVGCAQI

SEQ ID NO: 165021 - protein, 25 aa, Mycobacterium bovis
AGFLMLLWVFIWSVLRILKTDIYAP

SEQ ID NO: 165022 - protein, 17 aa, Mycobacterium bovis
AGLAFTLGMVLTSTLMV

SEQ ID NO: 165023 - protein, 21 aa, Mycobacterium bovis
AGWFGLFGLAFWVALAGLTPS

SEQ ID NO: 165024 - protein, 26 aa, Mycobacterium bovis
AHARRLLRRLLVAAVLFVPLADLSTL

SEQ ID NO: 165025 - protein, 20 aa, Mycobacterium bovis
AIGLLLFPQGFLKSLTYATI

SEQ ID NO: 165026 - protein, 19 aa, Mycobacterium bovis
AIGVLWWFMVVQLPFAGIV

SEQ ID NO: 165027 - protein, 20 aa, Mycobacterium bovis
AIVVLGWYYLRIPSLVGIGQ

SEQ ID NO: 165028 - protein, 25 aa, Mycobacterium bovis
AIYNYTWLVLMLPFGMIGVTVLTVV

SEQ ID NO: 165029 - protein, 25 aa, Mycobacterium bovis
AKVWGFLFIYFWLRATLPRLRYDQF

SEQ ID NO: 165030 - protein, 22 aa, Mycobacterium bovis
ALALLGVRRYVFARPPLLGTTG

SEQ ID NO: 165031 - protein, 20 aa, Mycobacterium bovis
ALALLPISWQLGVAALAGVP

SEQ ID NO: 165032 - protein, 19 aa, Mycobacterium bovis
ALALYLAAALMIWAQARLL

SEQ ID NO: 165033 - protein, 21 aa, Mycobacterium bovis
ALGILVMVVWVGTALTISTTA

SEQ ID NO: 165034 - protein, 17 aa, Mycobacterium bovis
ALITLLTVPLSLLVTRA

SEQ ID NO: 165035 - protein, 17 aa, Mycobacterium bovis
ALLAALTVLLLIWVLRR

SEQ ID NO: 165036 - protein, 19 aa, Mycobacterium bovis
ALLTRRWALAWVALAGSAM

SEQ ID NO: 165037 - protein, 37 aa, Mycobacterium bovis
ALQLYDFLWYPYYASYGLLLLPFFTPTLSALTALSAL

SEQ ID NO: 165038 - protein, 18 aa, Mycobacterium bovis
ALRRVWWLYKLVMSGQPA

SEQ ID NO: 165039 - protein, 23 aa, Mycobacterium bovis
ALTVWVVGYALRPLRRVAATAAE

SEQ ID NO: 165040 - protein, 27 aa, Mycobacterium bovis
AMAYSWYLWHWPLLIFWLSYTGHRHAN

SEQ ID NO: 165041 - protein, 21 aa, Mycobacterium bovis
AMLRRNLLIYGLGGLVVPFIG

SEQ ID NO: 165042 - protein, 20 aa, Mycobacterium bovis
APHHFLLTEWFAPYVEFLVS

SEQ ID NO: 165043 - protein, 18 aa, Mycobacterium bovis
APLWPFHRWLPDAAVEST

SEQ ID NO: 165044 - protein, 24 aa, Mycobacterium bovis
APQRAWLWLGWLSAATVAGWVLDA

SEQ ID NO: 165045 - protein, 21 aa, Mycobacterium bovis
APSALRQSFLWGLAGVIAAEH

SEQ ID NO: 165046 - protein, 26 aa, Mycobacterium bovis
APVGTRQLLLVNLLTDMFPALAVAVT

SEQ ID NO: 165047 - protein, 28 aa, Mycobacterium bovis
APVPIPVPIIIPPFPGWQPGMPTIPTAP

SEQ ID NO: 165048 - protein, 19 aa, Mycobacterium bovis
ARFWWPGLPIWVPALVTVA

SEQ ID NO: 165049 - protein, 20 aa, Mycobacterium bovis
ARGSPLRIMILLVLVSALAS

SEQ ID NO: 165050 - protein, 24 aa, Mycobacterium bovis
ARLWRGLLVFFSRWWQLETLYRSN

SEQ ID NO: 165051 - protein, 20 aa, Mycobacterium bovis
ASLHWYTWLAFSGWVAVAVI

SEQ ID NO: 165052 - protein, 18 aa, Mycobacterium bovis
ASSWLVRRPPLHGLTPSA

SEQ ID NO: 165053 - protein, 28 aa, Mycobacterium bovis
ATALPLRLISWLLMPISRLLVLLGNALT

SEQ ID NO: 165054 - protein, 25 aa, Mycobacterium bovis
ATGDWLLAIPWWTWAFVFGLGAFLL

SEQ ID NO: 165055 - protein, 23 aa, Mycobacterium bovis
ATMLQMLIIFGIVTVIALVAATT

SEQ ID NO: 165056 - protein, 28 aa, Mycobacterium bovis
AVIFIMLLLVYRSIITVVLLLITVGVEL

SEQ ID NO: 165057 - protein, 24 aa, Mycobacterium bovis
AVMNKLRWVLLIVGGIGVAVAAVA

SEQ ID NO: 165058 - protein, 20 aa, Mycobacterium bovis
AVQAPWPLLRTFAAGPALSR

SEQ ID NO: 165059 - protein, 24 aa, Mycobacterium bovis
AVSIPLTVLIIFTLNILLAEFGAA

SEQ ID NO: 165060 - protein, 25 aa, Mycobacterium bovis
AVVIVLLWLGFTAFVNLAVPQLEVV

SEQ ID NO: 165061 - protein, 18 aa, Mycobacterium bovis
AVWKPLLPGYTRPHMRLF

SEQ ID NO: 165062 - protein, 24 aa, Mycobacterium bovis
AYDIGLFYRYAWQNPVFADIVATR

SEQ ID NO: 165063 - protein, 18 aa, Mycobacterium bovis
AYRTWRWWLATAVAFFAV

SEQ ID NO: 165064 - protein, 20 aa, Mycobacterium bovis
CACLWLMLNLTALTWIRFGI

SEQ ID NO: 165065 - protein, 20 aa, Mycobacterium bovis
CVWWGLWLITINDWAPLATV

SEQ ID NO: 165066 - protein, 18 aa, Mycobacterium bovis
DFDDFWRPIRSYFYWEKH

SEQ ID NO: 165067 - protein, 25 aa, Mycobacterium bovis
DHARQLLIRLAIAAVLFVPVADLSV

SEQ ID NO: 165068 - protein, 23 aa, Mycobacterium bovis
DLYSLGCALFRLLTGEAPFAAGA

SEQ ID NO: 165069 - protein, 26 aa, Mycobacterium bovis
DRGVSWLPFFHDMGLITVLLASVLGH

SEQ ID NO: 165070 - protein, 17 aa, Mycobacterium bovis
DSLLAVARPFFAKNREV

SEQ ID NO: 165071 - protein, 18 aa, Mycobacterium bovis
DVNTWWAFRTSCTPTECL

SEQ ID NO: 165072 - protein, 27 aa, Mycobacterium bovis
DVRYRDRLLLPLPMFHVAALTTVIFSA

SEQ ID NO: 165073 - protein, 25 aa, Mycobacterium bovis
DYADILFITPWLLLLGVAMSGLTAY

SEQ ID NO: 165074 - protein, 20 aa, Mycobacterium bovis
EAVPAFFRWLAQFEPMHQVF

SEQ ID NO: 165075 - protein, 22 aa, Mycobacterium bovis
EEQYYVVWPLLLIGATLLLAAR

SEQ ID NO: 165076 - protein, 33 aa, Mycobacterium bovis
EFARAINIFVITPLRIAFLILLVGTTLEVLTET

SEQ ID NO: 165077 - protein, 22 aa, Mycobacterium bovis
ELLVVMLPLIGVLYVGIKALSS

SEQ ID NO: 165078 - protein, 31 aa, Mycobacterium bovis
ENVHWTIWQLWLVVLLVALWKGRRIGPLVAE

SEQ ID NO: 165079 - protein, 25 aa, Mycobacterium bovis
EPKSPPIPWYRLPAVIITGTTVAVL

SEQ ID NO: 165080 - protein, 26 aa, Mycobacterium bovis
ERDRLALWSRVLPITFTAAGLVALVG

SEQ ID NO: 165081 - protein, 18 aa, Mycobacterium bovis
ETIFRFALYAFLCATALM

SEQ ID NO: 165082 - protein, 24 aa, Mycobacterium bovis
ETLPMMLAPWVLLPTILALRGTSG

SEQ ID NO: 165083 - protein, 17 aa, Mycobacterium bovis
FAALIAVLLLTAPALGG

SEQ ID NO: 165084 - protein, 30 aa, Mycobacterium bovis
FAEGLQYWPWVLLGYFNIGIMIVSLIGWWA

SEQ ID NO: 165085 - protein, 18 aa, Mycobacterium bovis
FAEPLYRSVLIVYFVVMS

SEQ ID NO: 165086 - protein, 24 aa, Mycobacterium bovis
FAIIPAMFVGLYPVLDKLNVMALH

SEQ ID NO: 165087 - protein, 18 aa, Mycobacterium bovis
FAIVPLLHRFGGLVAPLT

SEQ ID NO: 165088 - protein, 22 aa, Mycobacterium bovis
FAQLGLWRWAFGVMTLLTALMA

SEQ ID NO: 165089 - protein, 33 aa, Mycobacterium bovis
FFFTSFVVALIPLVWLLWVVIARGWFAVTRSGW

SEQ ID NO: 165090 - protein, 17 aa, Mycobacterium bovis
FFQRVFGAGIATLVAVA

SEQ ID NO: 165091 - protein, 17 aa, Mycobacterium bovis
FGAFLRMPYALASAIFG

SEQ ID NO: 165092 - protein, 18 aa, Mycobacterium bovis
FGLFAVVVRLLPGWPIWF

SEQ ID NO: 165093 - protein, 17 aa, Mycobacterium bovis
FGLVFYVSLLPWIGELV

SEQ ID NO: 165094 - protein, 23 aa, Mycobacterium bovis
FHLSLRHALWWLGSLAAVASFTL

SEQ ID NO: 165095 - protein, 17 aa, Mycobacterium bovis
FIVGIGALIWAASLLWY

SEQ ID NO: 165096 - protein, 19 aa, Mycobacterium bovis
FKDHLYIAGRIKDLVIIDG

SEQ ID NO: 165097 - protein, 22 aa, Mycobacterium bovis
FLAYLVLDPLIYFGPFAPLTSP

SEQ ID NO: 165098 - protein, 20 aa, Mycobacterium bovis
FLETRYWWAGIALASLGVIV

SEQ ID NO: 165099 - protein, 19 aa, Mycobacterium bovis
FLRLPYTFAIPIFGGRNWT

SEQ ID NO: 165100 - protein, 21 aa, Mycobacterium bovis
FLVPLRVALAVLFLWGAAAAL

SEQ ID NO: 165101 - protein, 18 aa, Mycobacterium bovis
FPVLLGILTLLLSACQTA

SEQ ID NO: 165102 - protein, 26 aa, Mycobacterium bovis
FPVVQPWYLLWAIIPLAAWATRPGFR

SEQ ID NO: 165103 - protein, 17 aa, Mycobacterium bovis
FRLLTGEAPFAAGAGAA

SEQ ID NO: 165104 - protein, 25 aa, Mycobacterium bovis
FSNKPLVFIFYLGAAIFIISSSAAG

SEQ ID NO: 165105 - protein, 25 aa, Mycobacterium bovis
FSVGWLYWYFWVIVVGFEAVAGGKV

SEQ ID NO: 165106 - protein, 25 aa, Mycobacterium bovis
FTAVPLLWLLAIDAALITLGAMAFR

SEQ ID NO: 165107 - protein, 18 aa, Mycobacterium bovis
FTFMTPAAFVRRPGRWIR

SEQ ID NO: 165108 - protein, 25 aa, Mycobacterium bovis
FTKFTLLMALPWLSAVAAVYVVFRW

SEQ ID NO: 165109 - protein, 21 aa, Mycobacterium bovis
FTLIPYALVLLQLRVFYAREQ

SEQ ID NO: 165110 - protein, 26 aa, Mycobacterium bovis
FYAYLLTHVLFLNYVWGYTLLEAGMA

SEQ ID NO: 165111 - protein, 18 aa, Mycobacterium bovis
FYWAVGIAIGLPAGLIVL

SEQ ID NO: 165112 - protein, 22 aa, Mycobacterium bovis
GACIGFLWWNAAPAKIFMGDTG

SEQ ID NO: 165113 - protein, 21 aa, Mycobacterium bovis
GAFAVLFLPYSLLGPFAGALM

SEQ ID NO: 165114 - protein, 17 aa, Mycobacterium bovis
GAFLRLPYTFAIPIFGG

SEQ ID NO: 165115 - protein, 17 aa, Mycobacterium bovis
GAILGFALLWLTATAIW

SEQ ID NO: 165116 - protein, 19 aa, Mycobacterium bovis
GAVAWLISLFYKAIYTGGP

SEQ ID NO: 165117 - protein, 23 aa, Mycobacterium bovis
GAYPMYLDAYPLPQYAIYGAVPL

SEQ ID NO: 165118 - protein, 21 aa, Mycobacterium bovis
GEYLPMPWLFRHLSGYADRAG

SEQ ID NO: 165119 - protein, 26 aa, Mycobacterium bovis
GFAHSWFFLFLFVVAGLVALYILMQL

SEQ ID NO: 165120 - protein, 19 aa, Mycobacterium bovis
GFALLWLTATAIWLRSRRA

SEQ ID NO: 165121 - protein, 20 aa, Mycobacterium bovis
GFASLWSWFIGLVVTEFPLP

SEQ ID NO: 165122 - protein, 29 aa, Mycobacterium bovis
GGLILLVKKIWWPLAVWLLLIVMNVDAGT

SEQ ID NO: 165123 - protein, 19 aa, Mycobacterium bovis
GGMVLICLFLYHVFRNRNW

SEQ ID NO: 165124 - protein, 19 aa, Mycobacterium bovis
GGRALRWPRFPLVIEAAVA

SEQ ID NO: 165125 - protein, 24 aa, Mycobacterium bovis
GGVALWWMIGLLVAAGVLGLMVVL

SEQ ID NO: 165126 - protein, 20 aa, Mycobacterium bovis
GIALWLPWLIAAGVAFILAS

SEQ ID NO: 165127 - protein, 22 aa, Mycobacterium bovis
GIGAAILLGWFTLAHRHPDQPG

SEQ ID NO: 165128 - protein, 17 aa, Mycobacterium bovis
GILTWIFVDGHFSKWLN

SEQ ID NO: 165129 - protein, 17 aa, Mycobacterium bovis
GITFLGMRFAKLGVFST

SEQ ID NO: 165130 - protein, 30 aa, Mycobacterium bovis
GKLEFAGYFAWLAWLVLHLVYLVGYRNRIA

SEQ ID NO: 165131 - protein, 21 aa, Mycobacterium bovis
GKVSYLALGILVAIALVIGGI

SEQ ID NO: 165132 - protein, 18 aa, Mycobacterium bovis
GLGVLWLPAGWLAHRLLS

SEQ ID NO: 165133 - protein, 18 aa, Mycobacterium bovis
GLILLWRLLRRESARPVV

SEQ ID NO: 165134 - protein, 17 aa, Mycobacterium bovis
GLLVPVLTWPVSAPLLV

SEQ ID NO: 165135 - protein, 29 aa, Mycobacterium bovis
GLTAWIAAPLLFIGALFGLLLLAGITIRE

SEQ ID NO: 165136 - protein, 20 aa, Mycobacterium bovis
GLTIIFLLAVVTLQPFAIYS

SEQ ID NO: 165137 - protein, 24 aa, Mycobacterium bovis
GLVGPIFLVVYFTLGLGSLMSWMF

SEQ ID NO: 165138 - protein, 31 aa, Mycobacterium bovis
GPVEFSGFIAWLIWLVLHLAYLIGFKTKITT

SEQ ID NO: 165139 - protein, 17 aa, Mycobacterium bovis
GRKPLLLWFGVGGLIYT

SEQ ID NO: 165140 - protein, 24 aa, Mycobacterium bovis
GRRETWLIMRLPVIGNTQALRWRT

SEQ ID NO: 165141 - protein, 25 aa, Mycobacterium bovis
GSIFPLFMMVGIMMMMFRGMGGGQQ

SEQ ID NO: 165142 - protein, 17 aa, Mycobacterium bovis
GTPIWRLVLPFIALGVA

SEQ ID NO: 165143 - protein, 18 aa, Mycobacterium bovis
GVFALRRVWWLYKLVMSG

SEQ ID NO: 165144 - protein, 20 aa, Mycobacterium bovis
GVVLHWIIDYWNRFSLWVQH

SEQ ID NO: 165145 - protein, 18 aa, Mycobacterium bovis
GWALAVVVIVLALAAIAI

SEQ ID NO: 165146 - protein, 24 aa, Mycobacterium bovis
GYSTVLAFWLGWPTSEVPGVYLGA

SEQ ID NO: 165147 - protein, 17 aa, Mycobacterium bovis
GYWFTFFVALGGAVVLL

SEQ ID NO: 165148 - protein, 19 aa, Mycobacterium bovis
HAAVWWKALLALAVAVALV

SEQ ID NO: 165149 - protein, 20 aa, Mycobacterium bovis
HDMGFVLGLILPILAGIPAV

SEQ ID NO: 165150 - protein, 19 aa, Mycobacterium bovis
HGSLWVLPLRWSMVEYFYI

SEQ ID NO: 165151 - protein, 18 aa, Mycobacterium bovis
HHGFFIFAIVLTALSIIP

SEQ ID NO: 165152 - protein, 18 aa, Mycobacterium bovis
HIAKPWRWGYLGVLLVIF

SEQ ID NO: 165153 - protein, 27 aa, Mycobacterium bovis
HNLFKPLLLFFYFGFLIPIFKVRFEFP

SEQ ID NO: 165154 - protein, 20 aa, Mycobacterium bovis
HPGLPLWPYLVCAALTGLGG

SEQ ID NO: 165155 - protein, 19 aa, Mycobacterium bovis
HRRVLLICTFAIGAAAVFA

SEQ ID NO: 165156 - protein, 19 aa, Mycobacterium bovis
HVLYLNYVWHYSLLKAGFA

SEQ ID NO: 165157 - protein, 25 aa, Mycobacterium bovis
HWEFYMALAYFKLAIIAAGIDYRRR

SEQ ID NO: 165158 - protein, 24 aa, Mycobacterium bovis
HYWLKLFVFFFPFTDQIAAFKIIM

SEQ ID NO: 165159 - protein, 27 aa, Mycobacterium bovis
IAALLGRWFWWPLRVRSRPARTPTVPS

SEQ ID NO: 165160 - protein, 21 aa, Mycobacterium bovis
IAFDQLWRWNSIVALVLSVMV

SEQ ID NO: 165161 - protein, 22 aa, Mycobacterium bovis
IAVLLGRWFWWPQRVRPRPASR

SEQ ID NO: 165162 - protein, 25 aa, Mycobacterium bovis
IAVLVLWDLFGQLPLPLGVVGHEGS

SEQ ID NO: 165163 - protein, 27 aa, Mycobacterium bovis
IAVVVLGWYFLRIPSLVGIGRYTLYAE

SEQ ID NO: 165164 - protein, 18 aa, Mycobacterium bovis
ICTFAIGAAAVFAWLLAA

SEQ ID NO: 165165 - protein, 26 aa, Mycobacterium bovis
IFVLPALLMIGWWSGFPYWTTAAVCA

SEQ ID NO: 165166 - protein, 25 aa, Mycobacterium bovis
IGFFVFDLPFYRSVLNWLFVAVVLA

SEQ ID NO: 165167 - protein, 20 aa, Mycobacterium bovis
IGLVLLLLSSLIVGAGWPLI

SEQ ID NO: 165168 - protein, 19 aa, Mycobacterium bovis
IGTPLFFQRVFGAGIATLV

SEQ ID NO: 165169 - protein, 23 aa, Mycobacterium bovis
ILAVAMPWLFLRLRFCRRKWTVT

SEQ ID NO: 165170 - protein, 22 aa, Mycobacterium bovis
ILHGVWILLFASLFTNLVELIP

SEQ ID NO: 165171 - protein, 18 aa, Mycobacterium bovis
ILRLMLAWIPSTGVPLLA

SEQ ID NO: 165172 - protein, 23 aa, Mycobacterium bovis
ILYIISFSLFIYGLMGLTGPKTA

SEQ ID NO: 165173 - protein, 17 aa, Mycobacterium bovis
IPFLIISVLFYFTVVVQ

SEQ ID NO: 165174 - protein, 23 aa, Mycobacterium bovis
IQSKLMVLLLLTSIVSVAAIAAI

SEQ ID NO: 165175 - protein, 17 aa, Mycobacterium bovis
IRLPLVLGLAQLLSRVP

SEQ ID NO: 165176 - protein, 18 aa, Mycobacterium bovis
IRRFAVVIVLLWLGFTAF

SEQ ID NO: 165177 - protein, 26 aa, Mycobacterium bovis
ISPQTLFFPFVLLLAATALYRGNDKK

SEQ ID NO: 165178 - protein, 20 aa, Mycobacterium bovis
IVLLILIVLLRAIVAPLYLI

SEQ ID NO: 165179 - protein, 27 aa, Mycobacterium bovis
IVSDRGYFVFLALLPFIMGALSMSVPG

SEQ ID NO: 165180 - protein, 20 aa, Mycobacterium bovis
IVVLLILLLIVYRSAITATV

SEQ ID NO: 165181 - protein, 19 aa, Mycobacterium bovis
IYVDWLWFGEVGFRSVWIT

SEQ ID NO: 165182 - protein, 19 aa, Mycobacterium bovis
IYVLLPGRRMPIPQLPGAT

SEQ ID NO: 165183 - protein, 22 aa, Mycobacterium bovis
KFEPYRLWQPPLTQPVAIDDLV

SEQ ID NO: 165184 - protein, 20 aa, Mycobacterium bovis
KGDFLLGLLLPHGLLELTAV

SEQ ID NO: 165185 - protein, 21 aa, Mycobacterium bovis
KLAVLLALWAAVAGAFVSVLY

SEQ ID NO: 165186 - protein, 19 aa, Mycobacterium bovis
KPLLLWFGVGGLIYTYVLV

SEQ ID NO: 165187 - protein, 17 aa, Mycobacterium bovis
KVGPVIRLPLVLGLAQL

SEQ ID NO: 165188 - protein, 24 aa, Mycobacterium bovis
KWSYYYLYVILDIFSRYVVGWMVA

SEQ ID NO: 165189 - protein, 23 aa, Mycobacterium bovis
LAGCLPAVIWWACHRPNRLWWRY

SEQ ID NO: 165190 - protein, 24 aa, Mycobacterium bovis
LAIKPDICFLWDEAWYAFATAVPW

SEQ ID NO: 165191 - protein, 17 aa, Mycobacterium bovis
LAIVFLIPQRIGLTVLA

SEQ ID NO: 165192 - protein, 25 aa, Mycobacterium bovis
LALLPLLALLAFWRTGRRQLADRPT

SEQ ID NO: 165193 - protein, 17 aa, Mycobacterium bovis
LAMFPIAALGALVVYAA

SEQ ID NO: 165194 - protein, 21 aa, Mycobacterium bovis
LANLFPFQLFLVLYGLPLEDR

SEQ ID NO: 165195 - protein, 19 aa, Mycobacterium bovis
LANRLFIPRFLFSMGVIGV

SEQ ID NO: 165196 - protein, 19 aa, Mycobacterium bovis
LAWFPLWFVLLAVGWLVTQ

SEQ ID NO: 165197 - protein, 18 aa, Mycobacterium bovis
LDLDALLGGFRPLFQTLD

SEQ ID NO: 165198 - protein, 19 aa, Mycobacterium bovis
LDLVVVFLVTWPLVYLASK

SEQ ID NO: 165199 - protein, 19 aa, Mycobacterium bovis
LFCLFGVLFVLLRRGRVAG

SEQ ID NO: 165200 - protein, 17 aa, Mycobacterium bovis
LFYEPGASWYWVLTGPL

SEQ ID NO: 165201 - protein, 26 aa, Mycobacterium bovis
LGFYAFELPFYRLMLSYMLVSVFLAF

SEQ ID NO: 165202 - protein, 17 aa, Mycobacterium bovis
LGILVAIALVIGGIGGV

SEQ ID NO: 165203 - protein, 18 aa, Mycobacterium bovis
LGPYLSIYLLLIHDWDQA

SEQ ID NO: 165204 - protein, 27 aa, Mycobacterium bovis
LGSSMFFGAYPWAGWLAFAATLPVQFV

SEQ ID NO: 165205 - protein, 17 aa, Mycobacterium bovis
LGVAMLLGGTWLTCVLA

SEQ ID NO: 165206 - protein, 21 aa, Mycobacterium bovis
LGVHRIFLITVALALLTASPA

SEQ ID NO: 165207 - protein, 30 aa, Mycobacterium bovis
LGVPGWVTQRLWWAVLLTVGFWGLLRVAEA

SEQ ID NO: 165208 - protein, 19 aa, Mycobacterium bovis
LHYRHEVLYFKVLADHLPE

SEQ ID NO: 165209 - protein, 17 aa, Mycobacterium bovis
LIAIPLRRDPLLFPFQP

SEQ ID NO: 165210 - protein, 25 aa, Mycobacterium bovis
LIEADGWRWVFLVNLPLGVFAVLAA

SEQ ID NO: 165211 - protein, 19 aa, Mycobacterium bovis
LIFSRYLWAFELTSALLIT

SEQ ID NO: 165212 - protein, 25 aa, Mycobacterium bovis
LIPNGTFFVVLAIFLVVLAVIGTFV

SEQ ID NO: 165213 - protein, 17 aa, Mycobacterium bovis
LISLFYKAIYTGGPINE

SEQ ID NO: 165214 - protein, 18 aa, Mycobacterium bovis
LLAPLFPMTVVVPLSAFV

SEQ ID NO: 165215 - protein, 19 aa, Mycobacterium bovis
LLAVGGGALLLRKLNRTPE

SEQ ID NO: 165216 - protein, 24 aa, Mycobacterium bovis
LLIGALFFPWNLYFGFRIPDSSKT

SEQ ID NO: 165217 - protein, 20 aa, Mycobacterium bovis
LLIVFLLLLIFIGRLINWLS

SEQ ID NO: 165218 - protein, 18 aa, Mycobacterium bovis
LLLAPLLRRLLPDNPQRA

SEQ ID NO: 165219 - protein, 24 aa, Mycobacterium bovis
LLLVLVYSLLYYRVLGLLTALSLV

SEQ ID NO: 165220 - protein, 20 aa, Mycobacterium bovis
LLPAVIALALLPISWQLGVA

SEQ ID NO: 165221 - protein, 22 aa, Mycobacterium bovis
LLPNEDLPLLQPLRGIVPEPLL

SEQ ID NO: 165222 - protein, 25 aa, Mycobacterium bovis
LLTGWLVRRTLLVSTLLVASAWWLF

SEQ ID NO: 165223 - protein, 26 aa, Mycobacterium bovis
LLVEWAGWRWVLLVNVPLGIVAAIAT

SEQ ID NO: 165224 - protein, 19 aa, Mycobacterium bovis
LLVPPYLVYVRLARPFIAF

SEQ ID NO: 165225 - protein, 24 aa, Mycobacterium bovis
LMVGLFIPLFVGCPVILTSPEAFI

SEQ ID NO: 165226 - protein, 31 aa, Mycobacterium bovis
LPALAFPAPSWWWLAWFGLVPLLLVVRAAPT

SEQ ID NO: 165227 - protein, 23 aa, Mycobacterium bovis
LPFVMLGAALLWFGWYGFNAGSA

SEQ ID NO: 165228 - protein, 25 aa, Mycobacterium bovis
LQGKPAVLWFWTPWCPFCNAEAPSL

SEQ ID NO: 165229 - protein, 24 aa, Mycobacterium bovis
LRENVVALTVLWLLNIGEYLQDLT

SEQ ID NO: 165230 - protein, 20 aa, Mycobacterium bovis
LRRALPYLIGILIVGMIVAL

SEQ ID NO: 165231 - protein, 19 aa, Mycobacterium bovis
LSLFYWWYHTLDKTAAVFV

SEQ ID NO: 165232 - protein, 18 aa, Mycobacterium bovis
LSRRSLLIGNAVVAFAVI

SEQ ID NO: 165233 - protein, 27 aa, Mycobacterium bovis
LTAKLAWFSKFLTIAILGLAALTFGVG

SEQ ID NO: 165234 - protein, 34 aa, Mycobacterium bovis
LTARMLAIAFFALLYLLPLILRLWRGDTTHDRHA

SEQ ID NO: 165235 - protein, 17 aa, Mycobacterium bovis
LTTALISLIQRPQLRNL

SEQ ID NO: 165236 - protein, 21 aa, Mycobacterium bovis
LTVTLVWLYIEILRLLSYLQN

SEQ ID NO: 165237 - protein, 17 aa, Mycobacterium bovis
LVALPLAGAAILLFGGR

SEQ ID NO: 165238 - protein, 19 aa, Mycobacterium bovis
LVFVAVIAFLMLLISIRSV

SEQ ID NO: 165239 - protein, 27 aa, Mycobacterium bovis
LVGGLAWPFLLLPQLGMIRGAAVTGIV

SEQ ID NO: 165240 - protein, 18 aa, Mycobacterium bovis
LVIVGWLTLWPFLSWLTT

SEQ ID NO: 165241 - protein, 22 aa, Mycobacterium bovis
LVTYLLYIELLYTPIGELAQMF

SEQ ID NO: 165242 - protein, 19 aa, Mycobacterium bovis
LVVIMPLYALALDMAFTSG

SEQ ID NO: 165243 - protein, 20 aa, Mycobacterium bovis
LWGWRRTPVLRWFVLGAAVG

SEQ ID NO: 165244 - protein, 19 aa, Mycobacterium bovis
LWQHLFWFFGHPEVYIIAL

SEQ ID NO: 165245 - protein, 28 aa, Mycobacterium bovis
MAMFDRWNWWLPRWLAHILPSVDFDRPL

SEQ ID NO: 165246 - protein, 19 aa, Mycobacterium bovis
MAMWIIGMVAAIGLALWIG

SEQ ID NO: 165247 - protein, 23 aa, Mycobacterium bovis
MATLLGRASWWPGHPWQRCAPEE

SEQ ID NO: 165248 - protein, 17 aa, Mycobacterium bovis
MLLGLIFLLWSGPGRWS

SEQ ID NO: 165249 - protein, 19 aa, Mycobacterium bovis
MLMMPLMMIVMMVGGLAGS

SEQ ID NO: 165250 - protein, 18 aa, Mycobacterium bovis
MLVAAAWLALLGLPLLLV

SEQ ID NO: 165251 - protein, 26 aa, Mycobacterium bovis
MPAFPPYVPTLLPPPPPPQPATLINI

SEQ ID NO: 165252 - protein, 29 aa, Mycobacterium bovis
MQVTLKPVPVILILLMLISGGATGWLYLE

SEQ ID NO: 165253 - protein, 19 aa, Mycobacterium bovis
MVLTILAAGLLLGPPAGAQ

SEQ ID NO: 165254 - protein, 25 aa, Mycobacterium bovis
NDQFMITVLILWAPLLIFGFILMWI

SEQ ID NO: 165255 - protein, 25 aa, Mycobacterium bovis
NGAPEAMWWTLYLACYLAGGWGSAW

SEQ ID NO: 165256 - protein, 20 aa, Mycobacterium bovis
NLELYLIFPLASEQATITLV

SEQ ID NO: 165257 - protein, 24 aa, Mycobacterium bovis
NPEVWAWMVWLPHNLHDELFDACG

SEQ ID NO: 165258 - protein, 24 aa, Mycobacterium bovis
NPLNPVQFPKALLLKVTGPIAQQF

SEQ ID NO: 165259 - protein, 24 aa, Mycobacterium bovis
NRRRPLLHLLTFLCGGYTMAGGVA

SEQ ID NO: 165260 - protein, 18 aa, Mycobacterium bovis
NSFPKWRWSLTTALLELT

SEQ ID NO: 165261 - protein, 23 aa, Mycobacterium bovis
NTRQLLLVNMLTDALPAAALAVS

SEQ ID NO: 165262 - protein, 17 aa, Mycobacterium bovis
NVHWSVLVILWLFTWSL

SEQ ID NO: 165263 - protein, 26 aa, Mycobacterium bovis
PALKYLSYRLFMKRYDARWLVTRMTT

SEQ ID NO: 165264 - protein, 18 aa, Mycobacterium bovis
PALMVLLGRWLWWPRRSV

SEQ ID NO: 165265 - protein, 25 aa, Mycobacterium bovis
PARWRHWWWALLLAFVPIHLVVSAI

SEQ ID NO: 165266 - protein, 24 aa, Mycobacterium bovis
PATRWGPILQWILVGAAAAVVLVA

SEQ ID NO: 165267 - protein, 19 aa, Mycobacterium bovis
PCILPVLPVIFFSGAQSVD

SEQ ID NO: 165268 - protein, 18 aa, Mycobacterium bovis
PDMGPWQLPPIPAAGAPN

SEQ ID NO: 165269 - protein, 22 aa, Mycobacterium bovis
PEDLPWEVPLIELGLDSLMAVR

SEQ ID NO: 165270 - protein, 22 aa, Mycobacterium bovis
PEFPWSALTIVLLIGVLAAAVG

SEQ ID NO: 165271 - protein, 19 aa, Mycobacterium bovis
PFLLIMGGFMYFASRRQRR

SEQ ID NO: 165272 - protein, 17 aa, Mycobacterium bovis
PGDWLYFVTIDSQGTTL

SEQ ID NO: 165273 - protein, 27 aa, Mycobacterium bovis
PGGWFTITVLLILLMIAVTAAVQIARR

SEQ ID NO: 165274 - protein, 19 aa, Mycobacterium bovis
PGYCVLAFILGTYWLTRQT

SEQ ID NO: 165275 - protein, 18 aa, Mycobacterium bovis
PIIPRTIRLAAIPILLCW

SEQ ID NO: 165276 - protein, 23 aa, Mycobacterium bovis
PLRRLLREFRGPLALSLLLVAVQ

SEQ ID NO: 165277 - protein, 22 aa, Mycobacterium bovis
PLSFLVLIWVFGGLLAAGLPMA

SEQ ID NO: 165278 - protein, 24 aa, Mycobacterium bovis
PLSKWFLLIMAFGSLFMVAGKRYA

SEQ ID NO: 165279 - protein, 17 aa, Mycobacterium bovis
PLTGFIYAFDDMLARHN

SEQ ID NO: 165280 - protein, 18 aa, Mycobacterium bovis
PMYLNIAVAVLGLAAYFA

SEQ ID NO: 165281 - protein, 21 aa, Mycobacterium bovis
PPCIIAFLETRYWWAGIALAS

SEQ ID NO: 165282 - protein, 18 aa, Mycobacterium bovis
PPGPPPPPYSYGGPFGGP

SEQ ID NO: 165283 - protein, 23 aa, Mycobacterium bovis
PPKGPAWRRIRVSQLLIGVSAVV

SEQ ID NO: 165284 - protein, 30 aa, Mycobacterium bovis
PPPGKKFTWHWWWLGAAALGVLLVVMVALV

SEQ ID NO: 165285 - protein, 24 aa, Mycobacterium bovis
PPWEFYFWHHTIPAPVWVAVIMGL

SEQ ID NO: 165286 - protein, 17 aa, Mycobacterium bovis
PTLWGWRRTPVLRWFVL

SEQ ID NO: 165287 - protein, 17 aa, Mycobacterium bovis
PVLLIPLTFALFTPLAV

SEQ ID NO: 165288 - protein, 21 aa, Mycobacterium bovis
PVPLIVAVTLSLLALLLIRQL

SEQ ID NO: 165289 - protein, 19 aa, Mycobacterium bovis
PYFTGYLPTLLLAAILTPA

SEQ ID NO: 165290 - protein, 27 aa, Mycobacterium bovis
QAIPATLLLLRYRWLRSEPLPVRRPAS

SEQ ID NO: 165291 - protein, 23 aa, Mycobacterium bovis
QEAALTWLLLVSVPILAVANYWI

SEQ ID NO: 165292 - protein, 18 aa, Mycobacterium bovis
QERRLVFERFYRSASARA

SEQ ID NO: 165293 - protein, 23 aa, Mycobacterium bovis
QGGRFLCTFPFSFEITEGEDRYV

SEQ ID NO: 165294 - protein, 30 aa, Mycobacterium bovis; identical to SEQ ID NO: 25920

SEQ ID NO: 165295 - protein, 19 aa, Mycobacterium bovis
QPTSWWPLRWYPQNYRTAT

SEQ ID NO: 165296 - protein, 23 aa, Mycobacterium bovis
QQYPPGWPAGPYPPGPPPPGPGS

SEQ ID NO: 165297 - protein, 20 aa, Mycobacterium bovis
QRWLPLILAGFTSGFLLLRG

SEQ ID NO: 165298 - protein, 26 aa, Mycobacterium bovis
QVLTGLLFLLFGLWLLFDDALGFRSI

SEQ ID NO: 165299 - protein, 26 aa, Mycobacterium bovis
RARYRPLWVFLLVPVLILLTVSGRWL

SEQ ID NO: 165300 - protein, 20 aa, Mycobacterium bovis
RAVSWMWQALAATLVAAVFA

SEQ ID NO: 165301 - protein, 17 aa, Mycobacterium bovis
RAWLRLFGVLPFDYDRL

SEQ ID NO: 165302 - protein, 22 aa, Mycobacterium bovis
RCRWLVFTGWLLALVPAVYLAM

SEQ ID NO: 165303 - protein, 17 aa, Mycobacterium bovis
RCWQARAVSWMWQALAA

SEQ ID NO: 165304 - protein, 17 aa, Mycobacterium bovis
RFAVLVLLFCLFGVLFV

SEQ ID NO: 165305 - protein, 19 aa, Mycobacterium bovis
RFTGWQWVLSALALPVVTW

SEQ ID NO: 165306 - protein, 24 aa, Mycobacterium bovis
RGGRSRLVFGTLAILLCLVLGVAI

SEQ ID NO: 165307 - protein, 21 aa, Mycobacterium bovis
RILIMIALGVIVLLLAGPRLI

SEQ ID NO: 165308 - protein, 23 aa, Mycobacterium bovis
RILVGAVAVLLLAGLFAVGIVIG

SEQ ID NO: 165309 - protein, 17 aa, Mycobacterium bovis
RIPAIGLVLLLLSSLIV

SEQ ID NO: 165310 - protein, 18 aa, Mycobacterium bovis
RLLPYMIGAFLLIVGASV

SEQ ID NO: 165311 - protein, 21 aa, Mycobacterium bovis
RLSLPILLFWVGVAAITNAAV

SEQ ID NO: 165312 - protein, 20 aa, Mycobacterium bovis
RLSVLALIMLPILAAVTLCA

SEQ ID NO: 165313 - protein, 21 aa, Mycobacterium bovis
RNRMAFLAALFFLLALCWATT

SEQ ID NO: 165314 - protein, 17 aa, Mycobacterium bovis
RNYLLPLGAVLLLLVKA

SEQ ID NO: 165315 - protein, 18 aa, Mycobacterium bovis
RPATFLWLIAATGTLLVA

SEQ ID NO: 165316 - protein, 21 aa, Mycobacterium bovis
RPWMAVMFFAGFLILYGLGVM

SEQ ID NO: 165317 - protein, 25 aa, Mycobacterium bovis
RQFHHPLIYVLLVAGTITAGLKEFV

SEQ ID NO: 165318 - protein, 34 aa, Mycobacterium bovis
RRERRTWLPRVWLALPLGLLALGSSMFFGAYPWA

SEQ ID NO: 165319 - protein, 20 aa, Mycobacterium bovis
RTANWWWALLGLAVSALTYV

SEQ ID NO: 165320 - protein, 20 aa, Mycobacterium bovis
RTLLLWMLPLLIAPPMYSKD

SEQ ID NO: 165321 - protein, 23 aa, Mycobacterium bovis
RVHFDLDPLLPFPRWHEHAAMVE

SEQ ID NO: 165322 - protein, 19 aa, Mycobacterium bovis
RVRLPRLSTIAMAAAVVII

SEQ ID NO: 165323 - protein, 24 aa, Mycobacterium bovis
RVRSAAALWWIPAWLAMIVEVAVL

SEQ ID NO: 165324 - protein, 21 aa, Mycobacterium bovis
RVSLPLWVLLLSVPLATVYIA

SEQ ID NO: 165325 - protein, 18 aa, Mycobacterium bovis
RWLGGIGAVIPLLALVLV

SEQ ID NO: 165326 - protein, 28 aa, Mycobacterium bovis
RWRHVPAILLVLSLLLFTIAMAGPTHDV

SEQ ID NO: 165327 - protein, 25 aa, Mycobacterium bovis
SAAKLYPLLFLYPLLLLGIRAGRLN

SEQ ID NO: 165328 - protein, 23 aa, Mycobacterium bovis
SATAFPWVFLFPASILVLILVCA

SEQ ID NO: 165329 - protein, 25 aa, Mycobacterium bovis
SELPAVAWVWFQLFVDILGFNIIGF

SEQ ID NO: 165330 - protein, 24 aa, Mycobacterium bovis
SGNRAWWILAAVVVVGVLVLVGGI

SEQ ID NO: 165331 - protein, 20 aa, Mycobacterium bovis
SIEAFRRFHAALFSKDIQPA

SEQ ID NO: 165332 - protein, 24 aa, Mycobacterium bovis
SIITVLMPLALFGILGLAAVVLVH

SEQ ID NO: 165333 - protein, 28 aa, Mycobacterium bovis
SLVAAWAYPLWPVVLGLKALALAVGAST

SEQ ID NO: 165334 - protein, 20 aa, Mycobacterium bovis
SMRLPFLYAPLPYGGTLHVD

SEQ ID NO: 165335 - protein, 22 aa, Mycobacterium bovis
SMVEYFYIKYYLPRGRSRPVIE

SEQ ID NO: 165336 - protein, 22 aa, Mycobacterium bovis
SRGTVYQMWLLGGAKGPRSAET

SEQ ID NO: 165337 - protein, 22 aa, Mycobacterium bovis
SRPRWSGRRLAFVVALVTVLMT

SEQ ID NO: 165338 - protein, 26 aa, Mycobacterium bovis
SSFWFTAIYVLLFVSLVGCLAPRTIE

SEQ ID NO: 165339 - protein, 25 aa, Mycobacterium bovis
SSLCLIFIIMLIITRAFIAAAVIVG

SEQ ID NO: 165340 - protein, 23 aa, Mycobacterium bovis
SVLLWQHILAIHLHWLVLAMSVI

SEQ ID NO: 165341 - protein, 18 aa, Mycobacterium bovis
SVPILAVANYWIISHMLP

SEQ ID NO: 165342 - protein, 23 aa, Mycobacterium bovis
SVPRWLWIVLAIGFLTAALAGGT

SEQ ID NO: 165343 - protein, 26 aa, Mycobacterium bovis
TAAVVILLLMVTFTMAYLIVDVPKPG

SEQ ID NO: 165344 - protein, 24 aa, Mycobacterium bovis
TAFGFLVLVLLLSLLNATLFQGAP

SEQ ID NO: 165345 - protein, 26 aa, Mycobacterium bovis
TAPVWITMLWPLADRPRLAPGAPGGT

SEQ ID NO: 165346 - protein, 25 aa, Mycobacterium bovis
TDGIYPLLIMILLPVLVGLDVSTRR

SEQ ID NO: 165347 - protein, 24 aa, Mycobacterium bovis
TERIWLPFTIWLTAAPALLPPRSH

SEQ ID NO: 165348 - protein, 17 aa, Mycobacterium bovis
TFLWLIAATGTLLVATH

SEQ ID NO: 165349 - protein, 22 aa, Mycobacterium bovis
TILAWLLIAILLARLFVPDDVG

SEQ ID NO: 165350 - protein, 26 aa, Mycobacterium bovis
TILLLVILLIIYRNPITMVLPLITIG

SEQ ID NO: 165351 - protein, 27 aa, Mycobacterium bovis
TIVIVFLILVILLRALVAPIYLIGSVL

SEQ ID NO: 165352 - protein, 19 aa, Mycobacterium bovis
TLGSWLPPGPAAVADYPTV

SEQ ID NO: 165353 - protein, 24 aa, Mycobacterium bovis
TLLLPLLWRMPDTARWYLLKGRIA

SEQ ID NO: 165354 - protein, 23 aa, Mycobacterium bovis
TLVFQLILGQEMHWSLPGLSFIL

SEQ ID NO: 165355 - protein, 26 aa, Mycobacterium bovis
TSMGTALVLLFLLALAAIPGALLPQR

SEQ ID NO: 165356 - protein, 25 aa, Mycobacterium bovis
TTEWLHVPFLPVPIPVPIPQNPGAG

SEQ ID NO: 165357 - protein, 28 aa, Mycobacterium bovis
TTLIFGFLVMWILAWLTAAPVRVVRAAL

SEQ ID NO: 165358 - protein, 23 aa, Mycobacterium bovis
TVIIVMLLLVYRSIITSAIMLTM

SEQ ID NO: 165359 - protein, 17 aa, Mycobacterium bovis
TVLLALLANLFLPWGIA

SEQ ID NO: 165360 - protein, 17 aa, Mycobacterium bovis
TVLLIFTLNILLAQFGA

SEQ ID NO: 165361 - protein, 18 aa, Mycobacterium bovis
TYLKWWKFVLVVLGVWIG

SEQ ID NO: 165362 - protein, 21 aa, Mycobacterium bovis
TYSMDLFLRIAPELYLKRLCV

SEQ ID NO: 165363 - protein, 22 aa, Mycobacterium bovis
VALASLLWQLLLVSAGAFLRSR

SEQ ID NO: 165364 - protein, 20 aa, Mycobacterium bovis
VALLVSAWWLFEALRHPVRS

SEQ ID NO: 165365 - protein, 17 aa, Mycobacterium bovis
VAWLDRFMGIGGESALF

SEQ ID NO: 165366 - protein, 20 aa, Mycobacterium bovis
VDAWLRLCQTYGWAPGVMGA

SEQ ID NO: 165367 - protein, 26 aa, Mycobacterium bovis
VDTLSLFVGWLWPLWDSRRRTFADLL

SEQ ID NO: 165368 - protein, 22 aa, Mycobacterium bovis
VEPGIPAWRRILDDLSYEPVMA

SEQ ID NO: 165369 - protein, 17 aa, Mycobacterium bovis
VFALVVALVYLQFRGEF

SEQ ID NO: 165370 - protein, 24 aa, Mycobacterium bovis
VFGFILMWILAWLTATPVRVVRAA

SEQ ID NO: 165371 - protein, 26 aa, Mycobacterium bovis
VFGLALLLIFLFWPWEFKAADGESDF

SEQ ID NO: 165372 - protein, 17 aa, Mycobacterium bovis
VFGMRLVFPLAIIWTTA

SEQ ID NO: 165373 - protein, 24 aa, Mycobacterium bovis
VFNGLVAAFLWFTVLFANFAEAMA

SEQ ID NO: 165374 - protein, 18 aa, Mycobacterium bovis
VGPWALYGLLFTIVILFA

SEQ ID NO: 165375 - protein, 30 aa, Mycobacterium bovis
VGQANWWLPSSWRPATWWPLGRRRGRAQRT

SEQ ID NO: 165376 - protein, 25 aa, Mycobacterium bovis
VGVALVFVQWWGQPAWSWAVLGLRG

SEQ ID NO: 165377 - protein, 18 aa, Mycobacterium bovis
VGVIVWGLIFWSAVFHRK

SEQ ID NO: 165378 - protein, 24 aa, Mycobacterium bovis
VIARPYQWWRLALVLASGLAYVVI

SEQ ID NO: 165379 - protein, 18 aa, Mycobacterium bovis
VIATIVIVFLILVILLRA

SEQ ID NO: 165380 - protein, 17 aa, Mycobacterium bovis
VIEALPALLLAPLLRRL

SEQ ID NO: 165381 - protein, 17 aa, Mycobacterium bovis
VIIMILLIIPVGKLSLG

SEQ ID NO: 165382 - protein, 20 aa, Mycobacterium bovis
VIPPSLLRRALPYLIGILIV

SEQ ID NO: 165383 - protein, 27 aa, Mycobacterium bovis
VLFIGAVLILGFWAPGFFVTTKLDVIK

SEQ ID NO: 165384 - protein, 18 aa, Mycobacterium bovis
VLGLFTPLAAAGALAFLI

SEQ ID NO: 165385 - protein, 21 aa, Mycobacterium bovis
VLGVLFWFTFVGWVTVVIAGG

SEQ ID NO: 165386 - protein, 22 aa, Mycobacterium bovis
VLIAAFLAVWWIYETYRPQAPG

SEQ ID NO: 165387 - protein, 17 aa, Mycobacterium bovis
VLLAAGLGVLWLPAGWL

SEQ ID NO: 165388 - protein, 23 aa, Mycobacterium bovis
VLQAYLNIIYFGRGAYGISAASK

SEQ ID NO: 165389 - protein, 24 aa, Mycobacterium bovis
VLSGAWLGLFIGLVLGFFSPNPWS

SEQ ID NO: 165390 - protein, 23 aa, Mycobacterium bovis
VLVLFTLIFFLYGGRSIWQYVTK

SEQ ID NO: 165391 - protein, 21 aa, Mycobacterium bovis
VMAIFYLRLPATFGIGTYGVS

SEQ ID NO: 165392 - protein, 23 aa, Mycobacterium bovis
VMVAGVILWCFFGDALSNRSHTA

SEQ ID NO: 165393 - protein, 20 aa, Mycobacterium bovis
VMVGFLFLYPAFVAKAHEAN

SEQ ID NO: 165394 - protein, 18 aa, Mycobacterium bovis
VMVPVFLLALFYGGGHHS

SEQ ID NO: 165395 - protein, 18 aa, Mycobacterium bovis
VNAEYWYRSIRQPVQFER

SEQ ID NO: 165396 - protein, 18 aa, Mycobacterium bovis
VNFEPWLVLTGMIDMFFA

SEQ ID NO: 165397 - protein, 17 aa, Mycobacterium bovis
VPVLTWPVSAPLLVIPV

SEQ ID NO: 165398 - protein, 24 aa, Mycobacterium bovis
VQPTFLYELIWNVLVFVALIYIDR

SEQ ID NO: 165399 - protein, 18 aa, Mycobacterium bovis
VRAIWVLRALLREYGRRL

SEQ ID NO: 165400 - protein, 23 aa, Mycobacterium bovis
VRLLPGWPIWFAVGWAAQEWLKS

SEQ ID NO: 165401 - protein, 26 aa, Mycobacterium bovis
VRSGHRRLWWALAGVVAFLGLVGAGV

SEQ ID NO: 165402 - protein, 19 aa, Mycobacterium bovis
VSIALWQHLLDRELNALVP

SEQ ID NO: 165403 - protein, 25 aa, Mycobacterium bovis
VSLAYLYVVLLFAPVLIVLERLPIV

SEQ ID NO: 165404 - protein, 25 aa, Mycobacterium bovis
VSMGIILLGLLWYAGLPLRVFLSSL

SEQ ID NO: 165405 - protein, 18 aa, Mycobacterium bovis
VSSVLPLAAPWLRDLRAG

SEQ ID NO: 165406 - protein, 17 aa, Mycobacterium bovis
VSTLLVASAWWLFAWEL

SEQ ID NO: 165407 - protein, 18 aa, Mycobacterium bovis
VSTYGWRAYALPVLMVLT

SEQ ID NO: 165408 - protein, 21 aa, Mycobacterium bovis
VTLCWLLISYGFAASVLPVWL

SEQ ID NO: 165409 - protein, 17 aa, Mycobacterium bovis
VTMLLPLVTIGASLMTA

SEQ ID NO: 165410 - protein, 25 aa, Mycobacterium bovis
VVAGQVLFSLLLTPAIRLTNGAANW

SEQ ID NO: 165411 - protein, 20 aa, Mycobacterium bovis
VVFLVTWPLVYLASKSSLLA

SEQ ID NO: 165412 - protein, 23 aa, Mycobacterium bovis
VVVALGGGALWWCVARRSWHAPR

SEQ ID NO: 165413 - protein, 18 aa, Mycobacterium bovis
VVVFAVVLVFYIVTSRDD

SEQ ID NO: 165414 - protein, 23 aa, Mycobacterium bovis
VVVLLGWSFFYFSDDTRGYKPVD

SEQ ID NO: 165415 - protein, 36 aa, Mycobacterium bovis
WACHRPNRLWWRYTAWWLLAMALATLWWVMALTQLH

SEQ ID NO: 165416 - protein, 29 aa, Mycobacterium bovis
WAPLLIFGFILMWILAWLTATPVRVVREA

SEQ ID NO: 165417 - protein, 17 aa, Mycobacterium bovis
WARYNVPWQPAFVFYRA

SEQ ID NO: 165418 - protein, 18 aa, Mycobacterium bovis
WFDMAMLVALSVIYVGFV

SEQ ID NO: 165419 - protein, 17 aa, Mycobacterium bovis
WHPLVVVGLIALVAIMI

SEQ ID NO: 165420 - protein, 18 aa, Mycobacterium bovis
WIGALLGVLFVLTTALGD

SEQ ID NO: 165421 - protein, 17 aa, Mycobacterium bovis
WLGAQWWHPLVVVGLIA

SEQ ID NO: 165422 - protein, 27 aa, Mycobacterium bovis
WLIGAYGWRWIFLVNLPVGLSALVLAA

SEQ ID NO: 165423 - protein, 18 aa, Mycobacterium bovis
WLVLTGMIDMFFATVGFA

SEQ ID NO: 165424 - protein, 21 aa, Mycobacterium bovis
WPLIVIGCWIAVAAALTLLLP

SEQ ID NO: 165425 - protein, 21 aa, Mycobacterium bovis
WPTWGMILSSPFLLPAGLGLG

SEQ ID NO: 165426 - protein, 17 aa, Mycobacterium bovis
WPVGWVVVLLYAVCVVL

SEQ ID NO: 165427 - protein, 28 aa, Mycobacterium bovis
WQHLLGIQLYWIVLALAVILLLAVGSDY

SEQ ID NO: 165428 - protein, 18 aa, Mycobacterium bovis
WRAYALPVLMVLTTVVVY

SEQ ID NO: 165429 - protein, 23 aa, Mycobacterium bovis
WRNRPVLVFVLDAGMPGLTQGKP

SEQ ID NO: 165430 - protein, 26 aa, Mycobacterium bovis
WSIPGLAHFFTMWGFFILLTVYIEAY

SEQ ID NO: 165431 - protein, 21 aa, Mycobacterium bovis
WSVLVILWLFTWSLATMLPGT

SEQ ID NO: 165432 - protein, 17 aa, Mycobacterium bovis
WTTPLWLILMAAPFGYL

SEQ ID NO: 165433 - protein, 18 aa, Mycobacterium bovis
WVLGWRRPQAYPLMSHLA

SEQ ID NO: 165434 - protein, 18 aa, Mycobacterium bovis
WYRSIRQPVQFERAVRNA

SEQ ID NO: 165435 - protein, 22 aa, Mycobacterium bovis
YGDFFNFYLCDISLKVNGLQPG

SEQ ID NO: 165436 - protein, 23 aa, Mycobacterium bovis
YGDFQNFYLCDLQIKWNGFQAGG

SEQ ID NO: 165437 - protein, 17 aa, Mycobacterium bovis
YGWRAYALPVLMVLTTV

SEQ ID NO: 165438 - protein, 21 aa, Mycobacterium bovis
YSTFFFFFFVAELLDTWIWRW

SEQ ID NO: 165439 - protein, 19 aa, Mycobacterium bovis
YVISSWRPVLLIPLTFALF

SEQ ID NO: 165440 - protein, 18 aa, Mycobacterium bovis
AEVPLLMTLLQRGRVAGA

SEQ ID NO: 165441 - protein, 19 aa, Mycobacterium bovis
ALLLLYWQWRTMPAVIWDV

SEQ ID NO: 165442 - protein, 17 aa, Mycobacterium bovis
ASAWWFDMAMLVALSVI

SEQ ID NO: 165443 - protein, 17 aa, Mycobacterium bovis
AWWFDMAMLVALSVIYV

SEQ ID NO: 165444 - protein, 21 aa, Mycobacterium bovis
CLIFIIMLIITRSVVAAAVIV

SEQ ID NO: 165445 - protein, 23 aa, Mycobacterium bovis
DDELAAPRWPWVVGVAAIIAAVA

SEQ ID NO: 165446 - protein, 27 aa, Mycobacterium bovis
DGEVVLLLFLPAILYWESMNTSFREIR

SEQ ID NO: 165447 - protein, 24 aa, Mycobacterium bovis
DHGLWVAFWFFLAQLNLILATINL

SEQ ID NO: 165448 - protein, 18 aa, Mycobacterium bovis
DPLRTGIFGLVLVICVVL

SEQ ID NO: 165449 - protein, 20 aa, Mycobacterium bovis
EFSWQLERVLPVPVFAQTMA

SEQ ID NO: 165450 - protein, 20 aa, Mycobacterium bovis
ELVLTVIPFLIISVLFYFTV

SEQ ID NO: 165451 - protein, 19 aa, Mycobacterium bovis
EQLFWLIMTESLVAGLIGT

SEQ ID NO: 165452 - protein, 17 aa, Mycobacterium bovis
FAALALALTGGAWQWSA

SEQ ID NO: 165453 - protein, 23 aa, Mycobacterium bovis
FGEGWWTSVWFLSFWVTGTSILL

SEQ ID NO: 165454 - protein, 24 aa, Mycobacterium bovis
FGLASRYIRLLPRGLVKRVVPKPG

SEQ ID NO: 165455 - protein, 18 aa, Mycobacterium bovis
GCHTMSLDWVAWRGLGLA

SEQ ID NO: 165456 - protein, 17 aa, Mycobacterium bovis
GGLVVIMPLYALALDMA

SEQ ID NO: 165457 - protein, 20 aa, Mycobacterium bovis
GIFGLVLVICVVLIAFGYSG

SEQ ID NO: 165458 - protein, 34 aa, Mycobacterium bovis
GLPLRAMVMVLLFLGVVFLLLGWQALGSSPNSED

SEQ ID NO: 165459 - protein, 20 aa, Mycobacterium bovis
GLSWRWLFGLSIIPALISLI

SEQ ID NO: 165460 - protein, 18 aa, Mycobacterium bovis
GLVFVWFSMTPSLLPRGP

SEQ ID NO: 165461 - protein, 26 aa, Mycobacterium bovis
IGVLLGWPLWWVSTCSVLVLLVVEGV

SEQ ID NO: 165462 - protein, 26 aa, Mycobacterium bovis
INFFLIAFAVYFLVVLPYNTLRKKGE

SEQ ID NO: 165463 - protein, 22 aa, Mycobacterium bovis
ISLVLLLLFAIGGVVWGVMDGR

SEQ ID NO: 165464 - protein, 19 aa, Mycobacterium bovis
KAWPLLWFVVIGLIAAAVG

SEQ ID NO: 165465 - protein, 24 aa, Mycobacterium bovis
KLMPWLWVAWFGLGSFGVLMLWLP

SEQ ID NO: 165466 - protein, 20 aa, Mycobacterium bovis
LGDWTIFYWGWWISWAPFVG

SEQ ID NO: 165467 - protein, 25 aa, Mycobacterium bovis
LIVVLFVPAALPWYYSWPLAVAAPL

SEQ ID NO: 165468 - protein, 18 aa, Mycobacterium bovis
LLLLVYRSIATTLLILPM

SEQ ID NO: 165469 - protein, 21 aa, Mycobacterium bovis
LLSIPLWIVIVLPIAKILATS

SEQ ID NO: 165470 - protein, 18 aa, Mycobacterium bovis
LLWPAIFVAAFAALGLAV

SEQ ID NO: 165471 - protein, 18 aa, Mycobacterium bovis
LRRAAFSGVLLTASLVAA

SEQ ID NO: 165472 - protein, 17 aa, Mycobacterium bovis
LVASAWWLFAWELDNGA

SEQ ID NO: 165473 - protein, 17 aa, Mycobacterium bovis
LVILVVVIVGGFTVHRI

SEQ ID NO: 165474 - protein, 23 aa, Mycobacterium bovis
LWISLVVLWLFVLVPMLISKRDA

SEQ ID NO: 165475 - protein, 18 aa, Mycobacterium bovis
LWQVAKLRRAAFSGVLLT

SEQ ID NO: 165476 - protein, 23 aa, Mycobacterium bovis
NGGAWLVLLMIFNVIWTYVLVRG

SEQ ID NO: 165477 - protein, 23 aa, Mycobacterium bovis
NLRSLPVPFILNQPPPPGPVPAP

SEQ ID NO: 165478 - protein, 23 aa, Mycobacterium bovis
PRAKLFAALFLILALVVVGEVAG

SEQ ID NO: 165479 - protein, 33 aa, Mycobacterium bovis
PYLRASPWLLWRKRVVWLLVLFAAEAYTGSVLR

SEQ ID NO: 165480 - protein, 19 aa, Mycobacterium bovis
RMLRLIRRYGPIMTMPILS

SEQ ID NO: 165481 - protein, 17 aa, Mycobacterium bovis
RQPWAWLALLVAGLTVG

SEQ ID NO: 165482 - protein, 20 aa, Mycobacterium bovis
RSASWRRRLRVRLPRLSTIA

SEQ ID NO: 165483 - protein, 18 aa, Mycobacterium bovis
SAMLIYRLISWLLIAAIG

SEQ ID NO: 165484 - protein, 20 aa, Mycobacterium bovis
SLAALFAALALALTGGAWQW

SEQ ID NO: 165485 - protein, 31 aa, Mycobacterium bovis
SPRNWPVRWKVFTIALLPLVVAMVLAGLRVE

SEQ ID NO: 165486 - protein, 23 aa, Mycobacterium bovis
SRLRRGWLVGIAATLLALAGGLG

SEQ ID NO: 165487 - protein, 25 aa, Mycobacterium bovis
SVLLLPLHLLLLPWSSMRSSMHDGF

SEQ ID NO: 165488 - protein, 18 aa, Mycobacterium bovis
TFIRFWTVSFPVVAYRTW

SEQ ID NO: 165489 - protein, 18 aa, Mycobacterium bovis
TSAILLPAVIALALLPIS

SEQ ID NO: 165490 - protein, 17 aa, Mycobacterium bovis
TVFIVAVIFFTGYILGK

SEQ ID NO: 165491 - protein, 22 aa, Mycobacterium bovis
TVFTVAQWRWRWFRAAMCKTMA

SEQ ID NO: 165492 - protein, 17 aa, Mycobacterium bovis
VAVIFFTGYILGKHAGH

SEQ ID NO: 165493 - protein, 17 aa, Mycobacterium bovis
VIAIMLFIAYRSLSAAL

SEQ ID NO: 165494 - protein, 18 aa, Mycobacterium bovis
VLVLLLAAPLLRPGYLLL

SEQ ID NO: 165495 - protein, 17 aa, Mycobacterium bovis
VTREQLFWLIMTESLVA

SEQ ID NO: 165496 - protein, 21 aa, Mycobacterium bovis
VVKALLLLGLWLAGWGAARLV

SEQ ID NO: 165497 - protein, 21 aa, Mycobacterium bovis
VVTWAAWPFHRVAMRNARHHA

SEQ ID NO: 165498 - protein, 17 aa, Mycobacterium bovis
WIVIVLPIAKILATSLS

SEQ ID NO: 165499 - protein, 17 aa, Mycobacterium bovis
WQIVLILLLLGVLGLRD

SEQ ID NO: 165500 - protein, 28 aa, Mycobacterium bovis
YRLRHFGVRITRILALLLAVLLAVSGVA

SEQ ID NO: 165501 - protein, 19 aa, Mycobacterium bovis
YTWLLVALPLAGAAILLFG

SEQ ID NO: 165502 - protein, 28 aa, Mycobacterium bovis
AIGVLLGWPLWWVSTCSVLVLLVVEGVA

SEQ ID NO: 165503 - protein, 17 aa, Mycobacterium bovis
AMFLGFVAPALSLSPVT

SEQ ID NO: 165504 - protein, 17 aa, Mycobacterium bovis
APLLLWQVATRHFTNIS

SEQ ID NO: 165505 - protein, 21 aa, Mycobacterium bovis
ARSASWRRRLRVRLPRLSTIA

SEQ ID NO: 165506 - protein, 19 aa, Mycobacterium bovis
ASAWWFDMAMLVALSVIYV

SEQ ID NO: 165507 - protein, 23 aa, Mycobacterium bovis
ASFGVAPLLLWQVATRHFTNISV

SEQ ID NO: 165508 - protein, 18 aa, Mycobacterium bovis
AWFVLYLVLVLRAVGAGG

SEQ ID NO: 165509 - protein, 21 aa, Mycobacterium bovis
DELAAPRWPWVVGVAAIIAAV

SEQ ID NO: 165510 - protein, 23 aa, Mycobacterium bovis
DFDPYQFLLIPLARITGIEDPAL

SEQ ID NO: 165511 - protein, 26 aa, Mycobacterium bovis
DGEVVLLLFLPAILYWESMNTSFREI

SEQ ID NO: 165512 - protein, 24 aa, Mycobacterium bovis
DHGLWVAFWFFLAQLNLILAAINL

SEQ ID NO: 165513 - protein, 17 aa, Mycobacterium bovis
DTTLPWSYTITTTLPAV

SEQ ID NO: 165514 - protein, 17 aa, Mycobacterium bovis
DWVAWRGLGLAADAQLV

SEQ ID NO: 165515 - protein, 21 aa, Mycobacterium bovis
EFSWQLERVLPVPVFAQTMAQ

SEQ ID NO: 165516 - protein, 21 aa, Mycobacterium bovis
EGWWTSVWFLSFWVTGTSILL

SEQ ID NO: 165517 - protein, 20 aa, Mycobacterium bovis
EKAWPLLWFVVIGLIAAAVG

SEQ ID NO: 165518 - protein, 21 aa, Mycobacterium bovis
ELVLTVIPFLIISVLFYFTVV

SEQ ID NO: 165519 - protein, 17 aa, Mycobacterium bovis
EVPLLMTLLQRGRVAGA

SEQ ID NO: 165520 - protein, 17 aa, Mycobacterium bovis
FGEGWWTSVWFLSFWVT

SEQ ID NO: 165521 - protein, 23 aa, Mycobacterium bovis
FGLASRYIRLLPRGLVKRVVPKP

SEQ ID NO: 165522 - protein, 17 aa, Mycobacterium bovis
FWSLAPLVVGCILLAGL

SEQ ID NO: 165523 - protein, 19 aa, Mycobacterium bovis
GDWTIFYWGWWISWAPFVG

SEQ ID NO: 165524 - protein, 24 aa, Mycobacterium bovis
IHALSLPIILFWVALTIVVNVVAP

SEQ ID NO: 165525 - protein, 17 aa, Mycobacterium bovis
KLGPLISALLNPGARNA

SEQ ID NO: 165526 - protein, 22 aa, Mycobacterium bovis
LCLIFIIMLIITRSVVAAAVIV

SEQ ID NO: 165527 - protein, 21 aa, Mycobacterium bovis
LGLSWRWLFGLSIIPALISLI

SEQ ID NO: 165528 - protein, 23 aa, Mycobacterium bovis
LISLVLLLLFAIGGVVWGVMDGR

SEQ ID NO: 165529 - protein, 24 aa, Mycobacterium bovis
LIVVLFVPAALPWYYSWPLAVAAP

SEQ ID NO: 165530 - protein, 19 aa, Mycobacterium bovis
LLLLVYRSIATTLLILPMV

SEQ ID NO: 165531 - protein, 27 aa, Mycobacterium bovis
LLLSVALFFVWMITVAFLYLVLGGMGV

SEQ ID NO: 165532 - protein, 23 aa, Mycobacterium bovis
LLSIPLWIVIVLPIAKILATSLS

SEQ ID NO: 165533 - protein, 25 aa, Mycobacterium bovis
LLSVALFFVWMITVAFLYLVLGGMG

SEQ ID NO: 165534 - protein, 24 aa, Mycobacterium bovis
LQDGRDMFWSLAPLVVGCILLAGL

SEQ ID NO: 165535 - protein, 17 aa, Mycobacterium bovis
LRRAAFSGVLLTASLVA

SEQ ID NO: 165536 - protein, 22 aa, Mycobacterium bovis
LSVALFFVWMITVAFLYLVLGG

SEQ ID NO: 165537 - protein, 18 aa, Mycobacterium bovis
LTLIYPTLTLPSWSAGSR

SEQ ID NO: 165538 - protein, 18 aa, Mycobacterium bovis
LVASAWWLFAWELDNGAG

SEQ ID NO: 165539 - protein, 24 aa, Mycobacterium bovis
LWISLVVLWLFVLVPMLISKRDAV

SEQ ID NO: 165540 - protein, 17 aa, Mycobacterium bovis
MFWVDAEPRLRALGWTG

SEQ ID NO: 165541 - protein, 19 aa, Mycobacterium bovis
MGLVFVWFSMTPSLLPRGP

SEQ ID NO: 165542 - protein, 22 aa, Mycobacterium bovis
MLAIAMLLMLVPLATGCLRVRA

SEQ ID NO: 165543 - protein, 17 aa, Mycobacterium bovis
MLRLIRRYGPIMTMPIL

SEQ ID NO: 165544 - protein, 25 aa, Mycobacterium bovis
NFFLIAFAVYFLVVLPYNTLRKKGE

SEQ ID NO: 165545 - protein, 24 aa, Mycobacterium bovis
NGGAWLVLLMIFNVIWTYVLVRGS

SEQ ID NO: 165546 - protein, 24 aa, Mycobacterium bovis
NLRSLPVPFILNQPPPPPGPVPAP

SEQ ID NO: 165547 - protein, 23 aa, Mycobacterium bovis
PPEPPTLLWPIGVPFSDGLNTLS

SEQ ID NO: 165548 - protein, 17 aa, Mycobacterium bovis
PPKPRVFAIKPPCPEPA

SEQ ID NO: 165549 - protein, 33 aa, Mycobacterium bovis
PYLRASPWLLWRKRAVWLLVLFAAEAYTGSVLR

SEQ ID NO: 165550 - protein, 22 aa, Mycobacterium bovis
QEDFAYHQFLIKKSKMPSQTPP

SEQ ID NO: 165551 - protein, 19 aa, Mycobacterium bovis
QGCHTMSLDWVAWRGLGLA

SEQ ID NO: 165552 - protein, 22 aa, Mycobacterium bovis
RAKLFAALFLILALVVVGEVAG

SEQ ID NO: 165553 - protein, 26 aa, Mycobacterium bovis
RDPLTVFLVLIIVFSLVLAGLIGGEL

SEQ ID NO: 165554 - protein, 22 aa, Mycobacterium bovis
RHPTFLAFPMMMLVSLVVTAVT

SEQ ID NO: 165555 - protein, 21 aa, Mycobacterium bovis
RLRRGWLVGIAATLLALAGGL

SEQ ID NO: 165556 - protein, 28 aa, Mycobacterium bovis
RRDPLTVFLVLIIVFSLVLAGLIGGELY

SEQ ID NO: 165557 - protein, 19 aa, Mycobacterium bovis
RTFIRFWTVSFPVVAYRTW

SEQ ID NO: 165558 - protein, 19 aa, Mycobacterium bovis
SAMLIYRLISWLLIAAIGW

SEQ ID NO: 165559 - protein, 17 aa, Mycobacterium bovis
SFGVAPLLLWQVATRHF

SEQ ID NO: 165560 - protein, 17 aa, Mycobacterium bovis
SGMFWVDAEPRLRALGW

SEQ ID NO: 165561 - protein, 22 aa, Mycobacterium bovis
SLAALFAALALALTGGAWQWSA

SEQ ID NO: 165562 - protein, 24 aa, Mycobacterium bovis
SMLTYNIAGLPFPLSSAILPRFFY

SEQ ID NO: 165563 - protein, 21 aa, Mycobacterium bovis
SVALFFVWMITVAFLYLVLGG

SEQ ID NO: 165564 - protein, 31 aa, Mycobacterium bovis
TAKLIIWYPHYAWLLLSVYLTVALVALVVVG

SEQ ID NO: 165565 - protein, 17 aa, Mycobacterium bovis
TALISLIQRPQLRNLLH

SEQ ID NO: 165566 - protein, 17 aa, Mycobacterium bovis
TLLVASAWWLFAWELDN

SEQ ID NO: 165567 - protein, 19 aa, Mycobacterium bovis
TLTLIYPTLTLPSWSAGSR

SEQ ID NO: 165568 - protein, 19 aa, Mycobacterium bovis
TSAILLPAVIALALLPISW

SEQ ID NO: 165569 - protein, 21 aa, Mycobacterium bovis
TTLTLIYPTLTLPSWSAGSRV

SEQ ID NO: 165570 - protein, 20 aa, Mycobacterium bovis
VALLLLYWQWRTMPAVIWDV

SEQ ID NO: 165571 - protein, 18 aa, Mycobacterium bovis
VAVIFFTGYILGKHAGHG

SEQ ID NO: 165572 - protein, 19 aa, Mycobacterium bovis
VAWFVLYLVLVLRAVGAGG

SEQ ID NO: 165573 - protein, 19 aa, Mycobacterium bovis
VPWWWWPLAFALAALIAFE

SEQ ID NO: 165574 - protein, 23 aa, Mycobacterium bovis
VRRSNALLDWAYGRRFRYSETMS

SEQ ID NO: 165575 - protein, 22 aa, Mycobacterium bovis
VTREQLFWLIMTESLVAGLIGT

SEQ ID NO: 165576 - protein, 22 aa, Mycobacterium bovis
VVKALLLLGLWLAGWGAARLVA

SEQ ID NO: 165577 - protein, 20 aa, Mycobacterium bovis
VVTWAAWPFHRVAMRNARHH

SEQ ID NO: 165578 - protein, 17 aa, Mycobacterium bovis
WGQPAWSWAVLGLRGRR

SEQ ID NO: 165579 - protein, 5 aa, Mycobacterium bovis
SGTGN

SEQ ID NO: 165580 - protein, 6 aa, Mycobacterium bovis
SSSGAL

SEQ ID NO: 165581 - protein, 19 aa, Mycobacterium bovis
IASPAQPGEAGRHASDPVT

SEQ ID NO: 165582 - protein, 6 aa, Mycobacterium bovis
AQASPD

SEQ ID NO: 165583 - protein, 7 aa, Mycobacterium bovis
KRAERAL

SEQ ID NO: 165584 - protein, 5 aa, Mycobacterium bovis
LASPA

SEQ ID NO: 165585 - protein, 5 aa, Mycobacterium bovis
NAEGY

SEQ ID NO: 165586 - protein, 6 aa, Mycobacterium bovis
PLDAGP

SEQ ID NO: 165587 - protein, 4 aa, Mycobacterium bovis
RSGE

SEQ ID NO: 165588 - protein, 4 aa, Mycobacterium bovis
SKSQ

SEQ ID NO: 165589 - protein, 7 aa, Mycobacterium bovis
TSAEDGA

SEQ ID NO: 165590 - protein, 16 aa, Mycobacterium bovis
YRERSDERSNQRNGYR

SEQ ID NO: 165591 - protein, 5 aa, Mycobacterium bovis
AAPYA

SEQ ID NO: 165592 - protein, 20 aa, Mycobacterium bovis
ALTSTEEPAKQQTTNTPALT

SEQ ID NO: 165593 - protein, 8 aa, Mycobacterium bovis
ANTGTGNI

SEQ ID NO: 165594 - protein, 7 aa, Mycobacterium bovis
ATPKPSW

SEQ ID NO: 165595 - protein, 7 aa, Mycobacterium bovis
DQPDAES

SEQ ID NO: 165596 - protein, 4 aa, Mycobacterium bovis
DTAR

SEQ ID NO: 165597 - protein, 9 aa, Mycobacterium bovis
LSGGTSPVT

SEQ ID NO: 165598 - protein, 8 aa, Mycobacterium bovis
NNPQERLN

SEQ ID NO: 165599 - protein, 4 aa, Mycobacterium bovis
VRRR

SEQ ID NO: 165600 - protein, 6 aa, Mycobacterium bovis
ADEVST

SEQ ID NO: 165601 - protein, 6 aa, Mycobacterium bovis
GADEVS

SEQ ID NO: 165602 - protein, 7 aa, Mycobacterium bovis
LSGGTNA

SEQ ID NO: 165603 - protein, 12 aa, Mycobacterium bovis
QQKSIEGNDAMT

SEQ ID NO: 165604 - protein, 4 aa, Mycobacterium bovis
EGRG

SEQ ID NO: 165605 - protein, 8 aa, Mycobacterium bovis
TPPITTPP

SEQ ID NO: 165606 - protein, 4 aa, Mycobacterium bovis
AAEP

SEQ ID NO: 165607 - protein, 8 aa, Mycobacterium bovis
ANTGNNNI

SEQ ID NO: 165608 - protein, 5 aa, Mycobacterium bovis
GISGT

SEQ ID NO: 165609 - protein, 4 aa, Mycobacterium bovis
GTGN

SEQ ID NO: 165610 - protein, 4 aa, Mycobacterium bovis
LPPE

SEQ ID NO: 165611 - protein, 25 aa, Mycobacterium bovis
NAHGQKVQAAGNNMAQTDSAVGSSW

SEQ ID NO: 165612 - protein, 6 aa, Mycobacterium bovis
NAPTQT

SEQ ID NO: 165613 - protein, 9 aa, Mycobacterium bovis
PAATTPANI

SEQ ID NO: 165614 - protein, 4 aa, Mycobacterium bovis
PPTV

SEQ ID NO: 165615 - protein, 4 aa, Mycobacterium bovis
QLPD

SEQ ID NO: 165616 - protein, 5 aa, Mycobacterium bovis
SGSGN

SEQ ID NO: 165617 - protein, 4 aa, Mycobacterium bovis
TGGV

SEQ ID NO: 165618 - protein, 4 aa, Mycobacterium bovis
AAAA

SEQ ID NO: 165619 - protein, 4 aa, Mycobacterium bovis
AARG

SEQ ID NO: 165620 - protein, 4 aa, Mycobacterium bovis
GLRP

SEQ ID NO: 165621 - protein, 7 aa, Mycobacterium bovis
GADEVSA

SEQ ID NO: 165622 - protein, 5 aa, Mycobacterium bovis
NVGNT

SEQ ID NO: 165623 - protein, 4 aa, Mycobacterium bovis
PARA

SEQ ID NO: 165624 - protein, 6 aa, Mycobacterium bovis
RNGTRL

SEQ ID NO: 165625 - protein, 13 aa, Mycobacterium bovis
AAPGATNPDDHTP

SEQ ID NO: 165626 - protein, 5 aa, Mycobacterium bovis
AASAA

SEQ ID NO: 165627 - protein, 5 aa, Mycobacterium bovis
ADEVS

SEQ ID NO: 165628 - protein, 4 aa, Mycobacterium bovis
AGVS

SEQ ID NO: 165629 - protein, 16 aa, Mycobacterium bovis
ANNYEQQEQASQQILS

SEQ ID NO: 165630 - protein, 4 aa, Mycobacterium bovis
DPGL

SEQ ID NO: 165631 - protein, 22 aa, Mycobacterium bovis
DTTPDAAAIDRDTRSQAQRNHD

SEQ ID NO: 165632 - protein, 7 aa, Mycobacterium bovis
EAYADGI

SEQ ID NO: 165633 - protein, 6 aa, Mycobacterium bovis
ELGQHN

SEQ ID NO: 165634 - protein, 14 aa, Mycobacterium bovis
GDLTDTERARKRGI

SEQ ID NO: 165635 - protein, 4 aa, Mycobacterium bovis
GGAG

SEQ ID NO: 165636 - protein, 4 aa, Mycobacterium bovis
GGDA

SEQ ID NO: 165637 - protein, 7 aa, Mycobacterium bovis
GTGMAGS

SEQ ID NO: 165638 - protein, 5 aa, Mycobacterium bovis
HGQPR

SEQ ID NO: 165639 - protein, 7 aa, Mycobacterium bovis
LNSGTGN

SEQ ID NO: 165640 - protein, 4 aa, Mycobacterium bovis
LPAG

SEQ ID NO: 165641 - protein, 13 aa, Mycobacterium bovis
LQTGAGKGFTGGG

SEQ ID NO: 165642 - protein, 6 aa, Mycobacterium bovis
NAGLSA

SEQ ID NO: 165643 - protein, 7 aa, Mycobacterium bovis
NQQYDGM

SEQ ID NO: 165644 - protein, 5 aa, Mycobacterium bovis
NSGSH

SEQ ID NO: 165645 - protein, 4 aa, Mycobacterium bovis
PARK

SEQ ID NO: 165646 - protein, 19 aa, Mycobacterium bovis
PDNRLAEKGWTTRKNTHGH

SEQ ID NO: 165647 - protein, 14 aa, Mycobacterium bovis
RGCTKPGCDAPAYH

SEQ ID NO: 165648 - protein, 4 aa, Mycobacterium bovis
RPGG

SEQ ID NO: 165649 - protein, 7 aa, Mycobacterium bovis
SHSPQVD

SEQ ID NO: 165650 - protein, 4 aa, Mycobacterium bovis
SPES

SEQ ID NO: 165651 - protein, 4 aa, Mycobacterium bovis
SPRA

SEQ ID NO: 165652 - protein, 5 aa, Mycobacterium bovis
TPQAR

SEQ ID NO: 165653 - protein, 8 aa, Mycobacterium bovis
TSTGRTDI

SEQ ID NO: 165654 - protein, 6 aa, Mycobacterium bovis
TVEDEA

SEQ ID NO: 165655 - protein, 6 aa, Mycobacterium bovis
VNPGGN

SEQ ID NO: 165656 - protein, 9 aa, Mycobacterium bovis
YSPASGRYP

SEQ ID NO: 165657 - protein, 4 aa, Mycobacterium bovis
AGEA

SEQ ID NO: 165658 - protein, 4 aa, Mycobacterium bovis
DRPR

SEQ ID NO: 165659 - protein, 4 aa, Mycobacterium bovis
GNGQ

SEQ ID NO: 165660 - protein, 9 aa, Mycobacterium bovis
LGRAASVGS

SEQ ID NO: 165661 - protein, 6 aa, Mycobacterium bovis
LSPGAG

SEQ ID NO: 165662 - protein, 4 aa, Mycobacterium bovis
PDDL

SEQ ID NO: 165663 - protein, 4 aa, Mycobacterium bovis
PPRP

SEQ ID NO: 165664 - protein, 4 aa, Mycobacterium bovis
RPLI

SEQ ID NO: 165665 - protein, 4 aa, Mycobacterium bovis
APTA

SEQ ID NO: 165666 - protein, 9 aa, Mycobacterium bovis
FGNTGNNNI

SEQ ID NO: 165667 - protein, 4 aa, Mycobacterium bovis
GAAA

SEQ ID NO: 165668 - protein, 8 aa, Mycobacterium bovis
GNTGNNNI

SEQ ID NO: 165669 - protein, 4 aa, Mycobacterium bovis
LGTG

SEQ ID NO: 165670 - protein, 7 aa, Mycobacterium bovis
NAPAIAA

SEQ ID NO: 165671 - protein, 11 aa, Mycobacterium bovis
NTANTAAAATT

SEQ ID NO: 165672 - protein, 5 aa, Mycobacterium bovis
RAEES

SEQ ID NO: 165673 - protein, 4 aa, Mycobacterium bovis
SAAR

SEQ ID NO: 165674 - protein, 12 aa, Mycobacterium bovis
TAAADAARIGSA

SEQ ID NO: 165675 - protein, 4 aa, Mycobacterium bovis
VPAG

SEQ ID NO: 165676 - protein, 5 aa, Mycobacterium bovis
AAAAE

SEQ ID NO: 165677 - protein, 4 aa, Mycobacterium bovis
AAAG

SEQ ID NO: 165678 - protein, 4 aa, Mycobacterium bovis
AAAQ

SEQ ID NO: 165679 - protein, 6 aa, Mycobacterium bovis
AADEVS

SEQ ID NO: 165680 - protein, 4 aa, Mycobacterium bovis
AADL

SEQ ID NO: 165681 - protein, 10 aa, Mycobacterium bovis
AAEPGAAGRH

SEQ ID NO: 165682 - protein, 5 aa, Mycobacterium bovis
AAERA

SEQ ID NO: 165683 - protein, 4 aa, Mycobacterium bovis
AAGA

SEQ ID NO: 165684 - protein, 9 aa, Mycobacterium bovis
AAGGPTHAS

SEQ ID NO: 165685 - protein, 4 aa, Mycobacterium bovis
AAGV

SEQ ID NO: 165686 - protein, 8 aa, Mycobacterium bovis
AALGTPRR

SEQ ID NO: 165687 - protein, 13 aa, Mycobacterium bovis
AANEDGTFKSDEE

SEQ ID NO: 165688 - protein, 4 aa, Mycobacterium bovis
AAPS

SEQ ID NO: 165689 - protein, 11 aa, Mycobacterium bovis
AARAEQAGMQA

SEQ ID NO: 165690 - protein, 7 aa, Mycobacterium bovis
AASASAS

SEQ ID NO: 165691 - protein, 7 aa, Mycobacterium bovis
AASATPL

SEQ ID NO: 165692 - protein, 5 aa, Mycobacterium bovis
AASRD

SEQ ID NO: 165693 - protein, 7 aa, Mycobacterium bovis
AATGGRG

SEQ ID NO: 165694 - protein, 4 aa, Mycobacterium bovis
AATS

SEQ ID NO: 165695 - protein, 9 aa, Mycobacterium bovis
ACEEELGGT

SEQ ID NO: 165696 - protein, 4 aa, Mycobacterium bovis
ADAE

SEQ ID NO: 165697 - protein, 4 aa, Mycobacterium bovis
ADEV

SEQ ID NO: 165698 - protein, 4 aa, Mycobacterium bovis
ADPA

SEQ ID NO: 165699 - protein, 4 aa, Mycobacterium bovis
ADQA

SEQ ID NO: 165700 - protein, 4 aa, Mycobacterium bovis
ADRA

SEQ ID NO: 165701 - protein, 34 aa, Mycobacterium bovis
ADSAGRPLSAGSLARASTKPPPAVAPWPGPTGER

SEQ ID NO: 165702 - protein, 4 aa, Mycobacterium bovis
ADTG

SEQ ID NO: 165703 - protein, 19 aa, Mycobacterium bovis
AEDLGERRALTGEPLPAQL

SEQ ID NO: 165704 - protein, 4 aa, Mycobacterium bovis
AGAD

SEQ ID NO: 165705 - protein, 11 aa, Mycobacterium bovis
AGANGGAGGAG

SEQ ID NO: 165706 - protein, 4 aa, Mycobacterium bovis
AGAQ

SEQ ID NO: 165707 - protein, 4 aa, Mycobacterium bovis
AGAR

SEQ ID NO: 165708 - protein, 8 aa, Mycobacterium bovis
AGDQLGGS

SEQ ID NO: 165709 - protein, 5 aa, Mycobacterium bovis
AGEDI

SEQ ID NO: 165710 - protein, 11 aa, Mycobacterium bovis
AGKAAQYRPDE

SEQ ID NO: 165711 - protein, 9 aa, Mycobacterium bovis
AGLDNSKET

SEQ ID NO: 165712 - protein, 4 aa, Mycobacterium bovis
AGRA

SEQ ID NO: 165713 - protein, 4 aa, Mycobacterium bovis
AGRP

SEQ ID NO: 165714 - protein, 4 aa, Mycobacterium bovis
AGSL

SEQ ID NO: 165715 - protein, 25 aa, Mycobacterium bovis
AGSYNTGSFNAGQANTGGFNPGSVN

SEQ ID NO: 165716 - protein, 4 aa, Mycobacterium bovis
AGTF

SEQ ID NO: 165717 - protein, 4 aa, Mycobacterium bovis
AHGA

SEQ ID NO: 165718 - protein, 8 aa, Mycobacterium bovis
AKDKSIPL

SEQ ID NO: 165719 - protein, 4 aa, Mycobacterium bovis
AKTV

SEQ ID NO: 165720 - protein, 8 aa, Mycobacterium bovis
ALAGGADR

SEQ ID NO: 165721 - protein, 4 aa, Mycobacterium bovis
ALPG

SEQ ID NO: 165722 - protein, 8 aa, Mycobacterium bovis
AMQAGQGA

SEQ ID NO: 165723 - protein, 8 aa, Mycobacterium bovis
ANTGPGLT

SEQ ID NO: 165724 - protein, 8 aa, Mycobacterium bovis
ANTGSGNF

SEQ ID NO: 165725 - protein, 18 aa, Mycobacterium bovis
ANTGSNNVGFGNTGSNNV

SEQ ID NO: 165726 - protein, 4 aa, Mycobacterium bovis
APGA

SEQ ID NO: 165727 - protein, 10 aa, Mycobacterium bovis
APPKTTNSAG

SEQ ID NO: 165728 - protein, 4 aa, Mycobacterium bovis
APTV

SEQ ID NO: 165729 - protein, 8 aa, Mycobacterium bovis
AQGRLEAG

SEQ ID NO: 165730 - protein, 6 aa, Mycobacterium bovis
AQNATK

SEQ ID NO: 165731 - protein, 7 aa, Mycobacterium bovis
AQTEHPG

SEQ ID NO: 165732 - protein, 4 aa, Mycobacterium bovis
ARAC

SEQ ID NO: 165733 - protein, 5 aa, Mycobacterium bovis
ARAKM

SEQ ID NO: 165734 - protein, 4 aa, Mycobacterium bovis
ARDA

SEQ ID NO: 165735 - protein, 4 aa, Mycobacterium bovis
ARDR

SEQ ID NO: 165736 - protein, 4 aa, Mycobacterium bovis
ARGL

SEQ ID NO: 165737 - protein, 4 aa, Mycobacterium bovis
ARGP

SEQ ID NO: 165738 - protein, 4 aa, Mycobacterium bovis
ARHT

SEQ ID NO: 165739 - protein, 4 aa, Mycobacterium bovis
ARQR

SEQ ID NO: 165740 - protein, 8 aa, Mycobacterium bovis
ARRPHGQH

SEQ ID NO: 165741 - protein, 4 aa, Mycobacterium bovis
ASAA

SEQ ID NO: 165742 - protein, 16 aa, Mycobacterium bovis
ASAPEARAEILEPVPL

SEQ ID NO: 165743 - protein, 4 aa, Mycobacterium bovis
ASGA

SEQ ID NO: 165744 - protein, 7 aa, Mycobacterium bovis
ASKGKWD

SEQ ID NO: 165745 - protein, 13 aa, Mycobacterium bovis
ATAAAQREGKIGR

SEQ ID NO: 165746 - protein, 6 aa, Mycobacterium bovis
ATATGL

SEQ ID NO: 165747 - protein, 4 aa, Mycobacterium bovis
ATGE

SEQ ID NO: 165748 - protein, 4 aa, Mycobacterium bovis
ATHA

SEQ ID NO: 165749 - protein, 4 aa, Mycobacterium bovis
ATSL

SEQ ID NO: 165750 - protein, 7 aa, Mycobacterium bovis
ATSRRPD

SEQ ID NO: 165751 - protein, 6 aa, Mycobacterium bovis
ATVEPT

SEQ ID NO: 165752 - protein, 4 aa, Mycobacterium bovis
AVTG

SEQ ID NO: 165753 - protein, 11 aa, Mycobacterium bovis
CAAGKRPAAPP

SEQ ID NO: 165754 - protein, 4 aa, Mycobacterium bovis
CSSG

SEQ ID NO: 165755 - protein, 4 aa, Mycobacterium bovis
DAAR

SEQ ID NO: 165756 - protein, 6 aa, Mycobacterium bovis
DALADG

SEQ ID NO: 165757 - protein, 6 aa, Mycobacterium bovis
DEEERR

SEQ ID NO: 165758 - protein, 9 aa, Mycobacterium bovis
DEKKTAETF

SEQ ID NO: 165759 - protein, 4 aa, Mycobacterium bovis
DELG

SEQ ID NO: 165760 - protein, 6 aa, Mycobacterium bovis
DEPATN

SEQ ID NO: 165761 - protein, 4 aa, Mycobacterium bovis
DERS

SEQ ID NO: 165762 - protein, 16 aa, Mycobacterium bovis
DGANGIDGTGQAGGNG

SEQ ID NO: 165763 - protein, 4 aa, Mycobacterium bovis
DGDA

SEQ ID NO: 165764 - protein, 7 aa, Mycobacterium bovis
DGGATEL

SEQ ID NO: 165765 - protein, 5 aa, Mycobacterium bovis
DGGRK

SEQ ID NO: 165766 - protein, 4 aa, Mycobacterium bovis
DGRT

SEQ ID NO: 165767 - protein, 5 aa, Mycobacterium bovis
DKEGT

SEQ ID NO: 165768 - protein, 7 aa, Mycobacterium bovis
DLGESDN

SEQ ID NO: 165769 - protein, 4 aa, Mycobacterium bovis
DPAA

SEQ ID NO: 165770 - protein, 5 aa, Mycobacterium bovis
DPRLP

SEQ ID NO: 165771 - protein, 5 aa, Mycobacterium bovis
DPSGA

SEQ ID NO: 165772 - protein, 6 aa, Mycobacterium bovis
DSAGGY

SEQ ID NO: 165773 - protein, 4 aa, Mycobacterium bovis
DYSG

SEQ ID NO: 165774 - protein, 16 aa, Mycobacterium bovis
EAATGKGVTGGGSRVP

SEQ ID NO: 165775 - protein, 4 aa, Mycobacterium bovis
EALG

SEQ ID NO: 165776 - protein, 5 aa, Mycobacterium bovis
EASNR

SEQ ID NO: 165777 - protein, 6 aa, Mycobacterium bovis
EASRRG

SEQ ID NO: 165778 - protein, 9 aa, Mycobacterium bovis
EDDAGDGAR

SEQ ID NO: 165779 - protein, 8 aa, Mycobacterium bovis
EDLTERQS

SEQ ID NO: 165780 - protein, 5 aa, Mycobacterium bovis
EDPPM

SEQ ID NO: 165781 - protein, 8 aa, Mycobacterium bovis
EDTSAYDR

SEQ ID NO: 165782 - protein, 4 aa, Mycobacterium bovis
ELTP

SEQ ID NO: 165783 - protein, 5 aa, Mycobacterium bovis
EPAGA

SEQ ID NO: 165784 - protein, 4 aa, Mycobacterium bovis
EPDE

SEQ ID NO: 165785 - protein, 6 aa, Mycobacterium bovis
EPGVGK

SEQ ID NO: 165786 - protein, 24 aa, Mycobacterium bovis
EPRPEPEPDFRPEPRPSITRSADE

SEQ ID NO: 165787 - protein, 4 aa, Mycobacterium bovis
EQGT

SEQ ID NO: 165788 - protein, 19 aa, Mycobacterium bovis
EQTEARPADDVHAGHVTSG

SEQ ID NO: 165789 - protein, 4 aa, Mycobacterium bovis
ERQA

SEQ ID NO: 165790 - protein, 11 aa, Mycobacterium bovis
ERRQNHAARQR

SEQ ID NO: 165791 - protein, 5 aa, Mycobacterium bovis
ESTNT

SEQ ID NO: 165792 - protein, 5 aa, Mycobacterium bovis
ETSPD

SEQ ID NO: 165793 - protein, 5 aa, Mycobacterium bovis
EVRGS

SEQ ID NO: 165794 - protein, 8 aa, Mycobacterium bovis
FANTGNNN

SEQ ID NO: 165795 - protein, 4 aa, Mycobacterium bovis
FEET

SEQ ID NO: 165796 - protein, 4 aa, Mycobacterium bovis
FERQ

SEQ ID NO: 165797 - protein, 17 aa, Mycobacterium bovis
FGPGGTTAGSGGAWYPT

SEQ ID NO: 165798 - protein, 7 aa, Mycobacterium bovis
FNPDRTR

SEQ ID NO: 165799 - protein, 15 aa, Mycobacterium bovis
FNTGIGNSGTGSTGL

SEQ ID NO: 165800 - protein, 7 aa, Mycobacterium bovis
FNTGSGN

SEQ ID NO: 165801 - protein, 4 aa, Mycobacterium bovis
GAAQ

SEQ ID NO: 165802 - protein, 4 aa, Mycobacterium bovis
GAGK

SEQ ID NO: 165803 - protein, 8 aa, Mycobacterium bovis
GAKSVPAQ

SEQ ID NO: 165804 - protein, 4 aa, Mycobacterium bovis
GARA

SEQ ID NO: 165805 - protein, 9 aa, Mycobacterium bovis
GARTRRAGV

SEQ ID NO: 165806 - protein, 5 aa, Mycobacterium bovis
GASAA

SEQ ID NO: 165807 - protein, 12 aa, Mycobacterium bovis
GASMEGTNTGSF

SEQ ID NO: 165808 - protein, 14 aa, Mycobacterium bovis
GDAPPEPGYAPSKA

SEQ ID NO: 165809 - protein, 4 aa, Mycobacterium bovis
GDDA

SEQ ID NO: 165810 - protein, 5 aa, Mycobacterium bovis
GDDGL

SEQ ID NO: 165811 - protein, 5 aa, Mycobacterium bovis
GDEPA

SEQ ID NO: 165812 - protein, 5 aa, Mycobacterium bovis
GDGQI

SEQ ID NO: 165813 - protein, 4 aa, Mycobacterium bovis
GDNQ

SEQ ID NO: 165814 - protein, 4 aa, Mycobacterium bovis
GDRL

SEQ ID NO: 165815 - protein, 4 aa, Mycobacterium bovis
GDRV

SEQ ID NO: 165816 - protein, 4 aa, Mycobacterium bovis
GEEH

SEQ ID NO: 165817 - protein, 6 aa, Mycobacterium bovis
GELGQH

SEQ ID NO: 165818 - protein, 4 aa, Mycobacterium bovis
GELP

SEQ ID NO: 165819 - protein, 6 aa, Mycobacterium bovis
GEPQPE

SEQ ID NO: 165820 - protein, 4 aa, Mycobacterium bovis
GEPV

SEQ ID NO: 165821 - protein, 11 aa, Mycobacterium bovis
GESDDTSKLSR

SEQ ID NO: 165822 - protein, 8 aa, Mycobacterium bovis
GFGGPDTF

SEQ ID NO: 165823 - protein, 22 aa, Mycobacterium bovis
GGAAPVTRAGDDAEQSDGEERR

SEQ ID NO: 165824 - protein, 7 aa, Mycobacterium bovis
GGAGSAA

SEQ ID NO: 165825 - protein, 10 aa, Mycobacterium bovis
GGAGTTAAGL

SEQ ID NO: 165826 - protein, 4 aa, Mycobacterium bovis
GGAN

SEQ ID NO: 165827 - protein, 5 aa, Mycobacterium bovis
GGARG

SEQ ID NO: 165828 - protein, 6 aa, Mycobacterium bovis
GGIGEK

SEQ ID NO: 165829 - protein, 5 aa, Mycobacterium bovis
GGTPF

SEQ ID NO: 165830 - protein, 13 aa, Mycobacterium bovis
GHGTGTTLGDPIE

SEQ ID NO: 165831 - protein, 12 aa, Mycobacterium bovis
GIDPTGLRGSAT

SEQ ID NO: 165832 - protein, 8 aa, Mycobacterium bovis
GKSKSDVI

SEQ ID NO: 165833 - protein, 4 aa, Mycobacterium bovis
GKYT

SEQ ID NO: 165834 - protein, 4 aa, Mycobacterium bovis
GLGA

SEQ ID NO: 165835 - protein, 5 aa, Mycobacterium bovis
GNAGS

SEQ ID NO: 165836 - protein, 16 aa, Mycobacterium bovis
GNANTGVANAGNVNTG

SEQ ID NO: 165837 - protein, 15 aa, Mycobacterium bovis
GNFSDQERARKRGIT

SEQ ID NO: 165838 - protein, 13 aa, Mycobacterium bovis
GNQGSYNIGPANL

SEQ ID NO: 165839 - protein, 4 aa, Mycobacterium bovis
GPAA

SEQ ID NO: 165840 - protein, 7 aa, Mycobacterium bovis
GPADNLT

SEQ ID NO: 165841 - protein, 4 aa, Mycobacterium bovis
GPAG

SEQ ID NO: 165842 - protein, 4 aa, Mycobacterium bovis
GPDR

SEQ ID NO: 165843 - protein, 6 aa, Mycobacterium bovis
GPGGGL

SEQ ID NO: 165844 - protein, 5 aa, Mycobacterium bovis
GPGLT

SEQ ID NO: 165845 - protein, 4 aa, Mycobacterium bovis
GPQV

SEQ ID NO: 165846 - protein, 5 aa, Mycobacterium bovis
GPVAT

SEQ ID NO: 165847 - protein, 6 aa, Mycobacterium bovis
GPYPGY

SEQ ID NO: 165848 - protein, 6 aa, Mycobacterium bovis
GQAELT

SEQ ID NO: 165849 - protein, 10 aa, Mycobacterium bovis
GRAGEGSDAH

SEQ ID NO: 165850 - protein, 25 aa, Mycobacterium bovis
GRPLSSDPVSRPVTSYTASPPDNTI

SEQ ID NO: 165851 - protein, 4 aa, Mycobacterium bovis
GRPP

SEQ ID NO: 165852 - protein, 6 aa, Mycobacterium bovis
GRPYQD

SEQ ID NO: 165853 - protein, 5 aa, Mycobacterium bovis
GSAPM

SEQ ID NO: 165854 - protein, 5 aa, Mycobacterium bovis
GSGPM

SEQ ID NO: 165855 - protein, 5 aa, Mycobacterium bovis
GSPWR

SEQ ID NO: 165856 - protein, 4 aa, Mycobacterium bovis
GSQW

SEQ ID NO: 165857 - protein, 6 aa, Mycobacterium bovis
GSTEVG

SEQ ID NO: 165858 - protein, 15 aa, Mycobacterium bovis
GSYNTGIGNSGIAST

SEQ ID NO: 165859 - protein, 4 aa, Mycobacterium bovis
GTAV

SEQ ID NO: 165860 - protein, 4 aa, Mycobacterium bovis
GVPA

SEQ ID NO: 165861 - protein, 6 aa, Mycobacterium bovis
HETTAA

SEQ ID NO: 165862 - protein, 6 aa, Mycobacterium bovis
HGRGGF

SEQ ID NO: 165863 - protein, 7 aa, Mycobacterium bovis
HISDSRS

SEQ ID NO: 165864 - protein, 4 aa, Mycobacterium bovis
HNPA

SEQ ID NO: 165865 - protein, 8 aa, Mycobacterium bovis
HQRDDNAA

SEQ ID NO: 165866 - protein, 6 aa, Mycobacterium bovis
HRNHQA

SEQ ID NO: 165867 - protein, 13 aa, Mycobacterium bovis
IAAANAAAAANTT

SEQ ID NO: 165868 - protein, 28 aa, Mycobacterium bovis
IARTEPKWGRGRPGKNAAPRPGRERARR

SEQ ID NO: 165869 - protein, 4 aa, Mycobacterium bovis
IDTG

SEQ ID NO: 165870 - protein, 15 aa, Mycobacterium bovis
IGNGGAGGAGGQGLP

SEQ ID NO: 165871 - protein, 12 aa, Mycobacterium bovis
IPEGSGEDGRPY

SEQ ID NO: 165872 - protein, 11 aa, Mycobacterium bovis
IPITTSGKVRR

SEQ ID NO: 165873 - protein, 4 aa, Mycobacterium bovis
IRPG

SEQ ID NO: 165874 - protein, 7 aa, Mycobacterium bovis
ITPTERT

SEQ ID NO: 165875 - protein, 8 aa, Mycobacterium bovis
KDAEGSPV

SEQ ID NO: 165876 - protein, 8 aa, Mycobacterium bovis
KGEEGKQA

SEQ ID NO: 165877 - protein, 4 aa, Mycobacterium bovis
KGHP

SEQ ID NO: 165878 - protein, 5 aa, Mycobacterium bovis
KKGAN

SEQ ID NO: 165879 - protein, 10 aa, Mycobacterium bovis
KRSPAGKPDY

SEQ ID NO: 165880 - protein, 7 aa, Mycobacterium bovis
KSATGLS

SEQ ID NO: 165881 - protein, 10 aa, Mycobacterium bovis
KSESALRGQA

SEQ ID NO: 165882 - protein, 4 aa, Mycobacterium bovis
LAPD

SEQ ID NO: 165883 - protein, 5 aa, Mycobacterium bovis
LDEDS

SEQ ID NO: 165884 - protein, 5 aa, Mycobacterium bovis
LDGPT

SEQ ID NO: 165885 - protein, 4 aa, Mycobacterium bovis
LDPA

SEQ ID NO: 165886 - protein, 5 aa, Mycobacterium bovis
LDPSR

SEQ ID NO: 165887 - protein, 4 aa, Mycobacterium bovis
LDSA

SEQ ID NO: 165888 - protein, 8 aa, Mycobacterium bovis
LDTPAGAR

SEQ ID NO: 165889 - protein, 4 aa, Mycobacterium bovis
LEPG

SEQ ID NO: 165890 - protein, 9 aa, Mycobacterium bovis
LGAATGALA

SEQ ID NO: 165891 - protein, 4 aa, Mycobacterium bovis
LGDT

SEQ ID NO: 165892 - protein, 4 aa, Mycobacterium bovis
LGER

SEQ ID NO: 165893 - protein, 10 aa, Mycobacterium bovis
LGNTGSTNTG

SEQ ID NO: 165894 - protein, 4 aa, Mycobacterium bovis
LPDE

SEQ ID NO: 165895 - protein, 5 aa, Mycobacterium bovis
LPDGT

SEQ ID NO: 165896 - protein, 5 aa, Mycobacterium bovis
LPTPA

SEQ ID NO: 165897 - protein, 6 aa, Mycobacterium bovis
LSGYDD

SEQ ID NO: 165898 - protein, 5 aa, Mycobacterium bovis
LSPGQ

SEQ ID NO: 165899 - protein, 5 aa, Mycobacterium bovis
LTPEQ

SEQ ID NO: 165900 - protein, 8 aa, Mycobacterium bovis
MDPDKERR

SEQ ID NO: 165901 - protein, 5 aa, Mycobacterium bovis
MGDED

SEQ ID NO: 165902 - protein, 5 aa, Mycobacterium bovis
MGESA

SEQ ID NO: 165903 - protein, 5 aa, Mycobacterium bovis
MSEAQ

SEQ ID NO: 165904 - protein, 5 aa, Mycobacterium bovis
NAGDT

SEQ ID NO: 165905 - protein, 6 aa, Mycobacterium bovis
NAPTQA

SEQ ID NO: 165906 - protein, 17 aa, Mycobacterium bovis
NGANGAPGTGADGAPGG

SEQ ID NO: 165907 - protein, 22 aa, Mycobacterium bovis
NGGNGGSGAPGQAGGAGGAAGL

SEQ ID NO: 165908 - protein, 6 aa, Mycobacterium bovis
NGPAIG

SEQ ID NO: 165909 - protein, 8 aa, Mycobacterium bovis
NHSPDDIE

SEQ ID NO: 165910 - protein, 7 aa, Mycobacterium bovis
NISGAGW

SEQ ID NO: 165911 - protein, 8 aa, Mycobacterium bovis
NLGEAAGT

SEQ ID NO: 165912 - protein, 8 aa, Mycobacterium bovis
NRLGRRGA

SEQ ID NO: 165913 - protein, 6 aa, Mycobacterium bovis
NRPEGL

SEQ ID NO: 165914 - protein, 9 aa, Mycobacterium bovis
NRTPPKTQA

SEQ ID NO: 165915 - protein, 6 aa, Mycobacterium bovis
NSGSGN

SEQ ID NO: 165916 - protein, 6 aa, Mycobacterium bovis
NVGTGN

SEQ ID NO: 165917 - protein, 8 aa, Mycobacterium bovis
PAAADSTD

SEQ ID NO: 165918 - protein, 7 aa, Mycobacterium bovis
PAATKAD

SEQ ID NO: 165919 - protein, 5 aa, Mycobacterium bovis
PDGTR

SEQ ID NO: 165920 - protein, 4 aa, Mycobacterium bovis
PDGV

SEQ ID NO: 165921 - protein, 11 aa, Mycobacterium bovis
PDNVQGAAGPF

SEQ ID NO: 165922 - protein, 4 aa, Mycobacterium bovis
PDPD

SEQ ID NO: 165923 - protein, 7 aa, Mycobacterium bovis
PDPRYGQ

SEQ ID NO: 165924 - protein, 10 aa, Mycobacterium bovis
PEGAGPGTKG

SEQ ID NO: 165925 - protein, 4 aa, Mycobacterium bovis
PETL

SEQ ID NO: 165926 - protein, 4 aa, Mycobacterium bovis
PGGC

SEQ ID NO: 165927 - protein, 6 aa, Mycobacterium bovis
PGSGPM

SEQ ID NO: 165928 - protein, 4 aa, Mycobacterium bovis
PGTA

SEQ ID NO: 165929 - protein, 7 aa, Mycobacterium bovis
PGVPNAE

SEQ ID NO: 165930 - protein, 4 aa, Mycobacterium bovis
PKLR

SEQ ID NO: 165931 - protein, 7 aa, Mycobacterium bovis
PLTGSHR

SEQ ID NO: 165932 - protein, 7 aa, Mycobacterium bovis
PNPRPLD

SEQ ID NO: 165933 - protein, 4 aa, Mycobacterium bovis
PPAP

SEQ ID NO: 165934 - protein, 5 aa, Mycobacterium bovis
PPGCG

SEQ ID NO: 165935 - protein, 4 aa, Mycobacterium bovis
PPPV

SEQ ID NO: 165936 - protein, 11 aa, Mycobacterium bovis
PQEQSQRPGHI

SEQ ID NO: 165937 - protein, 4 aa, Mycobacterium bovis
PQQR

SEQ ID NO: 165938 - protein, 4 aa, Mycobacterium bovis
PRDG

SEQ ID NO: 165939 - protein, 5 aa, Mycobacterium bovis
PRTTR

SEQ ID NO: 165940 - protein, 4 aa, Mycobacterium bovis
PRVR

SEQ ID NO: 165941 - protein, 4 aa, Mycobacterium bovis
PSIT

SEQ ID NO: 165942 - protein, 5 aa, Mycobacterium bovis
PTHGP

SEQ ID NO: 165943 - protein, 4 aa, Mycobacterium bovis
PTRT

SEQ ID NO: 165944 - protein, 4 aa, Mycobacterium bovis
PTTA

SEQ ID NO: 165945 - protein, 4 aa, Mycobacterium bovis
PTTG

SEQ ID NO: 165946 - protein, 9 aa, Mycobacterium bovis
QALASSPMK

SEQ ID NO: 165947 - protein, 6 aa, Mycobacterium bovis
QAPGNA

SEQ ID NO: 165948 - protein, 8 aa, Mycobacterium bovis
QAQPDDVS

SEQ ID NO: 165949 - protein, 7 aa, Mycobacterium bovis
QAVTPAA

SEQ ID NO: 165950 - protein, 5 aa, Mycobacterium bovis
QGTGG

SEQ ID NO: 165951 - protein, 4 aa, Mycobacterium bovis
QPGQ

SEQ ID NO: 165952 - protein, 4 aa, Mycobacterium bovis
QPLP

SEQ ID NO: 165953 - protein, 4 aa, Mycobacterium bovis
QRAG

SEQ ID NO: 165954 - protein, 16 aa, Mycobacterium bovis
QTRKSARSRGKSDPID

SEQ ID NO: 165955 - protein, 8 aa, Mycobacterium bovis
QTYVTTPG

SEQ ID NO: 165956 - protein, 7 aa, Mycobacterium bovis
QVEEDGT

SEQ ID NO: 165957 - protein, 4 aa, Mycobacterium bovis
RAEA

SEQ ID NO: 165958 - protein, 4 aa, Mycobacterium bovis
RDDA

SEQ ID NO: 165959 - protein, 19 aa, Mycobacterium bovis
RDHDNSDGVSDQRPPLPGN

SEQ ID NO: 165960 - protein, 8 aa, Mycobacterium bovis
RDPQEAAQ

SEQ ID NO: 165961 - protein, 9 aa, Mycobacterium bovis
RDSENGAVA

SEQ ID NO: 165962 - protein, 7 aa, Mycobacterium bovis
REHTDPF

SEQ ID NO: 165963 - protein, 4 aa, Mycobacterium bovis
RGAG

SEQ ID NO: 165964 - protein, 12 aa, Mycobacterium bovis
RGCSRPGCDAPA

SEQ ID NO: 165965 - protein, 4 aa, Mycobacterium bovis
RGGA

SEQ ID NO: 165966 - protein, 6 aa, Mycobacterium bovis
RGIANE

SEQ ID NO: 165967 - protein, 4 aa, Mycobacterium bovis
RGRA

SEQ ID NO: 165968 - protein, 6 aa, Mycobacterium bovis
RGSQWA

SEQ ID NO: 165969 - protein, 8 aa, Mycobacterium bovis
RGTATAAG

SEQ ID NO: 165970 - protein, 4 aa, Mycobacterium bovis
RGTD

SEQ ID NO: 165971 - protein, 5 aa, Mycobacterium bovis
RLPEA

SEQ ID NO: 165972 - protein, 4 aa, Mycobacterium bovis
RLPK

SEQ ID NO: 165973 - protein, 6 aa, Mycobacterium bovis
RPAPDT

SEQ ID NO: 165974 - protein, 4 aa, Mycobacterium bovis
RPEQ

SEQ ID NO: 165975 - protein, 4 aa, Mycobacterium bovis
RPER

SEQ ID NO: 165976 - protein, 7 aa, Mycobacterium bovis
RPGCRPS

SEQ ID NO: 165977 - protein, 4 aa, Mycobacterium bovis
RPSG

SEQ ID NO: 165978 - protein, 14 aa, Mycobacterium bovis
RPTLPGRHNHPQIS

SEQ ID NO: 165979 - protein, 5 aa, Mycobacterium bovis
RREYP

SEQ ID NO: 165980 - protein, 10 aa, Mycobacterium bovis
RRGPDAPGAA

SEQ ID NO: 165981 - protein, 8 aa, Mycobacterium bovis
RRRQGAAE

SEQ ID NO: 165982 - protein, 4 aa, Mycobacterium bovis
RSGG

SEQ ID NO: 165983 - protein, 8 aa, Mycobacterium bovis
RSPAANKK

SEQ ID NO: 165984 - protein, 4 aa, Mycobacterium bovis
RTDA

SEQ ID NO: 165985 - protein, 4 aa, Mycobacterium bovis
RTPT

SEQ ID NO: 165986 - protein, 6 aa, Mycobacterium bovis
RTTRQI

SEQ ID NO: 165987 - protein, 4 aa, Mycobacterium bovis
SAAA

SEQ ID NO: 165988 - protein, 8 aa, Mycobacterium bovis
SAAQTAPG

SEQ ID NO: 165989 - protein, 4 aa, Mycobacterium bovis
SALD

SEQ ID NO: 165990 - protein, 11 aa, Mycobacterium bovis
SARESHGGEGR

SEQ ID NO: 165991 - protein, 6 aa, Mycobacterium bovis
SARRAE

SEQ ID NO: 165992 - protein, 4 aa, Mycobacterium bovis
SDGA

SEQ ID NO: 165993 - protein, 4 aa, Mycobacterium bovis
SDPS

SEQ ID NO: 165994 - protein, 5 aa, Mycobacterium bovis
SDPSL

SEQ ID NO: 165995 - protein, 9 aa, Mycobacterium bovis
SGAAGQYDP

SEQ ID NO: 165996 - protein, 9 aa, Mycobacterium bovis
SGAGGVSGF

SEQ ID NO: 165997 - protein, 4 aa, Mycobacterium bovis
SGAS

SEQ ID NO: 165998 - protein, 6 aa, Mycobacterium bovis
SGCGKT

SEQ ID NO: 165999 - protein, 7 aa, Mycobacterium bovis
SGCGKTT

SEQ ID NO: 166000 - protein, 5 aa, Mycobacterium bovis
SGDGN

SEQ ID NO: 166001 - protein, 7 aa, Mycobacterium bovis
SGDNQQG

SEQ ID NO: 166002 - protein, 9 aa, Mycobacterium bovis
SGGRRRGDT

SEQ ID NO: 166003 - protein, 4 aa, Mycobacterium bovis
SGIT

SEQ ID NO: 166004 - protein, 4 aa, Mycobacterium bovis
SGLP

SEQ ID NO: 166005 - protein, 4 aa, Mycobacterium bovis
SGPR

SEQ ID NO: 166006 - protein, 17 aa, Mycobacterium bovis
SGSITEAARRLMAHDDL

SEQ ID NO: 166007 - protein, 4 aa, Mycobacterium bovis
SGVA

SEQ ID NO: 166008 - protein, 10 aa, Mycobacterium bovis
SHEGKPGRRF

SEQ ID NO: 166009 - protein, 6 aa, Mycobacterium bovis
SKQRGR

SEQ ID NO: 166010 - protein, 11 aa, Mycobacterium bovis
SNMGHTQAAAG

SEQ ID NO: 166011 - protein, 6 aa, Mycobacterium bovis
SPDEFS

SEQ ID NO: 166012 - protein, 9 aa, Mycobacterium bovis
SPFPPDDAP

SEQ ID NO: 166013 - protein, 5 aa, Mycobacterium bovis
SPGLK

SEQ ID NO: 166014 - protein, 13 aa, Mycobacterium bovis
SPSGHTYVSTPGS

SEQ ID NO: 166015 - protein, 4 aa, Mycobacterium bovis
SRAG

SEQ ID NO: 166016 - protein, 4 aa, Mycobacterium bovis
SRAS

SEQ ID NO: 166017 - protein, 4 aa, Mycobacterium bovis
SREG

SEQ ID NO: 166018 - protein, 4 aa, Mycobacterium bovis
SRST

SEQ ID NO: 166019 - protein, 8 aa, Mycobacterium bovis
SRTSATGI

SEQ ID NO: 166020 - protein, 16 aa, Mycobacterium bovis
SSGSYAATEAANAAAA

SEQ ID NO: 166021 - protein, 6 aa, Mycobacterium bovis
SSVASG

SEQ ID NO: 166022 - protein, 6 aa, Mycobacterium bovis
STNVRA

SEQ ID NO: 166023 - protein, 9 aa, Mycobacterium bovis
STRTLTGAT

SEQ ID NO: 166024 - protein, 4 aa, Mycobacterium bovis
STVS

SEQ ID NO: 166025 - protein, 6 aa, Mycobacterium bovis
SVGATA

SEQ ID NO: 166026 - protein, 20 aa, Mycobacterium bovis
TAAATDTHGPPPDHNDDPPP

SEQ ID NO: 166027 - protein, 4 aa, Mycobacterium bovis
TAER

SEQ ID NO: 166028 - protein, 6 aa, Mycobacterium bovis
TDAEAA

SEQ ID NO: 166029 - protein, 4 aa, Mycobacterium bovis
TDEQ

SEQ ID NO: 166030 - protein, 4 aa, Mycobacterium bovis
TDER

SEQ ID NO: 166031 - protein, 6 aa, Mycobacterium bovis
TDIRDP

SEQ ID NO: 166032 - protein, 5 aa, Mycobacterium bovis
TEAPG

SEQ ID NO: 166033 - protein, 5 aa, Mycobacterium bovis
TEEQK

SEQ ID NO: 166034 - protein, 4 aa, Mycobacterium bovis
TEKR

SEQ ID NO: 166035 - protein, 17 aa, Mycobacterium bovis
TGDTNTGVANSGDVNTG

SEQ ID NO: 166036 - protein, 6 aa, Mycobacterium bovis
TGGVGQ

SEQ ID NO: 166037 - protein, 7 aa, Mycobacterium bovis
THDETSR

SEQ ID NO: 166038 - protein, 6 aa, Mycobacterium bovis
THENTR

SEQ ID NO: 166039 - protein, 14 aa, Mycobacterium bovis
TINGTGSAPASQMN

SEQ ID NO: 166040 - protein, 4 aa, Mycobacterium bovis
TNHL

SEQ ID NO: 166041 - protein, 4 aa, Mycobacterium bovis
TPAQ

SEQ ID NO: 166042 - protein, 11 aa, Mycobacterium bovis
TPGEASRRIAE

SEQ ID NO: 166043 - protein, 4 aa, Mycobacterium bovis
TPRT

SEQ ID NO: 166044 - protein, 8 aa, Mycobacterium bovis
TPTTGRTH

SEQ ID NO: 166045 - protein, 9 aa, Mycobacterium bovis
TRAENRAAA

SEQ ID NO: 166046 - protein, 4 aa, Mycobacterium bovis
TSPL

SEQ ID NO: 166047 - protein, 11 aa, Mycobacterium bovis
TTDKASGIVND

SEQ ID NO: 166048 - protein, 4 aa, Mycobacterium bovis
TTIG

SEQ ID NO: 166049 - protein, 6 aa, Mycobacterium bovis
TVLPPG

SEQ ID NO: 166050 - protein, 5 aa, Mycobacterium bovis
VDSPE

SEQ ID NO: 166051 - protein, 5 aa, Mycobacterium bovis
VEGEA

SEQ ID NO: 166052 - protein, 4 aa, Mycobacterium bovis
VGAT

SEQ ID NO: 166053 - protein, 14 aa, Mycobacterium bovis
VGDTNTGGFNPGSI

SEQ ID NO: 166054 - protein, 17 aa, Mycobacterium bovis
VGRQLGEKTVKATTAGH

SEQ ID NO: 166055 - protein, 11 aa, Mycobacterium bovis
VGSSGQANYAA

SEQ ID NO: 166056 - protein, 20 aa, Mycobacterium bovis
VNQDGASNGLTAPNGPSQQR

SEQ ID NO: 166057 - protein, 4 aa, Mycobacterium bovis
VQSL

SEQ ID NO: 166058 - protein, 5 aa, Mycobacterium bovis
VRPRS

SEQ ID NO: 166059 - protein, 4 aa, Mycobacterium bovis
VSGT

SEQ ID NO: 166060 - protein, 14 aa, Mycobacterium bovis
VSINSGGEKVYPEE

SEQ ID NO: 166061 - protein, 5 aa, Mycobacterium bovis
VTDGD

SEQ ID NO: 166062 - protein, 9 aa, Mycobacterium bovis
YAGPGSGPM

SEQ ID NO: 166063 - protein, 4 aa, Mycobacterium bovis
YDPR

SEQ ID NO: 166064 - protein, 8 aa, Mycobacterium bovis
YEEPPSVV

SEQ ID NO: 166065 - protein, 4 aa, Mycobacterium bovis
YGPQ

SEQ ID NO: 166066 - protein, 11 aa, Mycobacterium bovis
YGQDRGEPGEP

SEQ ID NO: 166067 - protein, 5 aa, Mycobacterium bovis
YPTLD

SEQ ID NO: 166068 - protein, 5 aa, Mycobacterium bovis
YRGEF

SEQ ID NO: 166069 - protein, 5 aa, Mycobacterium bovis
AAAPY

SEQ ID NO: 166070 - protein, 8 aa, Mycobacterium bovis
AAAQSADI

SEQ ID NO: 166071 - protein, 6 aa, Mycobacterium bovis
AAGGLD

SEQ ID NO: 166072 - protein, 5 aa, Mycobacterium bovis
AAPAG

SEQ ID NO: 166073 - protein, 7 aa, Mycobacterium bovis
AAPAYAE

SEQ ID NO: 166074 - protein, 9 aa, Mycobacterium bovis
AASVTRTGA

SEQ ID NO: 166075 - protein, 4 aa, Mycobacterium bovis
AATV

SEQ ID NO: 166076 - protein, 4 aa, Mycobacterium bovis
AAVG

SEQ ID NO: 166077 - protein, 4 aa, Mycobacterium bovis
ADAG

SEQ ID NO: 166078 - protein, 10 aa, Mycobacterium bovis
ADGPDAVDRE

SEQ ID NO: 166079 - protein, 7 aa, Mycobacterium bovis
ADYGSGP

SEQ ID NO: 166080 - protein, 9 aa, Mycobacterium bovis
AEAGHPPTR

SEQ ID NO: 166081 - protein, 4 aa, Mycobacterium bovis
AEVE

SEQ ID NO: 166082 - protein, 5 aa, Mycobacterium bovis
AGAGA

SEQ ID NO: 166083 - protein, 5 aa, Mycobacterium bovis
AGGLR

SEQ ID NO: 166084 - protein, 7 aa, Mycobacterium bovis
AGQRNAI

SEQ ID NO: 166085 - protein, 11 aa, Mycobacterium bovis
AGRSRPGARVQ

SEQ ID NO: 166086 - protein, 6 aa, Mycobacterium bovis
AIPQTG

SEQ ID NO: 166087 - protein, 8 aa, Mycobacterium bovis
ALETTRPL

SEQ ID NO: 166088 - protein, 6 aa, Mycobacterium bovis
APERFG

SEQ ID NO: 166089 - protein, 35 aa, Mycobacterium bovis
APGACNPDDQTPLVDDTPDADAVRRDTRSQAQRNH

SEQ ID NO: 166090 - protein, 8 aa, Mycobacterium bovis
APHSPMAG

SEQ ID NO: 166091 - protein, 5 aa, Mycobacterium bovis
APPGY

SEQ ID NO: 166092 - protein, 5 aa, Mycobacterium bovis
ARAAG

SEQ ID NO: 166093 - protein, 12 aa, Mycobacterium bovis
ATAADGSTSEHE

SEQ ID NO: 166094 - protein, 13 aa, Mycobacterium bovis
DADAVRRRKEYQA

SEQ ID NO: 166095 - protein, 6 aa, Mycobacterium bovis
DADGGF

SEQ ID NO: 166096 - protein, 5 aa, Mycobacterium bovis
DAGDE

SEQ ID NO: 166097 - protein, 8 aa, Mycobacterium bovis
DAGKTKRA

SEQ ID NO: 166098 - protein, 5 aa, Mycobacterium bovis
DAGLN

SEQ ID NO: 166099 - protein, 4 aa, Mycobacterium bovis
DATA

SEQ ID NO: 166100 - protein, 8 aa, Mycobacterium bovis
DDDGAVVD

SEQ ID NO: 166101 - protein, 8 aa, Mycobacterium bovis
DDVGGTWR

SEQ ID NO: 166102 - protein, 7 aa, Mycobacterium bovis
DEQTHQP

SEQ ID NO: 166103 - protein, 7 aa, Mycobacterium bovis
DGAARRT

SEQ ID NO: 166104 - protein, 5 aa, Mycobacterium bovis
DGGQA

SEQ ID NO: 166105 - protein, 7 aa, Mycobacterium bovis
DLPATDV

SEQ ID NO: 166106 - protein, 4 aa, Mycobacterium bovis
DSEH

SEQ ID NO: 166107 - protein, 7 aa, Mycobacterium bovis
DSRGQAY

SEQ ID NO: 166108 - protein, 5 aa, Mycobacterium bovis
DSTGY

SEQ ID NO: 166109 - protein, 7 aa, Mycobacterium bovis
DSTPGLA

SEQ ID NO: 166110 - protein, 5 aa, Mycobacterium bovis
DTAAA

SEQ ID NO: 166111 - protein, 5 aa, Mycobacterium bovis
DTEND

SEQ ID NO: 166112 - protein, 10 aa, Mycobacterium bovis
DTRQSGGGED

SEQ ID NO: 166113 - protein, 10 aa, Mycobacterium bovis
DYSEDSAVDK

SEQ ID NO: 166114 - protein, 8 aa, Mycobacterium bovis
EIAGAPSD

SEQ ID NO: 166115 - protein, 10 aa, Mycobacterium bovis
EKACAADGQP

SEQ ID NO: 166116 - protein, 8 aa, Mycobacterium bovis
EKPTAESV

SEQ ID NO: 166117 - protein, 12 aa, Mycobacterium bovis
ELAEEPEGAEEV

SEQ ID NO: 166118 - protein, 5 aa, Mycobacterium bovis
ERAEN

SEQ ID NO: 166119 - protein, 4 aa, Mycobacterium bovis
ERRA

SEQ ID NO: 166120 - protein, 11 aa, Mycobacterium bovis
ERTGAPYASTM

SEQ ID NO: 166121 - protein, 6 aa, Mycobacterium bovis
ERVRPE

SEQ ID NO: 166122 - protein, 7 aa, Mycobacterium bovis
GAASATR

SEQ ID NO: 166123 - protein, 4 aa, Mycobacterium bovis
GAPL

SEQ ID NO: 166124 - protein, 7 aa, Mycobacterium bovis
GASPRIL

SEQ ID NO: 166125 - protein, 18 aa, Mycobacterium bovis
GAVPQASGRGLGHTGGTL

SEQ ID NO: 166126 - protein, 6 aa, Mycobacterium bovis
GDGVGG

SEQ ID NO: 166127 - protein, 7 aa, Mycobacterium bovis
GGGPPDV

SEQ ID NO: 166128 - protein, 5 aa, Mycobacterium bovis
GGLPS

SEQ ID NO: 166129 - protein, 5 aa, Mycobacterium bovis
GKTQA

SEQ ID NO: 166130 - protein, 4 aa, Mycobacterium bovis
GPAT

SEQ ID NO: 166131 - protein, 8 aa, Mycobacterium bovis
GPTDIAGA

SEQ ID NO: 166132 - protein, 13 aa, Mycobacterium bovis
GRDPAQTLRDGTA

SEQ ID NO: 166133 - protein, 6 aa, Mycobacterium bovis
GRTVEG

SEQ ID NO: 166134 - protein, 4 aa, Mycobacterium bovis
GSTS

SEQ ID NO: 166135 - protein, 12 aa, Mycobacterium bovis
HDPRSREQRRAD

SEQ ID NO: 166136 - protein, 4 aa, Mycobacterium bovis
HGVP

SEQ ID NO: 166137 - protein, 11 aa, Mycobacterium bovis
HQPSSEHTQPA

SEQ ID NO: 166138 - protein, 6 aa, Mycobacterium bovis
HSGAGP

SEQ ID NO: 166139 - protein, 6 aa, Mycobacterium bovis
IDPRNS

SEQ ID NO: 166140 - protein, 9 aa, Mycobacterium bovis
IEAPPATMQ

SEQ ID NO: 166141 - protein, 11 aa, Mycobacterium bovis
IPAPEADPPYD

SEQ ID NO: 166142 - protein, 4 aa, Mycobacterium bovis
IRTD

SEQ ID NO: 166143 - protein, 6 aa, Mycobacterium bovis
ITGEPL

SEQ ID NO: 166144 - protein, 5 aa, Mycobacterium bovis
KAAPN

SEQ ID NO: 166145 - protein, 9 aa, Mycobacterium bovis
KHSTGGVGD

SEQ ID NO: 166146 - protein, 11 aa, Mycobacterium bovis
KRRARERGQSL

SEQ ID NO: 166147 - protein, 6 aa, Mycobacterium bovis
LAEGAG

SEQ ID NO: 166148 - protein, 6 aa, Mycobacterium bovis
LAPADA

SEQ ID NO: 166149 - protein, 5 aa, Mycobacterium bovis
LGPDA

SEQ ID NO: 166150 - protein, 7 aa, Mycobacterium bovis
LGSPTTV

SEQ ID NO: 166151 - protein, 7 aa, Mycobacterium bovis
LGSTDMG

SEQ ID NO: 166152 - protein, 8 aa, Mycobacterium bovis
LNPAEDNQ

SEQ ID NO: 166153 - protein, 9 aa, Mycobacterium bovis
LPGPHYETP

SEQ ID NO: 166154 - protein, 17 aa, Mycobacterium bovis
NGANGAPGTGANGGDGG

SEQ ID NO: 166155 - protein, 16 aa, Mycobacterium bovis
NGANGTPGTGADGGAG

SEQ ID NO: 166156 - protein, 14 aa, Mycobacterium bovis
NSPAPTLMISVDEY

SEQ ID NO: 166157 - protein, 5 aa, Mycobacterium bovis
NTAGQ

SEQ ID NO: 166158 - protein, 10 aa, Mycobacterium bovis
PADEKNLDRW

SEQ ID NO: 166159 - protein, 5 aa, Mycobacterium bovis
PAGYE

SEQ ID NO: 166160 - protein, 4 aa, Mycobacterium bovis
PDRS

SEQ ID NO: 166161 - protein, 17 aa, Mycobacterium bovis
PERAPAARSLDAAKHQQ

SEQ ID NO: 166162 - protein, 8 aa, Mycobacterium bovis
PPTAAGHA

SEQ ID NO: 166163 - protein, 4 aa, Mycobacterium bovis
PPVP

SEQ ID NO: 166164 - protein, 5 aa, Mycobacterium bovis
PQHQP

SEQ ID NO: 166165 - protein, 4 aa, Mycobacterium bovis
PRKA

SEQ ID NO: 166166 - protein, 9 aa, Mycobacterium bovis
PSAQPDGER

SEQ ID NO: 166167 - protein, 28 aa, Mycobacterium bovis
QGGDLSKPLPIGSHSETVTAGASGTMGD

SEQ ID NO: 166168 - protein, 8 aa, Mycobacterium bovis
QGSRGAAY

SEQ ID NO: 166169 - protein, 7 aa, Mycobacterium bovis
QSHSGSL

SEQ ID NO: 166170 - protein, 7 aa, Mycobacterium bovis
QTPDERD

SEQ ID NO: 166171 - protein, 5 aa, Mycobacterium bovis
RAAGA

SEQ ID NO: 166172 - protein, 4 aa, Mycobacterium bovis
RARG

SEQ ID NO: 166173 - protein, 6 aa, Mycobacterium bovis
RDAPCE

SEQ ID NO: 166174 - protein, 15 aa, Mycobacterium bovis
RDSPPQVRPLIVDRI

SEQ ID NO: 166175 - protein, 8 aa, Mycobacterium bovis
RGKESHAA

SEQ ID NO: 166176 - protein, 5 aa, Mycobacterium bovis
RPGEP

SEQ ID NO: 166177 - protein, 9 aa, Mycobacterium bovis
RPGYGRSTF

SEQ ID NO: 166178 - protein, 10 aa, Mycobacterium bovis
RQGPITSAAD

SEQ ID NO: 166179 - protein, 8 aa, Mycobacterium bovis
RQSDPQLA

SEQ ID NO: 166180 - protein, 9 aa, Mycobacterium bovis
RRRTRAQDR

SEQ ID NO: 166181 - protein, 7 aa, Mycobacterium bovis
RRTKNNP

SEQ ID NO: 166182 - protein, 9 aa, Mycobacterium bovis
RSDTREEIS

SEQ ID NO: 166183 - protein, 7 aa, Mycobacterium bovis
RSGNRQL

SEQ ID NO: 166184 - protein, 5 aa, Mycobacterium bovis
RSGPR

SEQ ID NO: 166185 - protein, 8 aa, Mycobacterium bovis
RTAATDGS

SEQ ID NO: 166186 - protein, 4 aa, Mycobacterium bovis
RTRP

SEQ ID NO: 166187 - protein, 9 aa, Mycobacterium bovis
SAGASADRA

SEQ ID NO: 166188 - protein, 4 aa, Mycobacterium bovis
SDGG

SEQ ID NO: 166189 - protein, 4 aa, Mycobacterium bovis
SGTN

SEQ ID NO: 166190 - protein, 5 aa, Mycobacterium bovis
SNQRV

SEQ ID NO: 166191 - protein, 7 aa, Mycobacterium bovis
SNVQTGA

SEQ ID NO: 166192 - protein, 10 aa, Mycobacterium bovis
SPGGHTSRPH

SEQ ID NO: 166193 - protein, 5 aa, Mycobacterium bovis
SQPRR

SEQ ID NO: 166194 - protein, 4 aa, Mycobacterium bovis
SRED

SEQ ID NO: 166195 - protein, 8 aa, Mycobacterium bovis
SSDTTTDP

SEQ ID NO: 166196 - protein, 7 aa, Mycobacterium bovis
SSGNAHT

SEQ ID NO: 166197 - protein, 5 aa, Mycobacterium bovis
STGGG

SEQ ID NO: 166198 - protein, 10 aa, Mycobacterium bovis
SVGKPTAPYA

SEQ ID NO: 166199 - protein, 6 aa, Mycobacterium bovis
TAATAT

SEQ ID NO: 166200 - protein, 9 aa, Mycobacterium bovis
TDGRVADEQ

SEQ ID NO: 166201 - protein, 5 aa, Mycobacterium bovis
TGGSM

SEQ ID NO: 166202 - protein, 5 aa, Mycobacterium bovis
TGIGE

SEQ ID NO: 166203 - protein, 9 aa, Mycobacterium bovis
TGKAGNKRW

SEQ ID NO: 166204 - protein, 9 aa, Mycobacterium bovis
TKRDGGRLS

SEQ ID NO: 166205 - protein, 4 aa, Mycobacterium bovis
TPAE

SEQ ID NO: 166206 - protein, 10 aa, Mycobacterium bovis
TPAEESGGGK

SEQ ID NO: 166207 - protein, 11 aa, Mycobacterium bovis
TPEVDAELSEK

SEQ ID NO: 166208 - protein, 4 aa, Mycobacterium bovis
TPHE

SEQ ID NO: 166209 - protein, 7 aa, Mycobacterium bovis
TPSSRLE

SEQ ID NO: 166210 - protein, 12 aa, Mycobacterium bovis
TRPARNIGPGTI

SEQ ID NO: 166211 - protein, 7 aa, Mycobacterium bovis
TSHPETA

SEQ ID NO: 166212 - protein, 9 aa, Mycobacterium bovis
TVGSRLTKP

SEQ ID NO: 166213 - protein, 8 aa, Mycobacterium bovis
TVRTASRQ

SEQ ID NO: 166214 - protein, 4 aa, Mycobacterium bovis
VAPP

SEQ ID NO: 166215 - protein, 24 aa, Mycobacterium bovis
VEATQDTQEAAESDDEEADAPGDS

SEQ ID NO: 166216 - protein, 6 aa, Mycobacterium bovis
VEDPDS

SEQ ID NO: 166217 - protein, 4 aa, Mycobacterium bovis
VGPS

SEQ ID NO: 166218 - protein, 7 aa, Mycobacterium bovis
VLPGGTG

SEQ ID NO: 166219 - protein, 4 aa, Mycobacterium bovis
VNAT

SEQ ID NO: 166220 - protein, 4 aa, Mycobacterium bovis
VPAA

SEQ ID NO: 166221 - protein, 7 aa, Mycobacterium bovis
VPNTSGL

SEQ ID NO: 166222 - protein, 5 aa, Mycobacterium bovis
VPPPV

SEQ ID NO: 166223 - protein, 4 aa, Mycobacterium bovis
VTGA

SEQ ID NO: 166224 - protein, 5 aa, Mycobacterium bovis
VTRTP

SEQ ID NO: 166225 - protein, 5 aa, Mycobacterium bovis
WGPLA

SEQ ID NO: 166226 - protein, 12 aa, Mycobacterium bovis
WKTRKNAHGDTE

SEQ ID NO: 166227 - protein, 9 aa, Mycobacterium bovis
YAGPGSASL

SEQ ID NO: 166228 - protein, 4 aa, Mycobacterium bovis
YPGQ

SEQ ID NO: 166229 - protein, 4 aa, Mycobacterium bovis
YSPR

SEQ ID NO: 166230 - protein, 13 aa, Mycobacterium bovis
AADGGCDADDAPA

SEQ ID NO: 166231 - protein, 5 aa, Mycobacterium bovis
AADPA

SEQ ID NO: 166232 - protein, 10 aa, Mycobacterium bovis
AADVGAPAAV

SEQ ID NO: 166233 - protein, 8 aa, Mycobacterium bovis
AAEHPDKV

SEQ ID NO: 166234 - protein, 6 aa, Mycobacterium bovis
AAGTVS

SEQ ID NO: 166235 - protein, 8 aa, Mycobacterium bovis
AALRSGTA

SEQ ID NO: 166236 - protein, 10 aa, Mycobacterium bovis
AARAGAPEVS

SEQ ID NO: 166237 - protein, 11 aa, Mycobacterium bovis
AARAGGAAVQA

SEQ ID NO: 166238 - protein, 16 aa, Mycobacterium bovis
AATGEADSTDALIGAQ

SEQ ID NO: 166239 - protein, 5 aa, Mycobacterium bovis
AATRG

SEQ ID NO: 166240 - protein, 5 aa, Mycobacterium bovis
ADAPL

SEQ ID NO: 166241 - protein, 10 aa, Mycobacterium bovis
ADHDDSHGGM

SEQ ID NO: 166242 - protein, 4 aa, Mycobacterium bovis
ADIG

SEQ ID NO: 166243 - protein, 8 aa, Mycobacterium bovis
ADPANPYG

SEQ ID NO: 166244 - protein, 12 aa, Mycobacterium bovis
ADPAWGPAARPA

SEQ ID NO: 166245 - protein, 6 aa, Mycobacterium bovis
ADPIAA

SEQ ID NO: 166246 - protein, 7 aa, Mycobacterium bovis
ADRAVGE

SEQ ID NO: 166247 - protein, 4 aa, Mycobacterium bovis
ADRR

SEQ ID NO: 166248 - protein, 6 aa, Mycobacterium bovis
ADSAPM

SEQ ID NO: 166249 - protein, 6 aa, Mycobacterium bovis
ADTPDK

SEQ ID NO: 166250 - protein, 4 aa, Mycobacterium bovis
ADVA

SEQ ID NO: 166251 - protein, 25 aa, Mycobacterium bovis
AEAPGGGVREDTATDADEADDQEER

SEQ ID NO: 166252 - protein, 20 aa, Mycobacterium bovis
AEAPKSASERAAESTAPHKV

SEQ ID NO: 166253 - protein, 9 aa, Mycobacterium bovis
AEGSAGGEQ

SEQ ID NO: 166254 - protein, 6 aa, Mycobacterium bovis
AERGAQ

SEQ ID NO: 166255 - protein, 14 aa, Mycobacterium bovis
AESDPDDELEETTT

SEQ ID NO: 166256 - protein, 6 aa, Mycobacterium bovis
AESPIP

SEQ ID NO: 166257 - protein, 4 aa, Mycobacterium bovis
AGDG

SEQ ID NO: 166258 - protein, 6 aa, Mycobacterium bovis
AGEGAG

SEQ ID NO: 166259 - protein, 4 aa, Mycobacterium bovis
AGGA

SEQ ID NO: 166260 - protein, 17 aa, Mycobacterium bovis
AGIQPSVGAVGSSYDNA

SEQ ID NO: 166261 - protein, 5 aa, Mycobacterium bovis
AGKPA

SEQ ID NO: 166262 - protein, 7 aa, Mycobacterium bovis
AGNSGID

SEQ ID NO: 166263 - protein, 9 aa, Mycobacterium bovis
AGPEAQEEL

SEQ ID NO: 166264 - protein, 8 aa, Mycobacterium bovis
AGPGTNGS

SEQ ID NO: 166265 - protein, 6 aa, Mycobacterium bovis
AGRDDT

SEQ ID NO: 166266 - protein, 29 aa, Mycobacterium bovis
AGSAPRAADPKLDAANAAALASSAKNRHE

SEQ ID NO: 166267 - protein, 7 aa, Mycobacterium bovis
AGSQTGV

SEQ ID NO: 166268 - protein, 6 aa, Mycobacterium bovis
AKAGRQ

SEQ ID NO: 166269 - protein, 4 aa, Mycobacterium bovis
AKDR

SEQ ID NO: 166270 - protein, 8 aa, Mycobacterium bovis
AKGERTWR

SEQ ID NO: 166271 - protein, 5 aa, Mycobacterium bovis
AKGKA

SEQ ID NO: 166272 - protein, 4 aa, Mycobacterium bovis
ALRP

SEQ ID NO: 166273 - protein, 4 aa, Mycobacterium bovis
ANER

SEQ ID NO: 166274 - protein, 5 aa, Mycobacterium bovis
ANLPG

SEQ ID NO: 166275 - protein, 26 aa, Mycobacterium bovis
ANPAPGDNAARKTGRGGARQSPQSRV

SEQ ID NO: 166276 - protein, 6 aa, Mycobacterium bovis
ANVRTR

SEQ ID NO: 166277 - protein, 13 aa, Mycobacterium bovis
APDTNQQVAGGAP

SEQ ID NO: 166278 - protein, 4 aa, Mycobacterium bovis
APEV

SEQ ID NO: 166279 - protein, 6 aa, Mycobacterium bovis
APGQPA

SEQ ID NO: 166280 - protein, 5 aa, Mycobacterium bovis
APNGP

SEQ ID NO: 166281 - protein, 7 aa, Mycobacterium bovis
APNPDFP

SEQ ID NO: 166282 - protein, 7 aa, Mycobacterium bovis
APPAAKT

SEQ ID NO: 166283 - protein, 46 aa, Mycobacterium bovis
APPATDEADDTTVPPSENPATTSPDTTTDNDEIDDSAAARGDNQHS

SEQ ID NO: 166284 - protein, 6 aa, Mycobacterium bovis
APPGYV

SEQ ID NO: 166285 - protein, 7 aa, Mycobacterium bovis
APPSVAS

SEQ ID NO: 166286 - protein, 9 aa, Mycobacterium bovis
APQYPVPAQ

SEQ ID NO: 166287 - protein, 12 aa, Mycobacterium bovis
ARLNRSSVRSTR

SEQ ID NO: 166288 - protein, 6 aa, Mycobacterium bovis
ARNNDK

SEQ ID NO: 166289 - protein, 6 aa, Mycobacterium bovis
ARPTAL

SEQ ID NO: 166290 - protein, 6 aa, Mycobacterium bovis
ARQTLT

SEQ ID NO: 166291 - protein, 8 aa, Mycobacterium bovis
ARRRSGHL

SEQ ID NO: 166292 - protein, 13 aa, Mycobacterium bovis
ARSGKSVAADAAT

SEQ ID NO: 166293 - protein, 5 aa, Mycobacterium bovis
ARTSS

SEQ ID NO: 166294 - protein, 6 aa, Mycobacterium bovis
ASERAG

SEQ ID NO: 166295 - protein, 5 aa, Mycobacterium bovis
ASGIP

SEQ ID NO: 166296 - protein, 7 aa, Mycobacterium bovis
ASNTPLQ

SEQ ID NO: 166297 - protein, 6 aa, Mycobacterium bovis
ASPNAL

SEQ ID NO: 166298 - protein, 6 aa, Mycobacterium bovis
ASSPDI

SEQ ID NO: 166299 - protein, 10 aa, Mycobacterium bovis
ATAPPADQIA

SEQ ID NO: 166300 - protein, 6 aa, Mycobacterium bovis
ATATAT

SEQ ID NO: 166301 - protein, 5 aa, Mycobacterium bovis
ATDAE

SEQ ID NO: 166302 - protein, 12 aa, Mycobacterium bovis
ATLRGRDTRSIS

SEQ ID NO: 166303 - protein, 4 aa, Mycobacterium bovis
AVAG

SEQ ID NO: 166304 - protein, 12 aa, Mycobacterium bovis
AVPDERSHAEPP

SEQ ID NO: 166305 - protein, 5 aa, Mycobacterium bovis
CGPDE

SEQ ID NO: 166306 - protein, 4 aa, Mycobacterium bovis
CGPE

SEQ ID NO: 166307 - protein, 11 aa, Mycobacterium bovis
CRGDRAPEGLR

SEQ ID NO: 166308 - protein, 9 aa, Mycobacterium bovis
CRSTDPRKS

SEQ ID NO: 166309 - protein, 6 aa, Mycobacterium bovis
DAAAAD

SEQ ID NO: 166310 - protein, 7 aa, Mycobacterium bovis
DAADVSN

SEQ ID NO: 166311 - protein, 8 aa, Mycobacterium bovis
DAEAEDRH

SEQ ID NO: 166312 - protein, 5 aa, Mycobacterium bovis
DAGRC

SEQ ID NO: 166313 - protein, 14 aa, Mycobacterium bovis
DAPPPAPSAPTTAQ

SEQ ID NO: 166314 - protein, 7 aa, Mycobacterium bovis
DARERGT

SEQ ID NO: 166315 - protein, 9 aa, Mycobacterium bovis
DARHGSPAF

SEQ ID NO: 166316 - protein, 10 aa, Mycobacterium bovis
DDAGRPAELG

SEQ ID NO: 166317 - protein, 8 aa, Mycobacterium bovis
DDPEANHA

SEQ ID NO: 166318 - protein, 7 aa, Mycobacterium bovis
DEAKNRQ

SEQ ID NO: 166319 - protein, 13 aa, Mycobacterium bovis
DEAMARSRKPEVY

SEQ ID NO: 166320 - protein, 9 aa, Mycobacterium bovis
DEKPTASDN

SEQ ID NO: 166321 - protein, 5 aa, Mycobacterium bovis
DEVST

SEQ ID NO: 166322 - protein, 7 aa, Mycobacterium bovis
DGAEKFT

SEQ ID NO: 166323 - protein, 8 aa, Mycobacterium bovis
DGDVSDED

SEQ ID NO: 166324 - protein, 6 aa, Mycobacterium bovis
DGSDDL

SEQ ID NO: 166325 - protein, 4 aa, Mycobacterium bovis
DGTL

SEQ ID NO: 166326 - protein, 6 aa, Mycobacterium bovis
DHGPQP

SEQ ID NO: 166327 - protein, 5 aa, Mycobacterium bovis
DHPGY

SEQ ID NO: 166328 - protein, 5 aa, Mycobacterium bovis
DLPAA

SEQ ID NO: 166329 - protein, 13 aa, Mycobacterium bovis
DLPEASRTARGQH

SEQ ID NO: 166330 - protein, 12 aa, Mycobacterium bovis
DNRPTAFDGLLS

SEQ ID NO: 166331 - protein, 4 aa, Mycobacterium bovis
DPAP

SEQ ID NO: 166332 - protein, 6 aa, Mycobacterium bovis
DPAPTP

SEQ ID NO: 166333 - protein, 4 aa, Mycobacterium bovis
DPFT

SEQ ID NO: 166334 - protein, 7 aa, Mycobacterium bovis
DPGSRGA

SEQ ID NO: 166335 - protein, 7 aa, Mycobacterium bovis
DPPPRTG

SEQ ID NO: 166336 - protein, 11 aa, Mycobacterium bovis
DPQGNASTALG

SEQ ID NO: 166337 - protein, 6 aa, Mycobacterium bovis
DPQTAA

SEQ ID NO: 166338 - protein, 9 aa, Mycobacterium bovis
DPSTDAERL

SEQ ID NO: 166339 - protein, 10 aa, Mycobacterium bovis
DQPAKGFASH

SEQ ID NO: 166340 - protein, 11 aa, Mycobacterium bovis
DRDNTLDPEVE

SEQ ID NO: 166341 - protein, 15 aa, Mycobacterium bovis
DRDSQTGDGPDDAGY

SEQ ID NO: 166342 - protein, 15 aa, Mycobacterium bovis
DRGFARGEQAHEGVS

SEQ ID NO: 166343 - protein, 4 aa, Mycobacterium bovis
DRPI

SEQ ID NO: 166344 - protein, 12 aa, Mycobacterium bovis
DTGTLTARPGAQ

SEQ ID NO: 166345 - protein, 6 aa, Mycobacterium bovis
DTLSGS

SEQ ID NO: 166346 - protein, 9 aa, Mycobacterium bovis
DTNPPLAAS

SEQ ID NO: 166347 - protein, 10 aa, Mycobacterium bovis
DTNTGAETTL

SEQ ID NO: 166348 - protein, 7 aa, Mycobacterium bovis
DTPLAER

SEQ ID NO: 166349 - protein, 4 aa, Mycobacterium bovis
DTTD

SEQ ID NO: 166350 - protein, 12 aa, Mycobacterium bovis
DVEESRGERDAR

SEQ ID NO: 166351 - protein, 4 aa, Mycobacterium bovis
DYDD

SEQ ID NO: 166352 - protein, 10 aa, Mycobacterium bovis
EAERDKGGKV

SEQ ID NO: 166353 - protein, 11 aa, Mycobacterium bovis
EAETAKPSPFA

SEQ ID NO: 166354 - protein, 6 aa, Mycobacterium bovis
EAPARA

SEQ ID NO: 166355 - protein, 8 aa, Mycobacterium bovis
EATRECPR

SEQ ID NO: 166356 - protein, 4 aa, Mycobacterium bovis
EAWR

SEQ ID NO: 166357 - protein, 8 aa, Mycobacterium bovis
ECTPETRE

SEQ ID NO: 166358 - protein, 5 aa, Mycobacterium bovis
EDEVS

SEQ ID NO: 166359 - protein, 7 aa, Mycobacterium bovis
EDGTVTP

SEQ ID NO: 166360 - protein, 6 aa, Mycobacterium bovis
EDPPRR

SEQ ID NO: 166361 - protein, 8 aa, Mycobacterium bovis
EEDLTTGR

SEQ ID NO: 166362 - protein, 8 aa, Mycobacterium bovis
EEDSRGRT

SEQ ID NO: 166363 - protein, 4 aa, Mycobacterium bovis
EGIQ

SEQ ID NO: 166364 - protein, 7 aa, Mycobacterium bovis
EGLASGQ

SEQ ID NO: 166365 - protein, 6 aa, Mycobacterium bovis
EHGATE

SEQ ID NO: 166366 - protein, 14 aa, Mycobacterium bovis
ELAERDRPPSAKGR

SEQ ID NO: 166367 - protein, 9 aa, Mycobacterium bovis
ELEEAGGQA

SEQ ID NO: 166368 - protein, 14 aa, Mycobacterium bovis
ELRGPGKTRALAQS

SEQ ID NO: 166369 - protein, 5 aa, Mycobacterium bovis
ENYPG

SEQ ID NO: 166370 - protein, 4 aa, Mycobacterium bovis
EPDV

SEQ ID NO: 166371 - protein, 9 aa, Mycobacterium bovis
EPENSASAR

SEQ ID NO: 166372 - protein, 8 aa, Mycobacterium bovis
EPLQRPGR

SEQ ID NO: 166373 - protein, 16 aa, Mycobacterium bovis
EPQFEGQTKTKLGNTE

SEQ ID NO: 166374 - protein, 5 aa, Mycobacterium bovis
EPRSG

SEQ ID NO: 166375 - protein, 7 aa, Mycobacterium bovis
EQEPMDG

SEQ ID NO: 166376 - protein, 4 aa, Mycobacterium bovis
EQLS

SEQ ID NO: 166377 - protein, 5 aa, Mycobacterium bovis
ERAGV

SEQ ID NO: 166378 - protein, 8 aa, Mycobacterium bovis
ERAHDEVR

SEQ ID NO: 166379 - protein, 10 aa, Mycobacterium bovis
ERGQADDDLP

SEQ ID NO: 166380 - protein, 14 aa, Mycobacterium bovis
ERPRNTDSATAGVT

SEQ ID NO: 166381 - protein, 8 aa, Mycobacterium bovis
ERPSRVGE

SEQ ID NO: 166382 - protein, 7 aa, Mycobacterium bovis
ERVTQDE

SEQ ID NO: 166383 - protein, 4 aa, Mycobacterium bovis
ETEI

SEQ ID NO: 166384 - protein, 6 aa, Mycobacterium bovis
ETGDDN

SEQ ID NO: 166385 - protein, 7 aa, Mycobacterium bovis
ETRAQGR

SEQ ID NO: 166386 - protein, 9 aa, Mycobacterium bovis
FEGSRDDRP

SEQ ID NO: 166387 - protein, 7 aa, Mycobacterium bovis
FGPPAPN

SEQ ID NO: 166388 - protein, 4 aa, Mycobacterium bovis
FNAG

SEQ ID NO: 166389 - protein, 7 aa, Mycobacterium bovis
FPTAPVS

SEQ ID NO: 166390 - protein, 16 aa, Mycobacterium bovis
FPTSTASAGEATGRTS

SEQ ID NO: 166391 - protein, 17 aa, Mycobacterium bovis
FRPDRSHAKSARSVAET

SEQ ID NO: 166392 - protein, 6 aa, Mycobacterium bovis
GDGKGM

SEQ ID NO: 166393 - protein, 4 aa, Mycobacterium bovis
GDGN

SEQ ID NO: 166394 - protein, 6 aa, Mycobacterium bovis
GDGTVS

SEQ ID NO: 166395 - protein, 9 aa, Mycobacterium bovis
GDPSAPDTL

SEQ ID NO: 166396 - protein, 13 aa, Mycobacterium bovis
GDPTGTGRGGPGY

SEQ ID NO: 166397 - protein, 7 aa, Mycobacterium bovis
GDQIDKG

SEQ ID NO: 166398 - protein, 14 aa, Mycobacterium bovis
GDSAGGSAKSGRDS

SEQ ID NO: 166399 - protein, 6 aa, Mycobacterium bovis
GDTTVT

SEQ ID NO: 166400 - protein, 6 aa, Mycobacterium bovis
GELPQT

SEQ ID NO: 166401 - protein, 8 aa, Mycobacterium bovis
GENPSAAE

SEQ ID NO: 166402 - protein, 6 aa, Mycobacterium bovis
GESFGA

SEQ ID NO: 166403 - protein, 12 aa, Mycobacterium bovis
GGAGDAGQAGQQ

SEQ ID NO: 166404 - protein, 21 aa, Mycobacterium bovis
GGAGTRKRAAPAHGGHRPPRL

SEQ ID NO: 166405 - protein, 9 aa, Mycobacterium bovis
GGASAAAAL

SEQ ID NO: 166406 - protein, 7 aa, Mycobacterium bovis
GGDSAME

SEQ ID NO: 166407 - protein, 8 aa, Mycobacterium bovis
GGGGGNFG

SEQ ID NO: 166408 - protein, 6 aa, Mycobacterium bovis
GGQPQH

SEQ ID NO: 166409 - protein, 4 aa, Mycobacterium bovis
GHGY

SEQ ID NO: 166410 - protein, 7 aa, Mycobacterium bovis
GKFDSDA

SEQ ID NO: 166411 - protein, 16 aa, Mycobacterium bovis
GKQIARGSARMASGGT

SEQ ID NO: 166412 - protein, 5 aa, Mycobacterium bovis
GKRKG

SEQ ID NO: 166413 - protein, 7 aa, Mycobacterium bovis
GKYPSTE

SEQ ID NO: 166414 - protein, 5 aa, Mycobacterium bovis
GLTEA

SEQ ID NO: 166415 - protein, 5 aa, Mycobacterium bovis
GMNPP

SEQ ID NO: 166416 - protein, 4 aa, Mycobacterium bovis
GNGN

SEQ ID NO: 166417 - protein, 6 aa, Mycobacterium bovis
GNPAEL

SEQ ID NO: 166418 - protein, 6 aa, Mycobacterium bovis
GPDFPT

SEQ ID NO: 166419 - protein, 9 aa, Mycobacterium bovis
GPPGTGKTT

SEQ ID NO: 166420 - protein, 8 aa, Mycobacterium bovis
GPQAQPFG

SEQ ID NO: 166421 - protein, 5 aa, Mycobacterium bovis
GQGCR

SEQ ID NO: 166422 - protein, 5 aa, Mycobacterium bovis
GQHDS

SEQ ID NO: 166423 - protein, 4 aa, Mycobacterium bovis
GQPV

SEQ ID NO: 166424 - protein, 4 aa, Mycobacterium bovis
GQSI

SEQ ID NO: 166425 - protein, 7 aa, Mycobacterium bovis
GQSPTTI

SEQ ID NO: 166426 - protein, 11 aa, Mycobacterium bovis
GRADREAAKTR

SEQ ID NO: 166427 - protein, 5 aa, Mycobacterium bovis
GRASA

SEQ ID NO: 166428 - protein, 5 aa, Mycobacterium bovis
GRGDG

SEQ ID NO: 166429 - protein, 5 aa, Mycobacterium bovis
GRGGE

SEQ ID NO: 166430 - protein, 10 aa, Mycobacterium bovis
GRGRHTSTRS

SEQ ID NO: 166431 - protein, 6 aa, Mycobacterium bovis
GRPDRR

SEQ ID NO: 166432 - protein, 10 aa, Mycobacterium bovis
GRPGTTPVRP

SEQ ID NO: 166433 - protein, 6 aa, Mycobacterium bovis
GRVQEP

SEQ ID NO: 166434 - protein, 4 aa, Mycobacterium bovis
GSAV

SEQ ID NO: 166435 - protein, 8 aa, Mycobacterium bovis
GSGAGLPG

SEQ ID NO: 166436 - protein, 9 aa, Mycobacterium bovis
GSISKEQRA

SEQ ID NO: 166437 - protein, 5 aa, Mycobacterium bovis
GSSKH

SEQ ID NO: 166438 - protein, 4 aa, Mycobacterium bovis
GSVR

SEQ ID NO: 166439 - protein, 7 aa, Mycobacterium bovis
GTAGQRC

SEQ ID NO: 166440 - protein, 9 aa, Mycobacterium bovis
GTGPGVGKD

SEQ ID NO: 166441 - protein, 6 aa, Mycobacterium bovis
GTVKSR

SEQ ID NO: 166442 - protein, 6 aa, Mycobacterium bovis
GVGKST

SEQ ID NO: 166443 - protein, 4 aa, Mycobacterium bovis
GVGS

SEQ ID NO: 166444 - protein, 19 aa, Mycobacterium bovis
GVHSESEGVEPERRVVVLR

SEQ ID NO: 166445 - protein, 20 aa, Mycobacterium bovis
GVTGSAGLQPGPSEETDEEL

SEQ ID NO: 166446 - protein, 11 aa, Mycobacterium bovis
GYEDKAPYAFT

SEQ ID NO: 166447 - protein, 8 aa, Mycobacterium bovis
GYPASTPV

SEQ ID NO: 166448 - protein, 5 aa, Mycobacterium bovis
HAPKT

SEQ ID NO: 166449 - protein, 8 aa, Mycobacterium bovis
HDADEEET

SEQ ID NO: 166450 - protein, 22 aa, Mycobacterium bovis
HEANRQAHHSDATTPAPPRRKP

SEQ ID NO: 166451 - protein, 7 aa, Mycobacterium bovis
HGDDRRT

SEQ ID NO: 166452 - protein, 7 aa, Mycobacterium bovis
HGSVSTI

SEQ ID NO: 166453 - protein, 4 aa, Mycobacterium bovis
HPEA

SEQ ID NO: 166454 - protein, 6 aa, Mycobacterium bovis
HPHGDA

SEQ ID NO: 166455 - protein, 6 aa, Mycobacterium bovis
HRLSDE

SEQ ID NO: 166456 - protein, 6 aa, Mycobacterium bovis
HTPFTT

SEQ ID NO: 166457 - protein, 6 aa, Mycobacterium bovis
IGEPKG

SEQ ID NO: 166458 - protein, 28 aa, Mycobacterium bovis
IGTSGAEIGGAFGGEKQTGGGRESGSDA

SEQ ID NO: 166459 - protein, 11 aa, Mycobacterium bovis
ISGNGKRSTTR

SEQ ID NO: 166460 - protein, 4 aa, Mycobacterium bovis
ITGP

SEQ ID NO: 166461 - protein, 14 aa, Mycobacterium bovis
KAGKKINKEDGIQR

SEQ ID NO: 166462 - protein, 8 aa, Mycobacterium bovis
KAHPTAPL

SEQ ID NO: 166463 - protein, 14 aa, Mycobacterium bovis
KDKDPNLTGDDIRE

SEQ ID NO: 166464 - protein, 10 aa, Mycobacterium bovis
KGQGRSVTDA

SEQ ID NO: 166465 - protein, 5 aa, Mycobacterium bovis
KPAPV

SEQ ID NO: 166466 - protein, 7 aa, Mycobacterium bovis
KPERQRG

SEQ ID NO: 166467 - protein, 4 aa, Mycobacterium bovis
KPID

SEQ ID NO: 166468 - protein, 12 aa, Mycobacterium bovis
KQGAPTKKTGST

SEQ ID NO: 166469 - protein, 6 aa, Mycobacterium bovis
KRPYDE

SEQ ID NO: 166470 - protein, 11 aa, Mycobacterium bovis
KSATDIGGLPG

SEQ ID NO: 166471 - protein, 5 aa, Mycobacterium bovis
KSDSL

SEQ ID NO: 166472 - protein, 7 aa, Mycobacterium bovis
KSEPLGL

SEQ ID NO: 166473 - protein, 10 aa, Mycobacterium bovis
KTAPAGAGGT

SEQ ID NO: 166474 - protein, 12 aa, Mycobacterium bovis
KTVNPSENRASD

SEQ ID NO: 166475 - protein, 22 aa, Mycobacterium bovis
KVRSGRSSRPRTKTRPEHADAE

SEQ ID NO: 166476 - protein, 6 aa, Mycobacterium bovis
LADPEF

SEQ ID NO: 166477 - protein, 13 aa, Mycobacterium bovis
LAEAAKAGIGGSD

SEQ ID NO: 166478 - protein, 7 aa, Mycobacterium bovis
LAPAEPF

SEQ ID NO: 166479 - protein, 6 aa, Mycobacterium bovis
LAQPTK

SEQ ID NO: 166480 - protein, 11 aa, Mycobacterium bovis
LASGTSSRSSK

SEQ ID NO: 166481 - protein, 12 aa, Mycobacterium bovis
LDPSQPDDAPAR

SEQ ID NO: 166482 - protein, 6 aa, Mycobacterium bovis
LGGTRD

SEQ ID NO: 166483 - protein, 6 aa, Mycobacterium bovis
LGPAQR

SEQ ID NO: 166484 - protein, 7 aa, Mycobacterium bovis
LGSPAEG

SEQ ID NO: 166485 - protein, 6 aa, Mycobacterium bovis
LHTNRG

SEQ ID NO: 166486 - protein, 5 aa, Mycobacterium bovis
LKRGQ

SEQ ID NO: 166487 - protein, 7 aa, Mycobacterium bovis
LNGPNGV

SEQ ID NO: 166488 - protein, 6 aa, Mycobacterium bovis
LPDTEI

SEQ ID NO: 166489 - protein, 7 aa, Mycobacterium bovis
LPEPDST

SEQ ID NO: 166490 - protein, 6 aa, Mycobacterium bovis
LPPPAD

SEQ ID NO: 166491 - protein, 13 aa, Mycobacterium bovis
LSAGADDVGRAEE

SEQ ID NO: 166492 - protein, 21 aa, Mycobacterium bovis
LSGPAARRAAAARRLLAVLSQ

SEQ ID NO: 166493 - protein, 7 aa, Mycobacterium bovis
LSGRPDT

SEQ ID NO: 166494 - protein, 24 aa, Mycobacterium bovis
LSGTTRGKARRTTIADPATARPAD

SEQ ID NO: 166495 - protein, 9 aa, Mycobacterium bovis
LSPGATYRS

SEQ ID NO: 166496 - protein, 8 aa, Mycobacterium bovis
LSSRRRAQ

SEQ ID NO: 166497 - protein, 9 aa, Mycobacterium bovis
LTPRGRERY

SEQ ID NO: 166498 - protein, 11 aa, Mycobacterium bovis
LTSSPAASGSA

SEQ ID NO: 166499 - protein, 8 aa, Mycobacterium bovis
MGPPADPE

SEQ ID NO: 166500 - protein, 6 aa, Mycobacterium bovis
MGPPIA

SEQ ID NO: 166501 - protein, 9 aa, Mycobacterium bovis
MGRATSGVQ

SEQ ID NO: 166502 - protein, 20 aa, Mycobacterium bovis
NAEESGDDNAVDANGADQTG

SEQ ID NO: 166503 - protein, 12 aa, Mycobacterium bovis
NAEHSSTGLRSA

SEQ ID NO: 166504 - protein, 5 aa, Mycobacterium bovis
NAPAI

SEQ ID NO: 166505 - protein, 7 aa, Mycobacterium bovis
NDRPTGT

SEQ ID NO: 166506 - protein, 6 aa, Mycobacterium bovis
NGSGGI

SEQ ID NO: 166507 - protein, 10 aa, Mycobacterium bovis
NIEDQSSDRV

SEQ ID NO: 166508 - protein, 6 aa, Mycobacterium bovis
NKTPID

SEQ ID NO: 166509 - protein, 12 aa, Mycobacterium bovis
NPSEITDTRMVH

SEQ ID NO: 166510 - protein, 6 aa, Mycobacterium bovis
NPTDSK

SEQ ID NO: 166511 - protein, 6 aa, Mycobacterium bovis
NQQEQA

SEQ ID NO: 166512 - protein, 5 aa, Mycobacterium bovis
NRDPI

SEQ ID NO: 166513 - protein, 7 aa, Mycobacterium bovis
NSGPALA

SEQ ID NO: 166514 - protein, 12 aa, Mycobacterium bovis
NTHEGGTHEEGF

SEQ ID NO: 166515 - protein, 8 aa, Mycobacterium bovis
PAAAEGSV

SEQ ID NO: 166516 - protein, 8 aa, Mycobacterium bovis
PAADPVSL

SEQ ID NO: 166517 - protein, 8 aa, Mycobacterium bovis
PAQPQLNR

SEQ ID NO: 166518 - protein, 4 aa, Mycobacterium bovis
PASG

SEQ ID NO: 166519 - protein, 7 aa, Mycobacterium bovis
PATEYTG

SEQ ID NO: 166520 - protein, 4 aa, Mycobacterium bovis
PDAD

SEQ ID NO: 166521 - protein, 6 aa, Mycobacterium bovis
PDGGAQ

SEQ ID NO: 166522 - protein, 9 aa, Mycobacterium bovis
PDWPTGPLP

SEQ ID NO: 166523 - protein, 18 aa, Mycobacterium bovis
PDYGPPGGPLGDPSRRTS

SEQ ID NO: 166524 - protein, 5 aa, Mycobacterium bovis
PEPTH

SEQ ID NO: 166525 - protein, 9 aa, Mycobacterium bovis
PESRSASIG

SEQ ID NO: 166526 - protein, 9 aa, Mycobacterium bovis
PGARYRGDR

SEQ ID NO: 166527 - protein, 15 aa, Mycobacterium bovis
PGFAGADPVTGRRRG

SEQ ID NO: 166528 - protein, 8 aa, Mycobacterium bovis
PGGRASAA

SEQ ID NO: 166529 - protein, 5 aa, Mycobacterium bovis
PGGSA

SEQ ID NO: 166530 - protein, 7 aa, Mycobacterium bovis
PGRGGVD

SEQ ID NO: 166531 - protein, 8 aa, Mycobacterium bovis
PGTYDPDQ

SEQ ID NO: 166532 - protein, 35 aa, Mycobacterium bovis
PIPEGLTTGRSCQTDVDGANDDWNPASKRGERESF

SEQ ID NO: 166533 - protein, 5 aa, Mycobacterium bovis
PLPTT

SEQ ID NO: 166534 - protein, 7 aa, Mycobacterium bovis
PNGYGKT

SEQ ID NO: 166535 - protein, 10 aa, Mycobacterium bovis
PNPEEPGATD

SEQ ID NO: 166536 - protein, 5 aa, Mycobacterium bovis
PPEIN

SEQ ID NO: 166537 - protein, 8 aa, Mycobacterium bovis
PPSAVPRA

SEQ ID NO: 166538 - protein, 5 aa, Mycobacterium bovis
PPYAG

SEQ ID NO: 166539 - protein, 8 aa, Mycobacterium bovis
PSTDAEMA

SEQ ID NO: 166540 - protein, 14 aa, Mycobacterium bovis
PTPAVGGVPTKAAT

SEQ ID NO: 166541 - protein, 8 aa, Mycobacterium bovis
PTTPEQAD

SEQ ID NO: 166542 - protein, 8 aa, Mycobacterium bovis
PVAASGGR

SEQ ID NO: 166543 - protein, 9 aa, Mycobacterium bovis
PVQGRGGKG

SEQ ID NO: 166544 - protein, 8 aa, Mycobacterium bovis
QAEPVSTA

SEQ ID NO: 166545 - protein, 7 aa, Mycobacterium bovis
QAGSTYA

SEQ ID NO: 166546 - protein, 11 aa, Mycobacterium bovis
QARNADPTVAG

SEQ ID NO: 166547 - protein, 7 aa, Mycobacterium bovis
QDPDKLP

SEQ ID NO: 166548 - protein, 13 aa, Mycobacterium bovis
QEPIAAGSTAGNT

SEQ ID NO: 166549 - protein, 15 aa, Mycobacterium bovis
QGNFGSPGNDPPAAM

SEQ ID NO: 166550 - protein, 9 aa, Mycobacterium bovis
QGPAGPISE

SEQ ID NO: 166551 - protein, 10 aa, Mycobacterium bovis
QGPPRTDGPD

SEQ ID NO: 166552 - protein, 20 aa, Mycobacterium bovis
QGTKDYSTQNASGGPSGPFY

SEQ ID NO: 166553 - protein, 5 aa, Mycobacterium bovis
QGWPA

SEQ ID NO: 166554 - protein, 23 aa, Mycobacterium bovis
QHSAGACSDTLATGGTVGLQEIR

SEQ ID NO: 166555 - protein, 4 aa, Mycobacterium bovis
QITN

SEQ ID NO: 166556 - protein, 11 aa, Mycobacterium bovis
QKGGVGKTTTA

SEQ ID NO: 166557 - protein, 10 aa, Mycobacterium bovis
QLGGSDAAVS

SEQ ID NO: 166558 - protein, 6 aa, Mycobacterium bovis
QNPEAA

SEQ ID NO: 166559 - protein, 5 aa, Mycobacterium bovis
QNTPA

SEQ ID NO: 166560 - protein, 6 aa, Mycobacterium bovis
QPPELE

SEQ ID NO: 166561 - protein, 11 aa, Mycobacterium bovis
QRTATAVVPTD

SEQ ID NO: 166562 - protein, 12 aa, Mycobacterium bovis
QTDDRASPPETR

SEQ ID NO: 166563 - protein, 6 aa, Mycobacterium bovis
QTFGAP

SEQ ID NO: 166564 - protein, 5 aa, Mycobacterium bovis
QTRDA

SEQ ID NO: 166565 - protein, 4 aa, Mycobacterium bovis
QVGE

SEQ ID NO: 166566 - protein, 5 aa, Mycobacterium bovis
QVRDG

SEQ ID NO: 166567 - protein, 7 aa, Mycobacterium bovis
RAARDGA

SEQ ID NO: 166568 - protein, 4 aa, Mycobacterium bovis
RADE

SEQ ID NO: 166569 - protein, 5 aa, Mycobacterium bovis
RARGG

SEQ ID NO: 166570 - protein, 22 aa, Mycobacterium bovis
RARTDGGEVIGGDRREVGSPGA

SEQ ID NO: 166571 - protein, 6 aa, Mycobacterium bovis
RATEET

SEQ ID NO: 166572 - protein, 5 aa, Mycobacterium bovis
RDGAE

SEQ ID NO: 166573 - protein, 13 aa, Mycobacterium bovis
RDNADDAPETRSE

SEQ ID NO: 166574 - protein, 7 aa, Mycobacterium bovis
RDNAELR

SEQ ID NO: 166575 - protein, 6 aa, Mycobacterium bovis
RDPDAV

SEQ ID NO: 166576 - protein, 4 aa, Mycobacterium bovis
RENP

SEQ ID NO: 166577 - protein, 12 aa, Mycobacterium bovis
REPSRRELRDGE

SEQ ID NO: 166578 - protein, 5 aa, Mycobacterium bovis
REPVE

SEQ ID NO: 166579 - protein, 7 aa, Mycobacterium bovis
RETEDSA

SEQ ID NO: 166580 - protein, 6 aa, Mycobacterium bovis
RGAGSF

SEQ ID NO: 166581 - protein, 8 aa, Mycobacterium bovis
RGDHPNHR

SEQ ID NO: 166582 - protein, 9 aa, Mycobacterium bovis
RGDPADRRR

SEQ ID NO: 166583 - protein, 8 aa, Mycobacterium bovis
RGGDPSAP

SEQ ID NO: 166584 - protein, 6 aa, Mycobacterium bovis
RGGPDA

SEQ ID NO: 166585 - protein, 6 aa, Mycobacterium bovis
RGLAGS

SEQ ID NO: 166586 - protein, 20 aa, Mycobacterium bovis
RGRRRSKRMAKSVTEPDDLA

SEQ ID NO: 166587 - protein, 12 aa, Mycobacterium bovis
RHIAGRGPRDTY

SEQ ID NO: 166588 - protein, 7 aa, Mycobacterium bovis
RHPGRRS

SEQ ID NO: 166589 - protein, 5 aa, Mycobacterium bovis
RINPE

SEQ ID NO: 166590 - protein, 14 aa, Mycobacterium bovis
RKKQRQPAEYPTEQ

SEQ ID NO: 166591 - protein, 4 aa, Mycobacterium bovis
RNGV

SEQ ID NO: 166592 - protein, 8 aa, Mycobacterium bovis
RNPADAED

SEQ ID NO: 166593 - protein, 6 aa, Mycobacterium bovis
RPDGRV

SEQ ID NO: 166594 - protein, 8 aa, Mycobacterium bovis
RPNTGPTV

SEQ ID NO: 166595 - protein, 8 aa, Mycobacterium bovis
RPSGTEPK

SEQ ID NO: 166596 - protein, 9 aa, Mycobacterium bovis
RPVGGAVET

SEQ ID NO: 166597 - protein, 6 aa, Mycobacterium bovis
RQEYAT

SEQ ID NO: 166598 - protein, 8 aa, Mycobacterium bovis
RQGLPAPQ

SEQ ID NO: 166599 - protein, 6 aa, Mycobacterium bovis
RRDAEL

SEQ ID NO: 166600 - protein, 10 aa, Mycobacterium bovis
RRTSNAEGRE

SEQ ID NO: 166601 - protein, 8 aa, Mycobacterium bovis
RSAGTDNA

SEQ ID NO: 166602 - protein, 15 aa, Mycobacterium bovis
RSARPNSSPGAAHAA

SEQ ID NO: 166603 - protein, 15 aa, Mycobacterium bovis
RSDPEFAYSDRERDG

SEQ ID NO: 166604 - protein, 9 aa, Mycobacterium bovis
RSGDTPPAL

SEQ ID NO: 166605 - protein, 5 aa, Mycobacterium bovis
RSGGS

SEQ ID NO: 166606 - protein, 5 aa, Mycobacterium bovis
RSPHS

SEQ ID NO: 166607 - protein, 9 aa, Mycobacterium bovis
RSSGPKLSG

SEQ ID NO: 166608 - protein, 5 aa, Mycobacterium bovis
RTAQV

SEQ ID NO: 166609 - protein, 4 aa, Mycobacterium bovis
RTGE

SEQ ID NO: 166610 - protein, 17 aa, Mycobacterium bovis
RTPAATDLQNPGAVTPD

SEQ ID NO: 166611 - protein, 8 aa, Mycobacterium bovis
RTTSTSLP

SEQ ID NO: 166612 - protein, 4 aa, Mycobacterium bovis
SAAD

SEQ ID NO: 166613 - protein, 8 aa, Mycobacterium bovis
SADADPPL

SEQ ID NO: 166614 - protein, 10 aa, Mycobacterium bovis
SAGNDDTGAA

SEQ ID NO: 166615 - protein, 7 aa, Mycobacterium bovis
SAKARNV

SEQ ID NO: 166616 - protein, 5 aa, Mycobacterium bovis
SASEL

SEQ ID NO: 166617 - protein, 4 aa, Mycobacterium bovis
SDGR

SEQ ID NO: 166618 - protein, 4 aa, Mycobacterium bovis
SDRA

SEQ ID NO: 166619 - protein, 8 aa, Mycobacterium bovis
SDRPPKQL

SEQ ID NO: 166620 - protein, 6 aa, Mycobacterium bovis
SEAPGY

SEQ ID NO: 166621 - protein, 20 aa, Mycobacterium bovis
SEDERRALKRRNARTKARTG

SEQ ID NO: 166622 - protein, 5 aa, Mycobacterium bovis
SGGGV

SEQ ID NO: 166623 - protein, 22 aa, Mycobacterium bovis
SGGVPGREGAVGQQNSCQHDGH

SEQ ID NO: 166624 - protein, 8 aa, Mycobacterium bovis
SGGYAKRT

SEQ ID NO: 166625 - protein, 8 aa, Mycobacterium bovis
SGKGTGHE

SEQ ID NO: 166626 - protein, 4 aa, Mycobacterium bovis
SGKT

SEQ ID NO: 166627 - protein, 4 aa, Mycobacterium bovis
SGPM

SEQ ID NO: 166628 - protein, 9 aa, Mycobacterium bovis
SHNPATDNG

SEQ ID NO: 166629 - protein, 22 aa, Mycobacterium bovis
SKTATDGNDRPTDPVVIESITI

SEQ ID NO: 166630 - protein, 13 aa, Mycobacterium bovis
SPGPGTPERAGAS

SEQ ID NO: 166631 - protein, 15 aa, Mycobacterium bovis
SPTGAGPHANPNAAG

SEQ ID NO: 166632 - protein, 4 aa, Mycobacterium bovis
SQAK

SEQ ID NO: 166633 - protein, 15 aa, Mycobacterium bovis
SQGTADAYKTGRGSI

SEQ ID NO: 166634 - protein, 4 aa, Mycobacterium bovis
SQPP

SEQ ID NO: 166635 - protein, 17 aa, Mycobacterium bovis
SRETSTEFDTPIGAAAE

SEQ ID NO: 166636 - protein, 6 aa, Mycobacterium bovis
SRPGDV

SEQ ID NO: 166637 - protein, 20 aa, Mycobacterium bovis
SRPTNRSPSDAERAATANAV

SEQ ID NO: 166638 - protein, 9 aa, Mycobacterium bovis
SRSSPRAGD

SEQ ID NO: 166639 - protein, 8 aa, Mycobacterium bovis
SSAGASDR

SEQ ID NO: 166640 - protein, 5 aa, Mycobacterium bovis
SSLRS

SEQ ID NO: 166641 - protein, 6 aa, Mycobacterium bovis
SSPWTY

SEQ ID NO: 166642 - protein, 7 aa, Mycobacterium bovis
SSRHVSS

SEQ ID NO: 166643 - protein, 6 aa, Mycobacterium bovis
STGERG

SEQ ID NO: 166644 - protein, 7 aa, Mycobacterium bovis
STPAPVR

SEQ ID NO: 166645 - protein, 7 aa, Mycobacterium bovis
TAAESAE

SEQ ID NO: 166646 - protein, 8 aa, Mycobacterium bovis
TAAGSGCA

SEQ ID NO: 166647 - protein, 5 aa, Mycobacterium bovis
TAARI

SEQ ID NO: 166648 - protein, 9 aa, Mycobacterium bovis
TADDTDPTE

SEQ ID NO: 166649 - protein, 8 aa, Mycobacterium bovis
TADGQTHR

SEQ ID NO: 166650 - protein, 8 aa, Mycobacterium bovis
TAEARGEV

SEQ ID NO: 166651 - protein, 9 aa, Mycobacterium bovis
TAEPHPKLP

SEQ ID NO: 166652 - protein, 13 aa, Mycobacterium bovis
TAPAVPNGQPVKG

SEQ ID NO: 166653 - protein, 10 aa, Mycobacterium bovis
TAVRDKDGIS

SEQ ID NO: 166654 - protein, 12 aa, Mycobacterium bovis
TDGRDKGLHRDA

SEQ ID NO: 166655 - protein, 22 aa, Mycobacterium bovis
TDPMGGPPAKRGAPLGEQDAEV

SEQ ID NO: 166656 - protein, 8 aa, Mycobacterium bovis
TDRGSQYT

SEQ ID NO: 166657 - protein, 5 aa, Mycobacterium bovis
TDRQI

SEQ ID NO: 166658 - protein, 11 aa, Mycobacterium bovis
TDRQSGTPSSY

SEQ ID NO: 166659 - protein, 4 aa, Mycobacterium bovis
TEEF

SEQ ID NO: 166660 - protein, 5 aa, Mycobacterium bovis
TEPDV

SEQ ID NO: 166661 - protein, 6 aa, Mycobacterium bovis
TERATD

SEQ ID NO: 166662 - protein, 9 aa, Mycobacterium bovis
TERGDAADH

SEQ ID NO: 166663 - protein, 6 aa, Mycobacterium bovis
TFPDAG

SEQ ID NO: 166664 - protein, 10 aa, Mycobacterium bovis
TGDPANGGSM

SEQ ID NO: 166665 - protein, 5 aa, Mycobacterium bovis
TGDTF

SEQ ID NO: 166666 - protein, 12 aa, Mycobacterium bovis
TGPAAPSWRKGP

SEQ ID NO: 166667 - protein, 7 aa, Mycobacterium bovis
TGQDSGV

SEQ ID NO: 166668 - protein, 10 aa, Mycobacterium bovis
TGQRHEPGTR

SEQ ID NO: 166669 - protein, 30 aa, Mycobacterium bovis; identical to SEQ ID NO: 57507

SEQ ID NO: 166670 - protein, 7 aa, Mycobacterium bovis
TKLADQV

SEQ ID NO: 166671 - protein, 5 aa, Mycobacterium bovis
TKRGA

SEQ ID NO: 166672 - protein, 9 aa, Mycobacterium bovis
TNKAPAPGM

SEQ ID NO: 166673 - protein, 4 aa, Mycobacterium bovis
TNSG

SEQ ID NO: 166674 - protein, 18 aa, Mycobacterium bovis
TNTVNYSSELPLAQGVKF

SEQ ID NO: 166675 - protein, 4 aa, Mycobacterium bovis
TPHL

SEQ ID NO: 166676 - protein, 4 aa, Mycobacterium bovis
TPRR

SEQ ID NO: 166677 - protein, 8 aa, Mycobacterium bovis
TQTSLAAN

SEQ ID NO: 166678 - protein, 4 aa, Mycobacterium bovis
TRAG

SEQ ID NO: 166679 - protein, 13 aa, Mycobacterium bovis
TRRPTVAGADRHP

SEQ ID NO: 166680 - protein, 9 aa, Mycobacterium bovis
TSGGAIPDR

SEQ ID NO: 166681 - protein, 12 aa, Mycobacterium bovis
TSRTSEDADDAL

SEQ ID NO: 166682 - protein, 8 aa, Mycobacterium bovis
TTGDTRAG

SEQ ID NO: 166683 - protein, 6 aa, Mycobacterium bovis
TVPPPV

SEQ ID NO: 166684 - protein, 12 aa, Mycobacterium bovis
TVSAGEDSPPGA

SEQ ID NO: 166685 - protein, 7 aa, Mycobacterium bovis
VAAEGVA

SEQ ID NO: 166686 - protein, 9 aa, Mycobacterium bovis
VAETGDREE

SEQ ID NO: 166687 - protein, 6 aa, Mycobacterium bovis
VAGEVA

SEQ ID NO: 166688 - protein, 7 aa, Mycobacterium bovis
VARDAEG

SEQ ID NO: 166689 - protein, 16 aa, Mycobacterium bovis
VDAGARPGTTTEESAE

SEQ ID NO: 166690 - protein, 5 aa, Mycobacterium bovis
VDGQH

SEQ ID NO: 166691 - protein, 4 aa, Mycobacterium bovis
VDPD

SEQ ID NO: 166692 - protein, 7 aa, Mycobacterium bovis
VDPEQPD

SEQ ID NO: 166693 - protein, 9 aa, Mycobacterium bovis
VDTNPETAR

SEQ ID NO: 166694 - protein, 11 aa, Mycobacterium bovis
VEVADDGRGIP

SEQ ID NO: 166695 - protein, 19 aa, Mycobacterium bovis
VGASGATAGLRKTHDGHHG

SEQ ID NO: 166696 - protein, 4 aa, Mycobacterium bovis
VGPR

SEQ ID NO: 166697 - protein, 4 aa, Mycobacterium bovis
VKRR

SEQ ID NO: 166698 - protein, 5 aa, Mycobacterium bovis
VNGPA

SEQ ID NO: 166699 - protein, 4 aa, Mycobacterium bovis
VPPN

SEQ ID NO: 166700 - protein, 5 aa, Mycobacterium bovis
VPQGL

SEQ ID NO: 166701 - protein, 10 aa, Mycobacterium bovis
VRKAGRQTKG

SEQ ID NO: 166702 - protein, 6 aa, Mycobacterium bovis
VRPPEE

SEQ ID NO: 166703 - protein, 8 aa, Mycobacterium bovis
VRSDPQAQ

SEQ ID NO: 166704 - protein, 20 aa, Mycobacterium bovis
VSGDDRPVAGLNGNGPFPAV

SEQ ID NO: 166705 - protein, 9 aa, Mycobacterium bovis
VSGGSPHAI

SEQ ID NO: 166706 - protein, 8 aa, Mycobacterium bovis
VSSAQARI

SEQ ID NO: 166707 - protein, 10 aa, Mycobacterium bovis
VSSEPLPTGD

SEQ ID NO: 166708 - protein, 13 aa, Mycobacterium bovis
VTGPSEQSDTDRQ

SEQ ID NO: 166709 - protein, 13 aa, Mycobacterium bovis
VTWSGAGSISGSD

SEQ ID NO: 166710 - protein, 4 aa, Mycobacterium bovis
WDLS

SEQ ID NO: 166711 - protein, 6 aa, Mycobacterium bovis
WDPQRA

SEQ ID NO: 166712 - protein, 16 aa, Mycobacterium bovis
WPASSADGTARPGRKA

SEQ ID NO: 166713 - protein, 4 aa, Mycobacterium bovis
YSES

SEQ ID NO: 166714 - protein, 29 aa, Mycobacterium bovis
AAAAADPGPGDAPTSASRISGHIRAALAA

SEQ ID NO: 166715 - protein, 8 aa, Mycobacterium bovis
AAAAAGDA

SEQ ID NO: 166716 - protein, 10 aa, Mycobacterium bovis
AAAAAGLSGA

SEQ ID NO: 166717 - protein, 10 aa, Mycobacterium bovis
AAAAAGVPTA

SEQ ID NO: 166718 - protein, 9 aa, Mycobacterium bovis
AAAAAPPPL

SEQ ID NO: 166719 - protein, 10 aa, Mycobacterium bovis
AAAAAPTTTG

SEQ ID NO: 166720 - protein, 90 aa, Mycobacterium bovis
AAAAAQQRSAVDGGARERAPSALRAKGVASESPALTYSGPAEDGSAQVQRNGGGAHKTPAGVPAGASRRERREAARRQGRGAKPPKSVKK

SEQ ID NO: 166721 - protein, 8 aa, Mycobacterium bovis
AAAAARRR

SEQ ID NO: 166722 - protein, 10 aa, Mycobacterium bovis
AAAADAGAKA

SEQ ID NO: 166723 - protein, 7 aa, Mycobacterium bovis
AAAADDV

SEQ ID NO: 166724 - protein, 8 aa, Mycobacterium bovis
AAAADGAA

SEQ ID NO: 166725 - protein, 7 aa, Mycobacterium bovis
AAAADKD

SEQ ID NO: 166726 - protein, 8 aa, Mycobacterium bovis
AAAADRSD

SEQ ID NO: 166727 - protein, 9 aa, Mycobacterium bovis
AAAAESAEL

SEQ ID NO: 166728 - protein, 5 aa, Mycobacterium bovis
AAAAG

SEQ ID NO: 166729 - protein, 6 aa, Mycobacterium bovis
AAAAGA

SEQ ID NO: 166730 - protein, 7 aa, Mycobacterium bovis
AAAAGRP

SEQ ID NO: 166731 - protein, 10 aa, Mycobacterium bovis
AAAAGSLQGI

SEQ ID NO: 166732 - protein, 8 aa, Mycobacterium bovis
AAAAKGKW

SEQ ID NO: 166733 - protein, 8 aa, Mycobacterium bovis
AAAAKPKQ

SEQ ID NO: 166734 - protein, 59 aa, Mycobacterium bovis
AAAAPAGADRPRRERPSGTRPRRSGASGTTATGTDAGRAAGGEEAAPDAAAPVEAQSTE

SEQ ID NO: 166735 - protein, 20 aa, Mycobacterium bovis
AAAAPQAPPKPADTAAAGNG

SEQ ID NO: 166736 - protein, 34 aa, Mycobacterium bovis
AAAAQADTQRQAAAGVARRGAQGSAMQQLRSTTG

SEQ ID NO: 166737 - protein, 5 aa, Mycobacterium bovis
AAAAR

SEQ ID NO: 166738 - protein, 11 aa, Mycobacterium bovis
AAAARRARAEL

SEQ ID NO: 166739 - protein, 8 aa, Mycobacterium bovis
AAAARRDY

SEQ ID NO: 166740 - protein, 16 aa, Mycobacterium bovis
AAAASGVEDQEELQGP

SEQ ID NO: 166741 - protein, 5 aa, Mycobacterium bovis
AAAAT

SEQ ID NO: 166742 - protein, 7 aa, Mycobacterium bovis
AAAATEK

SEQ ID NO: 166743 - protein, 10 aa, Mycobacterium bovis
AAAATTAPEP

SEQ ID NO: 166744 - protein, 16 aa, Mycobacterium bovis
AAADATKAAARLGPQQ

SEQ ID NO: 166745 - protein, 9 aa, Mycobacterium bovis
AAADATRRA

SEQ ID NO: 166746 - protein, 7 aa, Mycobacterium bovis
AAADEVS

SEQ ID NO: 166747 - protein, 14 aa, Mycobacterium bovis
AAADNSVDATAARD

SEQ ID NO: 166748 - protein, 8 aa, Mycobacterium bovis
AAADPRDN

SEQ ID NO: 166749 - protein, 5 aa, Mycobacterium bovis
AAAEA

SEQ ID NO: 166750 - protein, 23 aa, Mycobacterium bovis
AAAEAAARARQDSLTKPRGALGS

SEQ ID NO: 166751 - protein, 5 aa, Mycobacterium bovis
AAAED

SEQ ID NO: 166752 - protein, 7 aa, Mycobacterium bovis
AAAEGRL

SEQ ID NO: 166753 - protein, 7 aa, Mycobacterium bovis
AAAEPAA

SEQ ID NO: 166754 - protein, 8 aa, Mycobacterium bovis
AAAEPAKS

SEQ ID NO: 166755 - protein, 11 aa, Mycobacterium bovis
AAAEPEPSSAE

SEQ ID NO: 166756 - protein, 14 aa, Mycobacterium bovis
AAAEQGRAGADGLG

SEQ ID NO: 166757 - protein, 6 aa, Mycobacterium bovis
AAAERA

SEQ ID NO: 166758 - protein, 36 aa, Mycobacterium bovis
AAAESDSWSQAPEIEQRPAGPPADREEAADTPGLPK

SEQ ID NO: 166759 - protein, 14 aa, Mycobacterium bovis
AAAESRRLDHAPNA

SEQ ID NO: 166760 - protein, 10 aa, Mycobacterium bovis
AAAFGDDPAT

SEQ ID NO: 166761 - protein, 11 aa, Mycobacterium bovis
AAAGAGSEKVT

SEQ ID NO: 166762 - protein, 5 aa, Mycobacterium bovis
AAAGD

SEQ ID NO: 166763 - protein, 25 aa, Mycobacterium bovis
AAAGDLANVGSTISAANKAAAAATT

SEQ ID NO: 166764 - protein, 6 aa, Mycobacterium bovis
AAAGDR

SEQ ID NO: 166765 - protein, 10 aa, Mycobacterium bovis
AAAGEKVGQS

SEQ ID NO: 166766 - protein, 11 aa, Mycobacterium bovis
AAAGGRGGLGN

SEQ ID NO: 166767 - protein, 8 aa, Mycobacterium bovis
AAAGGSSC

SEQ ID NO: 166768 - protein, 9 aa, Mycobacterium bovis
AAAGGTTAL

SEQ ID NO: 166769 - protein, 7 aa, Mycobacterium bovis
AAAGLGG

SEQ ID NO: 166770 - protein, 19 aa, Mycobacterium bovis
AAAGPRRTASGSVAVPGAR

SEQ ID NO: 166771 - protein, 8 aa, Mycobacterium bovis
AAAGRADD

SEQ ID NO: 166772 - protein, 9 aa, Mycobacterium bovis
AAAGRDADG

SEQ ID NO: 166773 - protein, 18 aa, Mycobacterium bovis
AAAGRGSGNSRNGSRNKK

SEQ ID NO: 166774 - protein, 12 aa, Mycobacterium bovis
AAAGSAGKVATS

SEQ ID NO: 166775 - protein, 7 aa, Mycobacterium bovis
AAAGTPL

SEQ ID NO: 166776 - protein, 7 aa, Mycobacterium bovis
AAAGTST

SEQ ID NO: 166777 - protein, 8 aa, Mycobacterium bovis
AAAGVSGP

SEQ ID NO: 166778 - protein, 14 aa, Mycobacterium bovis
AAAHAGSQAMASAA

SEQ ID NO: 166779 - protein, 11 aa, Mycobacterium bovis
AAAKAAGKVRI

SEQ ID NO: 166780 - protein, 7 aa, Mycobacterium bovis
AAAKAEA

SEQ ID NO: 166781 - protein, 16 aa, Mycobacterium bovis
AAAKAKSLLDQEGRDD

SEQ ID NO: 166782 - protein, 7 aa, Mycobacterium bovis
AAAKANE

SEQ ID NO: 166783 - protein, 9 aa, Mycobacterium bovis
AAAKPADVD

SEQ ID NO: 166784 - protein, 14 aa, Mycobacterium bovis
AAAKPGSAMTPLPG

SEQ ID NO: 166785 - protein, 4 aa, Mycobacterium bovis
AAAL

SEQ ID NO: 166786 - protein, 10 aa, Mycobacterium bovis
AAALGESRTA

SEQ ID NO: 166787 - protein, 7 aa, Mycobacterium bovis
AAALSSA

SEQ ID NO: 166788 - protein, 13 aa, Mycobacterium bovis
AAANAQNNGGLDP

SEQ ID NO: 166789 - protein, 4 aa, Mycobacterium bovis
AAAP

SEQ ID NO: 166790 - protein, 6 aa, Mycobacterium bovis
AAAPAT

SEQ ID NO: 166791 - protein, 9 aa, Mycobacterium bovis
AAAPEHERE

SEQ ID NO: 166792 - protein, 13 aa, Mycobacterium bovis
AAAPEQTTDPGPG

SEQ ID NO: 166793 - protein, 7 aa, Mycobacterium bovis
AAAPGAS

SEQ ID NO: 166794 - protein, 7 aa, Mycobacterium bovis
AAAPGGL

SEQ ID NO: 166795 - protein, 6 aa, Mycobacterium bovis
AAAPGS

SEQ ID NO: 166796 - protein, 12 aa, Mycobacterium bovis
AAAPPEDRAEAW

SEQ ID NO: 166797 - protein, 11 aa, Mycobacterium bovis
AAAPQTTPAPQ

SEQ ID NO: 166798 - protein, 5 aa, Mycobacterium bovis
AAAPT

SEQ ID NO: 166799 - protein, 12 aa, Mycobacterium bovis
AAAPTANGPGGV

SEQ ID NO: 166800 - protein, 8 aa, Mycobacterium bovis
AAAPTPAA

SEQ ID NO: 166801 - protein, 8 aa, Mycobacterium bovis
AAAQGEGF

SEQ ID NO: 166802 - protein, 13 aa, Mycobacterium bovis
AAAQGPAAHTDEE

SEQ ID NO: 166803 - protein, 9 aa, Mycobacterium bovis
AAAQGRQAY

SEQ ID NO: 166804 - protein, 5 aa, Mycobacterium bovis
AAAQL

SEQ ID NO: 166805 - protein, 7 aa, Mycobacterium bovis
AAAQQEL

SEQ ID NO: 166806 - protein, 5 aa, Mycobacterium bovis
AAAQR

SEQ ID NO: 166807 - protein, 9 aa, Mycobacterium bovis
AAAQRAGHL

SEQ ID NO: 166808 - protein, 6 aa, Mycobacterium bovis
AAARAG

SEQ ID NO: 166809 - protein, 9 aa, Mycobacterium bovis
AAARGGERS

SEQ ID NO: 166810 - protein, 6 aa, Mycobacterium bovis
AAARGL

SEQ ID NO: 166811 - protein, 16 aa, Mycobacterium bovis
AAARGLTAAGAPAEAD

SEQ ID NO: 166812 - protein, 7 aa, Mycobacterium bovis
AAARGRT

SEQ ID NO: 166813 - protein, 6 aa, Mycobacterium bovis
AAARGT

SEQ ID NO: 166814 - protein, 14 aa, Mycobacterium bovis
AAARNQVDGEPEEL

SEQ ID NO: 166815 - protein, 7 aa, Mycobacterium bovis
AAARSGA

SEQ ID NO: 166816 - protein, 7 aa, Mycobacterium bovis
AAARSRG

SEQ ID NO: 166817 - protein, 7 aa, Mycobacterium bovis
AAARTGH

SEQ ID NO: 166818 - protein, 16 aa, Mycobacterium bovis
AAARTQARIDSGQQPV

SEQ ID NO: 166819 - protein, 13 aa, Mycobacterium bovis
AAASAESAAGQAR

SEQ ID NO: 166820 - protein, 27 aa, Mycobacterium bovis
AAASAQGASPEPNAAVPPGDAVIGGST

SEQ ID NO: 166821 - protein, 8 aa, Mycobacterium bovis
AAASGGGT

SEQ ID NO: 166822 - protein, 8 aa, Mycobacterium bovis
AAASGSDI

SEQ ID NO: 166823 - protein, 9 aa, Mycobacterium bovis
AAASGTPIA

SEQ ID NO: 166824 - protein, 14 aa, Mycobacterium bovis
AAASLQPLDPPDGF

SEQ ID NO: 166825 - protein, 7 aa, Mycobacterium bovis
AAASPGD

SEQ ID NO: 166826 - protein, 6 aa, Mycobacterium bovis
AAASQY

SEQ ID NO: 166827 - protein, 6 aa, Mycobacterium bovis
AAASSY

SEQ ID NO: 166828 - protein, 8 aa, Mycobacterium bovis
AAASTPGI

SEQ ID NO: 166829 - protein, 16 aa, Mycobacterium bovis
AAASYASVEAANASPL

SEQ ID NO: 166830 - protein, 5 aa, Mycobacterium bovis
AAATA

SEQ ID NO: 166831 - protein, 13 aa, Mycobacterium bovis
AAATADKARVVVR

SEQ ID NO: 166832 - protein, 5 aa, Mycobacterium bovis
AAATG

SEQ ID NO: 166833 - protein, 13 aa, Mycobacterium bovis
AAATGADNVSQEA

SEQ ID NO: 166834 - protein, 8 aa, Mycobacterium bovis
AAATGKRA

SEQ ID NO: 166835 - protein, 18 aa, Mycobacterium bovis
AAATGRPDRLPGVGSSSH

SEQ ID NO: 166836 - protein, 7 aa, Mycobacterium bovis
AAATNSL

SEQ ID NO: 166837 - protein, 5 aa, Mycobacterium bovis
AAATP

SEQ ID NO: 166838 - protein, 8 aa, Mycobacterium bovis
AAATRNPQ

SEQ ID NO: 166839 - protein, 14 aa, Mycobacterium bovis
AAATSGASTAAHAG

SEQ ID NO: 166840 - protein, 8 aa, Mycobacterium bovis
AAATSTDT

SEQ ID NO: 166841 - protein, 6 aa, Mycobacterium bovis
AAATTA

SEQ ID NO: 166842 - protein, 6 aa, Mycobacterium bovis
AAATTQ

SEQ ID NO: 166843 - protein, 13 aa, Mycobacterium bovis
AAATTRPPADPAA

SEQ ID NO: 166844 - protein, 15 aa, Mycobacterium bovis
AAATTTQRNPPEFAR

SEQ ID NO: 166845 - protein, 5 aa, Mycobacterium bovis
AAAVG

SEQ ID NO: 166846 - protein, 9 aa, Mycobacterium bovis
AAAYPNPAL

SEQ ID NO: 166847 - protein, 6 aa, Mycobacterium bovis
AACNRD

SEQ ID NO: 166848 - protein, 18 aa, Mycobacterium bovis
AADAAGDVLGEATSGGLG

SEQ ID NO: 166849 - protein, 8 aa, Mycobacterium bovis
AADAAGRG

SEQ ID NO: 166850 - protein, 11 aa, Mycobacterium bovis
AADAATALADA

SEQ ID NO: 166851 - protein, 9 aa, Mycobacterium bovis
AADADDAPA

SEQ ID NO: 166852 - protein, 7 aa, Mycobacterium bovis
AADDASD

SEQ ID NO: 166853 - protein, 12 aa, Mycobacterium bovis
AADDDGGTTSIT

SEQ ID NO: 166854 - protein, 12 aa, Mycobacterium bovis
AADDDSATGGPD

SEQ ID NO: 166855 - protein, 11 aa, Mycobacterium bovis
AADDESAASMA

SEQ ID NO: 166856 - protein, 9 aa, Mycobacterium bovis
AADDNGRVT

SEQ ID NO: 166857 - protein, 6 aa, Mycobacterium bovis
AADDSV

SEQ ID NO: 166858 - protein, 8 aa, Mycobacterium bovis
AADEAGVP

SEQ ID NO: 166859 - protein, 6 aa, Mycobacterium bovis
AADEGE

SEQ ID NO: 166860 - protein, 9 aa, Mycobacterium bovis
AADEKESEL

SEQ ID NO: 166861 - protein, 13 aa, Mycobacterium bovis
AADEQSATGSAGR

SEQ ID NO: 166862 - protein, 12 aa, Mycobacterium bovis
AADESGRFRSRE

SEQ ID NO: 166863 - protein, 4 aa, Mycobacterium bovis
AADG

SEQ ID NO: 166864 - protein, 7 aa, Mycobacterium bovis
AADGADT

SEQ ID NO: 166865 - protein, 8 aa, Mycobacterium bovis
AADGEGAY

SEQ ID NO: 166866 - protein, 50 aa, Mycobacterium bovis
AADGGPTTEATKPKKKSPAKKAAKAAEPAPQPEQPDTPALGGEQAELTAE

SEQ ID NO: 166867 - protein, 7 aa, Mycobacterium bovis
AADGSDR

SEQ ID NO: 166868 - protein, 10 aa, Mycobacterium bovis
AADGSVSATA

SEQ ID NO: 166869 - protein, 11 aa, Mycobacterium bovis
AADGTGFSEGG

SEQ ID NO: 166870 - protein, 10 aa, Mycobacterium bovis
AADGTGWGEG

SEQ ID NO: 166871 - protein, 11 aa, Mycobacterium bovis
AADKYAGKNRN

SEQ ID NO: 166872 - protein, 13 aa, Mycobacterium bovis
AADLAKSPDFSAA

SEQ ID NO: 166873 - protein, 9 aa, Mycobacterium bovis
AADLGQRRA

SEQ ID NO: 166874 - protein, 8 aa, Mycobacterium bovis
AADNGGSA

SEQ ID NO: 166875 - protein, 9 aa, Mycobacterium bovis
AADPADFPD

SEQ ID NO: 166876 - protein, 7 aa, Mycobacterium bovis
AADPDAP

SEQ ID NO: 166877 - protein, 9 aa, Mycobacterium bovis
AADPEPSTA

SEQ ID NO: 166878 - protein, 8 aa, Mycobacterium bovis
AADPGDAV

SEQ ID NO: 166879 - protein, 7 aa, Mycobacterium bovis
AADPGFR

SEQ ID NO: 166880 - protein, 5 aa, Mycobacterium bovis
AADPN

SEQ ID NO: 166881 - protein, 7 aa, Mycobacterium bovis
AADPNAR

SEQ ID NO: 166882 - protein, 16 aa, Mycobacterium bovis
AADPNRSLVGRLLRSD

SEQ ID NO: 166883 - protein, 5 aa, Mycobacterium bovis
AADPT

SEQ ID NO: 166884 - protein, 7 aa, Mycobacterium bovis
AADPTAQ

SEQ ID NO: 166885 - protein, 5 aa, Mycobacterium bovis
AADQA

SEQ ID NO: 166886 - protein, 6 aa, Mycobacterium bovis
AADQAR

SEQ ID NO: 166887 - protein, 6 aa, Mycobacterium bovis
AADQLR

SEQ ID NO: 166888 - protein, 14 aa, Mycobacterium bovis
AADQLRDQVGSDEF

SEQ ID NO: 166889 - protein, 8 aa, Mycobacterium bovis
AADRAADG

SEQ ID NO: 166890 - protein, 6 aa, Mycobacterium bovis
AADRDV

SEQ ID NO: 166891 - protein, 7 aa, Mycobacterium bovis
AADRPAH

SEQ ID NO: 166892 - protein, 6 aa, Mycobacterium bovis
AADRPV

SEQ ID NO: 166893 - protein, 15 aa, Mycobacterium bovis
AADRSSVASAAWTGE

SEQ ID NO: 166894 - protein, 6 aa, Mycobacterium bovis
AADSGI

SEQ ID NO: 166895 - protein, 10 aa, Mycobacterium bovis
AADSPPQTVD

SEQ ID NO: 166896 - protein, 22 aa, Mycobacterium bovis
AADSRVDSLSPPALAAGSDPAA

SEQ ID NO: 166897 - protein, 8 aa, Mycobacterium bovis
AADSTLEQ

SEQ ID NO: 166898 - protein, 6 aa, Mycobacterium bovis
AADTAV

SEQ ID NO: 166899 - protein, 5 aa, Mycobacterium bovis
AADTG

SEQ ID NO: 166900 - protein, 23 aa, Mycobacterium bovis
AADTGSATGTETGGAGQCAPSRS

SEQ ID NO: 166901 - protein, 8 aa, Mycobacterium bovis
AADTPEVA

SEQ ID NO: 166902 - protein, 7 aa, Mycobacterium bovis
AADTPTL

SEQ ID NO: 166903 - protein, 13 aa, Mycobacterium bovis
AADTRCDGRSRGQ

SEQ ID NO: 166904 - protein, 11 aa, Mycobacterium bovis
AADTRRDGDRF

SEQ ID NO: 166905 - protein, 13 aa, Mycobacterium bovis
AADTTFDDRTRGQ

SEQ ID NO: 166906 - protein, 10 aa, Mycobacterium bovis
AADVDAAAPA

SEQ ID NO: 166907 - protein, 10 aa, Mycobacterium bovis
AADVDDPDAA

SEQ ID NO: 166908 - protein, 4 aa, Mycobacterium bovis
AAEA

SEQ ID NO: 166909 - protein, 5 aa, Mycobacterium bovis
AAEAA

SEQ ID NO: 166910 - protein, 12 aa, Mycobacterium bovis
AAEAAAAGSGDF

SEQ ID NO: 166911 - protein, 7 aa, Mycobacterium bovis
AAEAAET

SEQ ID NO: 166912 - protein, 9 aa, Mycobacterium bovis
AAEAAGRNV

SEQ ID NO: 166913 - protein, 8 aa, Mycobacterium bovis
AAEAAGYS

SEQ ID NO: 166914 - protein, 12 aa, Mycobacterium bovis
AAEAANASPLQT

SEQ ID NO: 166915 - protein, 12 aa, Mycobacterium bovis
AAEAAPQSARSH

SEQ ID NO: 166916 - protein, 7 aa, Mycobacterium bovis
AAEADQL

SEQ ID NO: 166917 - protein, 8 aa, Mycobacterium bovis
AAEAERAQ

SEQ ID NO: 166918 - protein, 6 aa, Mycobacterium bovis
AAEAQR

SEQ ID NO: 166919 - protein, 16 aa, Mycobacterium bovis
AAEARGQQVDEAADAA

SEQ ID NO: 166920 - protein, 25 aa, Mycobacterium bovis
AAEARLRDGPRAAALPASGTSEGRQ

SEQ ID NO: 166921 - protein, 17 aa, Mycobacterium bovis
AAEATGRGLAALKRALH

SEQ ID NO: 166922 - protein, 8 aa, Mycobacterium bovis
AAEDAGAD

SEQ ID NO: 166923 - protein, 8 aa, Mycobacterium bovis
AAEDDEAR

SEQ ID NO: 166924 - protein, 5 aa, Mycobacterium bovis
AAEDL

SEQ ID NO: 166925 - protein, 5 aa, Mycobacterium bovis
AAEGA

SEQ ID NO: 166926 - protein, 7 aa, Mycobacterium bovis
AAEGETI

SEQ ID NO: 166927 - protein, 5 aa, Mycobacterium bovis
AAEGF

SEQ ID NO: 166928 - protein, 6 aa, Mycobacterium bovis
AAEGKR

SEQ ID NO: 166929 - protein, 5 aa, Mycobacterium bovis
AAEGT

SEQ ID NO: 166930 - protein, 6 aa, Mycobacterium bovis
AAEHPP

SEQ ID NO: 166931 - protein, 4 aa, Mycobacterium bovis
AAEL

SEQ ID NO: 166932 - protein, 5 aa, Mycobacterium bovis
AAELA

SEQ ID NO: 166933 - protein, 7 aa, Mycobacterium bovis
AAELGDT

SEQ ID NO: 166934 - protein, 11 aa, Mycobacterium bovis
AAELGGDPSRI

SEQ ID NO: 166935 - protein, 5 aa, Mycobacterium bovis
AAEMR

SEQ ID NO: 166936 - protein, 8 aa, Mycobacterium bovis
AAEPDGTG

SEQ ID NO: 166937 - protein, 5 aa, Mycobacterium bovis
AAEPG

SEQ ID NO: 166938 - protein, 12 aa, Mycobacterium bovis
AAEPGSKEYGVP

SEQ ID NO: 166939 - protein, 8 aa, Mycobacterium bovis
AAEPPPNV

SEQ ID NO: 166940 - protein, 7 aa, Mycobacterium bovis
AAEPSPL

SEQ ID NO: 166941 - protein, 6 aa, Mycobacterium bovis
AAEPVE

SEQ ID NO: 166942 - protein, 21 aa, Mycobacterium bovis
AAEQAEAADTTALPSAAELSN

SEQ ID NO: 166943 - protein, 10 aa, Mycobacterium bovis
AAEQAERGRT

SEQ ID NO: 166944 - protein, 32 aa, Mycobacterium bovis
AAEQKKRAKAPAPAAQAAAAPAPKAPPAPAPA

SEQ ID NO: 166945 - protein, 11 aa, Mycobacterium bovis
AAEQTRLPTDD

SEQ ID NO: 166946 - protein, 4 aa, Mycobacterium bovis
AAER

SEQ ID NO: 166947 - protein, 7 aa, Mycobacterium bovis
AAERDPE

SEQ ID NO: 166948 - protein, 8 aa, Mycobacterium bovis
AAERDSRA

SEQ ID NO: 166949 - protein, 8 aa, Mycobacterium bovis
AAERERAE

SEQ ID NO: 166950 - protein, 6 aa, Mycobacterium bovis
AAERGE

SEQ ID NO: 166951 - protein, 6 aa, Mycobacterium bovis
AAERGV

SEQ ID NO: 166952 - protein, 7 aa, Mycobacterium bovis
AAERPGH

SEQ ID NO: 166953 - protein, 8 aa, Mycobacterium bovis
AAERRTGL

SEQ ID NO: 166954 - protein, 6 aa, Mycobacterium bovis
AAERSE

SEQ ID NO: 166955 - protein, 9 aa, Mycobacterium bovis
AAERSPQAI

SEQ ID NO: 166956 - protein, 14 aa, Mycobacterium bovis
AAERSRKWNRNKTG

SEQ ID NO: 166957 - protein, 17 aa, Mycobacterium bovis
AAERSSGFNPRAGWAGN

SEQ ID NO: 166958 - protein, 9 aa, Mycobacterium bovis
AAESARDDG

SEQ ID NO: 166959 - protein, 7 aa, Mycobacterium bovis
AAESDRV

SEQ ID NO: 166960 - protein, 16 aa, Mycobacterium bovis
AAESSGPWNNAGTGHS

SEQ ID NO: 166961 - protein, 10 aa, Mycobacterium bovis
AAESSGVPES

SEQ ID NO: 166962 - protein, 5 aa, Mycobacterium bovis
AAETA

SEQ ID NO: 166963 - protein, 12 aa, Mycobacterium bovis
AAETATETGSDS

SEQ ID NO: 166964 - protein, 7 aa, Mycobacterium bovis
AAETPLT

SEQ ID NO: 166965 - protein, 5 aa, Mycobacterium bovis
AAEVQ

SEQ ID NO: 166966 - protein, 7 aa, Mycobacterium bovis
AAEYTDD

SEQ ID NO: 166967 - protein, 4 aa, Mycobacterium bovis
AAFE

SEQ ID NO: 166968 - protein, 6 aa, Mycobacterium bovis
AAFGSG

SEQ ID NO: 166969 - protein, 6 aa, Mycobacterium bovis
AAFGSV

SEQ ID NO: 166970 - protein, 15 aa, Mycobacterium bovis
AAFKPEPAMQDEDYQ

SEQ ID NO: 166971 - protein, 5 aa, Mycobacterium bovis
AAFPG

SEQ ID NO: 166972 - protein, 4 aa, Mycobacterium bovis
AAFT

SEQ ID NO: 166973 - protein, 12 aa, Mycobacterium bovis
AAGAAASSDITA

SEQ ID NO: 166974 - protein, 8 aa, Mycobacterium bovis
AAGAAGGG

SEQ ID NO: 166975 - protein, 9 aa, Mycobacterium bovis
AAGAATPKR

SEQ ID NO: 166976 - protein, 7 aa, Mycobacterium bovis
AAGADKD

SEQ ID NO: 166977 - protein, 5 aa, Mycobacterium bovis
AAGAE

SEQ ID NO: 166978 - protein, 10 aa, Mycobacterium bovis
AAGAGGAGGF

SEQ ID NO: 166979 - protein, 10 aa, Mycobacterium bovis
AAGAGSRRDT

SEQ ID NO: 166980 - protein, 14 aa, Mycobacterium bovis
AAGAPIAEVLDQTQ

SEQ ID NO: 166981 - protein, 6 aa, Mycobacterium bovis
AAGAQN

SEQ ID NO: 166982 - protein, 9 aa, Mycobacterium bovis
AAGASRHGS

SEQ ID NO: 166983 - protein, 6 aa, Mycobacterium bovis
AAGATG

SEQ ID NO: 166984 - protein, 8 aa, Mycobacterium bovis
AAGDAEPR

SEQ ID NO: 166985 - protein, 7 aa, Mycobacterium bovis
AAGDEVS

SEQ ID NO: 166986 - protein, 8 aa, Mycobacterium bovis
AAGDPARA

SEQ ID NO: 166987 - protein, 7 aa, Mycobacterium bovis
AAGDQSI

SEQ ID NO: 166988 - protein, 20 aa, Mycobacterium bovis
AAGDTDAWEQTVGDGVGDAP

SEQ ID NO: 166989 - protein, 4 aa, Mycobacterium bovis
AAGE

SEQ ID NO: 166990 - protein, 7 aa, Mycobacterium bovis
AAGEMPG

SEQ ID NO: 166991 - protein, 6 aa, Mycobacterium bovis
AAGEMR

SEQ ID NO: 166992 - protein, 8 aa, Mycobacterium bovis
AAGEPGAG

SEQ ID NO: 166993 - protein, 9 aa, Mycobacterium bovis
AAGEPGAGV

SEQ ID NO: 166994 - protein, 6 aa, Mycobacterium bovis
AAGERV

SEQ ID NO: 166995 - protein, 10 aa, Mycobacterium bovis
AAGESGAGVA

SEQ ID NO: 166996 - protein, 4 aa, Mycobacterium bovis
AAGG

SEQ ID NO: 166997 - protein, 6 aa, Mycobacterium bovis
AAGGAG

SEQ ID NO: 166998 - protein, 19 aa, Mycobacterium bovis
AAGGAYSSAEAANASAQAL

SEQ ID NO: 166999 - protein, 8 aa, Mycobacterium bovis
AAGGGRMR

SEQ ID NO: 167000 - protein, 6 aa, Mycobacterium bovis
AAGGGV

SEQ ID NO: 167001 - protein, 24 aa, Mycobacterium bovis
AAGGHRGSHGKSEQAATVRVVDDR

SEQ ID NO: 167002 - protein, 9 aa, Mycobacterium bovis
AAGGPEVDE

SEQ ID NO: 167003 - protein, 9 aa, Mycobacterium bovis
AAGGPSVEE

SEQ ID NO: 167004 - protein, 7 aa, Mycobacterium bovis
AAGGQVR

SEQ ID NO: 167005 - protein, 14 aa, Mycobacterium bovis
AAGGREAAARSARY

SEQ ID NO: 167006 - protein, 38 aa, Mycobacterium bovis
AAGGTGAGGTGGQGGLGGQGGNGGNGGTGATGGQGGDF

SEQ ID NO: 167007 - protein, 13 aa, Mycobacterium bovis
AAGGTRGRDGAQG

SEQ ID NO: 167008 - protein, 10 aa, Mycobacterium bovis
AAGGVGAATA

SEQ ID NO: 167009 - protein, 8 aa, Mycobacterium bovis
AAGGYGLD

SEQ ID NO: 167010 - protein, 7 aa, Mycobacterium bovis
AAGHDAE

SEQ ID NO: 167011 - protein, 8 aa, Mycobacterium bovis
AAGHRSPL

SEQ ID NO: 167012 - protein, 6 aa, Mycobacterium bovis
AAGISR

SEQ ID NO: 167013 - protein, 4 aa, Mycobacterium bovis
AAGK

SEQ ID NO: 167014 - protein, 13 aa, Mycobacterium bovis
AAGKDRYCPTPRR

SEQ ID NO: 167015 - protein, 5 aa, Mycobacterium bovis
AAGKG

SEQ ID NO: 167016 - protein, 10 aa, Mycobacterium bovis
AAGKLQGLTP

SEQ ID NO: 167017 - protein, 8 aa, Mycobacterium bovis
AAGKPASV

SEQ ID NO: 167018 - protein, 11 aa, Mycobacterium bovis
AAGKPITGTHA

SEQ ID NO: 167019 - protein, 10 aa, Mycobacterium bovis
AAGKTSGPVN

SEQ ID NO: 167020 - protein, 5 aa, Mycobacterium bovis
AAGLD

SEQ ID NO: 167021 - protein, 9 aa, Mycobacterium bovis
AAGLDLGGR

SEQ ID NO: 167022 - protein, 7 aa, Mycobacterium bovis
AAGLGRA

SEQ ID NO: 167023 - protein, 4 aa, Mycobacterium bovis
AAGN

SEQ ID NO: 167024 - protein, 6 aa, Mycobacterium bovis
AAGNAY

SEQ ID NO: 167025 - protein, 8 aa, Mycobacterium bovis
AAGNERRT

SEQ ID NO: 167026 - protein, 23 aa, Mycobacterium bovis
AAGNGDAVVQPSGAGIHEVDVKI

SEQ ID NO: 167027 - protein, 17 aa, Mycobacterium bovis
AAGNRLAAGSARPVQPA

SEQ ID NO: 167028 - protein, 6 aa, Mycobacterium bovis
AAGPAA

SEQ ID NO: 167029 - protein, 6 aa, Mycobacterium bovis
AAGPAS

SEQ ID NO: 167030 - protein, 6 aa, Mycobacterium bovis
AAGPDN

SEQ ID NO: 167031 - protein, 6 aa, Mycobacterium bovis
AAGPHI

SEQ ID NO: 167032 - protein, 5 aa, Mycobacterium bovis
AAGPL

SEQ ID NO: 167033 - protein, 11 aa, Mycobacterium bovis
AAGPLDRTHPA

SEQ ID NO: 167034 - protein, 9 aa, Mycobacterium bovis
AAGPMNRPS

SEQ ID NO: 167035 - protein, 11 aa, Mycobacterium bovis
AAGPSKGETPL

SEQ ID NO: 167036 - protein, 8 aa, Mycobacterium bovis
AAGPSRAK

SEQ ID NO: 167037 - protein, 14 aa, Mycobacterium bovis
AAGQAAQAAGQARL

SEQ ID NO: 167038 - protein, 9 aa, Mycobacterium bovis
AAGQGRSDD

SEQ ID NO: 167039 - protein, 11 aa, Mycobacterium bovis
AAGQPGAKARE

SEQ ID NO: 167040 - protein, 11 aa, Mycobacterium bovis
AAGRAPRGVPP

SEQ ID NO: 167041 - protein, 7 aa, Mycobacterium bovis
AAGRASA

SEQ ID NO: 167042 - protein, 10 aa, Mycobacterium bovis
AAGRASKDVD

SEQ ID NO: 167043 - protein, 8 aa, Mycobacterium bovis
AAGRDAAA

SEQ ID NO: 167044 - protein, 10 aa, Mycobacterium bovis
AAGRDAGAEV

SEQ ID NO: 167045 - protein, 8 aa, Mycobacterium bovis
AAGREKDK

SEQ ID NO: 167046 - protein, 6 aa, Mycobacterium bovis
AAGRGG

SEQ ID NO: 167047 - protein, 19 aa, Mycobacterium bovis
AAGRGVSAEPGAGAAGGIG

SEQ ID NO: 167048 - protein, 10 aa, Mycobacterium bovis
AAGRNPKLGY

SEQ ID NO: 167049 - protein, 5 aa, Mycobacterium bovis
AAGRQ

SEQ ID NO: 167050 - protein, 7 aa, Mycobacterium bovis
AAGRRAH

SEQ ID NO: 167051 - protein, 13 aa, Mycobacterium bovis
AAGRTDAGVHASG

SEQ ID NO: 167052 - protein, 8 aa, Mycobacterium bovis
AAGRTPGL

SEQ ID NO: 167053 - protein, 6 aa, Mycobacterium bovis
AAGRVA

SEQ ID NO: 167054 - protein, 7 aa, Mycobacterium bovis
AAGSDLD

SEQ ID NO: 167055 - protein, 7 aa, Mycobacterium bovis
AAGSGER

SEQ ID NO: 167056 - protein, 8 aa, Mycobacterium bovis
AAGSNAPV

SEQ ID NO: 167057 - protein, 5 aa, Mycobacterium bovis
AAGSP

SEQ ID NO: 167058 - protein, 23 aa, Mycobacterium bovis
AAGSRQTVTGQQPEQDLNSPREE

SEQ ID NO: 167059 - protein, 14 aa, Mycobacterium bovis
AAGSSVGKGESLRD

SEQ ID NO: 167060 - protein, 8 aa, Mycobacterium bovis
AAGSVGQA

SEQ ID NO: 167061 - protein, 25 aa, Mycobacterium bovis
AAGTDRRKADSDDGHGASTWDPDTP

SEQ ID NO: 167062 - protein, 7 aa, Mycobacterium bovis
AAGTGIR

SEQ ID NO: 167063 - protein, 7 aa, Mycobacterium bovis
AAGTPAE

SEQ ID NO: 167064 - protein, 6 aa, Mycobacterium bovis
AAGTQE

SEQ ID NO: 167065 - protein, 8 aa, Mycobacterium bovis
AAGTQQGI

SEQ ID NO: 167066 - protein, 5 aa, Mycobacterium bovis
AAGTR

SEQ ID NO: 167067 - protein, 13 aa, Mycobacterium bovis
AAGTSRSDPRPAL

SEQ ID NO: 167068 - protein, 6 aa, Mycobacterium bovis
AAGVGS

SEQ ID NO: 167069 - protein, 7 aa, Mycobacterium bovis
AAGVNPR

SEQ ID NO: 167070 - protein, 5 aa, Mycobacterium bovis
AAGVP

SEQ ID NO: 167071 - protein, 8 aa, Mycobacterium bovis
AAGVPSET

SEQ ID NO: 167072 - protein, 53 aa, Mycobacterium bovis
AAGVSGADGIGGAGGAGGAGGAGGSGGEAGAGGLTNGPGSPGVSGTEGMAGAP

SEQ ID NO: 167073 - protein, 8 aa, Mycobacterium bovis
AAGVTAPG

SEQ ID NO: 167074 - protein, 6 aa, Mycobacterium bovis
AAGWPG

SEQ ID NO: 167075 - protein, 8 aa, Mycobacterium bovis
AAGYPADE

SEQ ID NO: 167076 - protein, 11 aa, Mycobacterium bovis
AAHAEGAAGLA

SEQ ID NO: 167077 - protein, 21 aa, Mycobacterium bovis
AAHDADDAATYPSDLTAKAAE

SEQ ID NO: 167078 - protein, 5 aa, Mycobacterium bovis
AAHER

SEQ ID NO: 167079 - protein, 9 aa, Mycobacterium bovis
AAHGANRTG

SEQ ID NO: 167080 - protein, 11 aa, Mycobacterium bovis
AAHGPNPVLPP

SEQ ID NO: 167081 - protein, 7 aa, Mycobacterium bovis
AAHGYTP

SEQ ID NO: 167082 - protein, 5 aa, Mycobacterium bovis
AAHPD

SEQ ID NO: 167083 - protein, 6 aa, Mycobacterium bovis
AAHPGT

SEQ ID NO: 167084 - protein, 9 aa, Mycobacterium bovis
AAHSDGAAI

SEQ ID NO: 167085 - protein, 10 aa, Mycobacterium bovis
AAHSTKQRGK

SEQ ID NO: 167086 - protein, 7 aa, Mycobacterium bovis
AAHTTAH

SEQ ID NO: 167087 - protein, 9 aa, Mycobacterium bovis
AAIAATQAE

SEQ ID NO: 167088 - protein, 5 aa, Mycobacterium bovis
AAIAD

SEQ ID NO: 167089 - protein, 10 aa, Mycobacterium bovis
AAIASTRQNQ

SEQ ID NO: 167090 - protein, 4 aa, Mycobacterium bovis
AAID

SEQ ID NO: 167091 - protein, 9 aa, Mycobacterium bovis
AAIDTGAAE

SEQ ID NO: 167092 - protein, 11 aa, Mycobacterium bovis
AAIGETEDERA

SEQ ID NO: 167093 - protein, 6 aa, Mycobacterium bovis
AAIPGQ

SEQ ID NO: 167094 - protein, 12 aa, Mycobacterium bovis
AAITQGTVLAEI

SEQ ID NO: 167095 - protein, 5 aa, Mycobacterium bovis
AAKAG

SEQ ID NO: 167096 - protein, 10 aa, Mycobacterium bovis
AAKAGGGSIN

SEQ ID NO: 167097 - protein, 5 aa, Mycobacterium bovis
AAKAL

SEQ ID NO: 167098 - protein, 7 aa, Mycobacterium bovis
AAKANAK

SEQ ID NO: 167099 - protein, 53 aa, Mycobacterium bovis
AAKAYGEVDEEAATALDNDGEGTVQAESAGAVGGDSSAELTDTPRVATAGEPN

SEQ ID NO: 167100 - protein, 6 aa, Mycobacterium bovis
AAKDLE

SEQ ID NO: 167101 - protein, 6 aa, Mycobacterium bovis
AAKDQA

SEQ ID NO: 167102 - protein, 4 aa, Mycobacterium bovis
AAKE

SEQ ID NO: 167103 - protein, 7 aa, Mycobacterium bovis
AAKGAGA

SEQ ID NO: 167104 - protein, 6 aa, Mycobacterium bovis
AAKGDV

SEQ ID NO: 167105 - protein, 8 aa, Mycobacterium bovis
AAKGNGRA

SEQ ID NO: 167106 - protein, 7 aa, Mycobacterium bovis
AAKGPYA

SEQ ID NO: 167107 - protein, 7 aa, Mycobacterium bovis
AAKGVPD

SEQ ID NO: 167108 - protein, 10 aa, Mycobacterium bovis
AAKKDGDTLG

SEQ ID NO: 167109 - protein, 7 aa, Mycobacterium bovis
AAKNAAQ

SEQ ID NO: 167110 - protein, 6 aa, Mycobacterium bovis
AAKNAV

SEQ ID NO: 167111 - protein, 9 aa, Mycobacterium bovis
AAKPDPRAY

SEQ ID NO: 167112 - protein, 5 aa, Mycobacterium bovis
AAKPK

SEQ ID NO: 167113 - protein, 7 aa, Mycobacterium bovis
AAKPKIA

SEQ ID NO: 167114 - protein, 6 aa, Mycobacterium bovis
AAKPKR

SEQ ID NO: 167115 - protein, 7 aa, Mycobacterium bovis
AAKPSMG

SEQ ID NO: 167116 - protein, 8 aa, Mycobacterium bovis
AAKRLAKE

SEQ ID NO: 167117 - protein, 9 aa, Mycobacterium bovis
AAKRPSDYR

SEQ ID NO: 167118 - protein, 7 aa, Mycobacterium bovis
AAKRTGD

SEQ ID NO: 167119 - protein, 13 aa, Mycobacterium bovis
AAKSDFEMVEVAR

SEQ ID NO: 167120 - protein, 10 aa, Mycobacterium bovis
AAKSGANAIH

SEQ ID NO: 167121 - protein, 9 aa, Mycobacterium bovis
AAKSGKDVG

SEQ ID NO: 167122 - protein, 12 aa, Mycobacterium bovis
AAKSSPDQDEIQ

SEQ ID NO: 167123 - protein, 9 aa, Mycobacterium bovis
AAKTGAAVT

SEQ ID NO: 167124 - protein, 8 aa, Mycobacterium bovis
AAKTGDRF

SEQ ID NO: 167125 - protein, 12 aa, Mycobacterium bovis
AALEDDQKVEPA

SEQ ID NO: 167126 - protein, 5 aa, Mycobacterium bovis
AALEP

SEQ ID NO: 167127 - protein, 5 aa, Mycobacterium bovis
AALGE

SEQ ID NO: 167128 - protein, 5 aa, Mycobacterium bovis
AALGG

SEQ ID NO: 167129 - protein, 15 aa, Mycobacterium bovis
AALGGNERARKRHVS

SEQ ID NO: 167130 - protein, 17 aa, Mycobacterium bovis
AALGKGSSAGSLSVPPD

SEQ ID NO: 167131 - protein, 7 aa, Mycobacterium bovis
AALGQAA

SEQ ID NO: 167132 - protein, 6 aa, Mycobacterium bovis
AALGRP

SEQ ID NO: 167133 - protein, 18 aa, Mycobacterium bovis
AALPGSRTTTAAGTPGVD

SEQ ID NO: 167134 - protein, 53 aa, Mycobacterium bovis
AALPPPDPVPAVTSRPVTPSDFGSAPGDGSATPAGVGSAGGFGDAGGTGGLGG

SEQ ID NO: 167135 - protein, 9 aa, Mycobacterium bovis
AALPQAQAR

SEQ ID NO: 167136 - protein, 11 aa, Mycobacterium bovis
AALQSSDDAAL

SEQ ID NO: 167137 - protein, 11 aa, Mycobacterium bovis
AALQTSDARVS

SEQ ID NO: 167138 - protein, 7 aa, Mycobacterium bovis
AALSETV

SEQ ID NO: 167139 - protein, 8 aa, Mycobacterium bovis
AALSGTPR

SEQ ID NO: 167140 - protein, 7 aa, Mycobacterium bovis
AALSTDE

SEQ ID NO: 167141 - protein, 9 aa, Mycobacterium bovis
AALTPRPGV

SEQ ID NO: 167142 - protein, 12 aa, Mycobacterium bovis
AAMDNSRDATQI

SEQ ID NO: 167143 - protein, 9 aa, Mycobacterium bovis
AAMETDAET

SEQ ID NO: 167144 - protein, 7 aa, Mycobacterium bovis
AAMGTGQ

SEQ ID NO: 167145 - protein, 17 aa, Mycobacterium bovis
AAMGTSTAGQVSISSPE

SEQ ID NO: 167146 - protein, 11 aa, Mycobacterium bovis
AAMTASDVERA

SEQ ID NO: 167147 - protein, 13 aa, Mycobacterium bovis
AANAAAAAQTTGV

SEQ ID NO: 167148 - protein, 9 aa, Mycobacterium bovis
AANAAAAQT

SEQ ID NO: 167149 - protein, 9 aa, Mycobacterium bovis
AANAENDRT

SEQ ID NO: 167150 - protein, 6 aa, Mycobacterium bovis
AANASA

SEQ ID NO: 167151 - protein, 6 aa, Mycobacterium bovis
AANCPQ

SEQ ID NO: 167152 - protein, 8 aa, Mycobacterium bovis
AANGDELQ

SEQ ID NO: 167153 - protein, 7 aa, Mycobacterium bovis
AANPAGF

SEQ ID NO: 167154 - protein, 16 aa, Mycobacterium bovis
AANPDVADKIRGGKVA

SEQ ID NO: 167155 - protein, 5 aa, Mycobacterium bovis
AANPL

SEQ ID NO: 167156 - protein, 5 aa, Mycobacterium bovis
AANPP

SEQ ID NO: 167157 - protein, 7 aa, Mycobacterium bovis
AANPRIG

SEQ ID NO: 167158 - protein, 10 aa, Mycobacterium bovis
AANQKGVDEV

SEQ ID NO: 167159 - protein, 12 aa, Mycobacterium bovis
AANRAAEAPTTG

SEQ ID NO: 167160 - protein, 5 aa, Mycobacterium bovis
AANRK

SEQ ID NO: 167161 - protein, 5 aa, Mycobacterium bovis
AANRP

SEQ ID NO: 167162 - protein, 6 aa, Mycobacterium bovis
AANRPG

SEQ ID NO: 167163 - protein, 9 aa, Mycobacterium bovis
AANSDDLAD

SEQ ID NO: 167164 - protein, 5 aa, Mycobacterium bovis
AANSR

SEQ ID NO: 167165 - protein, 7 aa, Mycobacterium bovis
AANTPAQ

SEQ ID NO: 167166 - protein, 7 aa, Mycobacterium bovis
AANTPKG

SEQ ID NO: 167167 - protein, 7 aa, Mycobacterium bovis
AANTRSI

SEQ ID NO: 167168 - protein, 19 aa, Mycobacterium bovis
AAPAAVAAAGDAAKGLPGL

SEQ ID NO: 167169 - protein, 8 aa, Mycobacterium bovis
AAPAGAVG

SEQ ID NO: 167170 - protein, 8 aa, Mycobacterium bovis
AAPAGPAQ

SEQ ID NO: 167171 - protein, 6 aa, Mycobacterium bovis
AAPAHA

SEQ ID NO: 167172 - protein, 17 aa, Mycobacterium bovis
AAPANSTSIDRRLPSTR

SEQ ID NO: 167173 - protein, 7 aa, Mycobacterium bovis
AAPAPDA

SEQ ID NO: 167174 - protein, 21 aa, Mycobacterium bovis
AAPAPEHQPGARASDCGAGPI

SEQ ID NO: 167175 - protein, 14 aa, Mycobacterium bovis
AAPAPLPSPNELTD

SEQ ID NO: 167176 - protein, 8 aa, Mycobacterium bovis
AAPATVSE

SEQ ID NO: 167177 - protein, 7 aa, Mycobacterium bovis
AAPAYTA

SEQ ID NO: 167178 - protein, 10 aa, Mycobacterium bovis
AAPDAGEQDL

SEQ ID NO: 167179 - protein, 6 aa, Mycobacterium bovis
AAPDAH

SEQ ID NO: 167180 - protein, 7 aa, Mycobacterium bovis
AAPDNTL

SEQ ID NO: 167181 - protein, 5 aa, Mycobacterium bovis
AAPDQ

SEQ ID NO: 167182 - protein, 7 aa, Mycobacterium bovis
AAPDTGN

SEQ ID NO: 167183 - protein, 9 aa, Mycobacterium bovis
AAPDYGRDE

SEQ ID NO: 167184 - protein, 5 aa, Mycobacterium bovis
AAPEA

SEQ ID NO: 167185 - protein, 5 aa, Mycobacterium bovis
AAPEE

SEQ ID NO: 167186 - protein, 7 aa, Mycobacterium bovis
AAPEEND

SEQ ID NO: 167187 - protein, 6 aa, Mycobacterium bovis
AAPEEV

SEQ ID NO: 167188 - protein, 7 aa, Mycobacterium bovis
AAPESTC

SEQ ID NO: 167189 - protein, 5 aa, Mycobacterium bovis
AAPGA

SEQ ID NO: 167190 - protein, 16 aa, Mycobacterium bovis
AAPGFGNSTTNPSSGF

SEQ ID NO: 167191 - protein, 16 aa, Mycobacterium bovis
AAPGFGNSTTSPSSGF

SEQ ID NO: 167192 - protein, 7 aa, Mycobacterium bovis
AAPGNQA

SEQ ID NO: 167193 - protein, 11 aa, Mycobacterium bovis
AAPGNTPSLDE

SEQ ID NO: 167194 - protein, 5 aa, Mycobacterium bovis
AAPGP

SEQ ID NO: 167195 - protein, 5 aa, Mycobacterium bovis
AAPGQ

SEQ ID NO: 167196 - protein, 6 aa, Mycobacterium bovis
AAPGQG

SEQ ID NO: 167197 - protein, 7 aa, Mycobacterium bovis
AAPGQGE

SEQ ID NO: 167198 - protein, 5 aa, Mycobacterium bovis
AAPGT

SEQ ID NO: 167199 - protein, 7 aa, Mycobacterium bovis
AAPIPKE

SEQ ID NO: 167200 - protein, 8 aa, Mycobacterium bovis
AAPKPSKL

SEQ ID NO: 167201 - protein, 7 aa, Mycobacterium bovis
AAPKTGG

SEQ ID NO: 167202 - protein, 8 aa, Mycobacterium bovis
AAPKYAEA

SEQ ID NO: 167203 - protein, 4 aa, Mycobacterium bovis
AAPL

SEQ ID NO: 167204 - protein, 12 aa, Mycobacterium bovis
AAPLTSRSRFRP

SEQ ID NO: 167205 - protein, 35 aa, Mycobacterium bovis
AAPNDAEAIGAANAANVKGPKHTPRTPKPRGRRKT

SEQ ID NO: 167206 - protein, 11 aa, Mycobacterium bovis
AAPNLPAPSAQ

SEQ ID NO: 167207 - protein, 9 aa, Mycobacterium bovis
AAPPAGSKQ

SEQ ID NO: 167208 - protein, 7 aa, Mycobacterium bovis
AAPPDSY

SEQ ID NO: 167209 - protein, 8 aa, Mycobacterium bovis
AAPPGMAP

SEQ ID NO: 167210 - protein, 9 aa, Mycobacterium bovis
AAPPPATTR

SEQ ID NO: 167211 - protein, 8 aa, Mycobacterium bovis
AAPPPGHG

SEQ ID NO: 167212 - protein, 7 aa, Mycobacterium bovis
AAPPPLP

SEQ ID NO: 167213 - protein, 15 aa, Mycobacterium bovis
AAPPPTTNAAGLATQ

SEQ ID NO: 167214 - protein, 5 aa, Mycobacterium bovis
AAPPQ

SEQ ID NO: 167215 - protein, 11 aa, Mycobacterium bovis
AAPQATAPALS

SEQ ID NO: 167216 - protein, 6 aa, Mycobacterium bovis
AAPQQG

SEQ ID NO: 167217 - protein, 4 aa, Mycobacterium bovis
AAPR

SEQ ID NO: 167218 - protein, 7 aa, Mycobacterium bovis
AAPRPVR

SEQ ID NO: 167219 - protein, 6 aa, Mycobacterium bovis
AAPRPY

SEQ ID NO: 167220 - protein, 11 aa, Mycobacterium bovis
AAPSARGHQRD

SEQ ID NO: 167221 - protein, 7 aa, Mycobacterium bovis
AAPSGEI

SEQ ID NO: 167222 - protein, 16 aa, Mycobacterium bovis
AAPSLSDRDAAAPSFE

SEQ ID NO: 167223 - protein, 6 aa, Mycobacterium bovis
AAPSVA

SEQ ID NO: 167224 - protein, 4 aa, Mycobacterium bovis
AAPT

SEQ ID NO: 167225 - protein, 11 aa, Mycobacterium bovis
AAPTGKAAARL

SEQ ID NO: 167226 - protein, 7 aa, Mycobacterium bovis
AAPTPAE

SEQ ID NO: 167227 - protein, 7 aa, Mycobacterium bovis
AAPTSVH

SEQ ID NO: 167228 - protein, 17 aa, Mycobacterium bovis
AAPVAPAASSAGPRPDD

SEQ ID NO: 167229 - protein, 5 aa, Mycobacterium bovis
AAPVT

SEQ ID NO: 167230 - protein, 24 aa, Mycobacterium bovis
AAPYGGPCRPPQHTSKAAAPRIPA

SEQ ID NO: 167231 - protein, 10 aa, Mycobacterium bovis
AAPYQRARER

SEQ ID NO: 167232 - protein, 13 aa, Mycobacterium bovis
AAQAAAGKRCPPT

SEQ ID NO: 167233 - protein, 10 aa, Mycobacterium bovis
AAQAASTTAE

SEQ ID NO: 167234 - protein, 8 aa, Mycobacterium bovis
AAQAEPSF

SEQ ID NO: 167235 - protein, 9 aa, Mycobacterium bovis
AAQAEQAAA

SEQ ID NO: 167236 - protein, 14 aa, Mycobacterium bovis
AAQAEQAAGQAQAA

SEQ ID NO: 167237 - protein, 15 aa, Mycobacterium bovis
AAQAEQAATQARAAA

SEQ ID NO: 167238 - protein, 7 aa, Mycobacterium bovis
AAQAGRA

SEQ ID NO: 167239 - protein, 27 aa, Mycobacterium bovis
AAQAKAKKAAAMPTEESEAKPAEEGDV

SEQ ID NO: 167240 - protein, 12 aa, Mycobacterium bovis
AAQAQQAATQTR

SEQ ID NO: 167241 - protein, 11 aa, Mycobacterium bovis
AAQAQRSATQA

SEQ ID NO: 167242 - protein, 12 aa, Mycobacterium bovis
AAQARKRGYQPV

SEQ ID NO: 167243 - protein, 11 aa, Mycobacterium bovis
AAQASDQQRRA

SEQ ID NO: 167244 - protein, 6 aa, Mycobacterium bovis
AAQASG

SEQ ID NO: 167245 - protein, 7 aa, Mycobacterium bovis
AAQATTL

SEQ ID NO: 167246 - protein, 8 aa, Mycobacterium bovis
AAQEGVSR

SEQ ID NO: 167247 - protein, 7 aa, Mycobacterium bovis
AAQGAMA

SEQ ID NO: 167248 - protein, 20 aa, Mycobacterium bovis
AAQGDHEGAADRLSTGGDTA

SEQ ID NO: 167249 - protein, 8 aa, Mycobacterium bovis
AAQGQSAP

SEQ ID NO: 167250 - protein, 19 aa, Mycobacterium bovis
AAQGRGASTISGALRSRDT

SEQ ID NO: 167251 - protein, 7 aa, Mycobacterium bovis
AAQGRTP

SEQ ID NO: 167252 - protein, 10 aa, Mycobacterium bovis
AAQGSEAAEI

SEQ ID NO: 167253 - protein, 8 aa, Mycobacterium bovis
AAQGTTGP

SEQ ID NO: 167254 - protein, 5 aa, Mycobacterium bovis
AAQHG

SEQ ID NO: 167255 - protein, 8 aa, Mycobacterium bovis
AAQKEPEM

SEQ ID NO: 167256 - protein, 5 aa, Mycobacterium bovis
AAQLD

SEQ ID NO: 167257 - protein, 9 aa, Mycobacterium bovis
AAQLKSDHQ

SEQ ID NO: 167258 - protein, 7 aa, Mycobacterium bovis
AAQPDSV

SEQ ID NO: 167259 - protein, 6 aa, Mycobacterium bovis
AAQPEP

SEQ ID NO: 167260 - protein, 8 aa, Mycobacterium bovis
AAQPGSRL

SEQ ID NO: 167261 - protein, 8 aa, Mycobacterium bovis
AAQPPAMS

SEQ ID NO: 167262 - protein, 6 aa, Mycobacterium bovis
AAQQAL

SEQ ID NO: 167263 - protein, 8 aa, Mycobacterium bovis
AAQQGRKM

SEQ ID NO: 167264 - protein, 8 aa, Mycobacterium bovis
AAQQNQSP

SEQ ID NO: 167265 - protein, 12 aa, Mycobacterium bovis
AAQRAESKALKA

SEQ ID NO: 167266 - protein, 6 aa, Mycobacterium bovis
AAQRDI

SEQ ID NO: 167267 - protein, 12 aa, Mycobacterium bovis
AAQRPTAGPPTE

SEQ ID NO: 167268 - protein, 10 aa, Mycobacterium bovis
AAQRYSGTAD

SEQ ID NO: 167269 - protein, 12 aa, Mycobacterium bovis
AAQSAGAAGQAR

SEQ ID NO: 167270 - protein, 7 aa, Mycobacterium bovis
AAQSEAL

SEQ ID NO: 167271 - protein, 19 aa, Mycobacterium bovis
AAQSNTPVSKAIIVRLEPT

SEQ ID NO: 167272 - protein, 4 aa, Mycobacterium bovis
AAQT

SEQ ID NO: 167273 - protein, 8 aa, Mycobacterium bovis
AAQTDDQQ

SEQ ID NO: 167274 - protein, 8 aa, Mycobacterium bovis
AAQTVRAG

SEQ ID NO: 167275 - protein, 11 aa, Mycobacterium bovis
AAQVATTLTGT

SEQ ID NO: 167276 - protein, 10 aa, Mycobacterium bovis
AARAADADIA

SEQ ID NO: 167277 - protein, 7 aa, Mycobacterium bovis
AARAAEA

SEQ ID NO: 167278 - protein, 14 aa, Mycobacterium bovis
AARAAGAAAQAKAV

SEQ ID NO: 167279 - protein, 8 aa, Mycobacterium bovis
AARAAGDT

SEQ ID NO: 167280 - protein, 9 aa, Mycobacterium bovis
AARAAGHPG

SEQ ID NO: 167281 - protein, 12 aa, Mycobacterium bovis
AARADQRPLWQV

SEQ ID NO: 167282 - protein, 18 aa, Mycobacterium bovis
AARAERADRERRAAEADR

SEQ ID NO: 167283 - protein, 5 aa, Mycobacterium bovis
AARAG

SEQ ID NO: 167284 - protein, 15 aa, Mycobacterium bovis
AARAKAKELGADPPW

SEQ ID NO: 167285 - protein, 11 aa, Mycobacterium bovis
AARARAGDGPT

SEQ ID NO: 167286 - protein, 7 aa, Mycobacterium bovis
AARARDA

SEQ ID NO: 167287 - protein, 8 aa, Mycobacterium bovis
AARATKLA

SEQ ID NO: 167288 - protein, 7 aa, Mycobacterium bovis
AARATQP

SEQ ID NO: 167289 - protein, 7 aa, Mycobacterium bovis
AARATRK

SEQ ID NO: 167290 - protein, 4 aa, Mycobacterium bovis
AARD

SEQ ID NO: 167291 - protein, 6 aa, Mycobacterium bovis
AARDDA

SEQ ID NO: 167292 - protein, 8 aa, Mycobacterium bovis
AARDRNIR

SEQ ID NO: 167293 - protein, 5 aa, Mycobacterium bovis
AARDV

SEQ ID NO: 167294 - protein, 6 aa, Mycobacterium bovis
AAREAS

SEQ ID NO: 167295 - protein, 5 aa, Mycobacterium bovis
AAREE

SEQ ID NO: 167296 - protein, 16 aa, Mycobacterium bovis
AARENAKSAREVTSSE

SEQ ID NO: 167297 - protein, 10 aa, Mycobacterium bovis
AARGADPDFH

SEQ ID NO: 167298 - protein, 6 aa, Mycobacterium bovis
AARGGR

SEQ ID NO: 167299 - protein, 27 aa, Mycobacterium bovis
AARGTTGGGGTRSGTSTDGQEDGRKPP

SEQ ID NO: 167300 - protein, 7 aa, Mycobacterium bovis
AARHDSK

SEQ ID NO: 167301 - protein, 10 aa, Mycobacterium bovis
AARHTSGEAI

SEQ ID NO: 167302 - protein, 7 aa, Mycobacterium bovis
AARKAGH

SEQ ID NO: 167303 - protein, 16 aa, Mycobacterium bovis
AARKVPKVAGDATRLP

SEQ ID NO: 167304 - protein, 6 aa, Mycobacterium bovis
AARNRA

SEQ ID NO: 167305 - protein, 7 aa, Mycobacterium bovis
AARNRAY

SEQ ID NO: 167306 - protein, 5 aa, Mycobacterium bovis
AARNS

SEQ ID NO: 167307 - protein, 7 aa, Mycobacterium bovis
AARNTEP

SEQ ID NO: 167308 - protein, 11 aa, Mycobacterium bovis
AARPAGPAHPA

SEQ ID NO: 167309 - protein, 28 aa, Mycobacterium bovis
AARPGEDWTGSQQFSGDNPFGMGEGTQA

SEQ ID NO: 167310 - protein, 12 aa, Mycobacterium bovis
AARPGPSHRDNR

SEQ ID NO: 167311 - protein, 6 aa, Mycobacterium bovis
AARPPA

SEQ ID NO: 167312 - protein, 9 aa, Mycobacterium bovis
AARPPDDPI

SEQ ID NO: 167313 - protein, 7 aa, Mycobacterium bovis
AARPTRT

SEQ ID NO: 167314 - protein, 6 aa, Mycobacterium bovis
AARQAG

SEQ ID NO: 167315 - protein, 5 aa, Mycobacterium bovis
AARQG

SEQ ID NO: 167316 - protein, 7 aa, Mycobacterium bovis
AARQLGQ

SEQ ID NO: 167317 - protein, 12 aa, Mycobacterium bovis
AARQRHGQANSW

SEQ ID NO: 167318 - protein, 6 aa, Mycobacterium bovis
AARQSD

SEQ ID NO: 167319 - protein, 12 aa, Mycobacterium bovis
AARQSRRARIPP

SEQ ID NO: 167320 - protein, 5 aa, Mycobacterium bovis
AARRA

SEQ ID NO: 167321 - protein, 15 aa, Mycobacterium bovis
AARRAAASVAGAADP

SEQ ID NO: 167322 - protein, 15 aa, Mycobacterium bovis
AARRAQRAHPAGAPE

SEQ ID NO: 167323 - protein, 14 aa, Mycobacterium bovis
AARRPQVTTPGGRA

SEQ ID NO: 167324 - protein, 7 aa, Mycobacterium bovis
AARRQRP

SEQ ID NO: 167325 - protein, 4 aa, Mycobacterium bovis
AARS

SEQ ID NO: 167326 - protein, 7 aa, Mycobacterium bovis
AARSAGV

SEQ ID NO: 167327 - protein, 6 aa, Mycobacterium bovis
AARSAT

SEQ ID NO: 167328 - protein, 9 aa, Mycobacterium bovis
AARSGRADE

SEQ ID NO: 167329 - protein, 8 aa, Mycobacterium bovis
AARTAEQL

SEQ ID NO: 167330 - protein, 8 aa, Mycobacterium bovis
AARTGAQA

SEQ ID NO: 167331 - protein, 14 aa, Mycobacterium bovis
AARTGDDRSPEQVA

SEQ ID NO: 167332 - protein, 11 aa, Mycobacterium bovis
AARTGGARPTV

SEQ ID NO: 167333 - protein, 9 aa, Mycobacterium bovis
AARTGSGVG

SEQ ID NO: 167334 - protein, 6 aa, Mycobacterium bovis
AARTHR

SEQ ID NO: 167335 - protein, 7 aa, Mycobacterium bovis
AARTPAA

SEQ ID NO: 167336 - protein, 15 aa, Mycobacterium bovis
AARTRSGVILRSPAA

SEQ ID NO: 167337 - protein, 5 aa, Mycobacterium bovis
AARTT

SEQ ID NO: 167338 - protein, 5 aa, Mycobacterium bovis
AARYG

SEQ ID NO: 167339 - protein, 4 aa, Mycobacterium bovis
AASA

SEQ ID NO: 167340 - protein, 17 aa, Mycobacterium bovis
AASAAPGYPATAGTARL

SEQ ID NO: 167341 - protein, 11 aa, Mycobacterium bovis
AASAEQAAAQA

SEQ ID NO: 167342 - protein, 7 aa, Mycobacterium bovis
AASAERV

SEQ ID NO: 167343 - protein, 5 aa, Mycobacterium bovis
AASAL

SEQ ID NO: 167344 - protein, 7 aa, Mycobacterium bovis
AASANPV

SEQ ID NO: 167345 - protein, 14 aa, Mycobacterium bovis
AASAQDAADRPPVP

SEQ ID NO: 167346 - protein, 8 aa, Mycobacterium bovis
AASAREAQ

SEQ ID NO: 167347 - protein, 7 aa, Mycobacterium bovis
AASARGS

SEQ ID NO: 167348 - protein, 12 aa, Mycobacterium bovis
AASASAAGPTTG

SEQ ID NO: 167349 - protein, 6 aa, Mycobacterium bovis
AASASL

SEQ ID NO: 167350 - protein, 8 aa, Mycobacterium bovis
AASATPLQ

SEQ ID NO: 167351 - protein, 5 aa, Mycobacterium bovis
AASAV

SEQ ID NO: 167352 - protein, 8 aa, Mycobacterium bovis
AASCPDDP

SEQ ID NO: 167353 - protein, 8 aa, Mycobacterium bovis
AASDAAEL

SEQ ID NO: 167354 - protein, 14 aa, Mycobacterium bovis
AASDPGLTQTGTAV

SEQ ID NO: 167355 - protein, 13 aa, Mycobacterium bovis
AASDPRRDGQAAA

SEQ ID NO: 167356 - protein, 20 aa, Mycobacterium bovis
AASDQPKPEPAPKAKRRKGV

SEQ ID NO: 167357 - protein, 7 aa, Mycobacterium bovis
AASDRVR

SEQ ID NO: 167358 - protein, 21 aa, Mycobacterium bovis
AASELASRQRAMKSATDNADD

SEQ ID NO: 167359 - protein, 7 aa, Mycobacterium bovis
AASESAG

SEQ ID NO: 167360 - protein, 7 aa, Mycobacterium bovis
AASFGSV

SEQ ID NO: 167361 - protein, 4 aa, Mycobacterium bovis
AASG

SEQ ID NO: 167362 - protein, 7 aa, Mycobacterium bovis
AASGAAG

SEQ ID NO: 167363 - protein, 7 aa, Mycobacterium bovis
AASGADI

SEQ ID NO: 167364 - protein, 5 aa, Mycobacterium bovis
AASGG

SEQ ID NO: 167365 - protein, 7 aa, Mycobacterium bovis
AASGLDG

SEQ ID NO: 167366 - protein, 34 aa, Mycobacterium bovis
AASGQNGSQGAGGDGGAGGNGGTPGNGGHGAAGA

SEQ ID NO: 167367 - protein, 7 aa, Mycobacterium bovis
AASGTPL

SEQ ID NO: 167368 - protein, 6 aa, Mycobacterium bovis
AASGVS

SEQ ID NO: 167369 - protein, 14 aa, Mycobacterium bovis
AASIPTKSYDNAEG

SEQ ID NO: 167370 - protein, 8 aa, Mycobacterium bovis
AASKTNPT

SEQ ID NO: 167371 - protein, 4 aa, Mycobacterium bovis
AASN

SEQ ID NO: 167372 - protein, 12 aa, Mycobacterium bovis
AASPFRSDTDIS

SEQ ID NO: 167373 - protein, 9 aa, Mycobacterium bovis
AASPPPGLP

SEQ ID NO: 167374 - protein, 17 aa, Mycobacterium bovis
AASPVLSGGQKGPHPIQ

SEQ ID NO: 167375 - protein, 13 aa, Mycobacterium bovis
AASRASADGRPPM

SEQ ID NO: 167376 - protein, 13 aa, Mycobacterium bovis
AASREAESAFGDP

SEQ ID NO: 167377 - protein, 7 aa, Mycobacterium bovis
AASRQLR

SEQ ID NO: 167378 - protein, 8 aa, Mycobacterium bovis
AASSDREV

SEQ ID NO: 167379 - protein, 10 aa, Mycobacterium bovis
AASSGGFGGQ

SEQ ID NO: 167380 - protein, 10 aa, Mycobacterium bovis
AASSGGISTN

SEQ ID NO: 167381 - protein, 10 aa, Mycobacterium bovis
AASSPYGGEI

SEQ ID NO: 167382 - protein, 7 aa, Mycobacterium bovis
AASSRVD

SEQ ID NO: 167383 - protein, 11 aa, Mycobacterium bovis
AASTAGNPEIR

SEQ ID NO: 167384 - protein, 7 aa, Mycobacterium bovis
AASTDQL

SEQ ID NO: 167385 - protein, 10 aa, Mycobacterium bovis
AASTGNPGLR

SEQ ID NO: 167386 - protein, 6 aa, Mycobacterium bovis
AASTPD

SEQ ID NO: 167387 - protein, 7 aa, Mycobacterium bovis
AASYAQG

SEQ ID NO: 167388 - protein, 8 aa, Mycobacterium bovis
AASYGSTI

SEQ ID NO: 167389 - protein, 7 aa, Mycobacterium bovis
AATAAAT

SEQ ID NO: 167390 - protein, 7 aa, Mycobacterium bovis
AATAAVE

SEQ ID NO: 167391 - protein, 7 aa, Mycobacterium bovis
AATADTG

SEQ ID NO: 167392 - protein, 7 aa, Mycobacterium bovis
AATAGPQ

SEQ ID NO: 167393 - protein, 8 aa, Mycobacterium bovis
AATAPDAV

SEQ ID NO: 167394 - protein, 6 aa, Mycobacterium bovis
AATARL

SEQ ID NO: 167395 - protein, 4 aa, Mycobacterium bovis
AATD

SEQ ID NO: 167396 - protein, 11 aa, Mycobacterium bovis
AATDPAVRGGQ

SEQ ID NO: 167397 - protein, 27 aa, Mycobacterium bovis
AATDPTTQGGQYYGPDGFGEQRGHPKV

SEQ ID NO: 167398 - protein, 10 aa, Mycobacterium bovis
AATDRDLDAG

SEQ ID NO: 167399 - protein, 4 aa, Mycobacterium bovis
AATE

SEQ ID NO: 167400 - protein, 7 aa, Mycobacterium bovis
AATEAEY

SEQ ID NO: 167401 - protein, 18 aa, Mycobacterium bovis
AATEATNRGLVALRVVLH

SEQ ID NO: 167402 - protein, 16 aa, Mycobacterium bovis
AATEERFSDGSGRGSI

SEQ ID NO: 167403 - protein, 6 aa, Mycobacterium bovis
AATEQP

SEQ ID NO: 167404 - protein, 17 aa, Mycobacterium bovis
AATETALKERKESVEDA

SEQ ID NO: 167405 - protein, 4 aa, Mycobacterium bovis
AATG

SEQ ID NO: 167406 - protein, 9 aa, Mycobacterium bovis
AATGAGHGT

SEQ ID NO: 167407 - protein, 13 aa, Mycobacterium bovis
AATGAPTAAHPID

SEQ ID NO: 167408 - protein, 9 aa, Mycobacterium bovis
AATGGGVAT

SEQ ID NO: 167409 - protein, 6 aa, Mycobacterium bovis
AATGKP

SEQ ID NO: 167410 - protein, 11 aa, Mycobacterium bovis
AATGQSTDLDP

SEQ ID NO: 167411 - protein, 6 aa, Mycobacterium bovis
AATGRA

SEQ ID NO: 167412 - protein, 12 aa, Mycobacterium bovis
AATKAAEERGLT

SEQ ID NO: 167413 - protein, 18 aa, Mycobacterium bovis
AATKSMTAPTVDERPDIK

SEQ ID NO: 167414 - protein, 15 aa, Mycobacterium bovis
AATLQRAARDAAPDA

SEQ ID NO: 167415 - protein, 6 aa, Mycobacterium bovis
AATLRK

SEQ ID NO: 167416 - protein, 11 aa, Mycobacterium bovis
AATLSGGEAQR

SEQ ID NO: 167417 - protein, 8 aa, Mycobacterium bovis
AATNGEEF

SEQ ID NO: 167418 - protein, 7 aa, Mycobacterium bovis
AATNSAI

SEQ ID NO: 167419 - protein, 4 aa, Mycobacterium bovis
AATP

SEQ ID NO: 167420 - protein, 6 aa, Mycobacterium bovis
AATPAI

SEQ ID NO: 167421 - protein, 10 aa, Mycobacterium bovis
AATPARGGYT

SEQ ID NO: 167422 - protein, 13 aa, Mycobacterium bovis
AATPPPVRGGKQP

SEQ ID NO: 167423 - protein, 19 aa, Mycobacterium bovis
AATPTDAAKKVVPDTAAEQ

SEQ ID NO: 167424 - protein, 20 aa, Mycobacterium bovis
AATQKPPGDSFKDGSYDPSR

SEQ ID NO: 167425 - protein, 11 aa, Mycobacterium bovis
AATREQEMTPE

SEQ ID NO: 167426 - protein, 8 aa, Mycobacterium bovis
AATRGGQR

SEQ ID NO: 167427 - protein, 9 aa, Mycobacterium bovis
AATRGGWRA

SEQ ID NO: 167428 - protein, 21 aa, Mycobacterium bovis
AATRGSGRIGRSAAGRALDPE

SEQ ID NO: 167429 - protein, 7 aa, Mycobacterium bovis
AATRNGR

SEQ ID NO: 167430 - protein, 8 aa, Mycobacterium bovis
AATRTSME

SEQ ID NO: 167431 - protein, 9 aa, Mycobacterium bovis
AATSKDAID

SEQ ID NO: 167432 - protein, 5 aa, Mycobacterium bovis
AATSY

SEQ ID NO: 167433 - protein, 4 aa, Mycobacterium bovis
AATT

SEQ ID NO: 167434 - protein, 5 aa, Mycobacterium bovis
AATTG

SEQ ID NO: 167435 - protein, 8 aa, Mycobacterium bovis
AATTKTLP

SEQ ID NO: 167436 - protein, 8 aa, Mycobacterium bovis
AATTNVSD

SEQ ID NO: 167437 - protein, 6 aa, Mycobacterium bovis
AATVRG

SEQ ID NO: 167438 - protein, 9 aa, Mycobacterium bovis
AAVAGNPSL

SEQ ID NO: 167439 - protein, 6 aa, Mycobacterium bovis
AAVATN

SEQ ID NO: 167440 - protein, 7 aa, Mycobacterium bovis
AAVDGGG

SEQ ID NO: 167441 - protein, 16 aa, Mycobacterium bovis
AAVGASRAAVDSGYYP

SEQ ID NO: 167442 - protein, 5 aa, Mycobacterium bovis
AAVGT

SEQ ID NO: 167443 - protein, 6 aa, Mycobacterium bovis
AAVPHP

SEQ ID NO: 167444 - protein, 5 aa, Mycobacterium bovis
AAVSG

SEQ ID NO: 167445 - protein, 6 aa, Mycobacterium bovis
AAVSGI

SEQ ID NO: 167446 - protein, 6 aa, Mycobacterium bovis
AAVSPG

SEQ ID NO: 167447 - protein, 9 aa, Mycobacterium bovis
AAVSQATDP

SEQ ID NO: 167448 - protein, 14 aa, Mycobacterium bovis
AAVTGNGSADKAQV

SEQ ID NO: 167449 - protein, 6 aa, Mycobacterium bovis
AAYAQA

SEQ ID NO: 167450 - protein, 8 aa, Mycobacterium bovis
AAYDGPGV

SEQ ID NO: 167451 - protein, 5 aa, Mycobacterium bovis
ACGGP

SEQ ID NO: 167452 - protein, 24 aa, Mycobacterium bovis
ACGHSRRAVSPDQSLSMDPGVVLD

SEQ ID NO: 167453 - protein, 18 aa, Mycobacterium bovis
ACSVTTRPGNAAVDYGGA

SEQ ID NO: 167454 - protein, 17 aa, Mycobacterium bovis
ADAAAADKRRAAGDTAP

SEQ ID NO: 167455 - protein, 10 aa, Mycobacterium bovis
ADAAATAQTS

SEQ ID NO: 167456 - protein, 12 aa, Mycobacterium bovis
ADAAHSTKERGK

SEQ ID NO: 167457 - protein, 9 aa, Mycobacterium bovis
ADAANIPYD

SEQ ID NO: 167458 - protein, 8 aa, Mycobacterium bovis
ADAARATY

SEQ ID NO: 167459 - protein, 6 aa, Mycobacterium bovis
ADAASV

SEQ ID NO: 167460 - protein, 5 aa, Mycobacterium bovis
ADADD

SEQ ID NO: 167461 - protein, 13 aa, Mycobacterium bovis
ADADDDHSDHDMG

SEQ ID NO: 167462 - protein, 6 aa, Mycobacterium bovis
ADADGV

SEQ ID NO: 167463 - protein, 16 aa, Mycobacterium bovis
ADADKALQQPQTRRRY

SEQ ID NO: 167464 - protein, 8 aa, Mycobacterium bovis
ADADPSAT

SEQ ID NO: 167465 - protein, 8 aa, Mycobacterium bovis
ADAEGVTK

SEQ ID NO: 167466 - protein, 5 aa, Mycobacterium bovis
ADAGP

SEQ ID NO: 167467 - protein, 8 aa, Mycobacterium bovis
ADAGPEQM

SEQ ID NO: 167468 - protein, 7 aa, Mycobacterium bovis
ADAGSGR

SEQ ID NO: 167469 - protein, 8 aa, Mycobacterium bovis
ADAGSRSQ

SEQ ID NO: 167470 - protein, 6 aa, Mycobacterium bovis
ADAGVS

SEQ ID NO: 167471 - protein, 8 aa, Mycobacterium bovis
ADAPDTRR

SEQ ID NO: 167472 - protein, 12 aa, Mycobacterium bovis
ADAPGADGPANL

SEQ ID NO: 167473 - protein, 9 aa, Mycobacterium bovis
ADAPLGPGQ

SEQ ID NO: 167474 - protein, 8 aa, Mycobacterium bovis
ADAPPTVS

SEQ ID NO: 167475 - protein, 8 aa, Mycobacterium bovis
ADAPQVAS

SEQ ID NO: 167476 - protein, 12 aa, Mycobacterium bovis
ADAPRVQQGTER

SEQ ID NO: 167477 - protein, 8 aa, Mycobacterium bovis
ADARGADA

SEQ ID NO: 167478 - protein, 12 aa, Mycobacterium bovis
ADARGLTANEPS

SEQ ID NO: 167479 - protein, 8 aa, Mycobacterium bovis
ADARPQDD

SEQ ID NO: 167480 - protein, 4 aa, Mycobacterium bovis
ADAT

SEQ ID NO: 167481 - protein, 7 aa, Mycobacterium bovis
ADATAAA

SEQ ID NO: 167482 - protein, 14 aa, Mycobacterium bovis
ADATAAKAAAAGGQ

SEQ ID NO: 167483 - protein, 7 aa, Mycobacterium bovis
ADAVDDE

SEQ ID NO: 167484 - protein, 21 aa, Mycobacterium bovis
ADAVDGAAAPLAGTTSQPALS

SEQ ID NO: 167485 - protein, 6 aa, Mycobacterium bovis
ADAVEN

SEQ ID NO: 167486 - protein, 8 aa, Mycobacterium bovis
ADAVETNT

SEQ ID NO: 167487 - protein, 5 aa, Mycobacterium bovis
ADCAA

SEQ ID NO: 167488 - protein, 4 aa, Mycobacterium bovis
ADDA

SEQ ID NO: 167489 - protein, 12 aa, Mycobacterium bovis
ADDAPDQPPQKN

SEQ ID NO: 167490 - protein, 7 aa, Mycobacterium bovis
ADDAQPK

SEQ ID NO: 167491 - protein, 13 aa, Mycobacterium bovis
ADDDADDSAPHET

SEQ ID NO: 167492 - protein, 7 aa, Mycobacterium bovis
ADDDEDA

SEQ ID NO: 167493 - protein, 8 aa, Mycobacterium bovis
ADDEIQPI

SEQ ID NO: 167494 - protein, 11 aa, Mycobacterium bovis
ADDGGSSGRLR

SEQ ID NO: 167495 - protein, 6 aa, Mycobacterium bovis
ADDGTW

SEQ ID NO: 167496 - protein, 4 aa, Mycobacterium bovis
ADDL

SEQ ID NO: 167497 - protein, 9 aa, Mycobacterium bovis
ADDNDIDKG

SEQ ID NO: 167498 - protein, 5 aa, Mycobacterium bovis
ADDNR

SEQ ID NO: 167499 - protein, 4 aa, Mycobacterium bovis
ADDP

SEQ ID NO: 167500 - protein, 9 aa, Mycobacterium bovis
ADDPAAQVT

SEQ ID NO: 167501 - protein, 9 aa, Mycobacterium bovis
ADDPAENES

SEQ ID NO: 167502 - protein, 7 aa, Mycobacterium bovis
ADDPAHA

SEQ ID NO: 167503 - protein, 7 aa, Mycobacterium bovis
ADDPGTL

SEQ ID NO: 167504 - protein, 12 aa, Mycobacterium bovis
ADDPKRARRETR

SEQ ID NO: 167505 - protein, 7 aa, Mycobacterium bovis
ADDPLQL

SEQ ID NO: 167506 - protein, 6 aa, Mycobacterium bovis
ADDPMR

SEQ ID NO: 167507 - protein, 12 aa, Mycobacterium bovis
ADDQSPAPALNE

SEQ ID NO: 167508 - protein, 5 aa, Mycobacterium bovis
ADDRL

SEQ ID NO: 167509 - protein, 7 aa, Mycobacterium bovis
ADDRPGA

SEQ ID NO: 167510 - protein, 7 aa, Mycobacterium bovis
ADDRSDA

SEQ ID NO: 167511 - protein, 7 aa, Mycobacterium bovis
ADDRSDV

SEQ ID NO: 167512 - protein, 7 aa, Mycobacterium bovis
ADDRTGF

SEQ ID NO: 167513 - protein, 5 aa, Mycobacterium bovis
ADDSR

SEQ ID NO: 167514 - protein, 15 aa, Mycobacterium bovis
ADDSTPPADWEKPLD

SEQ ID NO: 167515 - protein, 4 aa, Mycobacterium bovis
ADDT

SEQ ID NO: 167516 - protein, 7 aa, Mycobacterium bovis
ADDVPDG

SEQ ID NO: 167517 - protein, 6 aa, Mycobacterium bovis
ADEAPG

SEQ ID NO: 167518 - protein, 12 aa, Mycobacterium bovis
ADEARAAGRDVG

SEQ ID NO: 167519 - protein, 10 aa, Mycobacterium bovis
ADEDATVPVG

SEQ ID NO: 167520 - protein, 9 aa, Mycobacterium bovis
ADEDERDRA

SEQ ID NO: 167521 - protein, 11 aa, Mycobacterium bovis
ADEDGRTMTER

SEQ ID NO: 167522 - protein, 8 aa, Mycobacterium bovis
ADEERGLG

SEQ ID NO: 167523 - protein, 4 aa, Mycobacterium bovis
ADEF

SEQ ID NO: 167524 - protein, 4 aa, Mycobacterium bovis
ADEG

SEQ ID NO: 167525 - protein, 5 aa, Mycobacterium bovis
ADENL

SEQ ID NO: 167526 - protein, 13 aa, Mycobacterium bovis
ADEPCSLDNERPA

SEQ ID NO: 167527 - protein, 6 aa, Mycobacterium bovis
ADEPPR

SEQ ID NO: 167528 - protein, 19 aa, Mycobacterium bovis
ADEPSGLRDPVPAADLLIL

SEQ ID NO: 167529 - protein, 9 aa, Mycobacterium bovis
ADEQARAAK

SEQ ID NO: 167530 - protein, 8 aa, Mycobacterium bovis
ADEQPFSD

SEQ ID NO: 167531 - protein, 5 aa, Mycobacterium bovis
ADEQR

SEQ ID NO: 167532 - protein, 6 aa, Mycobacterium bovis
ADEQRS

SEQ ID NO: 167533 - protein, 6 aa, Mycobacterium bovis
ADERAA

SEQ ID NO: 167534 - protein, 7 aa, Mycobacterium bovis
ADESDGS

SEQ ID NO: 167535 - protein, 7 aa, Mycobacterium bovis
ADESGHR

SEQ ID NO: 167536 - protein, 7 aa, Mycobacterium bovis
ADESPRS

SEQ ID NO: 167537 - protein, 5 aa, Mycobacterium bovis
ADESR

SEQ ID NO: 167538 - protein, 6 aa, Mycobacterium bovis
ADESSV

SEQ ID NO: 167539 - protein, 5 aa, Mycobacterium bovis
ADESV

SEQ ID NO: 167540 - protein, 4 aa, Mycobacterium bovis
ADET

SEQ ID NO: 167541 - protein, 6 aa, Mycobacterium bovis
ADETER

SEQ ID NO: 167542 - protein, 8 aa, Mycobacterium bovis
ADETGTSA

SEQ ID NO: 167543 - protein, 10 aa, Mycobacterium bovis
ADEVSGSGLA

SEQ ID NO: 167544 - protein, 7 aa, Mycobacterium bovis
ADEVSSA

SEQ ID NO: 167545 - protein, 7 aa, Mycobacterium bovis
ADFADPD

SEQ ID NO: 167546 - protein, 13 aa, Mycobacterium bovis
ADFATPANLSGLS

SEQ ID NO: 167547 - protein, 6 aa, Mycobacterium bovis
ADFGGS

SEQ ID NO: 167548 - protein, 8 aa, Mycobacterium bovis
ADFRQPGH

SEQ ID NO: 167549 - protein, 6 aa, Mycobacterium bovis
ADFSGT

SEQ ID NO: 167550 - protein, 13 aa, Mycobacterium bovis
ADGASETSRRLCA

SEQ ID NO: 167551 - protein, 5 aa, Mycobacterium bovis
ADGAT

SEQ ID NO: 167552 - protein, 8 aa, Mycobacterium bovis
ADGDGEPV

SEQ ID NO: 167553 - protein, 5 aa, Mycobacterium bovis
ADGDL

SEQ ID NO: 167554 - protein, 5 aa, Mycobacterium bovis
ADGDN

SEQ ID NO: 167555 - protein, 7 aa, Mycobacterium bovis
ADGEATV

SEQ ID NO: 167556 - protein, 8 aa, Mycobacterium bovis
ADGEHHKE

SEQ ID NO: 167557 - protein, 6 aa, Mycobacterium bovis
ADGERM

SEQ ID NO: 167558 - protein, 4 aa, Mycobacterium bovis
ADGG

SEQ ID NO: 167559 - protein, 7 aa, Mycobacterium bovis
ADGGARV

SEQ ID NO: 167560 - protein, 6 aa, Mycobacterium bovis
ADGGEE

SEQ ID NO: 167561 - protein, 8 aa, Mycobacterium bovis
ADGGGGSI

SEQ ID NO: 167562 - protein, 6 aa, Mycobacterium bovis
ADGGSV

SEQ ID NO: 167563 - protein, 9 aa, Mycobacterium bovis
ADGGTRTAA

SEQ ID NO: 167564 - protein, 9 aa, Mycobacterium bovis
ADGKAKWSA

SEQ ID NO: 167565 - protein, 16 aa, Mycobacterium bovis
ADGKSLNVAGSDNTLT

SEQ ID NO: 167566 - protein, 7 aa, Mycobacterium bovis
ADGLDGD

SEQ ID NO: 167567 - protein, 63 aa, Mycobacterium bovis
ADGNGGSAGLIGSGGAGGDGGSGGATGAGGEGGDAGASGSINGNAGDPGNSGERGAVGKPGAP

SEQ ID NO: 167568 - protein, 6 aa, Mycobacterium bovis
ADGPAL

SEQ ID NO: 167569 - protein, 10 aa, Mycobacterium bovis
ADGPSQNDEA

SEQ ID NO: 167570 - protein, 5 aa, Mycobacterium bovis
ADGPT

SEQ ID NO: 167571 - protein, 7 aa, Mycobacterium bovis
ADGQAFR

SEQ ID NO: 167572 - protein, 7 aa, Mycobacterium bovis
ADGQRPR

SEQ ID NO: 167573 - protein, 4 aa, Mycobacterium bovis
ADGR

SEQ ID NO: 167574 - protein, 7 aa, Mycobacterium bovis
ADGSEYR

SEQ ID NO: 167575 - protein, 7 aa, Mycobacterium bovis
ADGSLAP

SEQ ID NO: 167576 - protein, 5 aa, Mycobacterium bovis
ADGSP

SEQ ID NO: 167577 - protein, 6 aa, Mycobacterium bovis
ADGSSV

SEQ ID NO: 167578 - protein, 9 aa, Mycobacterium bovis
ADGTAGSTG

SEQ ID NO: 167579 - protein, 7 aa, Mycobacterium bovis
ADGTELA

SEQ ID NO: 167580 - protein, 14 aa, Mycobacterium bovis
ADGTEVATSPLATE

SEQ ID NO: 167581 - protein, 14 aa, Mycobacterium bovis
ADGTKFGKSTGGGS

SEQ ID NO: 167582 - protein, 7 aa, Mycobacterium bovis
ADGTPLA

SEQ ID NO: 167583 - protein, 11 aa, Mycobacterium bovis
ADGTSWDPTEL

SEQ ID NO: 167584 - protein, 6 aa, Mycobacterium bovis
ADGTTD

SEQ ID NO: 167585 - protein, 4 aa, Mycobacterium bovis
ADGV

SEQ ID NO: 167586 - protein, 14 aa, Mycobacterium bovis
ADGVADENRRDDLE

SEQ ID NO: 167587 - protein, 10 aa, Mycobacterium bovis
ADGVRAGRAM

SEQ ID NO: 167588 - protein, 14 aa, Mycobacterium bovis
ADGVRSDVETLRGR

SEQ ID NO: 167589 - protein, 11 aa, Mycobacterium bovis
ADGYSRSGAGF

SEQ ID NO: 167590 - protein, 10 aa, Mycobacterium bovis
ADHDYKDGPD

SEQ ID NO: 167591 - protein, 6 aa, Mycobacterium bovis
ADHGDP

SEQ ID NO: 167592 - protein, 7 aa, Mycobacterium bovis
ADHHEAS

SEQ ID NO: 167593 - protein, 5 aa, Mycobacterium bovis
ADHHP

SEQ ID NO: 167594 - protein, 10 aa, Mycobacterium bovis
ADHPARGEQD

SEQ ID NO: 167595 - protein, 7 aa, Mycobacterium bovis
ADHPGQP

SEQ ID NO: 167596 - protein, 6 aa, Mycobacterium bovis
ADHTYG

SEQ ID NO: 167597 - protein, 21 aa, Mycobacterium bovis
ADIDGVTDAEDRVDELGAREQ

SEQ ID NO: 167598 - protein, 5 aa, Mycobacterium bovis
ADIKG

SEQ ID NO: 167599 - protein, 5 aa, Mycobacterium bovis
ADIPS

SEQ ID NO: 167600 - protein, 9 aa, Mycobacterium bovis
ADISTATLN

SEQ ID NO: 167601 - protein, 4 aa, Mycobacterium bovis
ADIT

SEQ ID NO: 167602 - protein, 10 aa, Mycobacterium bovis
ADIVGPGEGI

SEQ ID NO: 167603 - protein, 17 aa, Mycobacterium bovis
ADKDPAEADTIDAVRAL

SEQ ID NO: 167604 - protein, 7 aa, Mycobacterium bovis
ADKEADY

SEQ ID NO: 167605 - protein, 9 aa, Mycobacterium bovis
ADKGEPAAY

SEQ ID NO: 167606 - protein, 21 aa, Mycobacterium bovis
ADKPEKEKASVPGGGDMGGMD

SEQ ID NO: 167607 - protein, 8 aa, Mycobacterium bovis
ADKPPPEA

SEQ ID NO: 167608 - protein, 12 aa, Mycobacterium bovis
ADKVRGGYYTPP

SEQ ID NO: 167609 - protein, 13 aa, Mycobacterium bovis
ADLADPQERSKLA

SEQ ID NO: 167610 - protein, 26 aa, Mycobacterium bovis
ADLAGSNNTTIKGADSFGPPSISTKE

SEQ ID NO: 167611 - protein, 6 aa, Mycobacterium bovis
ADLGGT

SEQ ID NO: 167612 - protein, 28 aa, Mycobacterium bovis
ADLGPRRALTGEPLAPQLTATATAQRQG

SEQ ID NO: 167613 - protein, 12 aa, Mycobacterium bovis
ADLGRTVTAADT

SEQ ID NO: 167614 - protein, 6 aa, Mycobacterium bovis
ADLPAG

SEQ ID NO: 167615 - protein, 23 aa, Mycobacterium bovis
ADLPGSTTDIDHPPRPGDAPWST

SEQ ID NO: 167616 - protein, 6 aa, Mycobacterium bovis
ADLPPA

SEQ ID NO: 167617 - protein, 14 aa, Mycobacterium bovis
ADLPSALTTPEAPT

SEQ ID NO: 167618 - protein, 7 aa, Mycobacterium bovis
ADLSGEE

SEQ ID NO: 167619 - protein, 7 aa, Mycobacterium bovis
ADLTNRS

SEQ ID NO: 167620 - protein, 4 aa, Mycobacterium bovis
ADLV

SEQ ID NO: 167621 - protein, 6 aa, Mycobacterium bovis
ADMKSG

SEQ ID NO: 167622 - protein, 6 aa, Mycobacterium bovis
ADNAPI

SEQ ID NO: 167623 - protein, 7 aa, Mycobacterium bovis
ADNASAA

SEQ ID NO: 167624 - protein, 14 aa, Mycobacterium bovis
ADNCPNPACGSDTL

SEQ ID NO: 167625 - protein, 9 aa, Mycobacterium bovis
ADNGATQVV

SEQ ID NO: 167626 - protein, 9 aa, Mycobacterium bovis
ADNGHSRVG

SEQ ID NO: 167627 - protein, 4 aa, Mycobacterium bovis
ADNP

SEQ ID NO: 167628 - protein, 8 aa, Mycobacterium bovis
ADNTDIDG

SEQ ID NO: 167629 - protein, 13 aa, Mycobacterium bovis
ADPAAHPLGTPSG

SEQ ID NO: 167630 - protein, 7 aa, Mycobacterium bovis
ADPAARD

SEQ ID NO: 167631 - protein, 7 aa, Mycobacterium bovis
ADPAEDL

SEQ ID NO: 167632 - protein, 15 aa, Mycobacterium bovis
ADPAKLAQAYQDGGA

SEQ ID NO: 167633 - protein, 6 aa, Mycobacterium bovis
ADPAPL

SEQ ID NO: 167634 - protein, 5 aa, Mycobacterium bovis
ADPAR

SEQ ID NO: 167635 - protein, 4 aa, Mycobacterium bovis
ADPD

SEQ ID NO: 167636 - protein, 20 aa, Mycobacterium bovis
ADPDWQSGDYHETGRAPDAG

SEQ ID NO: 167637 - protein, 4 aa, Mycobacterium bovis
ADPE

SEQ ID NO: 167638 - protein, 7 aa, Mycobacterium bovis
ADPEAKG

SEQ ID NO: 167639 - protein, 15 aa, Mycobacterium bovis
ADPEGSVYSGGAGRP

SEQ ID NO: 167640 - protein, 7 aa, Mycobacterium bovis
ADPEGVP

SEQ ID NO: 167641 - protein, 17 aa, Mycobacterium bovis
ADPERRRRYQQARGKGG

SEQ ID NO: 167642 - protein, 13 aa, Mycobacterium bovis
ADPESTAALPDGA

SEQ ID NO: 167643 - protein, 8 aa, Mycobacterium bovis
ADPETGSA

SEQ ID NO: 167644 - protein, 5 aa, Mycobacterium bovis
ADPEV

SEQ ID NO: 167645 - protein, 7 aa, Mycobacterium bovis
ADPGAAF

SEQ ID NO: 167646 - protein, 6 aa, Mycobacterium bovis
ADPGGG

SEQ ID NO: 167647 - protein, 7 aa, Mycobacterium bovis
ADPGGPV

SEQ ID NO: 167648 - protein, 5 aa, Mycobacterium bovis
ADPGM

SEQ ID NO: 167649 - protein, 6 aa, Mycobacterium bovis
ADPGYP

SEQ ID NO: 167650 - protein, 7 aa, Mycobacterium bovis
ADPHPIS

SEQ ID NO: 167651 - protein, 6 aa, Mycobacterium bovis
ADPKSV

SEQ ID NO: 167652 - protein, 7 aa, Mycobacterium bovis
ADPKTEL

SEQ ID NO: 167653 - protein, 7 aa, Mycobacterium bovis
ADPLGGA

SEQ ID NO: 167654 - protein, 8 aa, Mycobacterium bovis
ADPLPAGA

SEQ ID NO: 167655 - protein, 7 aa, Mycobacterium bovis
ADPLSER

SEQ ID NO: 167656 - protein, 7 aa, Mycobacterium bovis
ADPLTAS

SEQ ID NO: 167657 - protein, 8 aa, Mycobacterium bovis
ADPPMTKD

SEQ ID NO: 167658 - protein, 7 aa, Mycobacterium bovis
ADPQRAG

SEQ ID NO: 167659 - protein, 11 aa, Mycobacterium bovis
ADPQTAAQLGE

SEQ ID NO: 167660 - protein, 4 aa, Mycobacterium bovis
ADPR

SEQ ID NO: 167661 - protein, 6 aa, Mycobacterium bovis
ADPRDI

SEQ ID NO: 167662 - protein, 20 aa, Mycobacterium bovis
ADPREARGALTTPLPAPPAR

SEQ ID NO: 167663 - protein, 7 aa, Mycobacterium bovis
ADPRQTV

SEQ ID NO: 167664 - protein, 6 aa, Mycobacterium bovis
ADPRSR

SEQ ID NO: 167665 - protein, 5 aa, Mycobacterium bovis
ADPRV

SEQ ID NO: 167666 - protein, 16 aa, Mycobacterium bovis
ADPSFKGTLEDAEEAR

SEQ ID NO: 167667 - protein, 6 aa, Mycobacterium bovis
ADPSNF

SEQ ID NO: 167668 - protein, 7 aa, Mycobacterium bovis
ADPSQQL

SEQ ID NO: 167669 - protein, 7 aa, Mycobacterium bovis
ADPSRGR

SEQ ID NO: 167670 - protein, 8 aa, Mycobacterium bovis
ADPSRSVG

SEQ ID NO: 167671 - protein, 8 aa, Mycobacterium bovis
ADPSTGSI

SEQ ID NO: 167672 - protein, 9 aa, Mycobacterium bovis
ADPSWPDQA

SEQ ID NO: 167673 - protein, 4 aa, Mycobacterium bovis
ADPT

SEQ ID NO: 167674 - protein, 8 aa, Mycobacterium bovis
ADPTETNN

SEQ ID NO: 167675 - protein, 8 aa, Mycobacterium bovis
ADPTPAPG

SEQ ID NO: 167676 - protein, 14 aa, Mycobacterium bovis
ADPTPEDDPDPLNT

SEQ ID NO: 167677 - protein, 26 aa, Mycobacterium bovis
ADPTPTTGGPLLSSNGGYRDDSRLAT

SEQ ID NO: 167678 - protein, 9 aa, Mycobacterium bovis
ADPTSTKPA

SEQ ID NO: 167679 - protein, 8 aa, Mycobacterium bovis
ADPTTGAI

SEQ ID NO: 167680 - protein, 4 aa, Mycobacterium bovis
ADPV

SEQ ID NO: 167681 - protein, 8 aa, Mycobacterium bovis
ADPVDVDP

SEQ ID NO: 167682 - protein, 9 aa, Mycobacterium bovis
ADQAAQAGH

SEQ ID NO: 167683 - protein, 9 aa, Mycobacterium bovis
ADQAGQTSF

SEQ ID NO: 167684 - protein, 6 aa, Mycobacterium bovis
ADQARV

SEQ ID NO: 167685 - protein, 9 aa, Mycobacterium bovis
ADQDPVAGS

SEQ ID NO: 167686 - protein, 16 aa, Mycobacterium bovis
ADQGPTAKRIRPRAQG

SEQ ID NO: 167687 - protein, 5 aa, Mycobacterium bovis
ADQGR

SEQ ID NO: 167688 - protein, 17 aa, Mycobacterium bovis
ADQGRKDDIAFLRERTG

SEQ ID NO: 167689 - protein, 5 aa, Mycobacterium bovis
ADQIP

SEQ ID NO: 167690 - protein, 9 aa, Mycobacterium bovis
ADQKNPETL

SEQ ID NO: 167691 - protein, 5 aa, Mycobacterium bovis
ADQPA

SEQ ID NO: 167692 - protein, 11 aa, Mycobacterium bovis
ADQQGKPLTPP

SEQ ID NO: 167693 - protein, 18 aa, Mycobacterium bovis
ADQRPPQEELIADYSPWP

SEQ ID NO: 167694 - protein, 6 aa, Mycobacterium bovis
ADQVDQ

SEQ ID NO: 167695 - protein, 5 aa, Mycobacterium bovis
ADQVS

SEQ ID NO: 167696 - protein, 6 aa, Mycobacterium bovis
ADRAAL

SEQ ID NO: 167697 - protein, 9 aa, Mycobacterium bovis
ADRADRLRT

SEQ ID NO: 167698 - protein, 8 aa, Mycobacterium bovis
ADRARAEN

SEQ ID NO: 167699 - protein, 8 aa, Mycobacterium bovis
ADRASGAD

SEQ ID NO: 167700 - protein, 4 aa, Mycobacterium bovis
ADRD

SEQ ID NO: 167701 - protein, 9 aa, Mycobacterium bovis
ADRDAADAL

SEQ ID NO: 167702 - protein, 6 aa, Mycobacterium bovis
ADRDGV

SEQ ID NO: 167703 - protein, 4 aa, Mycobacterium bovis
ADRG

SEQ ID NO: 167704 - protein, 7 aa, Mycobacterium bovis
ADRGRTG

SEQ ID NO: 167705 - protein, 4 aa, Mycobacterium bovis
ADRK

SEQ ID NO: 167706 - protein, 6 aa, Mycobacterium bovis
ADRKGG

SEQ ID NO: 167707 - protein, 17 aa, Mycobacterium bovis
ADRKRGACAGRGGSAPS

SEQ ID NO: 167708 - protein, 9 aa, Mycobacterium bovis
ADRNPPVFD

SEQ ID NO: 167709 - protein, 16 aa, Mycobacterium bovis
ADRNSGAGPKDPSPAG

SEQ ID NO: 167710 - protein, 13 aa, Mycobacterium bovis
ADRQSEPGLPPLS

SEQ ID NO: 167711 - protein, 14 aa, Mycobacterium bovis
ADRQVRPVAPGSKA

SEQ ID NO: 167712 - protein, 5 aa, Mycobacterium bovis
ADRRA

SEQ ID NO: 167713 - protein, 8 aa, Mycobacterium bovis
ADRRADGE

SEQ ID NO: 167714 - protein, 6 aa, Mycobacterium bovis
ADRRPG

SEQ ID NO: 167715 - protein, 6 aa, Mycobacterium bovis
ADRRYS

SEQ ID NO: 167716 - protein, 8 aa, Mycobacterium bovis
ADRSRAGK

SEQ ID NO: 167717 - protein, 31 aa, Mycobacterium bovis
ADRSRREEHRAAQTARKEALAAEAEELAANA

SEQ ID NO: 167718 - protein, 16 aa, Mycobacterium bovis
ADRSSLRQLHAAIKAA

SEQ ID NO: 167719 - protein, 8 aa, Mycobacterium bovis
ADRTDEAR

SEQ ID NO: 167720 - protein, 9 aa, Mycobacterium bovis
ADRTDTDEH

SEQ ID NO: 167721 - protein, 25 aa, Mycobacterium bovis
ADSAARRPAPAPADGGDIGDGGGAG

SEQ ID NO: 167722 - protein, 9 aa, Mycobacterium bovis
ADSDDEDAL

SEQ ID NO: 167723 - protein, 5 aa, Mycobacterium bovis
ADSDL

SEQ ID NO: 167724 - protein, 9 aa, Mycobacterium bovis
ADSETPLSA

SEQ ID NO: 167725 - protein, 6 aa, Mycobacterium bovis
ADSGAK

SEQ ID NO: 167726 - protein, 6 aa, Mycobacterium bovis
ADSGVT

SEQ ID NO: 167727 - protein, 19 aa, Mycobacterium bovis
ADSLRKDSAKVSIKDGPWG

SEQ ID NO: 167728 - protein, 10 aa, Mycobacterium bovis
ADSPPDQQGP

SEQ ID NO: 167729 - protein, 8 aa, Mycobacterium bovis
ADSQSNEL

SEQ ID NO: 167730 - protein, 11 aa, Mycobacterium bovis
ADSTGVRASTD

SEQ ID NO: 167731 - protein, 11 aa, Mycobacterium bovis
ADSTRRAEEDR

SEQ ID NO: 167732 - protein, 8 aa, Mycobacterium bovis
ADSYDEQG

SEQ ID NO: 167733 - protein, 7 aa, Mycobacterium bovis
ADTAAAA

SEQ ID NO: 167734 - protein, 18 aa, Mycobacterium bovis
ADTAEHGHDDEYDEFSDP

SEQ ID NO: 167735 - protein, 8 aa, Mycobacterium bovis
ADTAESYP

SEQ ID NO: 167736 - protein, 12 aa, Mycobacterium bovis
ADTARGGRGSGL

SEQ ID NO: 167737 - protein, 9 aa, Mycobacterium bovis
ADTATPTAA

SEQ ID NO: 167738 - protein, 6 aa, Mycobacterium bovis
ADTDGS

SEQ ID NO: 167739 - protein, 4 aa, Mycobacterium bovis
ADTE

SEQ ID NO: 167740 - protein, 9 aa, Mycobacterium bovis
ADTEPGDGK

SEQ ID NO: 167741 - protein, 10 aa, Mycobacterium bovis
ADTGEPDDWD

SEQ ID NO: 167742 - protein, 7 aa, Mycobacterium bovis
ADTGIFP

SEQ ID NO: 167743 - protein, 5 aa, Mycobacterium bovis
ADTGL

SEQ ID NO: 167744 - protein, 9 aa, Mycobacterium bovis
ADTHATAEA

SEQ ID NO: 167745 - protein, 5 aa, Mycobacterium bovis
ADTLA

SEQ ID NO: 167746 - protein, 5 aa, Mycobacterium bovis
ADTPH

SEQ ID NO: 167747 - protein, 13 aa, Mycobacterium bovis
ADTPVQPGIPGRT

SEQ ID NO: 167748 - protein, 6 aa, Mycobacterium bovis
ADTQAE

SEQ ID NO: 167749 - protein, 7 aa, Mycobacterium bovis
ADTRDAS

SEQ ID NO: 167750 - protein, 8 aa, Mycobacterium bovis
ADTRSRAT

SEQ ID NO: 167751 - protein, 4 aa, Mycobacterium bovis
ADTT

SEQ ID NO: 167752 - protein, 7 aa, Mycobacterium bovis
ADTTPKG

SEQ ID NO: 167753 - protein, 7 aa, Mycobacterium bovis
ADTTSTI

SEQ ID NO: 167754 - protein, 12 aa, Mycobacterium bovis
ADTWPPPATTQS

SEQ ID NO: 167755 - protein, 20 aa, Mycobacterium bovis
ADVAAADAARAAADSDGTQL

SEQ ID NO: 167756 - protein, 7 aa, Mycobacterium bovis
ADVAAGR

SEQ ID NO: 167757 - protein, 9 aa, Mycobacterium bovis
ADVDAENTL

SEQ ID NO: 167758 - protein, 6 aa, Mycobacterium bovis
ADVDDD

SEQ ID NO: 167759 - protein, 8 aa, Mycobacterium bovis
ADVDPGPA

SEQ ID NO: 167760 - protein, 11 aa, Mycobacterium bovis
ADVDSQPGPVR

SEQ ID NO: 167761 - protein, 4 aa, Mycobacterium bovis
ADVE

SEQ ID NO: 167762 - protein, 14 aa, Mycobacterium bovis
ADVKPSDGGSTEDG

SEQ ID NO: 167763 - protein, 10 aa, Mycobacterium bovis
ADVNGSGSPL

SEQ ID NO: 167764 - protein, 8 aa, Mycobacterium bovis
ADVPDQSG

SEQ ID NO: 167765 - protein, 8 aa, Mycobacterium bovis
ADVPPPAM

SEQ ID NO: 167766 - protein, 8 aa, Mycobacterium bovis
ADVRPGDD

SEQ ID NO: 167767 - protein, 6 aa, Mycobacterium bovis
ADVRSG

SEQ ID NO: 167768 - protein, 6 aa, Mycobacterium bovis
ADVVGS

SEQ ID NO: 167769 - protein, 5 aa, Mycobacterium bovis
ADWPD

SEQ ID NO: 167770 - protein, 15 aa, Mycobacterium bovis
ADYAPTPDAPTGEDR

SEQ ID NO: 167771 - protein, 19 aa, Mycobacterium bovis
ADYDDYRRAAGPADHTAPP

SEQ ID NO: 167772 - protein, 7 aa, Mycobacterium bovis
ADYGGDP

SEQ ID NO: 167773 - protein, 5 aa, Mycobacterium bovis
ADYRP

SEQ ID NO: 167774 - protein, 8 aa, Mycobacterium bovis
AEAAENGC

SEQ ID NO: 167775 - protein, 10 aa, Mycobacterium bovis
AEAAKYQPQP

SEQ ID NO: 167776 - protein, 11 aa, Mycobacterium bovis
AEADGVKPPTA

SEQ ID NO: 167777 - protein, 6 aa, Mycobacterium bovis
AEADQA

SEQ ID NO: 167778 - protein, 18 aa, Mycobacterium bovis
AEAEAEVQRSVERFKAGT

SEQ ID NO: 167779 - protein, 8 aa, Mycobacterium bovis
AEAEGTDL

SEQ ID NO: 167780 - protein, 8 aa, Mycobacterium bovis
AEAEKTRK

SEQ ID NO: 167781 - protein, 6 aa, Mycobacterium bovis
AEAERR

SEQ ID NO: 167782 - protein, 4 aa, Mycobacterium bovis
AEAG

SEQ ID NO: 167783 - protein, 8 aa, Mycobacterium bovis
AEAGGIDE

SEQ ID NO: 167784 - protein, 8 aa, Mycobacterium bovis
AEAGKDAA

SEQ ID NO: 167785 - protein, 6 aa, Mycobacterium bovis
AEAGKQ

SEQ ID NO: 167786 - protein, 11 aa, Mycobacterium bovis
AEAGRAPGAIH

SEQ ID NO: 167787 - protein, 4 aa, Mycobacterium bovis
AEAH

SEQ ID NO: 167788 - protein, 6 aa, Mycobacterium bovis
AEAKPD

SEQ ID NO: 167789 - protein, 9 aa, Mycobacterium bovis
AEALPGPLT

SEQ ID NO: 167790 - protein, 12 aa, Mycobacterium bovis
AEAMSDEKSASP

SEQ ID NO: 167791 - protein, 12 aa, Mycobacterium bovis
AEANDGRPPGCE

SEQ ID NO: 167792 - protein, 6 aa, Mycobacterium bovis
AEANRA

SEQ ID NO: 167793 - protein, 6 aa, Mycobacterium bovis
AEAPED

SEQ ID NO: 167794 - protein, 10 aa, Mycobacterium bovis
AEAPHSSAVH

SEQ ID NO: 167795 - protein, 6 aa, Mycobacterium bovis
AEAQAE

SEQ ID NO: 167796 - protein, 18 aa, Mycobacterium bovis
AEAQDALRAEDAEPAASA

SEQ ID NO: 167797 - protein, 10 aa, Mycobacterium bovis
AEAQRAAAGR

SEQ ID NO: 167798 - protein, 8 aa, Mycobacterium bovis
AEAQRGPM

SEQ ID NO: 167799 - protein, 5 aa, Mycobacterium bovis
AEAQV

SEQ ID NO: 167800 - protein, 7 aa, Mycobacterium bovis
AEARHPP

SEQ ID NO: 167801 - protein, 16 aa, Mycobacterium bovis
AEARREKESAIDAQDF

SEQ ID NO: 167802 - protein, 12 aa, Mycobacterium bovis
AEARTASEKDVK

SEQ ID NO: 167803 - protein, 23 aa, Mycobacterium bovis
AEASGQLKPGGTIVEPTSGNTGV

SEQ ID NO: 167804 - protein, 6 aa, Mycobacterium bovis
AEASGV

SEQ ID NO: 167805 - protein, 6 aa, Mycobacterium bovis
AEASMS

SEQ ID NO: 167806 - protein, 6 aa, Mycobacterium bovis
AEATDH

SEQ ID NO: 167807 - protein, 7 aa, Mycobacterium bovis
AEATPQV

SEQ ID NO: 167808 - protein, 7 aa, Mycobacterium bovis
AEATRDG

SEQ ID NO: 167809 - protein, 7 aa, Mycobacterium bovis
AEAVAGQ

SEQ ID NO: 167810 - protein, 5 aa, Mycobacterium bovis
AEAVE

SEQ ID NO: 167811 - protein, 12 aa, Mycobacterium bovis
AEAVQRARDSVD

SEQ ID NO: 167812 - protein, 15 aa, Mycobacterium bovis
AECADDQGARCHLGQ

SEQ ID NO: 167813 - protein, 12 aa, Mycobacterium bovis
AECRDDRAQEFP

SEQ ID NO: 167814 - protein, 106 aa, Mycobacterium bovis
AEDAADNADDGDDAHPEEADEAAEPKEATEPDEADEVDDADESVPAERAQDVAEEATLPPVAEPPPPAAPPVAEPPPPVAAPAPPGAPEPANGPSPEALSEGATPC

SEQ ID NO: 167815 - protein, 7 aa, Mycobacterium bovis
AEDDPAK

SEQ ID NO: 167816 - protein, 19 aa, Mycobacterium bovis
AEDGTDERATVDQTEAKAR

SEQ ID NO: 167817 - protein, 5 aa, Mycobacterium bovis
AEDLA

SEQ ID NO: 167818 - protein, 6 aa, Mycobacterium bovis
AEDLPP

SEQ ID NO: 167819 - protein, 5 aa, Mycobacterium bovis
AEDPA

SEQ ID NO: 167820 - protein, 7 aa, Mycobacterium bovis
AEDPAVS

SEQ ID NO: 167821 - protein, 15 aa, Mycobacterium bovis
AEDPDEDDAAANRAK

SEQ ID NO: 167822 - protein, 8 aa, Mycobacterium bovis
AEDPFEGE

SEQ ID NO: 167823 - protein, 9 aa, Mycobacterium bovis
AEDPPAKAR

SEQ ID NO: 167824 - protein, 6 aa, Mycobacterium bovis
AEDPRA

SEQ ID NO: 167825 - protein, 6 aa, Mycobacterium bovis
AEDPRV

SEQ ID NO: 167826 - protein, 5 aa, Mycobacterium bovis
AEDPT

SEQ ID NO: 167827 - protein, 10 aa, Mycobacterium bovis
AEDPTRKPEF

SEQ ID NO: 167828 - protein, 7 aa, Mycobacterium bovis
AEDPVKV

SEQ ID NO: 167829 - protein, 7 aa, Mycobacterium bovis
AEDREIP

SEQ ID NO: 167830 - protein, 12 aa, Mycobacterium bovis
AEDTSGATPQNP

SEQ ID NO: 167831 - protein, 4 aa, Mycobacterium bovis
AEEA

SEQ ID NO: 167832 - protein, 21 aa, Mycobacterium bovis
AEEAALEEGLEGAGLSELGAA

SEQ ID NO: 167833 - protein, 7 aa, Mycobacterium bovis
AEEAARE

SEQ ID NO: 167834 - protein, 7 aa, Mycobacterium bovis
AEEAGPD

SEQ ID NO: 167835 - protein, 4 aa, Mycobacterium bovis
AEED

SEQ ID NO: 167836 - protein, 6 aa, Mycobacterium bovis
AEEDPT

SEQ ID NO: 167837 - protein, 20 aa, Mycobacterium bovis
AEEELPAEATEAIEALIRQI

SEQ ID NO: 167838 - protein, 12 aa, Mycobacterium bovis
AEEELSRLLLPS

SEQ ID NO: 167839 - protein, 9 aa, Mycobacterium bovis
AEEEPDGAL

SEQ ID NO: 167840 - protein, 5 aa, Mycobacterium bovis
AEEEV

SEQ ID NO: 167841 - protein, 6 aa, Mycobacterium bovis
AEEGTS

SEQ ID NO: 167842 - protein, 4 aa, Mycobacterium bovis
AEEL

SEQ ID NO: 167843 - protein, 8 aa, Mycobacterium bovis
AEELAKTD

SEQ ID NO: 167844 - protein, 9 aa, Mycobacterium bovis
AEELDGRTI

SEQ ID NO: 167845 - protein, 4 aa, Mycobacterium bovis
AEEN

SEQ ID NO: 167846 - protein, 6 aa, Mycobacterium bovis
AEENRH

SEQ ID NO: 167847 - protein, 5 aa, Mycobacterium bovis
AEEPA

SEQ ID NO: 167848 - protein, 6 aa, Mycobacterium bovis
AEEPRL

SEQ ID NO: 167849 - protein, 5 aa, Mycobacterium bovis
AEEPT

SEQ ID NO: 167850 - protein, 16 aa, Mycobacterium bovis
AEERGYTATKHQREVG

SEQ ID NO: 167851 - protein, 6 aa, Mycobacterium bovis
AEERRR

SEQ ID NO: 167852 - protein, 8 aa, Mycobacterium bovis
AEESSGVR

SEQ ID NO: 167853 - protein, 14 aa, Mycobacterium bovis
AEETAAAVGSTTGA

SEQ ID NO: 167854 - protein, 12 aa, Mycobacterium bovis
AEETLPQPVRDA

SEQ ID NO: 167855 - protein, 5 aa, Mycobacterium bovis
AEETN

SEQ ID NO: 167856 - protein, 8 aa, Mycobacterium bovis
AEEYGSHD

SEQ ID NO: 167857 - protein, 10 aa, Mycobacterium bovis
AEFASQGVPE

SEQ ID NO: 167858 - protein, 7 aa, Mycobacterium bovis
AEFASRQ

SEQ ID NO: 167859 - protein, 5 aa, Mycobacterium bovis
AEFDG

SEQ ID NO: 167860 - protein, 6 aa, Mycobacterium bovis
AEFSRG

SEQ ID NO: 167861 - protein, 4 aa, Mycobacterium bovis
AEGA

SEQ ID NO: 167862 - protein, 5 aa, Mycobacterium bovis
AEGAD

SEQ ID NO: 167863 - protein, 6 aa, Mycobacterium bovis
AEGAEE

SEQ ID NO: 167864 - protein, 7 aa, Mycobacterium bovis
AEGARLD

SEQ ID NO: 167865 - protein, 6 aa, Mycobacterium bovis
AEGATA

SEQ ID NO: 167866 - protein, 11 aa, Mycobacterium bovis
AEGDAAGGNQF

SEQ ID NO: 167867 - protein, 6 aa, Mycobacterium bovis
AEGDAE

SEQ ID NO: 167868 - protein, 16 aa, Mycobacterium bovis
AEGDSVNNYQASKQAD

SEQ ID NO: 167869 - protein, 6 aa, Mycobacterium bovis
AEGGAM

SEQ ID NO: 167870 - protein, 7 aa, Mycobacterium bovis
AEGGARP

SEQ ID NO: 167871 - protein, 10 aa, Mycobacterium bovis
AEGGEPAAGR

SEQ ID NO: 167872 - protein, 23 aa, Mycobacterium bovis
AEGGPGADGKLAEASAAIARLVR

SEQ ID NO: 167873 - protein, 12 aa, Mycobacterium bovis
AEGGSNTAVATA

SEQ ID NO: 167874 - protein, 19 aa, Mycobacterium bovis
AEGHRGATGWRAVGLPWRQ

SEQ ID NO: 167875 - protein, 8 aa, Mycobacterium bovis
AEGIPYDD

SEQ ID NO: 167876 - protein, 13 aa, Mycobacterium bovis
AEGKATELASREG

SEQ ID NO: 167877 - protein, 8 aa, Mycobacterium bovis
AEGLPGRR

SEQ ID NO: 167878 - protein, 5 aa, Mycobacterium bovis
AEGLR

SEQ ID NO: 167879 - protein, 7 aa, Mycobacterium bovis
AEGNHLG

SEQ ID NO: 167880 - protein, 5 aa, Mycobacterium bovis
AEGPI

SEQ ID NO: 167881 - protein, 5 aa, Mycobacterium bovis
AEGPV

SEQ ID NO: 167882 - protein, 5 aa, Mycobacterium bovis
AEGRA

SEQ ID NO: 167883 - protein, 12 aa, Mycobacterium bovis
AEGRPAAEHTQS

SEQ ID NO: 167884 - protein, 5 aa, Mycobacterium bovis
AEGRV

SEQ ID NO: 167885 - protein, 7 aa, Mycobacterium bovis
AEGSEIT

SEQ ID NO: 167886 - protein, 7 aa, Mycobacterium bovis
AEGSQVR

SEQ ID NO: 167887 - protein, 14 aa, Mycobacterium bovis
AEGTAGEGGEVSPK

SEQ ID NO: 167888 - protein, 9 aa, Mycobacterium bovis
AEGTNGSFP

SEQ ID NO: 167889 - protein, 4 aa, Mycobacterium bovis
AEGV

SEQ ID NO: 167890 - protein, 5 aa, Mycobacterium bovis
AEGVP

SEQ ID NO: 167891 - protein, 8 aa, Mycobacterium bovis
AEGYPGRR

SEQ ID NO: 167892 - protein, 5 aa, Mycobacterium bovis
AEHAH

SEQ ID NO: 167893 - protein, 8 aa, Mycobacterium bovis
AEHARESA

SEQ ID NO: 167894 - protein, 6 aa, Mycobacterium bovis
AEHDEL

SEQ ID NO: 167895 - protein, 7 aa, Mycobacterium bovis
AEHEGKP

SEQ ID NO: 167896 - protein, 26 aa, Mycobacterium bovis
AEHGGTVTAQRSRGTTSDATEHNAAA

SEQ ID NO: 167897 - protein, 9 aa, Mycobacterium bovis
AEHNAANDR

SEQ ID NO: 167898 - protein, 4 aa, Mycobacterium bovis
AEHP

SEQ ID NO: 167899 - protein, 6 aa, Mycobacterium bovis
AEHPLR

SEQ ID NO: 167900 - protein, 6 aa, Mycobacterium bovis
AEHPRD

SEQ ID NO: 167901 - protein, 7 aa, Mycobacterium bovis
AEHPSSG

SEQ ID NO: 167902 - protein, 18 aa, Mycobacterium bovis
AEHRPGRSTRRLEPRTLP

SEQ ID NO: 167903 - protein, 4 aa, Mycobacterium bovis
AEHT

SEQ ID NO: 167904 - protein, 4 aa, Mycobacterium bovis
AEIP

SEQ ID NO: 167905 - protein, 9 aa, Mycobacterium bovis
AEKAEPPVR

SEQ ID NO: 167906 - protein, 5 aa, Mycobacterium bovis
AEKEL

SEQ ID NO: 167907 - protein, 6 aa, Mycobacterium bovis
AEKGGY

SEQ ID NO: 167908 - protein, 8 aa, Mycobacterium bovis
AEKNTEEM

SEQ ID NO: 167909 - protein, 6 aa, Mycobacterium bovis
AEKPGQ

SEQ ID NO: 167910 - protein, 11 aa, Mycobacterium bovis
AEKQRADAGST

SEQ ID NO: 167911 - protein, 6 aa, Mycobacterium bovis
AEKSFA

SEQ ID NO: 167912 - protein, 8 aa, Mycobacterium bovis
AEKSFTSD

SEQ ID NO: 167913 - protein, 19 aa, Mycobacterium bovis
AEKSREFAEHGNRVYLPIT

SEQ ID NO: 167914 - protein, 10 aa, Mycobacterium bovis
AEKTQQTAIQ

SEQ ID NO: 167915 - protein, 6 aa, Mycobacterium bovis
AEKYTQ

SEQ ID NO: 167916 - protein, 10 aa, Mycobacterium bovis
AELAGNTDEH

SEQ ID NO: 167917 - protein, 8 aa, Mycobacterium bovis
AELGAEGA

SEQ ID NO: 167918 - protein, 4 aa, Mycobacterium bovis
AELP

SEQ ID NO: 167919 - protein, 13 aa, Mycobacterium bovis
AELPEATQADLRA

SEQ ID NO: 167920 - protein, 8 aa, Mycobacterium bovis
AELPGPPV

SEQ ID NO: 167921 - protein, 4 aa, Mycobacterium bovis
AELR

SEQ ID NO: 167922 - protein, 4 aa, Mycobacterium bovis
AELY

SEQ ID NO: 167923 - protein, 13 aa, Mycobacterium bovis
AENAARKAQDHGV

SEQ ID NO: 167924 - protein, 16 aa, Mycobacterium bovis
AENERTYGEFSTREGE

SEQ ID NO: 167925 - protein, 6 aa, Mycobacterium bovis
AENGHE

SEQ ID NO: 167926 - protein, 7 aa, Mycobacterium bovis
AENGRSW

SEQ ID NO: 167927 - protein, 7 aa, Mycobacterium bovis
AENPGYT

SEQ ID NO: 167928 - protein, 9 aa, Mycobacterium bovis
AENPPKKYQ

SEQ ID NO: 167929 - protein, 5 aa, Mycobacterium bovis
AENQF

SEQ ID NO: 167930 - protein, 6 aa, Mycobacterium bovis
AENQTL

SEQ ID NO: 167931 - protein, 7 aa, Mycobacterium bovis
AENSGFT

SEQ ID NO: 167932 - protein, 8 aa, Mycobacterium bovis
AENTPYGR

SEQ ID NO: 167933 - protein, 4 aa, Mycobacterium bovis
AEPA

SEQ ID NO: 167934 - protein, 7 aa, Mycobacterium bovis
AEPAAPV

SEQ ID NO: 167935 - protein, 13 aa, Mycobacterium bovis
AEPAHPATPYPEP

SEQ ID NO: 167936 - protein, 8 aa, Mycobacterium bovis
AEPAIRPG

SEQ ID NO: 167937 - protein, 11 aa, Mycobacterium bovis
AEPAKRKPGYA

SEQ ID NO: 167938 - protein, 10 aa, Mycobacterium bovis
AEPARGRKRT

SEQ ID NO: 167939 - protein, 5 aa, Mycobacterium bovis
AEPAT

SEQ ID NO: 167940 - protein, 6 aa, Mycobacterium bovis
AEPDAL

SEQ ID NO: 167941 - protein, 7 aa, Mycobacterium bovis
AEPDGLE

SEQ ID NO: 167942 - protein, 6 aa, Mycobacterium bovis
AEPDHA

SEQ ID NO: 167943 - protein, 6 aa, Mycobacterium bovis
AEPEER

SEQ ID NO: 167944 - protein, 4 aa, Mycobacterium bovis
AEPG

SEQ ID NO: 167945 - protein, 7 aa, Mycobacterium bovis
AEPGKSL

SEQ ID NO: 167946 - protein, 4 aa, Mycobacterium bovis
AEPI

SEQ ID NO: 167947 - protein, 12 aa, Mycobacterium bovis
AEPIGSMGTDTP

SEQ ID NO: 167948 - protein, 12 aa, Mycobacterium bovis
AEPLSGSQGEGG

SEQ ID NO: 167949 - protein, 16 aa, Mycobacterium bovis
AEPNGRNINDGCGSTH

SEQ ID NO: 167950 - protein, 8 aa, Mycobacterium bovis
AEPPAGVR

SEQ ID NO: 167951 - protein, 5 aa, Mycobacterium bovis
AEPPC

SEQ ID NO: 167952 - protein, 6 aa, Mycobacterium bovis
AEPPQL

SEQ ID NO: 167953 - protein, 4 aa, Mycobacterium bovis
AEPQ

SEQ ID NO: 167954 - protein, 4 aa, Mycobacterium bovis
AEPS

SEQ ID NO: 167955 - protein, 11 aa, Mycobacterium bovis
AEPSASLSEVK

SEQ ID NO: 167956 - protein, 5 aa, Mycobacterium bovis
AEPTH

SEQ ID NO: 167957 - protein, 7 aa, Mycobacterium bovis
AEPTNSA

SEQ ID NO: 167958 - protein, 8 aa, Mycobacterium bovis
AEPVEPAD

SEQ ID NO: 167959 - protein, 9 aa, Mycobacterium bovis
AEPYQADPE

SEQ ID NO: 167960 - protein, 8 aa, Mycobacterium bovis
AEQAAARR

SEQ ID NO: 167961 - protein, 6 aa, Mycobacterium bovis
AEQAGQ

SEQ ID NO: 167962 - protein, 9 aa, Mycobacterium bovis
AEQAGVDVE

SEQ ID NO: 167963 - protein, 6 aa, Mycobacterium bovis
AEQAPH

SEQ ID NO: 167964 - protein, 8 aa, Mycobacterium bovis
AEQARELA

SEQ ID NO: 167965 - protein, 9 aa, Mycobacterium bovis
AEQARRGDG

SEQ ID NO: 167966 - protein, 4 aa, Mycobacterium bovis
AEQD

SEQ ID NO: 167967 - protein, 5 aa, Mycobacterium bovis
AEQFA

SEQ ID NO: 167968 - protein, 4 aa, Mycobacterium bovis
AEQG

SEQ ID NO: 167969 - protein, 5 aa, Mycobacterium bovis
AEQGR

SEQ ID NO: 167970 - protein, 9 aa, Mycobacterium bovis
AEQKGTGRW

SEQ ID NO: 167971 - protein, 10 aa, Mycobacterium bovis
AEQKHSIDDP

SEQ ID NO: 167972 - protein, 10 aa, Mycobacterium bovis
AEQKQRRARG

SEQ ID NO: 167973 - protein, 7 aa, Mycobacterium bovis
AEQLDDD

SEQ ID NO: 167974 - protein, 6 aa, Mycobacterium bovis
AEQRDS

SEQ ID NO: 167975 - protein, 6 aa, Mycobacterium bovis
AEQRER

SEQ ID NO: 167976 - protein, 7 aa, Mycobacterium bovis
AEQRGRR

SEQ ID NO: 167977 - protein, 5 aa, Mycobacterium bovis
AEQVG

SEQ ID NO: 167978 - protein, 4 aa, Mycobacterium bovis
AERA

SEQ ID NO: 167979 - protein, 5 aa, Mycobacterium bovis
AERAA

SEQ ID NO: 167980 - protein, 11 aa, Mycobacterium bovis
AERADPNFADR

SEQ ID NO: 167981 - protein, 7 aa, Mycobacterium bovis
AERAGIT

SEQ ID NO: 167982 - protein, 8 aa, Mycobacterium bovis
AERARTIS

SEQ ID NO: 167983 - protein, 10 aa, Mycobacterium bovis
AERASAAEHP

SEQ ID NO: 167984 - protein, 13 aa, Mycobacterium bovis
AERASARSSEASV

SEQ ID NO: 167985 - protein, 10 aa, Mycobacterium bovis
AERAYAAREA

SEQ ID NO: 167986 - protein, 13 aa, Mycobacterium bovis
AERDRGAAPRTLP

SEQ ID NO: 167987 - protein, 6 aa, Mycobacterium bovis
AEREDW

SEQ ID NO: 167988 - protein, 6 aa, Mycobacterium bovis
AEREGR

SEQ ID NO: 167989 - protein, 8 aa, Mycobacterium bovis
AERETPKS

SEQ ID NO: 167990 - protein, 12 aa, Mycobacterium bovis
AERGEQELKGVP

SEQ ID NO: 167991 - protein, 12 aa, Mycobacterium bovis
AERGIDATTGDL

SEQ ID NO: 167992 - protein, 19 aa, Mycobacterium bovis
AERGNWPPGFPKSERPSYS

SEQ ID NO: 167993 - protein, 9 aa, Mycobacterium bovis
AERHGRTRD

SEQ ID NO: 167994 - protein, 7 aa, Mycobacterium bovis
AERKGAL

SEQ ID NO: 167995 - protein, 4 aa, Mycobacterium bovis
AERL

SEQ ID NO: 167996 - protein, 7 aa, Mycobacterium bovis
AERLTEE

SEQ ID NO: 167997 - protein, 7 aa, Mycobacterium bovis
AERNEPE

SEQ ID NO: 167998 - protein, 5 aa, Mycobacterium bovis
AERPA

SEQ ID NO: 167999 - protein, 7 aa, Mycobacterium bovis
AERPGDA

SEQ ID NO: 168000 - protein, 4 aa, Mycobacterium bovis
AERR

SEQ ID NO: 168001 - protein, 5 aa, Mycobacterium bovis
AERSG

SEQ ID NO: 168002 - protein, 6 aa, Mycobacterium bovis
AERSPT

SEQ ID NO: 168003 - protein, 7 aa, Mycobacterium bovis
AERSTEH

SEQ ID NO: 168004 - protein, 7 aa, Mycobacterium bovis
AERTDSN

SEQ ID NO: 168005 - protein, 14 aa, Mycobacterium bovis
AERTEQKDFDGRSE

SEQ ID NO: 168006 - protein, 9 aa, Mycobacterium bovis
AERVPGDER

SEQ ID NO: 168007 - protein, 7 aa, Mycobacterium bovis
AERYGVP

SEQ ID NO: 168008 - protein, 5 aa, Mycobacterium bovis
AESAA

SEQ ID NO: 168009 - protein, 5 aa, Mycobacterium bovis
AESAD

SEQ ID NO: 168010 - protein, 17 aa, Mycobacterium bovis
AESAKTLQRAEARHGTK

SEQ ID NO: 168011 - protein, 6 aa, Mycobacterium bovis
AESDDL

SEQ ID NO: 168012 - protein, 11 aa, Mycobacterium bovis
AESDVQPLGRP

SEQ ID NO: 168013 - protein, 18 aa, Mycobacterium bovis
AESESDADVGDRANDPVR

SEQ ID NO: 168014 - protein, 4 aa, Mycobacterium bovis
AESG

SEQ ID NO: 168015 - protein, 11 aa, Mycobacterium bovis
AESGAEQGDPL

SEQ ID NO: 168016 - protein, 5 aa, Mycobacterium bovis
AESGD

SEQ ID NO: 168017 - protein, 8 aa, Mycobacterium bovis
AESGPDER

SEQ ID NO: 168018 - protein, 11 aa, Mycobacterium bovis
AESGSEAAEAD

SEQ ID NO: 168019 - protein, 7 aa, Mycobacterium bovis
AESGYAA

SEQ ID NO: 168020 - protein, 4 aa, Mycobacterium bovis
AESP

SEQ ID NO: 168021 - protein, 8 aa, Mycobacterium bovis
AESQRAAA

SEQ ID NO: 168022 - protein, 14 aa, Mycobacterium bovis
AESQSGARAPKHSY

SEQ ID NO: 168023 - protein, 7 aa, Mycobacterium bovis
AESRDVT

SEQ ID NO: 168024 - protein, 8 aa, Mycobacterium bovis
AESSAPAG

SEQ ID NO: 168025 - protein, 9 aa, Mycobacterium bovis
AESTAGPDA

SEQ ID NO: 168026 - protein, 20 aa, Mycobacterium bovis
AESTDDAKAETILDEVLAAA

SEQ ID NO: 168027 - protein, 5 aa, Mycobacterium bovis
AESTG

SEQ ID NO: 168028 - protein, 12 aa, Mycobacterium bovis
AESTPDTNGISR

SEQ ID NO: 168029 - protein, 8 aa, Mycobacterium bovis
AESYGSNG

SEQ ID NO: 168030 - protein, 6 aa, Mycobacterium bovis
AETADD

SEQ ID NO: 168031 - protein, 32 aa, Mycobacterium bovis
AETAGRGADDQSSASSAPSEKTAGGSLASDAQ

SEQ ID NO: 168032 - protein, 7 aa, Mycobacterium bovis
AETAGSQ

SEQ ID NO: 168033 - protein, 4 aa, Mycobacterium bovis
AETD

SEQ ID NO: 168034 - protein, 9 aa, Mycobacterium bovis
AETDDPDRR

SEQ ID NO: 168035 - protein, 7 aa, Mycobacterium bovis
AETDSGA

SEQ ID NO: 168036 - protein, 8 aa, Mycobacterium bovis
AETDSTVR

SEQ ID NO: 168037 - protein, 4 aa, Mycobacterium bovis
AETE

SEQ ID NO: 168038 - protein, 8 aa, Mycobacterium bovis
AETETRTQ

SEQ ID NO: 168039 - protein, 4 aa, Mycobacterium bovis
AETG

SEQ ID NO: 168040 - protein, 6 aa, Mycobacterium bovis
AETGAG

SEQ ID NO: 168041 - protein, 8 aa, Mycobacterium bovis
AETGDANG

SEQ ID NO: 168042 - protein, 6 aa, Mycobacterium bovis
AETGED

SEQ ID NO: 168043 - protein, 5 aa, Mycobacterium bovis
AETGF

SEQ ID NO: 168044 - protein, 9 aa, Mycobacterium bovis
AETGTPRFS

SEQ ID NO: 168045 - protein, 5 aa, Mycobacterium bovis
AETGY

SEQ ID NO: 168046 - protein, 16 aa, Mycobacterium bovis
AETLDAETTDSDATSL

SEQ ID NO: 168047 - protein, 4 aa, Mycobacterium bovis
AETN

SEQ ID NO: 168048 - protein, 9 aa, Mycobacterium bovis
AETNRPPET

SEQ ID NO: 168049 - protein, 4 aa, Mycobacterium bovis
AETP

SEQ ID NO: 168050 - protein, 11 aa, Mycobacterium bovis
AETPDDVEQGS

SEQ ID NO: 168051 - protein, 5 aa, Mycobacterium bovis
AETPV

SEQ ID NO: 168052 - protein, 4 aa, Mycobacterium bovis
AETQ

SEQ ID NO: 168053 - protein, 18 aa, Mycobacterium bovis
AETRPEPGLLATLPRRVL

SEQ ID NO: 168054 - protein, 6 aa, Mycobacterium bovis
AETSTP

SEQ ID NO: 168055 - protein, 6 aa, Mycobacterium bovis
AETTQR

SEQ ID NO: 168056 - protein, 15 aa, Mycobacterium bovis
AETTTNGSVSPATVR

SEQ ID NO: 168057 - protein, 5 aa, Mycobacterium bovis
AETYG

SEQ ID NO: 168058 - protein, 4 aa, Mycobacterium bovis
AEVD

SEQ ID NO: 168059 - protein, 11 aa, Mycobacterium bovis
AEVDEKARFPE

SEQ ID NO: 168060 - protein, 5 aa, Mycobacterium bovis
AEVDP

SEQ ID NO: 168061 - protein, 9 aa, Mycobacterium bovis
AEVEIPSPY

SEQ ID NO: 168062 - protein, 8 aa, Mycobacterium bovis
AEVEQASD

SEQ ID NO: 168063 - protein, 5 aa, Mycobacterium bovis
AEVGD

SEQ ID NO: 168064 - protein, 7 aa, Mycobacterium bovis
AEVGGDA

SEQ ID NO: 168065 - protein, 12 aa, Mycobacterium bovis
AEVRGDDAHEAK

SEQ ID NO: 168066 - protein, 6 aa, Mycobacterium bovis
AEVSKA

SEQ ID NO: 168067 - protein, 13 aa, Mycobacterium bovis
AEVSTEANPESTW

SEQ ID NO: 168068 - protein, 6 aa, Mycobacterium bovis
AEYDGD

SEQ ID NO: 168069 - protein, 15 aa, Mycobacterium bovis
AEYDPDGLFNSWMGR

SEQ ID NO: 168070 - protein, 5 aa, Mycobacterium bovis
AEYPD

SEQ ID NO: 168071 - protein, 6 aa, Mycobacterium bovis
AEYPQA

SEQ ID NO: 168072 - protein, 8 aa, Mycobacterium bovis
AEYSGSRQ

SEQ ID NO: 168073 - protein, 5 aa, Mycobacterium bovis
AFAAG

SEQ ID NO: 168074 - protein, 5 aa, Mycobacterium bovis
AFARE

SEQ ID NO: 168075 - protein, 16 aa, Mycobacterium bovis
AFATQGVSAEAQANRA

SEQ ID NO: 168076 - protein, 5 aa, Mycobacterium bovis
AFDSS

SEQ ID NO: 168077 - protein, 7 aa, Mycobacterium bovis
AFGDDKD

SEQ ID NO: 168078 - protein, 20 aa, Mycobacterium bovis
AFGTPEANSVHRTGPGPMGP

SEQ ID NO: 168079 - protein, 7 aa, Mycobacterium bovis
AFNPGDT

SEQ ID NO: 168080 - protein, 5 aa, Mycobacterium bovis
AFNTA

SEQ ID NO: 168081 - protein, 10 aa, Mycobacterium bovis
AFRDDESRGV

SEQ ID NO: 168082 - protein, 8 aa, Mycobacterium bovis
AFREKDGR

SEQ ID NO: 168083 - protein, 20 aa, Mycobacterium bovis
AFRGDGTITAGSASQISDGA

SEQ ID NO: 168084 - protein, 12 aa, Mycobacterium bovis
AFSPPAQALGGG

SEQ ID NO: 168085 - protein, 10 aa, Mycobacterium bovis
AFSSLNDTGR

SEQ ID NO: 168086 - protein, 6 aa, Mycobacterium bovis
AGAAAA

SEQ ID NO: 168087 - protein, 8 aa, Mycobacterium bovis
AGAAAAKL

SEQ ID NO: 168088 - protein, 28 aa, Mycobacterium bovis
AGAAGGDASTGVGGPGGPGGTGTASSPF

SEQ ID NO: 168089 - protein, 8 aa, Mycobacterium bovis
AGAAGRQA

SEQ ID NO: 168090 - protein, 8 aa, Mycobacterium bovis
AGAAGVGN

SEQ ID NO: 168091 - protein, 6 aa, Mycobacterium bovis
AGAAMA

SEQ ID NO: 168092 - protein, 18 aa, Mycobacterium bovis
AGAAPAGAAVEAAEEQSE

SEQ ID NO: 168093 - protein, 12 aa, Mycobacterium bovis
AGAARTLFGRDP

SEQ ID NO: 168094 - protein, 8 aa, Mycobacterium bovis
AGAASADM

SEQ ID NO: 168095 - protein, 27 aa, Mycobacterium bovis
AGAAYAQAEASNTAAMSGTAGSSGALG

SEQ ID NO: 168096 - protein, 7 aa, Mycobacterium bovis
AGADDVS

SEQ ID NO: 168097 - protein, 5 aa, Mycobacterium bovis
AGADP

SEQ ID NO: 168098 - protein, 9 aa, Mycobacterium bovis
AGADPDDYT

SEQ ID NO: 168099 - protein, 8 aa, Mycobacterium bovis
AGADSDEV

SEQ ID NO: 168100 - protein, 6 aa, Mycobacterium bovis
AGADSL

SEQ ID NO: 168101 - protein, 8 aa, Mycobacterium bovis
AGADSTGR

SEQ ID NO: 168102 - protein, 4 aa, Mycobacterium bovis
AGAE

SEQ ID NO: 168103 - protein, 8 aa, Mycobacterium bovis
AGAEGADV

SEQ ID NO: 168104 - protein, 7 aa, Mycobacterium bovis
AGAEHTH

SEQ ID NO: 168105 - protein, 4 aa, Mycobacterium bovis
AGAG

SEQ ID NO: 168106 - protein, 6 aa, Mycobacterium bovis
AGAGAD

SEQ ID NO: 168107 - protein, 15 aa, Mycobacterium bovis
AGAGAYANAEAANVQ

SEQ ID NO: 168108 - protein, 17 aa, Mycobacterium bovis
AGAGAYASAEAAAAAPL

SEQ ID NO: 168109 - protein, 6 aa, Mycobacterium bovis
AGAGER

SEQ ID NO: 168110 - protein, 13 aa, Mycobacterium bovis
AGAGGAGAGPRYG

SEQ ID NO: 168111 - protein, 30 aa, Mycobacterium bovis
AGAGGAGGAAGSSFIGNGGNGGAGGAGGAA

SEQ ID NO: 168112 - protein, 10 aa, Mycobacterium bovis
AGAGGAGGNA

SEQ ID NO: 168113 - protein, 28 aa, Mycobacterium bovis
AGAGGAGGSGANALGAGTGGTGGDGGHA

SEQ ID NO: 168114 - protein, 9 aa, Mycobacterium bovis
AGAGGNGGL

SEQ ID NO: 168115 - protein, 6 aa, Mycobacterium bovis
AGAGGV

SEQ ID NO: 168116 - protein, 9 aa, Mycobacterium bovis
AGAGKTETM

SEQ ID NO: 168117 - protein, 8 aa, Mycobacterium bovis
AGAGNAPV

SEQ ID NO: 168118 - protein, 6 aa, Mycobacterium bovis
AGAGPI

SEQ ID NO: 168119 - protein, 7 aa, Mycobacterium bovis
AGAGQAA

SEQ ID NO: 168120 - protein, 18 aa, Mycobacterium bovis
AGAGRHGAPAPRAEQGDT

SEQ ID NO: 168121 - protein, 8 aa, Mycobacterium bovis
AGAGSGAL

SEQ ID NO: 168122 - protein, 15 aa, Mycobacterium bovis
AGAGSGVANAGTLSS

SEQ ID NO: 168123 - protein, 17 aa, Mycobacterium bovis
AGAGSYAAAEAASAAPL

SEQ ID NO: 168124 - protein, 19 aa, Mycobacterium bovis
AGAGSYAAAEAASAASITS

SEQ ID NO: 168125 - protein, 14 aa, Mycobacterium bovis
AGAGSYASAEAANV

SEQ ID NO: 168126 - protein, 14 aa, Mycobacterium bovis
AGAIDADGPETPRI

SEQ ID NO: 168127 - protein, 9 aa, Mycobacterium bovis
AGAKQIDGS

SEQ ID NO: 168128 - protein, 7 aa, Mycobacterium bovis
AGANPLG

SEQ ID NO: 168129 - protein, 6 aa, Mycobacterium bovis
AGAPDA

SEQ ID NO: 168130 - protein, 7 aa, Mycobacterium bovis
AGAPGGV

SEQ ID NO: 168131 - protein, 13 aa, Mycobacterium bovis
AGAPGRASANGTS

SEQ ID NO: 168132 - protein, 10 aa, Mycobacterium bovis
AGAPPGDDRV

SEQ ID NO: 168133 - protein, 23 aa, Mycobacterium bovis
AGAPPSPLDVPSDPGLPVMQGQV

SEQ ID NO: 168134 - protein, 7 aa, Mycobacterium bovis
AGAQGQV

SEQ ID NO: 168135 - protein, 15 aa, Mycobacterium bovis
AGAQRTLDGGHTDGG

SEQ ID NO: 168136 - protein, 10 aa, Mycobacterium bovis
AGARAPKGTR

SEQ ID NO: 168137 - protein, 11 aa, Mycobacterium bovis
AGARQADAQVR

SEQ ID NO: 168138 - protein, 14 aa, Mycobacterium bovis
AGARSTTSLAAGNG

SEQ ID NO: 168139 - protein, 4 aa, Mycobacterium bovis
AGAS

SEQ ID NO: 168140 - protein, 35 aa, Mycobacterium bovis
AGASAAASQLPPFTPPPATTSGAGSLSDAAATAAQ

SEQ ID NO: 168141 - protein, 6 aa, Mycobacterium bovis
AGASAV

SEQ ID NO: 168142 - protein, 8 aa, Mycobacterium bovis
AGASPDVA

SEQ ID NO: 168143 - protein, 10 aa, Mycobacterium bovis
AGASQAAAQL

SEQ ID NO: 168144 - protein, 6 aa, Mycobacterium bovis
AGASRV

SEQ ID NO: 168145 - protein, 8 aa, Mycobacterium bovis
AGASTGGF

SEQ ID NO: 168146 - protein, 12 aa, Mycobacterium bovis
AGASTLAGSTTT

SEQ ID NO: 168147 - protein, 10 aa, Mycobacterium bovis
AGATGDERSF

SEQ ID NO: 168148 - protein, 10 aa, Mycobacterium bovis
AGATGEGAMD

SEQ ID NO: 168149 - protein, 15 aa, Mycobacterium bovis
AGAVERTSASGDAGI

SEQ ID NO: 168150 - protein, 8 aa, Mycobacterium bovis
AGAVPGPF

SEQ ID NO: 168151 - protein, 6 aa, Mycobacterium bovis
AGCGDG

SEQ ID NO: 168152 - protein, 11 aa, Mycobacterium bovis
AGCGRDPDSAI

SEQ ID NO: 168153 - protein, 11 aa, Mycobacterium bovis
AGDAEAVAERR

SEQ ID NO: 168154 - protein, 8 aa, Mycobacterium bovis
AGDAGAGV

SEQ ID NO: 168155 - protein, 8 aa, Mycobacterium bovis
AGDAGEPW

SEQ ID NO: 168156 - protein, 8 aa, Mycobacterium bovis
AGDCAPAA

SEQ ID NO: 168157 - protein, 11 aa, Mycobacterium bovis
AGDDAALSGTE

SEQ ID NO: 168158 - protein, 9 aa, Mycobacterium bovis
AGDDPEVNE

SEQ ID NO: 168159 - protein, 9 aa, Mycobacterium bovis
AGDDSTQGV

SEQ ID NO: 168160 - protein, 10 aa, Mycobacterium bovis
AGDDVQPGDV

SEQ ID NO: 168161 - protein, 8 aa, Mycobacterium bovis
AGDEPGGA

SEQ ID NO: 168162 - protein, 10 aa, Mycobacterium bovis
AGDEPRPGAA

SEQ ID NO: 168163 - protein, 8 aa, Mycobacterium bovis
AGDERARA

SEQ ID NO: 168164 - protein, 6 aa, Mycobacterium bovis
AGDEVS

SEQ ID NO: 168165 - protein, 5 aa, Mycobacterium bovis
AGDFN

SEQ ID NO: 168166 - protein, 9 aa, Mycobacterium bovis
AGDGGAPAF

SEQ ID NO: 168167 - protein, 6 aa, Mycobacterium bovis
AGDGNV

SEQ ID NO: 168168 - protein, 8 aa, Mycobacterium bovis
AGDGRRAG

SEQ ID NO: 168169 - protein, 8 aa, Mycobacterium bovis
AGDGRSVE

SEQ ID NO: 168170 - protein, 10 aa, Mycobacterium bovis
AGDGTHEHPT

SEQ ID NO: 168171 - protein, 10 aa, Mycobacterium bovis
AGDGVETGRH

SEQ ID NO: 168172 - protein, 11 aa, Mycobacterium bovis
AGDLPEGIEGG

SEQ ID NO: 168173 - protein, 6 aa, Mycobacterium bovis
AGDNKF

SEQ ID NO: 168174 - protein, 7 aa, Mycobacterium bovis
AGDPDQL

SEQ ID NO: 168175 - protein, 7 aa, Mycobacterium bovis
AGDPMSG

SEQ ID NO: 168176 - protein, 6 aa, Mycobacterium bovis
AGDQRS

SEQ ID NO: 168177 - protein, 6 aa, Mycobacterium bovis
AGDQVG

SEQ ID NO: 168178 - protein, 11 aa, Mycobacterium bovis
AGDRDAVSNHR

SEQ ID NO: 168179 - protein, 5 aa, Mycobacterium bovis
AGDRP

SEQ ID NO: 168180 - protein, 4 aa, Mycobacterium bovis
AGDS

SEQ ID NO: 168181 - protein, 14 aa, Mycobacterium bovis
AGDSADRDQACQRA

SEQ ID NO: 168182 - protein, 7 aa, Mycobacterium bovis
AGDSAWA

SEQ ID NO: 168183 - protein, 6 aa, Mycobacterium bovis
AGDSGV

SEQ ID NO: 168184 - protein, 5 aa, Mycobacterium bovis
AGDTA

SEQ ID NO: 168185 - protein, 6 aa, Mycobacterium bovis
AGDTQP

SEQ ID NO: 168186 - protein, 7 aa, Mycobacterium bovis
AGDVSGA

SEQ ID NO: 168187 - protein, 8 aa, Mycobacterium bovis
AGEAATAG

SEQ ID NO: 168188 - protein, 9 aa, Mycobacterium bovis
AGEAGNHGQ

SEQ ID NO: 168189 - protein, 18 aa, Mycobacterium bovis
AGEATPTQRLVALTGRKP

SEQ ID NO: 168190 - protein, 5 aa, Mycobacterium bovis
AGEDA

SEQ ID NO: 168191 - protein, 6 aa, Mycobacterium bovis
AGEEFT

SEQ ID NO: 168192 - protein, 5 aa, Mycobacterium bovis
AGEGA

SEQ ID NO: 168193 - protein, 6 aa, Mycobacterium bovis
AGEGDA

SEQ ID NO: 168194 - protein, 21 aa, Mycobacterium bovis
AGEGDPGATRAAGEEARSLAD

SEQ ID NO: 168195 - protein, 9 aa, Mycobacterium bovis
AGEGEPEQV

SEQ ID NO: 168196 - protein, 10 aa, Mycobacterium bovis
AGEGESTTDL

SEQ ID NO: 168197 - protein, 10 aa, Mycobacterium bovis
AGEGGRSSGV

SEQ ID NO: 168198 - protein, 8 aa, Mycobacterium bovis
AGEGPRAA

SEQ ID NO: 168199 - protein, 7 aa, Mycobacterium bovis
AGEGTQQ

SEQ ID NO: 168200 - protein, 11 aa, Mycobacterium bovis
AGEGVEELGRS

SEQ ID NO: 168201 - protein, 10 aa, Mycobacterium bovis
AGEHAGQEAQ

SEQ ID NO: 168202 - protein, 4 aa, Mycobacterium bovis
AGEI

SEQ ID NO: 168203 - protein, 6 aa, Mycobacterium bovis
AGEIDE

SEQ ID NO: 168204 - protein, 10 aa, Mycobacterium bovis
AGEKAKDDPF

SEQ ID NO: 168205 - protein, 5 aa, Mycobacterium bovis
AGEKQ

SEQ ID NO: 168206 - protein, 7 aa, Mycobacterium bovis
AGEKTQV

SEQ ID NO: 168207 - protein, 4 aa, Mycobacterium bovis
AGEL

SEQ ID NO: 168208 - protein, 8 aa, Mycobacterium bovis
AGELSANG

SEQ ID NO: 168209 - protein, 8 aa, Mycobacterium bovis
AGEPDGNE

SEQ ID NO: 168210 - protein, 7 aa, Mycobacterium bovis
AGEPPLT

SEQ ID NO: 168211 - protein, 5 aa, Mycobacterium bovis
AGEPW

SEQ ID NO: 168212 - protein, 5 aa, Mycobacterium bovis
AGEQR

SEQ ID NO: 168213 - protein, 6 aa, Mycobacterium bovis
AGERER

SEQ ID NO: 168214 - protein, 7 aa, Mycobacterium bovis
AGERGTD

SEQ ID NO: 168215 - protein, 5 aa, Mycobacterium bovis
AGERK

SEQ ID NO: 168216 - protein, 14 aa, Mycobacterium bovis
AGERMRDAVAYLAA

SEQ ID NO: 168217 - protein, 9 aa, Mycobacterium bovis
AGESAKFGI

SEQ ID NO: 168218 - protein, 5 aa, Mycobacterium bovis
AGESG

SEQ ID NO: 168219 - protein, 14 aa, Mycobacterium bovis
AGESRAIPTGSCPT

SEQ ID NO: 168220 - protein, 4 aa, Mycobacterium bovis
AGET

SEQ ID NO: 168221 - protein, 15 aa, Mycobacterium bovis
AGETFGEVESTKSVS

SEQ ID NO: 168222 - protein, 7 aa, Mycobacterium bovis
AGFDPSK

SEQ ID NO: 168223 - protein, 8 aa, Mycobacterium bovis
AGFGGGGV

SEQ ID NO: 168224 - protein, 6 aa, Mycobacterium bovis
AGFGTS

SEQ ID NO: 168225 - protein, 6 aa, Mycobacterium bovis
AGFPAP

SEQ ID NO: 168226 - protein, 8 aa, Mycobacterium bovis
AGFPDTDS

SEQ ID NO: 168227 - protein, 5 aa, Mycobacterium bovis
AGGAA

SEQ ID NO: 168228 - protein, 10 aa, Mycobacterium bovis
AGGADASPQL

SEQ ID NO: 168229 - protein, 6 aa, Mycobacterium bovis
AGGAEL

SEQ ID NO: 168230 - protein, 9 aa, Mycobacterium bovis
AGGAGEGQR

SEQ ID NO: 168231 - protein, 27 aa, Mycobacterium bovis
AGGAGGAGALGGGATGVGGAGGNGGTA

SEQ ID NO: 168232 - protein, 11 aa, Mycobacterium bovis
AGGAGGAGGAT

SEQ ID NO: 168233 - protein, 70 aa, Mycobacterium bovis
AGGAGGAGGKAGLLSGAGGAGGAGGGSFAGAGGTGGAGGAPGLVGNAGNGGNGGASANGAGAAGGAGGSG

SEQ ID NO: 168234 - protein, 29 aa, Mycobacterium bovis
AGGAGGAGGRAGGGVGGIGGAGGAGGNGG

SEQ ID NO: 168235 - protein, 25 aa, Mycobacterium bovis
AGGAGGAGGSGGSDTAGHGGTGGAG

SEQ ID NO: 168236 - protein, 28 aa, Mycobacterium bovis
AGGAGGAGGVGGAGGAGGTGGGGGNGGA

SEQ ID NO: 168237 - protein, 7 aa, Mycobacterium bovis
AGGAGRV

SEQ ID NO: 168238 - protein, 16 aa, Mycobacterium bovis
AGGALGGAAARATGGF

SEQ ID NO: 168239 - protein, 13 aa, Mycobacterium bovis
AGGAPMYQRPGDR

SEQ ID NO: 168240 - protein, 9 aa, Mycobacterium bovis
AGGAQRGSA

SEQ ID NO: 168241 - protein, 7 aa, Mycobacterium bovis
AGGASGI

SEQ ID NO: 168242 - protein, 7 aa, Mycobacterium bovis
AGGATQH

SEQ ID NO: 168243 - protein, 5 aa, Mycobacterium bovis
AGGAV

SEQ ID NO: 168244 - protein, 7 aa, Mycobacterium bovis
AGGAVGG

SEQ ID NO: 168245 - protein, 7 aa, Mycobacterium bovis
AGGDCGR

SEQ ID NO: 168246 - protein, 8 aa, Mycobacterium bovis
AGGDDVSA

SEQ ID NO: 168247 - protein, 14 aa, Mycobacterium bovis
AGGDGCDSEPALTY

SEQ ID NO: 168248 - protein, 14 aa, Mycobacterium bovis
AGGDGGTGGVGGHG

SEQ ID NO: 168249 - protein, 8 aa, Mycobacterium bovis
AGGDPQGA

SEQ ID NO: 168250 - protein, 11 aa, Mycobacterium bovis
AGGEKGKPRYD

SEQ ID NO: 168251 - protein, 10 aa, Mycobacterium bovis
AGGELGAESS

SEQ ID NO: 168252 - protein, 4 aa, Mycobacterium bovis
AGGF

SEQ ID NO: 168253 - protein, 4 aa, Mycobacterium bovis
AGGG

SEQ ID NO: 168254 - protein, 33 aa, Mycobacterium bovis
AGGGGNGGAGSTGTAGGGSGGTGGDGGTGGRGG

SEQ ID NO: 168255 - protein, 8 aa, Mycobacterium bovis
AGGGGRGM

SEQ ID NO: 168256 - protein, 74 aa, Mycobacterium bovis
AGGGGTGGNGGASGAGGAGGTGGFAGNGNAGGNGGTGGASEDGDNGNAGSGATGGTGGNGGTGGDGGAAGLGGV

SEQ ID NO: 168257 - protein, 7 aa, Mycobacterium bovis
AGGGGTL

SEQ ID NO: 168258 - protein, 5 aa, Mycobacterium bovis
AGGGH

SEQ ID NO: 168259 - protein, 7 aa, Mycobacterium bovis
AGGGIGR

SEQ ID NO: 168260 - protein, 7 aa, Mycobacterium bovis
AGGGLGR

SEQ ID NO: 168261 - protein, 11 aa, Mycobacterium bovis
AGGGPGSLSAA

SEQ ID NO: 168262 - protein, 15 aa, Mycobacterium bovis
AGGGSYASAEIANAQ

SEQ ID NO: 168263 - protein, 21 aa, Mycobacterium bovis
AGGGVREAKVPAAARNDADSK

SEQ ID NO: 168264 - protein, 18 aa, Mycobacterium bovis
AGGHGRLKSAGPVNSGAT

SEQ ID NO: 168265 - protein, 5 aa, Mycobacterium bovis
AGGHT

SEQ ID NO: 168266 - protein, 4 aa, Mycobacterium bovis
AGGI

SEQ ID NO: 168267 - protein, 7 aa, Mycobacterium bovis
AGGIGTS

SEQ ID NO: 168268 - protein, 9 aa, Mycobacterium bovis
AGGKARPDI

SEQ ID NO: 168269 - protein, 8 aa, Mycobacterium bovis
AGGKSTID

SEQ ID NO: 168270 - protein, 10 aa, Mycobacterium bovis
AGGLQPGEEP

SEQ ID NO: 168271 - protein, 16 aa, Mycobacterium bovis
AGGLQSVAKASATKDV

SEQ ID NO: 168272 - protein, 5 aa, Mycobacterium bovis
AGGMH

SEQ ID NO: 168273 - protein, 10 aa, Mycobacterium bovis
AGGNDGGATL

SEQ ID NO: 168274 - protein, 19 aa, Mycobacterium bovis
AGGNGGAGGAGGAGGAGGA

SEQ ID NO: 168275 - protein, 29 aa, Mycobacterium bovis
AGGNGGNAGTGVGVNGANGGNGGSATGAL

SEQ ID NO: 168276 - protein, 8 aa, Mycobacterium bovis
AGGNSAGL

SEQ ID NO: 168277 - protein, 13 aa, Mycobacterium bovis
AGGPIPLPAPETL

SEQ ID NO: 168278 - protein, 8 aa, Mycobacterium bovis
AGGPPLPP

SEQ ID NO: 168279 - protein, 8 aa, Mycobacterium bovis
AGGPRKVS

SEQ ID NO: 168280 - protein, 8 aa, Mycobacterium bovis
AGGPSDAL

SEQ ID NO: 168281 - protein, 4 aa, Mycobacterium bovis
AGGQ

SEQ ID NO: 168282 - protein, 71 aa, Mycobacterium bovis
AGGQGGVGGSAGMLSGSGGSGGAGGSGGPAGTAAGGAGGAGGAPGLIGNGGNGGNGGESGGTGGVGGAGGN

SEQ ID NO: 168283 - protein, 7 aa, Mycobacterium bovis
AGGQGRY

SEQ ID NO: 168284 - protein, 7 aa, Mycobacterium bovis
AGGQLGS

SEQ ID NO: 168285 - protein, 6 aa, Mycobacterium bovis
AGGQLT

SEQ ID NO: 168286 - protein, 10 aa, Mycobacterium bovis
AGGRAPGALP

SEQ ID NO: 168287 - protein, 5 aa, Mycobacterium bovis
AGGRP

SEQ ID NO: 168288 - protein, 7 aa, Mycobacterium bovis
AGGRPDE

SEQ ID NO: 168289 - protein, 10 aa, Mycobacterium bovis
AGGRRRPRSV

SEQ ID NO: 168290 - protein, 7 aa, Mycobacterium bovis
AGGRVTT

SEQ ID NO: 168291 - protein, 11 aa, Mycobacterium bovis
AGGSPGELGRN

SEQ ID NO: 168292 - protein, 7 aa, Mycobacterium bovis
AGGSPYA

SEQ ID NO: 168293 - protein, 10 aa, Mycobacterium bovis
AGGTADQARD

SEQ ID NO: 168294 - protein, 12 aa, Mycobacterium bovis
AGGTAGAGGTGG

SEQ ID NO: 168295 - protein, 16 aa, Mycobacterium bovis
AGGTDPVQAAAPGTIR

SEQ ID NO: 168296 - protein, 7 aa, Mycobacterium bovis
AGGTESV

SEQ ID NO: 168297 - protein, 26 aa, Mycobacterium bovis
AGGTGGAGGSSGGTFGGNGGSGGNAG

SEQ ID NO: 168298 - protein, 21 aa, Mycobacterium bovis
AGGTGGAGTLGADGGAGGHGG

SEQ ID NO: 168299 - protein, 10 aa, Mycobacterium bovis
AGGTGGPGGF

SEQ ID NO: 168300 - protein, 6 aa, Mycobacterium bovis
AGGTGL

SEQ ID NO: 168301 - protein, 8 aa, Mycobacterium bovis
AGGTHDDW

SEQ ID NO: 168302 - protein, 8 aa, Mycobacterium bovis
AGGTREPI

SEQ ID NO: 168303 - protein, 10 aa, Mycobacterium bovis
AGGTSEVTRN

SEQ ID NO: 168304 - protein, 7 aa, Mycobacterium bovis
AGGTTAT

SEQ ID NO: 168305 - protein, 6 aa, Mycobacterium bovis
AGGVDA

SEQ ID NO: 168306 - protein, 14 aa, Mycobacterium bovis
AGGVDTTSDPPIGL

SEQ ID NO: 168307 - protein, 14 aa, Mycobacterium bovis
AGGVHAAGSGDRAV

SEQ ID NO: 168308 - protein, 4 aa, Mycobacterium bovis
AGGY

SEQ ID NO: 168309 - protein, 9 aa, Mycobacterium bovis
AGHALTGGG

SEQ ID NO: 168310 - protein, 14 aa, Mycobacterium bovis
AGHGNRPPAGAATE

SEQ ID NO: 168311 - protein, 9 aa, Mycobacterium bovis
AGHPEQGGW

SEQ ID NO: 168312 - protein, 6 aa, Mycobacterium bovis
AGHRCD

SEQ ID NO: 168313 - protein, 6 aa, Mycobacterium bovis
AGHSRE

SEQ ID NO: 168314 - protein, 13 aa, Mycobacterium bovis
AGIAGGSGGAAGL

SEQ ID NO: 168315 - protein, 4 aa, Mycobacterium bovis
AGID

SEQ ID NO: 168316 - protein, 7 aa, Mycobacterium bovis
AGIGPGA

SEQ ID NO: 168317 - protein, 8 aa, Mycobacterium bovis
AGIGPSRT

SEQ ID NO: 168318 - protein, 4 aa, Mycobacterium bovis
AGIK

SEQ ID NO: 168319 - protein, 11 aa, Mycobacterium bovis
AGIPHESHEVP

SEQ ID NO: 168320 - protein, 13 aa, Mycobacterium bovis
AGIPSQAPASRPH

SEQ ID NO: 168321 - protein, 6 aa, Mycobacterium bovis
AGIQSG

SEQ ID NO: 168322 - protein, 4 aa, Mycobacterium bovis
AGIR

SEQ ID NO: 168323 - protein, 16 aa, Mycobacterium bovis
AGKADGARLSAAVKER

SEQ ID NO: 168324 - protein, 14 aa, Mycobacterium bovis
AGKAGARDRADDLA

SEQ ID NO: 168325 - protein, 9 aa, Mycobacterium bovis
AGKETVTTL

SEQ ID NO: 168326 - protein, 6 aa, Mycobacterium bovis
AGKGAS

SEQ ID NO: 168327 - protein, 10 aa, Mycobacterium bovis
AGKGNKEPRN

SEQ ID NO: 168328 - protein, 6 aa, Mycobacterium bovis
AGKGVD

SEQ ID NO: 168329 - protein, 5 aa, Mycobacterium bovis
AGKLT

SEQ ID NO: 168330 - protein, 8 aa, Mycobacterium bovis
AGKNAAEV

SEQ ID NO: 168331 - protein, 11 aa, Mycobacterium bovis
AGKNGTRKGRR

SEQ ID NO: 168332 - protein, 9 aa, Mycobacterium bovis
AGKPAPDSF

SEQ ID NO: 168333 - protein, 7 aa, Mycobacterium bovis
AGKPARY

SEQ ID NO: 168334 - protein, 17 aa, Mycobacterium bovis
AGKPEQTLVRPDDQGAQ

SEQ ID NO: 168335 - protein, 12 aa, Mycobacterium bovis
AGKPKPDGTPTF

SEQ ID NO: 168336 - protein, 7 aa, Mycobacterium bovis
AGKPRQH

SEQ ID NO: 168337 - protein, 4 aa, Mycobacterium bovis
AGKQ

SEQ ID NO: 168338 - protein, 10 aa, Mycobacterium bovis
AGKRAGKTVG

SEQ ID NO: 168339 - protein, 8 aa, Mycobacterium bovis
AGKRARDV

SEQ ID NO: 168340 - protein, 6 aa, Mycobacterium bovis
AGKSQL

SEQ ID NO: 168341 - protein, 8 aa, Mycobacterium bovis
AGKTTTTE

SEQ ID NO: 168342 - protein, 6 aa, Mycobacterium bovis
AGKYGV

SEQ ID NO: 168343 - protein, 21 aa, Mycobacterium bovis
AGLASTSRGDGGHGSSGGHAS

SEQ ID NO: 168344 - protein, 7 aa, Mycobacterium bovis
AGLDGTQ

SEQ ID NO: 168345 - protein, 10 aa, Mycobacterium bovis
AGLGNAATVG

SEQ ID NO: 168346 - protein, 4 aa, Mycobacterium bovis
AGLP

SEQ ID NO: 168347 - protein, 5 aa, Mycobacterium bovis
AGLPD

SEQ ID NO: 168348 - protein, 8 aa, Mycobacterium bovis
AGLPPATY

SEQ ID NO: 168349 - protein, 14 aa, Mycobacterium bovis
AGLPSAIDGPTIGS

SEQ ID NO: 168350 - protein, 9 aa, Mycobacterium bovis
AGLPSRSAG

SEQ ID NO: 168351 - protein, 16 aa, Mycobacterium bovis
AGLPTSAEDKGAQATV

SEQ ID NO: 168352 - protein, 8 aa, Mycobacterium bovis
AGLQPDDA

SEQ ID NO: 168353 - protein, 11 aa, Mycobacterium bovis
AGLQPYQRHRD

SEQ ID NO: 168354 - protein, 7 aa, Mycobacterium bovis
AGLRPGA

SEQ ID NO: 168355 - protein, 10 aa, Mycobacterium bovis
AGLRSRSGKV

SEQ ID NO: 168356 - protein, 4 aa, Mycobacterium bovis
AGLS

SEQ ID NO: 168357 - protein, 9 aa, Mycobacterium bovis
AGLSPTDVD

SEQ ID NO: 168358 - protein, 4 aa, Mycobacterium bovis
AGLT

SEQ ID NO: 168359 - protein, 15 aa, Mycobacterium bovis
AGMAPEAKSGYPATP

SEQ ID NO: 168360 - protein, 8 aa, Mycobacterium bovis
AGMNEEQA

SEQ ID NO: 168361 - protein, 6 aa, Mycobacterium bovis
AGMQTS

SEQ ID NO: 168362 - protein, 14 aa, Mycobacterium bovis
AGMTTGMPTPEGKP

SEQ ID NO: 168363 - protein, 10 aa, Mycobacterium bovis
AGNAKGHGRH

SEQ ID NO: 168364 - protein, 18 aa, Mycobacterium bovis
AGNAPRPAERSLSDADRS

SEQ ID NO: 168365 - protein, 8 aa, Mycobacterium bovis
AGNAVRPE

SEQ ID NO: 168366 - protein, 6 aa, Mycobacterium bovis
AGNEIK

SEQ ID NO: 168367 - protein, 6 aa, Mycobacterium bovis
AGNGGS

SEQ ID NO: 168368 - protein, 10 aa, Mycobacterium bovis
AGNGMAGHTA

SEQ ID NO: 168369 - protein, 4 aa, Mycobacterium bovis
AGNL

SEQ ID NO: 168370 - protein, 9 aa, Mycobacterium bovis
AGNLGGSNL

SEQ ID NO: 168371 - protein, 12 aa, Mycobacterium bovis
AGNMSKRQSATG

SEQ ID NO: 168372 - protein, 7 aa, Mycobacterium bovis
AGNPAKR

SEQ ID NO: 168373 - protein, 19 aa, Mycobacterium bovis
AGNPGDPGGFGAAGADGLP

SEQ ID NO: 168374 - protein, 5 aa, Mycobacterium bovis
AGNPH

SEQ ID NO: 168375 - protein, 5 aa, Mycobacterium bovis
AGNPI

SEQ ID NO: 168376 - protein, 7 aa, Mycobacterium bovis
AGNSAAA

SEQ ID NO: 168377 - protein, 5 aa, Mycobacterium bovis
AGNTG

SEQ ID NO: 168378 - protein, 26 aa, Mycobacterium bovis
AGNTNTGSFNPGDYNTGGFNPGNYNT

SEQ ID NO: 168379 - protein, 8 aa, Mycobacterium bovis
AGPAAAPR

SEQ ID NO: 168380 - protein, 5 aa, Mycobacterium bovis
AGPAE

SEQ ID NO: 168381 - protein, 16 aa, Mycobacterium bovis
AGPAGLATAANAAQRG

SEQ ID NO: 168382 - protein, 26 aa, Mycobacterium bovis
AGPAGPAETVAPARPAAPGGPAGPAA

SEQ ID NO: 168383 - protein, 9 aa, Mycobacterium bovis
AGPAGSAAA

SEQ ID NO: 168384 - protein, 7 aa, Mycobacterium bovis
AGPAWDR

SEQ ID NO: 168385 - protein, 8 aa, Mycobacterium bovis
AGPDRAEK

SEQ ID NO: 168386 - protein, 15 aa, Mycobacterium bovis
AGPDSTLQSQPANAI

SEQ ID NO: 168387 - protein, 9 aa, Mycobacterium bovis
AGPDTSATY

SEQ ID NO: 168388 - protein, 7 aa, Mycobacterium bovis
AGPDYGG

SEQ ID NO: 168389 - protein, 12 aa, Mycobacterium bovis
AGPEGSDRPERH

SEQ ID NO: 168390 - protein, 6 aa, Mycobacterium bovis
AGPEIG

SEQ ID NO: 168391 - protein, 7 aa, Mycobacterium bovis
AGPEPMA

SEQ ID NO: 168392 - protein, 9 aa, Mycobacterium bovis
AGPERATEA

SEQ ID NO: 168393 - protein, 7 aa, Mycobacterium bovis
AGPGAHG

SEQ ID NO: 168394 - protein, 9 aa, Mycobacterium bovis
AGPGAPIDT

SEQ ID NO: 168395 - protein, 5 aa, Mycobacterium bovis
AGPGD

SEQ ID NO: 168396 - protein, 15 aa, Mycobacterium bovis
AGPGGAPDAKGPPLI

SEQ ID NO: 168397 - protein, 6 aa, Mycobacterium bovis
AGPGPL

SEQ ID NO: 168398 - protein, 6 aa, Mycobacterium bovis
AGPGPM

SEQ ID NO: 168399 - protein, 8 aa, Mycobacterium bovis
AGPGSAPM

SEQ ID NO: 168400 - protein, 12 aa, Mycobacterium bovis
AGPGSGLTGSIE

SEQ ID NO: 168401 - protein, 11 aa, Mycobacterium bovis
AGPGTPNQPDA

SEQ ID NO: 168402 - protein, 7 aa, Mycobacterium bovis
AGPGVPE

SEQ ID NO: 168403 - protein, 6 aa, Mycobacterium bovis
AGPGVR

SEQ ID NO: 168404 - protein, 5 aa, Mycobacterium bovis
AGPHG

SEQ ID NO: 168405 - protein, 6 aa, Mycobacterium bovis
AGPHPF

SEQ ID NO: 168406 - protein, 9 aa, Mycobacterium bovis
AGPITDDPY

SEQ ID NO: 168407 - protein, 7 aa, Mycobacterium bovis
AGPKEAR

SEQ ID NO: 168408 - protein, 6 aa, Mycobacterium bovis
AGPKKI

SEQ ID NO: 168409 - protein, 4 aa, Mycobacterium bovis
AGPL

SEQ ID NO: 168410 - protein, 8 aa, Mycobacterium bovis
AGPMSDGD

SEQ ID NO: 168411 - protein, 7 aa, Mycobacterium bovis
AGPPEQV

SEQ ID NO: 168412 - protein, 6 aa, Mycobacterium bovis
AGPPPQ

SEQ ID NO: 168413 - protein, 10 aa, Mycobacterium bovis
AGPPPTPSRV

SEQ ID NO: 168414 - protein, 6 aa, Mycobacterium bovis
AGPPRK

SEQ ID NO: 168415 - protein, 6 aa, Mycobacterium bovis
AGPQFD

SEQ ID NO: 168416 - protein, 9 aa, Mycobacterium bovis
AGPQLPTGL

SEQ ID NO: 168417 - protein, 6 aa, Mycobacterium bovis
AGPQVG

SEQ ID NO: 168418 - protein, 7 aa, Mycobacterium bovis
AGPRDKN

SEQ ID NO: 168419 - protein, 7 aa, Mycobacterium bovis
AGPRLGK

SEQ ID NO: 168420 - protein, 5 aa, Mycobacterium bovis
AGPRP

SEQ ID NO: 168421 - protein, 4 aa, Mycobacterium bovis
AGPS

SEQ ID NO: 168422 - protein, 8 aa, Mycobacterium bovis
AGPSAPRR

SEQ ID NO: 168423 - protein, 11 aa, Mycobacterium bovis
AGPSEQQAGST

SEQ ID NO: 168424 - protein, 6 aa, Mycobacterium bovis
AGPSGL

SEQ ID NO: 168425 - protein, 10 aa, Mycobacterium bovis
AGPSHGRDKP

SEQ ID NO: 168426 - protein, 8 aa, Mycobacterium bovis
AGPSRTAC

SEQ ID NO: 168427 - protein, 7 aa, Mycobacterium bovis
AGPTAGY

SEQ ID NO: 168428 - protein, 7 aa, Mycobacterium bovis
AGPTPRL

SEQ ID NO: 168429 - protein, 7 aa, Mycobacterium bovis
AGPVPQA

SEQ ID NO: 168430 - protein, 13 aa, Mycobacterium bovis
AGQAAAKGAAARL

SEQ ID NO: 168431 - protein, 25 aa, Mycobacterium bovis
AGQADPGDARTGVGASSAAPTGVGG

SEQ ID NO: 168432 - protein, 12 aa, Mycobacterium bovis
AGQAEQAGAQAK

SEQ ID NO: 168433 - protein, 4 aa, Mycobacterium bovis
AGQG

SEQ ID NO: 168434 - protein, 13 aa, Mycobacterium bovis
AGQGGGSKGDRGG

SEQ ID NO: 168435 - protein, 24 aa, Mycobacterium bovis
AGQGTIRRSGDRAEGTFNSDMGGG

SEQ ID NO: 168436 - protein, 11 aa, Mycobacterium bovis
AGQHPDPTTNA

SEQ ID NO: 168437 - protein, 6 aa, Mycobacterium bovis
AGQIKR

SEQ ID NO: 168438 - protein, 5 aa, Mycobacterium bovis
AGQKG

SEQ ID NO: 168439 - protein, 18 aa, Mycobacterium bovis
AGQLPPEPPIWPTTSTPT

SEQ ID NO: 168440 - protein, 4 aa, Mycobacterium bovis
AGQP

SEQ ID NO: 168441 - protein, 13 aa, Mycobacterium bovis
AGQPAKLFRATVG

SEQ ID NO: 168442 - protein, 6 aa, Mycobacterium bovis
AGQPMP

SEQ ID NO: 168443 - protein, 6 aa, Mycobacterium bovis
AGQPQL

SEQ ID NO: 168444 - protein, 6 aa, Mycobacterium bovis
AGQPRV

SEQ ID NO: 168445 - protein, 9 aa, Mycobacterium bovis
AGQQPGFRG

SEQ ID NO: 168446 - protein, 7 aa, Mycobacterium bovis
AGQRNRA

SEQ ID NO: 168447 - protein, 18 aa, Mycobacterium bovis
AGQSAPGVVAPREGSIGG

SEQ ID NO: 168448 - protein, 6 aa, Mycobacterium bovis
AGQSVT

SEQ ID NO: 168449 - protein, 9 aa, Mycobacterium bovis
AGQTALPDI

SEQ ID NO: 168450 - protein, 7 aa, Mycobacterium bovis
AGQTRST

SEQ ID NO: 168451 - protein, 30 aa, Mycobacterium bovis
AGRAAADYAARHQKSDRGPSSAVRAQARTE

SEQ ID NO: 168452 - protein, 23 aa, Mycobacterium bovis
AGRAAAGSTGHPIGSAAAPAVGA

SEQ ID NO: 168453 - protein, 15 aa, Mycobacterium bovis
AGRAAPLPAPPPSGC

SEQ ID NO: 168454 - protein, 9 aa, Mycobacterium bovis
AGRAAVTRT

SEQ ID NO: 168455 - protein, 8 aa, Mycobacterium bovis
AGRAGAQR

SEQ ID NO: 168456 - protein, 15 aa, Mycobacterium bovis
AGRAGEDGEGFSDGA

SEQ ID NO: 168457 - protein, 11 aa, Mycobacterium bovis
AGRAIENEQAA

SEQ ID NO: 168458 - protein, 15 aa, Mycobacterium bovis
AGRAPSPARENTSYR

SEQ ID NO: 168459 - protein, 7 aa, Mycobacterium bovis
AGRARGV

SEQ ID NO: 168460 - protein, 7 aa, Mycobacterium bovis
AGRASGV

SEQ ID NO: 168461 - protein, 7 aa, Mycobacterium bovis
AGRDADG

SEQ ID NO: 168462 - protein, 16 aa, Mycobacterium bovis
AGRDCRQASEELAADG

SEQ ID NO: 168463 - protein, 7 aa, Mycobacterium bovis
AGRDERS

SEQ ID NO: 168464 - protein, 6 aa, Mycobacterium bovis
AGRDGL

SEQ ID NO: 168465 - protein, 14 aa, Mycobacterium bovis
AGRDQNVAHPPAST

SEQ ID NO: 168466 - protein, 9 aa, Mycobacterium bovis
AGRDSNSRG

SEQ ID NO: 168467 - protein, 8 aa, Mycobacterium bovis
AGRGATRG

SEQ ID NO: 168468 - protein, 14 aa, Mycobacterium bovis
AGRGDPSPRRDPEE

SEQ ID NO: 168469 - protein, 15 aa, Mycobacterium bovis
AGRGFSSGADHKSAG

SEQ ID NO: 168470 - protein, 6 aa, Mycobacterium bovis
AGRGGL

SEQ ID NO: 168471 - protein, 11 aa, Mycobacterium bovis
AGRGHASRGDA

SEQ ID NO: 168472 - protein, 11 aa, Mycobacterium bovis
AGRGTKGRQLS

SEQ ID NO: 168473 - protein, 4 aa, Mycobacterium bovis
AGRH

SEQ ID NO: 168474 - protein, 9 aa, Mycobacterium bovis
AGRHGPSGR

SEQ ID NO: 168475 - protein, 4 aa, Mycobacterium bovis
AGRI

SEQ ID NO: 168476 - protein, 21 aa, Mycobacterium bovis
AGRIEARTDPWDPATEPGAED

SEQ ID NO: 168477 - protein, 9 aa, Mycobacterium bovis
AGRKAHSRA

SEQ ID NO: 168478 - protein, 6 aa, Mycobacterium bovis
AGRKGY

SEQ ID NO: 168479 - protein, 7 aa, Mycobacterium bovis
AGRPAQI

SEQ ID NO: 168480 - protein, 6 aa, Mycobacterium bovis
AGRPEA

SEQ ID NO: 168481 - protein, 6 aa, Mycobacterium bovis
AGRPEL

SEQ ID NO: 168482 - protein, 8 aa, Mycobacterium bovis
AGRPGPVP

SEQ ID NO: 168483 - protein, 6 aa, Mycobacterium bovis
AGRPIS

SEQ ID NO: 168484 - protein, 9 aa, Mycobacterium bovis
AGRPTRANF

SEQ ID NO: 168485 - protein, 15 aa, Mycobacterium bovis
AGRPVTSTSCPTAAR

SEQ ID NO: 168486 - protein, 4 aa, Mycobacterium bovis
AGRR

SEQ ID NO: 168487 - protein, 11 aa, Mycobacterium bovis
AGRRAAQACTP

SEQ ID NO: 168488 - protein, 9 aa, Mycobacterium bovis
AGRRDTARR

SEQ ID NO: 168489 - protein, 6 aa, Mycobacterium bovis
AGRRGG

SEQ ID NO: 168490 - protein, 5 aa, Mycobacterium bovis
AGRRH

SEQ ID NO: 168491 - protein, 12 aa, Mycobacterium bovis
AGRRIGAGHNNA

SEQ ID NO: 168492 - protein, 12 aa, Mycobacterium bovis
AGRRNPAVTAQA

SEQ ID NO: 168493 - protein, 11 aa, Mycobacterium bovis
AGRRPEHTGSH

SEQ ID NO: 168494 - protein, 25 aa, Mycobacterium bovis
AGRRTETHERPIDGTPVVGTDRGGK

SEQ ID NO: 168495 - protein, 6 aa, Mycobacterium bovis
AGRRTG

SEQ ID NO: 168496 - protein, 9 aa, Mycobacterium bovis
AGRSADEQL

SEQ ID NO: 168497 - protein, 6 aa, Mycobacterium bovis
AGRSDN

SEQ ID NO: 168498 - protein, 6 aa, Mycobacterium bovis
AGRSIR

SEQ ID NO: 168499 - protein, 4 aa, Mycobacterium bovis
AGRT

SEQ ID NO: 168500 - protein, 8 aa, Mycobacterium bovis
AGRTGTDV

SEQ ID NO: 168501 - protein, 6 aa, Mycobacterium bovis
AGRTPN

SEQ ID NO: 168502 - protein, 7 aa, Mycobacterium bovis
AGRTSAP

SEQ ID NO: 168503 - protein, 9 aa, Mycobacterium bovis
AGRTSPGID

SEQ ID NO: 168504 - protein, 8 aa, Mycobacterium bovis
AGRTTYRQ

SEQ ID NO: 168505 - protein, 4 aa, Mycobacterium bovis
AGRY

SEQ ID NO: 168506 - protein, 6 aa, Mycobacterium bovis
AGRYPT

SEQ ID NO: 168507 - protein, 11 aa, Mycobacterium bovis
AGRYQRDRGPS

SEQ ID NO: 168508 - protein, 8 aa, Mycobacterium bovis
AGRYRSAS

SEQ ID NO: 168509 - protein, 4 aa, Mycobacterium bovis
AGSA

SEQ ID NO: 168510 - protein, 15 aa, Mycobacterium bovis
AGSADTSGGDQPTLG

SEQ ID NO: 168511 - protein, 5 aa, Mycobacterium bovis
AGSAE

SEQ ID NO: 168512 - protein, 7 aa, Mycobacterium bovis
AGSAGSV

SEQ ID NO: 168513 - protein, 6 aa, Mycobacterium bovis
AGSAPM

SEQ ID NO: 168514 - protein, 6 aa, Mycobacterium bovis
AGSASG

SEQ ID NO: 168515 - protein, 6 aa, Mycobacterium bovis
AGSATP

SEQ ID NO: 168516 - protein, 4 aa, Mycobacterium bovis
AGSD

SEQ ID NO: 168517 - protein, 5 aa, Mycobacterium bovis
AGSDA

SEQ ID NO: 168518 - protein, 10 aa, Mycobacterium bovis
AGSDALPEPT

SEQ ID NO: 168519 - protein, 10 aa, Mycobacterium bovis
AGSDDQKAAF

SEQ ID NO: 168520 - protein, 6 aa, Mycobacterium bovis
AGSDGL

SEQ ID NO: 168521 - protein, 8 aa, Mycobacterium bovis
AGSDGVPS

SEQ ID NO: 168522 - protein, 9 aa, Mycobacterium bovis
AGSDPMNPR

SEQ ID NO: 168523 - protein, 7 aa, Mycobacterium bovis
AGSEAGL

SEQ ID NO: 168524 - protein, 10 aa, Mycobacterium bovis
AGSEHGSAKT

SEQ ID NO: 168525 - protein, 8 aa, Mycobacterium bovis
AGSEPARR

SEQ ID NO: 168526 - protein, 7 aa, Mycobacterium bovis
AGSEPMS

SEQ ID NO: 168527 - protein, 12 aa, Mycobacterium bovis
AGSEPMSERPAA

SEQ ID NO: 168528 - protein, 5 aa, Mycobacterium bovis
AGSGA

SEQ ID NO: 168529 - protein, 6 aa, Mycobacterium bovis
AGSGIR

SEQ ID NO: 168530 - protein, 7 aa, Mycobacterium bovis
AGSGKTA

SEQ ID NO: 168531 - protein, 16 aa, Mycobacterium bovis
AGSGNISLPAAKTGAT

SEQ ID NO: 168532 - protein, 7 aa, Mycobacterium bovis
AGSGNVS

SEQ ID NO: 168533 - protein, 6 aa, Mycobacterium bovis
AGSGPL

SEQ ID NO: 168534 - protein, 5 aa, Mycobacterium bovis
AGSGT

SEQ ID NO: 168535 - protein, 14 aa, Mycobacterium bovis
AGSGTGTGGAGPRY

SEQ ID NO: 168536 - protein, 6 aa, Mycobacterium bovis
AGSGTV

SEQ ID NO: 168537 - protein, 9 aa, Mycobacterium bovis
AGSHNPGHT

SEQ ID NO: 168538 - protein, 48 aa, Mycobacterium bovis
AGSINTGFANSGSINTGGFDSGDRNTGFGSSVDQSVSSSGFGNTGMNS

SEQ ID NO: 168539 - protein, 9 aa, Mycobacterium bovis
AGSNAQSQL

SEQ ID NO: 168540 - protein, 10 aa, Mycobacterium bovis
AGSNIGGIAE

SEQ ID NO: 168541 - protein, 9 aa, Mycobacterium bovis
AGSNPGSAA

SEQ ID NO: 168542 - protein, 4 aa, Mycobacterium bovis
AGSP

SEQ ID NO: 168543 - protein, 7 aa, Mycobacterium bovis
AGSPDLA

SEQ ID NO: 168544 - protein, 8 aa, Mycobacterium bovis
AGSPDTSA

SEQ ID NO: 168545 - protein, 7 aa, Mycobacterium bovis
AGSPEAD

SEQ ID NO: 168546 - protein, 13 aa, Mycobacterium bovis
AGSPERDFGERSA

SEQ ID NO: 168547 - protein, 8 aa, Mycobacterium bovis
AGSPEVDT

SEQ ID NO: 168548 - protein, 15 aa, Mycobacterium bovis
AGSPPPQSDSSTDGL

SEQ ID NO: 168549 - protein, 16 aa, Mycobacterium bovis
AGSPRAASRGAFGQSP

SEQ ID NO: 168550 - protein, 6 aa, Mycobacterium bovis
AGSRAA

SEQ ID NO: 168551 - protein, 10 aa, Mycobacterium bovis
AGSRFAERGH

SEQ ID NO: 168552 - protein, 7 aa, Mycobacterium bovis
AGSSAGA

SEQ ID NO: 168553 - protein, 31 aa, Mycobacterium bovis
AGSSASASAVTPFSTPPQIANPTAQGTQAAA

SEQ ID NO: 168554 - protein, 29 aa, Mycobacterium bovis
AGSSATASQLAPFSEPPQTTNPSATAAQS

SEQ ID NO: 168555 - protein, 9 aa, Mycobacterium bovis
AGSSATASR

SEQ ID NO: 168556 - protein, 10 aa, Mycobacterium bovis
AGSSATATKV

SEQ ID NO: 168557 - protein, 9 aa, Mycobacterium bovis
AGSSGSRSV

SEQ ID NO: 168558 - protein, 6 aa, Mycobacterium bovis
AGSSLA

SEQ ID NO: 168559 - protein, 9 aa, Mycobacterium bovis
AGSSSVATQ

SEQ ID NO: 168560 - protein, 5 aa, Mycobacterium bovis
AGSSV

SEQ ID NO: 168561 - protein, 7 aa, Mycobacterium bovis
AGSVSER

SEQ ID NO: 168562 - protein, 7 aa, Mycobacterium bovis
AGTADAR

SEQ ID NO: 168563 - protein, 6 aa, Mycobacterium bovis
AGTADN

SEQ ID NO: 168564 - protein, 18 aa, Mycobacterium bovis
AGTAEGASNTGARLADAA

SEQ ID NO: 168565 - protein, 7 aa, Mycobacterium bovis
AGTAEQK

SEQ ID NO: 168566 - protein, 6 aa, Mycobacterium bovis
AGTAGA

SEQ ID NO: 168567 - protein, 10 aa, Mycobacterium bovis
AGTDAGSTIE

SEQ ID NO: 168568 - protein, 14 aa, Mycobacterium bovis
AGTDEQHPDSQGRI

SEQ ID NO: 168569 - protein, 13 aa, Mycobacterium bovis
AGTDGQDQTEARD

SEQ ID NO: 168570 - protein, 6 aa, Mycobacterium bovis
AGTDRG

SEQ ID NO: 168571 - protein, 18 aa, Mycobacterium bovis
AGTDRPDGYRAILESHWR

SEQ ID NO: 168572 - protein, 8 aa, Mycobacterium bovis
AGTDTGPI

SEQ ID NO: 168573 - protein, 6 aa, Mycobacterium bovis
AGTDVR

SEQ ID NO: 168574 - protein, 5 aa, Mycobacterium bovis
AGTEK

SEQ ID NO: 168575 - protein, 7 aa, Mycobacterium bovis
AGTEPDH

SEQ ID NO: 168576 - protein, 22 aa, Mycobacterium bovis
AGTGGEGGTGGTGGTGGNGADA

SEQ ID NO: 168577 - protein, 25 aa, Mycobacterium bovis
AGTGGHGAAGGVPAGVGGAGGNGGL

SEQ ID NO: 168578 - protein, 9 aa, Mycobacterium bovis
AGTGGPDVR

SEQ ID NO: 168579 - protein, 9 aa, Mycobacterium bovis
AGTGGQAAL

SEQ ID NO: 168580 - protein, 129 aa, Mycobacterium bovis
AGTGGTGGNGGTGGTGGTGGAGGAGGTGSTLGATGATGAAGRAGNGGVGGSGGLGSAFGPGGTGGMGGAGGTSTVSAGGDGGRGGFGGDGLDASSGGNGGDGGHGGDGFRTAGAGGRGGDGGKGADPGG

SEQ ID NO: 168581 - protein, 10 aa, Mycobacterium bovis
AGTGGTSATI

SEQ ID NO: 168582 - protein, 5 aa, Mycobacterium bovis
AGTGI

SEQ ID NO: 168583 - protein, 15 aa, Mycobacterium bovis
AGTGIGSATARRALA

SEQ ID NO: 168584 - protein, 5 aa, Mycobacterium bovis
AGTGK

SEQ ID NO: 168585 - protein, 7 aa, Mycobacterium bovis
AGTGKLT

SEQ ID NO: 168586 - protein, 9 aa, Mycobacterium bovis
AGTGKTRTI

SEQ ID NO: 168587 - protein, 9 aa, Mycobacterium bovis
AGTGNDHAR

SEQ ID NO: 168588 - protein, 10 aa, Mycobacterium bovis
AGTGPRPGID

SEQ ID NO: 168589 - protein, 6 aa, Mycobacterium bovis
AGTGRN

SEQ ID NO: 168590 - protein, 16 aa, Mycobacterium bovis
AGTGTPAGPPAPFGPD

SEQ ID NO: 168591 - protein, 5 aa, Mycobacterium bovis
AGTGV

SEQ ID NO: 168592 - protein, 25 aa, Mycobacterium bovis
AGTGVAPTAVAAPGDAGLSQEGEPF

SEQ ID NO: 168593 - protein, 7 aa, Mycobacterium bovis
AGTIGAA

SEQ ID NO: 168594 - protein, 7 aa, Mycobacterium bovis
AGTKERM

SEQ ID NO: 168595 - protein, 4 aa, Mycobacterium bovis
AGTN

SEQ ID NO: 168596 - protein, 8 aa, Mycobacterium bovis
AGTNPAYG

SEQ ID NO: 168597 - protein, 8 aa, Mycobacterium bovis
AGTNYNKT

SEQ ID NO: 168598 - protein, 17 aa, Mycobacterium bovis
AGTPAGSRRAQPAADNV

SEQ ID NO: 168599 - protein, 7 aa, Mycobacterium bovis
AGTPESQ

SEQ ID NO: 168600 - protein, 58 aa, Mycobacterium bovis
AGTPGAAGTGGDGGVGGTGAAGGKGGAGGSGGVNGATGADGAKGLDGATGGKGNNGNP

SEQ ID NO: 168601 - protein, 7 aa, Mycobacterium bovis
AGTPGKR

SEQ ID NO: 168602 - protein, 6 aa, Mycobacterium bovis
AGTPMT

SEQ ID NO: 168603 - protein, 7 aa, Mycobacterium bovis
AGTPPDA

SEQ ID NO: 168604 - protein, 17 aa, Mycobacterium bovis
AGTPPITPEMVRRALDE

SEQ ID NO: 168605 - protein, 7 aa, Mycobacterium bovis
AGTPQRR

SEQ ID NO: 168606 - protein, 13 aa, Mycobacterium bovis
AGTPVKANRSAHG

SEQ ID NO: 168607 - protein, 6 aa, Mycobacterium bovis
AGTQPQ

SEQ ID NO: 168608 - protein, 6 aa, Mycobacterium bovis
AGTRGV

SEQ ID NO: 168609 - protein, 9 aa, Mycobacterium bovis
AGTRSAREL

SEQ ID NO: 168610 - protein, 7 aa, Mycobacterium bovis
AGTSDDA

SEQ ID NO: 168611 - protein, 8 aa, Mycobacterium bovis
AGTSDGSH

SEQ ID NO: 168612 - protein, 11 aa, Mycobacterium bovis
AGTSFATPDKL

SEQ ID NO: 168613 - protein, 6 aa, Mycobacterium bovis
AGTTAN

SEQ ID NO: 168614 - protein, 9 aa, Mycobacterium bovis
AGTTGYSEQ

SEQ ID NO: 168615 - protein, 7 aa, Mycobacterium bovis
AGTTSPV

SEQ ID NO: 168616 - protein, 7 aa, Mycobacterium bovis
AGTTVDP

SEQ ID NO: 168617 - protein, 11 aa, Mycobacterium bovis
AGTVKADERTQ

SEQ ID NO: 168618 - protein, 6 aa, Mycobacterium bovis
AGTVKP

SEQ ID NO: 168619 - protein, 7 aa, Mycobacterium bovis
AGTYDTA

SEQ ID NO: 168620 - protein, 11 aa, Mycobacterium bovis
AGVDGSNVGRS

SEQ ID NO: 168621 - protein, 5 aa, Mycobacterium bovis
AGVDP

SEQ ID NO: 168622 - protein, 7 aa, Mycobacterium bovis
AGVDPDS

SEQ ID NO: 168623 - protein, 5 aa, Mycobacterium bovis
AGVGD

SEQ ID NO: 168624 - protein, 7 aa, Mycobacterium bovis
AGVGGAD

SEQ ID NO: 168625 - protein, 6 aa, Mycobacterium bovis
AGVGGG

SEQ ID NO: 168626 - protein, 15 aa, Mycobacterium bovis
AGVGSGTADHPGDPW

SEQ ID NO: 168627 - protein, 11 aa, Mycobacterium bovis
AGVGTQVADGG

SEQ ID NO: 168628 - protein, 11 aa, Mycobacterium bovis
AGVPGADPSEW

SEQ ID NO: 168629 - protein, 6 aa, Mycobacterium bovis
AGVPQH

SEQ ID NO: 168630 - protein, 7 aa, Mycobacterium bovis
AGVQPET

SEQ ID NO: 168631 - protein, 8 aa, Mycobacterium bovis
AGVREAER

SEQ ID NO: 168632 - protein, 17 aa, Mycobacterium bovis
AGVRGEDAAEHLREAMT

SEQ ID NO: 168633 - protein, 5 aa, Mycobacterium bovis
AGVRP

SEQ ID NO: 168634 - protein, 9 aa, Mycobacterium bovis
AGVSDDTPL

SEQ ID NO: 168635 - protein, 6 aa, Mycobacterium bovis
AGVSRP

SEQ ID NO: 168636 - protein, 20 aa, Mycobacterium bovis
AGVSTRSVDGVDRTAPPAVS

SEQ ID NO: 168637 - protein, 4 aa, Mycobacterium bovis
AGVT

SEQ ID NO: 168638 - protein, 9 aa, Mycobacterium bovis
AGVTAARES

SEQ ID NO: 168639 - protein, 9 aa, Mycobacterium bovis
AGVTGPEAE

SEQ ID NO: 168640 - protein, 5 aa, Mycobacterium bovis
AGVTP

SEQ ID NO: 168641 - protein, 9 aa, Mycobacterium bovis
AGVTTYSTD

SEQ ID NO: 168642 - protein, 14 aa, Mycobacterium bovis
AGVTVTSDQGQAEA

SEQ ID NO: 168643 - protein, 6 aa, Mycobacterium bovis
AGWEER

SEQ ID NO: 168644 - protein, 5 aa, Mycobacterium bovis
AGWPN

SEQ ID NO: 168645 - protein, 16 aa, Mycobacterium bovis
AGWSSAPRSRYTKTEM

SEQ ID NO: 168646 - protein, 6 aa, Mycobacterium bovis
AGYASE

SEQ ID NO: 168647 - protein, 11 aa, Mycobacterium bovis
AGYEDALTGEG

SEQ ID NO: 168648 - protein, 7 aa, Mycobacterium bovis
AGYTEQD

SEQ ID NO: 168649 - protein, 11 aa, Mycobacterium bovis
AGYTGTTQSLG

SEQ ID NO: 168650 - protein, 4 aa, Mycobacterium bovis
AHAA

SEQ ID NO: 168651 - protein, 12 aa, Mycobacterium bovis
AHADGRVSNPVR

SEQ ID NO: 168652 - protein, 12 aa, Mycobacterium bovis
AHADRRAAGAWA

SEQ ID NO: 168653 - protein, 11 aa, Mycobacterium bovis
AHAGDKAKAAE

SEQ ID NO: 168654 - protein, 8 aa, Mycobacterium bovis
AHAGGDPG

SEQ ID NO: 168655 - protein, 9 aa, Mycobacterium bovis
AHAGPPGPV

SEQ ID NO: 168656 - protein, 8 aa, Mycobacterium bovis
AHASTAEF

SEQ ID NO: 168657 - protein, 13 aa, Mycobacterium bovis
AHATSGEESAPVT

SEQ ID NO: 168658 - protein, 7 aa, Mycobacterium bovis
AHDAPKG

SEQ ID NO: 168659 - protein, 6 aa, Mycobacterium bovis
AHDDGS

SEQ ID NO: 168660 - protein, 17 aa, Mycobacterium bovis
AHDGEHGDRADAAPTSD

SEQ ID NO: 168661 - protein, 25 aa, Mycobacterium bovis
AHDPAKSFPAPTELPKVTSRPASPL

SEQ ID NO: 168662 - protein, 4 aa, Mycobacterium bovis
AHDR

SEQ ID NO: 168663 - protein, 5 aa, Mycobacterium bovis
AHEAA

SEQ ID NO: 168664 - protein, 7 aa, Mycobacterium bovis
AHEEGGE

SEQ ID NO: 168665 - protein, 8 aa, Mycobacterium bovis
AHESGQAT

SEQ ID NO: 168666 - protein, 9 aa, Mycobacterium bovis
AHGGGGKGM

SEQ ID NO: 168667 - protein, 8 aa, Mycobacterium bovis
AHGMDSAT

SEQ ID NO: 168668 - protein, 5 aa, Mycobacterium bovis
AHGNE

SEQ ID NO: 168669 - protein, 6 aa, Mycobacterium bovis
AHGQDG

SEQ ID NO: 168670 - protein, 6 aa, Mycobacterium bovis
AHGSPT

SEQ ID NO: 168671 - protein, 9 aa, Mycobacterium bovis
AHGVGDPSG

SEQ ID NO: 168672 - protein, 7 aa, Mycobacterium bovis
AHGVTAA

SEQ ID NO: 168673 - protein, 5 aa, Mycobacterium bovis
AHKDE

SEQ ID NO: 168674 - protein, 4 aa, Mycobacterium bovis
AHKR

SEQ ID NO: 168675 - protein, 17 aa, Mycobacterium bovis
AHKRSGAEVATGRSAGR

SEQ ID NO: 168676 - protein, 12 aa, Mycobacterium bovis
AHKRTGAPISTH

SEQ ID NO: 168677 - protein, 8 aa, Mycobacterium bovis
AHNDGPAV

SEQ ID NO: 168678 - protein, 6 aa, Mycobacterium bovis
AHPAPA

SEQ ID NO: 168679 - protein, 9 aa, Mycobacterium bovis
AHPARPARR

SEQ ID NO: 168680 - protein, 5 aa, Mycobacterium bovis
AHPAS

SEQ ID NO: 168681 - protein, 21 aa, Mycobacterium bovis
AHPASGSTSSLCETGSPTTRM

SEQ ID NO: 168682 - protein, 5 aa, Mycobacterium bovis
AHPDR

SEQ ID NO: 168683 - protein, 4 aa, Mycobacterium bovis
AHPE

SEQ ID NO: 168684 - protein, 5 aa, Mycobacterium bovis
AHPEG

SEQ ID NO: 168685 - protein, 13 aa, Mycobacterium bovis
AHPELKSRPTRPH

SEQ ID NO: 168686 - protein, 12 aa, Mycobacterium bovis
AHPGGSNTELTR

SEQ ID NO: 168687 - protein, 7 aa, Mycobacterium bovis
AHPGLTK

SEQ ID NO: 168688 - protein, 17 aa, Mycobacterium bovis
AHPPALPDPLPAGPTRR

SEQ ID NO: 168689 - protein, 19 aa, Mycobacterium bovis
AHPPTDQNTPAEGRRRYTT

SEQ ID NO: 168690 - protein, 10 aa, Mycobacterium bovis
AHPQPGNPAP

SEQ ID NO: 168691 - protein, 6 aa, Mycobacterium bovis
AHPSAA

SEQ ID NO: 168692 - protein, 9 aa, Mycobacterium bovis
AHPSAEQAV

SEQ ID NO: 168693 - protein, 7 aa, Mycobacterium bovis
AHPSLPR

SEQ ID NO: 168694 - protein, 10 aa, Mycobacterium bovis
AHPSTQDRSL

SEQ ID NO: 168695 - protein, 6 aa, Mycobacterium bovis
AHPVTD

SEQ ID NO: 168696 - protein, 16 aa, Mycobacterium bovis
AHQDRADDAEKSLAET

SEQ ID NO: 168697 - protein, 19 aa, Mycobacterium bovis
AHQEATAASEMAAVTQVTV

SEQ ID NO: 168698 - protein, 7 aa, Mycobacterium bovis
AHQRPGA

SEQ ID NO: 168699 - protein, 6 aa, Mycobacterium bovis
AHQSGA

SEQ ID NO: 168700 - protein, 6 aa, Mycobacterium bovis
AHQSGT

SEQ ID NO: 168701 - protein, 4 aa, Mycobacterium bovis
AHRA

SEQ ID NO: 168702 - protein, 18 aa, Mycobacterium bovis
AHRAAGRDRAYPAETLPE

SEQ ID NO: 168703 - protein, 8 aa, Mycobacterium bovis
AHRAGADQ

SEQ ID NO: 168704 - protein, 5 aa, Mycobacterium bovis
AHRDT

SEQ ID NO: 168705 - protein, 11 aa, Mycobacterium bovis
AHRKTRPGPAA

SEQ ID NO: 168706 - protein, 12 aa, Mycobacterium bovis
AHRPSKPLPPGG

SEQ ID NO: 168707 - protein, 15 aa, Mycobacterium bovis
AHRRETAKVEESRGR

SEQ ID NO: 168708 - protein, 9 aa, Mycobacterium bovis
AHRSGTTTY

SEQ ID NO: 168709 - protein, 9 aa, Mycobacterium bovis
AHSAANGGV

SEQ ID NO: 168710 - protein, 18 aa, Mycobacterium bovis
AHSDTTAPAGGSTPIYEP

SEQ ID NO: 168711 - protein, 20 aa, Mycobacterium bovis
AHSGPGSPPVRRQLPRPRPS

SEQ ID NO: 168712 - protein, 6 aa, Mycobacterium bovis
AHSKGV

SEQ ID NO: 168713 - protein, 9 aa, Mycobacterium bovis
AHSRDRGES

SEQ ID NO: 168714 - protein, 7 aa, Mycobacterium bovis
AHSTQGS

SEQ ID NO: 168715 - protein, 7 aa, Mycobacterium bovis
AHSVDSS

SEQ ID NO: 168716 - protein, 13 aa, Mycobacterium bovis
AHSYPDAARTDAE

SEQ ID NO: 168717 - protein, 9 aa, Mycobacterium bovis
AHTAEAGAA

SEQ ID NO: 168718 - protein, 12 aa, Mycobacterium bovis
AHTASRRLAEER

SEQ ID NO: 168719 - protein, 6 aa, Mycobacterium bovis
AHTEPY

SEQ ID NO: 168720 - protein, 7 aa, Mycobacterium bovis
AHTPLDG

SEQ ID NO: 168721 - protein, 6 aa, Mycobacterium bovis
AHTRPD

SEQ ID NO: 168722 - protein, 11 aa, Mycobacterium bovis
AIAAQSDASYT

SEQ ID NO: 168723 - protein, 16 aa, Mycobacterium bovis
AIADGDSVTILPAVAG

SEQ ID NO: 168724 - protein, 6 aa, Mycobacterium bovis
AIADGK

SEQ ID NO: 168725 - protein, 10 aa, Mycobacterium bovis
AIANGSEPWR

SEQ ID NO: 168726 - protein, 5 aa, Mycobacterium bovis
AIDAE

SEQ ID NO: 168727 - protein, 10 aa, Mycobacterium bovis
AIDASPVRAY

SEQ ID NO: 168728 - protein, 10 aa, Mycobacterium bovis
AIDDTASALG

SEQ ID NO: 168729 - protein, 8 aa, Mycobacterium bovis
AIDPDHAS

SEQ ID NO: 168730 - protein, 6 aa, Mycobacterium bovis
AIDSDR

SEQ ID NO: 168731 - protein, 6 aa, Mycobacterium bovis
AIEDQS

SEQ ID NO: 168732 - protein, 12 aa, Mycobacterium bovis
AIEPADLDDPDA

SEQ ID NO: 168733 - protein, 12 aa, Mycobacterium bovis
AIETSRRTSRPL

SEQ ID NO: 168734 - protein, 14 aa, Mycobacterium bovis
AIGARAAGRPLDTT

SEQ ID NO: 168735 - protein, 7 aa, Mycobacterium bovis
AIGGTRA

SEQ ID NO: 168736 - protein, 8 aa, Mycobacterium bovis
AIGPDSSL

SEQ ID NO: 168737 - protein, 5 aa, Mycobacterium bovis
AIGPG

SEQ ID NO: 168738 - protein, 11 aa, Mycobacterium bovis
AIGRPEDFSSN

SEQ ID NO: 168739 - protein, 4 aa, Mycobacterium bovis
AIGS

SEQ ID NO: 168740 - protein, 15 aa, Mycobacterium bovis
AIGYEPADITDEEQT

SEQ ID NO: 168741 - protein, 13 aa, Mycobacterium bovis
AIHNGKKDADPYR

SEQ ID NO: 168742 - protein, 21 aa, Mycobacterium bovis
AINNDGSAKMGYAAPNPAAQA

SEQ ID NO: 168743 - protein, 14 aa, Mycobacterium bovis
AIPDGEIAGSAEAS

SEQ ID NO: 168744 - protein, 5 aa, Mycobacterium bovis
AIPER

SEQ ID NO: 168745 - protein, 9 aa, Mycobacterium bovis
AIPGELDDA

SEQ ID NO: 168746 - protein, 11 aa, Mycobacterium bovis
AIPGGNVKRGD

SEQ ID NO: 168747 - protein, 7 aa, Mycobacterium bovis
AIPPDGP

SEQ ID NO: 168748 - protein, 6 aa, Mycobacterium bovis
AIRPSY

SEQ ID NO: 168749 - protein, 12 aa, Mycobacterium bovis
AIRSSAESYDRA

SEQ ID NO: 168750 - protein, 9 aa, Mycobacterium bovis
AISAGDQSI

SEQ ID NO: 168751 - protein, 5 aa, Mycobacterium bovis
AISEG

SEQ ID NO: 168752 - protein, 7 aa, Mycobacterium bovis
AISERIA

SEQ ID NO: 168753 - protein, 5 aa, Mycobacterium bovis
AISGD

SEQ ID NO: 168754 - protein, 5 aa, Mycobacterium bovis
AISSR

SEQ ID NO: 168755 - protein, 7 aa, Mycobacterium bovis
AISTPAR

SEQ ID NO: 168756 - protein, 15 aa, Mycobacterium bovis
AISTTQRGARSGGIV

SEQ ID NO: 168757 - protein, 8 aa, Mycobacterium bovis
AITDPGAV

SEQ ID NO: 168758 - protein, 9 aa, Mycobacterium bovis
AITGSESDQ

SEQ ID NO: 168759 - protein, 4 aa, Mycobacterium bovis
AITP

SEQ ID NO: 168760 - protein, 19 aa, Mycobacterium bovis
AKAAALAARGERDAVAGRR

SEQ ID NO: 168761 - protein, 13 aa, Mycobacterium bovis
AKAAEGEVDADSV

SEQ ID NO: 168762 - protein, 8 aa, Mycobacterium bovis
AKAAGAAG

SEQ ID NO: 168763 - protein, 7 aa, Mycobacterium bovis
AKAAGAK

SEQ ID NO: 168764 - protein, 12 aa, Mycobacterium bovis
AKAAGDAVRNGD

SEQ ID NO: 168765 - protein, 6 aa, Mycobacterium bovis
AKAAGI

SEQ ID NO: 168766 - protein, 8 aa, Mycobacterium bovis
AKAAGLTP

SEQ ID NO: 168767 - protein, 10 aa, Mycobacterium bovis
AKAALGGSDI

SEQ ID NO: 168768 - protein, 5 aa, Mycobacterium bovis
AKAAP

SEQ ID NO: 168769 - protein, 9 aa, Mycobacterium bovis
AKAARSGRT

SEQ ID NO: 168770 - protein, 12 aa, Mycobacterium bovis
AKAATSDAYDNA

SEQ ID NO: 168771 - protein, 7 aa, Mycobacterium bovis
AKADLHS

SEQ ID NO: 168772 - protein, 6 aa, Mycobacterium bovis
AKAEAE

SEQ ID NO: 168773 - protein, 18 aa, Mycobacterium bovis
AKAGAGPPEHNRRLDSDA

SEQ ID NO: 168774 - protein, 6 aa, Mycobacterium bovis
AKAGAT

SEQ ID NO: 168775 - protein, 9 aa, Mycobacterium bovis
AKAGNPNRP

SEQ ID NO: 168776 - protein, 6 aa, Mycobacterium bovis
AKAGRT

SEQ ID NO: 168777 - protein, 5 aa, Mycobacterium bovis
AKAHG

SEQ ID NO: 168778 - protein, 19 aa, Mycobacterium bovis
AKAKDQISGVSTTKPSPLL

SEQ ID NO: 168779 - protein, 10 aa, Mycobacterium bovis
AKAKGHLDAG

SEQ ID NO: 168780 - protein, 11 aa, Mycobacterium bovis
AKALSDTVTPA

SEQ ID NO: 168781 - protein, 7 aa, Mycobacterium bovis
AKAPAAF

SEQ ID NO: 168782 - protein, 8 aa, Mycobacterium bovis
AKAPDGSR

SEQ ID NO: 168783 - protein, 13 aa, Mycobacterium bovis
AKAQETKEKAAGA

SEQ ID NO: 168784 - protein, 6 aa, Mycobacterium bovis
AKAQRH

SEQ ID NO: 168785 - protein, 7 aa, Mycobacterium bovis
AKAQTAE

SEQ ID NO: 168786 - protein, 10 aa, Mycobacterium bovis
AKARDAFSAT

SEQ ID NO: 168787 - protein, 6 aa, Mycobacterium bovis
AKARQS

SEQ ID NO: 168788 - protein, 21 aa, Mycobacterium bovis
AKASEKARKSVADDVHTGQPA

SEQ ID NO: 168789 - protein, 10 aa, Mycobacterium bovis
AKASGASRSE

SEQ ID NO: 168790 - protein, 8 aa, Mycobacterium bovis
AKATGTSV

SEQ ID NO: 168791 - protein, 8 aa, Mycobacterium bovis
AKATPPPF

SEQ ID NO: 168792 - protein, 7 aa, Mycobacterium bovis
AKATRKL

SEQ ID NO: 168793 - protein, 6 aa, Mycobacterium bovis
AKATSR

SEQ ID NO: 168794 - protein, 8 aa, Mycobacterium bovis
AKDAEGGS

SEQ ID NO: 168795 - protein, 15 aa, Mycobacterium bovis
AKDAFGAQKRQRQMD

SEQ ID NO: 168796 - protein, 44 aa, Mycobacterium bovis
AKDAGEAAAPAPEKVPAAQPESKPAPEPPPVQPTSGAPAGGDAK

SEQ ID NO: 168797 - protein, 23 aa, Mycobacterium bovis
AKDGAGAGTIPDPFGGPGRSPTM

SEQ ID NO: 168798 - protein, 12 aa, Mycobacterium bovis
AKDGDRRVPPTF

SEQ ID NO: 168799 - protein, 8 aa, Mycobacterium bovis
AKDGSPKI

SEQ ID NO: 168800 - protein, 11 aa, Mycobacterium bovis
AKDPDSTYPPI

SEQ ID NO: 168801 - protein, 8 aa, Mycobacterium bovis
AKDPESVQ

SEQ ID NO: 168802 - protein, 7 aa, Mycobacterium bovis
AKDPGRS

SEQ ID NO: 168803 - protein, 9 aa, Mycobacterium bovis
AKDSRTTAE

SEQ ID NO: 168804 - protein, 4 aa, Mycobacterium bovis
AKDT

SEQ ID NO: 168805 - protein, 8 aa, Mycobacterium bovis
AKDTRGEF

SEQ ID NO: 168806 - protein, 14 aa, Mycobacterium bovis
AKDVGKRAERATAE

SEQ ID NO: 168807 - protein, 8 aa, Mycobacterium bovis
AKEALADP

SEQ ID NO: 168808 - protein, 7 aa, Mycobacterium bovis
AKEIGGP

SEQ ID NO: 168809 - protein, 4 aa, Mycobacterium bovis
AKEM

SEQ ID NO: 168810 - protein, 8 aa, Mycobacterium bovis
AKENTRRV

SEQ ID NO: 168811 - protein, 22 aa, Mycobacterium bovis
AKEPGGEKAAAKRDKKGIPSAR

SEQ ID NO: 168812 - protein, 6 aa, Mycobacterium bovis
AKEQKA

SEQ ID NO: 168813 - protein, 6 aa, Mycobacterium bovis
AKEQQL

SEQ ID NO: 168814 - protein, 11 aa, Mycobacterium bovis
AKEVETKEQIA

SEQ ID NO: 168815 - protein, 12 aa, Mycobacterium bovis
AKFTPAREALDN

SEQ ID NO: 168816 - protein, 8 aa, Mycobacterium bovis
AKGAGISR

SEQ ID NO: 168817 - protein, 15 aa, Mycobacterium bovis
AKGAPPERIQHDPLS

SEQ ID NO: 168818 - protein, 7 aa, Mycobacterium bovis
AKGASEI

SEQ ID NO: 168819 - protein, 13 aa, Mycobacterium bovis
AKGEPTPQDGYAG

SEQ ID NO: 168820 - protein, 7 aa, Mycobacterium bovis
AKGGHPV

SEQ ID NO: 168821 - protein, 7 aa, Mycobacterium bovis
AKGGTSF

SEQ ID NO: 168822 - protein, 10 aa, Mycobacterium bovis
AKGGVTLHPN

SEQ ID NO: 168823 - protein, 15 aa, Mycobacterium bovis
AKGHPRAQERDDALS

SEQ ID NO: 168824 - protein, 15 aa, Mycobacterium bovis
AKGNSDSWPDTKNPL

SEQ ID NO: 168825 - protein, 13 aa, Mycobacterium bovis
AKGPFDGGAEGSA

SEQ ID NO: 168826 - protein, 10 aa, Mycobacterium bovis
AKGPGLNPFG

SEQ ID NO: 168827 - protein, 7 aa, Mycobacterium bovis
AKGRAAL

SEQ ID NO: 168828 - protein, 8 aa, Mycobacterium bovis
AKGRGRDM

SEQ ID NO: 168829 - protein, 5 aa, Mycobacterium bovis
AKGRQ

SEQ ID NO: 168830 - protein, 5 aa, Mycobacterium bovis
AKGTD

SEQ ID NO: 168831 - protein, 4 aa, Mycobacterium bovis
AKGV

SEQ ID NO: 168832 - protein, 14 aa, Mycobacterium bovis
AKGYRNPVSPDPFA

SEQ ID NO: 168833 - protein, 4 aa, Mycobacterium bovis
AKHA

SEQ ID NO: 168834 - protein, 8 aa, Mycobacterium bovis
AKHAGGDS

SEQ ID NO: 168835 - protein, 7 aa, Mycobacterium bovis
AKHDAEH

SEQ ID NO: 168836 - protein, 9 aa, Mycobacterium bovis
AKHKGEEAK

SEQ ID NO: 168837 - protein, 14 aa, Mycobacterium bovis
AKHTAPRGSSRPLT

SEQ ID NO: 168838 - protein, 9 aa, Mycobacterium bovis
AKIGPDKDI

SEQ ID NO: 168839 - protein, 14 aa, Mycobacterium bovis
AKIGSKGRPLPGAG

SEQ ID NO: 168840 - protein, 8 aa, Mycobacterium bovis
AKIPTERS

SEQ ID NO: 168841 - protein, 6 aa, Mycobacterium bovis
AKIPTG

SEQ ID NO: 168842 - protein, 7 aa, Mycobacterium bovis
AKKGGQH

SEQ ID NO: 168843 - protein, 6 aa, Mycobacterium bovis
AKKKAI

SEQ ID NO: 168844 - protein, 6 aa, Mycobacterium bovis
AKKNAI

SEQ ID NO: 168845 - protein, 8 aa, Mycobacterium bovis
AKKPEETR

SEQ ID NO: 168846 - protein, 7 aa, Mycobacterium bovis
AKKRALH

SEQ ID NO: 168847 - protein, 16 aa, Mycobacterium bovis
AKKTDDVAGDGTTTAT

SEQ ID NO: 168848 - protein, 12 aa, Mycobacterium bovis
AKLSAKNEARRI

SEQ ID NO: 168849 - protein, 6 aa, Mycobacterium bovis
AKLTNT

SEQ ID NO: 168850 - protein, 5 aa, Mycobacterium bovis
AKNDG

SEQ ID NO: 168851 - protein, 8 aa, Mycobacterium bovis
AKNHPSAA

SEQ ID NO: 168852 - protein, 7 aa, Mycobacterium bovis
AKNIPAD

SEQ ID NO: 168853 - protein, 9 aa, Mycobacterium bovis
AKNRGGTPD

SEQ ID NO: 168854 - protein, 14 aa, Mycobacterium bovis
AKNTDTREHDIADS

SEQ ID NO: 168855 - protein, 13 aa, Mycobacterium bovis
AKPAAQQPTWPAD

SEQ ID NO: 168856 - protein, 26 aa, Mycobacterium bovis
AKPAGEADPYRDNGSVAQSPAPGGLG

SEQ ID NO: 168857 - protein, 24 aa, Mycobacterium bovis
AKPAIDRKRTTRVAPDGGSPDGPR

SEQ ID NO: 168858 - protein, 5 aa, Mycobacterium bovis
AKPAQ

SEQ ID NO: 168859 - protein, 8 aa, Mycobacterium bovis
AKPDAQAL

SEQ ID NO: 168860 - protein, 10 aa, Mycobacterium bovis
AKPDGPREGG

SEQ ID NO: 168861 - protein, 9 aa, Mycobacterium bovis
AKPEPVGNI

SEQ ID NO: 168862 - protein, 15 aa, Mycobacterium bovis
AKPGARFRQDRQNRL

SEQ ID NO: 168863 - protein, 10 aa, Mycobacterium bovis
AKPGEPFQPY

SEQ ID NO: 168864 - protein, 6 aa, Mycobacterium bovis
AKPGKT

SEQ ID NO: 168865 - protein, 20 aa, Mycobacterium bovis
AKPGPTERQDMSSSESPAGI

SEQ ID NO: 168866 - protein, 11 aa, Mycobacterium bovis
AKPGRMVGPDP

SEQ ID NO: 168867 - protein, 8 aa, Mycobacterium bovis
AKPGVPRS

SEQ ID NO: 168868 - protein, 37 aa, Mycobacterium bovis
AKPHVEAEPDDKHHAPMSTSGLSPDELSALTASWDQW

SEQ ID NO: 168869 - protein, 8 aa, Mycobacterium bovis
AKPLDSIG

SEQ ID NO: 168870 - protein, 8 aa, Mycobacterium bovis
AKPLSDGV

SEQ ID NO: 168871 - protein, 12 aa, Mycobacterium bovis
AKPPGLPDSPDL

SEQ ID NO: 168872 - protein, 13 aa, Mycobacterium bovis
AKPPITVTDPPAD

SEQ ID NO: 168873 - protein, 10 aa, Mycobacterium bovis
AKPPPSGSPG

SEQ ID NO: 168874 - protein, 10 aa, Mycobacterium bovis
AKPTPADAAD

SEQ ID NO: 168875 - protein, 6 aa, Mycobacterium bovis
AKPTSN

SEQ ID NO: 168876 - protein, 10 aa, Mycobacterium bovis
AKPVGADTGL

SEQ ID NO: 168877 - protein, 4 aa, Mycobacterium bovis
AKPY

SEQ ID NO: 168878 - protein, 5 aa, Mycobacterium bovis
AKQDV

SEQ ID NO: 168879 - protein, 8 aa, Mycobacterium bovis
AKQGTNIE

SEQ ID NO: 168880 - protein, 7 aa, Mycobacterium bovis
AKQNSYA

SEQ ID NO: 168881 - protein, 10 aa, Mycobacterium bovis
AKQTAKSGAT

SEQ ID NO: 168882 - protein, 4 aa, Mycobacterium bovis
AKRA

SEQ ID NO: 168883 - protein, 7 aa, Mycobacterium bovis
AKRAVDA

SEQ ID NO: 168884 - protein, 14 aa, Mycobacterium bovis
AKREYEASVSRAQA

SEQ ID NO: 168885 - protein, 7 aa, Mycobacterium bovis
AKRGDAS

SEQ ID NO: 168886 - protein, 9 aa, Mycobacterium bovis
AKRGYPEDI

SEQ ID NO: 168887 - protein, 8 aa, Mycobacterium bovis
AKRKTTQR

SEQ ID NO: 168888 - protein, 11 aa, Mycobacterium bovis
AKRLGDDRRPL

SEQ ID NO: 168889 - protein, 9 aa, Mycobacterium bovis
AKRRLTDSV

SEQ ID NO: 168890 - protein, 11 aa, Mycobacterium bovis
AKRRRTAHSAI

SEQ ID NO: 168891 - protein, 18 aa, Mycobacterium bovis
AKSALDPAGILNPGVLLG

SEQ ID NO: 168892 - protein, 12 aa, Mycobacterium bovis
AKSEVTKAEKYE

SEQ ID NO: 168893 - protein, 8 aa, Mycobacterium bovis
AKSGTAEL

SEQ ID NO: 168894 - protein, 7 aa, Mycobacterium bovis
AKSHAGQ

SEQ ID NO: 168895 - protein, 4 aa, Mycobacterium bovis
AKSM

SEQ ID NO: 168896 - protein, 15 aa, Mycobacterium bovis
AKSQTAAYGSLPAQG

SEQ ID NO: 168897 - protein, 5 aa, Mycobacterium bovis
AKSVA

SEQ ID NO: 168898 - protein, 7 aa, Mycobacterium bovis
AKTAGRN

SEQ ID NO: 168899 - protein, 4 aa, Mycobacterium bovis
AKTD

SEQ ID NO: 168900 - protein, 12 aa, Mycobacterium bovis
AKTDAAADGGGV

SEQ ID NO: 168901 - protein, 8 aa, Mycobacterium bovis
AKTDEDKL

SEQ ID NO: 168902 - protein, 7 aa, Mycobacterium bovis
AKTDGNS

SEQ ID NO: 168903 - protein, 13 aa, Mycobacterium bovis
AKTDRSAVAGATP

SEQ ID NO: 168904 - protein, 9 aa, Mycobacterium bovis
AKTEPIGEE

SEQ ID NO: 168905 - protein, 6 aa, Mycobacterium bovis
AKTGDY

SEQ ID NO: 168906 - protein, 5 aa, Mycobacterium bovis
AKTGM

SEQ ID NO: 168907 - protein, 5 aa, Mycobacterium bovis
AKTGN

SEQ ID NO: 168908 - protein, 7 aa, Mycobacterium bovis
AKTPAEI

SEQ ID NO: 168909 - protein, 10 aa, Mycobacterium bovis
AKTPKQKRDR

SEQ ID NO: 168910 - protein, 6 aa, Mycobacterium bovis
AKVDRT

SEQ ID NO: 168911 - protein, 8 aa, Mycobacterium bovis
AKVEEERA

SEQ ID NO: 168912 - protein, 13 aa, Mycobacterium bovis
AKVGSDKDNPDIP

SEQ ID NO: 168913 - protein, 4 aa, Mycobacterium bovis
AKVN

SEQ ID NO: 168914 - protein, 7 aa, Mycobacterium bovis
AKVPGKG

SEQ ID NO: 168915 - protein, 9 aa, Mycobacterium bovis
AKVTSEGER

SEQ ID NO: 168916 - protein, 6 aa, Mycobacterium bovis
AKYPGT

SEQ ID NO: 168917 - protein, 4 aa, Mycobacterium bovis
ALAA

SEQ ID NO: 168918 - protein, 21 aa, Mycobacterium bovis
ALAAPPAATPAAISDQLPSDR

SEQ ID NO: 168919 - protein, 14 aa, Mycobacterium bovis
ALADASADRASQIR

SEQ ID NO: 168920 - protein, 8 aa, Mycobacterium bovis
ALADDKTV

SEQ ID NO: 168921 - protein, 14 aa, Mycobacterium bovis
ALADGDGPEPPLRT

SEQ ID NO: 168922 - protein, 17 aa, Mycobacterium bovis
ALAEAGKAVAPGVTTDE

SEQ ID NO: 168923 - protein, 15 aa, Mycobacterium bovis
ALAEESRESGWDKPS

SEQ ID NO: 168924 - protein, 6 aa, Mycobacterium bovis
ALAEPA

SEQ ID NO: 168925 - protein, 13 aa, Mycobacterium bovis
ALAEPSRQPDDMS

SEQ ID NO: 168926 - protein, 8 aa, Mycobacterium bovis
ALAGAHPD

SEQ ID NO: 168927 - protein, 8 aa, Mycobacterium bovis
ALAGGAGS

SEQ ID NO: 168928 - protein, 9 aa, Mycobacterium bovis
ALAGGGPKY

SEQ ID NO: 168929 - protein, 13 aa, Mycobacterium bovis
ALAGTDIAPPENL

SEQ ID NO: 168930 - protein, 7 aa, Mycobacterium bovis
ALANSNG

SEQ ID NO: 168931 - protein, 5 aa, Mycobacterium bovis
ALAPD

SEQ ID NO: 168932 - protein, 7 aa, Mycobacterium bovis
ALAPGLR

SEQ ID NO: 168933 - protein, 6 aa, Mycobacterium bovis
ALAPGT

SEQ ID NO: 168934 - protein, 6 aa, Mycobacterium bovis
ALAPRG

SEQ ID NO: 168935 - protein, 11 aa, Mycobacterium bovis
ALAPRRTTLPG

SEQ ID NO: 168936 - protein, 8 aa, Mycobacterium bovis
ALARPGTR

SEQ ID NO: 168937 - protein, 8 aa, Mycobacterium bovis
ALASGASE

SEQ ID NO: 168938 - protein, 10 aa, Mycobacterium bovis
ALATKDPRGL

SEQ ID NO: 168939 - protein, 7 aa, Mycobacterium bovis
ALATPRR

SEQ ID NO: 168940 - protein, 4 aa, Mycobacterium bovis
ALDA

SEQ ID NO: 168941 - protein, 9 aa, Mycobacterium bovis
ALDDDDADK

SEQ ID NO: 168942 - protein, 6 aa, Mycobacterium bovis
ALDDGD

SEQ ID NO: 168943 - protein, 8 aa, Mycobacterium bovis
ALDETGCP

SEQ ID NO: 168944 - protein, 6 aa, Mycobacterium bovis
ALDGGA

SEQ ID NO: 168945 - protein, 5 aa, Mycobacterium bovis
ALDPA

SEQ ID NO: 168946 - protein, 8 aa, Mycobacterium bovis
ALDRDGQK

SEQ ID NO: 168947 - protein, 9 aa, Mycobacterium bovis
ALDSGKPVR

SEQ ID NO: 168948 - protein, 11 aa, Mycobacterium bovis
ALEDGSGQARK

SEQ ID NO: 168949 - protein, 8 aa, Mycobacterium bovis
ALEGKNTE

SEQ ID NO: 168950 - protein, 26 aa, Mycobacterium bovis
ALEPVNPPKPPPRHQDRPAPPPQEQG

SEQ ID NO: 168951 - protein, 7 aa, Mycobacterium bovis
ALEQGKG

SEQ ID NO: 168952 - protein, 4 aa, Mycobacterium bovis
ALER

SEQ ID NO: 168953 - protein, 13 aa, Mycobacterium bovis
ALERGRTTQERSD

SEQ ID NO: 168954 - protein, 4 aa, Mycobacterium bovis
ALES

SEQ ID NO: 168955 - protein, 8 aa, Mycobacterium bovis
ALESGDSG

SEQ ID NO: 168956 - protein, 6 aa, Mycobacterium bovis
ALETGR

SEQ ID NO: 168957 - protein, 11 aa, Mycobacterium bovis
ALETQKADPLA

SEQ ID NO: 168958 - protein, 6 aa, Mycobacterium bovis
ALGAPT

SEQ ID NO: 168959 - protein, 14 aa, Mycobacterium bovis
ALGDAGGASGSTSM

SEQ ID NO: 168960 - protein, 5 aa, Mycobacterium bovis
ALGEP

SEQ ID NO: 168961 - protein, 10 aa, Mycobacterium bovis
ALGGERTSGF

SEQ ID NO: 168962 - protein, 18 aa, Mycobacterium bovis
ALGGNRPAVYAPKSALGH

SEQ ID NO: 168963 - protein, 6 aa, Mycobacterium bovis
ALGKGA

SEQ ID NO: 168964 - protein, 5 aa, Mycobacterium bovis
ALGNN

SEQ ID NO: 168965 - protein, 7 aa, Mycobacterium bovis
ALGPAAD

SEQ ID NO: 168966 - protein, 13 aa, Mycobacterium bovis
ALGPGGLSRERAG

SEQ ID NO: 168967 - protein, 8 aa, Mycobacterium bovis
ALGPGSPV

SEQ ID NO: 168968 - protein, 6 aa, Mycobacterium bovis
ALGPGT

SEQ ID NO: 168969 - protein, 5 aa, Mycobacterium bovis
ALGRS

SEQ ID NO: 168970 - protein, 11 aa, Mycobacterium bovis
ALGSAAGSEAA

SEQ ID NO: 168971 - protein, 7 aa, Mycobacterium bovis
ALGSQGG

SEQ ID NO: 168972 - protein, 8 aa, Mycobacterium bovis
ALGTTGLK

SEQ ID NO: 168973 - protein, 6 aa, Mycobacterium bovis
ALKETS

SEQ ID NO: 168974 - protein, 8 aa, Mycobacterium bovis
ALNNSGTT

SEQ ID NO: 168975 - protein, 6 aa, Mycobacterium bovis
ALNSSE

SEQ ID NO: 168976 - protein, 9 aa, Mycobacterium bovis
ALPAAPDSE

SEQ ID NO: 168977 - protein, 8 aa, Mycobacterium bovis
ALPAGPAA

SEQ ID NO: 168978 - protein, 13 aa, Mycobacterium bovis
ALPAPVKPTAAPL

SEQ ID NO: 168979 - protein, 8 aa, Mycobacterium bovis
ALPDRQRR

SEQ ID NO: 168980 - protein, 6 aa, Mycobacterium bovis
ALPDSA

SEQ ID NO: 168981 - protein, 7 aa, Mycobacterium bovis
ALPEPAR

SEQ ID NO: 168982 - protein, 22 aa, Mycobacterium bovis
ALPEPQIASDTEFRAPQTATER

SEQ ID NO: 168983 - protein, 5 aa, Mycobacterium bovis
ALPGA

SEQ ID NO: 168984 - protein, 19 aa, Mycobacterium bovis
ALPGAAVAGSRGQELSTSA

SEQ ID NO: 168985 - protein, 5 aa, Mycobacterium bovis
ALPGD

SEQ ID NO: 168986 - protein, 12 aa, Mycobacterium bovis
ALPGGDAIGSRP

SEQ ID NO: 168987 - protein, 7 aa, Mycobacterium bovis
ALPGSAA

SEQ ID NO: 168988 - protein, 9 aa, Mycobacterium bovis
ALPGTDIDP

SEQ ID NO: 168989 - protein, 5 aa, Mycobacterium bovis
ALPNT

SEQ ID NO: 168990 - protein, 6 aa, Mycobacterium bovis
ALPPAA

SEQ ID NO: 168991 - protein, 10 aa, Mycobacterium bovis
ALPPGSGGPV

SEQ ID NO: 168992 - protein, 19 aa, Mycobacterium bovis
ALPPGVGKSGQHGHGTGQY

SEQ ID NO: 168993 - protein, 6 aa, Mycobacterium bovis
ALPPKT

SEQ ID NO: 168994 - protein, 22 aa, Mycobacterium bovis
ALPPSDEPADPAARPATRSRVP

SEQ ID NO: 168995 - protein, 13 aa, Mycobacterium bovis
ALPPSEDFESGAR

SEQ ID NO: 168996 - protein, 7 aa, Mycobacterium bovis
ALPPTEP

SEQ ID NO: 168997 - protein, 16 aa, Mycobacterium bovis
ALPSEKEIARRSEAGI

SEQ ID NO: 168998 - protein, 8 aa, Mycobacterium bovis
ALPSGASF

SEQ ID NO: 168999 - protein, 8 aa, Mycobacterium bovis
ALPSPGRV

SEQ ID NO: 169000 - protein, 10 aa, Mycobacterium bovis
ALPSPGSDEQ

SEQ ID NO: 169001 - protein, 17 aa, Mycobacterium bovis
ALPSPPRGFTPAPPPQW

SEQ ID NO: 169002 - protein, 6 aa, Mycobacterium bovis
ALPTGV

SEQ ID NO: 169003 - protein, 19 aa, Mycobacterium bovis
ALPTSLKGAPVSEQSGSAQ

SEQ ID NO: 169004 - protein, 9 aa, Mycobacterium bovis
ALQESRDRV

SEQ ID NO: 169005 - protein, 5 aa, Mycobacterium bovis
ALQGG

SEQ ID NO: 169006 - protein, 12 aa, Mycobacterium bovis
ALQPPGGGLSTF

SEQ ID NO: 169007 - protein, 4 aa, Mycobacterium bovis
ALQT

SEQ ID NO: 169008 - protein, 4 aa, Mycobacterium bovis
ALRG

SEQ ID NO: 169009 - protein, 7 aa, Mycobacterium bovis
ALRGTAE

SEQ ID NO: 169010 - protein, 9 aa, Mycobacterium bovis
ALRNSAGRE

SEQ ID NO: 169011 - protein, 6 aa, Mycobacterium bovis
ALRPGD

SEQ ID NO: 169012 - protein, 10 aa, Mycobacterium bovis
ALSDDGHCRP

SEQ ID NO: 169013 - protein, 11 aa, Mycobacterium bovis
ALSDQETQALQ

SEQ ID NO: 169014 - protein, 6 aa, Mycobacterium bovis
ALSGEQ

SEQ ID NO: 169015 - protein, 8 aa, Mycobacterium bovis
ALSGRGVG

SEQ ID NO: 169016 - protein, 11 aa, Mycobacterium bovis
ALSPSSPIAQG

SEQ ID NO: 169017 - protein, 8 aa, Mycobacterium bovis
ALSPTGRC

SEQ ID NO: 169018 - protein, 9 aa, Mycobacterium bovis
ALSSPSGVG

SEQ ID NO: 169019 - protein, 6 aa, Mycobacterium bovis
ALSTPL

SEQ ID NO: 169020 - protein, 7 aa, Mycobacterium bovis
ALTADGP

SEQ ID NO: 169021 - protein, 4 aa, Mycobacterium bovis
ALTE

SEQ ID NO: 169022 - protein, 8 aa, Mycobacterium bovis
ALTEPGAH

SEQ ID NO: 169023 - protein, 4 aa, Mycobacterium bovis
ALTG

SEQ ID NO: 169024 - protein, 37 aa, Mycobacterium bovis
ALTGPGARGGSFGSVEGAGDLASPQSVGAGGFSGSGV

SEQ ID NO: 169025 - protein, 9 aa, Mycobacterium bovis
ALTGPHARL

SEQ ID NO: 169026 - protein, 15 aa, Mycobacterium bovis
ALTGSPGQSAYSAAN

SEQ ID NO: 169027 - protein, 8 aa, Mycobacterium bovis
ALTNADEA

SEQ ID NO: 169028 - protein, 16 aa, Mycobacterium bovis
ALTNQNPQPAASQEDA

SEQ ID NO: 169029 - protein, 5 aa, Mycobacterium bovis
ALTPP

SEQ ID NO: 169030 - protein, 6 aa, Mycobacterium bovis
ALTQTN

SEQ ID NO: 169031 - protein, 5 aa, Mycobacterium bovis
ALTSP

SEQ ID NO: 169032 - protein, 16 aa, Mycobacterium bovis
ALTSRSCNGSLDTQQR

SEQ ID NO: 169033 - protein, 12 aa, Mycobacterium bovis
ALTTEGADRPTA

SEQ ID NO: 169034 - protein, 5 aa, Mycobacterium bovis
AMENA

SEQ ID NO: 169035 - protein, 4 aa, Mycobacterium bovis
AMEP

SEQ ID NO: 169036 - protein, 18 aa, Mycobacterium bovis
AMGARGEGSGQEKPVEKR

SEQ ID NO: 169037 - protein, 20 aa, Mycobacterium bovis
AMGSDKYQTDGDPRTSGPGF

SEQ ID NO: 169038 - protein, 14 aa, Mycobacterium bovis
AMPATRIPGRQGAG

SEQ ID NO: 169039 - protein, 5 aa, Mycobacterium bovis
AMPGE

SEQ ID NO: 169040 - protein, 5 aa, Mycobacterium bovis
AMRPA

SEQ ID NO: 169041 - protein, 5 aa, Mycobacterium bovis
AMSAE

SEQ ID NO: 169042 - protein, 14 aa, Mycobacterium bovis
AMSNGRTDSRFTEA

SEQ ID NO: 169043 - protein, 5 aa, Mycobacterium bovis
AMTSG

SEQ ID NO: 169044 - protein, 6 aa, Mycobacterium bovis
AMTSGL

SEQ ID NO: 169045 - protein, 6 aa, Mycobacterium bovis
ANAAEG

SEQ ID NO: 169046 - protein, 10 aa, Mycobacterium bovis
ANAARLRSSA

SEQ ID NO: 169047 - protein, 8 aa, Mycobacterium bovis
ANADPLTS

SEQ ID NO: 169048 - protein, 5 aa, Mycobacterium bovis
ANADR

SEQ ID NO: 169049 - protein, 7 aa, Mycobacterium bovis
ANAESTR

SEQ ID NO: 169050 - protein, 4 aa, Mycobacterium bovis
ANAG

SEQ ID NO: 169051 - protein, 6 aa, Mycobacterium bovis
ANAGAG

SEQ ID NO: 169052 - protein, 8 aa, Mycobacterium bovis
ANAGGGNI

SEQ ID NO: 169053 - protein, 10 aa, Mycobacterium bovis
ANAGSYNTGS

SEQ ID NO: 169054 - protein, 10 aa, Mycobacterium bovis
ANASIPTPQP

SEQ ID NO: 169055 - protein, 8 aa, Mycobacterium bovis
ANASPLQS

SEQ ID NO: 169056 - protein, 4 aa, Mycobacterium bovis
ANAT

SEQ ID NO: 169057 - protein, 7 aa, Mycobacterium bovis
ANAYESA

SEQ ID NO: 169058 - protein, 5 aa, Mycobacterium bovis
ANDAD

SEQ ID NO: 169059 - protein, 9 aa, Mycobacterium bovis
ANDGGGSIR

SEQ ID NO: 169060 - protein, 6 aa, Mycobacterium bovis
ANDIQA

SEQ ID NO: 169061 - protein, 6 aa, Mycobacterium bovis
ANDPER

SEQ ID NO: 169062 - protein, 16 aa, Mycobacterium bovis
ANDPRFGASRSRVANR

SEQ ID NO: 169063 - protein, 12 aa, Mycobacterium bovis
ANDTKRVTSLLN

SEQ ID NO: 169064 - protein, 4 aa, Mycobacterium bovis
ANDV

SEQ ID NO: 169065 - protein, 12 aa, Mycobacterium bovis
ANDYVGKGLSGG

SEQ ID NO: 169066 - protein, 4 aa, Mycobacterium bovis
ANEA

SEQ ID NO: 169067 - protein, 6 aa, Mycobacterium bovis
ANEEAA

SEQ ID NO: 169068 - protein, 8 aa, Mycobacterium bovis
ANESHYAG

SEQ ID NO: 169069 - protein, 8 aa, Mycobacterium bovis
ANGAGKST

SEQ ID NO: 169070 - protein, 5 aa, Mycobacterium bovis
ANGDK

SEQ ID NO: 169071 - protein, 5 aa, Mycobacterium bovis
ANGDP

SEQ ID NO: 169072 - protein, 9 aa, Mycobacterium bovis
ANGEPTEDQ

SEQ ID NO: 169073 - protein, 11 aa, Mycobacterium bovis
ANGFGKNETHA

SEQ ID NO: 169074 - protein, 16 aa, Mycobacterium bovis
ANGGGCCGRPAREGVD

SEQ ID NO: 169075 - protein, 7 aa, Mycobacterium bovis
ANGGLGP

SEQ ID NO: 169076 - protein, 6 aa, Mycobacterium bovis
ANGHTV

SEQ ID NO: 169077 - protein, 7 aa, Mycobacterium bovis
ANGKATL

SEQ ID NO: 169078 - protein, 5 aa, Mycobacterium bovis
ANGLQ

SEQ ID NO: 169079 - protein, 7 aa, Mycobacterium bovis
ANGPSGG

SEQ ID NO: 169080 - protein, 6 aa, Mycobacterium bovis
ANGSSL

SEQ ID NO: 169081 - protein, 4 aa, Mycobacterium bovis
ANGV

SEQ ID NO: 169082 - protein, 5 aa, Mycobacterium bovis
ANHAD

SEQ ID NO: 169083 - protein, 6 aa, Mycobacterium bovis
ANHRQP

SEQ ID NO: 169084 - protein, 7 aa, Mycobacterium bovis
ANIGGAN

SEQ ID NO: 169085 - protein, 17 aa, Mycobacterium bovis
ANIGNGNIGSGNIGSSN

SEQ ID NO: 169086 - protein, 19 aa, Mycobacterium bovis
ANIGSTLGAANAAALGPTT

SEQ ID NO: 169087 - protein, 20 aa, Mycobacterium bovis
ANISGHPPPVDAEQARSQLG

SEQ ID NO: 169088 - protein, 6 aa, Mycobacterium bovis
ANKAAA

SEQ ID NO: 169089 - protein, 6 aa, Mycobacterium bovis
ANKREP

SEQ ID NO: 169090 - protein, 17 aa, Mycobacterium bovis
ANKTRESLQATAQLTQT

SEQ ID NO: 169091 - protein, 5 aa, Mycobacterium bovis
ANLET

SEQ ID NO: 169092 - protein, 6 aa, Mycobacterium bovis
ANLGDT

SEQ ID NO: 169093 - protein, 7 aa, Mycobacterium bovis
ANLGGNN

SEQ ID NO: 169094 - protein, 6 aa, Mycobacterium bovis
ANLPPD

SEQ ID NO: 169095 - protein, 7 aa, Mycobacterium bovis
ANLTRNA

SEQ ID NO: 169096 - protein, 7 aa, Mycobacterium bovis
ANNPSGH

SEQ ID NO: 169097 - protein, 4 aa, Mycobacterium bovis
ANNR

SEQ ID NO: 169098 - protein, 8 aa, Mycobacterium bovis
ANPAAQDL

SEQ ID NO: 169099 - protein, 8 aa, Mycobacterium bovis
ANPAIAND

SEQ ID NO: 169100 - protein, 6 aa, Mycobacterium bovis
ANPDAL

SEQ ID NO: 169101 - protein, 5 aa, Mycobacterium bovis
ANPDG

SEQ ID NO: 169102 - protein, 7 aa, Mycobacterium bovis
ANPDMEA

SEQ ID NO: 169103 - protein, 9 aa, Mycobacterium bovis
ANPDRGTLS

SEQ ID NO: 169104 - protein, 5 aa, Mycobacterium bovis
ANPDV

SEQ ID NO: 169105 - protein, 9 aa, Mycobacterium bovis
ANPEDYTNR

SEQ ID NO: 169106 - protein, 12 aa, Mycobacterium bovis
ANPEPPSTGQIN

SEQ ID NO: 169107 - protein, 6 aa, Mycobacterium bovis
ANPGLD

SEQ ID NO: 169108 - protein, 7 aa, Mycobacterium bovis
ANPGRRG

SEQ ID NO: 169109 - protein, 8 aa, Mycobacterium bovis
ANPGSVEA

SEQ ID NO: 169110 - protein, 8 aa, Mycobacterium bovis
ANPGTITG

SEQ ID NO: 169111 - protein, 11 aa, Mycobacterium bovis
ANPPTDKSDRD

SEQ ID NO: 169112 - protein, 5 aa, Mycobacterium bovis
ANPQL

SEQ ID NO: 169113 - protein, 5 aa, Mycobacterium bovis
ANPRG

SEQ ID NO: 169114 - protein, 6 aa, Mycobacterium bovis
ANPSHL

SEQ ID NO: 169115 - protein, 5 aa, Mycobacterium bovis
ANPSI

SEQ ID NO: 169116 - protein, 7 aa, Mycobacterium bovis
ANPTGPI

SEQ ID NO: 169117 - protein, 11 aa, Mycobacterium bovis
ANPVDPARISA

SEQ ID NO: 169118 - protein, 17 aa, Mycobacterium bovis
ANPVPGRGRIEATNPCG

SEQ ID NO: 169119 - protein, 6 aa, Mycobacterium bovis
ANQADY

SEQ ID NO: 169120 - protein, 8 aa, Mycobacterium bovis
ANQQAAQR

SEQ ID NO: 169121 - protein, 11 aa, Mycobacterium bovis
ANRDAARDDPR

SEQ ID NO: 169122 - protein, 5 aa, Mycobacterium bovis
ANRDG

SEQ ID NO: 169123 - protein, 10 aa, Mycobacterium bovis
ANRDPQTRHS

SEQ ID NO: 169124 - protein, 11 aa, Mycobacterium bovis
ANRDPRQYEDP

SEQ ID NO: 169125 - protein, 6 aa, Mycobacterium bovis
ANRKYP

SEQ ID NO: 169126 - protein, 7 aa, Mycobacterium bovis
ANRLGAG

SEQ ID NO: 169127 - protein, 9 aa, Mycobacterium bovis
ANRLGSNSL

SEQ ID NO: 169128 - protein, 8 aa, Mycobacterium bovis
ANRNAAGQ

SEQ ID NO: 169129 - protein, 15 aa, Mycobacterium bovis
ANRPTALSSDPRTGL

SEQ ID NO: 169130 - protein, 12 aa, Mycobacterium bovis
ANRSAPGRPGVL

SEQ ID NO: 169131 - protein, 9 aa, Mycobacterium bovis
ANRSEPDKV

SEQ ID NO: 169132 - protein, 6 aa, Mycobacterium bovis
ANRSNA

SEQ ID NO: 169133 - protein, 4 aa, Mycobacterium bovis
ANRT

SEQ ID NO: 169134 - protein, 10 aa, Mycobacterium bovis
ANRTDAPRPA

SEQ ID NO: 169135 - protein, 10 aa, Mycobacterium bovis
ANSATSGFNN

SEQ ID NO: 169136 - protein, 6 aa, Mycobacterium bovis
ANSAYH

SEQ ID NO: 169137 - protein, 5 aa, Mycobacterium bovis
ANSDL

SEQ ID NO: 169138 - protein, 7 aa, Mycobacterium bovis
ANSEDAA

SEQ ID NO: 169139 - protein, 13 aa, Mycobacterium bovis
ANSFEAQAARDGL

SEQ ID NO: 169140 - protein, 5 aa, Mycobacterium bovis
ANSGL

SEQ ID NO: 169141 - protein, 4 aa, Mycobacterium bovis
ANSP

SEQ ID NO: 169142 - protein, 8 aa, Mycobacterium bovis
ANSPDSPH

SEQ ID NO: 169143 - protein, 8 aa, Mycobacterium bovis
ANSPIDAD

SEQ ID NO: 169144 - protein, 13 aa, Mycobacterium bovis
ANSPKPGRAPTGL

SEQ ID NO: 169145 - protein, 12 aa, Mycobacterium bovis
ANSPVADVIDRW

SEQ ID NO: 169146 - protein, 10 aa, Mycobacterium bovis
ANSQADAEDV

SEQ ID NO: 169147 - protein, 6 aa, Mycobacterium bovis
ANSTDV

SEQ ID NO: 169148 - protein, 5 aa, Mycobacterium bovis
ANSYP

SEQ ID NO: 169149 - protein, 4 aa, Mycobacterium bovis
ANTA

SEQ ID NO: 169150 - protein, 9 aa, Mycobacterium bovis
ANTAGEDTF

SEQ ID NO: 169151 - protein, 6 aa, Mycobacterium bovis
ANTAVQ

SEQ ID NO: 169152 - protein, 6 aa, Mycobacterium bovis
ANTGIG

SEQ ID NO: 169153 - protein, 8 aa, Mycobacterium bovis
ANTGSGNI

SEQ ID NO: 169154 - protein, 8 aa, Mycobacterium bovis
ANTGSNNI

SEQ ID NO: 169155 - protein, 6 aa, Mycobacterium bovis
ANTGSY

SEQ ID NO: 169156 - protein, 20 aa, Mycobacterium bovis
ANTGSYNTGSTNTGSFNDGD

SEQ ID NO: 169157 - protein, 26 aa, Mycobacterium bovis
ANTGVGNAGNYNTGSYNPGNSNTGGF

SEQ ID NO: 169158 - protein, 6 aa, Mycobacterium bovis
ANTPPA

SEQ ID NO: 169159 - protein, 7 aa, Mycobacterium bovis
ANVAPPL

SEQ ID NO: 169160 - protein, 5 aa, Mycobacterium bovis
ANVDA

SEQ ID NO: 169161 - protein, 10 aa, Mycobacterium bovis
ANVGPGANKA

SEQ ID NO: 169162 - protein, 6 aa, Mycobacterium bovis
ANVGTT

SEQ ID NO: 169163 - protein, 7 aa, Mycobacterium bovis
ANVPVGS

SEQ ID NO: 169164 - protein, 5 aa, Mycobacterium bovis
ANVQD

SEQ ID NO: 169165 - protein, 5 aa, Mycobacterium bovis
ANVSK

SEQ ID NO: 169166 - protein, 4 aa, Mycobacterium bovis
ANYD

SEQ ID NO: 169167 - protein, 7 aa, Mycobacterium bovis
ANYGRAN

SEQ ID NO: 169168 - protein, 10 aa, Mycobacterium bovis
APAAAAPPLD

SEQ ID NO: 169169 - protein, 8 aa, Mycobacterium bovis
APAAALSG

SEQ ID NO: 169170 - protein, 14 aa, Mycobacterium bovis
APAAAQAVETAAEN

SEQ ID NO: 169171 - protein, 17 aa, Mycobacterium bovis
APAAAQAVETAAQNGVQ

SEQ ID NO: 169172 - protein, 7 aa, Mycobacterium bovis
APAADRV

SEQ ID NO: 169173 - protein, 13 aa, Mycobacterium bovis
APAAQPAQPGSAG

SEQ ID NO: 169174 - protein, 5 aa, Mycobacterium bovis
APAAR

SEQ ID NO: 169175 - protein, 14 aa, Mycobacterium bovis
APAASGAPHAAGGR

SEQ ID NO: 169176 - protein, 8 aa, Mycobacterium bovis
APADAGSF

SEQ ID NO: 169177 - protein, 6 aa, Mycobacterium bovis
APADAR

SEQ ID NO: 169178 - protein, 5 aa, Mycobacterium bovis
APADG

SEQ ID NO: 169179 - protein, 6 aa, Mycobacterium bovis
APADGL

SEQ ID NO: 169180 - protein, 11 aa, Mycobacterium bovis
APADGPDDAAL

SEQ ID NO: 169181 - protein, 10 aa, Mycobacterium bovis
APADREQKAR

SEQ ID NO: 169182 - protein, 8 aa, Mycobacterium bovis
APADTGTT

SEQ ID NO: 169183 - protein, 18 aa, Mycobacterium bovis
APAEASAPESSPGDAEVG

SEQ ID NO: 169184 - protein, 17 aa, Mycobacterium bovis
APAEASEVSAHAEPAGP

SEQ ID NO: 169185 - protein, 9 aa, Mycobacterium bovis
APAERQRQL

SEQ ID NO: 169186 - protein, 11 aa, Mycobacterium bovis
APAETPAAQAS

SEQ ID NO: 169187 - protein, 5 aa, Mycobacterium bovis
APAEV

SEQ ID NO: 169188 - protein, 8 aa, Mycobacterium bovis
APAGDGTV

SEQ ID NO: 169189 - protein, 5 aa, Mycobacterium bovis
APAGF

SEQ ID NO: 169190 - protein, 10 aa, Mycobacterium bovis
APAGPGSSVT

SEQ ID NO: 169191 - protein, 4 aa, Mycobacterium bovis
APAI

SEQ ID NO: 169192 - protein, 10 aa, Mycobacterium bovis
APAKDDPRLV

SEQ ID NO: 169193 - protein, 5 aa, Mycobacterium bovis
APAKV

SEQ ID NO: 169194 - protein, 13 aa, Mycobacterium bovis
APAKVKGPIEGTG

SEQ ID NO: 169195 - protein, 25 aa, Mycobacterium bovis
APALAATRKGRSDRSAARGGSARTT

SEQ ID NO: 169196 - protein, 5 aa, Mycobacterium bovis
APAND

SEQ ID NO: 169197 - protein, 7 aa, Mycobacterium bovis
APANGPA

SEQ ID NO: 169198 - protein, 17 aa, Mycobacterium bovis
APANPGPAPGSGAGLPE

SEQ ID NO: 169199 - protein, 9 aa, Mycobacterium bovis
APAPRQYTR

SEQ ID NO: 169200 - protein, 8 aa, Mycobacterium bovis
APAPTPVS

SEQ ID NO: 169201 - protein, 5 aa, Mycobacterium bovis
APAQA

SEQ ID NO: 169202 - protein, 20 aa, Mycobacterium bovis
APAQEAPAQEAPAPRGQYDP

SEQ ID NO: 169203 - protein, 6 aa, Mycobacterium bovis
APAQGA

SEQ ID NO: 169204 - protein, 8 aa, Mycobacterium bovis
APARPGCP

SEQ ID NO: 169205 - protein, 14 aa, Mycobacterium bovis
APARRAELGDSPPV

SEQ ID NO: 169206 - protein, 6 aa, Mycobacterium bovis
APARTC

SEQ ID NO: 169207 - protein, 9 aa, Mycobacterium bovis
APASADRSR

SEQ ID NO: 169208 - protein, 13 aa, Mycobacterium bovis
APASNTTGLTETS

SEQ ID NO: 169209 - protein, 6 aa, Mycobacterium bovis
APASQL

SEQ ID NO: 169210 - protein, 4 aa, Mycobacterium bovis
APAT

SEQ ID NO: 169211 - protein, 5 aa, Mycobacterium bovis
APATD

SEQ ID NO: 169212 - protein, 7 aa, Mycobacterium bovis
APATDED

SEQ ID NO: 169213 - protein, 8 aa, Mycobacterium bovis
APATSQPV

SEQ ID NO: 169214 - protein, 6 aa, Mycobacterium bovis
APATTH

SEQ ID NO: 169215 - protein, 12 aa, Mycobacterium bovis
APDAAAREHDPS

SEQ ID NO: 169216 - protein, 5 aa, Mycobacterium bovis
APDAD

SEQ ID NO: 169217 - protein, 10 aa, Mycobacterium bovis
APDAQNDPIG

SEQ ID NO: 169218 - protein, 12 aa, Mycobacterium bovis
APDDAPAAALSS

SEQ ID NO: 169219 - protein, 7 aa, Mycobacterium bovis
APDDGLR

SEQ ID NO: 169220 - protein, 4 aa, Mycobacterium bovis
APDE

SEQ ID NO: 169221 - protein, 12 aa, Mycobacterium bovis
APDFEPAHSRRT

SEQ ID NO: 169222 - protein, 4 aa, Mycobacterium bovis
APDG

SEQ ID NO: 169223 - protein, 9 aa, Mycobacterium bovis
APDGTALPR

SEQ ID NO: 169224 - protein, 13 aa, Mycobacterium bovis
APDGTHHQNDAAA

SEQ ID NO: 169225 - protein, 5 aa, Mycobacterium bovis
APDID

SEQ ID NO: 169226 - protein, 7 aa, Mycobacterium bovis
APDIPRE

SEQ ID NO: 169227 - protein, 4 aa, Mycobacterium bovis
APDK

SEQ ID NO: 169228 - protein, 6 aa, Mycobacterium bovis
APDPAR

SEQ ID NO: 169229 - protein, 7 aa, Mycobacterium bovis
APDPDGG

SEQ ID NO: 169230 - protein, 9 aa, Mycobacterium bovis
APDPDGGIE

SEQ ID NO: 169231 - protein, 19 aa, Mycobacterium bovis
APDPMAAAGTEPQRGPVPA

SEQ ID NO: 169232 - protein, 9 aa, Mycobacterium bovis
APDPSPEAA

SEQ ID NO: 169233 - protein, 6 aa, Mycobacterium bovis
APDRNR

SEQ ID NO: 169234 - protein, 6 aa, Mycobacterium bovis
APDRQR

SEQ ID NO: 169235 - protein, 9 aa, Mycobacterium bovis
APDSERGLA

SEQ ID NO: 169236 - protein, 9 aa, Mycobacterium bovis
APDSQRGER

SEQ ID NO: 169237 - protein, 10 aa, Mycobacterium bovis
APDSRYPASM

SEQ ID NO: 169238 - protein, 4 aa, Mycobacterium bovis
APDT

SEQ ID NO: 169239 - protein, 8 aa, Mycobacterium bovis
APDTAVAA

SEQ ID NO: 169240 - protein, 8 aa, Mycobacterium bovis
APDTENAA

SEQ ID NO: 169241 - protein, 13 aa, Mycobacterium bovis
APDVEAGQIDPLS

SEQ ID NO: 169242 - protein, 4 aa, Mycobacterium bovis
APEA

SEQ ID NO: 169243 - protein, 6 aa, Mycobacterium bovis
APEADG

SEQ ID NO: 169244 - protein, 9 aa, Mycobacterium bovis
APEATPFGP

SEQ ID NO: 169245 - protein, 4 aa, Mycobacterium bovis
APEL

SEQ ID NO: 169246 - protein, 8 aa, Mycobacterium bovis
APENPYPA

SEQ ID NO: 169247 - protein, 12 aa, Mycobacterium bovis
APEPADLDERTE

SEQ ID NO: 169248 - protein, 6 aa, Mycobacterium bovis
APEPAE

SEQ ID NO: 169249 - protein, 8 aa, Mycobacterium bovis
APEPDTDV

SEQ ID NO: 169250 - protein, 8 aa, Mycobacterium bovis
APEPGRVK

SEQ ID NO: 169251 - protein, 6 aa, Mycobacterium bovis
APEQGL

SEQ ID NO: 169252 - protein, 8 aa, Mycobacterium bovis
APERPQEA

SEQ ID NO: 169253 - protein, 12 aa, Mycobacterium bovis
APERRASNGRQQ

SEQ ID NO: 169254 - protein, 7 aa, Mycobacterium bovis
APERTVS

SEQ ID NO: 169255 - protein, 6 aa, Mycobacterium bovis
APESAG

SEQ ID NO: 169256 - protein, 13 aa, Mycobacterium bovis
APESARLGRRSAA

SEQ ID NO: 169257 - protein, 5 aa, Mycobacterium bovis
APEST

SEQ ID NO: 169258 - protein, 6 aa, Mycobacterium bovis
APEVAS

SEQ ID NO: 169259 - protein, 6 aa, Mycobacterium bovis
APFAEA

SEQ ID NO: 169260 - protein, 4 aa, Mycobacterium bovis
APFQ

SEQ ID NO: 169261 - protein, 4 aa, Mycobacterium bovis
APFT

SEQ ID NO: 169262 - protein, 7 aa, Mycobacterium bovis
APGADWE

SEQ ID NO: 169263 - protein, 33 aa, Mycobacterium bovis
APGANNGSPAGTADGSTAATVDAARNGESQTEV

SEQ ID NO: 169264 - protein, 5 aa, Mycobacterium bovis
APGAQ

SEQ ID NO: 169265 - protein, 5 aa, Mycobacterium bovis
APGAS

SEQ ID NO: 169266 - protein, 18 aa, Mycobacterium bovis
APGAVAPAPLGRKREGRD

SEQ ID NO: 169267 - protein, 10 aa, Mycobacterium bovis
APGCGQPGGS

SEQ ID NO: 169268 - protein, 5 aa, Mycobacterium bovis
APGDG

SEQ ID NO: 169269 - protein, 5 aa, Mycobacterium bovis
APGDI

SEQ ID NO: 169270 - protein, 11 aa, Mycobacterium bovis
APGDPKTLTSN

SEQ ID NO: 169271 - protein, 13 aa, Mycobacterium bovis
APGEPAIPTRTIP

SEQ ID NO: 169272 - protein, 5 aa, Mycobacterium bovis
APGFE

SEQ ID NO: 169273 - protein, 7 aa, Mycobacterium bovis
APGFGDR

SEQ ID NO: 169274 - protein, 28 aa, Mycobacterium bovis
APGFGGPGGSGGASLLGPPGLAGTNGAD

SEQ ID NO: 169275 - protein, 14 aa, Mycobacterium bovis
APGFGNDTTAPSSG

SEQ ID NO: 169276 - protein, 13 aa, Mycobacterium bovis
APGFGNSTQMPSS

SEQ ID NO: 169277 - protein, 14 aa, Mycobacterium bovis
APGFGNSTTTPSSG

SEQ ID NO: 169278 - protein, 6 aa, Mycobacterium bovis
APGGAH

SEQ ID NO: 169279 - protein, 8 aa, Mycobacterium bovis
APGGDATA

SEQ ID NO: 169280 - protein, 6 aa, Mycobacterium bovis
APGGRA

SEQ ID NO: 169281 - protein, 8 aa, Mycobacterium bovis
APGGVETA

SEQ ID NO: 169282 - protein, 4 aa, Mycobacterium bovis
APGH

SEQ ID NO: 169283 - protein, 5 aa, Mycobacterium bovis
APGHA

SEQ ID NO: 169284 - protein, 9 aa, Mycobacterium bovis
APGHDPQLR

SEQ ID NO: 169285 - protein, 6 aa, Mycobacterium bovis
APGHPE

SEQ ID NO: 169286 - protein, 6 aa, Mycobacterium bovis
APGHSA

SEQ ID NO: 169287 - protein, 15 aa, Mycobacterium bovis
APGIGNSTTSPSSGF

SEQ ID NO: 169288 - protein, 5 aa, Mycobacterium bovis
APGMA

SEQ ID NO: 169289 - protein, 13 aa, Mycobacterium bovis
APGMANPADDTPC

SEQ ID NO: 169290 - protein, 4 aa, Mycobacterium bovis
APGP

SEQ ID NO: 169291 - protein, 6 aa, Mycobacterium bovis
APGPGE

SEQ ID NO: 169292 - protein, 12 aa, Mycobacterium bovis
APGPPHSLLGRD

SEQ ID NO: 169293 - protein, 5 aa, Mycobacterium bovis
APGQT

SEQ ID NO: 169294 - protein, 5 aa, Mycobacterium bovis
APGRA

SEQ ID NO: 169295 - protein, 4 aa, Mycobacterium bovis
APGS

SEQ ID NO: 169296 - protein, 5 aa, Mycobacterium bovis
APGSA

SEQ ID NO: 169297 - protein, 5 aa, Mycobacterium bovis
APGSD

SEQ ID NO: 169298 - protein, 11 aa, Mycobacterium bovis
APGSGADLTSP

SEQ ID NO: 169299 - protein, 28 aa, Mycobacterium bovis
APGSGSTADGQTPAGGHSVPNSGGRQGY

SEQ ID NO: 169300 - protein, 12 aa, Mycobacterium bovis
APGSKMASSAVP

SEQ ID NO: 169301 - protein, 5 aa, Mycobacterium bovis
APGSP

SEQ ID NO: 169302 - protein, 4 aa, Mycobacterium bovis
APGT

SEQ ID NO: 169303 - protein, 8 aa, Mycobacterium bovis
APGTGLRD

SEQ ID NO: 169304 - protein, 7 aa, Mycobacterium bovis
APGTGTA

SEQ ID NO: 169305 - protein, 9 aa, Mycobacterium bovis
APGTPDDPI

SEQ ID NO: 169306 - protein, 7 aa, Mycobacterium bovis
APGTQSQ

SEQ ID NO: 169307 - protein, 15 aa, Mycobacterium bovis
APGVGNTTTAPSSGF

SEQ ID NO: 169308 - protein, 5 aa, Mycobacterium bovis
APGVS

SEQ ID NO: 169309 - protein, 14 aa, Mycobacterium bovis
APHAKDAEATARDA

SEQ ID NO: 169310 - protein, 11 aa, Mycobacterium bovis
APHDRTAEELR

SEQ ID NO: 169311 - protein, 7 aa, Mycobacterium bovis
APHEEPD

SEQ ID NO: 169312 - protein, 11 aa, Mycobacterium bovis
APHGPAEAQGG

SEQ ID NO: 169313 - protein, 4 aa, Mycobacterium bovis
APHN

SEQ ID NO: 169314 - protein, 5 aa, Mycobacterium bovis
APHRD

SEQ ID NO: 169315 - protein, 8 aa, Mycobacterium bovis
APHSRTSI

SEQ ID NO: 169316 - protein, 14 aa, Mycobacterium bovis
APHYGGSTARSGGG

SEQ ID NO: 169317 - protein, 5 aa, Mycobacterium bovis
APIDS

SEQ ID NO: 169318 - protein, 11 aa, Mycobacterium bovis
APIGAPDGDGF

SEQ ID NO: 169319 - protein, 11 aa, Mycobacterium bovis
APINATAKAGL

SEQ ID NO: 169320 - protein, 7 aa, Mycobacterium bovis
APIQGSA

SEQ ID NO: 169321 - protein, 14 aa, Mycobacterium bovis
APKAPLGYRPARST

SEQ ID NO: 169322 - protein, 7 aa, Mycobacterium bovis
APKEHGS

SEQ ID NO: 169323 - protein, 10 aa, Mycobacterium bovis
APKGSGTEVT

SEQ ID NO: 169324 - protein, 8 aa, Mycobacterium bovis
APKPEWED

SEQ ID NO: 169325 - protein, 7 aa, Mycobacterium bovis
APKPMLP

SEQ ID NO: 169326 - protein, 8 aa, Mycobacterium bovis
APKSAGAL

SEQ ID NO: 169327 - protein, 9 aa, Mycobacterium bovis
APKSAKSLS

SEQ ID NO: 169328 - protein, 7 aa, Mycobacterium bovis
APKSYAA

SEQ ID NO: 169329 - protein, 10 aa, Mycobacterium bovis
APLDEASRNR

SEQ ID NO: 169330 - protein, 11 aa, Mycobacterium bovis
APLEKTAEATG

SEQ ID NO: 169331 - protein, 8 aa, Mycobacterium bovis
APLEPGQK

SEQ ID NO: 169332 - protein, 7 aa, Mycobacterium bovis
APLESNA

SEQ ID NO: 169333 - protein, 6 aa, Mycobacterium bovis
APLGNA

SEQ ID NO: 169334 - protein, 12 aa, Mycobacterium bovis
APLGTGAGRVRT

SEQ ID NO: 169335 - protein, 6 aa, Mycobacterium bovis
APLNRQ

SEQ ID NO: 169336 - protein, 6 aa, Mycobacterium bovis
APLPCT

SEQ ID NO: 169337 - protein, 6 aa, Mycobacterium bovis
APLPDE

SEQ ID NO: 169338 - protein, 7 aa, Mycobacterium bovis
APLPPVG

SEQ ID NO: 169339 - protein, 10 aa, Mycobacterium bovis
APLPSAGAGL

SEQ ID NO: 169340 - protein, 7 aa, Mycobacterium bovis
APLRPPN

SEQ ID NO: 169341 - protein, 11 aa, Mycobacterium bovis
APLSASGDAVP

SEQ ID NO: 169342 - protein, 5 aa, Mycobacterium bovis
APLTA

SEQ ID NO: 169343 - protein, 4 aa, Mycobacterium bovis
APMA

SEQ ID NO: 169344 - protein, 4 aa, Mycobacterium bovis
APMG

SEQ ID NO: 169345 - protein, 12 aa, Mycobacterium bovis
APMGTDDDPRAV

SEQ ID NO: 169346 - protein, 8 aa, Mycobacterium bovis
APNAPGSI

SEQ ID NO: 169347 - protein, 8 aa, Mycobacterium bovis
APNCGEAS

SEQ ID NO: 169348 - protein, 4 aa, Mycobacterium bovis
APND

SEQ ID NO: 169349 - protein, 9 aa, Mycobacterium bovis
APNDFTDPR

SEQ ID NO: 169350 - protein, 6 aa, Mycobacterium bovis
APNGYT

SEQ ID NO: 169351 - protein, 8 aa, Mycobacterium bovis
APNTGGES

SEQ ID NO: 169352 - protein, 7 aa, Mycobacterium bovis
APNTGNA

SEQ ID NO: 169353 - protein, 5 aa, Mycobacterium bovis
APNTR

SEQ ID NO: 169354 - protein, 6 aa, Mycobacterium bovis
APPAEQ

SEQ ID NO: 169355 - protein, 13 aa, Mycobacterium bovis
APPAVPEERSGFR

SEQ ID NO: 169356 - protein, 5 aa, Mycobacterium bovis
APPDL

SEQ ID NO: 169357 - protein, 5 aa, Mycobacterium bovis
APPEL

SEQ ID NO: 169358 - protein, 21 aa, Mycobacterium bovis
APPEPGAGRRRGHLRVLPDPA

SEQ ID NO: 169359 - protein, 6 aa, Mycobacterium bovis
APPGRA

SEQ ID NO: 169360 - protein, 7 aa, Mycobacterium bovis
APPGSFN

SEQ ID NO: 169361 - protein, 8 aa, Mycobacterium bovis
APPGTVGS

SEQ ID NO: 169362 - protein, 14 aa, Mycobacterium bovis
APPHPRAPGATDKD

SEQ ID NO: 169363 - protein, 7 aa, Mycobacterium bovis
APPKLGR

SEQ ID NO: 169364 - protein, 4 aa, Mycobacterium bovis
APPL

SEQ ID NO: 169365 - protein, 12 aa, Mycobacterium bovis
APPMRRRGDRHR

SEQ ID NO: 169366 - protein, 6 aa, Mycobacterium bovis
APPPAV

SEQ ID NO: 169367 - protein, 6 aa, Mycobacterium bovis
APPPDV

SEQ ID NO: 169368 - protein, 9 aa, Mycobacterium bovis
APPPQEARP

SEQ ID NO: 169369 - protein, 11 aa, Mycobacterium bovis
APPPQTTNATG

SEQ ID NO: 169370 - protein, 8 aa, Mycobacterium bovis
APPRDRQG

SEQ ID NO: 169371 - protein, 4 aa, Mycobacterium bovis
APPS

SEQ ID NO: 169372 - protein, 7 aa, Mycobacterium bovis
APPTAAE

SEQ ID NO: 169373 - protein, 6 aa, Mycobacterium bovis
APPTAR

SEQ ID NO: 169374 - protein, 6 aa, Mycobacterium bovis
APPTGR

SEQ ID NO: 169375 - protein, 6 aa, Mycobacterium bovis
APPVEE

SEQ ID NO: 169376 - protein, 9 aa, Mycobacterium bovis
APPVKRQEQ

SEQ ID NO: 169377 - protein, 5 aa, Mycobacterium bovis
APPWV

SEQ ID NO: 169378 - protein, 7 aa, Mycobacterium bovis
APPYNRR

SEQ ID NO: 169379 - protein, 8 aa, Mycobacterium bovis
APQAADAL

SEQ ID NO: 169380 - protein, 6 aa, Mycobacterium bovis
APQDMG

SEQ ID NO: 169381 - protein, 19 aa, Mycobacterium bovis
APQIGNTGWNGEDSESRGE

SEQ ID NO: 169382 - protein, 8 aa, Mycobacterium bovis
APQKGADM

SEQ ID NO: 169383 - protein, 6 aa, Mycobacterium bovis
APQKGE

SEQ ID NO: 169384 - protein, 5 aa, Mycobacterium bovis
APQME

SEQ ID NO: 169385 - protein, 9 aa, Mycobacterium bovis
APQPAQPWP

SEQ ID NO: 169386 - protein, 5 aa, Mycobacterium bovis
APQQR

SEQ ID NO: 169387 - protein, 6 aa, Mycobacterium bovis
APQRSG

SEQ ID NO: 169388 - protein, 7 aa, Mycobacterium bovis
APQSGSI

SEQ ID NO: 169389 - protein, 5 aa, Mycobacterium bovis
APQST

SEQ ID NO: 169390 - protein, 8 aa, Mycobacterium bovis
APQTPLDR

SEQ ID NO: 169391 - protein, 20 aa, Mycobacterium bovis
APQTRADPVPGTSRRNRGAA

SEQ ID NO: 169392 - protein, 8 aa, Mycobacterium bovis
APRDATRL

SEQ ID NO: 169393 - protein, 11 aa, Mycobacterium bovis
APRGTARSVDG

SEQ ID NO: 169394 - protein, 10 aa, Mycobacterium bovis
APRKRANPDM

SEQ ID NO: 169395 - protein, 9 aa, Mycobacterium bovis
APRKREAAG

SEQ ID NO: 169396 - protein, 4 aa, Mycobacterium bovis
APRP

SEQ ID NO: 169397 - protein, 6 aa, Mycobacterium bovis
APRPGA

SEQ ID NO: 169398 - protein, 6 aa, Mycobacterium bovis
APRPGQ

SEQ ID NO: 169399 - protein, 7 aa, Mycobacterium bovis
APRPQRE

SEQ ID NO: 169400 - protein, 8 aa, Mycobacterium bovis
APRPTTPF

SEQ ID NO: 169401 - protein, 6 aa, Mycobacterium bovis
APRRRH

SEQ ID NO: 169402 - protein, 5 aa, Mycobacterium bovis
APRRV

SEQ ID NO: 169403 - protein, 9 aa, Mycobacterium bovis
APRRVPEPI

SEQ ID NO: 169404 - protein, 5 aa, Mycobacterium bovis
APRSA

SEQ ID NO: 169405 - protein, 6 aa, Mycobacterium bovis
APRSRF

SEQ ID NO: 169406 - protein, 8 aa, Mycobacterium bovis
APRSYPPD

SEQ ID NO: 169407 - protein, 6 aa, Mycobacterium bovis
APRTHA

SEQ ID NO: 169408 - protein, 6 aa, Mycobacterium bovis
APRTVR

SEQ ID NO: 169409 - protein, 11 aa, Mycobacterium bovis
APRYDPGGGGI

SEQ ID NO: 169410 - protein, 5 aa, Mycobacterium bovis
APRYI

SEQ ID NO: 169411 - protein, 6 aa, Mycobacterium bovis
APSAAA

SEQ ID NO: 169412 - protein, 6 aa, Mycobacterium bovis
APSAAD

SEQ ID NO: 169413 - protein, 9 aa, Mycobacterium bovis
APSAGTPVG

SEQ ID NO: 169414 - protein, 5 aa, Mycobacterium bovis
APSAR

SEQ ID NO: 169415 - protein, 6 aa, Mycobacterium bovis
APSARN

SEQ ID NO: 169416 - protein, 9 aa, Mycobacterium bovis
APSARQPAV

SEQ ID NO: 169417 - protein, 20 aa, Mycobacterium bovis
APSEHGSRCSSARGRLCLSM

SEQ ID NO: 169418 - protein, 4 aa, Mycobacterium bovis
APSK

SEQ ID NO: 169419 - protein, 5 aa, Mycobacterium bovis
APSKE

SEQ ID NO: 169420 - protein, 23 aa, Mycobacterium bovis
APSLTARSRRPPESRSRATTQAG

SEQ ID NO: 169421 - protein, 11 aa, Mycobacterium bovis
APSPALRGHRG

SEQ ID NO: 169422 - protein, 7 aa, Mycobacterium bovis
APSPDRL

SEQ ID NO: 169423 - protein, 16 aa, Mycobacterium bovis
APSPEPDSSRATSADT

SEQ ID NO: 169424 - protein, 5 aa, Mycobacterium bovis
APSRA

SEQ ID NO: 169425 - protein, 13 aa, Mycobacterium bovis
APSSGGGATSTQG

SEQ ID NO: 169426 - protein, 7 aa, Mycobacterium bovis
APSSSTS

SEQ ID NO: 169427 - protein, 13 aa, Mycobacterium bovis
APSTGAVTGEPDV

SEQ ID NO: 169428 - protein, 10 aa, Mycobacterium bovis
APSTRQSGKV

SEQ ID NO: 169429 - protein, 21 aa, Mycobacterium bovis
APSVSDPTAAGQIGASDGGAE

SEQ ID NO: 169430 - protein, 21 aa, Mycobacterium bovis
APSWDAGDPRAYSVSDTANAW

SEQ ID NO: 169431 - protein, 7 aa, Mycobacterium bovis
APTAAGT

SEQ ID NO: 169432 - protein, 8 aa, Mycobacterium bovis
APTAAQAS

SEQ ID NO: 169433 - protein, 8 aa, Mycobacterium bovis
APTADEVG

SEQ ID NO: 169434 - protein, 29 aa, Mycobacterium bovis
APTADRRAAVGTTSDINQQDPATLQDGGN

SEQ ID NO: 169435 - protein, 33 aa, Mycobacterium bovis
APTAEELEGEVAGAEEAEEAAVEAGEAEAAGES

SEQ ID NO: 169436 - protein, 6 aa, Mycobacterium bovis
APTDAS

SEQ ID NO: 169437 - protein, 6 aa, Mycobacterium bovis
APTDDD

SEQ ID NO: 169438 - protein, 5 aa, Mycobacterium bovis
APTDG

SEQ ID NO: 169439 - protein, 5 aa, Mycobacterium bovis
APTDQ

SEQ ID NO: 169440 - protein, 14 aa, Mycobacterium bovis
APTGRFRRWRSRHL

SEQ ID NO: 169441 - protein, 4 aa, Mycobacterium bovis
APTI

SEQ ID NO: 169442 - protein, 10 aa, Mycobacterium bovis
APTLAPRRAT

SEQ ID NO: 169443 - protein, 7 aa, Mycobacterium bovis
APTLDGA

SEQ ID NO: 169444 - protein, 6 aa, Mycobacterium bovis
APTLGA

SEQ ID NO: 169445 - protein, 5 aa, Mycobacterium bovis
APTLR

SEQ ID NO: 169446 - protein, 6 aa, Mycobacterium bovis
APTLRE

SEQ ID NO: 169447 - protein, 5 aa, Mycobacterium bovis
APTNG

SEQ ID NO: 169448 - protein, 6 aa, Mycobacterium bovis
APTNHQ

SEQ ID NO: 169449 - protein, 11 aa, Mycobacterium bovis
APTPASSEPTV

SEQ ID NO: 169450 - protein, 6 aa, Mycobacterium bovis
APTPER

SEQ ID NO: 169451 - protein, 9 aa, Mycobacterium bovis
APTPGRSRA

SEQ ID NO: 169452 - protein, 5 aa, Mycobacterium bovis
APTQA

SEQ ID NO: 169453 - protein, 5 aa, Mycobacterium bovis
APTQR

SEQ ID NO: 169454 - protein, 5 aa, Mycobacterium bovis
APTQT

SEQ ID NO: 169455 - protein, 4 aa, Mycobacterium bovis
APTR

SEQ ID NO: 169456 - protein, 6 aa, Mycobacterium bovis
APTRDN

SEQ ID NO: 169457 - protein, 11 aa, Mycobacterium bovis
APTREAQDRFN

SEQ ID NO: 169458 - protein, 8 aa, Mycobacterium bovis
APTRPRRR

SEQ ID NO: 169459 - protein, 5 aa, Mycobacterium bovis
APTSI

SEQ ID NO: 169460 - protein, 11 aa, Mycobacterium bovis
APTTGDLDAQT

SEQ ID NO: 169461 - protein, 12 aa, Mycobacterium bovis
APTTTQSTPRVP

SEQ ID NO: 169462 - protein, 13 aa, Mycobacterium bovis
APTTTVGGTPIGG

SEQ ID NO: 169463 - protein, 6 aa, Mycobacterium bovis
APVDEC

SEQ ID NO: 169464 - protein, 8 aa, Mycobacterium bovis
APVEPQGP

SEQ ID NO: 169465 - protein, 4 aa, Mycobacterium bovis
APVH

SEQ ID NO: 169466 - protein, 7 aa, Mycobacterium bovis
APVPEGD

SEQ ID NO: 169467 - protein, 8 aa, Mycobacterium bovis
APVPGTGA

SEQ ID NO: 169468 - protein, 7 aa, Mycobacterium bovis
APVPTGA

SEQ ID NO: 169469 - protein, 12 aa, Mycobacterium bovis
APVQTDDAEGDL

SEQ ID NO: 169470 - protein, 7 aa, Mycobacterium bovis
APVRAAD

SEQ ID NO: 169471 - protein, 5 aa, Mycobacterium bovis
APVSG

SEQ ID NO: 169472 - protein, 7 aa, Mycobacterium bovis
APVTPEA

SEQ ID NO: 169473 - protein, 6 aa, Mycobacterium bovis
APWPPE

SEQ ID NO: 169474 - protein, 8 aa, Mycobacterium bovis
APYETTNR

SEQ ID NO: 169475 - protein, 11 aa, Mycobacterium bovis
APYGRGASPAE

SEQ ID NO: 169476 - protein, 9 aa, Mycobacterium bovis
APYGVEPQQ

SEQ ID NO: 169477 - protein, 7 aa, Mycobacterium bovis
AQAAANA

SEQ ID NO: 169478 - protein, 16 aa, Mycobacterium bovis
AQAAASAYNDAAGEQL

SEQ ID NO: 169479 - protein, 6 aa, Mycobacterium bovis
AQAAGG

SEQ ID NO: 169480 - protein, 15 aa, Mycobacterium bovis
AQAASGQARLVGTFE

SEQ ID NO: 169481 - protein, 10 aa, Mycobacterium bovis
AQAEAQGATQ

SEQ ID NO: 169482 - protein, 5 aa, Mycobacterium bovis
AQAEE

SEQ ID NO: 169483 - protein, 10 aa, Mycobacterium bovis
AQAEQAAAQA

SEQ ID NO: 169484 - protein, 6 aa, Mycobacterium bovis
AQAERA

SEQ ID NO: 169485 - protein, 11 aa, Mycobacterium bovis
AQAERSRDPIG

SEQ ID NO: 169486 - protein, 5 aa, Mycobacterium bovis
AQAET

SEQ ID NO: 169487 - protein, 4 aa, Mycobacterium bovis
AQAG

SEQ ID NO: 169488 - protein, 8 aa, Mycobacterium bovis
AQAGNATL

SEQ ID NO: 169489 - protein, 6 aa, Mycobacterium bovis
AQAHPK

SEQ ID NO: 169490 - protein, 4 aa, Mycobacterium bovis
AQAL

SEQ ID NO: 169491 - protein, 9 aa, Mycobacterium bovis
AQANGDTPV

SEQ ID NO: 169492 - protein, 6 aa, Mycobacterium bovis
AQAREE

SEQ ID NO: 169493 - protein, 5 aa, Mycobacterium bovis
AQASE

SEQ ID NO: 169494 - protein, 7 aa, Mycobacterium bovis
AQATGSG

SEQ ID NO: 169495 - protein, 13 aa, Mycobacterium bovis
AQAVGANDEDFEG

SEQ ID NO: 169496 - protein, 6 aa, Mycobacterium bovis
AQDAFG

SEQ ID NO: 169497 - protein, 7 aa, Mycobacterium bovis
AQDAGFN

SEQ ID NO: 169498 - protein, 7 aa, Mycobacterium bovis
AQDEHDE

SEQ ID NO: 169499 - protein, 107 aa, Mycobacterium bovis
AQDGGQGGTGGTGGNAGAGGTGFTQGADGNAGNGGDGGVGGNGGNGADNTTTAAAGTTGGDGGAGGAGGTGGTGGAAGTGTGGQQGNGGNGGNGGTGGKGGTGGAGM

SEQ ID NO: 169500 - protein, 14 aa, Mycobacterium bovis
AQDISETDLAGRYE

SEQ ID NO: 169501 - protein, 5 aa, Mycobacterium bovis
AQDMT

SEQ ID NO: 169502 - protein, 9 aa, Mycobacterium bovis
AQDTDPRTC

SEQ ID NO: 169503 - protein, 7 aa, Mycobacterium bovis
AQEAGRD

SEQ ID NO: 169504 - protein, 5 aa, Mycobacterium bovis
AQEEV

SEQ ID NO: 169505 - protein, 12 aa, Mycobacterium bovis
AQEGALSQIDED

SEQ ID NO: 169506 - protein, 7 aa, Mycobacterium bovis
AQEGRSH

SEQ ID NO: 169507 - protein, 7 aa, Mycobacterium bovis
AQEPGRE

SEQ ID NO: 169508 - protein, 14 aa, Mycobacterium bovis
AQEPNYEAALAALG

SEQ ID NO: 169509 - protein, 8 aa, Mycobacterium bovis
AQFDAGES

SEQ ID NO: 169510 - protein, 17 aa, Mycobacterium bovis
AQFPRPAPRPSYSALSS

SEQ ID NO: 169511 - protein, 7 aa, Mycobacterium bovis
AQGEARI

SEQ ID NO: 169512 - protein, 5 aa, Mycobacterium bovis
AQGGG

SEQ ID NO: 169513 - protein, 24 aa, Mycobacterium bovis
AQGGSGGLGGFGESTGGDGGLGGA

SEQ ID NO: 169514 - protein, 5 aa, Mycobacterium bovis
AQGIR

SEQ ID NO: 169515 - protein, 8 aa, Mycobacterium bovis
AQGPTANP

SEQ ID NO: 169516 - protein, 6 aa, Mycobacterium bovis
AQGQSD

SEQ ID NO: 169517 - protein, 8 aa, Mycobacterium bovis
AQGTPEDV

SEQ ID NO: 169518 - protein, 5 aa, Mycobacterium bovis
AQGTR

SEQ ID NO: 169519 - protein, 6 aa, Mycobacterium bovis
AQGTVA

SEQ ID NO: 169520 - protein, 5 aa, Mycobacterium bovis
AQGYS

SEQ ID NO: 169521 - protein, 9 aa, Mycobacterium bovis
AQHARHEAE

SEQ ID NO: 169522 - protein, 16 aa, Mycobacterium bovis
AQHPATNSAQTRSEEI

SEQ ID NO: 169523 - protein, 5 aa, Mycobacterium bovis
AQHRG

SEQ ID NO: 169524 - protein, 14 aa, Mycobacterium bovis
AQHTGARRGIDRAA

SEQ ID NO: 169525 - protein, 12 aa, Mycobacterium bovis
AQIPPPDERRGY

SEQ ID NO: 169526 - protein, 8 aa, Mycobacterium bovis
AQISSAPN

SEQ ID NO: 169527 - protein, 6 aa, Mycobacterium bovis
AQKAGL

SEQ ID NO: 169528 - protein, 9 aa, Mycobacterium bovis
AQKQARRWS

SEQ ID NO: 169529 - protein, 8 aa, Mycobacterium bovis
AQKVSETA

SEQ ID NO: 169530 - protein, 4 aa, Mycobacterium bovis
AQLA

SEQ ID NO: 169531 - protein, 11 aa, Mycobacterium bovis
AQLGAGQSIPT

SEQ ID NO: 169532 - protein, 7 aa, Mycobacterium bovis
AQLGTTG

SEQ ID NO: 169533 - protein, 12 aa, Mycobacterium bovis
AQLPDRSGDGLR

SEQ ID NO: 169534 - protein, 20 aa, Mycobacterium bovis
AQLQKGATQPATSGASASVH

SEQ ID NO: 169535 - protein, 8 aa, Mycobacterium bovis
AQLSSPDS

SEQ ID NO: 169536 - protein, 4 aa, Mycobacterium bovis
AQNG

SEQ ID NO: 169537 - protein, 7 aa, Mycobacterium bovis
AQNGDLE

SEQ ID NO: 169538 - protein, 7 aa, Mycobacterium bovis
AQNTTAE

SEQ ID NO: 169539 - protein, 4 aa, Mycobacterium bovis
AQNY

SEQ ID NO: 169540 - protein, 8 aa, Mycobacterium bovis
AQPAASAA

SEQ ID NO: 169541 - protein, 7 aa, Mycobacterium bovis
AQPAPGM

SEQ ID NO: 169542 - protein, 13 aa, Mycobacterium bovis
AQPAQGVVPSSKL

SEQ ID NO: 169543 - protein, 7 aa, Mycobacterium bovis
AQPDTAD

SEQ ID NO: 169544 - protein, 18 aa, Mycobacterium bovis
AQPHHRGGPTTATNGLGS

SEQ ID NO: 169545 - protein, 14 aa, Mycobacterium bovis
AQPISEGDRANPGH

SEQ ID NO: 169546 - protein, 7 aa, Mycobacterium bovis
AQPPQNH

SEQ ID NO: 169547 - protein, 13 aa, Mycobacterium bovis
AQPPTQAPLTQEE

SEQ ID NO: 169548 - protein, 10 aa, Mycobacterium bovis
AQPPVGTRAR

SEQ ID NO: 169549 - protein, 5 aa, Mycobacterium bovis
AQPQG

SEQ ID NO: 169550 - protein, 9 aa, Mycobacterium bovis
AQPRAGAST

SEQ ID NO: 169551 - protein, 7 aa, Mycobacterium bovis
AQPRHTT

SEQ ID NO: 169552 - protein, 6 aa, Mycobacterium bovis
AQPRPL

SEQ ID NO: 169553 - protein, 11 aa, Mycobacterium bovis
AQPSLHKGHRA

SEQ ID NO: 169554 - protein, 6 aa, Mycobacterium bovis
AQPTEP

SEQ ID NO: 169555 - protein, 9 aa, Mycobacterium bovis
AQQAGAGGV

SEQ ID NO: 169556 - protein, 6 aa, Mycobacterium bovis
AQQAGL

SEQ ID NO: 169557 - protein, 7 aa, Mycobacterium bovis
AQQAGRQ

SEQ ID NO: 169558 - protein, 9 aa, Mycobacterium bovis
AQQKKPWER

SEQ ID NO: 169559 - protein, 8 aa, Mycobacterium bovis
AQQPNGYT

SEQ ID NO: 169560 - protein, 12 aa, Mycobacterium bovis
AQQPTSARPGDE

SEQ ID NO: 169561 - protein, 9 aa, Mycobacterium bovis
AQQQPDAPA

SEQ ID NO: 169562 - protein, 12 aa, Mycobacterium bovis
AQQSANPTLPRQ

SEQ ID NO: 169563 - protein, 6 aa, Mycobacterium bovis
AQQTVT

SEQ ID NO: 169564 - protein, 4 aa, Mycobacterium bovis
AQRA

SEQ ID NO: 169565 - protein, 13 aa, Mycobacterium bovis
AQRAENDYVGAPT

SEQ ID NO: 169566 - protein, 7 aa, Mycobacterium bovis
AQRAGDA

SEQ ID NO: 169567 - protein, 15 aa, Mycobacterium bovis
AQRAHAPADVVEVLT

SEQ ID NO: 169568 - protein, 8 aa, Mycobacterium bovis
AQRDTDVD

SEQ ID NO: 169569 - protein, 7 aa, Mycobacterium bovis
AQRDVAD

SEQ ID NO: 169570 - protein, 5 aa, Mycobacterium bovis
AQRGA

SEQ ID NO: 169571 - protein, 15 aa, Mycobacterium bovis
AQRGRGARKRPTSGW

SEQ ID NO: 169572 - protein, 15 aa, Mycobacterium bovis
AQRGRGERKRPARGW

SEQ ID NO: 169573 - protein, 15 aa, Mycobacterium bovis
AQRGRGERKRPSNGW

SEQ ID NO: 169574 - protein, 4 aa, Mycobacterium bovis
AQRK

SEQ ID NO: 169575 - protein, 4 aa, Mycobacterium bovis
AQRP

SEQ ID NO: 169576 - protein, 7 aa, Mycobacterium bovis
AQRPDAV

SEQ ID NO: 169577 - protein, 11 aa, Mycobacterium bovis
AQRPTPAYGGA

SEQ ID NO: 169578 - protein, 6 aa, Mycobacterium bovis
AQRPTY

SEQ ID NO: 169579 - protein, 12 aa, Mycobacterium bovis
AQRQATKDAGQI

SEQ ID NO: 169580 - protein, 9 aa, Mycobacterium bovis
AQRQLDGDA

SEQ ID NO: 169581 - protein, 10 aa, Mycobacterium bovis
AQRQRPLRTA

SEQ ID NO: 169582 - protein, 9 aa, Mycobacterium bovis
AQRQRTGEV

SEQ ID NO: 169583 - protein, 5 aa, Mycobacterium bovis
AQRRK

SEQ ID NO: 169584 - protein, 6 aa, Mycobacterium bovis
AQRSLR

SEQ ID NO: 169585 - protein, 9 aa, Mycobacterium bovis
AQRSTTNPV

SEQ ID NO: 169586 - protein, 5 aa, Mycobacterium bovis
AQRTP

SEQ ID NO: 169587 - protein, 4 aa, Mycobacterium bovis
AQRV

SEQ ID NO: 169588 - protein, 9 aa, Mycobacterium bovis
AQRVSGADH

SEQ ID NO: 169589 - protein, 4 aa, Mycobacterium bovis
AQSA

SEQ ID NO: 169590 - protein, 6 aa, Mycobacterium bovis
AQSAHP

SEQ ID NO: 169591 - protein, 5 aa, Mycobacterium bovis
AQSGR

SEQ ID NO: 169592 - protein, 13 aa, Mycobacterium bovis
AQSHGHNAEIELV

SEQ ID NO: 169593 - protein, 6 aa, Mycobacterium bovis
AQSKGL

SEQ ID NO: 169594 - protein, 10 aa, Mycobacterium bovis
AQSPDIAQGV

SEQ ID NO: 169595 - protein, 28 aa, Mycobacterium bovis
AQSRSEAQLRQAQEKADALQADAERKHS

SEQ ID NO: 169596 - protein, 8 aa, Mycobacterium bovis
AQSSDVLS

SEQ ID NO: 169597 - protein, 14 aa, Mycobacterium bovis
AQSSTTGSPGPLPL

SEQ ID NO: 169598 - protein, 9 aa, Mycobacterium bovis
AQSTDKRVN

SEQ ID NO: 169599 - protein, 4 aa, Mycobacterium bovis
AQSV

SEQ ID NO: 169600 - protein, 8 aa, Mycobacterium bovis
AQSVSRGS

SEQ ID NO: 169601 - protein, 8 aa, Mycobacterium bovis
AQSYQAVS

SEQ ID NO: 169602 - protein, 8 aa, Mycobacterium bovis
AQTAGSVA

SEQ ID NO: 169603 - protein, 13 aa, Mycobacterium bovis
AQTASLDGPLPRD

SEQ ID NO: 169604 - protein, 5 aa, Mycobacterium bovis
AQTDP

SEQ ID NO: 169605 - protein, 7 aa, Mycobacterium bovis
AQTGGAA

SEQ ID NO: 169606 - protein, 95 aa, Mycobacterium bovis
AQTGGAGGAGGAGGDGAPGGNGGNGGSVEHTGATGSSASGGNGATGGNGGVGAPGGAGGNGGHVSGGSVNTAGAGGKGGNGGTGGAGGPGGHGGS

SEQ ID NO: 169607 - protein, 5 aa, Mycobacterium bovis
AQTGI

SEQ ID NO: 169608 - protein, 8 aa, Mycobacterium bovis
AQTGNGYR

SEQ ID NO: 169609 - protein, 13 aa, Mycobacterium bovis
AQTGPEGGSEPQV

SEQ ID NO: 169610 - protein, 9 aa, Mycobacterium bovis
AQTGTGKTA

SEQ ID NO: 169611 - protein, 4 aa, Mycobacterium bovis
AQTP

SEQ ID NO: 169612 - protein, 6 aa, Mycobacterium bovis
AQTPDT

SEQ ID NO: 169613 - protein, 8 aa, Mycobacterium bovis
AQTPSEVE

SEQ ID NO: 169614 - protein, 22 aa, Mycobacterium bovis
AQTRSRPYQKNDQAHVESKNNH

SEQ ID NO: 169615 - protein, 6 aa, Mycobacterium bovis
AQTTAR

SEQ ID NO: 169616 - protein, 4 aa, Mycobacterium bovis
AQVA

SEQ ID NO: 169617 - protein, 5 aa, Mycobacterium bovis
AQVTD

SEQ ID NO: 169618 - protein, 4 aa, Mycobacterium bovis
AQWR

SEQ ID NO: 169619 - protein, 4 aa, Mycobacterium bovis
AQYA

SEQ ID NO: 169620 - protein, 5 aa, Mycobacterium bovis
AQYDE

SEQ ID NO: 169621 - protein, 12 aa, Mycobacterium bovis
AQYEDQGNPYYS

SEQ ID NO: 169622 - protein, 7 aa, Mycobacterium bovis
AQYPAST

SEQ ID NO: 169623 - protein, 4 aa, Mycobacterium bovis
ARAA

SEQ ID NO: 169624 - protein, 8 aa, Mycobacterium bovis
ARAAQSAD

SEQ ID NO: 169625 - protein, 17 aa, Mycobacterium bovis
ARAATGADESVQTGEGR

SEQ ID NO: 169626 - protein, 9 aa, Mycobacterium bovis
ARAATTGPI

SEQ ID NO: 169627 - protein, 14 aa, Mycobacterium bovis
ARADATRVRSGADR

SEQ ID NO: 169628 - protein, 17 aa, Mycobacterium bovis
ARADGAAPAADHAEQVA

SEQ ID NO: 169629 - protein, 15 aa, Mycobacterium bovis
ARADGHDHAASAVAA

SEQ ID NO: 169630 - protein, 7 aa, Mycobacterium bovis
ARADLGQ

SEQ ID NO: 169631 - protein, 5 aa, Mycobacterium bovis
ARAEG

SEQ ID NO: 169632 - protein, 6 aa, Mycobacterium bovis
ARAEGY

SEQ ID NO: 169633 - protein, 6 aa, Mycobacterium bovis
ARAEPL

SEQ ID NO: 169634 - protein, 6 aa, Mycobacterium bovis
ARAEPV

SEQ ID NO: 169635 - protein, 13 aa, Mycobacterium bovis
ARAEQRAPVFTDD

SEQ ID NO: 169636 - protein, 9 aa, Mycobacterium bovis
ARAERGEPD

SEQ ID NO: 169637 - protein, 19 aa, Mycobacterium bovis
ARAERRAIPSKGLTGTGYD

SEQ ID NO: 169638 - protein, 8 aa, Mycobacterium bovis
ARAETERT

SEQ ID NO: 169639 - protein, 15 aa, Mycobacterium bovis
ARAFQDAKNRADQYA

SEQ ID NO: 169640 - protein, 4 aa, Mycobacterium bovis
ARAG

SEQ ID NO: 169641 - protein, 7 aa, Mycobacterium bovis
ARAGAVG

SEQ ID NO: 169642 - protein, 5 aa, Mycobacterium bovis
ARAGE

SEQ ID NO: 169643 - protein, 5 aa, Mycobacterium bovis
ARAGG

SEQ ID NO: 169644 - protein, 8 aa, Mycobacterium bovis
ARAGGGPT

SEQ ID NO: 169645 - protein, 6 aa, Mycobacterium bovis
ARAGGL

SEQ ID NO: 169646 - protein, 19 aa, Mycobacterium bovis
ARAGGPELQRESTEKAPIG

SEQ ID NO: 169647 - protein, 15 aa, Mycobacterium bovis
ARAGLTGGGTATLPR

SEQ ID NO: 169648 - protein, 7 aa, Mycobacterium bovis
ARAGPRW

SEQ ID NO: 169649 - protein, 9 aa, Mycobacterium bovis
ARAKEQDTE

SEQ ID NO: 169650 - protein, 7 aa, Mycobacterium bovis
ARANAEQ

SEQ ID NO: 169651 - protein, 12 aa, Mycobacterium bovis
ARANGGEPDAGR

SEQ ID NO: 169652 - protein, 9 aa, Mycobacterium bovis
ARAQATVGE

SEQ ID NO: 169653 - protein, 8 aa, Mycobacterium bovis
ARAQTGKA

SEQ ID NO: 169654 - protein, 4 aa, Mycobacterium bovis
ARAR

SEQ ID NO: 169655 - protein, 9 aa, Mycobacterium bovis
ARARDGGIP

SEQ ID NO: 169656 - protein, 7 aa, Mycobacterium bovis
ARARDLK

SEQ ID NO: 169657 - protein, 5 aa, Mycobacterium bovis
ARARR

SEQ ID NO: 169658 - protein, 17 aa, Mycobacterium bovis
ARARSGNLKPDELSGGT

SEQ ID NO: 169659 - protein, 12 aa, Mycobacterium bovis
ARARSRARTKAR

SEQ ID NO: 169660 - protein, 4 aa, Mycobacterium bovis
ARAS

SEQ ID NO: 169661 - protein, 8 aa, Mycobacterium bovis
ARASGKSA

SEQ ID NO: 169662 - protein, 8 aa, Mycobacterium bovis
ARATATTI

SEQ ID NO: 169663 - protein, 5 aa, Mycobacterium bovis
ARATD

SEQ ID NO: 169664 - protein, 7 aa, Mycobacterium bovis
ARDADGS

SEQ ID NO: 169665 - protein, 10 aa, Mycobacterium bovis
ARDADRAGQP

SEQ ID NO: 169666 - protein, 7 aa, Mycobacterium bovis
ARDADTV

SEQ ID NO: 169667 - protein, 12 aa, Mycobacterium bovis
ARDEAEAVRTQK

SEQ ID NO: 169668 - protein, 5 aa, Mycobacterium bovis
ARDGA

SEQ ID NO: 169669 - protein, 9 aa, Mycobacterium bovis
ARDGHSDYG

SEQ ID NO: 169670 - protein, 10 aa, Mycobacterium bovis
ARDGKLTTED

SEQ ID NO: 169671 - protein, 5 aa, Mycobacterium bovis
ARDHR

SEQ ID NO: 169672 - protein, 7 aa, Mycobacterium bovis
ARDPATG

SEQ ID NO: 169673 - protein, 9 aa, Mycobacterium bovis
ARDRDDPRP

SEQ ID NO: 169674 - protein, 6 aa, Mycobacterium bovis
ARDRVG

SEQ ID NO: 169675 - protein, 6 aa, Mycobacterium bovis
ARDTEI

SEQ ID NO: 169676 - protein, 15 aa, Mycobacterium bovis
AREAAAQASAAAAAY

SEQ ID NO: 169677 - protein, 12 aa, Mycobacterium bovis
AREAARSRELAA

SEQ ID NO: 169678 - protein, 14 aa, Mycobacterium bovis
AREAARTAERAGQA

SEQ ID NO: 169679 - protein, 9 aa, Mycobacterium bovis
AREAEAAGY

SEQ ID NO: 169680 - protein, 5 aa, Mycobacterium bovis
AREAG

SEQ ID NO: 169681 - protein, 8 aa, Mycobacterium bovis
AREARPEL

SEQ ID NO: 169682 - protein, 7 aa, Mycobacterium bovis
AREEAEQ

SEQ ID NO: 169683 - protein, 11 aa, Mycobacterium bovis
AREGTLTPAEL

SEQ ID NO: 169684 - protein, 4 aa, Mycobacterium bovis
AREI

SEQ ID NO: 169685 - protein, 5 aa, Mycobacterium bovis
ARELN

SEQ ID NO: 169686 - protein, 9 aa, Mycobacterium bovis
ARELNPNET

SEQ ID NO: 169687 - protein, 5 aa, Mycobacterium bovis
AREPD

SEQ ID NO: 169688 - protein, 10 aa, Mycobacterium bovis
AREPRGDGGF

SEQ ID NO: 169689 - protein, 8 aa, Mycobacterium bovis
AREPRREP

SEQ ID NO: 169690 - protein, 4 aa, Mycobacterium bovis
AREQ

SEQ ID NO: 169691 - protein, 11 aa, Mycobacterium bovis
ARERDPAAPTA

SEQ ID NO: 169692 - protein, 16 aa, Mycobacterium bovis
ARERTPSPPPVDSADD

SEQ ID NO: 169693 - protein, 12 aa, Mycobacterium bovis
ARESGTKALRDA

SEQ ID NO: 169694 - protein, 22 aa, Mycobacterium bovis
ARESPDPPEIAEPANGPPPPGR

SEQ ID NO: 169695 - protein, 7 aa, Mycobacterium bovis
ARETGRA

SEQ ID NO: 169696 - protein, 11 aa, Mycobacterium bovis
AREVNKRKNER

SEQ ID NO: 169697 - protein, 7 aa, Mycobacterium bovis
AREVRDT

SEQ ID NO: 169698 - protein, 6 aa, Mycobacterium bovis
ARFPTA

SEQ ID NO: 169699 - protein, 6 aa, Mycobacterium bovis
ARGAAL

SEQ ID NO: 169700 - protein, 10 aa, Mycobacterium bovis
ARGAEKTPEG

SEQ ID NO: 169701 - protein, 10 aa, Mycobacterium bovis
ARGASTSKEV

SEQ ID NO: 169702 - protein, 7 aa, Mycobacterium bovis
ARGDASA

SEQ ID NO: 169703 - protein, 6 aa, Mycobacterium bovis
ARGDLN

SEQ ID NO: 169704 - protein, 13 aa, Mycobacterium bovis
ARGDLRADSDTGA

SEQ ID NO: 169705 - protein, 4 aa, Mycobacterium bovis
ARGE

SEQ ID NO: 169706 - protein, 13 aa, Mycobacterium bovis
ARGGDSARTRSCP

SEQ ID NO: 169707 - protein, 15 aa, Mycobacterium bovis
ARGGKAAGSVSKKTN

SEQ ID NO: 169708 - protein, 6 aa, Mycobacterium bovis
ARGGSA

SEQ ID NO: 169709 - protein, 9 aa, Mycobacterium bovis
ARGGSMSPA

SEQ ID NO: 169710 - protein, 18 aa, Mycobacterium bovis
ARGGSSGRAGVKCRRPTG

SEQ ID NO: 169711 - protein, 29 aa, Mycobacterium bovis
ARGGTNSAPGTATESARAPEPAASAPPEA

SEQ ID NO: 169712 - protein, 15 aa, Mycobacterium bovis
ARGGTSLGEGPARAW

SEQ ID NO: 169713 - protein, 9 aa, Mycobacterium bovis
ARGGTTATY

SEQ ID NO: 169714 - protein, 12 aa, Mycobacterium bovis
ARGGVGAGPDVR

SEQ ID NO: 169715 - protein, 9 aa, Mycobacterium bovis
ARGKGISDI

SEQ ID NO: 169716 - protein, 8 aa, Mycobacterium bovis
ARGKSGRL

SEQ ID NO: 169717 - protein, 7 aa, Mycobacterium bovis
ARGLGAP

SEQ ID NO: 169718 - protein, 5 aa, Mycobacterium bovis
ARGPV

SEQ ID NO: 169719 - protein, 9 aa, Mycobacterium bovis
ARGQDPDKV

SEQ ID NO: 169720 - protein, 8 aa, Mycobacterium bovis
ARGQPGYR

SEQ ID NO: 169721 - protein, 4 aa, Mycobacterium bovis
ARGR

SEQ ID NO: 169722 - protein, 7 aa, Mycobacterium bovis
ARGRGPV

SEQ ID NO: 169723 - protein, 6 aa, Mycobacterium bovis
ARGSGY

SEQ ID NO: 169724 - protein, 8 aa, Mycobacterium bovis
ARGSTRET

SEQ ID NO: 169725 - protein, 5 aa, Mycobacterium bovis
ARGTA

SEQ ID NO: 169726 - protein, 15 aa, Mycobacterium bovis
ARGTAPSSPLNATVS

SEQ ID NO: 169727 - protein, 11 aa, Mycobacterium bovis
ARGTKYPDEVE

SEQ ID NO: 169728 - protein, 4 aa, Mycobacterium bovis
ARGV

SEQ ID NO: 169729 - protein, 5 aa, Mycobacterium bovis
ARGVE

SEQ ID NO: 169730 - protein, 10 aa, Mycobacterium bovis
ARGYRGRPEL

SEQ ID NO: 169731 - protein, 20 aa, Mycobacterium bovis
ARHGGGAFSGKDPSKVDRSA

SEQ ID NO: 169732 - protein, 16 aa, Mycobacterium bovis
ARHPAAESTVTGSASD

SEQ ID NO: 169733 - protein, 4 aa, Mycobacterium bovis
ARHS

SEQ ID NO: 169734 - protein, 6 aa, Mycobacterium bovis
ARHSSG

SEQ ID NO: 169735 - protein, 7 aa, Mycobacterium bovis
ARHTPEG

SEQ ID NO: 169736 - protein, 4 aa, Mycobacterium bovis
ARID

SEQ ID NO: 169737 - protein, 13 aa, Mycobacterium bovis
ARIDPPGPSPAGP

SEQ ID NO: 169738 - protein, 15 aa, Mycobacterium bovis
ARIGPGAAAKRDPQL

SEQ ID NO: 169739 - protein, 21 aa, Mycobacterium bovis
ARIGPGTNNAPSAADTTTYAR

SEQ ID NO: 169740 - protein, 4 aa, Mycobacterium bovis
ARIS

SEQ ID NO: 169741 - protein, 6 aa, Mycobacterium bovis
ARITGG

SEQ ID NO: 169742 - protein, 9 aa, Mycobacterium bovis
ARKAADSTV

SEQ ID NO: 169743 - protein, 16 aa, Mycobacterium bovis
ARKAGTTVTHEDKGGR

SEQ ID NO: 169744 - protein, 7 aa, Mycobacterium bovis
ARKASLP

SEQ ID NO: 169745 - protein, 9 aa, Mycobacterium bovis
ARKDGYTST

SEQ ID NO: 169746 - protein, 8 aa, Mycobacterium bovis
ARKGDNAP

SEQ ID NO: 169747 - protein, 18 aa, Mycobacterium bovis
ARKGQKTRRREKKNVPHG

SEQ ID NO: 169748 - protein, 12 aa, Mycobacterium bovis
ARKLETGDQGAS

SEQ ID NO: 169749 - protein, 8 aa, Mycobacterium bovis
ARKLKSAG

SEQ ID NO: 169750 - protein, 8 aa, Mycobacterium bovis
ARKQGRER

SEQ ID NO: 169751 - protein, 8 aa, Mycobacterium bovis
ARKSGYGL

SEQ ID NO: 169752 - protein, 5 aa, Mycobacterium bovis
ARKSS

SEQ ID NO: 169753 - protein, 10 aa, Mycobacterium bovis
ARKVTAPAEI

SEQ ID NO: 169754 - protein, 5 aa, Mycobacterium bovis
ARLAE

SEQ ID NO: 169755 - protein, 5 aa, Mycobacterium bovis
ARLAG

SEQ ID NO: 169756 - protein, 14 aa, Mycobacterium bovis
ARLANDPTAPAPDK

SEQ ID NO: 169757 - protein, 5 aa, Mycobacterium bovis
ARLAQ

SEQ ID NO: 169758 - protein, 10 aa, Mycobacterium bovis
ARLDGSDPVN

SEQ ID NO: 169759 - protein, 4 aa, Mycobacterium bovis
ARLE

SEQ ID NO: 169760 - protein, 4 aa, Mycobacterium bovis
ARLP

SEQ ID NO: 169761 - protein, 7 aa, Mycobacterium bovis
ARLPGRA

SEQ ID NO: 169762 - protein, 10 aa, Mycobacterium bovis
ARLPSSAEAP

SEQ ID NO: 169763 - protein, 10 aa, Mycobacterium bovis
ARLSRDEKAV

SEQ ID NO: 169764 - protein, 11 aa, Mycobacterium bovis
ARLTPRSSSRQ

SEQ ID NO: 169765 - protein, 8 aa, Mycobacterium bovis
ARMASGGT

SEQ ID NO: 169766 - protein, 6 aa, Mycobacterium bovis
ARNAQR

SEQ ID NO: 169767 - protein, 12 aa, Mycobacterium bovis
ARNATAAEGLDQ

SEQ ID NO: 169768 - protein, 6 aa, Mycobacterium bovis
ARNDDG

SEQ ID NO: 169769 - protein, 4 aa, Mycobacterium bovis
ARNG

SEQ ID NO: 169770 - protein, 17 aa, Mycobacterium bovis
ARNHDLTESELADAERD

SEQ ID NO: 169771 - protein, 8 aa, Mycobacterium bovis
ARNNTEAR

SEQ ID NO: 169772 - protein, 6 aa, Mycobacterium bovis
ARNRHT

SEQ ID NO: 169773 - protein, 5 aa, Mycobacterium bovis
ARNVS

SEQ ID NO: 169774 - protein, 6 aa, Mycobacterium bovis
ARPAET

SEQ ID NO: 169775 - protein, 9 aa, Mycobacterium bovis
ARPAGLPGS

SEQ ID NO: 169776 - protein, 24 aa, Mycobacterium bovis
ARPARPPRGSGGTRTARNGARTAS

SEQ ID NO: 169777 - protein, 8 aa, Mycobacterium bovis
ARPDGHGA

SEQ ID NO: 169778 - protein, 5 aa, Mycobacterium bovis
ARPDQ

SEQ ID NO: 169779 - protein, 7 aa, Mycobacterium bovis
ARPDTLP

SEQ ID NO: 169780 - protein, 8 aa, Mycobacterium bovis
ARPEDAGD

SEQ ID NO: 169781 - protein, 5 aa, Mycobacterium bovis
ARPER

SEQ ID NO: 169782 - protein, 6 aa, Mycobacterium bovis
ARPERI

SEQ ID NO: 169783 - protein, 7 aa, Mycobacterium bovis
ARPGDGP

SEQ ID NO: 169784 - protein, 11 aa, Mycobacterium bovis
ARPGTPLHDPG

SEQ ID NO: 169785 - protein, 10 aa, Mycobacterium bovis
ARPNSKASIG

SEQ ID NO: 169786 - protein, 10 aa, Mycobacterium bovis
ARPNSPRPEG

SEQ ID NO: 169787 - protein, 33 aa, Mycobacterium bovis
ARPPNPAATAPPAGTTGHKKGGSATRSRRSSPP

SEQ ID NO: 169788 - protein, 5 aa, Mycobacterium bovis
ARPPV

SEQ ID NO: 169789 - protein, 11 aa, Mycobacterium bovis
ARPRNSTELDE

SEQ ID NO: 169790 - protein, 8 aa, Mycobacterium bovis
ARPSETAT

SEQ ID NO: 169791 - protein, 6 aa, Mycobacterium bovis
ARPTYA

SEQ ID NO: 169792 - protein, 4 aa, Mycobacterium bovis
ARPV

SEQ ID NO: 169793 - protein, 17 aa, Mycobacterium bovis
ARPWTNRQATDNSTVPD

SEQ ID NO: 169794 - protein, 4 aa, Mycobacterium bovis
ARQA

SEQ ID NO: 169795 - protein, 11 aa, Mycobacterium bovis
ARQARAAAGAF

SEQ ID NO: 169796 - protein, 8 aa, Mycobacterium bovis
ARQAVDDG

SEQ ID NO: 169797 - protein, 7 aa, Mycobacterium bovis
ARQEPGL

SEQ ID NO: 169798 - protein, 4 aa, Mycobacterium bovis
ARQG

SEQ ID NO: 169799 - protein, 6 aa, Mycobacterium bovis
ARQGAG

SEQ ID NO: 169800 - protein, 5 aa, Mycobacterium bovis
ARQGN

SEQ ID NO: 169801 - protein, 6 aa, Mycobacterium bovis
ARQHSE

SEQ ID NO: 169802 - protein, 4 aa, Mycobacterium bovis
ARQK

SEQ ID NO: 169803 - protein, 5 aa, Mycobacterium bovis
ARQLP

SEQ ID NO: 169804 - protein, 6 aa, Mycobacterium bovis
ARQPGR

SEQ ID NO: 169805 - protein, 11 aa, Mycobacterium bovis
ARQPRDASPVR

SEQ ID NO: 169806 - protein, 7 aa, Mycobacterium bovis
ARQQLED

SEQ ID NO: 169807 - protein, 10 aa, Mycobacterium bovis
ARQRAGTADV

SEQ ID NO: 169808 - protein, 7 aa, Mycobacterium bovis
ARQSRRP

SEQ ID NO: 169809 - protein, 4 aa, Mycobacterium bovis
ARQT

SEQ ID NO: 169810 - protein, 11 aa, Mycobacterium bovis
ARRAAGRDAPE

SEQ ID NO: 169811 - protein, 13 aa, Mycobacterium bovis
ARRADPPTTWSAC

SEQ ID NO: 169812 - protein, 8 aa, Mycobacterium bovis
ARRAGADA

SEQ ID NO: 169813 - protein, 9 aa, Mycobacterium bovis
ARRAGRAPE

SEQ ID NO: 169814 - protein, 6 aa, Mycobacterium bovis
ARRARQ

SEQ ID NO: 169815 - protein, 8 aa, Mycobacterium bovis
ARRCPDRP

SEQ ID NO: 169816 - protein, 14 aa, Mycobacterium bovis
ARRDDDAKRWADGQ

SEQ ID NO: 169817 - protein, 8 aa, Mycobacterium bovis
ARRDEATR

SEQ ID NO: 169818 - protein, 7 aa, Mycobacterium bovis
ARRDGAP

SEQ ID NO: 169819 - protein, 6 aa, Mycobacterium bovis
ARRDGN

SEQ ID NO: 169820 - protein, 12 aa, Mycobacterium bovis
ARRDGQDPYPPA

SEQ ID NO: 169821 - protein, 8 aa, Mycobacterium bovis
ARRDPPLD

SEQ ID NO: 169822 - protein, 13 aa, Mycobacterium bovis
ARRDQVRATGRSI

SEQ ID NO: 169823 - protein, 6 aa, Mycobacterium bovis
ARRDRP

SEQ ID NO: 169824 - protein, 13 aa, Mycobacterium bovis
ARRDTDPADTDAL

SEQ ID NO: 169825 - protein, 8 aa, Mycobacterium bovis
ARREGTRQ

SEQ ID NO: 169826 - protein, 7 aa, Mycobacterium bovis
ARRENTT

SEQ ID NO: 169827 - protein, 7 aa, Mycobacterium bovis
ARRERGD

SEQ ID NO: 169828 - protein, 6 aa, Mycobacterium bovis
ARRGER

SEQ ID NO: 169829 - protein, 11 aa, Mycobacterium bovis
ARRGSVTDLSP

SEQ ID NO: 169830 - protein, 8 aa, Mycobacterium bovis
ARRGTANS

SEQ ID NO: 169831 - protein, 5 aa, Mycobacterium bovis
ARRHD

SEQ ID NO: 169832 - protein, 13 aa, Mycobacterium bovis
ARRLSRSGAPGRR

SEQ ID NO: 169833 - protein, 8 aa, Mycobacterium bovis
ARRNEAAS

SEQ ID NO: 169834 - protein, 11 aa, Mycobacterium bovis
ARRNPNAQTRG

SEQ ID NO: 169835 - protein, 5 aa, Mycobacterium bovis
ARRNS

SEQ ID NO: 169836 - protein, 9 aa, Mycobacterium bovis
ARRPEGATV

SEQ ID NO: 169837 - protein, 6 aa, Mycobacterium bovis
ARRPGR

SEQ ID NO: 169838 - protein, 8 aa, Mycobacterium bovis
ARRPRLGV

SEQ ID NO: 169839 - protein, 4 aa, Mycobacterium bovis
ARRQ

SEQ ID NO: 169840 - protein, 7 aa, Mycobacterium bovis
ARRQRQY

SEQ ID NO: 169841 - protein, 14 aa, Mycobacterium bovis
ARRRQGSAPPGPLQ

SEQ ID NO: 169842 - protein, 8 aa, Mycobacterium bovis
ARRRYQTG

SEQ ID NO: 169843 - protein, 6 aa, Mycobacterium bovis
ARRSAD

SEQ ID NO: 169844 - protein, 9 aa, Mycobacterium bovis
ARRSAGAHP

SEQ ID NO: 169845 - protein, 11 aa, Mycobacterium bovis
ARRSGASWSDI

SEQ ID NO: 169846 - protein, 8 aa, Mycobacterium bovis
ARRSNGRR

SEQ ID NO: 169847 - protein, 4 aa, Mycobacterium bovis
ARRW

SEQ ID NO: 169848 - protein, 9 aa, Mycobacterium bovis
ARSADPGER

SEQ ID NO: 169849 - protein, 9 aa, Mycobacterium bovis
ARSAEGDRV

SEQ ID NO: 169850 - protein, 10 aa, Mycobacterium bovis
ARSAHAGNDA

SEQ ID NO: 169851 - protein, 5 aa, Mycobacterium bovis
ARSAK

SEQ ID NO: 169852 - protein, 13 aa, Mycobacterium bovis
ARSASEYGQEIPL

SEQ ID NO: 169853 - protein, 8 aa, Mycobacterium bovis
ARSEPRFT

SEQ ID NO: 169854 - protein, 5 aa, Mycobacterium bovis
ARSEW

SEQ ID NO: 169855 - protein, 4 aa, Mycobacterium bovis
ARSG

SEQ ID NO: 169856 - protein, 11 aa, Mycobacterium bovis
ARSGDKGGSAN

SEQ ID NO: 169857 - protein, 7 aa, Mycobacterium bovis
ARSGGTL

SEQ ID NO: 169858 - protein, 11 aa, Mycobacterium bovis
ARSGPRRNAQV

SEQ ID NO: 169859 - protein, 7 aa, Mycobacterium bovis
ARSGTPV

SEQ ID NO: 169860 - protein, 16 aa, Mycobacterium bovis
ARSHADPAAAGRRSPL

SEQ ID NO: 169861 - protein, 12 aa, Mycobacterium bovis
ARSNCGEGGEDV

SEQ ID NO: 169862 - protein, 7 aa, Mycobacterium bovis
ARSQGRK

SEQ ID NO: 169863 - protein, 10 aa, Mycobacterium bovis
ARSQRAPDEM

SEQ ID NO: 169864 - protein, 4 aa, Mycobacterium bovis
ARSR

SEQ ID NO: 169865 - protein, 8 aa, Mycobacterium bovis
ARSRATRR

SEQ ID NO: 169866 - protein, 5 aa, Mycobacterium bovis
ARSRK

SEQ ID NO: 169867 - protein, 7 aa, Mycobacterium bovis
ARSRQQA

SEQ ID NO: 169868 - protein, 5 aa, Mycobacterium bovis
ARSRS

SEQ ID NO: 169869 - protein, 6 aa, Mycobacterium bovis
ARSSAR

SEQ ID NO: 169870 - protein, 6 aa, Mycobacterium bovis
ARSSAS

SEQ ID NO: 169871 - protein, 12 aa, Mycobacterium bovis
ARSSLEKPVPVP

SEQ ID NO: 169872 - protein, 34 aa, Mycobacterium bovis
ARSSMGEKPGHDHQRNQRDQNQRDVRPRHPGYLG

SEQ ID NO: 169873 - protein, 4 aa, Mycobacterium bovis
ARST

SEQ ID NO: 169874 - protein, 10 aa, Mycobacterium bovis
ARSTGQRPSW

SEQ ID NO: 169875 - protein, 9 aa, Mycobacterium bovis
ARSTPEDAE

SEQ ID NO: 169876 - protein, 15 aa, Mycobacterium bovis
ARSVEGAGPGPEGNI

SEQ ID NO: 169877 - protein, 5 aa, Mycobacterium bovis
ARSVG

SEQ ID NO: 169878 - protein, 7 aa, Mycobacterium bovis
ARTAANY

SEQ ID NO: 169879 - protein, 5 aa, Mycobacterium bovis
ARTAE

SEQ ID NO: 169880 - protein, 8 aa, Mycobacterium bovis
ARTAGSGE

SEQ ID NO: 169881 - protein, 5 aa, Mycobacterium bovis
ARTAT

SEQ ID NO: 169882 - protein, 4 aa, Mycobacterium bovis
ARTD

SEQ ID NO: 169883 - protein, 19 aa, Mycobacterium bovis
ARTDAERLRDEDVSTEPDA

SEQ ID NO: 169884 - protein, 9 aa, Mycobacterium bovis
ARTDENTPL

SEQ ID NO: 169885 - protein, 5 aa, Mycobacterium bovis
ARTDQ

SEQ ID NO: 169886 - protein, 7 aa, Mycobacterium bovis
ARTDTLS

SEQ ID NO: 169887 - protein, 11 aa, Mycobacterium bovis
ARTGADNPFDR

SEQ ID NO: 169888 - protein, 10 aa, Mycobacterium bovis
ARTGDCTAAA

SEQ ID NO: 169889 - protein, 7 aa, Mycobacterium bovis
ARTGETL

SEQ ID NO: 169890 - protein, 7 aa, Mycobacterium bovis
ARTGPTA

SEQ ID NO: 169891 - protein, 11 aa, Mycobacterium bovis
ARTGTNQTAAV

SEQ ID NO: 169892 - protein, 8 aa, Mycobacterium bovis
ARTGVRRP

SEQ ID NO: 169893 - protein, 12 aa, Mycobacterium bovis
ARTLGTDAVDEA

SEQ ID NO: 169894 - protein, 8 aa, Mycobacterium bovis
ARTPEETA

SEQ ID NO: 169895 - protein, 5 aa, Mycobacterium bovis
ARTPP

SEQ ID NO: 169896 - protein, 6 aa, Mycobacterium bovis
ARTPTA

SEQ ID NO: 169897 - protein, 6 aa, Mycobacterium bovis
ARTREQ

SEQ ID NO: 169898 - protein, 8 aa, Mycobacterium bovis
ARTRRDGR

SEQ ID NO: 169899 - protein, 8 aa, Mycobacterium bovis
ARTRSPLS

SEQ ID NO: 169900 - protein, 8 aa, Mycobacterium bovis
ARTSAGNV

SEQ ID NO: 169901 - protein, 7 aa, Mycobacterium bovis
ARTSDVP

SEQ ID NO: 169902 - protein, 6 aa, Mycobacterium bovis
ARTSQF

SEQ ID NO: 169903 - protein, 6 aa, Mycobacterium bovis
ARTTGT

SEQ ID NO: 169904 - protein, 8 aa, Mycobacterium bovis
ARTTPEAA

SEQ ID NO: 169905 - protein, 7 aa, Mycobacterium bovis
ARVRGAG

SEQ ID NO: 169906 - protein, 4 aa, Mycobacterium bovis
ARVS

SEQ ID NO: 169907 - protein, 6 aa, Mycobacterium bovis
ARVSDQ

SEQ ID NO: 169908 - protein, 9 aa, Mycobacterium bovis
ARVTTDEEI

SEQ ID NO: 169909 - protein, 4 aa, Mycobacterium bovis
ARYD

SEQ ID NO: 169910 - protein, 19 aa, Mycobacterium bovis
ARYERSDTRVTDRNGARSR

SEQ ID NO: 169911 - protein, 5 aa, Mycobacterium bovis
ARYRD

SEQ ID NO: 169912 - protein, 5 aa, Mycobacterium bovis
ARYSA

SEQ ID NO: 169913 - protein, 7 aa, Mycobacterium bovis
ASAAEAR

SEQ ID NO: 169914 - protein, 8 aa, Mycobacterium bovis
ASAAESIE

SEQ ID NO: 169915 - protein, 5 aa, Mycobacterium bovis
ASAAP

SEQ ID NO: 169916 - protein, 5 aa, Mycobacterium bovis
ASAAR

SEQ ID NO: 169917 - protein, 7 aa, Mycobacterium bovis
ASAARMA

SEQ ID NO: 169918 - protein, 6 aa, Mycobacterium bovis
ASAASI

SEQ ID NO: 169919 - protein, 5 aa, Mycobacterium bovis
ASAAT

SEQ ID NO: 169920 - protein, 12 aa, Mycobacterium bovis
ASAATSPGPTPA

SEQ ID NO: 169921 - protein, 5 aa, Mycobacterium bovis
ASAAV

SEQ ID NO: 169922 - protein, 7 aa, Mycobacterium bovis
ASADEGR

SEQ ID NO: 169923 - protein, 6 aa, Mycobacterium bovis
ASADGS

SEQ ID NO: 169924 - protein, 10 aa, Mycobacterium bovis
ASADPGRPTN

SEQ ID NO: 169925 - protein, 10 aa, Mycobacterium bovis
ASADPPSPDE

SEQ ID NO: 169926 - protein, 9 aa, Mycobacterium bovis
ASADRTPGF

SEQ ID NO: 169927 - protein, 9 aa, Mycobacterium bovis
ASADTGLPI

SEQ ID NO: 169928 - protein, 18 aa, Mycobacterium bovis
ASAEATRRYGTGCSGSPL

SEQ ID NO: 169929 - protein, 7 aa, Mycobacterium bovis
ASAESRS

SEQ ID NO: 169930 - protein, 7 aa, Mycobacterium bovis
ASAGADA

SEQ ID NO: 169931 - protein, 7 aa, Mycobacterium bovis
ASAGATA

SEQ ID NO: 169932 - protein, 5 aa, Mycobacterium bovis
ASAGI

SEQ ID NO: 169933 - protein, 7 aa, Mycobacterium bovis
ASAGLGQ

SEQ ID NO: 169934 - protein, 9 aa, Mycobacterium bovis
ASAGNAAAA

SEQ ID NO: 169935 - protein, 7 aa, Mycobacterium bovis
ASAGPLD

SEQ ID NO: 169936 - protein, 19 aa, Mycobacterium bovis
ASAGRARPARKIKPPADPD

SEQ ID NO: 169937 - protein, 6 aa, Mycobacterium bovis
ASAGRK

SEQ ID NO: 169938 - protein, 8 aa, Mycobacterium bovis
ASAGTGKT

SEQ ID NO: 169939 - protein, 4 aa, Mycobacterium bovis
ASAI

SEQ ID NO: 169940 - protein, 4 aa, Mycobacterium bovis
ASAN

SEQ ID NO: 169941 - protein, 8 aa, Mycobacterium bovis
ASANTGDG

SEQ ID NO: 169942 - protein, 24 aa, Mycobacterium bovis
ASAPAPAAAAGATAAGPTPPATGF

SEQ ID NO: 169943 - protein, 30 aa, Mycobacterium bovis
ASAPGAAGSPGGNGGNGGPGGAGGEGGAGG

SEQ ID NO: 169944 - protein, 10 aa, Mycobacterium bovis
ASAPGGDSYA

SEQ ID NO: 169945 - protein, 10 aa, Mycobacterium bovis
ASAPGPDIDG

SEQ ID NO: 169946 - protein, 8 aa, Mycobacterium bovis
ASAPRPAP

SEQ ID NO: 169947 - protein, 13 aa, Mycobacterium bovis
ASAPVSGGWAGPE

SEQ ID NO: 169948 - protein, 14 aa, Mycobacterium bovis
ASAQAQLAAGQAKA

SEQ ID NO: 169949 - protein, 8 aa, Mycobacterium bovis
ASAQQKST

SEQ ID NO: 169950 - protein, 9 aa, Mycobacterium bovis
ASARASKAT

SEQ ID NO: 169951 - protein, 9 aa, Mycobacterium bovis
ASARETAAR

SEQ ID NO: 169952 - protein, 5 aa, Mycobacterium bovis
ASARP

SEQ ID NO: 169953 - protein, 4 aa, Mycobacterium bovis
ASAS

SEQ ID NO: 169954 - protein, 7 aa, Mycobacterium bovis
ASASSQF

SEQ ID NO: 169955 - protein, 8 aa, Mycobacterium bovis
ASASTQLG

SEQ ID NO: 169956 - protein, 13 aa, Mycobacterium bovis
ASATASSTGVDGG

SEQ ID NO: 169957 - protein, 8 aa, Mycobacterium bovis
ASATDVSK

SEQ ID NO: 169958 - protein, 14 aa, Mycobacterium bovis
ASATFDRPALGPSA

SEQ ID NO: 169959 - protein, 7 aa, Mycobacterium bovis
ASATNLP

SEQ ID NO: 169960 - protein, 8 aa, Mycobacterium bovis
ASATPAGL

SEQ ID NO: 169961 - protein, 10 aa, Mycobacterium bovis
ASATPDTAVT

SEQ ID NO: 169962 - protein, 14 aa, Mycobacterium bovis
ASATPPESGQPFQA

SEQ ID NO: 169963 - protein, 7 aa, Mycobacterium bovis
ASATRPH

SEQ ID NO: 169964 - protein, 26 aa, Mycobacterium bovis
ASATRSSAGFGAPRYGAKPIVMPKPA

SEQ ID NO: 169965 - protein, 4 aa, Mycobacterium bovis
ASAV

SEQ ID NO: 169966 - protein, 19 aa, Mycobacterium bovis
ASAVEAAAAEYANNEAAAA

SEQ ID NO: 169967 - protein, 5 aa, Mycobacterium bovis
ASAVT

SEQ ID NO: 169968 - protein, 14 aa, Mycobacterium bovis
ASAYDEAAATMSGK

SEQ ID NO: 169969 - protein, 9 aa, Mycobacterium bovis
ASCGPDAAL

SEQ ID NO: 169970 - protein, 5 aa, Mycobacterium bovis
ASDEF

SEQ ID NO: 169971 - protein, 8 aa, Mycobacterium bovis
ASDEPNRA

SEQ ID NO: 169972 - protein, 8 aa, Mycobacterium bovis
ASDFNARS

SEQ ID NO: 169973 - protein, 16 aa, Mycobacterium bovis
ASDGESNFGKIGSPQI

SEQ ID NO: 169974 - protein, 27 aa, Mycobacterium bovis
ASDGPRRSSTRSECHSSGAQSAPPNTS

SEQ ID NO: 169975 - protein, 5 aa, Mycobacterium bovis
ASDHR

SEQ ID NO: 169976 - protein, 6 aa, Mycobacterium bovis
ASDPNR

SEQ ID NO: 169977 - protein, 9 aa, Mycobacterium bovis
ASDPQSAGR

SEQ ID NO: 169978 - protein, 6 aa, Mycobacterium bovis
ASDPRK

SEQ ID NO: 169979 - protein, 13 aa, Mycobacterium bovis
ASDPWQPQYGSGQ

SEQ ID NO: 169980 - protein, 7 aa, Mycobacterium bovis
ASDQTVE

SEQ ID NO: 169981 - protein, 6 aa, Mycobacterium bovis
ASDRGA

SEQ ID NO: 169982 - protein, 10 aa, Mycobacterium bovis
ASDRGDAERG

SEQ ID NO: 169983 - protein, 8 aa, Mycobacterium bovis
ASDRGYDE

SEQ ID NO: 169984 - protein, 8 aa, Mycobacterium bovis
ASDSEPAF

SEQ ID NO: 169985 - protein, 7 aa, Mycobacterium bovis
ASDSPHG

SEQ ID NO: 169986 - protein, 8 aa, Mycobacterium bovis
ASDTDTEV

SEQ ID NO: 169987 - protein, 11 aa, Mycobacterium bovis
ASDTNPAPQLQ

SEQ ID NO: 169988 - protein, 7 aa, Mycobacterium bovis
ASDVNGP

SEQ ID NO: 169989 - protein, 7 aa, Mycobacterium bovis
ASDVTAT

SEQ ID NO: 169990 - protein, 12 aa, Mycobacterium bovis
ASEAAGRDPDTL

SEQ ID NO: 169991 - protein, 7 aa, Mycobacterium bovis
ASEAGIE

SEQ ID NO: 169992 - protein, 9 aa, Mycobacterium bovis
ASEEALARD

SEQ ID NO: 169993 - protein, 12 aa, Mycobacterium bovis
ASEETWRELANE

SEQ ID NO: 169994 - protein, 6 aa, Mycobacterium bovis
ASEGYG

SEQ ID NO: 169995 - protein, 7 aa, Mycobacterium bovis
ASEHTTG

SEQ ID NO: 169996 - protein, 5 aa, Mycobacterium bovis
ASEIK

SEQ ID NO: 169997 - protein, 6 aa, Mycobacterium bovis
ASEKAA

SEQ ID NO: 169998 - protein, 4 aa, Mycobacterium bovis
ASEL

SEQ ID NO: 169999 - protein, 25 aa, Mycobacterium bovis
ASENGVPVTARGSGCGLSGAARPVE

SEQ ID NO: 170000 - protein, 8 aa, Mycobacterium bovis
ASEPGHRH

SEQ ID NO: 170001 - protein, 8 aa, Mycobacterium bovis
ASEQPTSR

SEQ ID NO: 170002 - protein, 4 aa, Mycobacterium bovis
ASER

SEQ ID NO: 170003 - protein, 13 aa, Mycobacterium bovis
ASERTAPSRACQG

SEQ ID NO: 170004 - protein, 6 aa, Mycobacterium bovis
ASESLT

SEQ ID NO: 170005 - protein, 8 aa, Mycobacterium bovis
ASESPNHR

SEQ ID NO: 170006 - protein, 8 aa, Mycobacterium bovis
ASEYEING

SEQ ID NO: 170007 - protein, 5 aa, Mycobacterium bovis
ASFEG

SEQ ID NO: 170008 - protein, 5 aa, Mycobacterium bovis
ASGAD

SEQ ID NO: 170009 - protein, 9 aa, Mycobacterium bovis
ASGADIGRP

SEQ ID NO: 170010 - protein, 6 aa, Mycobacterium bovis
ASGAEA

SEQ ID NO: 170011 - protein, 9 aa, Mycobacterium bovis
ASGEDETAW

SEQ ID NO: 170012 - protein, 8 aa, Mycobacterium bovis
ASGEDPQR

SEQ ID NO: 170013 - protein, 18 aa, Mycobacterium bovis
ASGEPASGPASNSPARKR

SEQ ID NO: 170014 - protein, 5 aa, Mycobacterium bovis
ASGER

SEQ ID NO: 170015 - protein, 30 aa, Mycobacterium bovis
ASGGAGGSGGSALNVGGTGGVGGNGGSGGS

SEQ ID NO: 170016 - protein, 7 aa, Mycobacterium bovis
ASGGAGP

SEQ ID NO: 170017 - protein, 12 aa, Mycobacterium bovis
ASGGAVSLPARG

SEQ ID NO: 170018 - protein, 10 aa, Mycobacterium bovis
ASGGDGGQGG

SEQ ID NO: 170019 - protein, 5 aa, Mycobacterium bovis
ASGGG

SEQ ID NO: 170020 - protein, 11 aa, Mycobacterium bovis
ASGGGPGTGKC

SEQ ID NO: 170021 - protein, 8 aa, Mycobacterium bovis
ASGGIRTA

SEQ ID NO: 170022 - protein, 5 aa, Mycobacterium bovis
ASGGR

SEQ ID NO: 170023 - protein, 8 aa, Mycobacterium bovis
ASGGSVGY

SEQ ID NO: 170024 - protein, 19 aa, Mycobacterium bovis
ASGGTGGAGGTGGAGGRGG

SEQ ID NO: 170025 - protein, 16 aa, Mycobacterium bovis
ASGGTVINGQTSGIGN

SEQ ID NO: 170026 - protein, 10 aa, Mycobacterium bovis
ASGHGDALAS

SEQ ID NO: 170027 - protein, 4 aa, Mycobacterium bovis
ASGI

SEQ ID NO: 170028 - protein, 7 aa, Mycobacterium bovis
ASGIGRA

SEQ ID NO: 170029 - protein, 6 aa, Mycobacterium bovis
ASGIGS

SEQ ID NO: 170030 - protein, 5 aa, Mycobacterium bovis
ASGIS

SEQ ID NO: 170031 - protein, 18 aa, Mycobacterium bovis
ASGKHGMGNNRDGAAGAD

SEQ ID NO: 170032 - protein, 6 aa, Mycobacterium bovis
ASGLTV

SEQ ID NO: 170033 - protein, 8 aa, Mycobacterium bovis
ASGNESIG

SEQ ID NO: 170034 - protein, 13 aa, Mycobacterium bovis
ASGNIDATRANPS

SEQ ID NO: 170035 - protein, 16 aa, Mycobacterium bovis
ASGNVEGDRHQPPPVT

SEQ ID NO: 170036 - protein, 9 aa, Mycobacterium bovis
ASGPEAAAR

SEQ ID NO: 170037 - protein, 6 aa, Mycobacterium bovis
ASGPSL

SEQ ID NO: 170038 - protein, 15 aa, Mycobacterium bovis
ASGPVPPVDPQRLNA

SEQ ID NO: 170039 - protein, 7 aa, Mycobacterium bovis
ASGPVYD

SEQ ID NO: 170040 - protein, 6 aa, Mycobacterium bovis
ASGQPF

SEQ ID NO: 170041 - protein, 11 aa, Mycobacterium bovis
ASGRGGQAADI

SEQ ID NO: 170042 - protein, 8 aa, Mycobacterium bovis
ASGRTRSV

SEQ ID NO: 170043 - protein, 4 aa, Mycobacterium bovis
ASGS

SEQ ID NO: 170044 - protein, 45 aa, Mycobacterium bovis
ASGSNTAEVADGQPDPRDGTAQTGEGRWSKSSHPATMRATGRAQG

SEQ ID NO: 170045 - protein, 5 aa, Mycobacterium bovis
ASGSV

SEQ ID NO: 170046 - protein, 8 aa, Mycobacterium bovis
ASGTAATG

SEQ ID NO: 170047 - protein, 9 aa, Mycobacterium bovis
ASGTGDARK

SEQ ID NO: 170048 - protein, 11 aa, Mycobacterium bovis
ASGTPGQHTPS

SEQ ID NO: 170049 - protein, 13 aa, Mycobacterium bovis
ASGYAGRQSQAEP

SEQ ID NO: 170050 - protein, 6 aa, Mycobacterium bovis
ASHEES

SEQ ID NO: 170051 - protein, 12 aa, Mycobacterium bovis
ASHGGVDDTREL

SEQ ID NO: 170052 - protein, 4 aa, Mycobacterium bovis
ASHH

SEQ ID NO: 170053 - protein, 10 aa, Mycobacterium bovis
ASHPRDGRLG

SEQ ID NO: 170054 - protein, 6 aa, Mycobacterium bovis
ASIRNN

SEQ ID NO: 170055 - protein, 7 aa, Mycobacterium bovis
ASISGAE

SEQ ID NO: 170056 - protein, 13 aa, Mycobacterium bovis
ASKATRPEVRGGL

SEQ ID NO: 170057 - protein, 7 aa, Mycobacterium bovis
ASKFGRE

SEQ ID NO: 170058 - protein, 5 aa, Mycobacterium bovis
ASKPI

SEQ ID NO: 170059 - protein, 8 aa, Mycobacterium bovis
ASKTAQEH

SEQ ID NO: 170060 - protein, 7 aa, Mycobacterium bovis
ASKTSIE

SEQ ID NO: 170061 - protein, 6 aa, Mycobacterium bovis
ASKYGL

SEQ ID NO: 170062 - protein, 7 aa, Mycobacterium bovis
ASLAGGA

SEQ ID NO: 170063 - protein, 8 aa, Mycobacterium bovis
ASLAGTGV

SEQ ID NO: 170064 - protein, 6 aa, Mycobacterium bovis
ASLDGE

SEQ ID NO: 170065 - protein, 5 aa, Mycobacterium bovis
ASLDR

SEQ ID NO: 170066 - protein, 9 aa, Mycobacterium bovis
ASLEQAQEN

SEQ ID NO: 170067 - protein, 52 aa, Mycobacterium bovis
ASLGGGGGGGVPSAPLGSAIGGAESVRPAGAGDIAGLGQGRAGGGAALGGGG

SEQ ID NO: 170068 - protein, 10 aa, Mycobacterium bovis
ASLKKGQTVR

SEQ ID NO: 170069 - protein, 14 aa, Mycobacterium bovis
ASLNDAETKASCSG

SEQ ID NO: 170070 - protein, 10 aa, Mycobacterium bovis
ASLPEERSRE

SEQ ID NO: 170071 - protein, 19 aa, Mycobacterium bovis
ASLRAARASSVLDGGPARL

SEQ ID NO: 170072 - protein, 7 aa, Mycobacterium bovis
ASLRDRE

SEQ ID NO: 170073 - protein, 15 aa, Mycobacterium bovis
ASLTAKVPDDVTSEV

SEQ ID NO: 170074 - protein, 7 aa, Mycobacterium bovis
ASMDGNK

SEQ ID NO: 170075 - protein, 9 aa, Mycobacterium bovis
ASNASGQAG

SEQ ID NO: 170076 - protein, 40 aa, Mycobacterium bovis
ASNGAWGKGAGKSFQGGVGEGARGNDGTSAAAKNTPGSIT

SEQ ID NO: 170077 - protein, 7 aa, Mycobacterium bovis
ASNPAGH

SEQ ID NO: 170078 - protein, 7 aa, Mycobacterium bovis
ASNPERA

SEQ ID NO: 170079 - protein, 6 aa, Mycobacterium bovis
ASNPRF

SEQ ID NO: 170080 - protein, 6 aa, Mycobacterium bovis
ASNRSA

SEQ ID NO: 170081 - protein, 7 aa, Mycobacterium bovis
ASNTSSI

SEQ ID NO: 170082 - protein, 8 aa, Mycobacterium bovis
ASPAGPKV

SEQ ID NO: 170083 - protein, 8 aa, Mycobacterium bovis
ASPAISNR

SEQ ID NO: 170084 - protein, 6 aa, Mycobacterium bovis
ASPALQ

SEQ ID NO: 170085 - protein, 18 aa, Mycobacterium bovis
ASPAQPGEAGRHASDPVT

SEQ ID NO: 170086 - protein, 6 aa, Mycobacterium bovis
ASPAYV

SEQ ID NO: 170087 - protein, 5 aa, Mycobacterium bovis
ASPDL

SEQ ID NO: 170088 - protein, 16 aa, Mycobacterium bovis
ASPDWKPGAVPGDDLS

SEQ ID NO: 170089 - protein, 7 aa, Mycobacterium bovis
ASPERRK

SEQ ID NO: 170090 - protein, 5 aa, Mycobacterium bovis
ASPFH

SEQ ID NO: 170091 - protein, 6 aa, Mycobacterium bovis
ASPGAG

SEQ ID NO: 170092 - protein, 6 aa, Mycobacterium bovis
ASPGFR

SEQ ID NO: 170093 - protein, 16 aa, Mycobacterium bovis
ASPGGTGGAGGHGGAG

SEQ ID NO: 170094 - protein, 5 aa, Mycobacterium bovis
ASPGI

SEQ ID NO: 170095 - protein, 6 aa, Mycobacterium bovis
ASPGSH

SEQ ID NO: 170096 - protein, 5 aa, Mycobacterium bovis
ASPGY

SEQ ID NO: 170097 - protein, 6 aa, Mycobacterium bovis
ASPIKA

SEQ ID NO: 170098 - protein, 10 aa, Mycobacterium bovis
ASPLPGPSGN

SEQ ID NO: 170099 - protein, 4 aa, Mycobacterium bovis
ASPM

SEQ ID NO: 170100 - protein, 8 aa, Mycobacterium bovis
ASPPKGID

SEQ ID NO: 170101 - protein, 9 aa, Mycobacterium bovis
ASPQDIQDA

SEQ ID NO: 170102 - protein, 16 aa, Mycobacterium bovis
ASPQNVDAYSGTGNAH

SEQ ID NO: 170103 - protein, 6 aa, Mycobacterium bovis
ASPRAS

SEQ ID NO: 170104 - protein, 6 aa, Mycobacterium bovis
ASPRIA

SEQ ID NO: 170105 - protein, 5 aa, Mycobacterium bovis
ASPRQ

SEQ ID NO: 170106 - protein, 12 aa, Mycobacterium bovis
ASPSSGGTRMQE

SEQ ID NO: 170107 - protein, 4 aa, Mycobacterium bovis
ASQA

SEQ ID NO: 170108 - protein, 10 aa, Mycobacterium bovis
ASQAWQGPAA

SEQ ID NO: 170109 - protein, 8 aa, Mycobacterium bovis
ASQDPRGT

SEQ ID NO: 170110 - protein, 5 aa, Mycobacterium bovis
ASQGI

SEQ ID NO: 170111 - protein, 15 aa, Mycobacterium bovis
ASQQSRPVGSRAQLD

SEQ ID NO: 170112 - protein, 5 aa, Mycobacterium bovis
ASQRA

SEQ ID NO: 170113 - protein, 8 aa, Mycobacterium bovis
ASQSQGLG

SEQ ID NO: 170114 - protein, 7 aa, Mycobacterium bovis
ASQYPNR

SEQ ID NO: 170115 - protein, 10 aa, Mycobacterium bovis
ASRADKSAAY

SEQ ID NO: 170116 - protein, 8 aa, Mycobacterium bovis
ASRAENPL

SEQ ID NO: 170117 - protein, 8 aa, Mycobacterium bovis
ASRAEQGL

SEQ ID NO: 170118 - protein, 7 aa, Mycobacterium bovis
ASRAGGE

SEQ ID NO: 170119 - protein, 4 aa, Mycobacterium bovis
ASRD

SEQ ID NO: 170120 - protein, 7 aa, Mycobacterium bovis
ASREDLP

SEQ ID NO: 170121 - protein, 6 aa, Mycobacterium bovis
ASRELP

SEQ ID NO: 170122 - protein, 6 aa, Mycobacterium bovis
ASRELR

SEQ ID NO: 170123 - protein, 7 aa, Mycobacterium bovis
ASRGEPH

SEQ ID NO: 170124 - protein, 8 aa, Mycobacterium bovis
ASRGEPSM

SEQ ID NO: 170125 - protein, 6 aa, Mycobacterium bovis
ASRGKW

SEQ ID NO: 170126 - protein, 13 aa, Mycobacterium bovis
ASRKVEATGQPVK

SEQ ID NO: 170127 - protein, 20 aa, Mycobacterium bovis
ASRLAGAYGEHAAAEIVAVL

SEQ ID NO: 170128 - protein, 5 aa, Mycobacterium bovis
ASRLD

SEQ ID NO: 170129 - protein, 7 aa, Mycobacterium bovis
ASRPWAT

SEQ ID NO: 170130 - protein, 16 aa, Mycobacterium bovis
ASRQKARAARRLGFEV

SEQ ID NO: 170131 - protein, 8 aa, Mycobacterium bovis
ASRQPPDR

SEQ ID NO: 170132 - protein, 15 aa, Mycobacterium bovis
ASRQPRETPATLPCK

SEQ ID NO: 170133 - protein, 4 aa, Mycobacterium bovis
ASRR

SEQ ID NO: 170134 - protein, 13 aa, Mycobacterium bovis
ASRRRAQRRLPDT

SEQ ID NO: 170135 - protein, 5 aa, Mycobacterium bovis
ASRRT

SEQ ID NO: 170136 - protein, 7 aa, Mycobacterium bovis
ASRSDVG

SEQ ID NO: 170137 - protein, 8 aa, Mycobacterium bovis
ASRSERGA

SEQ ID NO: 170138 - protein, 8 aa, Mycobacterium bovis
ASRTATTA

SEQ ID NO: 170139 - protein, 9 aa, Mycobacterium bovis
ASRTGGTTI

SEQ ID NO: 170140 - protein, 7 aa, Mycobacterium bovis
ASRVQPG

SEQ ID NO: 170141 - protein, 11 aa, Mycobacterium bovis
ASRYPDPERAI

SEQ ID NO: 170142 - protein, 7 aa, Mycobacterium bovis
ASRYPYS

SEQ ID NO: 170143 - protein, 4 aa, Mycobacterium bovis
ASSA

SEQ ID NO: 170144 - protein, 9 aa, Mycobacterium bovis
ASSAAAAQL

SEQ ID NO: 170145 - protein, 9 aa, Mycobacterium bovis
ASSADDVPR

SEQ ID NO: 170146 - protein, 7 aa, Mycobacterium bovis
ASSAGTG

SEQ ID NO: 170147 - protein, 23 aa, Mycobacterium bovis
ASSARPRLTPPVPSIPGRRSKPT

SEQ ID NO: 170148 - protein, 18 aa, Mycobacterium bovis
ASSASSYAATEVANAAAA

SEQ ID NO: 170149 - protein, 9 aa, Mycobacterium bovis
ASSATSAHA

SEQ ID NO: 170150 - protein, 8 aa, Mycobacterium bovis
ASSAVPTY

SEQ ID NO: 170151 - protein, 8 aa, Mycobacterium bovis
ASSCGQGG

SEQ ID NO: 170152 - protein, 12 aa, Mycobacterium bovis
ASSDDGLPPGSL

SEQ ID NO: 170153 - protein, 7 aa, Mycobacterium bovis
ASSDERA

SEQ ID NO: 170154 - protein, 10 aa, Mycobacterium bovis
ASSDKTQVSI

SEQ ID NO: 170155 - protein, 10 aa, Mycobacterium bovis
ASSEASGSTL

SEQ ID NO: 170156 - protein, 6 aa, Mycobacterium bovis
ASSETA

SEQ ID NO: 170157 - protein, 15 aa, Mycobacterium bovis
ASSGAFTTPQLETGP

SEQ ID NO: 170158 - protein, 8 aa, Mycobacterium bovis
ASSGGLAR

SEQ ID NO: 170159 - protein, 12 aa, Mycobacterium bovis
ASSGIGAAATKQ

SEQ ID NO: 170160 - protein, 8 aa, Mycobacterium bovis
ASSGIGRA

SEQ ID NO: 170161 - protein, 7 aa, Mycobacterium bovis
ASSGVSA

SEQ ID NO: 170162 - protein, 10 aa, Mycobacterium bovis
ASSHSGPASL

SEQ ID NO: 170163 - protein, 7 aa, Mycobacterium bovis
ASSLRKA

SEQ ID NO: 170164 - protein, 9 aa, Mycobacterium bovis
ASSNLAAQR

SEQ ID NO: 170165 - protein, 5 aa, Mycobacterium bovis
ASSPA

SEQ ID NO: 170166 - protein, 11 aa, Mycobacterium bovis
ASSQDALRQTA

SEQ ID NO: 170167 - protein, 9 aa, Mycobacterium bovis
ASSQIQSES

SEQ ID NO: 170168 - protein, 8 aa, Mycobacterium bovis
ASSRLDDE

SEQ ID NO: 170169 - protein, 8 aa, Mycobacterium bovis
ASSSGRAT

SEQ ID NO: 170170 - protein, 8 aa, Mycobacterium bovis
ASSSQGTI

SEQ ID NO: 170171 - protein, 14 aa, Mycobacterium bovis
ASSTKKSGATVLSG

SEQ ID NO: 170172 - protein, 4 aa, Mycobacterium bovis
ASSV

SEQ ID NO: 170173 - protein, 4 aa, Mycobacterium bovis
ASSY

SEQ ID NO: 170174 - protein, 7 aa, Mycobacterium bovis
ASSYMTG

SEQ ID NO: 170175 - protein, 8 aa, Mycobacterium bovis
ASTAAASL

SEQ ID NO: 170176 - protein, 6 aa, Mycobacterium bovis
ASTAAV

SEQ ID NO: 170177 - protein, 15 aa, Mycobacterium bovis
ASTAEAQDRAGTDVA

SEQ ID NO: 170178 - protein, 7 aa, Mycobacterium bovis
ASTAGQR

SEQ ID NO: 170179 - protein, 22 aa, Mycobacterium bovis
ASTASPGISRETIEASRRELRG

SEQ ID NO: 170180 - protein, 8 aa, Mycobacterium bovis
ASTATAVA

SEQ ID NO: 170181 - protein, 11 aa, Mycobacterium bovis
ASTDGSRGSKV

SEQ ID NO: 170182 - protein, 6 aa, Mycobacterium bovis
ASTDPI

SEQ ID NO: 170183 - protein, 4 aa, Mycobacterium bovis
ASTE

SEQ ID NO: 170184 - protein, 10 aa, Mycobacterium bovis
ASTEVRADST

SEQ ID NO: 170185 - protein, 7 aa, Mycobacterium bovis
ASTGAGA

SEQ ID NO: 170186 - protein, 8 aa, Mycobacterium bovis
ASTGAGAL

SEQ ID NO: 170187 - protein, 7 aa, Mycobacterium bovis
ASTGGNI

SEQ ID NO: 170188 - protein, 6 aa, Mycobacterium bovis
ASTGSD

SEQ ID NO: 170189 - protein, 4 aa, Mycobacterium bovis
ASTL

SEQ ID NO: 170190 - protein, 14 aa, Mycobacterium bovis
ASTLGRTDRNLGEV

SEQ ID NO: 170191 - protein, 5 aa, Mycobacterium bovis
ASTLQ

SEQ ID NO: 170192 - protein, 17 aa, Mycobacterium bovis
ASTNTSYPGPATDPSTG

SEQ ID NO: 170193 - protein, 8 aa, Mycobacterium bovis
ASTPGCTK

SEQ ID NO: 170194 - protein, 22 aa, Mycobacterium bovis
ASTPKPAKTAGEKVTDEGEGGN

SEQ ID NO: 170195 - protein, 10 aa, Mycobacterium bovis
ASTRPTRPSV

SEQ ID NO: 170196 - protein, 10 aa, Mycobacterium bovis
ASTRQAGSAV

SEQ ID NO: 170197 - protein, 27 aa, Mycobacterium bovis
ASTRQALRPRADGPVGAAAEQVGGQSQ

SEQ ID NO: 170198 - protein, 35 aa, Mycobacterium bovis
ASTRRSPNCSPWPPPLTSHPRSTPSWSPASPTRAS

SEQ ID NO: 170199 - protein, 4 aa, Mycobacterium bovis
ASVG

SEQ ID NO: 170200 - protein, 14 aa, Mycobacterium bovis
ASVGDDELAAKAEA

SEQ ID NO: 170201 - protein, 13 aa, Mycobacterium bovis
ASVKGHGQAPAAL

SEQ ID NO: 170202 - protein, 10 aa, Mycobacterium bovis
ASVPKTSTYA

SEQ ID NO: 170203 - protein, 5 aa, Mycobacterium bovis
ASVRN

SEQ ID NO: 170204 - protein, 14 aa, Mycobacterium bovis
ASVSDPDAAPPTFS

SEQ ID NO: 170205 - protein, 7 aa, Mycobacterium bovis
ASVSEAA

SEQ ID NO: 170206 - protein, 6 aa, Mycobacterium bovis
ASVSKR

SEQ ID NO: 170207 - protein, 8 aa, Mycobacterium bovis
ASWAGPDE

SEQ ID NO: 170208 - protein, 19 aa, Mycobacterium bovis
ASWSTAAPATAAGAALDGT

SEQ ID NO: 170209 - protein, 12 aa, Mycobacterium bovis
ASYAAAAGPTTA

SEQ ID NO: 170210 - protein, 13 aa, Mycobacterium bovis
ASYAPRSGGSAAL

SEQ ID NO: 170211 - protein, 11 aa, Mycobacterium bovis
ASYEARAYGAR

SEQ ID NO: 170212 - protein, 13 aa, Mycobacterium bovis
ASYGTAPAGRGPL

SEQ ID NO: 170213 - protein, 5 aa, Mycobacterium bovis
ASYIS

SEQ ID NO: 170214 - protein, 10 aa, Mycobacterium bovis
ASYNEDTKEI

SEQ ID NO: 170215 - protein, 8 aa, Mycobacterium bovis
ASYPDGTN

SEQ ID NO: 170216 - protein, 6 aa, Mycobacterium bovis
ASYSGV

SEQ ID NO: 170217 - protein, 9 aa, Mycobacterium bovis
ATAAAASGA

SEQ ID NO: 170218 - protein, 11 aa, Mycobacterium bovis
ATAAGTAQSTL

SEQ ID NO: 170219 - protein, 5 aa, Mycobacterium bovis
ATAAI

SEQ ID NO: 170220 - protein, 11 aa, Mycobacterium bovis
ATAANATDTDM

SEQ ID NO: 170221 - protein, 4 aa, Mycobacterium bovis
ATAD

SEQ ID NO: 170222 - protein, 17 aa, Mycobacterium bovis
ATADAYATTEAVNVVAT

SEQ ID NO: 170223 - protein, 5 aa, Mycobacterium bovis
ATADG

SEQ ID NO: 170224 - protein, 9 aa, Mycobacterium bovis
ATADGTAIE

SEQ ID NO: 170225 - protein, 6 aa, Mycobacterium bovis
ATADLS

SEQ ID NO: 170226 - protein, 10 aa, Mycobacterium bovis
ATADSSLSPV

SEQ ID NO: 170227 - protein, 7 aa, Mycobacterium bovis
ATADTAA

SEQ ID NO: 170228 - protein, 8 aa, Mycobacterium bovis
ATADTASR

SEQ ID NO: 170229 - protein, 6 aa, Mycobacterium bovis
ATADTS

SEQ ID NO: 170230 - protein, 9 aa, Mycobacterium bovis
ATAEDPGGR

SEQ ID NO: 170231 - protein, 7 aa, Mycobacterium bovis
ATAEERS

SEQ ID NO: 170232 - protein, 7 aa, Mycobacterium bovis
ATAGAPA

SEQ ID NO: 170233 - protein, 23 aa, Mycobacterium bovis
ATAGKLKGAASSEESTEVDPAVA

SEQ ID NO: 170234 - protein, 8 aa, Mycobacterium bovis
ATAGPRDV

SEQ ID NO: 170235 - protein, 6 aa, Mycobacterium bovis
ATAGRE

SEQ ID NO: 170236 - protein, 6 aa, Mycobacterium bovis
ATAIQR

SEQ ID NO: 170237 - protein, 6 aa, Mycobacterium bovis
ATAKEA

SEQ ID NO: 170238 - protein, 7 aa, Mycobacterium bovis
ATALGTD

SEQ ID NO: 170239 - protein, 7 aa, Mycobacterium bovis
ATALRED

SEQ ID NO: 170240 - protein, 8 aa, Mycobacterium bovis
ATANAGGL

SEQ ID NO: 170241 - protein, 11 aa, Mycobacterium bovis
ATAPAGTPGEY

SEQ ID NO: 170242 - protein, 27 aa, Mycobacterium bovis
ATAPAVSPATTSAVAAESGSTPATKAQ

SEQ ID NO: 170243 - protein, 8 aa, Mycobacterium bovis
ATAPGATL

SEQ ID NO: 170244 - protein, 6 aa, Mycobacterium bovis
ATAPGD

SEQ ID NO: 170245 - protein, 7 aa, Mycobacterium bovis
ATAPGIE

SEQ ID NO: 170246 - protein, 7 aa, Mycobacterium bovis
ATAQGPR

SEQ ID NO: 170247 - protein, 9 aa, Mycobacterium bovis
ATAQSAENA

SEQ ID NO: 170248 - protein, 8 aa, Mycobacterium bovis
ATARETVR

SEQ ID NO: 170249 - protein, 6 aa, Mycobacterium bovis
ATARPP

SEQ ID NO: 170250 - protein, 7 aa, Mycobacterium bovis
ATARQQL

SEQ ID NO: 170251 - protein, 13 aa, Mycobacterium bovis
ATARTERPDPPGP

SEQ ID NO: 170252 - protein, 30 aa, Mycobacterium bovis
ATASATPSATASTTALTDAPAGATEPTTDA

SEQ ID NO: 170253 - protein, 4 aa, Mycobacterium bovis
ATAT

SEQ ID NO: 170254 - protein, 20 aa, Mycobacterium bovis
ATATAPARTEAPTPTRPAAA

SEQ ID NO: 170255 - protein, 7 aa, Mycobacterium bovis
ATATAPL

SEQ ID NO: 170256 - protein, 27 aa, Mycobacterium bovis
ATATATAKGLTESCGQRRPAKPAGCPQ

SEQ ID NO: 170257 - protein, 8 aa, Mycobacterium bovis
ATATPQVD

SEQ ID NO: 170258 - protein, 9 aa, Mycobacterium bovis
ATATSASSA

SEQ ID NO: 170259 - protein, 5 aa, Mycobacterium bovis
ATAVA

SEQ ID NO: 170260 - protein, 12 aa, Mycobacterium bovis
ATCSGADKPRYG

SEQ ID NO: 170261 - protein, 11 aa, Mycobacterium bovis
ATCTGRPATTF

SEQ ID NO: 170262 - protein, 7 aa, Mycobacterium bovis
ATDAGTA

SEQ ID NO: 170263 - protein, 8 aa, Mycobacterium bovis
ATDARPDV

SEQ ID NO: 170264 - protein, 9 aa, Mycobacterium bovis
ATDDLDDPA

SEQ ID NO: 170265 - protein, 6 aa, Mycobacterium bovis
ATDDRC

SEQ ID NO: 170266 - protein, 4 aa, Mycobacterium bovis
ATDE

SEQ ID NO: 170267 - protein, 5 aa, Mycobacterium bovis
ATDEL

SEQ ID NO: 170268 - protein, 6 aa, Mycobacterium bovis
ATDEQL

SEQ ID NO: 170269 - protein, 14 aa, Mycobacterium bovis
ATDERVAAAVGRLT

SEQ ID NO: 170270 - protein, 8 aa, Mycobacterium bovis
ATDGARKC

SEQ ID NO: 170271 - protein, 6 aa, Mycobacterium bovis
ATDGGV

SEQ ID NO: 170272 - protein, 7 aa, Mycobacterium bovis
ATDGGVD

SEQ ID NO: 170273 - protein, 7 aa, Mycobacterium bovis
ATDGRTA

SEQ ID NO: 170274 - protein, 20 aa, Mycobacterium bovis
ATDGRTPCEPGSAANKAGTL

SEQ ID NO: 170275 - protein, 10 aa, Mycobacterium bovis
ATDKPPVRGA

SEQ ID NO: 170276 - protein, 12 aa, Mycobacterium bovis
ATDNAVRGNETE

SEQ ID NO: 170277 - protein, 17 aa, Mycobacterium bovis
ATDPACSANGRDSQAGP

SEQ ID NO: 170278 - protein, 8 aa, Mycobacterium bovis
ATDPGTPV

SEQ ID NO: 170279 - protein, 10 aa, Mycobacterium bovis
ATDPPPGKDR

SEQ ID NO: 170280 - protein, 8 aa, Mycobacterium bovis
ATDPRHPF

SEQ ID NO: 170281 - protein, 8 aa, Mycobacterium bovis
ATDQPESL

SEQ ID NO: 170282 - protein, 8 aa, Mycobacterium bovis
ATDRDRRP

SEQ ID NO: 170283 - protein, 7 aa, Mycobacterium bovis
ATDSAVG

SEQ ID NO: 170284 - protein, 5 aa, Mycobacterium bovis
ATDTG

SEQ ID NO: 170285 - protein, 15 aa, Mycobacterium bovis
ATDVDNDGVVSPGGV

SEQ ID NO: 170286 - protein, 4 aa, Mycobacterium bovis
ATEA

SEQ ID NO: 170287 - protein, 6 aa, Mycobacterium bovis
ATEAEQ

SEQ ID NO: 170288 - protein, 8 aa, Mycobacterium bovis
ATEAGITP

SEQ ID NO: 170289 - protein, 15 aa, Mycobacterium bovis
ATEAIGAGRYERSDG

SEQ ID NO: 170290 - protein, 7 aa, Mycobacterium bovis
ATEAPEV

SEQ ID NO: 170291 - protein, 5 aa, Mycobacterium bovis
ATEAR

SEQ ID NO: 170292 - protein, 6 aa, Mycobacterium bovis
ATEASY

SEQ ID NO: 170293 - protein, 10 aa, Mycobacterium bovis
ATEAYPSRTD

SEQ ID NO: 170294 - protein, 5 aa, Mycobacterium bovis
ATEDR

SEQ ID NO: 170295 - protein, 23 aa, Mycobacterium bovis
ATEELEGYRSRATAETELPPARP

SEQ ID NO: 170296 - protein, 4 aa, Mycobacterium bovis
ATEF

SEQ ID NO: 170297 - protein, 4 aa, Mycobacterium bovis
ATEH

SEQ ID NO: 170298 - protein, 4 aa, Mycobacterium bovis
ATEN

SEQ ID NO: 170299 - protein, 5 aa, Mycobacterium bovis
ATEPG

SEQ ID NO: 170300 - protein, 19 aa, Mycobacterium bovis
ATEPLTKTTITRRDPGPHD

SEQ ID NO: 170301 - protein, 17 aa, Mycobacterium bovis
ATEPNPATSTPEGLRPD

SEQ ID NO: 170302 - protein, 7 aa, Mycobacterium bovis
ATEPTGM

SEQ ID NO: 170303 - protein, 9 aa, Mycobacterium bovis
ATEQRTNKA

SEQ ID NO: 170304 - protein, 10 aa, Mycobacterium bovis
ATESNPTAAS

SEQ ID NO: 170305 - protein, 18 aa, Mycobacterium bovis
ATESPTSPGWTGARGTPT

SEQ ID NO: 170306 - protein, 5 aa, Mycobacterium bovis
ATETL

SEQ ID NO: 170307 - protein, 5 aa, Mycobacterium bovis
ATFAG

SEQ ID NO: 170308 - protein, 11 aa, Mycobacterium bovis
ATFGGGARSAA

SEQ ID NO: 170309 - protein, 11 aa, Mycobacterium bovis
ATGAQTAKPSL

SEQ ID NO: 170310 - protein, 11 aa, Mycobacterium bovis
ATGARTANAGP

SEQ ID NO: 170311 - protein, 7 aa, Mycobacterium bovis
ATGASAV

SEQ ID NO: 170312 - protein, 6 aa, Mycobacterium bovis
ATGAVG

SEQ ID NO: 170313 - protein, 4 aa, Mycobacterium bovis
ATGD

SEQ ID NO: 170314 - protein, 6 aa, Mycobacterium bovis
ATGDDK

SEQ ID NO: 170315 - protein, 5 aa, Mycobacterium bovis
ATGDE

SEQ ID NO: 170316 - protein, 9 aa, Mycobacterium bovis
ATGDGATAV

SEQ ID NO: 170317 - protein, 10 aa, Mycobacterium bovis
ATGDKATMPS

SEQ ID NO: 170318 - protein, 12 aa, Mycobacterium bovis
ATGEDVVTSAQS

SEQ ID NO: 170319 - protein, 6 aa, Mycobacterium bovis
ATGEGV

SEQ ID NO: 170320 - protein, 10 aa, Mycobacterium bovis
ATGEHTKNNA

SEQ ID NO: 170321 - protein, 17 aa, Mycobacterium bovis
ATGETPYPPAVGQDDRG

SEQ ID NO: 170322 - protein, 19 aa, Mycobacterium bovis
ATGGGAYAAAEAASVSPLQ

SEQ ID NO: 170323 - protein, 6 aa, Mycobacterium bovis
ATGGHL

SEQ ID NO: 170324 - protein, 7 aa, Mycobacterium bovis
ATGGLTP

SEQ ID NO: 170325 - protein, 9 aa, Mycobacterium bovis
ATGHADGPT

SEQ ID NO: 170326 - protein, 7 aa, Mycobacterium bovis
ATGIDEP

SEQ ID NO: 170327 - protein, 6 aa, Mycobacterium bovis
ATGKGA

SEQ ID NO: 170328 - protein, 16 aa, Mycobacterium bovis
ATGMDPRVAGKPAPAL

SEQ ID NO: 170329 - protein, 11 aa, Mycobacterium bovis
ATGNDADADRH

SEQ ID NO: 170330 - protein, 4 aa, Mycobacterium bovis
ATGP

SEQ ID NO: 170331 - protein, 7 aa, Mycobacterium bovis
ATGPALG

SEQ ID NO: 170332 - protein, 6 aa, Mycobacterium bovis
ATGPED

SEQ ID NO: 170333 - protein, 8 aa, Mycobacterium bovis
ATGPETGR

SEQ ID NO: 170334 - protein, 6 aa, Mycobacterium bovis
ATGPQH

SEQ ID NO: 170335 - protein, 11 aa, Mycobacterium bovis
ATGPTQPEAGE

SEQ ID NO: 170336 - protein, 13 aa, Mycobacterium bovis
ATGRESDARNELA

SEQ ID NO: 170337 - protein, 12 aa, Mycobacterium bovis
ATGRLSSTEPNL

SEQ ID NO: 170338 - protein, 20 aa, Mycobacterium bovis
ATGRLTGADSGAGRLPEAEE

SEQ ID NO: 170339 - protein, 5 aa, Mycobacterium bovis
ATGRR

SEQ ID NO: 170340 - protein, 7 aa, Mycobacterium bovis
ATGRSSD

SEQ ID NO: 170341 - protein, 7 aa, Mycobacterium bovis
ATGSLGR

SEQ ID NO: 170342 - protein, 14 aa, Mycobacterium bovis
ATGSSTRLVPGTSL

SEQ ID NO: 170343 - protein, 7 aa, Mycobacterium bovis
ATGSSVD

SEQ ID NO: 170344 - protein, 10 aa, Mycobacterium bovis
ATGTGKSATT

SEQ ID NO: 170345 - protein, 5 aa, Mycobacterium bovis
ATGTP

SEQ ID NO: 170346 - protein, 7 aa, Mycobacterium bovis
ATGTPRR

SEQ ID NO: 170347 - protein, 10 aa, Mycobacterium bovis
ATGTVQGPQA

SEQ ID NO: 170348 - protein, 7 aa, Mycobacterium bovis
ATGVPRG

SEQ ID NO: 170349 - protein, 13 aa, Mycobacterium bovis
ATGYTAQRPLTGD

SEQ ID NO: 170350 - protein, 5 aa, Mycobacterium bovis
ATHAK

SEQ ID NO: 170351 - protein, 5 aa, Mycobacterium bovis
ATHAP

SEQ ID NO: 170352 - protein, 12 aa, Mycobacterium bovis
ATHLPGSQLDTT

SEQ ID NO: 170353 - protein, 6 aa, Mycobacterium bovis
ATHPDV

SEQ ID NO: 170354 - protein, 6 aa, Mycobacterium bovis
ATHSPR

SEQ ID NO: 170355 - protein, 21 aa, Mycobacterium bovis
ATHSRSDRESVRGRLSGRTQE

SEQ ID NO: 170356 - protein, 10 aa, Mycobacterium bovis
ATIDNGSFGT

SEQ ID NO: 170357 - protein, 5 aa, Mycobacterium bovis
ATIGG

SEQ ID NO: 170358 - protein, 8 aa, Mycobacterium bovis
ATISSTKI

SEQ ID NO: 170359 - protein, 11 aa, Mycobacterium bovis
ATKAALGDHDE

SEQ ID NO: 170360 - protein, 5 aa, Mycobacterium bovis
ATKAD

SEQ ID NO: 170361 - protein, 8 aa, Mycobacterium bovis
ATKDPRGL

SEQ ID NO: 170362 - protein, 11 aa, Mycobacterium bovis
ATKESTTSPSV

SEQ ID NO: 170363 - protein, 9 aa, Mycobacterium bovis
ATKGDGATI

SEQ ID NO: 170364 - protein, 5 aa, Mycobacterium bovis
ATKGI

SEQ ID NO: 170365 - protein, 7 aa, Mycobacterium bovis
ATKPERL

SEQ ID NO: 170366 - protein, 7 aa, Mycobacterium bovis
ATKQPQR

SEQ ID NO: 170367 - protein, 5 aa, Mycobacterium bovis
ATKRT

SEQ ID NO: 170368 - protein, 13 aa, Mycobacterium bovis
ATKYERKAQLGGG

SEQ ID NO: 170369 - protein, 5 aa, Mycobacterium bovis
ATLDT

SEQ ID NO: 170370 - protein, 6 aa, Mycobacterium bovis
ATLEQP

SEQ ID NO: 170371 - protein, 6 aa, Mycobacterium bovis
ATLPGG

SEQ ID NO: 170372 - protein, 5 aa, Mycobacterium bovis
ATLPK

SEQ ID NO: 170373 - protein, 10 aa, Mycobacterium bovis
ATNAEGANMD

SEQ ID NO: 170374 - protein, 7 aa, Mycobacterium bovis
ATNAIDP

SEQ ID NO: 170375 - protein, 6 aa, Mycobacterium bovis
ATNAST

SEQ ID NO: 170376 - protein, 17 aa, Mycobacterium bovis
ATNGAQALDRARETRPD

SEQ ID NO: 170377 - protein, 7 aa, Mycobacterium bovis
ATNPRAQ

SEQ ID NO: 170378 - protein, 6 aa, Mycobacterium bovis
ATNPTV

SEQ ID NO: 170379 - protein, 19 aa, Mycobacterium bovis
ATPAAAQEISDTEPELSDE

SEQ ID NO: 170380 - protein, 21 aa, Mycobacterium bovis
ATPADLRTAPDTAGRPAEGTE

SEQ ID NO: 170381 - protein, 6 aa, Mycobacterium bovis
ATPAES

SEQ ID NO: 170382 - protein, 14 aa, Mycobacterium bovis
ATPAGRAALTEDRR

SEQ ID NO: 170383 - protein, 7 aa, Mycobacterium bovis
ATPAGWS

SEQ ID NO: 170384 - protein, 8 aa, Mycobacterium bovis
ATPAPDGT

SEQ ID NO: 170385 - protein, 6 aa, Mycobacterium bovis
ATPAQA

SEQ ID NO: 170386 - protein, 5 aa, Mycobacterium bovis
ATPAR

SEQ ID NO: 170387 - protein, 7 aa, Mycobacterium bovis
ATPATEL

SEQ ID NO: 170388 - protein, 6 aa, Mycobacterium bovis
ATPATL

SEQ ID NO: 170389 - protein, 6 aa, Mycobacterium bovis
ATPAVT

SEQ ID NO: 170390 - protein, 15 aa, Mycobacterium bovis
ATPDQGFTRSQEACR

SEQ ID NO: 170391 - protein, 7 aa, Mycobacterium bovis
ATPDTTN

SEQ ID NO: 170392 - protein, 6 aa, Mycobacterium bovis
ATPEQI

SEQ ID NO: 170393 - protein, 10 aa, Mycobacterium bovis
ATPGCREGET

SEQ ID NO: 170394 - protein, 6 aa, Mycobacterium bovis
ATPGPH

SEQ ID NO: 170395 - protein, 9 aa, Mycobacterium bovis
ATPGRDEVG

SEQ ID NO: 170396 - protein, 7 aa, Mycobacterium bovis
ATPGSWR

SEQ ID NO: 170397 - protein, 4 aa, Mycobacterium bovis
ATPL

SEQ ID NO: 170398 - protein, 7 aa, Mycobacterium bovis
ATPLGGD

SEQ ID NO: 170399 - protein, 4 aa, Mycobacterium bovis
ATPM

SEQ ID NO: 170400 - protein, 7 aa, Mycobacterium bovis
ATPPAGI

SEQ ID NO: 170401 - protein, 6 aa, Mycobacterium bovis
ATPPFT

SEQ ID NO: 170402 - protein, 7 aa, Mycobacterium bovis
ATPPGAG

SEQ ID NO: 170403 - protein, 15 aa, Mycobacterium bovis
ATPQADGGAFYGPRG

SEQ ID NO: 170404 - protein, 6 aa, Mycobacterium bovis
ATPQEA

SEQ ID NO: 170405 - protein, 4 aa, Mycobacterium bovis
ATPR

SEQ ID NO: 170406 - protein, 11 aa, Mycobacterium bovis
ATPRASQLDDA

SEQ ID NO: 170407 - protein, 5 aa, Mycobacterium bovis
ATPRQ

SEQ ID NO: 170408 - protein, 8 aa, Mycobacterium bovis
ATPSDTIY

SEQ ID NO: 170409 - protein, 7 aa, Mycobacterium bovis
ATPSEPI

SEQ ID NO: 170410 - protein, 8 aa, Mycobacterium bovis
ATPSNEYR

SEQ ID NO: 170411 - protein, 9 aa, Mycobacterium bovis
ATPSQPAQV

SEQ ID NO: 170412 - protein, 9 aa, Mycobacterium bovis
ATPSRSAQV

SEQ ID NO: 170413 - protein, 7 aa, Mycobacterium bovis
ATPSRVA

SEQ ID NO: 170414 - protein, 18 aa, Mycobacterium bovis
ATPTFSSSAGADPTALNG

SEQ ID NO: 170415 - protein, 9 aa, Mycobacterium bovis
ATPTGSRGT

SEQ ID NO: 170416 - protein, 5 aa, Mycobacterium bovis
ATPTI

SEQ ID NO: 170417 - protein, 5 aa, Mycobacterium bovis
ATPVA

SEQ ID NO: 170418 - protein, 10 aa, Mycobacterium bovis
ATPVSGKTGI

SEQ ID NO: 170419 - protein, 9 aa, Mycobacterium bovis
ATPVTAGHP

SEQ ID NO: 170420 - protein, 7 aa, Mycobacterium bovis
ATPVTPT

SEQ ID NO: 170421 - protein, 13 aa, Mycobacterium bovis
ATQAEGAASQAQT

SEQ ID NO: 170422 - protein, 11 aa, Mycobacterium bovis
ATQAEQAATQA

SEQ ID NO: 170423 - protein, 9 aa, Mycobacterium bovis
ATQDQPDGL

SEQ ID NO: 170424 - protein, 6 aa, Mycobacterium bovis
ATQEST

SEQ ID NO: 170425 - protein, 5 aa, Mycobacterium bovis
ATQHR

SEQ ID NO: 170426 - protein, 7 aa, Mycobacterium bovis
ATQLPTA

SEQ ID NO: 170427 - protein, 8 aa, Mycobacterium bovis
ATQNDAAR

SEQ ID NO: 170428 - protein, 9 aa, Mycobacterium bovis
ATQPNYPAE

SEQ ID NO: 170429 - protein, 14 aa, Mycobacterium bovis
ATQVTSRSLEQNPL

SEQ ID NO: 170430 - protein, 7 aa, Mycobacterium bovis
ATRAEEG

SEQ ID NO: 170431 - protein, 7 aa, Mycobacterium bovis
ATRARQT

SEQ ID NO: 170432 - protein, 7 aa, Mycobacterium bovis
ATREGNQ

SEQ ID NO: 170433 - protein, 5 aa, Mycobacterium bovis
ATREN

SEQ ID NO: 170434 - protein, 13 aa, Mycobacterium bovis
ATRENAAKALRSG

SEQ ID NO: 170435 - protein, 4 aa, Mycobacterium bovis
ATRG

SEQ ID NO: 170436 - protein, 17 aa, Mycobacterium bovis
ATRGDPSNVDIPGATAA

SEQ ID NO: 170437 - protein, 10 aa, Mycobacterium bovis
ATRGFGDTEF

SEQ ID NO: 170438 - protein, 9 aa, Mycobacterium bovis
ATRGQADAA

SEQ ID NO: 170439 - protein, 20 aa, Mycobacterium bovis
ATRGSERLATSDVGERIAAA

SEQ ID NO: 170440 - protein, 5 aa, Mycobacterium bovis
ATRHH

SEQ ID NO: 170441 - protein, 11 aa, Mycobacterium bovis
ATRKSAPDLRL

SEQ ID NO: 170442 - protein, 5 aa, Mycobacterium bovis
ATRNP

SEQ ID NO: 170443 - protein, 6 aa, Mycobacterium bovis
ATRPPA

SEQ ID NO: 170444 - protein, 16 aa, Mycobacterium bovis
ATRPTNDAGQDGGNNS

SEQ ID NO: 170445 - protein, 28 aa, Mycobacterium bovis
ATRRNTELEGTRSTAATRADQNDYARGK

SEQ ID NO: 170446 - protein, 8 aa, Mycobacterium bovis
ATRSSPAL

SEQ ID NO: 170447 - protein, 12 aa, Mycobacterium bovis
ATRTQATATGVA

SEQ ID NO: 170448 - protein, 7 aa, Mycobacterium bovis
ATSAAPL

SEQ ID NO: 170449 - protein, 7 aa, Mycobacterium bovis
ATSAEVS

SEQ ID NO: 170450 - protein, 17 aa, Mycobacterium bovis
ATSAKGSSTEDPGPDLA

SEQ ID NO: 170451 - protein, 9 aa, Mycobacterium bovis
ATSAPKEPL

SEQ ID NO: 170452 - protein, 5 aa, Mycobacterium bovis
ATSAS

SEQ ID NO: 170453 - protein, 11 aa, Mycobacterium bovis
ATSAVAASRAA

SEQ ID NO: 170454 - protein, 7 aa, Mycobacterium bovis
ATSAVRP

SEQ ID NO: 170455 - protein, 4 aa, Mycobacterium bovis
ATSG

SEQ ID NO: 170456 - protein, 16 aa, Mycobacterium bovis
ATSGFGNSTTSPSSGF

SEQ ID NO: 170457 - protein, 8 aa, Mycobacterium bovis
ATSGLSGF

SEQ ID NO: 170458 - protein, 6 aa, Mycobacterium bovis
ATSGQP

SEQ ID NO: 170459 - protein, 5 aa, Mycobacterium bovis
ATSHG

SEQ ID NO: 170460 - protein, 11 aa, Mycobacterium bovis
ATSKALDKQGI

SEQ ID NO: 170461 - protein, 13 aa, Mycobacterium bovis
ATSNTLPEQLGEG

SEQ ID NO: 170462 - protein, 4 aa, Mycobacterium bovis
ATSP

SEQ ID NO: 170463 - protein, 18 aa, Mycobacterium bovis
ATSPGELPNGPQPPADPV

SEQ ID NO: 170464 - protein, 21 aa, Mycobacterium bovis
ATSPGGGVSASGAGGAASVGN

SEQ ID NO: 170465 - protein, 7 aa, Mycobacterium bovis
ATSPLPG

SEQ ID NO: 170466 - protein, 8 aa, Mycobacterium bovis
ATSPMGAP

SEQ ID NO: 170467 - protein, 13 aa, Mycobacterium bovis
ATSQISYTASKGG

SEQ ID NO: 170468 - protein, 6 aa, Mycobacterium bovis
ATSRDF

SEQ ID NO: 170469 - protein, 17 aa, Mycobacterium bovis
ATSRDTVRSRSFTGKPA

SEQ ID NO: 170470 - protein, 10 aa, Mycobacterium bovis
ATSREGKAQV

SEQ ID NO: 170471 - protein, 8 aa, Mycobacterium bovis
ATSRPSAL

SEQ ID NO: 170472 - protein, 7 aa, Mycobacterium bovis
ATSSADQ

SEQ ID NO: 170473 - protein, 17 aa, Mycobacterium bovis
ATSSDTVRSRSLTGKPA

SEQ ID NO: 170474 - protein, 6 aa, Mycobacterium bovis
ATSSQA

SEQ ID NO: 170475 - protein, 6 aa, Mycobacterium bovis
ATSSRL

SEQ ID NO: 170476 - protein, 14 aa, Mycobacterium bovis
ATSTGELAQAAESA

SEQ ID NO: 170477 - protein, 9 aa, Mycobacterium bovis
ATSTPRAED

SEQ ID NO: 170478 - protein, 15 aa, Mycobacterium bovis
ATSTTASSCRARFIR

SEQ ID NO: 170479 - protein, 4 aa, Mycobacterium bovis
ATSV

SEQ ID NO: 170480 - protein, 5 aa, Mycobacterium bovis
ATSVA

SEQ ID NO: 170481 - protein, 6 aa, Mycobacterium bovis
ATSVAE

SEQ ID NO: 170482 - protein, 7 aa, Mycobacterium bovis
ATTAEAY

SEQ ID NO: 170483 - protein, 5 aa, Mycobacterium bovis
ATTAG

SEQ ID NO: 170484 - protein, 6 aa, Mycobacterium bovis
ATTARE

SEQ ID NO: 170485 - protein, 8 aa, Mycobacterium bovis
ATTASAAV

SEQ ID NO: 170486 - protein, 13 aa, Mycobacterium bovis
ATTATATSASAGW

SEQ ID NO: 170487 - protein, 13 aa, Mycobacterium bovis
ATTDASGYVDPGY

SEQ ID NO: 170488 - protein, 6 aa, Mycobacterium bovis
ATTDFT

SEQ ID NO: 170489 - protein, 14 aa, Mycobacterium bovis
ATTDGTRFTNNRTG

SEQ ID NO: 170490 - protein, 4 aa, Mycobacterium bovis
ATTF

SEQ ID NO: 170491 - protein, 13 aa, Mycobacterium bovis
ATTFGPACPQPAI

SEQ ID NO: 170492 - protein, 8 aa, Mycobacterium bovis
ATTGEPTV

SEQ ID NO: 170493 - protein, 8 aa, Mycobacterium bovis
ATTGRSYG

SEQ ID NO: 170494 - protein, 6 aa, Mycobacterium bovis
ATTGSL

SEQ ID NO: 170495 - protein, 7 aa, Mycobacterium bovis
ATTKPDT

SEQ ID NO: 170496 - protein, 9 aa, Mycobacterium bovis
ATTKRAVEG

SEQ ID NO: 170497 - protein, 6 aa, Mycobacterium bovis
ATTLDG

SEQ ID NO: 170498 - protein, 12 aa, Mycobacterium bovis
ATTLDGTELPAD

SEQ ID NO: 170499 - protein, 5 aa, Mycobacterium bovis
ATTLR

SEQ ID NO: 170500 - protein, 30 aa, Mycobacterium bovis
ATTNPGNAAHQGNPADPGNSARRADGGRDE

SEQ ID NO: 170501 - protein, 7 aa, Mycobacterium bovis
ATTPGKV

SEQ ID NO: 170502 - protein, 11 aa, Mycobacterium bovis
ATTRAAAGPGP

SEQ ID NO: 170503 - protein, 12 aa, Mycobacterium bovis
ATTRAPRPGEVD

SEQ ID NO: 170504 - protein, 5 aa, Mycobacterium bovis
ATTRY

SEQ ID NO: 170505 - protein, 11 aa, Mycobacterium bovis
ATTSAEAKYAA

SEQ ID NO: 170506 - protein, 12 aa, Mycobacterium bovis
ATTSHRSTATVG

SEQ ID NO: 170507 - protein, 6 aa, Mycobacterium bovis
ATTSTG

SEQ ID NO: 170508 - protein, 7 aa, Mycobacterium bovis
ATTTRMR

SEQ ID NO: 170509 - protein, 26 aa, Mycobacterium bovis
ATTVASNAAAAAPTTGVVPPAADEVS

SEQ ID NO: 170510 - protein, 4 aa, Mycobacterium bovis
ATTY

SEQ ID NO: 170511 - protein, 7 aa, Mycobacterium bovis
ATVEGRP

SEQ ID NO: 170512 - protein, 6 aa, Mycobacterium bovis
ATVGRR

SEQ ID NO: 170513 - protein, 8 aa, Mycobacterium bovis
ATVHTGDT

SEQ ID NO: 170514 - protein, 8 aa, Mycobacterium bovis
ATVKGGTY

SEQ ID NO: 170515 - protein, 5 aa, Mycobacterium bovis
ATVPP

SEQ ID NO: 170516 - protein, 4 aa, Mycobacterium bovis
ATVS

SEQ ID NO: 170517 - protein, 6 aa, Mycobacterium bovis
ATVSAG

SEQ ID NO: 170518 - protein, 13 aa, Mycobacterium bovis
ATVTDSDGNTIDT

SEQ ID NO: 170519 - protein, 8 aa, Mycobacterium bovis
ATVTTDAK

SEQ ID NO: 170520 - protein, 7 aa, Mycobacterium bovis
ATYAETG

SEQ ID NO: 170521 - protein, 11 aa, Mycobacterium bovis
ATYAPAPQRFE

SEQ ID NO: 170522 - protein, 5 aa, Mycobacterium bovis
ATYDQ

SEQ ID NO: 170523 - protein, 13 aa, Mycobacterium bovis
AVADRKQLSDKIS

SEQ ID NO: 170524 - protein, 10 aa, Mycobacterium bovis
AVAGDVAGAA

SEQ ID NO: 170525 - protein, 6 aa, Mycobacterium bovis
AVAPAA

SEQ ID NO: 170526 - protein, 26 aa, Mycobacterium bovis
AVAPGQTADDDEEIAEPTEKDKASGD

SEQ ID NO: 170527 - protein, 6 aa, Mycobacterium bovis
AVAPQD

SEQ ID NO: 170528 - protein, 6 aa, Mycobacterium bovis
AVAPSG

SEQ ID NO: 170529 - protein, 6 aa, Mycobacterium bovis
AVAPTA

SEQ ID NO: 170530 - protein, 21 aa, Mycobacterium bovis
AVASHDPSHTRPSRREAPDRN

SEQ ID NO: 170531 - protein, 6 aa, Mycobacterium bovis
AVATDP

SEQ ID NO: 170532 - protein, 7 aa, Mycobacterium bovis
AVDATNG

SEQ ID NO: 170533 - protein, 16 aa, Mycobacterium bovis
AVDDVPGLARRSEQGQ

SEQ ID NO: 170534 - protein, 11 aa, Mycobacterium bovis
AVDEDAEAPGA

SEQ ID NO: 170535 - protein, 5 aa, Mycobacterium bovis
AVDEE

SEQ ID NO: 170536 - protein, 4 aa, Mycobacterium bovis
AVDP

SEQ ID NO: 170537 - protein, 8 aa, Mycobacterium bovis
AVDPGGEV

SEQ ID NO: 170538 - protein, 9 aa, Mycobacterium bovis
AVDPQYGEP

SEQ ID NO: 170539 - protein, 6 aa, Mycobacterium bovis
AVDQAG

SEQ ID NO: 170540 - protein, 4 aa, Mycobacterium bovis
AVDR

SEQ ID NO: 170541 - protein, 9 aa, Mycobacterium bovis
AVDRGGAQL

SEQ ID NO: 170542 - protein, 9 aa, Mycobacterium bovis
AVDSATGHV

SEQ ID NO: 170543 - protein, 6 aa, Mycobacterium bovis
AVEAQK

SEQ ID NO: 170544 - protein, 17 aa, Mycobacterium bovis
AVEDQRDGELEARAQKL

SEQ ID NO: 170545 - protein, 9 aa, Mycobacterium bovis
AVEESGRGR

SEQ ID NO: 170546 - protein, 5 aa, Mycobacterium bovis
AVEGR

SEQ ID NO: 170547 - protein, 9 aa, Mycobacterium bovis
AVEKASDIV

SEQ ID NO: 170548 - protein, 12 aa, Mycobacterium bovis
AVEPGQPLDQQE

SEQ ID NO: 170549 - protein, 9 aa, Mycobacterium bovis
AVETAATNP

SEQ ID NO: 170550 - protein, 10 aa, Mycobacterium bovis
AVETDRPDPL

SEQ ID NO: 170551 - protein, 7 aa, Mycobacterium bovis
AVGDSES

SEQ ID NO: 170552 - protein, 15 aa, Mycobacterium bovis
AVGESGIGYAAGDAV

SEQ ID NO: 170553 - protein, 7 aa, Mycobacterium bovis
AVGESGR

SEQ ID NO: 170554 - protein, 6 aa, Mycobacterium bovis
AVGGAA

SEQ ID NO: 170555 - protein, 7 aa, Mycobacterium bovis
AVGGRGQ

SEQ ID NO: 170556 - protein, 10 aa, Mycobacterium bovis
AVGGSTSCPG

SEQ ID NO: 170557 - protein, 10 aa, Mycobacterium bovis
AVGGTGAYGM

SEQ ID NO: 170558 - protein, 17 aa, Mycobacterium bovis
AVGGTGPVSAGLGNAAT

SEQ ID NO: 170559 - protein, 8 aa, Mycobacterium bovis
AVGKRGGA

SEQ ID NO: 170560 - protein, 9 aa, Mycobacterium bovis
AVGKSTTAR

SEQ ID NO: 170561 - protein, 12 aa, Mycobacterium bovis
AVGNAGHSATGL

SEQ ID NO: 170562 - protein, 9 aa, Mycobacterium bovis
AVGQAGALD

SEQ ID NO: 170563 - protein, 13 aa, Mycobacterium bovis
AVGQAGASASARQ

SEQ ID NO: 170564 - protein, 9 aa, Mycobacterium bovis
AVGSPAPAF

SEQ ID NO: 170565 - protein, 13 aa, Mycobacterium bovis
AVKSPADLDELAN

SEQ ID NO: 170566 - protein, 7 aa, Mycobacterium bovis
AVKSSLR

SEQ ID NO: 170567 - protein, 12 aa, Mycobacterium bovis
AVKTTPKDAVEN

SEQ ID NO: 170568 - protein, 7 aa, Mycobacterium bovis
AVNDNDL

SEQ ID NO: 170569 - protein, 8 aa, Mycobacterium bovis
AVNGDRSA

SEQ ID NO: 170570 - protein, 5 aa, Mycobacterium bovis
AVNPA

SEQ ID NO: 170571 - protein, 18 aa, Mycobacterium bovis
AVNQDGASNGLTAPNGLA

SEQ ID NO: 170572 - protein, 20 aa, Mycobacterium bovis
AVNQDGASNGLTAPNGPSQQ

SEQ ID NO: 170573 - protein, 21 aa, Mycobacterium bovis
AVNQDGASSGVTVPNGPAQQA

SEQ ID NO: 170574 - protein, 19 aa, Mycobacterium bovis
AVNQDGKSNGIMAPNPSAQ

SEQ ID NO: 170575 - protein, 18 aa, Mycobacterium bovis
AVNQDGRSNGVTAPNTAA

SEQ ID NO: 170576 - protein, 7 aa, Mycobacterium bovis
AVPAQDA

SEQ ID NO: 170577 - protein, 11 aa, Mycobacterium bovis
AVPEADTEAAP

SEQ ID NO: 170578 - protein, 11 aa, Mycobacterium bovis
AVPGRRDDLGG

SEQ ID NO: 170579 - protein, 17 aa, Mycobacterium bovis
AVPPEAGVPAALSPETQ

SEQ ID NO: 170580 - protein, 7 aa, Mycobacterium bovis
AVPPTGS

SEQ ID NO: 170581 - protein, 6 aa, Mycobacterium bovis
AVPQEK

SEQ ID NO: 170582 - protein, 8 aa, Mycobacterium bovis
AVPQPSEK

SEQ ID NO: 170583 - protein, 12 aa, Mycobacterium bovis
AVPSGASTGEHE

SEQ ID NO: 170584 - protein, 6 aa, Mycobacterium bovis
AVPSHD

SEQ ID NO: 170585 - protein, 26 aa, Mycobacterium bovis
AVPTAGTPHSKNRVAAATDESVERGS

SEQ ID NO: 170586 - protein, 6 aa, Mycobacterium bovis
AVPTAR

SEQ ID NO: 170587 - protein, 15 aa, Mycobacterium bovis
AVPTSAPGGPSGTSW

SEQ ID NO: 170588 - protein, 4 aa, Mycobacterium bovis
AVQA

SEQ ID NO: 170589 - protein, 13 aa, Mycobacterium bovis
AVQGRKDAKLQKR

SEQ ID NO: 170590 - protein, 9 aa, Mycobacterium bovis
AVQPTTHEP

SEQ ID NO: 170591 - protein, 11 aa, Mycobacterium bovis
AVQRRDSRAPT

SEQ ID NO: 170592 - protein, 4 aa, Mycobacterium bovis
AVQT

SEQ ID NO: 170593 - protein, 9 aa, Mycobacterium bovis
AVQTAESEL

SEQ ID NO: 170594 - protein, 5 aa, Mycobacterium bovis
AVRAD

SEQ ID NO: 170595 - protein, 12 aa, Mycobacterium bovis
AVRDDAARAGVK

SEQ ID NO: 170596 - protein, 5 aa, Mycobacterium bovis
AVRDG

SEQ ID NO: 170597 - protein, 6 aa, Mycobacterium bovis
AVRDGD

SEQ ID NO: 170598 - protein, 5 aa, Mycobacterium bovis
AVRDQ

SEQ ID NO: 170599 - protein, 13 aa, Mycobacterium bovis
AVRDSRPAVGQRG

SEQ ID NO: 170600 - protein, 10 aa, Mycobacterium bovis
AVRGGDRAAL

SEQ ID NO: 170601 - protein, 8 aa, Mycobacterium bovis
AVRGTGSS

SEQ ID NO: 170602 - protein, 4 aa, Mycobacterium bovis
AVRK

SEQ ID NO: 170603 - protein, 5 aa, Mycobacterium bovis
AVRPG

SEQ ID NO: 170604 - protein, 11 aa, Mycobacterium bovis
AVRQGDPLDTE

SEQ ID NO: 170605 - protein, 5 aa, Mycobacterium bovis
AVRRG

SEQ ID NO: 170606 - protein, 20 aa, Mycobacterium bovis
AVRRTGSGETITPSFVLPMD

SEQ ID NO: 170607 - protein, 14 aa, Mycobacterium bovis
AVSAGKVTERERDR

SEQ ID NO: 170608 - protein, 7 aa, Mycobacterium bovis
AVSAPSG

SEQ ID NO: 170609 - protein, 6 aa, Mycobacterium bovis
AVSEPV

SEQ ID NO: 170610 - protein, 8 aa, Mycobacterium bovis
AVSGRNYE

SEQ ID NO: 170611 - protein, 7 aa, Mycobacterium bovis
AVSGSGP

SEQ ID NO: 170612 - protein, 8 aa, Mycobacterium bovis
AVSPSGHT

SEQ ID NO: 170613 - protein, 7 aa, Mycobacterium bovis
AVSPTTA

SEQ ID NO: 170614 - protein, 20 aa, Mycobacterium bovis
AVSPYGSGALAGSSLGLDPD

SEQ ID NO: 170615 - protein, 9 aa, Mycobacterium bovis
AVSSGATGL

SEQ ID NO: 170616 - protein, 10 aa, Mycobacterium bovis
AVSSGDNSNI

SEQ ID NO: 170617 - protein, 6 aa, Mycobacterium bovis
AVSSGV

SEQ ID NO: 170618 - protein, 9 aa, Mycobacterium bovis
AVSSSGPDR

SEQ ID NO: 170619 - protein, 8 aa, Mycobacterium bovis
AVTAAPDG

SEQ ID NO: 170620 - protein, 13 aa, Mycobacterium bovis
AVTATDGQARPPA

SEQ ID NO: 170621 - protein, 8 aa, Mycobacterium bovis
AVTDGDVD

SEQ ID NO: 170622 - protein, 9 aa, Mycobacterium bovis
AVTDTGEPV

SEQ ID NO: 170623 - protein, 5 aa, Mycobacterium bovis
AVTGG

SEQ ID NO: 170624 - protein, 6 aa, Mycobacterium bovis
AVTGGP

SEQ ID NO: 170625 - protein, 5 aa, Mycobacterium bovis
AVTGK

SEQ ID NO: 170626 - protein, 9 aa, Mycobacterium bovis
AVTPEKAAD

SEQ ID NO: 170627 - protein, 8 aa, Mycobacterium bovis
AVTPEQAP

SEQ ID NO: 170628 - protein, 16 aa, Mycobacterium bovis
AVTPPGRPAGKPWTYT

SEQ ID NO: 170629 - protein, 7 aa, Mycobacterium bovis
AVTPTTE

SEQ ID NO: 170630 - protein, 14 aa, Mycobacterium bovis
AVTRAGQAARATSV

SEQ ID NO: 170631 - protein, 4 aa, Mycobacterium bovis
AVTS

SEQ ID NO: 170632 - protein, 17 aa, Mycobacterium bovis
AVTTGDPGPITPQPTPL

SEQ ID NO: 170633 - protein, 20 aa, Mycobacterium bovis
AVVSGGPDIRPALGDPADVA

SEQ ID NO: 170634 - protein, 21 aa, Mycobacterium bovis
AVYEPSPRALPTDTATQRPAP

SEQ ID NO: 170635 - protein, 10 aa, Mycobacterium bovis
AWAESSTSHY

SEQ ID NO: 170636 - protein, 5 aa, Mycobacterium bovis
AWHGP

SEQ ID NO: 170637 - protein, 7 aa, Mycobacterium bovis
AWNDDGS

SEQ ID NO: 170638 - protein, 4 aa, Mycobacterium bovis
AWPG

SEQ ID NO: 170639 - protein, 7 aa, Mycobacterium bovis
AWPPNAA

SEQ ID NO: 170640 - protein, 8 aa, Mycobacterium bovis
AWQGDTGI

SEQ ID NO: 170641 - protein, 5 aa, Mycobacterium bovis
AWRGP

SEQ ID NO: 170642 - protein, 18 aa, Mycobacterium bovis
AWRSAGGSIETGQVSPQL

SEQ ID NO: 170643 - protein, 15 aa, Mycobacterium bovis
AWSGPSSTSMASAAA

SEQ ID NO: 170644 - protein, 18 aa, Mycobacterium bovis
AWTGEPELAPAAQAARYT

SEQ ID NO: 170645 - protein, 13 aa, Mycobacterium bovis
AYADAAEARGTWD

SEQ ID NO: 170646 - protein, 4 aa, Mycobacterium bovis
AYAY

SEQ ID NO: 170647 - protein, 8 aa, Mycobacterium bovis
AYDEPASV

SEQ ID NO: 170648 - protein, 7 aa, Mycobacterium bovis
AYDERRE

SEQ ID NO: 170649 - protein, 5 aa, Mycobacterium bovis
AYDSP

SEQ ID NO: 170650 - protein, 5 aa, Mycobacterium bovis
AYEEN

SEQ ID NO: 170651 - protein, 8 aa, Mycobacterium bovis
AYEGGASI

SEQ ID NO: 170652 - protein, 5 aa, Mycobacterium bovis
AYEPH

SEQ ID NO: 170653 - protein, 12 aa, Mycobacterium bovis
AYERGRPSYPPE

SEQ ID NO: 170654 - protein, 8 aa, Mycobacterium bovis
AYESGDGQ

SEQ ID NO: 170655 - protein, 4 aa, Mycobacterium bovis
AYGE

SEQ ID NO: 170656 - protein, 5 aa, Mycobacterium bovis
AYGGA

SEQ ID NO: 170657 - protein, 11 aa, Mycobacterium bovis
AYGGQGLPDGT

SEQ ID NO: 170658 - protein, 7 aa, Mycobacterium bovis
AYGGTVA

SEQ ID NO: 170659 - protein, 11 aa, Mycobacterium bovis
AYGPDSDEQIN

SEQ ID NO: 170660 - protein, 7 aa, Mycobacterium bovis
AYGPTRN

SEQ ID NO: 170661 - protein, 9 aa, Mycobacterium bovis
AYGREGENC

SEQ ID NO: 170662 - protein, 19 aa, Mycobacterium bovis
AYHGGHGHSVSDAPGTAAK

SEQ ID NO: 170663 - protein, 6 aa, Mycobacterium bovis
AYHPAN

SEQ ID NO: 170664 - protein, 7 aa, Mycobacterium bovis
AYHRPDT

SEQ ID NO: 170665 - protein, 7 aa, Mycobacterium bovis
AYNDTRR

SEQ ID NO: 170666 - protein, 13 aa, Mycobacterium bovis
AYPANTEKPEFAD

SEQ ID NO: 170667 - protein, 5 aa, Mycobacterium bovis
AYPDR

SEQ ID NO: 170668 - protein, 10 aa, Mycobacterium bovis
AYPGTPPPMP

SEQ ID NO: 170669 - protein, 9 aa, Mycobacterium bovis
AYPPRADGS

SEQ ID NO: 170670 - protein, 9 aa, Mycobacterium bovis
AYPRPPRGR

SEQ ID NO: 170671 - protein, 10 aa, Mycobacterium bovis
AYQAASAEAA

SEQ ID NO: 170672 - protein, 9 aa, Mycobacterium bovis
AYQAASAQA

SEQ ID NO: 170673 - protein, 6 aa, Mycobacterium bovis
AYQGAD

SEQ ID NO: 170674 - protein, 6 aa, Mycobacterium bovis
AYQTGA

SEQ ID NO: 170675 - protein, 5 aa, Mycobacterium bovis
AYRGE

SEQ ID NO: 170676 - protein, 6 aa, Mycobacterium bovis
AYSDDP

SEQ ID NO: 170677 - protein, 6 aa, Mycobacterium bovis
AYSPGD

SEQ ID NO: 170678 - protein, 13 aa, Mycobacterium bovis
AYSQAASGRLPDP

SEQ ID NO: 170679 - protein, 6 aa, Mycobacterium bovis
AYSRAD

SEQ ID NO: 170680 - protein, 6 aa, Mycobacterium bovis
AYTASG

SEQ ID NO: 170681 - protein, 6 aa, Mycobacterium bovis
AYTGGG

SEQ ID NO: 170682 - protein, 5 aa, Mycobacterium bovis
AYTNP

SEQ ID NO: 170683 - protein, 10 aa, Mycobacterium bovis
AYTSADPVSG

SEQ ID NO: 170684 - protein, 14 aa, Mycobacterium bovis
CAAESGRAPCALRF

SEQ ID NO: 170685 - protein, 8 aa, Mycobacterium bovis
CAEARGKD

SEQ ID NO: 170686 - protein, 18 aa, Mycobacterium bovis
CAGQQADVGPTPQHRCRG

SEQ ID NO: 170687 - protein, 8 aa, Mycobacterium bovis
CAGRAPDW

SEQ ID NO: 170688 - protein, 13 aa, Mycobacterium bovis
CAPPGNSPTPAER

SEQ ID NO: 170689 - protein, 10 aa, Mycobacterium bovis
CAQRTDHRRG

SEQ ID NO: 170690 - protein, 7 aa, Mycobacterium bovis
CASGELD

SEQ ID NO: 170691 - protein, 12 aa, Mycobacterium bovis
CASGSQALQSAR

SEQ ID NO: 170692 - protein, 6 aa, Mycobacterium bovis
CASGSV

SEQ ID NO: 170693 - protein, 11 aa, Mycobacterium bovis
CASQGKTSPDR

SEQ ID NO: 170694 - protein, 8 aa, Mycobacterium bovis
CATGGGRV

SEQ ID NO: 170695 - protein, 6 aa, Mycobacterium bovis
CATKYG

SEQ ID NO: 170696 - protein, 4 aa, Mycobacterium bovis
CCDG

SEQ ID NO: 170697 - protein, 8 aa, Mycobacterium bovis
CDAGQTRK

SEQ ID NO: 170698 - protein, 12 aa, Mycobacterium bovis
CDEAGRDRSTLQ

SEQ ID NO: 170699 - protein, 9 aa, Mycobacterium bovis
CDETPREEV

SEQ ID NO: 170700 - protein, 7 aa, Mycobacterium bovis
CDRGGPG

SEQ ID NO: 170701 - protein, 5 aa, Mycobacterium bovis
CEEAD

SEQ ID NO: 170702 - protein, 4 aa, Mycobacterium bovis
CEEL

SEQ ID NO: 170703 - protein, 11 aa, Mycobacterium bovis
CEGAANLPDGP

SEQ ID NO: 170704 - protein, 7 aa, Mycobacterium bovis
CENAGTE

SEQ ID NO: 170705 - protein, 5 aa, Mycobacterium bovis
CEPGR

SEQ ID NO: 170706 - protein, 6 aa, Mycobacterium bovis
CEQRDN

SEQ ID NO: 170707 - protein, 5 aa, Mycobacterium bovis
CERAA

SEQ ID NO: 170708 - protein, 10 aa, Mycobacterium bovis
CERRDPKGLY

SEQ ID NO: 170709 - protein, 4 aa, Mycobacterium bovis
CETR

SEQ ID NO: 170710 - protein, 7 aa, Mycobacterium bovis
CGAGPGE

SEQ ID NO: 170711 - protein, 9 aa, Mycobacterium bovis
CGDRSAAVT

SEQ ID NO: 170712 - protein, 6 aa, Mycobacterium bovis
CGEGYG

SEQ ID NO: 170713 - protein, 10 aa, Mycobacterium bovis
CGEPAHDPDF

SEQ ID NO: 170714 - protein, 4 aa, Mycobacterium bovis
CGGA

SEQ ID NO: 170715 - protein, 12 aa, Mycobacterium bovis
CGGDTGDDDRPK

SEQ ID NO: 170716 - protein, 12 aa, Mycobacterium bovis
CGGDVGDATPVS

SEQ ID NO: 170717 - protein, 11 aa, Mycobacterium bovis
CGGPPIAAATR

SEQ ID NO: 170718 - protein, 15 aa, Mycobacterium bovis
CGKTATAIGKPAAEG

SEQ ID NO: 170719 - protein, 4 aa, Mycobacterium bovis
CGPD

SEQ ID NO: 170720 - protein, 7 aa, Mycobacterium bovis
CGPDGTA

SEQ ID NO: 170721 - protein, 4 aa, Mycobacterium bovis
CGPQ

SEQ ID NO: 170722 - protein, 6 aa, Mycobacterium bovis
CGPTYS

SEQ ID NO: 170723 - protein, 5 aa, Mycobacterium bovis
CGRPR

SEQ ID NO: 170724 - protein, 21 aa, Mycobacterium bovis
CGRRPKSSGWQPGPGFELTAT

SEQ ID NO: 170725 - protein, 4 aa, Mycobacterium bovis
CGRT

SEQ ID NO: 170726 - protein, 7 aa, Mycobacterium bovis
CGSGQQA

SEQ ID NO: 170727 - protein, 5 aa, Mycobacterium bovis
CGSGR

SEQ ID NO: 170728 - protein, 8 aa, Mycobacterium bovis
CGSPPAGE

SEQ ID NO: 170729 - protein, 8 aa, Mycobacterium bovis
CGSPPTDA

SEQ ID NO: 170730 - protein, 4 aa, Mycobacterium bovis
CGTG

SEQ ID NO: 170731 - protein, 5 aa, Mycobacterium bovis
CGTGP

SEQ ID NO: 170732 - protein, 4 aa, Mycobacterium bovis
CGTP

SEQ ID NO: 170733 - protein, 11 aa, Mycobacterium bovis
CGTPDADAFDR

SEQ ID NO: 170734 - protein, 7 aa, Mycobacterium bovis
CGTSTGE

SEQ ID NO: 170735 - protein, 9 aa, Mycobacterium bovis
CKPGDGLGI

SEQ ID NO: 170736 - protein, 6 aa, Mycobacterium bovis
CKRGEV

SEQ ID NO: 170737 - protein, 5 aa, Mycobacterium bovis
CLDDP

SEQ ID NO: 170738 - protein, 6 aa, Mycobacterium bovis
CLPEGV

SEQ ID NO: 170739 - protein, 5 aa, Mycobacterium bovis
CNASR

SEQ ID NO: 170740 - protein, 10 aa, Mycobacterium bovis
CNDPDLDPFG

SEQ ID NO: 170741 - protein, 4 aa, Mycobacterium bovis
CNMG

SEQ ID NO: 170742 - protein, 7 aa, Mycobacterium bovis
CNPTGGL

SEQ ID NO: 170743 - protein, 4 aa, Mycobacterium bovis
CPAP

SEQ ID NO: 170744 - protein, 4 aa, Mycobacterium bovis
CPAS

SEQ ID NO: 170745 - protein, 7 aa, Mycobacterium bovis
CPDQAEA

SEQ ID NO: 170746 - protein, 12 aa, Mycobacterium bovis
CPFSTADSENLQ

SEQ ID NO: 170747 - protein, 9 aa, Mycobacterium bovis
CPGDPTPRF

SEQ ID NO: 170748 - protein, 14 aa, Mycobacterium bovis
CPGGTGAAKFGGNY

SEQ ID NO: 170749 - protein, 6 aa, Mycobacterium bovis
CPGPEA

SEQ ID NO: 170750 - protein, 5 aa, Mycobacterium bovis
CPKDK

SEQ ID NO: 170751 - protein, 5 aa, Mycobacterium bovis
CPLND

SEQ ID NO: 170752 - protein, 5 aa, Mycobacterium bovis
CPNCS

SEQ ID NO: 170753 - protein, 8 aa, Mycobacterium bovis
CPPAGTGT

SEQ ID NO: 170754 - protein, 5 aa, Mycobacterium bovis
CPPGA

SEQ ID NO: 170755 - protein, 5 aa, Mycobacterium bovis
CPPRP

SEQ ID NO: 170756 - protein, 5 aa, Mycobacterium bovis
CPPRQ

SEQ ID NO: 170757 - protein, 6 aa, Mycobacterium bovis
CPPTGL

SEQ ID NO: 170758 - protein, 4 aa, Mycobacterium bovis
CPQE

SEQ ID NO: 170759 - protein, 6 aa, Mycobacterium bovis
CPSGEV

SEQ ID NO: 170760 - protein, 9 aa, Mycobacterium bovis
CPSGSGTPL

SEQ ID NO: 170761 - protein, 18 aa, Mycobacterium bovis
CPSGTDPSTHPSSDEVTE

SEQ ID NO: 170762 - protein, 4 aa, Mycobacterium bovis
CPTK

SEQ ID NO: 170763 - protein, 8 aa, Mycobacterium bovis
CQDSGGGA

SEQ ID NO: 170764 - protein, 8 aa, Mycobacterium bovis
CQGEVGSA

SEQ ID NO: 170765 - protein, 5 aa, Mycobacterium bovis
CQGRT

SEQ ID NO: 170766 - protein, 13 aa, Mycobacterium bovis
CQQPTQPPDADQT

SEQ ID NO: 170767 - protein, 4 aa, Mycobacterium bovis
CQTE

SEQ ID NO: 170768 - protein, 7 aa, Mycobacterium bovis
CRDGSDP

SEQ ID NO: 170769 - protein, 18 aa, Mycobacterium bovis
CRGSTGPSSLARDGKPWG

SEQ ID NO: 170770 - protein, 7 aa, Mycobacterium bovis
CRPASRG

SEQ ID NO: 170771 - protein, 4 aa, Mycobacterium bovis
CRPI

SEQ ID NO: 170772 - protein, 4 aa, Mycobacterium bovis
CRPR

SEQ ID NO: 170773 - protein, 9 aa, Mycobacterium bovis
CRRRPSDRA

SEQ ID NO: 170774 - protein, 19 aa, Mycobacterium bovis
CRTGPPQPLLPGRQPFSTA

SEQ ID NO: 170775 - protein, 4 aa, Mycobacterium bovis
CSAP

SEQ ID NO: 170776 - protein, 14 aa, Mycobacterium bovis
CSEEGTTLSDNEIR

SEQ ID NO: 170777 - protein, 6 aa, Mycobacterium bovis
CSPDSF

SEQ ID NO: 170778 - protein, 5 aa, Mycobacterium bovis
CSPNT

SEQ ID NO: 170779 - protein, 9 aa, Mycobacterium bovis
CSPTSDGSA

SEQ ID NO: 170780 - protein, 26 aa, Mycobacterium bovis
CSQPAPRAIGASSRHASAGPVPPAPV

SEQ ID NO: 170781 - protein, 4 aa, Mycobacterium bovis
CSRQ

SEQ ID NO: 170782 - protein, 6 aa, Mycobacterium bovis
CSRRGA

SEQ ID NO: 170783 - protein, 5 aa, Mycobacterium bovis
CTAEA

SEQ ID NO: 170784 - protein, 7 aa, Mycobacterium bovis
CTEPPPI

SEQ ID NO: 170785 - protein, 9 aa, Mycobacterium bovis
CTGKGNDQV

SEQ ID NO: 170786 - protein, 8 aa, Mycobacterium bovis
CTKSDTVD

SEQ ID NO: 170787 - protein, 6 aa, Mycobacterium bovis
CTNTEQ

SEQ ID NO: 170788 - protein, 8 aa, Mycobacterium bovis
CTNTSNPE

SEQ ID NO: 170789 - protein, 4 aa, Mycobacterium bovis
CTPC

SEQ ID NO: 170790 - protein, 10 aa, Mycobacterium bovis
CTSGGEPGCG

SEQ ID NO: 170791 - protein, 10 aa, Mycobacterium bovis
CTSPDGTPCR

SEQ ID NO: 170792 - protein, 4 aa, Mycobacterium bovis
CTTG

SEQ ID NO: 170793 - protein, 11 aa, Mycobacterium bovis
CTTRNKRRAAR

SEQ ID NO: 170794 - protein, 5 aa, Mycobacterium bovis
CYGPP

SEQ ID NO: 170795 - protein, 8 aa, Mycobacterium bovis
CYGQPPDN

SEQ ID NO: 170796 - protein, 13 aa, Mycobacterium bovis
DAAADPDVAGDAF

SEQ ID NO: 170797 - protein, 8 aa, Mycobacterium bovis
DAAADRVS

SEQ ID NO: 170798 - protein, 5 aa, Mycobacterium bovis
DAAAI

SEQ ID NO: 170799 - protein, 6 aa, Mycobacterium bovis
DAAALG

SEQ ID NO: 170800 - protein, 12 aa, Mycobacterium bovis
DAAAPAQTIDDN

SEQ ID NO: 170801 - protein, 23 aa, Mycobacterium bovis
DAAAQQALSPFEGPKDGSAPENP

SEQ ID NO: 170802 - protein, 9 aa, Mycobacterium bovis
DAAARELTD

SEQ ID NO: 170803 - protein, 7 aa, Mycobacterium bovis
DAAATFR

SEQ ID NO: 170804 - protein, 6 aa, Mycobacterium bovis
DAADAA

SEQ ID NO: 170805 - protein, 8 aa, Mycobacterium bovis
DAADAGDR

SEQ ID NO: 170806 - protein, 5 aa, Mycobacterium bovis
DAADC

SEQ ID NO: 170807 - protein, 7 aa, Mycobacterium bovis
DAADGLR

SEQ ID NO: 170808 - protein, 7 aa, Mycobacterium bovis
DAADLGA

SEQ ID NO: 170809 - protein, 7 aa, Mycobacterium bovis
DAADRGE

SEQ ID NO: 170810 - protein, 9 aa, Mycobacterium bovis
DAAEAERSG

SEQ ID NO: 170811 - protein, 18 aa, Mycobacterium bovis
DAAGLAETRYGAGKNNPG

SEQ ID NO: 170812 - protein, 8 aa, Mycobacterium bovis
DAAHAGEY

SEQ ID NO: 170813 - protein, 14 aa, Mycobacterium bovis
DAALTRRAKRASRL

SEQ ID NO: 170814 - protein, 7 aa, Mycobacterium bovis
DAAPDQI

SEQ ID NO: 170815 - protein, 11 aa, Mycobacterium bovis
DAAPDSPTAAK

SEQ ID NO: 170816 - protein, 7 aa, Mycobacterium bovis
DAAQGTR

SEQ ID NO: 170817 - protein, 10 aa, Mycobacterium bovis
DAARAARQVG

SEQ ID NO: 170818 - protein, 9 aa, Mycobacterium bovis
DAARAGNSS

SEQ ID NO: 170819 - protein, 7 aa, Mycobacterium bovis
DAARGRM

SEQ ID NO: 170820 - protein, 6 aa, Mycobacterium bovis
DAARYA

SEQ ID NO: 170821 - protein, 9 aa, Mycobacterium bovis
DAASAAAKV

SEQ ID NO: 170822 - protein, 9 aa, Mycobacterium bovis
DAASDEMTE

SEQ ID NO: 170823 - protein, 13 aa, Mycobacterium bovis
DAASNVVGMSDQQ

SEQ ID NO: 170824 - protein, 7 aa, Mycobacterium bovis
DAASRWT

SEQ ID NO: 170825 - protein, 6 aa, Mycobacterium bovis
DAATAR

SEQ ID NO: 170826 - protein, 7 aa, Mycobacterium bovis
DAATDDA

SEQ ID NO: 170827 - protein, 7 aa, Mycobacterium bovis
DAATGNA

SEQ ID NO: 170828 - protein, 5 aa, Mycobacterium bovis
DAATL

SEQ ID NO: 170829 - protein, 10 aa, Mycobacterium bovis
DAATPSRAYA

SEQ ID NO: 170830 - protein, 7 aa, Mycobacterium bovis
DAATQAA

SEQ ID NO: 170831 - protein, 9 aa, Mycobacterium bovis
DADADGRDV

SEQ ID NO: 170832 - protein, 11 aa, Mycobacterium bovis
DADADGREGST

SEQ ID NO: 170833 - protein, 5 aa, Mycobacterium bovis
DADAE

SEQ ID NO: 170834 - protein, 8 aa, Mycobacterium bovis
DADAPGAR

SEQ ID NO: 170835 - protein, 6 aa, Mycobacterium bovis
DADDDY

SEQ ID NO: 170836 - protein, 6 aa, Mycobacterium bovis
DADDGY

SEQ ID NO: 170837 - protein, 16 aa, Mycobacterium bovis
DADDVTSFSSGEPSLD

SEQ ID NO: 170838 - protein, 7 aa, Mycobacterium bovis
DADEDPE

SEQ ID NO: 170839 - protein, 26 aa, Mycobacterium bovis
DADGDVPRSRKRGAYQPPGRERVGSS

SEQ ID NO: 170840 - protein, 7 aa, Mycobacterium bovis
DADGGTG

SEQ ID NO: 170841 - protein, 8 aa, Mycobacterium bovis
DADGSAFA

SEQ ID NO: 170842 - protein, 6 aa, Mycobacterium bovis
DADGSI

SEQ ID NO: 170843 - protein, 8 aa, Mycobacterium bovis
DADGTKAG

SEQ ID NO: 170844 - protein, 4 aa, Mycobacterium bovis
DADL

SEQ ID NO: 170845 - protein, 8 aa, Mycobacterium bovis
DADLRGAT

SEQ ID NO: 170846 - protein, 4 aa, Mycobacterium bovis
DADP

SEQ ID NO: 170847 - protein, 7 aa, Mycobacterium bovis
DADPATI

SEQ ID NO: 170848 - protein, 11 aa, Mycobacterium bovis
DADQLRGQAGR

SEQ ID NO: 170849 - protein, 7 aa, Mycobacterium bovis
DADRSGR

SEQ ID NO: 170850 - protein, 8 aa, Mycobacterium bovis
DADTVNAA

SEQ ID NO: 170851 - protein, 9 aa, Mycobacterium bovis
DADVAGTQT

SEQ ID NO: 170852 - protein, 9 aa, Mycobacterium bovis
DADVPGPLT

SEQ ID NO: 170853 - protein, 7 aa, Mycobacterium bovis
DAEADDD

SEQ ID NO: 170854 - protein, 8 aa, Mycobacterium bovis
DAEAGPTE

SEQ ID NO: 170855 - protein, 8 aa, Mycobacterium bovis
DAEAVESG

SEQ ID NO: 170856 - protein, 5 aa, Mycobacterium bovis
DAEAY

SEQ ID NO: 170857 - protein, 4 aa, Mycobacterium bovis
DAED

SEQ ID NO: 170858 - protein, 9 aa, Mycobacterium bovis
DAEDLGGGA

SEQ ID NO: 170859 - protein, 7 aa, Mycobacterium bovis
DAEGADE

SEQ ID NO: 170860 - protein, 5 aa, Mycobacterium bovis
DAEGT

SEQ ID NO: 170861 - protein, 6 aa, Mycobacterium bovis
DAEHEH

SEQ ID NO: 170862 - protein, 9 aa, Mycobacterium bovis
DAEHNRASA

SEQ ID NO: 170863 - protein, 13 aa, Mycobacterium bovis
DAELQRLAGKLTR

SEQ ID NO: 170864 - protein, 11 aa, Mycobacterium bovis
DAELRAKTDEF

SEQ ID NO: 170865 - protein, 7 aa, Mycobacterium bovis
DAELTER

SEQ ID NO: 170866 - protein, 8 aa, Mycobacterium bovis
DAELTERP

SEQ ID NO: 170867 - protein, 8 aa, Mycobacterium bovis
DAEPEHDP

SEQ ID NO: 170868 - protein, 6 aa, Mycobacterium bovis
DAEPHR

SEQ ID NO: 170869 - protein, 5 aa, Mycobacterium bovis
DAEPI

SEQ ID NO: 170870 - protein, 8 aa, Mycobacterium bovis
DAEQSNTS

SEQ ID NO: 170871 - protein, 6 aa, Mycobacterium bovis
DAEQTH

SEQ ID NO: 170872 - protein, 9 aa, Mycobacterium bovis
DAERGTGGN

SEQ ID NO: 170873 - protein, 8 aa, Mycobacterium bovis
DAERQAAE

SEQ ID NO: 170874 - protein, 7 aa, Mycobacterium bovis
DAESDEV

SEQ ID NO: 170875 - protein, 20 aa, Mycobacterium bovis
DAESRRGGGDMQSSPKRSPS

SEQ ID NO: 170876 - protein, 11 aa, Mycobacterium bovis
DAFGGSPRTPM

SEQ ID NO: 170877 - protein, 6 aa, Mycobacterium bovis
DAFGGT

SEQ ID NO: 170878 - protein, 7 aa, Mycobacterium bovis
DAGAATV

SEQ ID NO: 170879 - protein, 10 aa, Mycobacterium bovis
DAGADPARFD

SEQ ID NO: 170880 - protein, 8 aa, Mycobacterium bovis
DAGADTVD

SEQ ID NO: 170881 - protein, 16 aa, Mycobacterium bovis
DAGAEIARRSRGTPRI

SEQ ID NO: 170882 - protein, 10 aa, Mycobacterium bovis
DAGAERGRAE

SEQ ID NO: 170883 - protein, 15 aa, Mycobacterium bovis
DAGAPTSGKPALSDP

SEQ ID NO: 170884 - protein, 5 aa, Mycobacterium bovis
DAGAQ

SEQ ID NO: 170885 - protein, 7 aa, Mycobacterium bovis
DAGAQDA

SEQ ID NO: 170886 - protein, 25 aa, Mycobacterium bovis
DAGAVARPASVSSGRSLPATLTARG

SEQ ID NO: 170887 - protein, 10 aa, Mycobacterium bovis
DAGDHAEGAW

SEQ ID NO: 170888 - protein, 15 aa, Mycobacterium bovis
DAGDPALAADPQSLA

SEQ ID NO: 170889 - protein, 6 aa, Mycobacterium bovis
DAGDPV

SEQ ID NO: 170890 - protein, 11 aa, Mycobacterium bovis
DAGDRPGHGGL

SEQ ID NO: 170891 - protein, 6 aa, Mycobacterium bovis
DAGGGI

SEQ ID NO: 170892 - protein, 7 aa, Mycobacterium bovis
DAGGRPL

SEQ ID NO: 170893 - protein, 8 aa, Mycobacterium bovis
DAGHGDSI

SEQ ID NO: 170894 - protein, 4 aa, Mycobacterium bovis
DAGI

SEQ ID NO: 170895 - protein, 9 aa, Mycobacterium bovis
DAGIEDGQQ

SEQ ID NO: 170896 - protein, 6 aa, Mycobacterium bovis
DAGIGD

SEQ ID NO: 170897 - protein, 8 aa, Mycobacterium bovis
DAGKSAVT

SEQ ID NO: 170898 - protein, 4 aa, Mycobacterium bovis
DAGL

SEQ ID NO: 170899 - protein, 7 aa, Mycobacterium bovis
DAGLPAE

SEQ ID NO: 170900 - protein, 14 aa, Mycobacterium bovis
DAGLTSSSWARGPH

SEQ ID NO: 170901 - protein, 8 aa, Mycobacterium bovis
DAGPADGP

SEQ ID NO: 170902 - protein, 7 aa, Mycobacterium bovis
DAGPPTM

SEQ ID NO: 170903 - protein, 5 aa, Mycobacterium bovis
DAGPV

SEQ ID NO: 170904 - protein, 22 aa, Mycobacterium bovis
DAGPWQRDGALSRSAVAGRRRS

SEQ ID NO: 170905 - protein, 10 aa, Mycobacterium bovis
DAGQGETELS

SEQ ID NO: 170906 - protein, 14 aa, Mycobacterium bovis
DAGQRGQLVGSQEE

SEQ ID NO: 170907 - protein, 7 aa, Mycobacterium bovis
DAGRAMA

SEQ ID NO: 170908 - protein, 7 aa, Mycobacterium bovis
DAGSGVA

SEQ ID NO: 170909 - protein, 7 aa, Mycobacterium bovis
DAGSNRE

SEQ ID NO: 170910 - protein, 10 aa, Mycobacterium bovis
DAGSSTYSLP

SEQ ID NO: 170911 - protein, 4 aa, Mycobacterium bovis
DAGT

SEQ ID NO: 170912 - protein, 12 aa, Mycobacterium bovis
DAGTISLPLIVT

SEQ ID NO: 170913 - protein, 10 aa, Mycobacterium bovis
DAGWARKTAA

SEQ ID NO: 170914 - protein, 7 aa, Mycobacterium bovis
DAHAPGQ

SEQ ID NO: 170915 - protein, 4 aa, Mycobacterium bovis
DAHD

SEQ ID NO: 170916 - protein, 5 aa, Mycobacterium bovis
DAHHA

SEQ ID NO: 170917 - protein, 10 aa, Mycobacterium bovis
DAHRPTKSAA

SEQ ID NO: 170918 - protein, 7 aa, Mycobacterium bovis
DAHRRPK

SEQ ID NO: 170919 - protein, 6 aa, Mycobacterium bovis
DAIAGG

SEQ ID NO: 170920 - protein, 9 aa, Mycobacterium bovis
DAIDGRPRG

SEQ ID NO: 170921 - protein, 7 aa, Mycobacterium bovis
DAIGTST

SEQ ID NO: 170922 - protein, 19 aa, Mycobacterium bovis
DAIRDGASGRPAPSHFSTR

SEQ ID NO: 170923 - protein, 8 aa, Mycobacterium bovis
DAIRGTGS

SEQ ID NO: 170924 - protein, 9 aa, Mycobacterium bovis
DAKAQADRM

SEQ ID NO: 170925 - protein, 8 aa, Mycobacterium bovis
DAKEGPRA

SEQ ID NO: 170926 - protein, 8 aa, Mycobacterium bovis
DAKSHQQL

SEQ ID NO: 170927 - protein, 6 aa, Mycobacterium bovis
DAKYGE

SEQ ID NO: 170928 - protein, 7 aa, Mycobacterium bovis
DALDGNQ

SEQ ID NO: 170929 - protein, 15 aa, Mycobacterium bovis
DALPNAYPRAGHVGD

SEQ ID NO: 170930 - protein, 6 aa, Mycobacterium bovis
DALPNG

SEQ ID NO: 170931 - protein, 8 aa, Mycobacterium bovis
DALPRRRG

SEQ ID NO: 170932 - protein, 6 aa, Mycobacterium bovis
DALRDG

SEQ ID NO: 170933 - protein, 13 aa, Mycobacterium bovis
DALTGDHDLEPGP

SEQ ID NO: 170934 - protein, 5 aa, Mycobacterium bovis
DAMTQ

SEQ ID NO: 170935 - protein, 8 aa, Mycobacterium bovis
DANERAEV

SEQ ID NO: 170936 - protein, 5 aa, Mycobacterium bovis
DANGA

SEQ ID NO: 170937 - protein, 5 aa, Mycobacterium bovis
DANGQ

SEQ ID NO: 170938 - protein, 6 aa, Mycobacterium bovis
DANQRA

SEQ ID NO: 170939 - protein, 22 aa, Mycobacterium bovis
DAPAQAGTESAVSGVEGLPPGS

SEQ ID NO: 170940 - protein, 12 aa, Mycobacterium bovis
DAPARPRPVTAE

SEQ ID NO: 170941 - protein, 6 aa, Mycobacterium bovis
DAPARY

SEQ ID NO: 170942 - protein, 7 aa, Mycobacterium bovis
DAPASEL

SEQ ID NO: 170943 - protein, 7 aa, Mycobacterium bovis
DAPAVPN

SEQ ID NO: 170944 - protein, 4 aa, Mycobacterium bovis
DAPD

SEQ ID NO: 170945 - protein, 6 aa, Mycobacterium bovis
DAPDGL

SEQ ID NO: 170946 - protein, 6 aa, Mycobacterium bovis
DAPDKE

SEQ ID NO: 170947 - protein, 7 aa, Mycobacterium bovis
DAPDNEA

SEQ ID NO: 170948 - protein, 7 aa, Mycobacterium bovis
DAPEGTK

SEQ ID NO: 170949 - protein, 8 aa, Mycobacterium bovis
DAPGGVPT

SEQ ID NO: 170950 - protein, 6 aa, Mycobacterium bovis
DAPGVT

SEQ ID NO: 170951 - protein, 5 aa, Mycobacterium bovis
DAPKL

SEQ ID NO: 170952 - protein, 10 aa, Mycobacterium bovis
DAPKSDPADV

SEQ ID NO: 170953 - protein, 7 aa, Mycobacterium bovis
DAPLDDS

SEQ ID NO: 170954 - protein, 7 aa, Mycobacterium bovis
DAPLESD

SEQ ID NO: 170955 - protein, 7 aa, Mycobacterium bovis
DAPLETQ

SEQ ID NO: 170956 - protein, 8 aa, Mycobacterium bovis
DAPLPPQT

SEQ ID NO: 170957 - protein, 7 aa, Mycobacterium bovis
DAPLRPR

SEQ ID NO: 170958 - protein, 13 aa, Mycobacterium bovis
DAPLSDDVLERFH

SEQ ID NO: 170959 - protein, 4 aa, Mycobacterium bovis
DAPP

SEQ ID NO: 170960 - protein, 10 aa, Mycobacterium bovis
DAPPDIGPEE

SEQ ID NO: 170961 - protein, 5 aa, Mycobacterium bovis
DAPRL

SEQ ID NO: 170962 - protein, 7 aa, Mycobacterium bovis
DAPSLNT

SEQ ID NO: 170963 - protein, 8 aa, Mycobacterium bovis
DAPTRANA

SEQ ID NO: 170964 - protein, 6 aa, Mycobacterium bovis
DAPVAD

SEQ ID NO: 170965 - protein, 12 aa, Mycobacterium bovis
DAPVTLSTPTDR

SEQ ID NO: 170966 - protein, 5 aa, Mycobacterium bovis
DAQAL

SEQ ID NO: 170967 - protein, 10 aa, Mycobacterium bovis
DAQAPDRHET

SEQ ID NO: 170968 - protein, 11 aa, Mycobacterium bovis
DAQDKNTRELA

SEQ ID NO: 170969 - protein, 8 aa, Mycobacterium bovis
DAQDTAEL

SEQ ID NO: 170970 - protein, 12 aa, Mycobacterium bovis
DAQPDGELPPFG

SEQ ID NO: 170971 - protein, 14 aa, Mycobacterium bovis
DAQPRYSAARRDAV

SEQ ID NO: 170972 - protein, 6 aa, Mycobacterium bovis
DAQRRA

SEQ ID NO: 170973 - protein, 5 aa, Mycobacterium bovis
DAQTP

SEQ ID NO: 170974 - protein, 9 aa, Mycobacterium bovis
DARAAGLNR

SEQ ID NO: 170975 - protein, 28 aa, Mycobacterium bovis
DARADAHRYSNGTDHAGRAADEPAETAH

SEQ ID NO: 170976 - protein, 5 aa, Mycobacterium bovis
DARAG

SEQ ID NO: 170977 - protein, 8 aa, Mycobacterium bovis
DARAQAGA

SEQ ID NO: 170978 - protein, 8 aa, Mycobacterium bovis
DARARTYQ

SEQ ID NO: 170979 - protein, 5 aa, Mycobacterium bovis
DARAT

SEQ ID NO: 170980 - protein, 4 aa, Mycobacterium bovis
DARD

SEQ ID NO: 170981 - protein, 12 aa, Mycobacterium bovis
DARDTKLGAEEI

SEQ ID NO: 170982 - protein, 12 aa, Mycobacterium bovis
DAREGLDRPSDT

SEQ ID NO: 170983 - protein, 10 aa, Mycobacterium bovis
DARGLDASGL

SEQ ID NO: 170984 - protein, 8 aa, Mycobacterium bovis
DARPADES

SEQ ID NO: 170985 - protein, 5 aa, Mycobacterium bovis
DARPI

SEQ ID NO: 170986 - protein, 7 aa, Mycobacterium bovis
DARPTAE

SEQ ID NO: 170987 - protein, 9 aa, Mycobacterium bovis
DARPTSDPR

SEQ ID NO: 170988 - protein, 23 aa, Mycobacterium bovis
DARQAAVEAAGQARDELAGEAPS

SEQ ID NO: 170989 - protein, 10 aa, Mycobacterium bovis
DARTAPRPDD

SEQ ID NO: 170990 - protein, 7 aa, Mycobacterium bovis
DARTDGH

SEQ ID NO: 170991 - protein, 4 aa, Mycobacterium bovis
DARV

SEQ ID NO: 170992 - protein, 5 aa, Mycobacterium bovis
DASAG

SEQ ID NO: 170993 - protein, 6 aa, Mycobacterium bovis
DASAND

SEQ ID NO: 170994 - protein, 14 aa, Mycobacterium bovis
DASASDCEYCDVTR

SEQ ID NO: 170995 - protein, 4 aa, Mycobacterium bovis
DASD

SEQ ID NO: 170996 - protein, 14 aa, Mycobacterium bovis
DASEAKNDDRRSDG

SEQ ID NO: 170997 - protein, 5 aa, Mycobacterium bovis
DASER

SEQ ID NO: 170998 - protein, 23 aa, Mycobacterium bovis
DASGYEPHDQQPQQQQQQQQQAF

SEQ ID NO: 170999 - protein, 8 aa, Mycobacterium bovis
DASHGTDV

SEQ ID NO: 171000 - protein, 40 aa, Mycobacterium bovis
DASKGDRGDADDRGPASVGSGGAPARGAGQQPELPTRAEP

SEQ ID NO: 171001 - protein, 20 aa, Mycobacterium bovis
DASKTPEPIPTAKPVTGDGN

SEQ ID NO: 171002 - protein, 5 aa, Mycobacterium bovis
DASPN

SEQ ID NO: 171003 - protein, 7 aa, Mycobacterium bovis
DASPRSV

SEQ ID NO: 171004 - protein, 5 aa, Mycobacterium bovis
DASPS

SEQ ID NO: 171005 - protein, 4 aa, Mycobacterium bovis
DASQ

SEQ ID NO: 171006 - protein, 7 aa, Mycobacterium bovis
DASQQVT

SEQ ID NO: 171007 - protein, 11 aa, Mycobacterium bovis
DASRGHARGCG

SEQ ID NO: 171008 - protein, 9 aa, Mycobacterium bovis
DASSGHDGP

SEQ ID NO: 171009 - protein, 6 aa, Mycobacterium bovis
DASSTD

SEQ ID NO: 171010 - protein, 9 aa, Mycobacterium bovis
DASTDATPR

SEQ ID NO: 171011 - protein, 5 aa, Mycobacterium bovis
DASTI

SEQ ID NO: 171012 - protein, 4 aa, Mycobacterium bovis
DASY

SEQ ID NO: 171013 - protein, 6 aa, Mycobacterium bovis
DATADA

SEQ ID NO: 171014 - protein, 7 aa, Mycobacterium bovis
DATDPAA

SEQ ID NO: 171015 - protein, 6 aa, Mycobacterium bovis
DATDPL

SEQ ID NO: 171016 - protein, 7 aa, Mycobacterium bovis
DATDRAR

SEQ ID NO: 171017 - protein, 8 aa, Mycobacterium bovis
DATGAEPV

SEQ ID NO: 171018 - protein, 8 aa, Mycobacterium bovis
DATGASDQ

SEQ ID NO: 171019 - protein, 7 aa, Mycobacterium bovis
DATGERI

SEQ ID NO: 171020 - protein, 5 aa, Mycobacterium bovis
DATGF

SEQ ID NO: 171021 - protein, 8 aa, Mycobacterium bovis
DATGRPVE

SEQ ID NO: 171022 - protein, 9 aa, Mycobacterium bovis
DATNSSPDQ

SEQ ID NO: 171023 - protein, 9 aa, Mycobacterium bovis
DATPGQGDD

SEQ ID NO: 171024 - protein, 6 aa, Mycobacterium bovis
DATPVA

SEQ ID NO: 171025 - protein, 9 aa, Mycobacterium bovis
DATRGPGLT

SEQ ID NO: 171026 - protein, 6 aa, Mycobacterium bovis
DATTPA

SEQ ID NO: 171027 - protein, 5 aa, Mycobacterium bovis
DATTV

SEQ ID NO: 171028 - protein, 4 aa, Mycobacterium bovis
DATV

SEQ ID NO: 171029 - protein, 4 aa, Mycobacterium bovis
DAVA

SEQ ID NO: 171030 - protein, 6 aa, Mycobacterium bovis
DAVEDR

SEQ ID NO: 171031 - protein, 7 aa, Mycobacterium bovis
DAVPSDA

SEQ ID NO: 171032 - protein, 7 aa, Mycobacterium bovis
DAVRDGN

SEQ ID NO: 171033 - protein, 9 aa, Mycobacterium bovis
DAVRDGRPT

SEQ ID NO: 171034 - protein, 15 aa, Mycobacterium bovis
DAVRRSQLSRGEDPA

SEQ ID NO: 171035 - protein, 6 aa, Mycobacterium bovis
DAVRSP

SEQ ID NO: 171036 - protein, 14 aa, Mycobacterium bovis
DAVTNGGARPNNEE

SEQ ID NO: 171037 - protein, 5 aa, Mycobacterium bovis
DAYGG

SEQ ID NO: 171038 - protein, 11 aa, Mycobacterium bovis
DAYPRTPDDDL

SEQ ID NO: 171039 - protein, 6 aa, Mycobacterium bovis
DAYRPT

SEQ ID NO: 171040 - protein, 11 aa, Mycobacterium bovis
DCGPAGTPLPA

SEQ ID NO: 171041 - protein, 6 aa, Mycobacterium bovis
DCRGSG

SEQ ID NO: 171042 - protein, 12 aa, Mycobacterium bovis
DCTNAASLQQQA

SEQ ID NO: 171043 - protein, 4 aa, Mycobacterium bovis
DDAA

SEQ ID NO: 171044 - protein, 7 aa, Mycobacterium bovis
DDAADLS

SEQ ID NO: 171045 - protein, 8 aa, Mycobacterium bovis
DDAARDGP

SEQ ID NO: 171046 - protein, 13 aa, Mycobacterium bovis
DDADAQAHPDRLE

SEQ ID NO: 171047 - protein, 7 aa, Mycobacterium bovis
DDADQTL

SEQ ID NO: 171048 - protein, 9 aa, Mycobacterium bovis
DDADRDCAA

SEQ ID NO: 171049 - protein, 7 aa, Mycobacterium bovis
DDADTPF

SEQ ID NO: 171050 - protein, 10 aa, Mycobacterium bovis
DDADTRAAVT

SEQ ID NO: 171051 - protein, 4 aa, Mycobacterium bovis
DDAG

SEQ ID NO: 171052 - protein, 8 aa, Mycobacterium bovis
DDAGAAVE

SEQ ID NO: 171053 - protein, 10 aa, Mycobacterium bovis
DDAGKASAMR

SEQ ID NO: 171054 - protein, 14 aa, Mycobacterium bovis
DDAHERQQRERYAQ

SEQ ID NO: 171055 - protein, 8 aa, Mycobacterium bovis
DDAPPPRL

SEQ ID NO: 171056 - protein, 10 aa, Mycobacterium bovis
DDAPYGGGPG

SEQ ID NO: 171057 - protein, 8 aa, Mycobacterium bovis
DDATAQRH

SEQ ID NO: 171058 - protein, 10 aa, Mycobacterium bovis
DDATSGNGDY

SEQ ID NO: 171059 - protein, 9 aa, Mycobacterium bovis
DDATYRPDL

SEQ ID NO: 171060 - protein, 5 aa, Mycobacterium bovis
DDAVD

SEQ ID NO: 171061 - protein, 17 aa, Mycobacterium bovis
DDAWDAPSPSALPAAQR

SEQ ID NO: 171062 - protein, 12 aa, Mycobacterium bovis
DDCPAPDDESDP

SEQ ID NO: 171063 - protein, 15 aa, Mycobacterium bovis
DDCRVPEGADAMGSG

SEQ ID NO: 171064 - protein, 4 aa, Mycobacterium bovis
DDDD

SEQ ID NO: 171065 - protein, 9 aa, Mycobacterium bovis
DDDELQNNT

SEQ ID NO: 171066 - protein, 14 aa, Mycobacterium bovis
DDDGGEVPHDGETV

SEQ ID NO: 171067 - protein, 6 aa, Mycobacterium bovis
DDDGNV

SEQ ID NO: 171068 - protein, 10 aa, Mycobacterium bovis
DDDGSKSSGK

SEQ ID NO: 171069 - protein, 8 aa, Mycobacterium bovis
DDDGTERK

SEQ ID NO: 171070 - protein, 7 aa, Mycobacterium bovis
DDDLDQA

SEQ ID NO: 171071 - protein, 4 aa, Mycobacterium bovis
DDDP

SEQ ID NO: 171072 - protein, 7 aa, Mycobacterium bovis
DDDPEDA

SEQ ID NO: 171073 - protein, 7 aa, Mycobacterium bovis
DDDPRFN

SEQ ID NO: 171074 - protein, 8 aa, Mycobacterium bovis
DDDPRQRL

SEQ ID NO: 171075 - protein, 8 aa, Mycobacterium bovis
DDDRPIPM

SEQ ID NO: 171076 - protein, 11 aa, Mycobacterium bovis
DDDRRPQDRSD

SEQ ID NO: 171077 - protein, 4 aa, Mycobacterium bovis
DDDT

SEQ ID NO: 171078 - protein, 9 aa, Mycobacterium bovis
DDDTDAETI

SEQ ID NO: 171079 - protein, 7 aa, Mycobacterium bovis
DDDTDKT

SEQ ID NO: 171080 - protein, 12 aa, Mycobacterium bovis
DDDYTGRPFSER

SEQ ID NO: 171081 - protein, 7 aa, Mycobacterium bovis
DDEAGLD

SEQ ID NO: 171082 - protein, 7 aa, Mycobacterium bovis
DDEAPAC

SEQ ID NO: 171083 - protein, 5 aa, Mycobacterium bovis
DDEAR

SEQ ID NO: 171084 - protein, 5 aa, Mycobacterium bovis
DDEDL

SEQ ID NO: 171085 - protein, 7 aa, Mycobacterium bovis
DDEEADH

SEQ ID NO: 171086 - protein, 8 aa, Mycobacterium bovis
DDEGYPKR

SEQ ID NO: 171087 - protein, 4 aa, Mycobacterium bovis
DDEH

SEQ ID NO: 171088 - protein, 6 aa, Mycobacterium bovis
DDEKPA

SEQ ID NO: 171089 - protein, 5 aa, Mycobacterium bovis
DDEMG

SEQ ID NO: 171090 - protein, 5 aa, Mycobacterium bovis
DDEPR

SEQ ID NO: 171091 - protein, 5 aa, Mycobacterium bovis
DDEPS

SEQ ID NO: 171092 - protein, 6 aa, Mycobacterium bovis
DDEQRK

SEQ ID NO: 171093 - protein, 11 aa, Mycobacterium bovis
DDEQRRLTGAG

SEQ ID NO: 171094 - protein, 6 aa, Mycobacterium bovis
DDERDP

SEQ ID NO: 171095 - protein, 5 aa, Mycobacterium bovis
DDETV

SEQ ID NO: 171096 - protein, 12 aa, Mycobacterium bovis
DDEVTMLKARYH

SEQ ID NO: 171097 - protein, 6 aa, Mycobacterium bovis
DDEWED

SEQ ID NO: 171098 - protein, 6 aa, Mycobacterium bovis
DDEWRR

SEQ ID NO: 171099 - protein, 5 aa, Mycobacterium bovis
DDEYR

SEQ ID NO: 171100 - protein, 19 aa, Mycobacterium bovis
DDEYYDDRAPSRGYARPRF

SEQ ID NO: 171101 - protein, 8 aa, Mycobacterium bovis
DDFGGGPT

SEQ ID NO: 171102 - protein, 5 aa, Mycobacterium bovis
DDGER

SEQ ID NO: 171103 - protein, 13 aa, Mycobacterium bovis
DDGETVTKRTRDA

SEQ ID NO: 171104 - protein, 5 aa, Mycobacterium bovis
DDGEV

SEQ ID NO: 171105 - protein, 5 aa, Mycobacterium bovis
DDGGL

SEQ ID NO: 171106 - protein, 8 aa, Mycobacterium bovis
DDGHAQDA

SEQ ID NO: 171107 - protein, 4 aa, Mycobacterium bovis
DDGL

SEQ ID NO: 171108 - protein, 12 aa, Mycobacterium bovis
DDGLAGVIDKIF

SEQ ID NO: 171109 - protein, 12 aa, Mycobacterium bovis
DDGNEVKPGSGM

SEQ ID NO: 171110 - protein, 8 aa, Mycobacterium bovis
DDGNVRPT

SEQ ID NO: 171111 - protein, 6 aa, Mycobacterium bovis
DDGPGL

SEQ ID NO: 171112 - protein, 6 aa, Mycobacterium bovis
DDGPIR

SEQ ID NO: 171113 - protein, 6 aa, Mycobacterium bovis
DDGQAY

SEQ ID NO: 171114 - protein, 8 aa, Mycobacterium bovis
DDGRPSQV

SEQ ID NO: 171115 - protein, 11 aa, Mycobacterium bovis
DDGRRAVDAGA

SEQ ID NO: 171116 - protein, 12 aa, Mycobacterium bovis
DDGSGETDEDQK

SEQ ID NO: 171117 - protein, 7 aa, Mycobacterium bovis
DDGTEIR

SEQ ID NO: 171118 - protein, 6 aa, Mycobacterium bovis
DDGTYV

SEQ ID NO: 171119 - protein, 4 aa, Mycobacterium bovis
DDGV

SEQ ID NO: 171120 - protein, 18 aa, Mycobacterium bovis
DDHPTHYSEPDAAAAGYP

SEQ ID NO: 171121 - protein, 6 aa, Mycobacterium bovis
DDHRRR

SEQ ID NO: 171122 - protein, 8 aa, Mycobacterium bovis
DDHSRTFN

SEQ ID NO: 171123 - protein, 5 aa, Mycobacterium bovis
DDIDA

SEQ ID NO: 171124 - protein, 4 aa, Mycobacterium bovis
DDIP

SEQ ID NO: 171125 - protein, 7 aa, Mycobacterium bovis
DDKESYR

SEQ ID NO: 171126 - protein, 5 aa, Mycobacterium bovis
DDKSY

SEQ ID NO: 171127 - protein, 6 aa, Mycobacterium bovis
DDKTDP

SEQ ID NO: 171128 - protein, 9 aa, Mycobacterium bovis
DDKYDGSQN

SEQ ID NO: 171129 - protein, 8 aa, Mycobacterium bovis
DDLAGAEE

SEQ ID NO: 171130 - protein, 10 aa, Mycobacterium bovis
DDLDDADDLA

SEQ ID NO: 171131 - protein, 18 aa, Mycobacterium bovis
DDLDDDDPTAVDGSESFN

SEQ ID NO: 171132 - protein, 5 aa, Mycobacterium bovis
DDMPE

SEQ ID NO: 171133 - protein, 10 aa, Mycobacterium bovis
DDNAKPANSH

SEQ ID NO: 171134 - protein, 7 aa, Mycobacterium bovis
DDNDLRN

SEQ ID NO: 171135 - protein, 6 aa, Mycobacterium bovis
DDNGEL

SEQ ID NO: 171136 - protein, 16 aa, Mycobacterium bovis
DDNPPALSLPPAAYTS

SEQ ID NO: 171137 - protein, 12 aa, Mycobacterium bovis
DDNPRDEDPTAI

SEQ ID NO: 171138 - protein, 8 aa, Mycobacterium bovis
DDNSPTFN

SEQ ID NO: 171139 - protein, 7 aa, Mycobacterium bovis
DDNTHTT

SEQ ID NO: 171140 - protein, 4 aa, Mycobacterium bovis
DDPA

SEQ ID NO: 171141 - protein, 17 aa, Mycobacterium bovis
DDPAAAQRRARAARQRL

SEQ ID NO: 171142 - protein, 6 aa, Mycobacterium bovis
DDPAAP

SEQ ID NO: 171143 - protein, 8 aa, Mycobacterium bovis
DDPADAEV

SEQ ID NO: 171144 - protein, 6 aa, Mycobacterium bovis
DDPADR

SEQ ID NO: 171145 - protein, 8 aa, Mycobacterium bovis
DDPAGFGP

SEQ ID NO: 171146 - protein, 5 aa, Mycobacterium bovis
DDPAL

SEQ ID NO: 171147 - protein, 6 aa, Mycobacterium bovis
DDPALT

SEQ ID NO: 171148 - protein, 7 aa, Mycobacterium bovis
DDPAQRI

SEQ ID NO: 171149 - protein, 5 aa, Mycobacterium bovis
DDPAR

SEQ ID NO: 171150 - protein, 5 aa, Mycobacterium bovis
DDPAV

SEQ ID NO: 171151 - protein, 6 aa, Mycobacterium bovis
DDPAYP

SEQ ID NO: 171152 - protein, 14 aa, Mycobacterium bovis
DDPDATPGVCRASR

SEQ ID NO: 171153 - protein, 6 aa, Mycobacterium bovis
DDPDDY

SEQ ID NO: 171154 - protein, 9 aa, Mycobacterium bovis
DDPDMPGTV

SEQ ID NO: 171155 - protein, 13 aa, Mycobacterium bovis
DDPGGAALAQRAT

SEQ ID NO: 171156 - protein, 8 aa, Mycobacterium bovis
DDPGGVTA

SEQ ID NO: 171157 - protein, 7 aa, Mycobacterium bovis
DDPGNTT

SEQ ID NO: 171158 - protein, 9 aa, Mycobacterium bovis
DDPGRGREL

SEQ ID NO: 171159 - protein, 8 aa, Mycobacterium bovis
DDPGSQAY

SEQ ID NO: 171160 - protein, 8 aa, Mycobacterium bovis
DDPGSSAR

SEQ ID NO: 171161 - protein, 7 aa, Mycobacterium bovis
DDPLSEE

SEQ ID NO: 171162 - protein, 27 aa, Mycobacterium bovis
DDPPEDPSGRDKRGKDGADSGSGANPL

SEQ ID NO: 171163 - protein, 13 aa, Mycobacterium bovis
DDPPPAGGAPIPS

SEQ ID NO: 171164 - protein, 17 aa, Mycobacterium bovis
DDPQPGWYDTESGEMVD

SEQ ID NO: 171165 - protein, 7 aa, Mycobacterium bovis
DDPRGLG

SEQ ID NO: 171166 - protein, 19 aa, Mycobacterium bovis
DDPRREDAAAAMKQAGARS

SEQ ID NO: 171167 - protein, 4 aa, Mycobacterium bovis
DDPS

SEQ ID NO: 171168 - protein, 9 aa, Mycobacterium bovis
DDPSGSTNV

SEQ ID NO: 171169 - protein, 5 aa, Mycobacterium bovis
DDPSL

SEQ ID NO: 171170 - protein, 8 aa, Mycobacterium bovis
DDPSTEVP

SEQ ID NO: 171171 - protein, 7 aa, Mycobacterium bovis
DDPSWTA

SEQ ID NO: 171172 - protein, 7 aa, Mycobacterium bovis
DDPTDES

SEQ ID NO: 171173 - protein, 5 aa, Mycobacterium bovis
DDPVA

SEQ ID NO: 171174 - protein, 6 aa, Mycobacterium bovis
DDPYPR

SEQ ID NO: 171175 - protein, 4 aa, Mycobacterium bovis
DDQA

SEQ ID NO: 171176 - protein, 10 aa, Mycobacterium bovis
DDQLSTEARG

SEQ ID NO: 171177 - protein, 15 aa, Mycobacterium bovis
DDQMEPASGFDPHPH

SEQ ID NO: 171178 - protein, 6 aa, Mycobacterium bovis
DDQQRE

SEQ ID NO: 171179 - protein, 4 aa, Mycobacterium bovis
DDQR

SEQ ID NO: 171180 - protein, 5 aa, Mycobacterium bovis
DDQRT

SEQ ID NO: 171181 - protein, 9 aa, Mycobacterium bovis
DDQTGSPTY

SEQ ID NO: 171182 - protein, 5 aa, Mycobacterium bovis
DDRAE

SEQ ID NO: 171183 - protein, 5 aa, Mycobacterium bovis
DDRAY

SEQ ID NO: 171184 - protein, 5 aa, Mycobacterium bovis
DDRES

SEQ ID NO: 171185 - protein, 10 aa, Mycobacterium bovis
DDRGGPDEDI

SEQ ID NO: 171186 - protein, 9 aa, Mycobacterium bovis
DDRKTTMAK

SEQ ID NO: 171187 - protein, 13 aa, Mycobacterium bovis
DDRPDSAGPMELP

SEQ ID NO: 171188 - protein, 20 aa, Mycobacterium bovis
DDRTAAQLSPAEKDAVSHRG

SEQ ID NO: 171189 - protein, 8 aa, Mycobacterium bovis
DDRTEFAA

SEQ ID NO: 171190 - protein, 10 aa, Mycobacterium bovis
DDSDAATEYQ

SEQ ID NO: 171191 - protein, 7 aa, Mycobacterium bovis
DDSETQV

SEQ ID NO: 171192 - protein, 10 aa, Mycobacterium bovis
DDSGDEAPAT

SEQ ID NO: 171193 - protein, 6 aa, Mycobacterium bovis
DDSGRI

SEQ ID NO: 171194 - protein, 8 aa, Mycobacterium bovis
DDSGVTGP

SEQ ID NO: 171195 - protein, 13 aa, Mycobacterium bovis
DDSLAEPRAPYPH

SEQ ID NO: 171196 - protein, 6 aa, Mycobacterium bovis
DDSPAD

SEQ ID NO: 171197 - protein, 8 aa, Mycobacterium bovis
DDSPGREG

SEQ ID NO: 171198 - protein, 7 aa, Mycobacterium bovis
DDSRRMT

SEQ ID NO: 171199 - protein, 6 aa, Mycobacterium bovis
DDSRVT

SEQ ID NO: 171200 - protein, 6 aa, Mycobacterium bovis
DDSSRQ

SEQ ID NO: 171201 - protein, 7 aa, Mycobacterium bovis
DDSTRAE

SEQ ID NO: 171202 - protein, 4 aa, Mycobacterium bovis
DDSV

SEQ ID NO: 171203 - protein, 6 aa, Mycobacterium bovis
DDSVPD

SEQ ID NO: 171204 - protein, 9 aa, Mycobacterium bovis
DDSVQPEQA

SEQ ID NO: 171205 - protein, 7 aa, Mycobacterium bovis
DDSYGQD

SEQ ID NO: 171206 - protein, 4 aa, Mycobacterium bovis
DDTA

SEQ ID NO: 171207 - protein, 10 aa, Mycobacterium bovis
DDTAESSLRG

SEQ ID NO: 171208 - protein, 11 aa, Mycobacterium bovis
DDTASRINPDL

SEQ ID NO: 171209 - protein, 5 aa, Mycobacterium bovis
DDTDR

SEQ ID NO: 171210 - protein, 5 aa, Mycobacterium bovis
DDTEV

SEQ ID NO: 171211 - protein, 10 aa, Mycobacterium bovis
DDTGALQPES

SEQ ID NO: 171212 - protein, 5 aa, Mycobacterium bovis
DDTGE

SEQ ID NO: 171213 - protein, 6 aa, Mycobacterium bovis
DDTLDE

SEQ ID NO: 171214 - protein, 7 aa, Mycobacterium bovis
DDTPEGF

SEQ ID NO: 171215 - protein, 6 aa, Mycobacterium bovis
DDTPQV

SEQ ID NO: 171216 - protein, 7 aa, Mycobacterium bovis
DDTSTVP

SEQ ID NO: 171217 - protein, 9 aa, Mycobacterium bovis
DDTTSSSTV

SEQ ID NO: 171218 - protein, 23 aa, Mycobacterium bovis
DDVAPDADDDLDSGDDEDHEDLE

SEQ ID NO: 171219 - protein, 7 aa, Mycobacterium bovis
DDVDGGL

SEQ ID NO: 171220 - protein, 4 aa, Mycobacterium bovis
DDVE

SEQ ID NO: 171221 - protein, 12 aa, Mycobacterium bovis
DDVGRDQFPDAD

SEQ ID NO: 171222 - protein, 6 aa, Mycobacterium bovis
DDVTPT

SEQ ID NO: 171223 - protein, 6 aa, Mycobacterium bovis
DDYGPD

SEQ ID NO: 171224 - protein, 45 aa, Mycobacterium bovis
DDYGRYDGRDYDDARSDSRGDLRGEPADYPPPGYRGGYADEPRFR

SEQ ID NO: 171225 - protein, 11 aa, Mycobacterium bovis
DDYTDPAPATT

SEQ ID NO: 171226 - protein, 6 aa, Mycobacterium bovis
DEAAAE

SEQ ID NO: 171227 - protein, 7 aa, Mycobacterium bovis
DEAAATL

SEQ ID NO: 171228 - protein, 12 aa, Mycobacterium bovis
DEAADKAAELAS

SEQ ID NO: 171229 - protein, 7 aa, Mycobacterium bovis
DEAAGQS

SEQ ID NO: 171230 - protein, 7 aa, Mycobacterium bovis
DEAETGV

SEQ ID NO: 171231 - protein, 4 aa, Mycobacterium bovis
DEAG

SEQ ID NO: 171232 - protein, 5 aa, Mycobacterium bovis
DEAGA

SEQ ID NO: 171233 - protein, 5 aa, Mycobacterium bovis
DEAGG

SEQ ID NO: 171234 - protein, 7 aa, Mycobacterium bovis
DEAGRAA

SEQ ID NO: 171235 - protein, 7 aa, Mycobacterium bovis
DEAISTG

SEQ ID NO: 171236 - protein, 6 aa, Mycobacterium bovis
DEANAA

SEQ ID NO: 171237 - protein, 5 aa, Mycobacterium bovis
DEANK

SEQ ID NO: 171238 - protein, 7 aa, Mycobacterium bovis
DEAPKVP

SEQ ID NO: 171239 - protein, 4 aa, Mycobacterium bovis
DEAQ

SEQ ID NO: 171240 - protein, 6 aa, Mycobacterium bovis
DEARQA

SEQ ID NO: 171241 - protein, 18 aa, Mycobacterium bovis
DEDAPGPIPDVPQPSSEE

SEQ ID NO: 171242 - protein, 8 aa, Mycobacterium bovis
DEDFAKPQ

SEQ ID NO: 171243 - protein, 13 aa, Mycobacterium bovis
DEDGDGSGPGELT

SEQ ID NO: 171244 - protein, 5 aa, Mycobacterium bovis
DEDGL

SEQ ID NO: 171245 - protein, 11 aa, Mycobacterium bovis
DEDLPSGDELG

SEQ ID NO: 171246 - protein, 7 aa, Mycobacterium bovis
DEDPAPR

SEQ ID NO: 171247 - protein, 8 aa, Mycobacterium bovis
DEDRRPLS

SEQ ID NO: 171248 - protein, 5 aa, Mycobacterium bovis
DEDSV

SEQ ID NO: 171249 - protein, 6 aa, Mycobacterium bovis
DEDTDE

SEQ ID NO: 171250 - protein, 6 aa, Mycobacterium bovis
DEEAEA

SEQ ID NO: 171251 - protein, 5 aa, Mycobacterium bovis
DEEDR

SEQ ID NO: 171252 - protein, 4 aa, Mycobacterium bovis
DEEE

SEQ ID NO: 171253 - protein, 79 aa, Mycobacterium bovis
DEEERRLTSAGDDAERSDEEERRLTSAGDDAERSDEEERRLTSAGDDAERSDEEERRLTSAGDDAERSDEEERRLTSAE

SEQ ID NO: 171254 - protein, 5 aa, Mycobacterium bovis
DEEKA

SEQ ID NO: 171255 - protein, 6 aa, Mycobacterium bovis
DEEQTE

SEQ ID NO: 171256 - protein, 7 aa, Mycobacterium bovis
DEESASE

SEQ ID NO: 171257 - protein, 4 aa, Mycobacterium bovis
DEET

SEQ ID NO: 171258 - protein, 17 aa, Mycobacterium bovis
DEETGKRVRISKRNGKD

SEQ ID NO: 171259 - protein, 7 aa, Mycobacterium bovis
DEFEDRD

SEQ ID NO: 171260 - protein, 7 aa, Mycobacterium bovis
DEFGEPY

SEQ ID NO: 171261 - protein, 6 aa, Mycobacterium bovis
DEFPND

SEQ ID NO: 171262 - protein, 11 aa, Mycobacterium bovis
DEGDSKIGRPR

SEQ ID NO: 171263 - protein, 7 aa, Mycobacterium bovis
DEGDSWA

SEQ ID NO: 171264 - protein, 14 aa, Mycobacterium bovis
DEGFTVGPKERKLG

SEQ ID NO: 171265 - protein, 9 aa, Mycobacterium bovis
DEGPRESSL

SEQ ID NO: 171266 - protein, 18 aa, Mycobacterium bovis
DEGRGTQPVLGMRATRRS

SEQ ID NO: 171267 - protein, 5 aa, Mycobacterium bovis
DEGRQ

SEQ ID NO: 171268 - protein, 8 aa, Mycobacterium bovis
DEGTAAAE

SEQ ID NO: 171269 - protein, 6 aa, Mycobacterium bovis
DEGVAQ

SEQ ID NO: 171270 - protein, 8 aa, Mycobacterium bovis
DEHADPKV

SEQ ID NO: 171271 - protein, 11 aa, Mycobacterium bovis
DEHDPGGAATP

SEQ ID NO: 171272 - protein, 5 aa, Mycobacterium bovis
DEHPG

SEQ ID NO: 171273 - protein, 7 aa, Mycobacterium bovis
DEHRRHR

SEQ ID NO: 171274 - protein, 20 aa, Mycobacterium bovis
DEIASSRAAIASRKRDPRLH

SEQ ID NO: 171275 - protein, 9 aa, Mycobacterium bovis
DEIGTSGGK

SEQ ID NO: 171276 - protein, 7 aa, Mycobacterium bovis
DEIPEHG

SEQ ID NO: 171277 - protein, 6 aa, Mycobacterium bovis
DEIRDG

SEQ ID NO: 171278 - protein, 6 aa, Mycobacterium bovis
DEKGTL

SEQ ID NO: 171279 - protein, 10 aa, Mycobacterium bovis
DEKPDAESYV

SEQ ID NO: 171280 - protein, 13 aa, Mycobacterium bovis
DEKSGGRSGHYRR

SEQ ID NO: 171281 - protein, 4 aa, Mycobacterium bovis
DEKV

SEQ ID NO: 171282 - protein, 4 aa, Mycobacterium bovis
DEKW

SEQ ID NO: 171283 - protein, 4 aa, Mycobacterium bovis
DELE

SEQ ID NO: 171284 - protein, 7 aa, Mycobacterium bovis
DELGRSN

SEQ ID NO: 171285 - protein, 6 aa, Mycobacterium bovis
DELPAK

SEQ ID NO: 171286 - protein, 5 aa, Mycobacterium bovis
DELTE

SEQ ID NO: 171287 - protein, 8 aa, Mycobacterium bovis
DEMASPQR

SEQ ID NO: 171288 - protein, 6 aa, Mycobacterium bovis
DENEDA

SEQ ID NO: 171289 - protein, 5 aa, Mycobacterium bovis
DENGG

SEQ ID NO: 171290 - protein, 9 aa, Mycobacterium bovis
DENGGYPHP

SEQ ID NO: 171291 - protein, 14 aa, Mycobacterium bovis
DENQPPGSRDIPDN

SEQ ID NO: 171292 - protein, 4 aa, Mycobacterium bovis
DENR

SEQ ID NO: 171293 - protein, 4 aa, Mycobacterium bovis
DENS

SEQ ID NO: 171294 - protein, 18 aa, Mycobacterium bovis
DEPADAAKVGASAAYGRY

SEQ ID NO: 171295 - protein, 9 aa, Mycobacterium bovis
DEPALTASD

SEQ ID NO: 171296 - protein, 8 aa, Mycobacterium bovis
DEPDEAAP

SEQ ID NO: 171297 - protein, 6 aa, Mycobacterium bovis
DEPDPV

SEQ ID NO: 171298 - protein, 7 aa, Mycobacterium bovis
DEPDPVT

SEQ ID NO: 171299 - protein, 6 aa, Mycobacterium bovis
DEPEAQ

SEQ ID NO: 171300 - protein, 6 aa, Mycobacterium bovis
DEPEDV

SEQ ID NO: 171301 - protein, 11 aa, Mycobacterium bovis
DEPEPAQPTLT

SEQ ID NO: 171302 - protein, 4 aa, Mycobacterium bovis
DEPG

SEQ ID NO: 171303 - protein, 7 aa, Mycobacterium bovis
DEPGYGE

SEQ ID NO: 171304 - protein, 4 aa, Mycobacterium bovis
DEPL

SEQ ID NO: 171305 - protein, 7 aa, Mycobacterium bovis
DEPLEGG

SEQ ID NO: 171306 - protein, 7 aa, Mycobacterium bovis
DEPNCAG

SEQ ID NO: 171307 - protein, 7 aa, Mycobacterium bovis
DEPPGTR

SEQ ID NO: 171308 - protein, 6 aa, Mycobacterium bovis
DEPRKG

SEQ ID NO: 171309 - protein, 8 aa, Mycobacterium bovis
DEPRRAGV

SEQ ID NO: 171310 - protein, 6 aa, Mycobacterium bovis
DEPSAI

SEQ ID NO: 171311 - protein, 8 aa, Mycobacterium bovis
DEPSPRVD

SEQ ID NO: 171312 - protein, 4 aa, Mycobacterium bovis
DEPT

SEQ ID NO: 171313 - protein, 6 aa, Mycobacterium bovis
DEPVGE

SEQ ID NO: 171314 - protein, 8 aa, Mycobacterium bovis
DEQPGLAP

SEQ ID NO: 171315 - protein, 6 aa, Mycobacterium bovis
DEQRRA

SEQ ID NO: 171316 - protein, 7 aa, Mycobacterium bovis
DEQRTEL

SEQ ID NO: 171317 - protein, 10 aa, Mycobacterium bovis
DEQTQGNYSD

SEQ ID NO: 171318 - protein, 9 aa, Mycobacterium bovis
DEQVQASAE

SEQ ID NO: 171319 - protein, 4 aa, Mycobacterium bovis
DERA

SEQ ID NO: 171320 - protein, 6 aa, Mycobacterium bovis
DERASQ

SEQ ID NO: 171321 - protein, 7 aa, Mycobacterium bovis
DEREGNS

SEQ ID NO: 171322 - protein, 4 aa, Mycobacterium bovis
DERG

SEQ ID NO: 171323 - protein, 7 aa, Mycobacterium bovis
DERGGSV

SEQ ID NO: 171324 - protein, 5 aa, Mycobacterium bovis
DERGL

SEQ ID NO: 171325 - protein, 64 aa, Mycobacterium bovis
DERGQEVRDPADYEHSNEPDERRADDREGADEDAGLGKSESPPQAPTTVTLPNGETVTAASPQL

SEQ ID NO: 171326 - protein, 6 aa, Mycobacterium bovis
DERNGG

SEQ ID NO: 171327 - protein, 7 aa, Mycobacterium bovis
DERPEQL

SEQ ID NO: 171328 - protein, 5 aa, Mycobacterium bovis
DERRV

SEQ ID NO: 171329 - protein, 4 aa, Mycobacterium bovis
DERT

SEQ ID NO: 171330 - protein, 7 aa, Mycobacterium bovis
DERTRTL

SEQ ID NO: 171331 - protein, 10 aa, Mycobacterium bovis
DERTSWAPDE

SEQ ID NO: 171332 - protein, 7 aa, Mycobacterium bovis
DERTVAP

SEQ ID NO: 171333 - protein, 8 aa, Mycobacterium bovis
DESASATV

SEQ ID NO: 171334 - protein, 16 aa, Mycobacterium bovis
DESDEEATTAVREDEV

SEQ ID NO: 171335 - protein, 22 aa, Mycobacterium bovis
DESEALRQARKDAELTASADSV

SEQ ID NO: 171336 - protein, 8 aa, Mycobacterium bovis
DESEPGTC

SEQ ID NO: 171337 - protein, 10 aa, Mycobacterium bovis
DESESAESFE

SEQ ID NO: 171338 - protein, 4 aa, Mycobacterium bovis
DESF

SEQ ID NO: 171339 - protein, 15 aa, Mycobacterium bovis
DESGRKMSKSKGNVI

SEQ ID NO: 171340 - protein, 8 aa, Mycobacterium bovis
DESGTTDN

SEQ ID NO: 171341 - protein, 5 aa, Mycobacterium bovis
DESPF

SEQ ID NO: 171342 - protein, 10 aa, Mycobacterium bovis
DESQPDSPLQ

SEQ ID NO: 171343 - protein, 7 aa, Mycobacterium bovis
DESQTAA

SEQ ID NO: 171344 - protein, 7 aa, Mycobacterium bovis
DESQTGA

SEQ ID NO: 171345 - protein, 7 aa, Mycobacterium bovis
DESSGTI

SEQ ID NO: 171346 - protein, 6 aa, Mycobacterium bovis
DESSPN

SEQ ID NO: 171347 - protein, 9 aa, Mycobacterium bovis
DESSYSTGA

SEQ ID NO: 171348 - protein, 7 aa, Mycobacterium bovis
DESTLRR

SEQ ID NO: 171349 - protein, 7 aa, Mycobacterium bovis
DETDEAR

SEQ ID NO: 171350 - protein, 7 aa, Mycobacterium bovis
DETDPTV

SEQ ID NO: 171351 - protein, 8 aa, Mycobacterium bovis
DETERRRA

SEQ ID NO: 171352 - protein, 7 aa, Mycobacterium bovis
DETSRTF

SEQ ID NO: 171353 - protein, 16 aa, Mycobacterium bovis
DETTIVEGAGDTDAIA

SEQ ID NO: 171354 - protein, 14 aa, Mycobacterium bovis
DETTRHTLSGGTEQ

SEQ ID NO: 171355 - protein, 10 aa, Mycobacterium bovis
DEVSRPGSDR

SEQ ID NO: 171356 - protein, 14 aa, Mycobacterium bovis
DEVTNSTDGRADGR

SEQ ID NO: 171357 - protein, 4 aa, Mycobacterium bovis
DEYN

SEQ ID NO: 171358 - protein, 7 aa, Mycobacterium bovis
DFDGDDV

SEQ ID NO: 171359 - protein, 7 aa, Mycobacterium bovis
DFDPAGK

SEQ ID NO: 171360 - protein, 11 aa, Mycobacterium bovis
DFGRGSGHPAG

SEQ ID NO: 171361 - protein, 5 aa, Mycobacterium bovis
DFKRP

SEQ ID NO: 171362 - protein, 7 aa, Mycobacterium bovis
DFNPDRY

SEQ ID NO: 171363 - protein, 7 aa, Mycobacterium bovis
DFPDRPD

SEQ ID NO: 171364 - protein, 11 aa, Mycobacterium bovis
DFSKNSGRSEL

SEQ ID NO: 171365 - protein, 8 aa, Mycobacterium bovis
DFTADGTI

SEQ ID NO: 171366 - protein, 4 aa, Mycobacterium bovis
DFTS

SEQ ID NO: 171367 - protein, 4 aa, Mycobacterium bovis
DGAA

SEQ ID NO: 171368 - protein, 8 aa, Mycobacterium bovis
DGAAEDEL

SEQ ID NO: 171369 - protein, 9 aa, Mycobacterium bovis
DGAAESDLA

SEQ ID NO: 171370 - protein, 8 aa, Mycobacterium bovis
DGAASITR

SEQ ID NO: 171371 - protein, 7 aa, Mycobacterium bovis
DGAASPV

SEQ ID NO: 171372 - protein, 16 aa, Mycobacterium bovis
DGADGTAPGQNGGAGG

SEQ ID NO: 171373 - protein, 5 aa, Mycobacterium bovis
DGADI

SEQ ID NO: 171374 - protein, 5 aa, Mycobacterium bovis
DGADP

SEQ ID NO: 171375 - protein, 5 aa, Mycobacterium bovis
DGADV

SEQ ID NO: 171376 - protein, 15 aa, Mycobacterium bovis
DGAEALRSATENRPD

SEQ ID NO: 171377 - protein, 7 aa, Mycobacterium bovis
DGAEGWT

SEQ ID NO: 171378 - protein, 9 aa, Mycobacterium bovis
DGAEPDSEE

SEQ ID NO: 171379 - protein, 4 aa, Mycobacterium bovis
DGAG

SEQ ID NO: 171380 - protein, 8 aa, Mycobacterium bovis
DGAGDAGF

SEQ ID NO: 171381 - protein, 10 aa, Mycobacterium bovis
DGAGERARTA

SEQ ID NO: 171382 - protein, 7 aa, Mycobacterium bovis
DGAGTAA

SEQ ID NO: 171383 - protein, 16 aa, Mycobacterium bovis
DGAHGAPGTGQAGGAG

SEQ ID NO: 171384 - protein, 10 aa, Mycobacterium bovis
DGAKDSEFPP

SEQ ID NO: 171385 - protein, 4 aa, Mycobacterium bovis
DGAL

SEQ ID NO: 171386 - protein, 16 aa, Mycobacterium bovis
DGANATTPGGAGGDGG

SEQ ID NO: 171387 - protein, 13 aa, Mycobacterium bovis
DGANFDKPPSVQD

SEQ ID NO: 171388 - protein, 15 aa, Mycobacterium bovis
DGANGGPGQNGGDGG

SEQ ID NO: 171389 - protein, 6 aa, Mycobacterium bovis
DGANGL

SEQ ID NO: 171390 - protein, 7 aa, Mycobacterium bovis
DGANKIR

SEQ ID NO: 171391 - protein, 4 aa, Mycobacterium bovis
DGAP

SEQ ID NO: 171392 - protein, 5 aa, Mycobacterium bovis
DGAPA

SEQ ID NO: 171393 - protein, 8 aa, Mycobacterium bovis
DGAPDMGP

SEQ ID NO: 171394 - protein, 8 aa, Mycobacterium bovis
DGAPGPDM

SEQ ID NO: 171395 - protein, 10 aa, Mycobacterium bovis
DGAPMGPDEY

SEQ ID NO: 171396 - protein, 10 aa, Mycobacterium bovis
DGAPQRPAKP

SEQ ID NO: 171397 - protein, 12 aa, Mycobacterium bovis
DGAPTKPARAGW

SEQ ID NO: 171398 - protein, 8 aa, Mycobacterium bovis
DGAQATAP

SEQ ID NO: 171399 - protein, 26 aa, Mycobacterium bovis
DGAQERSAAAAAGADEWHDPRTDQKL

SEQ ID NO: 171400 - protein, 7 aa, Mycobacterium bovis
DGARPHR

SEQ ID NO: 171401 - protein, 9 aa, Mycobacterium bovis
DGARVPPGE

SEQ ID NO: 171402 - protein, 16 aa, Mycobacterium bovis
DGASREVTRDGTPISL

SEQ ID NO: 171403 - protein, 7 aa, Mycobacterium bovis
DGASYQR

SEQ ID NO: 171404 - protein, 7 aa, Mycobacterium bovis
DGATRDV

SEQ ID NO: 171405 - protein, 9 aa, Mycobacterium bovis
DGATSEGDV

SEQ ID NO: 171406 - protein, 10 aa, Mycobacterium bovis
DGAYGEAKSA

SEQ ID NO: 171407 - protein, 9 aa, Mycobacterium bovis
DGAYTGAGT

SEQ ID NO: 171408 - protein, 5 aa, Mycobacterium bovis
DGCAT

SEQ ID NO: 171409 - protein, 17 aa, Mycobacterium bovis
DGCDAEAGSGPPFFHVK

SEQ ID NO: 171410 - protein, 8 aa, Mycobacterium bovis
DGCGDSPV

SEQ ID NO: 171411 - protein, 12 aa, Mycobacterium bovis
DGDAADAAATKI

SEQ ID NO: 171412 - protein, 7 aa, Mycobacterium bovis
DGDAARD

SEQ ID NO: 171413 - protein, 7 aa, Mycobacterium bovis
DGDALSI

SEQ ID NO: 171414 - protein, 37 aa, Mycobacterium bovis
DGDAPIPADSGPPVGPEGLTPTQLASDANEERLREER

SEQ ID NO: 171415 - protein, 12 aa, Mycobacterium bovis
DGDARPDHQGSA

SEQ ID NO: 171416 - protein, 10 aa, Mycobacterium bovis
DGDATRRGRP

SEQ ID NO: 171417 - protein, 7 aa, Mycobacterium bovis
DGDDDAV

SEQ ID NO: 171418 - protein, 4 aa, Mycobacterium bovis
DGDE

SEQ ID NO: 171419 - protein, 12 aa, Mycobacterium bovis
DGDGLDPDTANW

SEQ ID NO: 171420 - protein, 18 aa, Mycobacterium bovis
DGDGPLHRSGVDKSRAEA

SEQ ID NO: 171421 - protein, 8 aa, Mycobacterium bovis
DGDGQAVG

SEQ ID NO: 171422 - protein, 6 aa, Mycobacterium bovis
DGDGRL

SEQ ID NO: 171423 - protein, 17 aa, Mycobacterium bovis
DGDGSRGGVDSTTPGAV

SEQ ID NO: 171424 - protein, 6 aa, Mycobacterium bovis
DGDGTQ

SEQ ID NO: 171425 - protein, 5 aa, Mycobacterium bovis
DGDHS

SEQ ID NO: 171426 - protein, 4 aa, Mycobacterium bovis
DGDL

SEQ ID NO: 171427 - protein, 4 aa, Mycobacterium bovis
DGDP

SEQ ID NO: 171428 - protein, 7 aa, Mycobacterium bovis
DGDPERE

SEQ ID NO: 171429 - protein, 8 aa, Mycobacterium bovis
DGDPKDVS

SEQ ID NO: 171430 - protein, 11 aa, Mycobacterium bovis
DGDQQARGRPI

SEQ ID NO: 171431 - protein, 8 aa, Mycobacterium bovis
DGDREGEA

SEQ ID NO: 171432 - protein, 5 aa, Mycobacterium bovis
DGDRF

SEQ ID NO: 171433 - protein, 7 aa, Mycobacterium bovis
DGDRLSD

SEQ ID NO: 171434 - protein, 7 aa, Mycobacterium bovis
DGDTASS

SEQ ID NO: 171435 - protein, 5 aa, Mycobacterium bovis
DGDTE

SEQ ID NO: 171436 - protein, 8 aa, Mycobacterium bovis
DGDTGTVA

SEQ ID NO: 171437 - protein, 16 aa, Mycobacterium bovis
DGDTLTVTPPSWRPDL

SEQ ID NO: 171438 - protein, 4 aa, Mycobacterium bovis
DGDV

SEQ ID NO: 171439 - protein, 5 aa, Mycobacterium bovis
DGDWA

SEQ ID NO: 171440 - protein, 8 aa, Mycobacterium bovis
DGEAAARA

SEQ ID NO: 171441 - protein, 6 aa, Mycobacterium bovis
DGEAAR

SEQ ID NO: 171442 - protein, 8 aa, Mycobacterium bovis
DGEALARQ

SEQ ID NO: 171443 - protein, 5 aa, Mycobacterium bovis
DGEAR

SEQ ID NO: 171444 - protein, 8 aa, Mycobacterium bovis
DGEDGEPQ

SEQ ID NO: 171445 - protein, 8 aa, Mycobacterium bovis
DGEEPDPG

SEQ ID NO: 171446 - protein, 8 aa, Mycobacterium bovis
DGEGPGHQ

SEQ ID NO: 171447 - protein, 8 aa, Mycobacterium bovis
DGEKLSDD

SEQ ID NO: 171448 - protein, 8 aa, Mycobacterium bovis
DGEKQRVA

SEQ ID NO: 171449 - protein, 10 aa, Mycobacterium bovis
DGELAPETKI

SEQ ID NO: 171450 - protein, 5 aa, Mycobacterium bovis
DGEMD

SEQ ID NO: 171451 - protein, 9 aa, Mycobacterium bovis
DGEPDPSAQ

SEQ ID NO: 171452 - protein, 7 aa, Mycobacterium bovis
DGEPTAH

SEQ ID NO: 171453 - protein, 11 aa, Mycobacterium bovis
DGEPVGPGEEG

SEQ ID NO: 171454 - protein, 9 aa, Mycobacterium bovis
DGERNGLDA

SEQ ID NO: 171455 - protein, 4 aa, Mycobacterium bovis
DGET

SEQ ID NO: 171456 - protein, 6 aa, Mycobacterium bovis
DGETTA

SEQ ID NO: 171457 - protein, 47 aa, Mycobacterium bovis
DGFDGGSGGAGGDGGAGGAGGTQTGDGGDGGAGGLGGAGGVGGNGVD

SEQ ID NO: 171458 - protein, 6 aa, Mycobacterium bovis
DGFGTV

SEQ ID NO: 171459 - protein, 20 aa, Mycobacterium bovis
DGGAGGAALSAGSAGRGGDA

SEQ ID NO: 171460 - protein, 30 aa, Mycobacterium bovis
DGGAGGAGAAGGPGTPDGAAGPGGSGGTGG

SEQ ID NO: 171461 - protein, 72 aa, Mycobacterium bovis
DGGAGGAGGIGGAGGVGGGGGAGGTGGGGVASAFGGGNAFGGRGGDGGDGGDGGTGGAGGARGAGGAGGAGG

SEQ ID NO: 171462 - protein, 30 aa, Mycobacterium bovis
DGGAGGAGGNGSNGVTGVHGGNGGAGGAAG

SEQ ID NO: 171463 - protein, 24 aa, Mycobacterium bovis
DGGAGGAGGVGSTTGGAGGAGGNA

SEQ ID NO: 171464 - protein, 13 aa, Mycobacterium bovis
DGGAGGHGGQGAI

SEQ ID NO: 171465 - protein, 86 aa, Mycobacterium bovis
DGGAGGHGGQGGTGVSSGGNGGAGGTGGDGRGLSGSGGAGGHGGQTGVGGKVGENNFGGAGGAGGTGGLIGNGGAGGTGGKGGDGF

SEQ ID NO: 171466 - protein, 12 aa, Mycobacterium bovis
DGGAGGQGGPAV

SEQ ID NO: 171467 - protein, 14 aa, Mycobacterium bovis
DGGAQPSRVGGRTI

SEQ ID NO: 171468 - protein, 7 aa, Mycobacterium bovis
DGGATHA

SEQ ID NO: 171469 - protein, 17 aa, Mycobacterium bovis
DGGATVDGTSGAMAGPG

SEQ ID NO: 171470 - protein, 4 aa, Mycobacterium bovis
DGGD

SEQ ID NO: 171471 - protein, 9 aa, Mycobacterium bovis
DGGDPKGAL

SEQ ID NO: 171472 - protein, 9 aa, Mycobacterium bovis
DGGEEREDL

SEQ ID NO: 171473 - protein, 14 aa, Mycobacterium bovis
DGGEIRNGSDLPRI

SEQ ID NO: 171474 - protein, 13 aa, Mycobacterium bovis
DGGGGGDGGNGGL

SEQ ID NO: 171475 - protein, 6 aa, Mycobacterium bovis
DGGGLV

SEQ ID NO: 171476 - protein, 8 aa, Mycobacterium bovis
DGGHDPRR

SEQ ID NO: 171477 - protein, 7 aa, Mycobacterium bovis
DGGLTRP

SEQ ID NO: 171478 - protein, 60 aa, Mycobacterium bovis
DGGNGGAGGAGGIGGTGASGGAGGKGGSGLVGGDGGNGGAGGAGGNGGKGGAGGAGGGAG

SEQ ID NO: 171479 - protein, 60 aa, Mycobacterium bovis
DGGNGGDGGAGGRGGDGGAGGAGGDAPAGRAGSQGVGGDGGAGGAGGAPGNGGSGGRGDM

SEQ ID NO: 171480 - protein, 7 aa, Mycobacterium bovis
DGGPTAG

SEQ ID NO: 171481 - protein, 4 aa, Mycobacterium bovis
DGGR

SEQ ID NO: 171482 - protein, 5 aa, Mycobacterium bovis
DGGRG

SEQ ID NO: 171483 - protein, 4 aa, Mycobacterium bovis
DGGS

SEQ ID NO: 171484 - protein, 4 aa, Mycobacterium bovis
DGGT

SEQ ID NO: 171485 - protein, 8 aa, Mycobacterium bovis
DGGTESVT

SEQ ID NO: 171486 - protein, 5 aa, Mycobacterium bovis
DGGTL

SEQ ID NO: 171487 - protein, 7 aa, Mycobacterium bovis
DGGTRPY

SEQ ID NO: 171488 - protein, 4 aa, Mycobacterium bovis
DGGV

SEQ ID NO: 171489 - protein, 17 aa, Mycobacterium bovis
DGGVMTGADAAKISDRA

SEQ ID NO: 171490 - protein, 8 aa, Mycobacterium bovis
DGGVPQTQ

SEQ ID NO: 171491 - protein, 7 aa, Mycobacterium bovis
DGGYTQS

SEQ ID NO: 171492 - protein, 5 aa, Mycobacterium bovis
DGHDA

SEQ ID NO: 171493 - protein, 5 aa, Mycobacterium bovis
DGHDQ

SEQ ID NO: 171494 - protein, 9 aa, Mycobacterium bovis
DGHGETVSR

SEQ ID NO: 171495 - protein, 8 aa, Mycobacterium bovis
DGHGGSVE

SEQ ID NO: 171496 - protein, 4 aa, Mycobacterium bovis
DGHP

SEQ ID NO: 171497 - protein, 18 aa, Mycobacterium bovis
DGHRGRRRAARAGSAPAH

SEQ ID NO: 171498 - protein, 6 aa, Mycobacterium bovis
DGIAAG

SEQ ID NO: 171499 - protein, 12 aa, Mycobacterium bovis
DGIAGVEQIVEK

SEQ ID NO: 171500 - protein, 16 aa, Mycobacterium bovis
DGIGPTAPGAGPSASF

SEQ ID NO: 171501 - protein, 8 aa, Mycobacterium bovis
DGIPPPNS

SEQ ID NO: 171502 - protein, 5 aa, Mycobacterium bovis
DGIPS

SEQ ID NO: 171503 - protein, 5 aa, Mycobacterium bovis
DGIQA

SEQ ID NO: 171504 - protein, 5 aa, Mycobacterium bovis
DGITR

SEQ ID NO: 171505 - protein, 10 aa, Mycobacterium bovis
DGKNGEHREM

SEQ ID NO: 171506 - protein, 5 aa, Mycobacterium bovis
DGKPV

SEQ ID NO: 171507 - protein, 7 aa, Mycobacterium bovis
DGKPVTR

SEQ ID NO: 171508 - protein, 7 aa, Mycobacterium bovis
DGKRSGL

SEQ ID NO: 171509 - protein, 8 aa, Mycobacterium bovis
DGKRSYAA

SEQ ID NO: 171510 - protein, 20 aa, Mycobacterium bovis
DGKRTTRTPAESDTERIEEA

SEQ ID NO: 171511 - protein, 14 aa, Mycobacterium bovis
DGKTVEAEAAHGTV

SEQ ID NO: 171512 - protein, 7 aa, Mycobacterium bovis
DGKWTDS

SEQ ID NO: 171513 - protein, 12 aa, Mycobacterium bovis
DGLDELTTTTTS

SEQ ID NO: 171514 - protein, 13 aa, Mycobacterium bovis
DGLSGYPNRHESP

SEQ ID NO: 171515 - protein, 6 aa, Mycobacterium bovis
DGLSPL

SEQ ID NO: 171516 - protein, 8 aa, Mycobacterium bovis
DGLTTRAR

SEQ ID NO: 171517 - protein, 4 aa, Mycobacterium bovis
DGMG

SEQ ID NO: 171518 - protein, 5 aa, Mycobacterium bovis
DGMHG

SEQ ID NO: 171519 - protein, 10 aa, Mycobacterium bovis
DGNAAASYTK

SEQ ID NO: 171520 - protein, 18 aa, Mycobacterium bovis
DGNAFGSVPTVDDIRGLL

SEQ ID NO: 171521 - protein, 10 aa, Mycobacterium bovis
DGNDGLQAGR

SEQ ID NO: 171522 - protein, 13 aa, Mycobacterium bovis
DGNGAPGERTFRS

SEQ ID NO: 171523 - protein, 6 aa, Mycobacterium bovis
DGNITS

SEQ ID NO: 171524 - protein, 4 aa, Mycobacterium bovis
DGNL

SEQ ID NO: 171525 - protein, 7 aa, Mycobacterium bovis
DGNPVGE

SEQ ID NO: 171526 - protein, 4 aa, Mycobacterium bovis
DGNQ

SEQ ID NO: 171527 - protein, 4 aa, Mycobacterium bovis
DGNT

SEQ ID NO: 171528 - protein, 4 aa, Mycobacterium bovis
DGPA

SEQ ID NO: 171529 - protein, 7 aa, Mycobacterium bovis
DGPAGHW

SEQ ID NO: 171530 - protein, 8 aa, Mycobacterium bovis
DGPAGPIG

SEQ ID NO: 171531 - protein, 14 aa, Mycobacterium bovis
DGPAGTGKSSVSRR

SEQ ID NO: 171532 - protein, 7 aa, Mycobacterium bovis
DGPAGTV

SEQ ID NO: 171533 - protein, 9 aa, Mycobacterium bovis
DGPAPEPVK

SEQ ID NO: 171534 - protein, 5 aa, Mycobacterium bovis
DGPAS

SEQ ID NO: 171535 - protein, 12 aa, Mycobacterium bovis
DGPATDPVVTDD

SEQ ID NO: 171536 - protein, 8 aa, Mycobacterium bovis
DGPDPECV

SEQ ID NO: 171537 - protein, 7 aa, Mycobacterium bovis
DGPDYDL

SEQ ID NO: 171538 - protein, 22 aa, Mycobacterium bovis
DGPENPRATHSSTGARLQTHGD

SEQ ID NO: 171539 - protein, 18 aa, Mycobacterium bovis
DGPEQREVGQSAHAGRTP

SEQ ID NO: 171540 - protein, 8 aa, Mycobacterium bovis
DGPGAGYD

SEQ ID NO: 171541 - protein, 7 aa, Mycobacterium bovis
DGPGPGE

SEQ ID NO: 171542 - protein, 7 aa, Mycobacterium bovis
DGPGTQL

SEQ ID NO: 171543 - protein, 11 aa, Mycobacterium bovis
DGPHDRAEPTT

SEQ ID NO: 171544 - protein, 15 aa, Mycobacterium bovis
DGPHRRREGRPGAAQ

SEQ ID NO: 171545 - protein, 4 aa, Mycobacterium bovis
DGPI

SEQ ID NO: 171546 - protein, 7 aa, Mycobacterium bovis
DGPMPQT

SEQ ID NO: 171547 - protein, 8 aa, Mycobacterium bovis
DGPNGPVA

SEQ ID NO: 171548 - protein, 7 aa, Mycobacterium bovis
DGPPVPD

SEQ ID NO: 171549 - protein, 4 aa, Mycobacterium bovis
DGPQ

SEQ ID NO: 171550 - protein, 5 aa, Mycobacterium bovis
DGPQH

SEQ ID NO: 171551 - protein, 7 aa, Mycobacterium bovis
DGPRDAQ

SEQ ID NO: 171552 - protein, 24 aa, Mycobacterium bovis
DGPTPPPPGAPHPSGGADGPYSDP

SEQ ID NO: 171553 - protein, 5 aa, Mycobacterium bovis
DGPVR

SEQ ID NO: 171554 - protein, 8 aa, Mycobacterium bovis
DGPVRGNG

SEQ ID NO: 171555 - protein, 5 aa, Mycobacterium bovis
DGPVT

SEQ ID NO: 171556 - protein, 4 aa, Mycobacterium bovis
DGQA

SEQ ID NO: 171557 - protein, 10 aa, Mycobacterium bovis
DGQAHAGAAD

SEQ ID NO: 171558 - protein, 9 aa, Mycobacterium bovis
DGQAKSAKD

SEQ ID NO: 171559 - protein, 9 aa, Mycobacterium bovis
DGQEQRAQG

SEQ ID NO: 171560 - protein, 4 aa, Mycobacterium bovis
DGQL

SEQ ID NO: 171561 - protein, 22 aa, Mycobacterium bovis
DGQLAGSMSTDDANPDGQNSAN

SEQ ID NO: 171562 - protein, 7 aa, Mycobacterium bovis
DGQPGEV

SEQ ID NO: 171563 - protein, 7 aa, Mycobacterium bovis
DGQPLGR

SEQ ID NO: 171564 - protein, 7 aa, Mycobacterium bovis
DGQPRTL

SEQ ID NO: 171565 - protein, 8 aa, Mycobacterium bovis
DGQPRTLD

SEQ ID NO: 171566 - protein, 20 aa, Mycobacterium bovis
DGQPSWSGKPEVAATTEARA

SEQ ID NO: 171567 - protein, 8 aa, Mycobacterium bovis
DGQQRGSG

SEQ ID NO: 171568 - protein, 4 aa, Mycobacterium bovis
DGQR

SEQ ID NO: 171569 - protein, 20 aa, Mycobacterium bovis
DGQRPRRGPRPRERRPASPS

SEQ ID NO: 171570 - protein, 5 aa, Mycobacterium bovis
DGQTV

SEQ ID NO: 171571 - protein, 9 aa, Mycobacterium bovis
DGRAPNGEQ

SEQ ID NO: 171572 - protein, 5 aa, Mycobacterium bovis
DGRAS

SEQ ID NO: 171573 - protein, 7 aa, Mycobacterium bovis
DGRCVPG

SEQ ID NO: 171574 - protein, 7 aa, Mycobacterium bovis
DGRDGQT

SEQ ID NO: 171575 - protein, 8 aa, Mycobacterium bovis
DGREPPAL

SEQ ID NO: 171576 - protein, 7 aa, Mycobacterium bovis
DGRGART

SEQ ID NO: 171577 - protein, 10 aa, Mycobacterium bovis
DGRGGAGGGM

SEQ ID NO: 171578 - protein, 11 aa, Mycobacterium bovis
DGRGPGTPPAT

SEQ ID NO: 171579 - protein, 10 aa, Mycobacterium bovis
DGRGPPERGS

SEQ ID NO: 171580 - protein, 23 aa, Mycobacterium bovis
DGRHTTESSFEHSSPSRSPQSDD

SEQ ID NO: 171581 - protein, 4 aa, Mycobacterium bovis
DGRI

SEQ ID NO: 171582 - protein, 8 aa, Mycobacterium bovis
DGRKGGLI

SEQ ID NO: 171583 - protein, 8 aa, Mycobacterium bovis
DGRLDGPR

SEQ ID NO: 171584 - protein, 13 aa, Mycobacterium bovis
DGRLTDPVATPTA

SEQ ID NO: 171585 - protein, 4 aa, Mycobacterium bovis
DGRP

SEQ ID NO: 171586 - protein, 11 aa, Mycobacterium bovis
DGRPEDLAGDP

SEQ ID NO: 171587 - protein, 5 aa, Mycobacterium bovis
DGRPH

SEQ ID NO: 171588 - protein, 8 aa, Mycobacterium bovis
DGRQPDVA

SEQ ID NO: 171589 - protein, 7 aa, Mycobacterium bovis
DGRRDVA

SEQ ID NO: 171590 - protein, 7 aa, Mycobacterium bovis
DGRRRTT

SEQ ID NO: 171591 - protein, 8 aa, Mycobacterium bovis
DGRRTRDM

SEQ ID NO: 171592 - protein, 16 aa, Mycobacterium bovis
DGRSAAQAIEDGVEPR

SEQ ID NO: 171593 - protein, 4 aa, Mycobacterium bovis
DGRY

SEQ ID NO: 171594 - protein, 19 aa, Mycobacterium bovis
DGSAETEISIPDEAPRHPG

SEQ ID NO: 171595 - protein, 5 aa, Mycobacterium bovis
DGSAL

SEQ ID NO: 171596 - protein, 12 aa, Mycobacterium bovis
DGSARATGSATI

SEQ ID NO: 171597 - protein, 9 aa, Mycobacterium bovis
DGSDQDYRR

SEQ ID NO: 171598 - protein, 8 aa, Mycobacterium bovis
DGSDSSMR

SEQ ID NO: 171599 - protein, 6 aa, Mycobacterium bovis
DGSDSV

SEQ ID NO: 171600 - protein, 7 aa, Mycobacterium bovis
DGSEEEF

SEQ ID NO: 171601 - protein, 12 aa, Mycobacterium bovis
DGSELPPNQPGE

SEQ ID NO: 171602 - protein, 10 aa, Mycobacterium bovis
DGSGAADETV

SEQ ID NO: 171603 - protein, 6 aa, Mycobacterium bovis
DGSGAH

SEQ ID NO: 171604 - protein, 19 aa, Mycobacterium bovis
DGSGALSGNQIPVDKGALK

SEQ ID NO: 171605 - protein, 10 aa, Mycobacterium bovis
DGSGPQGTDV

SEQ ID NO: 171606 - protein, 10 aa, Mycobacterium bovis
DGSGRTKFSS

SEQ ID NO: 171607 - protein, 14 aa, Mycobacterium bovis
DGSHHQNAAATAAI

SEQ ID NO: 171608 - protein, 5 aa, Mycobacterium bovis
DGSMD

SEQ ID NO: 171609 - protein, 8 aa, Mycobacterium bovis
DGSMDAGD

SEQ ID NO: 171610 - protein, 6 aa, Mycobacterium bovis
DGSPAQ

SEQ ID NO: 171611 - protein, 8 aa, Mycobacterium bovis
DGSPTSGL

SEQ ID NO: 171612 - protein, 7 aa, Mycobacterium bovis
DGSQDAG

SEQ ID NO: 171613 - protein, 4 aa, Mycobacterium bovis
DGSS

SEQ ID NO: 171614 - protein, 8 aa, Mycobacterium bovis
DGSSASEL

SEQ ID NO: 171615 - protein, 6 aa, Mycobacterium bovis
DGSSDI

SEQ ID NO: 171616 - protein, 15 aa, Mycobacterium bovis
DGSTDGTGDIARRSG

SEQ ID NO: 171617 - protein, 21 aa, Mycobacterium bovis
DGSTLTNPSADEVKAKLVKIA

SEQ ID NO: 171618 - protein, 13 aa, Mycobacterium bovis
DGSVTEGTPGDCH

SEQ ID NO: 171619 - protein, 7 aa, Mycobacterium bovis
DGSYGVP

SEQ ID NO: 171620 - protein, 5 aa, Mycobacterium bovis
DGSYP

SEQ ID NO: 171621 - protein, 15 aa, Mycobacterium bovis
DGSYTAKSPATEGNL

SEQ ID NO: 171622 - protein, 7 aa, Mycobacterium bovis
DGTALRD

SEQ ID NO: 171623 - protein, 13 aa, Mycobacterium bovis
DGTATGAADPRAP

SEQ ID NO: 171624 - protein, 8 aa, Mycobacterium bovis
DGTDEARV

SEQ ID NO: 171625 - protein, 5 aa, Mycobacterium bovis
DGTDV

SEQ ID NO: 171626 - protein, 17 aa, Mycobacterium bovis
DGTEDYWSDEYRDLIEL

SEQ ID NO: 171627 - protein, 7 aa, Mycobacterium bovis
DGTEGTR

SEQ ID NO: 171628 - protein, 11 aa, Mycobacterium bovis
DGTESALQHGS

SEQ ID NO: 171629 - protein, 5 aa, Mycobacterium bovis
DGTEV

SEQ ID NO: 171630 - protein, 5 aa, Mycobacterium bovis
DGTGM

SEQ ID NO: 171631 - protein, 12 aa, Mycobacterium bovis
DGTHGGTGGGNH

SEQ ID NO: 171632 - protein, 6 aa, Mycobacterium bovis
DGTHKT

SEQ ID NO: 171633 - protein, 5 aa, Mycobacterium bovis
DGTIT

SEQ ID NO: 171634 - protein, 8 aa, Mycobacterium bovis
DGTLEAST

SEQ ID NO: 171635 - protein, 8 aa, Mycobacterium bovis
DGTLGGPV

SEQ ID NO: 171636 - protein, 7 aa, Mycobacterium bovis
DGTLPGG

SEQ ID NO: 171637 - protein, 11 aa, Mycobacterium bovis
DGTPDKSRLGG

SEQ ID NO: 171638 - protein, 8 aa, Mycobacterium bovis
DGTPTALR

SEQ ID NO: 171639 - protein, 15 aa, Mycobacterium bovis
DGTQRIPPAAGSRDF

SEQ ID NO: 171640 - protein, 5 aa, Mycobacterium bovis
DGTRR

SEQ ID NO: 171641 - protein, 7 aa, Mycobacterium bovis
DGTRTEI

SEQ ID NO: 171642 - protein, 4 aa, Mycobacterium bovis
DGTS

SEQ ID NO: 171643 - protein, 5 aa, Mycobacterium bovis
DGTSA

SEQ ID NO: 171644 - protein, 11 aa, Mycobacterium bovis
DGTSKRRTTVG

SEQ ID NO: 171645 - protein, 19 aa, Mycobacterium bovis
DGTTPELGTARTAPSGRKP

SEQ ID NO: 171646 - protein, 7 aa, Mycobacterium bovis
DGTTRAE

SEQ ID NO: 171647 - protein, 6 aa, Mycobacterium bovis
DGTTRE

SEQ ID NO: 171648 - protein, 5 aa, Mycobacterium bovis
DGTVE

SEQ ID NO: 171649 - protein, 9 aa, Mycobacterium bovis
DGTVTGDYD

SEQ ID NO: 171650 - protein, 8 aa, Mycobacterium bovis
DGVADGEA

SEQ ID NO: 171651 - protein, 7 aa, Mycobacterium bovis
DGVDGEQ

SEQ ID NO: 171652 - protein, 8 aa, Mycobacterium bovis
DGVDSEAG

SEQ ID NO: 171653 - protein, 8 aa, Mycobacterium bovis
DGVTPPGQ

SEQ ID NO: 171654 - protein, 4 aa, Mycobacterium bovis
DGYA

SEQ ID NO: 171655 - protein, 9 aa, Mycobacterium bovis
DGYGHGATR

SEQ ID NO: 171656 - protein, 11 aa, Mycobacterium bovis
DGYGQNVKSGR

SEQ ID NO: 171657 - protein, 14 aa, Mycobacterium bovis
DGYGRTGFGLAVLE

SEQ ID NO: 171658 - protein, 7 aa, Mycobacterium bovis
DGYPRQG

SEQ ID NO: 171659 - protein, 10 aa, Mycobacterium bovis
DGYSDEPDAI

SEQ ID NO: 171660 - protein, 4 aa, Mycobacterium bovis
DGYT

SEQ ID NO: 171661 - protein, 6 aa, Mycobacterium bovis
DGYTGR

SEQ ID NO: 171662 - protein, 9 aa, Mycobacterium bovis
DGYVPGDGG

SEQ ID NO: 171663 - protein, 5 aa, Mycobacterium bovis
DHAAA

SEQ ID NO: 171664 - protein, 10 aa, Mycobacterium bovis
DHADPETKRI

SEQ ID NO: 171665 - protein, 7 aa, Mycobacterium bovis
DHAGTTA

SEQ ID NO: 171666 - protein, 6 aa, Mycobacterium bovis
DHATGG

SEQ ID NO: 171667 - protein, 8 aa, Mycobacterium bovis
DHDEKGRV

SEQ ID NO: 171668 - protein, 9 aa, Mycobacterium bovis
DHDPTSRHG

SEQ ID NO: 171669 - protein, 6 aa, Mycobacterium bovis
DHDTEG

SEQ ID NO: 171670 - protein, 8 aa, Mycobacterium bovis
DHDYETKK

SEQ ID NO: 171671 - protein, 5 aa, Mycobacterium bovis
DHEAT

SEQ ID NO: 171672 - protein, 12 aa, Mycobacterium bovis
DHEGQRREVTTA

SEQ ID NO: 171673 - protein, 4 aa, Mycobacterium bovis
DHEN

SEQ ID NO: 171674 - protein, 8 aa, Mycobacterium bovis
DHEQYTGE

SEQ ID NO: 171675 - protein, 11 aa, Mycobacterium bovis
DHGDAAEAIQR

SEQ ID NO: 171676 - protein, 14 aa, Mycobacterium bovis
DHGDPLPPHTEGAQ

SEQ ID NO: 171677 - protein, 5 aa, Mycobacterium bovis
DHGEQ

SEQ ID NO: 171678 - protein, 6 aa, Mycobacterium bovis
DHGGSL

SEQ ID NO: 171679 - protein, 5 aa, Mycobacterium bovis
DHGPG

SEQ ID NO: 171680 - protein, 5 aa, Mycobacterium bovis
DHGTE

SEQ ID NO: 171681 - protein, 7 aa, Mycobacterium bovis
DHGTEIA

SEQ ID NO: 171682 - protein, 5 aa, Mycobacterium bovis
DHHSR

SEQ ID NO: 171683 - protein, 7 aa, Mycobacterium bovis
DHKGQPT

SEQ ID NO: 171684 - protein, 15 aa, Mycobacterium bovis
DHNTGSFNSGDYNTG

SEQ ID NO: 171685 - protein, 4 aa, Mycobacterium bovis
DHNV

SEQ ID NO: 171686 - protein, 4 aa, Mycobacterium bovis
DHPD

SEQ ID NO: 171687 - protein, 6 aa, Mycobacterium bovis
DHPGYG

SEQ ID NO: 171688 - protein, 8 aa, Mycobacterium bovis
DHPPAPAS

SEQ ID NO: 171689 - protein, 7 aa, Mycobacterium bovis
DHPSRDA

SEQ ID NO: 171690 - protein, 36 aa, Mycobacterium bovis
DHRHDQGDDKARPGNPLQRTDPAADAAKAGGSGASV

SEQ ID NO: 171691 - protein, 6 aa, Mycobacterium bovis
DHRRRT

SEQ ID NO: 171692 - protein, 4 aa, Mycobacterium bovis
DHSD

SEQ ID NO: 171693 - protein, 5 aa, Mycobacterium bovis
DHSDG

SEQ ID NO: 171694 - protein, 6 aa, Mycobacterium bovis
DHSGRE

SEQ ID NO: 171695 - protein, 9 aa, Mycobacterium bovis
DHSTDPQPF

SEQ ID NO: 171696 - protein, 7 aa, Mycobacterium bovis
DHTDEVT

SEQ ID NO: 171697 - protein, 10 aa, Mycobacterium bovis
DHTNPDTPRR

SEQ ID NO: 171698 - protein, 5 aa, Mycobacterium bovis
DIAKG

SEQ ID NO: 171699 - protein, 6 aa, Mycobacterium bovis
DIAPHG

SEQ ID NO: 171700 - protein, 11 aa, Mycobacterium bovis
DIAPTDATEAT

SEQ ID NO: 171701 - protein, 7 aa, Mycobacterium bovis
DIARAAG

SEQ ID NO: 171702 - protein, 6 aa, Mycobacterium bovis
DIDGPE

SEQ ID NO: 171703 - protein, 6 aa, Mycobacterium bovis
DIDPAA

SEQ ID NO: 171704 - protein, 5 aa, Mycobacterium bovis
DIDRA

SEQ ID NO: 171705 - protein, 9 aa, Mycobacterium bovis
DIDTHSPRQ

SEQ ID NO: 171706 - protein, 6 aa, Mycobacterium bovis
DIEAGD

SEQ ID NO: 171707 - protein, 23 aa, Mycobacterium bovis
DIGAQAKRGLDANTARSQEAIGR

SEQ ID NO: 171708 - protein, 6 aa, Mycobacterium bovis
DIGAQR

SEQ ID NO: 171709 - protein, 9 aa, Mycobacterium bovis
DIGDDPRTW

SEQ ID NO: 171710 - protein, 9 aa, Mycobacterium bovis
DIGEYSNIG

SEQ ID NO: 171711 - protein, 8 aa, Mycobacterium bovis
DIGQPASV

SEQ ID NO: 171712 - protein, 6 aa, Mycobacterium bovis
DIGSSE

SEQ ID NO: 171713 - protein, 15 aa, Mycobacterium bovis
DIHDPSCSAEPVPDY

SEQ ID NO: 171714 - protein, 11 aa, Mycobacterium bovis
DIPDPQDPQTF

SEQ ID NO: 171715 - protein, 5 aa, Mycobacterium bovis
DIPEG

SEQ ID NO: 171716 - protein, 8 aa, Mycobacterium bovis
DIPEPDSG

SEQ ID NO: 171717 - protein, 7 aa, Mycobacterium bovis
DIPPGKA

SEQ ID NO: 171718 - protein, 9 aa, Mycobacterium bovis
DIPRGPAGP

SEQ ID NO: 171719 - protein, 7 aa, Mycobacterium bovis
DIQGGGS

SEQ ID NO: 171720 - protein, 6 aa, Mycobacterium bovis
DIRDAQ

SEQ ID NO: 171721 - protein, 4 aa, Mycobacterium bovis
DIRN

SEQ ID NO: 171722 - protein, 6 aa, Mycobacterium bovis
DIRPER

SEQ ID NO: 171723 - protein, 5 aa, Mycobacterium bovis
DIRPG

SEQ ID NO: 171724 - protein, 16 aa, Mycobacterium bovis
DIRPRRRREIPHVREV

SEQ ID NO: 171725 - protein, 9 aa, Mycobacterium bovis
DISGPPRAH

SEQ ID NO: 171726 - protein, 12 aa, Mycobacterium bovis
DISPQDAAHRRV

SEQ ID NO: 171727 - protein, 5 aa, Mycobacterium bovis
DISRK

SEQ ID NO: 171728 - protein, 6 aa, Mycobacterium bovis
DISSPG

SEQ ID NO: 171729 - protein, 7 aa, Mycobacterium bovis
DITDNST

SEQ ID NO: 171730 - protein, 6 aa, Mycobacterium bovis
DITEDL

SEQ ID NO: 171731 - protein, 10 aa, Mycobacterium bovis
DITGADAKRL

SEQ ID NO: 171732 - protein, 4 aa, Mycobacterium bovis
DITR

SEQ ID NO: 171733 - protein, 5 aa, Mycobacterium bovis
DIYGD

SEQ ID NO: 171734 - protein, 6 aa, Mycobacterium bovis
DKAAEA

SEQ ID NO: 171735 - protein, 6 aa, Mycobacterium bovis
DKAALE

SEQ ID NO: 171736 - protein, 7 aa, Mycobacterium bovis
DKAARTL

SEQ ID NO: 171737 - protein, 11 aa, Mycobacterium bovis
DKAETKARYGE

SEQ ID NO: 171738 - protein, 8 aa, Mycobacterium bovis
DKAGNPHL

SEQ ID NO: 171739 - protein, 6 aa, Mycobacterium bovis
DKAGNW

SEQ ID NO: 171740 - protein, 11 aa, Mycobacterium bovis
DKAHPGSAGYT

SEQ ID NO: 171741 - protein, 12 aa, Mycobacterium bovis
DKALATLRAIRS

SEQ ID NO: 171742 - protein, 4 aa, Mycobacterium bovis
DKAN

SEQ ID NO: 171743 - protein, 9 aa, Mycobacterium bovis
DKATSMSEA

SEQ ID NO: 171744 - protein, 4 aa, Mycobacterium bovis
DKDE

SEQ ID NO: 171745 - protein, 9 aa, Mycobacterium bovis
DKDFTNESA

SEQ ID NO: 171746 - protein, 5 aa, Mycobacterium bovis
DKDMT

SEQ ID NO: 171747 - protein, 7 aa, Mycobacterium bovis
DKDREAA

SEQ ID NO: 171748 - protein, 4 aa, Mycobacterium bovis
DKEA

SEQ ID NO: 171749 - protein, 8 aa, Mycobacterium bovis
DKEDGSLA

SEQ ID NO: 171750 - protein, 6 aa, Mycobacterium bovis
DKFGGD

SEQ ID NO: 171751 - protein, 9 aa, Mycobacterium bovis
DKFTDGNAY

SEQ ID NO: 171752 - protein, 7 aa, Mycobacterium bovis
DKGEKEQ

SEQ ID NO: 171753 - protein, 5 aa, Mycobacterium bovis
DKGKL

SEQ ID NO: 171754 - protein, 6 aa, Mycobacterium bovis
DKGRLT

SEQ ID NO: 171755 - protein, 8 aa, Mycobacterium bovis
DKGSPGEL

SEQ ID NO: 171756 - protein, 7 aa, Mycobacterium bovis
DKGTATF

SEQ ID NO: 171757 - protein, 6 aa, Mycobacterium bovis
DKGTVT

SEQ ID NO: 171758 - protein, 5 aa, Mycobacterium bovis
DKGVR

SEQ ID NO: 171759 - protein, 7 aa, Mycobacterium bovis
DKIAESG

SEQ ID NO: 171760 - protein, 7 aa, Mycobacterium bovis
DKKTRAG

SEQ ID NO: 171761 - protein, 6 aa, Mycobacterium bovis
DKLAKE

SEQ ID NO: 171762 - protein, 16 aa, Mycobacterium bovis
DKLSPSGPDRYSYGEQ

SEQ ID NO: 171763 - protein, 10 aa, Mycobacterium bovis
DKPAKTTREA

SEQ ID NO: 171764 - protein, 6 aa, Mycobacterium bovis
DKPAPL

SEQ ID NO: 171765 - protein, 7 aa, Mycobacterium bovis
DKPATPW

SEQ ID NO: 171766 - protein, 5 aa, Mycobacterium bovis
DKPAV

SEQ ID NO: 171767 - protein, 4 aa, Mycobacterium bovis
DKPD

SEQ ID NO: 171768 - protein, 9 aa, Mycobacterium bovis
DKPDDSIND

SEQ ID NO: 171769 - protein, 6 aa, Mycobacterium bovis
DKPGLR

SEQ ID NO: 171770 - protein, 5 aa, Mycobacterium bovis
DKPGV

SEQ ID NO: 171771 - protein, 6 aa, Mycobacterium bovis
DKPGVA

SEQ ID NO: 171772 - protein, 8 aa, Mycobacterium bovis
DKPNNGDA

SEQ ID NO: 171773 - protein, 7 aa, Mycobacterium bovis
DKPPLPF

SEQ ID NO: 171774 - protein, 7 aa, Mycobacterium bovis
DKPRPHR

SEQ ID NO: 171775 - protein, 10 aa, Mycobacterium bovis
DKPSHTQSAA

SEQ ID NO: 171776 - protein, 7 aa, Mycobacterium bovis
DKPTGAV

SEQ ID NO: 171777 - protein, 4 aa, Mycobacterium bovis
DKRG

SEQ ID NO: 171778 - protein, 9 aa, Mycobacterium bovis
DKRGQQAAL

SEQ ID NO: 171779 - protein, 6 aa, Mycobacterium bovis
DKRPGD

SEQ ID NO: 171780 - protein, 12 aa, Mycobacterium bovis
DKSARQGSEATT

SEQ ID NO: 171781 - protein, 10 aa, Mycobacterium bovis
DKSDRPGRNQ

SEQ ID NO: 171782 - protein, 7 aa, Mycobacterium bovis
DKSPAAV

SEQ ID NO: 171783 - protein, 5 aa, Mycobacterium bovis
DKSQI

SEQ ID NO: 171784 - protein, 24 aa, Mycobacterium bovis
DKSTGLANPGQFAGYTGAAESPTS

SEQ ID NO: 171785 - protein, 11 aa, Mycobacterium bovis
DKTNGQPFSDD

SEQ ID NO: 171786 - protein, 9 aa, Mycobacterium bovis
DKVATSPAF

SEQ ID NO: 171787 - protein, 10 aa, Mycobacterium bovis
DKVDTEIPSP

SEQ ID NO: 171788 - protein, 13 aa, Mycobacterium bovis
DKVDTEIPSPAAG

SEQ ID NO: 171789 - protein, 4 aa, Mycobacterium bovis
DKVG

SEQ ID NO: 171790 - protein, 5 aa, Mycobacterium bovis
DKVSV

SEQ ID NO: 171791 - protein, 7 aa, Mycobacterium bovis
DLAGAGR

SEQ ID NO: 171792 - protein, 13 aa, Mycobacterium bovis
DLAGKAAQYRPDE

SEQ ID NO: 171793 - protein, 10 aa, Mycobacterium bovis
DLAGPLSGAG

SEQ ID NO: 171794 - protein, 9 aa, Mycobacterium bovis
DLAQAGAPK

SEQ ID NO: 171795 - protein, 7 aa, Mycobacterium bovis
DLARQKP

SEQ ID NO: 171796 - protein, 4 aa, Mycobacterium bovis
DLAS

SEQ ID NO: 171797 - protein, 12 aa, Mycobacterium bovis
DLASRSANTPFE

SEQ ID NO: 171798 - protein, 4 aa, Mycobacterium bovis
DLAT

SEQ ID NO: 171799 - protein, 5 aa, Mycobacterium bovis
DLATA

SEQ ID NO: 171800 - protein, 13 aa, Mycobacterium bovis
DLDAKAADPAHES

SEQ ID NO: 171801 - protein, 11 aa, Mycobacterium bovis
DLDDEAAAAAE

SEQ ID NO: 171802 - protein, 5 aa, Mycobacterium bovis
DLDGQ

SEQ ID NO: 171803 - protein, 7 aa, Mycobacterium bovis
DLDGRAP

SEQ ID NO: 171804 - protein, 6 aa, Mycobacterium bovis
DLDPAA

SEQ ID NO: 171805 - protein, 10 aa, Mycobacterium bovis
DLDPGEARRA

SEQ ID NO: 171806 - protein, 13 aa, Mycobacterium bovis
DLDPSNSGNYRAN

SEQ ID NO: 171807 - protein, 5 aa, Mycobacterium bovis
DLDRD

SEQ ID NO: 171808 - protein, 4 aa, Mycobacterium bovis
DLDS

SEQ ID NO: 171809 - protein, 12 aa, Mycobacterium bovis
DLDSAADSAEIR

SEQ ID NO: 171810 - protein, 14 aa, Mycobacterium bovis
DLEDAAKSLPGKNG

SEQ ID NO: 171811 - protein, 8 aa, Mycobacterium bovis
DLEGKSDN

SEQ ID NO: 171812 - protein, 8 aa, Mycobacterium bovis
DLEQATGA

SEQ ID NO: 171813 - protein, 9 aa, Mycobacterium bovis
DLEQRDVEE

SEQ ID NO: 171814 - protein, 10 aa, Mycobacterium bovis
DLESASPDLQ

SEQ ID NO: 171815 - protein, 8 aa, Mycobacterium bovis
DLESASPQ

SEQ ID NO: 171816 - protein, 8 aa, Mycobacterium bovis
DLESKASE

SEQ ID NO: 171817 - protein, 7 aa, Mycobacterium bovis
DLGDEDA

SEQ ID NO: 171818 - protein, 4 aa, Mycobacterium bovis
DLGE

SEQ ID NO: 171819 - protein, 4 aa, Mycobacterium bovis
DLGP

SEQ ID NO: 171820 - protein, 26 aa, Mycobacterium bovis
DLGPGRQPSPASVPAQPSATAAITPA

SEQ ID NO: 171821 - protein, 14 aa, Mycobacterium bovis
DLGPGTSTSAASRA

SEQ ID NO: 171822 - protein, 14 aa, Mycobacterium bovis
DLGPRRTLTGQPLP

SEQ ID NO: 171823 - protein, 9 aa, Mycobacterium bovis
DLGSAAASF

SEQ ID NO: 171824 - protein, 8 aa, Mycobacterium bovis
DLKDGPQG

SEQ ID NO: 171825 - protein, 5 aa, Mycobacterium bovis
DLLPS

SEQ ID NO: 171826 - protein, 5 aa, Mycobacterium bovis
DLNET

SEQ ID NO: 171827 - protein, 7 aa, Mycobacterium bovis
DLPAEAH

SEQ ID NO: 171828 - protein, 6 aa, Mycobacterium bovis
DLPAKA

SEQ ID NO: 171829 - protein, 5 aa, Mycobacterium bovis
DLPAT

SEQ ID NO: 171830 - protein, 19 aa, Mycobacterium bovis
DLPEGASTQNLSLDGQGRV

SEQ ID NO: 171831 - protein, 13 aa, Mycobacterium bovis
DLPEPKKVKPPRT

SEQ ID NO: 171832 - protein, 5 aa, Mycobacterium bovis
DLPGA

SEQ ID NO: 171833 - protein, 9 aa, Mycobacterium bovis
DLPGSPARD

SEQ ID NO: 171834 - protein, 13 aa, Mycobacterium bovis
DLPGSSGSSRPER

SEQ ID NO: 171835 - protein, 6 aa, Mycobacterium bovis
DLPGTT

SEQ ID NO: 171836 - protein, 5 aa, Mycobacterium bovis
DLPKL

SEQ ID NO: 171837 - protein, 20 aa, Mycobacterium bovis
DLPNTDPTRVGTHLSPPDRY

SEQ ID NO: 171838 - protein, 15 aa, Mycobacterium bovis
DLPPAPAPLSDEEVA

SEQ ID NO: 171839 - protein, 5 aa, Mycobacterium bovis
DLPPS

SEQ ID NO: 171840 - protein, 6 aa, Mycobacterium bovis
DLPRAT

SEQ ID NO: 171841 - protein, 9 aa, Mycobacterium bovis
DLPTAADPR

SEQ ID NO: 171842 - protein, 10 aa, Mycobacterium bovis
DLPTAEGTGS

SEQ ID NO: 171843 - protein, 11 aa, Mycobacterium bovis
DLPTEPHPSRE

SEQ ID NO: 171844 - protein, 6 aa, Mycobacterium bovis
DLPTGH

SEQ ID NO: 171845 - protein, 10 aa, Mycobacterium bovis
DLQPGSSIMP

SEQ ID NO: 171846 - protein, 10 aa, Mycobacterium bovis
DLRGRSPDVS

SEQ ID NO: 171847 - protein, 13 aa, Mycobacterium bovis
DLRPKSLRDAMAE

SEQ ID NO: 171848 - protein, 9 aa, Mycobacterium bovis
DLSDSDLDD

SEQ ID NO: 171849 - protein, 6 aa, Mycobacterium bovis
DLSEGG

SEQ ID NO: 171850 - protein, 6 aa, Mycobacterium bovis
DLSGDA

SEQ ID NO: 171851 - protein, 8 aa, Mycobacterium bovis
DLSGGQRR

SEQ ID NO: 171852 - protein, 14 aa, Mycobacterium bovis
DLSPHDSGAYTGDV

SEQ ID NO: 171853 - protein, 10 aa, Mycobacterium bovis
DLSPKARDLG

SEQ ID NO: 171854 - protein, 6 aa, Mycobacterium bovis
DLSTPI

SEQ ID NO: 171855 - protein, 5 aa, Mycobacterium bovis
DLTDA

SEQ ID NO: 171856 - protein, 17 aa, Mycobacterium bovis
DLTGSRVSAAEGKRLAA

SEQ ID NO: 171857 - protein, 9 aa, Mycobacterium bovis
DLTPQPPSI

SEQ ID NO: 171858 - protein, 7 aa, Mycobacterium bovis
DLTQETA

SEQ ID NO: 171859 - protein, 10 aa, Mycobacterium bovis
DLVDGAPKPL

SEQ ID NO: 171860 - protein, 5 aa, Mycobacterium bovis
DMNDD

SEQ ID NO: 171861 - protein, 5 aa, Mycobacterium bovis
DMPAA

SEQ ID NO: 171862 - protein, 5 aa, Mycobacterium bovis
DMPGV

SEQ ID NO: 171863 - protein, 7 aa, Mycobacterium bovis
DMPTKPA

SEQ ID NO: 171864 - protein, 19 aa, Mycobacterium bovis
DNAAVDASSGVEAAAGLGE

SEQ ID NO: 171865 - protein, 6 aa, Mycobacterium bovis
DNAEEA

SEQ ID NO: 171866 - protein, 7 aa, Mycobacterium bovis
DNAGTVE

SEQ ID NO: 171867 - protein, 10 aa, Mycobacterium bovis
DNAPEERQRG

SEQ ID NO: 171868 - protein, 7 aa, Mycobacterium bovis
DNARTAR

SEQ ID NO: 171869 - protein, 6 aa, Mycobacterium bovis
DNCPQR

SEQ ID NO: 171870 - protein, 8 aa, Mycobacterium bovis
DNDGTPES

SEQ ID NO: 171871 - protein, 10 aa, Mycobacterium bovis
DNDSARRTPD

SEQ ID NO: 171872 - protein, 8 aa, Mycobacterium bovis
DNEASDKA

SEQ ID NO: 171873 - protein, 9 aa, Mycobacterium bovis
DNEDQNDLM

SEQ ID NO: 171874 - protein, 5 aa, Mycobacterium bovis
DNEPD

SEQ ID NO: 171875 - protein, 5 aa, Mycobacterium bovis
DNERA

SEQ ID NO: 171876 - protein, 12 aa, Mycobacterium bovis
DNEVPGATDRDR

SEQ ID NO: 171877 - protein, 11 aa, Mycobacterium bovis
DNGDADGGDGL

SEQ ID NO: 171878 - protein, 7 aa, Mycobacterium bovis
DNGPETY

SEQ ID NO: 171879 - protein, 15 aa, Mycobacterium bovis
DNGRGLPDEFTGSGL

SEQ ID NO: 171880 - protein, 12 aa, Mycobacterium bovis
DNGSTDGTPQAA

SEQ ID NO: 171881 - protein, 4 aa, Mycobacterium bovis
DNGV

SEQ ID NO: 171882 - protein, 9 aa, Mycobacterium bovis
DNIDDSSDP

SEQ ID NO: 171883 - protein, 5 aa, Mycobacterium bovis
DNLPS

SEQ ID NO: 171884 - protein, 4 aa, Mycobacterium bovis
DNNF

SEQ ID NO: 171885 - protein, 21 aa, Mycobacterium bovis
DNNIPNSKEASMSKAKAGRMA

SEQ ID NO: 171886 - protein, 6 aa, Mycobacterium bovis
DNPAAE

SEQ ID NO: 171887 - protein, 9 aa, Mycobacterium bovis
DNPADRSRI

SEQ ID NO: 171888 - protein, 7 aa, Mycobacterium bovis
DNPARYR

SEQ ID NO: 171889 - protein, 4 aa, Mycobacterium bovis
DNPD

SEQ ID NO: 171890 - protein, 6 aa, Mycobacterium bovis
DNPDDV

SEQ ID NO: 171891 - protein, 5 aa, Mycobacterium bovis
DNPDI

SEQ ID NO: 171892 - protein, 6 aa, Mycobacterium bovis
DNPGRM

SEQ ID NO: 171893 - protein, 9 aa, Mycobacterium bovis
DNPLRGAPH

SEQ ID NO: 171894 - protein, 15 aa, Mycobacterium bovis
DNPNATGSCACGDSF

SEQ ID NO: 171895 - protein, 5 aa, Mycobacterium bovis
DNPQQ

SEQ ID NO: 171896 - protein, 9 aa, Mycobacterium bovis
DNPVPGGGG

SEQ ID NO: 171897 - protein, 7 aa, Mycobacterium bovis
DNQGDGP

SEQ ID NO: 171898 - protein, 5 aa, Mycobacterium bovis
DNQGQ

SEQ ID NO: 171899 - protein, 10 aa, Mycobacterium bovis
DNQSRRQTSF

SEQ ID NO: 171900 - protein, 7 aa, Mycobacterium bovis
DNQTTYG

SEQ ID NO: 171901 - protein, 6 aa, Mycobacterium bovis
DNRPQR

SEQ ID NO: 171902 - protein, 7 aa, Mycobacterium bovis
DNRRRAS

SEQ ID NO: 171903 - protein, 10 aa, Mycobacterium bovis
DNRSTSFAGG

SEQ ID NO: 171904 - protein, 7 aa, Mycobacterium bovis
DNSASRC

SEQ ID NO: 171905 - protein, 4 aa, Mycobacterium bovis
DNSG

SEQ ID NO: 171906 - protein, 13 aa, Mycobacterium bovis
DNSRRGRTDTPHT

SEQ ID NO: 171907 - protein, 7 aa, Mycobacterium bovis
DNSTTWN

SEQ ID NO: 171908 - protein, 7 aa, Mycobacterium bovis
DNTADDL

SEQ ID NO: 171909 - protein, 6 aa, Mycobacterium bovis
DNTGAK

SEQ ID NO: 171910 - protein, 9 aa, Mycobacterium bovis
DNTGGSSSI

SEQ ID NO: 171911 - protein, 4 aa, Mycobacterium bovis
DNTN

SEQ ID NO: 171912 - protein, 9 aa, Mycobacterium bovis
DNTPWGGKP

SEQ ID NO: 171913 - protein, 5 aa, Mycobacterium bovis
DNTYP

SEQ ID NO: 171914 - protein, 6 aa, Mycobacterium bovis
DNWSTD

SEQ ID NO: 171915 - protein, 5 aa, Mycobacterium bovis
DNYAK

SEQ ID NO: 171916 - protein, 8 aa, Mycobacterium bovis
DPAAANDV

SEQ ID NO: 171917 - protein, 10 aa, Mycobacterium bovis
DPAADTGKTT

SEQ ID NO: 171918 - protein, 8 aa, Mycobacterium bovis
DPAAGDPL

SEQ ID NO: 171919 - protein, 21 aa, Mycobacterium bovis
DPAAYGQEPHPATDHPRPGRD

SEQ ID NO: 171920 - protein, 10 aa, Mycobacterium bovis
DPADDGPVAT

SEQ ID NO: 171921 - protein, 9 aa, Mycobacterium bovis
DPADEPVAQ

SEQ ID NO: 171922 - protein, 6 aa, Mycobacterium bovis
DPADFS

SEQ ID NO: 171923 - protein, 9 aa, Mycobacterium bovis
DPADGVESG

SEQ ID NO: 171924 - protein, 8 aa, Mycobacterium bovis
DPADTGQR

SEQ ID NO: 171925 - protein, 6 aa, Mycobacterium bovis
DPADTR

SEQ ID NO: 171926 - protein, 4 aa, Mycobacterium bovis
DPAG

SEQ ID NO: 171927 - protein, 7 aa, Mycobacterium bovis
DPAGDGG

SEQ ID NO: 171928 - protein, 8 aa, Mycobacterium bovis
DPAGNTDR

SEQ ID NO: 171929 - protein, 5 aa, Mycobacterium bovis
DPAHQ

SEQ ID NO: 171930 - protein, 4 aa, Mycobacterium bovis
DPAK

SEQ ID NO: 171931 - protein, 8 aa, Mycobacterium bovis
DPAKHRGY

SEQ ID NO: 171932 - protein, 10 aa, Mycobacterium bovis
DPAKKAFGAR

SEQ ID NO: 171933 - protein, 9 aa, Mycobacterium bovis
DPAKPKALH

SEQ ID NO: 171934 - protein, 9 aa, Mycobacterium bovis
DPAKQQDEL

SEQ ID NO: 171935 - protein, 12 aa, Mycobacterium bovis
DPAKTAASRNKH

SEQ ID NO: 171936 - protein, 4 aa, Mycobacterium bovis
DPAL

SEQ ID NO: 171937 - protein, 6 aa, Mycobacterium bovis
DPALPE

SEQ ID NO: 171938 - protein, 6 aa, Mycobacterium bovis
DPANAR

SEQ ID NO: 171939 - protein, 11 aa, Mycobacterium bovis
DPANLTGQGLA

SEQ ID NO: 171940 - protein, 11 aa, Mycobacterium bovis
DPAPAAPEGPW

SEQ ID NO: 171941 - protein, 16 aa, Mycobacterium bovis
DPAPADRSTSRDGYGN

SEQ ID NO: 171942 - protein, 12 aa, Mycobacterium bovis
DPAPTAASGAAA

SEQ ID NO: 171943 - protein, 11 aa, Mycobacterium bovis
DPAQKKSTSEW

SEQ ID NO: 171944 - protein, 12 aa, Mycobacterium bovis
DPAQRADYQRRA

SEQ ID NO: 171945 - protein, 6 aa, Mycobacterium bovis
DPAQRD

SEQ ID NO: 171946 - protein, 4 aa, Mycobacterium bovis
DPAR

SEQ ID NO: 171947 - protein, 8 aa, Mycobacterium bovis
DPARATAS

SEQ ID NO: 171948 - protein, 9 aa, Mycobacterium bovis
DPARDKADH

SEQ ID NO: 171949 - protein, 7 aa, Mycobacterium bovis
DPARGRA

SEQ ID NO: 171950 - protein, 11 aa, Mycobacterium bovis
DPARGSAANMR

SEQ ID NO: 171951 - protein, 9 aa, Mycobacterium bovis
DPARRGETL

SEQ ID NO: 171952 - protein, 19 aa, Mycobacterium bovis
DPARTSPSSTSIGFKRFEA

SEQ ID NO: 171953 - protein, 17 aa, Mycobacterium bovis
DPASGEEITAQNGRYGP

SEQ ID NO: 171954 - protein, 6 aa, Mycobacterium bovis
DPASGN

SEQ ID NO: 171955 - protein, 8 aa, Mycobacterium bovis
DPASVQAT

SEQ ID NO: 171956 - protein, 13 aa, Mycobacterium bovis
DPATAERYGHAGR

SEQ ID NO: 171957 - protein, 8 aa, Mycobacterium bovis
DPATATPP

SEQ ID NO: 171958 - protein, 7 aa, Mycobacterium bovis
DPATGLA

SEQ ID NO: 171959 - protein, 7 aa, Mycobacterium bovis
DPATGRV

SEQ ID NO: 171960 - protein, 11 aa, Mycobacterium bovis
DPATGSRRRYP

SEQ ID NO: 171961 - protein, 6 aa, Mycobacterium bovis
DPATGV

SEQ ID NO: 171962 - protein, 7 aa, Mycobacterium bovis
DPATNTL

SEQ ID NO: 171963 - protein, 7 aa, Mycobacterium bovis
DPAYQTE

SEQ ID NO: 171964 - protein, 4 aa, Mycobacterium bovis
DPDA

SEQ ID NO: 171965 - protein, 8 aa, Mycobacterium bovis
DPDADYSQ

SEQ ID NO: 171966 - protein, 5 aa, Mycobacterium bovis
DPDAE

SEQ ID NO: 171967 - protein, 9 aa, Mycobacterium bovis
DPDASAATL

SEQ ID NO: 171968 - protein, 7 aa, Mycobacterium bovis
DPDASLG

SEQ ID NO: 171969 - protein, 5 aa, Mycobacterium bovis
DPDAV

SEQ ID NO: 171970 - protein, 6 aa, Mycobacterium bovis
DPDDLD

SEQ ID NO: 171971 - protein, 9 aa, Mycobacterium bovis
DPDDNQNHL

SEQ ID NO: 171972 - protein, 8 aa, Mycobacterium bovis
DPDDPRLD

SEQ ID NO: 171973 - protein, 5 aa, Mycobacterium bovis
DPDDV

SEQ ID NO: 171974 - protein, 10 aa, Mycobacterium bovis
DPDDWNPPEF

SEQ ID NO: 171975 - protein, 5 aa, Mycobacterium bovis
DPDEP

SEQ ID NO: 171976 - protein, 7 aa, Mycobacterium bovis
DPDEPWG

SEQ ID NO: 171977 - protein, 19 aa, Mycobacterium bovis
DPDEVTESSTHGRHRPDAS

SEQ ID NO: 171978 - protein, 5 aa, Mycobacterium bovis
DPDGP

SEQ ID NO: 171979 - protein, 6 aa, Mycobacterium bovis
DPDGRT

SEQ ID NO: 171980 - protein, 11 aa, Mycobacterium bovis
DPDGSVYPSAR

SEQ ID NO: 171981 - protein, 6 aa, Mycobacterium bovis
DPDHDM

SEQ ID NO: 171982 - protein, 8 aa, Mycobacterium bovis
DPDNGYGE

SEQ ID NO: 171983 - protein, 11 aa, Mycobacterium bovis
DPDNRRPVDYG

SEQ ID NO: 171984 - protein, 8 aa, Mycobacterium bovis
DPDPDGPL

SEQ ID NO: 171985 - protein, 11 aa, Mycobacterium bovis
DPDPRQRFTTA

SEQ ID NO: 171986 - protein, 7 aa, Mycobacterium bovis
DPDPSAV

SEQ ID NO: 171987 - protein, 4 aa, Mycobacterium bovis
DPDR

SEQ ID NO: 171988 - protein, 10 aa, Mycobacterium bovis
DPDRARRNDP

SEQ ID NO: 171989 - protein, 5 aa, Mycobacterium bovis
DPDRD

SEQ ID NO: 171990 - protein, 5 aa, Mycobacterium bovis
DPDRE

SEQ ID NO: 171991 - protein, 8 aa, Mycobacterium bovis
DPDREATG

SEQ ID NO: 171992 - protein, 8 aa, Mycobacterium bovis
DPDRGANG

SEQ ID NO: 171993 - protein, 8 aa, Mycobacterium bovis
DPDRPGSL

SEQ ID NO: 171994 - protein, 8 aa, Mycobacterium bovis
DPDRPLPE

SEQ ID NO: 171995 - protein, 12 aa, Mycobacterium bovis
DPDRRDEVHRSA

SEQ ID NO: 171996 - protein, 12 aa, Mycobacterium bovis
DPDRRNAVTDEM

SEQ ID NO: 171997 - protein, 7 aa, Mycobacterium bovis
DPDRTLA

SEQ ID NO: 171998 - protein, 7 aa, Mycobacterium bovis
DPDSGRT

SEQ ID NO: 171999 - protein, 7 aa, Mycobacterium bovis
DPDTARE

SEQ ID NO: 172000 - protein, 6 aa, Mycobacterium bovis
DPDTTY

SEQ ID NO: 172001 - protein, 9 aa, Mycobacterium bovis
DPDYPASTY

SEQ ID NO: 172002 - protein, 16 aa, Mycobacterium bovis
DPEAAARYAANPERSI

SEQ ID NO: 172003 - protein, 6 aa, Mycobacterium bovis
DPEAAS

SEQ ID NO: 172004 - protein, 7 aa, Mycobacterium bovis
DPEAGGG

SEQ ID NO: 172005 - protein, 6 aa, Mycobacterium bovis
DPEFGT

SEQ ID NO: 172006 - protein, 5 aa, Mycobacterium bovis
DPEGE

SEQ ID NO: 172007 - protein, 13 aa, Mycobacterium bovis
DPEGQLGSASRAR

SEQ ID NO: 172008 - protein, 8 aa, Mycobacterium bovis
DPELSQPW

SEQ ID NO: 172009 - protein, 6 aa, Mycobacterium bovis
DPENTD

SEQ ID NO: 172010 - protein, 9 aa, Mycobacterium bovis
DPEPPEEAR

SEQ ID NO: 172011 - protein, 6 aa, Mycobacterium bovis
DPEQYQ

SEQ ID NO: 172012 - protein, 8 aa, Mycobacterium bovis
DPERGGAL

SEQ ID NO: 172013 - protein, 7 aa, Mycobacterium bovis
DPERQEA

SEQ ID NO: 172014 - protein, 7 aa, Mycobacterium bovis
DPERTAE

SEQ ID NO: 172015 - protein, 9 aa, Mycobacterium bovis
DPESDGLAR

SEQ ID NO: 172016 - protein, 4 aa, Mycobacterium bovis
DPET

SEQ ID NO: 172017 - protein, 6 aa, Mycobacterium bovis
DPETAR

SEQ ID NO: 172018 - protein, 17 aa, Mycobacterium bovis
DPETGHDPTGSPQGAGT

SEQ ID NO: 172019 - protein, 7 aa, Mycobacterium bovis
DPEVPPA

SEQ ID NO: 172020 - protein, 12 aa, Mycobacterium bovis
DPFADDPCDPSA

SEQ ID NO: 172021 - protein, 4 aa, Mycobacterium bovis
DPFS

SEQ ID NO: 172022 - protein, 10 aa, Mycobacterium bovis
DPGAAAALGP

SEQ ID NO: 172023 - protein, 10 aa, Mycobacterium bovis
DPGAQSPKET

SEQ ID NO: 172024 - protein, 6 aa, Mycobacterium bovis
DPGAVT

SEQ ID NO: 172025 - protein, 17 aa, Mycobacterium bovis
DPGDDFSGTPDYSSSWP

SEQ ID NO: 172026 - protein, 8 aa, Mycobacterium bovis
DPGDSGQV

SEQ ID NO: 172027 - protein, 11 aa, Mycobacterium bovis
DPGEGTQAKRR

SEQ ID NO: 172028 - protein, 7 aa, Mycobacterium bovis
DPGESQM

SEQ ID NO: 172029 - protein, 5 aa, Mycobacterium bovis
DPGEV

SEQ ID NO: 172030 - protein, 6 aa, Mycobacterium bovis
DPGIAD

SEQ ID NO: 172031 - protein, 15 aa, Mycobacterium bovis
DPGNNDTPTPLHPNC

SEQ ID NO: 172032 - protein, 9 aa, Mycobacterium bovis
DPGPDDDEH

SEQ ID NO: 172033 - protein, 13 aa, Mycobacterium bovis
DPGPRTSSATTIT

SEQ ID NO: 172034 - protein, 10 aa, Mycobacterium bovis
DPGQAPKPGV

SEQ ID NO: 172035 - protein, 7 aa, Mycobacterium bovis
DPGQERL

SEQ ID NO: 172036 - protein, 11 aa, Mycobacterium bovis
DPGQPGGTTSI

SEQ ID NO: 172037 - protein, 4 aa, Mycobacterium bovis
DPGR

SEQ ID NO: 172038 - protein, 11 aa, Mycobacterium bovis
DPGRIDETGRR

SEQ ID NO: 172039 - protein, 9 aa, Mycobacterium bovis
DPGSRATEM

SEQ ID NO: 172040 - protein, 8 aa, Mycobacterium bovis
DPGTDRVT

SEQ ID NO: 172041 - protein, 8 aa, Mycobacterium bovis
DPGTGPGH

SEQ ID NO: 172042 - protein, 5 aa, Mycobacterium bovis
DPGVS

SEQ ID NO: 172043 - protein, 8 aa, Mycobacterium bovis
DPHNKPGR

SEQ ID NO: 172044 - protein, 6 aa, Mycobacterium bovis
DPHNSE

SEQ ID NO: 172045 - protein, 9 aa, Mycobacterium bovis
DPHNTDRRF

SEQ ID NO: 172046 - protein, 6 aa, Mycobacterium bovis
DPHQRQ

SEQ ID NO: 172047 - protein, 26 aa, Mycobacterium bovis
DPHRASDDAVGVPPACGGRSDEEERR

SEQ ID NO: 172048 - protein, 7 aa, Mycobacterium bovis
DPHSPPE

SEQ ID NO: 172049 - protein, 5 aa, Mycobacterium bovis
DPIGP

SEQ ID NO: 172050 - protein, 8 aa, Mycobacterium bovis
DPIPGNDA

SEQ ID NO: 172051 - protein, 7 aa, Mycobacterium bovis
DPIPVDQ

SEQ ID NO: 172052 - protein, 8 aa, Mycobacterium bovis
DPKAEPSI

SEQ ID NO: 172053 - protein, 8 aa, Mycobacterium bovis
DPKASSAE

SEQ ID NO: 172054 - protein, 5 aa, Mycobacterium bovis
DPKFS

SEQ ID NO: 172055 - protein, 9 aa, Mycobacterium bovis
DPKGRATRE

SEQ ID NO: 172056 - protein, 7 aa, Mycobacterium bovis
DPKHSGP

SEQ ID NO: 172057 - protein, 73 aa, Mycobacterium bovis
DPKVAAKAAPLSTTRVGQSAGSGIPESTLRTAQGQQASETSAAEETAPSLRPEAAAGQLRPRVRQDPKIQMRG

SEQ ID NO: 172058 - protein, 9 aa, Mycobacterium bovis
DPKVKAELT

SEQ ID NO: 172059 - protein, 5 aa, Mycobacterium bovis
DPLDP

SEQ ID NO: 172060 - protein, 8 aa, Mycobacterium bovis
DPLDTGAP

SEQ ID NO: 172061 - protein, 8 aa, Mycobacterium bovis
DPLEPGGR

SEQ ID NO: 172062 - protein, 4 aa, Mycobacterium bovis
DPLG

SEQ ID NO: 172063 - protein, 6 aa, Mycobacterium bovis
DPLGPY

SEQ ID NO: 172064 - protein, 6 aa, Mycobacterium bovis
DPLPAE

SEQ ID NO: 172065 - protein, 6 aa, Mycobacterium bovis
DPLPDD

SEQ ID NO: 172066 - protein, 6 aa, Mycobacterium bovis
DPLPVK

SEQ ID NO: 172067 - protein, 6 aa, Mycobacterium bovis
DPLRDD

SEQ ID NO: 172068 - protein, 4 aa, Mycobacterium bovis
DPLT

SEQ ID NO: 172069 - protein, 5 aa, Mycobacterium bovis
DPLTP

SEQ ID NO: 172070 - protein, 7 aa, Mycobacterium bovis
DPLTRDG

SEQ ID NO: 172071 - protein, 6 aa, Mycobacterium bovis
DPMDNG

SEQ ID NO: 172072 - protein, 9 aa, Mycobacterium bovis
DPNDPADHE

SEQ ID NO: 172073 - protein, 9 aa, Mycobacterium bovis
DPNGGYGHP

SEQ ID NO: 172074 - protein, 15 aa, Mycobacterium bovis
DPNGIAGGGAGRLSA

SEQ ID NO: 172075 - protein, 12 aa, Mycobacterium bovis
DPNPPGPESDYR

SEQ ID NO: 172076 - protein, 5 aa, Mycobacterium bovis
DPNQQ

SEQ ID NO: 172077 - protein, 5 aa, Mycobacterium bovis
DPNRP

SEQ ID NO: 172078 - protein, 10 aa, Mycobacterium bovis
DPNTEGEATA

SEQ ID NO: 172079 - protein, 7 aa, Mycobacterium bovis
DPNTGQI

SEQ ID NO: 172080 - protein, 17 aa, Mycobacterium bovis
DPNTNTVTGSIPVGTGA

SEQ ID NO: 172081 - protein, 5 aa, Mycobacterium bovis
DPPAE

SEQ ID NO: 172082 - protein, 6 aa, Mycobacterium bovis
DPPAGD

SEQ ID NO: 172083 - protein, 7 aa, Mycobacterium bovis
DPPAGER

SEQ ID NO: 172084 - protein, 4 aa, Mycobacterium bovis
DPPD

SEQ ID NO: 172085 - protein, 6 aa, Mycobacterium bovis
DPPDLQ

SEQ ID NO: 172086 - protein, 5 aa, Mycobacterium bovis
DPPDR

SEQ ID NO: 172087 - protein, 6 aa, Mycobacterium bovis
DPPDRG

SEQ ID NO: 172088 - protein, 6 aa, Mycobacterium bovis
DPPDRP

SEQ ID NO: 172089 - protein, 15 aa, Mycobacterium bovis
DPPEPLELPGPAGTC

SEQ ID NO: 172090 - protein, 6 aa, Mycobacterium bovis
DPPEQA

SEQ ID NO: 172091 - protein, 4 aa, Mycobacterium bovis
DPPH

SEQ ID NO: 172092 - protein, 5 aa, Mycobacterium bovis
DPPLQ

SEQ ID NO: 172093 - protein, 26 aa, Mycobacterium bovis
DPPLSRRNRDQRRDRPQRPKRRPDLT

SEQ ID NO: 172094 - protein, 6 aa, Mycobacterium bovis
DPPPEL

SEQ ID NO: 172095 - protein, 14 aa, Mycobacterium bovis
DPPQVAEPHTRPPI

SEQ ID NO: 172096 - protein, 7 aa, Mycobacterium bovis
DPPRARA

SEQ ID NO: 172097 - protein, 7 aa, Mycobacterium bovis
DPPRHPI

SEQ ID NO: 172098 - protein, 10 aa, Mycobacterium bovis
DPPRSGAGRE

SEQ ID NO: 172099 - protein, 5 aa, Mycobacterium bovis
DPPST

SEQ ID NO: 172100 - protein, 5 aa, Mycobacterium bovis
DPPTT

SEQ ID NO: 172101 - protein, 9 aa, Mycobacterium bovis
DPPVTPEEP

SEQ ID NO: 172102 - protein, 11 aa, Mycobacterium bovis
DPQAALDPAGD

SEQ ID NO: 172103 - protein, 8 aa, Mycobacterium bovis
DPQAARSA

SEQ ID NO: 172104 - protein, 5 aa, Mycobacterium bovis
DPQAG

SEQ ID NO: 172105 - protein, 6 aa, Mycobacterium bovis
DPQDTE

SEQ ID NO: 172106 - protein, 4 aa, Mycobacterium bovis
DPQG

SEQ ID NO: 172107 - protein, 8 aa, Mycobacterium bovis
DPQIRTSQ

SEQ ID NO: 172108 - protein, 8 aa, Mycobacterium bovis
DPQKTAEV

SEQ ID NO: 172109 - protein, 7 aa, Mycobacterium bovis
DPQPDPF

SEQ ID NO: 172110 - protein, 7 aa, Mycobacterium bovis
DPQPGTG

SEQ ID NO: 172111 - protein, 9 aa, Mycobacterium bovis
DPQPGVPGR

SEQ ID NO: 172112 - protein, 30 aa, Mycobacterium bovis
DPQPKFGDPQRADIDDQPKKEWMCRGWDKS

SEQ ID NO: 172113 - protein, 9 aa, Mycobacterium bovis
DPQPPFDSG

SEQ ID NO: 172114 - protein, 5 aa, Mycobacterium bovis
DPQRL

SEQ ID NO: 172115 - protein, 27 aa, Mycobacterium bovis
DPQRPASPRSQSSRGLPSSPGVTGAAA

SEQ ID NO: 172116 - protein, 7 aa, Mycobacterium bovis
DPQRPTH

SEQ ID NO: 172117 - protein, 9 aa, Mycobacterium bovis
DPRAAARAR

SEQ ID NO: 172118 - protein, 6 aa, Mycobacterium bovis
DPRALD

SEQ ID NO: 172119 - protein, 10 aa, Mycobacterium bovis
DPRDKKTPSL

SEQ ID NO: 172120 - protein, 4 aa, Mycobacterium bovis
DPRE

SEQ ID NO: 172121 - protein, 4 aa, Mycobacterium bovis
DPRG

SEQ ID NO: 172122 - protein, 6 aa, Mycobacterium bovis
DPRHGT

SEQ ID NO: 172123 - protein, 8 aa, Mycobacterium bovis
DPRKADQM

SEQ ID NO: 172124 - protein, 8 aa, Mycobacterium bovis
DPRKTADA

SEQ ID NO: 172125 - protein, 12 aa, Mycobacterium bovis
DPRLGDGGRGYR

SEQ ID NO: 172126 - protein, 12 aa, Mycobacterium bovis
DPRPNAEPLPAR

SEQ ID NO: 172127 - protein, 8 aa, Mycobacterium bovis
DPRQGPGV

SEQ ID NO: 172128 - protein, 6 aa, Mycobacterium bovis
DPRRLA

SEQ ID NO: 172129 - protein, 7 aa, Mycobacterium bovis
DPRSGTH

SEQ ID NO: 172130 - protein, 9 aa, Mycobacterium bovis
DPRTVPPEQ

SEQ ID NO: 172131 - protein, 7 aa, Mycobacterium bovis
DPRVNPE

SEQ ID NO: 172132 - protein, 4 aa, Mycobacterium bovis
DPSA

SEQ ID NO: 172133 - protein, 21 aa, Mycobacterium bovis
DPSIPTDESGTRHRSAERAAI

SEQ ID NO: 172134 - protein, 8 aa, Mycobacterium bovis
DPSLKPQA

SEQ ID NO: 172135 - protein, 20 aa, Mycobacterium bovis
DPSLRVPRRPERRTSMPPGS

SEQ ID NO: 172136 - protein, 4 aa, Mycobacterium bovis
DPSM

SEQ ID NO: 172137 - protein, 5 aa, Mycobacterium bovis
DPSME

SEQ ID NO: 172138 - protein, 7 aa, Mycobacterium bovis
DPSPDRI

SEQ ID NO: 172139 - protein, 15 aa, Mycobacterium bovis
DPSQKADDVSGSGSY

SEQ ID NO: 172140 - protein, 4 aa, Mycobacterium bovis
DPSR

SEQ ID NO: 172141 - protein, 8 aa, Mycobacterium bovis
DPSSPGKL

SEQ ID NO: 172142 - protein, 11 aa, Mycobacterium bovis
DPSSTRTGGSI

SEQ ID NO: 172143 - protein, 10 aa, Mycobacterium bovis
DPSTDPDGWS

SEQ ID NO: 172144 - protein, 5 aa, Mycobacterium bovis
DPSVP

SEQ ID NO: 172145 - protein, 7 aa, Mycobacterium bovis
DPTAGAA

SEQ ID NO: 172146 - protein, 7 aa, Mycobacterium bovis
DPTAPSL

SEQ ID NO: 172147 - protein, 6 aa, Mycobacterium bovis
DPTCEP

SEQ ID NO: 172148 - protein, 4 aa, Mycobacterium bovis
DPTD

SEQ ID NO: 172149 - protein, 6 aa, Mycobacterium bovis
DPTDAA

SEQ ID NO: 172150 - protein, 11 aa, Mycobacterium bovis
DPTDGDDVPAG

SEQ ID NO: 172151 - protein, 8 aa, Mycobacterium bovis
DPTEDQAK

SEQ ID NO: 172152 - protein, 8 aa, Mycobacterium bovis
DPTEDQAR

SEQ ID NO: 172153 - protein, 5 aa, Mycobacterium bovis
DPTGA

SEQ ID NO: 172154 - protein, 4 aa, Mycobacterium bovis
DPTI

SEQ ID NO: 172155 - protein, 16 aa, Mycobacterium bovis
DPTKKARTYSKGNRQK

SEQ ID NO: 172156 - protein, 7 aa, Mycobacterium bovis
DPTLPTE

SEQ ID NO: 172157 - protein, 6 aa, Mycobacterium bovis
DPTLQP

SEQ ID NO: 172158 - protein, 7 aa, Mycobacterium bovis
DPTLRDE

SEQ ID NO: 172159 - protein, 7 aa, Mycobacterium bovis
DPTNLDA

SEQ ID NO: 172160 - protein, 5 aa, Mycobacterium bovis
DPTRF

SEQ ID NO: 172161 - protein, 16 aa, Mycobacterium bovis
DPTSGTITVDGTDVST

SEQ ID NO: 172162 - protein, 8 aa, Mycobacterium bovis
DPTTGRED

SEQ ID NO: 172163 - protein, 21 aa, Mycobacterium bovis
DPTTNTVTGSPITVGTAPTGV

SEQ ID NO: 172164 - protein, 4 aa, Mycobacterium bovis
DPTV

SEQ ID NO: 172165 - protein, 12 aa, Mycobacterium bovis
DPTVKGGTSNPW

SEQ ID NO: 172166 - protein, 10 aa, Mycobacterium bovis
DPVCSSGGNW

SEQ ID NO: 172167 - protein, 4 aa, Mycobacterium bovis
DPVD

SEQ ID NO: 172168 - protein, 6 aa, Mycobacterium bovis
DPVDPV

SEQ ID NO: 172169 - protein, 9 aa, Mycobacterium bovis
DPVETPEEY

SEQ ID NO: 172170 - protein, 21 aa, Mycobacterium bovis
DPVGGTAGSARAGHGYVHADL

SEQ ID NO: 172171 - protein, 7 aa, Mycobacterium bovis
DPVGTGS

SEQ ID NO: 172172 - protein, 9 aa, Mycobacterium bovis
DPVKPRGNL

SEQ ID NO: 172173 - protein, 5 aa, Mycobacterium bovis
DPVPD

SEQ ID NO: 172174 - protein, 9 aa, Mycobacterium bovis
DPVQDSPYA

SEQ ID NO: 172175 - protein, 4 aa, Mycobacterium bovis
DPVT

SEQ ID NO: 172176 - protein, 6 aa, Mycobacterium bovis
DPWPPA

SEQ ID NO: 172177 - protein, 4 aa, Mycobacterium bovis
DPWT

SEQ ID NO: 172178 - protein, 9 aa, Mycobacterium bovis
DPYADRPRL

SEQ ID NO: 172179 - protein, 7 aa, Mycobacterium bovis
DPYHGGT

SEQ ID NO: 172180 - protein, 4 aa, Mycobacterium bovis
DPYP

SEQ ID NO: 172181 - protein, 8 aa, Mycobacterium bovis
DPYPTPGH

SEQ ID NO: 172182 - protein, 6 aa, Mycobacterium bovis
DPYRPH

SEQ ID NO: 172183 - protein, 6 aa, Mycobacterium bovis
DPYYGD

SEQ ID NO: 172184 - protein, 9 aa, Mycobacterium bovis
DQAAAGALK

SEQ ID NO: 172185 - protein, 11 aa, Mycobacterium bovis
DQAAGNASREI

SEQ ID NO: 172186 - protein, 5 aa, Mycobacterium bovis
DQAAL

SEQ ID NO: 172187 - protein, 21 aa, Mycobacterium bovis
DQADAARAAYRTYGKGRHRAG

SEQ ID NO: 172188 - protein, 7 aa, Mycobacterium bovis
DQAERDR

SEQ ID NO: 172189 - protein, 6 aa, Mycobacterium bovis
DQAIDY

SEQ ID NO: 172190 - protein, 5 aa, Mycobacterium bovis
DQAQR

SEQ ID NO: 172191 - protein, 12 aa, Mycobacterium bovis
DQARAAAAGDDE

SEQ ID NO: 172192 - protein, 5 aa, Mycobacterium bovis
DQASA

SEQ ID NO: 172193 - protein, 19 aa, Mycobacterium bovis
DQATAAGDAAKATEYNNAA

SEQ ID NO: 172194 - protein, 13 aa, Mycobacterium bovis
DQATKQTFTDDER

SEQ ID NO: 172195 - protein, 6 aa, Mycobacterium bovis
DQDDQR

SEQ ID NO: 172196 - protein, 10 aa, Mycobacterium bovis
DQDHSAPNSI

SEQ ID NO: 172197 - protein, 6 aa, Mycobacterium bovis
DQDSGE

SEQ ID NO: 172198 - protein, 18 aa, Mycobacterium bovis
DQDVQAYTERPLTDDENA

SEQ ID NO: 172199 - protein, 5 aa, Mycobacterium bovis
DQENG

SEQ ID NO: 172200 - protein, 11 aa, Mycobacterium bovis
DQERGLSAGEK

SEQ ID NO: 172201 - protein, 5 aa, Mycobacterium bovis
DQFED

SEQ ID NO: 172202 - protein, 5 aa, Mycobacterium bovis
DQFRG

SEQ ID NO: 172203 - protein, 5 aa, Mycobacterium bovis
DQGEV

SEQ ID NO: 172204 - protein, 5 aa, Mycobacterium bovis
DQGNV

SEQ ID NO: 172205 - protein, 6 aa, Mycobacterium bovis
DQHAAD

SEQ ID NO: 172206 - protein, 20 aa, Mycobacterium bovis
DQIPDQGHDGDKSVSGVTIF

SEQ ID NO: 172207 - protein, 27 aa, Mycobacterium bovis
DQLASGERCAATSNRNFEGRQGAGGRT

SEQ ID NO: 172208 - protein, 4 aa, Mycobacterium bovis
DQLD

SEQ ID NO: 172209 - protein, 10 aa, Mycobacterium bovis
DQLGGPTPCS

SEQ ID NO: 172210 - protein, 7 aa, Mycobacterium bovis
DQLPNRT

SEQ ID NO: 172211 - protein, 8 aa, Mycobacterium bovis
DQLPSTHP

SEQ ID NO: 172212 - protein, 11 aa, Mycobacterium bovis
DQLRAKAPAGI

SEQ ID NO: 172213 - protein, 4 aa, Mycobacterium bovis
DQNL

SEQ ID NO: 172214 - protein, 9 aa, Mycobacterium bovis
DQPAPDVRY

SEQ ID NO: 172215 - protein, 5 aa, Mycobacterium bovis
DQPAR

SEQ ID NO: 172216 - protein, 13 aa, Mycobacterium bovis
DQPDTPIEDEREG

SEQ ID NO: 172217 - protein, 6 aa, Mycobacterium bovis
DQPGHE

SEQ ID NO: 172218 - protein, 6 aa, Mycobacterium bovis
DQPGRL

SEQ ID NO: 172219 - protein, 5 aa, Mycobacterium bovis
DQPGV

SEQ ID NO: 172220 - protein, 6 aa, Mycobacterium bovis
DQPGVT

SEQ ID NO: 172221 - protein, 9 aa, Mycobacterium bovis
DQPLADTAN

SEQ ID NO: 172222 - protein, 7 aa, Mycobacterium bovis
DQPPFDL

SEQ ID NO: 172223 - protein, 9 aa, Mycobacterium bovis
DQPPMPSRG

SEQ ID NO: 172224 - protein, 10 aa, Mycobacterium bovis
DQPQPQPGHG

SEQ ID NO: 172225 - protein, 17 aa, Mycobacterium bovis
DQPQYPYEQDGFSGSSV

SEQ ID NO: 172226 - protein, 7 aa, Mycobacterium bovis
DQPRDRA

SEQ ID NO: 172227 - protein, 4 aa, Mycobacterium bovis
DQPW

SEQ ID NO: 172228 - protein, 7 aa, Mycobacterium bovis
DQPYPRG

SEQ ID NO: 172229 - protein, 5 aa, Mycobacterium bovis
DQQPA

SEQ ID NO: 172230 - protein, 11 aa, Mycobacterium bovis
DQQPRPNSDEV

SEQ ID NO: 172231 - protein, 10 aa, Mycobacterium bovis
DQQRTSAVSE

SEQ ID NO: 172232 - protein, 4 aa, Mycobacterium bovis
DQQY

SEQ ID NO: 172233 - protein, 6 aa, Mycobacterium bovis
DQQYGQ

SEQ ID NO: 172234 - protein, 8 aa, Mycobacterium bovis
DQRADRAA

SEQ ID NO: 172235 - protein, 8 aa, Mycobacterium bovis
DQRGDGRS

SEQ ID NO: 172236 - protein, 15 aa, Mycobacterium bovis
DQRHASQLRQSGDPY

SEQ ID NO: 172237 - protein, 13 aa, Mycobacterium bovis
DQRPGTKKCGHQG

SEQ ID NO: 172238 - protein, 5 aa, Mycobacterium bovis
DQRSA

SEQ ID NO: 172239 - protein, 16 aa, Mycobacterium bovis
DQSDPDLLSPERKSRR

SEQ ID NO: 172240 - protein, 8 aa, Mycobacterium bovis
DQSEGTGP

SEQ ID NO: 172241 - protein, 6 aa, Mycobacterium bovis
DQSERM

SEQ ID NO: 172242 - protein, 4 aa, Mycobacterium bovis
DQSL

SEQ ID NO: 172243 - protein, 9 aa, Mycobacterium bovis
DQSTPVPTC

SEQ ID NO: 172244 - protein, 8 aa, Mycobacterium bovis
DQSTVEPA

SEQ ID NO: 172245 - protein, 8 aa, Mycobacterium bovis
DQTDPNAP

SEQ ID NO: 172246 - protein, 9 aa, Mycobacterium bovis
DQTDQTELG

SEQ ID NO: 172247 - protein, 10 aa, Mycobacterium bovis
DQTDVPESGD

SEQ ID NO: 172248 - protein, 9 aa, Mycobacterium bovis
DQTTSAPVR

SEQ ID NO: 172249 - protein, 19 aa, Mycobacterium bovis
DQVDDDRLGRPRSDADVGP

SEQ ID NO: 172250 - protein, 12 aa, Mycobacterium bovis
DQVNPQAGRDAA

SEQ ID NO: 172251 - protein, 9 aa, Mycobacterium bovis
DQVPEAARR

SEQ ID NO: 172252 - protein, 13 aa, Mycobacterium bovis
DQVSATELAGEPI

SEQ ID NO: 172253 - protein, 7 aa, Mycobacterium bovis
DRAAAIE

SEQ ID NO: 172254 - protein, 5 aa, Mycobacterium bovis
DRAAR

SEQ ID NO: 172255 - protein, 7 aa, Mycobacterium bovis
DRAASYR

SEQ ID NO: 172256 - protein, 4 aa, Mycobacterium bovis
DRAD

SEQ ID NO: 172257 - protein, 9 aa, Mycobacterium bovis
DRADRTERG

SEQ ID NO: 172258 - protein, 6 aa, Mycobacterium bovis
DRAEAL

SEQ ID NO: 172259 - protein, 10 aa, Mycobacterium bovis
DRAERSHGLA

SEQ ID NO: 172260 - protein, 6 aa, Mycobacterium bovis
DRAGAI

SEQ ID NO: 172261 - protein, 7 aa, Mycobacterium bovis
DRAGRRR

SEQ ID NO: 172262 - protein, 9 aa, Mycobacterium bovis
DRAKPAVPF

SEQ ID NO: 172263 - protein, 6 aa, Mycobacterium bovis
DRALGD

SEQ ID NO: 172264 - protein, 14 aa, Mycobacterium bovis
DRANRGAEQRLAQR

SEQ ID NO: 172265 - protein, 7 aa, Mycobacterium bovis
DRAPVTG

SEQ ID NO: 172266 - protein, 7 aa, Mycobacterium bovis
DRAQPGD

SEQ ID NO: 172267 - protein, 9 aa, Mycobacterium bovis
DRARDVADT

SEQ ID NO: 172268 - protein, 8 aa, Mycobacterium bovis
DRARKQGT

SEQ ID NO: 172269 - protein, 7 aa, Mycobacterium bovis
DRARTKT

SEQ ID NO: 172270 - protein, 13 aa, Mycobacterium bovis
DRARTRPADSTTV

SEQ ID NO: 172271 - protein, 8 aa, Mycobacterium bovis
DRASAGAH

SEQ ID NO: 172272 - protein, 4 aa, Mycobacterium bovis
DRAT

SEQ ID NO: 172273 - protein, 13 aa, Mycobacterium bovis
DRATDTVNRYPDN

SEQ ID NO: 172274 - protein, 16 aa, Mycobacterium bovis
DRATGPHSSESRAADH

SEQ ID NO: 172275 - protein, 7 aa, Mycobacterium bovis
DRAVTTT

SEQ ID NO: 172276 - protein, 10 aa, Mycobacterium bovis
DRCGGPGLAG

SEQ ID NO: 172277 - protein, 5 aa, Mycobacterium bovis
DRDAM

SEQ ID NO: 172278 - protein, 5 aa, Mycobacterium bovis
DRDDA

SEQ ID NO: 172279 - protein, 6 aa, Mycobacterium bovis
DRDDAM

SEQ ID NO: 172280 - protein, 14 aa, Mycobacterium bovis
DRDDQPYKESYGMA

SEQ ID NO: 172281 - protein, 4 aa, Mycobacterium bovis
DRDG

SEQ ID NO: 172282 - protein, 5 aa, Mycobacterium bovis
DRDGG

SEQ ID NO: 172283 - protein, 7 aa, Mycobacterium bovis
DRDGGRG

SEQ ID NO: 172284 - protein, 5 aa, Mycobacterium bovis
DRDPD

SEQ ID NO: 172285 - protein, 6 aa, Mycobacterium bovis
DRDPRT

SEQ ID NO: 172286 - protein, 5 aa, Mycobacterium bovis
DRDQL

SEQ ID NO: 172287 - protein, 6 aa, Mycobacterium bovis
DRDRNA

SEQ ID NO: 172288 - protein, 7 aa, Mycobacterium bovis
DRDRRAT

SEQ ID NO: 172289 - protein, 9 aa, Mycobacterium bovis
DRDSLEPIS

SEQ ID NO: 172290 - protein, 12 aa, Mycobacterium bovis
DRDSSSPSDELE

SEQ ID NO: 172291 - protein, 5 aa, Mycobacterium bovis
DRDVE

SEQ ID NO: 172292 - protein, 4 aa, Mycobacterium bovis
DRDY

SEQ ID NO: 172293 - protein, 7 aa, Mycobacterium bovis
DREELQP

SEQ ID NO: 172294 - protein, 4 aa, Mycobacterium bovis
DREG

SEQ ID NO: 172295 - protein, 8 aa, Mycobacterium bovis
DREGRPRS

SEQ ID NO: 172296 - protein, 9 aa, Mycobacterium bovis
DREKHGALR

SEQ ID NO: 172297 - protein, 17 aa, Mycobacterium bovis
DREPRAIGRGYGPHAGG

SEQ ID NO: 172298 - protein, 17 aa, Mycobacterium bovis
DRERTFPDKLSGGEQQR

SEQ ID NO: 172299 - protein, 4 aa, Mycobacterium bovis
DRET

SEQ ID NO: 172300 - protein, 7 aa, Mycobacterium bovis
DRETARH

SEQ ID NO: 172301 - protein, 5 aa, Mycobacterium bovis
DRFDP

SEQ ID NO: 172302 - protein, 12 aa, Mycobacterium bovis
DRFRPDPAARAE

SEQ ID NO: 172303 - protein, 4 aa, Mycobacterium bovis
DRFT

SEQ ID NO: 172304 - protein, 9 aa, Mycobacterium bovis
DRGAGGEVQ

SEQ ID NO: 172305 - protein, 9 aa, Mycobacterium bovis
DRGAGGSAY

SEQ ID NO: 172306 - protein, 9 aa, Mycobacterium bovis
DRGATSVTD

SEQ ID NO: 172307 - protein, 7 aa, Mycobacterium bovis
DRGDRSV

SEQ ID NO: 172308 - protein, 11 aa, Mycobacterium bovis
DRGEAHPDVDP

SEQ ID NO: 172309 - protein, 10 aa, Mycobacterium bovis
DRGEISSAAI

SEQ ID NO: 172310 - protein, 10 aa, Mycobacterium bovis
DRGGDSPHTT

SEQ ID NO: 172311 - protein, 6 aa, Mycobacterium bovis
DRGGIT

SEQ ID NO: 172312 - protein, 11 aa, Mycobacterium bovis
DRGGPTYTKDT

SEQ ID NO: 172313 - protein, 23 aa, Mycobacterium bovis
DRGLSSAAQDIGPHTDDRLSDGQ

SEQ ID NO: 172314 - protein, 4 aa, Mycobacterium bovis
DRGM

SEQ ID NO: 172315 - protein, 14 aa, Mycobacterium bovis
DRGTQLQRARAGEI

SEQ ID NO: 172316 - protein, 5 aa, Mycobacterium bovis
DRGYT

SEQ ID NO: 172317 - protein, 5 aa, Mycobacterium bovis
DRHDR

SEQ ID NO: 172318 - protein, 14 aa, Mycobacterium bovis
DRHEAAGTTHSAEY

SEQ ID NO: 172319 - protein, 6 aa, Mycobacterium bovis
DRHGDP

SEQ ID NO: 172320 - protein, 7 aa, Mycobacterium bovis
DRKAQDA

SEQ ID NO: 172321 - protein, 10 aa, Mycobacterium bovis
DRKARNSAKM

SEQ ID NO: 172322 - protein, 40 aa, Mycobacterium bovis
DRKDAKGHKGVPRAPKTPSPTANRRISDGPARRLTRCCRQ

SEQ ID NO: 172323 - protein, 9 aa, Mycobacterium bovis
DRKEQGRGL

SEQ ID NO: 172324 - protein, 11 aa, Mycobacterium bovis
DRKTDRAADSL

SEQ ID NO: 172325 - protein, 8 aa, Mycobacterium bovis
DRLDDAQK

SEQ ID NO: 172326 - protein, 8 aa, Mycobacterium bovis
DRLERDPA

SEQ ID NO: 172327 - protein, 7 aa, Mycobacterium bovis
DRLRSGA

SEQ ID NO: 172328 - protein, 8 aa, Mycobacterium bovis
DRLTEGAA

SEQ ID NO: 172329 - protein, 7 aa, Mycobacterium bovis
DRMSREG

SEQ ID NO: 172330 - protein, 6 aa, Mycobacterium bovis
DRNDAF

SEQ ID NO: 172331 - protein, 7 aa, Mycobacterium bovis
DRNEDGL

SEQ ID NO: 172332 - protein, 19 aa, Mycobacterium bovis
DRNLGPGHGARRISSDDSP

SEQ ID NO: 172333 - protein, 6 aa, Mycobacterium bovis
DRNPLH

SEQ ID NO: 172334 - protein, 23 aa, Mycobacterium bovis
DRNPSPGSLDEAQAKIRAALAQL

SEQ ID NO: 172335 - protein, 5 aa, Mycobacterium bovis
DRNPV

SEQ ID NO: 172336 - protein, 6 aa, Mycobacterium bovis
DRPALG

SEQ ID NO: 172337 - protein, 12 aa, Mycobacterium bovis
DRPDEMSPYAPR

SEQ ID NO: 172338 - protein, 7 aa, Mycobacterium bovis
DRPDQPL

SEQ ID NO: 172339 - protein, 24 aa, Mycobacterium bovis
DRPDRRGRSLRADHADRGLSARGH

SEQ ID NO: 172340 - protein, 7 aa, Mycobacterium bovis
DRPEARW

SEQ ID NO: 172341 - protein, 5 aa, Mycobacterium bovis
DRPED

SEQ ID NO: 172342 - protein, 7 aa, Mycobacterium bovis
DRPELAS

SEQ ID NO: 172343 - protein, 5 aa, Mycobacterium bovis
DRPEV

SEQ ID NO: 172344 - protein, 9 aa, Mycobacterium bovis
DRPGKAKAL

SEQ ID NO: 172345 - protein, 5 aa, Mycobacterium bovis
DRPGR

SEQ ID NO: 172346 - protein, 7 aa, Mycobacterium bovis
DRPGSLG

SEQ ID NO: 172347 - protein, 7 aa, Mycobacterium bovis
DRPKEQY

SEQ ID NO: 172348 - protein, 5 aa, Mycobacterium bovis
DRPLT

SEQ ID NO: 172349 - protein, 19 aa, Mycobacterium bovis
DRPPAAEPKERTKSAASSM

SEQ ID NO: 172350 - protein, 6 aa, Mycobacterium bovis
DRPPLS

SEQ ID NO: 172351 - protein, 12 aa, Mycobacterium bovis
DRPPQTNEVGRS

SEQ ID NO: 172352 - protein, 12 aa, Mycobacterium bovis
DRPRPSAVGRNA

SEQ ID NO: 172353 - protein, 10 aa, Mycobacterium bovis
DRPSPAPAKG

SEQ ID NO: 172354 - protein, 9 aa, Mycobacterium bovis
DRPSSVDGI

SEQ ID NO: 172355 - protein, 5 aa, Mycobacterium bovis
DRPTA

SEQ ID NO: 172356 - protein, 7 aa, Mycobacterium bovis
DRPTRGH

SEQ ID NO: 172357 - protein, 5 aa, Mycobacterium bovis
DRPVQ

SEQ ID NO: 172358 - protein, 15 aa, Mycobacterium bovis
DRPVRTSRGWSASPV

SEQ ID NO: 172359 - protein, 7 aa, Mycobacterium bovis
DRQEVDN

SEQ ID NO: 172360 - protein, 6 aa, Mycobacterium bovis
DRQPRR

SEQ ID NO: 172361 - protein, 8 aa, Mycobacterium bovis
DRQSDALG

SEQ ID NO: 172362 - protein, 13 aa, Mycobacterium bovis
DRRADPDLAARTD

SEQ ID NO: 172363 - protein, 8 aa, Mycobacterium bovis
DRRARKGE

SEQ ID NO: 172364 - protein, 6 aa, Mycobacterium bovis
DRRDFD

SEQ ID NO: 172365 - protein, 8 aa, Mycobacterium bovis
DRREDGYH

SEQ ID NO: 172366 - protein, 4 aa, Mycobacterium bovis
DRRG

SEQ ID NO: 172367 - protein, 6 aa, Mycobacterium bovis
DRRGND

SEQ ID NO: 172368 - protein, 13 aa, Mycobacterium bovis
DRRGPGGDSRPSL

SEQ ID NO: 172369 - protein, 8 aa, Mycobacterium bovis
DRRGTRPL

SEQ ID NO: 172370 - protein, 9 aa, Mycobacterium bovis
DRRPDLPTG

SEQ ID NO: 172371 - protein, 11 aa, Mycobacterium bovis
DRRPLRNTREA

SEQ ID NO: 172372 - protein, 4 aa, Mycobacterium bovis
DRRQ

SEQ ID NO: 172373 - protein, 20 aa, Mycobacterium bovis
DRRQQKRAGRHRGTTGTEAA

SEQ ID NO: 172374 - protein, 8 aa, Mycobacterium bovis
DRRQRQRA

SEQ ID NO: 172375 - protein, 5 aa, Mycobacterium bovis
DRRRG

SEQ ID NO: 172376 - protein, 18 aa, Mycobacterium bovis
DRRRRGERSGDGAEAELR

SEQ ID NO: 172377 - protein, 18 aa, Mycobacterium bovis
DRRSARKRNALAARSRKR

SEQ ID NO: 172378 - protein, 7 aa, Mycobacterium bovis
DRRSRAA

SEQ ID NO: 172379 - protein, 9 aa, Mycobacterium bovis
DRRSTQGNM

SEQ ID NO: 172380 - protein, 4 aa, Mycobacterium bovis
DRRT

SEQ ID NO: 172381 - protein, 5 aa, Mycobacterium bovis
DRRTT

SEQ ID NO: 172382 - protein, 9 aa, Mycobacterium bovis
DRSADDAAA

SEQ ID NO: 172383 - protein, 32 aa, Mycobacterium bovis
DRSAKPPPEGPPGGGQTGASGGENTNGEGSMK

SEQ ID NO: 172384 - protein, 10 aa, Mycobacterium bovis
DRSAPPGPFQ

SEQ ID NO: 172385 - protein, 4 aa, Mycobacterium bovis
DRSD

SEQ ID NO: 172386 - protein, 7 aa, Mycobacterium bovis
DRSDPLA

SEQ ID NO: 172387 - protein, 5 aa, Mycobacterium bovis
DRSEV

SEQ ID NO: 172388 - protein, 4 aa, Mycobacterium bovis
DRSG

SEQ ID NO: 172389 - protein, 11 aa, Mycobacterium bovis
DRSRAKGASHW

SEQ ID NO: 172390 - protein, 51 aa, Mycobacterium bovis
DRSSGNRATQDLRPAGARPGRRCGADRRRRHVGGSAKPHRGYPRRYLHPGH

SEQ ID NO: 172391 - protein, 19 aa, Mycobacterium bovis
DRSTKKEVKQVKPTNADVG

SEQ ID NO: 172392 - protein, 5 aa, Mycobacterium bovis
DRTAE

SEQ ID NO: 172393 - protein, 8 aa, Mycobacterium bovis
DRTGALSP

SEQ ID NO: 172394 - protein, 24 aa, Mycobacterium bovis
DRTGAQLVGGESAANVGRGYGLPE

SEQ ID NO: 172395 - protein, 10 aa, Mycobacterium bovis
DRTGDPNAWQ

SEQ ID NO: 172396 - protein, 7 aa, Mycobacterium bovis
DRTGGGA

SEQ ID NO: 172397 - protein, 8 aa, Mycobacterium bovis
DRTPTADR

SEQ ID NO: 172398 - protein, 7 aa, Mycobacterium bovis
DRTRRPM

SEQ ID NO: 172399 - protein, 9 aa, Mycobacterium bovis
DRTSGRADT

SEQ ID NO: 172400 - protein, 7 aa, Mycobacterium bovis
DRTTARA

SEQ ID NO: 172401 - protein, 6 aa, Mycobacterium bovis
DRVEAG

SEQ ID NO: 172402 - protein, 4 aa, Mycobacterium bovis
DRVG

SEQ ID NO: 172403 - protein, 6 aa, Mycobacterium bovis
DRVGAD

SEQ ID NO: 172404 - protein, 11 aa, Mycobacterium bovis
DRVGGRSLTGR

SEQ ID NO: 172405 - protein, 10 aa, Mycobacterium bovis
DRVRRGQVGN

SEQ ID NO: 172406 - protein, 9 aa, Mycobacterium bovis
DRVSPGAVT

SEQ ID NO: 172407 - protein, 11 aa, Mycobacterium bovis
DRWGRNAEDAL

SEQ ID NO: 172408 - protein, 9 aa, Mycobacterium bovis
DRWPDKPGR

SEQ ID NO: 172409 - protein, 11 aa, Mycobacterium bovis
DRYGKTRGFPL

SEQ ID NO: 172410 - protein, 7 aa, Mycobacterium bovis
DRYGPEV

SEQ ID NO: 172411 - protein, 4 aa, Mycobacterium bovis
DRYR

SEQ ID NO: 172412 - protein, 7 aa, Mycobacterium bovis
DRYSARD

SEQ ID NO: 172413 - protein, 9 aa, Mycobacterium bovis
DSAADATEL

SEQ ID NO: 172414 - protein, 7 aa, Mycobacterium bovis
DSAADYA

SEQ ID NO: 172415 - protein, 7 aa, Mycobacterium bovis
DSAAGNF

SEQ ID NO: 172416 - protein, 8 aa, Mycobacterium bovis
DSAANGLG

SEQ ID NO: 172417 - protein, 4 aa, Mycobacterium bovis
DSAE

SEQ ID NO: 172418 - protein, 5 aa, Mycobacterium bovis
DSAEY

SEQ ID NO: 172419 - protein, 14 aa, Mycobacterium bovis
DSAGDLGDWGGPDA

SEQ ID NO: 172420 - protein, 7 aa, Mycobacterium bovis
DSAGEAM

SEQ ID NO: 172421 - protein, 6 aa, Mycobacterium bovis
DSAGGA

SEQ ID NO: 172422 - protein, 6 aa, Mycobacterium bovis
DSAGGH

SEQ ID NO: 172423 - protein, 8 aa, Mycobacterium bovis
DSAHDSAA

SEQ ID NO: 172424 - protein, 8 aa, Mycobacterium bovis
DSAIEARR

SEQ ID NO: 172425 - protein, 8 aa, Mycobacterium bovis
DSAPIPAD

SEQ ID NO: 172426 - protein, 8 aa, Mycobacterium bovis
DSASEPDR

SEQ ID NO: 172427 - protein, 6 aa, Mycobacterium bovis
DSASSG

SEQ ID NO: 172428 - protein, 7 aa, Mycobacterium bovis
DSASVEH

SEQ ID NO: 172429 - protein, 4 aa, Mycobacterium bovis
DSAV

SEQ ID NO: 172430 - protein, 13 aa, Mycobacterium bovis
DSAVRKKGNDFAT

SEQ ID NO: 172431 - protein, 10 aa, Mycobacterium bovis
DSDAGGGGHE

SEQ ID NO: 172432 - protein, 6 aa, Mycobacterium bovis
DSDFTA

SEQ ID NO: 172433 - protein, 7 aa, Mycobacterium bovis
DSDGNGA

SEQ ID NO: 172434 - protein, 10 aa, Mycobacterium bovis
DSDIADRAGH

SEQ ID NO: 172435 - protein, 7 aa, Mycobacterium bovis
DSDLSNQ

SEQ ID NO: 172436 - protein, 13 aa, Mycobacterium bovis
DSDNAVVAAISGG

SEQ ID NO: 172437 - protein, 7 aa, Mycobacterium bovis
DSDRNGL

SEQ ID NO: 172438 - protein, 18 aa, Mycobacterium bovis
DSDRYGGGQGNDLDGAAP

SEQ ID NO: 172439 - protein, 6 aa, Mycobacterium bovis
DSDSFD

SEQ ID NO: 172440 - protein, 5 aa, Mycobacterium bovis
DSDTG

SEQ ID NO: 172441 - protein, 8 aa, Mycobacterium bovis
DSEADGTA

SEQ ID NO: 172442 - protein, 6 aa, Mycobacterium bovis
DSEDEV

SEQ ID NO: 172443 - protein, 4 aa, Mycobacterium bovis
DSEI

SEQ ID NO: 172444 - protein, 9 aa, Mycobacterium bovis
DSELPDGSV

SEQ ID NO: 172445 - protein, 10 aa, Mycobacterium bovis
DSEPDWGPYA

SEQ ID NO: 172446 - protein, 10 aa, Mycobacterium bovis
DSEQPELDPA

SEQ ID NO: 172447 - protein, 16 aa, Mycobacterium bovis
DSESDESGKLPGTDVR

SEQ ID NO: 172448 - protein, 8 aa, Mycobacterium bovis
DSESPDTQ

SEQ ID NO: 172449 - protein, 6 aa, Mycobacterium bovis
DSFSDG

SEQ ID NO: 172450 - protein, 7 aa, Mycobacterium bovis
DSFTGGA

SEQ ID NO: 172451 - protein, 12 aa, Mycobacterium bovis
DSGACADNRPEA

SEQ ID NO: 172452 - protein, 7 aa, Mycobacterium bovis
DSGAGAL

SEQ ID NO: 172453 - protein, 5 aa, Mycobacterium bovis
DSGAT

SEQ ID NO: 172454 - protein, 9 aa, Mycobacterium bovis
DSGCSAPGC

SEQ ID NO: 172455 - protein, 7 aa, Mycobacterium bovis
DSGDDCP

SEQ ID NO: 172456 - protein, 20 aa, Mycobacterium bovis
DSGDLDELSKATRARLDTAG

SEQ ID NO: 172457 - protein, 8 aa, Mycobacterium bovis
DSGDRYAD

SEQ ID NO: 172458 - protein, 7 aa, Mycobacterium bovis
DSGEGPQ

SEQ ID NO: 172459 - protein, 18 aa, Mycobacterium bovis
DSGEQIGDDEPDDCGVRP

SEQ ID NO: 172460 - protein, 5 aa, Mycobacterium bovis
DSGFV

SEQ ID NO: 172461 - protein, 6 aa, Mycobacterium bovis
DSGFVS

SEQ ID NO: 172462 - protein, 6 aa, Mycobacterium bovis
DSGFVT

SEQ ID NO: 172463 - protein, 16 aa, Mycobacterium bovis
DSGGGSDDDARAITDT

SEQ ID NO: 172464 - protein, 5 aa, Mycobacterium bovis
DSGHD

SEQ ID NO: 172465 - protein, 5 aa, Mycobacterium bovis
DSGHN

SEQ ID NO: 172466 - protein, 5 aa, Mycobacterium bovis
DSGIG

SEQ ID NO: 172467 - protein, 6 aa, Mycobacterium bovis
DSGKDL

SEQ ID NO: 172468 - protein, 5 aa, Mycobacterium bovis
DSGLR

SEQ ID NO: 172469 - protein, 6 aa, Mycobacterium bovis
DSGNAH

SEQ ID NO: 172470 - protein, 7 aa, Mycobacterium bovis
DSGNPGL

SEQ ID NO: 172471 - protein, 6 aa, Mycobacterium bovis
DSGNSI

SEQ ID NO: 172472 - protein, 4 aa, Mycobacterium bovis
DSGR

SEQ ID NO: 172473 - protein, 5 aa, Mycobacterium bovis
DSGRK

SEQ ID NO: 172474 - protein, 19 aa, Mycobacterium bovis
DSGSPVSPDYAPGSNAFNG

SEQ ID NO: 172475 - protein, 9 aa, Mycobacterium bovis
DSGVETGSV

SEQ ID NO: 172476 - protein, 16 aa, Mycobacterium bovis
DSGYDDARDPAARTAR

SEQ ID NO: 172477 - protein, 4 aa, Mycobacterium bovis
DSHA

SEQ ID NO: 172478 - protein, 5 aa, Mycobacterium bovis
DSHGD

SEQ ID NO: 172479 - protein, 9 aa, Mycobacterium bovis
DSHGNAAYT

SEQ ID NO: 172480 - protein, 16 aa, Mycobacterium bovis
DSHITGPAGPGHPTPG

SEQ ID NO: 172481 - protein, 10 aa, Mycobacterium bovis
DSKATNPHAA

SEQ ID NO: 172482 - protein, 6 aa, Mycobacterium bovis
DSKPSA

SEQ ID NO: 172483 - protein, 16 aa, Mycobacterium bovis
DSLAEQSRRNPDGTGL

SEQ ID NO: 172484 - protein, 10 aa, Mycobacterium bovis
DSLASSASLP

SEQ ID NO: 172485 - protein, 6 aa, Mycobacterium bovis
DSLGRA

SEQ ID NO: 172486 - protein, 9 aa, Mycobacterium bovis
DSLGTAQAT

SEQ ID NO: 172487 - protein, 25 aa, Mycobacterium bovis
DSLRAEQKAASKSVGGASPEERPPL

SEQ ID NO: 172488 - protein, 6 aa, Mycobacterium bovis
DSLSDD

SEQ ID NO: 172489 - protein, 13 aa, Mycobacterium bovis
DSLTRKDHEFERD

SEQ ID NO: 172490 - protein, 8 aa, Mycobacterium bovis
DSNGPHGM

SEQ ID NO: 172491 - protein, 7 aa, Mycobacterium bovis
DSNKTQI

SEQ ID NO: 172492 - protein, 4 aa, Mycobacterium bovis
DSNT

SEQ ID NO: 172493 - protein, 14 aa, Mycobacterium bovis
DSNVQSDPPTDGVH

SEQ ID NO: 172494 - protein, 6 aa, Mycobacterium bovis
DSPAAQ

SEQ ID NO: 172495 - protein, 6 aa, Mycobacterium bovis
DSPAGQ

SEQ ID NO: 172496 - protein, 16 aa, Mycobacterium bovis
DSPAGRRYGRTNGNLT

SEQ ID NO: 172497 - protein, 7 aa, Mycobacterium bovis
DSPALRT

SEQ ID NO: 172498 - protein, 4 aa, Mycobacterium bovis
DSPD

SEQ ID NO: 172499 - protein, 7 aa, Mycobacterium bovis
DSPERAQ

SEQ ID NO: 172500 - protein, 6 aa, Mycobacterium bovis
DSPERF

SEQ ID NO: 172501 - protein, 10 aa, Mycobacterium bovis
DSPGGSVTAS

SEQ ID NO: 172502 - protein, 7 aa, Mycobacterium bovis
DSPGITV

SEQ ID NO: 172503 - protein, 9 aa, Mycobacterium bovis
DSPKPPPRR

SEQ ID NO: 172504 - protein, 9 aa, Mycobacterium bovis
DSPLDGQAA

SEQ ID NO: 172505 - protein, 6 aa, Mycobacterium bovis
DSPNSA

SEQ ID NO: 172506 - protein, 8 aa, Mycobacterium bovis
DSPPKGVS

SEQ ID NO: 172507 - protein, 8 aa, Mycobacterium bovis
DSPRERPG

SEQ ID NO: 172508 - protein, 6 aa, Mycobacterium bovis
DSPRPW

SEQ ID NO: 172509 - protein, 7 aa, Mycobacterium bovis
DSPRRKE

SEQ ID NO: 172510 - protein, 9 aa, Mycobacterium bovis
DSPRSATVT

SEQ ID NO: 172511 - protein, 6 aa, Mycobacterium bovis
DSPTEL

SEQ ID NO: 172512 - protein, 7 aa, Mycobacterium bovis
DSPTGRP

SEQ ID NO: 172513 - protein, 13 aa, Mycobacterium bovis
DSPYQRPKNPDLR

SEQ ID NO: 172514 - protein, 7 aa, Mycobacterium bovis
DSQDGDA

SEQ ID NO: 172515 - protein, 7 aa, Mycobacterium bovis
DSQESFG

SEQ ID NO: 172516 - protein, 6 aa, Mycobacterium bovis
DSQGRG

SEQ ID NO: 172517 - protein, 5 aa, Mycobacterium bovis
DSRAA

SEQ ID NO: 172518 - protein, 7 aa, Mycobacterium bovis
DSRANGS

SEQ ID NO: 172519 - protein, 22 aa, Mycobacterium bovis
DSRDEAGSGRDRHANLGSGQID

SEQ ID NO: 172520 - protein, 10 aa, Mycobacterium bovis
DSRDPDPRAA

SEQ ID NO: 172521 - protein, 12 aa, Mycobacterium bovis
DSRETDEGQAIR

SEQ ID NO: 172522 - protein, 14 aa, Mycobacterium bovis
DSRGCGRSDGTGDL

SEQ ID NO: 172523 - protein, 16 aa, Mycobacterium bovis
DSRRHRRPPTTVYRPR

SEQ ID NO: 172524 - protein, 5 aa, Mycobacterium bovis
DSRSV

SEQ ID NO: 172525 - protein, 9 aa, Mycobacterium bovis
DSRTGEMDT

SEQ ID NO: 172526 - protein, 6 aa, Mycobacterium bovis
DSRVPT

SEQ ID NO: 172527 - protein, 10 aa, Mycobacterium bovis
DSSDKGFDGA

SEQ ID NO: 172528 - protein, 12 aa, Mycobacterium bovis
DSSGAERDEDGS

SEQ ID NO: 172529 - protein, 8 aa, Mycobacterium bovis
DSSGASRA

SEQ ID NO: 172530 - protein, 6 aa, Mycobacterium bovis
DSSGSV

SEQ ID NO: 172531 - protein, 14 aa, Mycobacterium bovis
DSSNRQVREAAERA

SEQ ID NO: 172532 - protein, 6 aa, Mycobacterium bovis
DSSPEM

SEQ ID NO: 172533 - protein, 19 aa, Mycobacterium bovis
DSSPPSEDYGRQPPQDLAA

SEQ ID NO: 172534 - protein, 7 aa, Mycobacterium bovis
DSSPTLN

SEQ ID NO: 172535 - protein, 4 aa, Mycobacterium bovis
DSSR

SEQ ID NO: 172536 - protein, 9 aa, Mycobacterium bovis
DSSSRMSRL

SEQ ID NO: 172537 - protein, 7 aa, Mycobacterium bovis
DSSTPIA

SEQ ID NO: 172538 - protein, 12 aa, Mycobacterium bovis
DSSTSLADAEAA

SEQ ID NO: 172539 - protein, 7 aa, Mycobacterium bovis
DSTALSN

SEQ ID NO: 172540 - protein, 7 aa, Mycobacterium bovis
DSTALYP

SEQ ID NO: 172541 - protein, 7 aa, Mycobacterium bovis
DSTDTLE

SEQ ID NO: 172542 - protein, 5 aa, Mycobacterium bovis
DSTDV

SEQ ID NO: 172543 - protein, 9 aa, Mycobacterium bovis
DSTDWSRNT

SEQ ID NO: 172544 - protein, 4 aa, Mycobacterium bovis
DSTF

SEQ ID NO: 172545 - protein, 4 aa, Mycobacterium bovis
DSTG

SEQ ID NO: 172546 - protein, 10 aa, Mycobacterium bovis
DSTGADYASA

SEQ ID NO: 172547 - protein, 10 aa, Mycobacterium bovis
DSTGLPDTPL

SEQ ID NO: 172548 - protein, 12 aa, Mycobacterium bovis
DSTPDERRTAYD

SEQ ID NO: 172549 - protein, 7 aa, Mycobacterium bovis
DSTPPPW

SEQ ID NO: 172550 - protein, 7 aa, Mycobacterium bovis
DSTQGAH

SEQ ID NO: 172551 - protein, 9 aa, Mycobacterium bovis
DSTTLSESA

SEQ ID NO: 172552 - protein, 7 aa, Mycobacterium bovis
DSTVPDA

SEQ ID NO: 172553 - protein, 5 aa, Mycobacterium bovis
DSTVR

SEQ ID NO: 172554 - protein, 7 aa, Mycobacterium bovis
DSVGGPV

SEQ ID NO: 172555 - protein, 10 aa, Mycobacterium bovis
DSVPGLGEHR

SEQ ID NO: 172556 - protein, 4 aa, Mycobacterium bovis
DSVQ

SEQ ID NO: 172557 - protein, 6 aa, Mycobacterium bovis
DSVSER

SEQ ID NO: 172558 - protein, 15 aa, Mycobacterium bovis
DSVTKSKFDNKYGTR

SEQ ID NO: 172559 - protein, 8 aa, Mycobacterium bovis
DSVTPQQA

SEQ ID NO: 172560 - protein, 4 aa, Mycobacterium bovis
DSYL

SEQ ID NO: 172561 - protein, 5 aa, Mycobacterium bovis
DSYLT

SEQ ID NO: 172562 - protein, 7 aa, Mycobacterium bovis
DSYRAKS

SEQ ID NO: 172563 - protein, 5 aa, Mycobacterium bovis
DSYRI

SEQ ID NO: 172564 - protein, 10 aa, Mycobacterium bovis
DSYTAGGANV

SEQ ID NO: 172565 - protein, 6 aa, Mycobacterium bovis
DTAANL

SEQ ID NO: 172566 - protein, 18 aa, Mycobacterium bovis
DTAEAHPGSNVVGAKAKR

SEQ ID NO: 172567 - protein, 12 aa, Mycobacterium bovis
DTAGGTSAGLSG

SEQ ID NO: 172568 - protein, 5 aa, Mycobacterium bovis
DTAGV

SEQ ID NO: 172569 - protein, 23 aa, Mycobacterium bovis
DTAHEARVEGAADPLDSQGAGDQ

SEQ ID NO: 172570 - protein, 11 aa, Mycobacterium bovis
DTAKEKPQEGT

SEQ ID NO: 172571 - protein, 5 aa, Mycobacterium bovis
DTAQA

SEQ ID NO: 172572 - protein, 14 aa, Mycobacterium bovis
DTAQVEGGDLLVVV

SEQ ID NO: 172573 - protein, 6 aa, Mycobacterium bovis
DTARPA

SEQ ID NO: 172574 - protein, 10 aa, Mycobacterium bovis
DTATEVPAPV

SEQ ID NO: 172575 - protein, 7 aa, Mycobacterium bovis
DTATGEQ

SEQ ID NO: 172576 - protein, 6 aa, Mycobacterium bovis
DTAYGL

SEQ ID NO: 172577 - protein, 9 aa, Mycobacterium bovis
DTDAAGGAG

SEQ ID NO: 172578 - protein, 10 aa, Mycobacterium bovis
DTDDPARPLT

SEQ ID NO: 172579 - protein, 7 aa, Mycobacterium bovis
DTDEETL

SEQ ID NO: 172580 - protein, 7 aa, Mycobacterium bovis
DTDERTI

SEQ ID NO: 172581 - protein, 8 aa, Mycobacterium bovis
DTDGDGLA

SEQ ID NO: 172582 - protein, 5 aa, Mycobacterium bovis
DTDLS

SEQ ID NO: 172583 - protein, 23 aa, Mycobacterium bovis
DTDPEPEPEEDEPVAESPAPDVV

SEQ ID NO: 172584 - protein, 7 aa, Mycobacterium bovis
DTDPRRA

SEQ ID NO: 172585 - protein, 7 aa, Mycobacterium bovis
DTDSHPK

SEQ ID NO: 172586 - protein, 5 aa, Mycobacterium bovis
DTDTQ

SEQ ID NO: 172587 - protein, 7 aa, Mycobacterium bovis
DTEAERE

SEQ ID NO: 172588 - protein, 5 aa, Mycobacterium bovis
DTEAQ

SEQ ID NO: 172589 - protein, 9 aa, Mycobacterium bovis
DTEATAAAI

SEQ ID NO: 172590 - protein, 8 aa, Mycobacterium bovis
DTEEGPDA

SEQ ID NO: 172591 - protein, 5 aa, Mycobacterium bovis
DTEGK

SEQ ID NO: 172592 - protein, 6 aa, Mycobacterium bovis
DTEGLA

SEQ ID NO: 172593 - protein, 7 aa, Mycobacterium bovis
DTEPYRK

SEQ ID NO: 172594 - protein, 4 aa, Mycobacterium bovis
DTER

SEQ ID NO: 172595 - protein, 6 aa, Mycobacterium bovis
DTERPS

SEQ ID NO: 172596 - protein, 10 aa, Mycobacterium bovis
DTERQRAQGT

SEQ ID NO: 172597 - protein, 15 aa, Mycobacterium bovis
DTESTPTGGPVNSPD

SEQ ID NO: 172598 - protein, 4 aa, Mycobacterium bovis
DTET

SEQ ID NO: 172599 - protein, 13 aa, Mycobacterium bovis
DTETAKWRDPTGT

SEQ ID NO: 172600 - protein, 6 aa, Mycobacterium bovis
DTFDPD

SEQ ID NO: 172601 - protein, 4 aa, Mycobacterium bovis
DTFY

SEQ ID NO: 172602 - protein, 5 aa, Mycobacterium bovis
DTGAD

SEQ ID NO: 172603 - protein, 5 aa, Mycobacterium bovis
DTGAE

SEQ ID NO: 172604 - protein, 11 aa, Mycobacterium bovis
DTGALDDPDGR

SEQ ID NO: 172605 - protein, 8 aa, Mycobacterium bovis
DTGDTPTI

SEQ ID NO: 172606 - protein, 11 aa, Mycobacterium bovis
DTGFGEDPATL

SEQ ID NO: 172607 - protein, 4 aa, Mycobacterium bovis
DTGG

SEQ ID NO: 172608 - protein, 7 aa, Mycobacterium bovis
DTGGAVD

SEQ ID NO: 172609 - protein, 9 aa, Mycobacterium bovis
DTGHGGDPH

SEQ ID NO: 172610 - protein, 6 aa, Mycobacterium bovis
DTGLDA

SEQ ID NO: 172611 - protein, 9 aa, Mycobacterium bovis
DTGNGPYGP

SEQ ID NO: 172612 - protein, 9 aa, Mycobacterium bovis
DTGPDGDTT

SEQ ID NO: 172613 - protein, 16 aa, Mycobacterium bovis
DTGPTAVAQPNGEGAV

SEQ ID NO: 172614 - protein, 6 aa, Mycobacterium bovis
DTGQAD

SEQ ID NO: 172615 - protein, 4 aa, Mycobacterium bovis
DTGR

SEQ ID NO: 172616 - protein, 5 aa, Mycobacterium bovis
DTGRE

SEQ ID NO: 172617 - protein, 8 aa, Mycobacterium bovis
DTGVPRPG

SEQ ID NO: 172618 - protein, 5 aa, Mycobacterium bovis
DTGVS

SEQ ID NO: 172619 - protein, 6 aa, Mycobacterium bovis
DTHREA

SEQ ID NO: 172620 - protein, 5 aa, Mycobacterium bovis
DTHTP

SEQ ID NO: 172621 - protein, 4 aa, Mycobacterium bovis
DTHY

SEQ ID NO: 172622 - protein, 12 aa, Mycobacterium bovis
DTIDRDSAWAAK

SEQ ID NO: 172623 - protein, 13 aa, Mycobacterium bovis
DTIGGGARSGELT

SEQ ID NO: 172624 - protein, 7 aa, Mycobacterium bovis
DTIPGTA

SEQ ID NO: 172625 - protein, 7 aa, Mycobacterium bovis
DTIRNGY

SEQ ID NO: 172626 - protein, 6 aa, Mycobacterium bovis
DTLDND

SEQ ID NO: 172627 - protein, 6 aa, Mycobacterium bovis
DTLGPA

SEQ ID NO: 172628 - protein, 5 aa, Mycobacterium bovis
DTLQS

SEQ ID NO: 172629 - protein, 6 aa, Mycobacterium bovis
DTLRRS

SEQ ID NO: 172630 - protein, 6 aa, Mycobacterium bovis
DTNGTV

SEQ ID NO: 172631 - protein, 6 aa, Mycobacterium bovis
DTNPRW

SEQ ID NO: 172632 - protein, 6 aa, Mycobacterium bovis
DTNRSR

SEQ ID NO: 172633 - protein, 13 aa, Mycobacterium bovis
DTPAAPSGSFGDD

SEQ ID NO: 172634 - protein, 7 aa, Mycobacterium bovis
DTPADLT

SEQ ID NO: 172635 - protein, 10 aa, Mycobacterium bovis
DTPAGPPGST

SEQ ID NO: 172636 - protein, 7 aa, Mycobacterium bovis
DTPASYE

SEQ ID NO: 172637 - protein, 16 aa, Mycobacterium bovis
DTPDGTPPPGTGLSPT

SEQ ID NO: 172638 - protein, 10 aa, Mycobacterium bovis
DTPGEADYYR

SEQ ID NO: 172639 - protein, 6 aa, Mycobacterium bovis
DTPGFE

SEQ ID NO: 172640 - protein, 7 aa, Mycobacterium bovis
DTPGFTA

SEQ ID NO: 172641 - protein, 5 aa, Mycobacterium bovis
DTPGI

SEQ ID NO: 172642 - protein, 8 aa, Mycobacterium bovis
DTPGTSSL

SEQ ID NO: 172643 - protein, 9 aa, Mycobacterium bovis
DTPHTRPVP

SEQ ID NO: 172644 - protein, 7 aa, Mycobacterium bovis
DTPLGRR

SEQ ID NO: 172645 - protein, 5 aa, Mycobacterium bovis
DTPLP

SEQ ID NO: 172646 - protein, 14 aa, Mycobacterium bovis
DTPLRAQAATAGID

SEQ ID NO: 172647 - protein, 6 aa, Mycobacterium bovis
DTPRAL

SEQ ID NO: 172648 - protein, 5 aa, Mycobacterium bovis
DTPTG

SEQ ID NO: 172649 - protein, 7 aa, Mycobacterium bovis
DTQARAQ

SEQ ID NO: 172650 - protein, 7 aa, Mycobacterium bovis
DTQARPV

SEQ ID NO: 172651 - protein, 10 aa, Mycobacterium bovis
DTQASEEELG

SEQ ID NO: 172652 - protein, 5 aa, Mycobacterium bovis
DTQPR

SEQ ID NO: 172653 - protein, 5 aa, Mycobacterium bovis
DTQRA

SEQ ID NO: 172654 - protein, 7 aa, Mycobacterium bovis
DTQRMPE

SEQ ID NO: 172655 - protein, 18 aa, Mycobacterium bovis
DTRTVNSDTPYGQPSAPI

SEQ ID NO: 172656 - protein, 9 aa, Mycobacterium bovis
DTSAPGGVG

SEQ ID NO: 172657 - protein, 5 aa, Mycobacterium bovis
DTSAS

SEQ ID NO: 172658 - protein, 9 aa, Mycobacterium bovis
DTSKPAAAA

SEQ ID NO: 172659 - protein, 6 aa, Mycobacterium bovis
DTSRDI

SEQ ID NO: 172660 - protein, 9 aa, Mycobacterium bovis
DTSRPEPPI

SEQ ID NO: 172661 - protein, 9 aa, Mycobacterium bovis
DTSSQLVSS

SEQ ID NO: 172662 - protein, 9 aa, Mycobacterium bovis
DTSTSTATT

SEQ ID NO: 172663 - protein, 9 aa, Mycobacterium bovis
DTSTTGNSA

SEQ ID NO: 172664 - protein, 7 aa, Mycobacterium bovis
DTTNREA

SEQ ID NO: 172665 - protein, 7 aa, Mycobacterium bovis
DTTPEGY

SEQ ID NO: 172666 - protein, 8 aa, Mycobacterium bovis
DTTPEPEI

SEQ ID NO: 172667 - protein, 18 aa, Mycobacterium bovis
DTTTEGPVTTSGATCADN

SEQ ID NO: 172668 - protein, 13 aa, Mycobacterium bovis
DTTTGDTLSDPNQ

SEQ ID NO: 172669 - protein, 11 aa, Mycobacterium bovis
DTTVRQSNYGV

SEQ ID NO: 172670 - protein, 15 aa, Mycobacterium bovis
DTVDRARDDTVADSW

SEQ ID NO: 172671 - protein, 7 aa, Mycobacterium bovis
DTVGGDR

SEQ ID NO: 172672 - protein, 14 aa, Mycobacterium bovis
DTVGNPKLHGGDDQ

SEQ ID NO: 172673 - protein, 9 aa, Mycobacterium bovis
DTVKDATGH

SEQ ID NO: 172674 - protein, 4 aa, Mycobacterium bovis
DTYI

SEQ ID NO: 172675 - protein, 11 aa, Mycobacterium bovis
DTYPARADEYG

SEQ ID NO: 172676 - protein, 4 aa, Mycobacterium bovis
DTYQ

SEQ ID NO: 172677 - protein, 7 aa, Mycobacterium bovis
DTYSEQN

SEQ ID NO: 172678 - protein, 16 aa, Mycobacterium bovis
DVAEEARPIQPYGSSI

SEQ ID NO: 172679 - protein, 7 aa, Mycobacterium bovis
DVAESEE

SEQ ID NO: 172680 - protein, 6 aa, Mycobacterium bovis
DVAPGR

SEQ ID NO: 172681 - protein, 8 aa, Mycobacterium bovis
DVATDETV

SEQ ID NO: 172682 - protein, 8 aa, Mycobacterium bovis
DVATGRSA

SEQ ID NO: 172683 - protein, 10 aa, Mycobacterium bovis
DVDANGNDIA

SEQ ID NO: 172684 - protein, 5 aa, Mycobacterium bovis
DVDDT

SEQ ID NO: 172685 - protein, 8 aa, Mycobacterium bovis
DVDERDQP

SEQ ID NO: 172686 - protein, 4 aa, Mycobacterium bovis
DVDG

SEQ ID NO: 172687 - protein, 10 aa, Mycobacterium bovis
DVDGAESNEA

SEQ ID NO: 172688 - protein, 5 aa, Mycobacterium bovis
DVDGI

SEQ ID NO: 172689 - protein, 6 aa, Mycobacterium bovis
DVDHGK

SEQ ID NO: 172690 - protein, 7 aa, Mycobacterium bovis
DVDNAER

SEQ ID NO: 172691 - protein, 38 aa, Mycobacterium bovis
DVEDSDSDDEDSDEDAADADVDEEDAAGLDGSPGEVDV

SEQ ID NO: 172692 - protein, 6 aa, Mycobacterium bovis
DVEPGR

SEQ ID NO: 172693 - protein, 7 aa, Mycobacterium bovis
DVERTGA

SEQ ID NO: 172694 - protein, 7 aa, Mycobacterium bovis
DVGAGRS

SEQ ID NO: 172695 - protein, 6 aa, Mycobacterium bovis
DVGGPP

SEQ ID NO: 172696 - protein, 8 aa, Mycobacterium bovis
DVGGSGLR

SEQ ID NO: 172697 - protein, 7 aa, Mycobacterium bovis
DVGPAAV

SEQ ID NO: 172698 - protein, 6 aa, Mycobacterium bovis
DVGRSV

SEQ ID NO: 172699 - protein, 7 aa, Mycobacterium bovis
DVGSNRV

SEQ ID NO: 172700 - protein, 8 aa, Mycobacterium bovis
DVIKSGGE

SEQ ID NO: 172701 - protein, 45 aa, Mycobacterium bovis
DVNTGIGNTGSFNTGSFNPGDSNTGDFNPGSYNTGLGNTGDVDTG

SEQ ID NO: 172702 - protein, 7 aa, Mycobacterium bovis
DVPAADS

SEQ ID NO: 172703 - protein, 6 aa, Mycobacterium bovis
DVPAAQ

SEQ ID NO: 172704 - protein, 6 aa, Mycobacterium bovis
DVPDDV

SEQ ID NO: 172705 - protein, 8 aa, Mycobacterium bovis
DVPEDGGA

SEQ ID NO: 172706 - protein, 7 aa, Mycobacterium bovis
DVPEDVT

SEQ ID NO: 172707 - protein, 5 aa, Mycobacterium bovis
DVPGL

SEQ ID NO: 172708 - protein, 7 aa, Mycobacterium bovis
DVPGTSA

SEQ ID NO: 172709 - protein, 5 aa, Mycobacterium bovis
DVPMA

SEQ ID NO: 172710 - protein, 7 aa, Mycobacterium bovis
DVPNDAQ

SEQ ID NO: 172711 - protein, 6 aa, Mycobacterium bovis
DVPTPA

SEQ ID NO: 172712 - protein, 4 aa, Mycobacterium bovis
DVQA

SEQ ID NO: 172713 - protein, 10 aa, Mycobacterium bovis
DVQGGTTQEG

SEQ ID NO: 172714 - protein, 15 aa, Mycobacterium bovis
DVRADAARSLNVESA

SEQ ID NO: 172715 - protein, 6 aa, Mycobacterium bovis
DVRANT

SEQ ID NO: 172716 - protein, 5 aa, Mycobacterium bovis
DVRGV

SEQ ID NO: 172717 - protein, 23 aa, Mycobacterium bovis
DVRRAAAEAAAHAREELAGGTPA

SEQ ID NO: 172718 - protein, 5 aa, Mycobacterium bovis
DVRTE

SEQ ID NO: 172719 - protein, 9 aa, Mycobacterium bovis
DVSAEEAER

SEQ ID NO: 172720 - protein, 8 aa, Mycobacterium bovis
DVSAGPGE

SEQ ID NO: 172721 - protein, 18 aa, Mycobacterium bovis
DVSARDQQQSDGQWTRAK

SEQ ID NO: 172722 - protein, 7 aa, Mycobacterium bovis
DVSGGIG

SEQ ID NO: 172723 - protein, 5 aa, Mycobacterium bovis
DVSPV

SEQ ID NO: 172724 - protein, 7 aa, Mycobacterium bovis
DVSRETP

SEQ ID NO: 172725 - protein, 6 aa, Mycobacterium bovis
DVSTDD

SEQ ID NO: 172726 - protein, 8 aa, Mycobacterium bovis
DVTDEAAV

SEQ ID NO: 172727 - protein, 8 aa, Mycobacterium bovis
DVTGGATY

SEQ ID NO: 172728 - protein, 7 aa, Mycobacterium bovis
DVTGRRP

SEQ ID NO: 172729 - protein, 13 aa, Mycobacterium bovis
DVTGTSKGKGFAG

SEQ ID NO: 172730 - protein, 7 aa, Mycobacterium bovis
DVTPDSV

SEQ ID NO: 172731 - protein, 7 aa, Mycobacterium bovis
DVTPGEL

SEQ ID NO: 172732 - protein, 15 aa, Mycobacterium bovis
DVTPLGAHPNDPVGQ

SEQ ID NO: 172733 - protein, 17 aa, Mycobacterium bovis
DVTPQPHNGVRPPNRRR

SEQ ID NO: 172734 - protein, 5 aa, Mycobacterium bovis
DVYAD

SEQ ID NO: 172735 - protein, 12 aa, Mycobacterium bovis
DWDPSQSTLPRT

SEQ ID NO: 172736 - protein, 8 aa, Mycobacterium bovis
DWDSSTDT

SEQ ID NO: 172737 - protein, 10 aa, Mycobacterium bovis
DWGSPKIPEE

SEQ ID NO: 172738 - protein, 8 aa, Mycobacterium bovis
DWGTETGA

SEQ ID NO: 172739 - protein, 8 aa, Mycobacterium bovis
DWPASPLP

SEQ ID NO: 172740 - protein, 7 aa, Mycobacterium bovis
DWPEPSG

SEQ ID NO: 172741 - protein, 4 aa, Mycobacterium bovis
DWQD

SEQ ID NO: 172742 - protein, 9 aa, Mycobacterium bovis
DWRGSPDQF

SEQ ID NO: 172743 - protein, 7 aa, Mycobacterium bovis
DYADNTK

SEQ ID NO: 172744 - protein, 8 aa, Mycobacterium bovis
DYDGSGVE

SEQ ID NO: 172745 - protein, 6 aa, Mycobacterium bovis
DYEEGG

SEQ ID NO: 172746 - protein, 5 aa, Mycobacterium bovis
DYEGR

SEQ ID NO: 172747 - protein, 15 aa, Mycobacterium bovis
DYGPGGNYADIPTPA

SEQ ID NO: 172748 - protein, 17 aa, Mycobacterium bovis
DYLDPAEARAEKATGAW

SEQ ID NO: 172749 - protein, 6 aa, Mycobacterium bovis
DYLPPY

SEQ ID NO: 172750 - protein, 6 aa, Mycobacterium bovis
DYPTDP

SEQ ID NO: 172751 - protein, 15 aa, Mycobacterium bovis
DYQTGIGGLNSGAGN

SEQ ID NO: 172752 - protein, 8 aa, Mycobacterium bovis
DYRTSGRT

SEQ ID NO: 172753 - protein, 10 aa, Mycobacterium bovis
DYSLGGEQSG

SEQ ID NO: 172754 - protein, 5 aa, Mycobacterium bovis
DYTDV

SEQ ID NO: 172755 - protein, 14 aa, Mycobacterium bovis
DYYDPEPGVPGRSV

SEQ ID NO: 172756 - protein, 10 aa, Mycobacterium bovis
EAAAARTEEF

SEQ ID NO: 172757 - protein, 22 aa, Mycobacterium bovis
EAAADVGADAEAAIAASRSGSQ

SEQ ID NO: 172758 - protein, 6 aa, Mycobacterium bovis
EAAAER

SEQ ID NO: 172759 - protein, 12 aa, Mycobacterium bovis
EAAAGAGLTGGG

SEQ ID NO: 172760 - protein, 13 aa, Mycobacterium bovis
EAAAKGKGYSEKL

SEQ ID NO: 172761 - protein, 8 aa, Mycobacterium bovis
EAAAMDPQ

SEQ ID NO: 172762 - protein, 9 aa, Mycobacterium bovis
EAAANGEDI

SEQ ID NO: 172763 - protein, 9 aa, Mycobacterium bovis
EAAARQAGT

SEQ ID NO: 172764 - protein, 10 aa, Mycobacterium bovis
EAADKLRSPI

SEQ ID NO: 172765 - protein, 7 aa, Mycobacterium bovis
EAADPGE

SEQ ID NO: 172766 - protein, 8 aa, Mycobacterium bovis
EAADPTTH

SEQ ID NO: 172767 - protein, 11 aa, Mycobacterium bovis
EAADSPARDRM

SEQ ID NO: 172768 - protein, 4 aa, Mycobacterium bovis
EAAE

SEQ ID NO: 172769 - protein, 14 aa, Mycobacterium bovis
EAAEAAAAAPAAVG

SEQ ID NO: 172770 - protein, 6 aa, Mycobacterium bovis
EAAEAS

SEQ ID NO: 172771 - protein, 6 aa, Mycobacterium bovis
EAAEDN

SEQ ID NO: 172772 - protein, 29 aa, Mycobacterium bovis
EAAEGAASAAAAGLADSVTPAGLGASLGE

SEQ ID NO: 172773 - protein, 7 aa, Mycobacterium bovis
EAAEKAK

SEQ ID NO: 172774 - protein, 8 aa, Mycobacterium bovis
EAAEQALT

SEQ ID NO: 172775 - protein, 6 aa, Mycobacterium bovis
EAAGGR

SEQ ID NO: 172776 - protein, 8 aa, Mycobacterium bovis
EAAGGVGG

SEQ ID NO: 172777 - protein, 11 aa, Mycobacterium bovis
EAANDASHEHP

SEQ ID NO: 172778 - protein, 15 aa, Mycobacterium bovis
EAANGSGDISYEPTN

SEQ ID NO: 172779 - protein, 8 aa, Mycobacterium bovis
EAAPTAGL

SEQ ID NO: 172780 - protein, 8 aa, Mycobacterium bovis
EAAQAAGE

SEQ ID NO: 172781 - protein, 8 aa, Mycobacterium bovis
EAAQQTFE

SEQ ID NO: 172782 - protein, 4 aa, Mycobacterium bovis
EAAR

SEQ ID NO: 172783 - protein, 13 aa, Mycobacterium bovis
EAARREAQSAFGD

SEQ ID NO: 172784 - protein, 11 aa, Mycobacterium bovis
EAARRQLEETH

SEQ ID NO: 172785 - protein, 8 aa, Mycobacterium bovis
EAARRYER

SEQ ID NO: 172786 - protein, 7 aa, Mycobacterium bovis
EAARTTY

SEQ ID NO: 172787 - protein, 6 aa, Mycobacterium bovis
EAASDA

SEQ ID NO: 172788 - protein, 10 aa, Mycobacterium bovis
EAASRAAAHG

SEQ ID NO: 172789 - protein, 7 aa, Mycobacterium bovis
EAASTQV

SEQ ID NO: 172790 - protein, 5 aa, Mycobacterium bovis
EAATA

SEQ ID NO: 172791 - protein, 9 aa, Mycobacterium bovis
EAATKRRRG

SEQ ID NO: 172792 - protein, 7 aa, Mycobacterium bovis
EAATTAR

SEQ ID NO: 172793 - protein, 9 aa, Mycobacterium bovis
EAAVGEAPI

SEQ ID NO: 172794 - protein, 4 aa, Mycobacterium bovis
EADA

SEQ ID NO: 172795 - protein, 16 aa, Mycobacterium bovis
EADADIASGRTYGEDE

SEQ ID NO: 172796 - protein, 7 aa, Mycobacterium bovis
EADALKA

SEQ ID NO: 172797 - protein, 8 aa, Mycobacterium bovis
EADASGDL

SEQ ID NO: 172798 - protein, 9 aa, Mycobacterium bovis
EADASGDLI

SEQ ID NO: 172799 - protein, 5 aa, Mycobacterium bovis
EADDG

SEQ ID NO: 172800 - protein, 5 aa, Mycobacterium bovis
EADDT

SEQ ID NO: 172801 - protein, 17 aa, Mycobacterium bovis
EADEGKAPAGRTPGLPG

SEQ ID NO: 172802 - protein, 7 aa, Mycobacterium bovis
EADGRRP

SEQ ID NO: 172803 - protein, 7 aa, Mycobacterium bovis
EADGTIT

SEQ ID NO: 172804 - protein, 5 aa, Mycobacterium bovis
EADGY

SEQ ID NO: 172805 - protein, 4 aa, Mycobacterium bovis
EADP

SEQ ID NO: 172806 - protein, 7 aa, Mycobacterium bovis
EADPSMA

SEQ ID NO: 172807 - protein, 11 aa, Mycobacterium bovis
EADPSNPDMQK

SEQ ID NO: 172808 - protein, 7 aa, Mycobacterium bovis
EADRDGF

SEQ ID NO: 172809 - protein, 8 aa, Mycobacterium bovis
EADRPQLA

SEQ ID NO: 172810 - protein, 7 aa, Mycobacterium bovis
EADSDRD

SEQ ID NO: 172811 - protein, 5 aa, Mycobacterium bovis
EADSG

SEQ ID NO: 172812 - protein, 11 aa, Mycobacterium bovis
EADSKATGPGV

SEQ ID NO: 172813 - protein, 4 aa, Mycobacterium bovis
EAEA

SEQ ID NO: 172814 - protein, 8 aa, Mycobacterium bovis
EAEARRAR

SEQ ID NO: 172815 - protein, 8 aa, Mycobacterium bovis
EAEDTRKH

SEQ ID NO: 172816 - protein, 4 aa, Mycobacterium bovis
EAEG

SEQ ID NO: 172817 - protein, 21 aa, Mycobacterium bovis
EAEGAKADARRKVRDGGEREM

SEQ ID NO: 172818 - protein, 9 aa, Mycobacterium bovis
EAEGQPQVN

SEQ ID NO: 172819 - protein, 4 aa, Mycobacterium bovis
EAEN

SEQ ID NO: 172820 - protein, 8 aa, Mycobacterium bovis
EAEPGSDH

SEQ ID NO: 172821 - protein, 13 aa, Mycobacterium bovis
EAEQQQLQSYITQ

SEQ ID NO: 172822 - protein, 12 aa, Mycobacterium bovis
EAERKAGESAEQ

SEQ ID NO: 172823 - protein, 4 aa, Mycobacterium bovis
EAES

SEQ ID NO: 172824 - protein, 5 aa, Mycobacterium bovis
EAETT

SEQ ID NO: 172825 - protein, 17 aa, Mycobacterium bovis
EAGAAEAAAGAGGAAGW

SEQ ID NO: 172826 - protein, 7 aa, Mycobacterium bovis
EAGATAD

SEQ ID NO: 172827 - protein, 8 aa, Mycobacterium bovis
EAGDGQEA

SEQ ID NO: 172828 - protein, 8 aa, Mycobacterium bovis
EAGDRQAN

SEQ ID NO: 172829 - protein, 15 aa, Mycobacterium bovis
EAGEPQASGKTYKVT

SEQ ID NO: 172830 - protein, 12 aa, Mycobacterium bovis
EAGERSGSSTPF

SEQ ID NO: 172831 - protein, 8 aa, Mycobacterium bovis
EAGETAIG

SEQ ID NO: 172832 - protein, 16 aa, Mycobacterium bovis
EAGGDGSDGGAGGSGG

SEQ ID NO: 172833 - protein, 7 aa, Mycobacterium bovis
EAGGDPW

SEQ ID NO: 172834 - protein, 6 aa, Mycobacterium bovis
EAGHRS

SEQ ID NO: 172835 - protein, 8 aa, Mycobacterium bovis
EAGIGPED

SEQ ID NO: 172836 - protein, 6 aa, Mycobacterium bovis
EAGKED

SEQ ID NO: 172837 - protein, 4 aa, Mycobacterium bovis
EAGM

SEQ ID NO: 172838 - protein, 5 aa, Mycobacterium bovis
EAGNA

SEQ ID NO: 172839 - protein, 9 aa, Mycobacterium bovis
EAGPAFQGT

SEQ ID NO: 172840 - protein, 6 aa, Mycobacterium bovis
EAGPAR

SEQ ID NO: 172841 - protein, 8 aa, Mycobacterium bovis
EAGPDGHE

SEQ ID NO: 172842 - protein, 9 aa, Mycobacterium bovis
EAGRGIPVP

SEQ ID NO: 172843 - protein, 7 aa, Mycobacterium bovis
EAGSGEH

SEQ ID NO: 172844 - protein, 11 aa, Mycobacterium bovis
EAGSHGKDTRG

SEQ ID NO: 172845 - protein, 6 aa, Mycobacterium bovis
EAGSVA

SEQ ID NO: 172846 - protein, 8 aa, Mycobacterium bovis
EAGTNAAH

SEQ ID NO: 172847 - protein, 7 aa, Mycobacterium bovis
EAGTVNG

SEQ ID NO: 172848 - protein, 8 aa, Mycobacterium bovis
EAGVPPPR

SEQ ID NO: 172849 - protein, 6 aa, Mycobacterium bovis
EAGVPS

SEQ ID NO: 172850 - protein, 20 aa, Mycobacterium bovis
EAHAEEDRKRREEADVRNQA

SEQ ID NO: 172851 - protein, 7 aa, Mycobacterium bovis
EAIGPGD

SEQ ID NO: 172852 - protein, 10 aa, Mycobacterium bovis
EAISASGGTI

SEQ ID NO: 172853 - protein, 20 aa, Mycobacterium bovis
EAKARQAADEQATARAEAEA

SEQ ID NO: 172854 - protein, 13 aa, Mycobacterium bovis
EAKEGIETTETGE

SEQ ID NO: 172855 - protein, 7 aa, Mycobacterium bovis
EAKGRNG

SEQ ID NO: 172856 - protein, 5 aa, Mycobacterium bovis
EAKIE

SEQ ID NO: 172857 - protein, 11 aa, Mycobacterium bovis
EAKKSRDFASV

SEQ ID NO: 172858 - protein, 10 aa, Mycobacterium bovis
EAKNAAASEE

SEQ ID NO: 172859 - protein, 9 aa, Mycobacterium bovis
EAKQISAES

SEQ ID NO: 172860 - protein, 5 aa, Mycobacterium bovis
EALEG

SEQ ID NO: 172861 - protein, 11 aa, Mycobacterium bovis
EALGDAPEADG

SEQ ID NO: 172862 - protein, 7 aa, Mycobacterium bovis
EALGGDP

SEQ ID NO: 172863 - protein, 12 aa, Mycobacterium bovis
EALGSNGSTSMG

SEQ ID NO: 172864 - protein, 29 aa, Mycobacterium bovis
EALPAGGTTATPRPATETSGGAIAEQPYG

SEQ ID NO: 172865 - protein, 5 aa, Mycobacterium bovis
EALSK

SEQ ID NO: 172866 - protein, 5 aa, Mycobacterium bovis
EAMGG

SEQ ID NO: 172867 - protein, 6 aa, Mycobacterium bovis
EAMRPG

SEQ ID NO: 172868 - protein, 8 aa, Mycobacterium bovis
EAMTQKPP

SEQ ID NO: 172869 - protein, 4 aa, Mycobacterium bovis
EANA

SEQ ID NO: 172870 - protein, 8 aa, Mycobacterium bovis
EANASNAR

SEQ ID NO: 172871 - protein, 11 aa, Mycobacterium bovis
EANEETGIDPS

SEQ ID NO: 172872 - protein, 4 aa, Mycobacterium bovis
EANG

SEQ ID NO: 172873 - protein, 17 aa, Mycobacterium bovis
EANGDAREGFPAGTGWD

SEQ ID NO: 172874 - protein, 10 aa, Mycobacterium bovis
EANGIDPQPL

SEQ ID NO: 172875 - protein, 7 aa, Mycobacterium bovis
EANKDQA

SEQ ID NO: 172876 - protein, 7 aa, Mycobacterium bovis
EANKDRA

SEQ ID NO: 172877 - protein, 8 aa, Mycobacterium bovis
EANPRTRS

SEQ ID NO: 172878 - protein, 4 aa, Mycobacterium bovis
EAPA

SEQ ID NO: 172879 - protein, 7 aa, Mycobacterium bovis
EAPEETN

SEQ ID NO: 172880 - protein, 10 aa, Mycobacterium bovis
EAPGGEAARQ

SEQ ID NO: 172881 - protein, 12 aa, Mycobacterium bovis
EAPPAGADTEET

SEQ ID NO: 172882 - protein, 25 aa, Mycobacterium bovis
EAPPRSVPSHGEPLGSAAPEGLEGE

SEQ ID NO: 172883 - protein, 12 aa, Mycobacterium bovis
EAPQNGPAEGDS

SEQ ID NO: 172884 - protein, 6 aa, Mycobacterium bovis
EAPSPL

SEQ ID NO: 172885 - protein, 14 aa, Mycobacterium bovis
EAPSPLLDPQTRER

SEQ ID NO: 172886 - protein, 7 aa, Mycobacterium bovis
EAPTTER

SEQ ID NO: 172887 - protein, 4 aa, Mycobacterium bovis
EAPV

SEQ ID NO: 172888 - protein, 41 aa, Mycobacterium bovis
EAQKAPHCPAESDQTPAGAAGDGDLPEVGGRVTSPPQPPVA

SEQ ID NO: 172889 - protein, 5 aa, Mycobacterium bovis
EAQKR

SEQ ID NO: 172890 - protein, 8 aa, Mycobacterium bovis
EAQNRYGR

SEQ ID NO: 172891 - protein, 10 aa, Mycobacterium bovis
EAQPGSQALA

SEQ ID NO: 172892 - protein, 9 aa, Mycobacterium bovis
EAQQQSKGR

SEQ ID NO: 172893 - protein, 4 aa, Mycobacterium bovis
EAQR

SEQ ID NO: 172894 - protein, 9 aa, Mycobacterium bovis
EAQRDTSTS

SEQ ID NO: 172895 - protein, 14 aa, Mycobacterium bovis
EAQRTADPVEGEQA

SEQ ID NO: 172896 - protein, 7 aa, Mycobacterium bovis
EAQTGRK

SEQ ID NO: 172897 - protein, 7 aa, Mycobacterium bovis
EARAEAA

SEQ ID NO: 172898 - protein, 4 aa, Mycobacterium bovis
EARE

SEQ ID NO: 172899 - protein, 5 aa, Mycobacterium bovis
EARED

SEQ ID NO: 172900 - protein, 6 aa, Mycobacterium bovis
EAREDD

SEQ ID NO: 172901 - protein, 5 aa, Mycobacterium bovis
EAREH

SEQ ID NO: 172902 - protein, 5 aa, Mycobacterium bovis
EARGA

SEQ ID NO: 172903 - protein, 5 aa, Mycobacterium bovis
EARGH

SEQ ID NO: 172904 - protein, 9 aa, Mycobacterium bovis
EARPPGKKI

SEQ ID NO: 172905 - protein, 5 aa, Mycobacterium bovis
EARQP

SEQ ID NO: 172906 - protein, 10 aa, Mycobacterium bovis
EARQVPGARK

SEQ ID NO: 172907 - protein, 5 aa, Mycobacterium bovis
EARRT

SEQ ID NO: 172908 - protein, 4 aa, Mycobacterium bovis
EART

SEQ ID NO: 172909 - protein, 7 aa, Mycobacterium bovis
EARTPDA

SEQ ID NO: 172910 - protein, 7 aa, Mycobacterium bovis
EASAASG

SEQ ID NO: 172911 - protein, 20 aa, Mycobacterium bovis
EASASGSSVMAGRKNKGAVA

SEQ ID NO: 172912 - protein, 4 aa, Mycobacterium bovis
EASE

SEQ ID NO: 172913 - protein, 6 aa, Mycobacterium bovis
EASEAS

SEQ ID NO: 172914 - protein, 11 aa, Mycobacterium bovis
EASERAGEEVP

SEQ ID NO: 172915 - protein, 6 aa, Mycobacterium bovis
EASGGS

SEQ ID NO: 172916 - protein, 25 aa, Mycobacterium bovis
EASGLPHTAKGSLDRRAVAERFGHS

SEQ ID NO: 172917 - protein, 6 aa, Mycobacterium bovis
EASPEV

SEQ ID NO: 172918 - protein, 7 aa, Mycobacterium bovis
EASPGNM

SEQ ID NO: 172919 - protein, 4 aa, Mycobacterium bovis
EASR

SEQ ID NO: 172920 - protein, 6 aa, Mycobacterium bovis
EASRRN

SEQ ID NO: 172921 - protein, 6 aa, Mycobacterium bovis
EASRRR

SEQ ID NO: 172922 - protein, 11 aa, Mycobacterium bovis
EASSSGRAAQI

SEQ ID NO: 172923 - protein, 9 aa, Mycobacterium bovis
EASSSRAGL

SEQ ID NO: 172924 - protein, 6 aa, Mycobacterium bovis
EASTAH

SEQ ID NO: 172925 - protein, 4 aa, Mycobacterium bovis
EASY

SEQ ID NO: 172926 - protein, 5 aa, Mycobacterium bovis
EASYA

SEQ ID NO: 172927 - protein, 10 aa, Mycobacterium bovis
EATAAEASPM

SEQ ID NO: 172928 - protein, 6 aa, Mycobacterium bovis
EATAAF

SEQ ID NO: 172929 - protein, 6 aa, Mycobacterium bovis
EATDET

SEQ ID NO: 172930 - protein, 15 aa, Mycobacterium bovis
EATDSSGKITKRGAD

SEQ ID NO: 172931 - protein, 4 aa, Mycobacterium bovis
EATE

SEQ ID NO: 172932 - protein, 5 aa, Mycobacterium bovis
EATEF

SEQ ID NO: 172933 - protein, 5 aa, Mycobacterium bovis
EATER

SEQ ID NO: 172934 - protein, 5 aa, Mycobacterium bovis
EATGA

SEQ ID NO: 172935 - protein, 19 aa, Mycobacterium bovis
EATGCGGGKTSYNVAPTDT

SEQ ID NO: 172936 - protein, 9 aa, Mycobacterium bovis
EATGETRTY

SEQ ID NO: 172937 - protein, 7 aa, Mycobacterium bovis
EATGGVQ

SEQ ID NO: 172938 - protein, 10 aa, Mycobacterium bovis
EATGRRPSAS

SEQ ID NO: 172939 - protein, 4 aa, Mycobacterium bovis
EATK

SEQ ID NO: 172940 - protein, 5 aa, Mycobacterium bovis
EATPL

SEQ ID NO: 172941 - protein, 13 aa, Mycobacterium bovis
EATQGRRRGSQAT

SEQ ID NO: 172942 - protein, 6 aa, Mycobacterium bovis
EATQTE

SEQ ID NO: 172943 - protein, 24 aa, Mycobacterium bovis
EATSRAEARAAQQRHAYLAKLKAA

SEQ ID NO: 172944 - protein, 6 aa, Mycobacterium bovis
EATTDT

SEQ ID NO: 172945 - protein, 10 aa, Mycobacterium bovis
EATTLDSNQG

SEQ ID NO: 172946 - protein, 7 aa, Mycobacterium bovis
EAVDGGP

SEQ ID NO: 172947 - protein, 12 aa, Mycobacterium bovis
EAVEKANDTDYG

SEQ ID NO: 172948 - protein, 12 aa, Mycobacterium bovis
EAVGGGGGDGAD

SEQ ID NO: 172949 - protein, 4 aa, Mycobacterium bovis
EAVT

SEQ ID NO: 172950 - protein, 9 aa, Mycobacterium bovis
EAYADGIDG

SEQ ID NO: 172951 - protein, 9 aa, Mycobacterium bovis
EAYADGIGG

SEQ ID NO: 172952 - protein, 4 aa, Mycobacterium bovis
ECGA

SEQ ID NO: 172953 - protein, 5 aa, Mycobacterium bovis
ECRNG

SEQ ID NO: 172954 - protein, 4 aa, Mycobacterium bovis
EDAA

SEQ ID NO: 172955 - protein, 5 aa, Mycobacterium bovis
EDAAR

SEQ ID NO: 172956 - protein, 17 aa, Mycobacterium bovis
EDADERSHTAQKVDISR

SEQ ID NO: 172957 - protein, 11 aa, Mycobacterium bovis
EDAETADPSGL

SEQ ID NO: 172958 - protein, 4 aa, Mycobacterium bovis
EDAG

SEQ ID NO: 172959 - protein, 6 aa, Mycobacterium bovis
EDAGSR

SEQ ID NO: 172960 - protein, 12 aa, Mycobacterium bovis
EDAKRKAAAGLE

SEQ ID NO: 172961 - protein, 15 aa, Mycobacterium bovis
EDAPDRIAAAIIERF

SEQ ID NO: 172962 - protein, 9 aa, Mycobacterium bovis
EDAPERTSA

SEQ ID NO: 172963 - protein, 8 aa, Mycobacterium bovis
EDAPQGTS

SEQ ID NO: 172964 - protein, 4 aa, Mycobacterium bovis
EDAQ

SEQ ID NO: 172965 - protein, 6 aa, Mycobacterium bovis
EDASKD

SEQ ID NO: 172966 - protein, 9 aa, Mycobacterium bovis
EDASQSPFT

SEQ ID NO: 172967 - protein, 9 aa, Mycobacterium bovis
EDATADAVY

SEQ ID NO: 172968 - protein, 6 aa, Mycobacterium bovis
EDATER

SEQ ID NO: 172969 - protein, 9 aa, Mycobacterium bovis
EDAVRASRN

SEQ ID NO: 172970 - protein, 8 aa, Mycobacterium bovis
EDAWNGRA

SEQ ID NO: 172971 - protein, 10 aa, Mycobacterium bovis
EDCGGAGGSI

SEQ ID NO: 172972 - protein, 8 aa, Mycobacterium bovis
EDDAAAYA

SEQ ID NO: 172973 - protein, 8 aa, Mycobacterium bovis
EDDASGYT

SEQ ID NO: 172974 - protein, 6 aa, Mycobacterium bovis
EDDGPD

SEQ ID NO: 172975 - protein, 8 aa, Mycobacterium bovis
EDDTVEVG

SEQ ID NO: 172976 - protein, 7 aa, Mycobacterium bovis
EDDVDAE

SEQ ID NO: 172977 - protein, 15 aa, Mycobacterium bovis
EDEAERARSAGGGNW

SEQ ID NO: 172978 - protein, 9 aa, Mycobacterium bovis
EDEDELPAG

SEQ ID NO: 172979 - protein, 5 aa, Mycobacterium bovis
EDEQE

SEQ ID NO: 172980 - protein, 14 aa, Mycobacterium bovis
EDESGEPPASLSPA

SEQ ID NO: 172981 - protein, 7 aa, Mycobacterium bovis
EDEYPST

SEQ ID NO: 172982 - protein, 4 aa, Mycobacterium bovis
EDFD

SEQ ID NO: 172983 - protein, 5 aa, Mycobacterium bovis
EDFPD

SEQ ID NO: 172984 - protein, 15 aa, Mycobacterium bovis
EDGAELATSRRGQTV

SEQ ID NO: 172985 - protein, 8 aa, Mycobacterium bovis
EDGAETDL

SEQ ID NO: 172986 - protein, 9 aa, Mycobacterium bovis
EDGPAGPKL

SEQ ID NO: 172987 - protein, 6 aa, Mycobacterium bovis
EDGQPI

SEQ ID NO: 172988 - protein, 8 aa, Mycobacterium bovis
EDGQTIES

SEQ ID NO: 172989 - protein, 5 aa, Mycobacterium bovis
EDGRE

SEQ ID NO: 172990 - protein, 8 aa, Mycobacterium bovis
EDGSERVL

SEQ ID NO: 172991 - protein, 15 aa, Mycobacterium bovis
EDGSPVRGVSGGTDR

SEQ ID NO: 172992 - protein, 7 aa, Mycobacterium bovis
EDGTRVT

SEQ ID NO: 172993 - protein, 13 aa, Mycobacterium bovis
EDHTTTDSTLSIS

SEQ ID NO: 172994 - protein, 7 aa, Mycobacterium bovis
EDKSADV

SEQ ID NO: 172995 - protein, 12 aa, Mycobacterium bovis
EDLADNAQQPCG

SEQ ID NO: 172996 - protein, 14 aa, Mycobacterium bovis
EDLNAAREADTPAA

SEQ ID NO: 172997 - protein, 15 aa, Mycobacterium bovis
EDLPAHGEAVRRRFE

SEQ ID NO: 172998 - protein, 6 aa, Mycobacterium bovis
EDLPEQ

SEQ ID NO: 172999 - protein, 7 aa, Mycobacterium bovis
EDNAATR

SEQ ID NO: 173000 - protein, 7 aa, Mycobacterium bovis
EDNPDDV

SEQ ID NO: 173001 - protein, 6 aa, Mycobacterium bovis
EDPAAG

SEQ ID NO: 173002 - protein, 9 aa, Mycobacterium bovis
EDPAHGWQP

SEQ ID NO: 173003 - protein, 5 aa, Mycobacterium bovis
EDPAK

SEQ ID NO: 173004 - protein, 4 aa, Mycobacterium bovis
EDPD

SEQ ID NO: 173005 - protein, 5 aa, Mycobacterium bovis
EDPDK

SEQ ID NO: 173006 - protein, 8 aa, Mycobacterium bovis
EDPDRDGL

SEQ ID NO: 173007 - protein, 9 aa, Mycobacterium bovis
EDPETAPTT

SEQ ID NO: 173008 - protein, 10 aa, Mycobacterium bovis
EDPGTQAHSV

SEQ ID NO: 173009 - protein, 4 aa, Mycobacterium bovis
EDPL

SEQ ID NO: 173010 - protein, 7 aa, Mycobacterium bovis
EDPPHPQ

SEQ ID NO: 173011 - protein, 10 aa, Mycobacterium bovis
EDPSPGVDGQ

SEQ ID NO: 173012 - protein, 4 aa, Mycobacterium bovis
EDPT

SEQ ID NO: 173013 - protein, 10 aa, Mycobacterium bovis
EDPVPSDKHL

SEQ ID NO: 173014 - protein, 4 aa, Mycobacterium bovis
EDPY

SEQ ID NO: 173015 - protein, 4 aa, Mycobacterium bovis
EDQH

SEQ ID NO: 173016 - protein, 8 aa, Mycobacterium bovis
EDQLDPDD

SEQ ID NO: 173017 - protein, 8 aa, Mycobacterium bovis
EDQSRSAL

SEQ ID NO: 173018 - protein, 11 aa, Mycobacterium bovis
EDQYEPGSSRR

SEQ ID NO: 173019 - protein, 10 aa, Mycobacterium bovis
EDRAATDPLE

SEQ ID NO: 173020 - protein, 6 aa, Mycobacterium bovis
EDRDTI

SEQ ID NO: 173021 - protein, 7 aa, Mycobacterium bovis
EDRENEG

SEQ ID NO: 173022 - protein, 5 aa, Mycobacterium bovis
EDRGA

SEQ ID NO: 173023 - protein, 6 aa, Mycobacterium bovis
EDRPDA

SEQ ID NO: 173024 - protein, 8 aa, Mycobacterium bovis
EDRPGDKR

SEQ ID NO: 173025 - protein, 4 aa, Mycobacterium bovis
EDRQ

SEQ ID NO: 173026 - protein, 9 aa, Mycobacterium bovis
EDRSTPERA

SEQ ID NO: 173027 - protein, 6 aa, Mycobacterium bovis
EDSDDV

SEQ ID NO: 173028 - protein, 17 aa, Mycobacterium bovis
EDSGTELAERMLSWQQA

SEQ ID NO: 173029 - protein, 8 aa, Mycobacterium bovis
EDSPEEIG

SEQ ID NO: 173030 - protein, 4 aa, Mycobacterium bovis
EDSR

SEQ ID NO: 173031 - protein, 7 aa, Mycobacterium bovis
EDSRIGA

SEQ ID NO: 173032 - protein, 22 aa, Mycobacterium bovis
EDSSCGRPGDTRVSGRSSGAVR

SEQ ID NO: 173033 - protein, 17 aa, Mycobacterium bovis
EDSSSRRPFSQGFPKDS

SEQ ID NO: 173034 - protein, 14 aa, Mycobacterium bovis
EDSTAAATDAATVT

SEQ ID NO: 173035 - protein, 14 aa, Mycobacterium bovis
EDSVRAAGSPEIPS

SEQ ID NO: 173036 - protein, 8 aa, Mycobacterium bovis
EDTAAGGD

SEQ ID NO: 173037 - protein, 7 aa, Mycobacterium bovis
EDTDDDI

SEQ ID NO: 173038 - protein, 14 aa, Mycobacterium bovis
EDTDDLIADIDRAL

SEQ ID NO: 173039 - protein, 5 aa, Mycobacterium bovis
EDTER

SEQ ID NO: 173040 - protein, 9 aa, Mycobacterium bovis
EDTGELTPT

SEQ ID NO: 173041 - protein, 5 aa, Mycobacterium bovis
EDTGY

SEQ ID NO: 173042 - protein, 6 aa, Mycobacterium bovis
EDTGYS

SEQ ID NO: 173043 - protein, 4 aa, Mycobacterium bovis
EDTI

SEQ ID NO: 173044 - protein, 12 aa, Mycobacterium bovis
EDTKPKRRKRKK

SEQ ID NO: 173045 - protein, 7 aa, Mycobacterium bovis
EDTPLEQ

SEQ ID NO: 173046 - protein, 8 aa, Mycobacterium bovis
EDTRRRAG

SEQ ID NO: 173047 - protein, 5 aa, Mycobacterium bovis
EDVER

SEQ ID NO: 173048 - protein, 5 aa, Mycobacterium bovis
EDVGV

SEQ ID NO: 173049 - protein, 12 aa, Mycobacterium bovis
EDVPETSADPRV

SEQ ID NO: 173050 - protein, 7 aa, Mycobacterium bovis
EDVPPGA

SEQ ID NO: 173051 - protein, 12 aa, Mycobacterium bovis
EDVTGDYGSSVG

SEQ ID NO: 173052 - protein, 4 aa, Mycobacterium bovis
EEAA

SEQ ID NO: 173053 - protein, 5 aa, Mycobacterium bovis
EEAAD

SEQ ID NO: 173054 - protein, 5 aa, Mycobacterium bovis
EEAAS

SEQ ID NO: 173055 - protein, 5 aa, Mycobacterium bovis
EEAAT

SEQ ID NO: 173056 - protein, 8 aa, Mycobacterium bovis
EEADRREG

SEQ ID NO: 173057 - protein, 8 aa, Mycobacterium bovis
EEAETPPV

SEQ ID NO: 173058 - protein, 18 aa, Mycobacterium bovis
EEAGAAAADAVAEADAEL

SEQ ID NO: 173059 - protein, 6 aa, Mycobacterium bovis
EEAGPV

SEQ ID NO: 173060 - protein, 5 aa, Mycobacterium bovis
EEAHD

SEQ ID NO: 173061 - protein, 8 aa, Mycobacterium bovis
EEAHDNPD

SEQ ID NO: 173062 - protein, 6 aa, Mycobacterium bovis
EEAQNA

SEQ ID NO: 173063 - protein, 9 aa, Mycobacterium bovis
EEARAKEDH

SEQ ID NO: 173064 - protein, 10 aa, Mycobacterium bovis
EEASKEAKEV

SEQ ID NO: 173065 - protein, 11 aa, Mycobacterium bovis
EEATAAGTARY

SEQ ID NO: 173066 - protein, 5 aa, Mycobacterium bovis
EEDAA

SEQ ID NO: 173067 - protein, 7 aa, Mycobacterium bovis
EEDEKKM

SEQ ID NO: 173068 - protein, 4 aa, Mycobacterium bovis
EEEA

SEQ ID NO: 173069 - protein, 16 aa, Mycobacterium bovis
EEEADSSGMFQPANAP

SEQ ID NO: 173070 - protein, 10 aa, Mycobacterium bovis
EEENPEAAQA

SEQ ID NO: 173071 - protein, 12 aa, Mycobacterium bovis
EEGAPWQQEGET

SEQ ID NO: 173072 - protein, 5 aa, Mycobacterium bovis
EEGAR

SEQ ID NO: 173073 - protein, 5 aa, Mycobacterium bovis
EEGEV

SEQ ID NO: 173074 - protein, 9 aa, Mycobacterium bovis
EEGGQLTEK

SEQ ID NO: 173075 - protein, 4 aa, Mycobacterium bovis
EEGI

SEQ ID NO: 173076 - protein, 6 aa, Mycobacterium bovis
EEGIAD

SEQ ID NO: 173077 - protein, 27 aa, Mycobacterium bovis
EEGKAPFANPRNSAAGSLRQKDPAVTA

SEQ ID NO: 173078 - protein, 6 aa, Mycobacterium bovis
EEGKAV

SEQ ID NO: 173079 - protein, 7 aa, Mycobacterium bovis
EEGNADA

SEQ ID NO: 173080 - protein, 6 aa, Mycobacterium bovis
EEGPAL

SEQ ID NO: 173081 - protein, 7 aa, Mycobacterium bovis
EEGPTEQ

SEQ ID NO: 173082 - protein, 11 aa, Mycobacterium bovis
EEGQARTAQKK

SEQ ID NO: 173083 - protein, 7 aa, Mycobacterium bovis
EEGTKLG

SEQ ID NO: 173084 - protein, 8 aa, Mycobacterium bovis
EEHGGKYG

SEQ ID NO: 173085 - protein, 10 aa, Mycobacterium bovis
EEHGGRGLST

SEQ ID NO: 173086 - protein, 6 aa, Mycobacterium bovis
EEIGYG

SEQ ID NO: 173087 - protein, 10 aa, Mycobacterium bovis
EEKAKNPADD

SEQ ID NO: 173088 - protein, 10 aa, Mycobacterium bovis
EELESPPTNT

SEQ ID NO: 173089 - protein, 16 aa, Mycobacterium bovis
EELGGGDLHSRTSGVT

SEQ ID NO: 173090 - protein, 11 aa, Mycobacterium bovis
EELPDEPEPGT

SEQ ID NO: 173091 - protein, 13 aa, Mycobacterium bovis
EELQAQQTAESRA

SEQ ID NO: 173092 - protein, 14 aa, Mycobacterium bovis
EELSESTDWTATSA

SEQ ID NO: 173093 - protein, 22 aa, Mycobacterium bovis
EELTGPPQKPAYAAKPATPEEV

SEQ ID NO: 173094 - protein, 32 aa, Mycobacterium bovis
EEMGAAGDGSGGPAGSVDDEIRAAQKRVDDEE

SEQ ID NO: 173095 - protein, 8 aa, Mycobacterium bovis
EENKRQRA

SEQ ID NO: 173096 - protein, 6 aa, Mycobacterium bovis
EEPARR

SEQ ID NO: 173097 - protein, 7 aa, Mycobacterium bovis
EEPDGPV

SEQ ID NO: 173098 - protein, 7 aa, Mycobacterium bovis
EEPIDHT

SEQ ID NO: 173099 - protein, 7 aa, Mycobacterium bovis
EEPNGLQ

SEQ ID NO: 173100 - protein, 6 aa, Mycobacterium bovis
EEPPPS

SEQ ID NO: 173101 - protein, 11 aa, Mycobacterium bovis
EEPRPARPPHA

SEQ ID NO: 173102 - protein, 6 aa, Mycobacterium bovis
EEQDIQ

SEQ ID NO: 173103 - protein, 11 aa, Mycobacterium bovis
EEQGVAPEQLA

SEQ ID NO: 173104 - protein, 12 aa, Mycobacterium bovis
EEQNAADERAQH

SEQ ID NO: 173105 - protein, 4 aa, Mycobacterium bovis
EEQR

SEQ ID NO: 173106 - protein, 5 aa, Mycobacterium bovis
EEQRR

SEQ ID NO: 173107 - protein, 5 aa, Mycobacterium bovis
EERAE

SEQ ID NO: 173108 - protein, 9 aa, Mycobacterium bovis
EERAEREAR

SEQ ID NO: 173109 - protein, 4 aa, Mycobacterium bovis
EERG

SEQ ID NO: 173110 - protein, 20 aa, Mycobacterium bovis
EERKGKAPSDHAPVLVDLHA

SEQ ID NO: 173111 - protein, 9 aa, Mycobacterium bovis
EERNRADST

SEQ ID NO: 173112 - protein, 4 aa, Mycobacterium bovis
EERR

SEQ ID NO: 173113 - protein, 13 aa, Mycobacterium bovis
EESADPDIDADSD

SEQ ID NO: 173114 - protein, 7 aa, Mycobacterium bovis
EESGGQA

SEQ ID NO: 173115 - protein, 7 aa, Mycobacterium bovis
EESGTIA

SEQ ID NO: 173116 - protein, 6 aa, Mycobacterium bovis
EESIRR

SEQ ID NO: 173117 - protein, 4 aa, Mycobacterium bovis
EESL

SEQ ID NO: 173118 - protein, 7 aa, Mycobacterium bovis
EESQKAT

SEQ ID NO: 173119 - protein, 8 aa, Mycobacterium bovis
EESRGSTR

SEQ ID NO: 173120 - protein, 8 aa, Mycobacterium bovis
EESSTLGT

SEQ ID NO: 173121 - protein, 4 aa, Mycobacterium bovis
EETD

SEQ ID NO: 173122 - protein, 8 aa, Mycobacterium bovis
EETDPRIG

SEQ ID NO: 173123 - protein, 11 aa, Mycobacterium bovis
EETDRNPPRLE

SEQ ID NO: 173124 - protein, 6 aa, Mycobacterium bovis
EETGIR

SEQ ID NO: 173125 - protein, 11 aa, Mycobacterium bovis
EETTTHYSPSA

SEQ ID NO: 173126 - protein, 11 aa, Mycobacterium bovis
EEVGNGDGPEC

SEQ ID NO: 173127 - protein, 6 aa, Mycobacterium bovis
EEVPRD

SEQ ID NO: 173128 - protein, 16 aa, Mycobacterium bovis
EEVTRTTYSREHQREY

SEQ ID NO: 173129 - protein, 11 aa, Mycobacterium bovis
EEWSPDSESSH

SEQ ID NO: 173130 - protein, 10 aa, Mycobacterium bovis
EEYGGGGNAD

SEQ ID NO: 173131 - protein, 4 aa, Mycobacterium bovis
EFAP

SEQ ID NO: 173132 - protein, 16 aa, Mycobacterium bovis
EFAPGGPTAAVPPGSW

SEQ ID NO: 173133 - protein, 7 aa, Mycobacterium bovis
EFDGDRS

SEQ ID NO: 173134 - protein, 8 aa, Mycobacterium bovis
EFDPERAG

SEQ ID NO: 173135 - protein, 5 aa, Mycobacterium bovis
EFEGP

SEQ ID NO: 173136 - protein, 36 aa, Mycobacterium bovis
EFESEIDEAAAKQDSESDDPRIAARGRARLRAVGAI

SEQ ID NO: 173137 - protein, 5 aa, Mycobacterium bovis
EFGEK

SEQ ID NO: 173138 - protein, 7 aa, Mycobacterium bovis
EFGGPAV

SEQ ID NO: 173139 - protein, 9 aa, Mycobacterium bovis
EFGGSTTFT

SEQ ID NO: 173140 - protein, 7 aa, Mycobacterium bovis
EFGQPGT

SEQ ID NO: 173141 - protein, 7 aa, Mycobacterium bovis
EFGTPRS

SEQ ID NO: 173142 - protein, 5 aa, Mycobacterium bovis
EFPAK

SEQ ID NO: 173143 - protein, 5 aa, Mycobacterium bovis
EFTGE

SEQ ID NO: 173144 - protein, 5 aa, Mycobacterium bovis
EFTKR

SEQ ID NO: 173145 - protein, 6 aa, Mycobacterium bovis
EFTTPT

SEQ ID NO: 173146 - protein, 4 aa, Mycobacterium bovis
EGAA

SEQ ID NO: 173147 - protein, 12 aa, Mycobacterium bovis
EGAAAADRSVDG

SEQ ID NO: 173148 - protein, 7 aa, Mycobacterium bovis
EGAAATE

SEQ ID NO: 173149 - protein, 6 aa, Mycobacterium bovis
EGAALN

SEQ ID NO: 173150 - protein, 6 aa, Mycobacterium bovis
EGADGV

SEQ ID NO: 173151 - protein, 11 aa, Mycobacterium bovis
EGADQLPTDER

SEQ ID NO: 173152 - protein, 10 aa, Mycobacterium bovis
EGAEPGTQLT

SEQ ID NO: 173153 - protein, 6 aa, Mycobacterium bovis
EGAGDT

SEQ ID NO: 173154 - protein, 6 aa, Mycobacterium bovis
EGAGPA

SEQ ID NO: 173155 - protein, 9 aa, Mycobacterium bovis
EGAGSPAEI

SEQ ID NO: 173156 - protein, 13 aa, Mycobacterium bovis
EGALPPPRKKSRR

SEQ ID NO: 173157 - protein, 13 aa, Mycobacterium bovis
EGALRSGRTPDRR

SEQ ID NO: 173158 - protein, 6 aa, Mycobacterium bovis
EGAMTP

SEQ ID NO: 173159 - protein, 5 aa, Mycobacterium bovis
EGAPD

SEQ ID NO: 173160 - protein, 8 aa, Mycobacterium bovis
EGAPGQQE

SEQ ID NO: 173161 - protein, 9 aa, Mycobacterium bovis
EGAPPPAAV

SEQ ID NO: 173162 - protein, 16 aa, Mycobacterium bovis
EGARPGWVGSSAGALS

SEQ ID NO: 173163 - protein, 6 aa, Mycobacterium bovis
EGATTI

SEQ ID NO: 173164 - protein, 14 aa, Mycobacterium bovis
EGDAATACEASLDQ

SEQ ID NO: 173165 - protein, 7 aa, Mycobacterium bovis
EGDAAYD

SEQ ID NO: 173166 - protein, 8 aa, Mycobacterium bovis
EGDAGQQV

SEQ ID NO: 173167 - protein, 6 aa, Mycobacterium bovis
EGDANL

SEQ ID NO: 173168 - protein, 7 aa, Mycobacterium bovis
EGDDDRI

SEQ ID NO: 173169 - protein, 9 aa, Mycobacterium bovis
EGDEATGAN

SEQ ID NO: 173170 - protein, 8 aa, Mycobacterium bovis
EGDETVRP

SEQ ID NO: 173171 - protein, 6 aa, Mycobacterium bovis
EGDGGW

SEQ ID NO: 173172 - protein, 10 aa, Mycobacterium bovis
EGDRNPPVFD

SEQ ID NO: 173173 - protein, 6 aa, Mycobacterium bovis
EGDRVQ

SEQ ID NO: 173174 - protein, 4 aa, Mycobacterium bovis
EGDT

SEQ ID NO: 173175 - protein, 11 aa, Mycobacterium bovis
EGDTTPLREAG

SEQ ID NO: 173176 - protein, 6 aa, Mycobacterium bovis
EGDTVE

SEQ ID NO: 173177 - protein, 11 aa, Mycobacterium bovis
EGEDDPTEEEL

SEQ ID NO: 173178 - protein, 5 aa, Mycobacterium bovis
EGEDF

SEQ ID NO: 173179 - protein, 7 aa, Mycobacterium bovis
EGEGFDS

SEQ ID NO: 173180 - protein, 6 aa, Mycobacterium bovis
EGEGRS

SEQ ID NO: 173181 - protein, 7 aa, Mycobacterium bovis
EGEKDHA

SEQ ID NO: 173182 - protein, 19 aa, Mycobacterium bovis
EGESESRHGLARRVVAWLG

SEQ ID NO: 173183 - protein, 8 aa, Mycobacterium bovis
EGESQTVP

SEQ ID NO: 173184 - protein, 6 aa, Mycobacterium bovis
EGETRR

SEQ ID NO: 173185 - protein, 8 aa, Mycobacterium bovis
EGFAGKSS

SEQ ID NO: 173186 - protein, 4 aa, Mycobacterium bovis
EGFL

SEQ ID NO: 173187 - protein, 4 aa, Mycobacterium bovis
EGFS

SEQ ID NO: 173188 - protein, 6 aa, Mycobacterium bovis
EGGAAA

SEQ ID NO: 173189 - protein, 5 aa, Mycobacterium bovis
EGGAG

SEQ ID NO: 173190 - protein, 6 aa, Mycobacterium bovis
EGGAGL

SEQ ID NO: 173191 - protein, 6 aa, Mycobacterium bovis
EGGERV

SEQ ID NO: 173192 - protein, 10 aa, Mycobacterium bovis
EGGGELADGD

SEQ ID NO: 173193 - protein, 5 aa, Mycobacterium bovis
EGGGR

SEQ ID NO: 173194 - protein, 13 aa, Mycobacterium bovis
EGGGTANVTIIER

SEQ ID NO: 173195 - protein, 7 aa, Mycobacterium bovis
EGGIAPD

SEQ ID NO: 173196 - protein, 14 aa, Mycobacterium bovis
EGGKITGERETDEG

SEQ ID NO: 173197 - protein, 7 aa, Mycobacterium bovis
EGGPNTN

SEQ ID NO: 173198 - protein, 7 aa, Mycobacterium bovis
EGGPSRH

SEQ ID NO: 173199 - protein, 5 aa, Mycobacterium bovis
EGGPT

SEQ ID NO: 173200 - protein, 7 aa, Mycobacterium bovis
EGGPTYW

SEQ ID NO: 173201 - protein, 12 aa, Mycobacterium bovis
EGGRGPKQARDC

SEQ ID NO: 173202 - protein, 17 aa, Mycobacterium bovis
EGGSRDVAPAAQLQRRR

SEQ ID NO: 173203 - protein, 8 aa, Mycobacterium bovis
EGGTAGTV

SEQ ID NO: 173204 - protein, 8 aa, Mycobacterium bovis
EGHPGHGP

SEQ ID NO: 173205 - protein, 6 aa, Mycobacterium bovis
EGHRNG

SEQ ID NO: 173206 - protein, 12 aa, Mycobacterium bovis
EGIRANTTAAAL

SEQ ID NO: 173207 - protein, 5 aa, Mycobacterium bovis
EGKGD

SEQ ID NO: 173208 - protein, 9 aa, Mycobacterium bovis
EGKKLSAAS

SEQ ID NO: 173209 - protein, 7 aa, Mycobacterium bovis
EGKSAHN

SEQ ID NO: 173210 - protein, 8 aa, Mycobacterium bovis
EGKSSQEY

SEQ ID NO: 173211 - protein, 5 aa, Mycobacterium bovis
EGKTA

SEQ ID NO: 173212 - protein, 10 aa, Mycobacterium bovis
EGKTAGDSAR

SEQ ID NO: 173213 - protein, 14 aa, Mycobacterium bovis
EGLGGGSVSAGIGR

SEQ ID NO: 173214 - protein, 5 aa, Mycobacterium bovis
EGLTI

SEQ ID NO: 173215 - protein, 6 aa, Mycobacterium bovis
EGMDSQ

SEQ ID NO: 173216 - protein, 8 aa, Mycobacterium bovis
EGNPPDPA

SEQ ID NO: 173217 - protein, 18 aa, Mycobacterium bovis
EGNRALDAGDHDGALRSA

SEQ ID NO: 173218 - protein, 8 aa, Mycobacterium bovis
EGPAPDQE

SEQ ID NO: 173219 - protein, 13 aa, Mycobacterium bovis
EGPAVEQPGQDNV

SEQ ID NO: 173220 - protein, 7 aa, Mycobacterium bovis
EGPDGLE

SEQ ID NO: 173221 - protein, 5 aa, Mycobacterium bovis
EGPDT

SEQ ID NO: 173222 - protein, 6 aa, Mycobacterium bovis
EGPDYA

SEQ ID NO: 173223 - protein, 9 aa, Mycobacterium bovis
EGPEPGDSL

SEQ ID NO: 173224 - protein, 8 aa, Mycobacterium bovis
EGPEVETE

SEQ ID NO: 173225 - protein, 18 aa, Mycobacterium bovis
EGPEVGGPYGPYRQSQRA

SEQ ID NO: 173226 - protein, 5 aa, Mycobacterium bovis
EGPGA

SEQ ID NO: 173227 - protein, 8 aa, Mycobacterium bovis
EGPGDGPP

SEQ ID NO: 173228 - protein, 14 aa, Mycobacterium bovis
EGPGITDDARAGAA

SEQ ID NO: 173229 - protein, 6 aa, Mycobacterium bovis
EGPGLT

SEQ ID NO: 173230 - protein, 9 aa, Mycobacterium bovis
EGPKGGPGM

SEQ ID NO: 173231 - protein, 6 aa, Mycobacterium bovis
EGPKNV

SEQ ID NO: 173232 - protein, 5 aa, Mycobacterium bovis
EGPLR

SEQ ID NO: 173233 - protein, 11 aa, Mycobacterium bovis
EGPLRDSTAGR

SEQ ID NO: 173234 - protein, 4 aa, Mycobacterium bovis
EGPQ

SEQ ID NO: 173235 - protein, 4 aa, Mycobacterium bovis
EGPR

SEQ ID NO: 173236 - protein, 4 aa, Mycobacterium bovis
EGPT

SEQ ID NO: 173237 - protein, 24 aa, Mycobacterium bovis
EGPVASATDPLDTRGDSDYENQPV

SEQ ID NO: 173238 - protein, 5 aa, Mycobacterium bovis
EGPVD

SEQ ID NO: 173239 - protein, 5 aa, Mycobacterium bovis
EGQEV

SEQ ID NO: 173240 - protein, 5 aa, Mycobacterium bovis
EGQKT

SEQ ID NO: 173241 - protein, 7 aa, Mycobacterium bovis
EGQQAKT

SEQ ID NO: 173242 - protein, 4 aa, Mycobacterium bovis
EGQS

SEQ ID NO: 173243 - protein, 7 aa, Mycobacterium bovis
EGQSTRH

SEQ ID NO: 173244 - protein, 10 aa, Mycobacterium bovis
EGRDTSAMPR

SEQ ID NO: 173245 - protein, 8 aa, Mycobacterium bovis
EGREVTPT

SEQ ID NO: 173246 - protein, 7 aa, Mycobacterium bovis
EGRFDEQ

SEQ ID NO: 173247 - protein, 9 aa, Mycobacterium bovis
EGRGEPRDD

SEQ ID NO: 173248 - protein, 22 aa, Mycobacterium bovis
EGRGGGKADLAQGSGKNPTGID

SEQ ID NO: 173249 - protein, 13 aa, Mycobacterium bovis
EGRGQANATIVEL

SEQ ID NO: 173250 - protein, 5 aa, Mycobacterium bovis
EGRGV

SEQ ID NO: 173251 - protein, 5 aa, Mycobacterium bovis
EGRKD

SEQ ID NO: 173252 - protein, 7 aa, Mycobacterium bovis
EGRNATH

SEQ ID NO: 173253 - protein, 4 aa, Mycobacterium bovis
EGRQ

SEQ ID NO: 173254 - protein, 12 aa, Mycobacterium bovis
EGRRGQPRLRPP

SEQ ID NO: 173255 - protein, 10 aa, Mycobacterium bovis
EGRSLGDPET

SEQ ID NO: 173256 - protein, 11 aa, Mycobacterium bovis
EGSAADNRASL

SEQ ID NO: 173257 - protein, 7 aa, Mycobacterium bovis
EGSADPH

SEQ ID NO: 173258 - protein, 9 aa, Mycobacterium bovis
EGSARPGDT

SEQ ID NO: 173259 - protein, 8 aa, Mycobacterium bovis
EGSDADGL

SEQ ID NO: 173260 - protein, 8 aa, Mycobacterium bovis
EGSEERRI

SEQ ID NO: 173261 - protein, 7 aa, Mycobacterium bovis
EGSEGLR

SEQ ID NO: 173262 - protein, 10 aa, Mycobacterium bovis
EGSGADVSGL

SEQ ID NO: 173263 - protein, 9 aa, Mycobacterium bovis
EGSGLSKED

SEQ ID NO: 173264 - protein, 10 aa, Mycobacterium bovis
EGSHDRVSTT

SEQ ID NO: 173265 - protein, 5 aa, Mycobacterium bovis
EGSIS

SEQ ID NO: 173266 - protein, 7 aa, Mycobacterium bovis
EGSPTFG

SEQ ID NO: 173267 - protein, 10 aa, Mycobacterium bovis
EGSRPTTYDH

SEQ ID NO: 173268 - protein, 7 aa, Mycobacterium bovis
EGSRTRS

SEQ ID NO: 173269 - protein, 5 aa, Mycobacterium bovis
EGSVE

SEQ ID NO: 173270 - protein, 5 aa, Mycobacterium bovis
EGTAE

SEQ ID NO: 173271 - protein, 18 aa, Mycobacterium bovis
EGTAQLTPPAAAPDDDTV

SEQ ID NO: 173272 - protein, 8 aa, Mycobacterium bovis
EGTAVGKA

SEQ ID NO: 173273 - protein, 6 aa, Mycobacterium bovis
EGTDTA

SEQ ID NO: 173274 - protein, 5 aa, Mycobacterium bovis
EGTGA

SEQ ID NO: 173275 - protein, 6 aa, Mycobacterium bovis
EGTGPP

SEQ ID NO: 173276 - protein, 10 aa, Mycobacterium bovis
EGTGTVASTD

SEQ ID NO: 173277 - protein, 14 aa, Mycobacterium bovis
EGTKKLSKRDPQSN

SEQ ID NO: 173278 - protein, 7 aa, Mycobacterium bovis
EGTPAGG

SEQ ID NO: 173279 - protein, 5 aa, Mycobacterium bovis
EGTPE

SEQ ID NO: 173280 - protein, 16 aa, Mycobacterium bovis
EGTPHPARDGFPDEIA

SEQ ID NO: 173281 - protein, 7 aa, Mycobacterium bovis
EGTPPGL

SEQ ID NO: 173282 - protein, 6 aa, Mycobacterium bovis
EGTPVT

SEQ ID NO: 173283 - protein, 15 aa, Mycobacterium bovis
EGTPYKEATAAELAD

SEQ ID NO: 173284 - protein, 12 aa, Mycobacterium bovis
EGTRLDTTEVGS

SEQ ID NO: 173285 - protein, 10 aa, Mycobacterium bovis
EGTRSPDGRL

SEQ ID NO: 173286 - protein, 10 aa, Mycobacterium bovis
EGTRSRTGKM

SEQ ID NO: 173287 - protein, 7 aa, Mycobacterium bovis
EGTSTIT

SEQ ID NO: 173288 - protein, 4 aa, Mycobacterium bovis
EGTT

SEQ ID NO: 173289 - protein, 4 aa, Mycobacterium bovis
EGTV

SEQ ID NO: 173290 - protein, 9 aa, Mycobacterium bovis
EGVDENGTP

SEQ ID NO: 173291 - protein, 12 aa, Mycobacterium bovis
EGVEPSAALADN

SEQ ID NO: 173292 - protein, 6 aa, Mycobacterium bovis
EGVEQS

SEQ ID NO: 173293 - protein, 4 aa, Mycobacterium bovis
EGVP

SEQ ID NO: 173294 - protein, 6 aa, Mycobacterium bovis
EGVPAP

SEQ ID NO: 173295 - protein, 6 aa, Mycobacterium bovis
EGVPGE

SEQ ID NO: 173296 - protein, 4 aa, Mycobacterium bovis
EGVQ

SEQ ID NO: 173297 - protein, 11 aa, Mycobacterium bovis
EGVRRTGGNTV

SEQ ID NO: 173298 - protein, 8 aa, Mycobacterium bovis
EGVTASRA

SEQ ID NO: 173299 - protein, 5 aa, Mycobacterium bovis
EGVTP

SEQ ID NO: 173300 - protein, 7 aa, Mycobacterium bovis
EGWQGQA

SEQ ID NO: 173301 - protein, 9 aa, Mycobacterium bovis
EGYPTPTDK

SEQ ID NO: 173302 - protein, 10 aa, Mycobacterium bovis
EGYQQTENGY

SEQ ID NO: 173303 - protein, 9 aa, Mycobacterium bovis
EGYSPRFAG

SEQ ID NO: 173304 - protein, 7 aa, Mycobacterium bovis
EGYTPDF

SEQ ID NO: 173305 - protein, 17 aa, Mycobacterium bovis
EHAEAEKRAAARAGHAA

SEQ ID NO: 173306 - protein, 14 aa, Mycobacterium bovis
EHAHGGADQLSRGP

SEQ ID NO: 173307 - protein, 8 aa, Mycobacterium bovis
EHAKARGA

SEQ ID NO: 173308 - protein, 10 aa, Mycobacterium bovis
EHAKARGAKP

SEQ ID NO: 173309 - protein, 5 aa, Mycobacterium bovis
EHDEM

SEQ ID NO: 173310 - protein, 13 aa, Mycobacterium bovis
EHDGQPQHRTRKH

SEQ ID NO: 173311 - protein, 19 aa, Mycobacterium bovis
EHDPTAPGLPDVTTSAPAV

SEQ ID NO: 173312 - protein, 4 aa, Mycobacterium bovis
EHDR

SEQ ID NO: 173313 - protein, 7 aa, Mycobacterium bovis
EHEASDP

SEQ ID NO: 173314 - protein, 17 aa, Mycobacterium bovis
EHELGTKGPGQDGPGRE

SEQ ID NO: 173315 - protein, 10 aa, Mycobacterium bovis
EHGASSEAAR

SEQ ID NO: 173316 - protein, 9 aa, Mycobacterium bovis
EHGDRRSAA

SEQ ID NO: 173317 - protein, 15 aa, Mycobacterium bovis
EHGKTLADARGDVQR

SEQ ID NO: 173318 - protein, 7 aa, Mycobacterium bovis
EHGNERV

SEQ ID NO: 173319 - protein, 10 aa, Mycobacterium bovis
EHGPDGEPWR

SEQ ID NO: 173320 - protein, 12 aa, Mycobacterium bovis
EHGQGPGPGENI

SEQ ID NO: 173321 - protein, 4 aa, Mycobacterium bovis
EHGW

SEQ ID NO: 173322 - protein, 8 aa, Mycobacterium bovis
EHHSDSTE

SEQ ID NO: 173323 - protein, 4 aa, Mycobacterium bovis
EHKS

SEQ ID NO: 173324 - protein, 12 aa, Mycobacterium bovis
EHKSDPPQSLAE

SEQ ID NO: 173325 - protein, 6 aa, Mycobacterium bovis
EHKTRI

SEQ ID NO: 173326 - protein, 8 aa, Mycobacterium bovis
EHLGDRSP

SEQ ID NO: 173327 - protein, 4 aa, Mycobacterium bovis
EHPA

SEQ ID NO: 173328 - protein, 9 aa, Mycobacterium bovis
EHPAVPAAA

SEQ ID NO: 173329 - protein, 6 aa, Mycobacterium bovis
EHPDKL

SEQ ID NO: 173330 - protein, 7 aa, Mycobacterium bovis
EHPRGDA

SEQ ID NO: 173331 - protein, 5 aa, Mycobacterium bovis
EHPRP

SEQ ID NO: 173332 - protein, 5 aa, Mycobacterium bovis
EHPTY

SEQ ID NO: 173333 - protein, 25 aa, Mycobacterium bovis
EHQAEKAAAAGRTKEADEAKANAEQ

SEQ ID NO: 173334 - protein, 5 aa, Mycobacterium bovis
EHQGP

SEQ ID NO: 173335 - protein, 5 aa, Mycobacterium bovis
EHRDG

SEQ ID NO: 173336 - protein, 12 aa, Mycobacterium bovis
EHRGRKSGKPYQ

SEQ ID NO: 173337 - protein, 7 aa, Mycobacterium bovis
EHRGSPH

SEQ ID NO: 173338 - protein, 5 aa, Mycobacterium bovis
EHRRT

SEQ ID NO: 173339 - protein, 13 aa, Mycobacterium bovis
EHRSTVSPYLVKQ

SEQ ID NO: 173340 - protein, 8 aa, Mycobacterium bovis
EHSSDGKF

SEQ ID NO: 173341 - protein, 11 aa, Mycobacterium bovis
EHTDDYPELDQ

SEQ ID NO: 173342 - protein, 27 aa, Mycobacterium bovis
EHTEHDDSEIVGEPEAGALVDLSSMDA

SEQ ID NO: 173343 - protein, 6 aa, Mycobacterium bovis
EHTGGG

SEQ ID NO: 173344 - protein, 6 aa, Mycobacterium bovis
EHTGGP

SEQ ID NO: 173345 - protein, 11 aa, Mycobacterium bovis
EHTGNTSAASI

SEQ ID NO: 173346 - protein, 5 aa, Mycobacterium bovis
EHTGR

SEQ ID NO: 173347 - protein, 4 aa, Mycobacterium bovis
EHTS

SEQ ID NO: 173348 - protein, 12 aa, Mycobacterium bovis
EIAGARAAAAAG

SEQ ID NO: 173349 - protein, 5 aa, Mycobacterium bovis
EIAGP

SEQ ID NO: 173350 - protein, 4 aa, Mycobacterium bovis
EIDG

SEQ ID NO: 173351 - protein, 10 aa, Mycobacterium bovis
EIDKARSELA

SEQ ID NO: 173352 - protein, 16 aa, Mycobacterium bovis
EIDPEDLEDADPFEEG

SEQ ID NO: 173353 - protein, 10 aa, Mycobacterium bovis
EIEAPGSGAT

SEQ ID NO: 173354 - protein, 5 aa, Mycobacterium bovis
EIEDE

SEQ ID NO: 173355 - protein, 14 aa, Mycobacterium bovis
EIENSDSDYDREKL

SEQ ID NO: 173356 - protein, 4 aa, Mycobacterium bovis
EIER

SEQ ID NO: 173357 - protein, 5 aa, Mycobacterium bovis
EIGGG

SEQ ID NO: 173358 - protein, 6 aa, Mycobacterium bovis
EIGKSS

SEQ ID NO: 173359 - protein, 11 aa, Mycobacterium bovis
EIGPEDCPEAP

SEQ ID NO: 173360 - protein, 10 aa, Mycobacterium bovis
EIGPYGSSRT

SEQ ID NO: 173361 - protein, 5 aa, Mycobacterium bovis
EIGRG

SEQ ID NO: 173362 - protein, 9 aa, Mycobacterium bovis
EIGRTQYGN

SEQ ID NO: 173363 - protein, 8 aa, Mycobacterium bovis
EIGTGSVP

SEQ ID NO: 173364 - protein, 5 aa, Mycobacterium bovis
EIHDS

SEQ ID NO: 173365 - protein, 11 aa, Mycobacterium bovis
EIKNGQRKQVN

SEQ ID NO: 173366 - protein, 10 aa, Mycobacterium bovis
EIPADRPALP

SEQ ID NO: 173367 - protein, 15 aa, Mycobacterium bovis
EIPDGSPDDPGAAET

SEQ ID NO: 173368 - protein, 16 aa, Mycobacterium bovis
EIPDTTSEDGGLPTDH

SEQ ID NO: 173369 - protein, 4 aa, Mycobacterium bovis
EIPE

SEQ ID NO: 173370 - protein, 12 aa, Mycobacterium bovis
EIPEADAVEQGR

SEQ ID NO: 173371 - protein, 4 aa, Mycobacterium bovis
EIPN

SEQ ID NO: 173372 - protein, 22 aa, Mycobacterium bovis
EIPPTSSIASERSHRGLARGQS

SEQ ID NO: 173373 - protein, 15 aa, Mycobacterium bovis
EIPSFAPPKELQPSE

SEQ ID NO: 173374 - protein, 7 aa, Mycobacterium bovis
EIPTAKA

SEQ ID NO: 173375 - protein, 6 aa, Mycobacterium bovis
EIRNRA

SEQ ID NO: 173376 - protein, 10 aa, Mycobacterium bovis
EISEEQARAA

SEQ ID NO: 173377 - protein, 4 aa, Mycobacterium bovis
EISP

SEQ ID NO: 173378 - protein, 7 aa, Mycobacterium bovis
EITGKPV

SEQ ID NO: 173379 - protein, 7 aa, Mycobacterium bovis
EITPQTT

SEQ ID NO: 173380 - protein, 12 aa, Mycobacterium bovis
EIYGGTKSAWDY

SEQ ID NO: 173381 - protein, 8 aa, Mycobacterium bovis
EKAAGPRR

SEQ ID NO: 173382 - protein, 9 aa, Mycobacterium bovis
EKADAAVAA

SEQ ID NO: 173383 - protein, 6 aa, Mycobacterium bovis
EKADRT

SEQ ID NO: 173384 - protein, 18 aa, Mycobacterium bovis
EKAERDLAKQATQYRPDQ

SEQ ID NO: 173385 - protein, 4 aa, Mycobacterium bovis
EKAG

SEQ ID NO: 173386 - protein, 5 aa, Mycobacterium bovis
EKAQE

SEQ ID NO: 173387 - protein, 15 aa, Mycobacterium bovis
EKATQPRTVSAPTSH

SEQ ID NO: 173388 - protein, 9 aa, Mycobacterium bovis
EKDCETRRQ

SEQ ID NO: 173389 - protein, 8 aa, Mycobacterium bovis
EKDEAVKG

SEQ ID NO: 173390 - protein, 9 aa, Mycobacterium bovis
EKDNTVGTD

SEQ ID NO: 173391 - protein, 6 aa, Mycobacterium bovis
EKDPDT

SEQ ID NO: 173392 - protein, 9 aa, Mycobacterium bovis
EKDSSINDD

SEQ ID NO: 173393 - protein, 10 aa, Mycobacterium bovis
EKEAADGIEG

SEQ ID NO: 173394 - protein, 7 aa, Mycobacterium bovis
EKEAAPL

SEQ ID NO: 173395 - protein, 7 aa, Mycobacterium bovis
EKEDESF

SEQ ID NO: 173396 - protein, 6 aa, Mycobacterium bovis
EKFPTS

SEQ ID NO: 173397 - protein, 8 aa, Mycobacterium bovis
EKGAPTPV

SEQ ID NO: 173398 - protein, 14 aa, Mycobacterium bovis
EKGKPPKVFEDGGQ

SEQ ID NO: 173399 - protein, 8 aa, Mycobacterium bovis
EKGLTSKP

SEQ ID NO: 173400 - protein, 7 aa, Mycobacterium bovis
EKGNAAR

SEQ ID NO: 173401 - protein, 5 aa, Mycobacterium bovis
EKGPR

SEQ ID NO: 173402 - protein, 8 aa, Mycobacterium bovis
EKGQSRDL

SEQ ID NO: 173403 - protein, 4 aa, Mycobacterium bovis
EKGR

SEQ ID NO: 173404 - protein, 20 aa, Mycobacterium bovis
EKGSPESSGSQTSPDEKPPR

SEQ ID NO: 173405 - protein, 7 aa, Mycobacterium bovis
EKGTNRS

SEQ ID NO: 173406 - protein, 5 aa, Mycobacterium bovis
EKHKN

SEQ ID NO: 173407 - protein, 6 aa, Mycobacterium bovis
EKHPTP

SEQ ID NO: 173408 - protein, 10 aa, Mycobacterium bovis
EKKPKDVETK

SEQ ID NO: 173409 - protein, 4 aa, Mycobacterium bovis
EKKQ

SEQ ID NO: 173410 - protein, 7 aa, Mycobacterium bovis
EKLPAGQ

SEQ ID NO: 173411 - protein, 4 aa, Mycobacterium bovis
EKMG

SEQ ID NO: 173412 - protein, 6 aa, Mycobacterium bovis
EKMSKS

SEQ ID NO: 173413 - protein, 6 aa, Mycobacterium bovis
EKPDDV

SEQ ID NO: 173414 - protein, 10 aa, Mycobacterium bovis
EKPDETERTF

SEQ ID NO: 173415 - protein, 9 aa, Mycobacterium bovis
EKPGRREGW

SEQ ID NO: 173416 - protein, 21 aa, Mycobacterium bovis
EKPSARWGSQRTQRDPARRRR

SEQ ID NO: 173417 - protein, 6 aa, Mycobacterium bovis
EKPSLP

SEQ ID NO: 173418 - protein, 8 aa, Mycobacterium bovis
EKPTTGDV

SEQ ID NO: 173419 - protein, 6 aa, Mycobacterium bovis
EKPVKT

SEQ ID NO: 173420 - protein, 11 aa, Mycobacterium bovis
EKPVTPKSNYA

SEQ ID NO: 173421 - protein, 12 aa, Mycobacterium bovis
EKQARISTDIGA

SEQ ID NO: 173422 - protein, 5 aa, Mycobacterium bovis
EKQEP

SEQ ID NO: 173423 - protein, 5 aa, Mycobacterium bovis
EKQGE

SEQ ID NO: 173424 - protein, 18 aa, Mycobacterium bovis
EKQKDVSARFGSKEPDKF

SEQ ID NO: 173425 - protein, 11 aa, Mycobacterium bovis
EKQKEGKKRMK

SEQ ID NO: 173426 - protein, 4 aa, Mycobacterium bovis
EKQM

SEQ ID NO: 173427 - protein, 7 aa, Mycobacterium bovis
EKQRTRV

SEQ ID NO: 173428 - protein, 4 aa, Mycobacterium bovis
EKRA

SEQ ID NO: 173429 - protein, 8 aa, Mycobacterium bovis
EKRPLGDG

SEQ ID NO: 173430 - protein, 16 aa, Mycobacterium bovis
EKRPYPPGQHGRARIK

SEQ ID NO: 173431 - protein, 13 aa, Mycobacterium bovis
EKRRTYEARARGE

SEQ ID NO: 173432 - protein, 8 aa, Mycobacterium bovis
EKRSTVSE

SEQ ID NO: 173433 - protein, 11 aa, Mycobacterium bovis
EKSGEGGGNRV

SEQ ID NO: 173434 - protein, 21 aa, Mycobacterium bovis
EKSGGRSGVYRRSASDLACQS

SEQ ID NO: 173435 - protein, 9 aa, Mycobacterium bovis
EKSSAATEA

SEQ ID NO: 173436 - protein, 8 aa, Mycobacterium bovis
EKSSSEPI

SEQ ID NO: 173437 - protein, 8 aa, Mycobacterium bovis
EKSYGKGS

SEQ ID NO: 173438 - protein, 6 aa, Mycobacterium bovis
EKTGSL

SEQ ID NO: 173439 - protein, 8 aa, Mycobacterium bovis
EKVRGTGP

SEQ ID NO: 173440 - protein, 20 aa, Mycobacterium bovis
EKVSEKAARRSSGRPASNTA

SEQ ID NO: 173441 - protein, 8 aa, Mycobacterium bovis
ELAAPDDD

SEQ ID NO: 173442 - protein, 7 aa, Mycobacterium bovis
ELAATNP

SEQ ID NO: 173443 - protein, 9 aa, Mycobacterium bovis
ELADQKEKL

SEQ ID NO: 173444 - protein, 9 aa, Mycobacterium bovis
ELAGEPRPR

SEQ ID NO: 173445 - protein, 6 aa, Mycobacterium bovis
ELAPGR

SEQ ID NO: 173446 - protein, 5 aa, Mycobacterium bovis
ELAPR

SEQ ID NO: 173447 - protein, 14 aa, Mycobacterium bovis
ELAPVSEGGEDTGV

SEQ ID NO: 173448 - protein, 10 aa, Mycobacterium bovis
ELARAGADGV

SEQ ID NO: 173449 - protein, 14 aa, Mycobacterium bovis
ELASEQTLSFDVDR

SEQ ID NO: 173450 - protein, 8 aa, Mycobacterium bovis
ELDDESAA

SEQ ID NO: 173451 - protein, 8 aa, Mycobacterium bovis
ELDESAAR

SEQ ID NO: 173452 - protein, 10 aa, Mycobacterium bovis
ELDGQQAEDR

SEQ ID NO: 173453 - protein, 6 aa, Mycobacterium bovis
ELDPAG

SEQ ID NO: 173454 - protein, 14 aa, Mycobacterium bovis
ELDPSGAPDRPGGP

SEQ ID NO: 173455 - protein, 9 aa, Mycobacterium bovis
ELDTNDPVG

SEQ ID NO: 173456 - protein, 10 aa, Mycobacterium bovis
ELEGATPDGV

SEQ ID NO: 173457 - protein, 6 aa, Mycobacterium bovis
ELEKTK

SEQ ID NO: 173458 - protein, 8 aa, Mycobacterium bovis
ELENSATD

SEQ ID NO: 173459 - protein, 13 aa, Mycobacterium bovis
ELEPPGNRTGSNR

SEQ ID NO: 173460 - protein, 14 aa, Mycobacterium bovis
ELGEAGTNAHHGSG

SEQ ID NO: 173461 - protein, 5 aa, Mycobacterium bovis
ELGEP

SEQ ID NO: 173462 - protein, 21 aa, Mycobacterium bovis
ELGEPAVPPESARQAPPDTSL

SEQ ID NO: 173463 - protein, 7 aa, Mycobacterium bovis
ELGEPNR

SEQ ID NO: 173464 - protein, 11 aa, Mycobacterium bovis
ELGGADHQASY

SEQ ID NO: 173465 - protein, 7 aa, Mycobacterium bovis
ELGGDDK

SEQ ID NO: 173466 - protein, 7 aa, Mycobacterium bovis
ELGGQGF

SEQ ID NO: 173467 - protein, 8 aa, Mycobacterium bovis
ELGGSDAP

SEQ ID NO: 173468 - protein, 10 aa, Mycobacterium bovis
ELGKARDDAH

SEQ ID NO: 173469 - protein, 4 aa, Mycobacterium bovis
ELGP

SEQ ID NO: 173470 - protein, 7 aa, Mycobacterium bovis
ELGPDGK

SEQ ID NO: 173471 - protein, 27 aa, Mycobacterium bovis
ELGQRGSAAPVDSNADAGGFDQFNRGK

SEQ ID NO: 173472 - protein, 13 aa, Mycobacterium bovis
ELGRDPDSVRAEA

SEQ ID NO: 173473 - protein, 4 aa, Mycobacterium bovis
ELGS

SEQ ID NO: 173474 - protein, 5 aa, Mycobacterium bovis
ELGSA

SEQ ID NO: 173475 - protein, 9 aa, Mycobacterium bovis
ELGSAAASF

SEQ ID NO: 173476 - protein, 13 aa, Mycobacterium bovis
ELGSAASSFGSVT

SEQ ID NO: 173477 - protein, 7 aa, Mycobacterium bovis
ELGSAGA

SEQ ID NO: 173478 - protein, 8 aa, Mycobacterium bovis
ELGSPDRK

SEQ ID NO: 173479 - protein, 8 aa, Mycobacterium bovis
ELGTAAQS

SEQ ID NO: 173480 - protein, 18 aa, Mycobacterium bovis
ELGTAASSFSSVTTGLTG

SEQ ID NO: 173481 - protein, 7 aa, Mycobacterium bovis
ELGTLDE

SEQ ID NO: 173482 - protein, 9 aa, Mycobacterium bovis
ELGTTAASY

SEQ ID NO: 173483 - protein, 7 aa, Mycobacterium bovis
ELGYGSD

SEQ ID NO: 173484 - protein, 16 aa, Mycobacterium bovis
ELKPNSPYGASKAAAD

SEQ ID NO: 173485 - protein, 6 aa, Mycobacterium bovis
ELPAGH

SEQ ID NO: 173486 - protein, 6 aa, Mycobacterium bovis
ELPAPG

SEQ ID NO: 173487 - protein, 4 aa, Mycobacterium bovis
ELPD

SEQ ID NO: 173488 - protein, 7 aa, Mycobacterium bovis
ELPEGKD

SEQ ID NO: 173489 - protein, 15 aa, Mycobacterium bovis
ELPEGVGDGRELPGG

SEQ ID NO: 173490 - protein, 11 aa, Mycobacterium bovis
ELPENSHAEPG

SEQ ID NO: 173491 - protein, 12 aa, Mycobacterium bovis
ELPGARDQLRGT

SEQ ID NO: 173492 - protein, 6 aa, Mycobacterium bovis
ELPGDP

SEQ ID NO: 173493 - protein, 7 aa, Mycobacterium bovis
ELPGDPT

SEQ ID NO: 173494 - protein, 7 aa, Mycobacterium bovis
ELPGSDA

SEQ ID NO: 173495 - protein, 7 aa, Mycobacterium bovis
ELPKPAE

SEQ ID NO: 173496 - protein, 11 aa, Mycobacterium bovis
ELPKQGSRTPW

SEQ ID NO: 173497 - protein, 7 aa, Mycobacterium bovis
ELPMPQS

SEQ ID NO: 173498 - protein, 4 aa, Mycobacterium bovis
ELPN

SEQ ID NO: 173499 - protein, 5 aa, Mycobacterium bovis
ELPPG

SEQ ID NO: 173500 - protein, 7 aa, Mycobacterium bovis
ELPPGGR

SEQ ID NO: 173501 - protein, 10 aa, Mycobacterium bovis
ELPPQNDRAR

SEQ ID NO: 173502 - protein, 11 aa, Mycobacterium bovis
ELPPSSWGSGK

SEQ ID NO: 173503 - protein, 10 aa, Mycobacterium bovis
ELPSGDAPVQ

SEQ ID NO: 173504 - protein, 14 aa, Mycobacterium bovis
ELPTAGGEQARSVR

SEQ ID NO: 173505 - protein, 6 aa, Mycobacterium bovis
ELPTEP

SEQ ID NO: 173506 - protein, 9 aa, Mycobacterium bovis
ELQKRSTGR

SEQ ID NO: 173507 - protein, 4 aa, Mycobacterium bovis
ELQN

SEQ ID NO: 173508 - protein, 11 aa, Mycobacterium bovis
ELQRAGGGTGY

SEQ ID NO: 173509 - protein, 5 aa, Mycobacterium bovis
ELQSR

SEQ ID NO: 173510 - protein, 10 aa, Mycobacterium bovis
ELQSTAADYG

SEQ ID NO: 173511 - protein, 12 aa, Mycobacterium bovis
ELRAENRRRISP

SEQ ID NO: 173512 - protein, 6 aa, Mycobacterium bovis
ELRAPM

SEQ ID NO: 173513 - protein, 16 aa, Mycobacterium bovis
ELRDAGVSDKTLADPA

SEQ ID NO: 173514 - protein, 16 aa, Mycobacterium bovis
ELRDGNPGSSGQVPAP

SEQ ID NO: 173515 - protein, 5 aa, Mycobacterium bovis
ELRGS

SEQ ID NO: 173516 - protein, 4 aa, Mycobacterium bovis
ELRP

SEQ ID NO: 173517 - protein, 11 aa, Mycobacterium bovis
ELRPGSQGRSE

SEQ ID NO: 173518 - protein, 8 aa, Mycobacterium bovis
ELRPHQQQ

SEQ ID NO: 173519 - protein, 7 aa, Mycobacterium bovis
ELRRGAT

SEQ ID NO: 173520 - protein, 4 aa, Mycobacterium bovis
ELRT

SEQ ID NO: 173521 - protein, 8 aa, Mycobacterium bovis
ELRTEAGQ

SEQ ID NO: 173522 - protein, 4 aa, Mycobacterium bovis
ELSD

SEQ ID NO: 173523 - protein, 4 aa, Mycobacterium bovis
ELSQ

SEQ ID NO: 173524 - protein, 10 aa, Mycobacterium bovis
ELSTDDSPGF

SEQ ID NO: 173525 - protein, 10 aa, Mycobacterium bovis
ELSYSDQPDA

SEQ ID NO: 173526 - protein, 4 aa, Mycobacterium bovis
ELTG

SEQ ID NO: 173527 - protein, 7 aa, Mycobacterium bovis
ELTGRTR

SEQ ID NO: 173528 - protein, 11 aa, Mycobacterium bovis
ELTGVKEKSTL

SEQ ID NO: 173529 - protein, 6 aa, Mycobacterium bovis
ELTNGR

SEQ ID NO: 173530 - protein, 5 aa, Mycobacterium bovis
ELTRQ

SEQ ID NO: 173531 - protein, 9 aa, Mycobacterium bovis
ELTSTSNCT

SEQ ID NO: 173532 - protein, 9 aa, Mycobacterium bovis
EMDEPESRG

SEQ ID NO: 173533 - protein, 5 aa, Mycobacterium bovis
EMDPS

SEQ ID NO: 173534 - protein, 8 aa, Mycobacterium bovis
EMDPSGAG

SEQ ID NO: 173535 - protein, 5 aa, Mycobacterium bovis
EMDTP

SEQ ID NO: 173536 - protein, 11 aa, Mycobacterium bovis
EMEEPPPATPR

SEQ ID NO: 173537 - protein, 7 aa, Mycobacterium bovis
EMKSTGE

SEQ ID NO: 173538 - protein, 6 aa, Mycobacterium bovis
EMNTRG

SEQ ID NO: 173539 - protein, 5 aa, Mycobacterium bovis
EMPDD

SEQ ID NO: 173540 - protein, 14 aa, Mycobacterium bovis
EMPSTALSGTTGLG

SEQ ID NO: 173541 - protein, 9 aa, Mycobacterium bovis
EMSEESRVR

SEQ ID NO: 173542 - protein, 6 aa, Mycobacterium bovis
EMTKSN

SEQ ID NO: 173543 - protein, 4 aa, Mycobacterium bovis
EMTP

SEQ ID NO: 173544 - protein, 9 aa, Mycobacterium bovis
EMYPGPDGV

SEQ ID NO: 173545 - protein, 8 aa, Mycobacterium bovis
ENAAGKAA

SEQ ID NO: 173546 - protein, 7 aa, Mycobacterium bovis
ENADNRL

SEQ ID NO: 173547 - protein, 8 aa, Mycobacterium bovis
ENAEGADD

SEQ ID NO: 173548 - protein, 9 aa, Mycobacterium bovis
ENATGTQDE

SEQ ID NO: 173549 - protein, 4 aa, Mycobacterium bovis
ENDA

SEQ ID NO: 173550 - protein, 8 aa, Mycobacterium bovis
ENDEAERR

SEQ ID NO: 173551 - protein, 10 aa, Mycobacterium bovis
ENDPVATDPE

SEQ ID NO: 173552 - protein, 7 aa, Mycobacterium bovis
ENDQRPI

SEQ ID NO: 173553 - protein, 9 aa, Mycobacterium bovis
ENDSDESSL

SEQ ID NO: 173554 - protein, 8 aa, Mycobacterium bovis
ENEAGGPL

SEQ ID NO: 173555 - protein, 5 aa, Mycobacterium bovis
ENEDE

SEQ ID NO: 173556 - protein, 14 aa, Mycobacterium bovis
ENEDLPNTTNPDDW

SEQ ID NO: 173557 - protein, 5 aa, Mycobacterium bovis
ENEIE

SEQ ID NO: 173558 - protein, 12 aa, Mycobacterium bovis
ENERPTADPNIA

SEQ ID NO: 173559 - protein, 15 aa, Mycobacterium bovis
ENEVSGQLAATTGDV

SEQ ID NO: 173560 - protein, 8 aa, Mycobacterium bovis
ENGAEQLE

SEQ ID NO: 173561 - protein, 11 aa, Mycobacterium bovis
ENGSGRPPGPC

SEQ ID NO: 173562 - protein, 8 aa, Mycobacterium bovis
ENGSPAVA

SEQ ID NO: 173563 - protein, 7 aa, Mycobacterium bovis
ENGVGTV

SEQ ID NO: 173564 - protein, 9 aa, Mycobacterium bovis
ENHGGTGTI

SEQ ID NO: 173565 - protein, 6 aa, Mycobacterium bovis
ENHPQR

SEQ ID NO: 173566 - protein, 9 aa, Mycobacterium bovis
ENIPEPGIP

SEQ ID NO: 173567 - protein, 7 aa, Mycobacterium bovis
ENIPRDG

SEQ ID NO: 173568 - protein, 11 aa, Mycobacterium bovis
ENLGARPARFA

SEQ ID NO: 173569 - protein, 7 aa, Mycobacterium bovis
ENLGTAP

SEQ ID NO: 173570 - protein, 13 aa, Mycobacterium bovis
ENLPADDPVRNGN

SEQ ID NO: 173571 - protein, 6 aa, Mycobacterium bovis
ENLPFD

SEQ ID NO: 173572 - protein, 9 aa, Mycobacterium bovis
ENPADTDRE

SEQ ID NO: 173573 - protein, 8 aa, Mycobacterium bovis
ENPAEADH

SEQ ID NO: 173574 - protein, 6 aa, Mycobacterium bovis
ENPANP

SEQ ID NO: 173575 - protein, 5 aa, Mycobacterium bovis
ENPDL

SEQ ID NO: 173576 - protein, 6 aa, Mycobacterium bovis
ENPDMS

SEQ ID NO: 173577 - protein, 7 aa, Mycobacterium bovis
ENPDQLQ

SEQ ID NO: 173578 - protein, 5 aa, Mycobacterium bovis
ENPDS

SEQ ID NO: 173579 - protein, 7 aa, Mycobacterium bovis
ENPDSAA

SEQ ID NO: 173580 - protein, 8 aa, Mycobacterium bovis
ENPDTGWD

SEQ ID NO: 173581 - protein, 7 aa, Mycobacterium bovis
ENPHQQA

SEQ ID NO: 173582 - protein, 4 aa, Mycobacterium bovis
ENPL

SEQ ID NO: 173583 - protein, 12 aa, Mycobacterium bovis
ENPPAGGAESAI

SEQ ID NO: 173584 - protein, 6 aa, Mycobacterium bovis
ENPPGV

SEQ ID NO: 173585 - protein, 8 aa, Mycobacterium bovis
ENPPTDTR

SEQ ID NO: 173586 - protein, 7 aa, Mycobacterium bovis
ENPRPLG

SEQ ID NO: 173587 - protein, 7 aa, Mycobacterium bovis
ENPSARD

SEQ ID NO: 173588 - protein, 7 aa, Mycobacterium bovis
ENPVDAT

SEQ ID NO: 173589 - protein, 6 aa, Mycobacterium bovis
ENQAGH

SEQ ID NO: 173590 - protein, 7 aa, Mycobacterium bovis
ENQATDR

SEQ ID NO: 173591 - protein, 5 aa, Mycobacterium bovis
ENQAV

SEQ ID NO: 173592 - protein, 6 aa, Mycobacterium bovis
ENRAAV

SEQ ID NO: 173593 - protein, 10 aa, Mycobacterium bovis
ENRELGDTST

SEQ ID NO: 173594 - protein, 7 aa, Mycobacterium bovis
ENRNLQR

SEQ ID NO: 173595 - protein, 5 aa, Mycobacterium bovis
ENRSL

SEQ ID NO: 173596 - protein, 14 aa, Mycobacterium bovis
ENRTAKGKVVLRVR

SEQ ID NO: 173597 - protein, 6 aa, Mycobacterium bovis
ENSEAV

SEQ ID NO: 173598 - protein, 10 aa, Mycobacterium bovis
ENSPVTEVRP

SEQ ID NO: 173599 - protein, 10 aa, Mycobacterium bovis
ENSRGRPARE

SEQ ID NO: 173600 - protein, 9 aa, Mycobacterium bovis
ENSTAAPPL

SEQ ID NO: 173601 - protein, 9 aa, Mycobacterium bovis
ENTEGIERR

SEQ ID NO: 173602 - protein, 4 aa, Mycobacterium bovis
ENTH

SEQ ID NO: 173603 - protein, 17 aa, Mycobacterium bovis
ENTKGKPAVGGEPAKNI

SEQ ID NO: 173604 - protein, 9 aa, Mycobacterium bovis
ENVAESLTR

SEQ ID NO: 173605 - protein, 8 aa, Mycobacterium bovis
ENVPDQGG

SEQ ID NO: 173606 - protein, 10 aa, Mycobacterium bovis
ENWKGSSSDL

SEQ ID NO: 173607 - protein, 4 aa, Mycobacterium bovis
ENYD

SEQ ID NO: 173608 - protein, 8 aa, Mycobacterium bovis
ENYDDPAA

SEQ ID NO: 173609 - protein, 4 aa, Mycobacterium bovis
EPAA

SEQ ID NO: 173610 - protein, 5 aa, Mycobacterium bovis
EPAAG

SEQ ID NO: 173611 - protein, 8 aa, Mycobacterium bovis
EPAAGELG

SEQ ID NO: 173612 - protein, 6 aa, Mycobacterium bovis
EPADRD

SEQ ID NO: 173613 - protein, 5 aa, Mycobacterium bovis
EPADS

SEQ ID NO: 173614 - protein, 7 aa, Mycobacterium bovis
EPAEWGP

SEQ ID NO: 173615 - protein, 12 aa, Mycobacterium bovis
EPAGDAGMRSPT

SEQ ID NO: 173616 - protein, 6 aa, Mycobacterium bovis
EPAGEE

SEQ ID NO: 173617 - protein, 6 aa, Mycobacterium bovis
EPAGPI

SEQ ID NO: 173618 - protein, 10 aa, Mycobacterium bovis
EPAGQPGRWG

SEQ ID NO: 173619 - protein, 4 aa, Mycobacterium bovis
EPAK

SEQ ID NO: 173620 - protein, 4 aa, Mycobacterium bovis
EPAL

SEQ ID NO: 173621 - protein, 8 aa, Mycobacterium bovis
EPANQGAW

SEQ ID NO: 173622 - protein, 9 aa, Mycobacterium bovis
EPAPGTHSR

SEQ ID NO: 173623 - protein, 6 aa, Mycobacterium bovis
EPAPTG

SEQ ID NO: 173624 - protein, 10 aa, Mycobacterium bovis
EPAQPGRPTM

SEQ ID NO: 173625 - protein, 10 aa, Mycobacterium bovis
EPAREHPRPV

SEQ ID NO: 173626 - protein, 12 aa, Mycobacterium bovis
EPARSQPEQIQL

SEQ ID NO: 173627 - protein, 4 aa, Mycobacterium bovis
EPAS

SEQ ID NO: 173628 - protein, 5 aa, Mycobacterium bovis
EPATV

SEQ ID NO: 173629 - protein, 9 aa, Mycobacterium bovis
EPATVRAET

SEQ ID NO: 173630 - protein, 4 aa, Mycobacterium bovis
EPAY

SEQ ID NO: 173631 - protein, 6 aa, Mycobacterium bovis
EPCTDS

SEQ ID NO: 173632 - protein, 12 aa, Mycobacterium bovis
EPDAEGKRPPEC

SEQ ID NO: 173633 - protein, 8 aa, Mycobacterium bovis
EPDAESPH

SEQ ID NO: 173634 - protein, 19 aa, Mycobacterium bovis
EPDAGSDAASVKTRATRVE

SEQ ID NO: 173635 - protein, 21 aa, Mycobacterium bovis
EPDAGSDVGAARTKAVQQADG

SEQ ID NO: 173636 - protein, 21 aa, Mycobacterium bovis
EPDAGSDVGAGRTKAFEQPDG

SEQ ID NO: 173637 - protein, 4 aa, Mycobacterium bovis
EPDD

SEQ ID NO: 173638 - protein, 6 aa, Mycobacterium bovis
EPDDAG

SEQ ID NO: 173639 - protein, 5 aa, Mycobacterium bovis
EPDDV

SEQ ID NO: 173640 - protein, 6 aa, Mycobacterium bovis
EPDDVS

SEQ ID NO: 173641 - protein, 6 aa, Mycobacterium bovis
EPDGFR

SEQ ID NO: 173642 - protein, 6 aa, Mycobacterium bovis
EPDGPG

SEQ ID NO: 173643 - protein, 8 aa, Mycobacterium bovis
EPDGTGSL

SEQ ID NO: 173644 - protein, 6 aa, Mycobacterium bovis
EPDGTT

SEQ ID NO: 173645 - protein, 8 aa, Mycobacterium bovis
EPDPDEMH

SEQ ID NO: 173646 - protein, 5 aa, Mycobacterium bovis
EPDPS

SEQ ID NO: 173647 - protein, 4 aa, Mycobacterium bovis
EPDT

SEQ ID NO: 173648 - protein, 7 aa, Mycobacterium bovis
EPDTTDV

SEQ ID NO: 173649 - protein, 20 aa, Mycobacterium bovis
EPDVGSDPAAMKTRARRDGP

SEQ ID NO: 173650 - protein, 4 aa, Mycobacterium bovis
EPDY

SEQ ID NO: 173651 - protein, 6 aa, Mycobacterium bovis
EPEDES

SEQ ID NO: 173652 - protein, 5 aa, Mycobacterium bovis
EPEEV

SEQ ID NO: 173653 - protein, 19 aa, Mycobacterium bovis
EPEFGSDSAAVSTTATLDG

SEQ ID NO: 173654 - protein, 5 aa, Mycobacterium bovis
EPEHQ

SEQ ID NO: 173655 - protein, 4 aa, Mycobacterium bovis
EPEI

SEQ ID NO: 173656 - protein, 5 aa, Mycobacterium bovis
EPEIG

SEQ ID NO: 173657 - protein, 4 aa, Mycobacterium bovis
EPEK

SEQ ID NO: 173658 - protein, 4 aa, Mycobacterium bovis
EPEL

SEQ ID NO: 173659 - protein, 5 aa, Mycobacterium bovis
EPELA

SEQ ID NO: 173660 - protein, 6 aa, Mycobacterium bovis
EPERNQ

SEQ ID NO: 173661 - protein, 6 aa, Mycobacterium bovis
EPESAV

SEQ ID NO: 173662 - protein, 16 aa, Mycobacterium bovis
EPESRRPGRPKRLTDA

SEQ ID NO: 173663 - protein, 7 aa, Mycobacterium bovis
EPETDLD

SEQ ID NO: 173664 - protein, 7 aa, Mycobacterium bovis
EPETESG

SEQ ID NO: 173665 - protein, 6 aa, Mycobacterium bovis
EPETTE

SEQ ID NO: 173666 - protein, 4 aa, Mycobacterium bovis
EPFA

SEQ ID NO: 173667 - protein, 18 aa, Mycobacterium bovis
EPGAAGPGGSRGRGDISV

SEQ ID NO: 173668 - protein, 13 aa, Mycobacterium bovis
EPGAGSDAGALST

SEQ ID NO: 173669 - protein, 10 aa, Mycobacterium bovis
EPGAGSDLAS

SEQ ID NO: 173670 - protein, 19 aa, Mycobacterium bovis
EPGAGSDLASLATKATRVD

SEQ ID NO: 173671 - protein, 4 aa, Mycobacterium bovis
EPGD

SEQ ID NO: 173672 - protein, 8 aa, Mycobacterium bovis
EPGETAGF

SEQ ID NO: 173673 - protein, 8 aa, Mycobacterium bovis
EPGGAADA

SEQ ID NO: 173674 - protein, 5 aa, Mycobacterium bovis
EPGIP

SEQ ID NO: 173675 - protein, 5 aa, Mycobacterium bovis
EPGIR

SEQ ID NO: 173676 - protein, 4 aa, Mycobacterium bovis
EPGK

SEQ ID NO: 173677 - protein, 9 aa, Mycobacterium bovis
EPGPDFEPS

SEQ ID NO: 173678 - protein, 6 aa, Mycobacterium bovis
EPGPLG

SEQ ID NO: 173679 - protein, 9 aa, Mycobacterium bovis
EPGPSTEAN

SEQ ID NO: 173680 - protein, 6 aa, Mycobacterium bovis
EPGQTR

SEQ ID NO: 173681 - protein, 21 aa, Mycobacterium bovis
EPGREYAEDIETGSAAAALGG

SEQ ID NO: 173682 - protein, 8 aa, Mycobacterium bovis
EPGRSESQ

SEQ ID NO: 173683 - protein, 13 aa, Mycobacterium bovis
EPGSGELNPGPAT

SEQ ID NO: 173684 - protein, 6 aa, Mycobacterium bovis
EPGTDH

SEQ ID NO: 173685 - protein, 8 aa, Mycobacterium bovis
EPGTNGQH

SEQ ID NO: 173686 - protein, 6 aa, Mycobacterium bovis
EPHDGA

SEQ ID NO: 173687 - protein, 4 aa, Mycobacterium bovis
EPHI

SEQ ID NO: 173688 - protein, 8 aa, Mycobacterium bovis
EPIGPKAL

SEQ ID NO: 173689 - protein, 9 aa, Mycobacterium bovis
EPIRSGDEV

SEQ ID NO: 173690 - protein, 11 aa, Mycobacterium bovis
EPISARPHPRT

SEQ ID NO: 173691 - protein, 4 aa, Mycobacterium bovis
EPKN

SEQ ID NO: 173692 - protein, 8 aa, Mycobacterium bovis
EPKPDAPV

SEQ ID NO: 173693 - protein, 17 aa, Mycobacterium bovis
EPKRRGRQSASAPPLRE

SEQ ID NO: 173694 - protein, 11 aa, Mycobacterium bovis
EPKTKSDQEKL

SEQ ID NO: 173695 - protein, 9 aa, Mycobacterium bovis
EPLAGQPLD

SEQ ID NO: 173696 - protein, 13 aa, Mycobacterium bovis
EPLDQTTSRGQYA

SEQ ID NO: 173697 - protein, 5 aa, Mycobacterium bovis
EPLDT

SEQ ID NO: 173698 - protein, 7 aa, Mycobacterium bovis
EPLESGR

SEQ ID NO: 173699 - protein, 14 aa, Mycobacterium bovis
EPLGTTVSAGGMPD

SEQ ID NO: 173700 - protein, 17 aa, Mycobacterium bovis
EPLNANEELKKAGNPLD

SEQ ID NO: 173701 - protein, 10 aa, Mycobacterium bovis
EPLPRAHGGP

SEQ ID NO: 173702 - protein, 11 aa, Mycobacterium bovis
EPLSGHPPDGG

SEQ ID NO: 173703 - protein, 15 aa, Mycobacterium bovis
EPMPESAAARVKAGA

SEQ ID NO: 173704 - protein, 13 aa, Mycobacterium bovis
EPMTGERDIRSED

SEQ ID NO: 173705 - protein, 9 aa, Mycobacterium bovis
EPNGRGSRM

SEQ ID NO: 173706 - protein, 14 aa, Mycobacterium bovis
EPNGRRLRNRPQNW

SEQ ID NO: 173707 - protein, 10 aa, Mycobacterium bovis
EPNPADAHDA

SEQ ID NO: 173708 - protein, 7 aa, Mycobacterium bovis
EPNPTYA

SEQ ID NO: 173709 - protein, 5 aa, Mycobacterium bovis
EPPDH

SEQ ID NO: 173710 - protein, 9 aa, Mycobacterium bovis
EPPDHTRYR

SEQ ID NO: 173711 - protein, 18 aa, Mycobacterium bovis
EPPLNEDKTVRGNVEEGM

SEQ ID NO: 173712 - protein, 9 aa, Mycobacterium bovis
EPPQGAGPE

SEQ ID NO: 173713 - protein, 9 aa, Mycobacterium bovis
EPPRSPAQM

SEQ ID NO: 173714 - protein, 4 aa, Mycobacterium bovis
EPPV

SEQ ID NO: 173715 - protein, 13 aa, Mycobacterium bovis
EPPVTHTPPAPIE

SEQ ID NO: 173716 - protein, 29 aa, Mycobacterium bovis
EPQAATGTAGSAGDPTGGNGGPGTPGSPM

SEQ ID NO: 173717 - protein, 6 aa, Mycobacterium bovis
EPQHFT

SEQ ID NO: 173718 - protein, 5 aa, Mycobacterium bovis
EPQLP

SEQ ID NO: 173719 - protein, 7 aa, Mycobacterium bovis
EPQPELD

SEQ ID NO: 173720 - protein, 9 aa, Mycobacterium bovis
EPQSAGACG

SEQ ID NO: 173721 - protein, 14 aa, Mycobacterium bovis
EPRAKTRNLRRDPR

SEQ ID NO: 173722 - protein, 6 aa, Mycobacterium bovis
EPRGEN

SEQ ID NO: 173723 - protein, 10 aa, Mycobacterium bovis
EPRSTGARHD

SEQ ID NO: 173724 - protein, 13 aa, Mycobacterium bovis
EPRTAATLVAGQW

SEQ ID NO: 173725 - protein, 4 aa, Mycobacterium bovis
EPRV

SEQ ID NO: 173726 - protein, 11 aa, Mycobacterium bovis
EPRVGDPEGPT

SEQ ID NO: 173727 - protein, 6 aa, Mycobacterium bovis
EPRYGE

SEQ ID NO: 173728 - protein, 6 aa, Mycobacterium bovis
EPSAPL

SEQ ID NO: 173729 - protein, 11 aa, Mycobacterium bovis
EPSATYRPGQA

SEQ ID NO: 173730 - protein, 8 aa, Mycobacterium bovis
EPSETSQV

SEQ ID NO: 173731 - protein, 5 aa, Mycobacterium bovis
EPSEV

SEQ ID NO: 173732 - protein, 5 aa, Mycobacterium bovis
EPSGA

SEQ ID NO: 173733 - protein, 23 aa, Mycobacterium bovis
EPSPADDGTYQGKDGSGKVKWTG

SEQ ID NO: 173734 - protein, 6 aa, Mycobacterium bovis
EPSREI

SEQ ID NO: 173735 - protein, 7 aa, Mycobacterium bovis
EPSSGLD

SEQ ID NO: 173736 - protein, 6 aa, Mycobacterium bovis
EPSVED

SEQ ID NO: 173737 - protein, 5 aa, Mycobacterium bovis
EPTAA

SEQ ID NO: 173738 - protein, 6 aa, Mycobacterium bovis
EPTATL

SEQ ID NO: 173739 - protein, 9 aa, Mycobacterium bovis
EPTDPAGPV

SEQ ID NO: 173740 - protein, 7 aa, Mycobacterium bovis
EPTEVGQ

SEQ ID NO: 173741 - protein, 12 aa, Mycobacterium bovis
EPTGNLDPETSR

SEQ ID NO: 173742 - protein, 13 aa, Mycobacterium bovis
EPTGNLDSDTGDK

SEQ ID NO: 173743 - protein, 18 aa, Mycobacterium bovis
EPTLTEESYANNPKRGRH

SEQ ID NO: 173744 - protein, 4 aa, Mycobacterium bovis
EPTN

SEQ ID NO: 173745 - protein, 8 aa, Mycobacterium bovis
EPTPEQPA

SEQ ID NO: 173746 - protein, 4 aa, Mycobacterium bovis
EPTR

SEQ ID NO: 173747 - protein, 6 aa, Mycobacterium bovis
EPTSAL

SEQ ID NO: 173748 - protein, 9 aa, Mycobacterium bovis
EPTSGNTGI

SEQ ID NO: 173749 - protein, 7 aa, Mycobacterium bovis
EPTSTQT

SEQ ID NO: 173750 - protein, 15 aa, Mycobacterium bovis
EPTTGAQLAGMFENL

SEQ ID NO: 173751 - protein, 12 aa, Mycobacterium bovis
EPTTGLDPRSRQ

SEQ ID NO: 173752 - protein, 12 aa, Mycobacterium bovis
EPTTRRAEFGDG

SEQ ID NO: 173753 - protein, 5 aa, Mycobacterium bovis
EPTTS

SEQ ID NO: 173754 - protein, 11 aa, Mycobacterium bovis
EPTTVGDGYAR

SEQ ID NO: 173755 - protein, 13 aa, Mycobacterium bovis
EPTYEDGIGDRNK

SEQ ID NO: 173756 - protein, 6 aa, Mycobacterium bovis
EPVAPS

SEQ ID NO: 173757 - protein, 6 aa, Mycobacterium bovis
EPVDAA

SEQ ID NO: 173758 - protein, 7 aa, Mycobacterium bovis
EPVDGPW

SEQ ID NO: 173759 - protein, 5 aa, Mycobacterium bovis
EPVGR

SEQ ID NO: 173760 - protein, 5 aa, Mycobacterium bovis
EPVSE

SEQ ID NO: 173761 - protein, 6 aa, Mycobacterium bovis
EPVSLT

SEQ ID NO: 173762 - protein, 8 aa, Mycobacterium bovis
EPVSSRGA

SEQ ID NO: 173763 - protein, 4 aa, Mycobacterium bovis
EPWE

SEQ ID NO: 173764 - protein, 5 aa, Mycobacterium bovis
EPWRG

SEQ ID NO: 173765 - protein, 11 aa, Mycobacterium bovis
EPYAGSVTRAG

SEQ ID NO: 173766 - protein, 5 aa, Mycobacterium bovis
EPYTA

SEQ ID NO: 173767 - protein, 9 aa, Mycobacterium bovis
EQAAAAGHS

SEQ ID NO: 173768 - protein, 9 aa, Mycobacterium bovis
EQAAAHPSA

SEQ ID NO: 173769 - protein, 7 aa, Mycobacterium bovis
EQAEEYR

SEQ ID NO: 173770 - protein, 10 aa, Mycobacterium bovis
EQAGNQREVR

SEQ ID NO: 173771 - protein, 7 aa, Mycobacterium bovis
EQAGPEE

SEQ ID NO: 173772 - protein, 5 aa, Mycobacterium bovis
EQAHG

SEQ ID NO: 173773 - protein, 6 aa, Mycobacterium bovis
EQAKDA

SEQ ID NO: 173774 - protein, 12 aa, Mycobacterium bovis
EQAPTESPAAAA

SEQ ID NO: 173775 - protein, 9 aa, Mycobacterium bovis
EQARIAEGA

SEQ ID NO: 173776 - protein, 9 aa, Mycobacterium bovis
EQASLQDSN

SEQ ID NO: 173777 - protein, 8 aa, Mycobacterium bovis
EQATTEAF

SEQ ID NO: 173778 - protein, 6 aa, Mycobacterium bovis
EQDAAR

SEQ ID NO: 173779 - protein, 4 aa, Mycobacterium bovis
EQEG

SEQ ID NO: 173780 - protein, 7 aa, Mycobacterium bovis
EQEKNGI

SEQ ID NO: 173781 - protein, 6 aa, Mycobacterium bovis
EQERGI

SEQ ID NO: 173782 - protein, 4 aa, Mycobacterium bovis
EQEY

SEQ ID NO: 173783 - protein, 18 aa, Mycobacterium bovis
EQFADRKPRQLSGGQAQR

SEQ ID NO: 173784 - protein, 5 aa, Mycobacterium bovis
EQGAA

SEQ ID NO: 173785 - protein, 6 aa, Mycobacterium bovis
EQGEGD

SEQ ID NO: 173786 - protein, 8 aa, Mycobacterium bovis
EQGFNSGD

SEQ ID NO: 173787 - protein, 8 aa, Mycobacterium bovis
EQGKTDWA

SEQ ID NO: 173788 - protein, 4 aa, Mycobacterium bovis
EQGL

SEQ ID NO: 173789 - protein, 12 aa, Mycobacterium bovis
EQGRPAESTGEL

SEQ ID NO: 173790 - protein, 15 aa, Mycobacterium bovis
EQHPELRTPDSPTQL

SEQ ID NO: 173791 - protein, 13 aa, Mycobacterium bovis
EQHPLATKDSDGR

SEQ ID NO: 173792 - protein, 4 aa, Mycobacterium bovis
EQID

SEQ ID NO: 173793 - protein, 30 aa, Mycobacterium bovis
EQIGAGPPLPLTSKPNTGYETAAAVDLVSG

SEQ ID NO: 173794 - protein, 7 aa, Mycobacterium bovis
EQIGNDY

SEQ ID NO: 173795 - protein, 8 aa, Mycobacterium bovis
EQIPPEAF

SEQ ID NO: 173796 - protein, 9 aa, Mycobacterium bovis
EQLGAGKPI

SEQ ID NO: 173797 - protein, 7 aa, Mycobacterium bovis
EQLGGGY

SEQ ID NO: 173798 - protein, 11 aa, Mycobacterium bovis
EQLGQGKENAR

SEQ ID NO: 173799 - protein, 4 aa, Mycobacterium bovis
EQLH

SEQ ID NO: 173800 - protein, 7 aa, Mycobacterium bovis
EQNCSTS

SEQ ID NO: 173801 - protein, 9 aa, Mycobacterium bovis
EQNEPPGRR

SEQ ID NO: 173802 - protein, 9 aa, Mycobacterium bovis
EQNQPTGER

SEQ ID NO: 173803 - protein, 15 aa, Mycobacterium bovis
EQNRRSHPLQGEQTL

SEQ ID NO: 173804 - protein, 5 aa, Mycobacterium bovis
EQNRS

SEQ ID NO: 173805 - protein, 6 aa, Mycobacterium bovis
EQPAAV

SEQ ID NO: 173806 - protein, 12 aa, Mycobacterium bovis
EQPDLNSDNPEI

SEQ ID NO: 173807 - protein, 5 aa, Mycobacterium bovis
EQPDS

SEQ ID NO: 173808 - protein, 7 aa, Mycobacterium bovis
EQPDTGV

SEQ ID NO: 173809 - protein, 10 aa, Mycobacterium bovis
EQPEAGAAGN

SEQ ID NO: 173810 - protein, 6 aa, Mycobacterium bovis
EQPPER

SEQ ID NO: 173811 - protein, 6 aa, Mycobacterium bovis
EQPQNQ

SEQ ID NO: 173812 - protein, 8 aa, Mycobacterium bovis
EQPTYENA

SEQ ID NO: 173813 - protein, 5 aa, Mycobacterium bovis
EQQAA

SEQ ID NO: 173814 - protein, 9 aa, Mycobacterium bovis
EQQARNEGY

SEQ ID NO: 173815 - protein, 8 aa, Mycobacterium bovis
EQQARPRD

SEQ ID NO: 173816 - protein, 7 aa, Mycobacterium bovis
EQQGERF

SEQ ID NO: 173817 - protein, 4 aa, Mycobacterium bovis
EQQR

SEQ ID NO: 173818 - protein, 7 aa, Mycobacterium bovis
EQRATEP

SEQ ID NO: 173819 - protein, 6 aa, Mycobacterium bovis
EQRDPA

SEQ ID NO: 173820 - protein, 4 aa, Mycobacterium bovis
EQRE

SEQ ID NO: 173821 - protein, 16 aa, Mycobacterium bovis
EQREAEGGSKVPEDTL

SEQ ID NO: 173822 - protein, 4 aa, Mycobacterium bovis
EQRG

SEQ ID NO: 173823 - protein, 5 aa, Mycobacterium bovis
EQRSS

SEQ ID NO: 173824 - protein, 7 aa, Mycobacterium bovis
EQRTGRS

SEQ ID NO: 173825 - protein, 8 aa, Mycobacterium bovis
EQRTRPGQ

SEQ ID NO: 173826 - protein, 6 aa, Mycobacterium bovis
EQRVPD

SEQ ID NO: 173827 - protein, 8 aa, Mycobacterium bovis
EQSAKTGF

SEQ ID NO: 173828 - protein, 6 aa, Mycobacterium bovis
EQSALN

SEQ ID NO: 173829 - protein, 7 aa, Mycobacterium bovis
EQSGHTQ

SEQ ID NO: 173830 - protein, 7 aa, Mycobacterium bovis
EQSPTQQ

SEQ ID NO: 173831 - protein, 7 aa, Mycobacterium bovis
EQSRPEL

SEQ ID NO: 173832 - protein, 8 aa, Mycobacterium bovis
EQSRPLSE

SEQ ID NO: 173833 - protein, 8 aa, Mycobacterium bovis
EQSSDGGW

SEQ ID NO: 173834 - protein, 10 aa, Mycobacterium bovis
EQSSKAAGEV

SEQ ID NO: 173835 - protein, 6 aa, Mycobacterium bovis
EQSVDA

SEQ ID NO: 173836 - protein, 5 aa, Mycobacterium bovis
EQSVE

SEQ ID NO: 173837 - protein, 5 aa, Mycobacterium bovis
EQTAQ

SEQ ID NO: 173838 - protein, 4 aa, Mycobacterium bovis
EQTD

SEQ ID NO: 173839 - protein, 19 aa, Mycobacterium bovis
EQTDAAAGALPGLSEPAAK

SEQ ID NO: 173840 - protein, 10 aa, Mycobacterium bovis
EQTESLGPQS

SEQ ID NO: 173841 - protein, 13 aa, Mycobacterium bovis
EQTGDAIAPEEGA

SEQ ID NO: 173842 - protein, 11 aa, Mycobacterium bovis
EQTGGFEGRTK

SEQ ID NO: 173843 - protein, 6 aa, Mycobacterium bovis
EQTGRS

SEQ ID NO: 173844 - protein, 7 aa, Mycobacterium bovis
EQTHGAD

SEQ ID NO: 173845 - protein, 8 aa, Mycobacterium bovis
EQTPDTSR

SEQ ID NO: 173846 - protein, 11 aa, Mycobacterium bovis
EQTSGNSGQHP

SEQ ID NO: 173847 - protein, 10 aa, Mycobacterium bovis
EQTTRTPDAT

SEQ ID NO: 173848 - protein, 4 aa, Mycobacterium bovis
EQTY

SEQ ID NO: 173849 - protein, 10 aa, Mycobacterium bovis
EQVAKQARDI

SEQ ID NO: 173850 - protein, 15 aa, Mycobacterium bovis
EQVDAADAVPSAGQA

SEQ ID NO: 173851 - protein, 13 aa, Mycobacterium bovis
EQVGSPTDVYDAP

SEQ ID NO: 173852 - protein, 11 aa, Mycobacterium bovis
EQVPGESYEHG

SEQ ID NO: 173853 - protein, 5 aa, Mycobacterium bovis
EQVTA

SEQ ID NO: 173854 - protein, 9 aa, Mycobacterium bovis
EQWDDGNNT

SEQ ID NO: 173855 - protein, 8 aa, Mycobacterium bovis
EQYGGSPV

SEQ ID NO: 173856 - protein, 7 aa, Mycobacterium bovis
ERAAADP

SEQ ID NO: 173857 - protein, 10 aa, Mycobacterium bovis
ERAAAGPFGT

SEQ ID NO: 173858 - protein, 8 aa, Mycobacterium bovis
ERAAASGA

SEQ ID NO: 173859 - protein, 6 aa, Mycobacterium bovis
ERAAEL

SEQ ID NO: 173860 - protein, 10 aa, Mycobacterium bovis
ERAAQSPTEA

SEQ ID NO: 173861 - protein, 7 aa, Mycobacterium bovis
ERAARGA

SEQ ID NO: 173862 - protein, 13 aa, Mycobacterium bovis
ERAASGEAVEMTG

SEQ ID NO: 173863 - protein, 11 aa, Mycobacterium bovis
ERADKVEKQFQ

SEQ ID NO: 173864 - protein, 20 aa, Mycobacterium bovis
ERAEETRTDTRSRVEESRAR

SEQ ID NO: 173865 - protein, 8 aa, Mycobacterium bovis
ERAEEVNH

SEQ ID NO: 173866 - protein, 5 aa, Mycobacterium bovis
ERAGA

SEQ ID NO: 173867 - protein, 8 aa, Mycobacterium bovis
ERAGDARS

SEQ ID NO: 173868 - protein, 8 aa, Mycobacterium bovis
ERAGESRA

SEQ ID NO: 173869 - protein, 10 aa, Mycobacterium bovis
ERAGGSDLGA

SEQ ID NO: 173870 - protein, 14 aa, Mycobacterium bovis
ERAGPTPAQTTAEP

SEQ ID NO: 173871 - protein, 6 aa, Mycobacterium bovis
ERAGRK

SEQ ID NO: 173872 - protein, 8 aa, Mycobacterium bovis
ERAGTTKS

SEQ ID NO: 173873 - protein, 10 aa, Mycobacterium bovis
ERAHDTATPQ

SEQ ID NO: 173874 - protein, 5 aa, Mycobacterium bovis
ERALT

SEQ ID NO: 173875 - protein, 7 aa, Mycobacterium bovis
ERAPDGT

SEQ ID NO: 173876 - protein, 5 aa, Mycobacterium bovis
ERAQA

SEQ ID NO: 173877 - protein, 19 aa, Mycobacterium bovis
ERAQARASRLQRRQAATDA

SEQ ID NO: 173878 - protein, 7 aa, Mycobacterium bovis
ERARARG

SEQ ID NO: 173879 - protein, 6 aa, Mycobacterium bovis
ERARDR

SEQ ID NO: 173880 - protein, 6 aa, Mycobacterium bovis
ERARNG

SEQ ID NO: 173881 - protein, 7 aa, Mycobacterium bovis
ERARQAG

SEQ ID NO: 173882 - protein, 11 aa, Mycobacterium bovis
ERASARADPEG

SEQ ID NO: 173883 - protein, 7 aa, Mycobacterium bovis
ERASGFR

SEQ ID NO: 173884 - protein, 21 aa, Mycobacterium bovis
ERATGRLEKEARTNKARKPVY

SEQ ID NO: 173885 - protein, 7 aa, Mycobacterium bovis
ERDEEPE

SEQ ID NO: 173886 - protein, 9 aa, Mycobacterium bovis
ERDESVPRT

SEQ ID NO: 173887 - protein, 6 aa, Mycobacterium bovis
ERDETS

SEQ ID NO: 173888 - protein, 5 aa, Mycobacterium bovis
ERDGV

SEQ ID NO: 173889 - protein, 7 aa, Mycobacterium bovis
ERDNERC

SEQ ID NO: 173890 - protein, 7 aa, Mycobacterium bovis
ERDPGTT

SEQ ID NO: 173891 - protein, 4 aa, Mycobacterium bovis
ERDQ

SEQ ID NO: 173892 - protein, 20 aa, Mycobacterium bovis
ERDQQARGADDSGHDGGPVD

SEQ ID NO: 173893 - protein, 8 aa, Mycobacterium bovis
ERDTGNYT

SEQ ID NO: 173894 - protein, 6 aa, Mycobacterium bovis
EREEQA

SEQ ID NO: 173895 - protein, 5 aa, Mycobacterium bovis
EREGA

SEQ ID NO: 173896 - protein, 7 aa, Mycobacterium bovis
EREGEKD

SEQ ID NO: 173897 - protein, 8 aa, Mycobacterium bovis
EREKREAE

SEQ ID NO: 173898 - protein, 10 aa, Mycobacterium bovis
ERELPEPDDE

SEQ ID NO: 173899 - protein, 6 aa, Mycobacterium bovis
EREPGR

SEQ ID NO: 173900 - protein, 13 aa, Mycobacterium bovis
ERERAANAQGDPR

SEQ ID NO: 173901 - protein, 8 aa, Mycobacterium bovis
ERFGPDRV

SEQ ID NO: 173902 - protein, 7 aa, Mycobacterium bovis
ERFPKGV

SEQ ID NO: 173903 - protein, 6 aa, Mycobacterium bovis
ERGAEA

SEQ ID NO: 173904 - protein, 5 aa, Mycobacterium bovis
ERGAP

SEQ ID NO: 173905 - protein, 8 aa, Mycobacterium bovis
ERGAPEIQ

SEQ ID NO: 173906 - protein, 7 aa, Mycobacterium bovis
ERGAVPK

SEQ ID NO: 173907 - protein, 10 aa, Mycobacterium bovis
ERGEGTTKED

SEQ ID NO: 173908 - protein, 15 aa, Mycobacterium bovis
ERGGDPRRPGKSDEL

SEQ ID NO: 173909 - protein, 8 aa, Mycobacterium bovis
ERGGERVR

SEQ ID NO: 173910 - protein, 7 aa, Mycobacterium bovis
ERGGSHR

SEQ ID NO: 173911 - protein, 9 aa, Mycobacterium bovis
ERGGTPLRS

SEQ ID NO: 173912 - protein, 6 aa, Mycobacterium bovis
ERGHGD

SEQ ID NO: 173913 - protein, 5 aa, Mycobacterium bovis
ERGNA

SEQ ID NO: 173914 - protein, 9 aa, Mycobacterium bovis
ERGPAATSI

SEQ ID NO: 173915 - protein, 8 aa, Mycobacterium bovis
ERGQTAKR

SEQ ID NO: 173916 - protein, 10 aa, Mycobacterium bovis
ERGSADPTVN

SEQ ID NO: 173917 - protein, 6 aa, Mycobacterium bovis
ERGSGR

SEQ ID NO: 173918 - protein, 4 aa, Mycobacterium bovis
ERGT

SEQ ID NO: 173919 - protein, 6 aa, Mycobacterium bovis
ERGVPT

SEQ ID NO: 173920 - protein, 7 aa, Mycobacterium bovis
ERGYGED

SEQ ID NO: 173921 - protein, 8 aa, Mycobacterium bovis
ERHESRRI

SEQ ID NO: 173922 - protein, 11 aa, Mycobacterium bovis
ERHGLGNDPIS

SEQ ID NO: 173923 - protein, 8 aa, Mycobacterium bovis
ERIPGEAA

SEQ ID NO: 173924 - protein, 10 aa, Mycobacterium bovis
ERKDNRDKSI

SEQ ID NO: 173925 - protein, 11 aa, Mycobacterium bovis
ERKIPKPGGLG

SEQ ID NO: 173926 - protein, 8 aa, Mycobacterium bovis
ERKLTDGD

SEQ ID NO: 173927 - protein, 12 aa, Mycobacterium bovis
ERKPGRPHTGTA

SEQ ID NO: 173928 - protein, 6 aa, Mycobacterium bovis
ERKPSA

SEQ ID NO: 173929 - protein, 9 aa, Mycobacterium bovis
ERLEPSERP

SEQ ID NO: 173930 - protein, 11 aa, Mycobacterium bovis
ERLTPGDDYPV

SEQ ID NO: 173931 - protein, 7 aa, Mycobacterium bovis
ERNEFDG

SEQ ID NO: 173932 - protein, 19 aa, Mycobacterium bovis
ERNGWKAEVNSTKLRSAEP

SEQ ID NO: 173933 - protein, 16 aa, Mycobacterium bovis
ERNGYPVRDHRVSAQS

SEQ ID NO: 173934 - protein, 9 aa, Mycobacterium bovis
ERNPRSTPV

SEQ ID NO: 173935 - protein, 23 aa, Mycobacterium bovis
ERNRDQSNALKATSLREAGGEEL

SEQ ID NO: 173936 - protein, 10 aa, Mycobacterium bovis
ERNRRQRKSC

SEQ ID NO: 173937 - protein, 7 aa, Mycobacterium bovis
ERNSPGS

SEQ ID NO: 173938 - protein, 10 aa, Mycobacterium bovis
ERPASSGEGL

SEQ ID NO: 173939 - protein, 4 aa, Mycobacterium bovis
ERPD

SEQ ID NO: 173940 - protein, 10 aa, Mycobacterium bovis
ERPDAEAAQD

SEQ ID NO: 173941 - protein, 7 aa, Mycobacterium bovis
ERPDGPV

SEQ ID NO: 173942 - protein, 5 aa, Mycobacterium bovis
ERPDN

SEQ ID NO: 173943 - protein, 6 aa, Mycobacterium bovis
ERPDSD

SEQ ID NO: 173944 - protein, 6 aa, Mycobacterium bovis
ERPEAA

SEQ ID NO: 173945 - protein, 4 aa, Mycobacterium bovis
ERPG

SEQ ID NO: 173946 - protein, 7 aa, Mycobacterium bovis
ERPGPVA

SEQ ID NO: 173947 - protein, 13 aa, Mycobacterium bovis
ERPGRPLEASTAE

SEQ ID NO: 173948 - protein, 5 aa, Mycobacterium bovis
ERPPL

SEQ ID NO: 173949 - protein, 6 aa, Mycobacterium bovis
ERPSGF

SEQ ID NO: 173950 - protein, 4 aa, Mycobacterium bovis
ERPT

SEQ ID NO: 173951 - protein, 7 aa, Mycobacterium bovis
ERPTGGR

SEQ ID NO: 173952 - protein, 6 aa, Mycobacterium bovis
ERPYTT

SEQ ID NO: 173953 - protein, 7 aa, Mycobacterium bovis
ERQAQIT

SEQ ID NO: 173954 - protein, 5 aa, Mycobacterium bovis
ERQPE

SEQ ID NO: 173955 - protein, 10 aa, Mycobacterium bovis
ERQRAATPAY

SEQ ID NO: 173956 - protein, 7 aa, Mycobacterium bovis
ERQRTHG

SEQ ID NO: 173957 - protein, 7 aa, Mycobacterium bovis
ERQSDAL

SEQ ID NO: 173958 - protein, 6 aa, Mycobacterium bovis
ERRAGR

SEQ ID NO: 173959 - protein, 10 aa, Mycobacterium bovis
ERRAKDTEEL

SEQ ID NO: 173960 - protein, 9 aa, Mycobacterium bovis
ERRAPDAVT

SEQ ID NO: 173961 - protein, 6 aa, Mycobacterium bovis
ERRAQA

SEQ ID NO: 173962 - protein, 30 aa, Mycobacterium bovis
ERRDGPFGDYSQAPPELRPDPTHVITPDGS

SEQ ID NO: 173963 - protein, 9 aa, Mycobacterium bovis
ERREASGND

SEQ ID NO: 173964 - protein, 6 aa, Mycobacterium bovis
ERREQQ

SEQ ID NO: 173965 - protein, 4 aa, Mycobacterium bovis
ERRG

SEQ ID NO: 173966 - protein, 7 aa, Mycobacterium bovis
ERRGEYL

SEQ ID NO: 173967 - protein, 5 aa, Mycobacterium bovis
ERRGG

SEQ ID NO: 173968 - protein, 7 aa, Mycobacterium bovis
ERRGKGL

SEQ ID NO: 173969 - protein, 12 aa, Mycobacterium bovis
ERRGRRRAEPLG

SEQ ID NO: 173970 - protein, 9 aa, Mycobacterium bovis
ERRGRTDTG

SEQ ID NO: 173971 - protein, 6 aa, Mycobacterium bovis
ERRNAR

SEQ ID NO: 173972 - protein, 5 aa, Mycobacterium bovis
ERRPA

SEQ ID NO: 173973 - protein, 6 aa, Mycobacterium bovis
ERRQRL

SEQ ID NO: 173974 - protein, 4 aa, Mycobacterium bovis
ERRR

SEQ ID NO: 173975 - protein, 5 aa, Mycobacterium bovis
ERRRG

SEQ ID NO: 173976 - protein, 9 aa, Mycobacterium bovis
ERRRGRTLA

SEQ ID NO: 173977 - protein, 8 aa, Mycobacterium bovis
ERRRPDGS

SEQ ID NO: 173978 - protein, 5 aa, Mycobacterium bovis
ERRRR

SEQ ID NO: 173979 - protein, 9 aa, Mycobacterium bovis
ERRRRLAER

SEQ ID NO: 173980 - protein, 4 aa, Mycobacterium bovis
ERRT

SEQ ID NO: 173981 - protein, 12 aa, Mycobacterium bovis
ERRTKSKALTLP

SEQ ID NO: 173982 - protein, 9 aa, Mycobacterium bovis
ERRTYHNED

SEQ ID NO: 173983 - protein, 5 aa, Mycobacterium bovis
ERSAE

SEQ ID NO: 173984 - protein, 11 aa, Mycobacterium bovis
ERSDDDSGKGR

SEQ ID NO: 173985 - protein, 8 aa, Mycobacterium bovis
ERSGATRV

SEQ ID NO: 173986 - protein, 6 aa, Mycobacterium bovis
ERSGVR

SEQ ID NO: 173987 - protein, 9 aa, Mycobacterium bovis
ERSGVSNPY

SEQ ID NO: 173988 - protein, 4 aa, Mycobacterium bovis
ERSP

SEQ ID NO: 173989 - protein, 12 aa, Mycobacterium bovis
ERSPQAAAAHDR

SEQ ID NO: 173990 - protein, 4 aa, Mycobacterium bovis
ERST

SEQ ID NO: 173991 - protein, 4 aa, Mycobacterium bovis
ERSV

SEQ ID NO: 173992 - protein, 9 aa, Mycobacterium bovis
ERSVTGDPI

SEQ ID NO: 173993 - protein, 4 aa, Mycobacterium bovis
ERTA

SEQ ID NO: 173994 - protein, 10 aa, Mycobacterium bovis
ERTANGPFTS

SEQ ID NO: 173995 - protein, 7 aa, Mycobacterium bovis
ERTARAD

SEQ ID NO: 173996 - protein, 5 aa, Mycobacterium bovis
ERTCG

SEQ ID NO: 173997 - protein, 5 aa, Mycobacterium bovis
ERTDQ

SEQ ID NO: 173998 - protein, 7 aa, Mycobacterium bovis
ERTEIPG

SEQ ID NO: 173999 - protein, 6 aa, Mycobacterium bovis
ERTGPS

SEQ ID NO: 174000 - protein, 5 aa, Mycobacterium bovis
ERTGV

SEQ ID NO: 174001 - protein, 9 aa, Mycobacterium bovis
ERTQRYAPH

SEQ ID NO: 174002 - protein, 13 aa, Mycobacterium bovis
ERTRHRAETTTRE

SEQ ID NO: 174003 - protein, 6 aa, Mycobacterium bovis
ERTSMP

SEQ ID NO: 174004 - protein, 6 aa, Mycobacterium bovis
ERTTNT

SEQ ID NO: 174005 - protein, 7 aa, Mycobacterium bovis
ERTVTDQ

SEQ ID NO: 174006 - protein, 4 aa, Mycobacterium bovis
ERVA

SEQ ID NO: 174007 - protein, 8 aa, Mycobacterium bovis
ERVEDGSR

SEQ ID NO: 174008 - protein, 5 aa, Mycobacterium bovis
ERVHP

SEQ ID NO: 174009 - protein, 4 aa, Mycobacterium bovis
ERVL

SEQ ID NO: 174010 - protein, 6 aa, Mycobacterium bovis
ERVPGS

SEQ ID NO: 174011 - protein, 6 aa, Mycobacterium bovis
ERYAKG

SEQ ID NO: 174012 - protein, 8 aa, Mycobacterium bovis
ERYDSGQR

SEQ ID NO: 174013 - protein, 7 aa, Mycobacterium bovis
ERYPGDA

SEQ ID NO: 174014 - protein, 12 aa, Mycobacterium bovis
ERYSGKRDLENP

SEQ ID NO: 174015 - protein, 7 aa, Mycobacterium bovis
ESAAQDL

SEQ ID NO: 174016 - protein, 6 aa, Mycobacterium bovis
ESAARA

SEQ ID NO: 174017 - protein, 6 aa, Mycobacterium bovis
ESAASE

SEQ ID NO: 174018 - protein, 6 aa, Mycobacterium bovis
ESADGG

SEQ ID NO: 174019 - protein, 8 aa, Mycobacterium bovis
ESAERGQG

SEQ ID NO: 174020 - protein, 5 aa, Mycobacterium bovis
ESAGA

SEQ ID NO: 174021 - protein, 8 aa, Mycobacterium bovis
ESAGRGRA

SEQ ID NO: 174022 - protein, 7 aa, Mycobacterium bovis
ESAGYGG

SEQ ID NO: 174023 - protein, 5 aa, Mycobacterium bovis
ESAIP

SEQ ID NO: 174024 - protein, 8 aa, Mycobacterium bovis
ESAPPTRE

SEQ ID NO: 174025 - protein, 15 aa, Mycobacterium bovis
ESAPWPAAAGPRRAA

SEQ ID NO: 174026 - protein, 17 aa, Mycobacterium bovis
ESARESSRPCSPPRRPR

SEQ ID NO: 174027 - protein, 9 aa, Mycobacterium bovis
ESARGSRRE

SEQ ID NO: 174028 - protein, 13 aa, Mycobacterium bovis
ESARPWAHRRPSV

SEQ ID NO: 174029 - protein, 7 aa, Mycobacterium bovis
ESARRTL

SEQ ID NO: 174030 - protein, 10 aa, Mycobacterium bovis
ESATDADDEV

SEQ ID NO: 174031 - protein, 6 aa, Mycobacterium bovis
ESAVRS

SEQ ID NO: 174032 - protein, 5 aa, Mycobacterium bovis
ESAVS

SEQ ID NO: 174033 - protein, 4 aa, Mycobacterium bovis
ESDE

SEQ ID NO: 174034 - protein, 9 aa, Mycobacterium bovis
ESDEDARRR

SEQ ID NO: 174035 - protein, 6 aa, Mycobacterium bovis
ESDGTL

SEQ ID NO: 174036 - protein, 15 aa, Mycobacterium bovis
ESDMSRKTPSDNTRW

SEQ ID NO: 174037 - protein, 5 aa, Mycobacterium bovis
ESDPF

SEQ ID NO: 174038 - protein, 8 aa, Mycobacterium bovis
ESDPRHPV

SEQ ID NO: 174039 - protein, 8 aa, Mycobacterium bovis
ESDPSHPG

SEQ ID NO: 174040 - protein, 6 aa, Mycobacterium bovis
ESDQRE

SEQ ID NO: 174041 - protein, 12 aa, Mycobacterium bovis
ESEAPAALTPTV

SEQ ID NO: 174042 - protein, 6 aa, Mycobacterium bovis
ESEDES

SEQ ID NO: 174043 - protein, 7 aa, Mycobacterium bovis
ESEGMPG

SEQ ID NO: 174044 - protein, 7 aa, Mycobacterium bovis
ESENWSG

SEQ ID NO: 174045 - protein, 4 aa, Mycobacterium bovis
ESER

SEQ ID NO: 174046 - protein, 6 aa, Mycobacterium bovis
ESETIR

SEQ ID NO: 174047 - protein, 6 aa, Mycobacterium bovis
ESEVTA

SEQ ID NO: 174048 - protein, 9 aa, Mycobacterium bovis
ESGAPGRGN

SEQ ID NO: 174049 - protein, 5 aa, Mycobacterium bovis
ESGAV

SEQ ID NO: 174050 - protein, 12 aa, Mycobacterium bovis
ESGDNETQLDET

SEQ ID NO: 174051 - protein, 9 aa, Mycobacterium bovis
ESGEEGREQ

SEQ ID NO: 174052 - protein, 12 aa, Mycobacterium bovis
ESGESPRLSDEL

SEQ ID NO: 174053 - protein, 6 aa, Mycobacterium bovis
ESGFGS

SEQ ID NO: 174054 - protein, 7 aa, Mycobacterium bovis
ESGGAIA

SEQ ID NO: 174055 - protein, 11 aa, Mycobacterium bovis
ESGGGSGTANI

SEQ ID NO: 174056 - protein, 14 aa, Mycobacterium bovis
ESGGSELADELDQN

SEQ ID NO: 174057 - protein, 6 aa, Mycobacterium bovis
ESGPDC

SEQ ID NO: 174058 - protein, 9 aa, Mycobacterium bovis
ESGPKTNEL

SEQ ID NO: 174059 - protein, 6 aa, Mycobacterium bovis
ESGPSL

SEQ ID NO: 174060 - protein, 6 aa, Mycobacterium bovis
ESGQLD

SEQ ID NO: 174061 - protein, 5 aa, Mycobacterium bovis
ESGRA

SEQ ID NO: 174062 - protein, 6 aa, Mycobacterium bovis
ESGRQL

SEQ ID NO: 174063 - protein, 9 aa, Mycobacterium bovis
ESGSGGPGV

SEQ ID NO: 174064 - protein, 6 aa, Mycobacterium bovis
ESGSGL

SEQ ID NO: 174065 - protein, 8 aa, Mycobacterium bovis
ESGSQISA

SEQ ID NO: 174066 - protein, 9 aa, Mycobacterium bovis
ESGSRTPGL

SEQ ID NO: 174067 - protein, 8 aa, Mycobacterium bovis
ESGTADME

SEQ ID NO: 174068 - protein, 5 aa, Mycobacterium bovis
ESGVP

SEQ ID NO: 174069 - protein, 7 aa, Mycobacterium bovis
ESGVPAE

SEQ ID NO: 174070 - protein, 11 aa, Mycobacterium bovis
ESIADGGSQVT

SEQ ID NO: 174071 - protein, 8 aa, Mycobacterium bovis
ESIGGSVS

SEQ ID NO: 174072 - protein, 11 aa, Mycobacterium bovis
ESIPDPVRETD

SEQ ID NO: 174073 - protein, 9 aa, Mycobacterium bovis
ESIRKAEDP

SEQ ID NO: 174074 - protein, 8 aa, Mycobacterium bovis
ESKASEVV

SEQ ID NO: 174075 - protein, 13 aa, Mycobacterium bovis
ESKVAAARSPIKA

SEQ ID NO: 174076 - protein, 4 aa, Mycobacterium bovis
ESLA

SEQ ID NO: 174077 - protein, 13 aa, Mycobacterium bovis
ESLAAEGDALTDR

SEQ ID NO: 174078 - protein, 46 aa, Mycobacterium bovis
ESLAGAARPQANANYGATSDPPLTHQPKPGSPTQVGPRSPSPPGLR

SEQ ID NO: 174079 - protein, 7 aa, Mycobacterium bovis
ESLRQQA

SEQ ID NO: 174080 - protein, 17 aa, Mycobacterium bovis
ESLSAGHAKPCAGGGAT

SEQ ID NO: 174081 - protein, 6 aa, Mycobacterium bovis
ESLTPG

SEQ ID NO: 174082 - protein, 6 aa, Mycobacterium bovis
ESMDPA

SEQ ID NO: 174083 - protein, 7 aa, Mycobacterium bovis
ESMDPEA

SEQ ID NO: 174084 - protein, 5 aa, Mycobacterium bovis
ESMGG

SEQ ID NO: 174085 - protein, 18 aa, Mycobacterium bovis
ESMGQGRASRADGAPDTV

SEQ ID NO: 174086 - protein, 4 aa, Mycobacterium bovis
ESMS

SEQ ID NO: 174087 - protein, 18 aa, Mycobacterium bovis
ESNGKSTRADGSPVSADT

SEQ ID NO: 174088 - protein, 6 aa, Mycobacterium bovis
ESNRTV

SEQ ID NO: 174089 - protein, 4 aa, Mycobacterium bovis
ESNW

SEQ ID NO: 174090 - protein, 4 aa, Mycobacterium bovis
ESPA

SEQ ID NO: 174091 - protein, 5 aa, Mycobacterium bovis
ESPAG

SEQ ID NO: 174092 - protein, 5 aa, Mycobacterium bovis
ESPDF

SEQ ID NO: 174093 - protein, 5 aa, Mycobacterium bovis
ESPDG

SEQ ID NO: 174094 - protein, 5 aa, Mycobacterium bovis
ESPDL

SEQ ID NO: 174095 - protein, 6 aa, Mycobacterium bovis
ESPPGA

SEQ ID NO: 174096 - protein, 6 aa, Mycobacterium bovis
ESPRGE

SEQ ID NO: 174097 - protein, 4 aa, Mycobacterium bovis
ESPS

SEQ ID NO: 174098 - protein, 7 aa, Mycobacterium bovis
ESPSGED

SEQ ID NO: 174099 - protein, 10 aa, Mycobacterium bovis
ESPVTSAGPH

SEQ ID NO: 174100 - protein, 4 aa, Mycobacterium bovis
ESQD

SEQ ID NO: 174101 - protein, 4 aa, Mycobacterium bovis
ESQE

SEQ ID NO: 174102 - protein, 8 aa, Mycobacterium bovis
ESQHRGSA

SEQ ID NO: 174103 - protein, 5 aa, Mycobacterium bovis
ESQTI

SEQ ID NO: 174104 - protein, 11 aa, Mycobacterium bovis
ESQVGTTDRAG

SEQ ID NO: 174105 - protein, 10 aa, Mycobacterium bovis
ESRKRGEAAE

SEQ ID NO: 174106 - protein, 15 aa, Mycobacterium bovis
ESRPPPAAARQDRWR

SEQ ID NO: 174107 - protein, 8 aa, Mycobacterium bovis
ESRPTRTE

SEQ ID NO: 174108 - protein, 15 aa, Mycobacterium bovis
ESRRLPGSGAGPSPD

SEQ ID NO: 174109 - protein, 4 aa, Mycobacterium bovis
ESRS

SEQ ID NO: 174110 - protein, 5 aa, Mycobacterium bovis
ESRTR

SEQ ID NO: 174111 - protein, 6 aa, Mycobacterium bovis
ESSALA

SEQ ID NO: 174112 - protein, 7 aa, Mycobacterium bovis
ESSASTV

SEQ ID NO: 174113 - protein, 4 aa, Mycobacterium bovis
ESSI

SEQ ID NO: 174114 - protein, 7 aa, Mycobacterium bovis
ESSPSIV

SEQ ID NO: 174115 - protein, 9 aa, Mycobacterium bovis
ESSRPAKPR

SEQ ID NO: 174116 - protein, 6 aa, Mycobacterium bovis
ESSRRA

SEQ ID NO: 174117 - protein, 14 aa, Mycobacterium bovis
ESTADRCAERLSGK

SEQ ID NO: 174118 - protein, 10 aa, Mycobacterium bovis
ESTALDERIG

SEQ ID NO: 174119 - protein, 7 aa, Mycobacterium bovis
ESTGAST

SEQ ID NO: 174120 - protein, 7 aa, Mycobacterium bovis
ESTGRGI

SEQ ID NO: 174121 - protein, 8 aa, Mycobacterium bovis
ESTPQGTT

SEQ ID NO: 174122 - protein, 8 aa, Mycobacterium bovis
ESTSGQRA

SEQ ID NO: 174123 - protein, 13 aa, Mycobacterium bovis
ESTTNAEVDDHGY

SEQ ID NO: 174124 - protein, 37 aa, Mycobacterium bovis
ESVDDGTAVADTAENDQADQGNSADTLGEQAESEPSG

SEQ ID NO: 174125 - protein, 6 aa, Mycobacterium bovis
ESVTEG

SEQ ID NO: 174126 - protein, 7 aa, Mycobacterium bovis
ESVTEGT

SEQ ID NO: 174127 - protein, 11 aa, Mycobacterium bovis
ESYAEGDDEEL

SEQ ID NO: 174128 - protein, 9 aa, Mycobacterium bovis
ESYAENASL

SEQ ID NO: 174129 - protein, 5 aa, Mycobacterium bovis
ESYGV

SEQ ID NO: 174130 - protein, 4 aa, Mycobacterium bovis
ETAC

SEQ ID NO: 174131 - protein, 5 aa, Mycobacterium bovis
ETADE

SEQ ID NO: 174132 - protein, 7 aa, Mycobacterium bovis
ETAEQTA

SEQ ID NO: 174133 - protein, 4 aa, Mycobacterium bovis
ETAG

SEQ ID NO: 174134 - protein, 10 aa, Mycobacterium bovis
ETAGDPEHPP

SEQ ID NO: 174135 - protein, 8 aa, Mycobacterium bovis
ETAGERPI

SEQ ID NO: 174136 - protein, 4 aa, Mycobacterium bovis
ETAL

SEQ ID NO: 174137 - protein, 5 aa, Mycobacterium bovis
ETAPE

SEQ ID NO: 174138 - protein, 8 aa, Mycobacterium bovis
ETARGATA

SEQ ID NO: 174139 - protein, 7 aa, Mycobacterium bovis
ETASEQM

SEQ ID NO: 174140 - protein, 9 aa, Mycobacterium bovis
ETDDPTVPT

SEQ ID NO: 174141 - protein, 11 aa, Mycobacterium bovis
ETDDVSEDSLE

SEQ ID NO: 174142 - protein, 7 aa, Mycobacterium bovis
ETDEAGN

SEQ ID NO: 174143 - protein, 6 aa, Mycobacterium bovis
ETDEMK

SEQ ID NO: 174144 - protein, 4 aa, Mycobacterium bovis
ETDG

SEQ ID NO: 174145 - protein, 6 aa, Mycobacterium bovis
ETDKDK

SEQ ID NO: 174146 - protein, 6 aa, Mycobacterium bovis
ETDPDL

SEQ ID NO: 174147 - protein, 4 aa, Mycobacterium bovis
ETDQ

SEQ ID NO: 174148 - protein, 8 aa, Mycobacterium bovis
ETDRNDPR

SEQ ID NO: 174149 - protein, 7 aa, Mycobacterium bovis
ETDSGLD

SEQ ID NO: 174150 - protein, 10 aa, Mycobacterium bovis
ETDTGSPEAQ

SEQ ID NO: 174151 - protein, 6 aa, Mycobacterium bovis
ETEGRP

SEQ ID NO: 174152 - protein, 12 aa, Mycobacterium bovis
ETEISGSGNGPL

SEQ ID NO: 174153 - protein, 4 aa, Mycobacterium bovis
ETEP

SEQ ID NO: 174154 - protein, 4 aa, Mycobacterium bovis
ETET

SEQ ID NO: 174155 - protein, 5 aa, Mycobacterium bovis
ETETG

SEQ ID NO: 174156 - protein, 5 aa, Mycobacterium bovis
ETFEE

SEQ ID NO: 174157 - protein, 10 aa, Mycobacterium bovis
ETGAGQHGVA

SEQ ID NO: 174158 - protein, 5 aa, Mycobacterium bovis
ETGAI

SEQ ID NO: 174159 - protein, 6 aa, Mycobacterium bovis
ETGCTS

SEQ ID NO: 174160 - protein, 10 aa, Mycobacterium bovis
ETGEHTAHSQ

SEQ ID NO: 174161 - protein, 39 aa, Mycobacterium bovis
ETGEPAAAASPVGGGANVATAKAVNPAPTANSTQRDEEE

SEQ ID NO: 174162 - protein, 6 aa, Mycobacterium bovis
ETGGRW

SEQ ID NO: 174163 - protein, 5 aa, Mycobacterium bovis
ETGLP

SEQ ID NO: 174164 - protein, 5 aa, Mycobacterium bovis
ETGNS

SEQ ID NO: 174165 - protein, 6 aa, Mycobacterium bovis
ETGQPG

SEQ ID NO: 174166 - protein, 8 aa, Mycobacterium bovis
ETGQPPWT

SEQ ID NO: 174167 - protein, 5 aa, Mycobacterium bovis
ETGRE

SEQ ID NO: 174168 - protein, 9 aa, Mycobacterium bovis
ETGRGSHED

SEQ ID NO: 174169 - protein, 12 aa, Mycobacterium bovis
ETGSQTASDDEL

SEQ ID NO: 174170 - protein, 8 aa, Mycobacterium bovis
ETGSTGDT

SEQ ID NO: 174171 - protein, 10 aa, Mycobacterium bovis
ETGSVPSPSQ

SEQ ID NO: 174172 - protein, 9 aa, Mycobacterium bovis
ETGYETRHR

SEQ ID NO: 174173 - protein, 15 aa, Mycobacterium bovis
ETHGPPPDPDDDPPP

SEQ ID NO: 174174 - protein, 4 aa, Mycobacterium bovis
ETIQ

SEQ ID NO: 174175 - protein, 9 aa, Mycobacterium bovis
ETKAPAVPV

SEQ ID NO: 174176 - protein, 11 aa, Mycobacterium bovis
ETKRRTAEQLG

SEQ ID NO: 174177 - protein, 5 aa, Mycobacterium bovis
ETMAP

SEQ ID NO: 174178 - protein, 14 aa, Mycobacterium bovis
ETMGTGGSGSGDSN

SEQ ID NO: 174179 - protein, 10 aa, Mycobacterium bovis
ETNAAHPNSR

SEQ ID NO: 174180 - protein, 6 aa, Mycobacterium bovis
ETNKQH

SEQ ID NO: 174181 - protein, 5 aa, Mycobacterium bovis
ETPEY

SEQ ID NO: 174182 - protein, 10 aa, Mycobacterium bovis
ETPHTRARSV

SEQ ID NO: 174183 - protein, 5 aa, Mycobacterium bovis
ETPIG

SEQ ID NO: 174184 - protein, 15 aa, Mycobacterium bovis
ETPRSGPADAAETRY

SEQ ID NO: 174185 - protein, 8 aa, Mycobacterium bovis
ETPTSGDV

SEQ ID NO: 174186 - protein, 19 aa, Mycobacterium bovis
ETPVGREAETLTARSPLGQ

SEQ ID NO: 174187 - protein, 6 aa, Mycobacterium bovis
ETQPQG

SEQ ID NO: 174188 - protein, 7 aa, Mycobacterium bovis
ETRGSGV

SEQ ID NO: 174189 - protein, 6 aa, Mycobacterium bovis
ETRKSF

SEQ ID NO: 174190 - protein, 5 aa, Mycobacterium bovis
ETRPD

SEQ ID NO: 174191 - protein, 8 aa, Mycobacterium bovis
ETSDEVRT

SEQ ID NO: 174192 - protein, 5 aa, Mycobacterium bovis
ETSDP

SEQ ID NO: 174193 - protein, 8 aa, Mycobacterium bovis
ETSEGIPH

SEQ ID NO: 174194 - protein, 4 aa, Mycobacterium bovis
ETSK

SEQ ID NO: 174195 - protein, 19 aa, Mycobacterium bovis
ETSPVSTQTRADDSVDRRV

SEQ ID NO: 174196 - protein, 6 aa, Mycobacterium bovis
ETSRFT

SEQ ID NO: 174197 - protein, 4 aa, Mycobacterium bovis
ETST

SEQ ID NO: 174198 - protein, 8 aa, Mycobacterium bovis
ETSTERLT

SEQ ID NO: 174199 - protein, 9 aa, Mycobacterium bovis
ETSVAGEPI

SEQ ID NO: 174200 - protein, 7 aa, Mycobacterium bovis
ETSVGKY

SEQ ID NO: 174201 - protein, 11 aa, Mycobacterium bovis
ETTAESLEDEL

SEQ ID NO: 174202 - protein, 5 aa, Mycobacterium bovis
ETTAN

SEQ ID NO: 174203 - protein, 8 aa, Mycobacterium bovis
ETTATRSG

SEQ ID NO: 174204 - protein, 6 aa, Mycobacterium bovis
ETTPPG

SEQ ID NO: 174205 - protein, 17 aa, Mycobacterium bovis
ETTRSSTGTGLQGVTSG

SEQ ID NO: 174206 - protein, 7 aa, Mycobacterium bovis
ETTSDEM

SEQ ID NO: 174207 - protein, 10 aa, Mycobacterium bovis
ETTSDLGGYK

SEQ ID NO: 174208 - protein, 22 aa, Mycobacterium bovis
ETTTGPHRTECSHGSPFRSGPI

SEQ ID NO: 174209 - protein, 4 aa, Mycobacterium bovis
ETVQ

SEQ ID NO: 174210 - protein, 6 aa, Mycobacterium bovis
ETVTSW

SEQ ID NO: 174211 - protein, 4 aa, Mycobacterium bovis
ETYG

SEQ ID NO: 174212 - protein, 14 aa, Mycobacterium bovis
ETYRRRATAAGQSL

SEQ ID NO: 174213 - protein, 9 aa, Mycobacterium bovis
EVADGLTRR

SEQ ID NO: 174214 - protein, 26 aa, Mycobacterium bovis
EVAPGTVAPVAGASRPQLPTGDLTSV

SEQ ID NO: 174215 - protein, 5 aa, Mycobacterium bovis
EVAPR

SEQ ID NO: 174216 - protein, 5 aa, Mycobacterium bovis
EVAVS

SEQ ID NO: 174217 - protein, 4 aa, Mycobacterium bovis
EVDD

SEQ ID NO: 174218 - protein, 8 aa, Mycobacterium bovis
EVDDKQLD

SEQ ID NO: 174219 - protein, 13 aa, Mycobacterium bovis
EVDGKPTAVTPAH

SEQ ID NO: 174220 - protein, 14 aa, Mycobacterium bovis
EVEAENRARYGGRL

SEQ ID NO: 174221 - protein, 14 aa, Mycobacterium bovis
EVEAPMADPPTDVP

SEQ ID NO: 174222 - protein, 9 aa, Mycobacterium bovis
EVEEDRDED

SEQ ID NO: 174223 - protein, 7 aa, Mycobacterium bovis
EVEGAGA

SEQ ID NO: 174224 - protein, 7 aa, Mycobacterium bovis
EVEGESA

SEQ ID NO: 174225 - protein, 8 aa, Mycobacterium bovis
EVGEAPGR

SEQ ID NO: 174226 - protein, 7 aa, Mycobacterium bovis
EVGEEPA

SEQ ID NO: 174227 - protein, 14 aa, Mycobacterium bovis
EVGESASASGGPRR

SEQ ID NO: 174228 - protein, 9 aa, Mycobacterium bovis
EVGGPLPGL

SEQ ID NO: 174229 - protein, 7 aa, Mycobacterium bovis
EVGPDDI

SEQ ID NO: 174230 - protein, 6 aa, Mycobacterium bovis
EVGRGA

SEQ ID NO: 174231 - protein, 12 aa, Mycobacterium bovis
EVGRPEAHHEEA

SEQ ID NO: 174232 - protein, 7 aa, Mycobacterium bovis
EVGSGKT

SEQ ID NO: 174233 - protein, 8 aa, Mycobacterium bovis
EVNRGQRR

SEQ ID NO: 174234 - protein, 16 aa, Mycobacterium bovis
EVPANVSKEIIAKATG

SEQ ID NO: 174235 - protein, 5 aa, Mycobacterium bovis
EVPAT

SEQ ID NO: 174236 - protein, 8 aa, Mycobacterium bovis
EVPETGAE

SEQ ID NO: 174237 - protein, 27 aa, Mycobacterium bovis
EVPGDTGEYQPASGDHPETGVYSSPAE

SEQ ID NO: 174238 - protein, 12 aa, Mycobacterium bovis
EVPNSDGINPHD

SEQ ID NO: 174239 - protein, 18 aa, Mycobacterium bovis
EVPPQTASRVTSSDYTWG

SEQ ID NO: 174240 - protein, 7 aa, Mycobacterium bovis
EVPPTSR

SEQ ID NO: 174241 - protein, 4 aa, Mycobacterium bovis
EVPT

SEQ ID NO: 174242 - protein, 7 aa, Mycobacterium bovis
EVPTGEV

SEQ ID NO: 174243 - protein, 6 aa, Mycobacterium bovis
EVQGQD

SEQ ID NO: 174244 - protein, 14 aa, Mycobacterium bovis
EVREGDPSPDGAGP

SEQ ID NO: 174245 - protein, 8 aa, Mycobacterium bovis
EVREKEQQ

SEQ ID NO: 174246 - protein, 10 aa, Mycobacterium bovis
EVRGPTGYDG

SEQ ID NO: 174247 - protein, 4 aa, Mycobacterium bovis
EVSA

SEQ ID NO: 174248 - protein, 8 aa, Mycobacterium bovis
EVSDPDAH

SEQ ID NO: 174249 - protein, 9 aa, Mycobacterium bovis
EVSDPEQVA

SEQ ID NO: 174250 - protein, 8 aa, Mycobacterium bovis
EVSGDGGK

SEQ ID NO: 174251 - protein, 11 aa, Mycobacterium bovis
EVSHPKPTEFR

SEQ ID NO: 174252 - protein, 5 aa, Mycobacterium bovis
EVSPA

SEQ ID NO: 174253 - protein, 12 aa, Mycobacterium bovis
EVTADGRSDRGN

SEQ ID NO: 174254 - protein, 10 aa, Mycobacterium bovis
EVTDAEGKPV

SEQ ID NO: 174255 - protein, 5 aa, Mycobacterium bovis
EVTSR

SEQ ID NO: 174256 - protein, 13 aa, Mycobacterium bovis
EWHGPASASMTAA

SEQ ID NO: 174257 - protein, 5 aa, Mycobacterium bovis
EWSGR

SEQ ID NO: 174258 - protein, 14 aa, Mycobacterium bovis
EYAGAAQGKWDPGN

SEQ ID NO: 174259 - protein, 5 aa, Mycobacterium bovis
EYDER

SEQ ID NO: 174260 - protein, 8 aa, Mycobacterium bovis
EYEVGNPA

SEQ ID NO: 174261 - protein, 6 aa, Mycobacterium bovis
EYGGMG

SEQ ID NO: 174262 - protein, 9 aa, Mycobacterium bovis
EYGGQGADS

SEQ ID NO: 174263 - protein, 5 aa, Mycobacterium bovis
EYGGV

SEQ ID NO: 174264 - protein, 21 aa, Mycobacterium bovis
EYGSGVGRSKKEAEQKAAAAA

SEQ ID NO: 174265 - protein, 13 aa, Mycobacterium bovis
EYKANRSSTPDEF

SEQ ID NO: 174266 - protein, 5 aa, Mycobacterium bovis
EYNGS

SEQ ID NO: 174267 - protein, 7 aa, Mycobacterium bovis
EYPHPKG

SEQ ID NO: 174268 - protein, 4 aa, Mycobacterium bovis
EYPP

SEQ ID NO: 174269 - protein, 11 aa, Mycobacterium bovis
EYQAAAAQAAA

SEQ ID NO: 174270 - protein, 5 aa, Mycobacterium bovis
EYQTV

SEQ ID NO: 174271 - protein, 4 aa, Mycobacterium bovis
EYRP

SEQ ID NO: 174272 - protein, 10 aa, Mycobacterium bovis
EYRQKTTVGP

SEQ ID NO: 174273 - protein, 5 aa, Mycobacterium bovis
EYSQG

SEQ ID NO: 174274 - protein, 10 aa, Mycobacterium bovis
EYTEGAGPGI

SEQ ID NO: 174275 - protein, 14 aa, Mycobacterium bovis
EYTPDGEERRTGRP

SEQ ID NO: 174276 - protein, 8 aa, Mycobacterium bovis
EYTPGPSV

SEQ ID NO: 174277 - protein, 10 aa, Mycobacterium bovis
FAAASPNEAI

SEQ ID NO: 174278 - protein, 5 aa, Mycobacterium bovis
FAATG

SEQ ID NO: 174279 - protein, 11 aa, Mycobacterium bovis
FAATGGGSVVP

SEQ ID NO: 174280 - protein, 8 aa, Mycobacterium bovis
FADAGSDG

SEQ ID NO: 174281 - protein, 13 aa, Mycobacterium bovis
FADEDRRTLAAAS

SEQ ID NO: 174282 - protein, 8 aa, Mycobacterium bovis
FADEPEKA

SEQ ID NO: 174283 - protein, 4 aa, Mycobacterium bovis
FADP

SEQ ID NO: 174284 - protein, 12 aa, Mycobacterium bovis
FADSNGDGVGDL

SEQ ID NO: 174285 - protein, 9 aa, Mycobacterium bovis
FAEDSPEAY

SEQ ID NO: 174286 - protein, 11 aa, Mycobacterium bovis
FAEKPEAGTPM

SEQ ID NO: 174287 - protein, 5 aa, Mycobacterium bovis
FAEPP

SEQ ID NO: 174288 - protein, 9 aa, Mycobacterium bovis
FAEQRSRSI

SEQ ID NO: 174289 - protein, 5 aa, Mycobacterium bovis
FAERE

SEQ ID NO: 174290 - protein, 10 aa, Mycobacterium bovis
FAESSEKHPD

SEQ ID NO: 174291 - protein, 9 aa, Mycobacterium bovis
FAGGTPDGV

SEQ ID NO: 174292 - protein, 8 aa, Mycobacterium bovis
FAGPHGRT

SEQ ID NO: 174293 - protein, 4 aa, Mycobacterium bovis
FAGQ

SEQ ID NO: 174294 - protein, 9 aa, Mycobacterium bovis
FAGSSAGVV

SEQ ID NO: 174295 - protein, 6 aa, Mycobacterium bovis
FANAQS

SEQ ID NO: 174296 - protein, 6 aa, Mycobacterium bovis
FANPTA

SEQ ID NO: 174297 - protein, 14 aa, Mycobacterium bovis
FANSGQSVTGYNNS

SEQ ID NO: 174298 - protein, 5 aa, Mycobacterium bovis
FANTG

SEQ ID NO: 174299 - protein, 8 aa, Mycobacterium bovis
FANTGDNN

SEQ ID NO: 174300 - protein, 9 aa, Mycobacterium bovis
FANTGSNNI

SEQ ID NO: 174301 - protein, 11 aa, Mycobacterium bovis
FAPAAEDSTGA

SEQ ID NO: 174302 - protein, 10 aa, Mycobacterium bovis
FAPASDTAGL

SEQ ID NO: 174303 - protein, 12 aa, Mycobacterium bovis
FAPGGDPATVAA

SEQ ID NO: 174304 - protein, 15 aa, Mycobacterium bovis
FAPPAPAATTQRHGS

SEQ ID NO: 174305 - protein, 9 aa, Mycobacterium bovis
FAQDGVGGL

SEQ ID NO: 174306 - protein, 11 aa, Mycobacterium bovis
FARPGARRSRE

SEQ ID NO: 174307 - protein, 8 aa, Mycobacterium bovis
FASGNPAT

SEQ ID NO: 174308 - protein, 19 aa, Mycobacterium bovis
FASTPLTPAAPIVSRLVAR

SEQ ID NO: 174309 - protein, 11 aa, Mycobacterium bovis
FATQPSDAFRT

SEQ ID NO: 174310 - protein, 9 aa, Mycobacterium bovis
FATTPNGRG

SEQ ID NO: 174311 - protein, 8 aa, Mycobacterium bovis
FDAEPDEL

SEQ ID NO: 174312 - protein, 8 aa, Mycobacterium bovis
FDANRPSA

SEQ ID NO: 174313 - protein, 5 aa, Mycobacterium bovis
FDDDE

SEQ ID NO: 174314 - protein, 12 aa, Mycobacterium bovis
FDDQGAKYDGDG

SEQ ID NO: 174315 - protein, 5 aa, Mycobacterium bovis
FDEDA

SEQ ID NO: 174316 - protein, 4 aa, Mycobacterium bovis
FDGD

SEQ ID NO: 174317 - protein, 6 aa, Mycobacterium bovis
FDGDGT

SEQ ID NO: 174318 - protein, 9 aa, Mycobacterium bovis
FDGEQKLAG

SEQ ID NO: 174319 - protein, 23 aa, Mycobacterium bovis
FDGGPDSRQAFAASPDDNPMPGG

SEQ ID NO: 174320 - protein, 7 aa, Mycobacterium bovis
FDGTQPT

SEQ ID NO: 174321 - protein, 10 aa, Mycobacterium bovis
FDKDGTALSS

SEQ ID NO: 174322 - protein, 14 aa, Mycobacterium bovis
FDNGPWPSTPPHER

SEQ ID NO: 174323 - protein, 28 aa, Mycobacterium bovis
FDNSGNVNTGNGNSGNINTGSWNAGNVN

SEQ ID NO: 174324 - protein, 4 aa, Mycobacterium bovis
FDPA

SEQ ID NO: 174325 - protein, 7 aa, Mycobacterium bovis
FDPAESA

SEQ ID NO: 174326 - protein, 15 aa, Mycobacterium bovis
FDPAGILNPGVVFGD

SEQ ID NO: 174327 - protein, 6 aa, Mycobacterium bovis
FDPATG

SEQ ID NO: 174328 - protein, 4 aa, Mycobacterium bovis
FDPE

SEQ ID NO: 174329 - protein, 12 aa, Mycobacterium bovis
FDPEAPIPANQN

SEQ ID NO: 174330 - protein, 7 aa, Mycobacterium bovis
FDPQAKG

SEQ ID NO: 174331 - protein, 4 aa, Mycobacterium bovis
FDPR

SEQ ID NO: 174332 - protein, 14 aa, Mycobacterium bovis
FDPSSGASGGYDTP

SEQ ID NO: 174333 - protein, 8 aa, Mycobacterium bovis
FDQSPKDL

SEQ ID NO: 174334 - protein, 11 aa, Mycobacterium bovis
FDRDDPRGGEA

SEQ ID NO: 174335 - protein, 10 aa, Mycobacterium bovis
FDRDPNGDWR

SEQ ID NO: 174336 - protein, 10 aa, Mycobacterium bovis
FDRPPSDHTS

SEQ ID NO: 174337 - protein, 5 aa, Mycobacterium bovis
FDRPR

SEQ ID NO: 174338 - protein, 8 aa, Mycobacterium bovis
FDSAAPTA

SEQ ID NO: 174339 - protein, 4 aa, Mycobacterium bovis
FDSI

SEQ ID NO: 174340 - protein, 10 aa, Mycobacterium bovis
FDSSDALPQN

SEQ ID NO: 174341 - protein, 15 aa, Mycobacterium bovis
FDTQGAGSVPRSVSG

SEQ ID NO: 174342 - protein, 4 aa, Mycobacterium bovis
FEAS

SEQ ID NO: 174343 - protein, 8 aa, Mycobacterium bovis
FEDEEHRR

SEQ ID NO: 174344 - protein, 9 aa, Mycobacterium bovis
FEGDAGGEL

SEQ ID NO: 174345 - protein, 6 aa, Mycobacterium bovis
FEGNAA

SEQ ID NO: 174346 - protein, 11 aa, Mycobacterium bovis
FEKEPSDPKLS

SEQ ID NO: 174347 - protein, 9 aa, Mycobacterium bovis
FEKPGRHRR

SEQ ID NO: 174348 - protein, 8 aa, Mycobacterium bovis
FENDDSAA

SEQ ID NO: 174349 - protein, 7 aa, Mycobacterium bovis
FEPSGYP

SEQ ID NO: 174350 - protein, 5 aa, Mycobacterium bovis
FERRS

SEQ ID NO: 174351 - protein, 11 aa, Mycobacterium bovis
FESATASAGTV

SEQ ID NO: 174352 - protein, 18 aa, Mycobacterium bovis
FESGTSGRPVGLRPSGAL

SEQ ID NO: 174353 - protein, 7 aa, Mycobacterium bovis
FETNEDG

SEQ ID NO: 174354 - protein, 4 aa, Mycobacterium bovis
FETR

SEQ ID NO: 174355 - protein, 4 aa, Mycobacterium bovis
FGAA

SEQ ID NO: 174356 - protein, 8 aa, Mycobacterium bovis
FGAATGAA

SEQ ID NO: 174357 - protein, 6 aa, Mycobacterium bovis
FGAREA

SEQ ID NO: 174358 - protein, 9 aa, Mycobacterium bovis
FGDDPAAAQ

SEQ ID NO: 174359 - protein, 31 aa, Mycobacterium bovis
FGDEDNFPHPTLGPDTEPQDRMATTSRVRPP

SEQ ID NO: 174360 - protein, 10 aa, Mycobacterium bovis
FGDGALKDKP

SEQ ID NO: 174361 - protein, 34 aa, Mycobacterium bovis
FGDGGTGGTGGAGGAGSGTKAGGTGSDGGHGGNA

SEQ ID NO: 174362 - protein, 6 aa, Mycobacterium bovis
FGDGTT

SEQ ID NO: 174363 - protein, 8 aa, Mycobacterium bovis
FGDNPATR

SEQ ID NO: 174364 - protein, 7 aa, Mycobacterium bovis
FGDPQER

SEQ ID NO: 174365 - protein, 4 aa, Mycobacterium bovis
FGDQ

SEQ ID NO: 174366 - protein, 8 aa, Mycobacterium bovis
FGEDPDVD

SEQ ID NO: 174367 - protein, 14 aa, Mycobacterium bovis
FGEPGGREPKVSGQ

SEQ ID NO: 174368 - protein, 42 aa, Mycobacterium bovis
FGGAGGAGGLGGKAGLIGDGGDGGAGGNGTGAKGGDGGAGGG

SEQ ID NO: 174369 - protein, 11 aa, Mycobacterium bovis
FGGDGGATTSV

SEQ ID NO: 174370 - protein, 7 aa, Mycobacterium bovis
FGGDPGN

SEQ ID NO: 174371 - protein, 9 aa, Mycobacterium bovis
FGGEAGDTT

SEQ ID NO: 174372 - protein, 10 aa, Mycobacterium bovis
FGGEESAGAS

SEQ ID NO: 174373 - protein, 12 aa, Mycobacterium bovis
FGGGAASRGPIG

SEQ ID NO: 174374 - protein, 23 aa, Mycobacterium bovis
FGGLGGGSNGTGGAGGAGGTGAT

SEQ ID NO: 174375 - protein, 7 aa, Mycobacterium bovis
FGGPPGV

SEQ ID NO: 174376 - protein, 12 aa, Mycobacterium bovis
FGGQGGNGGAGG

SEQ ID NO: 174377 - protein, 4 aa, Mycobacterium bovis
FGGS

SEQ ID NO: 174378 - protein, 5 aa, Mycobacterium bovis
FGGSG

SEQ ID NO: 174379 - protein, 12 aa, Mycobacterium bovis
FGHTGVQRALDR

SEQ ID NO: 174380 - protein, 52 aa, Mycobacterium bovis
FGNAGDDNTGWGNSGDTNTGGFNSGDLNTGIGSPVTQGVANSGFGNTGTGHS

SEQ ID NO: 174381 - protein, 6 aa, Mycobacterium bovis
FGNAGS

SEQ ID NO: 174382 - protein, 25 aa, Mycobacterium bovis
FGNGGDGGAGGFGTGAGGTGGTGGN

SEQ ID NO: 174383 - protein, 35 aa, Mycobacterium bovis
FGNGGTGGVGGKGGTSSDLASATSGAGGAGGAGGV

SEQ ID NO: 174384 - protein, 8 aa, Mycobacterium bovis
FGNRGDAN

SEQ ID NO: 174385 - protein, 8 aa, Mycobacterium bovis
FGNSGNNN

SEQ ID NO: 174386 - protein, 9 aa, Mycobacterium bovis
FGNSGNNNI

SEQ ID NO: 174387 - protein, 4 aa, Mycobacterium bovis
FGNT

SEQ ID NO: 174388 - protein, 10 aa, Mycobacterium bovis
FGNTGAQTVG

SEQ ID NO: 174389 - protein, 29 aa, Mycobacterium bovis
FGNTGDANTGGGNTGNGNIGGGNTGNNNF

SEQ ID NO: 174390 - protein, 9 aa, Mycobacterium bovis
FGNTGNGNI

SEQ ID NO: 174391 - protein, 33 aa, Mycobacterium bovis
FGNTGSNNIGFGNTGSNNIGFGNTGDGNRGIGL

SEQ ID NO: 174392 - protein, 9 aa, Mycobacterium bovis
FGNTGTGNI

SEQ ID NO: 174393 - protein, 10 aa, Mycobacterium bovis
FGNTTAVPSS

SEQ ID NO: 174394 - protein, 5 aa, Mycobacterium bovis
FGPAA

SEQ ID NO: 174395 - protein, 5 aa, Mycobacterium bovis
FGPEE

SEQ ID NO: 174396 - protein, 9 aa, Mycobacterium bovis
FGPEKTAQI

SEQ ID NO: 174397 - protein, 35 aa, Mycobacterium bovis
FGPGGAGGTGGFGASSADQMAGGIGGSGGSGGAAK

SEQ ID NO: 174398 - protein, 6 aa, Mycobacterium bovis
FGPGPY

SEQ ID NO: 174399 - protein, 18 aa, Mycobacterium bovis
FGPKPQEPPPDPVPFPPY

SEQ ID NO: 174400 - protein, 9 aa, Mycobacterium bovis
FGPPAGDPA

SEQ ID NO: 174401 - protein, 4 aa, Mycobacterium bovis
FGPS

SEQ ID NO: 174402 - protein, 55 aa, Mycobacterium bovis
FGQSGSPGSGAAGGLGGAGGNGGAGGGGGTGFNPGAPGDPGTQGATGANGQHGLN

SEQ ID NO: 174403 - protein, 6 aa, Mycobacterium bovis
FGRGPN

SEQ ID NO: 174404 - protein, 9 aa, Mycobacterium bovis
FGRPATGLP

SEQ ID NO: 174405 - protein, 11 aa, Mycobacterium bovis
FGSADYRGGDH

SEQ ID NO: 174406 - protein, 7 aa, Mycobacterium bovis
FGSGKTT

SEQ ID NO: 174407 - protein, 10 aa, Mycobacterium bovis
FGSGLPPAEP

SEQ ID NO: 174408 - protein, 8 aa, Mycobacterium bovis
FGSPELQQ

SEQ ID NO: 174409 - protein, 4 aa, Mycobacterium bovis
FGST

SEQ ID NO: 174410 - protein, 4 aa, Mycobacterium bovis
FGSY

SEQ ID NO: 174411 - protein, 14 aa, Mycobacterium bovis
FGTAPNPGGGLPYT

SEQ ID NO: 174412 - protein, 10 aa, Mycobacterium bovis
FGTDDDNYRE

SEQ ID NO: 174413 - protein, 6 aa, Mycobacterium bovis
FGTEPD

SEQ ID NO: 174414 - protein, 5 aa, Mycobacterium bovis
FGTNA

SEQ ID NO: 174415 - protein, 19 aa, Mycobacterium bovis
FGVSSSGGHPDGHRATRGA

SEQ ID NO: 174416 - protein, 20 aa, Mycobacterium bovis
FHPEKSGDAGAAVLSNWVDG

SEQ ID NO: 174417 - protein, 5 aa, Mycobacterium bovis
FHPSQ

SEQ ID NO: 174418 - protein, 9 aa, Mycobacterium bovis
FKDETETDL

SEQ ID NO: 174419 - protein, 9 aa, Mycobacterium bovis
FKEGREKGL

SEQ ID NO: 174420 - protein, 9 aa, Mycobacterium bovis
FKNAEPADI

SEQ ID NO: 174421 - protein, 20 aa, Mycobacterium bovis
FKPEPHSAANEPKHPAARPK

SEQ ID NO: 174422 - protein, 4 aa, Mycobacterium bovis
FKQS

SEQ ID NO: 174423 - protein, 11 aa, Mycobacterium bovis
FKRSDAQLPAN

SEQ ID NO: 174424 - protein, 11 aa, Mycobacterium bovis
FKSGSSQPPLQ

SEQ ID NO: 174425 - protein, 7 aa, Mycobacterium bovis
FNAPTSV

SEQ ID NO: 174426 - protein, 11 aa, Mycobacterium bovis
FNDGTRGGEAD

SEQ ID NO: 174427 - protein, 4 aa, Mycobacterium bovis
FNEA

SEQ ID NO: 174428 - protein, 14 aa, Mycobacterium bovis
FNPDEPDAFAATGG

SEQ ID NO: 174429 - protein, 6 aa, Mycobacterium bovis
FNPECA

SEQ ID NO: 174430 - protein, 27 aa, Mycobacterium bovis
FNPGNSNTGFANSGDVNTGAFNSGNYS

SEQ ID NO: 174431 - protein, 19 aa, Mycobacterium bovis
FNPGSSNTGTFNTGNANTG

SEQ ID NO: 174432 - protein, 7 aa, Mycobacterium bovis
FNSGTNN

SEQ ID NO: 174433 - protein, 12 aa, Mycobacterium bovis
FNTGGVNPGTVN

SEQ ID NO: 174434 - protein, 12 aa, Mycobacterium bovis
FPANGATADTNA

SEQ ID NO: 174435 - protein, 8 aa, Mycobacterium bovis
FPAPPPRE

SEQ ID NO: 174436 - protein, 9 aa, Mycobacterium bovis
FPASDPGQL

SEQ ID NO: 174437 - protein, 6 aa, Mycobacterium bovis
FPDSHR

SEQ ID NO: 174438 - protein, 12 aa, Mycobacterium bovis
FPEPQPSKDVVQ

SEQ ID NO: 174439 - protein, 11 aa, Mycobacterium bovis
FPEPSSAVEQG

SEQ ID NO: 174440 - protein, 6 aa, Mycobacterium bovis
FPESYN

SEQ ID NO: 174441 - protein, 5 aa, Mycobacterium bovis
FPGAK

SEQ ID NO: 174442 - protein, 6 aa, Mycobacterium bovis
FPGGEG

SEQ ID NO: 174443 - protein, 12 aa, Mycobacterium bovis
FPNHEANPLDPA

SEQ ID NO: 174444 - protein, 4 aa, Mycobacterium bovis
FPPE

SEQ ID NO: 174445 - protein, 6 aa, Mycobacterium bovis
FPPPNT

SEQ ID NO: 174446 - protein, 10 aa, Mycobacterium bovis
FPQPNQPDQL

SEQ ID NO: 174447 - protein, 24 aa, Mycobacterium bovis
FPQRDPHGAPIPGADGQVPTPPAR

SEQ ID NO: 174448 - protein, 14 aa, Mycobacterium bovis
FPRDKPCGDGLTPR

SEQ ID NO: 174449 - protein, 6 aa, Mycobacterium bovis
FPRPQT

SEQ ID NO: 174450 - protein, 7 aa, Mycobacterium bovis
FPRPSTQ

SEQ ID NO: 174451 - protein, 7 aa, Mycobacterium bovis
FPSDNGE

SEQ ID NO: 174452 - protein, 6 aa, Mycobacterium bovis
FPSETR

SEQ ID NO: 174453 - protein, 6 aa, Mycobacterium bovis
FPSRKS

SEQ ID NO: 174454 - protein, 6 aa, Mycobacterium bovis
FPTDRG

SEQ ID NO: 174455 - protein, 10 aa, Mycobacterium bovis
FPTMRTPPGL

SEQ ID NO: 174456 - protein, 9 aa, Mycobacterium bovis
FPTRNGAQR

SEQ ID NO: 174457 - protein, 5 aa, Mycobacterium bovis
FPYQS

SEQ ID NO: 174458 - protein, 5 aa, Mycobacterium bovis
FQETT

SEQ ID NO: 174459 - protein, 6 aa, Mycobacterium bovis
FQGGQA

SEQ ID NO: 174460 - protein, 4 aa, Mycobacterium bovis
FQRG

SEQ ID NO: 174461 - protein, 10 aa, Mycobacterium bovis
FQRTRSGYDP

SEQ ID NO: 174462 - protein, 6 aa, Mycobacterium bovis
FRDETG

SEQ ID NO: 174463 - protein, 5 aa, Mycobacterium bovis
FRGGA

SEQ ID NO: 174464 - protein, 11 aa, Mycobacterium bovis
FRGPDEANARA

SEQ ID NO: 174465 - protein, 32 aa, Mycobacterium bovis
FRGPGKPFADEKPCPRERPPADQLAAFLGRTV

SEQ ID NO: 174466 - protein, 11 aa, Mycobacterium bovis
FRGQGASHGAQ

SEQ ID NO: 174467 - protein, 9 aa, Mycobacterium bovis
FRGRTTGPW

SEQ ID NO: 174468 - protein, 5 aa, Mycobacterium bovis
FRNDG

SEQ ID NO: 174469 - protein, 7 aa, Mycobacterium bovis
FRNPPQA

SEQ ID NO: 174470 - protein, 11 aa, Mycobacterium bovis
FRPGDDDAPAH

SEQ ID NO: 174471 - protein, 9 aa, Mycobacterium bovis
FRPGKAPAK

SEQ ID NO: 174472 - protein, 11 aa, Mycobacterium bovis
FRSRSKAAETT

SEQ ID NO: 174473 - protein, 11 aa, Mycobacterium bovis
FSAPPTPFNGP

SEQ ID NO: 174474 - protein, 5 aa, Mycobacterium bovis
FSDDE

SEQ ID NO: 174475 - protein, 4 aa, Mycobacterium bovis
FSDR

SEQ ID NO: 174476 - protein, 12 aa, Mycobacterium bovis
FSEGSEPAGIGG

SEQ ID NO: 174477 - protein, 10 aa, Mycobacterium bovis
FSERGGPQTN

SEQ ID NO: 174478 - protein, 6 aa, Mycobacterium bovis
FSGAKT

SEQ ID NO: 174479 - protein, 13 aa, Mycobacterium bovis
FSGDGSLDTATAA

SEQ ID NO: 174480 - protein, 6 aa, Mycobacterium bovis
FSGQTR

SEQ ID NO: 174481 - protein, 7 aa, Mycobacterium bovis
FSGRAQV

SEQ ID NO: 174482 - protein, 7 aa, Mycobacterium bovis
FSGSAPG

SEQ ID NO: 174483 - protein, 18 aa, Mycobacterium bovis
FSGSARAKITAAGGSATE

SEQ ID NO: 174484 - protein, 6 aa, Mycobacterium bovis
FSGSNG

SEQ ID NO: 174485 - protein, 9 aa, Mycobacterium bovis
FSKNSDTGA

SEQ ID NO: 174486 - protein, 10 aa, Mycobacterium bovis
FSNEPAGSGR

SEQ ID NO: 174487 - protein, 4 aa, Mycobacterium bovis
FSPA

SEQ ID NO: 174488 - protein, 7 aa, Mycobacterium bovis
FSPDEDR

SEQ ID NO: 174489 - protein, 8 aa, Mycobacterium bovis
FSPGQNHQ

SEQ ID NO: 174490 - protein, 9 aa, Mycobacterium bovis
FSPGQQDAW

SEQ ID NO: 174491 - protein, 6 aa, Mycobacterium bovis
FSPGRR

SEQ ID NO: 174492 - protein, 6 aa, Mycobacterium bovis
FSPGTP

SEQ ID NO: 174493 - protein, 16 aa, Mycobacterium bovis
FSPPRQTTNPAGLTAQ

SEQ ID NO: 174494 - protein, 9 aa, Mycobacterium bovis
FSRGAKSYH

SEQ ID NO: 174495 - protein, 15 aa, Mycobacterium bovis
FSRPEPRHRAQRTVE

SEQ ID NO: 174496 - protein, 9 aa, Mycobacterium bovis
FSRQGEHRA

SEQ ID NO: 174497 - protein, 9 aa, Mycobacterium bovis
FSSAPTNHA

SEQ ID NO: 174498 - protein, 8 aa, Mycobacterium bovis
FSSDSDAR

SEQ ID NO: 174499 - protein, 9 aa, Mycobacterium bovis
FSTAADSNA

SEQ ID NO: 174500 - protein, 18 aa, Mycobacterium bovis
FSTGETGRVGSPKRREIG

SEQ ID NO: 174501 - protein, 10 aa, Mycobacterium bovis
FSTGGKTPLA

SEQ ID NO: 174502 - protein, 9 aa, Mycobacterium bovis
FTAGSPGAF

SEQ ID NO: 174503 - protein, 9 aa, Mycobacterium bovis
FTAPPQNLT

SEQ ID NO: 174504 - protein, 20 aa, Mycobacterium bovis
FTAPPQTTNPSGLAGQAAAT

SEQ ID NO: 174505 - protein, 5 aa, Mycobacterium bovis
FTDPE

SEQ ID NO: 174506 - protein, 7 aa, Mycobacterium bovis
FTEGRSA

SEQ ID NO: 174507 - protein, 4 aa, Mycobacterium bovis
FTEK

SEQ ID NO: 174508 - protein, 10 aa, Mycobacterium bovis
FTEPRNEHKR

SEQ ID NO: 174509 - protein, 10 aa, Mycobacterium bovis
FTGEEGATYE

SEQ ID NO: 174510 - protein, 8 aa, Mycobacterium bovis
FTGEGAKL

SEQ ID NO: 174511 - protein, 11 aa, Mycobacterium bovis
FTGQPGSTVPV

SEQ ID NO: 174512 - protein, 5 aa, Mycobacterium bovis
FTGRG

SEQ ID NO: 174513 - protein, 13 aa, Mycobacterium bovis
FTGSPAPTPPTLG

SEQ ID NO: 174514 - protein, 4 aa, Mycobacterium bovis
FTGT

SEQ ID NO: 174515 - protein, 13 aa, Mycobacterium bovis
FTPEATAEADGNL

SEQ ID NO: 174516 - protein, 10 aa, Mycobacterium bovis
FTPEQKARNV

SEQ ID NO: 174517 - protein, 18 aa, Mycobacterium bovis
FTPGERRDASDKSSSAAR

SEQ ID NO: 174518 - protein, 6 aa, Mycobacterium bovis
FTPGPG

SEQ ID NO: 174519 - protein, 13 aa, Mycobacterium bovis
FTPKDGGRVVMRR

SEQ ID NO: 174520 - protein, 4 aa, Mycobacterium bovis
FTPR

SEQ ID NO: 174521 - protein, 4 aa, Mycobacterium bovis
FTPS

SEQ ID NO: 174522 - protein, 13 aa, Mycobacterium bovis
FTPSPSAAATPGG

SEQ ID NO: 174523 - protein, 5 aa, Mycobacterium bovis
FTPSW

SEQ ID NO: 174524 - protein, 8 aa, Mycobacterium bovis
FTQPGGPQ

SEQ ID NO: 174525 - protein, 5 aa, Mycobacterium bovis
FTSDG

SEQ ID NO: 174526 - protein, 5 aa, Mycobacterium bovis
FTSTE

SEQ ID NO: 174527 - protein, 23 aa, Mycobacterium bovis
FTTSDAQAVPKTAADRRPPVAAD

SEQ ID NO: 174528 - protein, 10 aa, Mycobacterium bovis
FVPGPSDPTA

SEQ ID NO: 174529 - protein, 8 aa, Mycobacterium bovis
FYGPGGAQ

SEQ ID NO: 174530 - protein, 5 aa, Mycobacterium bovis
FYPST

SEQ ID NO: 174531 - protein, 9 aa, Mycobacterium bovis
GAAAAAAHT

SEQ ID NO: 174532 - protein, 7 aa, Mycobacterium bovis
GAAAPLD

SEQ ID NO: 174533 - protein, 9 aa, Mycobacterium bovis
GAAAQASSL

SEQ ID NO: 174534 - protein, 14 aa, Mycobacterium bovis
GAAAYTGAEAASVS

SEQ ID NO: 174535 - protein, 11 aa, Mycobacterium bovis
GAADGTAWSEG

SEQ ID NO: 174536 - protein, 11 aa, Mycobacterium bovis
GAADNGPAEQQ

SEQ ID NO: 174537 - protein, 8 aa, Mycobacterium bovis
GAADQIPG

SEQ ID NO: 174538 - protein, 5 aa, Mycobacterium bovis
GAAED

SEQ ID NO: 174539 - protein, 7 aa, Mycobacterium bovis
GAAEGAI

SEQ ID NO: 174540 - protein, 17 aa, Mycobacterium bovis
GAAEKQDPLSGLTDQER

SEQ ID NO: 174541 - protein, 6 aa, Mycobacterium bovis
GAAELG

SEQ ID NO: 174542 - protein, 5 aa, Mycobacterium bovis
GAAER

SEQ ID NO: 174543 - protein, 26 aa, Mycobacterium bovis
GAAGAGGAATGDGATGGAGGFGGAGA

SEQ ID NO: 174544 - protein, 31 aa, Mycobacterium bovis
GAAGGAGGTGGAGGTVFGGGKGGAGGAGGNA

SEQ ID NO: 174545 - protein, 6 aa, Mycobacterium bovis
GAAGIG

SEQ ID NO: 174546 - protein, 11 aa, Mycobacterium bovis
GAAGPRSSWRA

SEQ ID NO: 174547 - protein, 6 aa, Mycobacterium bovis
GAAGQI

SEQ ID NO: 174548 - protein, 9 aa, Mycobacterium bovis
GAAGQPHAR

SEQ ID NO: 174549 - protein, 7 aa, Mycobacterium bovis
GAAGSSA

SEQ ID NO: 174550 - protein, 7 aa, Mycobacterium bovis
GAAGTGI

SEQ ID NO: 174551 - protein, 7 aa, Mycobacterium bovis
GAAGTSN

SEQ ID NO: 174552 - protein, 4 aa, Mycobacterium bovis
GAAI

SEQ ID NO: 174553 - protein, 9 aa, Mycobacterium bovis
GAAKGYAAA

SEQ ID NO: 174554 - protein, 12 aa, Mycobacterium bovis
GAALGQTVTLTL

SEQ ID NO: 174555 - protein, 4 aa, Mycobacterium bovis
GAAM

SEQ ID NO: 174556 - protein, 14 aa, Mycobacterium bovis
GAANEAAGPGPGSI

SEQ ID NO: 174557 - protein, 4 aa, Mycobacterium bovis
GAAP

SEQ ID NO: 174558 - protein, 10 aa, Mycobacterium bovis
GAAPAGHGSK

SEQ ID NO: 174559 - protein, 42 aa, Mycobacterium bovis
GAAPAPKPAPKPVPEPAPTPKAEPAPSPPAAQPAGAAEGAPY

SEQ ID NO: 174560 - protein, 7 aa, Mycobacterium bovis
GAAPDTR

SEQ ID NO: 174561 - protein, 5 aa, Mycobacterium bovis
GAAPG

SEQ ID NO: 174562 - protein, 8 aa, Mycobacterium bovis
GAAPRARV

SEQ ID NO: 174563 - protein, 8 aa, Mycobacterium bovis
GAAPSASD

SEQ ID NO: 174564 - protein, 10 aa, Mycobacterium bovis
GAAPSMAGPR

SEQ ID NO: 174565 - protein, 8 aa, Mycobacterium bovis
GAAPSYDQ

SEQ ID NO: 174566 - protein, 8 aa, Mycobacterium bovis
GAAPVSAG

SEQ ID NO: 174567 - protein, 5 aa, Mycobacterium bovis
GAAQG

SEQ ID NO: 174568 - protein, 10 aa, Mycobacterium bovis
GAARRRTPAR

SEQ ID NO: 174569 - protein, 9 aa, Mycobacterium bovis
GAASGQWTP

SEQ ID NO: 174570 - protein, 12 aa, Mycobacterium bovis
GAASNPDPERTI

SEQ ID NO: 174571 - protein, 8 aa, Mycobacterium bovis
GAASQGVA

SEQ ID NO: 174572 - protein, 13 aa, Mycobacterium bovis
GAASSAAPRAYRA

SEQ ID NO: 174573 - protein, 4 aa, Mycobacterium bovis
GAAT

SEQ ID NO: 174574 - protein, 14 aa, Mycobacterium bovis
GAATEADGSPNRGY

SEQ ID NO: 174575 - protein, 8 aa, Mycobacterium bovis
GAATEDDA

SEQ ID NO: 174576 - protein, 7 aa, Mycobacterium bovis
GAATEVE

SEQ ID NO: 174577 - protein, 8 aa, Mycobacterium bovis
GAATGTRI

SEQ ID NO: 174578 - protein, 6 aa, Mycobacterium bovis
GAATRQ

SEQ ID NO: 174579 - protein, 8 aa, Mycobacterium bovis
GAATSTDD

SEQ ID NO: 174580 - protein, 4 aa, Mycobacterium bovis
GAAV

SEQ ID NO: 174581 - protein, 18 aa, Mycobacterium bovis
GAAVGESATEEPMPDASN

SEQ ID NO: 174582 - protein, 6 aa, Mycobacterium bovis
GACHTG

SEQ ID NO: 174583 - protein, 7 aa, Mycobacterium bovis
GADAGAG

SEQ ID NO: 174584 - protein, 10 aa, Mycobacterium bovis
GADATDIAKR

SEQ ID NO: 174585 - protein, 7 aa, Mycobacterium bovis
GADDAEL

SEQ ID NO: 174586 - protein, 8 aa, Mycobacterium bovis
GADDGRSA

SEQ ID NO: 174587 - protein, 6 aa, Mycobacterium bovis
GADDVS

SEQ ID NO: 174588 - protein, 7 aa, Mycobacterium bovis
GADEADA

SEQ ID NO: 174589 - protein, 6 aa, Mycobacterium bovis
GADEIS

SEQ ID NO: 174590 - protein, 14 aa, Mycobacterium bovis
GADERTGQPRPPAV

SEQ ID NO: 174591 - protein, 7 aa, Mycobacterium bovis
GADEVSQ

SEQ ID NO: 174592 - protein, 6 aa, Mycobacterium bovis
GADGAG

SEQ ID NO: 174593 - protein, 16 aa, Mycobacterium bovis
GADGAPGTGQAGGAGG

SEQ ID NO: 174594 - protein, 8 aa, Mycobacterium bovis
GADGEGAG

SEQ ID NO: 174595 - protein, 16 aa, Mycobacterium bovis
GADGLRTAGERAVRSP

SEQ ID NO: 174596 - protein, 8 aa, Mycobacterium bovis
GADGMSGA

SEQ ID NO: 174597 - protein, 5 aa, Mycobacterium bovis
GADGS

SEQ ID NO: 174598 - protein, 7 aa, Mycobacterium bovis
GADHRRR

SEQ ID NO: 174599 - protein, 9 aa, Mycobacterium bovis
GADITTRAE

SEQ ID NO: 174600 - protein, 10 aa, Mycobacterium bovis
GADKEGPELR

SEQ ID NO: 174601 - protein, 4 aa, Mycobacterium bovis
GADL

SEQ ID NO: 174602 - protein, 4 aa, Mycobacterium bovis
GADM

SEQ ID NO: 174603 - protein, 16 aa, Mycobacterium bovis
GADNTEEERFSPGERY

SEQ ID NO: 174604 - protein, 6 aa, Mycobacterium bovis
GADPAR

SEQ ID NO: 174605 - protein, 6 aa, Mycobacterium bovis
GADPAV

SEQ ID NO: 174606 - protein, 6 aa, Mycobacterium bovis
GADPDL

SEQ ID NO: 174607 - protein, 8 aa, Mycobacterium bovis
GADPPHVR

SEQ ID NO: 174608 - protein, 8 aa, Mycobacterium bovis
GADPPLGA

SEQ ID NO: 174609 - protein, 10 aa, Mycobacterium bovis
GADPQRVRPV

SEQ ID NO: 174610 - protein, 7 aa, Mycobacterium bovis
GADPSDI

SEQ ID NO: 174611 - protein, 4 aa, Mycobacterium bovis
GADQ

SEQ ID NO: 174612 - protein, 7 aa, Mycobacterium bovis
GADQPGR

SEQ ID NO: 174613 - protein, 6 aa, Mycobacterium bovis
GADRDG

SEQ ID NO: 174614 - protein, 9 aa, Mycobacterium bovis
GADREAGAD

SEQ ID NO: 174615 - protein, 8 aa, Mycobacterium bovis
GADREEAL

SEQ ID NO: 174616 - protein, 7 aa, Mycobacterium bovis
GADSSRG

SEQ ID NO: 174617 - protein, 13 aa, Mycobacterium bovis
GADTERARDLLST

SEQ ID NO: 174618 - protein, 11 aa, Mycobacterium bovis
GADTGIGSEPP

SEQ ID NO: 174619 - protein, 12 aa, Mycobacterium bovis
GADTSVAGVPEL

SEQ ID NO: 174620 - protein, 6 aa, Mycobacterium bovis
GADVSQ

SEQ ID NO: 174621 - protein, 7 aa, Mycobacterium bovis
GAEAANV

SEQ ID NO: 174622 - protein, 13 aa, Mycobacterium bovis
GAEAGKPLASSDR

SEQ ID NO: 174623 - protein, 7 aa, Mycobacterium bovis
GAEANEA

SEQ ID NO: 174624 - protein, 7 aa, Mycobacterium bovis
GAEDPKL

SEQ ID NO: 174625 - protein, 8 aa, Mycobacterium bovis
GAEDVNDL

SEQ ID NO: 174626 - protein, 7 aa, Mycobacterium bovis
GAEDYAQ

SEQ ID NO: 174627 - protein, 7 aa, Mycobacterium bovis
GAEESQA

SEQ ID NO: 174628 - protein, 5 aa, Mycobacterium bovis
GAEGD

SEQ ID NO: 174629 - protein, 8 aa, Mycobacterium bovis
GAEGTENV

SEQ ID NO: 174630 - protein, 4 aa, Mycobacterium bovis
GAEH

SEQ ID NO: 174631 - protein, 15 aa, Mycobacterium bovis
GAENDPSFTADHAEK

SEQ ID NO: 174632 - protein, 12 aa, Mycobacterium bovis
GAENPEPGRYGG

SEQ ID NO: 174633 - protein, 9 aa, Mycobacterium bovis
GAEPDLPAL

SEQ ID NO: 174634 - protein, 5 aa, Mycobacterium bovis
GAEPQ

SEQ ID NO: 174635 - protein, 12 aa, Mycobacterium bovis
GAEQGGIDAQQA

SEQ ID NO: 174636 - protein, 8 aa, Mycobacterium bovis
GAEQIRTG

SEQ ID NO: 174637 - protein, 6 aa, Mycobacterium bovis
GAERAS

SEQ ID NO: 174638 - protein, 7 aa, Mycobacterium bovis
GAERTEL

SEQ ID NO: 174639 - protein, 9 aa, Mycobacterium bovis
GAETTRNSI

SEQ ID NO: 174640 - protein, 5 aa, Mycobacterium bovis
GAEYP

SEQ ID NO: 174641 - protein, 5 aa, Mycobacterium bovis
GAFPA

SEQ ID NO: 174642 - protein, 8 aa, Mycobacterium bovis
GAGAGMPG

SEQ ID NO: 174643 - protein, 6 aa, Mycobacterium bovis
GAGAPT

SEQ ID NO: 174644 - protein, 22 aa, Mycobacterium bovis
GAGAQGGAGTSGATGGAGGDGV

SEQ ID NO: 174645 - protein, 7 aa, Mycobacterium bovis
GAGARIQ

SEQ ID NO: 174646 - protein, 44 aa, Mycobacterium bovis
GAGATGATGGESVGTGATGGESVGTGGGESVGTGGATASGGGVG

SEQ ID NO: 174647 - protein, 6 aa, Mycobacterium bovis
GAGATV

SEQ ID NO: 174648 - protein, 8 aa, Mycobacterium bovis
GAGDKSLC

SEQ ID NO: 174649 - protein, 6 aa, Mycobacterium bovis
GAGEHG

SEQ ID NO: 174650 - protein, 7 aa, Mycobacterium bovis
GAGERGL

SEQ ID NO: 174651 - protein, 4 aa, Mycobacterium bovis
GAGG

SEQ ID NO: 174652 - protein, 23 aa, Mycobacterium bovis
GAGGAGGAATTGTGGAGGAGSNA

SEQ ID NO: 174653 - protein, 19 aa, Mycobacterium bovis
GAGGAGGAGAPGGTGGTGG

SEQ ID NO: 174654 - protein, 12 aa, Mycobacterium bovis
GAGGAGGHGGAA

SEQ ID NO: 174655 - protein, 26 aa, Mycobacterium bovis
GAGGAGGPGGAASAGSGGHGGTGGDA

SEQ ID NO: 174656 - protein, 26 aa, Mycobacterium bovis
GAGGAGGTATGTGGNGGAGGGGGLSS

SEQ ID NO: 174657 - protein, 24 aa, Mycobacterium bovis
GAGGAGGTGTNVTGGAGGAGGNGG

SEQ ID NO: 174658 - protein, 12 aa, Mycobacterium bovis
GAGGAPTASAVT

SEQ ID NO: 174659 - protein, 6 aa, Mycobacterium bovis
GAGGAR

SEQ ID NO: 174660 - protein, 29 aa, Mycobacterium bovis
GAGGDGGAGGSGLTTGGAAGNGGNAGTLS

SEQ ID NO: 174661 - protein, 138 aa, Mycobacterium bovis
GAGGDGGVGGVGAPGTNGMNPPPNQTSQAANGSPGANNGAGSGGAGLPGNPGAVPGRAGGAGGLGGSGSDTSEGPVTGGNGGNGGDGGPGAPGGNGAPGGIGVNTGTGWAYGGNGGNGGDGGAGARGGDGGNGGNGLA

SEQ ID NO: 174662 - protein, 14 aa, Mycobacterium bovis
GAGGDGLRQRTRAD

SEQ ID NO: 174663 - protein, 13 aa, Mycobacterium bovis
GAGGDKPSDGPLT

SEQ ID NO: 174664 - protein, 7 aa, Mycobacterium bovis
GAGGGAS

SEQ ID NO: 174665 - protein, 8 aa, Mycobacterium bovis
GAGGGDGG

SEQ ID NO: 174666 - protein, 33 aa, Mycobacterium bovis
GAGGGGGNGGNGADANIVSGGDGGLGGAGGGGG

SEQ ID NO: 174667 - protein, 17 aa, Mycobacterium bovis
GAGGGSGFGNFGAGTSG

SEQ ID NO: 174668 - protein, 5 aa, Mycobacterium bovis
GAGGH

SEQ ID NO: 174669 - protein, 36 aa, Mycobacterium bovis
GAGGHGGTGGAGGAGVDGGGAGGAGGAGGNGGAGGQ

SEQ ID NO: 174670 - protein, 23 aa, Mycobacterium bovis
GAGGMGGQGGTGGMGGAGGDGTT

SEQ ID NO: 174671 - protein, 13 aa, Mycobacterium bovis
GAGGQGDALILRA

SEQ ID NO: 174672 - protein, 10 aa, Mycobacterium bovis
GAGGSDLDTT

SEQ ID NO: 174673 - protein, 9 aa, Mycobacterium bovis
GAGGSREST

SEQ ID NO: 174674 - protein, 13 aa, Mycobacterium bovis
GAGGTEPAGGDHA

SEQ ID NO: 174675 - protein, 27 aa, Mycobacterium bovis
GAGGTGGAAGSGGSGITTGGGGHGGNA

SEQ ID NO: 174676 - protein, 32 aa, Mycobacterium bovis
GAGGTGGAGGTGGGEPSAGASGGNGGNGGNGG

SEQ ID NO: 174677 - protein, 13 aa, Mycobacterium bovis
GAGGTGGAGGTIG

SEQ ID NO: 174678 - protein, 93 aa, Mycobacterium bovis
GAGGTGGNGGNPGAGGAGGAGGASVGGSAHGANGAPGTTSTSGGNGGDGGKGADAISSGQTGANGGRGGDGGQVGNGGAGGAGGRGGAGGLGF

SEQ ID NO: 174679 - protein, 12 aa, Mycobacterium bovis
GAGGTGGSGGTS

SEQ ID NO: 174680 - protein, 26 aa, Mycobacterium bovis
GAGGTGGSSGIGSSGGTGGDGGTAGV

SEQ ID NO: 174681 - protein, 23 aa, Mycobacterium bovis
GAGGVGGSSEDVGGTGGAGGAGR

SEQ ID NO: 174682 - protein, 10 aa, Mycobacterium bovis
GAGHFNRGTQ

SEQ ID NO: 174683 - protein, 7 aa, Mycobacterium bovis
GAGHRDL

SEQ ID NO: 174684 - protein, 5 aa, Mycobacterium bovis
GAGKQ

SEQ ID NO: 174685 - protein, 5 aa, Mycobacterium bovis
GAGKT

SEQ ID NO: 174686 - protein, 5 aa, Mycobacterium bovis
GAGNI

SEQ ID NO: 174687 - protein, 5 aa, Mycobacterium bovis
GAGNS

SEQ ID NO: 174688 - protein, 7 aa, Mycobacterium bovis
GAGPAAM

SEQ ID NO: 174689 - protein, 7 aa, Mycobacterium bovis
GAGPAPM

SEQ ID NO: 174690 - protein, 8 aa, Mycobacterium bovis
GAGPAVSA

SEQ ID NO: 174691 - protein, 5 aa, Mycobacterium bovis
GAGPG

SEQ ID NO: 174692 - protein, 6 aa, Mycobacterium bovis
GAGPLD

SEQ ID NO: 174693 - protein, 7 aa, Mycobacterium bovis
GAGPNCD

SEQ ID NO: 174694 - protein, 7 aa, Mycobacterium bovis
GAGPQGR

SEQ ID NO: 174695 - protein, 7 aa, Mycobacterium bovis
GAGPRKD

SEQ ID NO: 174696 - protein, 9 aa, Mycobacterium bovis
GAGPSCERE

SEQ ID NO: 174697 - protein, 7 aa, Mycobacterium bovis
GAGPSSL

SEQ ID NO: 174698 - protein, 6 aa, Mycobacterium bovis
GAGPTT

SEQ ID NO: 174699 - protein, 10 aa, Mycobacterium bovis
GAGPVAASAT

SEQ ID NO: 174700 - protein, 9 aa, Mycobacterium bovis
GAGQMPARQ

SEQ ID NO: 174701 - protein, 9 aa, Mycobacterium bovis
GAGQQHGPA

SEQ ID NO: 174702 - protein, 7 aa, Mycobacterium bovis
GAGRARD

SEQ ID NO: 174703 - protein, 13 aa, Mycobacterium bovis
GAGRGGKDSPLAR

SEQ ID NO: 174704 - protein, 10 aa, Mycobacterium bovis
GAGSDPGPKA

SEQ ID NO: 174705 - protein, 7 aa, Mycobacterium bovis
GAGSGIG

SEQ ID NO: 174706 - protein, 7 aa, Mycobacterium bovis
GAGSRSE

SEQ ID NO: 174707 - protein, 7 aa, Mycobacterium bovis
GAGSSPL

SEQ ID NO: 174708 - protein, 16 aa, Mycobacterium bovis
GAGTASGFGNFGGGAS

SEQ ID NO: 174709 - protein, 7 aa, Mycobacterium bovis
GAGTDPE

SEQ ID NO: 174710 - protein, 5 aa, Mycobacterium bovis
GAGTG

SEQ ID NO: 174711 - protein, 6 aa, Mycobacterium bovis
GAGTGD

SEQ ID NO: 174712 - protein, 6 aa, Mycobacterium bovis
GAGTLE

SEQ ID NO: 174713 - protein, 10 aa, Mycobacterium bovis
GAGVGDPAEP

SEQ ID NO: 174714 - protein, 8 aa, Mycobacterium bovis
GAGVTGEN

SEQ ID NO: 174715 - protein, 5 aa, Mycobacterium bovis
GAGYG

SEQ ID NO: 174716 - protein, 6 aa, Mycobacterium bovis
GAGYRS

SEQ ID NO: 174717 - protein, 7 aa, Mycobacterium bovis
GAHADTA

SEQ ID NO: 174718 - protein, 4 aa, Mycobacterium bovis
GAHD

SEQ ID NO: 174719 - protein, 7 aa, Mycobacterium bovis
GAHDERT

SEQ ID NO: 174720 - protein, 15 aa, Mycobacterium bovis
GAHERTGSPDSPPRT

SEQ ID NO: 174721 - protein, 4 aa, Mycobacterium bovis
GAHG

SEQ ID NO: 174722 - protein, 23 aa, Mycobacterium bovis
GAHGDADAQHKGMTAQQTTELGT

SEQ ID NO: 174723 - protein, 13 aa, Mycobacterium bovis
GAHGGTATAIDDT

SEQ ID NO: 174724 - protein, 14 aa, Mycobacterium bovis
GAHGTAPGQPGGAG

SEQ ID NO: 174725 - protein, 11 aa, Mycobacterium bovis
GAHPDSQSVGS

SEQ ID NO: 174726 - protein, 8 aa, Mycobacterium bovis
GAHPQART

SEQ ID NO: 174727 - protein, 16 aa, Mycobacterium bovis
GAHRGNAAQRRASQDA

SEQ ID NO: 174728 - protein, 5 aa, Mycobacterium bovis
GAHTA

SEQ ID NO: 174729 - protein, 20 aa, Mycobacterium bovis
GAHTKQLRADRRDCAHDLSR

SEQ ID NO: 174730 - protein, 7 aa, Mycobacterium bovis
GAIDPAA

SEQ ID NO: 174731 - protein, 13 aa, Mycobacterium bovis
GAIGGKTGYTNAA

SEQ ID NO: 174732 - protein, 5 aa, Mycobacterium bovis
GAIGP

SEQ ID NO: 174733 - protein, 8 aa, Mycobacterium bovis
GAIGPRGR

SEQ ID NO: 174734 - protein, 6 aa, Mycobacterium bovis
GAIGRR

SEQ ID NO: 174735 - protein, 11 aa, Mycobacterium bovis
GAIGSGDAKTI

SEQ ID NO: 174736 - protein, 7 aa, Mycobacterium bovis
GAITGPA

SEQ ID NO: 174737 - protein, 8 aa, Mycobacterium bovis
GAKAPKLV

SEQ ID NO: 174738 - protein, 10 aa, Mycobacterium bovis
GAKAQARSGE

SEQ ID NO: 174739 - protein, 14 aa, Mycobacterium bovis
GAKARQAKSKARLQ

SEQ ID NO: 174740 - protein, 11 aa, Mycobacterium bovis
GAKEIADQHGK

SEQ ID NO: 174741 - protein, 8 aa, Mycobacterium bovis
GAKERQRL

SEQ ID NO: 174742 - protein, 4 aa, Mycobacterium bovis
GAKN

SEQ ID NO: 174743 - protein, 8 aa, Mycobacterium bovis
GAKPAPGT

SEQ ID NO: 174744 - protein, 7 aa, Mycobacterium bovis
GAKPTAI

SEQ ID NO: 174745 - protein, 9 aa, Mycobacterium bovis
GAKTGKLRK

SEQ ID NO: 174746 - protein, 9 aa, Mycobacterium bovis
GAKTLRGGK

SEQ ID NO: 174747 - protein, 6 aa, Mycobacterium bovis
GAKVSG

SEQ ID NO: 174748 - protein, 9 aa, Mycobacterium bovis
GALDSSSSA

SEQ ID NO: 174749 - protein, 19 aa, Mycobacterium bovis
GALGAGAEGANKDKPVEKR

SEQ ID NO: 174750 - protein, 13 aa, Mycobacterium bovis
GALGSAPASVSDG

SEQ ID NO: 174751 - protein, 7 aa, Mycobacterium bovis
GALGSGV

SEQ ID NO: 174752 - protein, 5 aa, Mycobacterium bovis
GALHN

SEQ ID NO: 174753 - protein, 11 aa, Mycobacterium bovis
GALNGARGNSG

SEQ ID NO: 174754 - protein, 9 aa, Mycobacterium bovis
GALPPGTRL

SEQ ID NO: 174755 - protein, 7 aa, Mycobacterium bovis
GALPRTR

SEQ ID NO: 174756 - protein, 9 aa, Mycobacterium bovis
GALRERGEL

SEQ ID NO: 174757 - protein, 9 aa, Mycobacterium bovis
GAMGGSASE

SEQ ID NO: 174758 - protein, 9 aa, Mycobacterium bovis
GANAGPDRS

SEQ ID NO: 174759 - protein, 6 aa, Mycobacterium bovis
GANDAV

SEQ ID NO: 174760 - protein, 7 aa, Mycobacterium bovis
GANDLGG

SEQ ID NO: 174761 - protein, 9 aa, Mycobacterium bovis
GANGKSEVT

SEQ ID NO: 174762 - protein, 6 aa, Mycobacterium bovis
GANINS

SEQ ID NO: 174763 - protein, 4 aa, Mycobacterium bovis
GANN

SEQ ID NO: 174764 - protein, 11 aa, Mycobacterium bovis
GANNPARSGFE

SEQ ID NO: 174765 - protein, 9 aa, Mycobacterium bovis
GANNVGNGN

SEQ ID NO: 174766 - protein, 6 aa, Mycobacterium bovis
GANPTV

SEQ ID NO: 174767 - protein, 6 aa, Mycobacterium bovis
GANQTM

SEQ ID NO: 174768 - protein, 8 aa, Mycobacterium bovis
GANRGMGR

SEQ ID NO: 174769 - protein, 16 aa, Mycobacterium bovis
GANRYAEADLCAAARI

SEQ ID NO: 174770 - protein, 4 aa, Mycobacterium bovis
GANS

SEQ ID NO: 174771 - protein, 11 aa, Mycobacterium bovis
GANSAIPHHRP

SEQ ID NO: 174772 - protein, 4 aa, Mycobacterium bovis
GANT

SEQ ID NO: 174773 - protein, 7 aa, Mycobacterium bovis
GANTGLG

SEQ ID NO: 174774 - protein, 6 aa, Mycobacterium bovis
GAPADE

SEQ ID NO: 174775 - protein, 8 aa, Mycobacterium bovis
GAPANGGS

SEQ ID NO: 174776 - protein, 6 aa, Mycobacterium bovis
GAPANV

SEQ ID NO: 174777 - protein, 4 aa, Mycobacterium bovis
GAPD

SEQ ID NO: 174778 - protein, 7 aa, Mycobacterium bovis
GAPDDRR

SEQ ID NO: 174779 - protein, 6 aa, Mycobacterium bovis
GAPDGD

SEQ ID NO: 174780 - protein, 6 aa, Mycobacterium bovis
GAPDGV

SEQ ID NO: 174781 - protein, 6 aa, Mycobacterium bovis
GAPDLP

SEQ ID NO: 174782 - protein, 5 aa, Mycobacterium bovis
GAPEA

SEQ ID NO: 174783 - protein, 7 aa, Mycobacterium bovis
GAPEAEQ

SEQ ID NO: 174784 - protein, 5 aa, Mycobacterium bovis
GAPEH

SEQ ID NO: 174785 - protein, 8 aa, Mycobacterium bovis
GAPEPRHD

SEQ ID NO: 174786 - protein, 7 aa, Mycobacterium bovis
GAPFSGA

SEQ ID NO: 174787 - protein, 9 aa, Mycobacterium bovis
GAPGAPGLD

SEQ ID NO: 174788 - protein, 8 aa, Mycobacterium bovis
GAPGAREV

SEQ ID NO: 174789 - protein, 6 aa, Mycobacterium bovis
GAPGHD

SEQ ID NO: 174790 - protein, 6 aa, Mycobacterium bovis
GAPGNA

SEQ ID NO: 174791 - protein, 9 aa, Mycobacterium bovis
GAPGQANYA

SEQ ID NO: 174792 - protein, 12 aa, Mycobacterium bovis
GAPGQPGDTGQP

SEQ ID NO: 174793 - protein, 6 aa, Mycobacterium bovis
GAPGSI

SEQ ID NO: 174794 - protein, 8 aa, Mycobacterium bovis
GAPHREQR

SEQ ID NO: 174795 - protein, 9 aa, Mycobacterium bovis
GAPKASPVE

SEQ ID NO: 174796 - protein, 7 aa, Mycobacterium bovis
GAPLAAA

SEQ ID NO: 174797 - protein, 7 aa, Mycobacterium bovis
GAPNDGW

SEQ ID NO: 174798 - protein, 7 aa, Mycobacterium bovis
GAPPERA

SEQ ID NO: 174799 - protein, 7 aa, Mycobacterium bovis
GAPPGTL

SEQ ID NO: 174800 - protein, 6 aa, Mycobacterium bovis
GAPPQR

SEQ ID NO: 174801 - protein, 17 aa, Mycobacterium bovis
GAPPSAVGGGGGAPKGW

SEQ ID NO: 174802 - protein, 8 aa, Mycobacterium bovis
GAPPTQGT

SEQ ID NO: 174803 - protein, 8 aa, Mycobacterium bovis
GAPPYRAD

SEQ ID NO: 174804 - protein, 4 aa, Mycobacterium bovis
GAPQ

SEQ ID NO: 174805 - protein, 7 aa, Mycobacterium bovis
GAPQTLD

SEQ ID NO: 174806 - protein, 6 aa, Mycobacterium bovis
GAPQTS

SEQ ID NO: 174807 - protein, 7 aa, Mycobacterium bovis
GAPQVNA

SEQ ID NO: 174808 - protein, 7 aa, Mycobacterium bovis
GAPRAST

SEQ ID NO: 174809 - protein, 5 aa, Mycobacterium bovis
GAPRP

SEQ ID NO: 174810 - protein, 6 aa, Mycobacterium bovis
GAPRSV

SEQ ID NO: 174811 - protein, 7 aa, Mycobacterium bovis
GAPSGAY

SEQ ID NO: 174812 - protein, 8 aa, Mycobacterium bovis
GAPSVRSQ

SEQ ID NO: 174813 - protein, 7 aa, Mycobacterium bovis
GAPTALT

SEQ ID NO: 174814 - protein, 9 aa, Mycobacterium bovis
GAPTITNDG

SEQ ID NO: 174815 - protein, 10 aa, Mycobacterium bovis
GAPTPAETQL

SEQ ID NO: 174816 - protein, 12 aa, Mycobacterium bovis
GAQAAAAGGDVQ

SEQ ID NO: 174817 - protein, 8 aa, Mycobacterium bovis
GAQAAFDK

SEQ ID NO: 174818 - protein, 9 aa, Mycobacterium bovis
GAQADPGLR

SEQ ID NO: 174819 - protein, 7 aa, Mycobacterium bovis
GAQAELA

SEQ ID NO: 174820 - protein, 7 aa, Mycobacterium bovis
GAQEAEL

SEQ ID NO: 174821 - protein, 9 aa, Mycobacterium bovis
GAQLAPRDV

SEQ ID NO: 174822 - protein, 7 aa, Mycobacterium bovis
GAQLDGP

SEQ ID NO: 174823 - protein, 5 aa, Mycobacterium bovis
GAQNP

SEQ ID NO: 174824 - protein, 8 aa, Mycobacterium bovis
GAQQRDQA

SEQ ID NO: 174825 - protein, 12 aa, Mycobacterium bovis
GAQRAHDVASKT

SEQ ID NO: 174826 - protein, 8 aa, Mycobacterium bovis
GAQRGSEL

SEQ ID NO: 174827 - protein, 12 aa, Mycobacterium bovis
GAQSGIGGGGRY

SEQ ID NO: 174828 - protein, 4 aa, Mycobacterium bovis
GAQT

SEQ ID NO: 174829 - protein, 5 aa, Mycobacterium bovis
GAQVR

SEQ ID NO: 174830 - protein, 7 aa, Mycobacterium bovis
GAQVSGV

SEQ ID NO: 174831 - protein, 8 aa, Mycobacterium bovis
GARADSVP

SEQ ID NO: 174832 - protein, 21 aa, Mycobacterium bovis
GARAGALKGGVGTASATLQSG

SEQ ID NO: 174833 - protein, 9 aa, Mycobacterium bovis
GARAGGGLS

SEQ ID NO: 174834 - protein, 7 aa, Mycobacterium bovis
GARAPQI

SEQ ID NO: 174835 - protein, 6 aa, Mycobacterium bovis
GARDGP

SEQ ID NO: 174836 - protein, 7 aa, Mycobacterium bovis
GARDGRT

SEQ ID NO: 174837 - protein, 4 aa, Mycobacterium bovis
GARE

SEQ ID NO: 174838 - protein, 5 aa, Mycobacterium bovis
GAREA

SEQ ID NO: 174839 - protein, 9 aa, Mycobacterium bovis
GAREATTAR

SEQ ID NO: 174840 - protein, 7 aa, Mycobacterium bovis
GARGPVR

SEQ ID NO: 174841 - protein, 4 aa, Mycobacterium bovis
GARI

SEQ ID NO: 174842 - protein, 7 aa, Mycobacterium bovis
GARIDPD

SEQ ID NO: 174843 - protein, 18 aa, Mycobacterium bovis
GARKGLADTALRTADSGY

SEQ ID NO: 174844 - protein, 14 aa, Mycobacterium bovis
GARKGSLALSSPPA

SEQ ID NO: 174845 - protein, 5 aa, Mycobacterium bovis
GARKS

SEQ ID NO: 174846 - protein, 5 aa, Mycobacterium bovis
GARKV

SEQ ID NO: 174847 - protein, 7 aa, Mycobacterium bovis
GARPADR

SEQ ID NO: 174848 - protein, 6 aa, Mycobacterium bovis
GARPAE

SEQ ID NO: 174849 - protein, 5 aa, Mycobacterium bovis
GARPS

SEQ ID NO: 174850 - protein, 12 aa, Mycobacterium bovis
GARPTRPPPPML

SEQ ID NO: 174851 - protein, 18 aa, Mycobacterium bovis
GARQEKRELSNRATPVGE

SEQ ID NO: 174852 - protein, 9 aa, Mycobacterium bovis
GARQVPGRH

SEQ ID NO: 174853 - protein, 4 aa, Mycobacterium bovis
GARR

SEQ ID NO: 174854 - protein, 14 aa, Mycobacterium bovis
GARRGGAVSGIGGH

SEQ ID NO: 174855 - protein, 6 aa, Mycobacterium bovis
GARSDT

SEQ ID NO: 174856 - protein, 8 aa, Mycobacterium bovis
GARSPLGR

SEQ ID NO: 174857 - protein, 11 aa, Mycobacterium bovis
GARSTVQRQQT

SEQ ID NO: 174858 - protein, 12 aa, Mycobacterium bovis
GARTAAARAQAV

SEQ ID NO: 174859 - protein, 9 aa, Mycobacterium bovis
GARTGKTGK

SEQ ID NO: 174860 - protein, 5 aa, Mycobacterium bovis
GARTH

SEQ ID NO: 174861 - protein, 8 aa, Mycobacterium bovis
GASAAAEA

SEQ ID NO: 174862 - protein, 45 aa, Mycobacterium bovis
GASAAASALPPFTPPVQGTGPAGPAAAAAATQAAGAGAVADAQAT

SEQ ID NO: 174863 - protein, 10 aa, Mycobacterium bovis
GASAAATQLT

SEQ ID NO: 174864 - protein, 10 aa, Mycobacterium bovis
GASAARPEHT

SEQ ID NO: 174865 - protein, 7 aa, Mycobacterium bovis
GASAAVQ

SEQ ID NO: 174866 - protein, 4 aa, Mycobacterium bovis
GASD

SEQ ID NO: 174867 - protein, 10 aa, Mycobacterium bovis
GASDRRARAD

SEQ ID NO: 174868 - protein, 9 aa, Mycobacterium bovis
GASEGAGLG

SEQ ID NO: 174869 - protein, 12 aa, Mycobacterium bovis
GASEIPPAQADL

SEQ ID NO: 174870 - protein, 19 aa, Mycobacterium bovis
GASEPDAKAPEEPPAEAPE

SEQ ID NO: 174871 - protein, 9 aa, Mycobacterium bovis
GASEVGRHQ

SEQ ID NO: 174872 - protein, 15 aa, Mycobacterium bovis
GASFPYRKDPDDKNI

SEQ ID NO: 174873 - protein, 4 aa, Mycobacterium bovis
GASG

SEQ ID NO: 174874 - protein, 8 aa, Mycobacterium bovis
GASGEHQR

SEQ ID NO: 174875 - protein, 26 aa, Mycobacterium bovis
GASGGAGGSGGASSLAGGAGGTGGNG

SEQ ID NO: 174876 - protein, 30 aa, Mycobacterium bovis
GASGGNGGQGGDAGTNGFAGFGGSAGGGGW

SEQ ID NO: 174877 - protein, 6 aa, Mycobacterium bovis
GASGMG

SEQ ID NO: 174878 - protein, 8 aa, Mycobacterium bovis
GASGPLDV

SEQ ID NO: 174879 - protein, 10 aa, Mycobacterium bovis
GASGTPKPRF

SEQ ID NO: 174880 - protein, 8 aa, Mycobacterium bovis
GASKGSIA

SEQ ID NO: 174881 - protein, 9 aa, Mycobacterium bovis
GASPAIGSV

SEQ ID NO: 174882 - protein, 9 aa, Mycobacterium bovis
GASPGGDLA

SEQ ID NO: 174883 - protein, 7 aa, Mycobacterium bovis
GASPRAE

SEQ ID NO: 174884 - protein, 7 aa, Mycobacterium bovis
GASPRRA

SEQ ID NO: 174885 - protein, 10 aa, Mycobacterium bovis
GASPTPASDV

SEQ ID NO: 174886 - protein, 7 aa, Mycobacterium bovis
GASQNIG

SEQ ID NO: 174887 - protein, 7 aa, Mycobacterium bovis
GASQSED

SEQ ID NO: 174888 - protein, 14 aa, Mycobacterium bovis
GASSAFGGPCRTST

SEQ ID NO: 174889 - protein, 16 aa, Mycobacterium bovis
GASSGIGAATATELAG

SEQ ID NO: 174890 - protein, 13 aa, Mycobacterium bovis
GASSGIGEATART

SEQ ID NO: 174891 - protein, 18 aa, Mycobacterium bovis
GASSTGISRKLPDTERQR

SEQ ID NO: 174892 - protein, 8 aa, Mycobacterium bovis
GASTGIGK

SEQ ID NO: 174893 - protein, 8 aa, Mycobacterium bovis
GASTPEEL

SEQ ID NO: 174894 - protein, 4 aa, Mycobacterium bovis
GASV

SEQ ID NO: 174895 - protein, 9 aa, Mycobacterium bovis
GATAAAAAS

SEQ ID NO: 174896 - protein, 10 aa, Mycobacterium bovis
GATADALPPR

SEQ ID NO: 174897 - protein, 6 aa, Mycobacterium bovis
GATADP

SEQ ID NO: 174898 - protein, 7 aa, Mycobacterium bovis
GATAEVN

SEQ ID NO: 174899 - protein, 8 aa, Mycobacterium bovis
GATAYRNT

SEQ ID NO: 174900 - protein, 8 aa, Mycobacterium bovis
GATDEQVE

SEQ ID NO: 174901 - protein, 8 aa, Mycobacterium bovis
GATDPEIE

SEQ ID NO: 174902 - protein, 12 aa, Mycobacterium bovis
GATFSDAAARDA

SEQ ID NO: 174903 - protein, 4 aa, Mycobacterium bovis
GATG

SEQ ID NO: 174904 - protein, 5 aa, Mycobacterium bovis
GATGD

SEQ ID NO: 174905 - protein, 11 aa, Mycobacterium bovis
GATGDEGAANA

SEQ ID NO: 174906 - protein, 9 aa, Mycobacterium bovis
GATGEGYAE

SEQ ID NO: 174907 - protein, 15 aa, Mycobacterium bovis
GATGGAGGAGGNGGL

SEQ ID NO: 174908 - protein, 5 aa, Mycobacterium bovis
GATGK

SEQ ID NO: 174909 - protein, 9 aa, Mycobacterium bovis
GATGLTDRQ

SEQ ID NO: 174910 - protein, 9 aa, Mycobacterium bovis
GATGNFTQT

SEQ ID NO: 174911 - protein, 6 aa, Mycobacterium bovis
GATGQL

SEQ ID NO: 174912 - protein, 11 aa, Mycobacterium bovis
GATGSRLVTGD

SEQ ID NO: 174913 - protein, 10 aa, Mycobacterium bovis
GATGTGKTKT

SEQ ID NO: 174914 - protein, 7 aa, Mycobacterium bovis
GATGTIE

SEQ ID NO: 174915 - protein, 7 aa, Mycobacterium bovis
GATKGLP

SEQ ID NO: 174916 - protein, 4 aa, Mycobacterium bovis
GATP

SEQ ID NO: 174917 - protein, 10 aa, Mycobacterium bovis
GATPADAYPT

SEQ ID NO: 174918 - protein, 11 aa, Mycobacterium bovis
GATPANSPYPT

SEQ ID NO: 174919 - protein, 8 aa, Mycobacterium bovis
GATPIPTV

SEQ ID NO: 174920 - protein, 10 aa, Mycobacterium bovis
GATPPDSPYQ

SEQ ID NO: 174921 - protein, 5 aa, Mycobacterium bovis
GATPR

SEQ ID NO: 174922 - protein, 7 aa, Mycobacterium bovis
GATPSQR

SEQ ID NO: 174923 - protein, 8 aa, Mycobacterium bovis
GATPTADR

SEQ ID NO: 174924 - protein, 5 aa, Mycobacterium bovis
GATPV

SEQ ID NO: 174925 - protein, 5 aa, Mycobacterium bovis
GATRR

SEQ ID NO: 174926 - protein, 7 aa, Mycobacterium bovis
GATRSLP

SEQ ID NO: 174927 - protein, 24 aa, Mycobacterium bovis
GATRTATDLAGGQDARQGPSSNSA

SEQ ID NO: 174928 - protein, 20 aa, Mycobacterium bovis
GATRTGSGGAAQDDDLAGSS

SEQ ID NO: 174929 - protein, 8 aa, Mycobacterium bovis
GATSGHTQ

SEQ ID NO: 174930 - protein, 5 aa, Mycobacterium bovis
GATTF

SEQ ID NO: 174931 - protein, 9 aa, Mycobacterium bovis
GATTGSAPA

SEQ ID NO: 174932 - protein, 7 aa, Mycobacterium bovis
GATTLGG

SEQ ID NO: 174933 - protein, 5 aa, Mycobacterium bovis
GATVD

SEQ ID NO: 174934 - protein, 5 aa, Mycobacterium bovis
GATVG

SEQ ID NO: 174935 - protein, 9 aa, Mycobacterium bovis
GATVTQTDA

SEQ ID NO: 174936 - protein, 10 aa, Mycobacterium bovis
GATYDGAGTN

SEQ ID NO: 174937 - protein, 4 aa, Mycobacterium bovis
GAVD

SEQ ID NO: 174938 - protein, 8 aa, Mycobacterium bovis
GAVDAGGR

SEQ ID NO: 174939 - protein, 8 aa, Mycobacterium bovis
GAVDANQS

SEQ ID NO: 174940 - protein, 4 aa, Mycobacterium bovis
GAVH

SEQ ID NO: 174941 - protein, 5 aa, Mycobacterium bovis
GAVQG

SEQ ID NO: 174942 - protein, 16 aa, Mycobacterium bovis
GAWNPNQYGNPDNVGA

SEQ ID NO: 174943 - protein, 13 aa, Mycobacterium bovis
GAWSNDSVSCPRS

SEQ ID NO: 174944 - protein, 19 aa, Mycobacterium bovis
GAYAGSLDDAETALEGQLW

SEQ ID NO: 174945 - protein, 14 aa, Mycobacterium bovis
GAYASAEAANAGPN

SEQ ID NO: 174946 - protein, 5 aa, Mycobacterium bovis
GAYGD

SEQ ID NO: 174947 - protein, 7 aa, Mycobacterium bovis
GAYGIDG

SEQ ID NO: 174948 - protein, 5 aa, Mycobacterium bovis
GAYGQ

SEQ ID NO: 174949 - protein, 5 aa, Mycobacterium bovis
GAYLG

SEQ ID NO: 174950 - protein, 8 aa, Mycobacterium bovis
GAYPSTLG

SEQ ID NO: 174951 - protein, 7 aa, Mycobacterium bovis
GAYTSQW

SEQ ID NO: 174952 - protein, 9 aa, Mycobacterium bovis
GCAGHSDGD

SEQ ID NO: 174953 - protein, 8 aa, Mycobacterium bovis
GCDPESGS

SEQ ID NO: 174954 - protein, 5 aa, Mycobacterium bovis
GCDVG

SEQ ID NO: 174955 - protein, 12 aa, Mycobacterium bovis
GCETTSGAAAAL

SEQ ID NO: 174956 - protein, 5 aa, Mycobacterium bovis
GCGKT

SEQ ID NO: 174957 - protein, 6 aa, Mycobacterium bovis
GCHGGP

SEQ ID NO: 174958 - protein, 6 aa, Mycobacterium bovis
GCPFDP

SEQ ID NO: 174959 - protein, 7 aa, Mycobacterium bovis
GCPPPTL

SEQ ID NO: 174960 - protein, 7 aa, Mycobacterium bovis
GCPPTPA

SEQ ID NO: 174961 - protein, 6 aa, Mycobacterium bovis
GCPTSS

SEQ ID NO: 174962 - protein, 29 aa, Mycobacterium bovis
GCRGSETSGRTCRAGGTRRRARWRGRDRG

SEQ ID NO: 174963 - protein, 8 aa, Mycobacterium bovis
GCSAGGTD

SEQ ID NO: 174964 - protein, 7 aa, Mycobacterium bovis
GDAAATE

SEQ ID NO: 174965 - protein, 7 aa, Mycobacterium bovis
GDAAKIN

SEQ ID NO: 174966 - protein, 9 aa, Mycobacterium bovis
GDAAQAEDV

SEQ ID NO: 174967 - protein, 12 aa, Mycobacterium bovis
GDAARSVGRGRP

SEQ ID NO: 174968 - protein, 8 aa, Mycobacterium bovis
GDAATDVM

SEQ ID NO: 174969 - protein, 17 aa, Mycobacterium bovis
GDADQAPSPLGRRISSL

SEQ ID NO: 174970 - protein, 11 aa, Mycobacterium bovis
GDAEASAAAPW

SEQ ID NO: 174971 - protein, 13 aa, Mycobacterium bovis
GDAEDGPAATTTW

SEQ ID NO: 174972 - protein, 5 aa, Mycobacterium bovis
GDAEL

SEQ ID NO: 174973 - protein, 6 aa, Mycobacterium bovis
GDAEVG

SEQ ID NO: 174974 - protein, 5 aa, Mycobacterium bovis
GDAFA

SEQ ID NO: 174975 - protein, 32 aa, Mycobacterium bovis
GDAGTGGTGGKGGTAGEDGTGGNGGTGGNGGA

SEQ ID NO: 174976 - protein, 13 aa, Mycobacterium bovis
GDAHYGAGQAHGD

SEQ ID NO: 174977 - protein, 6 aa, Mycobacterium bovis
GDAKER

SEQ ID NO: 174978 - protein, 14 aa, Mycobacterium bovis
GDANLSGHTYPDQS

SEQ ID NO: 174979 - protein, 17 aa, Mycobacterium bovis
GDANSYAATGGPGAQLP

SEQ ID NO: 174980 - protein, 4 aa, Mycobacterium bovis
GDAP

SEQ ID NO: 174981 - protein, 6 aa, Mycobacterium bovis
GDAPLD

SEQ ID NO: 174982 - protein, 22 aa, Mycobacterium bovis
GDAPPPPPGQPEPGVSRGMAHD

SEQ ID NO: 174983 - protein, 10 aa, Mycobacterium bovis
GDAPPQRSRR

SEQ ID NO: 174984 - protein, 12 aa, Mycobacterium bovis
GDAPPSGPGSRA

SEQ ID NO: 174985 - protein, 9 aa, Mycobacterium bovis
GDARPEAGE

SEQ ID NO: 174986 - protein, 6 aa, Mycobacterium bovis
GDARRA

SEQ ID NO: 174987 - protein, 18 aa, Mycobacterium bovis
GDASRYPAEFSGGQKQRI

SEQ ID NO: 174988 - protein, 14 aa, Mycobacterium bovis
GDASVSSVDPADRV

SEQ ID NO: 174989 - protein, 16 aa, Mycobacterium bovis
GDATMTAGNSTPLTDG

SEQ ID NO: 174990 - protein, 7 aa, Mycobacterium bovis
GDDAAAA

SEQ ID NO: 174991 - protein, 7 aa, Mycobacterium bovis
GDDDAAR

SEQ ID NO: 174992 - protein, 8 aa, Mycobacterium bovis
GDDDAPNE

SEQ ID NO: 174993 - protein, 6 aa, Mycobacterium bovis
GDDDNE

SEQ ID NO: 174994 - protein, 12 aa, Mycobacterium bovis
GDDDTMVPTSNS

SEQ ID NO: 174995 - protein, 7 aa, Mycobacterium bovis
GDDEETL

SEQ ID NO: 174996 - protein, 6 aa, Mycobacterium bovis
GDDERR

SEQ ID NO: 174997 - protein, 4 aa, Mycobacterium bovis
GDDG

SEQ ID NO: 174998 - protein, 9 aa, Mycobacterium bovis
GDDGTRSAE

SEQ ID NO: 174999 - protein, 5 aa, Mycobacterium bovis
GDDGW

SEQ ID NO: 175000 - protein, 5 aa, Mycobacterium bovis
GDDHY

SEQ ID NO: 175001 - protein, 9 aa, Mycobacterium bovis
GDDLDKARR

SEQ ID NO: 175002 - protein, 9 aa, Mycobacterium bovis
GDDLQPRAA

SEQ ID NO: 175003 - protein, 4 aa, Mycobacterium bovis
GDDP

SEQ ID NO: 175004 - protein, 6 aa, Mycobacterium bovis
GDDPAL

SEQ ID NO: 175005 - protein, 5 aa, Mycobacterium bovis
GDDPE

SEQ ID NO: 175006 - protein, 7 aa, Mycobacterium bovis
GDDPEHG

SEQ ID NO: 175007 - protein, 9 aa, Mycobacterium bovis
GDDPGDPAL

SEQ ID NO: 175008 - protein, 18 aa, Mycobacterium bovis
GDDPLGATQRITRRSQAA

SEQ ID NO: 175009 - protein, 5 aa, Mycobacterium bovis
GDDVH

SEQ ID NO: 175010 - protein, 6 aa, Mycobacterium bovis
GDDVRK

SEQ ID NO: 175011 - protein, 5 aa, Mycobacterium bovis
GDEAL

SEQ ID NO: 175012 - protein, 5 aa, Mycobacterium bovis
GDEGF

SEQ ID NO: 175013 - protein, 11 aa, Mycobacterium bovis
GDEGKGKATDL

SEQ ID NO: 175014 - protein, 12 aa, Mycobacterium bovis
GDENPAEVTPGD

SEQ ID NO: 175015 - protein, 7 aa, Mycobacterium bovis
GDEPLKR

SEQ ID NO: 175016 - protein, 7 aa, Mycobacterium bovis
GDERRRV

SEQ ID NO: 175017 - protein, 8 aa, Mycobacterium bovis
GDESCRPQ

SEQ ID NO: 175018 - protein, 7 aa, Mycobacterium bovis
GDESPFD

SEQ ID NO: 175019 - protein, 8 aa, Mycobacterium bovis
GDESPHAK

SEQ ID NO: 175020 - protein, 4 aa, Mycobacterium bovis
GDEV

SEQ ID NO: 175021 - protein, 7 aa, Mycobacterium bovis
GDEVSAA

SEQ ID NO: 175022 - protein, 8 aa, Mycobacterium bovis
GDFAGESY

SEQ ID NO: 175023 - protein, 10 aa, Mycobacterium bovis
GDFGPQATAD

SEQ ID NO: 175024 - protein, 4 aa, Mycobacterium bovis
GDGA

SEQ ID NO: 175025 - protein, 5 aa, Mycobacterium bovis
GDGAA

SEQ ID NO: 175026 - protein, 19 aa, Mycobacterium bovis
GDGADGASGPVGQPGGDGG

SEQ ID NO: 175027 - protein, 12 aa, Mycobacterium bovis
GDGAHAARNAPI

SEQ ID NO: 175028 - protein, 7 aa, Mycobacterium bovis
GDGARAS

SEQ ID NO: 175029 - protein, 6 aa, Mycobacterium bovis
GDGAVS

SEQ ID NO: 175030 - protein, 9 aa, Mycobacterium bovis
GDGEIDPSV

SEQ ID NO: 175031 - protein, 54 aa, Mycobacterium bovis
GDGGAGGDGADGTAAEALGGDGGAGGAGGKGGDAGDIGDGGDGGKGGDGAHGAL

SEQ ID NO: 175032 - protein, 24 aa, Mycobacterium bovis
GDGGAGGTSNNNGGDGGAGGTAGG

SEQ ID NO: 175033 - protein, 25 aa, Mycobacterium bovis
GDGGNGGNAGVGTPAGNVGAGGTGG

SEQ ID NO: 175034 - protein, 31 aa, Mycobacterium bovis
GDGGRGGNGGEGGDGPPGVKGDGGNGGNGGN

SEQ ID NO: 175035 - protein, 7 aa, Mycobacterium bovis
GDGGRTL

SEQ ID NO: 175036 - protein, 8 aa, Mycobacterium bovis
GDGLGGSS

SEQ ID NO: 175037 - protein, 6 aa, Mycobacterium bovis
GDGLRD

SEQ ID NO: 175038 - protein, 7 aa, Mycobacterium bovis
GDGLSGF

SEQ ID NO: 175039 - protein, 7 aa, Mycobacterium bovis
GDGPFTR

SEQ ID NO: 175040 - protein, 6 aa, Mycobacterium bovis
GDGQHR

SEQ ID NO: 175041 - protein, 9 aa, Mycobacterium bovis
GDGRRLSGT

SEQ ID NO: 175042 - protein, 4 aa, Mycobacterium bovis
GDGS

SEQ ID NO: 175043 - protein, 5 aa, Mycobacterium bovis
GDGSA

SEQ ID NO: 175044 - protein, 12 aa, Mycobacterium bovis
GDGSAPARRVGR

SEQ ID NO: 175045 - protein, 8 aa, Mycobacterium bovis
GDGSLEEE

SEQ ID NO: 175046 - protein, 5 aa, Mycobacterium bovis
GDGTA

SEQ ID NO: 175047 - protein, 8 aa, Mycobacterium bovis
GDGTAGHR

SEQ ID NO: 175048 - protein, 6 aa, Mycobacterium bovis
GDGTDA

SEQ ID NO: 175049 - protein, 8 aa, Mycobacterium bovis
GDGTKPEN

SEQ ID NO: 175050 - protein, 7 aa, Mycobacterium bovis
GDGTQAL

SEQ ID NO: 175051 - protein, 11 aa, Mycobacterium bovis
GDGTQTGLPDD

SEQ ID NO: 175052 - protein, 4 aa, Mycobacterium bovis
GDGV

SEQ ID NO: 175053 - protein, 5 aa, Mycobacterium bovis
GDGVD

SEQ ID NO: 175054 - protein, 13 aa, Mycobacterium bovis
GDGVGGTDPTDAF

SEQ ID NO: 175055 - protein, 12 aa, Mycobacterium bovis
GDHDEKRLTSCG

SEQ ID NO: 175056 - protein, 11 aa, Mycobacterium bovis
GDHHRTDRRTF

SEQ ID NO: 175057 - protein, 7 aa, Mycobacterium bovis
GDHTSGI

SEQ ID NO: 175058 - protein, 4 aa, Mycobacterium bovis
GDID

SEQ ID NO: 175059 - protein, 11 aa, Mycobacterium bovis
GDIDAEKQSIE

SEQ ID NO: 175060 - protein, 6 aa, Mycobacterium bovis
GDIDDE

SEQ ID NO: 175061 - protein, 4 aa, Mycobacterium bovis
GDIE

SEQ ID NO: 175062 - protein, 14 aa, Mycobacterium bovis
GDIEEGVTSEASSL

SEQ ID NO: 175063 - protein, 9 aa, Mycobacterium bovis
GDIGAAGVS

SEQ ID NO: 175064 - protein, 18 aa, Mycobacterium bovis
GDINTGFGNAGDTNTGFG

SEQ ID NO: 175065 - protein, 4 aa, Mycobacterium bovis
GDIP

SEQ ID NO: 175066 - protein, 4 aa, Mycobacterium bovis
GDIT

SEQ ID NO: 175067 - protein, 8 aa, Mycobacterium bovis
GDKAFAAG

SEQ ID NO: 175068 - protein, 17 aa, Mycobacterium bovis
GDKDADEYFATDSDNRN

SEQ ID NO: 175069 - protein, 8 aa, Mycobacterium bovis
GDKGEADL

SEQ ID NO: 175070 - protein, 4 aa, Mycobacterium bovis
GDKK

SEQ ID NO: 175071 - protein, 9 aa, Mycobacterium bovis
GDKSEPDLG

SEQ ID NO: 175072 - protein, 8 aa, Mycobacterium bovis
GDKTPVSL

SEQ ID NO: 175073 - protein, 6 aa, Mycobacterium bovis
GDKTYR

SEQ ID NO: 175074 - protein, 13 aa, Mycobacterium bovis
GDKVPRKGGPGVT

SEQ ID NO: 175075 - protein, 10 aa, Mycobacterium bovis
GDLADQESLG

SEQ ID NO: 175076 - protein, 6 aa, Mycobacterium bovis
GDLANA

SEQ ID NO: 175077 - protein, 22 aa, Mycobacterium bovis
GDLANPKADLRQKAAAAAGASG

SEQ ID NO: 175078 - protein, 4 aa, Mycobacterium bovis
GDLD

SEQ ID NO: 175079 - protein, 6 aa, Mycobacterium bovis
GDLDGR

SEQ ID NO: 175080 - protein, 10 aa, Mycobacterium bovis
GDLDKPFATE

SEQ ID NO: 175081 - protein, 9 aa, Mycobacterium bovis
GDLDKVTGK

SEQ ID NO: 175082 - protein, 7 aa, Mycobacterium bovis
GDLEREK

SEQ ID NO: 175083 - protein, 10 aa, Mycobacterium bovis
GDLGSSAARK

SEQ ID NO: 175084 - protein, 36 aa, Mycobacterium bovis
GDLNTGSLNPGSYNTGSVNTGSVNTGGFNAGNYNTG

SEQ ID NO: 175085 - protein, 6 aa, Mycobacterium bovis
GDLPPR

SEQ ID NO: 175086 - protein, 27 aa, Mycobacterium bovis
GDLSGLARPGEAADKTAARAKDTGDDW

SEQ ID NO: 175087 - protein, 13 aa, Mycobacterium bovis
GDLTEPPAAQVAE

SEQ ID NO: 175088 - protein, 4 aa, Mycobacterium bovis
GDLV

SEQ ID NO: 175089 - protein, 8 aa, Mycobacterium bovis
GDMDPEGS

SEQ ID NO: 175090 - protein, 5 aa, Mycobacterium bovis
GDNAA

SEQ ID NO: 175091 - protein, 6 aa, Mycobacterium bovis
GDNGSG

SEQ ID NO: 175092 - protein, 5 aa, Mycobacterium bovis
GDNKG

SEQ ID NO: 175093 - protein, 9 aa, Mycobacterium bovis
GDNLAHPKA

SEQ ID NO: 175094 - protein, 8 aa, Mycobacterium bovis
GDNPTEVH

SEQ ID NO: 175095 - protein, 16 aa, Mycobacterium bovis
GDNQQGFGGWNSGTGN

SEQ ID NO: 175096 - protein, 7 aa, Mycobacterium bovis
GDNSTEL

SEQ ID NO: 175097 - protein, 7 aa, Mycobacterium bovis
GDNTSRA

SEQ ID NO: 175098 - protein, 9 aa, Mycobacterium bovis
GDPAAAAAT

SEQ ID NO: 175099 - protein, 6 aa, Mycobacterium bovis
GDPAAR

SEQ ID NO: 175100 - protein, 10 aa, Mycobacterium bovis
GDPAKYGLSA

SEQ ID NO: 175101 - protein, 7 aa, Mycobacterium bovis
GDPAPRV

SEQ ID NO: 175102 - protein, 15 aa, Mycobacterium bovis
GDPAYGYSTSPPNVA

SEQ ID NO: 175103 - protein, 9 aa, Mycobacterium bovis
GDPDAFPAS

SEQ ID NO: 175104 - protein, 5 aa, Mycobacterium bovis
GDPDE

SEQ ID NO: 175105 - protein, 7 aa, Mycobacterium bovis
GDPDEEF

SEQ ID NO: 175106 - protein, 7 aa, Mycobacterium bovis
GDPDYPR

SEQ ID NO: 175107 - protein, 6 aa, Mycobacterium bovis
GDPETQ

SEQ ID NO: 175108 - protein, 4 aa, Mycobacterium bovis
GDPF

SEQ ID NO: 175109 - protein, 7 aa, Mycobacterium bovis
GDPGAAL

SEQ ID NO: 175110 - protein, 10 aa, Mycobacterium bovis
GDPGDLEGMG

SEQ ID NO: 175111 - protein, 7 aa, Mycobacterium bovis
GDPGDLS

SEQ ID NO: 175112 - protein, 9 aa, Mycobacterium bovis
GDPGGSSSI

SEQ ID NO: 175113 - protein, 8 aa, Mycobacterium bovis
GDPGGSTA

SEQ ID NO: 175114 - protein, 6 aa, Mycobacterium bovis
GDPGPF

SEQ ID NO: 175115 - protein, 9 aa, Mycobacterium bovis
GDPGQPGLL

SEQ ID NO: 175116 - protein, 6 aa, Mycobacterium bovis
GDPGVA

SEQ ID NO: 175117 - protein, 7 aa, Mycobacterium bovis
GDPGVGK

SEQ ID NO: 175118 - protein, 17 aa, Mycobacterium bovis
GDPLESAAAGGNGFGGF

SEQ ID NO: 175119 - protein, 5 aa, Mycobacterium bovis
GDPLR

SEQ ID NO: 175120 - protein, 7 aa, Mycobacterium bovis
GDPNGDG

SEQ ID NO: 175121 - protein, 5 aa, Mycobacterium bovis
GDPNQ

SEQ ID NO: 175122 - protein, 9 aa, Mycobacterium bovis
GDPNTGGDE

SEQ ID NO: 175123 - protein, 10 aa, Mycobacterium bovis
GDPNYGYSTS

SEQ ID NO: 175124 - protein, 6 aa, Mycobacterium bovis
GDPPEV

SEQ ID NO: 175125 - protein, 8 aa, Mycobacterium bovis
GDPPGGKA

SEQ ID NO: 175126 - protein, 4 aa, Mycobacterium bovis
GDPQ

SEQ ID NO: 175127 - protein, 8 aa, Mycobacterium bovis
GDPQPGQS

SEQ ID NO: 175128 - protein, 12 aa, Mycobacterium bovis
GDPQPLDTGGTK

SEQ ID NO: 175129 - protein, 8 aa, Mycobacterium bovis
GDPQRPGR

SEQ ID NO: 175130 - protein, 7 aa, Mycobacterium bovis
GDPRFSD

SEQ ID NO: 175131 - protein, 13 aa, Mycobacterium bovis
GDPRSTDQRRADA

SEQ ID NO: 175132 - protein, 5 aa, Mycobacterium bovis
GDPRW

SEQ ID NO: 175133 - protein, 19 aa, Mycobacterium bovis
GDPSDGLPGVPGVGEKTAA

SEQ ID NO: 175134 - protein, 5 aa, Mycobacterium bovis
GDPSF

SEQ ID NO: 175135 - protein, 10 aa, Mycobacterium bovis
GDPSKPSDAD

SEQ ID NO: 175136 - protein, 8 aa, Mycobacterium bovis
GDPSVPSG

SEQ ID NO: 175137 - protein, 8 aa, Mycobacterium bovis
GDPTAWPG

SEQ ID NO: 175138 - protein, 32 aa, Mycobacterium bovis
GDPTDPDTDVGPLATEQGRNEVAKQVEDAAAA

SEQ ID NO: 175139 - protein, 7 aa, Mycobacterium bovis
GDPTGRH

SEQ ID NO: 175140 - protein, 6 aa, Mycobacterium bovis
GDPVRA

SEQ ID NO: 175141 - protein, 4 aa, Mycobacterium bovis
GDQA

SEQ ID NO: 175142 - protein, 5 aa, Mycobacterium bovis
GDQEI

SEQ ID NO: 175143 - protein, 8 aa, Mycobacterium bovis
GDQEKPGG

SEQ ID NO: 175144 - protein, 7 aa, Mycobacterium bovis
GDQQRAD

SEQ ID NO: 175145 - protein, 4 aa, Mycobacterium bovis
GDQR

SEQ ID NO: 175146 - protein, 22 aa, Mycobacterium bovis
GDQRIRGRSGYQYASGDTADTV

SEQ ID NO: 175147 - protein, 7 aa, Mycobacterium bovis
GDQSGAN

SEQ ID NO: 175148 - protein, 9 aa, Mycobacterium bovis
GDQSTPALG

SEQ ID NO: 175149 - protein, 4 aa, Mycobacterium bovis
GDQT

SEQ ID NO: 175150 - protein, 5 aa, Mycobacterium bovis
GDQVT

SEQ ID NO: 175151 - protein, 4 aa, Mycobacterium bovis
GDRA

SEQ ID NO: 175152 - protein, 11 aa, Mycobacterium bovis
GDRAAQTGQQI

SEQ ID NO: 175153 - protein, 6 aa, Mycobacterium bovis
GDRAKN

SEQ ID NO: 175154 - protein, 7 aa, Mycobacterium bovis
GDRAPAV

SEQ ID NO: 175155 - protein, 4 aa, Mycobacterium bovis
GDRD

SEQ ID NO: 175156 - protein, 7 aa, Mycobacterium bovis
GDRDRDL

SEQ ID NO: 175157 - protein, 6 aa, Mycobacterium bovis
GDRERT

SEQ ID NO: 175158 - protein, 7 aa, Mycobacterium bovis
GDRGAAV

SEQ ID NO: 175159 - protein, 5 aa, Mycobacterium bovis
GDRGG

SEQ ID NO: 175160 - protein, 7 aa, Mycobacterium bovis
GDRGGRA

SEQ ID NO: 175161 - protein, 7 aa, Mycobacterium bovis
GDRGLKG

SEQ ID NO: 175162 - protein, 12 aa, Mycobacterium bovis
GDRHRAERDAHD

SEQ ID NO: 175163 - protein, 5 aa, Mycobacterium bovis
GDRNG

SEQ ID NO: 175164 - protein, 10 aa, Mycobacterium bovis
GDRRVSPRER

SEQ ID NO: 175165 - protein, 7 aa, Mycobacterium bovis
GDRSGDQ

SEQ ID NO: 175166 - protein, 5 aa, Mycobacterium bovis
GDRSH

SEQ ID NO: 175167 - protein, 8 aa, Mycobacterium bovis
GDRSTPQA

SEQ ID NO: 175168 - protein, 8 aa, Mycobacterium bovis
GDSAGGGL

SEQ ID NO: 175169 - protein, 8 aa, Mycobacterium bovis
GDSAGGNI

SEQ ID NO: 175170 - protein, 8 aa, Mycobacterium bovis
GDSAGGNL

SEQ ID NO: 175171 - protein, 8 aa, Mycobacterium bovis
GDSAGGTI

SEQ ID NO: 175172 - protein, 15 aa, Mycobacterium bovis
GDSAGGVGSDTASVS

SEQ ID NO: 175173 - protein, 8 aa, Mycobacterium bovis
GDSASSPA

SEQ ID NO: 175174 - protein, 11 aa, Mycobacterium bovis
GDSATLSGADL

SEQ ID NO: 175175 - protein, 11 aa, Mycobacterium bovis
GDSATRSRRAD

SEQ ID NO: 175176 - protein, 8 aa, Mycobacterium bovis
GDSDAEAE

SEQ ID NO: 175177 - protein, 10 aa, Mycobacterium bovis
GDSDSGRAHA

SEQ ID NO: 175178 - protein, 7 aa, Mycobacterium bovis
GDSEDET

SEQ ID NO: 175179 - protein, 10 aa, Mycobacterium bovis
GDSEKVPSTP

SEQ ID NO: 175180 - protein, 8 aa, Mycobacterium bovis
GDSGDGMQ

SEQ ID NO: 175181 - protein, 7 aa, Mycobacterium bovis
GDSPAGL

SEQ ID NO: 175182 - protein, 10 aa, Mycobacterium bovis
GDSPGSKYDK

SEQ ID NO: 175183 - protein, 7 aa, Mycobacterium bovis
GDSPVAG

SEQ ID NO: 175184 - protein, 6 aa, Mycobacterium bovis
GDSRRA

SEQ ID NO: 175185 - protein, 7 aa, Mycobacterium bovis
GDSTKLR

SEQ ID NO: 175186 - protein, 5 aa, Mycobacterium bovis
GDSVT

SEQ ID NO: 175187 - protein, 8 aa, Mycobacterium bovis
GDTAPKAA

SEQ ID NO: 175188 - protein, 9 aa, Mycobacterium bovis
GDTDQTPFG

SEQ ID NO: 175189 - protein, 8 aa, Mycobacterium bovis
GDTDVDEA

SEQ ID NO: 175190 - protein, 4 aa, Mycobacterium bovis
GDTE

SEQ ID NO: 175191 - protein, 9 aa, Mycobacterium bovis
GDTERLPGK

SEQ ID NO: 175192 - protein, 21 aa, Mycobacterium bovis
GDTGEPTPQRANLSDSITPDE

SEQ ID NO: 175193 - protein, 7 aa, Mycobacterium bovis
GDTITGA

SEQ ID NO: 175194 - protein, 5 aa, Mycobacterium bovis
GDTKT

SEQ ID NO: 175195 - protein, 4 aa, Mycobacterium bovis
GDTL

SEQ ID NO: 175196 - protein, 12 aa, Mycobacterium bovis
GDTNATFPAGDV

SEQ ID NO: 175197 - protein, 5 aa, Mycobacterium bovis
GDTPL

SEQ ID NO: 175198 - protein, 6 aa, Mycobacterium bovis
GDTPLD

SEQ ID NO: 175199 - protein, 16 aa, Mycobacterium bovis
GDTSEQLEDLHPLPTA

SEQ ID NO: 175200 - protein, 8 aa, Mycobacterium bovis
GDTSGIDE

SEQ ID NO: 175201 - protein, 6 aa, Mycobacterium bovis
GDTTDD

SEQ ID NO: 175202 - protein, 8 aa, Mycobacterium bovis
GDTTPGRV

SEQ ID NO: 175203 - protein, 7 aa, Mycobacterium bovis
GDTVTAG

SEQ ID NO: 175204 - protein, 6 aa, Mycobacterium bovis
GDTYDT

SEQ ID NO: 175205 - protein, 7 aa, Mycobacterium bovis
GDVDGPE

SEQ ID NO: 175206 - protein, 4 aa, Mycobacterium bovis
GDVE

SEQ ID NO: 175207 - protein, 7 aa, Mycobacterium bovis
GDVGNTA

SEQ ID NO: 175208 - protein, 36 aa, Mycobacterium bovis
GDVNTGAFNPGSFNTGSFNTGSFNTGGFNPGNTNTG

SEQ ID NO: 175209 - protein, 5 aa, Mycobacterium bovis
GDVRG

SEQ ID NO: 175210 - protein, 4 aa, Mycobacterium bovis
GDVT

SEQ ID NO: 175211 - protein, 4 aa, Mycobacterium bovis
GDWD

SEQ ID NO: 175212 - protein, 9 aa, Mycobacterium bovis
GDWSSASES

SEQ ID NO: 175213 - protein, 11 aa, Mycobacterium bovis
GDYAPDQAARE

SEQ ID NO: 175214 - protein, 8 aa, Mycobacterium bovis
GDYDSATK

SEQ ID NO: 175215 - protein, 7 aa, Mycobacterium bovis
GDYETTM

SEQ ID NO: 175216 - protein, 14 aa, Mycobacterium bovis
GDYGPGSAMARSTK

SEQ ID NO: 175217 - protein, 15 aa, Mycobacterium bovis
GDYNTGVANTGNVNT

SEQ ID NO: 175218 - protein, 14 aa, Mycobacterium bovis
GDYNVGSGNVGSYN

SEQ ID NO: 175219 - protein, 4 aa, Mycobacterium bovis
GDYP

SEQ ID NO: 175220 - protein, 7 aa, Mycobacterium bovis
GDYPRIG

SEQ ID NO: 175221 - protein, 5 aa, Mycobacterium bovis
GDYQD

SEQ ID NO: 175222 - protein, 6 aa, Mycobacterium bovis
GEAAIS

SEQ ID NO: 175223 - protein, 7 aa, Mycobacterium bovis
GEAARDA

SEQ ID NO: 175224 - protein, 9 aa, Mycobacterium bovis
GEADDGAAA

SEQ ID NO: 175225 - protein, 6 aa, Mycobacterium bovis
GEAGFG

SEQ ID NO: 175226 - protein, 6 aa, Mycobacterium bovis
GEAGLD

SEQ ID NO: 175227 - protein, 10 aa, Mycobacterium bovis
GEAGQSFATP

SEQ ID NO: 175228 - protein, 5 aa, Mycobacterium bovis
GEAGV

SEQ ID NO: 175229 - protein, 4 aa, Mycobacterium bovis
GEAL

SEQ ID NO: 175230 - protein, 13 aa, Mycobacterium bovis
GEANTGGADKSSI

SEQ ID NO: 175231 - protein, 10 aa, Mycobacterium bovis
GEASKNKATV

SEQ ID NO: 175232 - protein, 4 aa, Mycobacterium bovis
GEAT

SEQ ID NO: 175233 - protein, 6 aa, Mycobacterium bovis
GEATDA

SEQ ID NO: 175234 - protein, 9 aa, Mycobacterium bovis
GEATPTGGM

SEQ ID NO: 175235 - protein, 4 aa, Mycobacterium bovis
GEAV

SEQ ID NO: 175236 - protein, 7 aa, Mycobacterium bovis
GECEPPA

SEQ ID NO: 175237 - protein, 7 aa, Mycobacterium bovis
GEDAGRN

SEQ ID NO: 175238 - protein, 5 aa, Mycobacterium bovis
GEDAI

SEQ ID NO: 175239 - protein, 10 aa, Mycobacterium bovis
GEDELPDGRT

SEQ ID NO: 175240 - protein, 4 aa, Mycobacterium bovis
GEDG

SEQ ID NO: 175241 - protein, 7 aa, Mycobacterium bovis
GEDGKPV

SEQ ID NO: 175242 - protein, 15 aa, Mycobacterium bovis
GEDPSTRISSSYAPM

SEQ ID NO: 175243 - protein, 9 aa, Mycobacterium bovis
GEDQHQDTG

SEQ ID NO: 175244 - protein, 6 aa, Mycobacterium bovis
GEDQRQ

SEQ ID NO: 175245 - protein, 11 aa, Mycobacterium bovis
GEDSERLTGTA

SEQ ID NO: 175246 - protein, 8 aa, Mycobacterium bovis
GEDTGMPA

SEQ ID NO: 175247 - protein, 10 aa, Mycobacterium bovis
GEDTNADEAL

SEQ ID NO: 175248 - protein, 8 aa, Mycobacterium bovis
GEDVGTPT

SEQ ID NO: 175249 - protein, 5 aa, Mycobacterium bovis
GEDYR

SEQ ID NO: 175250 - protein, 10 aa, Mycobacterium bovis
GEEESGSPSL

SEQ ID NO: 175251 - protein, 6 aa, Mycobacterium bovis
GEEGSG

SEQ ID NO: 175252 - protein, 11 aa, Mycobacterium bovis
GEEGSPRDTVT

SEQ ID NO: 175253 - protein, 4 aa, Mycobacterium bovis
GEEI

SEQ ID NO: 175254 - protein, 5 aa, Mycobacterium bovis
GEEPG

SEQ ID NO: 175255 - protein, 8 aa, Mycobacterium bovis
GEESAGQI

SEQ ID NO: 175256 - protein, 11 aa, Mycobacterium bovis
GEFDARRRDQQ

SEQ ID NO: 175257 - protein, 14 aa, Mycobacterium bovis
GEFSGERKEIRPAT

SEQ ID NO: 175258 - protein, 9 aa, Mycobacterium bovis
GEFSSQPSA

SEQ ID NO: 175259 - protein, 4 aa, Mycobacterium bovis
GEGA

SEQ ID NO: 175260 - protein, 10 aa, Mycobacterium bovis
GEGAAAHAEA

SEQ ID NO: 175261 - protein, 9 aa, Mycobacterium bovis
GEGDDAEAR

SEQ ID NO: 175262 - protein, 8 aa, Mycobacterium bovis
GEGDGESA

SEQ ID NO: 175263 - protein, 4 aa, Mycobacterium bovis
GEGE

SEQ ID NO: 175264 - protein, 13 aa, Mycobacterium bovis
GEGEGRGPDGDYR

SEQ ID NO: 175265 - protein, 5 aa, Mycobacterium bovis
GEGGE

SEQ ID NO: 175266 - protein, 12 aa, Mycobacterium bovis
GEGGGTGTGGAP

SEQ ID NO: 175267 - protein, 5 aa, Mycobacterium bovis
GEGGL

SEQ ID NO: 175268 - protein, 6 aa, Mycobacterium bovis
GEGGNL

SEQ ID NO: 175269 - protein, 8 aa, Mycobacterium bovis
GEGGVGKT

SEQ ID NO: 175270 - protein, 13 aa, Mycobacterium bovis
GEGGVKGLSEPEK

SEQ ID NO: 175271 - protein, 15 aa, Mycobacterium bovis
GEGGYIGREDAANMT

SEQ ID NO: 175272 - protein, 6 aa, Mycobacterium bovis
GEGGYQ

SEQ ID NO: 175273 - protein, 14 aa, Mycobacterium bovis
GEGNSTADTASVGS

SEQ ID NO: 175274 - protein, 4 aa, Mycobacterium bovis
GEGP

SEQ ID NO: 175275 - protein, 5 aa, Mycobacterium bovis
GEGRA

SEQ ID NO: 175276 - protein, 8 aa, Mycobacterium bovis
GEGRGAEL

SEQ ID NO: 175277 - protein, 7 aa, Mycobacterium bovis
GEGSSGM

SEQ ID NO: 175278 - protein, 4 aa, Mycobacterium bovis
GEGT

SEQ ID NO: 175279 - protein, 6 aa, Mycobacterium bovis
GEGTLT

SEQ ID NO: 175280 - protein, 9 aa, Mycobacterium bovis
GEGTRGAPT

SEQ ID NO: 175281 - protein, 6 aa, Mycobacterium bovis
GEGTTE

SEQ ID NO: 175282 - protein, 4 aa, Mycobacterium bovis
GEGV

SEQ ID NO: 175283 - protein, 9 aa, Mycobacterium bovis
GEGVAAKSL

SEQ ID NO: 175284 - protein, 9 aa, Mycobacterium bovis
GEGVTGHQV

SEQ ID NO: 175285 - protein, 5 aa, Mycobacterium bovis
GEHAD

SEQ ID NO: 175286 - protein, 4 aa, Mycobacterium bovis
GEHD

SEQ ID NO: 175287 - protein, 6 aa, Mycobacterium bovis
GEHGDL

SEQ ID NO: 175288 - protein, 10 aa, Mycobacterium bovis
GEHGENLPGD

SEQ ID NO: 175289 - protein, 11 aa, Mycobacterium bovis
GEHGSTFGGNP

SEQ ID NO: 175290 - protein, 4 aa, Mycobacterium bovis
GEHK

SEQ ID NO: 175291 - protein, 7 aa, Mycobacterium bovis
GEHPDWD

SEQ ID NO: 175292 - protein, 7 aa, Mycobacterium bovis
GEHPPPR

SEQ ID NO: 175293 - protein, 13 aa, Mycobacterium bovis
GEHPYTPITPESI

SEQ ID NO: 175294 - protein, 4 aa, Mycobacterium bovis
GEHS

SEQ ID NO: 175295 - protein, 8 aa, Mycobacterium bovis
GEIDPATV

SEQ ID NO: 175296 - protein, 4 aa, Mycobacterium bovis
GEIE

SEQ ID NO: 175297 - protein, 20 aa, Mycobacterium bovis
GEIEAADAGDCGVRRVEIPA

SEQ ID NO: 175298 - protein, 7 aa, Mycobacterium bovis
GEIGSAA

SEQ ID NO: 175299 - protein, 5 aa, Mycobacterium bovis
GEIPT

SEQ ID NO: 175300 - protein, 12 aa, Mycobacterium bovis
GEKGTAKSTAVR

SEQ ID NO: 175301 - protein, 9 aa, Mycobacterium bovis
GEKHGGVKP

SEQ ID NO: 175302 - protein, 8 aa, Mycobacterium bovis
GEKMSKSV

SEQ ID NO: 175303 - protein, 17 aa, Mycobacterium bovis
GEKPGEPSWPTPWGRGR

SEQ ID NO: 175304 - protein, 13 aa, Mycobacterium bovis
GEKPNTHDDAEYD

SEQ ID NO: 175305 - protein, 4 aa, Mycobacterium bovis
GEKR

SEQ ID NO: 175306 - protein, 4 aa, Mycobacterium bovis
GEKS

SEQ ID NO: 175307 - protein, 8 aa, Mycobacterium bovis
GEKTSDEA

SEQ ID NO: 175308 - protein, 11 aa, Mycobacterium bovis
GELDPGQPTQL

SEQ ID NO: 175309 - protein, 6 aa, Mycobacterium bovis
GELGAD

SEQ ID NO: 175310 - protein, 10 aa, Mycobacterium bovis
GELGEPSEMT

SEQ ID NO: 175311 - protein, 4 aa, Mycobacterium bovis
GELR

SEQ ID NO: 175312 - protein, 13 aa, Mycobacterium bovis
GELRKGDRVAQPR

SEQ ID NO: 175313 - protein, 8 aa, Mycobacterium bovis
GELRPGSR

SEQ ID NO: 175314 - protein, 17 aa, Mycobacterium bovis
GELSESGPSAAWKSNGL

SEQ ID NO: 175315 - protein, 7 aa, Mycobacterium bovis
GELSGSH

SEQ ID NO: 175316 - protein, 18 aa, Mycobacterium bovis
GELSSSVGGNVGTNAGGM

SEQ ID NO: 175317 - protein, 15 aa, Mycobacterium bovis
GELSVDQTGKDAGAI

SEQ ID NO: 175318 - protein, 16 aa, Mycobacterium bovis
GELTASDIDDPERPNA

SEQ ID NO: 175319 - protein, 11 aa, Mycobacterium bovis
GELTGSGRITT

SEQ ID NO: 175320 - protein, 16 aa, Mycobacterium bovis
GEMGEGPVQAAGTGHG

SEQ ID NO: 175321 - protein, 5 aa, Mycobacterium bovis
GEMPE

SEQ ID NO: 175322 - protein, 13 aa, Mycobacterium bovis
GEMPPGEALPSER

SEQ ID NO: 175323 - protein, 5 aa, Mycobacterium bovis
GEMTS

SEQ ID NO: 175324 - protein, 16 aa, Mycobacterium bovis
GENGAIDPRQRRCRAK

SEQ ID NO: 175325 - protein, 8 aa, Mycobacterium bovis
GENISPRE

SEQ ID NO: 175326 - protein, 4 aa, Mycobacterium bovis
GENP

SEQ ID NO: 175327 - protein, 5 aa, Mycobacterium bovis
GENPR

SEQ ID NO: 175328 - protein, 4 aa, Mycobacterium bovis
GENQ

SEQ ID NO: 175329 - protein, 5 aa, Mycobacterium bovis
GENVP

SEQ ID NO: 175330 - protein, 5 aa, Mycobacterium bovis
GEPAA

SEQ ID NO: 175331 - protein, 6 aa, Mycobacterium bovis
GEPADI

SEQ ID NO: 175332 - protein, 6 aa, Mycobacterium bovis
GEPATL

SEQ ID NO: 175333 - protein, 5 aa, Mycobacterium bovis
GEPCR

SEQ ID NO: 175334 - protein, 5 aa, Mycobacterium bovis
GEPDH

SEQ ID NO: 175335 - protein, 7 aa, Mycobacterium bovis
GEPDPRH

SEQ ID NO: 175336 - protein, 7 aa, Mycobacterium bovis
GEPDPWS

SEQ ID NO: 175337 - protein, 6 aa, Mycobacterium bovis
GEPERN

SEQ ID NO: 175338 - protein, 5 aa, Mycobacterium bovis
GEPFT

SEQ ID NO: 175339 - protein, 8 aa, Mycobacterium bovis
GEPGAGTR

SEQ ID NO: 175340 - protein, 11 aa, Mycobacterium bovis
GEPGESSEQKI

SEQ ID NO: 175341 - protein, 6 aa, Mycobacterium bovis
GEPGGR

SEQ ID NO: 175342 - protein, 18 aa, Mycobacterium bovis
GEPGQPLDERRAPDSPLR

SEQ ID NO: 175343 - protein, 7 aa, Mycobacterium bovis
GEPGTGF

SEQ ID NO: 175344 - protein, 5 aa, Mycobacterium bovis
GEPGV

SEQ ID NO: 175345 - protein, 12 aa, Mycobacterium bovis
GEPGVGKTTAAK

SEQ ID NO: 175346 - protein, 6 aa, Mycobacterium bovis
GEPINP

SEQ ID NO: 175347 - protein, 11 aa, Mycobacterium bovis
GEPLSAEQTAR

SEQ ID NO: 175348 - protein, 6 aa, Mycobacterium bovis
GEPPHL

SEQ ID NO: 175349 - protein, 5 aa, Mycobacterium bovis
GEPPM

SEQ ID NO: 175350 - protein, 9 aa, Mycobacterium bovis
GEPPPPTYK

SEQ ID NO: 175351 - protein, 5 aa, Mycobacterium bovis
GEPQL

SEQ ID NO: 175352 - protein, 7 aa, Mycobacterium bovis
GEPQPTV

SEQ ID NO: 175353 - protein, 10 aa, Mycobacterium bovis
GEPQQNPDRP

SEQ ID NO: 175354 - protein, 7 aa, Mycobacterium bovis
GEPRARD

SEQ ID NO: 175355 - protein, 8 aa, Mycobacterium bovis
GEPRPGNY

SEQ ID NO: 175356 - protein, 7 aa, Mycobacterium bovis
GEPRYGD

SEQ ID NO: 175357 - protein, 15 aa, Mycobacterium bovis
GEPSADAGPSDGKGL

SEQ ID NO: 175358 - protein, 4 aa, Mycobacterium bovis
GEPT

SEQ ID NO: 175359 - protein, 8 aa, Mycobacterium bovis
GEPTDGIT

SEQ ID NO: 175360 - protein, 7 aa, Mycobacterium bovis
GEPTDLE

SEQ ID NO: 175361 - protein, 12 aa, Mycobacterium bovis
GEPTFSYKEHPK

SEQ ID NO: 175362 - protein, 5 aa, Mycobacterium bovis
GEPTV

SEQ ID NO: 175363 - protein, 5 aa, Mycobacterium bovis
GEQAA

SEQ ID NO: 175364 - protein, 12 aa, Mycobacterium bovis
GEQALPDEIRNP

SEQ ID NO: 175365 - protein, 6 aa, Mycobacterium bovis
GEQHRL

SEQ ID NO: 175366 - protein, 4 aa, Mycobacterium bovis
GEQL

SEQ ID NO: 175367 - protein, 19 aa, Mycobacterium bovis
GEQLSAAGTPWSPDEEEAF

SEQ ID NO: 175368 - protein, 4 aa, Mycobacterium bovis
GEQM

SEQ ID NO: 175369 - protein, 8 aa, Mycobacterium bovis
GEQPSVPE

SEQ ID NO: 175370 - protein, 7 aa, Mycobacterium bovis
GEQRTRR

SEQ ID NO: 175371 - protein, 6 aa, Mycobacterium bovis
GEQSEV

SEQ ID NO: 175372 - protein, 7 aa, Mycobacterium bovis
GEQSNNI

SEQ ID NO: 175373 - protein, 11 aa, Mycobacterium bovis
GEQSTEEELGG

SEQ ID NO: 175374 - protein, 4 aa, Mycobacterium bovis
GEQT

SEQ ID NO: 175375 - protein, 8 aa, Mycobacterium bovis
GEQTQNRI

SEQ ID NO: 175376 - protein, 4 aa, Mycobacterium bovis
GERA

SEQ ID NO: 175377 - protein, 28 aa, Mycobacterium bovis
GERADGGESIAAPEDELASRRKHRDRKI

SEQ ID NO: 175378 - protein, 11 aa, Mycobacterium bovis
GERAELGGDLS

SEQ ID NO: 175379 - protein, 6 aa, Mycobacterium bovis
GERAQV

SEQ ID NO: 175380 - protein, 14 aa, Mycobacterium bovis
GERDGVPPIHGVLT

SEQ ID NO: 175381 - protein, 10 aa, Mycobacterium bovis
GEREGNEPYG

SEQ ID NO: 175382 - protein, 6 aa, Mycobacterium bovis
GERGAL

SEQ ID NO: 175383 - protein, 9 aa, Mycobacterium bovis
GERGYRATT

SEQ ID NO: 175384 - protein, 13 aa, Mycobacterium bovis
GERLSATKAGSAM

SEQ ID NO: 175385 - protein, 6 aa, Mycobacterium bovis
GERPRF

SEQ ID NO: 175386 - protein, 5 aa, Mycobacterium bovis
GERPW

SEQ ID NO: 175387 - protein, 4 aa, Mycobacterium bovis
GERS

SEQ ID NO: 175388 - protein, 7 aa, Mycobacterium bovis
GERSRES

SEQ ID NO: 175389 - protein, 9 aa, Mycobacterium bovis
GERSSPVAD

SEQ ID NO: 175390 - protein, 4 aa, Mycobacterium bovis
GERT

SEQ ID NO: 175391 - protein, 8 aa, Mycobacterium bovis
GERTREGF

SEQ ID NO: 175392 - protein, 8 aa, Mycobacterium bovis
GERTREGN

SEQ ID NO: 175393 - protein, 11 aa, Mycobacterium bovis
GERTTPAGAEA

SEQ ID NO: 175394 - protein, 5 aa, Mycobacterium bovis
GERTV

SEQ ID NO: 175395 - protein, 4 aa, Mycobacterium bovis
GERV

SEQ ID NO: 175396 - protein, 6 aa, Mycobacterium bovis
GESADH

SEQ ID NO: 175397 - protein, 6 aa, Mycobacterium bovis
GESAEE

SEQ ID NO: 175398 - protein, 8 aa, Mycobacterium bovis
GESAKVSE

SEQ ID NO: 175399 - protein, 6 aa, Mycobacterium bovis
GESDAA

SEQ ID NO: 175400 - protein, 6 aa, Mycobacterium bovis
GESDDK

SEQ ID NO: 175401 - protein, 6 aa, Mycobacterium bovis
GESDER

SEQ ID NO: 175402 - protein, 9 aa, Mycobacterium bovis
GESFPTGRA

SEQ ID NO: 175403 - protein, 6 aa, Mycobacterium bovis
GESGAQ

SEQ ID NO: 175404 - protein, 10 aa, Mycobacterium bovis
GESGSGKSAA

SEQ ID NO: 175405 - protein, 10 aa, Mycobacterium bovis
GESGSGKSTL

SEQ ID NO: 175406 - protein, 10 aa, Mycobacterium bovis
GESGSGKSTT

SEQ ID NO: 175407 - protein, 12 aa, Mycobacterium bovis
GESGSGKSTTAA

SEQ ID NO: 175408 - protein, 5 aa, Mycobacterium bovis
GESGY

SEQ ID NO: 175409 - protein, 6 aa, Mycobacterium bovis
GESHGR

SEQ ID NO: 175410 - protein, 11 aa, Mycobacterium bovis
GESKGEHGAKS

SEQ ID NO: 175411 - protein, 4 aa, Mycobacterium bovis
GESL

SEQ ID NO: 175412 - protein, 8 aa, Mycobacterium bovis
GESLANRR

SEQ ID NO: 175413 - protein, 8 aa, Mycobacterium bovis
GESPQWSA

SEQ ID NO: 175414 - protein, 11 aa, Mycobacterium bovis
GESRDHAKTAD

SEQ ID NO: 175415 - protein, 7 aa, Mycobacterium bovis
GESTADR

SEQ ID NO: 175416 - protein, 4 aa, Mycobacterium bovis
GESV

SEQ ID NO: 175417 - protein, 8 aa, Mycobacterium bovis
GESVTDGS

SEQ ID NO: 175418 - protein, 6 aa, Mycobacterium bovis
GESYPT

SEQ ID NO: 175419 - protein, 4 aa, Mycobacterium bovis
GETA

SEQ ID NO: 175420 - protein, 8 aa, Mycobacterium bovis
GETAEHPG

SEQ ID NO: 175421 - protein, 7 aa, Mycobacterium bovis
GETAPGL

SEQ ID NO: 175422 - protein, 6 aa, Mycobacterium bovis
GETAPY

SEQ ID NO: 175423 - protein, 5 aa, Mycobacterium bovis
GETDP

SEQ ID NO: 175424 - protein, 9 aa, Mycobacterium bovis
GETEAKTNA

SEQ ID NO: 175425 - protein, 6 aa, Mycobacterium bovis
GETGGK

SEQ ID NO: 175426 - protein, 15 aa, Mycobacterium bovis
GETGGNCELTEPGRT

SEQ ID NO: 175427 - protein, 8 aa, Mycobacterium bovis
GETGTGKT

SEQ ID NO: 175428 - protein, 4 aa, Mycobacterium bovis
GETI

SEQ ID NO: 175429 - protein, 7 aa, Mycobacterium bovis
GETLTDG

SEQ ID NO: 175430 - protein, 4 aa, Mycobacterium bovis
GETP

SEQ ID NO: 175431 - protein, 8 aa, Mycobacterium bovis
GETRPGDR

SEQ ID NO: 175432 - protein, 6 aa, Mycobacterium bovis
GETRQQ

SEQ ID NO: 175433 - protein, 8 aa, Mycobacterium bovis
GETRSYGE

SEQ ID NO: 175434 - protein, 5 aa, Mycobacterium bovis
GETTH

SEQ ID NO: 175435 - protein, 6 aa, Mycobacterium bovis
GETTID

SEQ ID NO: 175436 - protein, 4 aa, Mycobacterium bovis
GETV

SEQ ID NO: 175437 - protein, 6 aa, Mycobacterium bovis
GETYNT

SEQ ID NO: 175438 - protein, 8 aa, Mycobacterium bovis
GEVAEQKV

SEQ ID NO: 175439 - protein, 22 aa, Mycobacterium bovis
GEVDLSSEEDTSEAEREERQKE

SEQ ID NO: 175440 - protein, 19 aa, Mycobacterium bovis
GEVESNAGGRFSAPDRQDV

SEQ ID NO: 175441 - protein, 5 aa, Mycobacterium bovis
GEVEY

SEQ ID NO: 175442 - protein, 6 aa, Mycobacterium bovis
GEVGKG

SEQ ID NO: 175443 - protein, 10 aa, Mycobacterium bovis
GEVGNAEQAN

SEQ ID NO: 175444 - protein, 9 aa, Mycobacterium bovis
GEVGSHSEG

SEQ ID NO: 175445 - protein, 4 aa, Mycobacterium bovis
GEVQ

SEQ ID NO: 175446 - protein, 8 aa, Mycobacterium bovis
GEVSTAEP

SEQ ID NO: 175447 - protein, 4 aa, Mycobacterium bovis
GEYA

SEQ ID NO: 175448 - protein, 6 aa, Mycobacterium bovis
GEYGEV

SEQ ID NO: 175449 - protein, 6 aa, Mycobacterium bovis
GEYGGP

SEQ ID NO: 175450 - protein, 5 aa, Mycobacterium bovis
GEYGP

SEQ ID NO: 175451 - protein, 11 aa, Mycobacterium bovis
GEYGPEKDGCG

SEQ ID NO: 175452 - protein, 5 aa, Mycobacterium bovis
GEYKS

SEQ ID NO: 175453 - protein, 6 aa, Mycobacterium bovis
GEYSSY

SEQ ID NO: 175454 - protein, 10 aa, Mycobacterium bovis
GFAEDSTTET

SEQ ID NO: 175455 - protein, 5 aa, Mycobacterium bovis
GFAGG

SEQ ID NO: 175456 - protein, 12 aa, Mycobacterium bovis
GFAPGQVGSSAM

SEQ ID NO: 175457 - protein, 36 aa, Mycobacterium bovis
GFAQGGRGGFGGNGNTGASGGMGGAGGAGGAGGAGG

SEQ ID NO: 175458 - protein, 7 aa, Mycobacterium bovis
GFDAAEP

SEQ ID NO: 175459 - protein, 5 aa, Mycobacterium bovis
GFDPA

SEQ ID NO: 175460 - protein, 11 aa, Mycobacterium bovis
GFDPARPTAFS

SEQ ID NO: 175461 - protein, 9 aa, Mycobacterium bovis
GFDPNQPSA

SEQ ID NO: 175462 - protein, 9 aa, Mycobacterium bovis
GFDPQRPSA

SEQ ID NO: 175463 - protein, 7 aa, Mycobacterium bovis
GFDPTAR

SEQ ID NO: 175464 - protein, 11 aa, Mycobacterium bovis
GFDPTQPTAWS

SEQ ID NO: 175465 - protein, 6 aa, Mycobacterium bovis
GFDTPS

SEQ ID NO: 175466 - protein, 11 aa, Mycobacterium bovis
GFETSRTPTYD

SEQ ID NO: 175467 - protein, 10 aa, Mycobacterium bovis
GFGADTATAI

SEQ ID NO: 175468 - protein, 4 aa, Mycobacterium bovis
GFGG

SEQ ID NO: 175469 - protein, 5 aa, Mycobacterium bovis
GFGGR

SEQ ID NO: 175470 - protein, 19 aa, Mycobacterium bovis
GFGNNGDNNLGLGNNGNNN

SEQ ID NO: 175471 - protein, 6 aa, Mycobacterium bovis
GFGPAE

SEQ ID NO: 175472 - protein, 5 aa, Mycobacterium bovis
GFGPE

SEQ ID NO: 175473 - protein, 4 aa, Mycobacterium bovis
GFGR

SEQ ID NO: 175474 - protein, 12 aa, Mycobacterium bovis
GFKGSRKSTPFA

SEQ ID NO: 175475 - protein, 10 aa, Mycobacterium bovis
GFNAPASTPL

SEQ ID NO: 175476 - protein, 6 aa, Mycobacterium bovis
GFPDST

SEQ ID NO: 175477 - protein, 13 aa, Mycobacterium bovis
GFPGDPRRCKPSF

SEQ ID NO: 175478 - protein, 5 aa, Mycobacterium bovis
GFPNA

SEQ ID NO: 175479 - protein, 7 aa, Mycobacterium bovis
GFPRRSK

SEQ ID NO: 175480 - protein, 9 aa, Mycobacterium bovis
GFPSGKHVS

SEQ ID NO: 175481 - protein, 5 aa, Mycobacterium bovis
GFPSP

SEQ ID NO: 175482 - protein, 4 aa, Mycobacterium bovis
GFRP

SEQ ID NO: 175483 - protein, 6 aa, Mycobacterium bovis
GFSAQG

SEQ ID NO: 175484 - protein, 12 aa, Mycobacterium bovis
GFSEDPKALEPA

SEQ ID NO: 175485 - protein, 9 aa, Mycobacterium bovis
GFSRDDAKE

SEQ ID NO: 175486 - protein, 6 aa, Mycobacterium bovis
GFTDQQ

SEQ ID NO: 175487 - protein, 5 aa, Mycobacterium bovis
GFTDT

SEQ ID NO: 175488 - protein, 4 aa, Mycobacterium bovis
GFTS

SEQ ID NO: 175489 - protein, 9 aa, Mycobacterium bovis
GFTTPDPSY

SEQ ID NO: 175490 - protein, 10 aa, Mycobacterium bovis
GFTVEPDGHG

SEQ ID NO: 175491 - protein, 5 aa, Mycobacterium bovis
GGAAA

SEQ ID NO: 175492 - protein, 10 aa, Mycobacterium bovis
GGAAARPFAT

SEQ ID NO: 175493 - protein, 15 aa, Mycobacterium bovis
GGAAAYASAEAANVQ

SEQ ID NO: 175494 - protein, 5 aa, Mycobacterium bovis
GGAAH

SEQ ID NO: 175495 - protein, 42 aa, Mycobacterium bovis
GGAAPGASAASAAGGISAAATEVGAGGGGAALGGGGMPATSF

SEQ ID NO: 175496 - protein, 6 aa, Mycobacterium bovis
GGAASH

SEQ ID NO: 175497 - protein, 7 aa, Mycobacterium bovis
GGAASNV

SEQ ID NO: 175498 - protein, 9 aa, Mycobacterium bovis
GGAASPKET

SEQ ID NO: 175499 - protein, 8 aa, Mycobacterium bovis
GGAAYGPA

SEQ ID NO: 175500 - protein, 4 aa, Mycobacterium bovis
GGAD

SEQ ID NO: 175501 - protein, 9 aa, Mycobacterium bovis
GGADDDAIE

SEQ ID NO: 175502 - protein, 7 aa, Mycobacterium bovis
GGADPAV

SEQ ID NO: 175503 - protein, 8 aa, Mycobacterium bovis
GGAEFGSG

SEQ ID NO: 175504 - protein, 20 aa, Mycobacterium bovis
GGAEPRPYEPTDETAPQGVY

SEQ ID NO: 175505 - protein, 6 aa, Mycobacterium bovis
GGAESL

SEQ ID NO: 175506 - protein, 9 aa, Mycobacterium bovis
GGAESPQET

SEQ ID NO: 175507 - protein, 14 aa, Mycobacterium bovis
GGAGAYAAAEAQVE

SEQ ID NO: 175508 - protein, 5 aa, Mycobacterium bovis
GGAGD

SEQ ID NO: 175509 - protein, 12 aa, Mycobacterium bovis
GGAGGAGGAATS

SEQ ID NO: 175510 - protein, 25 aa, Mycobacterium bovis
GGAGGAGGDSSFANGAAGGAGGAGG

SEQ ID NO: 175511 - protein, 9 aa, Mycobacterium bovis
GGAGGAGGF

SEQ ID NO: 175512 - protein, 9 aa, Mycobacterium bovis
GGAGGAGGI

SEQ ID NO: 175513 - protein, 30 aa, Mycobacterium bovis
GGAGGAGGLGGFRGAGGTGGAGGDGGNAGL

SEQ ID NO: 175514 - protein, 75 aa, Mycobacterium bovis
GGAGGAGGNGGDPGAGGRGGLGGDSGNGTSAANGVDASKHGPLTGGDGGVGGNGAKAAAAGGDGGQGGDGGNAGL

SEQ ID NO: 175515 - protein, 45 aa, Mycobacterium bovis
GGAGGAGGNGIAGVTGTSASTPGGSGTAGGAGGIGGNGGAGGAGG

SEQ ID NO: 175516 - protein, 27 aa, Mycobacterium bovis
GGAGGAGGSASGAPGAGGAGGDGGRGG

SEQ ID NO: 175517 - protein, 19 aa, Mycobacterium bovis
GGAGGAGGSGGGSGGAGGN

SEQ ID NO: 175518 - protein, 24 aa, Mycobacterium bovis
GGAGGASTNTTGGAGGAGGDGGNA

SEQ ID NO: 175519 - protein, 12 aa, Mycobacterium bovis
GGAGGDGGSGGL

SEQ ID NO: 175520 - protein, 27 aa, Mycobacterium bovis
GGAGGHGGAGTNGGAGGAGGAGGSSGT

SEQ ID NO: 175521 - protein, 21 aa, Mycobacterium bovis
GGAGGISPNGMGAGGSGGNGG

SEQ ID NO: 175522 - protein, 18 aa, Mycobacterium bovis
GGAGGLGAAGAAGAAGVN

SEQ ID NO: 175523 - protein, 19 aa, Mycobacterium bovis
GGAGGLGGTGASGGAGGAG

SEQ ID NO: 175524 - protein, 23 aa, Mycobacterium bovis
GGAGGNGGAATTGTGGAGGTGGF

SEQ ID NO: 175525 - protein, 14 aa, Mycobacterium bovis
GGAGGNGGIGGAGT

SEQ ID NO: 175526 - protein, 32 aa, Mycobacterium bovis
GGAGGNGGNGGTTADGALEGGTGGIGGTGGSA

SEQ ID NO: 175527 - protein, 29 aa, Mycobacterium bovis
GGAGGNGGVGVAGDPGGVGGAGGAGGAAG

SEQ ID NO: 175528 - protein, 18 aa, Mycobacterium bovis
GGAGGNSGGGGGAGGIGG

SEQ ID NO: 175529 - protein, 12 aa, Mycobacterium bovis
GGAGGPGGTGAM

SEQ ID NO: 175530 - protein, 7 aa, Mycobacterium bovis
GGAGGQH

SEQ ID NO: 175531 - protein, 23 aa, Mycobacterium bovis
GGAGGSGAKGANGGAGGPGGAAG

SEQ ID NO: 175532 - protein, 28 aa, Mycobacterium bovis
GGAGGTGGLSVNGGTGGTGGTGGGGGLF

SEQ ID NO: 175533 - protein, 16 aa, Mycobacterium bovis
GGAGGVGGAGGAGTTF

SEQ ID NO: 175534 - protein, 59 aa, Mycobacterium bovis
GGAGGVGGVGAAGANGATPGQDGAAGVAGSDDGAGGDGLAGSDGGDGGAGGVGGNGGRG

SEQ ID NO: 175535 - protein, 10 aa, Mycobacterium bovis
GGAGLEAETA

SEQ ID NO: 175536 - protein, 9 aa, Mycobacterium bovis
GGAGPARTG

SEQ ID NO: 175537 - protein, 22 aa, Mycobacterium bovis
GGAGSVGGLAADAGDGGAGGDG

SEQ ID NO: 175538 - protein, 6 aa, Mycobacterium bovis
GGAGTT

SEQ ID NO: 175539 - protein, 14 aa, Mycobacterium bovis
GGAGYTAAKHAQGA

SEQ ID NO: 175540 - protein, 29 aa, Mycobacterium bovis
GGAGYTGGNGGSAGLIGNGGTGGAGFAGG

SEQ ID NO: 175541 - protein, 4 aa, Mycobacterium bovis
GGAH

SEQ ID NO: 175542 - protein, 6 aa, Mycobacterium bovis
GGAKEQ

SEQ ID NO: 175543 - protein, 5 aa, Mycobacterium bovis
GGAKT

SEQ ID NO: 175544 - protein, 4 aa, Mycobacterium bovis
GGAL

SEQ ID NO: 175545 - protein, 8 aa, Mycobacterium bovis
GGALEDPA

SEQ ID NO: 175546 - protein, 6 aa, Mycobacterium bovis
GGANVA

SEQ ID NO: 175547 - protein, 5 aa, Mycobacterium bovis
GGAPG

SEQ ID NO: 175548 - protein, 8 aa, Mycobacterium bovis
GGAPGASS

SEQ ID NO: 175549 - protein, 15 aa, Mycobacterium bovis
GGAPGFGNSTTLPSS

SEQ ID NO: 175550 - protein, 7 aa, Mycobacterium bovis
GGAPKNP

SEQ ID NO: 175551 - protein, 6 aa, Mycobacterium bovis
GGAPYY

SEQ ID NO: 175552 - protein, 9 aa, Mycobacterium bovis
GGAQAPTES

SEQ ID NO: 175553 - protein, 9 aa, Mycobacterium bovis
GGAQSPKET

SEQ ID NO: 175554 - protein, 14 aa, Mycobacterium bovis
GGARDGTGAGSAMA

SEQ ID NO: 175555 - protein, 6 aa, Mycobacterium bovis
GGARLR

SEQ ID NO: 175556 - protein, 5 aa, Mycobacterium bovis
GGARN

SEQ ID NO: 175557 - protein, 7 aa, Mycobacterium bovis
GGARPGG

SEQ ID NO: 175558 - protein, 6 aa, Mycobacterium bovis
GGARPT

SEQ ID NO: 175559 - protein, 14 aa, Mycobacterium bovis
GGARRDEEKARAKE

SEQ ID NO: 175560 - protein, 10 aa, Mycobacterium bovis
GGASAAAAQL

SEQ ID NO: 175561 - protein, 6 aa, Mycobacterium bovis
GGASAE

SEQ ID NO: 175562 - protein, 9 aa, Mycobacterium bovis
GGASAGGGL

SEQ ID NO: 175563 - protein, 5 aa, Mycobacterium bovis
GGASG

SEQ ID NO: 175564 - protein, 8 aa, Mycobacterium bovis
GGASGLGL

SEQ ID NO: 175565 - protein, 10 aa, Mycobacterium bovis
GGASQPRRTL

SEQ ID NO: 175566 - protein, 8 aa, Mycobacterium bovis
GGASTVAS

SEQ ID NO: 175567 - protein, 4 aa, Mycobacterium bovis
GGAT

SEQ ID NO: 175568 - protein, 12 aa, Mycobacterium bovis
GGATAAASVSDV

SEQ ID NO: 175569 - protein, 7 aa, Mycobacterium bovis
GGATQTV

SEQ ID NO: 175570 - protein, 9 aa, Mycobacterium bovis
GGAVTSPGV

SEQ ID NO: 175571 - protein, 4 aa, Mycobacterium bovis
GGAY

SEQ ID NO: 175572 - protein, 10 aa, Mycobacterium bovis
GGAYAPDPAA

SEQ ID NO: 175573 - protein, 4 aa, Mycobacterium bovis
GGCA

SEQ ID NO: 175574 - protein, 9 aa, Mycobacterium bovis
GGDAEERAA

SEQ ID NO: 175575 - protein, 9 aa, Mycobacterium bovis
GGDAKTWGD

SEQ ID NO: 175576 - protein, 10 aa, Mycobacterium bovis
GGDASAPLDT

SEQ ID NO: 175577 - protein, 53 aa, Mycobacterium bovis
GGDATSEPGSGTASDSGSDVVSGSRSGNGEAARRRRRRRRRPTHAQDGFAARA

SEQ ID NO: 175578 - protein, 12 aa, Mycobacterium bovis
GGDAVSASADDH

SEQ ID NO: 175579 - protein, 27 aa, Mycobacterium bovis
GGDDDDIAGSTAAGQERREKLTEETDD

SEQ ID NO: 175580 - protein, 7 aa, Mycobacterium bovis
GGDDGRW

SEQ ID NO: 175581 - protein, 16 aa, Mycobacterium bovis
GGDDPEYTAATRGAAA

SEQ ID NO: 175582 - protein, 5 aa, Mycobacterium bovis
GGDEA

SEQ ID NO: 175583 - protein, 13 aa, Mycobacterium bovis
GGDEEATVYAGTG

SEQ ID NO: 175584 - protein, 20 aa, Mycobacterium bovis
GGDEKKFPGEISGGMRKRAG

SEQ ID NO: 175585 - protein, 6 aa, Mycobacterium bovis
GGDETE

SEQ ID NO: 175586 - protein, 4 aa, Mycobacterium bovis
GGDG

SEQ ID NO: 175587 - protein, 45 aa, Mycobacterium bovis
GGDGGAGGQGGDGAAGDAAASAGGTGGKGGQGGDGGTGGAGGAGP

SEQ ID NO: 175588 - protein, 24 aa, Mycobacterium bovis
GGDGGNAGNGAMPANGGNGGNAGV

SEQ ID NO: 175589 - protein, 28 aa, Mycobacterium bovis
GGDGGNGGAGTAIGSNAGDGGAGGDSSA

SEQ ID NO: 175590 - protein, 14 aa, Mycobacterium bovis
GGDGGNGGDVGAGS

SEQ ID NO: 175591 - protein, 10 aa, Mycobacterium bovis
GGDHNPIHTN

SEQ ID NO: 175592 - protein, 4 aa, Mycobacterium bovis
GGDI

SEQ ID NO: 175593 - protein, 5 aa, Mycobacterium bovis
GGDLD

SEQ ID NO: 175594 - protein, 8 aa, Mycobacterium bovis
GGDNLTAT

SEQ ID NO: 175595 - protein, 4 aa, Mycobacterium bovis
GGDP

SEQ ID NO: 175596 - protein, 6 aa, Mycobacterium bovis
GGDPEK

SEQ ID NO: 175597 - protein, 8 aa, Mycobacterium bovis
GGDPLDGD

SEQ ID NO: 175598 - protein, 8 aa, Mycobacterium bovis
GGDPMAPA

SEQ ID NO: 175599 - protein, 14 aa, Mycobacterium bovis
GGDPPIELPPAGRY

SEQ ID NO: 175600 - protein, 35 aa, Mycobacterium bovis
GGDQMARKATSPGKPAPTSGQYRPVGGGNEVTVPK

SEQ ID NO: 175601 - protein, 13 aa, Mycobacterium bovis
GGDRDPGKRAPMG

SEQ ID NO: 175602 - protein, 6 aa, Mycobacterium bovis
GGDRFT

SEQ ID NO: 175603 - protein, 5 aa, Mycobacterium bovis
GGDRQ

SEQ ID NO: 175604 - protein, 11 aa, Mycobacterium bovis
GGDSGPSGGTL

SEQ ID NO: 175605 - protein, 6 aa, Mycobacterium bovis
GGDSLS

SEQ ID NO: 175606 - protein, 11 aa, Mycobacterium bovis
GGDSLTTSGYP

SEQ ID NO: 175607 - protein, 5 aa, Mycobacterium bovis
GGDSQ

SEQ ID NO: 175608 - protein, 7 aa, Mycobacterium bovis
GGDTAKD

SEQ ID NO: 175609 - protein, 5 aa, Mycobacterium bovis
GGDTG

SEQ ID NO: 175610 - protein, 7 aa, Mycobacterium bovis
GGDTGAD

SEQ ID NO: 175611 - protein, 9 aa, Mycobacterium bovis
GGDVESNSA

SEQ ID NO: 175612 - protein, 10 aa, Mycobacterium bovis
GGEADDAERR

SEQ ID NO: 175613 - protein, 9 aa, Mycobacterium bovis
GGEAGGHCG

SEQ ID NO: 175614 - protein, 6 aa, Mycobacterium bovis
GGEAGQ

SEQ ID NO: 175615 - protein, 6 aa, Mycobacterium bovis
GGECPL

SEQ ID NO: 175616 - protein, 9 aa, Mycobacterium bovis
GGEDRRPTL

SEQ ID NO: 175617 - protein, 5 aa, Mycobacterium bovis
GGEEA

SEQ ID NO: 175618 - protein, 10 aa, Mycobacterium bovis
GGEEDGVANE

SEQ ID NO: 175619 - protein, 10 aa, Mycobacterium bovis
GGEFGGSPSV

SEQ ID NO: 175620 - protein, 4 aa, Mycobacterium bovis
GGEG

SEQ ID NO: 175621 - protein, 5 aa, Mycobacterium bovis
GGEGA

SEQ ID NO: 175622 - protein, 11 aa, Mycobacterium bovis
GGEGGGHTGPV

SEQ ID NO: 175623 - protein, 15 aa, Mycobacterium bovis
GGEGHSGAIGGVGEQ

SEQ ID NO: 175624 - protein, 8 aa, Mycobacterium bovis
GGEGYQPG

SEQ ID NO: 175625 - protein, 8 aa, Mycobacterium bovis
GGEHRRSA

SEQ ID NO: 175626 - protein, 6 aa, Mycobacterium bovis
GGEKAL

SEQ ID NO: 175627 - protein, 10 aa, Mycobacterium bovis
GGELPSEPDI

SEQ ID NO: 175628 - protein, 9 aa, Mycobacterium bovis
GGEPLPGEV

SEQ ID NO: 175629 - protein, 25 aa, Mycobacterium bovis
GGEPLPGPPPPGGCGGAIPSEQPNA

SEQ ID NO: 175630 - protein, 5 aa, Mycobacterium bovis
GGEPT

SEQ ID NO: 175631 - protein, 7 aa, Mycobacterium bovis
GGEPTGL

SEQ ID NO: 175632 - protein, 7 aa, Mycobacterium bovis
GGEPTVR

SEQ ID NO: 175633 - protein, 6 aa, Mycobacterium bovis
GGERGE

SEQ ID NO: 175634 - protein, 10 aa, Mycobacterium bovis
GGERKGDPDW

SEQ ID NO: 175635 - protein, 9 aa, Mycobacterium bovis
GGESGPNFR

SEQ ID NO: 175636 - protein, 8 aa, Mycobacterium bovis
GGESRDLD

SEQ ID NO: 175637 - protein, 17 aa, Mycobacterium bovis
GGESSRPGATRVDPAVE

SEQ ID NO: 175638 - protein, 7 aa, Mycobacterium bovis
GGESTAA

SEQ ID NO: 175639 - protein, 8 aa, Mycobacterium bovis
GGEVSPTL

SEQ ID NO: 175640 - protein, 9 aa, Mycobacterium bovis
GGEYDDSEG

SEQ ID NO: 175641 - protein, 18 aa, Mycobacterium bovis
GGFGGAGGLGAAGGVGGA

SEQ ID NO: 175642 - protein, 36 aa, Mycobacterium bovis
GGFNTGVANAGSYNTGSFNAGDTNTGGFNPGSTNTG

SEQ ID NO: 175643 - protein, 8 aa, Mycobacterium bovis
GGFPGTAA

SEQ ID NO: 175644 - protein, 5 aa, Mycobacterium bovis
GGFTS

SEQ ID NO: 175645 - protein, 8 aa, Mycobacterium bovis
GGGAATDV

SEQ ID NO: 175646 - protein, 9 aa, Mycobacterium bovis
GGGAPSLAE

SEQ ID NO: 175647 - protein, 8 aa, Mycobacterium bovis
GGGAPTLA

SEQ ID NO: 175648 - protein, 11 aa, Mycobacterium bovis
GGGAPTVEESR

SEQ ID NO: 175649 - protein, 18 aa, Mycobacterium bovis
GGGASAATSRSNRRRNVS

SEQ ID NO: 175650 - protein, 8 aa, Mycobacterium bovis
GGGDPDEL

SEQ ID NO: 175651 - protein, 8 aa, Mycobacterium bovis
GGGDSAAA

SEQ ID NO: 175652 - protein, 8 aa, Mycobacterium bovis
GGGDTEVS

SEQ ID NO: 175653 - protein, 4 aa, Mycobacterium bovis
GGGE

SEQ ID NO: 175654 - protein, 10 aa, Mycobacterium bovis
GGGEGGHNGL

SEQ ID NO: 175655 - protein, 7 aa, Mycobacterium bovis
GGGEKKT

SEQ ID NO: 175656 - protein, 7 aa, Mycobacterium bovis
GGGERKT

SEQ ID NO: 175657 - protein, 6 aa, Mycobacterium bovis
GGGETV

SEQ ID NO: 175658 - protein, 16 aa, Mycobacterium bovis
GGGGASFADGNAADIA

SEQ ID NO: 175659 - protein, 6 aa, Mycobacterium bovis
GGGGGA

SEQ ID NO: 175660 - protein, 73 aa, Mycobacterium bovis
GGGGGAGGVGGTGGIGGIGGAGGNGGAGGAGTTTGGGATIGGGGGTGGVGGAGGTGGTGGAGGTTGGSGGAGG

SEQ ID NO: 175661 - protein, 13 aa, Mycobacterium bovis
GGGGGNGGDPGLG

SEQ ID NO: 175662 - protein, 6 aa, Mycobacterium bovis
GGGGLS

SEQ ID NO: 175663 - protein, 6 aa, Mycobacterium bovis
GGGGNF

SEQ ID NO: 175664 - protein, 9 aa, Mycobacterium bovis
GGGGPGVGP

SEQ ID NO: 175665 - protein, 21 aa, Mycobacterium bovis
GGGGRPGPVGPEAVDTPRIRG

SEQ ID NO: 175666 - protein, 8 aa, Mycobacterium bovis
GGGGRPLA

SEQ ID NO: 175667 - protein, 5 aa, Mycobacterium bovis
GGGGV

SEQ ID NO: 175668 - protein, 24 aa, Mycobacterium bovis
GGGGVGGMGGAGGGAGGAGGNAGL

SEQ ID NO: 175669 - protein, 4 aa, Mycobacterium bovis
GGGH

SEQ ID NO: 175670 - protein, 5 aa, Mycobacterium bovis
GGGLA

SEQ ID NO: 175671 - protein, 9 aa, Mycobacterium bovis
GGGLGKGGE

SEQ ID NO: 175672 - protein, 9 aa, Mycobacterium bovis
GGGLPSYPH

SEQ ID NO: 175673 - protein, 5 aa, Mycobacterium bovis
GGGLR

SEQ ID NO: 175674 - protein, 4 aa, Mycobacterium bovis
GGGN

SEQ ID NO: 175675 - protein, 10 aa, Mycobacterium bovis
GGGNIGGNNV

SEQ ID NO: 175676 - protein, 8 aa, Mycobacterium bovis
GGGPAVGA

SEQ ID NO: 175677 - protein, 7 aa, Mycobacterium bovis
GGGPDTA

SEQ ID NO: 175678 - protein, 8 aa, Mycobacterium bovis
GGGPGDPE

SEQ ID NO: 175679 - protein, 54 aa, Mycobacterium bovis
GGGPGIGFGSGQSAHAKAAASDSAAAESAAQASARAQARAARRGRSAAKARGHR

SEQ ID NO: 175680 - protein, 6 aa, Mycobacterium bovis
GGGPGY

SEQ ID NO: 175681 - protein, 8 aa, Mycobacterium bovis
GGGPPTAI

SEQ ID NO: 175682 - protein, 10 aa, Mycobacterium bovis
GGGPSGQAGA

SEQ ID NO: 175683 - protein, 11 aa, Mycobacterium bovis
GGGQGNHLGGA

SEQ ID NO: 175684 - protein, 6 aa, Mycobacterium bovis
GGGQVT

SEQ ID NO: 175685 - protein, 9 aa, Mycobacterium bovis
GGGRAKSLA

SEQ ID NO: 175686 - protein, 15 aa, Mycobacterium bovis
GGGRANPGLDAGGYV

SEQ ID NO: 175687 - protein, 7 aa, Mycobacterium bovis
GGGRNKV

SEQ ID NO: 175688 - protein, 6 aa, Mycobacterium bovis
GGGRPM

SEQ ID NO: 175689 - protein, 9 aa, Mycobacterium bovis
GGGSGIGKG

SEQ ID NO: 175690 - protein, 15 aa, Mycobacterium bovis
GGGSGMARPGAVSRA

SEQ ID NO: 175691 - protein, 6 aa, Mycobacterium bovis
GGGSNA

SEQ ID NO: 175692 - protein, 8 aa, Mycobacterium bovis
GGGSPRDT

SEQ ID NO: 175693 - protein, 6 aa, Mycobacterium bovis
GGGSTE

SEQ ID NO: 175694 - protein, 5 aa, Mycobacterium bovis
GGGSV

SEQ ID NO: 175695 - protein, 9 aa, Mycobacterium bovis
GGGTAEAVA

SEQ ID NO: 175696 - protein, 21 aa, Mycobacterium bovis
GGGTGGAGGIGGGNGGHGGNG

SEQ ID NO: 175697 - protein, 18 aa, Mycobacterium bovis
GGGTGPAEGTKATTVTPG

SEQ ID NO: 175698 - protein, 14 aa, Mycobacterium bovis
GGGTLSTWQADRLP

SEQ ID NO: 175699 - protein, 8 aa, Mycobacterium bovis
GGGTPGEA

SEQ ID NO: 175700 - protein, 6 aa, Mycobacterium bovis
GGGTRI

SEQ ID NO: 175701 - protein, 9 aa, Mycobacterium bovis
GGGTSKPTN

SEQ ID NO: 175702 - protein, 6 aa, Mycobacterium bovis
GGGTSV

SEQ ID NO: 175703 - protein, 4 aa, Mycobacterium bovis
GGGV

SEQ ID NO: 175704 - protein, 5 aa, Mycobacterium bovis
GGGVD

SEQ ID NO: 175705 - protein, 10 aa, Mycobacterium bovis
GGGYGGDSDW

SEQ ID NO: 175706 - protein, 9 aa, Mycobacterium bovis
GGGYPAARA

SEQ ID NO: 175707 - protein, 12 aa, Mycobacterium bovis
GGGYPTGEELYI

SEQ ID NO: 175708 - protein, 11 aa, Mycobacterium bovis
GGHAGAADNAQ

SEQ ID NO: 175709 - protein, 5 aa, Mycobacterium bovis
GGHAP

SEQ ID NO: 175710 - protein, 5 aa, Mycobacterium bovis
GGHDY

SEQ ID NO: 175711 - protein, 21 aa, Mycobacterium bovis
GGHGGAGGIGGGSGGAGGNGG

SEQ ID NO: 175712 - protein, 12 aa, Mycobacterium bovis
GGHGGNGGNAGL

SEQ ID NO: 175713 - protein, 8 aa, Mycobacterium bovis
GGHPVGAS

SEQ ID NO: 175714 - protein, 4 aa, Mycobacterium bovis
GGHT

SEQ ID NO: 175715 - protein, 12 aa, Mycobacterium bovis
GGHTRDHGKAPV

SEQ ID NO: 175716 - protein, 4 aa, Mycobacterium bovis
GGIE

SEQ ID NO: 175717 - protein, 14 aa, Mycobacterium bovis
GGIETGQALTSNPD

SEQ ID NO: 175718 - protein, 20 aa, Mycobacterium bovis
GGIGGAGGTGGGAGGTGGNA

SEQ ID NO: 175719 - protein, 7 aa, Mycobacterium bovis
GGIGGNH

SEQ ID NO: 175720 - protein, 8 aa, Mycobacterium bovis
GGINSPDK

SEQ ID NO: 175721 - protein, 8 aa, Mycobacterium bovis
GGIRPDQP

SEQ ID NO: 175722 - protein, 6 aa, Mycobacterium bovis
GGITET

SEQ ID NO: 175723 - protein, 5 aa, Mycobacterium bovis
GGITG

SEQ ID NO: 175724 - protein, 10 aa, Mycobacterium bovis
GGKAERDQRI

SEQ ID NO: 175725 - protein, 10 aa, Mycobacterium bovis
GGKAGTGKSA

SEQ ID NO: 175726 - protein, 20 aa, Mycobacterium bovis
GGKEAEERAASSVKEKNDWT

SEQ ID NO: 175727 - protein, 5 aa, Mycobacterium bovis
GGKGR

SEQ ID NO: 175728 - protein, 8 aa, Mycobacterium bovis
GGKGRGTV

SEQ ID NO: 175729 - protein, 30 aa, Mycobacterium bovis
GGKKGLGSTRTLAERSATQAAAATAESALG

SEQ ID NO: 175730 - protein, 7 aa, Mycobacterium bovis
GGKLPRP

SEQ ID NO: 175731 - protein, 5 aa, Mycobacterium bovis
GGKLS

SEQ ID NO: 175732 - protein, 7 aa, Mycobacterium bovis
GGKNVAP

SEQ ID NO: 175733 - protein, 6 aa, Mycobacterium bovis
GGKPAR

SEQ ID NO: 175734 - protein, 9 aa, Mycobacterium bovis
GGKPHDPAV

SEQ ID NO: 175735 - protein, 7 aa, Mycobacterium bovis
GGKPITG

SEQ ID NO: 175736 - protein, 4 aa, Mycobacterium bovis
GGKR

SEQ ID NO: 175737 - protein, 4 aa, Mycobacterium bovis
GGKS

SEQ ID NO: 175738 - protein, 9 aa, Mycobacterium bovis
GGKSETFPG

SEQ ID NO: 175739 - protein, 5 aa, Mycobacterium bovis
GGKSP

SEQ ID NO: 175740 - protein, 8 aa, Mycobacterium bovis
GGKSTPDL

SEQ ID NO: 175741 - protein, 5 aa, Mycobacterium bovis
GGKVT

SEQ ID NO: 175742 - protein, 5 aa, Mycobacterium bovis
GGLAG

SEQ ID NO: 175743 - protein, 5 aa, Mycobacterium bovis
GGLAQ

SEQ ID NO: 175744 - protein, 5 aa, Mycobacterium bovis
GGLAT

SEQ ID NO: 175745 - protein, 8 aa, Mycobacterium bovis
GGLDGESV

SEQ ID NO: 175746 - protein, 5 aa, Mycobacterium bovis
GGLDS

SEQ ID NO: 175747 - protein, 6 aa, Mycobacterium bovis
GGLEGT

SEQ ID NO: 175748 - protein, 11 aa, Mycobacterium bovis
GGLGADSRHAG

SEQ ID NO: 175749 - protein, 26 aa, Mycobacterium bovis
GGLGGAGGMGGTGGGTGGTGGNGGNG

SEQ ID NO: 175750 - protein, 27 aa, Mycobacterium bovis
GGLGGNGGAATQIGGNGGNGGHGGNAG

SEQ ID NO: 175751 - protein, 9 aa, Mycobacterium bovis
GGLGPTADD

SEQ ID NO: 175752 - protein, 6 aa, Mycobacterium bovis
GGLGPV

SEQ ID NO: 175753 - protein, 8 aa, Mycobacterium bovis
GGLNPAGL

SEQ ID NO: 175754 - protein, 9 aa, Mycobacterium bovis
GGLNSGAGN

SEQ ID NO: 175755 - protein, 10 aa, Mycobacterium bovis
GGLPKGDALA

SEQ ID NO: 175756 - protein, 8 aa, Mycobacterium bovis
GGLPPESG

SEQ ID NO: 175757 - protein, 13 aa, Mycobacterium bovis
GGLYGTAGDNDGR

SEQ ID NO: 175758 - protein, 29 aa, Mycobacterium bovis
GGMGGAGGFGDHGTLGTGGAGGDGGGGGL

SEQ ID NO: 175759 - protein, 18 aa, Mycobacterium bovis
GGMGGAGGVGGNGGAGGQ

SEQ ID NO: 175760 - protein, 6 aa, Mycobacterium bovis
GGMSDN

SEQ ID NO: 175761 - protein, 6 aa, Mycobacterium bovis
GGMSPN

SEQ ID NO: 175762 - protein, 6 aa, Mycobacterium bovis
GGNAVD

SEQ ID NO: 175763 - protein, 12 aa, Mycobacterium bovis
GGNDGDGGDGGG

SEQ ID NO: 175764 - protein, 7 aa, Mycobacterium bovis
GGNDTAR

SEQ ID NO: 175765 - protein, 7 aa, Mycobacterium bovis
GGNEYRR

SEQ ID NO: 175766 - protein, 4 aa, Mycobacterium bovis
GGNG

SEQ ID NO: 175767 - protein, 18 aa, Mycobacterium bovis
GGNGFSPAAGPGGNGGAA

SEQ ID NO: 175768 - protein, 11 aa, Mycobacterium bovis
GGNGGAGGDAG

SEQ ID NO: 175769 - protein, 23 aa, Mycobacterium bovis
GGNGGHGATGADGGDGGSGGAGG

SEQ ID NO: 175770 - protein, 23 aa, Mycobacterium bovis
GGNGGHGATNTAATATGGAGGAG

SEQ ID NO: 175771 - protein, 23 aa, Mycobacterium bovis
GGNGGNAGTGFGANTGGNGGDTT

SEQ ID NO: 175772 - protein, 20 aa, Mycobacterium bovis
GGNGGNGVNGGTGGTGGSGG

SEQ ID NO: 175773 - protein, 7 aa, Mycobacterium bovis
GGNGSGR

SEQ ID NO: 175774 - protein, 14 aa, Mycobacterium bovis
GGNKAEIAPTISES

SEQ ID NO: 175775 - protein, 4 aa, Mycobacterium bovis
GGNN

SEQ ID NO: 175776 - protein, 7 aa, Mycobacterium bovis
GGNNAGH

SEQ ID NO: 175777 - protein, 6 aa, Mycobacterium bovis
GGNPHY

SEQ ID NO: 175778 - protein, 7 aa, Mycobacterium bovis
GGNRDHR

SEQ ID NO: 175779 - protein, 5 aa, Mycobacterium bovis
GGNRG

SEQ ID NO: 175780 - protein, 13 aa, Mycobacterium bovis
GGNSGFGNSGSGL

SEQ ID NO: 175781 - protein, 4 aa, Mycobacterium bovis
GGNT

SEQ ID NO: 175782 - protein, 14 aa, Mycobacterium bovis
GGNTCSATGSSRIY

SEQ ID NO: 175783 - protein, 5 aa, Mycobacterium bovis
GGNVG

SEQ ID NO: 175784 - protein, 4 aa, Mycobacterium bovis
GGPA

SEQ ID NO: 175785 - protein, 13 aa, Mycobacterium bovis
GGPAERRRDGTAR

SEQ ID NO: 175786 - protein, 6 aa, Mycobacterium bovis
GGPANF

SEQ ID NO: 175787 - protein, 8 aa, Mycobacterium bovis
GGPAPRPI

SEQ ID NO: 175788 - protein, 8 aa, Mycobacterium bovis
GGPAPTAT

SEQ ID NO: 175789 - protein, 16 aa, Mycobacterium bovis
GGPASVYADGAPKLDP

SEQ ID NO: 175790 - protein, 6 aa, Mycobacterium bovis
GGPAVA

SEQ ID NO: 175791 - protein, 10 aa, Mycobacterium bovis
GGPEPYTGAP

SEQ ID NO: 175792 - protein, 8 aa, Mycobacterium bovis
GGPGAASW

SEQ ID NO: 175793 - protein, 6 aa, Mycobacterium bovis
GGPGAG

SEQ ID NO: 175794 - protein, 7 aa, Mycobacterium bovis
GGPGAGA

SEQ ID NO: 175795 - protein, 7 aa, Mycobacterium bovis
GGPGGLA

SEQ ID NO: 175796 - protein, 6 aa, Mycobacterium bovis
GGPGRS

SEQ ID NO: 175797 - protein, 4 aa, Mycobacterium bovis
GGPK

SEQ ID NO: 175798 - protein, 4 aa, Mycobacterium bovis
GGPM

SEQ ID NO: 175799 - protein, 9 aa, Mycobacterium bovis
GGPPTPETA

SEQ ID NO: 175800 - protein, 5 aa, Mycobacterium bovis
GGPQI

SEQ ID NO: 175801 - protein, 9 aa, Mycobacterium bovis
GGPQPPPVA

SEQ ID NO: 175802 - protein, 6 aa, Mycobacterium bovis
GGPQPV

SEQ ID NO: 175803 - protein, 6 aa, Mycobacterium bovis
GGPQTY

SEQ ID NO: 175804 - protein, 6 aa, Mycobacterium bovis
GGPRAA

SEQ ID NO: 175805 - protein, 9 aa, Mycobacterium bovis
GGPSDDPFG

SEQ ID NO: 175806 - protein, 13 aa, Mycobacterium bovis
GGPSGSGLASPDG

SEQ ID NO: 175807 - protein, 5 aa, Mycobacterium bovis
GGPTF

SEQ ID NO: 175808 - protein, 5 aa, Mycobacterium bovis
GGPTL

SEQ ID NO: 175809 - protein, 10 aa, Mycobacterium bovis
GGPTPAPRGL

SEQ ID NO: 175810 - protein, 6 aa, Mycobacterium bovis
GGPTTA

SEQ ID NO: 175811 - protein, 9 aa, Mycobacterium bovis
GGPTTTIDG

SEQ ID NO: 175812 - protein, 10 aa, Mycobacterium bovis
GGPTVTNDGV

SEQ ID NO: 175813 - protein, 15 aa, Mycobacterium bovis
GGPVAAGLGNAASVG

SEQ ID NO: 175814 - protein, 9 aa, Mycobacterium bovis
GGPVGSGKT

SEQ ID NO: 175815 - protein, 6 aa, Mycobacterium bovis
GGPVPI

SEQ ID NO: 175816 - protein, 12 aa, Mycobacterium bovis
GGPVSDNKGISL

SEQ ID NO: 175817 - protein, 6 aa, Mycobacterium bovis
GGQAGN

SEQ ID NO: 175818 - protein, 25 aa, Mycobacterium bovis
GGQAPALSRLGGSDWANTKTKARRA

SEQ ID NO: 175819 - protein, 14 aa, Mycobacterium bovis
GGQAVADGSDISDW

SEQ ID NO: 175820 - protein, 11 aa, Mycobacterium bovis
GGQDPGAQSSV

SEQ ID NO: 175821 - protein, 17 aa, Mycobacterium bovis
GGQEAKGVRSSWPASLT

SEQ ID NO: 175822 - protein, 15 aa, Mycobacterium bovis
GGQERDIRSGTPDVA

SEQ ID NO: 175823 - protein, 5 aa, Mycobacterium bovis
GGQGF

SEQ ID NO: 175824 - protein, 4 aa, Mycobacterium bovis
GGQP

SEQ ID NO: 175825 - protein, 9 aa, Mycobacterium bovis
GGQPDNGLD

SEQ ID NO: 175826 - protein, 5 aa, Mycobacterium bovis
GGQPL

SEQ ID NO: 175827 - protein, 5 aa, Mycobacterium bovis
GGQPM

SEQ ID NO: 175828 - protein, 14 aa, Mycobacterium bovis
GGQPPTEPDEIASP

SEQ ID NO: 175829 - protein, 6 aa, Mycobacterium bovis
GGQPVD

SEQ ID NO: 175830 - protein, 4 aa, Mycobacterium bovis
GGQT

SEQ ID NO: 175831 - protein, 6 aa, Mycobacterium bovis
GGQTAL

SEQ ID NO: 175832 - protein, 5 aa, Mycobacterium bovis
GGQTI

SEQ ID NO: 175833 - protein, 9 aa, Mycobacterium bovis
GGQTPTSPL

SEQ ID NO: 175834 - protein, 9 aa, Mycobacterium bovis
GGQTRRSWG

SEQ ID NO: 175835 - protein, 8 aa, Mycobacterium bovis
GGQTSAES

SEQ ID NO: 175836 - protein, 11 aa, Mycobacterium bovis
GGRANASQAER

SEQ ID NO: 175837 - protein, 9 aa, Mycobacterium bovis
GGRAPKPGE

SEQ ID NO: 175838 - protein, 4 aa, Mycobacterium bovis
GGRC

SEQ ID NO: 175839 - protein, 4 aa, Mycobacterium bovis
GGRG

SEQ ID NO: 175840 - protein, 8 aa, Mycobacterium bovis
GGRGEVQT

SEQ ID NO: 175841 - protein, 8 aa, Mycobacterium bovis
GGRGGAGA

SEQ ID NO: 175842 - protein, 13 aa, Mycobacterium bovis
GGRGIRVDVVDTD

SEQ ID NO: 175843 - protein, 13 aa, Mycobacterium bovis
GGRGVPAKSLSGF

SEQ ID NO: 175844 - protein, 4 aa, Mycobacterium bovis
GGRI

SEQ ID NO: 175845 - protein, 17 aa, Mycobacterium bovis
GGRINTDALDNSAGVDC

SEQ ID NO: 175846 - protein, 5 aa, Mycobacterium bovis
GGRIT

SEQ ID NO: 175847 - protein, 7 aa, Mycobacterium bovis
GGRITQE

SEQ ID NO: 175848 - protein, 4 aa, Mycobacterium bovis
GGRL

SEQ ID NO: 175849 - protein, 17 aa, Mycobacterium bovis
GGRLGESAPASGTPPAT

SEQ ID NO: 175850 - protein, 7 aa, Mycobacterium bovis
GGRLSRQ

SEQ ID NO: 175851 - protein, 5 aa, Mycobacterium bovis
GGRLT

SEQ ID NO: 175852 - protein, 5 aa, Mycobacterium bovis
GGRNR

SEQ ID NO: 175853 - protein, 7 aa, Mycobacterium bovis
GGRPLAD

SEQ ID NO: 175854 - protein, 20 aa, Mycobacterium bovis
GGRPMSPARSQDVELGGDKE

SEQ ID NO: 175855 - protein, 7 aa, Mycobacterium bovis
GGRPPAD

SEQ ID NO: 175856 - protein, 6 aa, Mycobacterium bovis
GGRPPL

SEQ ID NO: 175857 - protein, 7 aa, Mycobacterium bovis
GGRQASA

SEQ ID NO: 175858 - protein, 4 aa, Mycobacterium bovis
GGRR

SEQ ID NO: 175859 - protein, 20 aa, Mycobacterium bovis
GGRRAGKPGRRLIVIQLRSS

SEQ ID NO: 175860 - protein, 5 aa, Mycobacterium bovis
GGRRR

SEQ ID NO: 175861 - protein, 8 aa, Mycobacterium bovis
GGRSELTT

SEQ ID NO: 175862 - protein, 7 aa, Mycobacterium bovis
GGRTADT

SEQ ID NO: 175863 - protein, 5 aa, Mycobacterium bovis
GGRTP

SEQ ID NO: 175864 - protein, 10 aa, Mycobacterium bovis
GGRTRTGKLR

SEQ ID NO: 175865 - protein, 7 aa, Mycobacterium bovis
GGRTRTR

SEQ ID NO: 175866 - protein, 5 aa, Mycobacterium bovis
GGRTV

SEQ ID NO: 175867 - protein, 14 aa, Mycobacterium bovis
GGRTVGAGRVTKII

SEQ ID NO: 175868 - protein, 4 aa, Mycobacterium bovis
GGSA

SEQ ID NO: 175869 - protein, 8 aa, Mycobacterium bovis
GGSAADAQ

SEQ ID NO: 175870 - protein, 9 aa, Mycobacterium bovis
GGSAAGTNE

SEQ ID NO: 175871 - protein, 5 aa, Mycobacterium bovis
GGSAG

SEQ ID NO: 175872 - protein, 6 aa, Mycobacterium bovis
GGSAGA

SEQ ID NO: 175873 - protein, 7 aa, Mycobacterium bovis
GGSAGRR

SEQ ID NO: 175874 - protein, 5 aa, Mycobacterium bovis
GGSAR

SEQ ID NO: 175875 - protein, 9 aa, Mycobacterium bovis
GGSARTGEL

SEQ ID NO: 175876 - protein, 7 aa, Mycobacterium bovis
GGSCAPE

SEQ ID NO: 175877 - protein, 6 aa, Mycobacterium bovis
GGSCGR

SEQ ID NO: 175878 - protein, 4 aa, Mycobacterium bovis
GGSD

SEQ ID NO: 175879 - protein, 5 aa, Mycobacterium bovis
GGSDL

SEQ ID NO: 175880 - protein, 4 aa, Mycobacterium bovis
GGSE

SEQ ID NO: 175881 - protein, 5 aa, Mycobacterium bovis
GGSGA

SEQ ID NO: 175882 - protein, 7 aa, Mycobacterium bovis
GGSGIKG

SEQ ID NO: 175883 - protein, 21 aa, Mycobacterium bovis
GGSGRNASRGRRAQGEPGRAV

SEQ ID NO: 175884 - protein, 9 aa, Mycobacterium bovis
GGSGTRGYG

SEQ ID NO: 175885 - protein, 10 aa, Mycobacterium bovis
GGSGTSAAAR

SEQ ID NO: 175886 - protein, 8 aa, Mycobacterium bovis
GGSIPETD

SEQ ID NO: 175887 - protein, 4 aa, Mycobacterium bovis
GGSL

SEQ ID NO: 175888 - protein, 15 aa, Mycobacterium bovis
GGSLEVSSGVDEEPE

SEQ ID NO: 175889 - protein, 8 aa, Mycobacterium bovis
GGSNRTDT

SEQ ID NO: 175890 - protein, 4 aa, Mycobacterium bovis
GGSP

SEQ ID NO: 175891 - protein, 9 aa, Mycobacterium bovis
GGSPGASTA

SEQ ID NO: 175892 - protein, 9 aa, Mycobacterium bovis
GGSQDPALK

SEQ ID NO: 175893 - protein, 8 aa, Mycobacterium bovis
GGSQTIGP

SEQ ID NO: 175894 - protein, 5 aa, Mycobacterium bovis
GGSRA

SEQ ID NO: 175895 - protein, 9 aa, Mycobacterium bovis
GGSSAGKTS

SEQ ID NO: 175896 - protein, 19 aa, Mycobacterium bovis
GGSSGIGAAAAKKIAEAGG

SEQ ID NO: 175897 - protein, 8 aa, Mycobacterium bovis
GGSSQDSV

SEQ ID NO: 175898 - protein, 6 aa, Mycobacterium bovis
GGSTAT

SEQ ID NO: 175899 - protein, 26 aa, Mycobacterium bovis
GGSTHGYDVTDPTTVSPELGGSDGLA

SEQ ID NO: 175900 - protein, 18 aa, Mycobacterium bovis
GGSTNTGLANAGAGNTGF

SEQ ID NO: 175901 - protein, 6 aa, Mycobacterium bovis
GGTAKD

SEQ ID NO: 175902 - protein, 4 aa, Mycobacterium bovis
GGTD

SEQ ID NO: 175903 - protein, 7 aa, Mycobacterium bovis
GGTDAKA

SEQ ID NO: 175904 - protein, 17 aa, Mycobacterium bovis
GGTDPQATAAPRRRTSP

SEQ ID NO: 175905 - protein, 7 aa, Mycobacterium bovis
GGTDQDF

SEQ ID NO: 175906 - protein, 10 aa, Mycobacterium bovis
GGTDTDGAAL

SEQ ID NO: 175907 - protein, 4 aa, Mycobacterium bovis
GGTE

SEQ ID NO: 175908 - protein, 7 aa, Mycobacterium bovis
GGTEAVE

SEQ ID NO: 175909 - protein, 8 aa, Mycobacterium bovis
GGTESDNL

SEQ ID NO: 175910 - protein, 19 aa, Mycobacterium bovis
GGTGGAGGAGAVGGVGGNG

SEQ ID NO: 175911 - protein, 25 aa, Mycobacterium bovis
GGTGGIGGTGAPGAMGGTGGNGGNG

SEQ ID NO: 175912 - protein, 58 aa, Mycobacterium bovis
GGTGGYGGMNPPVTDAPAPQVPARAQPMTTAAEHTPAVTQPQHTPVEPPVHDKPPSHS

SEQ ID NO: 175913 - protein, 9 aa, Mycobacterium bovis
GGTGPRRGI

SEQ ID NO: 175914 - protein, 7 aa, Mycobacterium bovis
GGTLESG

SEQ ID NO: 175915 - protein, 5 aa, Mycobacterium bovis
GGTMP

SEQ ID NO: 175916 - protein, 7 aa, Mycobacterium bovis
GGTNEVQ

SEQ ID NO: 175917 - protein, 11 aa, Mycobacterium bovis
GGTPDSALTGP

SEQ ID NO: 175918 - protein, 16 aa, Mycobacterium bovis
GGTPGFGNSTTGPSSG

SEQ ID NO: 175919 - protein, 15 aa, Mycobacterium bovis
GGTPKMPETAGQTPE

SEQ ID NO: 175920 - protein, 15 aa, Mycobacterium bovis
GGTPPPYPGWPTEPA

SEQ ID NO: 175921 - protein, 9 aa, Mycobacterium bovis
GGTPRKRRD

SEQ ID NO: 175922 - protein, 5 aa, Mycobacterium bovis
GGTPS

SEQ ID NO: 175923 - protein, 8 aa, Mycobacterium bovis
GGTPSLLG

SEQ ID NO: 175924 - protein, 5 aa, Mycobacterium bovis
GGTRE

SEQ ID NO: 175925 - protein, 6 aa, Mycobacterium bovis
GGTSLR

SEQ ID NO: 175926 - protein, 15 aa, Mycobacterium bovis
GGTSNTHPDHDEDER

SEQ ID NO: 175927 - protein, 9 aa, Mycobacterium bovis
GGTSSGAIA

SEQ ID NO: 175928 - protein, 8 aa, Mycobacterium bovis
GGTSTDVS

SEQ ID NO: 175929 - protein, 6 aa, Mycobacterium bovis
GGTTGM

SEQ ID NO: 175930 - protein, 5 aa, Mycobacterium bovis
GGTTY

SEQ ID NO: 175931 - protein, 13 aa, Mycobacterium bovis
GGVDDRDRDADLG

SEQ ID NO: 175932 - protein, 8 aa, Mycobacterium bovis
GGVDGPDG

SEQ ID NO: 175933 - protein, 8 aa, Mycobacterium bovis
GGVDSPEG

SEQ ID NO: 175934 - protein, 4 aa, Mycobacterium bovis
GGVE

SEQ ID NO: 175935 - protein, 9 aa, Mycobacterium bovis
GGVESRNRQ

SEQ ID NO: 175936 - protein, 26 aa, Mycobacterium bovis
GGVGGAGGATDAGTGGAGGSGGNGGL

SEQ ID NO: 175937 - protein, 18 aa, Mycobacterium bovis
GGVGGAGGIGGGTGGAGG

SEQ ID NO: 175938 - protein, 32 aa, Mycobacterium bovis
GGVGGAGGIGGQGTGAGGAAGAGGTGGNGGAG

SEQ ID NO: 175939 - protein, 24 aa, Mycobacterium bovis
GGVGGAGGQGHTGGAGGAGGAGGL

SEQ ID NO: 175940 - protein, 29 aa, Mycobacterium bovis
GGVGGRGGNGGQAPTPGNAGDGGAGGNAR

SEQ ID NO: 175941 - protein, 27 aa, Mycobacterium bovis
GGVGGSGGAGVGAGVAGGHGGAGGAAG

SEQ ID NO: 175942 - protein, 8 aa, Mycobacterium bovis
GGVGKTRL

SEQ ID NO: 175943 - protein, 10 aa, Mycobacterium bovis
GGVGKTTITA

SEQ ID NO: 175944 - protein, 6 aa, Mycobacterium bovis
GGVGTA

SEQ ID NO: 175945 - protein, 7 aa, Mycobacterium bovis
GGVNNPE

SEQ ID NO: 175946 - protein, 11 aa, Mycobacterium bovis
GGVPDGPWPDA

SEQ ID NO: 175947 - protein, 7 aa, Mycobacterium bovis
GGVPYSE

SEQ ID NO: 175948 - protein, 10 aa, Mycobacterium bovis
GGVRANHPDM

SEQ ID NO: 175949 - protein, 5 aa, Mycobacterium bovis
GGVRD

SEQ ID NO: 175950 - protein, 7 aa, Mycobacterium bovis
GGVRDGR

SEQ ID NO: 175951 - protein, 7 aa, Mycobacterium bovis
GGVSAGA

SEQ ID NO: 175952 - protein, 5 aa, Mycobacterium bovis
GGVTK

SEQ ID NO: 175953 - protein, 12 aa, Mycobacterium bovis
GGVTRPVDQEVG

SEQ ID NO: 175954 - protein, 4 aa, Mycobacterium bovis
GGVV

SEQ ID NO: 175955 - protein, 9 aa, Mycobacterium bovis
GGWEPNAKG

SEQ ID NO: 175956 - protein, 5 aa, Mycobacterium bovis
GGYDP

SEQ ID NO: 175957 - protein, 6 aa, Mycobacterium bovis
GGYGDR

SEQ ID NO: 175958 - protein, 5 aa, Mycobacterium bovis
GGYGF

SEQ ID NO: 175959 - protein, 6 aa, Mycobacterium bovis
GGYGNS

SEQ ID NO: 175960 - protein, 6 aa, Mycobacterium bovis
GGYGPS

SEQ ID NO: 175961 - protein, 12 aa, Mycobacterium bovis
GGYKQSGIGREG

SEQ ID NO: 175962 - protein, 25 aa, Mycobacterium bovis
GGYQTPGGHSASPAHEAPPGGAEGL

SEQ ID NO: 175963 - protein, 12 aa, Mycobacterium bovis
GGYRNTANRHTR

SEQ ID NO: 175964 - protein, 6 aa, Mycobacterium bovis
GGYRVG

SEQ ID NO: 175965 - protein, 4 aa, Mycobacterium bovis
GHAE

SEQ ID NO: 175966 - protein, 7 aa, Mycobacterium bovis
GHAGDGN

SEQ ID NO: 175967 - protein, 10 aa, Mycobacterium bovis
GHASATGRFD

SEQ ID NO: 175968 - protein, 5 aa, Mycobacterium bovis
GHDEH

SEQ ID NO: 175969 - protein, 4 aa, Mycobacterium bovis
GHDH

SEQ ID NO: 175970 - protein, 5 aa, Mycobacterium bovis
GHDKA

SEQ ID NO: 175971 - protein, 4 aa, Mycobacterium bovis
GHDP

SEQ ID NO: 175972 - protein, 4 aa, Mycobacterium bovis
GHEA

SEQ ID NO: 175973 - protein, 4 aa, Mycobacterium bovis
GHEP

SEQ ID NO: 175974 - protein, 6 aa, Mycobacterium bovis
GHEPDN

SEQ ID NO: 175975 - protein, 9 aa, Mycobacterium bovis
GHGASPQAL

SEQ ID NO: 175976 - protein, 22 aa, Mycobacterium bovis
GHGDDTELGAERPSLSEWRARG

SEQ ID NO: 175977 - protein, 6 aa, Mycobacterium bovis
GHGDRG

SEQ ID NO: 175978 - protein, 4 aa, Mycobacterium bovis
GHGE

SEQ ID NO: 175979 - protein, 12 aa, Mycobacterium bovis
GHGESDWSSEGD

SEQ ID NO: 175980 - protein, 4 aa, Mycobacterium bovis
GHGG

SEQ ID NO: 175981 - protein, 37 aa, Mycobacterium bovis
GHGGAGGNGGNATAPGGASAGFDGGAGGNGGSGGRGG

SEQ ID NO: 175982 - protein, 15 aa, Mycobacterium bovis
GHGGDGGTGGTGGAV

SEQ ID NO: 175983 - protein, 7 aa, Mycobacterium bovis
GHGGGAS

SEQ ID NO: 175984 - protein, 4 aa, Mycobacterium bovis
GHGQ

SEQ ID NO: 175985 - protein, 5 aa, Mycobacterium bovis
GHGRD

SEQ ID NO: 175986 - protein, 5 aa, Mycobacterium bovis
GHGRS

SEQ ID NO: 175987 - protein, 12 aa, Mycobacterium bovis
GHGRSGVPRRGA

SEQ ID NO: 175988 - protein, 16 aa, Mycobacterium bovis
GHGSSAAAAANPAERI

SEQ ID NO: 175989 - protein, 6 aa, Mycobacterium bovis
GHGTGT

SEQ ID NO: 175990 - protein, 6 aa, Mycobacterium bovis
GHGYGD

SEQ ID NO: 175991 - protein, 14 aa, Mycobacterium bovis
GHGYSSNGVGNPPL

SEQ ID NO: 175992 - protein, 8 aa, Mycobacterium bovis
GHHRGPSI

SEQ ID NO: 175993 - protein, 8 aa, Mycobacterium bovis
GHHRSGVR

SEQ ID NO: 175994 - protein, 5 aa, Mycobacterium bovis
GHIAG

SEQ ID NO: 175995 - protein, 12 aa, Mycobacterium bovis
GHNEGDDPSMTN

SEQ ID NO: 175996 - protein, 11 aa, Mycobacterium bovis
GHNGGPASGTR

SEQ ID NO: 175997 - protein, 8 aa, Mycobacterium bovis
GHNQQGFG

SEQ ID NO: 175998 - protein, 10 aa, Mycobacterium bovis
GHPAKNNYGS

SEQ ID NO: 175999 - protein, 7 aa, Mycobacterium bovis
GHPLGAT

SEQ ID NO: 176000 - protein, 9 aa, Mycobacterium bovis
GHPPDPASV

SEQ ID NO: 176001 - protein, 5 aa, Mycobacterium bovis
GHPPP

SEQ ID NO: 176002 - protein, 5 aa, Mycobacterium bovis
GHPPY

SEQ ID NO: 176003 - protein, 4 aa, Mycobacterium bovis
GHPS

SEQ ID NO: 176004 - protein, 5 aa, Mycobacterium bovis
GHPSE

SEQ ID NO: 176005 - protein, 11 aa, Mycobacterium bovis
GHPTPQPAALG

SEQ ID NO: 176006 - protein, 7 aa, Mycobacterium bovis
GHPVPGG

SEQ ID NO: 176007 - protein, 27 aa, Mycobacterium bovis
GHQPGDTVTYSTPQGPNQVQLLAVKLP

SEQ ID NO: 176008 - protein, 12 aa, Mycobacterium bovis
GHQTREHRQYGE

SEQ ID NO: 176009 - protein, 10 aa, Mycobacterium bovis
GHRANPVATG

SEQ ID NO: 176010 - protein, 5 aa, Mycobacterium bovis
GHRDD

SEQ ID NO: 176011 - protein, 13 aa, Mycobacterium bovis
GHRPKTVSTTAGD

SEQ ID NO: 176012 - protein, 5 aa, Mycobacterium bovis
GHRPS

SEQ ID NO: 176013 - protein, 9 aa, Mycobacterium bovis
GHRRSEYDA

SEQ ID NO: 176014 - protein, 4 aa, Mycobacterium bovis
GHSE

SEQ ID NO: 176015 - protein, 7 aa, Mycobacterium bovis
GHSEPAL

SEQ ID NO: 176016 - protein, 4 aa, Mycobacterium bovis
GHSS

SEQ ID NO: 176017 - protein, 8 aa, Mycobacterium bovis
GHTEPAER

SEQ ID NO: 176018 - protein, 5 aa, Mycobacterium bovis
GHTHA

SEQ ID NO: 176019 - protein, 6 aa, Mycobacterium bovis
GHTNTG

SEQ ID NO: 176020 - protein, 16 aa, Mycobacterium bovis
GHTNTGIANSGNVGTG

SEQ ID NO: 176021 - protein, 27 aa, Mycobacterium bovis
GHTNTGSFNAGSMNTGDFNSGNVNTGY

SEQ ID NO: 176022 - protein, 13 aa, Mycobacterium bovis
GHTPGQAAKPMAA

SEQ ID NO: 176023 - protein, 15 aa, Mycobacterium bovis
GHTPRQAADDPTRRA

SEQ ID NO: 176024 - protein, 13 aa, Mycobacterium bovis
GHTPSAQVPTTDD

SEQ ID NO: 176025 - protein, 4 aa, Mycobacterium bovis
GHWP

SEQ ID NO: 176026 - protein, 13 aa, Mycobacterium bovis
GHYQGRISTPDVS

SEQ ID NO: 176027 - protein, 25 aa, Mycobacterium bovis
GHYSGAAALGNAQGYKYSHDDPDGV

SEQ ID NO: 176028 - protein, 5 aa, Mycobacterium bovis
GIAGE

SEQ ID NO: 176029 - protein, 10 aa, Mycobacterium bovis
GIAGEGNKEI

SEQ ID NO: 176030 - protein, 14 aa, Mycobacterium bovis
GIAGPSGGTPEKPV

SEQ ID NO: 176031 - protein, 5 aa, Mycobacterium bovis
GIANR

SEQ ID NO: 176032 - protein, 7 aa, Mycobacterium bovis
GIAPAGG

SEQ ID NO: 176033 - protein, 5 aa, Mycobacterium bovis
GIAPG

SEQ ID NO: 176034 - protein, 5 aa, Mycobacterium bovis
GIARD

SEQ ID NO: 176035 - protein, 7 aa, Mycobacterium bovis
GIATPAD

SEQ ID NO: 176036 - protein, 7 aa, Mycobacterium bovis
GIDELTG

SEQ ID NO: 176037 - protein, 5 aa, Mycobacterium bovis
GIDPD

SEQ ID NO: 176038 - protein, 7 aa, Mycobacterium bovis
GIDPNAI

SEQ ID NO: 176039 - protein, 4 aa, Mycobacterium bovis
GIEA

SEQ ID NO: 176040 - protein, 11 aa, Mycobacterium bovis
GIEGPGGQVTE

SEQ ID NO: 176041 - protein, 7 aa, Mycobacterium bovis
GIEPRST

SEQ ID NO: 176042 - protein, 7 aa, Mycobacterium bovis
GIEQTNA

SEQ ID NO: 176043 - protein, 7 aa, Mycobacterium bovis
GIERPDY

SEQ ID NO: 176044 - protein, 5 aa, Mycobacterium bovis
GIERY

SEQ ID NO: 176045 - protein, 13 aa, Mycobacterium bovis
GIGATENAEGFTT

SEQ ID NO: 176046 - protein, 8 aa, Mycobacterium bovis
GIGDRPRA

SEQ ID NO: 176047 - protein, 10 aa, Mycobacterium bovis
GIGENDAAVR

SEQ ID NO: 176048 - protein, 22 aa, Mycobacterium bovis
GIGGAGGPGFNGGAGGAGGRSG

SEQ ID NO: 176049 - protein, 29 aa, Mycobacterium bovis
GIGGTGGTGLGAPDPGGTGGKGGVGGIGG

SEQ ID NO: 176050 - protein, 8 aa, Mycobacterium bovis
GIGKRGAE

SEQ ID NO: 176051 - protein, 7 aa, Mycobacterium bovis
GIGPAEL

SEQ ID NO: 176052 - protein, 5 aa, Mycobacterium bovis
GIGPG

SEQ ID NO: 176053 - protein, 7 aa, Mycobacterium bovis
GIGPGDR

SEQ ID NO: 176054 - protein, 7 aa, Mycobacterium bovis
GIGPKTA

SEQ ID NO: 176055 - protein, 7 aa, Mycobacterium bovis
GIGSGQQ

SEQ ID NO: 176056 - protein, 9 aa, Mycobacterium bovis
GIGSSNKKL

SEQ ID NO: 176057 - protein, 7 aa, Mycobacterium bovis
GIGTGKT

SEQ ID NO: 176058 - protein, 8 aa, Mycobacterium bovis
GIGTPRRA

SEQ ID NO: 176059 - protein, 5 aa, Mycobacterium bovis
GIGVT

SEQ ID NO: 176060 - protein, 7 aa, Mycobacterium bovis
GIKDTSD

SEQ ID NO: 176061 - protein, 4 aa, Mycobacterium bovis
GIKE

SEQ ID NO: 176062 - protein, 5 aa, Mycobacterium bovis
GINPA

SEQ ID NO: 176063 - protein, 8 aa, Mycobacterium bovis
GIPARSAQ

SEQ ID NO: 176064 - protein, 11 aa, Mycobacterium bovis
GIPDEAIDPGG

SEQ ID NO: 176065 - protein, 6 aa, Mycobacterium bovis
GIPEAQ

SEQ ID NO: 176066 - protein, 7 aa, Mycobacterium bovis
GIPGQDA

SEQ ID NO: 176067 - protein, 8 aa, Mycobacterium bovis
GIPKTPEW

SEQ ID NO: 176068 - protein, 4 aa, Mycobacterium bovis
GIPP

SEQ ID NO: 176069 - protein, 11 aa, Mycobacterium bovis
GIPPDSLGGTR

SEQ ID NO: 176070 - protein, 12 aa, Mycobacterium bovis
GIPPDSLSGTRT

SEQ ID NO: 176071 - protein, 6 aa, Mycobacterium bovis
GIQAPA

SEQ ID NO: 176072 - protein, 12 aa, Mycobacterium bovis
GIQRAKAAELRE

SEQ ID NO: 176073 - protein, 8 aa, Mycobacterium bovis
GIQTAKPS

SEQ ID NO: 176074 - protein, 11 aa, Mycobacterium bovis
GIQTPKPRCES

SEQ ID NO: 176075 - protein, 5 aa, Mycobacterium bovis
GIRKS

SEQ ID NO: 176076 - protein, 5 aa, Mycobacterium bovis
GIRRG

SEQ ID NO: 176077 - protein, 10 aa, Mycobacterium bovis
GISESEEQQQ

SEQ ID NO: 176078 - protein, 11 aa, Mycobacterium bovis
GISGDITESGL

SEQ ID NO: 176079 - protein, 8 aa, Mycobacterium bovis
GISPPEDN

SEQ ID NO: 176080 - protein, 6 aa, Mycobacterium bovis
GISRKA

SEQ ID NO: 176081 - protein, 25 aa, Mycobacterium bovis
GISSPPVVPPPAEPPPAMPARDEPL

SEQ ID NO: 176082 - protein, 11 aa, Mycobacterium bovis
GITASYQQQEI

SEQ ID NO: 176083 - protein, 14 aa, Mycobacterium bovis
GITDPSHERYKEAA

SEQ ID NO: 176084 - protein, 4 aa, Mycobacterium bovis
GITE

SEQ ID NO: 176085 - protein, 7 aa, Mycobacterium bovis
GITEPAG

SEQ ID NO: 176086 - protein, 11 aa, Mycobacterium bovis
GITGSDGASHN

SEQ ID NO: 176087 - protein, 4 aa, Mycobacterium bovis
GITP

SEQ ID NO: 176088 - protein, 5 aa, Mycobacterium bovis
GITPE

SEQ ID NO: 176089 - protein, 4 aa, Mycobacterium bovis
GITR

SEQ ID NO: 176090 - protein, 5 aa, Mycobacterium bovis
GITRD

SEQ ID NO: 176091 - protein, 11 aa, Mycobacterium bovis
GITSDGASRRV

SEQ ID NO: 176092 - protein, 21 aa, Mycobacterium bovis
GITSPPPESLGRRRSRLAQLE

SEQ ID NO: 176093 - protein, 8 aa, Mycobacterium bovis
GITTSASK

SEQ ID NO: 176094 - protein, 5 aa, Mycobacterium bovis
GIVGP

SEQ ID NO: 176095 - protein, 4 aa, Mycobacterium bovis
GKAE

SEQ ID NO: 176096 - protein, 9 aa, Mycobacterium bovis
GKAFSSGGS

SEQ ID NO: 176097 - protein, 12 aa, Mycobacterium bovis
GKAGGTIGRNNS

SEQ ID NO: 176098 - protein, 10 aa, Mycobacterium bovis
GKAGLPADEL

SEQ ID NO: 176099 - protein, 4 aa, Mycobacterium bovis
GKAL

SEQ ID NO: 176100 - protein, 15 aa, Mycobacterium bovis
GKAQGGMASSRSQLG

SEQ ID NO: 176101 - protein, 8 aa, Mycobacterium bovis
GKAQPGQV

SEQ ID NO: 176102 - protein, 9 aa, Mycobacterium bovis
GKARTTVAR

SEQ ID NO: 176103 - protein, 6 aa, Mycobacterium bovis
GKASQQ

SEQ ID NO: 176104 - protein, 6 aa, Mycobacterium bovis
GKATAV

SEQ ID NO: 176105 - protein, 7 aa, Mycobacterium bovis
GKATPEA

SEQ ID NO: 176106 - protein, 4 aa, Mycobacterium bovis
GKAV

SEQ ID NO: 176107 - protein, 13 aa, Mycobacterium bovis
GKCGSCSAEINGK

SEQ ID NO: 176108 - protein, 12 aa, Mycobacterium bovis
GKDAARIEGSKA

SEQ ID NO: 176109 - protein, 12 aa, Mycobacterium bovis
GKDGQPTQGGYS

SEQ ID NO: 176110 - protein, 9 aa, Mycobacterium bovis
GKDKGAKGK

SEQ ID NO: 176111 - protein, 8 aa, Mycobacterium bovis
GKEGQNAR

SEQ ID NO: 176112 - protein, 6 aa, Mycobacterium bovis
GKENAA

SEQ ID NO: 176113 - protein, 22 aa, Mycobacterium bovis
GKFTGAGGNLEQTVTKNNLEAA

SEQ ID NO: 176114 - protein, 8 aa, Mycobacterium bovis
GKGAPEGA

SEQ ID NO: 176115 - protein, 15 aa, Mycobacterium bovis
GKGCAEAMKGQGARV

SEQ ID NO: 176116 - protein, 6 aa, Mycobacterium bovis
GKGEYG

SEQ ID NO: 176117 - protein, 7 aa, Mycobacterium bovis
GKGGKQR

SEQ ID NO: 176118 - protein, 6 aa, Mycobacterium bovis
GKGKRI

SEQ ID NO: 176119 - protein, 9 aa, Mycobacterium bovis
GKGRGTDHS

SEQ ID NO: 176120 - protein, 5 aa, Mycobacterium bovis
GKGRI

SEQ ID NO: 176121 - protein, 11 aa, Mycobacterium bovis
GKHGDTGRSEL

SEQ ID NO: 176122 - protein, 5 aa, Mycobacterium bovis
GKHTG

SEQ ID NO: 176123 - protein, 8 aa, Mycobacterium bovis
GKIRSRGV

SEQ ID NO: 176124 - protein, 7 aa, Mycobacterium bovis
GKKKREV

SEQ ID NO: 176125 - protein, 8 aa, Mycobacterium bovis
GKKREDGV

SEQ ID NO: 176126 - protein, 8 aa, Mycobacterium bovis
GKKYESRQ

SEQ ID NO: 176127 - protein, 8 aa, Mycobacterium bovis
GKLDGTPE

SEQ ID NO: 176128 - protein, 19 aa, Mycobacterium bovis
GKLDSITAEPVGRALRGRR

SEQ ID NO: 176129 - protein, 6 aa, Mycobacterium bovis
GKLETI

SEQ ID NO: 176130 - protein, 10 aa, Mycobacterium bovis
GKLGEGRTAL

SEQ ID NO: 176131 - protein, 8 aa, Mycobacterium bovis
GKLSDPRP

SEQ ID NO: 176132 - protein, 7 aa, Mycobacterium bovis
GKLSNSL

SEQ ID NO: 176133 - protein, 4 aa, Mycobacterium bovis
GKLT

SEQ ID NO: 176134 - protein, 12 aa, Mycobacterium bovis
GKLTGYGGGINR

SEQ ID NO: 176135 - protein, 6 aa, Mycobacterium bovis
GKNIHE

SEQ ID NO: 176136 - protein, 9 aa, Mycobacterium bovis
GKNMSPANI

SEQ ID NO: 176137 - protein, 7 aa, Mycobacterium bovis
GKPAGKT

SEQ ID NO: 176138 - protein, 7 aa, Mycobacterium bovis
GKPANPD

SEQ ID NO: 176139 - protein, 13 aa, Mycobacterium bovis
GKPATRRHEPDGG

SEQ ID NO: 176140 - protein, 7 aa, Mycobacterium bovis
GKPDGST

SEQ ID NO: 176141 - protein, 6 aa, Mycobacterium bovis
GKPDSV

SEQ ID NO: 176142 - protein, 4 aa, Mycobacterium bovis
GKPE

SEQ ID NO: 176143 - protein, 5 aa, Mycobacterium bovis
GKPGR

SEQ ID NO: 176144 - protein, 11 aa, Mycobacterium bovis
GKPGSSDTSGR

SEQ ID NO: 176145 - protein, 5 aa, Mycobacterium bovis
GKPHA

SEQ ID NO: 176146 - protein, 7 aa, Mycobacterium bovis
GKPISPA

SEQ ID NO: 176147 - protein, 4 aa, Mycobacterium bovis
GKPL

SEQ ID NO: 176148 - protein, 6 aa, Mycobacterium bovis
GKPLAD

SEQ ID NO: 176149 - protein, 9 aa, Mycobacterium bovis
GKPLQSVAK

SEQ ID NO: 176150 - protein, 6 aa, Mycobacterium bovis
GKPLTD

SEQ ID NO: 176151 - protein, 5 aa, Mycobacterium bovis
GKPRF

SEQ ID NO: 176152 - protein, 20 aa, Mycobacterium bovis
GKPSRYRSEPQRQHLAAAPA

SEQ ID NO: 176153 - protein, 13 aa, Mycobacterium bovis
GKPTDQLPGPGRQ

SEQ ID NO: 176154 - protein, 6 aa, Mycobacterium bovis
GKPTGP

SEQ ID NO: 176155 - protein, 8 aa, Mycobacterium bovis
GKPTPEPR

SEQ ID NO: 176156 - protein, 4 aa, Mycobacterium bovis
GKPV

SEQ ID NO: 176157 - protein, 5 aa, Mycobacterium bovis
GKPYP

SEQ ID NO: 176158 - protein, 6 aa, Mycobacterium bovis
GKQAHE

SEQ ID NO: 176159 - protein, 8 aa, Mycobacterium bovis
GKQGDRGV

SEQ ID NO: 176160 - protein, 6 aa, Mycobacterium bovis
GKQGRF

SEQ ID NO: 176161 - protein, 9 aa, Mycobacterium bovis
GKQRPGSVR

SEQ ID NO: 176162 - protein, 4 aa, Mycobacterium bovis
GKQY

SEQ ID NO: 176163 - protein, 5 aa, Mycobacterium bovis
GKRAN

SEQ ID NO: 176164 - protein, 8 aa, Mycobacterium bovis
GKRHPTVG

SEQ ID NO: 176165 - protein, 4 aa, Mycobacterium bovis
GKRI

SEQ ID NO: 176166 - protein, 21 aa, Mycobacterium bovis
GKRKAGHAPVQPADEHVRPED

SEQ ID NO: 176167 - protein, 7 aa, Mycobacterium bovis
GKRPQAY

SEQ ID NO: 176168 - protein, 7 aa, Mycobacterium bovis
GKRPSVR

SEQ ID NO: 176169 - protein, 12 aa, Mycobacterium bovis
GKRRSNQAENGI

SEQ ID NO: 176170 - protein, 12 aa, Mycobacterium bovis
GKRSRRGQPDDQ

SEQ ID NO: 176171 - protein, 5 aa, Mycobacterium bovis
GKSDH

SEQ ID NO: 176172 - protein, 9 aa, Mycobacterium bovis
GKSDQRTAG

SEQ ID NO: 176173 - protein, 8 aa, Mycobacterium bovis
GKSLSAPT

SEQ ID NO: 176174 - protein, 4 aa, Mycobacterium bovis
GKSP

SEQ ID NO: 176175 - protein, 19 aa, Mycobacterium bovis
GKSSSASRAIDTESNLGQY

SEQ ID NO: 176176 - protein, 7 aa, Mycobacterium bovis
GKSTHAE

SEQ ID NO: 176177 - protein, 5 aa, Mycobacterium bovis
GKSTL

SEQ ID NO: 176178 - protein, 4 aa, Mycobacterium bovis
GKSY

SEQ ID NO: 176179 - protein, 12 aa, Mycobacterium bovis
GKTADADAYEPF

SEQ ID NO: 176180 - protein, 4 aa, Mycobacterium bovis
GKTG

SEQ ID NO: 176181 - protein, 8 aa, Mycobacterium bovis
GKTGEGVS

SEQ ID NO: 176182 - protein, 9 aa, Mycobacterium bovis
GKTPGRQGR

SEQ ID NO: 176183 - protein, 6 aa, Mycobacterium bovis
GKTPPC

SEQ ID NO: 176184 - protein, 4 aa, Mycobacterium bovis
GKTT

SEQ ID NO: 176185 - protein, 7 aa, Mycobacterium bovis
GKTTAMR

SEQ ID NO: 176186 - protein, 6 aa, Mycobacterium bovis
GKTTLT

SEQ ID NO: 176187 - protein, 5 aa, Mycobacterium bovis
GKTVS

SEQ ID NO: 176188 - protein, 5 aa, Mycobacterium bovis
GKTYG

SEQ ID NO: 176189 - protein, 11 aa, Mycobacterium bovis
GKVAAGETERA

SEQ ID NO: 176190 - protein, 9 aa, Mycobacterium bovis
GKVSPSAER

SEQ ID NO: 176191 - protein, 5 aa, Mycobacterium bovis
GKYGA

SEQ ID NO: 176192 - protein, 9 aa, Mycobacterium bovis
GKYPPPPGV

SEQ ID NO: 176193 - protein, 8 aa, Mycobacterium bovis
GLAAAGTH

SEQ ID NO: 176194 - protein, 4 aa, Mycobacterium bovis
GLAD

SEQ ID NO: 176195 - protein, 10 aa, Mycobacterium bovis
GLADGDAAEL

SEQ ID NO: 176196 - protein, 8 aa, Mycobacterium bovis
GLADPAGT

SEQ ID NO: 176197 - protein, 9 aa, Mycobacterium bovis
GLAETAEEI

SEQ ID NO: 176198 - protein, 13 aa, Mycobacterium bovis
GLAGEAAARPGDD

SEQ ID NO: 176199 - protein, 13 aa, Mycobacterium bovis
GLAGGSGQAWQGA

SEQ ID NO: 176200 - protein, 5 aa, Mycobacterium bovis
GLAGS

SEQ ID NO: 176201 - protein, 7 aa, Mycobacterium bovis
GLAGTGL

SEQ ID NO: 176202 - protein, 7 aa, Mycobacterium bovis
GLAKPDG

SEQ ID NO: 176203 - protein, 23 aa, Mycobacterium bovis
GLAPDGRCKPYAGRADGVGWSEG

SEQ ID NO: 176204 - protein, 8 aa, Mycobacterium bovis
GLAPMSPA

SEQ ID NO: 176205 - protein, 4 aa, Mycobacterium bovis
GLAR

SEQ ID NO: 176206 - protein, 9 aa, Mycobacterium bovis
GLARPQGDR

SEQ ID NO: 176207 - protein, 10 aa, Mycobacterium bovis
GLARTEGHKM

SEQ ID NO: 176208 - protein, 5 aa, Mycobacterium bovis
GLASG

SEQ ID NO: 176209 - protein, 6 aa, Mycobacterium bovis
GLASPV

SEQ ID NO: 176210 - protein, 7 aa, Mycobacterium bovis
GLDANTQ

SEQ ID NO: 176211 - protein, 6 aa, Mycobacterium bovis
GLDEDR

SEQ ID NO: 176212 - protein, 5 aa, Mycobacterium bovis
GLDEN

SEQ ID NO: 176213 - protein, 4 aa, Mycobacterium bovis
GLDG

SEQ ID NO: 176214 - protein, 5 aa, Mycobacterium bovis
GLDGE

SEQ ID NO: 176215 - protein, 5 aa, Mycobacterium bovis
GLDGI

SEQ ID NO: 176216 - protein, 9 aa, Mycobacterium bovis
GLDPAGPAA

SEQ ID NO: 176217 - protein, 7 aa, Mycobacterium bovis
GLDPKTT

SEQ ID NO: 176218 - protein, 13 aa, Mycobacterium bovis
GLDPNTATAGELA

SEQ ID NO: 176219 - protein, 6 aa, Mycobacterium bovis
GLDSPD

SEQ ID NO: 176220 - protein, 9 aa, Mycobacterium bovis
GLDSTAPTA

SEQ ID NO: 176221 - protein, 4 aa, Mycobacterium bovis
GLDT

SEQ ID NO: 176222 - protein, 5 aa, Mycobacterium bovis
GLERT

SEQ ID NO: 176223 - protein, 17 aa, Mycobacterium bovis
GLESPEEESAARASGRV

SEQ ID NO: 176224 - protein, 9 aa, Mycobacterium bovis
GLESSNLSQ

SEQ ID NO: 176225 - protein, 9 aa, Mycobacterium bovis
GLETATTAR

SEQ ID NO: 176226 - protein, 6 aa, Mycobacterium bovis
GLETEA

SEQ ID NO: 176227 - protein, 6 aa, Mycobacterium bovis
GLGASP

SEQ ID NO: 176228 - protein, 12 aa, Mycobacterium bovis
GLGDPELMRQAW

SEQ ID NO: 176229 - protein, 6 aa, Mycobacterium bovis
GLGEPT

SEQ ID NO: 176230 - protein, 5 aa, Mycobacterium bovis
GLGGA

SEQ ID NO: 176231 - protein, 10 aa, Mycobacterium bovis
GLGGADRKIE

SEQ ID NO: 176232 - protein, 16 aa, Mycobacterium bovis
GLGGAGGAGGVDGAIG

SEQ ID NO: 176233 - protein, 10 aa, Mycobacterium bovis
GLGGENAPGV

SEQ ID NO: 176234 - protein, 18 aa, Mycobacterium bovis
GLGGGAGGDGGQGGAGRG

SEQ ID NO: 176235 - protein, 11 aa, Mycobacterium bovis
GLGGPGREHEA

SEQ ID NO: 176236 - protein, 11 aa, Mycobacterium bovis
GLGGQTPVADM

SEQ ID NO: 176237 - protein, 5 aa, Mycobacterium bovis
GLGGT

SEQ ID NO: 176238 - protein, 28 aa, Mycobacterium bovis
GLGGTGGSGGTGGDGGAPGNGGAGGAGQ

SEQ ID NO: 176239 - protein, 10 aa, Mycobacterium bovis
GLGKPDKKAV

SEQ ID NO: 176240 - protein, 4 aa, Mycobacterium bovis
GLGN

SEQ ID NO: 176241 - protein, 9 aa, Mycobacterium bovis
GLGNAGTLA

SEQ ID NO: 176242 - protein, 5 aa, Mycobacterium bovis
GLGNS

SEQ ID NO: 176243 - protein, 7 aa, Mycobacterium bovis
GLGPEAR

SEQ ID NO: 176244 - protein, 7 aa, Mycobacterium bovis
GLGQGNR

SEQ ID NO: 176245 - protein, 5 aa, Mycobacterium bovis
GLGRT

SEQ ID NO: 176246 - protein, 5 aa, Mycobacterium bovis
GLGSA

SEQ ID NO: 176247 - protein, 5 aa, Mycobacterium bovis
GLGSP

SEQ ID NO: 176248 - protein, 6 aa, Mycobacterium bovis
GLGSQR

SEQ ID NO: 176249 - protein, 7 aa, Mycobacterium bovis
GLGTAED

SEQ ID NO: 176250 - protein, 9 aa, Mycobacterium bovis
GLGTDEAGA

SEQ ID NO: 176251 - protein, 4 aa, Mycobacterium bovis
GLHR

SEQ ID NO: 176252 - protein, 15 aa, Mycobacterium bovis
GLHSDGPRNPFTPKR

SEQ ID NO: 176253 - protein, 6 aa, Mycobacterium bovis
GLHSNG

SEQ ID NO: 176254 - protein, 8 aa, Mycobacterium bovis
GLHTDPRV

SEQ ID NO: 176255 - protein, 9 aa, Mycobacterium bovis
GLKPYSRDT

SEQ ID NO: 176256 - protein, 6 aa, Mycobacterium bovis
GLKQPD

SEQ ID NO: 176257 - protein, 6 aa, Mycobacterium bovis
GLKTSR

SEQ ID NO: 176258 - protein, 17 aa, Mycobacterium bovis
GLNDGTRVREDPLTYAG

SEQ ID NO: 176259 - protein, 12 aa, Mycobacterium bovis
GLNPPKPQAAGR

SEQ ID NO: 176260 - protein, 5 aa, Mycobacterium bovis
GLNQP

SEQ ID NO: 176261 - protein, 8 aa, Mycobacterium bovis
GLNSGSGN

SEQ ID NO: 176262 - protein, 8 aa, Mycobacterium bovis
GLNSGTGN

SEQ ID NO: 176263 - protein, 7 aa, Mycobacterium bovis
GLPADAK

SEQ ID NO: 176264 - protein, 9 aa, Mycobacterium bovis
GLPADGGDA

SEQ ID NO: 176265 - protein, 5 aa, Mycobacterium bovis
GLPAG

SEQ ID NO: 176266 - protein, 10 aa, Mycobacterium bovis
GLPAGRSGCS

SEQ ID NO: 176267 - protein, 12 aa, Mycobacterium bovis
GLPAPKYGTATT

SEQ ID NO: 176268 - protein, 5 aa, Mycobacterium bovis
GLPAQ

SEQ ID NO: 176269 - protein, 4 aa, Mycobacterium bovis
GLPD

SEQ ID NO: 176270 - protein, 10 aa, Mycobacterium bovis
GLPDDSDDTV

SEQ ID NO: 176271 - protein, 10 aa, Mycobacterium bovis
GLPDNTVGPP

SEQ ID NO: 176272 - protein, 14 aa, Mycobacterium bovis
GLPDPAKQAGRYPH

SEQ ID NO: 176273 - protein, 7 aa, Mycobacterium bovis
GLPDPGI

SEQ ID NO: 176274 - protein, 11 aa, Mycobacterium bovis
GLPDQPGRSTM

SEQ ID NO: 176275 - protein, 10 aa, Mycobacterium bovis
GLPDRKDVKD

SEQ ID NO: 176276 - protein, 6 aa, Mycobacterium bovis
GLPDSV

SEQ ID NO: 176277 - protein, 7 aa, Mycobacterium bovis
GLPEDDP

SEQ ID NO: 176278 - protein, 8 aa, Mycobacterium bovis
GLPGAQGR

SEQ ID NO: 176279 - protein, 12 aa, Mycobacterium bovis
GLPGARARRRAL

SEQ ID NO: 176280 - protein, 13 aa, Mycobacterium bovis
GLPGARARRRGLS

SEQ ID NO: 176281 - protein, 22 aa, Mycobacterium bovis
GLPGARARRRGLSDSALGTPRR

SEQ ID NO: 176282 - protein, 6 aa, Mycobacterium bovis
GLPGDT

SEQ ID NO: 176283 - protein, 8 aa, Mycobacterium bovis
GLPGEWPT

SEQ ID NO: 176284 - protein, 7 aa, Mycobacterium bovis
GLPGGLP

SEQ ID NO: 176285 - protein, 5 aa, Mycobacterium bovis
GLPGK

SEQ ID NO: 176286 - protein, 14 aa, Mycobacterium bovis
GLPGNGGAGGNAGL

SEQ ID NO: 176287 - protein, 8 aa, Mycobacterium bovis
GLPGPTGR

SEQ ID NO: 176288 - protein, 12 aa, Mycobacterium bovis
GLPKGDLPPPLP

SEQ ID NO: 176289 - protein, 6 aa, Mycobacterium bovis
GLPPAE

SEQ ID NO: 176290 - protein, 15 aa, Mycobacterium bovis
GLPPAGVTDLGSRSR

SEQ ID NO: 176291 - protein, 5 aa, Mycobacterium bovis
GLPPG

SEQ ID NO: 176292 - protein, 16 aa, Mycobacterium bovis
GLPPGSDYRNRAPKMS

SEQ ID NO: 176293 - protein, 7 aa, Mycobacterium bovis
GLPPGTY

SEQ ID NO: 176294 - protein, 7 aa, Mycobacterium bovis
GLPPIGS

SEQ ID NO: 176295 - protein, 7 aa, Mycobacterium bovis
GLPPKRR

SEQ ID NO: 176296 - protein, 13 aa, Mycobacterium bovis
GLPPPWQPALPRL

SEQ ID NO: 176297 - protein, 5 aa, Mycobacterium bovis
GLPPT

SEQ ID NO: 176298 - protein, 14 aa, Mycobacterium bovis
GLPPTATPPLLRDA

SEQ ID NO: 176299 - protein, 8 aa, Mycobacterium bovis
GLPSAAQQ

SEQ ID NO: 176300 - protein, 7 aa, Mycobacterium bovis
GLPSASA

SEQ ID NO: 176301 - protein, 6 aa, Mycobacterium bovis
GLPSSA

SEQ ID NO: 176302 - protein, 8 aa, Mycobacterium bovis
GLPSSPWH

SEQ ID NO: 176303 - protein, 8 aa, Mycobacterium bovis
GLPTHQDN

SEQ ID NO: 176304 - protein, 23 aa, Mycobacterium bovis
GLQARAGLGRADGKPEAEAAEPL

SEQ ID NO: 176305 - protein, 5 aa, Mycobacterium bovis
GLQEK

SEQ ID NO: 176306 - protein, 5 aa, Mycobacterium bovis
GLQRQ

SEQ ID NO: 176307 - protein, 4 aa, Mycobacterium bovis
GLRA

SEQ ID NO: 176308 - protein, 9 aa, Mycobacterium bovis
GLRAKGSKL

SEQ ID NO: 176309 - protein, 4 aa, Mycobacterium bovis
GLRD

SEQ ID NO: 176310 - protein, 8 aa, Mycobacterium bovis
GLRGATQQ

SEQ ID NO: 176311 - protein, 8 aa, Mycobacterium bovis
GLRKPSAD

SEQ ID NO: 176312 - protein, 13 aa, Mycobacterium bovis
GLRPDKKPSEVVR

SEQ ID NO: 176313 - protein, 8 aa, Mycobacterium bovis
GLRPGGQA

SEQ ID NO: 176314 - protein, 13 aa, Mycobacterium bovis
GLRPGRTERQVSR

SEQ ID NO: 176315 - protein, 15 aa, Mycobacterium bovis
GLRPGSIADANDAAQ

SEQ ID NO: 176316 - protein, 5 aa, Mycobacterium bovis
GLRTA

SEQ ID NO: 176317 - protein, 10 aa, Mycobacterium bovis
GLSASSGLAH

SEQ ID NO: 176318 - protein, 10 aa, Mycobacterium bovis
GLSDARDRQV

SEQ ID NO: 176319 - protein, 9 aa, Mycobacterium bovis
GLSDDERAQ

SEQ ID NO: 176320 - protein, 13 aa, Mycobacterium bovis
GLSGARARRRGLS

SEQ ID NO: 176321 - protein, 5 aa, Mycobacterium bovis
GLSGT

SEQ ID NO: 176322 - protein, 6 aa, Mycobacterium bovis
GLSNKD

SEQ ID NO: 176323 - protein, 7 aa, Mycobacterium bovis
GLSPATP

SEQ ID NO: 176324 - protein, 7 aa, Mycobacterium bovis
GLSPESV

SEQ ID NO: 176325 - protein, 8 aa, Mycobacterium bovis
GLSPSQDE

SEQ ID NO: 176326 - protein, 22 aa, Mycobacterium bovis
GLSQGDVVESGANADIKPGNNL

SEQ ID NO: 176327 - protein, 10 aa, Mycobacterium bovis
GLSRQGRHGP

SEQ ID NO: 176328 - protein, 12 aa, Mycobacterium bovis
GLSSDRATVAAA

SEQ ID NO: 176329 - protein, 7 aa, Mycobacterium bovis
GLTATRH

SEQ ID NO: 176330 - protein, 10 aa, Mycobacterium bovis
GLTGATSGLS

SEQ ID NO: 176331 - protein, 5 aa, Mycobacterium bovis
GLTGP

SEQ ID NO: 176332 - protein, 6 aa, Mycobacterium bovis
GLTGST

SEQ ID NO: 176333 - protein, 7 aa, Mycobacterium bovis
GLTGVSS

SEQ ID NO: 176334 - protein, 18 aa, Mycobacterium bovis
GLTNANSAEFDPDTPDPV

SEQ ID NO: 176335 - protein, 49 aa, Mycobacterium bovis
GLTNTPVAAPASAPVGGLDSGNPNPGSGSAAAGSGANPGLRSPGTSYPS

SEQ ID NO: 176336 - protein, 4 aa, Mycobacterium bovis
GLTP

SEQ ID NO: 176337 - protein, 7 aa, Mycobacterium bovis
GLTPADV

SEQ ID NO: 176338 - protein, 10 aa, Mycobacterium bovis
GLTPNQMASR

SEQ ID NO: 176339 - protein, 5 aa, Mycobacterium bovis
GLTPQ

SEQ ID NO: 176340 - protein, 6 aa, Mycobacterium bovis
GLTPTE

SEQ ID NO: 176341 - protein, 9 aa, Mycobacterium bovis
GLTSGADDY

SEQ ID NO: 176342 - protein, 6 aa, Mycobacterium bovis
GLTSPE

SEQ ID NO: 176343 - protein, 5 aa, Mycobacterium bovis
GMADP

SEQ ID NO: 176344 - protein, 8 aa, Mycobacterium bovis
GMADQSRT

SEQ ID NO: 176345 - protein, 10 aa, Mycobacterium bovis
GMAEADARAR

SEQ ID NO: 176346 - protein, 33 aa, Mycobacterium bovis
GMCNPEQKAPCVNGAPSKEQARRDTRSCPQRNH

SEQ ID NO: 176347 - protein, 5 aa, Mycobacterium bovis
GMEDD

SEQ ID NO: 176348 - protein, 8 aa, Mycobacterium bovis
GMESGHAY

SEQ ID NO: 176349 - protein, 4 aa, Mycobacterium bovis
GMGG

SEQ ID NO: 176350 - protein, 13 aa, Mycobacterium bovis
GMGGAGGAGGAGG

SEQ ID NO: 176351 - protein, 7 aa, Mycobacterium bovis
GMGGSQR

SEQ ID NO: 176352 - protein, 6 aa, Mycobacterium bovis
GMGREG

SEQ ID NO: 176353 - protein, 6 aa, Mycobacterium bovis
GMGRES

SEQ ID NO: 176354 - protein, 7 aa, Mycobacterium bovis
GMGSGPV

SEQ ID NO: 176355 - protein, 6 aa, Mycobacterium bovis
GMKPGD

SEQ ID NO: 176356 - protein, 5 aa, Mycobacterium bovis
GMKRQ

SEQ ID NO: 176357 - protein, 13 aa, Mycobacterium bovis
GMPAAPGPALRGG

SEQ ID NO: 176358 - protein, 8 aa, Mycobacterium bovis
GMPAPPPL

SEQ ID NO: 176359 - protein, 12 aa, Mycobacterium bovis
GMPDPEPPHSDG

SEQ ID NO: 176360 - protein, 8 aa, Mycobacterium bovis
GMRRGDAV

SEQ ID NO: 176361 - protein, 6 aa, Mycobacterium bovis
GMRTGG

SEQ ID NO: 176362 - protein, 9 aa, Mycobacterium bovis
GMSRADTRR

SEQ ID NO: 176363 - protein, 12 aa, Mycobacterium bovis
GMSRRASRRRAE

SEQ ID NO: 176364 - protein, 5 aa, Mycobacterium bovis
GMTEP

SEQ ID NO: 176365 - protein, 11 aa, Mycobacterium bovis
GMTGTAQTEAA

SEQ ID NO: 176366 - protein, 11 aa, Mycobacterium bovis
GMYSDESPGAG

SEQ ID NO: 176367 - protein, 4 aa, Mycobacterium bovis
GNAA

SEQ ID NO: 176368 - protein, 37 aa, Mycobacterium bovis
GNAGAGGSAGAGGNGASAGTAGGSGGDGGKGGNGGSV

SEQ ID NO: 176369 - protein, 9 aa, Mycobacterium bovis
GNAGGTNVG

SEQ ID NO: 176370 - protein, 7 aa, Mycobacterium bovis
GNAGKAG

SEQ ID NO: 176371 - protein, 5 aa, Mycobacterium bovis
GNAGN

SEQ ID NO: 176372 - protein, 14 aa, Mycobacterium bovis
GNAGNQSVGFGNAG

SEQ ID NO: 176373 - protein, 40 aa, Mycobacterium bovis
GNAGPNMSSPAVPTPGNGNVGIGNGGNGNFGGGNTGNANI

SEQ ID NO: 176374 - protein, 8 aa, Mycobacterium bovis
GNAGSGNV

SEQ ID NO: 176375 - protein, 10 aa, Mycobacterium bovis
GNAGSTNTGL

SEQ ID NO: 176376 - protein, 8 aa, Mycobacterium bovis
GNAMTDDT

SEQ ID NO: 176377 - protein, 16 aa, Mycobacterium bovis
GNANTGIANSGNVDTG

SEQ ID NO: 176378 - protein, 10 aa, Mycobacterium bovis
GNAPESQYNT

SEQ ID NO: 176379 - protein, 18 aa, Mycobacterium bovis
GNAPTDEADAEKIPVTTD

SEQ ID NO: 176380 - protein, 7 aa, Mycobacterium bovis
GNARPAQ

SEQ ID NO: 176381 - protein, 6 aa, Mycobacterium bovis
GNASAP

SEQ ID NO: 176382 - protein, 5 aa, Mycobacterium bovis
GNATQ

SEQ ID NO: 176383 - protein, 4 aa, Mycobacterium bovis
GNCL

SEQ ID NO: 176384 - protein, 8 aa, Mycobacterium bovis
GNDEQRRW

SEQ ID NO: 176385 - protein, 9 aa, Mycobacterium bovis
GNDNRDTGV

SEQ ID NO: 176386 - protein, 4 aa, Mycobacterium bovis
GNDP

SEQ ID NO: 176387 - protein, 4 aa, Mycobacterium bovis
GNDR

SEQ ID NO: 176388 - protein, 5 aa, Mycobacterium bovis
GNDRG

SEQ ID NO: 176389 - protein, 5 aa, Mycobacterium bovis
GNDYD

SEQ ID NO: 176390 - protein, 5 aa, Mycobacterium bovis
GNEQV

SEQ ID NO: 176391 - protein, 11 aa, Mycobacterium bovis
GNESTDGVGGA

SEQ ID NO: 176392 - protein, 9 aa, Mycobacterium bovis
GNETTRNSI

SEQ ID NO: 176393 - protein, 6 aa, Mycobacterium bovis
GNFPPT

SEQ ID NO: 176394 - protein, 17 aa, Mycobacterium bovis
GNGANGAPGTGANGGDA

SEQ ID NO: 176395 - protein, 18 aa, Mycobacterium bovis
GNGANGAPGTGANGGDGG

SEQ ID NO: 176396 - protein, 10 aa, Mycobacterium bovis
GNGATPDSDA

SEQ ID NO: 176397 - protein, 17 aa, Mycobacterium bovis
GNGDSGTPGTGDDGGAG

SEQ ID NO: 176398 - protein, 6 aa, Mycobacterium bovis
GNGEQR

SEQ ID NO: 176399 - protein, 25 aa, Mycobacterium bovis
GNGGAGGAASGVGNGGVGGAGGAGG

SEQ ID NO: 176400 - protein, 23 aa, Mycobacterium bovis
GNGGAGGAGAAGAAGANGQNPVS

SEQ ID NO: 176401 - protein, 22 aa, Mycobacterium bovis
GNGGAGGAGGAGGGAGGAGGNA

SEQ ID NO: 176402 - protein, 25 aa, Mycobacterium bovis
GNGGAGGAGGDGPGNGAAGGAGGAG

SEQ ID NO: 176403 - protein, 27 aa, Mycobacterium bovis
GNGGAGGAGGNVASGTAGFGGAGGAGG

SEQ ID NO: 176404 - protein, 26 aa, Mycobacterium bovis
GNGGAGGAGGSATAGAAGAGGNGGAG

SEQ ID NO: 176405 - protein, 27 aa, Mycobacterium bovis
GNGGAGGAGGTATANNGIGGAGGAGGS

SEQ ID NO: 176406 - protein, 8 aa, Mycobacterium bovis
GNGGAGGI

SEQ ID NO: 176407 - protein, 14 aa, Mycobacterium bovis
GNGGAGGNGGASGS

SEQ ID NO: 176408 - protein, 22 aa, Mycobacterium bovis
GNGGAGGSGAPGQAGEWDSDDR

SEQ ID NO: 176409 - protein, 36 aa, Mycobacterium bovis
GNGGAGGSGGSGAPGSVSSGGVGGAGNPGGSGGNGG

SEQ ID NO: 176410 - protein, 23 aa, Mycobacterium bovis
GNGGDGGAGGFGAGTGGSGGVGG

SEQ ID NO: 176411 - protein, 49 aa, Mycobacterium bovis
GNGGDGGSSTVAAGGAGGNTLVGNGGAGGAGGTSGLTGSGVAGGAGGSV

SEQ ID NO: 176412 - protein, 23 aa, Mycobacterium bovis
GNGGEGGDGGALGGNGGNGGNAQ

SEQ ID NO: 176413 - protein, 11 aa, Mycobacterium bovis
GNGGNGAAGVN

SEQ ID NO: 176414 - protein, 11 aa, Mycobacterium bovis
GNGGNGGAGGF

SEQ ID NO: 176415 - protein, 36 aa, Mycobacterium bovis
GNGGNGGAGGNGGNDNSSTLADAGSGGAGAAGGNGG

SEQ ID NO: 176416 - protein, 21 aa, Mycobacterium bovis
GNGGNGGDGGAGANGGAGGTA

SEQ ID NO: 176417 - protein, 53 aa, Mycobacterium bovis
GNGGNGGDGGASVTGTGGNGGAGGNGVQIGNGGNGGSGGTGAAAGKAGLGGLG

SEQ ID NO: 176418 - protein, 19 aa, Mycobacterium bovis
GNGGNGGMGGAGAAGVNAV

SEQ ID NO: 176419 - protein, 26 aa, Mycobacterium bovis
GNGGNGGNAGSGGGTGFEGSAGQGGA

SEQ ID NO: 176420 - protein, 17 aa, Mycobacterium bovis
GNGGNGGNGGNGGAGSL

SEQ ID NO: 176421 - protein, 24 aa, Mycobacterium bovis
GNGGNGGSSSTPGQPGGRGGAAGL

SEQ ID NO: 176422 - protein, 8 aa, Mycobacterium bovis
GNGGPGGF

SEQ ID NO: 176423 - protein, 37 aa, Mycobacterium bovis
GNGGQGGAGGTGGDHSGGNGIGGKGGASGNGGNAGQV

SEQ ID NO: 176424 - protein, 8 aa, Mycobacterium bovis
GNGKFNTI

SEQ ID NO: 176425 - protein, 4 aa, Mycobacterium bovis
GNGL

SEQ ID NO: 176426 - protein, 12 aa, Mycobacterium bovis
GNGLKDPDTALK

SEQ ID NO: 176427 - protein, 6 aa, Mycobacterium bovis
GNGLRR

SEQ ID NO: 176428 - protein, 26 aa, Mycobacterium bovis
GNGNFGIGNSGNFNTGGWNSGHGNTG

SEQ ID NO: 176429 - protein, 14 aa, Mycobacterium bovis
GNGNFGIGNSGNFS

SEQ ID NO: 176430 - protein, 25 aa, Mycobacterium bovis
GNGNLGIGNSSDANVGIGNSGATVG

SEQ ID NO: 176431 - protein, 26 aa, Mycobacterium bovis
GNGNVGIGNSGNYNTGLGNVGNANTG

SEQ ID NO: 176432 - protein, 15 aa, Mycobacterium bovis
GNGNVGIGNTGTANF

SEQ ID NO: 176433 - protein, 10 aa, Mycobacterium bovis
GNGPSPKDGG

SEQ ID NO: 176434 - protein, 5 aa, Mycobacterium bovis
GNGTE

SEQ ID NO: 176435 - protein, 11 aa, Mycobacterium bovis
GNGTGTPAEES

SEQ ID NO: 176436 - protein, 18 aa, Mycobacterium bovis
GNGTNGAPGTGEAGGPGG

SEQ ID NO: 176437 - protein, 18 aa, Mycobacterium bovis
GNGTNGAPGTGQAGGPGG

SEQ ID NO: 176438 - protein, 6 aa, Mycobacterium bovis
GNGVGD

SEQ ID NO: 176439 - protein, 13 aa, Mycobacterium bovis
GNHENEVGNGPIG

SEQ ID NO: 176440 - protein, 4 aa, Mycobacterium bovis
GNIP

SEQ ID NO: 176441 - protein, 11 aa, Mycobacterium bovis
GNISESAYTGD

SEQ ID NO: 176442 - protein, 8 aa, Mycobacterium bovis
GNIYEKDG

SEQ ID NO: 176443 - protein, 6 aa, Mycobacterium bovis
GNKPVA

SEQ ID NO: 176444 - protein, 12 aa, Mycobacterium bovis
GNKSRAIAAARE

SEQ ID NO: 176445 - protein, 22 aa, Mycobacterium bovis
GNLESVGSALNEAAAAAAPATV

SEQ ID NO: 176446 - protein, 18 aa, Mycobacterium bovis
GNLGGVDATDDPWHGRPA

SEQ ID NO: 176447 - protein, 8 aa, Mycobacterium bovis
GNLGQHNG

SEQ ID NO: 176448 - protein, 7 aa, Mycobacterium bovis
GNLGSQN

SEQ ID NO: 176449 - protein, 4 aa, Mycobacterium bovis
GNLP

SEQ ID NO: 176450 - protein, 8 aa, Mycobacterium bovis
GNLPTAPA

SEQ ID NO: 176451 - protein, 4 aa, Mycobacterium bovis
GNLQ

SEQ ID NO: 176452 - protein, 7 aa, Mycobacterium bovis
GNLRAGD

SEQ ID NO: 176453 - protein, 8 aa, Mycobacterium bovis
GNNDVSRY

SEQ ID NO: 176454 - protein, 4 aa, Mycobacterium bovis
GNNH

SEQ ID NO: 176455 - protein, 9 aa, Mycobacterium bovis
GNNKSVSEL

SEQ ID NO: 176456 - protein, 4 aa, Mycobacterium bovis
GNNN

SEQ ID NO: 176457 - protein, 5 aa, Mycobacterium bovis
GNNNV

SEQ ID NO: 176458 - protein, 13 aa, Mycobacterium bovis
GNNNVGSGNTGDY

SEQ ID NO: 176459 - protein, 6 aa, Mycobacterium bovis
GNNPVG

SEQ ID NO: 176460 - protein, 4 aa, Mycobacterium bovis
GNNQ

SEQ ID NO: 176461 - protein, 6 aa, Mycobacterium bovis
GNNQNA

SEQ ID NO: 176462 - protein, 5 aa, Mycobacterium bovis
GNNSS

SEQ ID NO: 176463 - protein, 4 aa, Mycobacterium bovis
GNPA

SEQ ID NO: 176464 - protein, 9 aa, Mycobacterium bovis
GNPALTASH

SEQ ID NO: 176465 - protein, 10 aa, Mycobacterium bovis
GNPANTDSHY

SEQ ID NO: 176466 - protein, 6 aa, Mycobacterium bovis
GNPDGA

SEQ ID NO: 176467 - protein, 8 aa, Mycobacterium bovis
GNPDTAAN

SEQ ID NO: 176468 - protein, 8 aa, Mycobacterium bovis
GNPDTAKH

SEQ ID NO: 176469 - protein, 12 aa, Mycobacterium bovis
GNPGTGKSTLAR

SEQ ID NO: 176470 - protein, 6 aa, Mycobacterium bovis
GNPTSS

SEQ ID NO: 176471 - protein, 7 aa, Mycobacterium bovis
GNPTTDV

SEQ ID NO: 176472 - protein, 6 aa, Mycobacterium bovis
GNPVPS

SEQ ID NO: 176473 - protein, 6 aa, Mycobacterium bovis
GNQGPI

SEQ ID NO: 176474 - protein, 11 aa, Mycobacterium bovis
GNQHDAEDLTQ

SEQ ID NO: 176475 - protein, 24 aa, Mycobacterium bovis
GNQRTAGELSRQEGGKVFGGGSRN

SEQ ID NO: 176476 - protein, 15 aa, Mycobacterium bovis
GNRAASSLSGGADTL

SEQ ID NO: 176477 - protein, 5 aa, Mycobacterium bovis
GNRAP

SEQ ID NO: 176478 - protein, 13 aa, Mycobacterium bovis
GNRGSYNIGPANL

SEQ ID NO: 176479 - protein, 14 aa, Mycobacterium bovis
GNRPAHVVNPEVLG

SEQ ID NO: 176480 - protein, 4 aa, Mycobacterium bovis
GNRR

SEQ ID NO: 176481 - protein, 7 aa, Mycobacterium bovis
GNRVPKA

SEQ ID NO: 176482 - protein, 13 aa, Mycobacterium bovis
GNSGGAPETVQHN

SEQ ID NO: 176483 - protein, 20 aa, Mycobacterium bovis
GNSRETAKSIARGRPDLPGP

SEQ ID NO: 176484 - protein, 9 aa, Mycobacterium bovis
GNSYDGTSA

SEQ ID NO: 176485 - protein, 8 aa, Mycobacterium bovis
GNTGNGNI

SEQ ID NO: 176486 - protein, 19 aa, Mycobacterium bovis
GNTGNGNIGIGNTGTGNIG

SEQ ID NO: 176487 - protein, 5 aa, Mycobacterium bovis
GNTGR

SEQ ID NO: 176488 - protein, 7 aa, Mycobacterium bovis
GNTGTNN

SEQ ID NO: 176489 - protein, 11 aa, Mycobacterium bovis
GNTHESSTGFK

SEQ ID NO: 176490 - protein, 5 aa, Mycobacterium bovis
GNTNF

SEQ ID NO: 176491 - protein, 7 aa, Mycobacterium bovis
GNTRSYG

SEQ ID NO: 176492 - protein, 7 aa, Mycobacterium bovis
GNTVAKD

SEQ ID NO: 176493 - protein, 7 aa, Mycobacterium bovis
GNTVNPD

SEQ ID NO: 176494 - protein, 7 aa, Mycobacterium bovis
GNTYRSP

SEQ ID NO: 176495 - protein, 5 aa, Mycobacterium bovis
GNTYY

SEQ ID NO: 176496 - protein, 13 aa, Mycobacterium bovis
GNVARGDDFDTSV

SEQ ID NO: 176497 - protein, 7 aa, Mycobacterium bovis
GNVGGQN

SEQ ID NO: 176498 - protein, 12 aa, Mycobacterium bovis
GNVNTGAFDTGD

SEQ ID NO: 176499 - protein, 14 aa, Mycobacterium bovis
GNVNTGAFNSGSFN

SEQ ID NO: 176500 - protein, 7 aa, Mycobacterium bovis
GNVTGPE

SEQ ID NO: 176501 - protein, 5 aa, Mycobacterium bovis
GNYKS

SEQ ID NO: 176502 - protein, 16 aa, Mycobacterium bovis
GNYNTGVGNAGTASTG

SEQ ID NO: 176503 - protein, 5 aa, Mycobacterium bovis
GNYQA

SEQ ID NO: 176504 - protein, 5 aa, Mycobacterium bovis
GNYSN

SEQ ID NO: 176505 - protein, 11 aa, Mycobacterium bovis
GPAAGGHRGTF

SEQ ID NO: 176506 - protein, 8 aa, Mycobacterium bovis
GPAAPQRL

SEQ ID NO: 176507 - protein, 6 aa, Mycobacterium bovis
GPAAPW

SEQ ID NO: 176508 - protein, 8 aa, Mycobacterium bovis
GPAAYRNQ

SEQ ID NO: 176509 - protein, 8 aa, Mycobacterium bovis
GPADGASN

SEQ ID NO: 176510 - protein, 13 aa, Mycobacterium bovis
GPAEDWADWADAA

SEQ ID NO: 176511 - protein, 11 aa, Mycobacterium bovis
GPAEPANVEPL

SEQ ID NO: 176512 - protein, 7 aa, Mycobacterium bovis
GPAEVGP

SEQ ID NO: 176513 - protein, 7 aa, Mycobacterium bovis
GPAFPRA

SEQ ID NO: 176514 - protein, 6 aa, Mycobacterium bovis
GPAFSA

SEQ ID NO: 176515 - protein, 7 aa, Mycobacterium bovis
GPAFTGR

SEQ ID NO: 176516 - protein, 6 aa, Mycobacterium bovis
GPAGER

SEQ ID NO: 176517 - protein, 8 aa, Mycobacterium bovis
GPAGVGKA

SEQ ID NO: 176518 - protein, 9 aa, Mycobacterium bovis
GPAGVGKTE

SEQ ID NO: 176519 - protein, 4 aa, Mycobacterium bovis
GPAI

SEQ ID NO: 176520 - protein, 8 aa, Mycobacterium bovis
GPAIAGGT

SEQ ID NO: 176521 - protein, 8 aa, Mycobacterium bovis
GPAKGQRR

SEQ ID NO: 176522 - protein, 5 aa, Mycobacterium bovis
GPAKR

SEQ ID NO: 176523 - protein, 14 aa, Mycobacterium bovis
GPALSAAAEQGGLA

SEQ ID NO: 176524 - protein, 7 aa, Mycobacterium bovis
GPAPLGG

SEQ ID NO: 176525 - protein, 4 aa, Mycobacterium bovis
GPAQ

SEQ ID NO: 176526 - protein, 5 aa, Mycobacterium bovis
GPAQR

SEQ ID NO: 176527 - protein, 8 aa, Mycobacterium bovis
GPASADGA

SEQ ID NO: 176528 - protein, 12 aa, Mycobacterium bovis
GPASESSIGSDG

SEQ ID NO: 176529 - protein, 7 aa, Mycobacterium bovis
GPASYTG

SEQ ID NO: 176530 - protein, 5 aa, Mycobacterium bovis
GPAVA

SEQ ID NO: 176531 - protein, 5 aa, Mycobacterium bovis
GPAVG

SEQ ID NO: 176532 - protein, 9 aa, Mycobacterium bovis
GPAYNTGSA

SEQ ID NO: 176533 - protein, 8 aa, Mycobacterium bovis
GPCGPSSE

SEQ ID NO: 176534 - protein, 4 aa, Mycobacterium bovis
GPCS

SEQ ID NO: 176535 - protein, 10 aa, Mycobacterium bovis
GPDASYVPGH

SEQ ID NO: 176536 - protein, 7 aa, Mycobacterium bovis
GPDDEIG

SEQ ID NO: 176537 - protein, 5 aa, Mycobacterium bovis
GPDDV

SEQ ID NO: 176538 - protein, 14 aa, Mycobacterium bovis
GPDETPPQGWEQDP

SEQ ID NO: 176539 - protein, 10 aa, Mycobacterium bovis
GPDGRGASAA

SEQ ID NO: 176540 - protein, 6 aa, Mycobacterium bovis
GPDGSG

SEQ ID NO: 176541 - protein, 8 aa, Mycobacterium bovis
GPDGTGVE

SEQ ID NO: 176542 - protein, 11 aa, Mycobacterium bovis
GPDGTPTAERR

SEQ ID NO: 176543 - protein, 5 aa, Mycobacterium bovis
GPDHS

SEQ ID NO: 176544 - protein, 4 aa, Mycobacterium bovis
GPDL

SEQ ID NO: 176545 - protein, 6 aa, Mycobacterium bovis
GPDLGG

SEQ ID NO: 176546 - protein, 15 aa, Mycobacterium bovis
GPDPLRSDANPSSAW

SEQ ID NO: 176547 - protein, 5 aa, Mycobacterium bovis
GPDRD

SEQ ID NO: 176548 - protein, 5 aa, Mycobacterium bovis
GPDRL

SEQ ID NO: 176549 - protein, 9 aa, Mycobacterium bovis
GPDSDAARR

SEQ ID NO: 176550 - protein, 9 aa, Mycobacterium bovis
GPDTEPLQT

SEQ ID NO: 176551 - protein, 5 aa, Mycobacterium bovis
GPDTR

SEQ ID NO: 176552 - protein, 9 aa, Mycobacterium bovis
GPDTTNLGE

SEQ ID NO: 176553 - protein, 9 aa, Mycobacterium bovis
GPDVPTLSQ

SEQ ID NO: 176554 - protein, 4 aa, Mycobacterium bovis
GPDY

SEQ ID NO: 176555 - protein, 13 aa, Mycobacterium bovis
GPEFGPAGGPIVS

SEQ ID NO: 176556 - protein, 8 aa, Mycobacterium bovis
GPEGPEQV

SEQ ID NO: 176557 - protein, 6 aa, Mycobacterium bovis
GPEGYR

SEQ ID NO: 176558 - protein, 20 aa, Mycobacterium bovis
GPEHPHSAQQPVPYELKQVA

SEQ ID NO: 176559 - protein, 4 aa, Mycobacterium bovis
GPEI

SEQ ID NO: 176560 - protein, 5 aa, Mycobacterium bovis
GPEIG

SEQ ID NO: 176561 - protein, 15 aa, Mycobacterium bovis
GPEKALGDAAHRPDE

SEQ ID NO: 176562 - protein, 6 aa, Mycobacterium bovis
GPELGP

SEQ ID NO: 176563 - protein, 19 aa, Mycobacterium bovis
GPEPDRSQTFACEASSHNQ

SEQ ID NO: 176564 - protein, 9 aa, Mycobacterium bovis
GPEPGADDA

SEQ ID NO: 176565 - protein, 15 aa, Mycobacterium bovis
GPEPHGAGLANSGFR

SEQ ID NO: 176566 - protein, 5 aa, Mycobacterium bovis
GPEPL

SEQ ID NO: 176567 - protein, 6 aa, Mycobacterium bovis
GPERGL

SEQ ID NO: 176568 - protein, 9 aa, Mycobacterium bovis
GPESSGKTT

SEQ ID NO: 176569 - protein, 5 aa, Mycobacterium bovis
GPEST

SEQ ID NO: 176570 - protein, 11 aa, Mycobacterium bovis
GPESTGKTTLA

SEQ ID NO: 176571 - protein, 9 aa, Mycobacterium bovis
GPESVDTAQ

SEQ ID NO: 176572 - protein, 6 aa, Mycobacterium bovis
GPFPKA

SEQ ID NO: 176573 - protein, 4 aa, Mycobacterium bovis
GPGA

SEQ ID NO: 176574 - protein, 8 aa, Mycobacterium bovis
GPGAAAPL

SEQ ID NO: 176575 - protein, 6 aa, Mycobacterium bovis
GPGAAV

SEQ ID NO: 176576 - protein, 5 aa, Mycobacterium bovis
GPGAE

SEQ ID NO: 176577 - protein, 6 aa, Mycobacterium bovis
GPGATN

SEQ ID NO: 176578 - protein, 6 aa, Mycobacterium bovis
GPGDDA

SEQ ID NO: 176579 - protein, 11 aa, Mycobacterium bovis
GPGDPALADPR

SEQ ID NO: 176580 - protein, 6 aa, Mycobacterium bovis
GPGDPE

SEQ ID NO: 176581 - protein, 8 aa, Mycobacterium bovis
GPGEAPEL

SEQ ID NO: 176582 - protein, 9 aa, Mycobacterium bovis
GPGEAREAD

SEQ ID NO: 176583 - protein, 7 aa, Mycobacterium bovis
GPGGKTA

SEQ ID NO: 176584 - protein, 5 aa, Mycobacterium bovis
GPGGY

SEQ ID NO: 176585 - protein, 8 aa, Mycobacterium bovis
GPGKADAV

SEQ ID NO: 176586 - protein, 9 aa, Mycobacterium bovis
GPGKGNAMG

SEQ ID NO: 176587 - protein, 4 aa, Mycobacterium bovis
GPGL

SEQ ID NO: 176588 - protein, 7 aa, Mycobacterium bovis
GPGLADP

SEQ ID NO: 176589 - protein, 7 aa, Mycobacterium bovis
GPGLDRA

SEQ ID NO: 176590 - protein, 6 aa, Mycobacterium bovis
GPGNRS

SEQ ID NO: 176591 - protein, 19 aa, Mycobacterium bovis
GPGPRSPESVDGWERVLTT

SEQ ID NO: 176592 - protein, 26 aa, Mycobacterium bovis
GPGQGWGYPQPRSGQRARRATGQGSG

SEQ ID NO: 176593 - protein, 7 aa, Mycobacterium bovis
GPGRADG

SEQ ID NO: 176594 - protein, 17 aa, Mycobacterium bovis
GPGREQTIVRRDVLQDR

SEQ ID NO: 176595 - protein, 9 aa, Mycobacterium bovis
GPGSGRETA

SEQ ID NO: 176596 - protein, 5 aa, Mycobacterium bovis
GPGSI

SEQ ID NO: 176597 - protein, 4 aa, Mycobacterium bovis
GPGT

SEQ ID NO: 176598 - protein, 8 aa, Mycobacterium bovis
GPGTGKST

SEQ ID NO: 176599 - protein, 11 aa, Mycobacterium bovis
GPGTRMRSDTP

SEQ ID NO: 176600 - protein, 6 aa, Mycobacterium bovis
GPGVTD

SEQ ID NO: 176601 - protein, 17 aa, Mycobacterium bovis
GPHGSKRSLPQQLRAMV

SEQ ID NO: 176602 - protein, 5 aa, Mycobacterium bovis
GPIAG

SEQ ID NO: 176603 - protein, 9 aa, Mycobacterium bovis
GPIAGSAKA

SEQ ID NO: 176604 - protein, 7 aa, Mycobacterium bovis
GPIASTG

SEQ ID NO: 176605 - protein, 4 aa, Mycobacterium bovis
GPIP

SEQ ID NO: 176606 - protein, 6 aa, Mycobacterium bovis
GPIQGG

SEQ ID NO: 176607 - protein, 5 aa, Mycobacterium bovis
GPISR

SEQ ID NO: 176608 - protein, 5 aa, Mycobacterium bovis
GPITS

SEQ ID NO: 176609 - protein, 6 aa, Mycobacterium bovis
GPKDQI

SEQ ID NO: 176610 - protein, 7 aa, Mycobacterium bovis
GPKEHAS

SEQ ID NO: 176611 - protein, 11 aa, Mycobacterium bovis
GPKGTDAQLRE

SEQ ID NO: 176612 - protein, 17 aa, Mycobacterium bovis
GPKNSGRTPELTHLQGI

SEQ ID NO: 176613 - protein, 13 aa, Mycobacterium bovis
GPKQGEDDGSTGG

SEQ ID NO: 176614 - protein, 8 aa, Mycobacterium bovis
GPKTGEQV

SEQ ID NO: 176615 - protein, 7 aa, Mycobacterium bovis
GPKTTKR

SEQ ID NO: 176616 - protein, 9 aa, Mycobacterium bovis
GPLKQSGAA

SEQ ID NO: 176617 - protein, 8 aa, Mycobacterium bovis
GPLPMPPS

SEQ ID NO: 176618 - protein, 10 aa, Mycobacterium bovis
GPLPSHPDED

SEQ ID NO: 176619 - protein, 7 aa, Mycobacterium bovis
GPLSEDD

SEQ ID NO: 176620 - protein, 4 aa, Mycobacterium bovis
GPLT

SEQ ID NO: 176621 - protein, 6 aa, Mycobacterium bovis
GPLTPA

SEQ ID NO: 176622 - protein, 5 aa, Mycobacterium bovis
GPNAV

SEQ ID NO: 176623 - protein, 4 aa, Mycobacterium bovis
GPND

SEQ ID NO: 176624 - protein, 9 aa, Mycobacterium bovis
GPNGAGKST

SEQ ID NO: 176625 - protein, 10 aa, Mycobacterium bovis
GPNGAGKSTT

SEQ ID NO: 176626 - protein, 9 aa, Mycobacterium bovis
GPNGAGKTT

SEQ ID NO: 176627 - protein, 10 aa, Mycobacterium bovis
GPNGSGKSTL

SEQ ID NO: 176628 - protein, 9 aa, Mycobacterium bovis
GPNHDGTPG

SEQ ID NO: 176629 - protein, 5 aa, Mycobacterium bovis
GPNLG

SEQ ID NO: 176630 - protein, 7 aa, Mycobacterium bovis
GPNRIGQ

SEQ ID NO: 176631 - protein, 8 aa, Mycobacterium bovis
GPNTPRGR

SEQ ID NO: 176632 - protein, 4 aa, Mycobacterium bovis
GPNV

SEQ ID NO: 176633 - protein, 4 aa, Mycobacterium bovis
GPPD

SEQ ID NO: 176634 - protein, 14 aa, Mycobacterium bovis
GPPESAQVQVGDGE

SEQ ID NO: 176635 - protein, 8 aa, Mycobacterium bovis
GPPGLGKT

SEQ ID NO: 176636 - protein, 9 aa, Mycobacterium bovis
GPPGSGKTT

SEQ ID NO: 176637 - protein, 8 aa, Mycobacterium bovis
GPPGSGRS

SEQ ID NO: 176638 - protein, 7 aa, Mycobacterium bovis
GPPGTAE

SEQ ID NO: 176639 - protein, 11 aa, Mycobacterium bovis
GPPGTGKTSVA

SEQ ID NO: 176640 - protein, 7 aa, Mycobacterium bovis
GPPGVGK

SEQ ID NO: 176641 - protein, 5 aa, Mycobacterium bovis
GPPHA

SEQ ID NO: 176642 - protein, 9 aa, Mycobacterium bovis
GPPLSQGEL

SEQ ID NO: 176643 - protein, 7 aa, Mycobacterium bovis
GPPLTRS

SEQ ID NO: 176644 - protein, 5 aa, Mycobacterium bovis
GPPPA

SEQ ID NO: 176645 - protein, 9 aa, Mycobacterium bovis
GPPPDSPRD

SEQ ID NO: 176646 - protein, 5 aa, Mycobacterium bovis
GPPPG

SEQ ID NO: 176647 - protein, 6 aa, Mycobacterium bovis
GPPREL

SEQ ID NO: 176648 - protein, 14 aa, Mycobacterium bovis
GPPRQLPADSPQGQ

SEQ ID NO: 176649 - protein, 74 aa, Mycobacterium bovis
GPPVESAPATAHQPQWATTPAAPAAAPHSTPGGVHSTESGPHGRSLSAHGSEPTHDGASHGSGHGSGSEPPGLH

SEQ ID NO: 176650 - protein, 4 aa, Mycobacterium bovis
GPQA

SEQ ID NO: 176651 - protein, 6 aa, Mycobacterium bovis
GPQAED

SEQ ID NO: 176652 - protein, 5 aa, Mycobacterium bovis
GPQAR

SEQ ID NO: 176653 - protein, 6 aa, Mycobacterium bovis
GPQETV

SEQ ID NO: 176654 - protein, 5 aa, Mycobacterium bovis
GPQGT

SEQ ID NO: 176655 - protein, 4 aa, Mycobacterium bovis
GPQR

SEQ ID NO: 176656 - protein, 5 aa, Mycobacterium bovis
GPRAA

SEQ ID NO: 176657 - protein, 7 aa, Mycobacterium bovis
GPRAEQR

SEQ ID NO: 176658 - protein, 5 aa, Mycobacterium bovis
GPRAF

SEQ ID NO: 176659 - protein, 21 aa, Mycobacterium bovis
GPRASPSVAGGGAVGGVQTPQ

SEQ ID NO: 176660 - protein, 6 aa, Mycobacterium bovis
GPRDAD

SEQ ID NO: 176661 - protein, 5 aa, Mycobacterium bovis
GPRDR

SEQ ID NO: 176662 - protein, 6 aa, Mycobacterium bovis
GPREQA

SEQ ID NO: 176663 - protein, 11 aa, Mycobacterium bovis
GPRGPGNGGAR

SEQ ID NO: 176664 - protein, 9 aa, Mycobacterium bovis
GPRGQGLPK

SEQ ID NO: 176665 - protein, 5 aa, Mycobacterium bovis
GPRHE

SEQ ID NO: 176666 - protein, 11 aa, Mycobacterium bovis
GPRHTAPATPG

SEQ ID NO: 176667 - protein, 17 aa, Mycobacterium bovis
GPRHTRGTPPNVVQTDP

SEQ ID NO: 176668 - protein, 5 aa, Mycobacterium bovis
GPRKT

SEQ ID NO: 176669 - protein, 7 aa, Mycobacterium bovis
GPRKVGD

SEQ ID NO: 176670 - protein, 4 aa, Mycobacterium bovis
GPRL

SEQ ID NO: 176671 - protein, 7 aa, Mycobacterium bovis
GPRLSGS

SEQ ID NO: 176672 - protein, 6 aa, Mycobacterium bovis
GPRPDQ

SEQ ID NO: 176673 - protein, 8 aa, Mycobacterium bovis
GPRPKEPV

SEQ ID NO: 176674 - protein, 17 aa, Mycobacterium bovis
GPRPTATPTPLIPTAES

SEQ ID NO: 176675 - protein, 6 aa, Mycobacterium bovis
GPRPTE

SEQ ID NO: 176676 - protein, 9 aa, Mycobacterium bovis
GPRQAGKTT

SEQ ID NO: 176677 - protein, 10 aa, Mycobacterium bovis
GPRQAGKTTL

SEQ ID NO: 176678 - protein, 5 aa, Mycobacterium bovis
GPRRK

SEQ ID NO: 176679 - protein, 6 aa, Mycobacterium bovis
GPRTMD

SEQ ID NO: 176680 - protein, 11 aa, Mycobacterium bovis
GPRTSGTAAER

SEQ ID NO: 176681 - protein, 12 aa, Mycobacterium bovis
GPRTYSEQRGHP

SEQ ID NO: 176682 - protein, 27 aa, Mycobacterium bovis
GPRWPDVSGNSQATGTRAVTTGAPRPA

SEQ ID NO: 176683 - protein, 8 aa, Mycobacterium bovis
GPSAVGKS

SEQ ID NO: 176684 - protein, 9 aa, Mycobacterium bovis
GPSDATGIP

SEQ ID NO: 176685 - protein, 7 aa, Mycobacterium bovis
GPSDTWS

SEQ ID NO: 176686 - protein, 4 aa, Mycobacterium bovis
GPSG

SEQ ID NO: 176687 - protein, 11 aa, Mycobacterium bovis
GPSGAGKSTTQ

SEQ ID NO: 176688 - protein, 8 aa, Mycobacterium bovis
GPSGCGKT

SEQ ID NO: 176689 - protein, 8 aa, Mycobacterium bovis
GPSGDIEE

SEQ ID NO: 176690 - protein, 12 aa, Mycobacterium bovis
GPSGDQPLDAGT

SEQ ID NO: 176691 - protein, 5 aa, Mycobacterium bovis
GPSGG

SEQ ID NO: 176692 - protein, 9 aa, Mycobacterium bovis
GPSGGGKTT

SEQ ID NO: 176693 - protein, 11 aa, Mycobacterium bovis
GPSGKRPGAIA

SEQ ID NO: 176694 - protein, 6 aa, Mycobacterium bovis
GPSGNY

SEQ ID NO: 176695 - protein, 9 aa, Mycobacterium bovis
GPSGSGKTT

SEQ ID NO: 176696 - protein, 8 aa, Mycobacterium bovis
GPSGTGKS

SEQ ID NO: 176697 - protein, 5 aa, Mycobacterium bovis
GPSPA

SEQ ID NO: 176698 - protein, 8 aa, Mycobacterium bovis
GPSPGGLR

SEQ ID NO: 176699 - protein, 7 aa, Mycobacterium bovis
GPSPLRA

SEQ ID NO: 176700 - protein, 7 aa, Mycobacterium bovis
GPSPSEV

SEQ ID NO: 176701 - protein, 4 aa, Mycobacterium bovis
GPSR

SEQ ID NO: 176702 - protein, 8 aa, Mycobacterium bovis
GPSRATGL

SEQ ID NO: 176703 - protein, 6 aa, Mycobacterium bovis
GPSSAA

SEQ ID NO: 176704 - protein, 10 aa, Mycobacterium bovis
GPSSAGGDTI

SEQ ID NO: 176705 - protein, 11 aa, Mycobacterium bovis
GPSSSHTVGPM

SEQ ID NO: 176706 - protein, 6 aa, Mycobacterium bovis
GPSWED

SEQ ID NO: 176707 - protein, 8 aa, Mycobacterium bovis
GPSYTRPA

SEQ ID NO: 176708 - protein, 6 aa, Mycobacterium bovis
GPTAAR

SEQ ID NO: 176709 - protein, 5 aa, Mycobacterium bovis
GPTDG

SEQ ID NO: 176710 - protein, 7 aa, Mycobacterium bovis
GPTEAIN

SEQ ID NO: 176711 - protein, 5 aa, Mycobacterium bovis
GPTEP

SEQ ID NO: 176712 - protein, 6 aa, Mycobacterium bovis
GPTETT

SEQ ID NO: 176713 - protein, 7 aa, Mycobacterium bovis
GPTETTV

SEQ ID NO: 176714 - protein, 4 aa, Mycobacterium bovis
GPTG

SEQ ID NO: 176715 - protein, 6 aa, Mycobacterium bovis
GPTGFI

SEQ ID NO: 176716 - protein, 7 aa, Mycobacterium bovis
GPTGGLG

SEQ ID NO: 176717 - protein, 11 aa, Mycobacterium bovis
GPTGGLPADDP

SEQ ID NO: 176718 - protein, 13 aa, Mycobacterium bovis
GPTGLSSEVPAPD

SEQ ID NO: 176719 - protein, 9 aa, Mycobacterium bovis
GPTGNQRDE

SEQ ID NO: 176720 - protein, 9 aa, Mycobacterium bovis
GPTGRAAAL

SEQ ID NO: 176721 - protein, 11 aa, Mycobacterium bovis
GPTKDAQGTRR

SEQ ID NO: 176722 - protein, 5 aa, Mycobacterium bovis
GPTLD

SEQ ID NO: 176723 - protein, 10 aa, Mycobacterium bovis
GPTLDQPGAG

SEQ ID NO: 176724 - protein, 6 aa, Mycobacterium bovis
GPTLGR

SEQ ID NO: 176725 - protein, 8 aa, Mycobacterium bovis
GPTPATRK

SEQ ID NO: 176726 - protein, 4 aa, Mycobacterium bovis
GPTT

SEQ ID NO: 176727 - protein, 5 aa, Mycobacterium bovis
GPTTV

SEQ ID NO: 176728 - protein, 4 aa, Mycobacterium bovis
GPTV

SEQ ID NO: 176729 - protein, 15 aa, Mycobacterium bovis
GPTVAGSDGEQADAI

SEQ ID NO: 176730 - protein, 4 aa, Mycobacterium bovis
GPVA

SEQ ID NO: 176731 - protein, 9 aa, Mycobacterium bovis
GPVDDDAEV

SEQ ID NO: 176732 - protein, 7 aa, Mycobacterium bovis
GPVEPGP

SEQ ID NO: 176733 - protein, 15 aa, Mycobacterium bovis
GPVGQNVADRARAGG

SEQ ID NO: 176734 - protein, 4 aa, Mycobacterium bovis
GPVN

SEQ ID NO: 176735 - protein, 4 aa, Mycobacterium bovis
GPVP

SEQ ID NO: 176736 - protein, 6 aa, Mycobacterium bovis
GPVPDI

SEQ ID NO: 176737 - protein, 11 aa, Mycobacterium bovis
GPVRGANDQRW

SEQ ID NO: 176738 - protein, 14 aa, Mycobacterium bovis
GPVRNPNLDSAPKK

SEQ ID NO: 176739 - protein, 14 aa, Mycobacterium bovis
GPVRTELPDASEAS

SEQ ID NO: 176740 - protein, 6 aa, Mycobacterium bovis
GPVSTE

SEQ ID NO: 176741 - protein, 6 aa, Mycobacterium bovis
GPVTGG

SEQ ID NO: 176742 - protein, 4 aa, Mycobacterium bovis
GPWG

SEQ ID NO: 176743 - protein, 13 aa, Mycobacterium bovis
GPYDDAPTAPGSA

SEQ ID NO: 176744 - protein, 5 aa, Mycobacterium bovis
GPYGY

SEQ ID NO: 176745 - protein, 4 aa, Mycobacterium bovis
GQAA

SEQ ID NO: 176746 - protein, 5 aa, Mycobacterium bovis
GQAAE

SEQ ID NO: 176747 - protein, 11 aa, Mycobacterium bovis
GQAAKLAPTSI

SEQ ID NO: 176748 - protein, 12 aa, Mycobacterium bovis
GQAAYSASKGGV

SEQ ID NO: 176749 - protein, 7 aa, Mycobacterium bovis
GQAFSAA

SEQ ID NO: 176750 - protein, 8 aa, Mycobacterium bovis
GQAGPDTL

SEQ ID NO: 176751 - protein, 7 aa, Mycobacterium bovis
GQAGRLP

SEQ ID NO: 176752 - protein, 10 aa, Mycobacterium bovis
GQAHGGGPRV

SEQ ID NO: 176753 - protein, 11 aa, Mycobacterium bovis
GQAKGKDSGIT

SEQ ID NO: 176754 - protein, 14 aa, Mycobacterium bovis
GQAKRTENGSEGAN

SEQ ID NO: 176755 - protein, 4 aa, Mycobacterium bovis
GQAP

SEQ ID NO: 176756 - protein, 10 aa, Mycobacterium bovis
GQAPDASGYW

SEQ ID NO: 176757 - protein, 10 aa, Mycobacterium bovis
GQAPPLGAEG

SEQ ID NO: 176758 - protein, 6 aa, Mycobacterium bovis
GQAQLT

SEQ ID NO: 176759 - protein, 9 aa, Mycobacterium bovis
GQATGRQVA

SEQ ID NO: 176760 - protein, 7 aa, Mycobacterium bovis
GQAWQGP

SEQ ID NO: 176761 - protein, 5 aa, Mycobacterium bovis
GQDAE

SEQ ID NO: 176762 - protein, 4 aa, Mycobacterium bovis
GQDC

SEQ ID NO: 176763 - protein, 6 aa, Mycobacterium bovis
GQDDAS

SEQ ID NO: 176764 - protein, 4 aa, Mycobacterium bovis
GQDG

SEQ ID NO: 176765 - protein, 10 aa, Mycobacterium bovis
GQDGHDRGQK

SEQ ID NO: 176766 - protein, 9 aa, Mycobacterium bovis
GQDGSYSDE

SEQ ID NO: 176767 - protein, 4 aa, Mycobacterium bovis
GQDL

SEQ ID NO: 176768 - protein, 6 aa, Mycobacterium bovis
GQDPEL

SEQ ID NO: 176769 - protein, 10 aa, Mycobacterium bovis
GQDPKLAPAP

SEQ ID NO: 176770 - protein, 5 aa, Mycobacterium bovis
GQDYQ

SEQ ID NO: 176771 - protein, 10 aa, Mycobacterium bovis
GQEARAAEEE

SEQ ID NO: 176772 - protein, 13 aa, Mycobacterium bovis
GQEATPEPPSALN

SEQ ID NO: 176773 - protein, 4 aa, Mycobacterium bovis
GQEG

SEQ ID NO: 176774 - protein, 6 aa, Mycobacterium bovis
GQERPF

SEQ ID NO: 176775 - protein, 7 aa, Mycobacterium bovis
GQESMTK

SEQ ID NO: 176776 - protein, 4 aa, Mycobacterium bovis
GQGA

SEQ ID NO: 176777 - protein, 7 aa, Mycobacterium bovis
GQGAQRI

SEQ ID NO: 176778 - protein, 5 aa, Mycobacterium bovis
GQGAV

SEQ ID NO: 176779 - protein, 14 aa, Mycobacterium bovis
GQGEAGLRGAPSGD

SEQ ID NO: 176780 - protein, 5 aa, Mycobacterium bovis
GQGGE

SEQ ID NO: 176781 - protein, 8 aa, Mycobacterium bovis
GQGGLTRN

SEQ ID NO: 176782 - protein, 5 aa, Mycobacterium bovis
GQGGV

SEQ ID NO: 176783 - protein, 5 aa, Mycobacterium bovis
GQGIP

SEQ ID NO: 176784 - protein, 10 aa, Mycobacterium bovis
GQGNCDSAPS

SEQ ID NO: 176785 - protein, 7 aa, Mycobacterium bovis
GQGSQWA

SEQ ID NO: 176786 - protein, 9 aa, Mycobacterium bovis
GQGSSRPPR

SEQ ID NO: 176787 - protein, 6 aa, Mycobacterium bovis
GQHAPG

SEQ ID NO: 176788 - protein, 5 aa, Mycobacterium bovis
GQHEA

SEQ ID NO: 176789 - protein, 10 aa, Mycobacterium bovis
GQHESSDDES

SEQ ID NO: 176790 - protein, 8 aa, Mycobacterium bovis
GQHGTTTG

SEQ ID NO: 176791 - protein, 4 aa, Mycobacterium bovis
GQHL

SEQ ID NO: 176792 - protein, 5 aa, Mycobacterium bovis
GQHNG

SEQ ID NO: 176793 - protein, 6 aa, Mycobacterium bovis
GQHPGS

SEQ ID NO: 176794 - protein, 7 aa, Mycobacterium bovis
GQIAGDS

SEQ ID NO: 176795 - protein, 4 aa, Mycobacterium bovis
GQIE

SEQ ID NO: 176796 - protein, 10 aa, Mycobacterium bovis
GQIGDGREAA

SEQ ID NO: 176797 - protein, 10 aa, Mycobacterium bovis
GQKPEVRRAR

SEQ ID NO: 176798 - protein, 11 aa, Mycobacterium bovis
GQLAGAGYGSP

SEQ ID NO: 176799 - protein, 10 aa, Mycobacterium bovis
GQLAGDDFGS

SEQ ID NO: 176800 - protein, 6 aa, Mycobacterium bovis
GQLDGP

SEQ ID NO: 176801 - protein, 8 aa, Mycobacterium bovis
GQLDPEYQ

SEQ ID NO: 176802 - protein, 10 aa, Mycobacterium bovis
GQLGGAENAT

SEQ ID NO: 176803 - protein, 6 aa, Mycobacterium bovis
GQLPAQ

SEQ ID NO: 176804 - protein, 18 aa, Mycobacterium bovis
GQLPSASADVAAASAGTH

SEQ ID NO: 176805 - protein, 11 aa, Mycobacterium bovis
GQLPTGKGWED

SEQ ID NO: 176806 - protein, 11 aa, Mycobacterium bovis
GQMAGAGYGDG

SEQ ID NO: 176807 - protein, 6 aa, Mycobacterium bovis
GQMGSG

SEQ ID NO: 176808 - protein, 19 aa, Mycobacterium bovis
GQMSASAGPVSGRMDPSPV

SEQ ID NO: 176809 - protein, 6 aa, Mycobacterium bovis
GQNAHT

SEQ ID NO: 176810 - protein, 10 aa, Mycobacterium bovis
GQNPSTKSAR

SEQ ID NO: 176811 - protein, 7 aa, Mycobacterium bovis
GQNTPAI

SEQ ID NO: 176812 - protein, 14 aa, Mycobacterium bovis
GQNTPAIATSEAQY

SEQ ID NO: 176813 - protein, 4 aa, Mycobacterium bovis
GQPA

SEQ ID NO: 176814 - protein, 5 aa, Mycobacterium bovis
GQPAE

SEQ ID NO: 176815 - protein, 9 aa, Mycobacterium bovis
GQPAGSAEL

SEQ ID NO: 176816 - protein, 5 aa, Mycobacterium bovis
GQPAS

SEQ ID NO: 176817 - protein, 6 aa, Mycobacterium bovis
GQPATE

SEQ ID NO: 176818 - protein, 14 aa, Mycobacterium bovis
GQPGQPGPPGQPGP

SEQ ID NO: 176819 - protein, 16 aa, Mycobacterium bovis
GQPIDGRGDVDSDTRR

SEQ ID NO: 176820 - protein, 5 aa, Mycobacterium bovis
GQPIS

SEQ ID NO: 176821 - protein, 12 aa, Mycobacterium bovis
GQPRRAARKAGY

SEQ ID NO: 176822 - protein, 7 aa, Mycobacterium bovis
GQPTDQE

SEQ ID NO: 176823 - protein, 6 aa, Mycobacterium bovis
GQPTEL

SEQ ID NO: 176824 - protein, 9 aa, Mycobacterium bovis
GQPVADTSL

SEQ ID NO: 176825 - protein, 5 aa, Mycobacterium bovis
GQPVR

SEQ ID NO: 176826 - protein, 13 aa, Mycobacterium bovis
GQPWQKGRQVSAA

SEQ ID NO: 176827 - protein, 15 aa, Mycobacterium bovis
GQPWTPASRSALAGP

SEQ ID NO: 176828 - protein, 5 aa, Mycobacterium bovis
GQQDS

SEQ ID NO: 176829 - protein, 10 aa, Mycobacterium bovis
GQQGDGSARL

SEQ ID NO: 176830 - protein, 7 aa, Mycobacterium bovis
GQQPDKL

SEQ ID NO: 176831 - protein, 9 aa, Mycobacterium bovis
GQQPRADSL

SEQ ID NO: 176832 - protein, 7 aa, Mycobacterium bovis
GQQQAQA

SEQ ID NO: 176833 - protein, 5 aa, Mycobacterium bovis
GQQRT

SEQ ID NO: 176834 - protein, 7 aa, Mycobacterium bovis
GQQTVTT

SEQ ID NO: 176835 - protein, 6 aa, Mycobacterium bovis
GQQTYE

SEQ ID NO: 176836 - protein, 4 aa, Mycobacterium bovis
GQQV

SEQ ID NO: 176837 - protein, 17 aa, Mycobacterium bovis
GQRAVSAAAAAAPGGAY

SEQ ID NO: 176838 - protein, 18 aa, Mycobacterium bovis
GQRCGGTAGHLRTSGPHL

SEQ ID NO: 176839 - protein, 6 aa, Mycobacterium bovis
GQRERI

SEQ ID NO: 176840 - protein, 7 aa, Mycobacterium bovis
GQRKPLA

SEQ ID NO: 176841 - protein, 7 aa, Mycobacterium bovis
GQRNKYE

SEQ ID NO: 176842 - protein, 8 aa, Mycobacterium bovis
GQRPGQAA

SEQ ID NO: 176843 - protein, 6 aa, Mycobacterium bovis
GQRPIR

SEQ ID NO: 176844 - protein, 4 aa, Mycobacterium bovis
GQRS

SEQ ID NO: 176845 - protein, 9 aa, Mycobacterium bovis
GQRTPRKNE

SEQ ID NO: 176846 - protein, 9 aa, Mycobacterium bovis
GQSAAAARD

SEQ ID NO: 176847 - protein, 4 aa, Mycobacterium bovis
GQSE

SEQ ID NO: 176848 - protein, 5 aa, Mycobacterium bovis
GQSEA

SEQ ID NO: 176849 - protein, 9 aa, Mycobacterium bovis
GQSEGEPIG

SEQ ID NO: 176850 - protein, 7 aa, Mycobacterium bovis
GQSERGL

SEQ ID NO: 176851 - protein, 5 aa, Mycobacterium bovis
GQSGA

SEQ ID NO: 176852 - protein, 6 aa, Mycobacterium bovis
GQSLTP

SEQ ID NO: 176853 - protein, 4 aa, Mycobacterium bovis
GQSQ

SEQ ID NO: 176854 - protein, 11 aa, Mycobacterium bovis
GQSQPSPGGPF

SEQ ID NO: 176855 - protein, 18 aa, Mycobacterium bovis
GQSRERMRKRGGGPGPAI

SEQ ID NO: 176856 - protein, 16 aa, Mycobacterium bovis
GQTATTQALPDNSDGI

SEQ ID NO: 176857 - protein, 6 aa, Mycobacterium bovis
GQTDTA

SEQ ID NO: 176858 - protein, 9 aa, Mycobacterium bovis
GQTGKTVSP

SEQ ID NO: 176859 - protein, 4 aa, Mycobacterium bovis
GQTH

SEQ ID NO: 176860 - protein, 7 aa, Mycobacterium bovis
GQTHRSA

SEQ ID NO: 176861 - protein, 5 aa, Mycobacterium bovis
GQTKY

SEQ ID NO: 176862 - protein, 7 aa, Mycobacterium bovis
GQTPGNA

SEQ ID NO: 176863 - protein, 5 aa, Mycobacterium bovis
GQTPL

SEQ ID NO: 176864 - protein, 15 aa, Mycobacterium bovis
GQTPLGVETDRDIAQ

SEQ ID NO: 176865 - protein, 18 aa, Mycobacterium bovis
GQTPRSQPRELGAPWGTS

SEQ ID NO: 176866 - protein, 7 aa, Mycobacterium bovis
GQTTMTV

SEQ ID NO: 176867 - protein, 12 aa, Mycobacterium bovis
GQTTSTEDAEGQ

SEQ ID NO: 176868 - protein, 7 aa, Mycobacterium bovis
GQVDDEE

SEQ ID NO: 176869 - protein, 13 aa, Mycobacterium bovis
GQVLPNDGNAVGE

SEQ ID NO: 176870 - protein, 6 aa, Mycobacterium bovis
GQVRNR

SEQ ID NO: 176871 - protein, 5 aa, Mycobacterium bovis
GQYPR

SEQ ID NO: 176872 - protein, 20 aa, Mycobacterium bovis
GQYSPTSEVGKVTKSTPMGS

SEQ ID NO: 176873 - protein, 6 aa, Mycobacterium bovis
GRAAAA

SEQ ID NO: 176874 - protein, 6 aa, Mycobacterium bovis
GRAAEA

SEQ ID NO: 176875 - protein, 12 aa, Mycobacterium bovis
GRAAGRGAAEDI

SEQ ID NO: 176876 - protein, 14 aa, Mycobacterium bovis
GRADAGAPSVPRDH

SEQ ID NO: 176877 - protein, 10 aa, Mycobacterium bovis
GRADVSGLGA

SEQ ID NO: 176878 - protein, 9 aa, Mycobacterium bovis
GRAESAMES

SEQ ID NO: 176879 - protein, 8 aa, Mycobacterium bovis
GRAGGHHS

SEQ ID NO: 176880 - protein, 6 aa, Mycobacterium bovis
GRAGQL

SEQ ID NO: 176881 - protein, 10 aa, Mycobacterium bovis
GRAGVSATPR

SEQ ID NO: 176882 - protein, 5 aa, Mycobacterium bovis
GRALA

SEQ ID NO: 176883 - protein, 8 aa, Mycobacterium bovis
GRALDDPH

SEQ ID NO: 176884 - protein, 8 aa, Mycobacterium bovis
GRALRDDG

SEQ ID NO: 176885 - protein, 7 aa, Mycobacterium bovis
GRANSIG

SEQ ID NO: 176886 - protein, 4 aa, Mycobacterium bovis
GRAP

SEQ ID NO: 176887 - protein, 15 aa, Mycobacterium bovis
GRAPRPAHRCPARRH

SEQ ID NO: 176888 - protein, 8 aa, Mycobacterium bovis
GRARTRAS

SEQ ID NO: 176889 - protein, 18 aa, Mycobacterium bovis
GRATAGPDPLGRSRTAAA

SEQ ID NO: 176890 - protein, 8 aa, Mycobacterium bovis
GRCDQGEH

SEQ ID NO: 176891 - protein, 12 aa, Mycobacterium bovis
GRDAVSDFPADR

SEQ ID NO: 176892 - protein, 11 aa, Mycobacterium bovis
GRDEATETARR

SEQ ID NO: 176893 - protein, 5 aa, Mycobacterium bovis
GRDED

SEQ ID NO: 176894 - protein, 4 aa, Mycobacterium bovis
GRDG

SEQ ID NO: 176895 - protein, 19 aa, Mycobacterium bovis
GRDGAAGLDAGQAFADSGF

SEQ ID NO: 176896 - protein, 6 aa, Mycobacterium bovis
GRDGDD

SEQ ID NO: 176897 - protein, 34 aa, Mycobacterium bovis
GRDGGPGGNGGAGGQLYGNGGDGGPGGQGGQAFG

SEQ ID NO: 176898 - protein, 7 aa, Mycobacterium bovis
GRDGWVG

SEQ ID NO: 176899 - protein, 15 aa, Mycobacterium bovis
GRDPEQSFSATDLMR

SEQ ID NO: 176900 - protein, 9 aa, Mycobacterium bovis
GRDPTPPAA

SEQ ID NO: 176901 - protein, 13 aa, Mycobacterium bovis
GRDPYHPSQRQQR

SEQ ID NO: 176902 - protein, 6 aa, Mycobacterium bovis
GRDPYP

SEQ ID NO: 176903 - protein, 8 aa, Mycobacterium bovis
GRDRASDD

SEQ ID NO: 176904 - protein, 11 aa, Mycobacterium bovis
GRDSNDGIPPG

SEQ ID NO: 176905 - protein, 9 aa, Mycobacterium bovis
GRDTAARAR

SEQ ID NO: 176906 - protein, 4 aa, Mycobacterium bovis
GREA

SEQ ID NO: 176907 - protein, 6 aa, Mycobacterium bovis
GREAAA

SEQ ID NO: 176908 - protein, 8 aa, Mycobacterium bovis
GREANADR

SEQ ID NO: 176909 - protein, 13 aa, Mycobacterium bovis
GREARARTRMKEG

SEQ ID NO: 176910 - protein, 9 aa, Mycobacterium bovis
GREATGSID

SEQ ID NO: 176911 - protein, 9 aa, Mycobacterium bovis
GREDESAVG

SEQ ID NO: 176912 - protein, 7 aa, Mycobacterium bovis
GREEFDT

SEQ ID NO: 176913 - protein, 10 aa, Mycobacterium bovis
GREGGSAPTA

SEQ ID NO: 176914 - protein, 4 aa, Mycobacterium bovis
GREI

SEQ ID NO: 176915 - protein, 4 aa, Mycobacterium bovis
GREL

SEQ ID NO: 176916 - protein, 9 aa, Mycobacterium bovis
GREPTPEEL

SEQ ID NO: 176917 - protein, 5 aa, Mycobacterium bovis
GREQT

SEQ ID NO: 176918 - protein, 9 aa, Mycobacterium bovis
GRETQPHIP

SEQ ID NO: 176919 - protein, 10 aa, Mycobacterium bovis
GREVEATGSH

SEQ ID NO: 176920 - protein, 11 aa, Mycobacterium bovis
GREVGGGDTRC

SEQ ID NO: 176921 - protein, 5 aa, Mycobacterium bovis
GRFEQ

SEQ ID NO: 176922 - protein, 22 aa, Mycobacterium bovis
GRGAQEGRTAFSAPGGGTRVGE

SEQ ID NO: 176923 - protein, 6 aa, Mycobacterium bovis
GRGDGG

SEQ ID NO: 176924 - protein, 12 aa, Mycobacterium bovis
GRGDKEGGDGAA

SEQ ID NO: 176925 - protein, 4 aa, Mycobacterium bovis
GRGE

SEQ ID NO: 176926 - protein, 5 aa, Mycobacterium bovis
GRGFN

SEQ ID NO: 176927 - protein, 4 aa, Mycobacterium bovis
GRGG

SEQ ID NO: 176928 - protein, 6 aa, Mycobacterium bovis
GRGGGF

SEQ ID NO: 176929 - protein, 5 aa, Mycobacterium bovis
GRGGL

SEQ ID NO: 176930 - protein, 22 aa, Mycobacterium bovis
GRGGRNAHGRITTRHKGGGHKR

SEQ ID NO: 176931 - protein, 9 aa, Mycobacterium bovis
GRGGRTATA

SEQ ID NO: 176932 - protein, 13 aa, Mycobacterium bovis
GRGHGPVSPLFRL

SEQ ID NO: 176933 - protein, 4 aa, Mycobacterium bovis
GRGK

SEQ ID NO: 176934 - protein, 5 aa, Mycobacterium bovis
GRGLG

SEQ ID NO: 176935 - protein, 12 aa, Mycobacterium bovis
GRGPDGSLPPNN

SEQ ID NO: 176936 - protein, 5 aa, Mycobacterium bovis
GRGPL

SEQ ID NO: 176937 - protein, 17 aa, Mycobacterium bovis
GRGPQTGKARGDTTGAH

SEQ ID NO: 176938 - protein, 9 aa, Mycobacterium bovis
GRGRADDTD

SEQ ID NO: 176939 - protein, 7 aa, Mycobacterium bovis
GRGREAD

SEQ ID NO: 176940 - protein, 8 aa, Mycobacterium bovis
GRGRPAKR

SEQ ID NO: 176941 - protein, 13 aa, Mycobacterium bovis
GRGRRFSSATKES

SEQ ID NO: 176942 - protein, 8 aa, Mycobacterium bovis
GRGSAANS

SEQ ID NO: 176943 - protein, 16 aa, Mycobacterium bovis
GRGSPQGLAASKALTT

SEQ ID NO: 176944 - protein, 12 aa, Mycobacterium bovis
GRGTADDKAGIA

SEQ ID NO: 176945 - protein, 8 aa, Mycobacterium bovis
GRGTETAD

SEQ ID NO: 176946 - protein, 9 aa, Mycobacterium bovis
GRGVGSAEN

SEQ ID NO: 176947 - protein, 17 aa, Mycobacterium bovis
GRGYETAESLAARGERA

SEQ ID NO: 176948 - protein, 15 aa, Mycobacterium bovis
GRHDPSGFADWSTLA

SEQ ID NO: 176949 - protein, 5 aa, Mycobacterium bovis
GRHGE

SEQ ID NO: 176950 - protein, 7 aa, Mycobacterium bovis
GRIAPGY

SEQ ID NO: 176951 - protein, 5 aa, Mycobacterium bovis
GRIDE

SEQ ID NO: 176952 - protein, 22 aa, Mycobacterium bovis
GRIDKSTAELADERSAVTELGL

SEQ ID NO: 176953 - protein, 8 aa, Mycobacterium bovis
GRIGPGKA

SEQ ID NO: 176954 - protein, 15 aa, Mycobacterium bovis
GRIQQAEHKPEGTRI

SEQ ID NO: 176955 - protein, 11 aa, Mycobacterium bovis
GRISGVTEPGE

SEQ ID NO: 176956 - protein, 6 aa, Mycobacterium bovis
GRKGVS

SEQ ID NO: 176957 - protein, 7 aa, Mycobacterium bovis
GRKMTTD

SEQ ID NO: 176958 - protein, 13 aa, Mycobacterium bovis
GRKTGQPRRTAVG

SEQ ID NO: 176959 - protein, 12 aa, Mycobacterium bovis
GRKTVSIVGSTT

SEQ ID NO: 176960 - protein, 4 aa, Mycobacterium bovis
GRLE

SEQ ID NO: 176961 - protein, 10 aa, Mycobacterium bovis
GRLEGKSSLG

SEQ ID NO: 176962 - protein, 6 aa, Mycobacterium bovis
GRLGTR

SEQ ID NO: 176963 - protein, 11 aa, Mycobacterium bovis
GRLNPERITES

SEQ ID NO: 176964 - protein, 6 aa, Mycobacterium bovis
GRLPGL

SEQ ID NO: 176965 - protein, 6 aa, Mycobacterium bovis
GRLPST

SEQ ID NO: 176966 - protein, 7 aa, Mycobacterium bovis
GRNAPTV

SEQ ID NO: 176967 - protein, 9 aa, Mycobacterium bovis
GRNDSDAEV

SEQ ID NO: 176968 - protein, 8 aa, Mycobacterium bovis
GRNGESPV

SEQ ID NO: 176969 - protein, 8 aa, Mycobacterium bovis
GRNLNDAV

SEQ ID NO: 176970 - protein, 8 aa, Mycobacterium bovis
GRNPTGVA

SEQ ID NO: 176971 - protein, 7 aa, Mycobacterium bovis
GRNQRRS

SEQ ID NO: 176972 - protein, 10 aa, Mycobacterium bovis
GRNRDDVEEA

SEQ ID NO: 176973 - protein, 9 aa, Mycobacterium bovis
GRNTSGKDR

SEQ ID NO: 176974 - protein, 6 aa, Mycobacterium bovis
GRPAEA

SEQ ID NO: 176975 - protein, 7 aa, Mycobacterium bovis
GRPAETA

SEQ ID NO: 176976 - protein, 6 aa, Mycobacterium bovis
GRPARK

SEQ ID NO: 176977 - protein, 13 aa, Mycobacterium bovis
GRPATRKRWPNGV

SEQ ID NO: 176978 - protein, 7 aa, Mycobacterium bovis
GRPDPTQ

SEQ ID NO: 176979 - protein, 7 aa, Mycobacterium bovis
GRPDRTL

SEQ ID NO: 176980 - protein, 15 aa, Mycobacterium bovis
GRPDVDDLGTSYGEA

SEQ ID NO: 176981 - protein, 4 aa, Mycobacterium bovis
GRPE

SEQ ID NO: 176982 - protein, 5 aa, Mycobacterium bovis
GRPEE

SEQ ID NO: 176983 - protein, 7 aa, Mycobacterium bovis
GRPEELR

SEQ ID NO: 176984 - protein, 7 aa, Mycobacterium bovis
GRPEETR

SEQ ID NO: 176985 - protein, 6 aa, Mycobacterium bovis
GRPETY

SEQ ID NO: 176986 - protein, 5 aa, Mycobacterium bovis
GRPGP

SEQ ID NO: 176987 - protein, 5 aa, Mycobacterium bovis
GRPGV

SEQ ID NO: 176988 - protein, 11 aa, Mycobacterium bovis
GRPKDGPDPTL

SEQ ID NO: 176989 - protein, 4 aa, Mycobacterium bovis
GRPL

SEQ ID NO: 176990 - protein, 7 aa, Mycobacterium bovis
GRPLTGV

SEQ ID NO: 176991 - protein, 7 aa, Mycobacterium bovis
GRPNPLA

SEQ ID NO: 176992 - protein, 10 aa, Mycobacterium bovis
GRPNRSPTDA

SEQ ID NO: 176993 - protein, 10 aa, Mycobacterium bovis
GRPPADAPTR

SEQ ID NO: 176994 - protein, 14 aa, Mycobacterium bovis
GRPPADSPTKAAQT

SEQ ID NO: 176995 - protein, 5 aa, Mycobacterium bovis
GRPPC

SEQ ID NO: 176996 - protein, 10 aa, Mycobacterium bovis
GRPPGRKDPA

SEQ ID NO: 176997 - protein, 5 aa, Mycobacterium bovis
GRPPL

SEQ ID NO: 176998 - protein, 5 aa, Mycobacterium bovis
GRPPR

SEQ ID NO: 176999 - protein, 5 aa, Mycobacterium bovis
GRPPV

SEQ ID NO: 177000 - protein, 5 aa, Mycobacterium bovis
GRPQR

SEQ ID NO: 177001 - protein, 8 aa, Mycobacterium bovis
GRPRRAGV

SEQ ID NO: 177002 - protein, 14 aa, Mycobacterium bovis
GRPSAEDVDPDTEF

SEQ ID NO: 177003 - protein, 7 aa, Mycobacterium bovis
GRPSRID

SEQ ID NO: 177004 - protein, 7 aa, Mycobacterium bovis
GRPSTYS

SEQ ID NO: 177005 - protein, 7 aa, Mycobacterium bovis
GRPTSAW

SEQ ID NO: 177006 - protein, 9 aa, Mycobacterium bovis
GRPVPAAHP

SEQ ID NO: 177007 - protein, 7 aa, Mycobacterium bovis
GRPYEPQ

SEQ ID NO: 177008 - protein, 9 aa, Mycobacterium bovis
GRPYVPGST

SEQ ID NO: 177009 - protein, 10 aa, Mycobacterium bovis
GRQETDPELT

SEQ ID NO: 177010 - protein, 4 aa, Mycobacterium bovis
GRQG

SEQ ID NO: 177011 - protein, 7 aa, Mycobacterium bovis
GRQGQTD

SEQ ID NO: 177012 - protein, 5 aa, Mycobacterium bovis
GRQRV

SEQ ID NO: 177013 - protein, 5 aa, Mycobacterium bovis
GRQVD

SEQ ID NO: 177014 - protein, 5 aa, Mycobacterium bovis
GRQVG

SEQ ID NO: 177015 - protein, 10 aa, Mycobacterium bovis
GRRAAGTGAR

SEQ ID NO: 177016 - protein, 6 aa, Mycobacterium bovis
GRRAAQ

SEQ ID NO: 177017 - protein, 11 aa, Mycobacterium bovis
GRRAPVSSSDQ

SEQ ID NO: 177018 - protein, 6 aa, Mycobacterium bovis
GRRARA

SEQ ID NO: 177019 - protein, 4 aa, Mycobacterium bovis
GRRE

SEQ ID NO: 177020 - protein, 6 aa, Mycobacterium bovis
GRREPL

SEQ ID NO: 177021 - protein, 4 aa, Mycobacterium bovis
GRRG

SEQ ID NO: 177022 - protein, 7 aa, Mycobacterium bovis
GRRGASV

SEQ ID NO: 177023 - protein, 8 aa, Mycobacterium bovis
GRRGMKAA

SEQ ID NO: 177024 - protein, 8 aa, Mycobacterium bovis
GRRGTTTD

SEQ ID NO: 177025 - protein, 7 aa, Mycobacterium bovis
GRRHGPE

SEQ ID NO: 177026 - protein, 4 aa, Mycobacterium bovis
GRRP

SEQ ID NO: 177027 - protein, 5 aa, Mycobacterium bovis
GRRPG

SEQ ID NO: 177028 - protein, 19 aa, Mycobacterium bovis
GRRPGQSQVPDRCTPRVTD

SEQ ID NO: 177029 - protein, 20 aa, Mycobacterium bovis
GRRPTPGTAAYGAAKAGLEN

SEQ ID NO: 177030 - protein, 6 aa, Mycobacterium bovis
GRRQPA

SEQ ID NO: 177031 - protein, 7 aa, Mycobacterium bovis
GRRRGRP

SEQ ID NO: 177032 - protein, 10 aa, Mycobacterium bovis
GRRRHRGGAA

SEQ ID NO: 177033 - protein, 13 aa, Mycobacterium bovis
GRRSNWPKGSGVN

SEQ ID NO: 177034 - protein, 4 aa, Mycobacterium bovis
GRRT

SEQ ID NO: 177035 - protein, 7 aa, Mycobacterium bovis
GRRTQFD

SEQ ID NO: 177036 - protein, 12 aa, Mycobacterium bovis
GRRWASAEARRH

SEQ ID NO: 177037 - protein, 4 aa, Mycobacterium bovis
GRSA

SEQ ID NO: 177038 - protein, 5 aa, Mycobacterium bovis
GRSAA

SEQ ID NO: 177039 - protein, 7 aa, Mycobacterium bovis
GRSAEQR

SEQ ID NO: 177040 - protein, 7 aa, Mycobacterium bovis
GRSATEV

SEQ ID NO: 177041 - protein, 16 aa, Mycobacterium bovis
GRSATLTAESGDAEPI

SEQ ID NO: 177042 - protein, 7 aa, Mycobacterium bovis
GRSDPAL

SEQ ID NO: 177043 - protein, 9 aa, Mycobacterium bovis
GRSDPTDEQ

SEQ ID NO: 177044 - protein, 6 aa, Mycobacterium bovis
GRSDRL

SEQ ID NO: 177045 - protein, 4 aa, Mycobacterium bovis
GRSG

SEQ ID NO: 177046 - protein, 12 aa, Mycobacterium bovis
GRSGAADRRSHT

SEQ ID NO: 177047 - protein, 9 aa, Mycobacterium bovis
GRSGAPPVG

SEQ ID NO: 177048 - protein, 17 aa, Mycobacterium bovis
GRSGVDLDEKGREQATG

SEQ ID NO: 177049 - protein, 4 aa, Mycobacterium bovis
GRSH

SEQ ID NO: 177050 - protein, 5 aa, Mycobacterium bovis
GRSIR

SEQ ID NO: 177051 - protein, 6 aa, Mycobacterium bovis
GRSIRR

SEQ ID NO: 177052 - protein, 6 aa, Mycobacterium bovis
GRSNEH

SEQ ID NO: 177053 - protein, 9 aa, Mycobacterium bovis
GRSNRLGTP

SEQ ID NO: 177054 - protein, 6 aa, Mycobacterium bovis
GRSPDI

SEQ ID NO: 177055 - protein, 5 aa, Mycobacterium bovis
GRSQD

SEQ ID NO: 177056 - protein, 10 aa, Mycobacterium bovis
GRSRAPGQTP

SEQ ID NO: 177057 - protein, 8 aa, Mycobacterium bovis
GRSRENGY

SEQ ID NO: 177058 - protein, 6 aa, Mycobacterium bovis
GRSTGA

SEQ ID NO: 177059 - protein, 5 aa, Mycobacterium bovis
GRSTL

SEQ ID NO: 177060 - protein, 7 aa, Mycobacterium bovis
GRSTRGA

SEQ ID NO: 177061 - protein, 9 aa, Mycobacterium bovis
GRSTRPPLD

SEQ ID NO: 177062 - protein, 6 aa, Mycobacterium bovis
GRSVGD

SEQ ID NO: 177063 - protein, 13 aa, Mycobacterium bovis
GRSYGDNAQNGGG

SEQ ID NO: 177064 - protein, 7 aa, Mycobacterium bovis
GRTAPSV

SEQ ID NO: 177065 - protein, 11 aa, Mycobacterium bovis
GRTDEEEKNRL

SEQ ID NO: 177066 - protein, 12 aa, Mycobacterium bovis
GRTDRDTRNGRK

SEQ ID NO: 177067 - protein, 12 aa, Mycobacterium bovis
GRTEGLSDVERA

SEQ ID NO: 177068 - protein, 10 aa, Mycobacterium bovis
GRTEITEATR

SEQ ID NO: 177069 - protein, 6 aa, Mycobacterium bovis
GRTGRP

SEQ ID NO: 177070 - protein, 12 aa, Mycobacterium bovis
GRTGSRPRLTDD

SEQ ID NO: 177071 - protein, 8 aa, Mycobacterium bovis
GRTHPTVA

SEQ ID NO: 177072 - protein, 7 aa, Mycobacterium bovis
GRTIGGE

SEQ ID NO: 177073 - protein, 10 aa, Mycobacterium bovis
GRTNYRNPAT

SEQ ID NO: 177074 - protein, 6 aa, Mycobacterium bovis
GRTPEQ

SEQ ID NO: 177075 - protein, 8 aa, Mycobacterium bovis
GRTPKAFG

SEQ ID NO: 177076 - protein, 5 aa, Mycobacterium bovis
GRTPN

SEQ ID NO: 177077 - protein, 6 aa, Mycobacterium bovis
GRTPPF

SEQ ID NO: 177078 - protein, 9 aa, Mycobacterium bovis
GRTRPDQEK

SEQ ID NO: 177079 - protein, 7 aa, Mycobacterium bovis
GRTRQNL

SEQ ID NO: 177080 - protein, 7 aa, Mycobacterium bovis
GRTSDTT

SEQ ID NO: 177081 - protein, 8 aa, Mycobacterium bovis
GRTSRSEL

SEQ ID NO: 177082 - protein, 7 aa, Mycobacterium bovis
GRTTTRT

SEQ ID NO: 177083 - protein, 5 aa, Mycobacterium bovis
GRTYN

SEQ ID NO: 177084 - protein, 7 aa, Mycobacterium bovis
GRVGGQA

SEQ ID NO: 177085 - protein, 9 aa, Mycobacterium bovis
GRVPNPALP

SEQ ID NO: 177086 - protein, 6 aa, Mycobacterium bovis
GRWATQ

SEQ ID NO: 177087 - protein, 6 aa, Mycobacterium bovis
GRYQSG

SEQ ID NO: 177088 - protein, 9 aa, Mycobacterium bovis
GSAAASPDV

SEQ ID NO: 177089 - protein, 7 aa, Mycobacterium bovis
GSAASPF

SEQ ID NO: 177090 - protein, 7 aa, Mycobacterium bovis
GSAASRF

SEQ ID NO: 177091 - protein, 5 aa, Mycobacterium bovis
GSAAT

SEQ ID NO: 177092 - protein, 12 aa, Mycobacterium bovis
GSAATGGAGRSR

SEQ ID NO: 177093 - protein, 4 aa, Mycobacterium bovis
GSAD

SEQ ID NO: 177094 - protein, 12 aa, Mycobacterium bovis
GSADAGGTRPWQ

SEQ ID NO: 177095 - protein, 9 aa, Mycobacterium bovis
GSADGAAGD

SEQ ID NO: 177096 - protein, 11 aa, Mycobacterium bovis
GSAELAESSVQ

SEQ ID NO: 177097 - protein, 12 aa, Mycobacterium bovis
GSAEQVRDLAAL

SEQ ID NO: 177098 - protein, 10 aa, Mycobacterium bovis
GSAEVSHVGD

SEQ ID NO: 177099 - protein, 6 aa, Mycobacterium bovis
GSAGAR

SEQ ID NO: 177100 - protein, 11 aa, Mycobacterium bovis
GSAGARDERGW

SEQ ID NO: 177101 - protein, 7 aa, Mycobacterium bovis
GSAGNSF

SEQ ID NO: 177102 - protein, 10 aa, Mycobacterium bovis
GSAKQAERSY

SEQ ID NO: 177103 - protein, 9 aa, Mycobacterium bovis
GSANRDDRV

SEQ ID NO: 177104 - protein, 7 aa, Mycobacterium bovis
GSAPDAM

SEQ ID NO: 177105 - protein, 10 aa, Mycobacterium bovis
GSAPQDVPGM

SEQ ID NO: 177106 - protein, 7 aa, Mycobacterium bovis
GSAQSNA

SEQ ID NO: 177107 - protein, 7 aa, Mycobacterium bovis
GSARGYR

SEQ ID NO: 177108 - protein, 4 aa, Mycobacterium bovis
GSAS

SEQ ID NO: 177109 - protein, 6 aa, Mycobacterium bovis
GSATAL

SEQ ID NO: 177110 - protein, 12 aa, Mycobacterium bovis
GSATGVVPTPDE

SEQ ID NO: 177111 - protein, 19 aa, Mycobacterium bovis
GSATNSDGRSNGMTAPNAL

SEQ ID NO: 177112 - protein, 6 aa, Mycobacterium bovis
GSATRD

SEQ ID NO: 177113 - protein, 7 aa, Mycobacterium bovis
GSAVPTP

SEQ ID NO: 177114 - protein, 6 aa, Mycobacterium bovis
GSAYGL

SEQ ID NO: 177115 - protein, 6 aa, Mycobacterium bovis
GSCGRA

SEQ ID NO: 177116 - protein, 4 aa, Mycobacterium bovis
GSCN

SEQ ID NO: 177117 - protein, 4 aa, Mycobacterium bovis
GSCR

SEQ ID NO: 177118 - protein, 7 aa, Mycobacterium bovis
GSCSTND

SEQ ID NO: 177119 - protein, 4 aa, Mycobacterium bovis
GSDA

SEQ ID NO: 177120 - protein, 5 aa, Mycobacterium bovis
GSDAY

SEQ ID NO: 177121 - protein, 8 aa, Mycobacterium bovis
GSDEASVV

SEQ ID NO: 177122 - protein, 10 aa, Mycobacterium bovis
GSDEGGHDTV

SEQ ID NO: 177123 - protein, 7 aa, Mycobacterium bovis
GSDEQKR

SEQ ID NO: 177124 - protein, 20 aa, Mycobacterium bovis
GSDGADTIGTVGRQGTPARV

SEQ ID NO: 177125 - protein, 6 aa, Mycobacterium bovis
GSDGDA

SEQ ID NO: 177126 - protein, 7 aa, Mycobacterium bovis
GSDGHPL

SEQ ID NO: 177127 - protein, 6 aa, Mycobacterium bovis
GSDHPV

SEQ ID NO: 177128 - protein, 7 aa, Mycobacterium bovis
GSDNGLT

SEQ ID NO: 177129 - protein, 7 aa, Mycobacterium bovis
GSDPEFR

SEQ ID NO: 177130 - protein, 7 aa, Mycobacterium bovis
GSDPVAD

SEQ ID NO: 177131 - protein, 8 aa, Mycobacterium bovis
GSDRPAWA

SEQ ID NO: 177132 - protein, 6 aa, Mycobacterium bovis
GSDRPR

SEQ ID NO: 177133 - protein, 8 aa, Mycobacterium bovis
GSDSCDRT

SEQ ID NO: 177134 - protein, 10 aa, Mycobacterium bovis
GSDSGGGAGI

SEQ ID NO: 177135 - protein, 4 aa, Mycobacterium bovis
GSDT

SEQ ID NO: 177136 - protein, 8 aa, Mycobacterium bovis
GSDTGGSI

SEQ ID NO: 177137 - protein, 7 aa, Mycobacterium bovis
GSEADEV

SEQ ID NO: 177138 - protein, 48 aa, Mycobacterium bovis
GSEAPGRPGGAGGTGGAGGNGGTQAGDGGTGGAGGAGGDGGSGGAGSI

SEQ ID NO: 177139 - protein, 8 aa, Mycobacterium bovis
GSEEEAPL

SEQ ID NO: 177140 - protein, 8 aa, Mycobacterium bovis
GSEKSPGF

SEQ ID NO: 177141 - protein, 4 aa, Mycobacterium bovis
GSEL

SEQ ID NO: 177142 - protein, 16 aa, Mycobacterium bovis
GSELASPGTPLQPGQI

SEQ ID NO: 177143 - protein, 6 aa, Mycobacterium bovis
GSEPIA

SEQ ID NO: 177144 - protein, 17 aa, Mycobacterium bovis
GSEQTAAAEGKVGNVRR

SEQ ID NO: 177145 - protein, 6 aa, Mycobacterium bovis
GSESEL

SEQ ID NO: 177146 - protein, 18 aa, Mycobacterium bovis
GSESGWDRGSDRPPPPLP

SEQ ID NO: 177147 - protein, 8 aa, Mycobacterium bovis
GSETNDGR

SEQ ID NO: 177148 - protein, 22 aa, Mycobacterium bovis
GSFNSGAFNSGSFNGGDANSGF

SEQ ID NO: 177149 - protein, 12 aa, Mycobacterium bovis
GSGARPGTSPKV

SEQ ID NO: 177150 - protein, 9 aa, Mycobacterium bovis
GSGARYGRQ

SEQ ID NO: 177151 - protein, 9 aa, Mycobacterium bovis
GSGATRPAL

SEQ ID NO: 177152 - protein, 7 aa, Mycobacterium bovis
GSGDDSL

SEQ ID NO: 177153 - protein, 9 aa, Mycobacterium bovis
GSGDNGGDA

SEQ ID NO: 177154 - protein, 11 aa, Mycobacterium bovis
GSGDWEATKTD

SEQ ID NO: 177155 - protein, 4 aa, Mycobacterium bovis
GSGE

SEQ ID NO: 177156 - protein, 9 aa, Mycobacterium bovis
GSGESSERV

SEQ ID NO: 177157 - protein, 14 aa, Mycobacterium bovis
GSGGAGGDGGAATS

SEQ ID NO: 177158 - protein, 183 aa, Mycobacterium bovis
GSGGAGGQGGTGLAGTNGVNPGSIANPNTGANGTDNSGNGNQTGGNGGPGPAGGVGEAGGVGGQGGLGESLDGNDGTGGKGGAGGTAGTDGGAGGAGGAGGIGETDGSAGGVATGGEGGDGATGGVDGGVGGAGGKGGQGHNTGVGDAFGGDGGIGGDGNGALGAAGGNGGTGGAGGNGGRGG

SEQ ID NO: 177159 - protein, 9 aa, Mycobacterium bovis
GSGGAGGSR

SEQ ID NO: 177160 - protein, 8 aa, Mycobacterium bovis
GSGGARGY

SEQ ID NO: 177161 - protein, 7 aa, Mycobacterium bovis
GSGGLSQ

SEQ ID NO: 177162 - protein, 29 aa, Mycobacterium bovis
GSGGQGGDSAMGSGGAGGAGGSGGAASPF

SEQ ID NO: 177163 - protein, 7 aa, Mycobacterium bovis
GSGGRRV

SEQ ID NO: 177164 - protein, 16 aa, Mycobacterium bovis
GSGGVGGSGGDGGNGG

SEQ ID NO: 177165 - protein, 9 aa, Mycobacterium bovis
GSGKSTIGR

SEQ ID NO: 177166 - protein, 4 aa, Mycobacterium bovis
GSGL

SEQ ID NO: 177167 - protein, 8 aa, Mycobacterium bovis
GSGLSSSA

SEQ ID NO: 177168 - protein, 6 aa, Mycobacterium bovis
GSGMVG

SEQ ID NO: 177169 - protein, 4 aa, Mycobacterium bovis
GSGN

SEQ ID NO: 177170 - protein, 7 aa, Mycobacterium bovis
GSGNAGA

SEQ ID NO: 177171 - protein, 6 aa, Mycobacterium bovis
GSGNFG

SEQ ID NO: 177172 - protein, 16 aa, Mycobacterium bovis
GSGNFGIGNAGTGNWG

SEQ ID NO: 177173 - protein, 28 aa, Mycobacterium bovis
GSGNFGVGNSGVTNTGVANSGNINTGFG

SEQ ID NO: 177174 - protein, 9 aa, Mycobacterium bovis
GSGNGEQIA

SEQ ID NO: 177175 - protein, 14 aa, Mycobacterium bovis
GSGNGNVGIGPSSF

SEQ ID NO: 177176 - protein, 8 aa, Mycobacterium bovis
GSGNIGSY

SEQ ID NO: 177177 - protein, 5 aa, Mycobacterium bovis
GSGNL

SEQ ID NO: 177178 - protein, 8 aa, Mycobacterium bovis
GSGNQGDI

SEQ ID NO: 177179 - protein, 6 aa, Mycobacterium bovis
GSGNSI

SEQ ID NO: 177180 - protein, 21 aa, Mycobacterium bovis
GSGNTGSNNIGFGNTGSGNFG

SEQ ID NO: 177181 - protein, 5 aa, Mycobacterium bovis
GSGNV

SEQ ID NO: 177182 - protein, 9 aa, Mycobacterium bovis
GSGNVGSYN

SEQ ID NO: 177183 - protein, 4 aa, Mycobacterium bovis
GSGP

SEQ ID NO: 177184 - protein, 9 aa, Mycobacterium bovis
GSGPAGLAA

SEQ ID NO: 177185 - protein, 7 aa, Mycobacterium bovis
GSGPDPL

SEQ ID NO: 177186 - protein, 7 aa, Mycobacterium bovis
GSGPNAL

SEQ ID NO: 177187 - protein, 7 aa, Mycobacterium bovis
GSGPRFD

SEQ ID NO: 177188 - protein, 8 aa, Mycobacterium bovis
GSGQDDFG

SEQ ID NO: 177189 - protein, 5 aa, Mycobacterium bovis
GSGQI

SEQ ID NO: 177190 - protein, 7 aa, Mycobacterium bovis
GSGRTLS

SEQ ID NO: 177191 - protein, 9 aa, Mycobacterium bovis
GSGSAEVPA

SEQ ID NO: 177192 - protein, 9 aa, Mycobacterium bovis
GSGSESANR

SEQ ID NO: 177193 - protein, 9 aa, Mycobacterium bovis
GSGSGTSTL

SEQ ID NO: 177194 - protein, 9 aa, Mycobacterium bovis
GSGSLKSEI

SEQ ID NO: 177195 - protein, 9 aa, Mycobacterium bovis
GSGSSRHSI

SEQ ID NO: 177196 - protein, 13 aa, Mycobacterium bovis
GSGSVVRDPEGLT

SEQ ID NO: 177197 - protein, 4 aa, Mycobacterium bovis
GSGT

SEQ ID NO: 177198 - protein, 5 aa, Mycobacterium bovis
GSGTA

SEQ ID NO: 177199 - protein, 5 aa, Mycobacterium bovis
GSGTL

SEQ ID NO: 177200 - protein, 8 aa, Mycobacterium bovis
GSGTPIPS

SEQ ID NO: 177201 - protein, 8 aa, Mycobacterium bovis
GSGTSEKT

SEQ ID NO: 177202 - protein, 14 aa, Mycobacterium bovis
GSGTSGLPAGGWTR

SEQ ID NO: 177203 - protein, 5 aa, Mycobacterium bovis
GSGTV

SEQ ID NO: 177204 - protein, 4 aa, Mycobacterium bovis
GSGV

SEQ ID NO: 177205 - protein, 6 aa, Mycobacterium bovis
GSGVTN

SEQ ID NO: 177206 - protein, 6 aa, Mycobacterium bovis
GSGVTV

SEQ ID NO: 177207 - protein, 10 aa, Mycobacterium bovis
GSHAPTRSAR

SEQ ID NO: 177208 - protein, 6 aa, Mycobacterium bovis
GSHDER

SEQ ID NO: 177209 - protein, 29 aa, Mycobacterium bovis
GSHGAGGAGGSGGDGGAPGDGGNGATGTW

SEQ ID NO: 177210 - protein, 7 aa, Mycobacterium bovis
GSHGTKR

SEQ ID NO: 177211 - protein, 8 aa, Mycobacterium bovis
GSHNAGFG

SEQ ID NO: 177212 - protein, 7 aa, Mycobacterium bovis
GSHPAQL

SEQ ID NO: 177213 - protein, 11 aa, Mycobacterium bovis
GSHPSKNPLRT

SEQ ID NO: 177214 - protein, 9 aa, Mycobacterium bovis
GSHQDAINK

SEQ ID NO: 177215 - protein, 4 aa, Mycobacterium bovis
GSID

SEQ ID NO: 177216 - protein, 9 aa, Mycobacterium bovis
GSIDDAEAA

SEQ ID NO: 177217 - protein, 11 aa, Mycobacterium bovis
GSIDGARSAAA

SEQ ID NO: 177218 - protein, 6 aa, Mycobacterium bovis
GSIKPI

SEQ ID NO: 177219 - protein, 11 aa, Mycobacterium bovis
GSIPTTTSGKI

SEQ ID NO: 177220 - protein, 4 aa, Mycobacterium bovis
GSIQ

SEQ ID NO: 177221 - protein, 7 aa, Mycobacterium bovis
GSIRSQQ

SEQ ID NO: 177222 - protein, 4 aa, Mycobacterium bovis
GSIV

SEQ ID NO: 177223 - protein, 8 aa, Mycobacterium bovis
GSKAPADM

SEQ ID NO: 177224 - protein, 7 aa, Mycobacterium bovis
GSKARDE

SEQ ID NO: 177225 - protein, 14 aa, Mycobacterium bovis
GSKDPRSAANARAI

SEQ ID NO: 177226 - protein, 6 aa, Mycobacterium bovis
GSKEAR

SEQ ID NO: 177227 - protein, 7 aa, Mycobacterium bovis
GSKPAVQ

SEQ ID NO: 177228 - protein, 6 aa, Mycobacterium bovis
GSKPSP

SEQ ID NO: 177229 - protein, 7 aa, Mycobacterium bovis
GSKSAAV

SEQ ID NO: 177230 - protein, 15 aa, Mycobacterium bovis
GSKSRGGQQIRAQGV

SEQ ID NO: 177231 - protein, 9 aa, Mycobacterium bovis
GSKTPGHPE

SEQ ID NO: 177232 - protein, 8 aa, Mycobacterium bovis
GSKTTGWL

SEQ ID NO: 177233 - protein, 9 aa, Mycobacterium bovis
GSKYGGYGR

SEQ ID NO: 177234 - protein, 13 aa, Mycobacterium bovis
GSLAPPDGAAVPD

SEQ ID NO: 177235 - protein, 8 aa, Mycobacterium bovis
GSLDQEPE

SEQ ID NO: 177236 - protein, 6 aa, Mycobacterium bovis
GSLESD

SEQ ID NO: 177237 - protein, 6 aa, Mycobacterium bovis
GSLGQV

SEQ ID NO: 177238 - protein, 6 aa, Mycobacterium bovis
GSLGSG

SEQ ID NO: 177239 - protein, 10 aa, Mycobacterium bovis
GSLHPGARYR

SEQ ID NO: 177240 - protein, 10 aa, Mycobacterium bovis
GSLPRTSSGK

SEQ ID NO: 177241 - protein, 9 aa, Mycobacterium bovis
GSLSAAGDL

SEQ ID NO: 177242 - protein, 7 aa, Mycobacterium bovis
GSLTAPA

SEQ ID NO: 177243 - protein, 6 aa, Mycobacterium bovis
GSLTTQ

SEQ ID NO: 177244 - protein, 6 aa, Mycobacterium bovis
GSMAAR

SEQ ID NO: 177245 - protein, 6 aa, Mycobacterium bovis
GSMGGA

SEQ ID NO: 177246 - protein, 13 aa, Mycobacterium bovis
GSMSSNSNGEGDI

SEQ ID NO: 177247 - protein, 9 aa, Mycobacterium bovis
GSNAPVSTS

SEQ ID NO: 177248 - protein, 7 aa, Mycobacterium bovis
GSNERQV

SEQ ID NO: 177249 - protein, 5 aa, Mycobacterium bovis
GSNHV

SEQ ID NO: 177250 - protein, 6 aa, Mycobacterium bovis
GSNNVG

SEQ ID NO: 177251 - protein, 6 aa, Mycobacterium bovis
GSNPNV

SEQ ID NO: 177252 - protein, 4 aa, Mycobacterium bovis
GSNQ

SEQ ID NO: 177253 - protein, 10 aa, Mycobacterium bovis
GSNRLGGNSL

SEQ ID NO: 177254 - protein, 17 aa, Mycobacterium bovis
GSNTGTPHQGSADRGAE

SEQ ID NO: 177255 - protein, 8 aa, Mycobacterium bovis
GSNTSTLP

SEQ ID NO: 177256 - protein, 15 aa, Mycobacterium bovis
GSPAEPLTAGTPDDM

SEQ ID NO: 177257 - protein, 9 aa, Mycobacterium bovis
GSPASEAAT

SEQ ID NO: 177258 - protein, 6 aa, Mycobacterium bovis
GSPDRV

SEQ ID NO: 177259 - protein, 4 aa, Mycobacterium bovis
GSPE

SEQ ID NO: 177260 - protein, 7 aa, Mycobacterium bovis
GSPEDPG

SEQ ID NO: 177261 - protein, 28 aa, Mycobacterium bovis
GSPGGAAKVGMTENDPQAVKDLAPQSED

SEQ ID NO: 177262 - protein, 5 aa, Mycobacterium bovis
GSPGR

SEQ ID NO: 177263 - protein, 8 aa, Mycobacterium bovis
GSPGTELT

SEQ ID NO: 177264 - protein, 5 aa, Mycobacterium bovis
GSPIT

SEQ ID NO: 177265 - protein, 15 aa, Mycobacterium bovis
GSPLAPEKEGDADIR

SEQ ID NO: 177266 - protein, 5 aa, Mycobacterium bovis
GSPNI

SEQ ID NO: 177267 - protein, 7 aa, Mycobacterium bovis
GSPNPDD

SEQ ID NO: 177268 - protein, 7 aa, Mycobacterium bovis
GSPNRGM

SEQ ID NO: 177269 - protein, 6 aa, Mycobacterium bovis
GSPPAA

SEQ ID NO: 177270 - protein, 7 aa, Mycobacterium bovis
GSPPAAE

SEQ ID NO: 177271 - protein, 8 aa, Mycobacterium bovis
GSPPDREQ

SEQ ID NO: 177272 - protein, 7 aa, Mycobacterium bovis
GSPPTKA

SEQ ID NO: 177273 - protein, 7 aa, Mycobacterium bovis
GSPRQQI

SEQ ID NO: 177274 - protein, 12 aa, Mycobacterium bovis
GSPSQARKHADA

SEQ ID NO: 177275 - protein, 12 aa, Mycobacterium bovis
GSPTDTRGLDDH

SEQ ID NO: 177276 - protein, 20 aa, Mycobacterium bovis
GSPVGRTRDAAPGAPSDRPV

SEQ ID NO: 177277 - protein, 6 aa, Mycobacterium bovis
GSPVSE

SEQ ID NO: 177278 - protein, 7 aa, Mycobacterium bovis
GSPYEPG

SEQ ID NO: 177279 - protein, 9 aa, Mycobacterium bovis
GSQASNDQL

SEQ ID NO: 177280 - protein, 6 aa, Mycobacterium bovis
GSQGHA

SEQ ID NO: 177281 - protein, 6 aa, Mycobacterium bovis
GSQGVH

SEQ ID NO: 177282 - protein, 16 aa, Mycobacterium bovis
GSQLGSSLGSSGLGAG

SEQ ID NO: 177283 - protein, 5 aa, Mycobacterium bovis
GSQWA

SEQ ID NO: 177284 - protein, 6 aa, Mycobacterium bovis
GSRARP

SEQ ID NO: 177285 - protein, 5 aa, Mycobacterium bovis
GSRDG

SEQ ID NO: 177286 - protein, 18 aa, Mycobacterium bovis
GSRGCAPESAESEAHYPG

SEQ ID NO: 177287 - protein, 10 aa, Mycobacterium bovis
GSRGPRESKY

SEQ ID NO: 177288 - protein, 8 aa, Mycobacterium bovis
GSRKQLAA

SEQ ID NO: 177289 - protein, 10 aa, Mycobacterium bovis
GSRKTHDDRM

SEQ ID NO: 177290 - protein, 7 aa, Mycobacterium bovis
GSRLTGR

SEQ ID NO: 177291 - protein, 8 aa, Mycobacterium bovis
GSRPGGPI

SEQ ID NO: 177292 - protein, 8 aa, Mycobacterium bovis
GSRRADGM

SEQ ID NO: 177293 - protein, 5 aa, Mycobacterium bovis
GSRRK

SEQ ID NO: 177294 - protein, 7 aa, Mycobacterium bovis
GSRRNGF

SEQ ID NO: 177295 - protein, 5 aa, Mycobacterium bovis
GSRRR

SEQ ID NO: 177296 - protein, 4 aa, Mycobacterium bovis
GSRY

SEQ ID NO: 177297 - protein, 27 aa, Mycobacterium bovis
GSSAERSSGFGNSGELSTGIGNSGQLS

SEQ ID NO: 177298 - protein, 5 aa, Mycobacterium bovis
GSSAL

SEQ ID NO: 177299 - protein, 10 aa, Mycobacterium bovis
GSSDGSYAGL

SEQ ID NO: 177300 - protein, 10 aa, Mycobacterium bovis
GSSDPGSLGY

SEQ ID NO: 177301 - protein, 7 aa, Mycobacterium bovis
GSSDPHR

SEQ ID NO: 177302 - protein, 6 aa, Mycobacterium bovis
GSSEKA

SEQ ID NO: 177303 - protein, 8 aa, Mycobacterium bovis
GSSGAYEE

SEQ ID NO: 177304 - protein, 14 aa, Mycobacterium bovis
GSSGFVTDQDTAEL

SEQ ID NO: 177305 - protein, 7 aa, Mycobacterium bovis
GSSGGKN

SEQ ID NO: 177306 - protein, 8 aa, Mycobacterium bovis
GSSGKGGE

SEQ ID NO: 177307 - protein, 10 aa, Mycobacterium bovis
GSSGKTSTKD

SEQ ID NO: 177308 - protein, 5 aa, Mycobacterium bovis
GSSHT

SEQ ID NO: 177309 - protein, 4 aa, Mycobacterium bovis
GSSI

SEQ ID NO: 177310 - protein, 15 aa, Mycobacterium bovis
GSSISAASAAAAGPT

SEQ ID NO: 177311 - protein, 4 aa, Mycobacterium bovis
GSSL

SEQ ID NO: 177312 - protein, 6 aa, Mycobacterium bovis
GSSNTV

SEQ ID NO: 177313 - protein, 6 aa, Mycobacterium bovis
GSSPEA

SEQ ID NO: 177314 - protein, 16 aa, Mycobacterium bovis
GSSPQDTSAVAAGEAE

SEQ ID NO: 177315 - protein, 7 aa, Mycobacterium bovis
GSSRRYA

SEQ ID NO: 177316 - protein, 11 aa, Mycobacterium bovis
GSSRSLADGTA

SEQ ID NO: 177317 - protein, 7 aa, Mycobacterium bovis
GSSSRPM

SEQ ID NO: 177318 - protein, 15 aa, Mycobacterium bovis
GSSTENSAYGPTRNP

SEQ ID NO: 177319 - protein, 7 aa, Mycobacterium bovis
GSSTYPG

SEQ ID NO: 177320 - protein, 10 aa, Mycobacterium bovis
GSTAADVRPD

SEQ ID NO: 177321 - protein, 8 aa, Mycobacterium bovis
GSTAEGQR

SEQ ID NO: 177322 - protein, 12 aa, Mycobacterium bovis
GSTARRGSPRRA

SEQ ID NO: 177323 - protein, 8 aa, Mycobacterium bovis
GSTATELA

SEQ ID NO: 177324 - protein, 8 aa, Mycobacterium bovis
GSTATGRA

SEQ ID NO: 177325 - protein, 7 aa, Mycobacterium bovis
GSTDLSS

SEQ ID NO: 177326 - protein, 18 aa, Mycobacterium bovis
GSTDQSGTPEQSTPDEVN

SEQ ID NO: 177327 - protein, 5 aa, Mycobacterium bovis
GSTEF

SEQ ID NO: 177328 - protein, 7 aa, Mycobacterium bovis
GSTEGGV

SEQ ID NO: 177329 - protein, 7 aa, Mycobacterium bovis
GSTGDGI

SEQ ID NO: 177330 - protein, 18 aa, Mycobacterium bovis
GSTHLGGRRGKSEQGLSR

SEQ ID NO: 177331 - protein, 17 aa, Mycobacterium bovis
GSTIAGANAAAAANTTS

SEQ ID NO: 177332 - protein, 16 aa, Mycobacterium bovis
GSTIGTANAAAAVPTT

SEQ ID NO: 177333 - protein, 16 aa, Mycobacterium bovis
GSTISAANAAASIPTT

SEQ ID NO: 177334 - protein, 12 aa, Mycobacterium bovis
GSTITAANTAAA

SEQ ID NO: 177335 - protein, 6 aa, Mycobacterium bovis
GSTLGG

SEQ ID NO: 177336 - protein, 11 aa, Mycobacterium bovis
GSTLQAGQSDH

SEQ ID NO: 177337 - protein, 7 aa, Mycobacterium bovis
GSTPATE

SEQ ID NO: 177338 - protein, 8 aa, Mycobacterium bovis
GSTPGKVP

SEQ ID NO: 177339 - protein, 10 aa, Mycobacterium bovis
GSTQGVTTTD

SEQ ID NO: 177340 - protein, 8 aa, Mycobacterium bovis
GSTRSINA

SEQ ID NO: 177341 - protein, 7 aa, Mycobacterium bovis
GSTTENH

SEQ ID NO: 177342 - protein, 25 aa, Mycobacterium bovis
GSTTGASAATSTAAATAAATNALRG

SEQ ID NO: 177343 - protein, 7 aa, Mycobacterium bovis
GSTVGQA

SEQ ID NO: 177344 - protein, 13 aa, Mycobacterium bovis
GSVDGGAAEMAPP

SEQ ID NO: 177345 - protein, 20 aa, Mycobacterium bovis
GSVGADTVSGRADVGGSGGG

SEQ ID NO: 177346 - protein, 9 aa, Mycobacterium bovis
GSVGGSTGV

SEQ ID NO: 177347 - protein, 13 aa, Mycobacterium bovis
GSVGPDPGEATGL

SEQ ID NO: 177348 - protein, 11 aa, Mycobacterium bovis
GSVGQDATNLA

SEQ ID NO: 177349 - protein, 28 aa, Mycobacterium bovis
GSVGQRSAASGLASGKLGEQPADPATFT

SEQ ID NO: 177350 - protein, 11 aa, Mycobacterium bovis
GSVNRGNAAQA

SEQ ID NO: 177351 - protein, 4 aa, Mycobacterium bovis
GSVP

SEQ ID NO: 177352 - protein, 8 aa, Mycobacterium bovis
GSVPATPT

SEQ ID NO: 177353 - protein, 8 aa, Mycobacterium bovis
GSVPRGLG

SEQ ID NO: 177354 - protein, 7 aa, Mycobacterium bovis
GSVSDGD

SEQ ID NO: 177355 - protein, 5 aa, Mycobacterium bovis
GSVSV

SEQ ID NO: 177356 - protein, 9 aa, Mycobacterium bovis
GSWGPEAAQ

SEQ ID NO: 177357 - protein, 6 aa, Mycobacterium bovis
GSWGTT

SEQ ID NO: 177358 - protein, 4 aa, Mycobacterium bovis
GSWP

SEQ ID NO: 177359 - protein, 14 aa, Mycobacterium bovis
GSYASGGFATGTDY

SEQ ID NO: 177360 - protein, 6 aa, Mycobacterium bovis
GSYGHG

SEQ ID NO: 177361 - protein, 6 aa, Mycobacterium bovis
GSYNTG

SEQ ID NO: 177362 - protein, 16 aa, Mycobacterium bovis
GSYNTGIGNSGVASTG

SEQ ID NO: 177363 - protein, 7 aa, Mycobacterium bovis
GSYPQTS

SEQ ID NO: 177364 - protein, 4 aa, Mycobacterium bovis
GSYS

SEQ ID NO: 177365 - protein, 16 aa, Mycobacterium bovis
GSYSTGVGNAGTASTG

SEQ ID NO: 177366 - protein, 12 aa, Mycobacterium bovis
GTAAPAIKEGTP

SEQ ID NO: 177367 - protein, 7 aa, Mycobacterium bovis
GTAARSQ

SEQ ID NO: 177368 - protein, 7 aa, Mycobacterium bovis
GTAEAPG

SEQ ID NO: 177369 - protein, 10 aa, Mycobacterium bovis
GTAENQAPVD

SEQ ID NO: 177370 - protein, 5 aa, Mycobacterium bovis
GTAEP

SEQ ID NO: 177371 - protein, 6 aa, Mycobacterium bovis
GTAESR

SEQ ID NO: 177372 - protein, 6 aa, Mycobacterium bovis
GTAGDQ

SEQ ID NO: 177373 - protein, 9 aa, Mycobacterium bovis
GTAGEAPDH

SEQ ID NO: 177374 - protein, 15 aa, Mycobacterium bovis
GTAGKESVGRPAGLT

SEQ ID NO: 177375 - protein, 14 aa, Mycobacterium bovis
GTAGNISARRSDGN

SEQ ID NO: 177376 - protein, 10 aa, Mycobacterium bovis
GTAGPSAIHT

SEQ ID NO: 177377 - protein, 27 aa, Mycobacterium bovis
GTAGSKAHFSGDDSKRPLDKRGRAQAE

SEQ ID NO: 177378 - protein, 7 aa, Mycobacterium bovis
GTAGYNA

SEQ ID NO: 177379 - protein, 8 aa, Mycobacterium bovis
GTAHGRRR

SEQ ID NO: 177380 - protein, 9 aa, Mycobacterium bovis
GTALGADGK

SEQ ID NO: 177381 - protein, 11 aa, Mycobacterium bovis
GTANELKHRAG

SEQ ID NO: 177382 - protein, 13 aa, Mycobacterium bovis
GTAPAAGDPNAPY

SEQ ID NO: 177383 - protein, 7 aa, Mycobacterium bovis
GTAPAGR

SEQ ID NO: 177384 - protein, 9 aa, Mycobacterium bovis
GTAPENGYS

SEQ ID NO: 177385 - protein, 9 aa, Mycobacterium bovis
GTAQGPAGQ

SEQ ID NO: 177386 - protein, 10 aa, Mycobacterium bovis
GTAQHARRHA

SEQ ID NO: 177387 - protein, 16 aa, Mycobacterium bovis
GTASNETVAAPAGLTT

SEQ ID NO: 177388 - protein, 11 aa, Mycobacterium bovis
GTASTAALGRR

SEQ ID NO: 177389 - protein, 7 aa, Mycobacterium bovis
GTASTEQ

SEQ ID NO: 177390 - protein, 6 aa, Mycobacterium bovis
GTATDL

SEQ ID NO: 177391 - protein, 6 aa, Mycobacterium bovis
GTATFG

SEQ ID NO: 177392 - protein, 41 aa, Mycobacterium bovis
GTATPTTAPASAPAAGAAPGPPAGTATATSASVPTSAGGFP

SEQ ID NO: 177393 - protein, 6 aa, Mycobacterium bovis
GTAVGT

SEQ ID NO: 177394 - protein, 13 aa, Mycobacterium bovis
GTAVGTGLNAPDD

SEQ ID NO: 177395 - protein, 33 aa, Mycobacterium bovis
GTAVRSGAGAARVAGGSVTEDVASTTTIIVIPA

SEQ ID NO: 177396 - protein, 8 aa, Mycobacterium bovis
GTAVTPAS

SEQ ID NO: 177397 - protein, 6 aa, Mycobacterium bovis
GTAYTE

SEQ ID NO: 177398 - protein, 6 aa, Mycobacterium bovis
GTDAAY

SEQ ID NO: 177399 - protein, 9 aa, Mycobacterium bovis
GTDADTGAV

SEQ ID NO: 177400 - protein, 9 aa, Mycobacterium bovis
GTDAEGVAR

SEQ ID NO: 177401 - protein, 7 aa, Mycobacterium bovis
GTDAPLG

SEQ ID NO: 177402 - protein, 7 aa, Mycobacterium bovis
GTDARTA

SEQ ID NO: 177403 - protein, 7 aa, Mycobacterium bovis
GTDEQRK

SEQ ID NO: 177404 - protein, 5 aa, Mycobacterium bovis
GTDGG

SEQ ID NO: 177405 - protein, 6 aa, Mycobacterium bovis
GTDGRQ

SEQ ID NO: 177406 - protein, 6 aa, Mycobacterium bovis
GTDGRV

SEQ ID NO: 177407 - protein, 6 aa, Mycobacterium bovis
GTDGVE

SEQ ID NO: 177408 - protein, 8 aa, Mycobacterium bovis
GTDHAGIA

SEQ ID NO: 177409 - protein, 6 aa, Mycobacterium bovis
GTDKPD

SEQ ID NO: 177410 - protein, 10 aa, Mycobacterium bovis
GTDPAGDGFG

SEQ ID NO: 177411 - protein, 9 aa, Mycobacterium bovis
GTDPASGKP

SEQ ID NO: 177412 - protein, 7 aa, Mycobacterium bovis
GTDPVAG

SEQ ID NO: 177413 - protein, 9 aa, Mycobacterium bovis
GTDQGEAAT

SEQ ID NO: 177414 - protein, 6 aa, Mycobacterium bovis
GTDRSW

SEQ ID NO: 177415 - protein, 6 aa, Mycobacterium bovis
GTDSHT

SEQ ID NO: 177416 - protein, 4 aa, Mycobacterium bovis
GTDT

SEQ ID NO: 177417 - protein, 10 aa, Mycobacterium bovis
GTDTSRGTVG

SEQ ID NO: 177418 - protein, 4 aa, Mycobacterium bovis
GTEA

SEQ ID NO: 177419 - protein, 8 aa, Mycobacterium bovis
GTEAATAT

SEQ ID NO: 177420 - protein, 16 aa, Mycobacterium bovis
GTEADYQAAVHNFGAS

SEQ ID NO: 177421 - protein, 10 aa, Mycobacterium bovis
GTEAGGHTGE

SEQ ID NO: 177422 - protein, 12 aa, Mycobacterium bovis
GTEGPYTGNGGA

SEQ ID NO: 177423 - protein, 8 aa, Mycobacterium bovis
GTEHRPSS

SEQ ID NO: 177424 - protein, 4 aa, Mycobacterium bovis
GTEI

SEQ ID NO: 177425 - protein, 5 aa, Mycobacterium bovis
GTEID

SEQ ID NO: 177426 - protein, 7 aa, Mycobacterium bovis
GTEIRVP

SEQ ID NO: 177427 - protein, 4 aa, Mycobacterium bovis
GTEL

SEQ ID NO: 177428 - protein, 5 aa, Mycobacterium bovis
GTELP

SEQ ID NO: 177429 - protein, 9 aa, Mycobacterium bovis
GTENPSGPI

SEQ ID NO: 177430 - protein, 4 aa, Mycobacterium bovis
GTEP

SEQ ID NO: 177431 - protein, 7 aa, Mycobacterium bovis
GTEPPSE

SEQ ID NO: 177432 - protein, 16 aa, Mycobacterium bovis
GTERPFTGEYTDTTTA

SEQ ID NO: 177433 - protein, 9 aa, Mycobacterium bovis
GTETEDPVK

SEQ ID NO: 177434 - protein, 7 aa, Mycobacterium bovis
GTFAESG

SEQ ID NO: 177435 - protein, 7 aa, Mycobacterium bovis
GTFGGNP

SEQ ID NO: 177436 - protein, 5 aa, Mycobacterium bovis
GTFGS

SEQ ID NO: 177437 - protein, 8 aa, Mycobacterium bovis
GTGAGKTT

SEQ ID NO: 177438 - protein, 5 aa, Mycobacterium bovis
GTGAR

SEQ ID NO: 177439 - protein, 11 aa, Mycobacterium bovis
GTGASQASERA

SEQ ID NO: 177440 - protein, 10 aa, Mycobacterium bovis
GTGDRSTRPG

SEQ ID NO: 177441 - protein, 62 aa, Mycobacterium bovis
GTGGAGGHGGQGGGTGGPPLPGQAGMGAAGGAGGLIGNGGAGGDGGVGASGGVAGVGGAGGN

SEQ ID NO: 177442 - protein, 8 aa, Mycobacterium bovis
GTGGHSAG

SEQ ID NO: 177443 - protein, 14 aa, Mycobacterium bovis
GTGGIGGGPGGNGG

SEQ ID NO: 177444 - protein, 6 aa, Mycobacterium bovis
GTGGIK

SEQ ID NO: 177445 - protein, 8 aa, Mycobacterium bovis
GTGGSTAK

SEQ ID NO: 177446 - protein, 7 aa, Mycobacterium bovis
GTGGTIT

SEQ ID NO: 177447 - protein, 10 aa, Mycobacterium bovis
GTGGTITGAG

SEQ ID NO: 177448 - protein, 7 aa, Mycobacterium bovis
GTGGVGQ

SEQ ID NO: 177449 - protein, 7 aa, Mycobacterium bovis
GTGLSER

SEQ ID NO: 177450 - protein, 6 aa, Mycobacterium bovis
GTGLTD

SEQ ID NO: 177451 - protein, 6 aa, Mycobacterium bovis
GTGNAE

SEQ ID NO: 177452 - protein, 8 aa, Mycobacterium bovis
GTGNFGIG

SEQ ID NO: 177453 - protein, 27 aa, Mycobacterium bovis
GTGNFGIGNSGSFNTGIGNSGTGSTGL

SEQ ID NO: 177454 - protein, 16 aa, Mycobacterium bovis
GTGNFGIGNTGTGNFG

SEQ ID NO: 177455 - protein, 16 aa, Mycobacterium bovis
GTGNVGIANSGTGNWG

SEQ ID NO: 177456 - protein, 9 aa, Mycobacterium bovis
GTGPAGGVG

SEQ ID NO: 177457 - protein, 6 aa, Mycobacterium bovis
GTGPFT

SEQ ID NO: 177458 - protein, 4 aa, Mycobacterium bovis
GTGQ

SEQ ID NO: 177459 - protein, 11 aa, Mycobacterium bovis
GTGQLESTVSD

SEQ ID NO: 177460 - protein, 8 aa, Mycobacterium bovis
GTGQQLKG

SEQ ID NO: 177461 - protein, 5 aa, Mycobacterium bovis
GTGQV

SEQ ID NO: 177462 - protein, 4 aa, Mycobacterium bovis
GTGS

SEQ ID NO: 177463 - protein, 6 aa, Mycobacterium bovis
GTGSNT

SEQ ID NO: 177464 - protein, 9 aa, Mycobacterium bovis
GTGTPLGDP

SEQ ID NO: 177465 - protein, 12 aa, Mycobacterium bovis
GTGTSERDERDR

SEQ ID NO: 177466 - protein, 17 aa, Mycobacterium bovis
GTGTVSGVGNVGSNSSG

SEQ ID NO: 177467 - protein, 4 aa, Mycobacterium bovis
GTGV

SEQ ID NO: 177468 - protein, 6 aa, Mycobacterium bovis
GTGVGT

SEQ ID NO: 177469 - protein, 15 aa, Mycobacterium bovis
GTGVTPRDVTPEATR

SEQ ID NO: 177470 - protein, 4 aa, Mycobacterium bovis
GTHG

SEQ ID NO: 177471 - protein, 5 aa, Mycobacterium bovis
GTHPG

SEQ ID NO: 177472 - protein, 14 aa, Mycobacterium bovis
GTIAQSGRSGGRPA

SEQ ID NO: 177473 - protein, 4 aa, Mycobacterium bovis
GTID

SEQ ID NO: 177474 - protein, 9 aa, Mycobacterium bovis
GTIDTATEA

SEQ ID NO: 177475 - protein, 5 aa, Mycobacterium bovis
GTIGP

SEQ ID NO: 177476 - protein, 20 aa, Mycobacterium bovis
GTIPKTPSGKLRRANSVTLV

SEQ ID NO: 177477 - protein, 7 aa, Mycobacterium bovis
GTIPSKT

SEQ ID NO: 177478 - protein, 4 aa, Mycobacterium bovis
GTIR

SEQ ID NO: 177479 - protein, 5 aa, Mycobacterium bovis
GTITR

SEQ ID NO: 177480 - protein, 4 aa, Mycobacterium bovis
GTKA

SEQ ID NO: 177481 - protein, 15 aa, Mycobacterium bovis
GTKAKIRDTRKTLPG

SEQ ID NO: 177482 - protein, 15 aa, Mycobacterium bovis
GTKDDIKEARDNGGS

SEQ ID NO: 177483 - protein, 8 aa, Mycobacterium bovis
GTKDGPAL

SEQ ID NO: 177484 - protein, 5 aa, Mycobacterium bovis
GTKFD

SEQ ID NO: 177485 - protein, 8 aa, Mycobacterium bovis
GTKGKRYA

SEQ ID NO: 177486 - protein, 8 aa, Mycobacterium bovis
GTKKAEAL

SEQ ID NO: 177487 - protein, 5 aa, Mycobacterium bovis
GTLKQ

SEQ ID NO: 177488 - protein, 4 aa, Mycobacterium bovis
GTLN

SEQ ID NO: 177489 - protein, 6 aa, Mycobacterium bovis
GTLPEP

SEQ ID NO: 177490 - protein, 13 aa, Mycobacterium bovis
GTLSGKGSQAQRA

SEQ ID NO: 177491 - protein, 8 aa, Mycobacterium bovis
GTLSGNPV

SEQ ID NO: 177492 - protein, 5 aa, Mycobacterium bovis
GTMKS

SEQ ID NO: 177493 - protein, 4 aa, Mycobacterium bovis
GTMP

SEQ ID NO: 177494 - protein, 15 aa, Mycobacterium bovis
GTNARDTIGAELGGQ

SEQ ID NO: 177495 - protein, 7 aa, Mycobacterium bovis
GTNCENL

SEQ ID NO: 177496 - protein, 4 aa, Mycobacterium bovis
GTNE

SEQ ID NO: 177497 - protein, 6 aa, Mycobacterium bovis
GTNEIQ

SEQ ID NO: 177498 - protein, 11 aa, Mycobacterium bovis
GTNGKSTTTRM

SEQ ID NO: 177499 - protein, 8 aa, Mycobacterium bovis
GTNGKTSV

SEQ ID NO: 177500 - protein, 10 aa, Mycobacterium bovis
GTNGKTTTTS

SEQ ID NO: 177501 - protein, 25 aa, Mycobacterium bovis
GTNNSGYANAGTFNSGFDNNARDEH

SEQ ID NO: 177502 - protein, 16 aa, Mycobacterium bovis
GTNNVGIGNSGTGNWG

SEQ ID NO: 177503 - protein, 4 aa, Mycobacterium bovis
GTNQ

SEQ ID NO: 177504 - protein, 12 aa, Mycobacterium bovis
GTNTDPYQRAEG

SEQ ID NO: 177505 - protein, 5 aa, Mycobacterium bovis
GTNTS

SEQ ID NO: 177506 - protein, 14 aa, Mycobacterium bovis
GTNTSPLAGKVGGH

SEQ ID NO: 177507 - protein, 11 aa, Mycobacterium bovis
GTNWKSNPNAM

SEQ ID NO: 177508 - protein, 7 aa, Mycobacterium bovis
GTPAFGS

SEQ ID NO: 177509 - protein, 14 aa, Mycobacterium bovis
GTPAGVGPIEDGDT

SEQ ID NO: 177510 - protein, 14 aa, Mycobacterium bovis
GTPAVEDDGEPIDE

SEQ ID NO: 177511 - protein, 5 aa, Mycobacterium bovis
GTPAW

SEQ ID NO: 177512 - protein, 6 aa, Mycobacterium bovis
GTPCAL

SEQ ID NO: 177513 - protein, 5 aa, Mycobacterium bovis
GTPDA

SEQ ID NO: 177514 - protein, 7 aa, Mycobacterium bovis
GTPDDGD

SEQ ID NO: 177515 - protein, 6 aa, Mycobacterium bovis
GTPDEV

SEQ ID NO: 177516 - protein, 9 aa, Mycobacterium bovis
GTPDHHGEF

SEQ ID NO: 177517 - protein, 7 aa, Mycobacterium bovis
GTPDLEA

SEQ ID NO: 177518 - protein, 9 aa, Mycobacterium bovis
GTPDTPDRH

SEQ ID NO: 177519 - protein, 5 aa, Mycobacterium bovis
GTPDW

SEQ ID NO: 177520 - protein, 13 aa, Mycobacterium bovis
GTPEAAASTNERI

SEQ ID NO: 177521 - protein, 5 aa, Mycobacterium bovis
GTPEQ

SEQ ID NO: 177522 - protein, 6 aa, Mycobacterium bovis
GTPEQL

SEQ ID NO: 177523 - protein, 8 aa, Mycobacterium bovis
GTPFPTTA

SEQ ID NO: 177524 - protein, 11 aa, Mycobacterium bovis
GTPFRSDDSPI

SEQ ID NO: 177525 - protein, 4 aa, Mycobacterium bovis
GTPG

SEQ ID NO: 177526 - protein, 16 aa, Mycobacterium bovis
GTPGEEQKASLPSSDE

SEQ ID NO: 177527 - protein, 10 aa, Mycobacterium bovis
GTPGESDDDL

SEQ ID NO: 177528 - protein, 15 aa, Mycobacterium bovis
GTPGFGNSTTTPSSG

SEQ ID NO: 177529 - protein, 5 aa, Mycobacterium bovis
GTPHC

SEQ ID NO: 177530 - protein, 7 aa, Mycobacterium bovis
GTPIESG

SEQ ID NO: 177531 - protein, 5 aa, Mycobacterium bovis
GTPIN

SEQ ID NO: 177532 - protein, 4 aa, Mycobacterium bovis
GTPL

SEQ ID NO: 177533 - protein, 5 aa, Mycobacterium bovis
GTPME

SEQ ID NO: 177534 - protein, 4 aa, Mycobacterium bovis
GTPN

SEQ ID NO: 177535 - protein, 4 aa, Mycobacterium bovis
GTPP

SEQ ID NO: 177536 - protein, 6 aa, Mycobacterium bovis
GTPPEA

SEQ ID NO: 177537 - protein, 5 aa, Mycobacterium bovis
GTPPI

SEQ ID NO: 177538 - protein, 6 aa, Mycobacterium bovis
GTPRAG

SEQ ID NO: 177539 - protein, 6 aa, Mycobacterium bovis
GTPRGL

SEQ ID NO: 177540 - protein, 7 aa, Mycobacterium bovis
GTPRGPN

SEQ ID NO: 177541 - protein, 8 aa, Mycobacterium bovis
GTPRQVEN

SEQ ID NO: 177542 - protein, 6 aa, Mycobacterium bovis
GTPTFT

SEQ ID NO: 177543 - protein, 5 aa, Mycobacterium bovis
GTPVD

SEQ ID NO: 177544 - protein, 11 aa, Mycobacterium bovis
GTPVPPEPTEI

SEQ ID NO: 177545 - protein, 12 aa, Mycobacterium bovis
GTPVPSGTPKQR

SEQ ID NO: 177546 - protein, 4 aa, Mycobacterium bovis
GTQA

SEQ ID NO: 177547 - protein, 20 aa, Mycobacterium bovis
GTQGRKGKLDAAETEREHAA

SEQ ID NO: 177548 - protein, 6 aa, Mycobacterium bovis
GTQQNL

SEQ ID NO: 177549 - protein, 9 aa, Mycobacterium bovis
GTQRRAEAR

SEQ ID NO: 177550 - protein, 8 aa, Mycobacterium bovis
GTQSPLAD

SEQ ID NO: 177551 - protein, 10 aa, Mycobacterium bovis
GTRDQMARAE

SEQ ID NO: 177552 - protein, 12 aa, Mycobacterium bovis
GTREFSTPGRDD

SEQ ID NO: 177553 - protein, 12 aa, Mycobacterium bovis
GTREGSSVRGGA

SEQ ID NO: 177554 - protein, 5 aa, Mycobacterium bovis
GTREI

SEQ ID NO: 177555 - protein, 13 aa, Mycobacterium bovis
GTRGPDAKPYGAL

SEQ ID NO: 177556 - protein, 5 aa, Mycobacterium bovis
GTRGW

SEQ ID NO: 177557 - protein, 19 aa, Mycobacterium bovis
GTRIPTGATIEASTPDGAP

SEQ ID NO: 177558 - protein, 9 aa, Mycobacterium bovis
GTRNLTGAD

SEQ ID NO: 177559 - protein, 11 aa, Mycobacterium bovis
GTRPARPSGVE

SEQ ID NO: 177560 - protein, 6 aa, Mycobacterium bovis
GTRRGY

SEQ ID NO: 177561 - protein, 10 aa, Mycobacterium bovis
GTRTQVGYGP

SEQ ID NO: 177562 - protein, 11 aa, Mycobacterium bovis
GTRTRAGQPLT

SEQ ID NO: 177563 - protein, 7 aa, Mycobacterium bovis
GTSAATG

SEQ ID NO: 177564 - protein, 7 aa, Mycobacterium bovis
GTSAGGI

SEQ ID NO: 177565 - protein, 8 aa, Mycobacterium bovis
GTSAGGSL

SEQ ID NO: 177566 - protein, 10 aa, Mycobacterium bovis
GTSANQDGHT

SEQ ID NO: 177567 - protein, 8 aa, Mycobacterium bovis
GTSDISKP

SEQ ID NO: 177568 - protein, 22 aa, Mycobacterium bovis
GTSEAAARQLASRARKAVTAQP

SEQ ID NO: 177569 - protein, 16 aa, Mycobacterium bovis
GTSFPSRLRNPDKGFP

SEQ ID NO: 177570 - protein, 9 aa, Mycobacterium bovis
GTSGDPKAV

SEQ ID NO: 177571 - protein, 6 aa, Mycobacterium bovis
GTSGGR

SEQ ID NO: 177572 - protein, 12 aa, Mycobacterium bovis
GTSGHRGSALTG

SEQ ID NO: 177573 - protein, 12 aa, Mycobacterium bovis
GTSGKDLTVEQA

SEQ ID NO: 177574 - protein, 11 aa, Mycobacterium bovis
GTSGMKSALNG

SEQ ID NO: 177575 - protein, 9 aa, Mycobacterium bovis
GTSGNPKAV

SEQ ID NO: 177576 - protein, 4 aa, Mycobacterium bovis
GTSI

SEQ ID NO: 177577 - protein, 9 aa, Mycobacterium bovis
GTSNDEIQA

SEQ ID NO: 177578 - protein, 8 aa, Mycobacterium bovis
GTSRANAA

SEQ ID NO: 177579 - protein, 5 aa, Mycobacterium bovis
GTSRY

SEQ ID NO: 177580 - protein, 9 aa, Mycobacterium bovis
GTSSPRRAA

SEQ ID NO: 177581 - protein, 6 aa, Mycobacterium bovis
GTSVGG

SEQ ID NO: 177582 - protein, 4 aa, Mycobacterium bovis
GTTA

SEQ ID NO: 177583 - protein, 5 aa, Mycobacterium bovis
GTTAI

SEQ ID NO: 177584 - protein, 9 aa, Mycobacterium bovis
GTTARGTPL

SEQ ID NO: 177585 - protein, 12 aa, Mycobacterium bovis
GTTASTEEITDT

SEQ ID NO: 177586 - protein, 7 aa, Mycobacterium bovis
GTTEQRD

SEQ ID NO: 177587 - protein, 4 aa, Mycobacterium bovis
GTTF

SEQ ID NO: 177588 - protein, 12 aa, Mycobacterium bovis
GTTGDVVAPGTT

SEQ ID NO: 177589 - protein, 7 aa, Mycobacterium bovis
GTTGEPK

SEQ ID NO: 177590 - protein, 14 aa, Mycobacterium bovis
GTTGESPTTTDGEK

SEQ ID NO: 177591 - protein, 6 aa, Mycobacterium bovis
GTTGFP

SEQ ID NO: 177592 - protein, 5 aa, Mycobacterium bovis
GTTGL

SEQ ID NO: 177593 - protein, 7 aa, Mycobacterium bovis
GTTGLPK

SEQ ID NO: 177594 - protein, 9 aa, Mycobacterium bovis
GTTGRPKGA

SEQ ID NO: 177595 - protein, 15 aa, Mycobacterium bovis
GTTGSGDDIAAQTRD

SEQ ID NO: 177596 - protein, 6 aa, Mycobacterium bovis
GTTGTL

SEQ ID NO: 177597 - protein, 9 aa, Mycobacterium bovis
GTTGTPKGV

SEQ ID NO: 177598 - protein, 11 aa, Mycobacterium bovis
GTTHKASPGQV

SEQ ID NO: 177599 - protein, 7 aa, Mycobacterium bovis
GTTLGEA

SEQ ID NO: 177600 - protein, 5 aa, Mycobacterium bovis
GTTPA

SEQ ID NO: 177601 - protein, 6 aa, Mycobacterium bovis
GTTPVE

SEQ ID NO: 177602 - protein, 14 aa, Mycobacterium bovis
GTTRGRLDEQERAA

SEQ ID NO: 177603 - protein, 15 aa, Mycobacterium bovis
GTTRRDDGAIVSSGG

SEQ ID NO: 177604 - protein, 4 aa, Mycobacterium bovis
GTTT

SEQ ID NO: 177605 - protein, 6 aa, Mycobacterium bovis
GTTTRG

SEQ ID NO: 177606 - protein, 11 aa, Mycobacterium bovis
GTVAGRPNDGC

SEQ ID NO: 177607 - protein, 4 aa, Mycobacterium bovis
GTVD

SEQ ID NO: 177608 - protein, 10 aa, Mycobacterium bovis
GTVEYDADDR

SEQ ID NO: 177609 - protein, 5 aa, Mycobacterium bovis
GTVGR

SEQ ID NO: 177610 - protein, 5 aa, Mycobacterium bovis
GTVNG

SEQ ID NO: 177611 - protein, 10 aa, Mycobacterium bovis
GTVPNSHTPV

SEQ ID NO: 177612 - protein, 8 aa, Mycobacterium bovis
GTVRAGDT

SEQ ID NO: 177613 - protein, 11 aa, Mycobacterium bovis
GTVSEHNATRT

SEQ ID NO: 177614 - protein, 8 aa, Mycobacterium bovis
GTVTAKPS

SEQ ID NO: 177615 - protein, 9 aa, Mycobacterium bovis
GTVTATTSV

SEQ ID NO: 177616 - protein, 7 aa, Mycobacterium bovis
GTWDGPT

SEQ ID NO: 177617 - protein, 32 aa, Mycobacterium bovis
GTWGLPGGARDSHETPEQTAVRESSEEAGLSA

SEQ ID NO: 177618 - protein, 7 aa, Mycobacterium bovis
GTWKGQR

SEQ ID NO: 177619 - protein, 5 aa, Mycobacterium bovis
GTWTP

SEQ ID NO: 177620 - protein, 7 aa, Mycobacterium bovis
GTYDTEK

SEQ ID NO: 177621 - protein, 17 aa, Mycobacterium bovis
GTYNTGGYNVGSTNTGI

SEQ ID NO: 177622 - protein, 7 aa, Mycobacterium bovis
GTYRPTV

SEQ ID NO: 177623 - protein, 4 aa, Mycobacterium bovis
GTYT

SEQ ID NO: 177624 - protein, 9 aa, Mycobacterium bovis
GVAAGDGVK

SEQ ID NO: 177625 - protein, 7 aa, Mycobacterium bovis
GVADPDA

SEQ ID NO: 177626 - protein, 79 aa, Mycobacterium bovis
GVAGASGKGGAGGTGGNGGAGSAGADAPAGSGAMGSTGFAGGAGGDGGNGGGSGASQGNGGNGGNGGTGGKGGTGGAGM

SEQ ID NO: 177627 - protein, 6 aa, Mycobacterium bovis
GVAGGT

SEQ ID NO: 177628 - protein, 19 aa, Mycobacterium bovis
GVAGQGSSVVAGPNEVEPA

SEQ ID NO: 177629 - protein, 4 aa, Mycobacterium bovis
GVAK

SEQ ID NO: 177630 - protein, 5 aa, Mycobacterium bovis
GVAKS

SEQ ID NO: 177631 - protein, 4 aa, Mycobacterium bovis
GVAP

SEQ ID NO: 177632 - protein, 30 aa, Mycobacterium bovis
GVAQARGSGALQLSGSRAGEIEAWLPLVDL

SEQ ID NO: 177633 - protein, 5 aa, Mycobacterium bovis
GVARP

SEQ ID NO: 177634 - protein, 14 aa, Mycobacterium bovis
GVARSGVSAYPPEV

SEQ ID NO: 177635 - protein, 7 aa, Mycobacterium bovis
GVASGAG

SEQ ID NO: 177636 - protein, 4 aa, Mycobacterium bovis
GVAT

SEQ ID NO: 177637 - protein, 11 aa, Mycobacterium bovis
GVDNRSPGGST

SEQ ID NO: 177638 - protein, 8 aa, Mycobacterium bovis
GVDPGPKV

SEQ ID NO: 177639 - protein, 8 aa, Mycobacterium bovis
GVDPPVDC

SEQ ID NO: 177640 - protein, 13 aa, Mycobacterium bovis
GVDPQRGWGQRDE

SEQ ID NO: 177641 - protein, 5 aa, Mycobacterium bovis
GVDSA

SEQ ID NO: 177642 - protein, 10 aa, Mycobacterium bovis
GVDSARCDAE

SEQ ID NO: 177643 - protein, 5 aa, Mycobacterium bovis
GVDSP

SEQ ID NO: 177644 - protein, 6 aa, Mycobacterium bovis
GVEEAR

SEQ ID NO: 177645 - protein, 6 aa, Mycobacterium bovis
GVEELG

SEQ ID NO: 177646 - protein, 4 aa, Mycobacterium bovis
GVEK

SEQ ID NO: 177647 - protein, 4 aa, Mycobacterium bovis
GVEP

SEQ ID NO: 177648 - protein, 13 aa, Mycobacterium bovis
GVEPKDVASRRLG

SEQ ID NO: 177649 - protein, 14 aa, Mycobacterium bovis
GVEPPPVGSRRSRG

SEQ ID NO: 177650 - protein, 11 aa, Mycobacterium bovis
GVERKPTDAAV

SEQ ID NO: 177651 - protein, 5 aa, Mycobacterium bovis
GVESR

SEQ ID NO: 177652 - protein, 6 aa, Mycobacterium bovis
GVETEA

SEQ ID NO: 177653 - protein, 4 aa, Mycobacterium bovis
GVEV

SEQ ID NO: 177654 - protein, 5 aa, Mycobacterium bovis
GVGAA

SEQ ID NO: 177655 - protein, 6 aa, Mycobacterium bovis
GVGAGD

SEQ ID NO: 177656 - protein, 15 aa, Mycobacterium bovis
GVGASEGQTPDTVTT

SEQ ID NO: 177657 - protein, 4 aa, Mycobacterium bovis
GVGD

SEQ ID NO: 177658 - protein, 7 aa, Mycobacterium bovis
GVGDTGG

SEQ ID NO: 177659 - protein, 10 aa, Mycobacterium bovis
GVGEDITGGL

SEQ ID NO: 177660 - protein, 13 aa, Mycobacterium bovis
GVGETRSCGTGTV

SEQ ID NO: 177661 - protein, 11 aa, Mycobacterium bovis
GVGGAGGSGGT

SEQ ID NO: 177662 - protein, 14 aa, Mycobacterium bovis
GVGGATAAGVGGAH

SEQ ID NO: 177663 - protein, 7 aa, Mycobacterium bovis
GVGGGSL

SEQ ID NO: 177664 - protein, 19 aa, Mycobacterium bovis
GVGGLGGAGAAGGNGGAGG

SEQ ID NO: 177665 - protein, 8 aa, Mycobacterium bovis
GVGGPGGF

SEQ ID NO: 177666 - protein, 14 aa, Mycobacterium bovis
GVGGQAGAAGGAGL

SEQ ID NO: 177667 - protein, 11 aa, Mycobacterium bovis
GVGGSSEHPQY

SEQ ID NO: 177668 - protein, 5 aa, Mycobacterium bovis
GVGGT

SEQ ID NO: 177669 - protein, 25 aa, Mycobacterium bovis
GVGGVGGAATDTGGNGGAGGSGTGL

SEQ ID NO: 177670 - protein, 23 aa, Mycobacterium bovis
GVGGVGGKGGFGGAGGAGGNGGL

SEQ ID NO: 177671 - protein, 7 aa, Mycobacterium bovis
GVGKTEL

SEQ ID NO: 177672 - protein, 9 aa, Mycobacterium bovis
GVGKTTTAA

SEQ ID NO: 177673 - protein, 6 aa, Mycobacterium bovis
GVGNDQ

SEQ ID NO: 177674 - protein, 7 aa, Mycobacterium bovis
GVGNSGF

SEQ ID NO: 177675 - protein, 14 aa, Mycobacterium bovis
GVGNSGLTAGVPGL

SEQ ID NO: 177676 - protein, 11 aa, Mycobacterium bovis
GVGNSGNANIG

SEQ ID NO: 177677 - protein, 4 aa, Mycobacterium bovis
GVGP

SEQ ID NO: 177678 - protein, 12 aa, Mycobacterium bovis
GVGPATARAVAH

SEQ ID NO: 177679 - protein, 5 aa, Mycobacterium bovis
GVGPG

SEQ ID NO: 177680 - protein, 6 aa, Mycobacterium bovis
GVGPGS

SEQ ID NO: 177681 - protein, 16 aa, Mycobacterium bovis
GVGPPPYARSGPASAT

SEQ ID NO: 177682 - protein, 5 aa, Mycobacterium bovis
GVGPT

SEQ ID NO: 177683 - protein, 5 aa, Mycobacterium bovis
GVGPV

SEQ ID NO: 177684 - protein, 6 aa, Mycobacterium bovis
GVGRKT

SEQ ID NO: 177685 - protein, 4 aa, Mycobacterium bovis
GVGT

SEQ ID NO: 177686 - protein, 20 aa, Mycobacterium bovis
GVGTGAPGRRSRARNASGSV

SEQ ID NO: 177687 - protein, 29 aa, Mycobacterium bovis
GVHGAGGTGGQGGAGGAGGAGGAAGAGTV

SEQ ID NO: 177688 - protein, 13 aa, Mycobacterium bovis
GVHPDKSRNRKGS

SEQ ID NO: 177689 - protein, 7 aa, Mycobacterium bovis
GVHPGDP

SEQ ID NO: 177690 - protein, 6 aa, Mycobacterium bovis
GVIGRG

SEQ ID NO: 177691 - protein, 5 aa, Mycobacterium bovis
GVKDH

SEQ ID NO: 177692 - protein, 4 aa, Mycobacterium bovis
GVKE

SEQ ID NO: 177693 - protein, 16 aa, Mycobacterium bovis
GVKPAAASAGGDDDSW

SEQ ID NO: 177694 - protein, 6 aa, Mycobacterium bovis
GVKPPW

SEQ ID NO: 177695 - protein, 5 aa, Mycobacterium bovis
GVKRQ

SEQ ID NO: 177696 - protein, 4 aa, Mycobacterium bovis
GVMP

SEQ ID NO: 177697 - protein, 8 aa, Mycobacterium bovis
GVNGPNPR

SEQ ID NO: 177698 - protein, 8 aa, Mycobacterium bovis
GVNPTNDG

SEQ ID NO: 177699 - protein, 7 aa, Mycobacterium bovis
GVNTPAI

SEQ ID NO: 177700 - protein, 6 aa, Mycobacterium bovis
GVPADE

SEQ ID NO: 177701 - protein, 11 aa, Mycobacterium bovis
GVPADVSDAAG

SEQ ID NO: 177702 - protein, 11 aa, Mycobacterium bovis
GVPARGLNGEA

SEQ ID NO: 177703 - protein, 8 aa, Mycobacterium bovis
GVPDESYQ

SEQ ID NO: 177704 - protein, 6 aa, Mycobacterium bovis
GVPDGP

SEQ ID NO: 177705 - protein, 10 aa, Mycobacterium bovis
GVPDYVPPDS

SEQ ID NO: 177706 - protein, 8 aa, Mycobacterium bovis
GVPEGKSI

SEQ ID NO: 177707 - protein, 7 aa, Mycobacterium bovis
GVPEPVD

SEQ ID NO: 177708 - protein, 7 aa, Mycobacterium bovis
GVPPGRR

SEQ ID NO: 177709 - protein, 15 aa, Mycobacterium bovis
GVPPQISATPGMPER

SEQ ID NO: 177710 - protein, 5 aa, Mycobacterium bovis
GVPPT

SEQ ID NO: 177711 - protein, 9 aa, Mycobacterium bovis
GVPQPPLAD

SEQ ID NO: 177712 - protein, 4 aa, Mycobacterium bovis
GVPR

SEQ ID NO: 177713 - protein, 6 aa, Mycobacterium bovis
GVPTEQ

SEQ ID NO: 177714 - protein, 8 aa, Mycobacterium bovis
GVPTPGLG

SEQ ID NO: 177715 - protein, 9 aa, Mycobacterium bovis
GVPTSAPER

SEQ ID NO: 177716 - protein, 5 aa, Mycobacterium bovis
GVPVT

SEQ ID NO: 177717 - protein, 21 aa, Mycobacterium bovis
GVQAGSTGAGQSTSAGENFGN

SEQ ID NO: 177718 - protein, 9 aa, Mycobacterium bovis
GVQAGTATG

SEQ ID NO: 177719 - protein, 10 aa, Mycobacterium bovis
GVQGDGRTYG

SEQ ID NO: 177720 - protein, 7 aa, Mycobacterium bovis
GVQKDDK

SEQ ID NO: 177721 - protein, 5 aa, Mycobacterium bovis
GVQTP

SEQ ID NO: 177722 - protein, 8 aa, Mycobacterium bovis
GVQTRAPR

SEQ ID NO: 177723 - protein, 5 aa, Mycobacterium bovis
GVRAQ

SEQ ID NO: 177724 - protein, 8 aa, Mycobacterium bovis
GVRASEQR

SEQ ID NO: 177725 - protein, 10 aa, Mycobacterium bovis
GVRDTPEAAR

SEQ ID NO: 177726 - protein, 7 aa, Mycobacterium bovis
GVRGGGR

SEQ ID NO: 177727 - protein, 5 aa, Mycobacterium bovis
GVRPD

SEQ ID NO: 177728 - protein, 12 aa, Mycobacterium bovis
GVRPPTRTVRGL

SEQ ID NO: 177729 - protein, 5 aa, Mycobacterium bovis
GVRQG

SEQ ID NO: 177730 - protein, 8 aa, Mycobacterium bovis
GVRRTRSK

SEQ ID NO: 177731 - protein, 5 aa, Mycobacterium bovis
GVRST

SEQ ID NO: 177732 - protein, 10 aa, Mycobacterium bovis
GVSADRTRYD

SEQ ID NO: 177733 - protein, 9 aa, Mycobacterium bovis
GVSATPETL

SEQ ID NO: 177734 - protein, 4 aa, Mycobacterium bovis
GVSG

SEQ ID NO: 177735 - protein, 6 aa, Mycobacterium bovis
GVSGLS

SEQ ID NO: 177736 - protein, 5 aa, Mycobacterium bovis
GVSGT

SEQ ID NO: 177737 - protein, 7 aa, Mycobacterium bovis
GVSKSEV

SEQ ID NO: 177738 - protein, 9 aa, Mycobacterium bovis
GVSPDSYPT

SEQ ID NO: 177739 - protein, 10 aa, Mycobacterium bovis
GVSPGNDGRG

SEQ ID NO: 177740 - protein, 21 aa, Mycobacterium bovis
GVSQDTKDVTTLGRGGSDTTA

SEQ ID NO: 177741 - protein, 5 aa, Mycobacterium bovis
GVSQR

SEQ ID NO: 177742 - protein, 5 aa, Mycobacterium bovis
GVSSG

SEQ ID NO: 177743 - protein, 9 aa, Mycobacterium bovis
GVSSSGCGV

SEQ ID NO: 177744 - protein, 7 aa, Mycobacterium bovis
GVTAESI

SEQ ID NO: 177745 - protein, 6 aa, Mycobacterium bovis
GVTAQE

SEQ ID NO: 177746 - protein, 4 aa, Mycobacterium bovis
GVTD

SEQ ID NO: 177747 - protein, 15 aa, Mycobacterium bovis
GVTGARDAVSQAAPE

SEQ ID NO: 177748 - protein, 14 aa, Mycobacterium bovis
GVTGHPDHRRATEA

SEQ ID NO: 177749 - protein, 11 aa, Mycobacterium bovis
GVTGPDGPSHH

SEQ ID NO: 177750 - protein, 6 aa, Mycobacterium bovis
GVTGQG

SEQ ID NO: 177751 - protein, 7 aa, Mycobacterium bovis
GVTGSAA

SEQ ID NO: 177752 - protein, 8 aa, Mycobacterium bovis
GVTKDASM

SEQ ID NO: 177753 - protein, 18 aa, Mycobacterium bovis
GVTNPGYRPGDTATALPA

SEQ ID NO: 177754 - protein, 9 aa, Mycobacterium bovis
GVTPQQATE

SEQ ID NO: 177755 - protein, 8 aa, Mycobacterium bovis
GVTSGASV

SEQ ID NO: 177756 - protein, 14 aa, Mycobacterium bovis
GVTTGGAGGTGGAA

SEQ ID NO: 177757 - protein, 7 aa, Mycobacterium bovis
GVTVTED

SEQ ID NO: 177758 - protein, 20 aa, Mycobacterium bovis
GVVADSNGSYEYNEARNKAR

SEQ ID NO: 177759 - protein, 6 aa, Mycobacterium bovis
GVYRGD

SEQ ID NO: 177760 - protein, 15 aa, Mycobacterium bovis
GWDGRNGQDFGRGDD

SEQ ID NO: 177761 - protein, 10 aa, Mycobacterium bovis
GWKTKEPGIE

SEQ ID NO: 177762 - protein, 4 aa, Mycobacterium bovis
GWLG

SEQ ID NO: 177763 - protein, 6 aa, Mycobacterium bovis
GWQGGE

SEQ ID NO: 177764 - protein, 6 aa, Mycobacterium bovis
GWQPEG

SEQ ID NO: 177765 - protein, 6 aa, Mycobacterium bovis
GWQPMP

SEQ ID NO: 177766 - protein, 6 aa, Mycobacterium bovis
GWRPGD

SEQ ID NO: 177767 - protein, 13 aa, Mycobacterium bovis
GWRRGATQGHSGT

SEQ ID NO: 177768 - protein, 23 aa, Mycobacterium bovis
GWSAPPGAGAKELAEAAGAGDPV

SEQ ID NO: 177769 - protein, 4 aa, Mycobacterium bovis
GWSP

SEQ ID NO: 177770 - protein, 4 aa, Mycobacterium bovis
GWSS

SEQ ID NO: 177771 - protein, 13 aa, Mycobacterium bovis
GWTTRKNAHGDTE

SEQ ID NO: 177772 - protein, 9 aa, Mycobacterium bovis
GYAATGIDG

SEQ ID NO: 177773 - protein, 8 aa, Mycobacterium bovis
GYAATSIS

SEQ ID NO: 177774 - protein, 4 aa, Mycobacterium bovis
GYAG

SEQ ID NO: 177775 - protein, 8 aa, Mycobacterium bovis
GYAGLSDT

SEQ ID NO: 177776 - protein, 19 aa, Mycobacterium bovis
GYANPADNPFRPEGGRLHA

SEQ ID NO: 177777 - protein, 5 aa, Mycobacterium bovis
GYAPG

SEQ ID NO: 177778 - protein, 5 aa, Mycobacterium bovis
GYASG

SEQ ID NO: 177779 - protein, 8 aa, Mycobacterium bovis
GYDGAGLQ

SEQ ID NO: 177780 - protein, 5 aa, Mycobacterium bovis
GYDSS

SEQ ID NO: 177781 - protein, 7 aa, Mycobacterium bovis
GYEGEVR

SEQ ID NO: 177782 - protein, 5 aa, Mycobacterium bovis
GYENK

SEQ ID NO: 177783 - protein, 14 aa, Mycobacterium bovis
GYEPRRPAGPGDDE

SEQ ID NO: 177784 - protein, 9 aa, Mycobacterium bovis
GYESPTAIQ

SEQ ID NO: 177785 - protein, 15 aa, Mycobacterium bovis
GYGADKLASPVGRGR

SEQ ID NO: 177786 - protein, 13 aa, Mycobacterium bovis
GYGGSDKPPRGYD

SEQ ID NO: 177787 - protein, 6 aa, Mycobacterium bovis
GYGNRD

SEQ ID NO: 177788 - protein, 4 aa, Mycobacterium bovis
GYGQ

SEQ ID NO: 177789 - protein, 7 aa, Mycobacterium bovis
GYGSAGE

SEQ ID NO: 177790 - protein, 11 aa, Mycobacterium bovis
GYGSNPNLPGQ

SEQ ID NO: 177791 - protein, 9 aa, Mycobacterium bovis
GYGYPEAGQ

SEQ ID NO: 177792 - protein, 6 aa, Mycobacterium bovis
GYHRRE

SEQ ID NO: 177793 - protein, 10 aa, Mycobacterium bovis
GYIDGNTADG

SEQ ID NO: 177794 - protein, 14 aa, Mycobacterium bovis
GYKPNTKPHSRQVR

SEQ ID NO: 177795 - protein, 8 aa, Mycobacterium bovis
GYKPTLPG

SEQ ID NO: 177796 - protein, 11 aa, Mycobacterium bovis
GYNAPESTSPW

SEQ ID NO: 177797 - protein, 6 aa, Mycobacterium bovis
GYNEDE

SEQ ID NO: 177798 - protein, 16 aa, Mycobacterium bovis
GYPDARPALEEARRRG

SEQ ID NO: 177799 - protein, 8 aa, Mycobacterium bovis
GYPDGPAA

SEQ ID NO: 177800 - protein, 7 aa, Mycobacterium bovis
GYPDVPA

SEQ ID NO: 177801 - protein, 6 aa, Mycobacterium bovis
GYPGGL

SEQ ID NO: 177802 - protein, 6 aa, Mycobacterium bovis
GYPGRH

SEQ ID NO: 177803 - protein, 7 aa, Mycobacterium bovis
GYPPGVH

SEQ ID NO: 177804 - protein, 14 aa, Mycobacterium bovis
GYPPLGEDSLPRAT

SEQ ID NO: 177805 - protein, 23 aa, Mycobacterium bovis
GYPPSDGPPRRGQAYTGTDRQVR

SEQ ID NO: 177806 - protein, 5 aa, Mycobacterium bovis
GYPRR

SEQ ID NO: 177807 - protein, 8 aa, Mycobacterium bovis
GYQAVGSG

SEQ ID NO: 177808 - protein, 4 aa, Mycobacterium bovis
GYQS

SEQ ID NO: 177809 - protein, 5 aa, Mycobacterium bovis
GYRDT

SEQ ID NO: 177810 - protein, 4 aa, Mycobacterium bovis
GYRP

SEQ ID NO: 177811 - protein, 7 aa, Mycobacterium bovis
GYRPETP

SEQ ID NO: 177812 - protein, 10 aa, Mycobacterium bovis
GYRRRTDSKD

SEQ ID NO: 177813 - protein, 19 aa, Mycobacterium bovis
GYSGGNIPNATYRNHGTHA

SEQ ID NO: 177814 - protein, 10 aa, Mycobacterium bovis
GYSGQALSDE

SEQ ID NO: 177815 - protein, 6 aa, Mycobacterium bovis
GYSPGD

SEQ ID NO: 177816 - protein, 5 aa, Mycobacterium bovis
GYSTE

SEQ ID NO: 177817 - protein, 11 aa, Mycobacterium bovis
GYTDNTGSEGI

SEQ ID NO: 177818 - protein, 5 aa, Mycobacterium bovis
GYTGA

SEQ ID NO: 177819 - protein, 6 aa, Mycobacterium bovis
GYTGEH

SEQ ID NO: 177820 - protein, 7 aa, Mycobacterium bovis
GYTGSPT

SEQ ID NO: 177821 - protein, 6 aa, Mycobacterium bovis
GYTSSL

SEQ ID NO: 177822 - protein, 5 aa, Mycobacterium bovis
GYTYG

SEQ ID NO: 177823 - protein, 12 aa, Mycobacterium bovis
GYVATTTRVGGP

SEQ ID NO: 177824 - protein, 7 aa, Mycobacterium bovis
GYVEDSG

SEQ ID NO: 177825 - protein, 4 aa, Mycobacterium bovis
GYYG

SEQ ID NO: 177826 - protein, 6 aa, Mycobacterium bovis
HAAAAG

SEQ ID NO: 177827 - protein, 17 aa, Mycobacterium bovis
HAAAGVPAQAAAAPVDV

SEQ ID NO: 177828 - protein, 15 aa, Mycobacterium bovis
HAAAPGWGKTAPAER

SEQ ID NO: 177829 - protein, 4 aa, Mycobacterium bovis
HAAG

SEQ ID NO: 177830 - protein, 5 aa, Mycobacterium bovis
HAAQR

SEQ ID NO: 177831 - protein, 12 aa, Mycobacterium bovis
HAARGAPARGLP

SEQ ID NO: 177832 - protein, 12 aa, Mycobacterium bovis
HAATAGAQAALD

SEQ ID NO: 177833 - protein, 7 aa, Mycobacterium bovis
HADESKL

SEQ ID NO: 177834 - protein, 15 aa, Mycobacterium bovis
HADPHSYQASPADAA

SEQ ID NO: 177835 - protein, 6 aa, Mycobacterium bovis
HADQLG

SEQ ID NO: 177836 - protein, 5 aa, Mycobacterium bovis
HADTR

SEQ ID NO: 177837 - protein, 9 aa, Mycobacterium bovis
HAEAANAAR

SEQ ID NO: 177838 - protein, 7 aa, Mycobacterium bovis
HAEADRL

SEQ ID NO: 177839 - protein, 4 aa, Mycobacterium bovis
HAEI

SEQ ID NO: 177840 - protein, 8 aa, Mycobacterium bovis
HAEPDEEK

SEQ ID NO: 177841 - protein, 5 aa, Mycobacterium bovis
HAERV

SEQ ID NO: 177842 - protein, 5 aa, Mycobacterium bovis
HAETE

SEQ ID NO: 177843 - protein, 7 aa, Mycobacterium bovis
HAGAAPA

SEQ ID NO: 177844 - protein, 7 aa, Mycobacterium bovis
HAGARGV

SEQ ID NO: 177845 - protein, 12 aa, Mycobacterium bovis
HAGDEISTYPTR

SEQ ID NO: 177846 - protein, 7 aa, Mycobacterium bovis
HAGGDGA

SEQ ID NO: 177847 - protein, 5 aa, Mycobacterium bovis
HAGGE

SEQ ID NO: 177848 - protein, 5 aa, Mycobacterium bovis
HAGGV

SEQ ID NO: 177849 - protein, 4 aa, Mycobacterium bovis
HAGK

SEQ ID NO: 177850 - protein, 6 aa, Mycobacterium bovis
HAGPAA

SEQ ID NO: 177851 - protein, 7 aa, Mycobacterium bovis
HAGPGIP

SEQ ID NO: 177852 - protein, 11 aa, Mycobacterium bovis
HAGPRKSALDE

SEQ ID NO: 177853 - protein, 15 aa, Mycobacterium bovis
HAGPVADARSNQATA

SEQ ID NO: 177854 - protein, 5 aa, Mycobacterium bovis
HAGRS

SEQ ID NO: 177855 - protein, 5 aa, Mycobacterium bovis
HAKGE

SEQ ID NO: 177856 - protein, 14 aa, Mycobacterium bovis
HALSSPGRRSNSVP

SEQ ID NO: 177857 - protein, 8 aa, Mycobacterium bovis
HANDEGRQ

SEQ ID NO: 177858 - protein, 6 aa, Mycobacterium bovis
HANGVT

SEQ ID NO: 177859 - protein, 8 aa, Mycobacterium bovis
HANRDQED

SEQ ID NO: 177860 - protein, 13 aa, Mycobacterium bovis
HANTGLANAGTFG

SEQ ID NO: 177861 - protein, 4 aa, Mycobacterium bovis
HAPA

SEQ ID NO: 177862 - protein, 11 aa, Mycobacterium bovis
HAPAGDQPAAI

SEQ ID NO: 177863 - protein, 10 aa, Mycobacterium bovis
HAPAKEDEEV

SEQ ID NO: 177864 - protein, 6 aa, Mycobacterium bovis
HAPDDI

SEQ ID NO: 177865 - protein, 11 aa, Mycobacterium bovis
HAPDPARARPL

SEQ ID NO: 177866 - protein, 6 aa, Mycobacterium bovis
HAPGDD

SEQ ID NO: 177867 - protein, 5 aa, Mycobacterium bovis
HAPGE

SEQ ID NO: 177868 - protein, 6 aa, Mycobacterium bovis
HAPHAE

SEQ ID NO: 177869 - protein, 5 aa, Mycobacterium bovis
HAPPE

SEQ ID NO: 177870 - protein, 19 aa, Mycobacterium bovis
HAPPTMPQMPPPDSDPEEV

SEQ ID NO: 177871 - protein, 5 aa, Mycobacterium bovis
HAPRP

SEQ ID NO: 177872 - protein, 14 aa, Mycobacterium bovis
HAPTPTNAATARLA

SEQ ID NO: 177873 - protein, 4 aa, Mycobacterium bovis
HAQG

SEQ ID NO: 177874 - protein, 11 aa, Mycobacterium bovis
HARAGAAAAAV

SEQ ID NO: 177875 - protein, 10 aa, Mycobacterium bovis
HARGEDTQRD

SEQ ID NO: 177876 - protein, 8 aa, Mycobacterium bovis
HARSTGPY

SEQ ID NO: 177877 - protein, 8 aa, Mycobacterium bovis
HASGTAWA

SEQ ID NO: 177878 - protein, 4 aa, Mycobacterium bovis
HAST

SEQ ID NO: 177879 - protein, 11 aa, Mycobacterium bovis
HASTAGSQLEV

SEQ ID NO: 177880 - protein, 7 aa, Mycobacterium bovis
HASVPPS

SEQ ID NO: 177881 - protein, 6 aa, Mycobacterium bovis
HATAPF

SEQ ID NO: 177882 - protein, 185 aa, Mycobacterium bovis
HATDGADGTTGPDGNGTDAGSGSNAVNPGVGGGAGGIGGDGTNLGQTDVSGGAGGDGGDGANFASGGAGGNGGAAQSGFGDAVGGNGGAGGNGGAGGGGGLGGAGGSANVANAGNSIGGNGGAGGNGGIGAPGGAGGAGGNANQDNPPGGNSTGGNGGAGGDGGVGASADVGGAGGFGGSGGRGG

SEQ ID NO: 177883 - protein, 5 aa, Mycobacterium bovis
HATEY

SEQ ID NO: 177884 - protein, 14 aa, Mycobacterium bovis
HATGASAGAQQTTL

SEQ ID NO: 177885 - protein, 9 aa, Mycobacterium bovis
HATGTQVGD

SEQ ID NO: 177886 - protein, 4 aa, Mycobacterium bovis
HATH

SEQ ID NO: 177887 - protein, 11 aa, Mycobacterium bovis
HATTAGATPVE

SEQ ID NO: 177888 - protein, 8 aa, Mycobacterium bovis
HAYGGGSQ

SEQ ID NO: 177889 - protein, 7 aa, Mycobacterium bovis
HDAAARV

SEQ ID NO: 177890 - protein, 8 aa, Mycobacterium bovis
HDAERENK

SEQ ID NO: 177891 - protein, 8 aa, Mycobacterium bovis
HDAGPENI

SEQ ID NO: 177892 - protein, 12 aa, Mycobacterium bovis
HDAHPAGADPGL

SEQ ID NO: 177893 - protein, 7 aa, Mycobacterium bovis
HDAPPAT

SEQ ID NO: 177894 - protein, 6 aa, Mycobacterium bovis
HDASTI

SEQ ID NO: 177895 - protein, 19 aa, Mycobacterium bovis
HDATTSSALRSALSLLGKA

SEQ ID NO: 177896 - protein, 4 aa, Mycobacterium bovis
HDDG

SEQ ID NO: 177897 - protein, 5 aa, Mycobacterium bovis
HDDGV

SEQ ID NO: 177898 - protein, 4 aa, Mycobacterium bovis
HDDP

SEQ ID NO: 177899 - protein, 7 aa, Mycobacterium bovis
HDDPHTG

SEQ ID NO: 177900 - protein, 6 aa, Mycobacterium bovis
HDDQVR

SEQ ID NO: 177901 - protein, 8 aa, Mycobacterium bovis
HDDSSSIT

SEQ ID NO: 177902 - protein, 5 aa, Mycobacterium bovis
HDEPG

SEQ ID NO: 177903 - protein, 5 aa, Mycobacterium bovis
HDERN

SEQ ID NO: 177904 - protein, 8 aa, Mycobacterium bovis
HDERTRAK

SEQ ID NO: 177905 - protein, 8 aa, Mycobacterium bovis
HDETTSDG

SEQ ID NO: 177906 - protein, 6 aa, Mycobacterium bovis
HDGDAD

SEQ ID NO: 177907 - protein, 8 aa, Mycobacterium bovis
HDGDPPPE

SEQ ID NO: 177908 - protein, 6 aa, Mycobacterium bovis
HDGDTV

SEQ ID NO: 177909 - protein, 5 aa, Mycobacterium bovis
HDGEA

SEQ ID NO: 177910 - protein, 6 aa, Mycobacterium bovis
HDGESD

SEQ ID NO: 177911 - protein, 4 aa, Mycobacterium bovis
HDGG

SEQ ID NO: 177912 - protein, 11 aa, Mycobacterium bovis
HDGGTGATPLT

SEQ ID NO: 177913 - protein, 8 aa, Mycobacterium bovis
HDGNTGHA

SEQ ID NO: 177914 - protein, 6 aa, Mycobacterium bovis
HDGQEA

SEQ ID NO: 177915 - protein, 7 aa, Mycobacterium bovis
HDGRPHR

SEQ ID NO: 177916 - protein, 8 aa, Mycobacterium bovis
HDGRPQLS

SEQ ID NO: 177917 - protein, 13 aa, Mycobacterium bovis
HDHNDSPEQHRTC

SEQ ID NO: 177918 - protein, 9 aa, Mycobacterium bovis
HDLDQASPH

SEQ ID NO: 177919 - protein, 10 aa, Mycobacterium bovis
HDLGASAGAP

SEQ ID NO: 177920 - protein, 22 aa, Mycobacterium bovis
HDLGSADDIRERSPGPDQHPSY

SEQ ID NO: 177921 - protein, 7 aa, Mycobacterium bovis
HDLGSKT

SEQ ID NO: 177922 - protein, 8 aa, Mycobacterium bovis
HDLPPTAG

SEQ ID NO: 177923 - protein, 9 aa, Mycobacterium bovis
HDNDGSGAA

SEQ ID NO: 177924 - protein, 4 aa, Mycobacterium bovis
HDPA

SEQ ID NO: 177925 - protein, 6 aa, Mycobacterium bovis
HDPAAR

SEQ ID NO: 177926 - protein, 7 aa, Mycobacterium bovis
HDPHPSP

SEQ ID NO: 177927 - protein, 7 aa, Mycobacterium bovis
HDPLRDD

SEQ ID NO: 177928 - protein, 5 aa, Mycobacterium bovis
HDPQA

SEQ ID NO: 177929 - protein, 13 aa, Mycobacterium bovis
HDPRDSTSVDAEV

SEQ ID NO: 177930 - protein, 6 aa, Mycobacterium bovis
HDPSDT

SEQ ID NO: 177931 - protein, 9 aa, Mycobacterium bovis
HDQPGGAPG

SEQ ID NO: 177932 - protein, 4 aa, Mycobacterium bovis
HDQR

SEQ ID NO: 177933 - protein, 9 aa, Mycobacterium bovis
HDQTAARRE

SEQ ID NO: 177934 - protein, 5 aa, Mycobacterium bovis
HDQYN

SEQ ID NO: 177935 - protein, 7 aa, Mycobacterium bovis
HDRDDAM

SEQ ID NO: 177936 - protein, 6 aa, Mycobacterium bovis
HDRDID

SEQ ID NO: 177937 - protein, 10 aa, Mycobacterium bovis
HDRPLAPRGI

SEQ ID NO: 177938 - protein, 5 aa, Mycobacterium bovis
HDRPP

SEQ ID NO: 177939 - protein, 6 aa, Mycobacterium bovis
HDRSEA

SEQ ID NO: 177940 - protein, 4 aa, Mycobacterium bovis
HDRT

SEQ ID NO: 177941 - protein, 11 aa, Mycobacterium bovis
HDRTQQNTPAW

SEQ ID NO: 177942 - protein, 4 aa, Mycobacterium bovis
HDSG

SEQ ID NO: 177943 - protein, 6 aa, Mycobacterium bovis
HDSSHE

SEQ ID NO: 177944 - protein, 4 aa, Mycobacterium bovis
HDTE

SEQ ID NO: 177945 - protein, 4 aa, Mycobacterium bovis
HDTL

SEQ ID NO: 177946 - protein, 15 aa, Mycobacterium bovis
HDTPDEMAYPDGTER

SEQ ID NO: 177947 - protein, 8 aa, Mycobacterium bovis
HDTPGGQL

SEQ ID NO: 177948 - protein, 15 aa, Mycobacterium bovis
HDTSTLANDPNETEL

SEQ ID NO: 177949 - protein, 7 aa, Mycobacterium bovis
HDTTATG

SEQ ID NO: 177950 - protein, 6 aa, Mycobacterium bovis
HDTTNR

SEQ ID NO: 177951 - protein, 11 aa, Mycobacterium bovis
HDVGRGRGGVS

SEQ ID NO: 177952 - protein, 7 aa, Mycobacterium bovis
HEAAGAA

SEQ ID NO: 177953 - protein, 7 aa, Mycobacterium bovis
HEADSQT

SEQ ID NO: 177954 - protein, 10 aa, Mycobacterium bovis
HEANDWPSPP

SEQ ID NO: 177955 - protein, 9 aa, Mycobacterium bovis
HEDDSFDEE

SEQ ID NO: 177956 - protein, 5 aa, Mycobacterium bovis
HEDQK

SEQ ID NO: 177957 - protein, 16 aa, Mycobacterium bovis
HEDVGADEVGGHQHPA

SEQ ID NO: 177958 - protein, 8 aa, Mycobacterium bovis
HEEAPEEV

SEQ ID NO: 177959 - protein, 10 aa, Mycobacterium bovis
HEENKDAFAG

SEQ ID NO: 177960 - protein, 4 aa, Mycobacterium bovis
HEEY

SEQ ID NO: 177961 - protein, 5 aa, Mycobacterium bovis
HEGAG

SEQ ID NO: 177962 - protein, 12 aa, Mycobacterium bovis
HEGDGGQGSKPV

SEQ ID NO: 177963 - protein, 14 aa, Mycobacterium bovis
HEGDTAAAVAILEA

SEQ ID NO: 177964 - protein, 6 aa, Mycobacterium bovis
HEGESD

SEQ ID NO: 177965 - protein, 6 aa, Mycobacterium bovis
HEGLTR

SEQ ID NO: 177966 - protein, 12 aa, Mycobacterium bovis
HEGQGPDHTSAR

SEQ ID NO: 177967 - protein, 6 aa, Mycobacterium bovis
HEGSGV

SEQ ID NO: 177968 - protein, 12 aa, Mycobacterium bovis
HENASAAASTTA

SEQ ID NO: 177969 - protein, 10 aa, Mycobacterium bovis
HENVTTGHQN

SEQ ID NO: 177970 - protein, 9 aa, Mycobacterium bovis
HEPDRSDAA

SEQ ID NO: 177971 - protein, 5 aa, Mycobacterium bovis
HEPSE

SEQ ID NO: 177972 - protein, 5 aa, Mycobacterium bovis
HEQTA

SEQ ID NO: 177973 - protein, 6 aa, Mycobacterium bovis
HERTER

SEQ ID NO: 177974 - protein, 4 aa, Mycobacterium bovis
HESM

SEQ ID NO: 177975 - protein, 9 aa, Mycobacterium bovis
HESNDALAE

SEQ ID NO: 177976 - protein, 4 aa, Mycobacterium bovis
HETD

SEQ ID NO: 177977 - protein, 10 aa, Mycobacterium bovis
HEVGSGGQAE

SEQ ID NO: 177978 - protein, 8 aa, Mycobacterium bovis
HFPNEQSA

SEQ ID NO: 177979 - protein, 6 aa, Mycobacterium bovis
HGAEPD

SEQ ID NO: 177980 - protein, 4 aa, Mycobacterium bovis
HGAL

SEQ ID NO: 177981 - protein, 7 aa, Mycobacterium bovis
HGANAPT

SEQ ID NO: 177982 - protein, 4 aa, Mycobacterium bovis
HGAP

SEQ ID NO: 177983 - protein, 7 aa, Mycobacterium bovis
HGAQPRA

SEQ ID NO: 177984 - protein, 7 aa, Mycobacterium bovis
HGCSDDH

SEQ ID NO: 177985 - protein, 5 aa, Mycobacterium bovis
HGDAE

SEQ ID NO: 177986 - protein, 7 aa, Mycobacterium bovis
HGDDAGR

SEQ ID NO: 177987 - protein, 10 aa, Mycobacterium bovis
HGDPPPGGST

SEQ ID NO: 177988 - protein, 8 aa, Mycobacterium bovis
HGDQDVAP

SEQ ID NO: 177989 - protein, 9 aa, Mycobacterium bovis
HGDQRRATT

SEQ ID NO: 177990 - protein, 12 aa, Mycobacterium bovis
HGDSDKPRDYPY

SEQ ID NO: 177991 - protein, 4 aa, Mycobacterium bovis
HGED

SEQ ID NO: 177992 - protein, 7 aa, Mycobacterium bovis
HGEGGSV

SEQ ID NO: 177993 - protein, 12 aa, Mycobacterium bovis
HGERADRLRSYA

SEQ ID NO: 177994 - protein, 14 aa, Mycobacterium bovis
HGGAGGAGGDRAGA

SEQ ID NO: 177995 - protein, 33 aa, Mycobacterium bovis
HGGAGGNGGDGGHGGSGKAGGSGGSGGFGQFGG

SEQ ID NO: 177996 - protein, 6 aa, Mycobacterium bovis
HGGASM

SEQ ID NO: 177997 - protein, 5 aa, Mycobacterium bovis
HGGDD

SEQ ID NO: 177998 - protein, 6 aa, Mycobacterium bovis
HGGDGV

SEQ ID NO: 177999 - protein, 16 aa, Mycobacterium bovis
HGGGEPPPYLGASSAN

SEQ ID NO: 178000 - protein, 7 aa, Mycobacterium bovis
HGGISGR

SEQ ID NO: 178001 - protein, 24 aa, Mycobacterium bovis
HGGNGGAGGSNAAGAGGVGGAGGA

SEQ ID NO: 178002 - protein, 21 aa, Mycobacterium bovis
HGGNGGVGALGANGGAGGTGG

SEQ ID NO: 178003 - protein, 7 aa, Mycobacterium bovis
HGGPEQL

SEQ ID NO: 178004 - protein, 8 aa, Mycobacterium bovis
HGGPTELA

SEQ ID NO: 178005 - protein, 4 aa, Mycobacterium bovis
HGGQ

SEQ ID NO: 178006 - protein, 6 aa, Mycobacterium bovis
HGGQAT

SEQ ID NO: 178007 - protein, 7 aa, Mycobacterium bovis
HGGRQLD

SEQ ID NO: 178008 - protein, 11 aa, Mycobacterium bovis
HGGSGGAGGHG

SEQ ID NO: 178009 - protein, 21 aa, Mycobacterium bovis
HGGTGGAGGTGASGGKGGTGG

SEQ ID NO: 178010 - protein, 57 aa, Mycobacterium bovis
HGGTGGPGGNGGSTGAGGTGGAGGPGGLYGAGGSGGAGGHGGMAGGGGGVGGNAGSL

SEQ ID NO: 178011 - protein, 12 aa, Mycobacterium bovis
HGGTNTRELPSA

SEQ ID NO: 178012 - protein, 4 aa, Mycobacterium bovis
HGKG

SEQ ID NO: 178013 - protein, 4 aa, Mycobacterium bovis
HGKP

SEQ ID NO: 178014 - protein, 7 aa, Mycobacterium bovis
HGKPDGL

SEQ ID NO: 178015 - protein, 10 aa, Mycobacterium bovis
HGKPVKQGEV

SEQ ID NO: 178016 - protein, 5 aa, Mycobacterium bovis
HGLSE

SEQ ID NO: 178017 - protein, 4 aa, Mycobacterium bovis
HGMN

SEQ ID NO: 178018 - protein, 6 aa, Mycobacterium bovis
HGMPGV

SEQ ID NO: 178019 - protein, 8 aa, Mycobacterium bovis
HGNRQRAH

SEQ ID NO: 178020 - protein, 10 aa, Mycobacterium bovis
HGPAPRPTIP

SEQ ID NO: 178021 - protein, 9 aa, Mycobacterium bovis
HGPDALQTR

SEQ ID NO: 178022 - protein, 12 aa, Mycobacterium bovis
HGPGPSSARGAE

SEQ ID NO: 178023 - protein, 10 aa, Mycobacterium bovis
HGPGTPIGDP

SEQ ID NO: 178024 - protein, 10 aa, Mycobacterium bovis
HGPGTPVGDP

SEQ ID NO: 178025 - protein, 5 aa, Mycobacterium bovis
HGPGW

SEQ ID NO: 178026 - protein, 15 aa, Mycobacterium bovis
HGPKPRDYSQRTPKK

SEQ ID NO: 178027 - protein, 11 aa, Mycobacterium bovis
HGPNSEPVEEE

SEQ ID NO: 178028 - protein, 12 aa, Mycobacterium bovis
HGPPGTGKTYTA

SEQ ID NO: 178029 - protein, 7 aa, Mycobacterium bovis
HGPQVDK

SEQ ID NO: 178030 - protein, 11 aa, Mycobacterium bovis
HGPVEQRSERQ

SEQ ID NO: 178031 - protein, 10 aa, Mycobacterium bovis
HGPVTGPDGI

SEQ ID NO: 178032 - protein, 4 aa, Mycobacterium bovis
HGQL

SEQ ID NO: 178033 - protein, 8 aa, Mycobacterium bovis
HGQPRTNS

SEQ ID NO: 178034 - protein, 8 aa, Mycobacterium bovis
HGQPRTNT

SEQ ID NO: 178035 - protein, 5 aa, Mycobacterium bovis
HGQQY

SEQ ID NO: 178036 - protein, 11 aa, Mycobacterium bovis
HGQSDKPRADY

SEQ ID NO: 178037 - protein, 12 aa, Mycobacterium bovis
HGQVDSADLATQ

SEQ ID NO: 178038 - protein, 4 aa, Mycobacterium bovis
HGRF

SEQ ID NO: 178039 - protein, 7 aa, Mycobacterium bovis
HGRGDSK

SEQ ID NO: 178040 - protein, 6 aa, Mycobacterium bovis
HGRGGL

SEQ ID NO: 178041 - protein, 7 aa, Mycobacterium bovis
HGRPDKK

SEQ ID NO: 178042 - protein, 8 aa, Mycobacterium bovis
HGRSGPIP

SEQ ID NO: 178043 - protein, 5 aa, Mycobacterium bovis
HGRWP

SEQ ID NO: 178044 - protein, 4 aa, Mycobacterium bovis
HGSA

SEQ ID NO: 178045 - protein, 9 aa, Mycobacterium bovis
HGSAAGTLT

SEQ ID NO: 178046 - protein, 9 aa, Mycobacterium bovis
HGSAKPRGF

SEQ ID NO: 178047 - protein, 6 aa, Mycobacterium bovis
HGSELQ

SEQ ID NO: 178048 - protein, 15 aa, Mycobacterium bovis
HGTATPIGDAAEANA

SEQ ID NO: 178049 - protein, 13 aa, Mycobacterium bovis
HGTATRLGDRTEL

SEQ ID NO: 178050 - protein, 11 aa, Mycobacterium bovis
HGTATTLGDPI

SEQ ID NO: 178051 - protein, 7 aa, Mycobacterium bovis
HGTDEAE

SEQ ID NO: 178052 - protein, 8 aa, Mycobacterium bovis
HGTDGEDQ

SEQ ID NO: 178053 - protein, 11 aa, Mycobacterium bovis
HGTDPAAAVGL

SEQ ID NO: 178054 - protein, 4 aa, Mycobacterium bovis
HGTG

SEQ ID NO: 178055 - protein, 5 aa, Mycobacterium bovis
HGTGA

SEQ ID NO: 178056 - protein, 5 aa, Mycobacterium bovis
HGTGG

SEQ ID NO: 178057 - protein, 12 aa, Mycobacterium bovis
HGTGTKIGDPIE

SEQ ID NO: 178058 - protein, 10 aa, Mycobacterium bovis
HGTGTPIGDP

SEQ ID NO: 178059 - protein, 10 aa, Mycobacterium bovis
HGTGTPLGDP

SEQ ID NO: 178060 - protein, 10 aa, Mycobacterium bovis
HGTGTSLGDR

SEQ ID NO: 178061 - protein, 6 aa, Mycobacterium bovis
HGTGTV

SEQ ID NO: 178062 - protein, 16 aa, Mycobacterium bovis
HGTPDAYEAGTWGPES

SEQ ID NO: 178063 - protein, 4 aa, Mycobacterium bovis
HGTR

SEQ ID NO: 178064 - protein, 6 aa, Mycobacterium bovis
HGTTQG

SEQ ID NO: 178065 - protein, 6 aa, Mycobacterium bovis
HGVDPA

SEQ ID NO: 178066 - protein, 12 aa, Mycobacterium bovis
HGVQPSESVESD

SEQ ID NO: 178067 - protein, 15 aa, Mycobacterium bovis
HGVSGRSSRKPLGLN

SEQ ID NO: 178068 - protein, 4 aa, Mycobacterium bovis
HGVT

SEQ ID NO: 178069 - protein, 6 aa, Mycobacterium bovis
HGYGTE

SEQ ID NO: 178070 - protein, 6 aa, Mycobacterium bovis
HHASGV

SEQ ID NO: 178071 - protein, 15 aa, Mycobacterium bovis
HHEADADATVAAIAS

SEQ ID NO: 178072 - protein, 4 aa, Mycobacterium bovis
HHED

SEQ ID NO: 178073 - protein, 11 aa, Mycobacterium bovis
HHESGQRGRQA

SEQ ID NO: 178074 - protein, 5 aa, Mycobacterium bovis
HHGGK

SEQ ID NO: 178075 - protein, 4 aa, Mycobacterium bovis
HHKG

SEQ ID NO: 178076 - protein, 10 aa, Mycobacterium bovis
HHLPTSPGPR

SEQ ID NO: 178077 - protein, 4 aa, Mycobacterium bovis
HHNP

SEQ ID NO: 178078 - protein, 9 aa, Mycobacterium bovis
HHPANSDGF

SEQ ID NO: 178079 - protein, 6 aa, Mycobacterium bovis
HHPESE

SEQ ID NO: 178080 - protein, 5 aa, Mycobacterium bovis
HHPGT

SEQ ID NO: 178081 - protein, 5 aa, Mycobacterium bovis
HHQQT

SEQ ID NO: 178082 - protein, 26 aa, Mycobacterium bovis
HHSGSGRQYDRGSRAADGRDGRPPRW

SEQ ID NO: 178083 - protein, 6 aa, Mycobacterium bovis
HHTNAT

SEQ ID NO: 178084 - protein, 4 aa, Mycobacterium bovis
HIET

SEQ ID NO: 178085 - protein, 7 aa, Mycobacterium bovis
HIGDSRT

SEQ ID NO: 178086 - protein, 5 aa, Mycobacterium bovis
HIGPS

SEQ ID NO: 178087 - protein, 8 aa, Mycobacterium bovis
HIPKGSAA

SEQ ID NO: 178088 - protein, 11 aa, Mycobacterium bovis
HKALDPRARRE

SEQ ID NO: 178089 - protein, 4 aa, Mycobacterium bovis
HKDE

SEQ ID NO: 178090 - protein, 6 aa, Mycobacterium bovis
HKGPDV

SEQ ID NO: 178091 - protein, 6 aa, Mycobacterium bovis
HKIGPG

SEQ ID NO: 178092 - protein, 10 aa, Mycobacterium bovis
HKKQTGGSGQ

SEQ ID NO: 178093 - protein, 4 aa, Mycobacterium bovis
HKPA

SEQ ID NO: 178094 - protein, 5 aa, Mycobacterium bovis
HKPGL

SEQ ID NO: 178095 - protein, 6 aa, Mycobacterium bovis
HKPHGD

SEQ ID NO: 178096 - protein, 7 aa, Mycobacterium bovis
HKPNGSH

SEQ ID NO: 178097 - protein, 11 aa, Mycobacterium bovis
HKPTFAPNVDG

SEQ ID NO: 178098 - protein, 4 aa, Mycobacterium bovis
HKPV

SEQ ID NO: 178099 - protein, 8 aa, Mycobacterium bovis
HKQAHPNI

SEQ ID NO: 178100 - protein, 5 aa, Mycobacterium bovis
HKRDH

SEQ ID NO: 178101 - protein, 13 aa, Mycobacterium bovis
HKRPRGRPRKDAV

SEQ ID NO: 178102 - protein, 8 aa, Mycobacterium bovis
HKTTKASA

SEQ ID NO: 178103 - protein, 6 aa, Mycobacterium bovis
HKVDGA

SEQ ID NO: 178104 - protein, 8 aa, Mycobacterium bovis
HKYKDSRE

SEQ ID NO: 178105 - protein, 6 aa, Mycobacterium bovis
HLAESA

SEQ ID NO: 178106 - protein, 13 aa, Mycobacterium bovis
HLASATARGPKSA

SEQ ID NO: 178107 - protein, 14 aa, Mycobacterium bovis
HLDSTRAVSPLQAA

SEQ ID NO: 178108 - protein, 9 aa, Mycobacterium bovis
HLERPADEA

SEQ ID NO: 178109 - protein, 8 aa, Mycobacterium bovis
HLGDTAAD

SEQ ID NO: 178110 - protein, 10 aa, Mycobacterium bovis
HLPPGAWPPT

SEQ ID NO: 178111 - protein, 7 aa, Mycobacterium bovis
HLPRERA

SEQ ID NO: 178112 - protein, 6 aa, Mycobacterium bovis
HLRSGG

SEQ ID NO: 178113 - protein, 8 aa, Mycobacterium bovis
HLRSSDGS

SEQ ID NO: 178114 - protein, 16 aa, Mycobacterium bovis
HNASSDEPTNRHPWPA

SEQ ID NO: 178115 - protein, 8 aa, Mycobacterium bovis
HNDRGTAV

SEQ ID NO: 178116 - protein, 4 aa, Mycobacterium bovis
HNEA

SEQ ID NO: 178117 - protein, 8 aa, Mycobacterium bovis
HNGAGKST

SEQ ID NO: 178118 - protein, 4 aa, Mycobacterium bovis
HNGL

SEQ ID NO: 178119 - protein, 8 aa, Mycobacterium bovis
HNGSPRAL

SEQ ID NO: 178120 - protein, 8 aa, Mycobacterium bovis
HNGYADDG

SEQ ID NO: 178121 - protein, 5 aa, Mycobacterium bovis
HNHPS

SEQ ID NO: 178122 - protein, 4 aa, Mycobacterium bovis
HNIP

SEQ ID NO: 178123 - protein, 10 aa, Mycobacterium bovis
HNLKEGERLD

SEQ ID NO: 178124 - protein, 6 aa, Mycobacterium bovis
HNPAAY

SEQ ID NO: 178125 - protein, 9 aa, Mycobacterium bovis
HNPAGASAL

SEQ ID NO: 178126 - protein, 8 aa, Mycobacterium bovis
HNPDHRTS

SEQ ID NO: 178127 - protein, 6 aa, Mycobacterium bovis
HNPIHT

SEQ ID NO: 178128 - protein, 7 aa, Mycobacterium bovis
HNPMPDN

SEQ ID NO: 178129 - protein, 4 aa, Mycobacterium bovis
HNPR

SEQ ID NO: 178130 - protein, 9 aa, Mycobacterium bovis
HNPTGSVHT

SEQ ID NO: 178131 - protein, 5 aa, Mycobacterium bovis
HNPTM

SEQ ID NO: 178132 - protein, 4 aa, Mycobacterium bovis
HNPV

SEQ ID NO: 178133 - protein, 6 aa, Mycobacterium bovis
HNQAHG

SEQ ID NO: 178134 - protein, 7 aa, Mycobacterium bovis
HNQPRIT

SEQ ID NO: 178135 - protein, 5 aa, Mycobacterium bovis
HNRAQ

SEQ ID NO: 178136 - protein, 6 aa, Mycobacterium bovis
HNRDAT

SEQ ID NO: 178137 - protein, 16 aa, Mycobacterium bovis
HNSGGFNSENQRSGFG

SEQ ID NO: 178138 - protein, 6 aa, Mycobacterium bovis
HNTNTE

SEQ ID NO: 178139 - protein, 8 aa, Mycobacterium bovis
HPADGRGE

SEQ ID NO: 178140 - protein, 16 aa, Mycobacterium bovis
HPADRPATAADVGEEL

SEQ ID NO: 178141 - protein, 6 aa, Mycobacterium bovis
HPADTQ

SEQ ID NO: 178142 - protein, 4 aa, Mycobacterium bovis
HPAT

SEQ ID NO: 178143 - protein, 17 aa, Mycobacterium bovis
HPDAKDFGSAAALPADP

SEQ ID NO: 178144 - protein, 10 aa, Mycobacterium bovis
HPDDAQLGPP

SEQ ID NO: 178145 - protein, 6 aa, Mycobacterium bovis
HPDDER

SEQ ID NO: 178146 - protein, 13 aa, Mycobacterium bovis
HPDDESSKGAATL

SEQ ID NO: 178147 - protein, 5 aa, Mycobacterium bovis
HPDGT

SEQ ID NO: 178148 - protein, 15 aa, Mycobacterium bovis
HPDNPVNRVRDGGTQ

SEQ ID NO: 178149 - protein, 10 aa, Mycobacterium bovis
HPDPKRDSQA

SEQ ID NO: 178150 - protein, 5 aa, Mycobacterium bovis
HPDSA

SEQ ID NO: 178151 - protein, 6 aa, Mycobacterium bovis
HPDTQI

SEQ ID NO: 178152 - protein, 16 aa, Mycobacterium bovis
HPEAQGPATGTTVSPA

SEQ ID NO: 178153 - protein, 5 aa, Mycobacterium bovis
HPEEQ

SEQ ID NO: 178154 - protein, 14 aa, Mycobacterium bovis
HPENEQVEQALSDT

SEQ ID NO: 178155 - protein, 6 aa, Mycobacterium bovis
HPEQST

SEQ ID NO: 178156 - protein, 6 aa, Mycobacterium bovis
HPGARA

SEQ ID NO: 178157 - protein, 14 aa, Mycobacterium bovis
HPGASPESGPGDPV

SEQ ID NO: 178158 - protein, 11 aa, Mycobacterium bovis
HPGAVSANRGR

SEQ ID NO: 178159 - protein, 5 aa, Mycobacterium bovis
HPGGG

SEQ ID NO: 178160 - protein, 11 aa, Mycobacterium bovis
HPGGLSQAEIG

SEQ ID NO: 178161 - protein, 6 aa, Mycobacterium bovis
HPGGPK

SEQ ID NO: 178162 - protein, 8 aa, Mycobacterium bovis
HPGKPQLR

SEQ ID NO: 178163 - protein, 7 aa, Mycobacterium bovis
HPGPPHV

SEQ ID NO: 178164 - protein, 5 aa, Mycobacterium bovis
HPGRT

SEQ ID NO: 178165 - protein, 10 aa, Mycobacterium bovis
HPGSQQRAAD

SEQ ID NO: 178166 - protein, 11 aa, Mycobacterium bovis
HPGSVGKPIQG

SEQ ID NO: 178167 - protein, 4 aa, Mycobacterium bovis
HPGV

SEQ ID NO: 178168 - protein, 7 aa, Mycobacterium bovis
HPGVSNT

SEQ ID NO: 178169 - protein, 6 aa, Mycobacterium bovis
HPHADT

SEQ ID NO: 178170 - protein, 35 aa, Mycobacterium bovis
HPHGGGEGKTSGGRHPVSPWGKPEGRTRNANKSSN

SEQ ID NO: 178171 - protein, 4 aa, Mycobacterium bovis
HPHK

SEQ ID NO: 178172 - protein, 4 aa, Mycobacterium bovis
HPHS

SEQ ID NO: 178173 - protein, 6 aa, Mycobacterium bovis
HPHTRG

SEQ ID NO: 178174 - protein, 4 aa, Mycobacterium bovis
HPID

SEQ ID NO: 178175 - protein, 13 aa, Mycobacterium bovis
HPIPAEPADQLVN

SEQ ID NO: 178176 - protein, 6 aa, Mycobacterium bovis
HPITGS

SEQ ID NO: 178177 - protein, 5 aa, Mycobacterium bovis
HPKPE

SEQ ID NO: 178178 - protein, 9 aa, Mycobacterium bovis
HPKVDNKTG

SEQ ID NO: 178179 - protein, 10 aa, Mycobacterium bovis
HPLGTGGGIA

SEQ ID NO: 178180 - protein, 8 aa, Mycobacterium bovis
HPLGTRPF

SEQ ID NO: 178181 - protein, 6 aa, Mycobacterium bovis
HPNGAD

SEQ ID NO: 178182 - protein, 13 aa, Mycobacterium bovis
HPPEPHPTIPTTP

SEQ ID NO: 178183 - protein, 10 aa, Mycobacterium bovis
HPPGKPERVR

SEQ ID NO: 178184 - protein, 30 aa, Mycobacterium bovis
HPPGRRSRPGRQSRSISSRRAGPLRPAGHG

SEQ ID NO: 178185 - protein, 8 aa, Mycobacterium bovis
HPPKSPNA

SEQ ID NO: 178186 - protein, 8 aa, Mycobacterium bovis
HPPNPKAT

SEQ ID NO: 178187 - protein, 9 aa, Mycobacterium bovis
HPPSGPGVR

SEQ ID NO: 178188 - protein, 12 aa, Mycobacterium bovis
HPPYGHNGERAL

SEQ ID NO: 178189 - protein, 9 aa, Mycobacterium bovis
HPQGGGSEA

SEQ ID NO: 178190 - protein, 5 aa, Mycobacterium bovis
HPQGR

SEQ ID NO: 178191 - protein, 4 aa, Mycobacterium bovis
HPQH

SEQ ID NO: 178192 - protein, 4 aa, Mycobacterium bovis
HPRL

SEQ ID NO: 178193 - protein, 6 aa, Mycobacterium bovis
HPRQIG

SEQ ID NO: 178194 - protein, 21 aa, Mycobacterium bovis
HPRRGGRPGRGCPGRRDRDLG

SEQ ID NO: 178195 - protein, 4 aa, Mycobacterium bovis
HPRV

SEQ ID NO: 178196 - protein, 23 aa, Mycobacterium bovis
HPSAAESVQNSAPTLGGGHSTVT

SEQ ID NO: 178197 - protein, 12 aa, Mycobacterium bovis
HPSADRRGIHSA

SEQ ID NO: 178198 - protein, 5 aa, Mycobacterium bovis
HPSAS

SEQ ID NO: 178199 - protein, 5 aa, Mycobacterium bovis
HPSEV

SEQ ID NO: 178200 - protein, 6 aa, Mycobacterium bovis
HPSHEG

SEQ ID NO: 178201 - protein, 5 aa, Mycobacterium bovis
HPSPR

SEQ ID NO: 178202 - protein, 5 aa, Mycobacterium bovis
HPSPV

SEQ ID NO: 178203 - protein, 6 aa, Mycobacterium bovis
HPSPVP

SEQ ID NO: 178204 - protein, 8 aa, Mycobacterium bovis
HPSRGAWT

SEQ ID NO: 178205 - protein, 14 aa, Mycobacterium bovis
HPSTAAPEDPGSNK

SEQ ID NO: 178206 - protein, 4 aa, Mycobacterium bovis
HPTE

SEQ ID NO: 178207 - protein, 6 aa, Mycobacterium bovis
HPTGSH

SEQ ID NO: 178208 - protein, 13 aa, Mycobacterium bovis
HPTTDSLTESANR

SEQ ID NO: 178209 - protein, 5 aa, Mycobacterium bovis
HPWPP

SEQ ID NO: 178210 - protein, 5 aa, Mycobacterium bovis
HPYEE

SEQ ID NO: 178211 - protein, 4 aa, Mycobacterium bovis
HPYG

SEQ ID NO: 178212 - protein, 6 aa, Mycobacterium bovis
HQAAAD

SEQ ID NO: 178213 - protein, 10 aa, Mycobacterium bovis
HQDGSPGPGT

SEQ ID NO: 178214 - protein, 7 aa, Mycobacterium bovis
HQDGTPD

SEQ ID NO: 178215 - protein, 9 aa, Mycobacterium bovis
HQDSAGNSG

SEQ ID NO: 178216 - protein, 8 aa, Mycobacterium bovis
HQEDPGRI

SEQ ID NO: 178217 - protein, 10 aa, Mycobacterium bovis
HQGESAAAFQ

SEQ ID NO: 178218 - protein, 9 aa, Mycobacterium bovis
HQGESSAAF

SEQ ID NO: 178219 - protein, 6 aa, Mycobacterium bovis
HQGGDD

SEQ ID NO: 178220 - protein, 5 aa, Mycobacterium bovis
HQGKR

SEQ ID NO: 178221 - protein, 19 aa, Mycobacterium bovis
HQGQGGAKSKGSQQEDEAL

SEQ ID NO: 178222 - protein, 5 aa, Mycobacterium bovis
HQGQW

SEQ ID NO: 178223 - protein, 8 aa, Mycobacterium bovis
HQITSSRA

SEQ ID NO: 178224 - protein, 18 aa, Mycobacterium bovis
HQNEATREECPSDPTPTD

SEQ ID NO: 178225 - protein, 21 aa, Mycobacterium bovis
HQPTESAKAQAAQPERGYSSA

SEQ ID NO: 178226 - protein, 5 aa, Mycobacterium bovis
HQQSG

SEQ ID NO: 178227 - protein, 21 aa, Mycobacterium bovis
HQRGNDAAVRNGGRAREPRRA

SEQ ID NO: 178228 - protein, 10 aa, Mycobacterium bovis
HQRPDGSVRV

SEQ ID NO: 178229 - protein, 6 aa, Mycobacterium bovis
HQRTAD

SEQ ID NO: 178230 - protein, 11 aa, Mycobacterium bovis
HQTGPAPQRIS

SEQ ID NO: 178231 - protein, 4 aa, Mycobacterium bovis
HQTY

SEQ ID NO: 178232 - protein, 12 aa, Mycobacterium bovis
HQVQPQTGGVSP

SEQ ID NO: 178233 - protein, 10 aa, Mycobacterium bovis
HQVTDDDVAA

SEQ ID NO: 178234 - protein, 7 aa, Mycobacterium bovis
HQVTTTQ

SEQ ID NO: 178235 - protein, 6 aa, Mycobacterium bovis
HRAPGP

SEQ ID NO: 178236 - protein, 14 aa, Mycobacterium bovis
HRAQSQQWATEKGD

SEQ ID NO: 178237 - protein, 17 aa, Mycobacterium bovis
HRDEHTQDAGDKDGRTL

SEQ ID NO: 178238 - protein, 4 aa, Mycobacterium bovis
HRDG

SEQ ID NO: 178239 - protein, 9 aa, Mycobacterium bovis
HRDGHGQAH

SEQ ID NO: 178240 - protein, 4 aa, Mycobacterium bovis
HRDR

SEQ ID NO: 178241 - protein, 9 aa, Mycobacterium bovis
HRDSGRRRL

SEQ ID NO: 178242 - protein, 18 aa, Mycobacterium bovis
HREKRPARFGADPDPGAG

SEQ ID NO: 178243 - protein, 4 aa, Mycobacterium bovis
HREP

SEQ ID NO: 178244 - protein, 4 aa, Mycobacterium bovis
HRGN

SEQ ID NO: 178245 - protein, 10 aa, Mycobacterium bovis
HRGSGAPKGL

SEQ ID NO: 178246 - protein, 4 aa, Mycobacterium bovis
HRGT

SEQ ID NO: 178247 - protein, 8 aa, Mycobacterium bovis
HRGTGARG

SEQ ID NO: 178248 - protein, 23 aa, Mycobacterium bovis
HRGTTLATPPSHSGTGHVPLGRG

SEQ ID NO: 178249 - protein, 5 aa, Mycobacterium bovis
HRHRR

SEQ ID NO: 178250 - protein, 29 aa, Mycobacterium bovis
HRHTGGGTPTVPTPPTPATKYRPSVPTGS

SEQ ID NO: 178251 - protein, 12 aa, Mycobacterium bovis
HRLPPSPKPGQK

SEQ ID NO: 178252 - protein, 8 aa, Mycobacterium bovis
HRNERTLT

SEQ ID NO: 178253 - protein, 12 aa, Mycobacterium bovis
HRNPASTATAHA

SEQ ID NO: 178254 - protein, 6 aa, Mycobacterium bovis
HRNTAT

SEQ ID NO: 178255 - protein, 13 aa, Mycobacterium bovis
HRPDGTSVVLAAT

SEQ ID NO: 178256 - protein, 5 aa, Mycobacterium bovis
HRPDI

SEQ ID NO: 178257 - protein, 5 aa, Mycobacterium bovis
HRPEV

SEQ ID NO: 178258 - protein, 13 aa, Mycobacterium bovis
HRPGDLSGGQQQR

SEQ ID NO: 178259 - protein, 13 aa, Mycobacterium bovis
HRPGDMSGGQQQR

SEQ ID NO: 178260 - protein, 5 aa, Mycobacterium bovis
HRPNQ

SEQ ID NO: 178261 - protein, 11 aa, Mycobacterium bovis
HRPPRKPADRH

SEQ ID NO: 178262 - protein, 4 aa, Mycobacterium bovis
HRPS

SEQ ID NO: 178263 - protein, 5 aa, Mycobacterium bovis
HRQAP

SEQ ID NO: 178264 - protein, 11 aa, Mycobacterium bovis
HRQARGQSEVP

SEQ ID NO: 178265 - protein, 9 aa, Mycobacterium bovis
HRQRPATAQ

SEQ ID NO: 178266 - protein, 6 aa, Mycobacterium bovis
HRQSDL

SEQ ID NO: 178267 - protein, 14 aa, Mycobacterium bovis
HRQYPAHRKPAPSW

SEQ ID NO: 178268 - protein, 19 aa, Mycobacterium bovis
HRRAAGATTSSTEATPNDL

SEQ ID NO: 178269 - protein, 5 aa, Mycobacterium bovis
HRRGE

SEQ ID NO: 178270 - protein, 5 aa, Mycobacterium bovis
HRRPG

SEQ ID NO: 178271 - protein, 13 aa, Mycobacterium bovis
HRRPGSIGGCATP

SEQ ID NO: 178272 - protein, 6 aa, Mycobacterium bovis
HRSAEG

SEQ ID NO: 178273 - protein, 13 aa, Mycobacterium bovis
HRSGSLGGQDPRH

SEQ ID NO: 178274 - protein, 4 aa, Mycobacterium bovis
HRSS

SEQ ID NO: 178275 - protein, 9 aa, Mycobacterium bovis
HRSSEPGHG

SEQ ID NO: 178276 - protein, 6 aa, Mycobacterium bovis
HRSTGE

SEQ ID NO: 178277 - protein, 6 aa, Mycobacterium bovis
HRSTNF

SEQ ID NO: 178278 - protein, 5 aa, Mycobacterium bovis
HRTDD

SEQ ID NO: 178279 - protein, 5 aa, Mycobacterium bovis
HRTLS

SEQ ID NO: 178280 - protein, 5 aa, Mycobacterium bovis
HRTPE

SEQ ID NO: 178281 - protein, 11 aa, Mycobacterium bovis
HRTPGSGVSAR

SEQ ID NO: 178282 - protein, 5 aa, Mycobacterium bovis
HRTRP

SEQ ID NO: 178283 - protein, 9 aa, Mycobacterium bovis
HRTRPCPTG

SEQ ID NO: 178284 - protein, 5 aa, Mycobacterium bovis
HRTTG

SEQ ID NO: 178285 - protein, 9 aa, Mycobacterium bovis
HSDDAQPGV

SEQ ID NO: 178286 - protein, 7 aa, Mycobacterium bovis
HSDDTLS

SEQ ID NO: 178287 - protein, 11 aa, Mycobacterium bovis
HSDEPAEAATV

SEQ ID NO: 178288 - protein, 10 aa, Mycobacterium bovis
HSDPKRGEQL

SEQ ID NO: 178289 - protein, 6 aa, Mycobacterium bovis
HSDTDV

SEQ ID NO: 178290 - protein, 11 aa, Mycobacterium bovis
HSERSGEPIEP

SEQ ID NO: 178291 - protein, 11 aa, Mycobacterium bovis
HSETAIDAAGA

SEQ ID NO: 178292 - protein, 9 aa, Mycobacterium bovis
HSETGQTPL

SEQ ID NO: 178293 - protein, 18 aa, Mycobacterium bovis
HSGAEEFGDIDSRNGDAA

SEQ ID NO: 178294 - protein, 56 aa, Mycobacterium bovis
HSGAHGAMGSGGEGGAGGGGGARGEAGAGGGTSTGTNPGKAGAPGTQGDSGDPGPP

SEQ ID NO: 178295 - protein, 11 aa, Mycobacterium bovis
HSGASAAAAAL

SEQ ID NO: 178296 - protein, 7 aa, Mycobacterium bovis
HSGKAEV

SEQ ID NO: 178297 - protein, 6 aa, Mycobacterium bovis
HSGSAP

SEQ ID NO: 178298 - protein, 5 aa, Mycobacterium bovis
HSGTL

SEQ ID NO: 178299 - protein, 10 aa, Mycobacterium bovis
HSGYSGGAGP

SEQ ID NO: 178300 - protein, 10 aa, Mycobacterium bovis
HSHRRSRRRW

SEQ ID NO: 178301 - protein, 12 aa, Mycobacterium bovis
HSHRRTRRRWPP

SEQ ID NO: 178302 - protein, 10 aa, Mycobacterium bovis
HSHRRTSRRW

SEQ ID NO: 178303 - protein, 4 aa, Mycobacterium bovis
HSHS

SEQ ID NO: 178304 - protein, 4 aa, Mycobacterium bovis
HSIP

SEQ ID NO: 178305 - protein, 6 aa, Mycobacterium bovis
HSNETV

SEQ ID NO: 178306 - protein, 4 aa, Mycobacterium bovis
HSPA

SEQ ID NO: 178307 - protein, 18 aa, Mycobacterium bovis
HSPDDAGTPPTSTLQCEA

SEQ ID NO: 178308 - protein, 9 aa, Mycobacterium bovis
HSPDTAGGL

SEQ ID NO: 178309 - protein, 6 aa, Mycobacterium bovis
HSPEPR

SEQ ID NO: 178310 - protein, 13 aa, Mycobacterium bovis
HSPGRAAAAATEA

SEQ ID NO: 178311 - protein, 13 aa, Mycobacterium bovis
HSPKGPQATGVRS

SEQ ID NO: 178312 - protein, 8 aa, Mycobacterium bovis
HSPKHPPD

SEQ ID NO: 178313 - protein, 7 aa, Mycobacterium bovis
HSPKQVT

SEQ ID NO: 178314 - protein, 7 aa, Mycobacterium bovis
HSPKRLE

SEQ ID NO: 178315 - protein, 8 aa, Mycobacterium bovis
HSQAAKPF

SEQ ID NO: 178316 - protein, 5 aa, Mycobacterium bovis
HSQGE

SEQ ID NO: 178317 - protein, 7 aa, Mycobacterium bovis
HSQSHYA

SEQ ID NO: 178318 - protein, 12 aa, Mycobacterium bovis
HSSISPPTAAGW

SEQ ID NO: 178319 - protein, 12 aa, Mycobacterium bovis
HSSQPHAAVTPA

SEQ ID NO: 178320 - protein, 9 aa, Mycobacterium bovis
HSTAPEGGT

SEQ ID NO: 178321 - protein, 10 aa, Mycobacterium bovis
HSTGRDPASH

SEQ ID NO: 178322 - protein, 6 aa, Mycobacterium bovis
HSTPDA

SEQ ID NO: 178323 - protein, 5 aa, Mycobacterium bovis
HSTPG

SEQ ID NO: 178324 - protein, 8 aa, Mycobacterium bovis
HSYGGRQT

SEQ ID NO: 178325 - protein, 10 aa, Mycobacterium bovis
HSYRGRNGRN

SEQ ID NO: 178326 - protein, 13 aa, Mycobacterium bovis
HTAGTSSQISDGA

SEQ ID NO: 178327 - protein, 10 aa, Mycobacterium bovis
HTDANAVDDA

SEQ ID NO: 178328 - protein, 5 aa, Mycobacterium bovis
HTDDS

SEQ ID NO: 178329 - protein, 6 aa, Mycobacterium bovis
HTDGSA

SEQ ID NO: 178330 - protein, 7 aa, Mycobacterium bovis
HTDSPNL

SEQ ID NO: 178331 - protein, 23 aa, Mycobacterium bovis
HTEPGLQGDRSSAGTKPATLQTG

SEQ ID NO: 178332 - protein, 7 aa, Mycobacterium bovis
HTETHDE

SEQ ID NO: 178333 - protein, 6 aa, Mycobacterium bovis
HTEVPS

SEQ ID NO: 178334 - protein, 6 aa, Mycobacterium bovis
HTEYDT

SEQ ID NO: 178335 - protein, 4 aa, Mycobacterium bovis
HTGA

SEQ ID NO: 178336 - protein, 5 aa, Mycobacterium bovis
HTGAR

SEQ ID NO: 178337 - protein, 8 aa, Mycobacterium bovis
HTGETRVA

SEQ ID NO: 178338 - protein, 10 aa, Mycobacterium bovis
HTGGNSSGIV

SEQ ID NO: 178339 - protein, 14 aa, Mycobacterium bovis
HTGPLRPSETGRPI

SEQ ID NO: 178340 - protein, 6 aa, Mycobacterium bovis
HTGSDP

SEQ ID NO: 178341 - protein, 10 aa, Mycobacterium bovis
HTGSSLPSAP

SEQ ID NO: 178342 - protein, 22 aa, Mycobacterium bovis
HTGTAGDGNDGAAAASGPVQPG

SEQ ID NO: 178343 - protein, 9 aa, Mycobacterium bovis
HTGTGDGGY

SEQ ID NO: 178344 - protein, 10 aa, Mycobacterium bovis
HTKASQAPIS

SEQ ID NO: 178345 - protein, 6 aa, Mycobacterium bovis
HTKGPK

SEQ ID NO: 178346 - protein, 5 aa, Mycobacterium bovis
HTKRY

SEQ ID NO: 178347 - protein, 6 aa, Mycobacterium bovis
HTLPDE

SEQ ID NO: 178348 - protein, 9 aa, Mycobacterium bovis
HTNEASPLD

SEQ ID NO: 178349 - protein, 5 aa, Mycobacterium bovis
HTPGS

SEQ ID NO: 178350 - protein, 4 aa, Mycobacterium bovis
HTPL

SEQ ID NO: 178351 - protein, 6 aa, Mycobacterium bovis
HTPYPE

SEQ ID NO: 178352 - protein, 6 aa, Mycobacterium bovis
HTQRQR

SEQ ID NO: 178353 - protein, 7 aa, Mycobacterium bovis
HTRAAPH

SEQ ID NO: 178354 - protein, 11 aa, Mycobacterium bovis
HTRAGSAVSGG

SEQ ID NO: 178355 - protein, 7 aa, Mycobacterium bovis
HTRASNF

SEQ ID NO: 178356 - protein, 4 aa, Mycobacterium bovis
HTRG

SEQ ID NO: 178357 - protein, 8 aa, Mycobacterium bovis
HTRGEFEN

SEQ ID NO: 178358 - protein, 6 aa, Mycobacterium bovis
HTRKAG

SEQ ID NO: 178359 - protein, 6 aa, Mycobacterium bovis
HTRPED

SEQ ID NO: 178360 - protein, 4 aa, Mycobacterium bovis
HTSG

SEQ ID NO: 178361 - protein, 9 aa, Mycobacterium bovis
HTSGQDVAE

SEQ ID NO: 178362 - protein, 10 aa, Mycobacterium bovis
HTSPGLEDQI

SEQ ID NO: 178363 - protein, 8 aa, Mycobacterium bovis
HTSSGTAS

SEQ ID NO: 178364 - protein, 4 aa, Mycobacterium bovis
HTTE

SEQ ID NO: 178365 - protein, 6 aa, Mycobacterium bovis
HTTEGW

SEQ ID NO: 178366 - protein, 5 aa, Mycobacterium bovis
HTTRA

SEQ ID NO: 178367 - protein, 8 aa, Mycobacterium bovis
HTTYPPEG

SEQ ID NO: 178368 - protein, 5 aa, Mycobacterium bovis
HTVAE

SEQ ID NO: 178369 - protein, 11 aa, Mycobacterium bovis
HTVTPSPHHPI

SEQ ID NO: 178370 - protein, 5 aa, Mycobacterium bovis
HTYGQ

SEQ ID NO: 178371 - protein, 4 aa, Mycobacterium bovis
HVAD

SEQ ID NO: 178372 - protein, 14 aa, Mycobacterium bovis
HVATEEDRVDTRKV

SEQ ID NO: 178373 - protein, 5 aa, Mycobacterium bovis
HVPDD

SEQ ID NO: 178374 - protein, 5 aa, Mycobacterium bovis
HVQGG

SEQ ID NO: 178375 - protein, 7 aa, Mycobacterium bovis
HVRTGSD

SEQ ID NO: 178376 - protein, 8 aa, Mycobacterium bovis
HVSNTAQI

SEQ ID NO: 178377 - protein, 16 aa, Mycobacterium bovis
HWEPGSKALATRAASG

SEQ ID NO: 178378 - protein, 5 aa, Mycobacterium bovis
HYDKS

SEQ ID NO: 178379 - protein, 7 aa, Mycobacterium bovis
HYERSKD

SEQ ID NO: 178380 - protein, 12 aa, Mycobacterium bovis
HYGPPAQNRELA

SEQ ID NO: 178381 - protein, 10 aa, Mycobacterium bovis
HYGSPDKDPA

SEQ ID NO: 178382 - protein, 6 aa, Mycobacterium bovis
HYPDDN

SEQ ID NO: 178383 - protein, 7 aa, Mycobacterium bovis
HYPPSQG

SEQ ID NO: 178384 - protein, 4 aa, Mycobacterium bovis
HYRS

SEQ ID NO: 178385 - protein, 5 aa, Mycobacterium bovis
IAAAD

SEQ ID NO: 178386 - protein, 8 aa, Mycobacterium bovis
IAADGSRE

SEQ ID NO: 178387 - protein, 16 aa, Mycobacterium bovis
IAAETAPVHGEERRAE

SEQ ID NO: 178388 - protein, 4 aa, Mycobacterium bovis
IAAS

SEQ ID NO: 178389 - protein, 9 aa, Mycobacterium bovis
IAASGRRSV

SEQ ID NO: 178390 - protein, 9 aa, Mycobacterium bovis
IAATDGAGA

SEQ ID NO: 178391 - protein, 7 aa, Mycobacterium bovis
IAATEAQ

SEQ ID NO: 178392 - protein, 11 aa, Mycobacterium bovis
IAATPGSVAAA

SEQ ID NO: 178393 - protein, 7 aa, Mycobacterium bovis
IAATTTA

SEQ ID NO: 178394 - protein, 9 aa, Mycobacterium bovis
IADGQHDDQ

SEQ ID NO: 178395 - protein, 6 aa, Mycobacterium bovis
IADGRG

SEQ ID NO: 178396 - protein, 4 aa, Mycobacterium bovis
IADP

SEQ ID NO: 178397 - protein, 9 aa, Mycobacterium bovis
IADPDIPAE

SEQ ID NO: 178398 - protein, 16 aa, Mycobacterium bovis
IADQRSENWLASEHGG

SEQ ID NO: 178399 - protein, 6 aa, Mycobacterium bovis
IADSPE

SEQ ID NO: 178400 - protein, 6 aa, Mycobacterium bovis
IADYDP

SEQ ID NO: 178401 - protein, 5 aa, Mycobacterium bovis
IAEAE

SEQ ID NO: 178402 - protein, 7 aa, Mycobacterium bovis
IAEAEGA

SEQ ID NO: 178403 - protein, 11 aa, Mycobacterium bovis
IAEPDKDGGAL

SEQ ID NO: 178404 - protein, 4 aa, Mycobacterium bovis
IAES

SEQ ID NO: 178405 - protein, 10 aa, Mycobacterium bovis
IAGASASALH

SEQ ID NO: 178406 - protein, 5 aa, Mycobacterium bovis
IAGGS

SEQ ID NO: 178407 - protein, 14 aa, Mycobacterium bovis
IAGNRGQTNYATTK

SEQ ID NO: 178408 - protein, 10 aa, Mycobacterium bovis
IAGPKRPQDR

SEQ ID NO: 178409 - protein, 10 aa, Mycobacterium bovis
IAGPNADGDD

SEQ ID NO: 178410 - protein, 16 aa, Mycobacterium bovis
IAGRGRHPLPSGASLQ

SEQ ID NO: 178411 - protein, 11 aa, Mycobacterium bovis
IAKDRGIGGPV

SEQ ID NO: 178412 - protein, 7 aa, Mycobacterium bovis
IAKRGSV

SEQ ID NO: 178413 - protein, 30 aa, Mycobacterium bovis
IANPGHYNTGSYNTGSYNTGMANAGDYGTG

SEQ ID NO: 178414 - protein, 9 aa, Mycobacterium bovis
IANPGNHNT

SEQ ID NO: 178415 - protein, 21 aa, Mycobacterium bovis
IANPSMNEGFSPNDTGKGLSR

SEQ ID NO: 178416 - protein, 6 aa, Mycobacterium bovis
IAPAST

SEQ ID NO: 178417 - protein, 5 aa, Mycobacterium bovis
IAPDA

SEQ ID NO: 178418 - protein, 11 aa, Mycobacterium bovis
IAPGAVDPAGL

SEQ ID NO: 178419 - protein, 5 aa, Mycobacterium bovis
IAPGD

SEQ ID NO: 178420 - protein, 8 aa, Mycobacterium bovis
IAPGKGPE

SEQ ID NO: 178421 - protein, 6 aa, Mycobacterium bovis
IAPGSQ

SEQ ID NO: 178422 - protein, 4 aa, Mycobacterium bovis
IAPL

SEQ ID NO: 178423 - protein, 9 aa, Mycobacterium bovis
IAQASPPDM

SEQ ID NO: 178424 - protein, 6 aa, Mycobacterium bovis
IAQNAA

SEQ ID NO: 178425 - protein, 8 aa, Mycobacterium bovis
IAQPGTAE

SEQ ID NO: 178426 - protein, 9 aa, Mycobacterium bovis
IAQSGNQQI

SEQ ID NO: 178427 - protein, 10 aa, Mycobacterium bovis
IAQSRAAGDG

SEQ ID NO: 178428 - protein, 4 aa, Mycobacterium bovis
IARE

SEQ ID NO: 178429 - protein, 7 aa, Mycobacterium bovis
IARGKEG

SEQ ID NO: 178430 - protein, 5 aa, Mycobacterium bovis
IARGR

SEQ ID NO: 178431 - protein, 11 aa, Mycobacterium bovis
IARGSADGRVR

SEQ ID NO: 178432 - protein, 20 aa, Mycobacterium bovis
IARKSENPSITRDVSGEGVQ

SEQ ID NO: 178433 - protein, 12 aa, Mycobacterium bovis
IARNGAGTIDAA

SEQ ID NO: 178434 - protein, 21 aa, Mycobacterium bovis
IASPAQPGEAGRHASDPVTSK

SEQ ID NO: 178435 - protein, 6 aa, Mycobacterium bovis
IASPTL

SEQ ID NO: 178436 - protein, 6 aa, Mycobacterium bovis
IASRRA

SEQ ID NO: 178437 - protein, 10 aa, Mycobacterium bovis
IASSSGAERV

SEQ ID NO: 178438 - protein, 4 aa, Mycobacterium bovis
IASY

SEQ ID NO: 178439 - protein, 4 aa, Mycobacterium bovis
IATA

SEQ ID NO: 178440 - protein, 13 aa, Mycobacterium bovis
IATDSTAAVPAPE

SEQ ID NO: 178441 - protein, 6 aa, Mycobacterium bovis
IATEQS

SEQ ID NO: 178442 - protein, 5 aa, Mycobacterium bovis
IATET

SEQ ID NO: 178443 - protein, 4 aa, Mycobacterium bovis
IATG

SEQ ID NO: 178444 - protein, 9 aa, Mycobacterium bovis
IATGATAKA

SEQ ID NO: 178445 - protein, 9 aa, Mycobacterium bovis
IATGGHTGD

SEQ ID NO: 178446 - protein, 5 aa, Mycobacterium bovis
IATRT

SEQ ID NO: 178447 - protein, 8 aa, Mycobacterium bovis
IATTASYQ

SEQ ID NO: 178448 - protein, 8 aa, Mycobacterium bovis
IAYSTDEV

SEQ ID NO: 178449 - protein, 12 aa, Mycobacterium bovis
IDAAADPPLRDE

SEQ ID NO: 178450 - protein, 7 aa, Mycobacterium bovis
IDAANEH

SEQ ID NO: 178451 - protein, 17 aa, Mycobacterium bovis
IDADKGRAVVGPGKGGS

SEQ ID NO: 178452 - protein, 8 aa, Mycobacterium bovis
IDAGPTNN

SEQ ID NO: 178453 - protein, 7 aa, Mycobacterium bovis
IDANPAA

SEQ ID NO: 178454 - protein, 17 aa, Mycobacterium bovis
IDAPTAARLGKPYRQEF

SEQ ID NO: 178455 - protein, 6 aa, Mycobacterium bovis
IDASPA

SEQ ID NO: 178456 - protein, 8 aa, Mycobacterium bovis
IDDDPEAA

SEQ ID NO: 178457 - protein, 5 aa, Mycobacterium bovis
IDDEG

SEQ ID NO: 178458 - protein, 13 aa, Mycobacterium bovis
IDDGDTGYPYGTE

SEQ ID NO: 178459 - protein, 6 aa, Mycobacterium bovis
IDDPKL

SEQ ID NO: 178460 - protein, 4 aa, Mycobacterium bovis
IDDQ

SEQ ID NO: 178461 - protein, 8 aa, Mycobacterium bovis
IDDSTPNR

SEQ ID NO: 178462 - protein, 19 aa, Mycobacterium bovis
IDDVERGSKDSDWEPVKEA

SEQ ID NO: 178463 - protein, 5 aa, Mycobacterium bovis
IDEDG

SEQ ID NO: 178464 - protein, 6 aa, Mycobacterium bovis
IDEPGL

SEQ ID NO: 178465 - protein, 20 aa, Mycobacterium bovis
IDESDDTDVQGGVRPSATAE

SEQ ID NO: 178466 - protein, 8 aa, Mycobacterium bovis
IDGADPAA

SEQ ID NO: 178467 - protein, 8 aa, Mycobacterium bovis
IDGDETDL

SEQ ID NO: 178468 - protein, 6 aa, Mycobacterium bovis
IDGEPA

SEQ ID NO: 178469 - protein, 17 aa, Mycobacterium bovis
IDGETHPAQRQIRFTAM

SEQ ID NO: 178470 - protein, 8 aa, Mycobacterium bovis
IDGPAPQR

SEQ ID NO: 178471 - protein, 6 aa, Mycobacterium bovis
IDGSQY

SEQ ID NO: 178472 - protein, 5 aa, Mycobacterium bovis
IDGTR

SEQ ID NO: 178473 - protein, 7 aa, Mycobacterium bovis
IDGTRRP

SEQ ID NO: 178474 - protein, 12 aa, Mycobacterium bovis
IDKEGADPAKIR

SEQ ID NO: 178475 - protein, 14 aa, Mycobacterium bovis
IDKSDSDWDREKLG

SEQ ID NO: 178476 - protein, 9 aa, Mycobacterium bovis
IDKSTDKTL

SEQ ID NO: 178477 - protein, 9 aa, Mycobacterium bovis
IDNADRDDV

SEQ ID NO: 178478 - protein, 6 aa, Mycobacterium bovis
IDNARR

SEQ ID NO: 178479 - protein, 6 aa, Mycobacterium bovis
IDNGRE

SEQ ID NO: 178480 - protein, 8 aa, Mycobacterium bovis
IDNSDNAL

SEQ ID NO: 178481 - protein, 10 aa, Mycobacterium bovis
IDPAHTRSKL

SEQ ID NO: 178482 - protein, 17 aa, Mycobacterium bovis
IDPATGQATKVAGPGWT

SEQ ID NO: 178483 - protein, 4 aa, Mycobacterium bovis
IDPD

SEQ ID NO: 178484 - protein, 8 aa, Mycobacterium bovis
IDPDDGQR

SEQ ID NO: 178485 - protein, 17 aa, Mycobacterium bovis
IDPDGQNGGPELQSPTF

SEQ ID NO: 178486 - protein, 8 aa, Mycobacterium bovis
IDPEETSE

SEQ ID NO: 178487 - protein, 11 aa, Mycobacterium bovis
IDPGKEASPRF

SEQ ID NO: 178488 - protein, 6 aa, Mycobacterium bovis
IDPGKV

SEQ ID NO: 178489 - protein, 7 aa, Mycobacterium bovis
IDPGPTL

SEQ ID NO: 178490 - protein, 14 aa, Mycobacterium bovis
IDPGTVDAGTVGNA

SEQ ID NO: 178491 - protein, 8 aa, Mycobacterium bovis
IDPPWETR

SEQ ID NO: 178492 - protein, 7 aa, Mycobacterium bovis
IDPRDTR

SEQ ID NO: 178493 - protein, 9 aa, Mycobacterium bovis
IDPTDATRG

SEQ ID NO: 178494 - protein, 27 aa, Mycobacterium bovis
IDQAEEELAERSTPATMPRRPRSTDDV

SEQ ID NO: 178495 - protein, 15 aa, Mycobacterium bovis
IDQKSTNRNPRSTVG

SEQ ID NO: 178496 - protein, 8 aa, Mycobacterium bovis
IDRATKSV

SEQ ID NO: 178497 - protein, 5 aa, Mycobacterium bovis
IDRSQ

SEQ ID NO: 178498 - protein, 6 aa, Mycobacterium bovis
IDSDRE

SEQ ID NO: 178499 - protein, 9 aa, Mycobacterium bovis
IDSETAELQ

SEQ ID NO: 178500 - protein, 11 aa, Mycobacterium bovis
IDSETLDDEHR

SEQ ID NO: 178501 - protein, 28 aa, Mycobacterium bovis
IDSGRRGIAHPPRGGLGHRSKHRGPRHL

SEQ ID NO: 178502 - protein, 10 aa, Mycobacterium bovis
IDSPKSQAAQ

SEQ ID NO: 178503 - protein, 6 aa, Mycobacterium bovis
IDSTRG

SEQ ID NO: 178504 - protein, 21 aa, Mycobacterium bovis
IDTAGPRERSVGQAYHIWRSA

SEQ ID NO: 178505 - protein, 6 aa, Mycobacterium bovis
IDTATE

SEQ ID NO: 178506 - protein, 6 aa, Mycobacterium bovis
IDTGEK

SEQ ID NO: 178507 - protein, 8 aa, Mycobacterium bovis
IDTGPDGS

SEQ ID NO: 178508 - protein, 12 aa, Mycobacterium bovis
IDTQGRNTAVRS

SEQ ID NO: 178509 - protein, 7 aa, Mycobacterium bovis
IDTTGAE

SEQ ID NO: 178510 - protein, 5 aa, Mycobacterium bovis
IDTVP

SEQ ID NO: 178511 - protein, 9 aa, Mycobacterium bovis
IDVSPDSWD

SEQ ID NO: 178512 - protein, 13 aa, Mycobacterium bovis
IDYESAEASFQPS

SEQ ID NO: 178513 - protein, 8 aa, Mycobacterium bovis
IEADPANP

SEQ ID NO: 178514 - protein, 18 aa, Mycobacterium bovis
IEAEPGARTASANWLNVR

SEQ ID NO: 178515 - protein, 8 aa, Mycobacterium bovis
IEAETEEL

SEQ ID NO: 178516 - protein, 10 aa, Mycobacterium bovis
IEARGESMSG

SEQ ID NO: 178517 - protein, 10 aa, Mycobacterium bovis
IEASKKALER

SEQ ID NO: 178518 - protein, 16 aa, Mycobacterium bovis
IECSTGSACTAGVAQP

SEQ ID NO: 178519 - protein, 8 aa, Mycobacterium bovis
IEDSSAEK

SEQ ID NO: 178520 - protein, 11 aa, Mycobacterium bovis
IEEGQQVKRTG

SEQ ID NO: 178521 - protein, 6 aa, Mycobacterium bovis
IEGDRD

SEQ ID NO: 178522 - protein, 7 aa, Mycobacterium bovis
IEGDTSV

SEQ ID NO: 178523 - protein, 71 aa, Mycobacterium bovis
IEGEPGLGGEPGAGDVGAGGGGGGTTPTGYLGPPPVPTSSPPTTPAGAPAKSVTPDPVSGTPRASGPAGMT

SEQ ID NO: 178524 - protein, 9 aa, Mycobacterium bovis
IEGIGRPRV

SEQ ID NO: 178525 - protein, 6 aa, Mycobacterium bovis
IEGRSW

SEQ ID NO: 178526 - protein, 11 aa, Mycobacterium bovis
IELSSSQSTSI

SEQ ID NO: 178527 - protein, 4 aa, Mycobacterium bovis
IENH

SEQ ID NO: 178528 - protein, 9 aa, Mycobacterium bovis
IEPDPDDLA

SEQ ID NO: 178529 - protein, 14 aa, Mycobacterium bovis
IEPERSEVRQPPPR

SEQ ID NO: 178530 - protein, 5 aa, Mycobacterium bovis
IEPGS

SEQ ID NO: 178531 - protein, 4 aa, Mycobacterium bovis
IEPP

SEQ ID NO: 178532 - protein, 21 aa, Mycobacterium bovis
IEPRARRAASTRARRAPSPSV

SEQ ID NO: 178533 - protein, 7 aa, Mycobacterium bovis
IEPRSGR

SEQ ID NO: 178534 - protein, 10 aa, Mycobacterium bovis
IEPSEITPEK

SEQ ID NO: 178535 - protein, 6 aa, Mycobacterium bovis
IEQGDE

SEQ ID NO: 178536 - protein, 9 aa, Mycobacterium bovis
IEQPAQPAF

SEQ ID NO: 178537 - protein, 6 aa, Mycobacterium bovis
IEQTRA

SEQ ID NO: 178538 - protein, 9 aa, Mycobacterium bovis
IERAKGAAA

SEQ ID NO: 178539 - protein, 5 aa, Mycobacterium bovis
IERGE

SEQ ID NO: 178540 - protein, 9 aa, Mycobacterium bovis
IERSGRSAQ

SEQ ID NO: 178541 - protein, 8 aa, Mycobacterium bovis
IESDTGSV

SEQ ID NO: 178542 - protein, 9 aa, Mycobacterium bovis
IESENPDAV

SEQ ID NO: 178543 - protein, 14 aa, Mycobacterium bovis
IESFSDTDRKLADE

SEQ ID NO: 178544 - protein, 6 aa, Mycobacterium bovis
IETADD

SEQ ID NO: 178545 - protein, 4 aa, Mycobacterium bovis
IETE

SEQ ID NO: 178546 - protein, 5 aa, Mycobacterium bovis
IETEK

SEQ ID NO: 178547 - protein, 8 aa, Mycobacterium bovis
IETGAMPP

SEQ ID NO: 178548 - protein, 10 aa, Mycobacterium bovis
IETLGKDELG

SEQ ID NO: 178549 - protein, 6 aa, Mycobacterium bovis
IETRYG

SEQ ID NO: 178550 - protein, 6 aa, Mycobacterium bovis
IETSPA

SEQ ID NO: 178551 - protein, 6 aa, Mycobacterium bovis
IGAERD

SEQ ID NO: 178552 - protein, 5 aa, Mycobacterium bovis
IGAES

SEQ ID NO: 178553 - protein, 7 aa, Mycobacterium bovis
IGAGNKL

SEQ ID NO: 178554 - protein, 12 aa, Mycobacterium bovis
IGAGQSGLGDNG

SEQ ID NO: 178555 - protein, 7 aa, Mycobacterium bovis
IGAPANV

SEQ ID NO: 178556 - protein, 12 aa, Mycobacterium bovis
IGASKKDGQRAK

SEQ ID NO: 178557 - protein, 7 aa, Mycobacterium bovis
IGATTEA

SEQ ID NO: 178558 - protein, 43 aa, Mycobacterium bovis
IGDGGAGGTGGDSVRGAAGSGGTGGTGGLIGDGGAGGAGGTGI

SEQ ID NO: 178559 - protein, 11 aa, Mycobacterium bovis
IGDNTRPDAIR

SEQ ID NO: 178560 - protein, 9 aa, Mycobacterium bovis
IGDPAANAA

SEQ ID NO: 178561 - protein, 8 aa, Mycobacterium bovis
IGDPRKDE

SEQ ID NO: 178562 - protein, 6 aa, Mycobacterium bovis
IGDSRD

SEQ ID NO: 178563 - protein, 5 aa, Mycobacterium bovis
IGEDD

SEQ ID NO: 178564 - protein, 10 aa, Mycobacterium bovis
IGEESENAAF

SEQ ID NO: 178565 - protein, 4 aa, Mycobacterium bovis
IGEG

SEQ ID NO: 178566 - protein, 6 aa, Mycobacterium bovis
IGEQDA

SEQ ID NO: 178567 - protein, 9 aa, Mycobacterium bovis
IGEQTQQLA

SEQ ID NO: 178568 - protein, 4 aa, Mycobacterium bovis
IGER

SEQ ID NO: 178569 - protein, 8 aa, Mycobacterium bovis
IGETSTHY

SEQ ID NO: 178570 - protein, 7 aa, Mycobacterium bovis
IGGAARG

SEQ ID NO: 178571 - protein, 18 aa, Mycobacterium bovis
IGGADPVSVPAAGAVGRQ

SEQ ID NO: 178572 - protein, 11 aa, Mycobacterium bovis
IGGAGGRGGDA

SEQ ID NO: 178573 - protein, 5 aa, Mycobacterium bovis
IGGAL

SEQ ID NO: 178574 - protein, 4 aa, Mycobacterium bovis
IGGD

SEQ ID NO: 178575 - protein, 12 aa, Mycobacterium bovis
IGGDGETPGSRL

SEQ ID NO: 178576 - protein, 66 aa, Mycobacterium bovis
IGGEPGLGSGAGGGDVGGGGAGGTTPTGYLGPPPVPTSSPPTTPAGAPTKSATMPPPGGASPASAH

SEQ ID NO: 178577 - protein, 5 aa, Mycobacterium bovis
IGGGF

SEQ ID NO: 178578 - protein, 10 aa, Mycobacterium bovis
IGGGSGFGGL

SEQ ID NO: 178579 - protein, 7 aa, Mycobacterium bovis
IGGPNTA

SEQ ID NO: 178580 - protein, 6 aa, Mycobacterium bovis
IGGQES

SEQ ID NO: 178581 - protein, 18 aa, Mycobacterium bovis
IGGRSAPARITEQTPWGT

SEQ ID NO: 178582 - protein, 5 aa, Mycobacterium bovis
IGGSG

SEQ ID NO: 178583 - protein, 24 aa, Mycobacterium bovis
IGGTGGSGGIGTTGQGGTGGTGGA

SEQ ID NO: 178584 - protein, 7 aa, Mycobacterium bovis
IGGTPEG

SEQ ID NO: 178585 - protein, 4 aa, Mycobacterium bovis
IGHD

SEQ ID NO: 178586 - protein, 4 aa, Mycobacterium bovis
IGKG

SEQ ID NO: 178587 - protein, 7 aa, Mycobacterium bovis
IGKGSVT

SEQ ID NO: 178588 - protein, 12 aa, Mycobacterium bovis
IGLPDESYYRDE

SEQ ID NO: 178589 - protein, 8 aa, Mycobacterium bovis
IGNAGANN

SEQ ID NO: 178590 - protein, 23 aa, Mycobacterium bovis
IGNGGAGGAGGPGANGGAGGNGG

SEQ ID NO: 178591 - protein, 26 aa, Mycobacterium bovis
IGNGGAGGAGGVGGAGGAGGAGGTGG

SEQ ID NO: 178592 - protein, 30 aa, Mycobacterium bovis
IGNGGAGGDGGNGGLSNTGASGGAGGAGGA

SEQ ID NO: 178593 - protein, 12 aa, Mycobacterium bovis
IGNGGAGGTGGA

SEQ ID NO: 178594 - protein, 32 aa, Mycobacterium bovis
IGNGGDGGAGGAGGAGSPAGAPGNGGTGGTGG

SEQ ID NO: 178595 - protein, 21 aa, Mycobacterium bovis
IGNGGDGGDGGGAGAPGLGGR

SEQ ID NO: 178596 - protein, 30 aa, Mycobacterium bovis
IGNGGDGGHGGNGGHGNSGGAGGAGGAGGH

SEQ ID NO: 178597 - protein, 19 aa, Mycobacterium bovis
IGNGGNGGAGGAGGDVSAD

SEQ ID NO: 178598 - protein, 25 aa, Mycobacterium bovis
IGNGGNGGAGGVGTTGGAGGHGGAG

SEQ ID NO: 178599 - protein, 36 aa, Mycobacterium bovis
IGNGGNGGNGGVGSAPGKGGAGGTAGLLGLNGSPGL

SEQ ID NO: 178600 - protein, 23 aa, Mycobacterium bovis
IGNGGSGGAGGAGAAGGSGGQGG

SEQ ID NO: 178601 - protein, 10 aa, Mycobacterium bovis
IGNPGTDNTG

SEQ ID NO: 178602 - protein, 59 aa, Mycobacterium bovis
IGNQGNANLGGGNTGSGNIGNGNKGSSNLGGGNIGNNNIGSGNRGSDNFGAGNVGTGNI

SEQ ID NO: 178603 - protein, 10 aa, Mycobacterium bovis
IGNSGAGNFG

SEQ ID NO: 178604 - protein, 6 aa, Mycobacterium bovis
IGNSGL

SEQ ID NO: 178605 - protein, 20 aa, Mycobacterium bovis
IGNSGSGNTGIGNTGSTNTG

SEQ ID NO: 178606 - protein, 11 aa, Mycobacterium bovis
IGNSGSTSTGL

SEQ ID NO: 178607 - protein, 21 aa, Mycobacterium bovis
IGNSGTSYNTGIGNTGQANTG

SEQ ID NO: 178608 - protein, 8 aa, Mycobacterium bovis
IGNSSPRV

SEQ ID NO: 178609 - protein, 5 aa, Mycobacterium bovis
IGNTG

SEQ ID NO: 178610 - protein, 7 aa, Mycobacterium bovis
IGNTGNY

SEQ ID NO: 178611 - protein, 5 aa, Mycobacterium bovis
IGNTT

SEQ ID NO: 178612 - protein, 4 aa, Mycobacterium bovis
IGPA

SEQ ID NO: 178613 - protein, 5 aa, Mycobacterium bovis
IGPAS

SEQ ID NO: 178614 - protein, 5 aa, Mycobacterium bovis
IGPAT

SEQ ID NO: 178615 - protein, 4 aa, Mycobacterium bovis
IGPD

SEQ ID NO: 178616 - protein, 9 aa, Mycobacterium bovis
IGPGADPGT

SEQ ID NO: 178617 - protein, 9 aa, Mycobacterium bovis
IGPGGPVSL

SEQ ID NO: 178618 - protein, 8 aa, Mycobacterium bovis
IGPGQEEQ

SEQ ID NO: 178619 - protein, 5 aa, Mycobacterium bovis
IGPKG

SEQ ID NO: 178620 - protein, 8 aa, Mycobacterium bovis
IGPLTTPP

SEQ ID NO: 178621 - protein, 5 aa, Mycobacterium bovis
IGPNT

SEQ ID NO: 178622 - protein, 9 aa, Mycobacterium bovis
IGPQPDAAA

SEQ ID NO: 178623 - protein, 4 aa, Mycobacterium bovis
IGPT

SEQ ID NO: 178624 - protein, 5 aa, Mycobacterium bovis
IGPTG

SEQ ID NO: 178625 - protein, 13 aa, Mycobacterium bovis
IGPTSDEAGPAVA

SEQ ID NO: 178626 - protein, 7 aa, Mycobacterium bovis
IGREGDG

SEQ ID NO: 178627 - protein, 7 aa, Mycobacterium bovis
IGRGEHP

SEQ ID NO: 178628 - protein, 5 aa, Mycobacterium bovis
IGRGQ

SEQ ID NO: 178629 - protein, 11 aa, Mycobacterium bovis
IGRGSGLAAQG

SEQ ID NO: 178630 - protein, 9 aa, Mycobacterium bovis
IGRGSTEDT

SEQ ID NO: 178631 - protein, 16 aa, Mycobacterium bovis
IGRPARQRTTTYALLA

SEQ ID NO: 178632 - protein, 5 aa, Mycobacterium bovis
IGRPR

SEQ ID NO: 178633 - protein, 10 aa, Mycobacterium bovis
IGRRAPDGRE

SEQ ID NO: 178634 - protein, 8 aa, Mycobacterium bovis
IGRSAQDA

SEQ ID NO: 178635 - protein, 9 aa, Mycobacterium bovis
IGRSGAAIG

SEQ ID NO: 178636 - protein, 7 aa, Mycobacterium bovis
IGSAGAK

SEQ ID NO: 178637 - protein, 9 aa, Mycobacterium bovis
IGSDGAGSI

SEQ ID NO: 178638 - protein, 7 aa, Mycobacterium bovis
IGSDPQK

SEQ ID NO: 178639 - protein, 13 aa, Mycobacterium bovis
IGSDTGGSIRQPA

SEQ ID NO: 178640 - protein, 5 aa, Mycobacterium bovis
IGSED

SEQ ID NO: 178641 - protein, 11 aa, Mycobacterium bovis
IGSETGRIHGA

SEQ ID NO: 178642 - protein, 8 aa, Mycobacterium bovis
IGSGSTAQ

SEQ ID NO: 178643 - protein, 5 aa, Mycobacterium bovis
IGSPF

SEQ ID NO: 178644 - protein, 17 aa, Mycobacterium bovis
IGSTIGAANAAAAANTT

SEQ ID NO: 178645 - protein, 7 aa, Mycobacterium bovis
IGTASDA

SEQ ID NO: 178646 - protein, 7 aa, Mycobacterium bovis
IGTESDR

SEQ ID NO: 178647 - protein, 8 aa, Mycobacterium bovis
IGTGGGQG

SEQ ID NO: 178648 - protein, 14 aa, Mycobacterium bovis
IGTPEGRRAALGPY

SEQ ID NO: 178649 - protein, 6 aa, Mycobacterium bovis
IGTPGS

SEQ ID NO: 178650 - protein, 6 aa, Mycobacterium bovis
IGTSPF

SEQ ID NO: 178651 - protein, 10 aa, Mycobacterium bovis
IGTTNPAAAQ

SEQ ID NO: 178652 - protein, 6 aa, Mycobacterium bovis
IGTTSL

SEQ ID NO: 178653 - protein, 6 aa, Mycobacterium bovis
IHPTAD

SEQ ID NO: 178654 - protein, 6 aa, Mycobacterium bovis
IHSGDS

SEQ ID NO: 178655 - protein, 7 aa, Mycobacterium bovis
IHSSDTD

SEQ ID NO: 178656 - protein, 6 aa, Mycobacterium bovis
IHTSGE

SEQ ID NO: 178657 - protein, 9 aa, Mycobacterium bovis
IKARSTRGA

SEQ ID NO: 178658 - protein, 6 aa, Mycobacterium bovis
IKASGA

SEQ ID NO: 178659 - protein, 13 aa, Mycobacterium bovis
IKATDVDDPDGTW

SEQ ID NO: 178660 - protein, 4 aa, Mycobacterium bovis
IKDG

SEQ ID NO: 178661 - protein, 6 aa, Mycobacterium bovis
IKDPDE

SEQ ID NO: 178662 - protein, 6 aa, Mycobacterium bovis
IKDSLS

SEQ ID NO: 178663 - protein, 6 aa, Mycobacterium bovis
IKGSDT

SEQ ID NO: 178664 - protein, 8 aa, Mycobacterium bovis
IKGSPTTE

SEQ ID NO: 178665 - protein, 4 aa, Mycobacterium bovis
IKKR

SEQ ID NO: 178666 - protein, 4 aa, Mycobacterium bovis
IKPQ

SEQ ID NO: 178667 - protein, 15 aa, Mycobacterium bovis
IKPRDGRFGSGPSKV

SEQ ID NO: 178668 - protein, 18 aa, Mycobacterium bovis
IKPRSRDVTDGLEKAAAR

SEQ ID NO: 178669 - protein, 4 aa, Mycobacterium bovis
IKRR

SEQ ID NO: 178670 - protein, 6 aa, Mycobacterium bovis
IKTSKQ

SEQ ID NO: 178671 - protein, 7 aa, Mycobacterium bovis
ILDSGGR

SEQ ID NO: 178672 - protein, 9 aa, Mycobacterium bovis
IMPRQGSKH

SEQ ID NO: 178673 - protein, 5 aa, Mycobacterium bovis
INAGE

SEQ ID NO: 178674 - protein, 8 aa, Mycobacterium bovis
INAGPGGG

SEQ ID NO: 178675 - protein, 6 aa, Mycobacterium bovis
INEPRF

SEQ ID NO: 178676 - protein, 7 aa, Mycobacterium bovis
INGATTL

SEQ ID NO: 178677 - protein, 4 aa, Mycobacterium bovis
INGE

SEQ ID NO: 178678 - protein, 13 aa, Mycobacterium bovis
INGGSGGQGGHGG

SEQ ID NO: 178679 - protein, 8 aa, Mycobacterium bovis
INGTDRRG

SEQ ID NO: 178680 - protein, 10 aa, Mycobacterium bovis
INPTSLADPA

SEQ ID NO: 178681 - protein, 10 aa, Mycobacterium bovis
INRNSASLDE

SEQ ID NO: 178682 - protein, 16 aa, Mycobacterium bovis
INRSPSAFDRNPPADK

SEQ ID NO: 178683 - protein, 7 aa, Mycobacterium bovis
INTAATA

SEQ ID NO: 178684 - protein, 10 aa, Mycobacterium bovis
INTGGVTRDD

SEQ ID NO: 178685 - protein, 4 aa, Mycobacterium bovis
INTR

SEQ ID NO: 178686 - protein, 4 aa, Mycobacterium bovis
INTT

SEQ ID NO: 178687 - protein, 7 aa, Mycobacterium bovis
INTVTGN

SEQ ID NO: 178688 - protein, 6 aa, Mycobacterium bovis
IPAATA

SEQ ID NO: 178689 - protein, 9 aa, Mycobacterium bovis
IPADADQHE

SEQ ID NO: 178690 - protein, 8 aa, Mycobacterium bovis
IPADPNGR

SEQ ID NO: 178691 - protein, 5 aa, Mycobacterium bovis
IPAGR

SEQ ID NO: 178692 - protein, 6 aa, Mycobacterium bovis
IPAPPG

SEQ ID NO: 178693 - protein, 15 aa, Mycobacterium bovis
IPARPPETELFAGIE

SEQ ID NO: 178694 - protein, 7 aa, Mycobacterium bovis
IPARTTA

SEQ ID NO: 178695 - protein, 4 aa, Mycobacterium bovis
IPAS

SEQ ID NO: 178696 - protein, 4 aa, Mycobacterium bovis
IPAT

SEQ ID NO: 178697 - protein, 12 aa, Mycobacterium bovis
IPATERTETPTF

SEQ ID NO: 178698 - protein, 5 aa, Mycobacterium bovis
IPATR

SEQ ID NO: 178699 - protein, 4 aa, Mycobacterium bovis
IPDE

SEQ ID NO: 178700 - protein, 5 aa, Mycobacterium bovis
IPDEA

SEQ ID NO: 178701 - protein, 16 aa, Mycobacterium bovis
IPDGAPLDAPRPMPPE

SEQ ID NO: 178702 - protein, 6 aa, Mycobacterium bovis
IPDPDP

SEQ ID NO: 178703 - protein, 9 aa, Mycobacterium bovis
IPDPPPPGA

SEQ ID NO: 178704 - protein, 6 aa, Mycobacterium bovis
IPDPQH

SEQ ID NO: 178705 - protein, 5 aa, Mycobacterium bovis
IPDSG

SEQ ID NO: 178706 - protein, 5 aa, Mycobacterium bovis
IPDSH

SEQ ID NO: 178707 - protein, 6 aa, Mycobacterium bovis
IPDSPA

SEQ ID NO: 178708 - protein, 12 aa, Mycobacterium bovis
IPDSRTSKDFDT

SEQ ID NO: 178709 - protein, 4 aa, Mycobacterium bovis
IPDT

SEQ ID NO: 178710 - protein, 6 aa, Mycobacterium bovis
IPDTEY

SEQ ID NO: 178711 - protein, 6 aa, Mycobacterium bovis
IPEAEK

SEQ ID NO: 178712 - protein, 5 aa, Mycobacterium bovis
IPEDY

SEQ ID NO: 178713 - protein, 6 aa, Mycobacterium bovis
IPEGPI

SEQ ID NO: 178714 - protein, 6 aa, Mycobacterium bovis
IPENEH

SEQ ID NO: 178715 - protein, 7 aa, Mycobacterium bovis
IPEPTIP

SEQ ID NO: 178716 - protein, 5 aa, Mycobacterium bovis
IPERG

SEQ ID NO: 178717 - protein, 10 aa, Mycobacterium bovis
IPETSQRSPG

SEQ ID NO: 178718 - protein, 6 aa, Mycobacterium bovis
IPGAAS

SEQ ID NO: 178719 - protein, 6 aa, Mycobacterium bovis
IPGAPP

SEQ ID NO: 178720 - protein, 8 aa, Mycobacterium bovis
IPGHGRDK

SEQ ID NO: 178721 - protein, 5 aa, Mycobacterium bovis
IPGNE

SEQ ID NO: 178722 - protein, 10 aa, Mycobacterium bovis
IPGPASQALT

SEQ ID NO: 178723 - protein, 8 aa, Mycobacterium bovis
IPGPTNPQ

SEQ ID NO: 178724 - protein, 6 aa, Mycobacterium bovis
IPGSGI

SEQ ID NO: 178725 - protein, 30 aa, Mycobacterium bovis
IPGTPASIDPEWSRPPGSITDDHVFDAPLH

SEQ ID NO: 178726 - protein, 14 aa, Mycobacterium bovis
IPIDGGRPRGDDAW

SEQ ID NO: 178727 - protein, 5 aa, Mycobacterium bovis
IPKPT

SEQ ID NO: 178728 - protein, 8 aa, Mycobacterium bovis
IPKTNPEL

SEQ ID NO: 178729 - protein, 5 aa, Mycobacterium bovis
IPKWG

SEQ ID NO: 178730 - protein, 6 aa, Mycobacterium bovis
IPNDSP

SEQ ID NO: 178731 - protein, 8 aa, Mycobacterium bovis
IPPAPRGI

SEQ ID NO: 178732 - protein, 6 aa, Mycobacterium bovis
IPPDRW

SEQ ID NO: 178733 - protein, 5 aa, Mycobacterium bovis
IPPGN

SEQ ID NO: 178734 - protein, 9 aa, Mycobacterium bovis
IPPGTQPGS

SEQ ID NO: 178735 - protein, 6 aa, Mycobacterium bovis
IPPNGQ

SEQ ID NO: 178736 - protein, 5 aa, Mycobacterium bovis
IPPNR

SEQ ID NO: 178737 - protein, 10 aa, Mycobacterium bovis
IPPPGTGAPE

SEQ ID NO: 178738 - protein, 5 aa, Mycobacterium bovis
IPPQQ

SEQ ID NO: 178739 - protein, 6 aa, Mycobacterium bovis
IPPSLQ

SEQ ID NO: 178740 - protein, 8 aa, Mycobacterium bovis
IPPYGDAR

SEQ ID NO: 178741 - protein, 4 aa, Mycobacterium bovis
IPRG

SEQ ID NO: 178742 - protein, 8 aa, Mycobacterium bovis
IPRGEEAG

SEQ ID NO: 178743 - protein, 5 aa, Mycobacterium bovis
IPRGG

SEQ ID NO: 178744 - protein, 16 aa, Mycobacterium bovis
IPRKPNGKIDSDNLPR

SEQ ID NO: 178745 - protein, 13 aa, Mycobacterium bovis
IPRRKSQNVKSAH

SEQ ID NO: 178746 - protein, 12 aa, Mycobacterium bovis
IPRTTSGKLARQ

SEQ ID NO: 178747 - protein, 4 aa, Mycobacterium bovis
IPSA

SEQ ID NO: 178748 - protein, 8 aa, Mycobacterium bovis
IPSGEYGA

SEQ ID NO: 178749 - protein, 7 aa, Mycobacterium bovis
IPSRNPI

SEQ ID NO: 178750 - protein, 11 aa, Mycobacterium bovis
IPTAADRRCGP

SEQ ID NO: 178751 - protein, 10 aa, Mycobacterium bovis
IPTGNSANFA

SEQ ID NO: 178752 - protein, 8 aa, Mycobacterium bovis
IPTPPGWA

SEQ ID NO: 178753 - protein, 4 aa, Mycobacterium bovis
IPTQ

SEQ ID NO: 178754 - protein, 4 aa, Mycobacterium bovis
IPTR

SEQ ID NO: 178755 - protein, 11 aa, Mycobacterium bovis
IPTTPTHRDGR

SEQ ID NO: 178756 - protein, 4 aa, Mycobacterium bovis
IPVP

SEQ ID NO: 178757 - protein, 4 aa, Mycobacterium bovis
IPVQ

SEQ ID NO: 178758 - protein, 15 aa, Mycobacterium bovis
IPVSKGADEPLGGRW

SEQ ID NO: 178759 - protein, 14 aa, Mycobacterium bovis
IPVTTSGKVRRSAS

SEQ ID NO: 178760 - protein, 20 aa, Mycobacterium bovis
IQDETGIRPTWSPESYPDAV

SEQ ID NO: 178761 - protein, 9 aa, Mycobacterium bovis
IQDKGEGKN

SEQ ID NO: 178762 - protein, 9 aa, Mycobacterium bovis
IQGEGGDRH

SEQ ID NO: 178763 - protein, 6 aa, Mycobacterium bovis
IQPGVT

SEQ ID NO: 178764 - protein, 8 aa, Mycobacterium bovis
IQPLPPKR

SEQ ID NO: 178765 - protein, 7 aa, Mycobacterium bovis
IQPPGKK

SEQ ID NO: 178766 - protein, 11 aa, Mycobacterium bovis
IQPRSPTVSGE

SEQ ID NO: 178767 - protein, 9 aa, Mycobacterium bovis
IQPSGSVAR

SEQ ID NO: 178768 - protein, 11 aa, Mycobacterium bovis
IQQSETPRTET

SEQ ID NO: 178769 - protein, 4 aa, Mycobacterium bovis
IQRT

SEQ ID NO: 178770 - protein, 5 aa, Mycobacterium bovis
IQSDA

SEQ ID NO: 178771 - protein, 7 aa, Mycobacterium bovis
IQSVGAG

SEQ ID NO: 178772 - protein, 6 aa, Mycobacterium bovis
IQTAPS

SEQ ID NO: 178773 - protein, 9 aa, Mycobacterium bovis
IRAPSGGNV

SEQ ID NO: 178774 - protein, 13 aa, Mycobacterium bovis
IRAQGGVSRMSDP

SEQ ID NO: 178775 - protein, 4 aa, Mycobacterium bovis
IRDG

SEQ ID NO: 178776 - protein, 10 aa, Mycobacterium bovis
IRGESENLAP

SEQ ID NO: 178777 - protein, 4 aa, Mycobacterium bovis
IRGP

SEQ ID NO: 178778 - protein, 5 aa, Mycobacterium bovis
IRGTQ

SEQ ID NO: 178779 - protein, 4 aa, Mycobacterium bovis
IRHP

SEQ ID NO: 178780 - protein, 9 aa, Mycobacterium bovis
IRKDTDRDK

SEQ ID NO: 178781 - protein, 11 aa, Mycobacterium bovis
IRNDPSDGHKV

SEQ ID NO: 178782 - protein, 12 aa, Mycobacterium bovis
IRNQSPLGTRKE

SEQ ID NO: 178783 - protein, 22 aa, Mycobacterium bovis
IRNRRSRKRSQSHMPPRTPPRG

SEQ ID NO: 178784 - protein, 13 aa, Mycobacterium bovis
IRPAGETFATPDA

SEQ ID NO: 178785 - protein, 11 aa, Mycobacterium bovis
IRPDGRNDAAG

SEQ ID NO: 178786 - protein, 6 aa, Mycobacterium bovis
IRPDTT

SEQ ID NO: 178787 - protein, 5 aa, Mycobacterium bovis
IRPGE

SEQ ID NO: 178788 - protein, 4 aa, Mycobacterium bovis
IRPP

SEQ ID NO: 178789 - protein, 6 aa, Mycobacterium bovis
IRPPQR

SEQ ID NO: 178790 - protein, 12 aa, Mycobacterium bovis
IRPQRDHRRIPG

SEQ ID NO: 178791 - protein, 6 aa, Mycobacterium bovis
IRPSTI

SEQ ID NO: 178792 - protein, 5 aa, Mycobacterium bovis
IRQQR

SEQ ID NO: 178793 - protein, 6 aa, Mycobacterium bovis
IRRGSD

SEQ ID NO: 178794 - protein, 6 aa, Mycobacterium bovis
IRSAQA

SEQ ID NO: 178795 - protein, 4 aa, Mycobacterium bovis
IRSG

SEQ ID NO: 178796 - protein, 5 aa, Mycobacterium bovis
IRSGE

SEQ ID NO: 178797 - protein, 9 aa, Mycobacterium bovis
IRSRDGGFE

SEQ ID NO: 178798 - protein, 16 aa, Mycobacterium bovis
IRSSKAAALKSNDPTT

SEQ ID NO: 178799 - protein, 21 aa, Mycobacterium bovis
IRSSSTNDPQRPSPPAQEASP

SEQ ID NO: 178800 - protein, 17 aa, Mycobacterium bovis
IRSTGRWRGRPKNQDAY

SEQ ID NO: 178801 - protein, 7 aa, Mycobacterium bovis
IRTRRGS

SEQ ID NO: 178802 - protein, 4 aa, Mycobacterium bovis
ISAE

SEQ ID NO: 178803 - protein, 9 aa, Mycobacterium bovis
ISAEARRRS

SEQ ID NO: 178804 - protein, 5 aa, Mycobacterium bovis
ISAGA

SEQ ID NO: 178805 - protein, 7 aa, Mycobacterium bovis
ISAPDNP

SEQ ID NO: 178806 - protein, 7 aa, Mycobacterium bovis
ISAPERL

SEQ ID NO: 178807 - protein, 11 aa, Mycobacterium bovis
ISDPGSAEGYS

SEQ ID NO: 178808 - protein, 5 aa, Mycobacterium bovis
ISEDD

SEQ ID NO: 178809 - protein, 10 aa, Mycobacterium bovis
ISEDNPGVGR

SEQ ID NO: 178810 - protein, 4 aa, Mycobacterium bovis
ISEN

SEQ ID NO: 178811 - protein, 9 aa, Mycobacterium bovis
ISGDPNALR

SEQ ID NO: 178812 - protein, 13 aa, Mycobacterium bovis
ISGDVPQAQRERT

SEQ ID NO: 178813 - protein, 5 aa, Mycobacterium bovis
ISGEG

SEQ ID NO: 178814 - protein, 12 aa, Mycobacterium bovis
ISGEHGVGRAKT

SEQ ID NO: 178815 - protein, 4 aa, Mycobacterium bovis
ISGG

SEQ ID NO: 178816 - protein, 25 aa, Mycobacterium bovis
ISGGEEGALNGPSIMPGGPAESYQS

SEQ ID NO: 178817 - protein, 8 aa, Mycobacterium bovis
ISGKKGER

SEQ ID NO: 178818 - protein, 8 aa, Mycobacterium bovis
ISGPSQGG

SEQ ID NO: 178819 - protein, 6 aa, Mycobacterium bovis
ISGRTR

SEQ ID NO: 178820 - protein, 10 aa, Mycobacterium bovis
ISGSGNQRLP

SEQ ID NO: 178821 - protein, 14 aa, Mycobacterium bovis
ISGSTPPAQPEPTR

SEQ ID NO: 178822 - protein, 10 aa, Mycobacterium bovis
ISGTAPGVTS

SEQ ID NO: 178823 - protein, 4 aa, Mycobacterium bovis
ISHS

SEQ ID NO: 178824 - protein, 4 aa, Mycobacterium bovis
ISNA

SEQ ID NO: 178825 - protein, 13 aa, Mycobacterium bovis
ISPPSGATDVRDE

SEQ ID NO: 178826 - protein, 15 aa, Mycobacterium bovis
ISPRKVNKPLTGQYT

SEQ ID NO: 178827 - protein, 14 aa, Mycobacterium bovis
ISQATVNRMRGVLL

SEQ ID NO: 178828 - protein, 9 aa, Mycobacterium bovis
ISQGPGGIA

SEQ ID NO: 178829 - protein, 8 aa, Mycobacterium bovis
ISQRATAD

SEQ ID NO: 178830 - protein, 4 aa, Mycobacterium bovis
ISQS

SEQ ID NO: 178831 - protein, 6 aa, Mycobacterium bovis
ISQTPG

SEQ ID NO: 178832 - protein, 8 aa, Mycobacterium bovis
ISRAGRDA

SEQ ID NO: 178833 - protein, 6 aa, Mycobacterium bovis
ISRASS

SEQ ID NO: 178834 - protein, 6 aa, Mycobacterium bovis
ISRDKR

SEQ ID NO: 178835 - protein, 5 aa, Mycobacterium bovis
ISREG

SEQ ID NO: 178836 - protein, 8 aa, Mycobacterium bovis
ISRRTGDI

SEQ ID NO: 178837 - protein, 4 aa, Mycobacterium bovis
ISSG

SEQ ID NO: 178838 - protein, 5 aa, Mycobacterium bovis
ISSGE

SEQ ID NO: 178839 - protein, 10 aa, Mycobacterium bovis
ISSGGENPAG

SEQ ID NO: 178840 - protein, 12 aa, Mycobacterium bovis
ISSPSDPTANPI

SEQ ID NO: 178841 - protein, 12 aa, Mycobacterium bovis
ISTADDNNGADL

SEQ ID NO: 178842 - protein, 10 aa, Mycobacterium bovis
ISTEEANEQM

SEQ ID NO: 178843 - protein, 9 aa, Mycobacterium bovis
ISTPDAPSI

SEQ ID NO: 178844 - protein, 9 aa, Mycobacterium bovis
ISTTKPSPL

SEQ ID NO: 178845 - protein, 8 aa, Mycobacterium bovis
ISTVPADR

SEQ ID NO: 178846 - protein, 5 aa, Mycobacterium bovis
ISVTD

SEQ ID NO: 178847 - protein, 26 aa, Mycobacterium bovis
ITAATKAPARNQTLTRGHPFQQTFEK

SEQ ID NO: 178848 - protein, 10 aa, Mycobacterium bovis
ITADGEFADR

SEQ ID NO: 178849 - protein, 4 aa, Mycobacterium bovis
ITAG

SEQ ID NO: 178850 - protein, 4 aa, Mycobacterium bovis
ITAP

SEQ ID NO: 178851 - protein, 11 aa, Mycobacterium bovis
ITAPDARGERV

SEQ ID NO: 178852 - protein, 11 aa, Mycobacterium bovis
ITAPDEPKYDA

SEQ ID NO: 178853 - protein, 4 aa, Mycobacterium bovis
ITAR

SEQ ID NO: 178854 - protein, 8 aa, Mycobacterium bovis
ITDARNEE

SEQ ID NO: 178855 - protein, 5 aa, Mycobacterium bovis
ITDED

SEQ ID NO: 178856 - protein, 4 aa, Mycobacterium bovis
ITDN

SEQ ID NO: 178857 - protein, 7 aa, Mycobacterium bovis
ITDPAAA

SEQ ID NO: 178858 - protein, 8 aa, Mycobacterium bovis
ITDPDNPV

SEQ ID NO: 178859 - protein, 11 aa, Mycobacterium bovis
ITDVTAASAAT

SEQ ID NO: 178860 - protein, 10 aa, Mycobacterium bovis
ITEDPTPRGH

SEQ ID NO: 178861 - protein, 5 aa, Mycobacterium bovis
ITEHG

SEQ ID NO: 178862 - protein, 8 aa, Mycobacterium bovis
ITEPDTAE

SEQ ID NO: 178863 - protein, 5 aa, Mycobacterium bovis
ITEPQ

SEQ ID NO: 178864 - protein, 5 aa, Mycobacterium bovis
ITERQ

SEQ ID NO: 178865 - protein, 4 aa, Mycobacterium bovis
ITGA

SEQ ID NO: 178866 - protein, 5 aa, Mycobacterium bovis
ITGEQ

SEQ ID NO: 178867 - protein, 10 aa, Mycobacterium bovis
ITGESQARAV

SEQ ID NO: 178868 - protein, 6 aa, Mycobacterium bovis
ITGETP

SEQ ID NO: 178869 - protein, 5 aa, Mycobacterium bovis
ITGGR

SEQ ID NO: 178870 - protein, 8 aa, Mycobacterium bovis
ITGKDEDE

SEQ ID NO: 178871 - protein, 14 aa, Mycobacterium bovis
ITGQPTEWIVPRGT

SEQ ID NO: 178872 - protein, 7 aa, Mycobacterium bovis
ITGQRPG

SEQ ID NO: 178873 - protein, 5 aa, Mycobacterium bovis
ITGRE

SEQ ID NO: 178874 - protein, 11 aa, Mycobacterium bovis
ITHPSAATAEA

SEQ ID NO: 178875 - protein, 6 aa, Mycobacterium bovis
ITMPAP

SEQ ID NO: 178876 - protein, 8 aa, Mycobacterium bovis
ITNSGTDI

SEQ ID NO: 178877 - protein, 16 aa, Mycobacterium bovis
ITNTPLGYGGVDGDER

SEQ ID NO: 178878 - protein, 17 aa, Mycobacterium bovis
ITPATRNSAGFAAPAAV

SEQ ID NO: 178879 - protein, 7 aa, Mycobacterium bovis
ITPDDDE

SEQ ID NO: 178880 - protein, 7 aa, Mycobacterium bovis
ITPDEAR

SEQ ID NO: 178881 - protein, 11 aa, Mycobacterium bovis
ITPDEIRATNP

SEQ ID NO: 178882 - protein, 4 aa, Mycobacterium bovis
ITPG

SEQ ID NO: 178883 - protein, 6 aa, Mycobacterium bovis
ITPGQR

SEQ ID NO: 178884 - protein, 9 aa, Mycobacterium bovis
ITPGSGPKR

SEQ ID NO: 178885 - protein, 13 aa, Mycobacterium bovis
ITPGSMPADSREI

SEQ ID NO: 178886 - protein, 9 aa, Mycobacterium bovis
ITPPDPDGK

SEQ ID NO: 178887 - protein, 5 aa, Mycobacterium bovis
ITQGK

SEQ ID NO: 178888 - protein, 12 aa, Mycobacterium bovis
ITRESGRSQGDF

SEQ ID NO: 178889 - protein, 7 aa, Mycobacterium bovis
ITRGDAE

SEQ ID NO: 178890 - protein, 6 aa, Mycobacterium bovis
ITRNNP

SEQ ID NO: 178891 - protein, 5 aa, Mycobacterium bovis
ITRRS

SEQ ID NO: 178892 - protein, 5 aa, Mycobacterium bovis
ITRTA

SEQ ID NO: 178893 - protein, 5 aa, Mycobacterium bovis
ITRTP

SEQ ID NO: 178894 - protein, 13 aa, Mycobacterium bovis
ITSGEDPGIARTG

SEQ ID NO: 178895 - protein, 6 aa, Mycobacterium bovis
ITSPID

SEQ ID NO: 178896 - protein, 17 aa, Mycobacterium bovis
ITSSDTKDPNREHDTSD

SEQ ID NO: 178897 - protein, 6 aa, Mycobacterium bovis
ITSSKG

SEQ ID NO: 178898 - protein, 10 aa, Mycobacterium bovis
ITSTRGRSIT

SEQ ID NO: 178899 - protein, 8 aa, Mycobacterium bovis
ITTAPGRP

SEQ ID NO: 178900 - protein, 7 aa, Mycobacterium bovis
ITTGPGG

SEQ ID NO: 178901 - protein, 6 aa, Mycobacterium bovis
ITTGQT

SEQ ID NO: 178902 - protein, 5 aa, Mycobacterium bovis
ITTSG

SEQ ID NO: 178903 - protein, 6 aa, Mycobacterium bovis
IVPGGG

SEQ ID NO: 178904 - protein, 4 aa, Mycobacterium bovis
IVPP

SEQ ID NO: 178905 - protein, 5 aa, Mycobacterium bovis
IVPPA

SEQ ID NO: 178906 - protein, 4 aa, Mycobacterium bovis
IYDA

SEQ ID NO: 178907 - protein, 4 aa, Mycobacterium bovis
IYEA

SEQ ID NO: 178908 - protein, 8 aa, Mycobacterium bovis
IYGGSNEI

SEQ ID NO: 178909 - protein, 8 aa, Mycobacterium bovis
KAAAANPP

SEQ ID NO: 178910 - protein, 8 aa, Mycobacterium bovis
KAAADSAE

SEQ ID NO: 178911 - protein, 6 aa, Mycobacterium bovis
KAAAEY

SEQ ID NO: 178912 - protein, 7 aa, Mycobacterium bovis
KAADAVS

SEQ ID NO: 178913 - protein, 9 aa, Mycobacterium bovis
KAADPNNPT

SEQ ID NO: 178914 - protein, 11 aa, Mycobacterium bovis
KAAEADEVEAE

SEQ ID NO: 178915 - protein, 6 aa, Mycobacterium bovis
KAAEGY

SEQ ID NO: 178916 - protein, 7 aa, Mycobacterium bovis
KAAEPAV

SEQ ID NO: 178917 - protein, 6 aa, Mycobacterium bovis
KAAGAA

SEQ ID NO: 178918 - protein, 11 aa, Mycobacterium bovis
KAAGKQGSIDR

SEQ ID NO: 178919 - protein, 8 aa, Mycobacterium bovis
KAAGNVDT

SEQ ID NO: 178920 - protein, 17 aa, Mycobacterium bovis
KAAGPSKPRLARDPVNQ

SEQ ID NO: 178921 - protein, 13 aa, Mycobacterium bovis
KAAGTSAGAAQSA

SEQ ID NO: 178922 - protein, 8 aa, Mycobacterium bovis
KAAKAAGH

SEQ ID NO: 178923 - protein, 19 aa, Mycobacterium bovis
KAAKAAKTAGDQAGDHHRD

SEQ ID NO: 178924 - protein, 7 aa, Mycobacterium bovis
KAALKDS

SEQ ID NO: 178925 - protein, 5 aa, Mycobacterium bovis
KAARK

SEQ ID NO: 178926 - protein, 17 aa, Mycobacterium bovis
KAARRDSAHSAGGGGTM

SEQ ID NO: 178927 - protein, 4 aa, Mycobacterium bovis
KAAT

SEQ ID NO: 178928 - protein, 6 aa, Mycobacterium bovis
KAATAL

SEQ ID NO: 178929 - protein, 29 aa, Mycobacterium bovis
KAATLGATSTHATTPSGLDGPGGSGASTA

SEQ ID NO: 178930 - protein, 5 aa, Mycobacterium bovis
KAAVE

SEQ ID NO: 178931 - protein, 7 aa, Mycobacterium bovis
KADESYQ

SEQ ID NO: 178932 - protein, 11 aa, Mycobacterium bovis
KADGGSSWGNQ

SEQ ID NO: 178933 - protein, 10 aa, Mycobacterium bovis
KADGQPFSDD

SEQ ID NO: 178934 - protein, 13 aa, Mycobacterium bovis
KADPAKVNPNGGA

SEQ ID NO: 178935 - protein, 7 aa, Mycobacterium bovis
KADPSMG

SEQ ID NO: 178936 - protein, 8 aa, Mycobacterium bovis
KAEATNAR

SEQ ID NO: 178937 - protein, 6 aa, Mycobacterium bovis
KAEFDG

SEQ ID NO: 178938 - protein, 10 aa, Mycobacterium bovis
KAELPQAVPH

SEQ ID NO: 178939 - protein, 8 aa, Mycobacterium bovis
KAERPGRK

SEQ ID NO: 178940 - protein, 8 aa, Mycobacterium bovis
KAESPSEL

SEQ ID NO: 178941 - protein, 14 aa, Mycobacterium bovis
KAEVHGTASPQKHQ

SEQ ID NO: 178942 - protein, 11 aa, Mycobacterium bovis
KAFAGAAGDQV

SEQ ID NO: 178943 - protein, 4 aa, Mycobacterium bovis
KAGE

SEQ ID NO: 178944 - protein, 5 aa, Mycobacterium bovis
KAGEQ

SEQ ID NO: 178945 - protein, 19 aa, Mycobacterium bovis
KAGESAATRWESSGEGTYT

SEQ ID NO: 178946 - protein, 6 aa, Mycobacterium bovis
KAGFTV

SEQ ID NO: 178947 - protein, 7 aa, Mycobacterium bovis
KAGGARD

SEQ ID NO: 178948 - protein, 11 aa, Mycobacterium bovis
KAGGATTPIGT

SEQ ID NO: 178949 - protein, 9 aa, Mycobacterium bovis
KAGGESARS

SEQ ID NO: 178950 - protein, 8 aa, Mycobacterium bovis
KAGGPNLD

SEQ ID NO: 178951 - protein, 5 aa, Mycobacterium bovis
KAGIS

SEQ ID NO: 178952 - protein, 7 aa, Mycobacterium bovis
KAGKAGL

SEQ ID NO: 178953 - protein, 9 aa, Mycobacterium bovis
KAGKAPKDI

SEQ ID NO: 178954 - protein, 6 aa, Mycobacterium bovis
KAGNEH

SEQ ID NO: 178955 - protein, 12 aa, Mycobacterium bovis
KAGNISKRQSAT

SEQ ID NO: 178956 - protein, 7 aa, Mycobacterium bovis
KAGNPDI

SEQ ID NO: 178957 - protein, 4 aa, Mycobacterium bovis
KAGR

SEQ ID NO: 178958 - protein, 9 aa, Mycobacterium bovis
KAGTAHPIS

SEQ ID NO: 178959 - protein, 12 aa, Mycobacterium bovis
KAGWAAAAGEPL

SEQ ID NO: 178960 - protein, 9 aa, Mycobacterium bovis
KAHHGRAGT

SEQ ID NO: 178961 - protein, 8 aa, Mycobacterium bovis
KAHSGAPA

SEQ ID NO: 178962 - protein, 6 aa, Mycobacterium bovis
KAIDDD

SEQ ID NO: 178963 - protein, 8 aa, Mycobacterium bovis
KAKANGAK

SEQ ID NO: 178964 - protein, 8 aa, Mycobacterium bovis
KAKEVPAA

SEQ ID NO: 178965 - protein, 6 aa, Mycobacterium bovis
KAKGLD

SEQ ID NO: 178966 - protein, 5 aa, Mycobacterium bovis
KAKKN

SEQ ID NO: 178967 - protein, 28 aa, Mycobacterium bovis
KAKKSSVPNENIERARKRGAGEEAGGAD

SEQ ID NO: 178968 - protein, 8 aa, Mycobacterium bovis
KAKPGRSV

SEQ ID NO: 178969 - protein, 8 aa, Mycobacterium bovis
KAKSQKAV

SEQ ID NO: 178970 - protein, 21 aa, Mycobacterium bovis
KAKVDGIPDTESVVTPDLLED

SEQ ID NO: 178971 - protein, 6 aa, Mycobacterium bovis
KALAGN

SEQ ID NO: 178972 - protein, 6 aa, Mycobacterium bovis
KALREN

SEQ ID NO: 178973 - protein, 5 aa, Mycobacterium bovis
KAMRE

SEQ ID NO: 178974 - protein, 7 aa, Mycobacterium bovis
KANEAGI

SEQ ID NO: 178975 - protein, 14 aa, Mycobacterium bovis
KANPDGAGVQPWDK

SEQ ID NO: 178976 - protein, 6 aa, Mycobacterium bovis
KANVPA

SEQ ID NO: 178977 - protein, 5 aa, Mycobacterium bovis
KANVT

SEQ ID NO: 178978 - protein, 6 aa, Mycobacterium bovis
KAPAFT

SEQ ID NO: 178979 - protein, 9 aa, Mycobacterium bovis
KAPDALSLP

SEQ ID NO: 178980 - protein, 6 aa, Mycobacterium bovis
KAPDAV

SEQ ID NO: 178981 - protein, 9 aa, Mycobacterium bovis
KAPGQRIPR

SEQ ID NO: 178982 - protein, 10 aa, Mycobacterium bovis
KAPNAGPSRD

SEQ ID NO: 178983 - protein, 7 aa, Mycobacterium bovis
KAPPPIA

SEQ ID NO: 178984 - protein, 10 aa, Mycobacterium bovis
KAPQGPPVTK

SEQ ID NO: 178985 - protein, 8 aa, Mycobacterium bovis
KAPSQEDH

SEQ ID NO: 178986 - protein, 5 aa, Mycobacterium bovis
KAPSV

SEQ ID NO: 178987 - protein, 7 aa, Mycobacterium bovis
KAQETQR

SEQ ID NO: 178988 - protein, 7 aa, Mycobacterium bovis
KAQRHQR

SEQ ID NO: 178989 - protein, 4 aa, Mycobacterium bovis
KARA

SEQ ID NO: 178990 - protein, 19 aa, Mycobacterium bovis
KARAAEKPAPSDRAGDDAA

SEQ ID NO: 178991 - protein, 7 aa, Mycobacterium bovis
KAREQMS

SEQ ID NO: 178992 - protein, 8 aa, Mycobacterium bovis
KAREVRGA

SEQ ID NO: 178993 - protein, 6 aa, Mycobacterium bovis
KARGDG

SEQ ID NO: 178994 - protein, 9 aa, Mycobacterium bovis
KARHAATGF

SEQ ID NO: 178995 - protein, 6 aa, Mycobacterium bovis
KARQRT

SEQ ID NO: 178996 - protein, 8 aa, Mycobacterium bovis
KARQSGAA

SEQ ID NO: 178997 - protein, 10 aa, Mycobacterium bovis
KARRDSDRAA

SEQ ID NO: 178998 - protein, 5 aa, Mycobacterium bovis
KARRG

SEQ ID NO: 178999 - protein, 6 aa, Mycobacterium bovis
KARRTL

SEQ ID NO: 179000 - protein, 10 aa, Mycobacterium bovis
KARYEGGPTP

SEQ ID NO: 179001 - protein, 4 aa, Mycobacterium bovis
KASD

SEQ ID NO: 179002 - protein, 8 aa, Mycobacterium bovis
KASGRDLS

SEQ ID NO: 179003 - protein, 8 aa, Mycobacterium bovis
KASISGAV

SEQ ID NO: 179004 - protein, 9 aa, Mycobacterium bovis
KASQATAQR

SEQ ID NO: 179005 - protein, 4 aa, Mycobacterium bovis
KAST

SEQ ID NO: 179006 - protein, 13 aa, Mycobacterium bovis
KATAAAAPSVRTA

SEQ ID NO: 179007 - protein, 16 aa, Mycobacterium bovis
KATAITPGLESPTIAP

SEQ ID NO: 179008 - protein, 29 aa, Mycobacterium bovis
KATAQRPVAAGRPRPRPQRPVSDRVSDQR

SEQ ID NO: 179009 - protein, 7 aa, Mycobacterium bovis
KATGVDE

SEQ ID NO: 179010 - protein, 5 aa, Mycobacterium bovis
KATPE

SEQ ID NO: 179011 - protein, 7 aa, Mycobacterium bovis
KATQEDP

SEQ ID NO: 179012 - protein, 7 aa, Mycobacterium bovis
KATREDI

SEQ ID NO: 179013 - protein, 8 aa, Mycobacterium bovis
KATRQTLT

SEQ ID NO: 179014 - protein, 8 aa, Mycobacterium bovis
KATTDEPF

SEQ ID NO: 179015 - protein, 12 aa, Mycobacterium bovis
KAVAEEATKRTV

SEQ ID NO: 179016 - protein, 9 aa, Mycobacterium bovis
KAVGTDTQA

SEQ ID NO: 179017 - protein, 7 aa, Mycobacterium bovis
KAYDPDS

SEQ ID NO: 179018 - protein, 8 aa, Mycobacterium bovis
KAYGRNSD

SEQ ID NO: 179019 - protein, 5 aa, Mycobacterium bovis
KAYSA

SEQ ID NO: 179020 - protein, 7 aa, Mycobacterium bovis
KDAAGVS

SEQ ID NO: 179021 - protein, 9 aa, Mycobacterium bovis
KDADRAQRR

SEQ ID NO: 179022 - protein, 4 aa, Mycobacterium bovis
KDAG

SEQ ID NO: 179023 - protein, 9 aa, Mycobacterium bovis
KDAPPLPAS

SEQ ID NO: 179024 - protein, 12 aa, Mycobacterium bovis
KDAQARAGATAL

SEQ ID NO: 179025 - protein, 7 aa, Mycobacterium bovis
KDAQRDK

SEQ ID NO: 179026 - protein, 10 aa, Mycobacterium bovis
KDDKAGETVG

SEQ ID NO: 179027 - protein, 8 aa, Mycobacterium bovis
KDDLKSTV

SEQ ID NO: 179028 - protein, 5 aa, Mycobacterium bovis
KDDQR

SEQ ID NO: 179029 - protein, 6 aa, Mycobacterium bovis
KDEEAP

SEQ ID NO: 179030 - protein, 8 aa, Mycobacterium bovis
KDEGGRHT

SEQ ID NO: 179031 - protein, 4 aa, Mycobacterium bovis
KDEQ

SEQ ID NO: 179032 - protein, 8 aa, Mycobacterium bovis
KDEYPATA

SEQ ID NO: 179033 - protein, 9 aa, Mycobacterium bovis
KDGAIAGPR

SEQ ID NO: 179034 - protein, 7 aa, Mycobacterium bovis
KDGASSL

SEQ ID NO: 179035 - protein, 373 aa, Mycobacterium bovis
KDGDGGAGGDGGDPGAGGKGGAGGAGATEGVTGATGATVHSGGNGGKGGNGADATVAGANGGKGGAGGNGGLVGDGGAGGDGGSGAAGANGANVGEDGADGTLSGQPGEGSEANGGQGGVGGGGAGGAGGDGGAGSSALGSGGNGGRGDAGQAGGAGGAGGAGGAGGSVSGDGGPGGKGGAGGAGGAGASGGGGGKGASGADSAEAVGGAGGKGGDGGVGGVGGDGGPGGDGGAGGAAPAGQVGSHGVGGVGGDGGLGGAGGNGGDGGHGSDGGDGGDGGDPGAGGLGGLGGDSGNGTRAASGVDASDHGPGSGGNGGNGGNGAQASVAGGAGGNGGDGGNAGRVGDGGAGGNGGDGAAGANGANSGAPGSDA

SEQ ID NO: 179036 - protein, 16 aa, Mycobacterium bovis
KDGDQDSGAGRRGAQR

SEQ ID NO: 179037 - protein, 10 aa, Mycobacterium bovis
KDGGAQRRTV

SEQ ID NO: 179038 - protein, 7 aa, Mycobacterium bovis
KDGGKVE

SEQ ID NO: 179039 - protein, 6 aa, Mycobacterium bovis
KDGGVL

SEQ ID NO: 179040 - protein, 4 aa, Mycobacterium bovis
KDGQ

SEQ ID NO: 179041 - protein, 8 aa, Mycobacterium bovis
KDGRPKPV

SEQ ID NO: 179042 - protein, 6 aa, Mycobacterium bovis
KDGRPV

SEQ ID NO: 179043 - protein, 9 aa, Mycobacterium bovis
KDGRSPSTE

SEQ ID NO: 179044 - protein, 7 aa, Mycobacterium bovis
KDGSGGR

SEQ ID NO: 179045 - protein, 6 aa, Mycobacterium bovis
KDGTLH

SEQ ID NO: 179046 - protein, 8 aa, Mycobacterium bovis
KDGTNSLD

SEQ ID NO: 179047 - protein, 8 aa, Mycobacterium bovis
KDGVAQEL

SEQ ID NO: 179048 - protein, 4 aa, Mycobacterium bovis
KDIQ

SEQ ID NO: 179049 - protein, 7 aa, Mycobacterium bovis
KDIRTPA

SEQ ID NO: 179050 - protein, 6 aa, Mycobacterium bovis
KDIRTT

SEQ ID NO: 179051 - protein, 5 aa, Mycobacterium bovis
KDKAD

SEQ ID NO: 179052 - protein, 11 aa, Mycobacterium bovis
KDKGTGKENTI

SEQ ID NO: 179053 - protein, 7 aa, Mycobacterium bovis
KDLAGRP

SEQ ID NO: 179054 - protein, 7 aa, Mycobacterium bovis
KDLTEGI

SEQ ID NO: 179055 - protein, 7 aa, Mycobacterium bovis
KDNAQQV

SEQ ID NO: 179056 - protein, 6 aa, Mycobacterium bovis
KDNGRI

SEQ ID NO: 179057 - protein, 10 aa, Mycobacterium bovis
KDPADEAKYA

SEQ ID NO: 179058 - protein, 7 aa, Mycobacterium bovis
KDPATGV

SEQ ID NO: 179059 - protein, 8 aa, Mycobacterium bovis
KDPEKKKK

SEQ ID NO: 179060 - protein, 6 aa, Mycobacterium bovis
KDPGYS

SEQ ID NO: 179061 - protein, 12 aa, Mycobacterium bovis
KDPMVPSAQSRA

SEQ ID NO: 179062 - protein, 6 aa, Mycobacterium bovis
KDPQVS

SEQ ID NO: 179063 - protein, 6 aa, Mycobacterium bovis
KDPRMK

SEQ ID NO: 179064 - protein, 6 aa, Mycobacterium bovis
KDPRRH

SEQ ID NO: 179065 - protein, 12 aa, Mycobacterium bovis
KDPVGHKGARLT

SEQ ID NO: 179066 - protein, 8 aa, Mycobacterium bovis
KDQTRDGA

SEQ ID NO: 179067 - protein, 9 aa, Mycobacterium bovis
KDRADQHSA

SEQ ID NO: 179068 - protein, 6 aa, Mycobacterium bovis
KDRATR

SEQ ID NO: 179069 - protein, 4 aa, Mycobacterium bovis
KDRE

SEQ ID NO: 179070 - protein, 5 aa, Mycobacterium bovis
KDREL

SEQ ID NO: 179071 - protein, 9 aa, Mycobacterium bovis
KDRKQFGES

SEQ ID NO: 179072 - protein, 10 aa, Mycobacterium bovis
KDRNPNWSPA

SEQ ID NO: 179073 - protein, 9 aa, Mycobacterium bovis
KDRPEPATL

SEQ ID NO: 179074 - protein, 6 aa, Mycobacterium bovis
KDRPKK

SEQ ID NO: 179075 - protein, 6 aa, Mycobacterium bovis
KDRRQH

SEQ ID NO: 179076 - protein, 5 aa, Mycobacterium bovis
KDRRR

SEQ ID NO: 179077 - protein, 4 aa, Mycobacterium bovis
KDRT

SEQ ID NO: 179078 - protein, 8 aa, Mycobacterium bovis
KDRTPDQV

SEQ ID NO: 179079 - protein, 4 aa, Mycobacterium bovis
KDSI

SEQ ID NO: 179080 - protein, 7 aa, Mycobacterium bovis
KDSITGA

SEQ ID NO: 179081 - protein, 5 aa, Mycobacterium bovis
KDSPE

SEQ ID NO: 179082 - protein, 13 aa, Mycobacterium bovis
KDSPPSFDPSEVA

SEQ ID NO: 179083 - protein, 10 aa, Mycobacterium bovis
KDTGVQDAPD

SEQ ID NO: 179084 - protein, 6 aa, Mycobacterium bovis
KDTISR

SEQ ID NO: 179085 - protein, 20 aa, Mycobacterium bovis
KEAADEAKAKLEAAGATVTV

SEQ ID NO: 179086 - protein, 5 aa, Mycobacterium bovis
KEAAE

SEQ ID NO: 179087 - protein, 6 aa, Mycobacterium bovis
KEACGA

SEQ ID NO: 179088 - protein, 6 aa, Mycobacterium bovis
KEAPDR

SEQ ID NO: 179089 - protein, 10 aa, Mycobacterium bovis
KEAVGADRKL

SEQ ID NO: 179090 - protein, 6 aa, Mycobacterium bovis
KECYSS

SEQ ID NO: 179091 - protein, 7 aa, Mycobacterium bovis
KEDKEGR

SEQ ID NO: 179092 - protein, 10 aa, Mycobacterium bovis
KEEDEASAER

SEQ ID NO: 179093 - protein, 5 aa, Mycobacterium bovis
KEGLR

SEQ ID NO: 179094 - protein, 23 aa, Mycobacterium bovis
KEGLSTGLGDEGGFAPDVAGTTA

SEQ ID NO: 179095 - protein, 6 aa, Mycobacterium bovis
KEGNER

SEQ ID NO: 179096 - protein, 9 aa, Mycobacterium bovis
KEGVEPQSE

SEQ ID NO: 179097 - protein, 12 aa, Mycobacterium bovis
KEHGSSAGPPVS

SEQ ID NO: 179098 - protein, 9 aa, Mycobacterium bovis
KEHPAKPMS

SEQ ID NO: 179099 - protein, 7 aa, Mycobacterium bovis
KEHPNHK

SEQ ID NO: 179100 - protein, 7 aa, Mycobacterium bovis
KELAPGQ

SEQ ID NO: 179101 - protein, 7 aa, Mycobacterium bovis
KELASDP

SEQ ID NO: 179102 - protein, 13 aa, Mycobacterium bovis
KELGTTTKKDTVH

SEQ ID NO: 179103 - protein, 6 aa, Mycobacterium bovis
KELPAK

SEQ ID NO: 179104 - protein, 5 aa, Mycobacterium bovis
KENDG

SEQ ID NO: 179105 - protein, 6 aa, Mycobacterium bovis
KEPLQT

SEQ ID NO: 179106 - protein, 7 aa, Mycobacterium bovis
KEPPAEG

SEQ ID NO: 179107 - protein, 6 aa, Mycobacterium bovis
KEPPKR

SEQ ID NO: 179108 - protein, 7 aa, Mycobacterium bovis
KEPQRGA

SEQ ID NO: 179109 - protein, 6 aa, Mycobacterium bovis
KEQAGA

SEQ ID NO: 179110 - protein, 24 aa, Mycobacterium bovis
KEQRAEAGKRVNAARNAAQRSYDE

SEQ ID NO: 179111 - protein, 16 aa, Mycobacterium bovis
KERAHNAGAKNVEERP

SEQ ID NO: 179112 - protein, 17 aa, Mycobacterium bovis
KERKEGDVLGRNQSGKA

SEQ ID NO: 179113 - protein, 10 aa, Mycobacterium bovis
KERTDPTQSE

SEQ ID NO: 179114 - protein, 5 aa, Mycobacterium bovis
KESTA

SEQ ID NO: 179115 - protein, 5 aa, Mycobacterium bovis
KETGV

SEQ ID NO: 179116 - protein, 10 aa, Mycobacterium bovis
KEYGGQGRSA

SEQ ID NO: 179117 - protein, 13 aa, Mycobacterium bovis
KEYGSGSSRDWAA

SEQ ID NO: 179118 - protein, 13 aa, Mycobacterium bovis
KFANSNPQTSPEY

SEQ ID NO: 179119 - protein, 13 aa, Mycobacterium bovis
KFGGDSLAETQRN

SEQ ID NO: 179120 - protein, 8 aa, Mycobacterium bovis
KFGGPESY

SEQ ID NO: 179121 - protein, 7 aa, Mycobacterium bovis
KFHGPKG

SEQ ID NO: 179122 - protein, 5 aa, Mycobacterium bovis
KFSDE

SEQ ID NO: 179123 - protein, 4 aa, Mycobacterium bovis
KFSP

SEQ ID NO: 179124 - protein, 9 aa, Mycobacterium bovis
KFSRPNDRR

SEQ ID NO: 179125 - protein, 5 aa, Mycobacterium bovis
KFTRD

SEQ ID NO: 179126 - protein, 9 aa, Mycobacterium bovis
KFTSAESRT

SEQ ID NO: 179127 - protein, 6 aa, Mycobacterium bovis
KGAGLG

SEQ ID NO: 179128 - protein, 10 aa, Mycobacterium bovis
KGAHGSRSSV

SEQ ID NO: 179129 - protein, 8 aa, Mycobacterium bovis
KGAPMPAP

SEQ ID NO: 179130 - protein, 9 aa, Mycobacterium bovis
KGAPPAPLD

SEQ ID NO: 179131 - protein, 5 aa, Mycobacterium bovis
KGAPR

SEQ ID NO: 179132 - protein, 9 aa, Mycobacterium bovis
KGAQPQAAK

SEQ ID NO: 179133 - protein, 10 aa, Mycobacterium bovis
KGASIGDKTV

SEQ ID NO: 179134 - protein, 6 aa, Mycobacterium bovis
KGAVAD

SEQ ID NO: 179135 - protein, 5 aa, Mycobacterium bovis
KGDPH

SEQ ID NO: 179136 - protein, 15 aa, Mycobacterium bovis
KGDPTLDAGELLKAS

SEQ ID NO: 179137 - protein, 7 aa, Mycobacterium bovis
KGDVGED

SEQ ID NO: 179138 - protein, 4 aa, Mycobacterium bovis
KGEA

SEQ ID NO: 179139 - protein, 6 aa, Mycobacterium bovis
KGEAKD

SEQ ID NO: 179140 - protein, 4 aa, Mycobacterium bovis
KGEE

SEQ ID NO: 179141 - protein, 8 aa, Mycobacterium bovis
KGEKRSGL

SEQ ID NO: 179142 - protein, 11 aa, Mycobacterium bovis
KGESARKAGRR

SEQ ID NO: 179143 - protein, 15 aa, Mycobacterium bovis
KGGAGGTGGRGGAAG

SEQ ID NO: 179144 - protein, 9 aa, Mycobacterium bovis
KGGDPRSPG

SEQ ID NO: 179145 - protein, 7 aa, Mycobacterium bovis
KGGDYLA

SEQ ID NO: 179146 - protein, 14 aa, Mycobacterium bovis
KGGGSVKCCTLEIH

SEQ ID NO: 179147 - protein, 20 aa, Mycobacterium bovis
KGGKGVSDEISRRAPTRVRP

SEQ ID NO: 179148 - protein, 17 aa, Mycobacterium bovis
KGGKQGPRAKLVGQHPR

SEQ ID NO: 179149 - protein, 4 aa, Mycobacterium bovis
KGGR

SEQ ID NO: 179150 - protein, 9 aa, Mycobacterium bovis
KGGTGKSTI

SEQ ID NO: 179151 - protein, 7 aa, Mycobacterium bovis
KGGVGKT

SEQ ID NO: 179152 - protein, 11 aa, Mycobacterium bovis
KGGVGKTTSTI

SEQ ID NO: 179153 - protein, 14 aa, Mycobacterium bovis
KGHETGQRGGGRVR

SEQ ID NO: 179154 - protein, 14 aa, Mycobacterium bovis
KGHGAADWSKRPLP

SEQ ID NO: 179155 - protein, 14 aa, Mycobacterium bovis
KGIGESATVGSPPA

SEQ ID NO: 179156 - protein, 13 aa, Mycobacterium bovis
KGKKAGGGAKPCT

SEQ ID NO: 179157 - protein, 7 aa, Mycobacterium bovis
KGKLTAR

SEQ ID NO: 179158 - protein, 6 aa, Mycobacterium bovis
KGKRFN

SEQ ID NO: 179159 - protein, 6 aa, Mycobacterium bovis
KGKTGL

SEQ ID NO: 179160 - protein, 6 aa, Mycobacterium bovis
KGLGAD

SEQ ID NO: 179161 - protein, 6 aa, Mycobacterium bovis
KGLGAR

SEQ ID NO: 179162 - protein, 23 aa, Mycobacterium bovis
KGLPPNPDATSTSLPGARGADVD

SEQ ID NO: 179163 - protein, 7 aa, Mycobacterium bovis
KGLSTHE

SEQ ID NO: 179164 - protein, 4 aa, Mycobacterium bovis
KGMT

SEQ ID NO: 179165 - protein, 15 aa, Mycobacterium bovis
KGNKQRTVPFGQPAA

SEQ ID NO: 179166 - protein, 4 aa, Mycobacterium bovis
KGNL

SEQ ID NO: 179167 - protein, 7 aa, Mycobacterium bovis
KGNPDYG

SEQ ID NO: 179168 - protein, 6 aa, Mycobacterium bovis
KGNPLP

SEQ ID NO: 179169 - protein, 12 aa, Mycobacterium bovis
KGNSIESPEEAE

SEQ ID NO: 179170 - protein, 18 aa, Mycobacterium bovis
KGPDDDEELEFFGFAGPE

SEQ ID NO: 179171 - protein, 19 aa, Mycobacterium bovis
KGPDQQKPAGVLSGGERNR

SEQ ID NO: 179172 - protein, 8 aa, Mycobacterium bovis
KGPGATSI

SEQ ID NO: 179173 - protein, 6 aa, Mycobacterium bovis
KGPIEA

SEQ ID NO: 179174 - protein, 11 aa, Mycobacterium bovis
KGPKQDHPNIG

SEQ ID NO: 179175 - protein, 8 aa, Mycobacterium bovis
KGPMGTGQ

SEQ ID NO: 179176 - protein, 8 aa, Mycobacterium bovis
KGPSGERE

SEQ ID NO: 179177 - protein, 6 aa, Mycobacterium bovis
KGPTEQ

SEQ ID NO: 179178 - protein, 5 aa, Mycobacterium bovis
KGQET

SEQ ID NO: 179179 - protein, 13 aa, Mycobacterium bovis
KGQLDGPGPSAGP

SEQ ID NO: 179180 - protein, 8 aa, Mycobacterium bovis
KGQVGPGG

SEQ ID NO: 179181 - protein, 5 aa, Mycobacterium bovis
KGRLR

SEQ ID NO: 179182 - protein, 8 aa, Mycobacterium bovis
KGRRDREV

SEQ ID NO: 179183 - protein, 12 aa, Mycobacterium bovis
KGRYPDRKTARR

SEQ ID NO: 179184 - protein, 4 aa, Mycobacterium bovis
KGSF

SEQ ID NO: 179185 - protein, 5 aa, Mycobacterium bovis
KGSLR

SEQ ID NO: 179186 - protein, 4 aa, Mycobacterium bovis
KGSN

SEQ ID NO: 179187 - protein, 5 aa, Mycobacterium bovis
KGSQA

SEQ ID NO: 179188 - protein, 12 aa, Mycobacterium bovis
KGSYEAARERLT

SEQ ID NO: 179189 - protein, 8 aa, Mycobacterium bovis
KGTAGAAV

SEQ ID NO: 179190 - protein, 13 aa, Mycobacterium bovis
KGTAKKGEVPARP

SEQ ID NO: 179191 - protein, 10 aa, Mycobacterium bovis
KGTGVTTRTR

SEQ ID NO: 179192 - protein, 5 aa, Mycobacterium bovis
KGTIR

SEQ ID NO: 179193 - protein, 8 aa, Mycobacterium bovis
KGTPGLSF

SEQ ID NO: 179194 - protein, 5 aa, Mycobacterium bovis
KGTRL

SEQ ID NO: 179195 - protein, 13 aa, Mycobacterium bovis
KGTSEEIEHGPAP

SEQ ID NO: 179196 - protein, 7 aa, Mycobacterium bovis
KGTSGID

SEQ ID NO: 179197 - protein, 11 aa, Mycobacterium bovis
KGTSLSTYTPD

SEQ ID NO: 179198 - protein, 7 aa, Mycobacterium bovis
KGTTSGY

SEQ ID NO: 179199 - protein, 10 aa, Mycobacterium bovis
KGTTYPNPPV

SEQ ID NO: 179200 - protein, 4 aa, Mycobacterium bovis
KGTV

SEQ ID NO: 179201 - protein, 7 aa, Mycobacterium bovis
KGVAGSR

SEQ ID NO: 179202 - protein, 4 aa, Mycobacterium bovis
KGVD

SEQ ID NO: 179203 - protein, 6 aa, Mycobacterium bovis
KGYDGR

SEQ ID NO: 179204 - protein, 11 aa, Mycobacterium bovis
KGYSQGDPYGN

SEQ ID NO: 179205 - protein, 9 aa, Mycobacterium bovis
KGYSTPAHS

SEQ ID NO: 179206 - protein, 5 aa, Mycobacterium bovis
KGYVS

SEQ ID NO: 179207 - protein, 7 aa, Mycobacterium bovis
KHAEGDR

SEQ ID NO: 179208 - protein, 6 aa, Mycobacterium bovis
KHEPEF

SEQ ID NO: 179209 - protein, 4 aa, Mycobacterium bovis
KHGE

SEQ ID NO: 179210 - protein, 10 aa, Mycobacterium bovis
KHGHPPPNGL

SEQ ID NO: 179211 - protein, 5 aa, Mycobacterium bovis
KHGPP

SEQ ID NO: 179212 - protein, 9 aa, Mycobacterium bovis
KHGTADARL

SEQ ID NO: 179213 - protein, 8 aa, Mycobacterium bovis
KHIDGQGR

SEQ ID NO: 179214 - protein, 6 aa, Mycobacterium bovis
KHPDEQ

SEQ ID NO: 179215 - protein, 11 aa, Mycobacterium bovis
KHPPPQTYDEA

SEQ ID NO: 179216 - protein, 7 aa, Mycobacterium bovis
KHPSDHV

SEQ ID NO: 179217 - protein, 10 aa, Mycobacterium bovis
KHPVDEPDEW

SEQ ID NO: 179218 - protein, 4 aa, Mycobacterium bovis
KHPW

SEQ ID NO: 179219 - protein, 7 aa, Mycobacterium bovis
KHRDAVP

SEQ ID NO: 179220 - protein, 7 aa, Mycobacterium bovis
KHSGLSD

SEQ ID NO: 179221 - protein, 9 aa, Mycobacterium bovis
KHSVNNPYA

SEQ ID NO: 179222 - protein, 4 aa, Mycobacterium bovis
KHTY

SEQ ID NO: 179223 - protein, 5 aa, Mycobacterium bovis
KIAES

SEQ ID NO: 179224 - protein, 6 aa, Mycobacterium bovis
KIGEKS

SEQ ID NO: 179225 - protein, 12 aa, Mycobacterium bovis
KIGGRGKAGGVK

SEQ ID NO: 179226 - protein, 11 aa, Mycobacterium bovis
KIGTTGRGIGP

SEQ ID NO: 179227 - protein, 6 aa, Mycobacterium bovis
KIGYPP

SEQ ID NO: 179228 - protein, 6 aa, Mycobacterium bovis
KIPDED

SEQ ID NO: 179229 - protein, 4 aa, Mycobacterium bovis
KIQL

SEQ ID NO: 179230 - protein, 7 aa, Mycobacterium bovis
KIRDDPR

SEQ ID NO: 179231 - protein, 5 aa, Mycobacterium bovis
KISPR

SEQ ID NO: 179232 - protein, 20 aa, Mycobacterium bovis
KITAATAGIATTTFPETPSI

SEQ ID NO: 179233 - protein, 6 aa, Mycobacterium bovis
KITERT

SEQ ID NO: 179234 - protein, 8 aa, Mycobacterium bovis
KKAAAGEI

SEQ ID NO: 179235 - protein, 38 aa, Mycobacterium bovis
KKAAPAKKAAPAKKAAPAKKAAAKKAPAKKAAAKKVTQ

SEQ ID NO: 179236 - protein, 7 aa, Mycobacterium bovis
KKAASDA

SEQ ID NO: 179237 - protein, 7 aa, Mycobacterium bovis
KKAGYGG

SEQ ID NO: 179238 - protein, 6 aa, Mycobacterium bovis
KKAQAA

SEQ ID NO: 179239 - protein, 6 aa, Mycobacterium bovis
KKDHPC

SEQ ID NO: 179240 - protein, 14 aa, Mycobacterium bovis
KKDPVSRRPLQGPR

SEQ ID NO: 179241 - protein, 7 aa, Mycobacterium bovis
KKEYGQD

SEQ ID NO: 179242 - protein, 16 aa, Mycobacterium bovis
KKGGLSGYPSRAESEH

SEQ ID NO: 179243 - protein, 7 aa, Mycobacterium bovis
KKGRDAD

SEQ ID NO: 179244 - protein, 9 aa, Mycobacterium bovis
KKGRDADRV

SEQ ID NO: 179245 - protein, 9 aa, Mycobacterium bovis
KKGRDPDRV

SEQ ID NO: 179246 - protein, 9 aa, Mycobacterium bovis
KKGRDQDRV

SEQ ID NO: 179247 - protein, 9 aa, Mycobacterium bovis
KKGSGHQEV

SEQ ID NO: 179248 - protein, 9 aa, Mycobacterium bovis
KKGVEGPPT

SEQ ID NO: 179249 - protein, 10 aa, Mycobacterium bovis
KKHPDHDKPW

SEQ ID NO: 179250 - protein, 8 aa, Mycobacterium bovis
KKKGKSLT

SEQ ID NO: 179251 - protein, 7 aa, Mycobacterium bovis
KKKPNRK

SEQ ID NO: 179252 - protein, 10 aa, Mycobacterium bovis
KKNRRNDPDR

SEQ ID NO: 179253 - protein, 5 aa, Mycobacterium bovis
KKPGI

SEQ ID NO: 179254 - protein, 7 aa, Mycobacterium bovis
KKPLPEQ

SEQ ID NO: 179255 - protein, 16 aa, Mycobacterium bovis
KKPVGYTSTVNGRRKR

SEQ ID NO: 179256 - protein, 13 aa, Mycobacterium bovis
KKQAQESVAAEAT

SEQ ID NO: 179257 - protein, 8 aa, Mycobacterium bovis
KKRPEEAI

SEQ ID NO: 179258 - protein, 4 aa, Mycobacterium bovis
KKRR

SEQ ID NO: 179259 - protein, 11 aa, Mycobacterium bovis
KKRTSTRISNP

SEQ ID NO: 179260 - protein, 9 aa, Mycobacterium bovis
KKSARGEYE

SEQ ID NO: 179261 - protein, 9 aa, Mycobacterium bovis
KKSIGPDKV

SEQ ID NO: 179262 - protein, 5 aa, Mycobacterium bovis
KKSLA

SEQ ID NO: 179263 - protein, 8 aa, Mycobacterium bovis
KKYTAPEI

SEQ ID NO: 179264 - protein, 7 aa, Mycobacterium bovis
KLAAAEN

SEQ ID NO: 179265 - protein, 13 aa, Mycobacterium bovis
KLAERQGEKSYAQ

SEQ ID NO: 179266 - protein, 6 aa, Mycobacterium bovis
KLAGEQ

SEQ ID NO: 179267 - protein, 5 aa, Mycobacterium bovis
KLAGG

SEQ ID NO: 179268 - protein, 9 aa, Mycobacterium bovis
KLATPDTSV

SEQ ID NO: 179269 - protein, 6 aa, Mycobacterium bovis
KLDGEE

SEQ ID NO: 179270 - protein, 17 aa, Mycobacterium bovis
KLENGTKAIYNPHYEIQ

SEQ ID NO: 179271 - protein, 7 aa, Mycobacterium bovis
KLEREPE

SEQ ID NO: 179272 - protein, 7 aa, Mycobacterium bovis
KLGGARP

SEQ ID NO: 179273 - protein, 6 aa, Mycobacterium bovis
KLGGHD

SEQ ID NO: 179274 - protein, 7 aa, Mycobacterium bovis
KLGGSKI

SEQ ID NO: 179275 - protein, 16 aa, Mycobacterium bovis
KLGPGVDVRMKLVEWN

SEQ ID NO: 179276 - protein, 9 aa, Mycobacterium bovis
KLGQESQAL

SEQ ID NO: 179277 - protein, 6 aa, Mycobacterium bovis
KLGSEP

SEQ ID NO: 179278 - protein, 10 aa, Mycobacterium bovis
KLGTRSVASG

SEQ ID NO: 179279 - protein, 4 aa, Mycobacterium bovis
KLNG

SEQ ID NO: 179280 - protein, 9 aa, Mycobacterium bovis
KLNPPPTRD

SEQ ID NO: 179281 - protein, 4 aa, Mycobacterium bovis
KLPD

SEQ ID NO: 179282 - protein, 7 aa, Mycobacterium bovis
KLPDQAR

SEQ ID NO: 179283 - protein, 6 aa, Mycobacterium bovis
KLPGQP

SEQ ID NO: 179284 - protein, 7 aa, Mycobacterium bovis
KLPPPEP

SEQ ID NO: 179285 - protein, 4 aa, Mycobacterium bovis
KLPT

SEQ ID NO: 179286 - protein, 11 aa, Mycobacterium bovis
KLRGSLSASQY

SEQ ID NO: 179287 - protein, 5 aa, Mycobacterium bovis
KLRND

SEQ ID NO: 179288 - protein, 6 aa, Mycobacterium bovis
KLRPKI

SEQ ID NO: 179289 - protein, 7 aa, Mycobacterium bovis
KLSPGMQ

SEQ ID NO: 179290 - protein, 5 aa, Mycobacterium bovis
KLSPT

SEQ ID NO: 179291 - protein, 17 aa, Mycobacterium bovis
KLSTGSANRCEPKTGTP

SEQ ID NO: 179292 - protein, 7 aa, Mycobacterium bovis
KLTDAPR

SEQ ID NO: 179293 - protein, 12 aa, Mycobacterium bovis
KLTDFDSNRSGG

SEQ ID NO: 179294 - protein, 5 aa, Mycobacterium bovis
KLTPP

SEQ ID NO: 179295 - protein, 6 aa, Mycobacterium bovis
KMAAGD

SEQ ID NO: 179296 - protein, 6 aa, Mycobacterium bovis
KNAERV

SEQ ID NO: 179297 - protein, 7 aa, Mycobacterium bovis
KNAQEAH

SEQ ID NO: 179298 - protein, 9 aa, Mycobacterium bovis
KNASDADIK

SEQ ID NO: 179299 - protein, 7 aa, Mycobacterium bovis
KNDAEEA

SEQ ID NO: 179300 - protein, 5 aa, Mycobacterium bovis
KNELR

SEQ ID NO: 179301 - protein, 5 aa, Mycobacterium bovis
KNGPY

SEQ ID NO: 179302 - protein, 4 aa, Mycobacterium bovis
KNGQ

SEQ ID NO: 179303 - protein, 6 aa, Mycobacterium bovis
KNGSYS

SEQ ID NO: 179304 - protein, 10 aa, Mycobacterium bovis
KNIDAARAEK

SEQ ID NO: 179305 - protein, 6 aa, Mycobacterium bovis
KNKGVQ

SEQ ID NO: 179306 - protein, 8 aa, Mycobacterium bovis
KNKLERSL

SEQ ID NO: 179307 - protein, 16 aa, Mycobacterium bovis
KNLKSREVSDDVPAEQ

SEQ ID NO: 179308 - protein, 5 aa, Mycobacterium bovis
KNPEF

SEQ ID NO: 179309 - protein, 6 aa, Mycobacterium bovis
KNPELE

SEQ ID NO: 179310 - protein, 7 aa, Mycobacterium bovis
KNPERAA

SEQ ID NO: 179311 - protein, 8 aa, Mycobacterium bovis
KNPESQAQ

SEQ ID NO: 179312 - protein, 4 aa, Mycobacterium bovis
KNPF

SEQ ID NO: 179313 - protein, 7 aa, Mycobacterium bovis
KNPTDPA

SEQ ID NO: 179314 - protein, 6 aa, Mycobacterium bovis
KNQANH

SEQ ID NO: 179315 - protein, 7 aa, Mycobacterium bovis
KNQGSAI

SEQ ID NO: 179316 - protein, 7 aa, Mycobacterium bovis
KNQKDQK

SEQ ID NO: 179317 - protein, 6 aa, Mycobacterium bovis
KNREAG

SEQ ID NO: 179318 - protein, 5 aa, Mycobacterium bovis
KNSAG

SEQ ID NO: 179319 - protein, 15 aa, Mycobacterium bovis
KNSISPRDALASAGK

SEQ ID NO: 179320 - protein, 9 aa, Mycobacterium bovis
KNSKARGFY

SEQ ID NO: 179321 - protein, 20 aa, Mycobacterium bovis
KNSRHGLDNPNARYRKENSI

SEQ ID NO: 179322 - protein, 6 aa, Mycobacterium bovis
KNTGCT

SEQ ID NO: 179323 - protein, 23 aa, Mycobacterium bovis
KNTVKSALESNQQPKYERAPQGS

SEQ ID NO: 179324 - protein, 10 aa, Mycobacterium bovis
KNVPTSRSES

SEQ ID NO: 179325 - protein, 7 aa, Mycobacterium bovis
KNVSATV

SEQ ID NO: 179326 - protein, 7 aa, Mycobacterium bovis
KNVTPGA

SEQ ID NO: 179327 - protein, 8 aa, Mycobacterium bovis
KNYDGSWT

SEQ ID NO: 179328 - protein, 6 aa, Mycobacterium bovis
KNYSGM

SEQ ID NO: 179329 - protein, 8 aa, Mycobacterium bovis
KPAAAARL

SEQ ID NO: 179330 - protein, 5 aa, Mycobacterium bovis
KPADI

SEQ ID NO: 179331 - protein, 8 aa, Mycobacterium bovis
KPAEQTPA

SEQ ID NO: 179332 - protein, 15 aa, Mycobacterium bovis
KPAKAEDHDHHHGHA

SEQ ID NO: 179333 - protein, 9 aa, Mycobacterium bovis
KPAPAPDMN

SEQ ID NO: 179334 - protein, 10 aa, Mycobacterium bovis
KPASIDEARE

SEQ ID NO: 179335 - protein, 16 aa, Mycobacterium bovis
KPCLPGGEVPVGGGHQ

SEQ ID NO: 179336 - protein, 8 aa, Mycobacterium bovis
KPDENRED

SEQ ID NO: 179337 - protein, 8 aa, Mycobacterium bovis
KPDSQTPY

SEQ ID NO: 179338 - protein, 4 aa, Mycobacterium bovis
KPEA

SEQ ID NO: 179339 - protein, 7 aa, Mycobacterium bovis
KPEARTY

SEQ ID NO: 179340 - protein, 8 aa, Mycobacterium bovis
KPEDREAI

SEQ ID NO: 179341 - protein, 7 aa, Mycobacterium bovis
KPEERSV

SEQ ID NO: 179342 - protein, 9 aa, Mycobacterium bovis
KPEESKRTF

SEQ ID NO: 179343 - protein, 7 aa, Mycobacterium bovis
KPEGVDR

SEQ ID NO: 179344 - protein, 13 aa, Mycobacterium bovis
KPESDDVRDSPAL

SEQ ID NO: 179345 - protein, 7 aa, Mycobacterium bovis
KPESVDT

SEQ ID NO: 179346 - protein, 4 aa, Mycobacterium bovis
KPFG

SEQ ID NO: 179347 - protein, 5 aa, Mycobacterium bovis
KPFGL

SEQ ID NO: 179348 - protein, 6 aa, Mycobacterium bovis
KPFKKE

SEQ ID NO: 179349 - protein, 11 aa, Mycobacterium bovis
KPGADPEDRET

SEQ ID NO: 179350 - protein, 5 aa, Mycobacterium bovis
KPGAG

SEQ ID NO: 179351 - protein, 6 aa, Mycobacterium bovis
KPGALD

SEQ ID NO: 179352 - protein, 6 aa, Mycobacterium bovis
KPGDKR

SEQ ID NO: 179353 - protein, 9 aa, Mycobacterium bovis
KPGEPGDSG

SEQ ID NO: 179354 - protein, 7 aa, Mycobacterium bovis
KPGKEGH

SEQ ID NO: 179355 - protein, 8 aa, Mycobacterium bovis
KPGKGPAF

SEQ ID NO: 179356 - protein, 8 aa, Mycobacterium bovis
KPGKPWRS

SEQ ID NO: 179357 - protein, 4 aa, Mycobacterium bovis
KPGN

SEQ ID NO: 179358 - protein, 8 aa, Mycobacterium bovis
KPGRSYTA

SEQ ID NO: 179359 - protein, 7 aa, Mycobacterium bovis
KPGSAPD

SEQ ID NO: 179360 - protein, 10 aa, Mycobacterium bovis
KPGSRDDASE

SEQ ID NO: 179361 - protein, 14 aa, Mycobacterium bovis
KPHDSGERANLEQA

SEQ ID NO: 179362 - protein, 15 aa, Mycobacterium bovis
KPHGVATGSSTGPRY

SEQ ID NO: 179363 - protein, 11 aa, Mycobacterium bovis
KPISKSDAVEG

SEQ ID NO: 179364 - protein, 14 aa, Mycobacterium bovis
KPKAETAPSRYAAA

SEQ ID NO: 179365 - protein, 11 aa, Mycobacterium bovis
KPKGQKSSFGP

SEQ ID NO: 179366 - protein, 7 aa, Mycobacterium bovis
KPKQTAQ

SEQ ID NO: 179367 - protein, 6 aa, Mycobacterium bovis
KPLRND

SEQ ID NO: 179368 - protein, 7 aa, Mycobacterium bovis
KPLSPSG

SEQ ID NO: 179369 - protein, 9 aa, Mycobacterium bovis
KPLSSAERR

SEQ ID NO: 179370 - protein, 6 aa, Mycobacterium bovis
KPLTAA

SEQ ID NO: 179371 - protein, 10 aa, Mycobacterium bovis
KPNEVDEDEL

SEQ ID NO: 179372 - protein, 8 aa, Mycobacterium bovis
KPNVGKSS

SEQ ID NO: 179373 - protein, 5 aa, Mycobacterium bovis
KPPAF

SEQ ID NO: 179374 - protein, 7 aa, Mycobacterium bovis
KPPEGMT

SEQ ID NO: 179375 - protein, 9 aa, Mycobacterium bovis
KPPEPPALP

SEQ ID NO: 179376 - protein, 6 aa, Mycobacterium bovis
KPPQHG

SEQ ID NO: 179377 - protein, 9 aa, Mycobacterium bovis
KPQAPIPQT

SEQ ID NO: 179378 - protein, 6 aa, Mycobacterium bovis
KPQEGF

SEQ ID NO: 179379 - protein, 15 aa, Mycobacterium bovis
KPRAGEEVAGEETRL

SEQ ID NO: 179380 - protein, 10 aa, Mycobacterium bovis
KPRAWGPQES

SEQ ID NO: 179381 - protein, 4 aa, Mycobacterium bovis
KPRE

SEQ ID NO: 179382 - protein, 7 aa, Mycobacterium bovis
KPRPSDI

SEQ ID NO: 179383 - protein, 7 aa, Mycobacterium bovis
KPRREWP

SEQ ID NO: 179384 - protein, 16 aa, Mycobacterium bovis
KPSGARTDRRGRTTGV

SEQ ID NO: 179385 - protein, 7 aa, Mycobacterium bovis
KPSKADI

SEQ ID NO: 179386 - protein, 4 aa, Mycobacterium bovis
KPSL

SEQ ID NO: 179387 - protein, 6 aa, Mycobacterium bovis
KPSRED

SEQ ID NO: 179388 - protein, 8 aa, Mycobacterium bovis
KPSRGRLP

SEQ ID NO: 179389 - protein, 9 aa, Mycobacterium bovis
KPSSSKGRY

SEQ ID NO: 179390 - protein, 9 aa, Mycobacterium bovis
KPSTRTRRL

SEQ ID NO: 179391 - protein, 7 aa, Mycobacterium bovis
KPTKGQI

SEQ ID NO: 179392 - protein, 11 aa, Mycobacterium bovis
KPTKTGEGSDK

SEQ ID NO: 179393 - protein, 4 aa, Mycobacterium bovis
KPTQ

SEQ ID NO: 179394 - protein, 5 aa, Mycobacterium bovis
KPTRA

SEQ ID NO: 179395 - protein, 5 aa, Mycobacterium bovis
KPTVR

SEQ ID NO: 179396 - protein, 7 aa, Mycobacterium bovis
KPTYGTV

SEQ ID NO: 179397 - protein, 4 aa, Mycobacterium bovis
KPVP

SEQ ID NO: 179398 - protein, 4 aa, Mycobacterium bovis
KPVQ

SEQ ID NO: 179399 - protein, 9 aa, Mycobacterium bovis
KPVQPHDPD

SEQ ID NO: 179400 - protein, 7 aa, Mycobacterium bovis
KQAAGVT

SEQ ID NO: 179401 - protein, 7 aa, Mycobacterium bovis
KQADGGR

SEQ ID NO: 179402 - protein, 6 aa, Mycobacterium bovis
KQAEAY

SEQ ID NO: 179403 - protein, 9 aa, Mycobacterium bovis
KQAEEATDT

SEQ ID NO: 179404 - protein, 5 aa, Mycobacterium bovis
KQAER

SEQ ID NO: 179405 - protein, 4 aa, Mycobacterium bovis
KQAG

SEQ ID NO: 179406 - protein, 5 aa, Mycobacterium bovis
KQAGS

SEQ ID NO: 179407 - protein, 12 aa, Mycobacterium bovis
KQAIGRATNNVA

SEQ ID NO: 179408 - protein, 4 aa, Mycobacterium bovis
KQAL

SEQ ID NO: 179409 - protein, 10 aa, Mycobacterium bovis
KQALKERKTI

SEQ ID NO: 179410 - protein, 9 aa, Mycobacterium bovis
KQANRAAEN

SEQ ID NO: 179411 - protein, 6 aa, Mycobacterium bovis
KQAPGW

SEQ ID NO: 179412 - protein, 14 aa, Mycobacterium bovis
KQDGGTSPPPPFAP

SEQ ID NO: 179413 - protein, 7 aa, Mycobacterium bovis
KQDTTSA

SEQ ID NO: 179414 - protein, 7 aa, Mycobacterium bovis
KQDVDGM

SEQ ID NO: 179415 - protein, 15 aa, Mycobacterium bovis
KQEGNEWKISSLLPV

SEQ ID NO: 179416 - protein, 6 aa, Mycobacterium bovis
KQFGKP

SEQ ID NO: 179417 - protein, 9 aa, Mycobacterium bovis
KQGGEPAVN

SEQ ID NO: 179418 - protein, 10 aa, Mycobacterium bovis
KQGHGEPNPT

SEQ ID NO: 179419 - protein, 7 aa, Mycobacterium bovis
KQGLSGA

SEQ ID NO: 179420 - protein, 6 aa, Mycobacterium bovis
KQGQGG

SEQ ID NO: 179421 - protein, 15 aa, Mycobacterium bovis
KQGSRSRPKVEEQGL

SEQ ID NO: 179422 - protein, 6 aa, Mycobacterium bovis
KQIDGA

SEQ ID NO: 179423 - protein, 5 aa, Mycobacterium bovis
KQKAR

SEQ ID NO: 179424 - protein, 8 aa, Mycobacterium bovis
KQKRSVTR

SEQ ID NO: 179425 - protein, 6 aa, Mycobacterium bovis
KQKVGQ

SEQ ID NO: 179426 - protein, 16 aa, Mycobacterium bovis
KQLAEKKAAKKGGGPL

SEQ ID NO: 179427 - protein, 7 aa, Mycobacterium bovis
KQLEEPY

SEQ ID NO: 179428 - protein, 7 aa, Mycobacterium bovis
KQPGEVR

SEQ ID NO: 179429 - protein, 15 aa, Mycobacterium bovis
KQPKTAPLAGNSIAT

SEQ ID NO: 179430 - protein, 15 aa, Mycobacterium bovis
KQPNQVVRAGSGGVR

SEQ ID NO: 179431 - protein, 7 aa, Mycobacterium bovis
KQQRPAA

SEQ ID NO: 179432 - protein, 7 aa, Mycobacterium bovis
KQRGKTT

SEQ ID NO: 179433 - protein, 11 aa, Mycobacterium bovis
KQRKGSVQAPK

SEQ ID NO: 179434 - protein, 16 aa, Mycobacterium bovis
KQRQLDREARTGKKVS

SEQ ID NO: 179435 - protein, 4 aa, Mycobacterium bovis
KQRR

SEQ ID NO: 179436 - protein, 6 aa, Mycobacterium bovis
KQRTQF

SEQ ID NO: 179437 - protein, 9 aa, Mycobacterium bovis
KQSADPRSD

SEQ ID NO: 179438 - protein, 6 aa, Mycobacterium bovis
KQSESN

SEQ ID NO: 179439 - protein, 9 aa, Mycobacterium bovis
KQSGGHGQY

SEQ ID NO: 179440 - protein, 8 aa, Mycobacterium bovis
KQSPVSTS

SEQ ID NO: 179441 - protein, 16 aa, Mycobacterium bovis
KQTDADVGSFDGGYGS

SEQ ID NO: 179442 - protein, 6 aa, Mycobacterium bovis
KQTELQ

SEQ ID NO: 179443 - protein, 12 aa, Mycobacterium bovis
KQVAAGEPLPSA

SEQ ID NO: 179444 - protein, 8 aa, Mycobacterium bovis
KRAAAAQR

SEQ ID NO: 179445 - protein, 11 aa, Mycobacterium bovis
KRAARQRGVSE

SEQ ID NO: 179446 - protein, 4 aa, Mycobacterium bovis
KRAE

SEQ ID NO: 179447 - protein, 8 aa, Mycobacterium bovis
KRAEPADD

SEQ ID NO: 179448 - protein, 4 aa, Mycobacterium bovis
KRAG

SEQ ID NO: 179449 - protein, 9 aa, Mycobacterium bovis
KRAKTLSES

SEQ ID NO: 179450 - protein, 7 aa, Mycobacterium bovis
KRASKIA

SEQ ID NO: 179451 - protein, 7 aa, Mycobacterium bovis
KRATEGY

SEQ ID NO: 179452 - protein, 30 aa, Mycobacterium bovis
KRDNSVSAGQRRLQSRTATTNLGTKPPARR

SEQ ID NO: 179453 - protein, 9 aa, Mycobacterium bovis
KRDSDAASL

SEQ ID NO: 179454 - protein, 5 aa, Mycobacterium bovis
KRDTV

SEQ ID NO: 179455 - protein, 8 aa, Mycobacterium bovis
KRENADEK

SEQ ID NO: 179456 - protein, 13 aa, Mycobacterium bovis
KRETSKNDDDRRA

SEQ ID NO: 179457 - protein, 10 aa, Mycobacterium bovis
KRFRRTGTGK

SEQ ID NO: 179458 - protein, 7 aa, Mycobacterium bovis
KRGDIGA

SEQ ID NO: 179459 - protein, 10 aa, Mycobacterium bovis
KRGDSDEDVA

SEQ ID NO: 179460 - protein, 10 aa, Mycobacterium bovis
KRGDSDQDAM

SEQ ID NO: 179461 - protein, 51 aa, Mycobacterium bovis
KRGEAPDENSPEAIKAREKEAERKARHQRSKRIAAQRKAAEEPVEVPERSD

SEQ ID NO: 179462 - protein, 20 aa, Mycobacterium bovis
KRGERQPQPRLPIVEHALPD

SEQ ID NO: 179463 - protein, 6 aa, Mycobacterium bovis
KRGKRI

SEQ ID NO: 179464 - protein, 10 aa, Mycobacterium bovis
KRGNDSRSLV

SEQ ID NO: 179465 - protein, 6 aa, Mycobacterium bovis
KRGPGI

SEQ ID NO: 179466 - protein, 4 aa, Mycobacterium bovis
KRGR

SEQ ID NO: 179467 - protein, 5 aa, Mycobacterium bovis
KRGRD

SEQ ID NO: 179468 - protein, 5 aa, Mycobacterium bovis
KRGRP

SEQ ID NO: 179469 - protein, 10 aa, Mycobacterium bovis
KRGRPQGDQV

SEQ ID NO: 179470 - protein, 14 aa, Mycobacterium bovis
KRGVGVRPSLVSTA

SEQ ID NO: 179471 - protein, 6 aa, Mycobacterium bovis
KRHPDL

SEQ ID NO: 179472 - protein, 9 aa, Mycobacterium bovis
KRKDGTTEW

SEQ ID NO: 179473 - protein, 5 aa, Mycobacterium bovis
KRKHT

SEQ ID NO: 179474 - protein, 5 aa, Mycobacterium bovis
KRKPY

SEQ ID NO: 179475 - protein, 17 aa, Mycobacterium bovis
KRKQAAENGSLPDTKAN

SEQ ID NO: 179476 - protein, 10 aa, Mycobacterium bovis
KRLGENRKRD

SEQ ID NO: 179477 - protein, 7 aa, Mycobacterium bovis
KRLGGDD

SEQ ID NO: 179478 - protein, 9 aa, Mycobacterium bovis
KRLGSDKGM

SEQ ID NO: 179479 - protein, 13 aa, Mycobacterium bovis
KRLPAESVTHWNG

SEQ ID NO: 179480 - protein, 6 aa, Mycobacterium bovis
KRLPDG

SEQ ID NO: 179481 - protein, 5 aa, Mycobacterium bovis
KRNLP

SEQ ID NO: 179482 - protein, 6 aa, Mycobacterium bovis
KRPDPH

SEQ ID NO: 179483 - protein, 5 aa, Mycobacterium bovis
KRPEL

SEQ ID NO: 179484 - protein, 13 aa, Mycobacterium bovis
KRPERQVSYEPSV

SEQ ID NO: 179485 - protein, 7 aa, Mycobacterium bovis
KRPGSGP

SEQ ID NO: 179486 - protein, 13 aa, Mycobacterium bovis
KRPGTPAAQLDGQ

SEQ ID NO: 179487 - protein, 8 aa, Mycobacterium bovis
KRPKAEIK

SEQ ID NO: 179488 - protein, 5 aa, Mycobacterium bovis
KRPLV

SEQ ID NO: 179489 - protein, 5 aa, Mycobacterium bovis
KRPNT

SEQ ID NO: 179490 - protein, 12 aa, Mycobacterium bovis
KRPPDWSPFPRY

SEQ ID NO: 179491 - protein, 5 aa, Mycobacterium bovis
KRPRE

SEQ ID NO: 179492 - protein, 4 aa, Mycobacterium bovis
KRQQ

SEQ ID NO: 179493 - protein, 7 aa, Mycobacterium bovis
KRQRRSP

SEQ ID NO: 179494 - protein, 10 aa, Mycobacterium bovis
KRRIDPETGE

SEQ ID NO: 179495 - protein, 4 aa, Mycobacterium bovis
KRRQ

SEQ ID NO: 179496 - protein, 21 aa, Mycobacterium bovis
KRRQKRGYDGVTSSRRSQVGP

SEQ ID NO: 179497 - protein, 5 aa, Mycobacterium bovis
KRRQP

SEQ ID NO: 179498 - protein, 5 aa, Mycobacterium bovis
KRRRR

SEQ ID NO: 179499 - protein, 7 aa, Mycobacterium bovis
KRRTPRA

SEQ ID NO: 179500 - protein, 6 aa, Mycobacterium bovis
KRRTRN

SEQ ID NO: 179501 - protein, 6 aa, Mycobacterium bovis
KRRVTD

SEQ ID NO: 179502 - protein, 15 aa, Mycobacterium bovis
KRSATTLPDGSQADL

SEQ ID NO: 179503 - protein, 6 aa, Mycobacterium bovis
KRSDFD

SEQ ID NO: 179504 - protein, 7 aa, Mycobacterium bovis
KRSGTGI

SEQ ID NO: 179505 - protein, 8 aa, Mycobacterium bovis
KRSGYGRE

SEQ ID NO: 179506 - protein, 5 aa, Mycobacterium bovis
KRSNT

SEQ ID NO: 179507 - protein, 8 aa, Mycobacterium bovis
KRTAQKVA

SEQ ID NO: 179508 - protein, 4 aa, Mycobacterium bovis
KRTE

SEQ ID NO: 179509 - protein, 5 aa, Mycobacterium bovis
KRTGK

SEQ ID NO: 179510 - protein, 6 aa, Mycobacterium bovis
KRTGQR

SEQ ID NO: 179511 - protein, 5 aa, Mycobacterium bovis
KRTHE

SEQ ID NO: 179512 - protein, 7 aa, Mycobacterium bovis
KRTRGGK

SEQ ID NO: 179513 - protein, 9 aa, Mycobacterium bovis
KRVKDKEAS

SEQ ID NO: 179514 - protein, 5 aa, Mycobacterium bovis
KRVPG

SEQ ID NO: 179515 - protein, 6 aa, Mycobacterium bovis
KRWDAR

SEQ ID NO: 179516 - protein, 8 aa, Mycobacterium bovis
KRWRDRGG

SEQ ID NO: 179517 - protein, 14 aa, Mycobacterium bovis
KRYEELSDKVSEER

SEQ ID NO: 179518 - protein, 6 aa, Mycobacterium bovis
KRYQEA

SEQ ID NO: 179519 - protein, 8 aa, Mycobacterium bovis
KSAARKRA

SEQ ID NO: 179520 - protein, 8 aa, Mycobacterium bovis
KSAAYTMT

SEQ ID NO: 179521 - protein, 5 aa, Mycobacterium bovis
KSAGT

SEQ ID NO: 179522 - protein, 8 aa, Mycobacterium bovis
KSAHGGPF

SEQ ID NO: 179523 - protein, 14 aa, Mycobacterium bovis
KSAKQQKESEDRGE

SEQ ID NO: 179524 - protein, 6 aa, Mycobacterium bovis
KSALRS

SEQ ID NO: 179525 - protein, 8 aa, Mycobacterium bovis
KSANATVP

SEQ ID NO: 179526 - protein, 7 aa, Mycobacterium bovis
KSAPECT

SEQ ID NO: 179527 - protein, 7 aa, Mycobacterium bovis
KSARLDN

SEQ ID NO: 179528 - protein, 4 aa, Mycobacterium bovis
KSAS

SEQ ID NO: 179529 - protein, 6 aa, Mycobacterium bovis
KSASDL

SEQ ID NO: 179530 - protein, 8 aa, Mycobacterium bovis
KSASGGEL

SEQ ID NO: 179531 - protein, 4 aa, Mycobacterium bovis
KSDE

SEQ ID NO: 179532 - protein, 14 aa, Mycobacterium bovis
KSDLERQESREKTG

SEQ ID NO: 179533 - protein, 8 aa, Mycobacterium bovis
KSDMSTLT

SEQ ID NO: 179534 - protein, 6 aa, Mycobacterium bovis
KSDQGL

SEQ ID NO: 179535 - protein, 9 aa, Mycobacterium bovis
KSDQSEQVA

SEQ ID NO: 179536 - protein, 6 aa, Mycobacterium bovis
KSEHAA

SEQ ID NO: 179537 - protein, 5 aa, Mycobacterium bovis
KSEPY

SEQ ID NO: 179538 - protein, 6 aa, Mycobacterium bovis
KSEVGD

SEQ ID NO: 179539 - protein, 6 aa, Mycobacterium bovis
KSFGSS

SEQ ID NO: 179540 - protein, 21 aa, Mycobacterium bovis
KSGAAGVAERKQDPLTPAARD

SEQ ID NO: 179541 - protein, 5 aa, Mycobacterium bovis
KSGAL

SEQ ID NO: 179542 - protein, 8 aa, Mycobacterium bovis
KSGFGPEY

SEQ ID NO: 179543 - protein, 7 aa, Mycobacterium bovis
KSGKTTI

SEQ ID NO: 179544 - protein, 5 aa, Mycobacterium bovis
KSGPL

SEQ ID NO: 179545 - protein, 7 aa, Mycobacterium bovis
KSGSDAI

SEQ ID NO: 179546 - protein, 6 aa, Mycobacterium bovis
KSGSDY

SEQ ID NO: 179547 - protein, 15 aa, Mycobacterium bovis
KSGTAHYAASGEQDA

SEQ ID NO: 179548 - protein, 5 aa, Mycobacterium bovis
KSGTL

SEQ ID NO: 179549 - protein, 5 aa, Mycobacterium bovis
KSGTV

SEQ ID NO: 179550 - protein, 10 aa, Mycobacterium bovis
KSHGPQGTEC

SEQ ID NO: 179551 - protein, 4 aa, Mycobacterium bovis
KSHI

SEQ ID NO: 179552 - protein, 11 aa, Mycobacterium bovis
KSHPADDGGKA

SEQ ID NO: 179553 - protein, 8 aa, Mycobacterium bovis
KSHPGGGD

SEQ ID NO: 179554 - protein, 6 aa, Mycobacterium bovis
KSHTVT

SEQ ID NO: 179555 - protein, 6 aa, Mycobacterium bovis
KSIPLS

SEQ ID NO: 179556 - protein, 7 aa, Mycobacterium bovis
KSKQDHS

SEQ ID NO: 179557 - protein, 12 aa, Mycobacterium bovis
KSLKDSDSPDKL

SEQ ID NO: 179558 - protein, 11 aa, Mycobacterium bovis
KSLKNSVSPDE

SEQ ID NO: 179559 - protein, 6 aa, Mycobacterium bovis
KSLRSR

SEQ ID NO: 179560 - protein, 7 aa, Mycobacterium bovis
KSLTLDP

SEQ ID NO: 179561 - protein, 8 aa, Mycobacterium bovis
KSMSTGGV

SEQ ID NO: 179562 - protein, 12 aa, Mycobacterium bovis
KSMTPTSLGGTP

SEQ ID NO: 179563 - protein, 8 aa, Mycobacterium bovis
KSNAAGIE

SEQ ID NO: 179564 - protein, 14 aa, Mycobacterium bovis
KSPAAELSMSGTAI

SEQ ID NO: 179565 - protein, 7 aa, Mycobacterium bovis
KSPAGAW

SEQ ID NO: 179566 - protein, 15 aa, Mycobacterium bovis
KSPAGEGIGPGTKTS

SEQ ID NO: 179567 - protein, 5 aa, Mycobacterium bovis
KSPSF

SEQ ID NO: 179568 - protein, 8 aa, Mycobacterium bovis
KSQGSQVD

SEQ ID NO: 179569 - protein, 6 aa, Mycobacterium bovis
KSQKQV

SEQ ID NO: 179570 - protein, 5 aa, Mycobacterium bovis
KSQRV

SEQ ID NO: 179571 - protein, 6 aa, Mycobacterium bovis
KSQVGA

SEQ ID NO: 179572 - protein, 7 aa, Mycobacterium bovis
KSRAAEA

SEQ ID NO: 179573 - protein, 4 aa, Mycobacterium bovis
KSRE

SEQ ID NO: 179574 - protein, 14 aa, Mycobacterium bovis
KSRGRIFDQVVDLT

SEQ ID NO: 179575 - protein, 6 aa, Mycobacterium bovis
KSRRPI

SEQ ID NO: 179576 - protein, 6 aa, Mycobacterium bovis
KSRSLK

SEQ ID NO: 179577 - protein, 7 aa, Mycobacterium bovis
KSSAGTL

SEQ ID NO: 179578 - protein, 8 aa, Mycobacterium bovis
KSSGESVA

SEQ ID NO: 179579 - protein, 7 aa, Mycobacterium bovis
KSSHDID

SEQ ID NO: 179580 - protein, 6 aa, Mycobacterium bovis
KSSPTC

SEQ ID NO: 179581 - protein, 8 aa, Mycobacterium bovis
KSSPTVAG

SEQ ID NO: 179582 - protein, 44 aa, Mycobacterium bovis
KSTAPATTQAQPSNPTPPLASATAAATTGAAAGDTSRRAAEQQR

SEQ ID NO: 179583 - protein, 5 aa, Mycobacterium bovis
KSTDF

SEQ ID NO: 179584 - protein, 4 aa, Mycobacterium bovis
KSTF

SEQ ID NO: 179585 - protein, 7 aa, Mycobacterium bovis
KSTGLDV

SEQ ID NO: 179586 - protein, 12 aa, Mycobacterium bovis
KSTPTAEPDTPC

SEQ ID NO: 179587 - protein, 5 aa, Mycobacterium bovis
KSTTR

SEQ ID NO: 179588 - protein, 5 aa, Mycobacterium bovis
KSVGQ

SEQ ID NO: 179589 - protein, 16 aa, Mycobacterium bovis
KSVTNPDGSGIKGKEA

SEQ ID NO: 179590 - protein, 5 aa, Mycobacterium bovis
KSVVT

SEQ ID NO: 179591 - protein, 5 aa, Mycobacterium bovis
KSVYQ

SEQ ID NO: 179592 - protein, 6 aa, Mycobacterium bovis
KSWQES

SEQ ID NO: 179593 - protein, 8 aa, Mycobacterium bovis
KSYARTGG

SEQ ID NO: 179594 - protein, 8 aa, Mycobacterium bovis
KSYPGAGH

SEQ ID NO: 179595 - protein, 4 aa, Mycobacterium bovis
KTAA

SEQ ID NO: 179596 - protein, 4 aa, Mycobacterium bovis
KTAD

SEQ ID NO: 179597 - protein, 9 aa, Mycobacterium bovis
KTADTSDTV

SEQ ID NO: 179598 - protein, 7 aa, Mycobacterium bovis
KTANTHF

SEQ ID NO: 179599 - protein, 6 aa, Mycobacterium bovis
KTAPHG

SEQ ID NO: 179600 - protein, 11 aa, Mycobacterium bovis
KTAQQHGQHGE

SEQ ID NO: 179601 - protein, 7 aa, Mycobacterium bovis
KTAQRMA

SEQ ID NO: 179602 - protein, 5 aa, Mycobacterium bovis
KTARE

SEQ ID NO: 179603 - protein, 13 aa, Mycobacterium bovis
KTASALAAQAGRL

SEQ ID NO: 179604 - protein, 12 aa, Mycobacterium bovis
KTAVPPPAEGDE

SEQ ID NO: 179605 - protein, 8 aa, Mycobacterium bovis
KTDEDTAA

SEQ ID NO: 179606 - protein, 4 aa, Mycobacterium bovis
KTDL

SEQ ID NO: 179607 - protein, 6 aa, Mycobacterium bovis
KTDLPL

SEQ ID NO: 179608 - protein, 5 aa, Mycobacterium bovis
KTDRF

SEQ ID NO: 179609 - protein, 7 aa, Mycobacterium bovis
KTDSDAF

SEQ ID NO: 179610 - protein, 7 aa, Mycobacterium bovis
KTEAAAG

SEQ ID NO: 179611 - protein, 8 aa, Mycobacterium bovis
KTEADGEP

SEQ ID NO: 179612 - protein, 5 aa, Mycobacterium bovis
KTEPA

SEQ ID NO: 179613 - protein, 8 aa, Mycobacterium bovis
KTEPRDGE

SEQ ID NO: 179614 - protein, 4 aa, Mycobacterium bovis
KTEQ

SEQ ID NO: 179615 - protein, 14 aa, Mycobacterium bovis
KTERRPVPSTELRK

SEQ ID NO: 179616 - protein, 6 aa, Mycobacterium bovis
KTGAAR

SEQ ID NO: 179617 - protein, 34 aa, Mycobacterium bovis
KTGGGVDPLTDAPAPITAQQRKESGIDAQPKRVQ

SEQ ID NO: 179618 - protein, 7 aa, Mycobacterium bovis
KTGKAEK

SEQ ID NO: 179619 - protein, 7 aa, Mycobacterium bovis
KTGNERA

SEQ ID NO: 179620 - protein, 7 aa, Mycobacterium bovis
KTGQPGH

SEQ ID NO: 179621 - protein, 5 aa, Mycobacterium bovis
KTGSL

SEQ ID NO: 179622 - protein, 20 aa, Mycobacterium bovis
KTHGAGPADLVGPEPEAAPL

SEQ ID NO: 179623 - protein, 6 aa, Mycobacterium bovis
KTHPKV

SEQ ID NO: 179624 - protein, 8 aa, Mycobacterium bovis
KTIRGASR

SEQ ID NO: 179625 - protein, 16 aa, Mycobacterium bovis
KTKKTPAGDAVNDYRA

SEQ ID NO: 179626 - protein, 5 aa, Mycobacterium bovis
KTKNN

SEQ ID NO: 179627 - protein, 7 aa, Mycobacterium bovis
KTKRDRH

SEQ ID NO: 179628 - protein, 7 aa, Mycobacterium bovis
KTKTEAL

SEQ ID NO: 179629 - protein, 5 aa, Mycobacterium bovis
KTLND

SEQ ID NO: 179630 - protein, 7 aa, Mycobacterium bovis
KTLSDPN

SEQ ID NO: 179631 - protein, 4 aa, Mycobacterium bovis
KTMP

SEQ ID NO: 179632 - protein, 8 aa, Mycobacterium bovis
KTNTPRNF

SEQ ID NO: 179633 - protein, 9 aa, Mycobacterium bovis
KTPAGKVDG

SEQ ID NO: 179634 - protein, 6 aa, Mycobacterium bovis
KTPEGY

SEQ ID NO: 179635 - protein, 5 aa, Mycobacterium bovis
KTPEQ

SEQ ID NO: 179636 - protein, 7 aa, Mycobacterium bovis
KTPETAG

SEQ ID NO: 179637 - protein, 7 aa, Mycobacterium bovis
KTPFTST

SEQ ID NO: 179638 - protein, 5 aa, Mycobacterium bovis
KTPHI

SEQ ID NO: 179639 - protein, 5 aa, Mycobacterium bovis
KTPPT

SEQ ID NO: 179640 - protein, 7 aa, Mycobacterium bovis
KTPQRPV

SEQ ID NO: 179641 - protein, 5 aa, Mycobacterium bovis
KTPRS

SEQ ID NO: 179642 - protein, 8 aa, Mycobacterium bovis
KTPTGRSA

SEQ ID NO: 179643 - protein, 8 aa, Mycobacterium bovis
KTQASTET

SEQ ID NO: 179644 - protein, 13 aa, Mycobacterium bovis
KTQPPLVLRDLAT

SEQ ID NO: 179645 - protein, 10 aa, Mycobacterium bovis
KTQSGPAAVN

SEQ ID NO: 179646 - protein, 6 aa, Mycobacterium bovis
KTRAEA

SEQ ID NO: 179647 - protein, 6 aa, Mycobacterium bovis
KTRDAE

SEQ ID NO: 179648 - protein, 4 aa, Mycobacterium bovis
KTRE

SEQ ID NO: 179649 - protein, 7 aa, Mycobacterium bovis
KTRFQGQ

SEQ ID NO: 179650 - protein, 6 aa, Mycobacterium bovis
KTRLGD

SEQ ID NO: 179651 - protein, 6 aa, Mycobacterium bovis
KTRRGL

SEQ ID NO: 179652 - protein, 7 aa, Mycobacterium bovis
KTRRPSV

SEQ ID NO: 179653 - protein, 8 aa, Mycobacterium bovis
KTSADSGK

SEQ ID NO: 179654 - protein, 6 aa, Mycobacterium bovis
KTSTTV

SEQ ID NO: 179655 - protein, 5 aa, Mycobacterium bovis
KTSVS

SEQ ID NO: 179656 - protein, 5 aa, Mycobacterium bovis
KTTEA

SEQ ID NO: 179657 - protein, 6 aa, Mycobacterium bovis
KTTSVN

SEQ ID NO: 179658 - protein, 7 aa, Mycobacterium bovis
KTVDGRS

SEQ ID NO: 179659 - protein, 8 aa, Mycobacterium bovis
KTVESGSL

SEQ ID NO: 179660 - protein, 5 aa, Mycobacterium bovis
KTVGD

SEQ ID NO: 179661 - protein, 5 aa, Mycobacterium bovis
KTVPG

SEQ ID NO: 179662 - protein, 9 aa, Mycobacterium bovis
KTVYRSAET

SEQ ID NO: 179663 - protein, 5 aa, Mycobacterium bovis
KTWQP

SEQ ID NO: 179664 - protein, 5 aa, Mycobacterium bovis
KTWTS

SEQ ID NO: 179665 - protein, 5 aa, Mycobacterium bovis
KTYGG

SEQ ID NO: 179666 - protein, 6 aa, Mycobacterium bovis
KVAPAT

SEQ ID NO: 179667 - protein, 18 aa, Mycobacterium bovis
KVATRYPAQLSGGEQQRV

SEQ ID NO: 179668 - protein, 10 aa, Mycobacterium bovis
KVDAARRVGG

SEQ ID NO: 179669 - protein, 10 aa, Mycobacterium bovis
KVDAKQPGDY

SEQ ID NO: 179670 - protein, 7 aa, Mycobacterium bovis
KVDPDNP

SEQ ID NO: 179671 - protein, 8 aa, Mycobacterium bovis
KVDPGPTH

SEQ ID NO: 179672 - protein, 8 aa, Mycobacterium bovis
KVEDGKTD

SEQ ID NO: 179673 - protein, 8 aa, Mycobacterium bovis
KVEQSPRE

SEQ ID NO: 179674 - protein, 5 aa, Mycobacterium bovis
KVERP

SEQ ID NO: 179675 - protein, 8 aa, Mycobacterium bovis
KVGDGSGL

SEQ ID NO: 179676 - protein, 4 aa, Mycobacterium bovis
KVGE

SEQ ID NO: 179677 - protein, 14 aa, Mycobacterium bovis
KVGEAPKQSGVALP

SEQ ID NO: 179678 - protein, 5 aa, Mycobacterium bovis
KVGNE

SEQ ID NO: 179679 - protein, 10 aa, Mycobacterium bovis
KVGNGHPGTA

SEQ ID NO: 179680 - protein, 8 aa, Mycobacterium bovis
KVGQASGH

SEQ ID NO: 179681 - protein, 8 aa, Mycobacterium bovis
KVNALGPA

SEQ ID NO: 179682 - protein, 5 aa, Mycobacterium bovis
KVNDE

SEQ ID NO: 179683 - protein, 6 aa, Mycobacterium bovis
KVNTGL

SEQ ID NO: 179684 - protein, 6 aa, Mycobacterium bovis
KVPGRT

SEQ ID NO: 179685 - protein, 7 aa, Mycobacterium bovis
KVPGTAM

SEQ ID NO: 179686 - protein, 5 aa, Mycobacterium bovis
KVPKE

SEQ ID NO: 179687 - protein, 9 aa, Mycobacterium bovis
KVPSEEVPA

SEQ ID NO: 179688 - protein, 4 aa, Mycobacterium bovis
KVPT

SEQ ID NO: 179689 - protein, 21 aa, Mycobacterium bovis
KVREAGEADWSDPQARARAEQ

SEQ ID NO: 179690 - protein, 5 aa, Mycobacterium bovis
KVRGT

SEQ ID NO: 179691 - protein, 7 aa, Mycobacterium bovis
KVRPDDL

SEQ ID NO: 179692 - protein, 5 aa, Mycobacterium bovis
KVRTR

SEQ ID NO: 179693 - protein, 11 aa, Mycobacterium bovis
KVSETSDHGYP

SEQ ID NO: 179694 - protein, 17 aa, Mycobacterium bovis
KVSGGPSRSGDLVPAGP

SEQ ID NO: 179695 - protein, 13 aa, Mycobacterium bovis
KVSKDDVGNPVAA

SEQ ID NO: 179696 - protein, 4 aa, Mycobacterium bovis
KVSP

SEQ ID NO: 179697 - protein, 6 aa, Mycobacterium bovis
KVSPTV

SEQ ID NO: 179698 - protein, 7 aa, Mycobacterium bovis
KVSSGDL

SEQ ID NO: 179699 - protein, 4 aa, Mycobacterium bovis
KVTE

SEQ ID NO: 179700 - protein, 8 aa, Mycobacterium bovis
KVTGAGST

SEQ ID NO: 179701 - protein, 8 aa, Mycobacterium bovis
KVTSDELG

SEQ ID NO: 179702 - protein, 6 aa, Mycobacterium bovis
KWGQRG

SEQ ID NO: 179703 - protein, 10 aa, Mycobacterium bovis
KYDSAPANRY

SEQ ID NO: 179704 - protein, 15 aa, Mycobacterium bovis
KYESADGPDGQSAPD

SEQ ID NO: 179705 - protein, 7 aa, Mycobacterium bovis
KYGGRDA

SEQ ID NO: 179706 - protein, 4 aa, Mycobacterium bovis
KYGK

SEQ ID NO: 179707 - protein, 6 aa, Mycobacterium bovis
KYGKKL

SEQ ID NO: 179708 - protein, 12 aa, Mycobacterium bovis
KYGPFGRNAPAA

SEQ ID NO: 179709 - protein, 5 aa, Mycobacterium bovis
KYGPI

SEQ ID NO: 179710 - protein, 7 aa, Mycobacterium bovis
KYGVTTE

SEQ ID NO: 179711 - protein, 9 aa, Mycobacterium bovis
KYKETSAGG

SEQ ID NO: 179712 - protein, 12 aa, Mycobacterium bovis
KYSSSRGPSFSS

SEQ ID NO: 179713 - protein, 8 aa, Mycobacterium bovis
LAAADTGL

SEQ ID NO: 179714 - protein, 6 aa, Mycobacterium bovis
LAAASA

SEQ ID NO: 179715 - protein, 6 aa, Mycobacterium bovis
LAAAST

SEQ ID NO: 179716 - protein, 24 aa, Mycobacterium bovis
LAAATTDRLRRQKQANRVRDDVPS

SEQ ID NO: 179717 - protein, 10 aa, Mycobacterium bovis
LAAAVDKDGT

SEQ ID NO: 179718 - protein, 5 aa, Mycobacterium bovis
LAADA

SEQ ID NO: 179719 - protein, 10 aa, Mycobacterium bovis
LAADARDTCR

SEQ ID NO: 179720 - protein, 6 aa, Mycobacterium bovis
LAADGN

SEQ ID NO: 179721 - protein, 11 aa, Mycobacterium bovis
LAADRDALTAA

SEQ ID NO: 179722 - protein, 8 aa, Mycobacterium bovis
LAAGASTA

SEQ ID NO: 179723 - protein, 7 aa, Mycobacterium bovis
LAAGERA

SEQ ID NO: 179724 - protein, 17 aa, Mycobacterium bovis
LAAGGGAGVTPQATQAI

SEQ ID NO: 179725 - protein, 6 aa, Mycobacterium bovis
LAAGNT

SEQ ID NO: 179726 - protein, 8 aa, Mycobacterium bovis
LAAGQKPT

SEQ ID NO: 179727 - protein, 5 aa, Mycobacterium bovis
LAAGR

SEQ ID NO: 179728 - protein, 12 aa, Mycobacterium bovis
LAAKSDDTNARV

SEQ ID NO: 179729 - protein, 8 aa, Mycobacterium bovis
LAAQSGYS

SEQ ID NO: 179730 - protein, 12 aa, Mycobacterium bovis
LAARADANPVLG

SEQ ID NO: 179731 - protein, 11 aa, Mycobacterium bovis
LAARRGDVERG

SEQ ID NO: 179732 - protein, 7 aa, Mycobacterium bovis
LAASGTP

SEQ ID NO: 179733 - protein, 9 aa, Mycobacterium bovis
LAASKSDLP

SEQ ID NO: 179734 - protein, 7 aa, Mycobacterium bovis
LAASPSA

SEQ ID NO: 179735 - protein, 10 aa, Mycobacterium bovis
LAASTGVPQE

SEQ ID NO: 179736 - protein, 5 aa, Mycobacterium bovis
LAATG

SEQ ID NO: 179737 - protein, 5 aa, Mycobacterium bovis
LAATR

SEQ ID NO: 179738 - protein, 11 aa, Mycobacterium bovis
LAATSPQVGQD

SEQ ID NO: 179739 - protein, 6 aa, Mycobacterium bovis
LADGSA

SEQ ID NO: 179740 - protein, 8 aa, Mycobacterium bovis
LADNEAAT

SEQ ID NO: 179741 - protein, 8 aa, Mycobacterium bovis
LADPGTGE

SEQ ID NO: 179742 - protein, 6 aa, Mycobacterium bovis
LADPRR

SEQ ID NO: 179743 - protein, 6 aa, Mycobacterium bovis
LADQAE

SEQ ID NO: 179744 - protein, 8 aa, Mycobacterium bovis
LADSGGDG

SEQ ID NO: 179745 - protein, 9 aa, Mycobacterium bovis
LADSGSTFD

SEQ ID NO: 179746 - protein, 8 aa, Mycobacterium bovis
LADTPEKV

SEQ ID NO: 179747 - protein, 4 aa, Mycobacterium bovis
LAEA

SEQ ID NO: 179748 - protein, 5 aa, Mycobacterium bovis
LAEAG

SEQ ID NO: 179749 - protein, 12 aa, Mycobacterium bovis
LAEAQQTHSGRA

SEQ ID NO: 179750 - protein, 7 aa, Mycobacterium bovis
LAEGGGQ

SEQ ID NO: 179751 - protein, 16 aa, Mycobacterium bovis
LAEGPAQRAVTEDRTV

SEQ ID NO: 179752 - protein, 6 aa, Mycobacterium bovis
LAEGTQ

SEQ ID NO: 179753 - protein, 8 aa, Mycobacterium bovis
LAEKPQAT

SEQ ID NO: 179754 - protein, 6 aa, Mycobacterium bovis
LAEPSG

SEQ ID NO: 179755 - protein, 4 aa, Mycobacterium bovis
LAEQ

SEQ ID NO: 179756 - protein, 8 aa, Mycobacterium bovis
LAERDEEV

SEQ ID NO: 179757 - protein, 8 aa, Mycobacterium bovis
LAESAEAL

SEQ ID NO: 179758 - protein, 9 aa, Mycobacterium bovis
LAETDGDFD

SEQ ID NO: 179759 - protein, 5 aa, Mycobacterium bovis
LAETS

SEQ ID NO: 179760 - protein, 8 aa, Mycobacterium bovis
LAGADSGV

SEQ ID NO: 179761 - protein, 9 aa, Mycobacterium bovis
LAGAGSGFA

SEQ ID NO: 179762 - protein, 9 aa, Mycobacterium bovis
LAGAGSGIA

SEQ ID NO: 179763 - protein, 16 aa, Mycobacterium bovis
LAGAQKELASTAAKLA

SEQ ID NO: 179764 - protein, 12 aa, Mycobacterium bovis
LAGATDDDRRRV

SEQ ID NO: 179765 - protein, 11 aa, Mycobacterium bovis
LAGEERAPAPA

SEQ ID NO: 179766 - protein, 7 aa, Mycobacterium bovis
LAGERRE

SEQ ID NO: 179767 - protein, 32 aa, Mycobacterium bovis
LAGERSRGRAQRDPGRARDNYERDAELQQRTG

SEQ ID NO: 179768 - protein, 5 aa, Mycobacterium bovis
LAGET

SEQ ID NO: 179769 - protein, 12 aa, Mycobacterium bovis
LAGETGLRPDFP

SEQ ID NO: 179770 - protein, 11 aa, Mycobacterium bovis
LAGGDAQANAA

SEQ ID NO: 179771 - protein, 6 aa, Mycobacterium bovis
LAGGDE

SEQ ID NO: 179772 - protein, 10 aa, Mycobacterium bovis
LAGKDELTGK

SEQ ID NO: 179773 - protein, 7 aa, Mycobacterium bovis
LAGPARP

SEQ ID NO: 179774 - protein, 11 aa, Mycobacterium bovis
LAGPDGQLDPV

SEQ ID NO: 179775 - protein, 6 aa, Mycobacterium bovis
LAGPGG

SEQ ID NO: 179776 - protein, 7 aa, Mycobacterium bovis
LAGPGVE

SEQ ID NO: 179777 - protein, 13 aa, Mycobacterium bovis
LAGRGAARPTAQL

SEQ ID NO: 179778 - protein, 9 aa, Mycobacterium bovis
LAGRRTDPQ

SEQ ID NO: 179779 - protein, 8 aa, Mycobacterium bovis
LAGSDSLR

SEQ ID NO: 179780 - protein, 10 aa, Mycobacterium bovis
LAGSGGTDHQ

SEQ ID NO: 179781 - protein, 12 aa, Mycobacterium bovis
LAGTPPPPHYPQ

SEQ ID NO: 179782 - protein, 4 aa, Mycobacterium bovis
LAGV

SEQ ID NO: 179783 - protein, 7 aa, Mycobacterium bovis
LAGVSGS

SEQ ID NO: 179784 - protein, 10 aa, Mycobacterium bovis
LAGYGAGDTD

SEQ ID NO: 179785 - protein, 10 aa, Mycobacterium bovis
LAHPNSATAQ

SEQ ID NO: 179786 - protein, 15 aa, Mycobacterium bovis
LAKETATQARAAAEA

SEQ ID NO: 179787 - protein, 13 aa, Mycobacterium bovis
LAKETSSTKQDAT

SEQ ID NO: 179788 - protein, 10 aa, Mycobacterium bovis
LAKNPQKAKK

SEQ ID NO: 179789 - protein, 7 aa, Mycobacterium bovis
LAKTGTA

SEQ ID NO: 179790 - protein, 6 aa, Mycobacterium bovis
LAKTKP

SEQ ID NO: 179791 - protein, 9 aa, Mycobacterium bovis
LANGATAEE

SEQ ID NO: 179792 - protein, 7 aa, Mycobacterium bovis
LANGSAS

SEQ ID NO: 179793 - protein, 9 aa, Mycobacterium bovis
LAPATAQRC

SEQ ID NO: 179794 - protein, 7 aa, Mycobacterium bovis
LAPDAQR

SEQ ID NO: 179795 - protein, 6 aa, Mycobacterium bovis
LAPEGA

SEQ ID NO: 179796 - protein, 4 aa, Mycobacterium bovis
LAPG

SEQ ID NO: 179797 - protein, 7 aa, Mycobacterium bovis
LAPGGTT

SEQ ID NO: 179798 - protein, 12 aa, Mycobacterium bovis
LAPGNADLSGLP

SEQ ID NO: 179799 - protein, 8 aa, Mycobacterium bovis
LAPGPHET

SEQ ID NO: 179800 - protein, 9 aa, Mycobacterium bovis
LAPGQPGPV

SEQ ID NO: 179801 - protein, 5 aa, Mycobacterium bovis
LAPGR

SEQ ID NO: 179802 - protein, 6 aa, Mycobacterium bovis
LAPGRR

SEQ ID NO: 179803 - protein, 6 aa, Mycobacterium bovis
LAPHSP

SEQ ID NO: 179804 - protein, 5 aa, Mycobacterium bovis
LAPRE

SEQ ID NO: 179805 - protein, 14 aa, Mycobacterium bovis
LAPRRGQSFDSGVS

SEQ ID NO: 179806 - protein, 6 aa, Mycobacterium bovis
LAPRTR

SEQ ID NO: 179807 - protein, 4 aa, Mycobacterium bovis
LAPS

SEQ ID NO: 179808 - protein, 10 aa, Mycobacterium bovis
LAPSADNRRE

SEQ ID NO: 179809 - protein, 15 aa, Mycobacterium bovis
LAPSDASELKARADA

SEQ ID NO: 179810 - protein, 5 aa, Mycobacterium bovis
LAPST

SEQ ID NO: 179811 - protein, 6 aa, Mycobacterium bovis
LAPSTV

SEQ ID NO: 179812 - protein, 14 aa, Mycobacterium bovis
LAPTGPVRTPDDDG

SEQ ID NO: 179813 - protein, 13 aa, Mycobacterium bovis
LAPTSKLAPVTPA

SEQ ID NO: 179814 - protein, 9 aa, Mycobacterium bovis
LAQPPPGSI

SEQ ID NO: 179815 - protein, 4 aa, Mycobacterium bovis
LARD

SEQ ID NO: 179816 - protein, 10 aa, Mycobacterium bovis
LARDRTRHQV

SEQ ID NO: 179817 - protein, 7 aa, Mycobacterium bovis
LAREDSD

SEQ ID NO: 179818 - protein, 18 aa, Mycobacterium bovis
LAREPRRGPRLPVQNIRA

SEQ ID NO: 179819 - protein, 6 aa, Mycobacterium bovis
LARNGD

SEQ ID NO: 179820 - protein, 13 aa, Mycobacterium bovis
LARPAPPSTEYTR

SEQ ID NO: 179821 - protein, 9 aa, Mycobacterium bovis
LARPDTAPA

SEQ ID NO: 179822 - protein, 5 aa, Mycobacterium bovis
LARPQ

SEQ ID NO: 179823 - protein, 7 aa, Mycobacterium bovis
LARPRTD

SEQ ID NO: 179824 - protein, 7 aa, Mycobacterium bovis
LARPTST

SEQ ID NO: 179825 - protein, 9 aa, Mycobacterium bovis
LARRNADGD

SEQ ID NO: 179826 - protein, 7 aa, Mycobacterium bovis
LARSPTV

SEQ ID NO: 179827 - protein, 7 aa, Mycobacterium bovis
LARTGDR

SEQ ID NO: 179828 - protein, 10 aa, Mycobacterium bovis
LASAQSQALR

SEQ ID NO: 179829 - protein, 10 aa, Mycobacterium bovis
LASEKKCGHL

SEQ ID NO: 179830 - protein, 10 aa, Mycobacterium bovis
LASESGPLRP

SEQ ID NO: 179831 - protein, 7 aa, Mycobacterium bovis
LASGDVN

SEQ ID NO: 179832 - protein, 7 aa, Mycobacterium bovis
LASNGPS

SEQ ID NO: 179833 - protein, 10 aa, Mycobacterium bovis
LASPGDEREL

SEQ ID NO: 179834 - protein, 9 aa, Mycobacterium bovis
LASPGPTDV

SEQ ID NO: 179835 - protein, 6 aa, Mycobacterium bovis
LASPGQ

SEQ ID NO: 179836 - protein, 9 aa, Mycobacterium bovis
LASPGSVSR

SEQ ID NO: 179837 - protein, 9 aa, Mycobacterium bovis
LASPTRRGE

SEQ ID NO: 179838 - protein, 18 aa, Mycobacterium bovis
LASQASRAMSATYRPSSF

SEQ ID NO: 179839 - protein, 7 aa, Mycobacterium bovis
LASRSTA

SEQ ID NO: 179840 - protein, 9 aa, Mycobacterium bovis
LASSQRRSL

SEQ ID NO: 179841 - protein, 7 aa, Mycobacterium bovis
LASSSTI

SEQ ID NO: 179842 - protein, 6 aa, Mycobacterium bovis
LASTDE

SEQ ID NO: 179843 - protein, 10 aa, Mycobacterium bovis
LASTGGPEEF

SEQ ID NO: 179844 - protein, 6 aa, Mycobacterium bovis
LASTPK

SEQ ID NO: 179845 - protein, 10 aa, Mycobacterium bovis
LASTPSQRSW

SEQ ID NO: 179846 - protein, 4 aa, Mycobacterium bovis
LATA

SEQ ID NO: 179847 - protein, 5 aa, Mycobacterium bovis
LATAG

SEQ ID NO: 179848 - protein, 5 aa, Mycobacterium bovis
LATEL

SEQ ID NO: 179849 - protein, 4 aa, Mycobacterium bovis
LATG

SEQ ID NO: 179850 - protein, 8 aa, Mycobacterium bovis
LATGARES

SEQ ID NO: 179851 - protein, 7 aa, Mycobacterium bovis
LATNGEL

SEQ ID NO: 179852 - protein, 24 aa, Mycobacterium bovis
LATPRRRPHRHRTRPQTRHHPEQP

SEQ ID NO: 179853 - protein, 4 aa, Mycobacterium bovis
LATQ

SEQ ID NO: 179854 - protein, 15 aa, Mycobacterium bovis
LATRASTSPSCPSTG

SEQ ID NO: 179855 - protein, 7 aa, Mycobacterium bovis
LATSATA

SEQ ID NO: 179856 - protein, 10 aa, Mycobacterium bovis
LDAANGRGTQ

SEQ ID NO: 179857 - protein, 12 aa, Mycobacterium bovis
LDAASKAQLERG

SEQ ID NO: 179858 - protein, 11 aa, Mycobacterium bovis
LDADGSPVSIE

SEQ ID NO: 179859 - protein, 15 aa, Mycobacterium bovis
LDAEPDLDVEPGEDL

SEQ ID NO: 179860 - protein, 8 aa, Mycobacterium bovis
LDAGADDY

SEQ ID NO: 179861 - protein, 6 aa, Mycobacterium bovis
LDAGDD

SEQ ID NO: 179862 - protein, 6 aa, Mycobacterium bovis
LDAGDP

SEQ ID NO: 179863 - protein, 8 aa, Mycobacterium bovis
LDAGDQAG

SEQ ID NO: 179864 - protein, 9 aa, Mycobacterium bovis
LDAGETLPT

SEQ ID NO: 179865 - protein, 9 aa, Mycobacterium bovis
LDAGGSETL

SEQ ID NO: 179866 - protein, 4 aa, Mycobacterium bovis
LDAP

SEQ ID NO: 179867 - protein, 9 aa, Mycobacterium bovis
LDAPQSPVK

SEQ ID NO: 179868 - protein, 12 aa, Mycobacterium bovis
LDAPSVAGHERR

SEQ ID NO: 179869 - protein, 6 aa, Mycobacterium bovis
LDAQEA

SEQ ID NO: 179870 - protein, 7 aa, Mycobacterium bovis
LDAYDRG

SEQ ID NO: 179871 - protein, 4 aa, Mycobacterium bovis
LDDA

SEQ ID NO: 179872 - protein, 11 aa, Mycobacterium bovis
LDDAGESSSDV

SEQ ID NO: 179873 - protein, 9 aa, Mycobacterium bovis
LDDDPWSPE

SEQ ID NO: 179874 - protein, 4 aa, Mycobacterium bovis
LDDE

SEQ ID NO: 179875 - protein, 5 aa, Mycobacterium bovis
LDDPA

SEQ ID NO: 179876 - protein, 13 aa, Mycobacterium bovis
LDDPTTHDDVRAD

SEQ ID NO: 179877 - protein, 10 aa, Mycobacterium bovis
LDDPVGPDAP

SEQ ID NO: 179878 - protein, 8 aa, Mycobacterium bovis
LDDQGGTA

SEQ ID NO: 179879 - protein, 5 aa, Mycobacterium bovis
LDDRT

SEQ ID NO: 179880 - protein, 9 aa, Mycobacterium bovis
LDDSDSPIA

SEQ ID NO: 179881 - protein, 12 aa, Mycobacterium bovis
LDDSKKLSEQAR

SEQ ID NO: 179882 - protein, 6 aa, Mycobacterium bovis
LDDSQP

SEQ ID NO: 179883 - protein, 6 aa, Mycobacterium bovis
LDDSRA

SEQ ID NO: 179884 - protein, 6 aa, Mycobacterium bovis
LDDSRG

SEQ ID NO: 179885 - protein, 4 aa, Mycobacterium bovis
LDDY

SEQ ID NO: 179886 - protein, 18 aa, Mycobacterium bovis
LDEAPSPTLSGPRAPTPR

SEQ ID NO: 179887 - protein, 5 aa, Mycobacterium bovis
LDEDD

SEQ ID NO: 179888 - protein, 13 aa, Mycobacterium bovis
LDEDGQPPITAKG

SEQ ID NO: 179889 - protein, 10 aa, Mycobacterium bovis
LDEDGTITDA

SEQ ID NO: 179890 - protein, 10 aa, Mycobacterium bovis
LDEDQDPPAD

SEQ ID NO: 179891 - protein, 6 aa, Mycobacterium bovis
LDEDTE

SEQ ID NO: 179892 - protein, 9 aa, Mycobacterium bovis
LDEGEPFGL

SEQ ID NO: 179893 - protein, 13 aa, Mycobacterium bovis
LDEPTAIEVSDIH

SEQ ID NO: 179894 - protein, 7 aa, Mycobacterium bovis
LDEQPAA

SEQ ID NO: 179895 - protein, 9 aa, Mycobacterium bovis
LDESGLRPE

SEQ ID NO: 179896 - protein, 6 aa, Mycobacterium bovis
LDETGG

SEQ ID NO: 179897 - protein, 4 aa, Mycobacterium bovis
LDGA

SEQ ID NO: 179898 - protein, 9 aa, Mycobacterium bovis
LDGAAAGQQ

SEQ ID NO: 179899 - protein, 10 aa, Mycobacterium bovis
LDGDARGGAA

SEQ ID NO: 179900 - protein, 8 aa, Mycobacterium bovis
LDGDDREA

SEQ ID NO: 179901 - protein, 8 aa, Mycobacterium bovis
LDGGADDY

SEQ ID NO: 179902 - protein, 15 aa, Mycobacterium bovis
LDGGPAAAGFGATST

SEQ ID NO: 179903 - protein, 8 aa, Mycobacterium bovis
LDGGTGKM

SEQ ID NO: 179904 - protein, 10 aa, Mycobacterium bovis
LDGPSGPAAD

SEQ ID NO: 179905 - protein, 8 aa, Mycobacterium bovis
LDGRADPG

SEQ ID NO: 179906 - protein, 7 aa, Mycobacterium bovis
LDGREAI

SEQ ID NO: 179907 - protein, 10 aa, Mycobacterium bovis
LDGRQPQLGT

SEQ ID NO: 179908 - protein, 9 aa, Mycobacterium bovis
LDGRRGPQV

SEQ ID NO: 179909 - protein, 5 aa, Mycobacterium bovis
LDGRS

SEQ ID NO: 179910 - protein, 14 aa, Mycobacterium bovis
LDGSPASGGSAAQD

SEQ ID NO: 179911 - protein, 7 aa, Mycobacterium bovis
LDGSPLR

SEQ ID NO: 179912 - protein, 11 aa, Mycobacterium bovis
LDGSTEQSTVG

SEQ ID NO: 179913 - protein, 5 aa, Mycobacterium bovis
LDGTE

SEQ ID NO: 179914 - protein, 8 aa, Mycobacterium bovis
LDGTERAR

SEQ ID NO: 179915 - protein, 5 aa, Mycobacterium bovis
LDGYS

SEQ ID NO: 179916 - protein, 7 aa, Mycobacterium bovis
LDKDRDL

SEQ ID NO: 179917 - protein, 11 aa, Mycobacterium bovis
LDKDTSALRGE

SEQ ID NO: 179918 - protein, 9 aa, Mycobacterium bovis
LDKPPGVAE

SEQ ID NO: 179919 - protein, 16 aa, Mycobacterium bovis
LDPAAETEVAPQTERP

SEQ ID NO: 179920 - protein, 13 aa, Mycobacterium bovis
LDPAGILNPGKLI

SEQ ID NO: 179921 - protein, 13 aa, Mycobacterium bovis
LDPANSREAPRAA

SEQ ID NO: 179922 - protein, 7 aa, Mycobacterium bovis
LDPAQRA

SEQ ID NO: 179923 - protein, 8 aa, Mycobacterium bovis
LDPARPPH

SEQ ID NO: 179924 - protein, 12 aa, Mycobacterium bovis
LDPASLAGSSTA

SEQ ID NO: 179925 - protein, 6 aa, Mycobacterium bovis
LDPDGT

SEQ ID NO: 179926 - protein, 9 aa, Mycobacterium bovis
LDPDHDKPS

SEQ ID NO: 179927 - protein, 5 aa, Mycobacterium bovis
LDPDI

SEQ ID NO: 179928 - protein, 8 aa, Mycobacterium bovis
LDPDRGGV

SEQ ID NO: 179929 - protein, 8 aa, Mycobacterium bovis
LDPDTPRQ

SEQ ID NO: 179930 - protein, 5 aa, Mycobacterium bovis
LDPDY

SEQ ID NO: 179931 - protein, 7 aa, Mycobacterium bovis
LDPETGH

SEQ ID NO: 179932 - protein, 9 aa, Mycobacterium bovis
LDPGDGSVI

SEQ ID NO: 179933 - protein, 10 aa, Mycobacterium bovis
LDPGKARALA

SEQ ID NO: 179934 - protein, 7 aa, Mycobacterium bovis
LDPGQPV

SEQ ID NO: 179935 - protein, 8 aa, Mycobacterium bovis
LDPGQRDT

SEQ ID NO: 179936 - protein, 16 aa, Mycobacterium bovis
LDPGQVAKKPHDHTAG

SEQ ID NO: 179937 - protein, 5 aa, Mycobacterium bovis
LDPGT

SEQ ID NO: 179938 - protein, 11 aa, Mycobacterium bovis
LDPGTPDTATP

SEQ ID NO: 179939 - protein, 10 aa, Mycobacterium bovis
LDPKADYGPL

SEQ ID NO: 179940 - protein, 10 aa, Mycobacterium bovis
LDPKGTGQTK

SEQ ID NO: 179941 - protein, 5 aa, Mycobacterium bovis
LDPLA

SEQ ID NO: 179942 - protein, 5 aa, Mycobacterium bovis
LDPND

SEQ ID NO: 179943 - protein, 14 aa, Mycobacterium bovis
LDPNDKVNGRPHGL

SEQ ID NO: 179944 - protein, 4 aa, Mycobacterium bovis
LDPQ

SEQ ID NO: 179945 - protein, 6 aa, Mycobacterium bovis
LDPQGQ

SEQ ID NO: 179946 - protein, 4 aa, Mycobacterium bovis
LDPS

SEQ ID NO: 179947 - protein, 10 aa, Mycobacterium bovis
LDPSSRTSEA

SEQ ID NO: 179948 - protein, 8 aa, Mycobacterium bovis
LDPSTEKL

SEQ ID NO: 179949 - protein, 6 aa, Mycobacterium bovis
LDPTAY

SEQ ID NO: 179950 - protein, 6 aa, Mycobacterium bovis
LDQGRS

SEQ ID NO: 179951 - protein, 10 aa, Mycobacterium bovis
LDQPDTGTIT

SEQ ID NO: 179952 - protein, 6 aa, Mycobacterium bovis
LDQQHP

SEQ ID NO: 179953 - protein, 11 aa, Mycobacterium bovis
LDQSGPTVSQT

SEQ ID NO: 179954 - protein, 8 aa, Mycobacterium bovis
LDRAERSN

SEQ ID NO: 179955 - protein, 5 aa, Mycobacterium bovis
LDRAK

SEQ ID NO: 179956 - protein, 9 aa, Mycobacterium bovis
LDRDGRGNL

SEQ ID NO: 179957 - protein, 20 aa, Mycobacterium bovis
LDREDRARAEARRAAAEQTL

SEQ ID NO: 179958 - protein, 5 aa, Mycobacterium bovis
LDRNP

SEQ ID NO: 179959 - protein, 4 aa, Mycobacterium bovis
LDRS

SEQ ID NO: 179960 - protein, 6 aa, Mycobacterium bovis
LDRSDA

SEQ ID NO: 179961 - protein, 9 aa, Mycobacterium bovis
LDRTSTGAG

SEQ ID NO: 179962 - protein, 5 aa, Mycobacterium bovis
LDSAL

SEQ ID NO: 179963 - protein, 10 aa, Mycobacterium bovis
LDSDSARPRL

SEQ ID NO: 179964 - protein, 6 aa, Mycobacterium bovis
LDSEAR

SEQ ID NO: 179965 - protein, 16 aa, Mycobacterium bovis
LDSEGKPLFTLWKDYK

SEQ ID NO: 179966 - protein, 8 aa, Mycobacterium bovis
LDSETRQD

SEQ ID NO: 179967 - protein, 5 aa, Mycobacterium bovis
LDSGP

SEQ ID NO: 179968 - protein, 7 aa, Mycobacterium bovis
LDSSEAV

SEQ ID NO: 179969 - protein, 6 aa, Mycobacterium bovis
LDSSSP

SEQ ID NO: 179970 - protein, 6 aa, Mycobacterium bovis
LDTEED

SEQ ID NO: 179971 - protein, 11 aa, Mycobacterium bovis
LDTEPPPAQGY

SEQ ID NO: 179972 - protein, 12 aa, Mycobacterium bovis
LDTLGQAEAAGA

SEQ ID NO: 179973 - protein, 13 aa, Mycobacterium bovis
LDTPAGALGPLPG

SEQ ID NO: 179974 - protein, 6 aa, Mycobacterium bovis
LDTPAS

SEQ ID NO: 179975 - protein, 6 aa, Mycobacterium bovis
LDTPKA

SEQ ID NO: 179976 - protein, 22 aa, Mycobacterium bovis
LDTQGVKNRKQARSRYGAKKEK

SEQ ID NO: 179977 - protein, 6 aa, Mycobacterium bovis
LDTSPL

SEQ ID NO: 179978 - protein, 9 aa, Mycobacterium bovis
LDTTPGQVT

SEQ ID NO: 179979 - protein, 6 aa, Mycobacterium bovis
LEAAQS

SEQ ID NO: 179980 - protein, 6 aa, Mycobacterium bovis
LEAGAD

SEQ ID NO: 179981 - protein, 8 aa, Mycobacterium bovis
LEAGGGPR

SEQ ID NO: 179982 - protein, 25 aa, Mycobacterium bovis
LEANPDNNSATSGFGNSGKQDSGGF

SEQ ID NO: 179983 - protein, 4 aa, Mycobacterium bovis
LEAP

SEQ ID NO: 179984 - protein, 8 aa, Mycobacterium bovis
LEAQKSDP

SEQ ID NO: 179985 - protein, 13 aa, Mycobacterium bovis
LEARKTVGSVVLL

SEQ ID NO: 179986 - protein, 9 aa, Mycobacterium bovis
LEASDAARP

SEQ ID NO: 179987 - protein, 10 aa, Mycobacterium bovis
LEASTDPQEL

SEQ ID NO: 179988 - protein, 7 aa, Mycobacterium bovis
LEATPRP

SEQ ID NO: 179989 - protein, 10 aa, Mycobacterium bovis
LEDAAAASAV

SEQ ID NO: 179990 - protein, 9 aa, Mycobacterium bovis
LEDDPSHPK

SEQ ID NO: 179991 - protein, 6 aa, Mycobacterium bovis
LEDKGV

SEQ ID NO: 179992 - protein, 12 aa, Mycobacterium bovis
LEDNTNERVSAS

SEQ ID NO: 179993 - protein, 20 aa, Mycobacterium bovis
LEDPATGAPLATNDNEGVVD

SEQ ID NO: 179994 - protein, 6 aa, Mycobacterium bovis
LEEGGA

SEQ ID NO: 179995 - protein, 6 aa, Mycobacterium bovis
LEEGQA

SEQ ID NO: 179996 - protein, 6 aa, Mycobacterium bovis
LEENSA

SEQ ID NO: 179997 - protein, 5 aa, Mycobacterium bovis
LEGAG

SEQ ID NO: 179998 - protein, 8 aa, Mycobacterium bovis
LEGDTGAS

SEQ ID NO: 179999 - protein, 4 aa, Mycobacterium bovis
LEGE

SEQ ID NO: 180000 - protein, 6 aa, Mycobacterium bovis
LEGEMG

SEQ ID NO: 180001 - protein, 7 aa, Mycobacterium bovis
LEGGAGP

SEQ ID NO: 180002 - protein, 9 aa, Mycobacterium bovis
LEGGPRPTH

SEQ ID NO: 180003 - protein, 14 aa, Mycobacterium bovis
LEGGQAFTAEDQPR

SEQ ID NO: 180004 - protein, 4 aa, Mycobacterium bovis
LEGI

SEQ ID NO: 180005 - protein, 11 aa, Mycobacterium bovis
LEGSSRSGDQL

SEQ ID NO: 180006 - protein, 11 aa, Mycobacterium bovis
LEGVSADRAPQ

SEQ ID NO: 180007 - protein, 9 aa, Mycobacterium bovis
LEKDPAIHD

SEQ ID NO: 180008 - protein, 9 aa, Mycobacterium bovis
LEKTDGSSA

SEQ ID NO: 180009 - protein, 5 aa, Mycobacterium bovis
LENEP

SEQ ID NO: 180010 - protein, 4 aa, Mycobacterium bovis
LENG

SEQ ID NO: 180011 - protein, 10 aa, Mycobacterium bovis
LENRNDDEAV

SEQ ID NO: 180012 - protein, 8 aa, Mycobacterium bovis
LENRPGGV

SEQ ID NO: 180013 - protein, 9 aa, Mycobacterium bovis
LEPATAPAA

SEQ ID NO: 180014 - protein, 16 aa, Mycobacterium bovis
LEPGGRPDAPEPGPSM

SEQ ID NO: 180015 - protein, 9 aa, Mycobacterium bovis
LEPGPNGRD

SEQ ID NO: 180016 - protein, 5 aa, Mycobacterium bovis
LEPGR

SEQ ID NO: 180017 - protein, 8 aa, Mycobacterium bovis
LEPQGADR

SEQ ID NO: 180018 - protein, 16 aa, Mycobacterium bovis
LEPRDVSAAKAAASEA

SEQ ID NO: 180019 - protein, 8 aa, Mycobacterium bovis
LEPTEGYR

SEQ ID NO: 180020 - protein, 4 aa, Mycobacterium bovis
LEQD

SEQ ID NO: 180021 - protein, 6 aa, Mycobacterium bovis
LEQGTN

SEQ ID NO: 180022 - protein, 6 aa, Mycobacterium bovis
LEQPRS

SEQ ID NO: 180023 - protein, 15 aa, Mycobacterium bovis
LEQYGSDVLQLVRGR

SEQ ID NO: 180024 - protein, 12 aa, Mycobacterium bovis
LERSPNSRMSAP

SEQ ID NO: 180025 - protein, 4 aa, Mycobacterium bovis
LESA

SEQ ID NO: 180026 - protein, 8 aa, Mycobacterium bovis
LESARADR

SEQ ID NO: 180027 - protein, 9 aa, Mycobacterium bovis
LESASPALK

SEQ ID NO: 180028 - protein, 9 aa, Mycobacterium bovis
LESEQGEKV

SEQ ID NO: 180029 - protein, 5 aa, Mycobacterium bovis
LESGD

SEQ ID NO: 180030 - protein, 9 aa, Mycobacterium bovis
LESGSRARG

SEQ ID NO: 180031 - protein, 8 aa, Mycobacterium bovis
LESGTTVD

SEQ ID NO: 180032 - protein, 5 aa, Mycobacterium bovis
LESQG

SEQ ID NO: 180033 - protein, 9 aa, Mycobacterium bovis
LESRDAKQE

SEQ ID NO: 180034 - protein, 8 aa, Mycobacterium bovis
LETGGGEV

SEQ ID NO: 180035 - protein, 9 aa, Mycobacterium bovis
LETQARQRE

SEQ ID NO: 180036 - protein, 10 aa, Mycobacterium bovis
LETQDGPRLS

SEQ ID NO: 180037 - protein, 6 aa, Mycobacterium bovis
LETTHE

SEQ ID NO: 180038 - protein, 5 aa, Mycobacterium bovis
LEVDT

SEQ ID NO: 180039 - protein, 4 aa, Mycobacterium bovis
LGAA

SEQ ID NO: 180040 - protein, 8 aa, Mycobacterium bovis
LGADDDTA

SEQ ID NO: 180041 - protein, 7 aa, Mycobacterium bovis
LGAEPGE

SEQ ID NO: 180042 - protein, 8 aa, Mycobacterium bovis
LGAEPSAI

SEQ ID NO: 180043 - protein, 5 aa, Mycobacterium bovis
LGAEQ

SEQ ID NO: 180044 - protein, 11 aa, Mycobacterium bovis
LGAESEGERAA

SEQ ID NO: 180045 - protein, 4 aa, Mycobacterium bovis
LGAG

SEQ ID NO: 180046 - protein, 7 aa, Mycobacterium bovis
LGAGAAE

SEQ ID NO: 180047 - protein, 20 aa, Mycobacterium bovis
LGAGGTGKGTGAALRGATGA

SEQ ID NO: 180048 - protein, 13 aa, Mycobacterium bovis
LGAGSGVGNVGTL

SEQ ID NO: 180049 - protein, 6 aa, Mycobacterium bovis
LGANPG

SEQ ID NO: 180050 - protein, 7 aa, Mycobacterium bovis
LGAPANV

SEQ ID NO: 180051 - protein, 12 aa, Mycobacterium bovis
LGAPGPGPDESV

SEQ ID NO: 180052 - protein, 4 aa, Mycobacterium bovis
LGAQ

SEQ ID NO: 180053 - protein, 8 aa, Mycobacterium bovis
LGAQPTAD

SEQ ID NO: 180054 - protein, 8 aa, Mycobacterium bovis
LGARQGAG

SEQ ID NO: 180055 - protein, 5 aa, Mycobacterium bovis
LGASR

SEQ ID NO: 180056 - protein, 4 aa, Mycobacterium bovis
LGAT

SEQ ID NO: 180057 - protein, 5 aa, Mycobacterium bovis
LGATG

SEQ ID NO: 180058 - protein, 6 aa, Mycobacterium bovis
LGAVDE

SEQ ID NO: 180059 - protein, 7 aa, Mycobacterium bovis
LGDDATV

SEQ ID NO: 180060 - protein, 8 aa, Mycobacterium bovis
LGDDGDPL

SEQ ID NO: 180061 - protein, 6 aa, Mycobacterium bovis
LGDDRT

SEQ ID NO: 180062 - protein, 12 aa, Mycobacterium bovis
LGDEPMDEKPSW

SEQ ID NO: 180063 - protein, 4 aa, Mycobacterium bovis
LGDG

SEQ ID NO: 180064 - protein, 10 aa, Mycobacterium bovis
LGDGARAAFS

SEQ ID NO: 180065 - protein, 7 aa, Mycobacterium bovis
LGDNERT

SEQ ID NO: 180066 - protein, 6 aa, Mycobacterium bovis
LGDPEA

SEQ ID NO: 180067 - protein, 11 aa, Mycobacterium bovis
LGDPPGGWPEP

SEQ ID NO: 180068 - protein, 6 aa, Mycobacterium bovis
LGDPRA

SEQ ID NO: 180069 - protein, 8 aa, Mycobacterium bovis
LGDQAAVD

SEQ ID NO: 180070 - protein, 15 aa, Mycobacterium bovis
LGDRQRKALLEKFGS

SEQ ID NO: 180071 - protein, 4 aa, Mycobacterium bovis
LGDS

SEQ ID NO: 180072 - protein, 9 aa, Mycobacterium bovis
LGDSGEADV

SEQ ID NO: 180073 - protein, 12 aa, Mycobacterium bovis
LGDTRARTRTGA

SEQ ID NO: 180074 - protein, 7 aa, Mycobacterium bovis
LGEAGGG

SEQ ID NO: 180075 - protein, 8 aa, Mycobacterium bovis
LGEAGKST

SEQ ID NO: 180076 - protein, 8 aa, Mycobacterium bovis
LGEASPLG

SEQ ID NO: 180077 - protein, 13 aa, Mycobacterium bovis
LGEDEASDNDYSE

SEQ ID NO: 180078 - protein, 10 aa, Mycobacterium bovis
LGEDGPTHQP

SEQ ID NO: 180079 - protein, 10 aa, Mycobacterium bovis
LGEDMQQAPP

SEQ ID NO: 180080 - protein, 7 aa, Mycobacterium bovis
LGEEAGA

SEQ ID NO: 180081 - protein, 18 aa, Mycobacterium bovis
LGEEGGGPADVTATPSDR

SEQ ID NO: 180082 - protein, 16 aa, Mycobacterium bovis
LGEPGEHSLPASTPIT

SEQ ID NO: 180083 - protein, 11 aa, Mycobacterium bovis
LGEPGPMSAPR

SEQ ID NO: 180084 - protein, 8 aa, Mycobacterium bovis
LGEPPRLT

SEQ ID NO: 180085 - protein, 8 aa, Mycobacterium bovis
LGEQPCDH

SEQ ID NO: 180086 - protein, 7 aa, Mycobacterium bovis
LGEQPQV

SEQ ID NO: 180087 - protein, 8 aa, Mycobacterium bovis
LGESQYPI

SEQ ID NO: 180088 - protein, 4 aa, Mycobacterium bovis
LGET

SEQ ID NO: 180089 - protein, 15 aa, Mycobacterium bovis
LGETRQTVRTSGTPF

SEQ ID NO: 180090 - protein, 7 aa, Mycobacterium bovis
LGGAEMS

SEQ ID NO: 180091 - protein, 9 aa, Mycobacterium bovis
LGGAGGELA

SEQ ID NO: 180092 - protein, 8 aa, Mycobacterium bovis
LGGCGGGA

SEQ ID NO: 180093 - protein, 5 aa, Mycobacterium bovis
LGGDD

SEQ ID NO: 180094 - protein, 6 aa, Mycobacterium bovis
LGGDDS

SEQ ID NO: 180095 - protein, 7 aa, Mycobacterium bovis
LGGDPAT

SEQ ID NO: 180096 - protein, 7 aa, Mycobacterium bovis
LGGEARA

SEQ ID NO: 180097 - protein, 23 aa, Mycobacterium bovis
LGGEHSDSTNTELANPSSTTTRI

SEQ ID NO: 180098 - protein, 4 aa, Mycobacterium bovis
LGGG

SEQ ID NO: 180099 - protein, 6 aa, Mycobacterium bovis
LGGGAV

SEQ ID NO: 180100 - protein, 5 aa, Mycobacterium bovis
LGGGL

SEQ ID NO: 180101 - protein, 8 aa, Mycobacterium bovis
LGGGPQAA

SEQ ID NO: 180102 - protein, 4 aa, Mycobacterium bovis
LGGH

SEQ ID NO: 180103 - protein, 4 aa, Mycobacterium bovis
LGGK

SEQ ID NO: 180104 - protein, 5 aa, Mycobacterium bovis
LGGKN

SEQ ID NO: 180105 - protein, 33 aa, Mycobacterium bovis
LGGNGGAGGAGGSPGGSSGIQGNMGPPGTQGAD

SEQ ID NO: 180106 - protein, 12 aa, Mycobacterium bovis
LGGNPDKVNPLA

SEQ ID NO: 180107 - protein, 9 aa, Mycobacterium bovis
LGGPDRNTF

SEQ ID NO: 180108 - protein, 10 aa, Mycobacterium bovis
LGGPETHHKK

SEQ ID NO: 180109 - protein, 239 aa, Mycobacterium bovis
LGGPGGNGGTGGNASATGTNGVANAGNGGKGGDGGQFGAGGNGGAGGSVTDGSAGSTAGNGGNGGNATNGTIAGQPAGGNGSAGGKGGDGGNIAAGATGTAGNGGNGGNGNDGAVNAGTGGSGGNGGNAGGGGANGGDGGAGGAGGAGGRGGKGIDGGFGGDGGNGGSNNGTGAGGNGGNGGTGGVGSVGAAGGDGGNGGTGGFAGFGGTAGNGGSGGTGGAGGDGGTGGGGGNGGTGV

SEQ ID NO: 180110 - protein, 5 aa, Mycobacterium bovis
LGGPL

SEQ ID NO: 180111 - protein, 5 aa, Mycobacterium bovis
LGGPT

SEQ ID NO: 180112 - protein, 8 aa, Mycobacterium bovis
LGGPTSGE

SEQ ID NO: 180113 - protein, 20 aa, Mycobacterium bovis
LGGQAGGVIGGSAAGAIGAG

SEQ ID NO: 180114 - protein, 9 aa, Mycobacterium bovis
LGGQPIEAG

SEQ ID NO: 180115 - protein, 13 aa, Mycobacterium bovis
LGGRAGDPGARDA

SEQ ID NO: 180116 - protein, 7 aa, Mycobacterium bovis
LGGRAGY

SEQ ID NO: 180117 - protein, 11 aa, Mycobacterium bovis
LGGRKTLDPAV

SEQ ID NO: 180118 - protein, 4 aa, Mycobacterium bovis
LGGS

SEQ ID NO: 180119 - protein, 7 aa, Mycobacterium bovis
LGGSNPS

SEQ ID NO: 180120 - protein, 6 aa, Mycobacterium bovis
LGGSSS

SEQ ID NO: 180121 - protein, 14 aa, Mycobacterium bovis
LGGSSSRRADGAYR

SEQ ID NO: 180122 - protein, 9 aa, Mycobacterium bovis
LGGTARAER

SEQ ID NO: 180123 - protein, 4 aa, Mycobacterium bovis
LGHR

SEQ ID NO: 180124 - protein, 4 aa, Mycobacterium bovis
LGHS

SEQ ID NO: 180125 - protein, 8 aa, Mycobacterium bovis
LGKGGGRL

SEQ ID NO: 180126 - protein, 4 aa, Mycobacterium bovis
LGLS

SEQ ID NO: 180127 - protein, 11 aa, Mycobacterium bovis
LGNAGELNTGF

SEQ ID NO: 180128 - protein, 9 aa, Mycobacterium bovis
LGNAGGNNW

SEQ ID NO: 180129 - protein, 9 aa, Mycobacterium bovis
LGNAGSGSW

SEQ ID NO: 180130 - protein, 10 aa, Mycobacterium bovis
LGNAGSSNYG

SEQ ID NO: 180131 - protein, 5 aa, Mycobacterium bovis
LGNAR

SEQ ID NO: 180132 - protein, 11 aa, Mycobacterium bovis
LGNGISSTAYD

SEQ ID NO: 180133 - protein, 11 aa, Mycobacterium bovis
LGNGTVQATVS

SEQ ID NO: 180134 - protein, 14 aa, Mycobacterium bovis
LGNHANASSEVEYD

SEQ ID NO: 180135 - protein, 11 aa, Mycobacterium bovis
LGNPADAPQLA

SEQ ID NO: 180136 - protein, 6 aa, Mycobacterium bovis
LGNPAT

SEQ ID NO: 180137 - protein, 4 aa, Mycobacterium bovis
LGNS

SEQ ID NO: 180138 - protein, 8 aa, Mycobacterium bovis
LGNTPQRV

SEQ ID NO: 180139 - protein, 7 aa, Mycobacterium bovis
LGPAATL

SEQ ID NO: 180140 - protein, 9 aa, Mycobacterium bovis
LGPAPARES

SEQ ID NO: 180141 - protein, 19 aa, Mycobacterium bovis
LGPAPLSADVPERHFDFGS

SEQ ID NO: 180142 - protein, 11 aa, Mycobacterium bovis
LGPDDLRSRNP

SEQ ID NO: 180143 - protein, 5 aa, Mycobacterium bovis
LGPDE

SEQ ID NO: 180144 - protein, 9 aa, Mycobacterium bovis
LGPDGARAQ

SEQ ID NO: 180145 - protein, 13 aa, Mycobacterium bovis
LGPDNKPTGSRSN

SEQ ID NO: 180146 - protein, 9 aa, Mycobacterium bovis
LGPDRVKPG

SEQ ID NO: 180147 - protein, 5 aa, Mycobacterium bovis
LGPDS

SEQ ID NO: 180148 - protein, 6 aa, Mycobacterium bovis
LGPEEC

SEQ ID NO: 180149 - protein, 5 aa, Mycobacterium bovis
LGPEH

SEQ ID NO: 180150 - protein, 9 aa, Mycobacterium bovis
LGPGDSDWM

SEQ ID NO: 180151 - protein, 5 aa, Mycobacterium bovis
LGPGH

SEQ ID NO: 180152 - protein, 8 aa, Mycobacterium bovis
LGPGTGTV

SEQ ID NO: 180153 - protein, 6 aa, Mycobacterium bovis
LGPGTQ

SEQ ID NO: 180154 - protein, 4 aa, Mycobacterium bovis
LGPK

SEQ ID NO: 180155 - protein, 6 aa, Mycobacterium bovis
LGPKNS

SEQ ID NO: 180156 - protein, 4 aa, Mycobacterium bovis
LGPN

SEQ ID NO: 180157 - protein, 9 aa, Mycobacterium bovis
LGPNPNWDS

SEQ ID NO: 180158 - protein, 8 aa, Mycobacterium bovis
LGPPPPDL

SEQ ID NO: 180159 - protein, 12 aa, Mycobacterium bovis
LGPPQKAQSAKP

SEQ ID NO: 180160 - protein, 22 aa, Mycobacterium bovis
LGPQAKSVQSPEFAARLAAAQH

SEQ ID NO: 180161 - protein, 4 aa, Mycobacterium bovis
LGPR

SEQ ID NO: 180162 - protein, 12 aa, Mycobacterium bovis
LGPRSTLPGVGG

SEQ ID NO: 180163 - protein, 10 aa, Mycobacterium bovis
LGPSGSGKST

SEQ ID NO: 180164 - protein, 20 aa, Mycobacterium bovis
LGPYAAQRGLDASPAALAAD

SEQ ID NO: 180165 - protein, 8 aa, Mycobacterium bovis
LGQAENPQ

SEQ ID NO: 180166 - protein, 10 aa, Mycobacterium bovis
LGQNRSGTSK

SEQ ID NO: 180167 - protein, 129 aa, Mycobacterium bovis
LGQPGGNGGQGDAGQAGGAGGAGGAGGSVSGDGGAGGNGGAGGNGGVGASGGAGARGANGIDSIGGTGGAGGGGGDGGAGGVGGHGGDGGVGGAAPSGTVGSHGTGGVGGDGGLGGAGGVGGAGGNGGI

SEQ ID NO: 180168 - protein, 8 aa, Mycobacterium bovis
LGQPPSED

SEQ ID NO: 180169 - protein, 8 aa, Mycobacterium bovis
LGQPPSGY

SEQ ID NO: 180170 - protein, 6 aa, Mycobacterium bovis
LGQRTG

SEQ ID NO: 180171 - protein, 6 aa, Mycobacterium bovis
LGRADD

SEQ ID NO: 180172 - protein, 10 aa, Mycobacterium bovis
LGRAPSASEL

SEQ ID NO: 180173 - protein, 5 aa, Mycobacterium bovis
LGRGE

SEQ ID NO: 180174 - protein, 7 aa, Mycobacterium bovis
LGRGPAV

SEQ ID NO: 180175 - protein, 7 aa, Mycobacterium bovis
LGRPVGK

SEQ ID NO: 180176 - protein, 6 aa, Mycobacterium bovis
LGRQRD

SEQ ID NO: 180177 - protein, 9 aa, Mycobacterium bovis
LGRRGPAEA

SEQ ID NO: 180178 - protein, 7 aa, Mycobacterium bovis
LGRSEGA

SEQ ID NO: 180179 - protein, 9 aa, Mycobacterium bovis
LGRSPQSYG

SEQ ID NO: 180180 - protein, 9 aa, Mycobacterium bovis
LGRTGNAGH

SEQ ID NO: 180181 - protein, 8 aa, Mycobacterium bovis
LGSADSAH

SEQ ID NO: 180182 - protein, 10 aa, Mycobacterium bovis
LGSAGGLGGT

SEQ ID NO: 180183 - protein, 11 aa, Mycobacterium bovis
LGSAGLGDQPL

SEQ ID NO: 180184 - protein, 9 aa, Mycobacterium bovis
LGSDGGGSI

SEQ ID NO: 180185 - protein, 8 aa, Mycobacterium bovis
LGSDPDGW

SEQ ID NO: 180186 - protein, 11 aa, Mycobacterium bovis
LGSDRRQATAA

SEQ ID NO: 180187 - protein, 7 aa, Mycobacterium bovis
LGSESAL

SEQ ID NO: 180188 - protein, 6 aa, Mycobacterium bovis
LGSGGL

SEQ ID NO: 180189 - protein, 9 aa, Mycobacterium bovis
LGSGGSAEQ

SEQ ID NO: 180190 - protein, 31 aa, Mycobacterium bovis
LGSGNTGDTNFGGGNTGNLNVGGGNTGNSNF

SEQ ID NO: 180191 - protein, 26 aa, Mycobacterium bovis
LGSGNTGDTNVGSGNIGNTNLGGGNI

SEQ ID NO: 180192 - protein, 7 aa, Mycobacterium bovis
LGSGRRY

SEQ ID NO: 180193 - protein, 11 aa, Mycobacterium bovis
LGSKSDSAGDV

SEQ ID NO: 180194 - protein, 11 aa, Mycobacterium bovis
LGSNNAGFGNT

SEQ ID NO: 180195 - protein, 14 aa, Mycobacterium bovis
LGSPDPAETYSNSP

SEQ ID NO: 180196 - protein, 9 aa, Mycobacterium bovis
LGSPEDAIT

SEQ ID NO: 180197 - protein, 5 aa, Mycobacterium bovis
LGSPK

SEQ ID NO: 180198 - protein, 17 aa, Mycobacterium bovis
LGSQLGSSLGSSGLGAG

SEQ ID NO: 180199 - protein, 4 aa, Mycobacterium bovis
LGSR

SEQ ID NO: 180200 - protein, 14 aa, Mycobacterium bovis
LGSSLGSSGLGGGV

SEQ ID NO: 180201 - protein, 5 aa, Mycobacterium bovis
LGSSP

SEQ ID NO: 180202 - protein, 5 aa, Mycobacterium bovis
LGSSV

SEQ ID NO: 180203 - protein, 8 aa, Mycobacterium bovis
LGSTGGLQ

SEQ ID NO: 180204 - protein, 9 aa, Mycobacterium bovis
LGSTSRAPR

SEQ ID NO: 180205 - protein, 6 aa, Mycobacterium bovis
LGTDRS

SEQ ID NO: 180206 - protein, 12 aa, Mycobacterium bovis
LGTDTRTPIPVD

SEQ ID NO: 180207 - protein, 6 aa, Mycobacterium bovis
LGTERA

SEQ ID NO: 180208 - protein, 5 aa, Mycobacterium bovis
LGTGG

SEQ ID NO: 180209 - protein, 6 aa, Mycobacterium bovis
LGTHPG

SEQ ID NO: 180210 - protein, 17 aa, Mycobacterium bovis
LGTNPRKSTKTGAGERD

SEQ ID NO: 180211 - protein, 7 aa, Mycobacterium bovis
LGTPEPI

SEQ ID NO: 180212 - protein, 11 aa, Mycobacterium bovis
LGTPGQGAYAA

SEQ ID NO: 180213 - protein, 6 aa, Mycobacterium bovis
LGTPPA

SEQ ID NO: 180214 - protein, 4 aa, Mycobacterium bovis
LGTR

SEQ ID NO: 180215 - protein, 4 aa, Mycobacterium bovis
LGTS

SEQ ID NO: 180216 - protein, 8 aa, Mycobacterium bovis
LGTTTIKD

SEQ ID NO: 180217 - protein, 5 aa, Mycobacterium bovis
LGVDT

SEQ ID NO: 180218 - protein, 16 aa, Mycobacterium bovis
LGVGSDAVRTNANADA

SEQ ID NO: 180219 - protein, 8 aa, Mycobacterium bovis
LGVPPNPV

SEQ ID NO: 180220 - protein, 4 aa, Mycobacterium bovis
LGYG

SEQ ID NO: 180221 - protein, 6 aa, Mycobacterium bovis
LHGGAN

SEQ ID NO: 180222 - protein, 15 aa, Mycobacterium bovis
LHPDANPGNPAAGER

SEQ ID NO: 180223 - protein, 4 aa, Mycobacterium bovis
LHPG

SEQ ID NO: 180224 - protein, 10 aa, Mycobacterium bovis
LHPSSAETLR

SEQ ID NO: 180225 - protein, 5 aa, Mycobacterium bovis
LHRGR

SEQ ID NO: 180226 - protein, 6 aa, Mycobacterium bovis
LHSNGR

SEQ ID NO: 180227 - protein, 11 aa, Mycobacterium bovis
LHSNPAEARRV

SEQ ID NO: 180228 - protein, 6 aa, Mycobacterium bovis
LIPDAD

SEQ ID NO: 180229 - protein, 17 aa, Mycobacterium bovis
LIPGGKSLSGGSAHSPA

SEQ ID NO: 180230 - protein, 7 aa, Mycobacterium bovis
LKAGKST

SEQ ID NO: 180231 - protein, 19 aa, Mycobacterium bovis
LKDENAALKDTSPSAQAVT

SEQ ID NO: 180232 - protein, 12 aa, Mycobacterium bovis
LKDGTNAVGNRT

SEQ ID NO: 180233 - protein, 7 aa, Mycobacterium bovis
LKESHPH

SEQ ID NO: 180234 - protein, 5 aa, Mycobacterium bovis
LKGDP

SEQ ID NO: 180235 - protein, 10 aa, Mycobacterium bovis
LKNQTYNTPA

SEQ ID NO: 180236 - protein, 7 aa, Mycobacterium bovis
LKNRTPA

SEQ ID NO: 180237 - protein, 4 aa, Mycobacterium bovis
LKPA

SEQ ID NO: 180238 - protein, 20 aa, Mycobacterium bovis
LKPAGTTEFGTRTETKNVNS

SEQ ID NO: 180239 - protein, 12 aa, Mycobacterium bovis
LKPAQPHRQTGG

SEQ ID NO: 180240 - protein, 7 aa, Mycobacterium bovis
LKPEKDG

SEQ ID NO: 180241 - protein, 5 aa, Mycobacterium bovis
LKPES

SEQ ID NO: 180242 - protein, 8 aa, Mycobacterium bovis
LKPGSPDG

SEQ ID NO: 180243 - protein, 4 aa, Mycobacterium bovis
LKPQ

SEQ ID NO: 180244 - protein, 7 aa, Mycobacterium bovis
LKPSPKI

SEQ ID NO: 180245 - protein, 29 aa, Mycobacterium bovis
LKPSPLDPPHVPAAPTADEDLSTKPAAQV

SEQ ID NO: 180246 - protein, 8 aa, Mycobacterium bovis
LKRGGTNL

SEQ ID NO: 180247 - protein, 12 aa, Mycobacterium bovis
LKRNEANDLRNE

SEQ ID NO: 180248 - protein, 15 aa, Mycobacterium bovis
LKSGTTVNLEVVDVG

SEQ ID NO: 180249 - protein, 7 aa, Mycobacterium bovis
LKSNPGI

SEQ ID NO: 180250 - protein, 16 aa, Mycobacterium bovis
LKTGKAQSEVKQTGRP

SEQ ID NO: 180251 - protein, 15 aa, Mycobacterium bovis
LKVDSRDGSYLGRVN

SEQ ID NO: 180252 - protein, 7 aa, Mycobacterium bovis
LLGPDRP

SEQ ID NO: 180253 - protein, 9 aa, Mycobacterium bovis
LLGSPGQAA

SEQ ID NO: 180254 - protein, 12 aa, Mycobacterium bovis
LLGSPGQGAYAA

SEQ ID NO: 180255 - protein, 24 aa, Mycobacterium bovis
LLPDTGEDSDEDGHNHGGHSHGGH

SEQ ID NO: 180256 - protein, 7 aa, Mycobacterium bovis
LLPSEDD

SEQ ID NO: 180257 - protein, 15 aa, Mycobacterium bovis
LNAQNAAAATPTTGV

SEQ ID NO: 180258 - protein, 14 aa, Mycobacterium bovis
LNDDTRPRKLRPGD

SEQ ID NO: 180259 - protein, 15 aa, Mycobacterium bovis
LNDTKTKALKMCVAA

SEQ ID NO: 180260 - protein, 44 aa, Mycobacterium bovis
LNGDGGAGGAGGLGIAGDGGNGGKGGKAGMVGNGGDGGAGGASV

SEQ ID NO: 180261 - protein, 35 aa, Mycobacterium bovis
LNGGNGIGGNGGAGGRGGTGAAGGNGGIGGGATGT

SEQ ID NO: 180262 - protein, 4 aa, Mycobacterium bovis
LNGH

SEQ ID NO: 180263 - protein, 7 aa, Mycobacterium bovis
LNHTGSH

SEQ ID NO: 180264 - protein, 8 aa, Mycobacterium bovis
LNNPDAAN

SEQ ID NO: 180265 - protein, 7 aa, Mycobacterium bovis
LNPAQIG

SEQ ID NO: 180266 - protein, 5 aa, Mycobacterium bovis
LNPDS

SEQ ID NO: 180267 - protein, 8 aa, Mycobacterium bovis
LNPGGNNF

SEQ ID NO: 180268 - protein, 10 aa, Mycobacterium bovis
LNPGGSSKDR

SEQ ID NO: 180269 - protein, 9 aa, Mycobacterium bovis
LNPKAPEIP

SEQ ID NO: 180270 - protein, 7 aa, Mycobacterium bovis
LNPQQRQ

SEQ ID NO: 180271 - protein, 8 aa, Mycobacterium bovis
LNPQVGSA

SEQ ID NO: 180272 - protein, 6 aa, Mycobacterium bovis
LNPSTG

SEQ ID NO: 180273 - protein, 9 aa, Mycobacterium bovis
LNPTGSFKD

SEQ ID NO: 180274 - protein, 7 aa, Mycobacterium bovis
LNQAAKE

SEQ ID NO: 180275 - protein, 7 aa, Mycobacterium bovis
LNRSERD

SEQ ID NO: 180276 - protein, 5 aa, Mycobacterium bovis
LNRSS

SEQ ID NO: 180277 - protein, 8 aa, Mycobacterium bovis
LNSGNGNV

SEQ ID NO: 180278 - protein, 7 aa, Mycobacterium bovis
LNSGSGN

SEQ ID NO: 180279 - protein, 17 aa, Mycobacterium bovis
LNSGSGNIGFGNSGTGN

SEQ ID NO: 180280 - protein, 18 aa, Mycobacterium bovis
LNSGSGNIGFGNSGTGNV

SEQ ID NO: 180281 - protein, 7 aa, Mycobacterium bovis
LNSGSNN

SEQ ID NO: 180282 - protein, 12 aa, Mycobacterium bovis
LNTAETGQRAAG

SEQ ID NO: 180283 - protein, 10 aa, Mycobacterium bovis
LNTDDNVTAA

SEQ ID NO: 180284 - protein, 22 aa, Mycobacterium bovis
LNTGVGNTGNVNTGGFNSGNYS

SEQ ID NO: 180285 - protein, 8 aa, Mycobacterium bovis
LNYDNPAV

SEQ ID NO: 180286 - protein, 5 aa, Mycobacterium bovis
LPAAG

SEQ ID NO: 180287 - protein, 8 aa, Mycobacterium bovis
LPAAPSAL

SEQ ID NO: 180288 - protein, 11 aa, Mycobacterium bovis
LPAASRGSGTV

SEQ ID NO: 180289 - protein, 5 aa, Mycobacterium bovis
LPADA

SEQ ID NO: 180290 - protein, 7 aa, Mycobacterium bovis
LPADGTR

SEQ ID NO: 180291 - protein, 9 aa, Mycobacterium bovis
LPADTVPDD

SEQ ID NO: 180292 - protein, 11 aa, Mycobacterium bovis
LPAEPADDDGV

SEQ ID NO: 180293 - protein, 8 aa, Mycobacterium bovis
LPAEPHTD

SEQ ID NO: 180294 - protein, 10 aa, Mycobacterium bovis
LPAEPNPAGL

SEQ ID NO: 180295 - protein, 9 aa, Mycobacterium bovis
LPAETGPAP

SEQ ID NO: 180296 - protein, 11 aa, Mycobacterium bovis
LPAGAASLDAG

SEQ ID NO: 180297 - protein, 6 aa, Mycobacterium bovis
LPAGGN

SEQ ID NO: 180298 - protein, 13 aa, Mycobacterium bovis
LPAGHGLNAQTGV

SEQ ID NO: 180299 - protein, 18 aa, Mycobacterium bovis
LPAGPAYYPDGELTDEPE

SEQ ID NO: 180300 - protein, 7 aa, Mycobacterium bovis
LPAGPPR

SEQ ID NO: 180301 - protein, 13 aa, Mycobacterium bovis
LPAGPTPAGDALD

SEQ ID NO: 180302 - protein, 6 aa, Mycobacterium bovis
LPAGTP

SEQ ID NO: 180303 - protein, 6 aa, Mycobacterium bovis
LPAPGC

SEQ ID NO: 180304 - protein, 9 aa, Mycobacterium bovis
LPAPGEPKR

SEQ ID NO: 180305 - protein, 8 aa, Mycobacterium bovis
LPAPPAAD

SEQ ID NO: 180306 - protein, 15 aa, Mycobacterium bovis
LPAPREAMTCALAAL

SEQ ID NO: 180307 - protein, 4 aa, Mycobacterium bovis
LPAR

SEQ ID NO: 180308 - protein, 6 aa, Mycobacterium bovis
LPARPA

SEQ ID NO: 180309 - protein, 9 aa, Mycobacterium bovis
LPASPAKAV

SEQ ID NO: 180310 - protein, 12 aa, Mycobacterium bovis
LPATPIADSADD

SEQ ID NO: 180311 - protein, 8 aa, Mycobacterium bovis
LPATPQRL

SEQ ID NO: 180312 - protein, 15 aa, Mycobacterium bovis
LPATSLAAAPATQIP

SEQ ID NO: 180313 - protein, 4 aa, Mycobacterium bovis
LPAY

SEQ ID NO: 180314 - protein, 9 aa, Mycobacterium bovis
LPDDDRAPA

SEQ ID NO: 180315 - protein, 8 aa, Mycobacterium bovis
LPDDPAGL

SEQ ID NO: 180316 - protein, 9 aa, Mycobacterium bovis
LPDDQHQHL

SEQ ID NO: 180317 - protein, 5 aa, Mycobacterium bovis
LPDET

SEQ ID NO: 180318 - protein, 13 aa, Mycobacterium bovis
LPDGFPARAVRTR

SEQ ID NO: 180319 - protein, 5 aa, Mycobacterium bovis
LPDGL

SEQ ID NO: 180320 - protein, 15 aa, Mycobacterium bovis
LPDGSTTWKRSPGGL

SEQ ID NO: 180321 - protein, 6 aa, Mycobacterium bovis
LPDGSW

SEQ ID NO: 180322 - protein, 20 aa, Mycobacterium bovis
LPDGTTVSTDDGPRPGTTYE

SEQ ID NO: 180323 - protein, 5 aa, Mycobacterium bovis
LPDGW

SEQ ID NO: 180324 - protein, 5 aa, Mycobacterium bovis
LPDHK

SEQ ID NO: 180325 - protein, 14 aa, Mycobacterium bovis
LPDPADAENGPSLA

SEQ ID NO: 180326 - protein, 7 aa, Mycobacterium bovis
LPDPDRL

SEQ ID NO: 180327 - protein, 6 aa, Mycobacterium bovis
LPDQLG

SEQ ID NO: 180328 - protein, 4 aa, Mycobacterium bovis
LPDR

SEQ ID NO: 180329 - protein, 5 aa, Mycobacterium bovis
LPDSA

SEQ ID NO: 180330 - protein, 6 aa, Mycobacterium bovis
LPDTDE

SEQ ID NO: 180331 - protein, 6 aa, Mycobacterium bovis
LPDTDQ

SEQ ID NO: 180332 - protein, 5 aa, Mycobacterium bovis
LPEAQ

SEQ ID NO: 180333 - protein, 11 aa, Mycobacterium bovis
LPEATSAAQLR

SEQ ID NO: 180334 - protein, 4 aa, Mycobacterium bovis
LPED

SEQ ID NO: 180335 - protein, 9 aa, Mycobacterium bovis
LPEDASPAY

SEQ ID NO: 180336 - protein, 6 aa, Mycobacterium bovis
LPEDGD

SEQ ID NO: 180337 - protein, 12 aa, Mycobacterium bovis
LPEDVNAPSGEA

SEQ ID NO: 180338 - protein, 6 aa, Mycobacterium bovis
LPEEKR

SEQ ID NO: 180339 - protein, 6 aa, Mycobacterium bovis
LPEEPE

SEQ ID NO: 180340 - protein, 4 aa, Mycobacterium bovis
LPEG

SEQ ID NO: 180341 - protein, 18 aa, Mycobacterium bovis
LPEGLTDAQAAAVTTASA

SEQ ID NO: 180342 - protein, 6 aa, Mycobacterium bovis
LPEGTQ

SEQ ID NO: 180343 - protein, 13 aa, Mycobacterium bovis
LPEGYQATELTPG

SEQ ID NO: 180344 - protein, 5 aa, Mycobacterium bovis
LPEPK

SEQ ID NO: 180345 - protein, 8 aa, Mycobacterium bovis
LPEPPLPG

SEQ ID NO: 180346 - protein, 10 aa, Mycobacterium bovis
LPEPTASAAF

SEQ ID NO: 180347 - protein, 5 aa, Mycobacterium bovis
LPEQG

SEQ ID NO: 180348 - protein, 12 aa, Mycobacterium bovis
LPERERAAKRLG

SEQ ID NO: 180349 - protein, 4 aa, Mycobacterium bovis
LPES

SEQ ID NO: 180350 - protein, 7 aa, Mycobacterium bovis
LPESDPA

SEQ ID NO: 180351 - protein, 10 aa, Mycobacterium bovis
LPETTPSTSV

SEQ ID NO: 180352 - protein, 15 aa, Mycobacterium bovis
LPGAADREVGDPEEL

SEQ ID NO: 180353 - protein, 8 aa, Mycobacterium bovis
LPGASGRI

SEQ ID NO: 180354 - protein, 12 aa, Mycobacterium bovis
LPGDDPLSPYAD

SEQ ID NO: 180355 - protein, 6 aa, Mycobacterium bovis
LPGEDV

SEQ ID NO: 180356 - protein, 5 aa, Mycobacterium bovis
LPGEE

SEQ ID NO: 180357 - protein, 9 aa, Mycobacterium bovis
LPGGARSGL

SEQ ID NO: 180358 - protein, 9 aa, Mycobacterium bovis
LPGGETAND

SEQ ID NO: 180359 - protein, 6 aa, Mycobacterium bovis
LPGGGF

SEQ ID NO: 180360 - protein, 15 aa, Mycobacterium bovis
LPGGPLSKLGSKGRD

SEQ ID NO: 180361 - protein, 5 aa, Mycobacterium bovis
LPGGQ

SEQ ID NO: 180362 - protein, 6 aa, Mycobacterium bovis
LPGGQG

SEQ ID NO: 180363 - protein, 4 aa, Mycobacterium bovis
LPGI

SEQ ID NO: 180364 - protein, 5 aa, Mycobacterium bovis
LPGNG

SEQ ID NO: 180365 - protein, 13 aa, Mycobacterium bovis
LPGNRSDIRERST

SEQ ID NO: 180366 - protein, 19 aa, Mycobacterium bovis
LPGPAGRSKPIEPSPYLPT

SEQ ID NO: 180367 - protein, 8 aa, Mycobacterium bovis
LPGPSPEL

SEQ ID NO: 180368 - protein, 8 aa, Mycobacterium bovis
LPGRGAAT

SEQ ID NO: 180369 - protein, 23 aa, Mycobacterium bovis
LPGRRPARRSSSRSVRSQRVVDS

SEQ ID NO: 180370 - protein, 6 aa, Mycobacterium bovis
LPGRSV

SEQ ID NO: 180371 - protein, 11 aa, Mycobacterium bovis
LPGSANVTTGQ

SEQ ID NO: 180372 - protein, 11 aa, Mycobacterium bovis
LPGSESEKMGP

SEQ ID NO: 180373 - protein, 17 aa, Mycobacterium bovis
LPGTGAAPALAAEAPGA

SEQ ID NO: 180374 - protein, 12 aa, Mycobacterium bovis
LPGTGPDAPTCP

SEQ ID NO: 180375 - protein, 8 aa, Mycobacterium bovis
LPGTGTAT

SEQ ID NO: 180376 - protein, 5 aa, Mycobacterium bovis
LPGVD

SEQ ID NO: 180377 - protein, 5 aa, Mycobacterium bovis
LPHRP

SEQ ID NO: 180378 - protein, 13 aa, Mycobacterium bovis
LPISPTSEGTPMT

SEQ ID NO: 180379 - protein, 7 aa, Mycobacterium bovis
LPKPEPL

SEQ ID NO: 180380 - protein, 10 aa, Mycobacterium bovis
LPKPKRDYGR

SEQ ID NO: 180381 - protein, 7 aa, Mycobacterium bovis
LPKPQTQ

SEQ ID NO: 180382 - protein, 7 aa, Mycobacterium bovis
LPKRRPV

SEQ ID NO: 180383 - protein, 6 aa, Mycobacterium bovis
LPLGES

SEQ ID NO: 180384 - protein, 5 aa, Mycobacterium bovis
LPLGT

SEQ ID NO: 180385 - protein, 6 aa, Mycobacterium bovis
LPLPAG

SEQ ID NO: 180386 - protein, 13 aa, Mycobacterium bovis
LPLPSRAHDGDAG

SEQ ID NO: 180387 - protein, 11 aa, Mycobacterium bovis
LPLSDRDDDHM

SEQ ID NO: 180388 - protein, 5 aa, Mycobacterium bovis
LPNAS

SEQ ID NO: 180389 - protein, 13 aa, Mycobacterium bovis
LPNEDADVSKEIE

SEQ ID NO: 180390 - protein, 10 aa, Mycobacterium bovis
LPNGASASID

SEQ ID NO: 180391 - protein, 5 aa, Mycobacterium bovis
LPNKP

SEQ ID NO: 180392 - protein, 12 aa, Mycobacterium bovis
LPNSSSSQPSYL

SEQ ID NO: 180393 - protein, 9 aa, Mycobacterium bovis
LPPAAAAAT

SEQ ID NO: 180394 - protein, 7 aa, Mycobacterium bovis
LPPAGSY

SEQ ID NO: 180395 - protein, 12 aa, Mycobacterium bovis
LPPAKSQITWED

SEQ ID NO: 180396 - protein, 9 aa, Mycobacterium bovis
LPPAPAPAV

SEQ ID NO: 180397 - protein, 8 aa, Mycobacterium bovis
LPPAPPTT

SEQ ID NO: 180398 - protein, 9 aa, Mycobacterium bovis
LPPAQTRAA

SEQ ID NO: 180399 - protein, 6 aa, Mycobacterium bovis
LPPATS

SEQ ID NO: 180400 - protein, 5 aa, Mycobacterium bovis
LPPDA

SEQ ID NO: 180401 - protein, 5 aa, Mycobacterium bovis
LPPDQ

SEQ ID NO: 180402 - protein, 16 aa, Mycobacterium bovis
LPPEEAASIPQTPTQL

SEQ ID NO: 180403 - protein, 6 aa, Mycobacterium bovis
LPPEGA

SEQ ID NO: 180404 - protein, 7 aa, Mycobacterium bovis
LPPEGRF

SEQ ID NO: 180405 - protein, 5 aa, Mycobacterium bovis
LPPEI

SEQ ID NO: 180406 - protein, 5 aa, Mycobacterium bovis
LPPEQ

SEQ ID NO: 180407 - protein, 5 aa, Mycobacterium bovis
LPPFE

SEQ ID NO: 180408 - protein, 11 aa, Mycobacterium bovis
LPPGADTPTEL

SEQ ID NO: 180409 - protein, 7 aa, Mycobacterium bovis
LPPGAGE

SEQ ID NO: 180410 - protein, 12 aa, Mycobacterium bovis
LPPGSPTDLTDD

SEQ ID NO: 180411 - protein, 9 aa, Mycobacterium bovis
LPPIDEPDT

SEQ ID NO: 180412 - protein, 6 aa, Mycobacterium bovis
LPPLPT

SEQ ID NO: 180413 - protein, 5 aa, Mycobacterium bovis
LPPNT

SEQ ID NO: 180414 - protein, 10 aa, Mycobacterium bovis
LPPPAPQPAL

SEQ ID NO: 180415 - protein, 16 aa, Mycobacterium bovis
LPPPARTASGYRNYGP

SEQ ID NO: 180416 - protein, 7 aa, Mycobacterium bovis
LPPPASQ

SEQ ID NO: 180417 - protein, 5 aa, Mycobacterium bovis
LPPPD

SEQ ID NO: 180418 - protein, 19 aa, Mycobacterium bovis
LPPPPQPPGREPVHRRALA

SEQ ID NO: 180419 - protein, 8 aa, Mycobacterium bovis
LPPPRPAV

SEQ ID NO: 180420 - protein, 9 aa, Mycobacterium bovis
LPPQAAGTV

SEQ ID NO: 180421 - protein, 5 aa, Mycobacterium bovis
LPPRA

SEQ ID NO: 180422 - protein, 7 aa, Mycobacterium bovis
LPPRAGT

SEQ ID NO: 180423 - protein, 5 aa, Mycobacterium bovis
LPPRD

SEQ ID NO: 180424 - protein, 19 aa, Mycobacterium bovis
LPPSGASNGLVRRVLGRFV

SEQ ID NO: 180425 - protein, 9 aa, Mycobacterium bovis
LPPSPAGAV

SEQ ID NO: 180426 - protein, 5 aa, Mycobacterium bovis
LPPSQ

SEQ ID NO: 180427 - protein, 6 aa, Mycobacterium bovis
LPPSQA

SEQ ID NO: 180428 - protein, 4 aa, Mycobacterium bovis
LPPT

SEQ ID NO: 180429 - protein, 5 aa, Mycobacterium bovis
LPPTA

SEQ ID NO: 180430 - protein, 15 aa, Mycobacterium bovis
LPPTATGVRAAGDPD

SEQ ID NO: 180431 - protein, 6 aa, Mycobacterium bovis
LPPTYD

SEQ ID NO: 180432 - protein, 32 aa, Mycobacterium bovis
LPPVSGPAPAEPVAGNGDAAGGGSAQEHGRAA

SEQ ID NO: 180433 - protein, 6 aa, Mycobacterium bovis
LPQADR

SEQ ID NO: 180434 - protein, 8 aa, Mycobacterium bovis
LPQGGPYE

SEQ ID NO: 180435 - protein, 8 aa, Mycobacterium bovis
LPQGNNPV

SEQ ID NO: 180436 - protein, 12 aa, Mycobacterium bovis
LPQGPPPPKAFG

SEQ ID NO: 180437 - protein, 8 aa, Mycobacterium bovis
LPQPGAQD

SEQ ID NO: 180438 - protein, 18 aa, Mycobacterium bovis
LPQPGEHVPAQAPPATTL

SEQ ID NO: 180439 - protein, 6 aa, Mycobacterium bovis
LPQTTD

SEQ ID NO: 180440 - protein, 4 aa, Mycobacterium bovis
LPRA

SEQ ID NO: 180441 - protein, 6 aa, Mycobacterium bovis
LPRDEG

SEQ ID NO: 180442 - protein, 19 aa, Mycobacterium bovis
LPRDPRSEQPWNPEPLAGN

SEQ ID NO: 180443 - protein, 15 aa, Mycobacterium bovis
LPREKSPVLQTLAML

SEQ ID NO: 180444 - protein, 7 aa, Mycobacterium bovis
LPRGGAD

SEQ ID NO: 180445 - protein, 6 aa, Mycobacterium bovis
LPRKSD

SEQ ID NO: 180446 - protein, 9 aa, Mycobacterium bovis
LPRPARDEL

SEQ ID NO: 180447 - protein, 5 aa, Mycobacterium bovis
LPRPE

SEQ ID NO: 180448 - protein, 9 aa, Mycobacterium bovis
LPRPEGPPI

SEQ ID NO: 180449 - protein, 6 aa, Mycobacterium bovis
LPRPGA

SEQ ID NO: 180450 - protein, 18 aa, Mycobacterium bovis
LPRPRADHSRGRRVSKPV

SEQ ID NO: 180451 - protein, 6 aa, Mycobacterium bovis
LPRPRG

SEQ ID NO: 180452 - protein, 6 aa, Mycobacterium bovis
LPRQPQ

SEQ ID NO: 180453 - protein, 4 aa, Mycobacterium bovis
LPSA

SEQ ID NO: 180454 - protein, 8 aa, Mycobacterium bovis
LPSDATLS

SEQ ID NO: 180455 - protein, 5 aa, Mycobacterium bovis
LPSHD

SEQ ID NO: 180456 - protein, 11 aa, Mycobacterium bovis
LPSPEEAAAAE

SEQ ID NO: 180457 - protein, 8 aa, Mycobacterium bovis
LPSPLPPT

SEQ ID NO: 180458 - protein, 8 aa, Mycobacterium bovis
LPSRYGQA

SEQ ID NO: 180459 - protein, 6 aa, Mycobacterium bovis
LPSTAT

SEQ ID NO: 180460 - protein, 6 aa, Mycobacterium bovis
LPSTPR

SEQ ID NO: 180461 - protein, 10 aa, Mycobacterium bovis
LPTAKRPPVR

SEQ ID NO: 180462 - protein, 4 aa, Mycobacterium bovis
LPTD

SEQ ID NO: 180463 - protein, 5 aa, Mycobacterium bovis
LPTDA

SEQ ID NO: 180464 - protein, 5 aa, Mycobacterium bovis
LPTDP

SEQ ID NO: 180465 - protein, 16 aa, Mycobacterium bovis
LPTGVKDEFDALKERL

SEQ ID NO: 180466 - protein, 4 aa, Mycobacterium bovis
LPTI

SEQ ID NO: 180467 - protein, 8 aa, Mycobacterium bovis
LPTNPGPR

SEQ ID NO: 180468 - protein, 6 aa, Mycobacterium bovis
LPTNTL

SEQ ID NO: 180469 - protein, 10 aa, Mycobacterium bovis
LPTPSEPQQR

SEQ ID NO: 180470 - protein, 8 aa, Mycobacterium bovis
LPTPVNPW

SEQ ID NO: 180471 - protein, 4 aa, Mycobacterium bovis
LPTR

SEQ ID NO: 180472 - protein, 10 aa, Mycobacterium bovis
LPTSGGTAAK

SEQ ID NO: 180473 - protein, 14 aa, Mycobacterium bovis
LPTSTRTGAGMGSW

SEQ ID NO: 180474 - protein, 6 aa, Mycobacterium bovis
LPTTSI

SEQ ID NO: 180475 - protein, 6 aa, Mycobacterium bovis
LPTTTI

SEQ ID NO: 180476 - protein, 5 aa, Mycobacterium bovis
LPTTV

SEQ ID NO: 180477 - protein, 4 aa, Mycobacterium bovis
LPTV

SEQ ID NO: 180478 - protein, 9 aa, Mycobacterium bovis
LPVKTGSID

SEQ ID NO: 180479 - protein, 9 aa, Mycobacterium bovis
LPVSDRGRL

SEQ ID NO: 180480 - protein, 6 aa, Mycobacterium bovis
LPWPDP

SEQ ID NO: 180481 - protein, 5 aa, Mycobacterium bovis
LPYGE

SEQ ID NO: 180482 - protein, 10 aa, Mycobacterium bovis
LQAPSTDPDV

SEQ ID NO: 180483 - protein, 5 aa, Mycobacterium bovis
LQAPY

SEQ ID NO: 180484 - protein, 8 aa, Mycobacterium bovis
LQDPPSDD

SEQ ID NO: 180485 - protein, 8 aa, Mycobacterium bovis
LQEDKEPV

SEQ ID NO: 180486 - protein, 9 aa, Mycobacterium bovis
LQEEARDAA

SEQ ID NO: 180487 - protein, 15 aa, Mycobacterium bovis
LQETNGSVKYSPSAS

SEQ ID NO: 180488 - protein, 9 aa, Mycobacterium bovis
LQGAGSPGA

SEQ ID NO: 180489 - protein, 22 aa, Mycobacterium bovis
LQGAGSSSGMTVTPQARAADSD

SEQ ID NO: 180490 - protein, 11 aa, Mycobacterium bovis
LQGDPASSLPD

SEQ ID NO: 180491 - protein, 7 aa, Mycobacterium bovis
LQGGFGQ

SEQ ID NO: 180492 - protein, 5 aa, Mycobacterium bovis
LQGNL

SEQ ID NO: 180493 - protein, 10 aa, Mycobacterium bovis
LQGTTGGERD

SEQ ID NO: 180494 - protein, 10 aa, Mycobacterium bovis
LQNATPDIRP

SEQ ID NO: 180495 - protein, 4 aa, Mycobacterium bovis
LQNG

SEQ ID NO: 180496 - protein, 6 aa, Mycobacterium bovis
LQPADQ

SEQ ID NO: 180497 - protein, 6 aa, Mycobacterium bovis
LQPETR

SEQ ID NO: 180498 - protein, 4 aa, Mycobacterium bovis
LQPG

SEQ ID NO: 180499 - protein, 6 aa, Mycobacterium bovis
LQPGGL

SEQ ID NO: 180500 - protein, 6 aa, Mycobacterium bovis
LQPGPT

SEQ ID NO: 180501 - protein, 11 aa, Mycobacterium bovis
LQPGSATVAET

SEQ ID NO: 180502 - protein, 7 aa, Mycobacterium bovis
LQPGSTV

SEQ ID NO: 180503 - protein, 4 aa, Mycobacterium bovis
LQPH

SEQ ID NO: 180504 - protein, 11 aa, Mycobacterium bovis
LQPNAGSQGEY

SEQ ID NO: 180505 - protein, 4 aa, Mycobacterium bovis
LQPP

SEQ ID NO: 180506 - protein, 9 aa, Mycobacterium bovis
LQPSHNPQV

SEQ ID NO: 180507 - protein, 19 aa, Mycobacterium bovis
LQPTASAESDHTENREECQ

SEQ ID NO: 180508 - protein, 11 aa, Mycobacterium bovis
LQRAQETAAPI

SEQ ID NO: 180509 - protein, 5 aa, Mycobacterium bovis
LQRPT

SEQ ID NO: 180510 - protein, 4 aa, Mycobacterium bovis
LQSG

SEQ ID NO: 180511 - protein, 16 aa, Mycobacterium bovis
LQSLDDGGVLGKVVLE

SEQ ID NO: 180512 - protein, 13 aa, Mycobacterium bovis
LQSNKDKAIEVTS

SEQ ID NO: 180513 - protein, 13 aa, Mycobacterium bovis
LQTGQSLTSITPK

SEQ ID NO: 180514 - protein, 6 aa, Mycobacterium bovis
LQTPKA

SEQ ID NO: 180515 - protein, 7 aa, Mycobacterium bovis
LQTTEAC

SEQ ID NO: 180516 - protein, 5 aa, Mycobacterium bovis
LQYSG

SEQ ID NO: 180517 - protein, 6 aa, Mycobacterium bovis
LRADGR

SEQ ID NO: 180518 - protein, 8 aa, Mycobacterium bovis
LRAGPPTV

SEQ ID NO: 180519 - protein, 10 aa, Mycobacterium bovis
LRAGSAEPTA

SEQ ID NO: 180520 - protein, 11 aa, Mycobacterium bovis
LRAQGSSTYME

SEQ ID NO: 180521 - protein, 6 aa, Mycobacterium bovis
LRASTR

SEQ ID NO: 180522 - protein, 7 aa, Mycobacterium bovis
LRDAEND

SEQ ID NO: 180523 - protein, 5 aa, Mycobacterium bovis
LRDDS

SEQ ID NO: 180524 - protein, 16 aa, Mycobacterium bovis
LRDEDEGKDENHNGAN

SEQ ID NO: 180525 - protein, 5 aa, Mycobacterium bovis
LRDEP

SEQ ID NO: 180526 - protein, 7 aa, Mycobacterium bovis
LRDNGQT

SEQ ID NO: 180527 - protein, 16 aa, Mycobacterium bovis
LRDPGARVPANLGTEP

SEQ ID NO: 180528 - protein, 6 aa, Mycobacterium bovis
LRDPRQ

SEQ ID NO: 180529 - protein, 14 aa, Mycobacterium bovis
LRDQQAAADRAKAS

SEQ ID NO: 180530 - protein, 6 aa, Mycobacterium bovis
LRDSEP

SEQ ID NO: 180531 - protein, 16 aa, Mycobacterium bovis
LREATAAAAGPTTGLA

SEQ ID NO: 180532 - protein, 6 aa, Mycobacterium bovis
LRESKE

SEQ ID NO: 180533 - protein, 4 aa, Mycobacterium bovis
LRET

SEQ ID NO: 180534 - protein, 6 aa, Mycobacterium bovis
LRGDGR

SEQ ID NO: 180535 - protein, 7 aa, Mycobacterium bovis
LRGDTRE

SEQ ID NO: 180536 - protein, 5 aa, Mycobacterium bovis
LRGGA

SEQ ID NO: 180537 - protein, 9 aa, Mycobacterium bovis
LRGGGDATQ

SEQ ID NO: 180538 - protein, 24 aa, Mycobacterium bovis
LRGGNGAKVEELTESDKDLLPIGL

SEQ ID NO: 180539 - protein, 14 aa, Mycobacterium bovis
LRGGPTRLKSSGRD

SEQ ID NO: 180540 - protein, 17 aa, Mycobacterium bovis
LRGKGRLTDADIDATTR

SEQ ID NO: 180541 - protein, 6 aa, Mycobacterium bovis
LRGNPT

SEQ ID NO: 180542 - protein, 7 aa, Mycobacterium bovis
LRGPNGD

SEQ ID NO: 180543 - protein, 7 aa, Mycobacterium bovis
LRGQGHT

SEQ ID NO: 180544 - protein, 6 aa, Mycobacterium bovis
LRGQGR

SEQ ID NO: 180545 - protein, 8 aa, Mycobacterium bovis
LRGQTRNQ

SEQ ID NO: 180546 - protein, 6 aa, Mycobacterium bovis
LRGRES

SEQ ID NO: 180547 - protein, 5 aa, Mycobacterium bovis
LRGSV

SEQ ID NO: 180548 - protein, 9 aa, Mycobacterium bovis
LRKANAQHT

SEQ ID NO: 180549 - protein, 4 aa, Mycobacterium bovis
LRKG

SEQ ID NO: 180550 - protein, 17 aa, Mycobacterium bovis
LRKPGQPVPANLGPDPL

SEQ ID NO: 180551 - protein, 14 aa, Mycobacterium bovis
LRKSGRPNTRPQDA

SEQ ID NO: 180552 - protein, 11 aa, Mycobacterium bovis
LRNAGSGSRHD

SEQ ID NO: 180553 - protein, 16 aa, Mycobacterium bovis
LRNPAGVGADDGARRD

SEQ ID NO: 180554 - protein, 16 aa, Mycobacterium bovis
LRNPGAPVPANLGPEP

SEQ ID NO: 180555 - protein, 12 aa, Mycobacterium bovis
LRNSAKRKRNQG

SEQ ID NO: 180556 - protein, 14 aa, Mycobacterium bovis
LRPAQSYPQKPPVG

SEQ ID NO: 180557 - protein, 8 aa, Mycobacterium bovis
LRPDRPSV

SEQ ID NO: 180558 - protein, 12 aa, Mycobacterium bovis
LRPDSGRVTRRS

SEQ ID NO: 180559 - protein, 6 aa, Mycobacterium bovis
LRPEAG

SEQ ID NO: 180560 - protein, 9 aa, Mycobacterium bovis
LRPEERQTT

SEQ ID NO: 180561 - protein, 9 aa, Mycobacterium bovis
LRPEGRNGE

SEQ ID NO: 180562 - protein, 9 aa, Mycobacterium bovis
LRPEGRNGP

SEQ ID NO: 180563 - protein, 4 aa, Mycobacterium bovis
LRPG

SEQ ID NO: 180564 - protein, 6 aa, Mycobacterium bovis
LRPGAT

SEQ ID NO: 180565 - protein, 7 aa, Mycobacterium bovis
LRPGDPI

SEQ ID NO: 180566 - protein, 12 aa, Mycobacterium bovis
LRPGTALTPGDV

SEQ ID NO: 180567 - protein, 12 aa, Mycobacterium bovis
LRPKDYSEARTI

SEQ ID NO: 180568 - protein, 5 aa, Mycobacterium bovis
LRPPD

SEQ ID NO: 180569 - protein, 12 aa, Mycobacterium bovis
LRPPDPEPGSKA

SEQ ID NO: 180570 - protein, 5 aa, Mycobacterium bovis
LRPPK

SEQ ID NO: 180571 - protein, 7 aa, Mycobacterium bovis
LRPPRTP

SEQ ID NO: 180572 - protein, 6 aa, Mycobacterium bovis
LRPRPE

SEQ ID NO: 180573 - protein, 10 aa, Mycobacterium bovis
LRPSGLTNTQ

SEQ ID NO: 180574 - protein, 5 aa, Mycobacterium bovis
LRPWP

SEQ ID NO: 180575 - protein, 8 aa, Mycobacterium bovis
LRQGAKGG

SEQ ID NO: 180576 - protein, 5 aa, Mycobacterium bovis
LRQNT

SEQ ID NO: 180577 - protein, 6 aa, Mycobacterium bovis
LRQQTR

SEQ ID NO: 180578 - protein, 11 aa, Mycobacterium bovis
LRQTGGDPREA

SEQ ID NO: 180579 - protein, 4 aa, Mycobacterium bovis
LRRD

SEQ ID NO: 180580 - protein, 20 aa, Mycobacterium bovis
LRREESRGAHQRTDFPNRDD

SEQ ID NO: 180581 - protein, 7 aa, Mycobacterium bovis
LRRQESG

SEQ ID NO: 180582 - protein, 4 aa, Mycobacterium bovis
LRRR

SEQ ID NO: 180583 - protein, 8 aa, Mycobacterium bovis
LRRSARAA

SEQ ID NO: 180584 - protein, 4 aa, Mycobacterium bovis
LRSA

SEQ ID NO: 180585 - protein, 5 aa, Mycobacterium bovis
LRSEG

SEQ ID NO: 180586 - protein, 5 aa, Mycobacterium bovis
LRSGA

SEQ ID NO: 180587 - protein, 10 aa, Mycobacterium bovis
LRSGDRVDRN

SEQ ID NO: 180588 - protein, 8 aa, Mycobacterium bovis
LRSPDTAR

SEQ ID NO: 180589 - protein, 7 aa, Mycobacterium bovis
LRSPSGV

SEQ ID NO: 180590 - protein, 5 aa, Mycobacterium bovis
LRSPT

SEQ ID NO: 180591 - protein, 8 aa, Mycobacterium bovis
LRSRDEQR

SEQ ID NO: 180592 - protein, 4 aa, Mycobacterium bovis
LRTG

SEQ ID NO: 180593 - protein, 19 aa, Mycobacterium bovis
LRTGPTPWSGSETLPGGTE

SEQ ID NO: 180594 - protein, 10 aa, Mycobacterium bovis
LRTPGDPVTR

SEQ ID NO: 180595 - protein, 9 aa, Mycobacterium bovis
LRTPGGNQT

SEQ ID NO: 180596 - protein, 12 aa, Mycobacterium bovis
LSAAATAGASHA

SEQ ID NO: 180597 - protein, 9 aa, Mycobacterium bovis
LSAARGRLG

SEQ ID NO: 180598 - protein, 4 aa, Mycobacterium bovis
LSAD

SEQ ID NO: 180599 - protein, 6 aa, Mycobacterium bovis
LSADEL

SEQ ID NO: 180600 - protein, 15 aa, Mycobacterium bovis
LSAGDTIDVLPPFAG

SEQ ID NO: 180601 - protein, 5 aa, Mycobacterium bovis
LSAKE

SEQ ID NO: 180602 - protein, 12 aa, Mycobacterium bovis
LSAPDSRLATQS

SEQ ID NO: 180603 - protein, 7 aa, Mycobacterium bovis
LSAPGSR

SEQ ID NO: 180604 - protein, 17 aa, Mycobacterium bovis
LSASASWAANGKITSDD

SEQ ID NO: 180605 - protein, 12 aa, Mycobacterium bovis
LSASKGAARRTI

SEQ ID NO: 180606 - protein, 12 aa, Mycobacterium bovis
LSATTAATAGAE

SEQ ID NO: 180607 - protein, 7 aa, Mycobacterium bovis
LSATTGQ

SEQ ID NO: 180608 - protein, 6 aa, Mycobacterium bovis
LSDAGR

SEQ ID NO: 180609 - protein, 9 aa, Mycobacterium bovis
LSDDERDYA

SEQ ID NO: 180610 - protein, 10 aa, Mycobacterium bovis
LSDDETERAV

SEQ ID NO: 180611 - protein, 6 aa, Mycobacterium bovis
LSDEAR

SEQ ID NO: 180612 - protein, 6 aa, Mycobacterium bovis
LSDEDL

SEQ ID NO: 180613 - protein, 5 aa, Mycobacterium bovis
LSDEE

SEQ ID NO: 180614 - protein, 17 aa, Mycobacterium bovis
LSDGRAGTFPTVNPATE

SEQ ID NO: 180615 - protein, 8 aa, Mycobacterium bovis
LSDGTPAP

SEQ ID NO: 180616 - protein, 6 aa, Mycobacterium bovis
LSDGTV

SEQ ID NO: 180617 - protein, 9 aa, Mycobacterium bovis
LSDHPPPDL

SEQ ID NO: 180618 - protein, 7 aa, Mycobacterium bovis
LSDPAAE

SEQ ID NO: 180619 - protein, 6 aa, Mycobacterium bovis
LSDQEL

SEQ ID NO: 180620 - protein, 9 aa, Mycobacterium bovis
LSDRARNGR

SEQ ID NO: 180621 - protein, 4 aa, Mycobacterium bovis
LSEA

SEQ ID NO: 180622 - protein, 8 aa, Mycobacterium bovis
LSEADPPL

SEQ ID NO: 180623 - protein, 12 aa, Mycobacterium bovis
LSEAGGGGGDPY

SEQ ID NO: 180624 - protein, 9 aa, Mycobacterium bovis
LSEAGSRAE

SEQ ID NO: 180625 - protein, 6 aa, Mycobacterium bovis
LSEARS

SEQ ID NO: 180626 - protein, 4 aa, Mycobacterium bovis
LSED

SEQ ID NO: 180627 - protein, 10 aa, Mycobacterium bovis
LSEDAEGPGA

SEQ ID NO: 180628 - protein, 7 aa, Mycobacterium bovis
LSEEDKQ

SEQ ID NO: 180629 - protein, 10 aa, Mycobacterium bovis
LSEGTVKGDE

SEQ ID NO: 180630 - protein, 6 aa, Mycobacterium bovis
LSEPAT

SEQ ID NO: 180631 - protein, 7 aa, Mycobacterium bovis
LSEQRNA

SEQ ID NO: 180632 - protein, 4 aa, Mycobacterium bovis
LSES

SEQ ID NO: 180633 - protein, 8 aa, Mycobacterium bovis
LSESGEAD

SEQ ID NO: 180634 - protein, 7 aa, Mycobacterium bovis
LSETGHS

SEQ ID NO: 180635 - protein, 8 aa, Mycobacterium bovis
LSETSGGV

SEQ ID NO: 180636 - protein, 5 aa, Mycobacterium bovis
LSGAD

SEQ ID NO: 180637 - protein, 12 aa, Mycobacterium bovis
LSGARTTGARLD

SEQ ID NO: 180638 - protein, 13 aa, Mycobacterium bovis
LSGDPNTAATPIG

SEQ ID NO: 180639 - protein, 8 aa, Mycobacterium bovis
LSGEEAER

SEQ ID NO: 180640 - protein, 15 aa, Mycobacterium bovis
LSGGAGAPPMPADAE

SEQ ID NO: 180641 - protein, 6 aa, Mycobacterium bovis
LSGGER

SEQ ID NO: 180642 - protein, 8 aa, Mycobacterium bovis
LSGGPDSL

SEQ ID NO: 180643 - protein, 8 aa, Mycobacterium bovis
LSGGQQQR

SEQ ID NO: 180644 - protein, 8 aa, Mycobacterium bovis
LSGGQRAR

SEQ ID NO: 180645 - protein, 8 aa, Mycobacterium bovis
LSGGQRRR

SEQ ID NO: 180646 - protein, 8 aa, Mycobacterium bovis
LSGGTGAV

SEQ ID NO: 180647 - protein, 7 aa, Mycobacterium bovis
LSGNPTF

SEQ ID NO: 180648 - protein, 4 aa, Mycobacterium bovis
LSGP

SEQ ID NO: 180649 - protein, 7 aa, Mycobacterium bovis
LSGPAGG

SEQ ID NO: 180650 - protein, 6 aa, Mycobacterium bovis
LSGPGS

SEQ ID NO: 180651 - protein, 6 aa, Mycobacterium bovis
LSGQGT

SEQ ID NO: 180652 - protein, 11 aa, Mycobacterium bovis
LSGQREPGPVP

SEQ ID NO: 180653 - protein, 25 aa, Mycobacterium bovis
LSGRHGERDHRRAGAAGELTGATRP

SEQ ID NO: 180654 - protein, 7 aa, Mycobacterium bovis
LSGSESL

SEQ ID NO: 180655 - protein, 7 aa, Mycobacterium bovis
LSGSPDV

SEQ ID NO: 180656 - protein, 8 aa, Mycobacterium bovis
LSGTAERP

SEQ ID NO: 180657 - protein, 27 aa, Mycobacterium bovis
LSGTGTDRLDGDGPSDDDSWNDEDDWR

SEQ ID NO: 180658 - protein, 6 aa, Mycobacterium bovis
LSGTKV

SEQ ID NO: 180659 - protein, 4 aa, Mycobacterium bovis
LSGV

SEQ ID NO: 180660 - protein, 6 aa, Mycobacterium bovis
LSHDER

SEQ ID NO: 180661 - protein, 7 aa, Mycobacterium bovis
LSHTQGE

SEQ ID NO: 180662 - protein, 6 aa, Mycobacterium bovis
LSHYSD

SEQ ID NO: 180663 - protein, 17 aa, Mycobacterium bovis
LSIGGDDDDVDVPPFMR

SEQ ID NO: 180664 - protein, 8 aa, Mycobacterium bovis
LSKENRDF

SEQ ID NO: 180665 - protein, 6 aa, Mycobacterium bovis
LSKQTG

SEQ ID NO: 180666 - protein, 8 aa, Mycobacterium bovis
LSKTGREF

SEQ ID NO: 180667 - protein, 7 aa, Mycobacterium bovis
LSMGSSA

SEQ ID NO: 180668 - protein, 9 aa, Mycobacterium bovis
LSNAGSNNW

SEQ ID NO: 180669 - protein, 9 aa, Mycobacterium bovis
LSNGGGCDP

SEQ ID NO: 180670 - protein, 7 aa, Mycobacterium bovis
LSNGGTA

SEQ ID NO: 180671 - protein, 5 aa, Mycobacterium bovis
LSNKE

SEQ ID NO: 180672 - protein, 15 aa, Mycobacterium bovis
LSNQKHTDLTARYGR

SEQ ID NO: 180673 - protein, 6 aa, Mycobacterium bovis
LSPAQL

SEQ ID NO: 180674 - protein, 6 aa, Mycobacterium bovis
LSPARD

SEQ ID NO: 180675 - protein, 9 aa, Mycobacterium bovis
LSPASGRPL

SEQ ID NO: 180676 - protein, 9 aa, Mycobacterium bovis
LSPDAIPAE

SEQ ID NO: 180677 - protein, 8 aa, Mycobacterium bovis
LSPDAPAL

SEQ ID NO: 180678 - protein, 5 aa, Mycobacterium bovis
LSPDE

SEQ ID NO: 180679 - protein, 6 aa, Mycobacterium bovis
LSPDER

SEQ ID NO: 180680 - protein, 6 aa, Mycobacterium bovis
LSPDGA

SEQ ID NO: 180681 - protein, 9 aa, Mycobacterium bovis
LSPDGPDRV

SEQ ID NO: 180682 - protein, 6 aa, Mycobacterium bovis
LSPDGR

SEQ ID NO: 180683 - protein, 6 aa, Mycobacterium bovis
LSPDRL

SEQ ID NO: 180684 - protein, 4 aa, Mycobacterium bovis
LSPE

SEQ ID NO: 180685 - protein, 4 aa, Mycobacterium bovis
LSPG

SEQ ID NO: 180686 - protein, 7 aa, Mycobacterium bovis
LSPGADV

SEQ ID NO: 180687 - protein, 5 aa, Mycobacterium bovis
LSPGI

SEQ ID NO: 180688 - protein, 9 aa, Mycobacterium bovis
LSPNEIANS

SEQ ID NO: 180689 - protein, 5 aa, Mycobacterium bovis
LSPPG

SEQ ID NO: 180690 - protein, 6 aa, Mycobacterium bovis
LSPQAL

SEQ ID NO: 180691 - protein, 6 aa, Mycobacterium bovis
LSPQHS

SEQ ID NO: 180692 - protein, 5 aa, Mycobacterium bovis
LSPQR

SEQ ID NO: 180693 - protein, 6 aa, Mycobacterium bovis
LSPRAA

SEQ ID NO: 180694 - protein, 5 aa, Mycobacterium bovis
LSPTG

SEQ ID NO: 180695 - protein, 19 aa, Mycobacterium bovis
LSPTRPGRGSALTDSSTRD

SEQ ID NO: 180696 - protein, 6 aa, Mycobacterium bovis
LSPYTP

SEQ ID NO: 180697 - protein, 4 aa, Mycobacterium bovis
LSQA

SEQ ID NO: 180698 - protein, 6 aa, Mycobacterium bovis
LSQADE

SEQ ID NO: 180699 - protein, 13 aa, Mycobacterium bovis
LSQDGLTSLGAPG

SEQ ID NO: 180700 - protein, 9 aa, Mycobacterium bovis
LSQEQRDEL

SEQ ID NO: 180701 - protein, 12 aa, Mycobacterium bovis
LSQGGPAAAQRA

SEQ ID NO: 180702 - protein, 8 aa, Mycobacterium bovis
LSQKGTAI

SEQ ID NO: 180703 - protein, 14 aa, Mycobacterium bovis
LSQTHSGAPIPTPR

SEQ ID NO: 180704 - protein, 7 aa, Mycobacterium bovis
LSRAPET

SEQ ID NO: 180705 - protein, 7 aa, Mycobacterium bovis
LSRASSI

SEQ ID NO: 180706 - protein, 7 aa, Mycobacterium bovis
LSRDDAT

SEQ ID NO: 180707 - protein, 5 aa, Mycobacterium bovis
LSRDE

SEQ ID NO: 180708 - protein, 6 aa, Mycobacterium bovis
LSRDGA

SEQ ID NO: 180709 - protein, 12 aa, Mycobacterium bovis
LSREKSTFAAAV

SEQ ID NO: 180710 - protein, 9 aa, Mycobacterium bovis
LSRQSDGSW

SEQ ID NO: 180711 - protein, 24 aa, Mycobacterium bovis
LSRSGPTAGTPVLPPDGIASATAA

SEQ ID NO: 180712 - protein, 8 aa, Mycobacterium bovis
LSSAATGY

SEQ ID NO: 180713 - protein, 10 aa, Mycobacterium bovis
LSSAATGYGA

SEQ ID NO: 180714 - protein, 11 aa, Mycobacterium bovis
LSSADTAEQQH

SEQ ID NO: 180715 - protein, 8 aa, Mycobacterium bovis
LSSAGRTI

SEQ ID NO: 180716 - protein, 7 aa, Mycobacterium bovis
LSSATRR

SEQ ID NO: 180717 - protein, 6 aa, Mycobacterium bovis
LSSGAD

SEQ ID NO: 180718 - protein, 10 aa, Mycobacterium bovis
LSSNTAETAT

SEQ ID NO: 180719 - protein, 4 aa, Mycobacterium bovis
LSSP

SEQ ID NO: 180720 - protein, 6 aa, Mycobacterium bovis
LSSQEL

SEQ ID NO: 180721 - protein, 4 aa, Mycobacterium bovis
LSSR

SEQ ID NO: 180722 - protein, 7 aa, Mycobacterium bovis
LSSRRGR

SEQ ID NO: 180723 - protein, 8 aa, Mycobacterium bovis
LSSSARAR

SEQ ID NO: 180724 - protein, 15 aa, Mycobacterium bovis
LSSSTAATSASGPSG

SEQ ID NO: 180725 - protein, 8 aa, Mycobacterium bovis
LSTDPATT

SEQ ID NO: 180726 - protein, 9 aa, Mycobacterium bovis
LSTDPHDTT

SEQ ID NO: 180727 - protein, 5 aa, Mycobacterium bovis
LSTNP

SEQ ID NO: 180728 - protein, 6 aa, Mycobacterium bovis
LSTPAA

SEQ ID NO: 180729 - protein, 9 aa, Mycobacterium bovis
LSTPANVSG

SEQ ID NO: 180730 - protein, 8 aa, Mycobacterium bovis
LSTPQARD

SEQ ID NO: 180731 - protein, 6 aa, Mycobacterium bovis
LSTPQI

SEQ ID NO: 180732 - protein, 9 aa, Mycobacterium bovis
LSTQPHSHE

SEQ ID NO: 180733 - protein, 4 aa, Mycobacterium bovis
LSTR

SEQ ID NO: 180734 - protein, 7 aa, Mycobacterium bovis
LSTRAES

SEQ ID NO: 180735 - protein, 7 aa, Mycobacterium bovis
LSTRRRG

SEQ ID NO: 180736 - protein, 4 aa, Mycobacterium bovis
LSTS

SEQ ID NO: 180737 - protein, 11 aa, Mycobacterium bovis
LSTSLDDAGPW

SEQ ID NO: 180738 - protein, 5 aa, Mycobacterium bovis
LSTTD

SEQ ID NO: 180739 - protein, 6 aa, Mycobacterium bovis
LSTTGP

SEQ ID NO: 180740 - protein, 9 aa, Mycobacterium bovis
LSTTTDNRQ

SEQ ID NO: 180741 - protein, 15 aa, Mycobacterium bovis
LSVEQTSELDDGRRR

SEQ ID NO: 180742 - protein, 14 aa, Mycobacterium bovis
LSYGPQSDGSLSPE

SEQ ID NO: 180743 - protein, 5 aa, Mycobacterium bovis
LTADA

SEQ ID NO: 180744 - protein, 7 aa, Mycobacterium bovis
LTADPAE

SEQ ID NO: 180745 - protein, 8 aa, Mycobacterium bovis
LTAEARSG

SEQ ID NO: 180746 - protein, 10 aa, Mycobacterium bovis
LTAGAGGLGN

SEQ ID NO: 180747 - protein, 8 aa, Mycobacterium bovis
LTAGGDDY

SEQ ID NO: 180748 - protein, 5 aa, Mycobacterium bovis
LTAKQ

SEQ ID NO: 180749 - protein, 4 aa, Mycobacterium bovis
LTAN

SEQ ID NO: 180750 - protein, 5 aa, Mycobacterium bovis
LTATP

SEQ ID NO: 180751 - protein, 4 aa, Mycobacterium bovis
LTDA

SEQ ID NO: 180752 - protein, 14 aa, Mycobacterium bovis
LTDATLPPNAAAWL

SEQ ID NO: 180753 - protein, 7 aa, Mycobacterium bovis
LTDDTGA

SEQ ID NO: 180754 - protein, 6 aa, Mycobacterium bovis
LTDEDA

SEQ ID NO: 180755 - protein, 10 aa, Mycobacterium bovis
LTDEDAEGSA

SEQ ID NO: 180756 - protein, 7 aa, Mycobacterium bovis
LTDEQKR

SEQ ID NO: 180757 - protein, 7 aa, Mycobacterium bovis
LTDGTEL

SEQ ID NO: 180758 - protein, 6 aa, Mycobacterium bovis
LTDKPV

SEQ ID NO: 180759 - protein, 10 aa, Mycobacterium bovis
LTDPAATAAL

SEQ ID NO: 180760 - protein, 7 aa, Mycobacterium bovis
LTDPGEQ

SEQ ID NO: 180761 - protein, 9 aa, Mycobacterium bovis
LTDPKAGPL

SEQ ID NO: 180762 - protein, 7 aa, Mycobacterium bovis
LTDSGEH

SEQ ID NO: 180763 - protein, 11 aa, Mycobacterium bovis
LTDTGRTQAEL

SEQ ID NO: 180764 - protein, 7 aa, Mycobacterium bovis
LTDTNNG

SEQ ID NO: 180765 - protein, 9 aa, Mycobacterium bovis
LTEADGPTV

SEQ ID NO: 180766 - protein, 9 aa, Mycobacterium bovis
LTEAGAKGQ

SEQ ID NO: 180767 - protein, 5 aa, Mycobacterium bovis
LTEDE

SEQ ID NO: 180768 - protein, 7 aa, Mycobacterium bovis
LTEDEKE

SEQ ID NO: 180769 - protein, 9 aa, Mycobacterium bovis
LTEDSDDLA

SEQ ID NO: 180770 - protein, 7 aa, Mycobacterium bovis
LTEERRR

SEQ ID NO: 180771 - protein, 9 aa, Mycobacterium bovis
LTEPGRSSA

SEQ ID NO: 180772 - protein, 14 aa, Mycobacterium bovis
LTEQSAGQDAAEQA

SEQ ID NO: 180773 - protein, 6 aa, Mycobacterium bovis
LTESDA

SEQ ID NO: 180774 - protein, 6 aa, Mycobacterium bovis
LTGADT

SEQ ID NO: 180775 - protein, 4 aa, Mycobacterium bovis
LTGD

SEQ ID NO: 180776 - protein, 7 aa, Mycobacterium bovis
LTGEPLP

SEQ ID NO: 180777 - protein, 15 aa, Mycobacterium bovis
LTGGKEPNKGVNPDE

SEQ ID NO: 180778 - protein, 6 aa, Mycobacterium bovis
LTGGLA

SEQ ID NO: 180779 - protein, 7 aa, Mycobacterium bovis
LTGGTGV

SEQ ID NO: 180780 - protein, 4 aa, Mycobacterium bovis
LTGK

SEQ ID NO: 180781 - protein, 8 aa, Mycobacterium bovis
LTGKDTEL

SEQ ID NO: 180782 - protein, 11 aa, Mycobacterium bovis
LTGKSKDEVTA

SEQ ID NO: 180783 - protein, 8 aa, Mycobacterium bovis
LTGNSPSF

SEQ ID NO: 180784 - protein, 6 aa, Mycobacterium bovis
LTGPDG

SEQ ID NO: 180785 - protein, 8 aa, Mycobacterium bovis
LTGPSDDG

SEQ ID NO: 180786 - protein, 6 aa, Mycobacterium bovis
LTGQHP

SEQ ID NO: 180787 - protein, 15 aa, Mycobacterium bovis
LTGQKTERLTHRPPS

SEQ ID NO: 180788 - protein, 15 aa, Mycobacterium bovis
LTGQPAKQTPFAPLP

SEQ ID NO: 180789 - protein, 5 aa, Mycobacterium bovis
LTGQS

SEQ ID NO: 180790 - protein, 7 aa, Mycobacterium bovis
LTGRDSG

SEQ ID NO: 180791 - protein, 21 aa, Mycobacterium bovis
LTGRPPRAIPDPTPRSSHGPA

SEQ ID NO: 180792 - protein, 5 aa, Mycobacterium bovis
LTGRQ

SEQ ID NO: 180793 - protein, 20 aa, Mycobacterium bovis
LTGSRDGTQKTGETPLARYD

SEQ ID NO: 180794 - protein, 9 aa, Mycobacterium bovis
LTGSRTTAA

SEQ ID NO: 180795 - protein, 6 aa, Mycobacterium bovis
LTGTTT

SEQ ID NO: 180796 - protein, 6 aa, Mycobacterium bovis
LTNDGT

SEQ ID NO: 180797 - protein, 15 aa, Mycobacterium bovis
LTNKDDLEARGAKTL

SEQ ID NO: 180798 - protein, 5 aa, Mycobacterium bovis
LTNKQ

SEQ ID NO: 180799 - protein, 11 aa, Mycobacterium bovis
LTNSGGGFGGV

SEQ ID NO: 180800 - protein, 14 aa, Mycobacterium bovis
LTNSLGESKPPQVH

SEQ ID NO: 180801 - protein, 4 aa, Mycobacterium bovis
LTPA

SEQ ID NO: 180802 - protein, 6 aa, Mycobacterium bovis
LTPAEG

SEQ ID NO: 180803 - protein, 6 aa, Mycobacterium bovis
LTPAQG

SEQ ID NO: 180804 - protein, 4 aa, Mycobacterium bovis
LTPD

SEQ ID NO: 180805 - protein, 7 aa, Mycobacterium bovis
LTPDEAA

SEQ ID NO: 180806 - protein, 6 aa, Mycobacterium bovis
LTPDTD

SEQ ID NO: 180807 - protein, 7 aa, Mycobacterium bovis
LTPEDTG

SEQ ID NO: 180808 - protein, 5 aa, Mycobacterium bovis
LTPER

SEQ ID NO: 180809 - protein, 11 aa, Mycobacterium bovis
LTPGETVPSGS

SEQ ID NO: 180810 - protein, 13 aa, Mycobacterium bovis
LTPGGLATQYSSA

SEQ ID NO: 180811 - protein, 5 aa, Mycobacterium bovis
LTPGH

SEQ ID NO: 180812 - protein, 6 aa, Mycobacterium bovis
LTPPDV

SEQ ID NO: 180813 - protein, 6 aa, Mycobacterium bovis
LTPPPA

SEQ ID NO: 180814 - protein, 8 aa, Mycobacterium bovis
LTPPVPGQ

SEQ ID NO: 180815 - protein, 6 aa, Mycobacterium bovis
LTPQNQ

SEQ ID NO: 180816 - protein, 8 aa, Mycobacterium bovis
LTPQPPTI

SEQ ID NO: 180817 - protein, 5 aa, Mycobacterium bovis
LTPRG

SEQ ID NO: 180818 - protein, 6 aa, Mycobacterium bovis
LTPRNT

SEQ ID NO: 180819 - protein, 12 aa, Mycobacterium bovis
LTPRPQPADGVS

SEQ ID NO: 180820 - protein, 6 aa, Mycobacterium bovis
LTPRQY

SEQ ID NO: 180821 - protein, 7 aa, Mycobacterium bovis
LTPRTPT

SEQ ID NO: 180822 - protein, 4 aa, Mycobacterium bovis
LTPS

SEQ ID NO: 180823 - protein, 6 aa, Mycobacterium bovis
LTPTER

SEQ ID NO: 180824 - protein, 11 aa, Mycobacterium bovis
LTPTSTRGASA

SEQ ID NO: 180825 - protein, 4 aa, Mycobacterium bovis
LTQP

SEQ ID NO: 180826 - protein, 4 aa, Mycobacterium bovis
LTQR

SEQ ID NO: 180827 - protein, 6 aa, Mycobacterium bovis
LTRDPA

SEQ ID NO: 180828 - protein, 5 aa, Mycobacterium bovis
LTREG

SEQ ID NO: 180829 - protein, 6 aa, Mycobacterium bovis
LTRNGE

SEQ ID NO: 180830 - protein, 5 aa, Mycobacterium bovis
LTRTG

SEQ ID NO: 180831 - protein, 9 aa, Mycobacterium bovis
LTRTGKPDA

SEQ ID NO: 180832 - protein, 16 aa, Mycobacterium bovis
LTSAAAAAAGPPSAAG

SEQ ID NO: 180833 - protein, 11 aa, Mycobacterium bovis
LTSARDDLETA

SEQ ID NO: 180834 - protein, 5 aa, Mycobacterium bovis
LTSDG

SEQ ID NO: 180835 - protein, 7 aa, Mycobacterium bovis
LTSDPVP

SEQ ID NO: 180836 - protein, 19 aa, Mycobacterium bovis
LTSGGGAYAAAEAAATSPL

SEQ ID NO: 180837 - protein, 7 aa, Mycobacterium bovis
LTSGYSP

SEQ ID NO: 180838 - protein, 4 aa, Mycobacterium bovis
LTSL

SEQ ID NO: 180839 - protein, 7 aa, Mycobacterium bovis
LTSPEAT

SEQ ID NO: 180840 - protein, 9 aa, Mycobacterium bovis
LTSPRGKRQ

SEQ ID NO: 180841 - protein, 4 aa, Mycobacterium bovis
LTSQ

SEQ ID NO: 180842 - protein, 8 aa, Mycobacterium bovis
LTSRNPRS

SEQ ID NO: 180843 - protein, 7 aa, Mycobacterium bovis
LTSSKLT

SEQ ID NO: 180844 - protein, 7 aa, Mycobacterium bovis
LTSTSSV

SEQ ID NO: 180845 - protein, 9 aa, Mycobacterium bovis
LTTAEQPDR

SEQ ID NO: 180846 - protein, 5 aa, Mycobacterium bovis
LTTGE

SEQ ID NO: 180847 - protein, 7 aa, Mycobacterium bovis
LTTGEQV

SEQ ID NO: 180848 - protein, 7 aa, Mycobacterium bovis
LTTPPPI

SEQ ID NO: 180849 - protein, 9 aa, Mycobacterium bovis
LTTPRTPFN

SEQ ID NO: 180850 - protein, 6 aa, Mycobacterium bovis
LTTRTE

SEQ ID NO: 180851 - protein, 6 aa, Mycobacterium bovis
LTTSGV

SEQ ID NO: 180852 - protein, 8 aa, Mycobacterium bovis
LTTSTDGW

SEQ ID NO: 180853 - protein, 6 aa, Mycobacterium bovis
LTTTAE

SEQ ID NO: 180854 - protein, 20 aa, Mycobacterium bovis
LTWPPPSKKERRAQHRKEGA

SEQ ID NO: 180855 - protein, 8 aa, Mycobacterium bovis
LVGPDDPR

SEQ ID NO: 180856 - protein, 12 aa, Mycobacterium bovis
LVGSPGQGAYAA

SEQ ID NO: 180857 - protein, 13 aa, Mycobacterium bovis
LVSGSDAKESRGV

SEQ ID NO: 180858 - protein, 5 aa, Mycobacterium bovis
LYGPD

SEQ ID NO: 180859 - protein, 6 aa, Mycobacterium bovis
LYGPNG

SEQ ID NO: 180860 - protein, 10 aa, Mycobacterium bovis
LYPDPERFDP

SEQ ID NO: 180861 - protein, 5 aa, Mycobacterium bovis
LYPPG

SEQ ID NO: 180862 - protein, 11 aa, Mycobacterium bovis
MAAEDPEAKED

SEQ ID NO: 180863 - protein, 8 aa, Mycobacterium bovis
MAAPPGVD

SEQ ID NO: 180864 - protein, 4 aa, Mycobacterium bovis
MAAT

SEQ ID NO: 180865 - protein, 8 aa, Mycobacterium bovis
MADEGRND

SEQ ID NO: 180866 - protein, 6 aa, Mycobacterium bovis
MADPPR

SEQ ID NO: 180867 - protein, 7 aa, Mycobacterium bovis
MAEGPGS

SEQ ID NO: 180868 - protein, 6 aa, Mycobacterium bovis
MAEPRY

SEQ ID NO: 180869 - protein, 9 aa, Mycobacterium bovis
MAGDDPAGA

SEQ ID NO: 180870 - protein, 11 aa, Mycobacterium bovis
MAGEDRTTGVA

SEQ ID NO: 180871 - protein, 11 aa, Mycobacterium bovis
MAGGPSTPALA

SEQ ID NO: 180872 - protein, 8 aa, Mycobacterium bovis
MAGGSADA

SEQ ID NO: 180873 - protein, 9 aa, Mycobacterium bovis
MAGKAGTFN

SEQ ID NO: 180874 - protein, 9 aa, Mycobacterium bovis
MAGKSDIDA

SEQ ID NO: 180875 - protein, 6 aa, Mycobacterium bovis
MAGRGT

SEQ ID NO: 180876 - protein, 10 aa, Mycobacterium bovis
MAGTDEGPGF

SEQ ID NO: 180877 - protein, 8 aa, Mycobacterium bovis
MAKESGAD

SEQ ID NO: 180878 - protein, 8 aa, Mycobacterium bovis
MAKNPAER

SEQ ID NO: 180879 - protein, 6 aa, Mycobacterium bovis
MAPESL

SEQ ID NO: 180880 - protein, 11 aa, Mycobacterium bovis
MAPGDGERGTI

SEQ ID NO: 180881 - protein, 34 aa, Mycobacterium bovis
MAQSSSGSDHKDGGGKQSRAHGPVASRREFRRKS

SEQ ID NO: 180882 - protein, 8 aa, Mycobacterium bovis
MASDQPLA

SEQ ID NO: 180883 - protein, 16 aa, Mycobacterium bovis
MATDENGRIVSPRTGS

SEQ ID NO: 180884 - protein, 16 aa, Mycobacterium bovis
MDAAAQSAAADADPAK

SEQ ID NO: 180885 - protein, 20 aa, Mycobacterium bovis
MDGTPGHDDMPGQPAPSRGE

SEQ ID NO: 180886 - protein, 7 aa, Mycobacterium bovis
MDPDDAA

SEQ ID NO: 180887 - protein, 11 aa, Mycobacterium bovis
MDPWRDRTTEE

SEQ ID NO: 180888 - protein, 6 aa, Mycobacterium bovis
MDSPDF

SEQ ID NO: 180889 - protein, 18 aa, Mycobacterium bovis
MEADEAAARAASRTPHES

SEQ ID NO: 180890 - protein, 7 aa, Mycobacterium bovis
MEEDTGK

SEQ ID NO: 180891 - protein, 6 aa, Mycobacterium bovis
MEKTGA

SEQ ID NO: 180892 - protein, 16 aa, Mycobacterium bovis
MENPNAVEAEISGRTF

SEQ ID NO: 180893 - protein, 8 aa, Mycobacterium bovis
MGDAGLTG

SEQ ID NO: 180894 - protein, 19 aa, Mycobacterium bovis
MGGRDSSSNLGRSQPTVSV

SEQ ID NO: 180895 - protein, 10 aa, Mycobacterium bovis
MGNANPKDNW

SEQ ID NO: 180896 - protein, 11 aa, Mycobacterium bovis
MGPGTKLPTLG

SEQ ID NO: 180897 - protein, 6 aa, Mycobacterium bovis
MGPSYP

SEQ ID NO: 180898 - protein, 18 aa, Mycobacterium bovis
MGPTGSGKTTFFAHPKPD

SEQ ID NO: 180899 - protein, 4 aa, Mycobacterium bovis
MGRA

SEQ ID NO: 180900 - protein, 4 aa, Mycobacterium bovis
MGRG

SEQ ID NO: 180901 - protein, 7 aa, Mycobacterium bovis
MGRNGGG

SEQ ID NO: 180902 - protein, 10 aa, Mycobacterium bovis
MGSKRSTERM

SEQ ID NO: 180903 - protein, 5 aa, Mycobacterium bovis
MGTGG

SEQ ID NO: 180904 - protein, 4 aa, Mycobacterium bovis
MGTQ

SEQ ID NO: 180905 - protein, 14 aa, Mycobacterium bovis
MGYPPAEADQAEQM

SEQ ID NO: 180906 - protein, 47 aa, Mycobacterium bovis
MHPSSGASKGTTTKKYSEGAAAGTEDAERAPVEADAGGGQKVLVRNV

SEQ ID NO: 180907 - protein, 4 aa, Mycobacterium bovis
MKAG

SEQ ID NO: 180908 - protein, 12 aa, Mycobacterium bovis
MKEAEDALRDYQ

SEQ ID NO: 180909 - protein, 8 aa, Mycobacterium bovis
MKEAGRGS

SEQ ID NO: 180910 - protein, 6 aa, Mycobacterium bovis
MKEGRY

SEQ ID NO: 180911 - protein, 9 aa, Mycobacterium bovis
MKNPDRGYA

SEQ ID NO: 180912 - protein, 9 aa, Mycobacterium bovis
MKPADRERI

SEQ ID NO: 180913 - protein, 10 aa, Mycobacterium bovis
MKPETQAAKD

SEQ ID NO: 180914 - protein, 4 aa, Mycobacterium bovis
MKPG

SEQ ID NO: 180915 - protein, 6 aa, Mycobacterium bovis
MKPNTP

SEQ ID NO: 180916 - protein, 8 aa, Mycobacterium bovis
MKTGEGKT

SEQ ID NO: 180917 - protein, 7 aa, Mycobacterium bovis
MLPPGTS

SEQ ID NO: 180918 - protein, 15 aa, Mycobacterium bovis
MNAQNAAAAAPTTGV

SEQ ID NO: 180919 - protein, 5 aa, Mycobacterium bovis
MNPNG

SEQ ID NO: 180920 - protein, 4 aa, Mycobacterium bovis
MPDG

SEQ ID NO: 180921 - protein, 6 aa, Mycobacterium bovis
MPDNAT

SEQ ID NO: 180922 - protein, 9 aa, Mycobacterium bovis
MPDYPEEGA

SEQ ID NO: 180923 - protein, 12 aa, Mycobacterium bovis
MPGAGGNGGNAN

SEQ ID NO: 180924 - protein, 15 aa, Mycobacterium bovis
MPGMPGAPGAPPVPG

SEQ ID NO: 180925 - protein, 5 aa, Mycobacterium bovis
MPGPL

SEQ ID NO: 180926 - protein, 14 aa, Mycobacterium bovis
MPGPNGHRPIPWPA

SEQ ID NO: 180927 - protein, 7 aa, Mycobacterium bovis
MPGPTGL

SEQ ID NO: 180928 - protein, 4 aa, Mycobacterium bovis
MPGQ

SEQ ID NO: 180929 - protein, 4 aa, Mycobacterium bovis
MPGS

SEQ ID NO: 180930 - protein, 7 aa, Mycobacterium bovis
MPGSGLA

SEQ ID NO: 180931 - protein, 6 aa, Mycobacterium bovis
MPHPQQ

SEQ ID NO: 180932 - protein, 8 aa, Mycobacterium bovis
MPHTSPPP

SEQ ID NO: 180933 - protein, 11 aa, Mycobacterium bovis
MPNPKTGTVTA

SEQ ID NO: 180934 - protein, 16 aa, Mycobacterium bovis
MPPDEEWPRSTVSEQT

SEQ ID NO: 180935 - protein, 6 aa, Mycobacterium bovis
MPREPR

SEQ ID NO: 180936 - protein, 11 aa, Mycobacterium bovis
MPSATAQRPGD

SEQ ID NO: 180937 - protein, 14 aa, Mycobacterium bovis
MPTGGTLLRWSAPL

SEQ ID NO: 180938 - protein, 4 aa, Mycobacterium bovis
MPVG

SEQ ID NO: 180939 - protein, 7 aa, Mycobacterium bovis
MPVTSGG

SEQ ID NO: 180940 - protein, 5 aa, Mycobacterium bovis
MQEQV

SEQ ID NO: 180941 - protein, 6 aa, Mycobacterium bovis
MQGHSD

SEQ ID NO: 180942 - protein, 11 aa, Mycobacterium bovis
MQSQSASVRRG

SEQ ID NO: 180943 - protein, 9 aa, Mycobacterium bovis
MRAPDPAEI

SEQ ID NO: 180944 - protein, 7 aa, Mycobacterium bovis
MRGATAP

SEQ ID NO: 180945 - protein, 11 aa, Mycobacterium bovis
MRGEGSPAPIW

SEQ ID NO: 180946 - protein, 5 aa, Mycobacterium bovis
MRGPS

SEQ ID NO: 180947 - protein, 13 aa, Mycobacterium bovis
MRGRGGATSYSKD

SEQ ID NO: 180948 - protein, 4 aa, Mycobacterium bovis
MRPD

SEQ ID NO: 180949 - protein, 10 aa, Mycobacterium bovis
MRPDTTKEGL

SEQ ID NO: 180950 - protein, 13 aa, Mycobacterium bovis
MRPKPACTPTRPK

SEQ ID NO: 180951 - protein, 18 aa, Mycobacterium bovis
MRPPAPPAAPPGAPGMPG

SEQ ID NO: 180952 - protein, 12 aa, Mycobacterium bovis
MRPTDGRDTATA

SEQ ID NO: 180953 - protein, 5 aa, Mycobacterium bovis
MRQPN

SEQ ID NO: 180954 - protein, 7 aa, Mycobacterium bovis
MRRGGTV

SEQ ID NO: 180955 - protein, 10 aa, Mycobacterium bovis
MRSEGTEFRP

SEQ ID NO: 180956 - protein, 9 aa, Mycobacterium bovis
MRSNPGAGG

SEQ ID NO: 180957 - protein, 7 aa, Mycobacterium bovis
MRTAGDD

SEQ ID NO: 180958 - protein, 15 aa, Mycobacterium bovis
MRTDPSAQPAPEQPI

SEQ ID NO: 180959 - protein, 4 aa, Mycobacterium bovis
MSAG

SEQ ID NO: 180960 - protein, 5 aa, Mycobacterium bovis
MSAPN

SEQ ID NO: 180961 - protein, 11 aa, Mycobacterium bovis
MSAPSSGSSKV

SEQ ID NO: 180962 - protein, 19 aa, Mycobacterium bovis
MSARRTRQATKRAPRAFFA

SEQ ID NO: 180963 - protein, 8 aa, Mycobacterium bovis
MSDDRGRP

SEQ ID NO: 180964 - protein, 18 aa, Mycobacterium bovis
MSEPIGAAGGAHAGDRGN

SEQ ID NO: 180965 - protein, 7 aa, Mycobacterium bovis
MSETSGG

SEQ ID NO: 180966 - protein, 7 aa, Mycobacterium bovis
MSGATED

SEQ ID NO: 180967 - protein, 8 aa, Mycobacterium bovis
MSGPADDR

SEQ ID NO: 180968 - protein, 8 aa, Mycobacterium bovis
MSGRARDG

SEQ ID NO: 180969 - protein, 16 aa, Mycobacterium bovis
MSGSRPTESGDPTSQV

SEQ ID NO: 180970 - protein, 8 aa, Mycobacterium bovis
MSGTHESN

SEQ ID NO: 180971 - protein, 5 aa, Mycobacterium bovis
MSGTN

SEQ ID NO: 180972 - protein, 6 aa, Mycobacterium bovis
MSKSRG

SEQ ID NO: 180973 - protein, 6 aa, Mycobacterium bovis
MSPARK

SEQ ID NO: 180974 - protein, 5 aa, Mycobacterium bovis
MSPQG

SEQ ID NO: 180975 - protein, 9 aa, Mycobacterium bovis
MSRGAAKPQ

SEQ ID NO: 180976 - protein, 4 aa, Mycobacterium bovis
MSSF

SEQ ID NO: 180977 - protein, 11 aa, Mycobacterium bovis
MSTSSNERGMS

SEQ ID NO: 180978 - protein, 12 aa, Mycobacterium bovis
MTAGQKKQVRAE

SEQ ID NO: 180979 - protein, 7 aa, Mycobacterium bovis
MTAGSGA

SEQ ID NO: 180980 - protein, 6 aa, Mycobacterium bovis
MTDGGA

SEQ ID NO: 180981 - protein, 33 aa, Mycobacterium bovis
MTGGALGAAAPAIYTGSGARARANGGTPSAEPV

SEQ ID NO: 180982 - protein, 7 aa, Mycobacterium bovis
MTGGGFG

SEQ ID NO: 180983 - protein, 9 aa, Mycobacterium bovis
MTGNEDPEY

SEQ ID NO: 180984 - protein, 10 aa, Mycobacterium bovis
MTGSRQRIQP

SEQ ID NO: 180985 - protein, 16 aa, Mycobacterium bovis
MTPDHDGYAAVVGASK

SEQ ID NO: 180986 - protein, 5 aa, Mycobacterium bovis
MTPEA

SEQ ID NO: 180987 - protein, 10 aa, Mycobacterium bovis
MTPPERVTTA

SEQ ID NO: 180988 - protein, 5 aa, Mycobacterium bovis
MTPTS

SEQ ID NO: 180989 - protein, 8 aa, Mycobacterium bovis
MTQRRDEP

SEQ ID NO: 180990 - protein, 12 aa, Mycobacterium bovis
MTQTHPSIPPEL

SEQ ID NO: 180991 - protein, 8 aa, Mycobacterium bovis
MTRPTAAV

SEQ ID NO: 180992 - protein, 9 aa, Mycobacterium bovis
MVDGRPEDL

SEQ ID NO: 180993 - protein, 19 aa, Mycobacterium bovis
MYGADGKLKDTKAVNPEST

SEQ ID NO: 180994 - protein, 10 aa, Mycobacterium bovis
MYSGPGPESM

SEQ ID NO: 180995 - protein, 10 aa, Mycobacterium bovis
MYSGPGSGPL

SEQ ID NO: 180996 - protein, 10 aa, Mycobacterium bovis
MYTGPGPGPM

SEQ ID NO: 180997 - protein, 10 aa, Mycobacterium bovis
NAAAAAPTAG

SEQ ID NO: 180998 - protein, 8 aa, Mycobacterium bovis
NAAAAGPT

SEQ ID NO: 180999 - protein, 21 aa, Mycobacterium bovis
NAAAAVPTTGALAPAADEVSA

SEQ ID NO: 181000 - protein, 6 aa, Mycobacterium bovis
NAAAGY

SEQ ID NO: 181001 - protein, 12 aa, Mycobacterium bovis
NAADAPAYGGHN

SEQ ID NO: 181002 - protein, 13 aa, Mycobacterium bovis
NAANAAAAAPTTG

SEQ ID NO: 181003 - protein, 12 aa, Mycobacterium bovis
NAANAAAALPTT

SEQ ID NO: 181004 - protein, 6 aa, Mycobacterium bovis
NAANTR

SEQ ID NO: 181005 - protein, 6 aa, Mycobacterium bovis
NAAPDL

SEQ ID NO: 181006 - protein, 8 aa, Mycobacterium bovis
NAAPDRKR

SEQ ID NO: 181007 - protein, 10 aa, Mycobacterium bovis
NAAPNPELRA

SEQ ID NO: 181008 - protein, 8 aa, Mycobacterium bovis
NAARDEPA

SEQ ID NO: 181009 - protein, 9 aa, Mycobacterium bovis
NAARGTPSR

SEQ ID NO: 181010 - protein, 6 aa, Mycobacterium bovis
NAARRE

SEQ ID NO: 181011 - protein, 9 aa, Mycobacterium bovis
NAARTQARQ

SEQ ID NO: 181012 - protein, 14 aa, Mycobacterium bovis
NAASRAEALDLILR

SEQ ID NO: 181013 - protein, 19 aa, Mycobacterium bovis
NAATAEKEAELRANADAKE

SEQ ID NO: 181014 - protein, 15 aa, Mycobacterium bovis
NAATSSTTCAPRAGT

SEQ ID NO: 181015 - protein, 20 aa, Mycobacterium bovis
NAATTRAKDKGRGMQTTSRQ

SEQ ID NO: 181016 - protein, 6 aa, Mycobacterium bovis
NAAYSA

SEQ ID NO: 181017 - protein, 11 aa, Mycobacterium bovis
NADAANASRDA

SEQ ID NO: 181018 - protein, 5 aa, Mycobacterium bovis
NADAK

SEQ ID NO: 181019 - protein, 6 aa, Mycobacterium bovis
NADDAT

SEQ ID NO: 181020 - protein, 8 aa, Mycobacterium bovis
NADKTVEQ

SEQ ID NO: 181021 - protein, 43 aa, Mycobacterium bovis
NADLGGTNADIEGDDTDRRAHAADAARKFSANEANAAEQMQGV

SEQ ID NO: 181022 - protein, 7 aa, Mycobacterium bovis
NADPERI

SEQ ID NO: 181023 - protein, 6 aa, Mycobacterium bovis
NADPGG

SEQ ID NO: 181024 - protein, 4 aa, Mycobacterium bovis
NAEE

SEQ ID NO: 181025 - protein, 6 aa, Mycobacterium bovis
NAEEGR

SEQ ID NO: 181026 - protein, 6 aa, Mycobacterium bovis
NAEHTG

SEQ ID NO: 181027 - protein, 16 aa, Mycobacterium bovis
NAEIPGVGPSESEVGP

SEQ ID NO: 181028 - protein, 8 aa, Mycobacterium bovis
NAEPNAER

SEQ ID NO: 181029 - protein, 8 aa, Mycobacterium bovis
NAEPPPAV

SEQ ID NO: 181030 - protein, 13 aa, Mycobacterium bovis
NAEQAGVNGPLPE

SEQ ID NO: 181031 - protein, 14 aa, Mycobacterium bovis
NAERATDWRGNNNI

SEQ ID NO: 181032 - protein, 7 aa, Mycobacterium bovis
NAEVSGP

SEQ ID NO: 181033 - protein, 7 aa, Mycobacterium bovis
NAFEDPA

SEQ ID NO: 181034 - protein, 7 aa, Mycobacterium bovis
NAGAEPA

SEQ ID NO: 181035 - protein, 10 aa, Mycobacterium bovis
NAGDARHGTA

SEQ ID NO: 181036 - protein, 6 aa, Mycobacterium bovis
NAGDFN

SEQ ID NO: 181037 - protein, 15 aa, Mycobacterium bovis
NAGECAAGKPLPGAR

SEQ ID NO: 181038 - protein, 7 aa, Mycobacterium bovis
NAGGAKG

SEQ ID NO: 181039 - protein, 24 aa, Mycobacterium bovis
NAGGLGPTQGHPLSSATDEPEPHW

SEQ ID NO: 181040 - protein, 14 aa, Mycobacterium bovis
NAGGSRPEGIGKTP

SEQ ID NO: 181041 - protein, 7 aa, Mycobacterium bovis
NAGLREG

SEQ ID NO: 181042 - protein, 7 aa, Mycobacterium bovis
NAGLSAA

SEQ ID NO: 181043 - protein, 15 aa, Mycobacterium bovis
NAGNEDMGVGNGGSF

SEQ ID NO: 181044 - protein, 7 aa, Mycobacterium bovis
NAGPATR

SEQ ID NO: 181045 - protein, 4 aa, Mycobacterium bovis
NAGR

SEQ ID NO: 181046 - protein, 13 aa, Mycobacterium bovis
NAGRTAAGDDNDA

SEQ ID NO: 181047 - protein, 5 aa, Mycobacterium bovis
NAHPD

SEQ ID NO: 181048 - protein, 13 aa, Mycobacterium bovis
NAHTAHPPRADEL

SEQ ID NO: 181049 - protein, 4 aa, Mycobacterium bovis
NAIN

SEQ ID NO: 181050 - protein, 7 aa, Mycobacterium bovis
NAKAAVE

SEQ ID NO: 181051 - protein, 9 aa, Mycobacterium bovis
NAKDRTVAS

SEQ ID NO: 181052 - protein, 4 aa, Mycobacterium bovis
NAKG

SEQ ID NO: 181053 - protein, 6 aa, Mycobacterium bovis
NAKPGQ

SEQ ID NO: 181054 - protein, 8 aa, Mycobacterium bovis
NAKSPQAQ

SEQ ID NO: 181055 - protein, 10 aa, Mycobacterium bovis
NALERTPSVA

SEQ ID NO: 181056 - protein, 7 aa, Mycobacterium bovis
NALGGPG

SEQ ID NO: 181057 - protein, 6 aa, Mycobacterium bovis
NALPRR

SEQ ID NO: 181058 - protein, 120 aa, Mycobacterium bovis
NANLGGGNTGDLNTGNGNIGNTNLGSGNRGDANLGSGNIGNSNVGGGNVGNGNFGSGNGRAGLPGSGNVGNGNLGNSNLGSGNTGNSNVGFGNTGNNNVGTGNAGSGNIGAGNTGSSNWG

SEQ ID NO: 181059 - protein, 19 aa, Mycobacterium bovis
NANLGNGNIGNANLGSGNA

SEQ ID NO: 181060 - protein, 14 aa, Mycobacterium bovis
NANLGNNNLGSGNF

SEQ ID NO: 181061 - protein, 7 aa, Mycobacterium bovis
NANPDCT

SEQ ID NO: 181062 - protein, 9 aa, Mycobacterium bovis
NANPPNAEL

SEQ ID NO: 181063 - protein, 7 aa, Mycobacterium bovis
NANPSAR

SEQ ID NO: 181064 - protein, 7 aa, Mycobacterium bovis
NANTGSF

SEQ ID NO: 181065 - protein, 12 aa, Mycobacterium bovis
NANTGSLNTGSY

SEQ ID NO: 181066 - protein, 8 aa, Mycobacterium bovis
NANVGHGN

SEQ ID NO: 181067 - protein, 5 aa, Mycobacterium bovis
NAPAQ

SEQ ID NO: 181068 - protein, 5 aa, Mycobacterium bovis
NAPAR

SEQ ID NO: 181069 - protein, 4 aa, Mycobacterium bovis
NAPT

SEQ ID NO: 181070 - protein, 13 aa, Mycobacterium bovis
NAPTAASDEPNQV

SEQ ID NO: 181071 - protein, 10 aa, Mycobacterium bovis
NAQAAPAKYP

SEQ ID NO: 181072 - protein, 8 aa, Mycobacterium bovis
NAQAYQAL

SEQ ID NO: 181073 - protein, 5 aa, Mycobacterium bovis
NAQLE

SEQ ID NO: 181074 - protein, 18 aa, Mycobacterium bovis
NAQSQHSSSNNSGGADPV

SEQ ID NO: 181075 - protein, 6 aa, Mycobacterium bovis
NAQTVR

SEQ ID NO: 181076 - protein, 7 aa, Mycobacterium bovis
NARAGLA

SEQ ID NO: 181077 - protein, 7 aa, Mycobacterium bovis
NARDRTM

SEQ ID NO: 181078 - protein, 11 aa, Mycobacterium bovis
NARGLTPEAIG

SEQ ID NO: 181079 - protein, 5 aa, Mycobacterium bovis
NARGP

SEQ ID NO: 181080 - protein, 7 aa, Mycobacterium bovis
NARGRPV

SEQ ID NO: 181081 - protein, 7 aa, Mycobacterium bovis
NARRDSE

SEQ ID NO: 181082 - protein, 7 aa, Mycobacterium bovis
NARSKID

SEQ ID NO: 181083 - protein, 4 aa, Mycobacterium bovis
NARV

SEQ ID NO: 181084 - protein, 7 aa, Mycobacterium bovis
NASDTHP

SEQ ID NO: 181085 - protein, 27 aa, Mycobacterium bovis
NASGGAGGSGGSSLSGKAGAGGAGGSA

SEQ ID NO: 181086 - protein, 11 aa, Mycobacterium bovis
NASGRSPSAWT

SEQ ID NO: 181087 - protein, 6 aa, Mycobacterium bovis
NASGSR

SEQ ID NO: 181088 - protein, 4 aa, Mycobacterium bovis
NASR

SEQ ID NO: 181089 - protein, 6 aa, Mycobacterium bovis
NASRAA

SEQ ID NO: 181090 - protein, 8 aa, Mycobacterium bovis
NASRSADE

SEQ ID NO: 181091 - protein, 9 aa, Mycobacterium bovis
NASTPAPAA

SEQ ID NO: 181092 - protein, 12 aa, Mycobacterium bovis
NATAAAENDSAE

SEQ ID NO: 181093 - protein, 5 aa, Mycobacterium bovis
NATEA

SEQ ID NO: 181094 - protein, 6 aa, Mycobacterium bovis
NATGHP

SEQ ID NO: 181095 - protein, 7 aa, Mycobacterium bovis
NATGQWA

SEQ ID NO: 181096 - protein, 9 aa, Mycobacterium bovis
NATHADAAA

SEQ ID NO: 181097 - protein, 10 aa, Mycobacterium bovis
NATKGKKERL

SEQ ID NO: 181098 - protein, 8 aa, Mycobacterium bovis
NATPQSPR

SEQ ID NO: 181099 - protein, 7 aa, Mycobacterium bovis
NATRELS

SEQ ID NO: 181100 - protein, 5 aa, Mycobacterium bovis
NATSL

SEQ ID NO: 181101 - protein, 5 aa, Mycobacterium bovis
NATTV

SEQ ID NO: 181102 - protein, 7 aa, Mycobacterium bovis
NAVDTPD

SEQ ID NO: 181103 - protein, 4 aa, Mycobacterium bovis
NAVN

SEQ ID NO: 181104 - protein, 12 aa, Mycobacterium bovis
NAVPNDPRPPMV

SEQ ID NO: 181105 - protein, 12 aa, Mycobacterium bovis
NAVQAGSLNRPG

SEQ ID NO: 181106 - protein, 6 aa, Mycobacterium bovis
NAVQTT

SEQ ID NO: 181107 - protein, 5 aa, Mycobacterium bovis
NAVYP

SEQ ID NO: 181108 - protein, 6 aa, Mycobacterium bovis
NAYEQA

SEQ ID NO: 181109 - protein, 6 aa, Mycobacterium bovis
NCDPDE

SEQ ID NO: 181110 - protein, 7 aa, Mycobacterium bovis
NCSTGST

SEQ ID NO: 181111 - protein, 15 aa, Mycobacterium bovis
NDAAGLASPVRSAGP

SEQ ID NO: 181112 - protein, 6 aa, Mycobacterium bovis
NDAANT

SEQ ID NO: 181113 - protein, 10 aa, Mycobacterium bovis
NDAGDAASDA

SEQ ID NO: 181114 - protein, 7 aa, Mycobacterium bovis
NDALPDT

SEQ ID NO: 181115 - protein, 6 aa, Mycobacterium bovis
NDAPEL

SEQ ID NO: 181116 - protein, 5 aa, Mycobacterium bovis
NDAPI

SEQ ID NO: 181117 - protein, 30 aa, Mycobacterium bovis
NDAQSQPFTTEPELRPQPSSTPPPPPPLPP

SEQ ID NO: 181118 - protein, 7 aa, Mycobacterium bovis
NDDAAES

SEQ ID NO: 181119 - protein, 9 aa, Mycobacterium bovis
NDDEPLGLP

SEQ ID NO: 181120 - protein, 6 aa, Mycobacterium bovis
NDDGAI

SEQ ID NO: 181121 - protein, 10 aa, Mycobacterium bovis
NDDGSDPANI

SEQ ID NO: 181122 - protein, 5 aa, Mycobacterium bovis
NDDNN

SEQ ID NO: 181123 - protein, 11 aa, Mycobacterium bovis
NDDNQPGAPNR

SEQ ID NO: 181124 - protein, 7 aa, Mycobacterium bovis
NDDNRIN

SEQ ID NO: 181125 - protein, 10 aa, Mycobacterium bovis
NDDPLDTPAR

SEQ ID NO: 181126 - protein, 6 aa, Mycobacterium bovis
NDDQGI

SEQ ID NO: 181127 - protein, 7 aa, Mycobacterium bovis
NDDRNDR

SEQ ID NO: 181128 - protein, 10 aa, Mycobacterium bovis
NDEAAEAERM

SEQ ID NO: 181129 - protein, 6 aa, Mycobacterium bovis
NDEELD

SEQ ID NO: 181130 - protein, 4 aa, Mycobacterium bovis
NDEI

SEQ ID NO: 181131 - protein, 7 aa, Mycobacterium bovis
NDEYAGP

SEQ ID NO: 181132 - protein, 7 aa, Mycobacterium bovis
NDEYDNE

SEQ ID NO: 181133 - protein, 38 aa, Mycobacterium bovis
NDFGEPPSGAGDTEPASGTPPAPRQPPAGSPLSDRERE

SEQ ID NO: 181134 - protein, 6 aa, Mycobacterium bovis
NDGATA

SEQ ID NO: 181135 - protein, 9 aa, Mycobacterium bovis
NDGEGLGGT

SEQ ID NO: 181136 - protein, 5 aa, Mycobacterium bovis
NDGEL

SEQ ID NO: 181137 - protein, 4 aa, Mycobacterium bovis
NDGI

SEQ ID NO: 181138 - protein, 8 aa, Mycobacterium bovis
NDGKTPKT

SEQ ID NO: 181139 - protein, 14 aa, Mycobacterium bovis
NDHTAGGLATNSAP

SEQ ID NO: 181140 - protein, 8 aa, Mycobacterium bovis
NDKDGVNA

SEQ ID NO: 181141 - protein, 20 aa, Mycobacterium bovis
NDKHNEANGENNRDGESYNR

SEQ ID NO: 181142 - protein, 17 aa, Mycobacterium bovis
NDKSPSRKTGELDNRGS

SEQ ID NO: 181143 - protein, 6 aa, Mycobacterium bovis
NDLNAL

SEQ ID NO: 181144 - protein, 7 aa, Mycobacterium bovis
NDLSSGR

SEQ ID NO: 181145 - protein, 12 aa, Mycobacterium bovis
NDMQAPPTPGAD

SEQ ID NO: 181146 - protein, 6 aa, Mycobacterium bovis
NDNGGG

SEQ ID NO: 181147 - protein, 4 aa, Mycobacterium bovis
NDPD

SEQ ID NO: 181148 - protein, 7 aa, Mycobacterium bovis
NDPDELA

SEQ ID NO: 181149 - protein, 7 aa, Mycobacterium bovis
NDPDGDL

SEQ ID NO: 181150 - protein, 27 aa, Mycobacterium bovis
NDPDPALNNADTIRDRARQRAAARHGA

SEQ ID NO: 181151 - protein, 9 aa, Mycobacterium bovis
NDPEANAER

SEQ ID NO: 181152 - protein, 6 aa, Mycobacterium bovis
NDPEGL

SEQ ID NO: 181153 - protein, 9 aa, Mycobacterium bovis
NDPERAGVG

SEQ ID NO: 181154 - protein, 8 aa, Mycobacterium bovis
NDPQNRIN

SEQ ID NO: 181155 - protein, 4 aa, Mycobacterium bovis
NDPR

SEQ ID NO: 181156 - protein, 5 aa, Mycobacterium bovis
NDPRN

SEQ ID NO: 181157 - protein, 6 aa, Mycobacterium bovis
NDPSMQ

SEQ ID NO: 181158 - protein, 9 aa, Mycobacterium bovis
NDPTSSAQI

SEQ ID NO: 181159 - protein, 14 aa, Mycobacterium bovis
NDQPVDVPAATGRT

SEQ ID NO: 181160 - protein, 7 aa, Mycobacterium bovis
NDQTPEL

SEQ ID NO: 181161 - protein, 7 aa, Mycobacterium bovis
NDRANAA

SEQ ID NO: 181162 - protein, 11 aa, Mycobacterium bovis
NDRGCTKPGVR

SEQ ID NO: 181163 - protein, 7 aa, Mycobacterium bovis
NDRKGYT

SEQ ID NO: 181164 - protein, 9 aa, Mycobacterium bovis
NDRNAAAAE

SEQ ID NO: 181165 - protein, 28 aa, Mycobacterium bovis
NDRREEGDLRENGGYHAAREEQGQQEAR

SEQ ID NO: 181166 - protein, 6 aa, Mycobacterium bovis
NDSANN

SEQ ID NO: 181167 - protein, 7 aa, Mycobacterium bovis
NDSATEP

SEQ ID NO: 181168 - protein, 9 aa, Mycobacterium bovis
NDSGGARIQ

SEQ ID NO: 181169 - protein, 8 aa, Mycobacterium bovis
NDSITPDD

SEQ ID NO: 181170 - protein, 8 aa, Mycobacterium bovis
NDSPYGLS

SEQ ID NO: 181171 - protein, 6 aa, Mycobacterium bovis
NDSQSG

SEQ ID NO: 181172 - protein, 6 aa, Mycobacterium bovis
NDTGGV

SEQ ID NO: 181173 - protein, 10 aa, Mycobacterium bovis
NDTPVASASI

SEQ ID NO: 181174 - protein, 6 aa, Mycobacterium bovis
NDTRVS

SEQ ID NO: 181175 - protein, 11 aa, Mycobacterium bovis
NDTTDGRGTTS

SEQ ID NO: 181176 - protein, 6 aa, Mycobacterium bovis
NDTVAT

SEQ ID NO: 181177 - protein, 13 aa, Mycobacterium bovis
NDYAAMPDVEVIT

SEQ ID NO: 181178 - protein, 12 aa, Mycobacterium bovis
NDYADRKNNRQA

SEQ ID NO: 181179 - protein, 8 aa, Mycobacterium bovis
NDYTERTT

SEQ ID NO: 181180 - protein, 8 aa, Mycobacterium bovis
NEAATEDA

SEQ ID NO: 181181 - protein, 17 aa, Mycobacterium bovis
NEADAGVPARRRGRGVA

SEQ ID NO: 181182 - protein, 4 aa, Mycobacterium bovis
NEAE

SEQ ID NO: 181183 - protein, 9 aa, Mycobacterium bovis
NEAETTTAS

SEQ ID NO: 181184 - protein, 6 aa, Mycobacterium bovis
NEAGSV

SEQ ID NO: 181185 - protein, 10 aa, Mycobacterium bovis
NEANDKDIEE

SEQ ID NO: 181186 - protein, 9 aa, Mycobacterium bovis
NEANTEPLA

SEQ ID NO: 181187 - protein, 4 aa, Mycobacterium bovis
NEAQ

SEQ ID NO: 181188 - protein, 13 aa, Mycobacterium bovis
NEARAEKTAATVK

SEQ ID NO: 181189 - protein, 8 aa, Mycobacterium bovis
NEDDRTAV

SEQ ID NO: 181190 - protein, 9 aa, Mycobacterium bovis
NEDGSNITK

SEQ ID NO: 181191 - protein, 5 aa, Mycobacterium bovis
NEDSR

SEQ ID NO: 181192 - protein, 4 aa, Mycobacterium bovis
NEEL

SEQ ID NO: 181193 - protein, 10 aa, Mycobacterium bovis
NEENASGGRV

SEQ ID NO: 181194 - protein, 11 aa, Mycobacterium bovis
NEGADSTHSPE

SEQ ID NO: 181195 - protein, 12 aa, Mycobacterium bovis
NEGFSGGEKKRH

SEQ ID NO: 181196 - protein, 6 aa, Mycobacterium bovis
NEGGLH

SEQ ID NO: 181197 - protein, 8 aa, Mycobacterium bovis
NEGSERSN

SEQ ID NO: 181198 - protein, 10 aa, Mycobacterium bovis
NEGTEGAERA

SEQ ID NO: 181199 - protein, 8 aa, Mycobacterium bovis
NEGVPGDI

SEQ ID NO: 181200 - protein, 6 aa, Mycobacterium bovis
NEHDEA

SEQ ID NO: 181201 - protein, 6 aa, Mycobacterium bovis
NEHEAK

SEQ ID NO: 181202 - protein, 7 aa, Mycobacterium bovis
NEHTAEL

SEQ ID NO: 181203 - protein, 4 aa, Mycobacterium bovis
NEIT

SEQ ID NO: 181204 - protein, 6 aa, Mycobacterium bovis
NEITPT

SEQ ID NO: 181205 - protein, 8 aa, Mycobacterium bovis
NEKSQLQN

SEQ ID NO: 181206 - protein, 7 aa, Mycobacterium bovis
NELGRRD

SEQ ID NO: 181207 - protein, 14 aa, Mycobacterium bovis
NELNAGYAADGYGR

SEQ ID NO: 181208 - protein, 13 aa, Mycobacterium bovis
NELPPQATASQEA

SEQ ID NO: 181209 - protein, 6 aa, Mycobacterium bovis
NENAKE

SEQ ID NO: 181210 - protein, 11 aa, Mycobacterium bovis
NENGNDPTPAD

SEQ ID NO: 181211 - protein, 8 aa, Mycobacterium bovis
NENPQRPW

SEQ ID NO: 181212 - protein, 8 aa, Mycobacterium bovis
NEPESPAE

SEQ ID NO: 181213 - protein, 14 aa, Mycobacterium bovis
NEPGAALPDRPATS

SEQ ID NO: 181214 - protein, 9 aa, Mycobacterium bovis
NEPTQALTG

SEQ ID NO: 181215 - protein, 6 aa, Mycobacterium bovis
NERGFS

SEQ ID NO: 181216 - protein, 6 aa, Mycobacterium bovis
NERGVD

SEQ ID NO: 181217 - protein, 11 aa, Mycobacterium bovis
NERSQLQNKTR

SEQ ID NO: 181218 - protein, 14 aa, Mycobacterium bovis
NESAKRDYDVQGNG

SEQ ID NO: 181219 - protein, 6 aa, Mycobacterium bovis
NESDTA

SEQ ID NO: 181220 - protein, 8 aa, Mycobacterium bovis
NESEEIDG

SEQ ID NO: 181221 - protein, 7 aa, Mycobacterium bovis
NESGIDV

SEQ ID NO: 181222 - protein, 6 aa, Mycobacterium bovis
NESPSI

SEQ ID NO: 181223 - protein, 19 aa, Mycobacterium bovis
NETETSGQDPALAPTAEQE

SEQ ID NO: 181224 - protein, 7 aa, Mycobacterium bovis
NETLGNS

SEQ ID NO: 181225 - protein, 5 aa, Mycobacterium bovis
NETQI

SEQ ID NO: 181226 - protein, 5 aa, Mycobacterium bovis
NETRT

SEQ ID NO: 181227 - protein, 6 aa, Mycobacterium bovis
NETSTG

SEQ ID NO: 181228 - protein, 7 aa, Mycobacterium bovis
NETTRNA

SEQ ID NO: 181229 - protein, 6 aa, Mycobacterium bovis
NETTTK

SEQ ID NO: 181230 - protein, 5 aa, Mycobacterium bovis
NEYPG

SEQ ID NO: 181231 - protein, 6 aa, Mycobacterium bovis
NFASDG

SEQ ID NO: 181232 - protein, 7 aa, Mycobacterium bovis
NFDNDEA

SEQ ID NO: 181233 - protein, 10 aa, Mycobacterium bovis
NFDPTRRSGR

SEQ ID NO: 181234 - protein, 7 aa, Mycobacterium bovis
NFETPSH

SEQ ID NO: 181235 - protein, 11 aa, Mycobacterium bovis
NFGHTQSAAGA

SEQ ID NO: 181236 - protein, 9 aa, Mycobacterium bovis
NFGHTQSTA

SEQ ID NO: 181237 - protein, 10 aa, Mycobacterium bovis
NFKTRGGLTT

SEQ ID NO: 181238 - protein, 12 aa, Mycobacterium bovis
NFPDQTATSPMD

SEQ ID NO: 181239 - protein, 13 aa, Mycobacterium bovis
NFPPNNGAVPGTR

SEQ ID NO: 181240 - protein, 19 aa, Mycobacterium bovis
NFPQLPPAPDDYPTFPDTS

SEQ ID NO: 181241 - protein, 4 aa, Mycobacterium bovis
NFPT

SEQ ID NO: 181242 - protein, 8 aa, Mycobacterium bovis
NFTQTSDD

SEQ ID NO: 181243 - protein, 23 aa, Mycobacterium bovis
NFYPSPDRESAYASPRIGQPVGS

SEQ ID NO: 181244 - protein, 16 aa, Mycobacterium bovis
NGADGAPGTGAAGGAG

SEQ ID NO: 181245 - protein, 17 aa, Mycobacterium bovis
NGADGAPGTGQAGGAGG

SEQ ID NO: 181246 - protein, 17 aa, Mycobacterium bovis
NGADGAPGTGQPGGPGG

SEQ ID NO: 181247 - protein, 15 aa, Mycobacterium bovis
NGADGGPGQNGGPGG

SEQ ID NO: 181248 - protein, 17 aa, Mycobacterium bovis
NGADGSPGTGQAGGPGG

SEQ ID NO: 181249 - protein, 16 aa, Mycobacterium bovis
NGADGSTPGQAGGPGG

SEQ ID NO: 181250 - protein, 21 aa, Mycobacterium bovis
NGADGVAGTGSNAGGNGGPGG

SEQ ID NO: 181251 - protein, 16 aa, Mycobacterium bovis
NGANATTPGGNGGDGG

SEQ ID NO: 181252 - protein, 17 aa, Mycobacterium bovis
NGANGADGTGAPGGPGG

SEQ ID NO: 181253 - protein, 17 aa, Mycobacterium bovis
NGANGAPGTGQAGGAGG

SEQ ID NO: 181254 - protein, 17 aa, Mycobacterium bovis
NGANGAPGTGQAGGDGG

SEQ ID NO: 181255 - protein, 16 aa, Mycobacterium bovis
NGANGTAASPNGGDGG

SEQ ID NO: 181256 - protein, 16 aa, Mycobacterium bovis
NGANGTPGTGAAGGAG

SEQ ID NO: 181257 - protein, 17 aa, Mycobacterium bovis
NGANGVAGTGQNGGDGG

SEQ ID NO: 181258 - protein, 16 aa, Mycobacterium bovis
NGAQQDRVPGGTQQIA

SEQ ID NO: 181259 - protein, 12 aa, Mycobacterium bovis
NGASAEGTINGT

SEQ ID NO: 181260 - protein, 15 aa, Mycobacterium bovis
NGASASAIARGRPVE

SEQ ID NO: 181261 - protein, 15 aa, Mycobacterium bovis
NGASGEGGPNGSVNE

SEQ ID NO: 181262 - protein, 39 aa, Mycobacterium bovis
NGASGGSAGIAGNGGDAGLVGNGGAGGNGGNGAAGSALG

SEQ ID NO: 181263 - protein, 8 aa, Mycobacterium bovis
NGAYNQRQ

SEQ ID NO: 181264 - protein, 14 aa, Mycobacterium bovis
NGDELADQARAHPD

SEQ ID NO: 181265 - protein, 5 aa, Mycobacterium bovis
NGDEV

SEQ ID NO: 181266 - protein, 11 aa, Mycobacterium bovis
NGDGNVTRRNG

SEQ ID NO: 181267 - protein, 9 aa, Mycobacterium bovis
NGDKSDSET

SEQ ID NO: 181268 - protein, 4 aa, Mycobacterium bovis
NGDL

SEQ ID NO: 181269 - protein, 4 aa, Mycobacterium bovis
NGDQ

SEQ ID NO: 181270 - protein, 4 aa, Mycobacterium bovis
NGDR

SEQ ID NO: 181271 - protein, 8 aa, Mycobacterium bovis
NGDTAAAP

SEQ ID NO: 181272 - protein, 8 aa, Mycobacterium bovis
NGEAGTRV

SEQ ID NO: 181273 - protein, 6 aa, Mycobacterium bovis
NGEEIA

SEQ ID NO: 181274 - protein, 5 aa, Mycobacterium bovis
NGEGE

SEQ ID NO: 181275 - protein, 6 aa, Mycobacterium bovis
NGEPTR

SEQ ID NO: 181276 - protein, 5 aa, Mycobacterium bovis
NGERN

SEQ ID NO: 181277 - protein, 6 aa, Mycobacterium bovis
NGERTG

SEQ ID NO: 181278 - protein, 13 aa, Mycobacterium bovis
NGFDGGWTAEASH

SEQ ID NO: 181279 - protein, 5 aa, Mycobacterium bovis
NGFGA

SEQ ID NO: 181280 - protein, 37 aa, Mycobacterium bovis
NGGAAGSGGNGGDAGTGVSSDGFAGLGGSGGRGGDAG

SEQ ID NO: 181281 - protein, 16 aa, Mycobacterium bovis
NGGAASGEIELAALNI

SEQ ID NO: 181282 - protein, 18 aa, Mycobacterium bovis
NGGAGASSFLGGGGAGGR

SEQ ID NO: 181283 - protein, 31 aa, Mycobacterium bovis
NGGAGGAAGQGGPGMNTTSPGGPGGVGGHGG

SEQ ID NO: 181284 - protein, 46 aa, Mycobacterium bovis
NGGAGGAGGFNAAGGNGGNGGLFGTGGTGGAGTNFGAGGNGGNGGL

SEQ ID NO: 181285 - protein, 73 aa, Mycobacterium bovis
NGGAGGAGGLGGAGGAGGAGGEGGAGGAGGEAIPGGASTNSAGGDGGAGGTGGNGGDGGAGGAPGLGGAGGAG

SEQ ID NO: 181286 - protein, 16 aa, Mycobacterium bovis
NGGAGGAGGNGGDTTV

SEQ ID NO: 181287 - protein, 74 aa, Mycobacterium bovis
NGGAGGAGGTGGTGGGGAAGFAGGVGGAGGEGLTDGAGTAEGGTGGLGGLGGVGGTGGMGGSGGVGGNGGAAGS

SEQ ID NO: 181288 - protein, 25 aa, Mycobacterium bovis
NGGAGGAGGTGSTAGGAGGAGGAGG

SEQ ID NO: 181289 - protein, 24 aa, Mycobacterium bovis
NGGAGGFGGAGAVGGNGGAGGTAG

SEQ ID NO: 181290 - protein, 38 aa, Mycobacterium bovis
NGGAGGFGGVGTTVSGNGGAGGAAGAFGNGGVGGAGGA

SEQ ID NO: 181291 - protein, 28 aa, Mycobacterium bovis
NGGAGGLGGTGVAGVNGGMGAAGGAGGN

SEQ ID NO: 181292 - protein, 15 aa, Mycobacterium bovis
NGGAGGNGATGGTGV

SEQ ID NO: 181293 - protein, 37 aa, Mycobacterium bovis
NGGAGGNGGAAGSPGSVTAFGGNGGSGGSGGNGGNAL

SEQ ID NO: 181294 - protein, 26 aa, Mycobacterium bovis
NGGAGGNGGAATIPGGNGGAGGAGGN

SEQ ID NO: 181295 - protein, 20 aa, Mycobacterium bovis
NGGAGGNGGSAAAAGGAGGN

SEQ ID NO: 181296 - protein, 14 aa, Mycobacterium bovis
NGGAGGPGASGGAL

SEQ ID NO: 181297 - protein, 28 aa, Mycobacterium bovis
NGGAGGPGGPTDVPAGTGGAGGAGGDAP

SEQ ID NO: 181298 - protein, 10 aa, Mycobacterium bovis
NGGAGGQGGL

SEQ ID NO: 181299 - protein, 22 aa, Mycobacterium bovis
NGGAGGSGAAGMPGGNGGAAGL

SEQ ID NO: 181300 - protein, 57 aa, Mycobacterium bovis
NGGAGGSGAANNAVGGTGGTGGAGGASGLLGSGGAGGAGGVATNTGGIGGAGGTGGN

SEQ ID NO: 181301 - protein, 24 aa, Mycobacterium bovis
NGGAGGSGAGGASSAHGGAGGQAG

SEQ ID NO: 181302 - protein, 14 aa, Mycobacterium bovis
NGGAGGSGAPGGAG

SEQ ID NO: 181303 - protein, 21 aa, Mycobacterium bovis
NGGAGGSGAPGQAGGPGGAAG

SEQ ID NO: 181304 - protein, 33 aa, Mycobacterium bovis
NGGAGGVGGTGDNGVGDLGAGGGGGDGGLGGRA

SEQ ID NO: 181305 - protein, 68 aa, Mycobacterium bovis
NGGAGGVGGVGGAGGAGAAGGAGGAGATGINGPAGISAAGGDGGAGGNGGAGGNGGVGGAGGAGGSAG

SEQ ID NO: 181306 - protein, 72 aa, Mycobacterium bovis
NGGDGGAGGVGGVGGAGAAGAIGGHGGDGGSVNTPIGGSEAGDGGKGGLGGDGGDGAAGGDGGAGGDGGGRG

SEQ ID NO: 181307 - protein, 18 aa, Mycobacterium bovis
NGGEGGIGALAGKSGFGG

SEQ ID NO: 181308 - protein, 5 aa, Mycobacterium bovis
NGGEI

SEQ ID NO: 181309 - protein, 7 aa, Mycobacterium bovis
NGGEPVD

SEQ ID NO: 181310 - protein, 33 aa, Mycobacterium bovis
NGGGGGAGGNGGAGNDGTPGNGGGGGVGGTGGT

SEQ ID NO: 181311 - protein, 57 aa, Mycobacterium bovis
NGGHGGAGAAGQDRGAGNSAGLIGNGGAGGAGGNGGIGGAGAPGGLGGDGGKGGFAD

SEQ ID NO: 181312 - protein, 6 aa, Mycobacterium bovis
NGGKST

SEQ ID NO: 181313 - protein, 15 aa, Mycobacterium bovis
NGGLGGAGGDGGNAG

SEQ ID NO: 181314 - protein, 7 aa, Mycobacterium bovis
NGGMTPK

SEQ ID NO: 181315 - protein, 39 aa, Mycobacterium bovis
NGGNAGAGSGLAGADGGLFGNGGDGGSSTSKAGGAGGNA

SEQ ID NO: 181316 - protein, 20 aa, Mycobacterium bovis
NGGNGAAGAVGQVGGAGGAA

SEQ ID NO: 181317 - protein, 45 aa, Mycobacterium bovis
NGGNGFSQTTAGVAGGAGGSAGLIGNGGNGGAGGAGAAGGAGGAG

SEQ ID NO: 181318 - protein, 23 aa, Mycobacterium bovis
NGGNGGAGAAGTNGSAGGAGGAG

SEQ ID NO: 181319 - protein, 46 aa, Mycobacterium bovis
NGGNGGAGDTANPNGGNGGSAGLIGNGGAGGAGAATGAGGAGGNGG

SEQ ID NO: 181320 - protein, 57 aa, Mycobacterium bovis
NGGNGGAGGEGGPGGAGGAGASGAHATNLGADGQAGGNGGNGGAGGTGGVGGPGGGH

SEQ ID NO: 181321 - protein, 12 aa, Mycobacterium bovis
NGGNGGAGGIGG

SEQ ID NO: 181322 - protein, 23 aa, Mycobacterium bovis
NGGNGGAGGPDGGAGGNGGAAGL

SEQ ID NO: 181323 - protein, 44 aa, Mycobacterium bovis
NGGNGGDSTSPGVAGGAGGSAGLIGNGGRGGNGAPGGAGGNGGL

SEQ ID NO: 181324 - protein, 27 aa, Mycobacterium bovis
NGGNGGLGGDGDGGTGGGHGGNGGNPG

SEQ ID NO: 181325 - protein, 22 aa, Mycobacterium bovis
NGGNGGNAGKAGATPGAGGTGG

SEQ ID NO: 181326 - protein, 34 aa, Mycobacterium bovis
NGGNGGNAGSGTPNGSAGTGGAGGLLGKNGMNGL

SEQ ID NO: 181327 - protein, 32 aa, Mycobacterium bovis
NGGNGGNGGKAGGTPGAGGTSGLIIGENGLNG

SEQ ID NO: 181328 - protein, 22 aa, Mycobacterium bovis
NGGNGGSGAAGQAGGAGGPAGL

SEQ ID NO: 181329 - protein, 20 aa, Mycobacterium bovis
NGGNGGSGAPGQAGGAGGAA

SEQ ID NO: 181330 - protein, 49 aa, Mycobacterium bovis
NGGNGGSGAPGQPGGAGGDAGLIGNGGTGGKGGDGLVGSGAAGGVGGRG

SEQ ID NO: 181331 - protein, 22 aa, Mycobacterium bovis
NGGNGGSGAPGQRGGAGGAAGL

SEQ ID NO: 181332 - protein, 21 aa, Mycobacterium bovis
NGGNGGSGAPGQTGGAGGAAG

SEQ ID NO: 181333 - protein, 18 aa, Mycobacterium bovis
NGGNGGSGASGGAAGHAG

SEQ ID NO: 181334 - protein, 20 aa, Mycobacterium bovis
NGGNGGSGATGQAGGAGGAA

SEQ ID NO: 181335 - protein, 24 aa, Mycobacterium bovis
NGGNGGSGGTGAPAGTAGAGGLGG

SEQ ID NO: 181336 - protein, 57 aa, Mycobacterium bovis
NGGNGGSGGTGQNGGNGGSAGLWGSGGNGGQGGAGANGAAGQPGKAGGSGGNGGAGG

SEQ ID NO: 181337 - protein, 75 aa, Mycobacterium bovis
NGGNGGSGGVGGAGGVGGAGGDGGNGGSGGNASTFGDENSIGGAGGTGGNGGNGANGGNGGAGGIAGGAGGSGGF

SEQ ID NO: 181338 - protein, 21 aa, Mycobacterium bovis
NGGNGGSGGVGQAGGAGGSAG

SEQ ID NO: 181339 - protein, 22 aa, Mycobacterium bovis
NGGNGGSGVAGVGGPGGSGGAA

SEQ ID NO: 181340 - protein, 39 aa, Mycobacterium bovis
NGGNGSVGGMGGQGTNDTAGDSAGSGGLGGNGGNGAQGG

SEQ ID NO: 181341 - protein, 22 aa, Mycobacterium bovis
NGGNSGSGAPGQAGGAGGAAGL

SEQ ID NO: 181342 - protein, 26 aa, Mycobacterium bovis
NGGPGGAAGLGTAGGVSPAGGAGGAA

SEQ ID NO: 181343 - protein, 9 aa, Mycobacterium bovis
NGGPGTVSG

SEQ ID NO: 181344 - protein, 6 aa, Mycobacterium bovis
NGGPGV

SEQ ID NO: 181345 - protein, 21 aa, Mycobacterium bovis
NGGQGGDSGAGGGTDSTQTGV

SEQ ID NO: 181346 - protein, 10 aa, Mycobacterium bovis
NGGSAQESVV

SEQ ID NO: 181347 - protein, 27 aa, Mycobacterium bovis
NGGSGGHGGAVTAGNTGIGGAGGVGGD

SEQ ID NO: 181348 - protein, 19 aa, Mycobacterium bovis
NGGSNGESGESSQSINDAA

SEQ ID NO: 181349 - protein, 15 aa, Mycobacterium bovis
NGGSVEDAKKRPEFG

SEQ ID NO: 181350 - protein, 8 aa, Mycobacterium bovis
NGGTAERV

SEQ ID NO: 181351 - protein, 15 aa, Mycobacterium bovis
NGGTGGAGGAAGATL

SEQ ID NO: 181352 - protein, 5 aa, Mycobacterium bovis
NGGWG

SEQ ID NO: 181353 - protein, 4 aa, Mycobacterium bovis
NGHI

SEQ ID NO: 181354 - protein, 11 aa, Mycobacterium bovis
NGHNVSTRGRI

SEQ ID NO: 181355 - protein, 4 aa, Mycobacterium bovis
NGHT

SEQ ID NO: 181356 - protein, 38 aa, Mycobacterium bovis
NGIGGNGGNGGNAGPSGAGGSGGAGSTFGATGSSSSIH

SEQ ID NO: 181357 - protein, 8 aa, Mycobacterium bovis
NGIPKAGR

SEQ ID NO: 181358 - protein, 25 aa, Mycobacterium bovis
NGIVSTSATTCNYPPAANDSAQDGF

SEQ ID NO: 181359 - protein, 7 aa, Mycobacterium bovis
NGKPVRE

SEQ ID NO: 181360 - protein, 11 aa, Mycobacterium bovis
NGLATHAKPGT

SEQ ID NO: 181361 - protein, 4 aa, Mycobacterium bovis
NGLH

SEQ ID NO: 181362 - protein, 5 aa, Mycobacterium bovis
NGLRP

SEQ ID NO: 181363 - protein, 6 aa, Mycobacterium bovis
NGLTED

SEQ ID NO: 181364 - protein, 13 aa, Mycobacterium bovis
NGMGGDAYRTDPL

SEQ ID NO: 181365 - protein, 4 aa, Mycobacterium bovis
NGNA

SEQ ID NO: 181366 - protein, 13 aa, Mycobacterium bovis
NGNDGNTNFGSGN

SEQ ID NO: 181367 - protein, 23 aa, Mycobacterium bovis
NGNFGSGNLGSGNTGSTNFGGGN

SEQ ID NO: 181368 - protein, 4 aa, Mycobacterium bovis
NGNK

SEQ ID NO: 181369 - protein, 7 aa, Mycobacterium bovis
NGNPAPV

SEQ ID NO: 181370 - protein, 9 aa, Mycobacterium bovis
NGPDESGVR

SEQ ID NO: 181371 - protein, 9 aa, Mycobacterium bovis
NGPGDPATA

SEQ ID NO: 181372 - protein, 14 aa, Mycobacterium bovis
NGPIKGTSNFGVFR

SEQ ID NO: 181373 - protein, 21 aa, Mycobacterium bovis
NGPPASPAPPAAAPAGPLPAY

SEQ ID NO: 181374 - protein, 37 aa, Mycobacterium bovis
NGPRRSRAIGPSAATPNRSSRPGSGTRRGTAGLRVEK

SEQ ID NO: 181375 - protein, 7 aa, Mycobacterium bovis
NGPTETT

SEQ ID NO: 181376 - protein, 6 aa, Mycobacterium bovis
NGQAGV

SEQ ID NO: 181377 - protein, 5 aa, Mycobacterium bovis
NGQPA

SEQ ID NO: 181378 - protein, 7 aa, Mycobacterium bovis
NGQPCRP

SEQ ID NO: 181379 - protein, 7 aa, Mycobacterium bovis
NGQQRLK

SEQ ID NO: 181380 - protein, 10 aa, Mycobacterium bovis
NGQSTSESRA

SEQ ID NO: 181381 - protein, 5 aa, Mycobacterium bovis
NGQTG

SEQ ID NO: 181382 - protein, 9 aa, Mycobacterium bovis
NGRDSAAQR

SEQ ID NO: 181383 - protein, 7 aa, Mycobacterium bovis
NGRGGPQ

SEQ ID NO: 181384 - protein, 4 aa, Mycobacterium bovis
NGRI

SEQ ID NO: 181385 - protein, 17 aa, Mycobacterium bovis
NGRRGRPVTGPGNRPLK

SEQ ID NO: 181386 - protein, 8 aa, Mycobacterium bovis
NGRRSAES

SEQ ID NO: 181387 - protein, 10 aa, Mycobacterium bovis
NGRSYAPTIG

SEQ ID NO: 181388 - protein, 11 aa, Mycobacterium bovis
NGRSYDPTAGA

SEQ ID NO: 181389 - protein, 11 aa, Mycobacterium bovis
NGRTAAPSTEA

SEQ ID NO: 181390 - protein, 9 aa, Mycobacterium bovis
NGRTISAGP

SEQ ID NO: 181391 - protein, 16 aa, Mycobacterium bovis
NGSEAGPARDAEPNVT

SEQ ID NO: 181392 - protein, 13 aa, Mycobacterium bovis
NGSFRATDEAETV

SEQ ID NO: 181393 - protein, 8 aa, Mycobacterium bovis
NGSIGEGG

SEQ ID NO: 181394 - protein, 4 aa, Mycobacterium bovis
NGSL

SEQ ID NO: 181395 - protein, 5 aa, Mycobacterium bovis
NGSNE

SEQ ID NO: 181396 - protein, 13 aa, Mycobacterium bovis
NGSPDSPHDPHSK

SEQ ID NO: 181397 - protein, 9 aa, Mycobacterium bovis
NGSPSWSAA

SEQ ID NO: 181398 - protein, 8 aa, Mycobacterium bovis
NGSQIPRE

SEQ ID NO: 181399 - protein, 9 aa, Mycobacterium bovis
NGSYADYPS

SEQ ID NO: 181400 - protein, 14 aa, Mycobacterium bovis
NGTAPSASSGGVDR

SEQ ID NO: 181401 - protein, 5 aa, Mycobacterium bovis
NGTAT

SEQ ID NO: 181402 - protein, 8 aa, Mycobacterium bovis
NGTDRRKR

SEQ ID NO: 181403 - protein, 5 aa, Mycobacterium bovis
NGTGQ

SEQ ID NO: 181404 - protein, 4 aa, Mycobacterium bovis
NGTM

SEQ ID NO: 181405 - protein, 8 aa, Mycobacterium bovis
NGTPPPEV

SEQ ID NO: 181406 - protein, 6 aa, Mycobacterium bovis
NGTRID

SEQ ID NO: 181407 - protein, 6 aa, Mycobacterium bovis
NGTRRT

SEQ ID NO: 181408 - protein, 5 aa, Mycobacterium bovis
NGTTT

SEQ ID NO: 181409 - protein, 9 aa, Mycobacterium bovis
NGVAPPDTT

SEQ ID NO: 181410 - protein, 14 aa, Mycobacterium bovis
NGVGGLGGQGGQGA

SEQ ID NO: 181411 - protein, 12 aa, Mycobacterium bovis
NGVNGGAGSAVS

SEQ ID NO: 181412 - protein, 16 aa, Mycobacterium bovis
NGVTGTAAAPNGGPGG

SEQ ID NO: 181413 - protein, 10 aa, Mycobacterium bovis
NGWATTPITE

SEQ ID NO: 181414 - protein, 6 aa, Mycobacterium bovis
NGWEIP

SEQ ID NO: 181415 - protein, 10 aa, Mycobacterium bovis
NHDPLDASSV

SEQ ID NO: 181416 - protein, 7 aa, Mycobacterium bovis
NHEPRRN

SEQ ID NO: 181417 - protein, 19 aa, Mycobacterium bovis
NHESAGKRHHGARRKGNQH

SEQ ID NO: 181418 - protein, 19 aa, Mycobacterium bovis
NHESAGKRHHGARRTGNQH

SEQ ID NO: 181419 - protein, 7 aa, Mycobacterium bovis
NHHSAGM

SEQ ID NO: 181420 - protein, 8 aa, Mycobacterium bovis
NHHSAGSF

SEQ ID NO: 181421 - protein, 14 aa, Mycobacterium bovis
NHLAGPPDDPRIPD

SEQ ID NO: 181422 - protein, 15 aa, Mycobacterium bovis
NHNQGNEDPTAGGRY

SEQ ID NO: 181423 - protein, 6 aa, Mycobacterium bovis
NHRGGT

SEQ ID NO: 181424 - protein, 10 aa, Mycobacterium bovis
NHRGHGTELG

SEQ ID NO: 181425 - protein, 8 aa, Mycobacterium bovis
NHRYRGNN

SEQ ID NO: 181426 - protein, 6 aa, Mycobacterium bovis
NHTSSA

SEQ ID NO: 181427 - protein, 6 aa, Mycobacterium bovis
NHYPDD

SEQ ID NO: 181428 - protein, 6 aa, Mycobacterium bovis
NHYPED

SEQ ID NO: 181429 - protein, 6 aa, Mycobacterium bovis
NHYPQD

SEQ ID NO: 181430 - protein, 12 aa, Mycobacterium bovis
NIAGGDETLPYT

SEQ ID NO: 181431 - protein, 17 aa, Mycobacterium bovis
NIAQDGKGYASGTQLGE

SEQ ID NO: 181432 - protein, 10 aa, Mycobacterium bovis
NIATADPTAT

SEQ ID NO: 181433 - protein, 4 aa, Mycobacterium bovis
NIDG

SEQ ID NO: 181434 - protein, 6 aa, Mycobacterium bovis
NIDQRR

SEQ ID NO: 181435 - protein, 8 aa, Mycobacterium bovis
NIENQSSG

SEQ ID NO: 181436 - protein, 12 aa, Mycobacterium bovis
NIGHAQAAAGGL

SEQ ID NO: 181437 - protein, 11 aa, Mycobacterium bovis
NIGHTSAAAGV

SEQ ID NO: 181438 - protein, 4 aa, Mycobacterium bovis
NIGN

SEQ ID NO: 181439 - protein, 13 aa, Mycobacterium bovis
NIGNSAVTSSIAE

SEQ ID NO: 181440 - protein, 11 aa, Mycobacterium bovis
NIGPTAKAVSG

SEQ ID NO: 181441 - protein, 5 aa, Mycobacterium bovis
NIGST

SEQ ID NO: 181442 - protein, 7 aa, Mycobacterium bovis
NIKTGDG

SEQ ID NO: 181443 - protein, 4 aa, Mycobacterium bovis
NING

SEQ ID NO: 181444 - protein, 5 aa, Mycobacterium bovis
NIPDE

SEQ ID NO: 181445 - protein, 5 aa, Mycobacterium bovis
NIPQE

SEQ ID NO: 181446 - protein, 5 aa, Mycobacterium bovis
NIRRN

SEQ ID NO: 181447 - protein, 4 aa, Mycobacterium bovis
NISG

SEQ ID NO: 181448 - protein, 17 aa, Mycobacterium bovis
NISGAGWSGQAEATSLD

SEQ ID NO: 181449 - protein, 5 aa, Mycobacterium bovis
NITTA

SEQ ID NO: 181450 - protein, 6 aa, Mycobacterium bovis
NKAGRW

SEQ ID NO: 181451 - protein, 7 aa, Mycobacterium bovis
NKAPGGV

SEQ ID NO: 181452 - protein, 6 aa, Mycobacterium bovis
NKASTN

SEQ ID NO: 181453 - protein, 11 aa, Mycobacterium bovis
NKENPVDRASA

SEQ ID NO: 181454 - protein, 7 aa, Mycobacterium bovis
NKERGPI

SEQ ID NO: 181455 - protein, 4 aa, Mycobacterium bovis
NKEV

SEQ ID NO: 181456 - protein, 10 aa, Mycobacterium bovis
NKGRTVDTPY

SEQ ID NO: 181457 - protein, 11 aa, Mycobacterium bovis
NKHRRRRAAQV

SEQ ID NO: 181458 - protein, 10 aa, Mycobacterium bovis
NKIEPQAPVD

SEQ ID NO: 181459 - protein, 6 aa, Mycobacterium bovis
NKPADH

SEQ ID NO: 181460 - protein, 9 aa, Mycobacterium bovis
NKPDETRHT

SEQ ID NO: 181461 - protein, 8 aa, Mycobacterium bovis
NKPSNSDV

SEQ ID NO: 181462 - protein, 4 aa, Mycobacterium bovis
NKRS

SEQ ID NO: 181463 - protein, 10 aa, Mycobacterium bovis
NKTAGDAEKL

SEQ ID NO: 181464 - protein, 9 aa, Mycobacterium bovis
NKTAGQAAV

SEQ ID NO: 181465 - protein, 23 aa, Mycobacterium bovis
NKTGYHKRQGHRQQLTVLKVTGI

SEQ ID NO: 181466 - protein, 6 aa, Mycobacterium bovis
NKVPGA

SEQ ID NO: 181467 - protein, 6 aa, Mycobacterium bovis
NKVPNA

SEQ ID NO: 181468 - protein, 7 aa, Mycobacterium bovis
NLDDPDA

SEQ ID NO: 181469 - protein, 4 aa, Mycobacterium bovis
NLDP

SEQ ID NO: 181470 - protein, 6 aa, Mycobacterium bovis
NLDPPW

SEQ ID NO: 181471 - protein, 5 aa, Mycobacterium bovis
NLGDA

SEQ ID NO: 181472 - protein, 21 aa, Mycobacterium bovis
NLGGGNTGDLNPGSGNTGTLN

SEQ ID NO: 181473 - protein, 58 aa, Mycobacterium bovis
NLGGGNTGEYNLGSGNSGNANVGSGNSGNANVGSGNDGATNLGSGNIGNTNLGSGNVG

SEQ ID NO: 181474 - protein, 5 aa, Mycobacterium bovis
NLGNT

SEQ ID NO: 181475 - protein, 11 aa, Mycobacterium bovis
NLGSGNRGFGN

SEQ ID NO: 181476 - protein, 7 aa, Mycobacterium bovis
NLGSGNV

SEQ ID NO: 181477 - protein, 4 aa, Mycobacterium bovis
NLKD

SEQ ID NO: 181478 - protein, 12 aa, Mycobacterium bovis
NLNPSQAHGSGD

SEQ ID NO: 181479 - protein, 6 aa, Mycobacterium bovis
NLPADT

SEQ ID NO: 181480 - protein, 13 aa, Mycobacterium bovis
NLPATGRSMTSAP

SEQ ID NO: 181481 - protein, 7 aa, Mycobacterium bovis
NLPDNTS

SEQ ID NO: 181482 - protein, 13 aa, Mycobacterium bovis
NLPDTAKRRYHPD

SEQ ID NO: 181483 - protein, 5 aa, Mycobacterium bovis
NLPEA

SEQ ID NO: 181484 - protein, 7 aa, Mycobacterium bovis
NLPFPDE

SEQ ID NO: 181485 - protein, 5 aa, Mycobacterium bovis
NLPPP

SEQ ID NO: 181486 - protein, 10 aa, Mycobacterium bovis
NLPSRRENDQ

SEQ ID NO: 181487 - protein, 9 aa, Mycobacterium bovis
NLPTPSGNT

SEQ ID NO: 181488 - protein, 7 aa, Mycobacterium bovis
NLPTSGG

SEQ ID NO: 181489 - protein, 8 aa, Mycobacterium bovis
NLQRDPDE

SEQ ID NO: 181490 - protein, 6 aa, Mycobacterium bovis
NLRKGA

SEQ ID NO: 181491 - protein, 8 aa, Mycobacterium bovis
NLRPNSSV

SEQ ID NO: 181492 - protein, 10 aa, Mycobacterium bovis
NLSGGGNVGA

SEQ ID NO: 181493 - protein, 4 aa, Mycobacterium bovis
NLSR

SEQ ID NO: 181494 - protein, 5 aa, Mycobacterium bovis
NLTAA

SEQ ID NO: 181495 - protein, 6 aa, Mycobacterium bovis
NLTAQR

SEQ ID NO: 181496 - protein, 8 aa, Mycobacterium bovis
NLTPGPRA

SEQ ID NO: 181497 - protein, 10 aa, Mycobacterium bovis
NMGHTQAAAG

SEQ ID NO: 181498 - protein, 4 aa, Mycobacterium bovis
NMPD

SEQ ID NO: 181499 - protein, 4 aa, Mycobacterium bovis
NNAE

SEQ ID NO: 181500 - protein, 24 aa, Mycobacterium bovis
NNANRYTNYQSRTSRPIPVVVLTR

SEQ ID NO: 181501 - protein, 6 aa, Mycobacterium bovis
NNDGTL

SEQ ID NO: 181502 - protein, 9 aa, Mycobacterium bovis
NNDLRRGGT

SEQ ID NO: 181503 - protein, 8 aa, Mycobacterium bovis
NNDPRTSN

SEQ ID NO: 181504 - protein, 4 aa, Mycobacterium bovis
NNER

SEQ ID NO: 181505 - protein, 4 aa, Mycobacterium bovis
NNFG

SEQ ID NO: 181506 - protein, 5 aa, Mycobacterium bovis
NNFTG

SEQ ID NO: 181507 - protein, 7 aa, Mycobacterium bovis
NNGLTAS

SEQ ID NO: 181508 - protein, 7 aa, Mycobacterium bovis
NNGTDTV

SEQ ID NO: 181509 - protein, 56 aa, Mycobacterium bovis
NNIGGTGGAGGNGGPAILSGNGGNGGAGGAGGAGGAGGGAGGVGGAGGAPGTGGTL

SEQ ID NO: 181510 - protein, 7 aa, Mycobacterium bovis
NNLHSRG

SEQ ID NO: 181511 - protein, 14 aa, Mycobacterium bovis
NNNIGMGNSGNGVG

SEQ ID NO: 181512 - protein, 7 aa, Mycobacterium bovis
NNNNGHE

SEQ ID NO: 181513 - protein, 9 aa, Mycobacterium bovis
NNPAKRVGL

SEQ ID NO: 181514 - protein, 8 aa, Mycobacterium bovis
NNPDRQAD

SEQ ID NO: 181515 - protein, 6 aa, Mycobacterium bovis
NNPLGT

SEQ ID NO: 181516 - protein, 7 aa, Mycobacterium bovis
NNPLSGL

SEQ ID NO: 181517 - protein, 7 aa, Mycobacterium bovis
NNPNGGV

SEQ ID NO: 181518 - protein, 9 aa, Mycobacterium bovis
NNPVAQYTP

SEQ ID NO: 181519 - protein, 14 aa, Mycobacterium bovis
NNPYGSRPSTIYPD

SEQ ID NO: 181520 - protein, 5 aa, Mycobacterium bovis
NNQVG

SEQ ID NO: 181521 - protein, 20 aa, Mycobacterium bovis
NNRARLSSPMRRRADGTYEE

SEQ ID NO: 181522 - protein, 7 aa, Mycobacterium bovis
NNRETGE

SEQ ID NO: 181523 - protein, 9 aa, Mycobacterium bovis
NNRGKKSVT

SEQ ID NO: 181524 - protein, 5 aa, Mycobacterium bovis
NNRPR

SEQ ID NO: 181525 - protein, 5 aa, Mycobacterium bovis
NNRVR

SEQ ID NO: 181526 - protein, 12 aa, Mycobacterium bovis
NNSASTVSGSLS

SEQ ID NO: 181527 - protein, 7 aa, Mycobacterium bovis
NNSSRSL

SEQ ID NO: 181528 - protein, 11 aa, Mycobacterium bovis
NNSTDDTATVA

SEQ ID NO: 181529 - protein, 6 aa, Mycobacterium bovis
NNTATA

SEQ ID NO: 181530 - protein, 8 aa, Mycobacterium bovis
NNTGEIKS

SEQ ID NO: 181531 - protein, 5 aa, Mycobacterium bovis
NNTRE

SEQ ID NO: 181532 - protein, 8 aa, Mycobacterium bovis
NNTRSARY

SEQ ID NO: 181533 - protein, 7 aa, Mycobacterium bovis
NNVEEGR

SEQ ID NO: 181534 - protein, 35 aa, Mycobacterium bovis
NPAAGSADPGGKADGGVRQKPGPGARHPSDAGTRR

SEQ ID NO: 181535 - protein, 10 aa, Mycobacterium bovis
NPADRNVPEI

SEQ ID NO: 181536 - protein, 6 aa, Mycobacterium bovis
NPAGAE

SEQ ID NO: 181537 - protein, 5 aa, Mycobacterium bovis
NPAGW

SEQ ID NO: 181538 - protein, 7 aa, Mycobacterium bovis
NPANGEP

SEQ ID NO: 181539 - protein, 4 aa, Mycobacterium bovis
NPAP

SEQ ID NO: 181540 - protein, 6 aa, Mycobacterium bovis
NPAPFG

SEQ ID NO: 181541 - protein, 6 aa, Mycobacterium bovis
NPAPYT

SEQ ID NO: 181542 - protein, 14 aa, Mycobacterium bovis
NPASHQDDSHSTGL

SEQ ID NO: 181543 - protein, 10 aa, Mycobacterium bovis
NPATDAQRES

SEQ ID NO: 181544 - protein, 11 aa, Mycobacterium bovis
NPDCAAEGRPV

SEQ ID NO: 181545 - protein, 6 aa, Mycobacterium bovis
NPDENS

SEQ ID NO: 181546 - protein, 12 aa, Mycobacterium bovis
NPDETWRHHRRN

SEQ ID NO: 181547 - protein, 14 aa, Mycobacterium bovis
NPDGNYNDTDRARR

SEQ ID NO: 181548 - protein, 6 aa, Mycobacterium bovis
NPDKLA

SEQ ID NO: 181549 - protein, 5 aa, Mycobacterium bovis
NPDMA

SEQ ID NO: 181550 - protein, 5 aa, Mycobacterium bovis
NPDPA

SEQ ID NO: 181551 - protein, 9 aa, Mycobacterium bovis
NPDPDAAGA

SEQ ID NO: 181552 - protein, 9 aa, Mycobacterium bovis
NPDPRTTSR

SEQ ID NO: 181553 - protein, 4 aa, Mycobacterium bovis
NPDR

SEQ ID NO: 181554 - protein, 10 aa, Mycobacterium bovis
NPDRRHGAER

SEQ ID NO: 181555 - protein, 8 aa, Mycobacterium bovis
NPEEGELR

SEQ ID NO: 181556 - protein, 6 aa, Mycobacterium bovis
NPERTA

SEQ ID NO: 181557 - protein, 9 aa, Mycobacterium bovis
NPGAAAHSQ

SEQ ID NO: 181558 - protein, 9 aa, Mycobacterium bovis
NPGANYART

SEQ ID NO: 181559 - protein, 7 aa, Mycobacterium bovis
NPGARED

SEQ ID NO: 181560 - protein, 6 aa, Mycobacterium bovis
NPGDAV

SEQ ID NO: 181561 - protein, 4 aa, Mycobacterium bovis
NPGF

SEQ ID NO: 181562 - protein, 17 aa, Mycobacterium bovis
NPGLATPVTPAANGGNG

SEQ ID NO: 181563 - protein, 4 aa, Mycobacterium bovis
NPGN

SEQ ID NO: 181564 - protein, 18 aa, Mycobacterium bovis
NPGPSNTGTFNTGGANTG

SEQ ID NO: 181565 - protein, 8 aa, Mycobacterium bovis
NPGTGGTL

SEQ ID NO: 181566 - protein, 5 aa, Mycobacterium bovis
NPGTS

SEQ ID NO: 181567 - protein, 12 aa, Mycobacterium bovis
NPHRPRPSDPDG

SEQ ID NO: 181568 - protein, 7 aa, Mycobacterium bovis
NPHTKPP

SEQ ID NO: 181569 - protein, 22 aa, Mycobacterium bovis
NPIASNATPEGRAKNRRVEIVV

SEQ ID NO: 181570 - protein, 4 aa, Mycobacterium bovis
NPIE

SEQ ID NO: 181571 - protein, 5 aa, Mycobacterium bovis
NPIEY

SEQ ID NO: 181572 - protein, 5 aa, Mycobacterium bovis
NPIGA

SEQ ID NO: 181573 - protein, 7 aa, Mycobacterium bovis
NPKGKYQ

SEQ ID NO: 181574 - protein, 6 aa, Mycobacterium bovis
NPKHEY

SEQ ID NO: 181575 - protein, 7 aa, Mycobacterium bovis
NPKHPPL

SEQ ID NO: 181576 - protein, 6 aa, Mycobacterium bovis
NPKRGI

SEQ ID NO: 181577 - protein, 4 aa, Mycobacterium bovis
NPKV

SEQ ID NO: 181578 - protein, 5 aa, Mycobacterium bovis
NPKVQ

SEQ ID NO: 181579 - protein, 5 aa, Mycobacterium bovis
NPLAG

SEQ ID NO: 181580 - protein, 8 aa, Mycobacterium bovis
NPLESGEL

SEQ ID NO: 181581 - protein, 6 aa, Mycobacterium bovis
NPLNDS

SEQ ID NO: 181582 - protein, 8 aa, Mycobacterium bovis
NPLPGRPA

SEQ ID NO: 181583 - protein, 17 aa, Mycobacterium bovis
NPLSDDTLSALSLPGVF

SEQ ID NO: 181584 - protein, 21 aa, Mycobacterium bovis
NPNALSNDSGTSSLAHGSTGQ

SEQ ID NO: 181585 - protein, 8 aa, Mycobacterium bovis
NPNITPNT

SEQ ID NO: 181586 - protein, 10 aa, Mycobacterium bovis
NPNNPNGGVA

SEQ ID NO: 181587 - protein, 7 aa, Mycobacterium bovis
NPNVTGS

SEQ ID NO: 181588 - protein, 13 aa, Mycobacterium bovis
NPPAPMAPGRAEN

SEQ ID NO: 181589 - protein, 6 aa, Mycobacterium bovis
NPPERL

SEQ ID NO: 181590 - protein, 13 aa, Mycobacterium bovis
NPPGTQRRGPRAL

SEQ ID NO: 181591 - protein, 6 aa, Mycobacterium bovis
NPPRTV

SEQ ID NO: 181592 - protein, 7 aa, Mycobacterium bovis
NPQGSVS

SEQ ID NO: 181593 - protein, 5 aa, Mycobacterium bovis
NPQLA

SEQ ID NO: 181594 - protein, 6 aa, Mycobacterium bovis
NPQLPT

SEQ ID NO: 181595 - protein, 8 aa, Mycobacterium bovis
NPQQTEAT

SEQ ID NO: 181596 - protein, 4 aa, Mycobacterium bovis
NPQR

SEQ ID NO: 181597 - protein, 5 aa, Mycobacterium bovis
NPQRV

SEQ ID NO: 181598 - protein, 15 aa, Mycobacterium bovis
NPRARDADTPSPAAS

SEQ ID NO: 181599 - protein, 7 aa, Mycobacterium bovis
NPRASRT

SEQ ID NO: 181600 - protein, 5 aa, Mycobacterium bovis
NPRLT

SEQ ID NO: 181601 - protein, 6 aa, Mycobacterium bovis
NPRPED

SEQ ID NO: 181602 - protein, 11 aa, Mycobacterium bovis
NPRPTNPEGKM

SEQ ID NO: 181603 - protein, 11 aa, Mycobacterium bovis
NPRQCTPRTPA

SEQ ID NO: 181604 - protein, 14 aa, Mycobacterium bovis
NPRRLTKAEAAPYV

SEQ ID NO: 181605 - protein, 15 aa, Mycobacterium bovis
NPRSYVGAESDPNAA

SEQ ID NO: 181606 - protein, 11 aa, Mycobacterium bovis
NPRTSEDGTAF

SEQ ID NO: 181607 - protein, 6 aa, Mycobacterium bovis
NPSAND

SEQ ID NO: 181608 - protein, 9 aa, Mycobacterium bovis
NPSARAEDD

SEQ ID NO: 181609 - protein, 8 aa, Mycobacterium bovis
NPSDWPEG

SEQ ID NO: 181610 - protein, 9 aa, Mycobacterium bovis
NPSEALTAS

SEQ ID NO: 181611 - protein, 8 aa, Mycobacterium bovis
NPSGTRKD

SEQ ID NO: 181612 - protein, 6 aa, Mycobacterium bovis
NPSGVT

SEQ ID NO: 181613 - protein, 9 aa, Mycobacterium bovis
NPSIAADPA

SEQ ID NO: 181614 - protein, 8 aa, Mycobacterium bovis
NPSNDAAA

SEQ ID NO: 181615 - protein, 4 aa, Mycobacterium bovis
NPSP

SEQ ID NO: 181616 - protein, 5 aa, Mycobacterium bovis
NPSPE

SEQ ID NO: 181617 - protein, 5 aa, Mycobacterium bovis
NPSRL

SEQ ID NO: 181618 - protein, 6 aa, Mycobacterium bovis
NPSRSL

SEQ ID NO: 181619 - protein, 8 aa, Mycobacterium bovis
NPSSPVSL

SEQ ID NO: 181620 - protein, 12 aa, Mycobacterium bovis
NPSVPDDEVTPE

SEQ ID NO: 181621 - protein, 5 aa, Mycobacterium bovis
NPTDL

SEQ ID NO: 181622 - protein, 8 aa, Mycobacterium bovis
NPTELSEE

SEQ ID NO: 181623 - protein, 9 aa, Mycobacterium bovis
NPTGDTAPF

SEQ ID NO: 181624 - protein, 7 aa, Mycobacterium bovis
NPTLGGT

SEQ ID NO: 181625 - protein, 7 aa, Mycobacterium bovis
NPTNPTS

SEQ ID NO: 181626 - protein, 17 aa, Mycobacterium bovis
NPTPGSDWDASPKPVER

SEQ ID NO: 181627 - protein, 8 aa, Mycobacterium bovis
NPTPVTGQ

SEQ ID NO: 181628 - protein, 15 aa, Mycobacterium bovis
NPTQLDPAGRTSDAV

SEQ ID NO: 181629 - protein, 5 aa, Mycobacterium bovis
NPTSI

SEQ ID NO: 181630 - protein, 11 aa, Mycobacterium bovis
NPTTSPFGNPI

SEQ ID NO: 181631 - protein, 4 aa, Mycobacterium bovis
NPVG

SEQ ID NO: 181632 - protein, 5 aa, Mycobacterium bovis
NQAAH

SEQ ID NO: 181633 - protein, 16 aa, Mycobacterium bovis
NQAANKKSALAQALNK

SEQ ID NO: 181634 - protein, 6 aa, Mycobacterium bovis
NQDNAY

SEQ ID NO: 181635 - protein, 8 aa, Mycobacterium bovis
NQGGLNAG

SEQ ID NO: 181636 - protein, 8 aa, Mycobacterium bovis
NQGLGGTA

SEQ ID NO: 181637 - protein, 6 aa, Mycobacterium bovis
NQGNHE

SEQ ID NO: 181638 - protein, 8 aa, Mycobacterium bovis
NQGPDGMS

SEQ ID NO: 181639 - protein, 7 aa, Mycobacterium bovis
NQGSNTV

SEQ ID NO: 181640 - protein, 18 aa, Mycobacterium bovis
NQGYQDLRDGKNIRGVIV

SEQ ID NO: 181641 - protein, 6 aa, Mycobacterium bovis
NQHADA

SEQ ID NO: 181642 - protein, 5 aa, Mycobacterium bovis
NQHAR

SEQ ID NO: 181643 - protein, 5 aa, Mycobacterium bovis
NQHDE

SEQ ID NO: 181644 - protein, 4 aa, Mycobacterium bovis
NQHG

SEQ ID NO: 181645 - protein, 5 aa, Mycobacterium bovis
NQHGP

SEQ ID NO: 181646 - protein, 7 aa, Mycobacterium bovis
NQLRDNQ

SEQ ID NO: 181647 - protein, 10 aa, Mycobacterium bovis
NQPDATAAAF

SEQ ID NO: 181648 - protein, 5 aa, Mycobacterium bovis
NQPGA

SEQ ID NO: 181649 - protein, 26 aa, Mycobacterium bovis
NQPTPPGPGVTPTDPRPFRAGPHETS

SEQ ID NO: 181650 - protein, 6 aa, Mycobacterium bovis
NQPVQN

SEQ ID NO: 181651 - protein, 4 aa, Mycobacterium bovis
NQQA

SEQ ID NO: 181652 - protein, 13 aa, Mycobacterium bovis
NQQKTPKTKIETA

SEQ ID NO: 181653 - protein, 5 aa, Mycobacterium bovis
NQRET

SEQ ID NO: 181654 - protein, 4 aa, Mycobacterium bovis
NQRR

SEQ ID NO: 181655 - protein, 8 aa, Mycobacterium bovis
NQRYESGA

SEQ ID NO: 181656 - protein, 8 aa, Mycobacterium bovis
NQSDAADR

SEQ ID NO: 181657 - protein, 10 aa, Mycobacterium bovis
NQTEEAGRRR

SEQ ID NO: 181658 - protein, 5 aa, Mycobacterium bovis
NQTGS

SEQ ID NO: 181659 - protein, 8 aa, Mycobacterium bovis
NQTPESAR

SEQ ID NO: 181660 - protein, 8 aa, Mycobacterium bovis
NQTWSTPA

SEQ ID NO: 181661 - protein, 5 aa, Mycobacterium bovis
NQWPG

SEQ ID NO: 181662 - protein, 4 aa, Mycobacterium bovis
NQYA

SEQ ID NO: 181663 - protein, 12 aa, Mycobacterium bovis
NQYPPGPGSAPL

SEQ ID NO: 181664 - protein, 4 aa, Mycobacterium bovis
NRAD

SEQ ID NO: 181665 - protein, 9 aa, Mycobacterium bovis
NRAGPPSMA

SEQ ID NO: 181666 - protein, 6 aa, Mycobacterium bovis
NRAGSA

SEQ ID NO: 181667 - protein, 9 aa, Mycobacterium bovis
NRANPIDGK

SEQ ID NO: 181668 - protein, 7 aa, Mycobacterium bovis
NRANVGG

SEQ ID NO: 181669 - protein, 7 aa, Mycobacterium bovis
NRAPAKV

SEQ ID NO: 181670 - protein, 6 aa, Mycobacterium bovis
NRAPGV

SEQ ID NO: 181671 - protein, 8 aa, Mycobacterium bovis
NRARELRE

SEQ ID NO: 181672 - protein, 10 aa, Mycobacterium bovis
NRDDLPEQYR

SEQ ID NO: 181673 - protein, 7 aa, Mycobacterium bovis
NRDESKF

SEQ ID NO: 181674 - protein, 11 aa, Mycobacterium bovis
NRDGKPVTSAA

SEQ ID NO: 181675 - protein, 10 aa, Mycobacterium bovis
NRDGRHTTTE

SEQ ID NO: 181676 - protein, 5 aa, Mycobacterium bovis
NRDKR

SEQ ID NO: 181677 - protein, 8 aa, Mycobacterium bovis
NRDLARGQ

SEQ ID NO: 181678 - protein, 10 aa, Mycobacterium bovis
NRDPAQFEAP

SEQ ID NO: 181679 - protein, 6 aa, Mycobacterium bovis
NRDPAV

SEQ ID NO: 181680 - protein, 5 aa, Mycobacterium bovis
NREDM

SEQ ID NO: 181681 - protein, 7 aa, Mycobacterium bovis
NREEPRK

SEQ ID NO: 181682 - protein, 17 aa, Mycobacterium bovis
NRENGEHPINDSAEVQR

SEQ ID NO: 181683 - protein, 5 aa, Mycobacterium bovis
NREPV

SEQ ID NO: 181684 - protein, 12 aa, Mycobacterium bovis
NRGPEQRTDKKP

SEQ ID NO: 181685 - protein, 7 aa, Mycobacterium bovis
NRGPGGK

SEQ ID NO: 181686 - protein, 6 aa, Mycobacterium bovis
NRGRAG

SEQ ID NO: 181687 - protein, 4 aa, Mycobacterium bovis
NRGS

SEQ ID NO: 181688 - protein, 5 aa, Mycobacterium bovis
NRISG

SEQ ID NO: 181689 - protein, 7 aa, Mycobacterium bovis
NRKARHN

SEQ ID NO: 181690 - protein, 4 aa, Mycobacterium bovis
NRKN

SEQ ID NO: 181691 - protein, 7 aa, Mycobacterium bovis
NRKPPPR

SEQ ID NO: 181692 - protein, 6 aa, Mycobacterium bovis
NRLGTN

SEQ ID NO: 181693 - protein, 8 aa, Mycobacterium bovis
NRNFEGRI

SEQ ID NO: 181694 - protein, 8 aa, Mycobacterium bovis
NRNRAASE

SEQ ID NO: 181695 - protein, 5 aa, Mycobacterium bovis
NRPDL

SEQ ID NO: 181696 - protein, 10 aa, Mycobacterium bovis
NRPDSPVANE

SEQ ID NO: 181697 - protein, 8 aa, Mycobacterium bovis
NRPEKGNA

SEQ ID NO: 181698 - protein, 5 aa, Mycobacterium bovis
NRPNH

SEQ ID NO: 181699 - protein, 9 aa, Mycobacterium bovis
NRPPTQDTV

SEQ ID NO: 181700 - protein, 9 aa, Mycobacterium bovis
NRPQSRNAL

SEQ ID NO: 181701 - protein, 5 aa, Mycobacterium bovis
NRPRR

SEQ ID NO: 181702 - protein, 9 aa, Mycobacterium bovis
NRQSELPSR

SEQ ID NO: 181703 - protein, 5 aa, Mycobacterium bovis
NRRHH

SEQ ID NO: 181704 - protein, 7 aa, Mycobacterium bovis
NRRRAPG

SEQ ID NO: 181705 - protein, 5 aa, Mycobacterium bovis
NRRRF

SEQ ID NO: 181706 - protein, 5 aa, Mycobacterium bovis
NRSAE

SEQ ID NO: 181707 - protein, 6 aa, Mycobacterium bovis
NRSIGA

SEQ ID NO: 181708 - protein, 8 aa, Mycobacterium bovis
NRSNGGIR

SEQ ID NO: 181709 - protein, 16 aa, Mycobacterium bovis
NRSQQSGRRQPDSLSD

SEQ ID NO: 181710 - protein, 9 aa, Mycobacterium bovis
NRSSGKQGY

SEQ ID NO: 181711 - protein, 7 aa, Mycobacterium bovis
NRSSLPA

SEQ ID NO: 181712 - protein, 17 aa, Mycobacterium bovis
NRSVPDGVAAGSPEERA

SEQ ID NO: 181713 - protein, 5 aa, Mycobacterium bovis
NRTDR

SEQ ID NO: 181714 - protein, 7 aa, Mycobacterium bovis
NRTGPSV

SEQ ID NO: 181715 - protein, 5 aa, Mycobacterium bovis
NRTGT

SEQ ID NO: 181716 - protein, 8 aa, Mycobacterium bovis
NRTQAERA

SEQ ID NO: 181717 - protein, 4 aa, Mycobacterium bovis
NRVP

SEQ ID NO: 181718 - protein, 6 aa, Mycobacterium bovis
NRYDGR

SEQ ID NO: 181719 - protein, 12 aa, Mycobacterium bovis
NRYESGDRDPDQ

SEQ ID NO: 181720 - protein, 8 aa, Mycobacterium bovis
NSAAPGNI

SEQ ID NO: 181721 - protein, 10 aa, Mycobacterium bovis
NSAATNEADP

SEQ ID NO: 181722 - protein, 7 aa, Mycobacterium bovis
NSAHPES

SEQ ID NO: 181723 - protein, 10 aa, Mycobacterium bovis
NSAHSDADHQ

SEQ ID NO: 181724 - protein, 7 aa, Mycobacterium bovis
NSATDYD

SEQ ID NO: 181725 - protein, 8 aa, Mycobacterium bovis
NSATKAGI

SEQ ID NO: 181726 - protein, 4 aa, Mycobacterium bovis
NSAV

SEQ ID NO: 181727 - protein, 5 aa, Mycobacterium bovis
NSDGG

SEQ ID NO: 181728 - protein, 18 aa, Mycobacterium bovis
NSDGLSDGLTAPSGDAQT

SEQ ID NO: 181729 - protein, 5 aa, Mycobacterium bovis
NSDLR

SEQ ID NO: 181730 - protein, 7 aa, Mycobacterium bovis
NSDPYGA

SEQ ID NO: 181731 - protein, 4 aa, Mycobacterium bovis
NSDQ

SEQ ID NO: 181732 - protein, 6 aa, Mycobacterium bovis
NSEGRY

SEQ ID NO: 181733 - protein, 10 aa, Mycobacterium bovis
NSEGSRTTPS

SEQ ID NO: 181734 - protein, 15 aa, Mycobacterium bovis
NSENRRAMNPWTDPS

SEQ ID NO: 181735 - protein, 5 aa, Mycobacterium bovis
NSENS

SEQ ID NO: 181736 - protein, 9 aa, Mycobacterium bovis
NSESAEKAA

SEQ ID NO: 181737 - protein, 19 aa, Mycobacterium bovis
NSFPSSDRSASKCGTERGL

SEQ ID NO: 181738 - protein, 10 aa, Mycobacterium bovis
NSGANNSGFF

SEQ ID NO: 181739 - protein, 5 aa, Mycobacterium bovis
NSGAP

SEQ ID NO: 181740 - protein, 35 aa, Mycobacterium bovis
NSGDGGAAGNGAGISQNGPASGFGGNGGHAGTTGL

SEQ ID NO: 181741 - protein, 58 aa, Mycobacterium bovis
NSGDGNTGGFNPGNFNTGNFNTGSFNTGGFNAGNTNTGHFNTGNYNTGIANTGDVSTG

SEQ ID NO: 181742 - protein, 17 aa, Mycobacterium bovis
NSGDGSASGFGNVGPGI

SEQ ID NO: 181743 - protein, 9 aa, Mycobacterium bovis
NSGEGWDGR

SEQ ID NO: 181744 - protein, 19 aa, Mycobacterium bovis
NSGGFNTGIGNAGSTNTGV

SEQ ID NO: 181745 - protein, 7 aa, Mycobacterium bovis
NSGGGSL

SEQ ID NO: 181746 - protein, 12 aa, Mycobacterium bovis
NSGGKTAEAAAH

SEQ ID NO: 181747 - protein, 5 aa, Mycobacterium bovis
NSGHP

SEQ ID NO: 181748 - protein, 10 aa, Mycobacterium bovis
NSGINPDDLA

SEQ ID NO: 181749 - protein, 9 aa, Mycobacterium bovis
NSGLANVGN

SEQ ID NO: 181750 - protein, 26 aa, Mycobacterium bovis
NSGLTAGAAGLGNTGFGNAGSANYGF

SEQ ID NO: 181751 - protein, 6 aa, Mycobacterium bovis
NSGLTP

SEQ ID NO: 181752 - protein, 7 aa, Mycobacterium bovis
NSGLTPG

SEQ ID NO: 181753 - protein, 49 aa, Mycobacterium bovis
NSGNSGSGFQNLGNGSSGFGNASDTSSGFQNAGTALTRASSTWADSPRA

SEQ ID NO: 181754 - protein, 6 aa, Mycobacterium bovis
NSGNTV

SEQ ID NO: 181755 - protein, 17 aa, Mycobacterium bovis
NSGNYNTGLANSGNVNT

SEQ ID NO: 181756 - protein, 6 aa, Mycobacterium bovis
NSGPGS

SEQ ID NO: 181757 - protein, 9 aa, Mycobacterium bovis
NSGPLPEEI

SEQ ID NO: 181758 - protein, 31 aa, Mycobacterium bovis
NSGQLNAGSFNAGSINTGNFNSGQGNTGDFN

SEQ ID NO: 181759 - protein, 19 aa, Mycobacterium bovis
NSGRFNTGIGNSGTASTGL

SEQ ID NO: 181760 - protein, 17 aa, Mycobacterium bovis
NSGSGNIGFGNSGTGNV

SEQ ID NO: 181761 - protein, 16 aa, Mycobacterium bovis
NSGSGNIGIGNSGTNN

SEQ ID NO: 181762 - protein, 16 aa, Mycobacterium bovis
NSGSGNLGFGNSGNGN

SEQ ID NO: 181763 - protein, 12 aa, Mycobacterium bovis
NSGSNDSGLRNT

SEQ ID NO: 181764 - protein, 7 aa, Mycobacterium bovis
NSGSNNI

SEQ ID NO: 181765 - protein, 8 aa, Mycobacterium bovis
NSGSPEDL

SEQ ID NO: 181766 - protein, 10 aa, Mycobacterium bovis
NSGSPTGASA

SEQ ID NO: 181767 - protein, 5 aa, Mycobacterium bovis
NSGTA

SEQ ID NO: 181768 - protein, 19 aa, Mycobacterium bovis
NSGTGGTSGFGNVGSGGSG

SEQ ID NO: 181769 - protein, 21 aa, Mycobacterium bovis
NSGTGGTSGFQNVGGGSSGVW

SEQ ID NO: 181770 - protein, 9 aa, Mycobacterium bovis
NSGTGNTGL

SEQ ID NO: 181771 - protein, 8 aa, Mycobacterium bovis
NSGTGNVG

SEQ ID NO: 181772 - protein, 19 aa, Mycobacterium bovis
NSGTGSSSGFGNVGANNSG

SEQ ID NO: 181773 - protein, 4 aa, Mycobacterium bovis
NSHG

SEQ ID NO: 181774 - protein, 15 aa, Mycobacterium bovis
NSKHNSGGLNWPFTG

SEQ ID NO: 181775 - protein, 6 aa, Mycobacterium bovis
NSLPGQ

SEQ ID NO: 181776 - protein, 9 aa, Mycobacterium bovis
NSPAGDSLA

SEQ ID NO: 181777 - protein, 11 aa, Mycobacterium bovis
NSPESVAPHGQ

SEQ ID NO: 181778 - protein, 12 aa, Mycobacterium bovis
NSPGTIDAGYRG

SEQ ID NO: 181779 - protein, 5 aa, Mycobacterium bovis
NSPRQ

SEQ ID NO: 181780 - protein, 9 aa, Mycobacterium bovis
NSPSERAEN

SEQ ID NO: 181781 - protein, 14 aa, Mycobacterium bovis
NSPWPTAEGPRRAA

SEQ ID NO: 181782 - protein, 7 aa, Mycobacterium bovis
NSQRHGI

SEQ ID NO: 181783 - protein, 9 aa, Mycobacterium bovis
NSQSGKGGV

SEQ ID NO: 181784 - protein, 4 aa, Mycobacterium bovis
NSRD

SEQ ID NO: 181785 - protein, 13 aa, Mycobacterium bovis
NSRDHDGQKGDRE

SEQ ID NO: 181786 - protein, 11 aa, Mycobacterium bovis
NSRPERRDPPT

SEQ ID NO: 181787 - protein, 12 aa, Mycobacterium bovis
NSRPTRAEASDV

SEQ ID NO: 181788 - protein, 7 aa, Mycobacterium bovis
NSRRGQI

SEQ ID NO: 181789 - protein, 9 aa, Mycobacterium bovis
NSRSEAATE

SEQ ID NO: 181790 - protein, 11 aa, Mycobacterium bovis
NSRSGKRDGKR

SEQ ID NO: 181791 - protein, 11 aa, Mycobacterium bovis
NSRSGKREGKT

SEQ ID NO: 181792 - protein, 9 aa, Mycobacterium bovis
NSRSSARVR

SEQ ID NO: 181793 - protein, 6 aa, Mycobacterium bovis
NSRVRA

SEQ ID NO: 181794 - protein, 9 aa, Mycobacterium bovis
NSSATPSSG

SEQ ID NO: 181795 - protein, 8 aa, Mycobacterium bovis
NSSETQSV

SEQ ID NO: 181796 - protein, 6 aa, Mycobacterium bovis
NSSNSR

SEQ ID NO: 181797 - protein, 10 aa, Mycobacterium bovis
NSSTDCRPSH

SEQ ID NO: 181798 - protein, 4 aa, Mycobacterium bovis
NSSV

SEQ ID NO: 181799 - protein, 9 aa, Mycobacterium bovis
NSTAGGAYV

SEQ ID NO: 181800 - protein, 8 aa, Mycobacterium bovis
NSTASIPE

SEQ ID NO: 181801 - protein, 5 aa, Mycobacterium bovis
NSTDR

SEQ ID NO: 181802 - protein, 16 aa, Mycobacterium bovis
NSTGHGRPERGSRTRH

SEQ ID NO: 181803 - protein, 13 aa, Mycobacterium bovis
NSTNGTTVNNAPV

SEQ ID NO: 181804 - protein, 4 aa, Mycobacterium bovis
NSTR

SEQ ID NO: 181805 - protein, 6 aa, Mycobacterium bovis
NSTRGA

SEQ ID NO: 181806 - protein, 6 aa, Mycobacterium bovis
NSTRTR

SEQ ID NO: 181807 - protein, 4 aa, Mycobacterium bovis
NSTV

SEQ ID NO: 181808 - protein, 6 aa, Mycobacterium bovis
NSTWGG

SEQ ID NO: 181809 - protein, 7 aa, Mycobacterium bovis
NSVASGR

SEQ ID NO: 181810 - protein, 5 aa, Mycobacterium bovis
NSVKD

SEQ ID NO: 181811 - protein, 10 aa, Mycobacterium bovis
NSVSSPDDTT

SEQ ID NO: 181812 - protein, 10 aa, Mycobacterium bovis
NTAAAKSSIT

SEQ ID NO: 181813 - protein, 10 aa, Mycobacterium bovis
NTAAQKVRSG

SEQ ID NO: 181814 - protein, 13 aa, Mycobacterium bovis
NTAEQNAANAGKG

SEQ ID NO: 181815 - protein, 13 aa, Mycobacterium bovis
NTAGFNPGSYNTG

SEQ ID NO: 181816 - protein, 8 aa, Mycobacterium bovis
NTAGGDHA

SEQ ID NO: 181817 - protein, 11 aa, Mycobacterium bovis
NTASIAATEAQ

SEQ ID NO: 181818 - protein, 13 aa, Mycobacterium bovis
NTDDDPNRQSRRA

SEQ ID NO: 181819 - protein, 7 aa, Mycobacterium bovis
NTDLPGT

SEQ ID NO: 181820 - protein, 10 aa, Mycobacterium bovis
NTDSAGNSYG

SEQ ID NO: 181821 - protein, 4 aa, Mycobacterium bovis
NTED

SEQ ID NO: 181822 - protein, 5 aa, Mycobacterium bovis
NTEGD

SEQ ID NO: 181823 - protein, 9 aa, Mycobacterium bovis
NTESANGGQ

SEQ ID NO: 181824 - protein, 14 aa, Mycobacterium bovis
NTESARKSVEQFER

SEQ ID NO: 181825 - protein, 5 aa, Mycobacterium bovis
NTGAI

SEQ ID NO: 181826 - protein, 9 aa, Mycobacterium bovis
NTGDTNTGI

SEQ ID NO: 181827 - protein, 10 aa, Mycobacterium bovis
NTGDTNTGIA

SEQ ID NO: 181828 - protein, 5 aa, Mycobacterium bovis
NTGEA

SEQ ID NO: 181829 - protein, 28 aa, Mycobacterium bovis
NTGFGNSGSLNTGMGNAGGVNTGFGNGG

SEQ ID NO: 181830 - protein, 41 aa, Mycobacterium bovis
NTGFGNTTDGLGENSGFGNAGSGNSGFNNSGKGNSGAQNVG

SEQ ID NO: 181831 - protein, 11 aa, Mycobacterium bovis
NTGGGGGSGFA

SEQ ID NO: 181832 - protein, 18 aa, Mycobacterium bovis
NTGGGGGSGFSNSGSGMS

SEQ ID NO: 181833 - protein, 14 aa, Mycobacterium bovis
NTGIGNTGNYNTGS

SEQ ID NO: 181834 - protein, 5 aa, Mycobacterium bovis
NTGLG

SEQ ID NO: 181835 - protein, 6 aa, Mycobacterium bovis
NTGNNN

SEQ ID NO: 181836 - protein, 7 aa, Mycobacterium bovis
NTGNNNI

SEQ ID NO: 181837 - protein, 16 aa, Mycobacterium bovis
NTGNNNIGNGLTGNNQ

SEQ ID NO: 181838 - protein, 6 aa, Mycobacterium bovis
NTGQQV

SEQ ID NO: 181839 - protein, 9 aa, Mycobacterium bovis
NTGRFSPET

SEQ ID NO: 181840 - protein, 6 aa, Mycobacterium bovis
NTGSAN

SEQ ID NO: 181841 - protein, 6 aa, Mycobacterium bovis
NTGSNN

SEQ ID NO: 181842 - protein, 14 aa, Mycobacterium bovis
NTGVANAGSYNTGS

SEQ ID NO: 181843 - protein, 30 aa, Mycobacterium bovis
NTGVANAGSYNTGSFNAGDTNTGGFNPGTI

SEQ ID NO: 181844 - protein, 5 aa, Mycobacterium bovis
NTGVG

SEQ ID NO: 181845 - protein, 9 aa, Mycobacterium bovis
NTIDATGVG

SEQ ID NO: 181846 - protein, 6 aa, Mycobacterium bovis
NTIRAH

SEQ ID NO: 181847 - protein, 6 aa, Mycobacterium bovis
NTITDR

SEQ ID NO: 181848 - protein, 7 aa, Mycobacterium bovis
NTKPTIT

SEQ ID NO: 181849 - protein, 17 aa, Mycobacterium bovis
NTLRRQRTELTDQPEGS

SEQ ID NO: 181850 - protein, 6 aa, Mycobacterium bovis
NTLSSY

SEQ ID NO: 181851 - protein, 4 aa, Mycobacterium bovis
NTLT

SEQ ID NO: 181852 - protein, 10 aa, Mycobacterium bovis
NTNAGNPTTR

SEQ ID NO: 181853 - protein, 7 aa, Mycobacterium bovis
NTPAIAA

SEQ ID NO: 181854 - protein, 10 aa, Mycobacterium bovis
NTPAIAATEA

SEQ ID NO: 181855 - protein, 5 aa, Mycobacterium bovis
NTPDP

SEQ ID NO: 181856 - protein, 4 aa, Mycobacterium bovis
NTPE

SEQ ID NO: 181857 - protein, 9 aa, Mycobacterium bovis
NTPNSAGRY

SEQ ID NO: 181858 - protein, 6 aa, Mycobacterium bovis
NTQETL

SEQ ID NO: 181859 - protein, 13 aa, Mycobacterium bovis
NTQGTGMGGGTSM

SEQ ID NO: 181860 - protein, 9 aa, Mycobacterium bovis
NTRAPADYA

SEQ ID NO: 181861 - protein, 10 aa, Mycobacterium bovis
NTRSRRSQWK

SEQ ID NO: 181862 - protein, 5 aa, Mycobacterium bovis
NTSED

SEQ ID NO: 181863 - protein, 7 aa, Mycobacterium bovis
NTSEEEF

SEQ ID NO: 181864 - protein, 6 aa, Mycobacterium bovis
NTSRRR

SEQ ID NO: 181865 - protein, 8 aa, Mycobacterium bovis
NTSSAYAK

SEQ ID NO: 181866 - protein, 13 aa, Mycobacterium bovis
NTSTSDLATPAFN

SEQ ID NO: 181867 - protein, 12 aa, Mycobacterium bovis
NTSTSNLATPAF

SEQ ID NO: 181868 - protein, 13 aa, Mycobacterium bovis
NTTSAATPAISGD

SEQ ID NO: 181869 - protein, 9 aa, Mycobacterium bovis
NTTTRTRRQ

SEQ ID NO: 181870 - protein, 14 aa, Mycobacterium bovis
NTTVSRDGLTTPGV

SEQ ID NO: 181871 - protein, 9 aa, Mycobacterium bovis
NTVDGGTPV

SEQ ID NO: 181872 - protein, 17 aa, Mycobacterium bovis
NTVTGSITDGNGPSGVA

SEQ ID NO: 181873 - protein, 6 aa, Mycobacterium bovis
NVADNG

SEQ ID NO: 181874 - protein, 5 aa, Mycobacterium bovis
NVAEG

SEQ ID NO: 181875 - protein, 5 aa, Mycobacterium bovis
NVATS

SEQ ID NO: 181876 - protein, 6 aa, Mycobacterium bovis
NVATTQ

SEQ ID NO: 181877 - protein, 4 aa, Mycobacterium bovis
NVDE

SEQ ID NO: 181878 - protein, 12 aa, Mycobacterium bovis
NVDGKGASYGSH

SEQ ID NO: 181879 - protein, 4 aa, Mycobacterium bovis
NVDH

SEQ ID NO: 181880 - protein, 5 aa, Mycobacterium bovis
NVDPA

SEQ ID NO: 181881 - protein, 8 aa, Mycobacterium bovis
NVETSQAI

SEQ ID NO: 181882 - protein, 9 aa, Mycobacterium bovis
NVGAGSSGW

SEQ ID NO: 181883 - protein, 9 aa, Mycobacterium bovis
NVGAGTSGW

SEQ ID NO: 181884 - protein, 7 aa, Mycobacterium bovis
NVGDGNL

SEQ ID NO: 181885 - protein, 15 aa, Mycobacterium bovis
NVGDGNVGFGNSGSY

SEQ ID NO: 181886 - protein, 10 aa, Mycobacterium bovis
NVGDSNAGLA

SEQ ID NO: 181887 - protein, 8 aa, Mycobacterium bovis
NVGKPQVA

SEQ ID NO: 181888 - protein, 6 aa, Mycobacterium bovis
NVGQNP

SEQ ID NO: 181889 - protein, 6 aa, Mycobacterium bovis
NVGSDS

SEQ ID NO: 181890 - protein, 22 aa, Mycobacterium bovis
NVGSGNIGNANVGGGNSGDNNF

SEQ ID NO: 181891 - protein, 14 aa, Mycobacterium bovis
NVLPSSTNPTRPHT

SEQ ID NO: 181892 - protein, 4 aa, Mycobacterium bovis
NVNG

SEQ ID NO: 181893 - protein, 35 aa, Mycobacterium bovis
NVNTGIGNAGSYNTGSYNAGDTNTGDLNPGNANTG

SEQ ID NO: 181894 - protein, 11 aa, Mycobacterium bovis
NVPASQAAFDD

SEQ ID NO: 181895 - protein, 7 aa, Mycobacterium bovis
NVPGPQG

SEQ ID NO: 181896 - protein, 8 aa, Mycobacterium bovis
NVPGPRRP

SEQ ID NO: 181897 - protein, 4 aa, Mycobacterium bovis
NVPK

SEQ ID NO: 181898 - protein, 12 aa, Mycobacterium bovis
NVPSPPATPSTA

SEQ ID NO: 181899 - protein, 11 aa, Mycobacterium bovis
NVREAEAGGIT

SEQ ID NO: 181900 - protein, 11 aa, Mycobacterium bovis
NVTDADDAAAA

SEQ ID NO: 181901 - protein, 16 aa, Mycobacterium bovis
NVTPEPGPGFKAKLAS

SEQ ID NO: 181902 - protein, 10 aa, Mycobacterium bovis
NWESGDPKKQ

SEQ ID NO: 181903 - protein, 10 aa, Mycobacterium bovis
NYAGRPSPLY

SEQ ID NO: 181904 - protein, 14 aa, Mycobacterium bovis
NYATSSKFSDDERA

SEQ ID NO: 181905 - protein, 9 aa, Mycobacterium bovis
NYGETTEAF

SEQ ID NO: 181906 - protein, 8 aa, Mycobacterium bovis
NYGPGDPN

SEQ ID NO: 181907 - protein, 6 aa, Mycobacterium bovis
NYGPTI

SEQ ID NO: 181908 - protein, 9 aa, Mycobacterium bovis
NYGVPDNET

SEQ ID NO: 181909 - protein, 10 aa, Mycobacterium bovis
NYGVPDNETD

SEQ ID NO: 181910 - protein, 5 aa, Mycobacterium bovis
NYPDG

SEQ ID NO: 181911 - protein, 14 aa, Mycobacterium bovis
NYPEAWGDEDKRVA

SEQ ID NO: 181912 - protein, 8 aa, Mycobacterium bovis
NYPGRPRV

SEQ ID NO: 181913 - protein, 6 aa, Mycobacterium bovis
NYQPGT

SEQ ID NO: 181914 - protein, 9 aa, Mycobacterium bovis
NYRRPPREL

SEQ ID NO: 181915 - protein, 6 aa, Mycobacterium bovis
NYSGGG

SEQ ID NO: 181916 - protein, 10 aa, Mycobacterium bovis
NYTTPSGQHG

SEQ ID NO: 181917 - protein, 25 aa, Mycobacterium bovis
PAAAENAARITAREPAVAGDRPELT

SEQ ID NO: 181918 - protein, 7 aa, Mycobacterium bovis
PAAAEVN

SEQ ID NO: 181919 - protein, 16 aa, Mycobacterium bovis
PAAAQAVETAAQNGVR

SEQ ID NO: 181920 - protein, 12 aa, Mycobacterium bovis
PAAARAAAQERP

SEQ ID NO: 181921 - protein, 5 aa, Mycobacterium bovis
PAAAT

SEQ ID NO: 181922 - protein, 12 aa, Mycobacterium bovis
PAAATGAPTGGG

SEQ ID NO: 181923 - protein, 9 aa, Mycobacterium bovis
PAADPDRYA

SEQ ID NO: 181924 - protein, 5 aa, Mycobacterium bovis
PAAED

SEQ ID NO: 181925 - protein, 12 aa, Mycobacterium bovis
PAAERAHPGNYS

SEQ ID NO: 181926 - protein, 5 aa, Mycobacterium bovis
PAAES

SEQ ID NO: 181927 - protein, 7 aa, Mycobacterium bovis
PAAFATA

SEQ ID NO: 181928 - protein, 9 aa, Mycobacterium bovis
PAAGANSSC

SEQ ID NO: 181929 - protein, 11 aa, Mycobacterium bovis
PAAGGDGPADV

SEQ ID NO: 181930 - protein, 5 aa, Mycobacterium bovis
PAAGL

SEQ ID NO: 181931 - protein, 10 aa, Mycobacterium bovis
PAAGQASQQA

SEQ ID NO: 181932 - protein, 10 aa, Mycobacterium bovis
PAAGQRTAQR

SEQ ID NO: 181933 - protein, 6 aa, Mycobacterium bovis
PAAHVG

SEQ ID NO: 181934 - protein, 18 aa, Mycobacterium bovis
PAAKRDPARGTVSTHDPR

SEQ ID NO: 181935 - protein, 4 aa, Mycobacterium bovis
PAAL

SEQ ID NO: 181936 - protein, 8 aa, Mycobacterium bovis
PAANGVAT

SEQ ID NO: 181937 - protein, 8 aa, Mycobacterium bovis
PAANSTRI

SEQ ID NO: 181938 - protein, 21 aa, Mycobacterium bovis
PAAPALPAGLADRPNYWTCVL

SEQ ID NO: 181939 - protein, 6 aa, Mycobacterium bovis
PAAPGL

SEQ ID NO: 181940 - protein, 5 aa, Mycobacterium bovis
PAAPL

SEQ ID NO: 181941 - protein, 11 aa, Mycobacterium bovis
PAAPPPDGLPG

SEQ ID NO: 181942 - protein, 14 aa, Mycobacterium bovis
PAAPTALQAAAGDI

SEQ ID NO: 181943 - protein, 7 aa, Mycobacterium bovis
PAAQRRG

SEQ ID NO: 181944 - protein, 7 aa, Mycobacterium bovis
PAARATD

SEQ ID NO: 181945 - protein, 7 aa, Mycobacterium bovis
PAARNAL

SEQ ID NO: 181946 - protein, 15 aa, Mycobacterium bovis
PAARPAPHFCDVRCS

SEQ ID NO: 181947 - protein, 6 aa, Mycobacterium bovis
PAARPD

SEQ ID NO: 181948 - protein, 14 aa, Mycobacterium bovis
PAARSPQSQDTATT

SEQ ID NO: 181949 - protein, 7 aa, Mycobacterium bovis
PAARTRM

SEQ ID NO: 181950 - protein, 7 aa, Mycobacterium bovis
PAASGWT

SEQ ID NO: 181951 - protein, 6 aa, Mycobacterium bovis
PAATPW

SEQ ID NO: 181952 - protein, 4 aa, Mycobacterium bovis
PAAV

SEQ ID NO: 181953 - protein, 7 aa, Mycobacterium bovis
PAAVGAA

SEQ ID NO: 181954 - protein, 5 aa, Mycobacterium bovis
PAAVP

SEQ ID NO: 181955 - protein, 4 aa, Mycobacterium bovis
PADA

SEQ ID NO: 181956 - protein, 8 aa, Mycobacterium bovis
PADANETA

SEQ ID NO: 181957 - protein, 7 aa, Mycobacterium bovis
PADAPGA

SEQ ID NO: 181958 - protein, 8 aa, Mycobacterium bovis
PADARDYG

SEQ ID NO: 181959 - protein, 7 aa, Mycobacterium bovis
PADASAL

SEQ ID NO: 181960 - protein, 12 aa, Mycobacterium bovis
PADEATAAGEVA

SEQ ID NO: 181961 - protein, 5 aa, Mycobacterium bovis
PADEP

SEQ ID NO: 181962 - protein, 9 aa, Mycobacterium bovis
PADERRGDF

SEQ ID NO: 181963 - protein, 8 aa, Mycobacterium bovis
PADGPIGD

SEQ ID NO: 181964 - protein, 21 aa, Mycobacterium bovis
PADGSTMPSTAPGSGTPVPPL

SEQ ID NO: 181965 - protein, 8 aa, Mycobacterium bovis
PADMPPPF

SEQ ID NO: 181966 - protein, 6 aa, Mycobacterium bovis
PADPAQ

SEQ ID NO: 181967 - protein, 13 aa, Mycobacterium bovis
PADPATANATVTV

SEQ ID NO: 181968 - protein, 10 aa, Mycobacterium bovis
PADPDDAARL

SEQ ID NO: 181969 - protein, 8 aa, Mycobacterium bovis
PADPRDPD

SEQ ID NO: 181970 - protein, 9 aa, Mycobacterium bovis
PADPRRGGQ

SEQ ID NO: 181971 - protein, 6 aa, Mycobacterium bovis
PADPVG

SEQ ID NO: 181972 - protein, 4 aa, Mycobacterium bovis
PADR

SEQ ID NO: 181973 - protein, 9 aa, Mycobacterium bovis
PADRATDGA

SEQ ID NO: 181974 - protein, 7 aa, Mycobacterium bovis
PADTPGL

SEQ ID NO: 181975 - protein, 24 aa, Mycobacterium bovis
PAEAKASLGQQVPHPSRLGNPDEY

SEQ ID NO: 181976 - protein, 9 aa, Mycobacterium bovis
PAEAPTTRG

SEQ ID NO: 181977 - protein, 4 aa, Mycobacterium bovis
PAEG

SEQ ID NO: 181978 - protein, 9 aa, Mycobacterium bovis
PAEIGKNRH

SEQ ID NO: 181979 - protein, 23 aa, Mycobacterium bovis
PAEKAGRVTKVSSSGPNSTPLPA

SEQ ID NO: 181980 - protein, 4 aa, Mycobacterium bovis
PAEL

SEQ ID NO: 181981 - protein, 7 aa, Mycobacterium bovis
PAELGRP

SEQ ID NO: 181982 - protein, 6 aa, Mycobacterium bovis
PAELTE

SEQ ID NO: 181983 - protein, 4 aa, Mycobacterium bovis
PAER

SEQ ID NO: 181984 - protein, 6 aa, Mycobacterium bovis
PAERAE

SEQ ID NO: 181985 - protein, 13 aa, Mycobacterium bovis
PAERSGSDSESRF

SEQ ID NO: 181986 - protein, 5 aa, Mycobacterium bovis
PAESK

SEQ ID NO: 181987 - protein, 12 aa, Mycobacterium bovis
PAFADSPEEAEQ

SEQ ID NO: 181988 - protein, 14 aa, Mycobacterium bovis
PAFRPNGTVTAGNA

SEQ ID NO: 181989 - protein, 6 aa, Mycobacterium bovis
PAFSSV

SEQ ID NO: 181990 - protein, 4 aa, Mycobacterium bovis
PAGA

SEQ ID NO: 181991 - protein, 5 aa, Mycobacterium bovis
PAGAA

SEQ ID NO: 181992 - protein, 20 aa, Mycobacterium bovis
PAGAGARGGMDADRLRTALG

SEQ ID NO: 181993 - protein, 12 aa, Mycobacterium bovis
PAGAGVDASRAS

SEQ ID NO: 181994 - protein, 11 aa, Mycobacterium bovis
PAGAPPGPYPV

SEQ ID NO: 181995 - protein, 10 aa, Mycobacterium bovis
PAGATNGSGQ

SEQ ID NO: 181996 - protein, 30 aa, Mycobacterium bovis
PAGDPVESGDDLGCDTNPDTPTGRAALLAP

SEQ ID NO: 181997 - protein, 16 aa, Mycobacterium bovis
PAGDRVASTGGTASGP

SEQ ID NO: 181998 - protein, 7 aa, Mycobacterium bovis
PAGESVA

SEQ ID NO: 181999 - protein, 4 aa, Mycobacterium bovis
PAGG

SEQ ID NO: 182000 - protein, 8 aa, Mycobacterium bovis
PAGGSTGS

SEQ ID NO: 182001 - protein, 7 aa, Mycobacterium bovis
PAGHGIN

SEQ ID NO: 182002 - protein, 8 aa, Mycobacterium bovis
PAGKPPTW

SEQ ID NO: 182003 - protein, 4 aa, Mycobacterium bovis
PAGL

SEQ ID NO: 182004 - protein, 13 aa, Mycobacterium bovis
PAGLLGGSGYQNF

SEQ ID NO: 182005 - protein, 6 aa, Mycobacterium bovis
PAGMTD

SEQ ID NO: 182006 - protein, 6 aa, Mycobacterium bovis
PAGMTS

SEQ ID NO: 182007 - protein, 4 aa, Mycobacterium bovis
PAGP

SEQ ID NO: 182008 - protein, 8 aa, Mycobacterium bovis
PAGPAAES

SEQ ID NO: 182009 - protein, 9 aa, Mycobacterium bovis
PAGPARTGS

SEQ ID NO: 182010 - protein, 11 aa, Mycobacterium bovis
PAGPDKRTEMR

SEQ ID NO: 182011 - protein, 6 aa, Mycobacterium bovis
PAGPGY

SEQ ID NO: 182012 - protein, 11 aa, Mycobacterium bovis
PAGPPDGYRER

SEQ ID NO: 182013 - protein, 10 aa, Mycobacterium bovis
PAGPSGSPLR

SEQ ID NO: 182014 - protein, 15 aa, Mycobacterium bovis
PAGQSWAATAGSGDV

SEQ ID NO: 182015 - protein, 7 aa, Mycobacterium bovis
PAGRAEA

SEQ ID NO: 182016 - protein, 18 aa, Mycobacterium bovis
PAGRAHQRQRADTAGRAG

SEQ ID NO: 182017 - protein, 5 aa, Mycobacterium bovis
PAGRR

SEQ ID NO: 182018 - protein, 10 aa, Mycobacterium bovis
PAGRRAARRA

SEQ ID NO: 182019 - protein, 10 aa, Mycobacterium bovis
PAGSDGQGLP

SEQ ID NO: 182020 - protein, 5 aa, Mycobacterium bovis
PAGSF

SEQ ID NO: 182021 - protein, 11 aa, Mycobacterium bovis
PAGSGAGAGAL

SEQ ID NO: 182022 - protein, 9 aa, Mycobacterium bovis
PAGSNEPAP

SEQ ID NO: 182023 - protein, 10 aa, Mycobacterium bovis
PAGSNTPTTL

SEQ ID NO: 182024 - protein, 5 aa, Mycobacterium bovis
PAGSP

SEQ ID NO: 182025 - protein, 14 aa, Mycobacterium bovis
PAGSPSSVPDDLDP

SEQ ID NO: 182026 - protein, 5 aa, Mycobacterium bovis
PAGST

SEQ ID NO: 182027 - protein, 9 aa, Mycobacterium bovis
PAGSTTPPL

SEQ ID NO: 182028 - protein, 5 aa, Mycobacterium bovis
PAGTA

SEQ ID NO: 182029 - protein, 13 aa, Mycobacterium bovis
PAGTEAPVSDATK

SEQ ID NO: 182030 - protein, 7 aa, Mycobacterium bovis
PAGTGKT

SEQ ID NO: 182031 - protein, 6 aa, Mycobacterium bovis
PAGTGP

SEQ ID NO: 182032 - protein, 14 aa, Mycobacterium bovis
PAGVGGTALTADLG

SEQ ID NO: 182033 - protein, 4 aa, Mycobacterium bovis
PAGY

SEQ ID NO: 182034 - protein, 13 aa, Mycobacterium bovis
PAGYGGRSNGGRR

SEQ ID NO: 182035 - protein, 15 aa, Mycobacterium bovis
PAGYGSSAVTPPGGY

SEQ ID NO: 182036 - protein, 4 aa, Mycobacterium bovis
PAHA

SEQ ID NO: 182037 - protein, 5 aa, Mycobacterium bovis
PAHGT

SEQ ID NO: 182038 - protein, 6 aa, Mycobacterium bovis
PAHPTG

SEQ ID NO: 182039 - protein, 7 aa, Mycobacterium bovis
PAHTTAD

SEQ ID NO: 182040 - protein, 5 aa, Mycobacterium bovis
PAKAR

SEQ ID NO: 182041 - protein, 6 aa, Mycobacterium bovis
PAKKRD

SEQ ID NO: 182042 - protein, 8 aa, Mycobacterium bovis
PAKPTDRA

SEQ ID NO: 182043 - protein, 6 aa, Mycobacterium bovis
PAKQVN

SEQ ID NO: 182044 - protein, 6 aa, Mycobacterium bovis
PAKTIE

SEQ ID NO: 182045 - protein, 5 aa, Mycobacterium bovis
PALAA

SEQ ID NO: 182046 - protein, 9 aa, Mycobacterium bovis
PALAGGPTA

SEQ ID NO: 182047 - protein, 5 aa, Mycobacterium bovis
PALGP

SEQ ID NO: 182048 - protein, 7 aa, Mycobacterium bovis
PALPDDL

SEQ ID NO: 182049 - protein, 6 aa, Mycobacterium bovis
PALPPQ

SEQ ID NO: 182050 - protein, 8 aa, Mycobacterium bovis
PALPRNRG

SEQ ID NO: 182051 - protein, 5 aa, Mycobacterium bovis
PALRE

SEQ ID NO: 182052 - protein, 6 aa, Mycobacterium bovis
PALRPS

SEQ ID NO: 182053 - protein, 7 aa, Mycobacterium bovis
PALSAKK

SEQ ID NO: 182054 - protein, 7 aa, Mycobacterium bovis
PALSEKD

SEQ ID NO: 182055 - protein, 10 aa, Mycobacterium bovis
PALSPSRATD

SEQ ID NO: 182056 - protein, 5 aa, Mycobacterium bovis
PALSS

SEQ ID NO: 182057 - protein, 6 aa, Mycobacterium bovis
PANADG

SEQ ID NO: 182058 - protein, 7 aa, Mycobacterium bovis
PANPPPR

SEQ ID NO: 182059 - protein, 9 aa, Mycobacterium bovis
PANRPGRAV

SEQ ID NO: 182060 - protein, 5 aa, Mycobacterium bovis
PANSE

SEQ ID NO: 182061 - protein, 10 aa, Mycobacterium bovis
PANSEPRTGL

SEQ ID NO: 182062 - protein, 17 aa, Mycobacterium bovis
PANVSRRAKVDVLIVHT

SEQ ID NO: 182063 - protein, 8 aa, Mycobacterium bovis
PAPAAEPL

SEQ ID NO: 182064 - protein, 5 aa, Mycobacterium bovis
PAPAR

SEQ ID NO: 182065 - protein, 15 aa, Mycobacterium bovis
PAPARRVGGHPAKRT

SEQ ID NO: 182066 - protein, 7 aa, Mycobacterium bovis
PAPATGA

SEQ ID NO: 182067 - protein, 9 aa, Mycobacterium bovis
PAPATTDSD

SEQ ID NO: 182068 - protein, 6 aa, Mycobacterium bovis
PAPDTP

SEQ ID NO: 182069 - protein, 5 aa, Mycobacterium bovis
PAPEA

SEQ ID NO: 182070 - protein, 11 aa, Mycobacterium bovis
PAPEDPEQRDR

SEQ ID NO: 182071 - protein, 14 aa, Mycobacterium bovis
PAPEDVGKGESEFR

SEQ ID NO: 182072 - protein, 5 aa, Mycobacterium bovis
PAPER

SEQ ID NO: 182073 - protein, 9 aa, Mycobacterium bovis
PAPERTPPV

SEQ ID NO: 182074 - protein, 20 aa, Mycobacterium bovis
PAPEYGDTNGYRAPAGPVEK

SEQ ID NO: 182075 - protein, 8 aa, Mycobacterium bovis
PAPGAPPL

SEQ ID NO: 182076 - protein, 16 aa, Mycobacterium bovis
PAPGFGNSTTGPSSGF

SEQ ID NO: 182077 - protein, 8 aa, Mycobacterium bovis
PAPGGRRE

SEQ ID NO: 182078 - protein, 16 aa, Mycobacterium bovis
PAPGIGNSTTNPSSGF

SEQ ID NO: 182079 - protein, 6 aa, Mycobacterium bovis
PAPGLP

SEQ ID NO: 182080 - protein, 6 aa, Mycobacterium bovis
PAPGPV

SEQ ID NO: 182081 - protein, 6 aa, Mycobacterium bovis
PAPGSM

SEQ ID NO: 182082 - protein, 7 aa, Mycobacterium bovis
PAPGSYA

SEQ ID NO: 182083 - protein, 12 aa, Mycobacterium bovis
PAPLPPSGSARA

SEQ ID NO: 182084 - protein, 17 aa, Mycobacterium bovis
PAPPDREQGDAARAIAD

SEQ ID NO: 182085 - protein, 7 aa, Mycobacterium bovis
PAPPGAP

SEQ ID NO: 182086 - protein, 8 aa, Mycobacterium bovis
PAPPPPGL

SEQ ID NO: 182087 - protein, 7 aa, Mycobacterium bovis
PAPPPRE

SEQ ID NO: 182088 - protein, 17 aa, Mycobacterium bovis
PAPQAPQSASGEMLPSG

SEQ ID NO: 182089 - protein, 26 aa, Mycobacterium bovis
PAPQAVPRPSAAAAEPKHQPAREPRP

SEQ ID NO: 182090 - protein, 16 aa, Mycobacterium bovis
PAPQPSQLRPGRVPPA

SEQ ID NO: 182091 - protein, 4 aa, Mycobacterium bovis
PAPR

SEQ ID NO: 182092 - protein, 5 aa, Mycobacterium bovis
PAPRD

SEQ ID NO: 182093 - protein, 6 aa, Mycobacterium bovis
PAPRGH

SEQ ID NO: 182094 - protein, 6 aa, Mycobacterium bovis
PAPSGT

SEQ ID NO: 182095 - protein, 19 aa, Mycobacterium bovis
PAPSPKDAARGAHNVGANA

SEQ ID NO: 182096 - protein, 4 aa, Mycobacterium bovis
PAPT

SEQ ID NO: 182097 - protein, 9 aa, Mycobacterium bovis
PAPTDRERG

SEQ ID NO: 182098 - protein, 14 aa, Mycobacterium bovis
PAPTTTSGDLAAEA

SEQ ID NO: 182099 - protein, 14 aa, Mycobacterium bovis
PAPVPPPSGRVGGY

SEQ ID NO: 182100 - protein, 4 aa, Mycobacterium bovis
PAQA

SEQ ID NO: 182101 - protein, 5 aa, Mycobacterium bovis
PAQAE

SEQ ID NO: 182102 - protein, 10 aa, Mycobacterium bovis
PAQPTAAEAN

SEQ ID NO: 182103 - protein, 5 aa, Mycobacterium bovis
PAQQR

SEQ ID NO: 182104 - protein, 6 aa, Mycobacterium bovis
PAQRAA

SEQ ID NO: 182105 - protein, 5 aa, Mycobacterium bovis
PAQRT

SEQ ID NO: 182106 - protein, 4 aa, Mycobacterium bovis
PAQT

SEQ ID NO: 182107 - protein, 18 aa, Mycobacterium bovis
PAQVEGATKLPTSPGYTG

SEQ ID NO: 182108 - protein, 7 aa, Mycobacterium bovis
PAQVRTK

SEQ ID NO: 182109 - protein, 8 aa, Mycobacterium bovis
PARDAKGI

SEQ ID NO: 182110 - protein, 9 aa, Mycobacterium bovis
PARDGPPDI

SEQ ID NO: 182111 - protein, 8 aa, Mycobacterium bovis
PARDPGPL

SEQ ID NO: 182112 - protein, 5 aa, Mycobacterium bovis
PARDS

SEQ ID NO: 182113 - protein, 7 aa, Mycobacterium bovis
PARESNT

SEQ ID NO: 182114 - protein, 9 aa, Mycobacterium bovis
PARGGSSIG

SEQ ID NO: 182115 - protein, 12 aa, Mycobacterium bovis
PARGSEANNQRP

SEQ ID NO: 182116 - protein, 7 aa, Mycobacterium bovis
PARIDTP

SEQ ID NO: 182117 - protein, 4 aa, Mycobacterium bovis
PARL

SEQ ID NO: 182118 - protein, 7 aa, Mycobacterium bovis
PARNADA

SEQ ID NO: 182119 - protein, 4 aa, Mycobacterium bovis
PARP

SEQ ID NO: 182120 - protein, 5 aa, Mycobacterium bovis
PARRP

SEQ ID NO: 182121 - protein, 20 aa, Mycobacterium bovis
PARRSPRSNARDRCQAGTRT

SEQ ID NO: 182122 - protein, 24 aa, Mycobacterium bovis
PARVTGRNVPSEQKAPYDPERADR

SEQ ID NO: 182123 - protein, 4 aa, Mycobacterium bovis
PASA

SEQ ID NO: 182124 - protein, 14 aa, Mycobacterium bovis
PASAAARKAGHPGP

SEQ ID NO: 182125 - protein, 9 aa, Mycobacterium bovis
PASAAGGFA

SEQ ID NO: 182126 - protein, 9 aa, Mycobacterium bovis
PASAAGPDL

SEQ ID NO: 182127 - protein, 7 aa, Mycobacterium bovis
PASADEV

SEQ ID NO: 182128 - protein, 9 aa, Mycobacterium bovis
PASARTGSR

SEQ ID NO: 182129 - protein, 19 aa, Mycobacterium bovis
PASATPAAVTDAATAAGQA

SEQ ID NO: 182130 - protein, 9 aa, Mycobacterium bovis
PASATTTAS

SEQ ID NO: 182131 - protein, 10 aa, Mycobacterium bovis
PASDGDDRNQ

SEQ ID NO: 182132 - protein, 6 aa, Mycobacterium bovis
PASDPA

SEQ ID NO: 182133 - protein, 5 aa, Mycobacterium bovis
PASDS

SEQ ID NO: 182134 - protein, 11 aa, Mycobacterium bovis
PASDTEGLGSV

SEQ ID NO: 182135 - protein, 9 aa, Mycobacterium bovis
PASEYGTKA

SEQ ID NO: 182136 - protein, 9 aa, Mycobacterium bovis
PASGPGTIA

SEQ ID NO: 182137 - protein, 14 aa, Mycobacterium bovis
PASGRYPHQPAPTG

SEQ ID NO: 182138 - protein, 10 aa, Mycobacterium bovis
PASNSRVPPL

SEQ ID NO: 182139 - protein, 10 aa, Mycobacterium bovis
PASPASRASP

SEQ ID NO: 182140 - protein, 8 aa, Mycobacterium bovis
PASPGSTM

SEQ ID NO: 182141 - protein, 8 aa, Mycobacterium bovis
PASPGTGV

SEQ ID NO: 182142 - protein, 7 aa, Mycobacterium bovis
PASPHAA

SEQ ID NO: 182143 - protein, 11 aa, Mycobacterium bovis
PASPRLRSSRR

SEQ ID NO: 182144 - protein, 12 aa, Mycobacterium bovis
PASRNAVNGPTA

SEQ ID NO: 182145 - protein, 5 aa, Mycobacterium bovis
PASVE

SEQ ID NO: 182146 - protein, 7 aa, Mycobacterium bovis
PASYGAD

SEQ ID NO: 182147 - protein, 7 aa, Mycobacterium bovis
PASYPQT

SEQ ID NO: 182148 - protein, 5 aa, Mycobacterium bovis
PASYT

SEQ ID NO: 182149 - protein, 61 aa, Mycobacterium bovis
PATAGGTVGPARKSQGRRRDTDCDGQKTAQHARNTPRRRRTRGGKPVTGHPGTNPISSPIV

SEQ ID NO: 182150 - protein, 5 aa, Mycobacterium bovis
PATAV

SEQ ID NO: 182151 - protein, 8 aa, Mycobacterium bovis
PATDPSVR

SEQ ID NO: 182152 - protein, 10 aa, Mycobacterium bovis
PATEDPEFTE

SEQ ID NO: 182153 - protein, 6 aa, Mycobacterium bovis
PATETP

SEQ ID NO: 182154 - protein, 4 aa, Mycobacterium bovis
PATG

SEQ ID NO: 182155 - protein, 9 aa, Mycobacterium bovis
PATGTTKSD

SEQ ID NO: 182156 - protein, 4 aa, Mycobacterium bovis
PATH

SEQ ID NO: 182157 - protein, 7 aa, Mycobacterium bovis
PATLGTK

SEQ ID NO: 182158 - protein, 12 aa, Mycobacterium bovis
PATNTVTGSPIP

SEQ ID NO: 182159 - protein, 21 aa, Mycobacterium bovis
PATNTVTGSPITIGNGPSGVA

SEQ ID NO: 182160 - protein, 6 aa, Mycobacterium bovis
PATPDG

SEQ ID NO: 182161 - protein, 5 aa, Mycobacterium bovis
PATQD

SEQ ID NO: 182162 - protein, 4 aa, Mycobacterium bovis
PATT

SEQ ID NO: 182163 - protein, 7 aa, Mycobacterium bovis
PATTDFP

SEQ ID NO: 182164 - protein, 7 aa, Mycobacterium bovis
PATTDMA

SEQ ID NO: 182165 - protein, 8 aa, Mycobacterium bovis
PATTSNEY

SEQ ID NO: 182166 - protein, 8 aa, Mycobacterium bovis
PATTTPAN

SEQ ID NO: 182167 - protein, 14 aa, Mycobacterium bovis
PATWASKAAGPLGA

SEQ ID NO: 182168 - protein, 4 aa, Mycobacterium bovis
PAVA

SEQ ID NO: 182169 - protein, 7 aa, Mycobacterium bovis
PAVADPM

SEQ ID NO: 182170 - protein, 20 aa, Mycobacterium bovis
PAVASSDARNIETTISRDGA

SEQ ID NO: 182171 - protein, 5 aa, Mycobacterium bovis
PAVER

SEQ ID NO: 182172 - protein, 5 aa, Mycobacterium bovis
PAVGE

SEQ ID NO: 182173 - protein, 12 aa, Mycobacterium bovis
PAVGRSGKAPNV

SEQ ID NO: 182174 - protein, 5 aa, Mycobacterium bovis
PAVRG

SEQ ID NO: 182175 - protein, 10 aa, Mycobacterium bovis
PAVRTTSEDP

SEQ ID NO: 182176 - protein, 10 aa, Mycobacterium bovis
PAVTDGYRQD

SEQ ID NO: 182177 - protein, 17 aa, Mycobacterium bovis
PAVTGKPSGDDLKSGKR

SEQ ID NO: 182178 - protein, 6 aa, Mycobacterium bovis
PAYEDP

SEQ ID NO: 182179 - protein, 16 aa, Mycobacterium bovis
PAYEPEPGKPAPAAVS

SEQ ID NO: 182180 - protein, 8 aa, Mycobacterium bovis
PAYPIPED

SEQ ID NO: 182181 - protein, 8 aa, Mycobacterium bovis
PAYQGRGI

SEQ ID NO: 182182 - protein, 34 aa, Mycobacterium bovis
PAYTGPSAGDLPAATGTGAAGAADAPASAADSVS

SEQ ID NO: 182183 - protein, 8 aa, Mycobacterium bovis
PAYTPAGL

SEQ ID NO: 182184 - protein, 8 aa, Mycobacterium bovis
PCAPADPQ

SEQ ID NO: 182185 - protein, 4 aa, Mycobacterium bovis
PCDA

SEQ ID NO: 182186 - protein, 4 aa, Mycobacterium bovis
PCEP

SEQ ID NO: 182187 - protein, 10 aa, Mycobacterium bovis
PCGGSPRRAV

SEQ ID NO: 182188 - protein, 6 aa, Mycobacterium bovis
PCTGTG

SEQ ID NO: 182189 - protein, 8 aa, Mycobacterium bovis
PDAATRKS

SEQ ID NO: 182190 - protein, 8 aa, Mycobacterium bovis
PDADGNNV

SEQ ID NO: 182191 - protein, 4 aa, Mycobacterium bovis
PDAE

SEQ ID NO: 182192 - protein, 5 aa, Mycobacterium bovis
PDAEA

SEQ ID NO: 182193 - protein, 9 aa, Mycobacterium bovis
PDAEAGKDL

SEQ ID NO: 182194 - protein, 9 aa, Mycobacterium bovis
PDAEPGASP

SEQ ID NO: 182195 - protein, 8 aa, Mycobacterium bovis
PDAGGPRD

SEQ ID NO: 182196 - protein, 14 aa, Mycobacterium bovis
PDAGPPLWAMWREP

SEQ ID NO: 182197 - protein, 5 aa, Mycobacterium bovis
PDAGS

SEQ ID NO: 182198 - protein, 18 aa, Mycobacterium bovis
PDAGTSTAPNAAPEPVAR

SEQ ID NO: 182199 - protein, 7 aa, Mycobacterium bovis
PDAHRES

SEQ ID NO: 182200 - protein, 11 aa, Mycobacterium bovis
PDAKPAATGLE

SEQ ID NO: 182201 - protein, 7 aa, Mycobacterium bovis
PDALEGT

SEQ ID NO: 182202 - protein, 16 aa, Mycobacterium bovis
PDAPAPQPVRGTGGGN

SEQ ID NO: 182203 - protein, 8 aa, Mycobacterium bovis
PDAPPDPE

SEQ ID NO: 182204 - protein, 6 aa, Mycobacterium bovis
PDAPTL

SEQ ID NO: 182205 - protein, 5 aa, Mycobacterium bovis
PDAQD

SEQ ID NO: 182206 - protein, 5 aa, Mycobacterium bovis
PDAQN

SEQ ID NO: 182207 - protein, 12 aa, Mycobacterium bovis
PDATPGRPNAKT

SEQ ID NO: 182208 - protein, 5 aa, Mycobacterium bovis
PDATV

SEQ ID NO: 182209 - protein, 6 aa, Mycobacterium bovis
PDAVDS

SEQ ID NO: 182210 - protein, 5 aa, Mycobacterium bovis
PDAVP

SEQ ID NO: 182211 - protein, 6 aa, Mycobacterium bovis
PDAVTT

SEQ ID NO: 182212 - protein, 8 aa, Mycobacterium bovis
PDDAAARE

SEQ ID NO: 182213 - protein, 14 aa, Mycobacterium bovis
PDDADSEPSPPLAK

SEQ ID NO: 182214 - protein, 5 aa, Mycobacterium bovis
PDDAS

SEQ ID NO: 182215 - protein, 8 aa, Mycobacterium bovis
PDDELGSN

SEQ ID NO: 182216 - protein, 10 aa, Mycobacterium bovis
PDDESLSNGA

SEQ ID NO: 182217 - protein, 4 aa, Mycobacterium bovis
PDDG

SEQ ID NO: 182218 - protein, 8 aa, Mycobacterium bovis
PDDGGEEV

SEQ ID NO: 182219 - protein, 6 aa, Mycobacterium bovis
PDDIEP

SEQ ID NO: 182220 - protein, 7 aa, Mycobacterium bovis
PDDLPDS

SEQ ID NO: 182221 - protein, 6 aa, Mycobacterium bovis
PDDPAD

SEQ ID NO: 182222 - protein, 14 aa, Mycobacterium bovis
PDDPGYAAHGAAAR

SEQ ID NO: 182223 - protein, 6 aa, Mycobacterium bovis
PDDPIR

SEQ ID NO: 182224 - protein, 8 aa, Mycobacterium bovis
PDDPPGRR

SEQ ID NO: 182225 - protein, 6 aa, Mycobacterium bovis
PDDRTE

SEQ ID NO: 182226 - protein, 4 aa, Mycobacterium bovis
PDDW

SEQ ID NO: 182227 - protein, 5 aa, Mycobacterium bovis
PDDYA

SEQ ID NO: 182228 - protein, 4 aa, Mycobacterium bovis
PDEA

SEQ ID NO: 182229 - protein, 5 aa, Mycobacterium bovis
PDEAA

SEQ ID NO: 182230 - protein, 13 aa, Mycobacterium bovis
PDEAAAAAAAGLG

SEQ ID NO: 182231 - protein, 15 aa, Mycobacterium bovis
PDEAAALGDELKGVT

SEQ ID NO: 182232 - protein, 6 aa, Mycobacterium bovis
PDEADL

SEQ ID NO: 182233 - protein, 4 aa, Mycobacterium bovis
PDEG

SEQ ID NO: 182234 - protein, 5 aa, Mycobacterium bovis
PDEGY

SEQ ID NO: 182235 - protein, 7 aa, Mycobacterium bovis
PDEKWGE

SEQ ID NO: 182236 - protein, 4 aa, Mycobacterium bovis
PDEL

SEQ ID NO: 182237 - protein, 6 aa, Mycobacterium bovis
PDEQEL

SEQ ID NO: 182238 - protein, 7 aa, Mycobacterium bovis
PDEQRGA

SEQ ID NO: 182239 - protein, 7 aa, Mycobacterium bovis
PDERRGA

SEQ ID NO: 182240 - protein, 15 aa, Mycobacterium bovis
PDERTEMEKDRHGPA

SEQ ID NO: 182241 - protein, 6 aa, Mycobacterium bovis
PDERTL

SEQ ID NO: 182242 - protein, 6 aa, Mycobacterium bovis
PDEVPI

SEQ ID NO: 182243 - protein, 10 aa, Mycobacterium bovis
PDFGTGSSRE

SEQ ID NO: 182244 - protein, 4 aa, Mycobacterium bovis
PDFR

SEQ ID NO: 182245 - protein, 5 aa, Mycobacterium bovis
PDGAE

SEQ ID NO: 182246 - protein, 15 aa, Mycobacterium bovis
PDGDYTDEDRARRRG

SEQ ID NO: 182247 - protein, 8 aa, Mycobacterium bovis
PDGELPAN

SEQ ID NO: 182248 - protein, 5 aa, Mycobacterium bovis
PDGET

SEQ ID NO: 182249 - protein, 5 aa, Mycobacterium bovis
PDGEV

SEQ ID NO: 182250 - protein, 7 aa, Mycobacterium bovis
PDGGASA

SEQ ID NO: 182251 - protein, 6 aa, Mycobacterium bovis
PDGGAT

SEQ ID NO: 182252 - protein, 14 aa, Mycobacterium bovis
PDGHATNPPARYTE

SEQ ID NO: 182253 - protein, 7 aa, Mycobacterium bovis
PDGHTED

SEQ ID NO: 182254 - protein, 7 aa, Mycobacterium bovis
PDGKTQV

SEQ ID NO: 182255 - protein, 5 aa, Mycobacterium bovis
PDGLD

SEQ ID NO: 182256 - protein, 7 aa, Mycobacterium bovis
PDGLPEA

SEQ ID NO: 182257 - protein, 5 aa, Mycobacterium bovis
PDGMD

SEQ ID NO: 182258 - protein, 8 aa, Mycobacterium bovis
PDGMPGGE

SEQ ID NO: 182259 - protein, 5 aa, Mycobacterium bovis
PDGNG

SEQ ID NO: 182260 - protein, 10 aa, Mycobacterium bovis
PDGNYGEPEE

SEQ ID NO: 182261 - protein, 7 aa, Mycobacterium bovis
PDGPAPY

SEQ ID NO: 182262 - protein, 9 aa, Mycobacterium bovis
PDGPDGPRA

SEQ ID NO: 182263 - protein, 9 aa, Mycobacterium bovis
PDGPDGQRT

SEQ ID NO: 182264 - protein, 12 aa, Mycobacterium bovis
PDGPDLRVQPGD

SEQ ID NO: 182265 - protein, 7 aa, Mycobacterium bovis
PDGPGRW

SEQ ID NO: 182266 - protein, 16 aa, Mycobacterium bovis
PDGQWTASPQEGHSVR

SEQ ID NO: 182267 - protein, 8 aa, Mycobacterium bovis
PDGSDAWD

SEQ ID NO: 182268 - protein, 12 aa, Mycobacterium bovis
PDGSDDPEIPPR

SEQ ID NO: 182269 - protein, 9 aa, Mycobacterium bovis
PDGSPCPCG

SEQ ID NO: 182270 - protein, 10 aa, Mycobacterium bovis
PDGSPSWADP

SEQ ID NO: 182271 - protein, 8 aa, Mycobacterium bovis
PDGSTTVD

SEQ ID NO: 182272 - protein, 13 aa, Mycobacterium bovis
PDGSVSGSVSGGC

SEQ ID NO: 182273 - protein, 5 aa, Mycobacterium bovis
PDGSW

SEQ ID NO: 182274 - protein, 8 aa, Mycobacterium bovis
PDGTAPGQ

SEQ ID NO: 182275 - protein, 16 aa, Mycobacterium bovis
PDGTKTPGKTVPDPYF

SEQ ID NO: 182276 - protein, 18 aa, Mycobacterium bovis
PDGTRCQGDWPARQPSTP

SEQ ID NO: 182277 - protein, 11 aa, Mycobacterium bovis
PDGTTAGPGVE

SEQ ID NO: 182278 - protein, 6 aa, Mycobacterium bovis
PDGTVR

SEQ ID NO: 182279 - protein, 4 aa, Mycobacterium bovis
PDHD

SEQ ID NO: 182280 - protein, 9 aa, Mycobacterium bovis
PDHEGPKGL

SEQ ID NO: 182281 - protein, 5 aa, Mycobacterium bovis
PDHPG

SEQ ID NO: 182282 - protein, 7 aa, Mycobacterium bovis
PDHRDTY

SEQ ID NO: 182283 - protein, 19 aa, Mycobacterium bovis
PDHTAGRAAVGAAPPADAL

SEQ ID NO: 182284 - protein, 5 aa, Mycobacterium bovis
PDIGA

SEQ ID NO: 182285 - protein, 6 aa, Mycobacterium bovis
PDIQQQ

SEQ ID NO: 182286 - protein, 9 aa, Mycobacterium bovis
PDKEEAQEL

SEQ ID NO: 182287 - protein, 24 aa, Mycobacterium bovis
PDKFTGSPLKERRAQPTGRGRHHR

SEQ ID NO: 182288 - protein, 5 aa, Mycobacterium bovis
PDKPD

SEQ ID NO: 182289 - protein, 7 aa, Mycobacterium bovis
PDKRPDI

SEQ ID NO: 182290 - protein, 5 aa, Mycobacterium bovis
PDKTA

SEQ ID NO: 182291 - protein, 4 aa, Mycobacterium bovis
PDLA

SEQ ID NO: 182292 - protein, 10 aa, Mycobacterium bovis
PDLARRGRGT

SEQ ID NO: 182293 - protein, 4 aa, Mycobacterium bovis
PDLD

SEQ ID NO: 182294 - protein, 5 aa, Mycobacterium bovis
PDLDP

SEQ ID NO: 182295 - protein, 4 aa, Mycobacterium bovis
PDLP

SEQ ID NO: 182296 - protein, 10 aa, Mycobacterium bovis
PDLPTPWPQE

SEQ ID NO: 182297 - protein, 9 aa, Mycobacterium bovis
PDMEPGTES

SEQ ID NO: 182298 - protein, 62 aa, Mycobacterium bovis
PDNASRGPVGTTAPSAPGPTTTVGTGHGADTGSSGAGGASVRPRPRRAGRGEAKTQTPQGDA

SEQ ID NO: 182299 - protein, 9 aa, Mycobacterium bovis
PDNDPRGTR

SEQ ID NO: 182300 - protein, 5 aa, Mycobacterium bovis
PDNPE

SEQ ID NO: 182301 - protein, 13 aa, Mycobacterium bovis
PDNPSYDAAADER

SEQ ID NO: 182302 - protein, 5 aa, Mycobacterium bovis
PDNPV

SEQ ID NO: 182303 - protein, 6 aa, Mycobacterium bovis
PDNTEV

SEQ ID NO: 182304 - protein, 11 aa, Mycobacterium bovis
PDPAPRGSAPA

SEQ ID NO: 182305 - protein, 6 aa, Mycobacterium bovis
PDPDAC

SEQ ID NO: 182306 - protein, 7 aa, Mycobacterium bovis
PDPDKPA

SEQ ID NO: 182307 - protein, 6 aa, Mycobacterium bovis
PDPDVR

SEQ ID NO: 182308 - protein, 9 aa, Mycobacterium bovis
PDPDWDGRT

SEQ ID NO: 182309 - protein, 7 aa, Mycobacterium bovis
PDPEDEE

SEQ ID NO: 182310 - protein, 7 aa, Mycobacterium bovis
PDPEPLG

SEQ ID NO: 182311 - protein, 4 aa, Mycobacterium bovis
PDPG

SEQ ID NO: 182312 - protein, 8 aa, Mycobacterium bovis
PDPGPGEA

SEQ ID NO: 182313 - protein, 8 aa, Mycobacterium bovis
PDPGTDPV

SEQ ID NO: 182314 - protein, 10 aa, Mycobacterium bovis
PDPNAPEAQA

SEQ ID NO: 182315 - protein, 10 aa, Mycobacterium bovis
PDPNGERAGH

SEQ ID NO: 182316 - protein, 5 aa, Mycobacterium bovis
PDPRA

SEQ ID NO: 182317 - protein, 5 aa, Mycobacterium bovis
PDPRL

SEQ ID NO: 182318 - protein, 15 aa, Mycobacterium bovis
PDPRTGCSTTAPNSV

SEQ ID NO: 182319 - protein, 21 aa, Mycobacterium bovis
PDPSVRAAAERRAQDTGASVT

SEQ ID NO: 182320 - protein, 7 aa, Mycobacterium bovis
PDPTEGV

SEQ ID NO: 182321 - protein, 12 aa, Mycobacterium bovis
PDQGRPLEVGEP

SEQ ID NO: 182322 - protein, 4 aa, Mycobacterium bovis
PDQL

SEQ ID NO: 182323 - protein, 9 aa, Mycobacterium bovis
PDQPGRSTV

SEQ ID NO: 182324 - protein, 17 aa, Mycobacterium bovis
PDQRPDEGQGGPGAPTL

SEQ ID NO: 182325 - protein, 5 aa, Mycobacterium bovis
PDQTG

SEQ ID NO: 182326 - protein, 9 aa, Mycobacterium bovis
PDQTGTPRR

SEQ ID NO: 182327 - protein, 14 aa, Mycobacterium bovis
PDQWADSDRDQVNT

SEQ ID NO: 182328 - protein, 6 aa, Mycobacterium bovis
PDQYGK

SEQ ID NO: 182329 - protein, 4 aa, Mycobacterium bovis
PDRE

SEQ ID NO: 182330 - protein, 7 aa, Mycobacterium bovis
PDRGFTN

SEQ ID NO: 182331 - protein, 13 aa, Mycobacterium bovis
PDRNAGFSTANPG

SEQ ID NO: 182332 - protein, 7 aa, Mycobacterium bovis
PDRPAAE

SEQ ID NO: 182333 - protein, 5 aa, Mycobacterium bovis
PDRPR

SEQ ID NO: 182334 - protein, 8 aa, Mycobacterium bovis
PDRSEGDL

SEQ ID NO: 182335 - protein, 6 aa, Mycobacterium bovis
PDRTHR

SEQ ID NO: 182336 - protein, 30 aa, Mycobacterium bovis
PDRTLTEDDASAARDAAVQSAAERVGAVLR

SEQ ID NO: 182337 - protein, 8 aa, Mycobacterium bovis
PDRVPGLS

SEQ ID NO: 182338 - protein, 8 aa, Mycobacterium bovis
PDRVTRDA

SEQ ID NO: 182339 - protein, 34 aa, Mycobacterium bovis
PDSAAAQGISRPDADRPPAPRRPRRSARAGVPRP

SEQ ID NO: 182340 - protein, 24 aa, Mycobacterium bovis
PDSAPTPSPAPIAPPTTDNASAMT

SEQ ID NO: 182341 - protein, 15 aa, Mycobacterium bovis
PDSATDETTEEDEVG

SEQ ID NO: 182342 - protein, 6 aa, Mycobacterium bovis
PDSDFE

SEQ ID NO: 182343 - protein, 5 aa, Mycobacterium bovis
PDSDN

SEQ ID NO: 182344 - protein, 8 aa, Mycobacterium bovis
PDSGLDPV

SEQ ID NO: 182345 - protein, 6 aa, Mycobacterium bovis
PDSGRV

SEQ ID NO: 182346 - protein, 9 aa, Mycobacterium bovis
PDSGSSPQL

SEQ ID NO: 182347 - protein, 12 aa, Mycobacterium bovis
PDSHPQSAAAAR

SEQ ID NO: 182348 - protein, 8 aa, Mycobacterium bovis
PDSHTRDL

SEQ ID NO: 182349 - protein, 7 aa, Mycobacterium bovis
PDSLADA

SEQ ID NO: 182350 - protein, 7 aa, Mycobacterium bovis
PDSMPAD

SEQ ID NO: 182351 - protein, 4 aa, Mycobacterium bovis
PDSP

SEQ ID NO: 182352 - protein, 8 aa, Mycobacterium bovis
PDSPNQPY

SEQ ID NO: 182353 - protein, 4 aa, Mycobacterium bovis
PDSR

SEQ ID NO: 182354 - protein, 8 aa, Mycobacterium bovis
PDSTIAGR

SEQ ID NO: 182355 - protein, 6 aa, Mycobacterium bovis
PDTAAQ

SEQ ID NO: 182356 - protein, 6 aa, Mycobacterium bovis
PDTAPQ

SEQ ID NO: 182357 - protein, 7 aa, Mycobacterium bovis
PDTDRAR

SEQ ID NO: 182358 - protein, 4 aa, Mycobacterium bovis
PDTG

SEQ ID NO: 182359 - protein, 9 aa, Mycobacterium bovis
PDTGEPCPT

SEQ ID NO: 182360 - protein, 12 aa, Mycobacterium bovis
PDTGLSARGRPL

SEQ ID NO: 182361 - protein, 15 aa, Mycobacterium bovis
PDTGPEAGAELPDGE

SEQ ID NO: 182362 - protein, 18 aa, Mycobacterium bovis
PDTKSPVTGSLGSARADA

SEQ ID NO: 182363 - protein, 4 aa, Mycobacterium bovis
PDTM

SEQ ID NO: 182364 - protein, 6 aa, Mycobacterium bovis
PDTNSG

SEQ ID NO: 182365 - protein, 4 aa, Mycobacterium bovis
PDTP

SEQ ID NO: 182366 - protein, 8 aa, Mycobacterium bovis
PDTPATAT

SEQ ID NO: 182367 - protein, 7 aa, Mycobacterium bovis
PDTPEVR

SEQ ID NO: 182368 - protein, 12 aa, Mycobacterium bovis
PDTPPGEDRAER

SEQ ID NO: 182369 - protein, 7 aa, Mycobacterium bovis
PDTREIG

SEQ ID NO: 182370 - protein, 5 aa, Mycobacterium bovis
PDTSI

SEQ ID NO: 182371 - protein, 5 aa, Mycobacterium bovis
PDTTL

SEQ ID NO: 182372 - protein, 6 aa, Mycobacterium bovis
PDVAQD

SEQ ID NO: 182373 - protein, 24 aa, Mycobacterium bovis
PDVGSDPARMASTATPIDDGQAYE

SEQ ID NO: 182374 - protein, 7 aa, Mycobacterium bovis
PDVKPGV

SEQ ID NO: 182375 - protein, 7 aa, Mycobacterium bovis
PDVNESG

SEQ ID NO: 182376 - protein, 12 aa, Mycobacterium bovis
PDVNPDEAAQAK

SEQ ID NO: 182377 - protein, 5 aa, Mycobacterium bovis
PDVPE

SEQ ID NO: 182378 - protein, 17 aa, Mycobacterium bovis
PDVPGADAGAEGLPSRS

SEQ ID NO: 182379 - protein, 14 aa, Mycobacterium bovis
PDVPWTTDADGGPA

SEQ ID NO: 182380 - protein, 4 aa, Mycobacterium bovis
PDVR

SEQ ID NO: 182381 - protein, 7 aa, Mycobacterium bovis
PDVSAPR

SEQ ID NO: 182382 - protein, 6 aa, Mycobacterium bovis
PEAART

SEQ ID NO: 182383 - protein, 10 aa, Mycobacterium bovis
PEAARTPSTT

SEQ ID NO: 182384 - protein, 8 aa, Mycobacterium bovis
PEAASDEW

SEQ ID NO: 182385 - protein, 10 aa, Mycobacterium bovis
PEAGAAPKTV

SEQ ID NO: 182386 - protein, 13 aa, Mycobacterium bovis
PEAGPGDGGVPDD

SEQ ID NO: 182387 - protein, 9 aa, Mycobacterium bovis
PEAGTPNSP

SEQ ID NO: 182388 - protein, 11 aa, Mycobacterium bovis
PEAPLRDAPAH

SEQ ID NO: 182389 - protein, 5 aa, Mycobacterium bovis
PEAQD

SEQ ID NO: 182390 - protein, 6 aa, Mycobacterium bovis
PEARAT

SEQ ID NO: 182391 - protein, 7 aa, Mycobacterium bovis
PEARTAD

SEQ ID NO: 182392 - protein, 13 aa, Mycobacterium bovis
PEASLADATDRLR

SEQ ID NO: 182393 - protein, 8 aa, Mycobacterium bovis
PEASQAEL

SEQ ID NO: 182394 - protein, 5 aa, Mycobacterium bovis
PEATA

SEQ ID NO: 182395 - protein, 7 aa, Mycobacterium bovis
PEATAEA

SEQ ID NO: 182396 - protein, 7 aa, Mycobacterium bovis
PEATAQE

SEQ ID NO: 182397 - protein, 6 aa, Mycobacterium bovis
PEATRR

SEQ ID NO: 182398 - protein, 6 aa, Mycobacterium bovis
PEATRS

SEQ ID NO: 182399 - protein, 5 aa, Mycobacterium bovis
PEAVA

SEQ ID NO: 182400 - protein, 7 aa, Mycobacterium bovis
PEAVHEP

SEQ ID NO: 182401 - protein, 8 aa, Mycobacterium bovis
PEDAEDDL

SEQ ID NO: 182402 - protein, 8 aa, Mycobacterium bovis
PEDFQDPK

SEQ ID NO: 182403 - protein, 4 aa, Mycobacterium bovis
PEDG

SEQ ID NO: 182404 - protein, 9 aa, Mycobacterium bovis
PEDGGGIPW

SEQ ID NO: 182405 - protein, 6 aa, Mycobacterium bovis
PEDGSA

SEQ ID NO: 182406 - protein, 8 aa, Mycobacterium bovis
PEDKPKPW

SEQ ID NO: 182407 - protein, 7 aa, Mycobacterium bovis
PEDPNQQ

SEQ ID NO: 182408 - protein, 6 aa, Mycobacterium bovis
PEDTTR

SEQ ID NO: 182409 - protein, 8 aa, Mycobacterium bovis
PEEERNRA

SEQ ID NO: 182410 - protein, 8 aa, Mycobacterium bovis
PEEPATQP

SEQ ID NO: 182411 - protein, 6 aa, Mycobacterium bovis
PEEPER

SEQ ID NO: 182412 - protein, 8 aa, Mycobacterium bovis
PEEPGGRK

SEQ ID NO: 182413 - protein, 5 aa, Mycobacterium bovis
PEEQR

SEQ ID NO: 182414 - protein, 5 aa, Mycobacterium bovis
PEERR

SEQ ID NO: 182415 - protein, 5 aa, Mycobacterium bovis
PEFAQ

SEQ ID NO: 182416 - protein, 7 aa, Mycobacterium bovis
PEFPDRP

SEQ ID NO: 182417 - protein, 11 aa, Mycobacterium bovis
PEGANSKAEGV

SEQ ID NO: 182418 - protein, 11 aa, Mycobacterium bovis
PEGAPDSTRGV

SEQ ID NO: 182419 - protein, 10 aa, Mycobacterium bovis
PEGGAGGGTV

SEQ ID NO: 182420 - protein, 4 aa, Mycobacterium bovis
PEGI

SEQ ID NO: 182421 - protein, 12 aa, Mycobacterium bovis
PEGKSASSLGLD

SEQ ID NO: 182422 - protein, 11 aa, Mycobacterium bovis
PEGPNGNPDPM

SEQ ID NO: 182423 - protein, 16 aa, Mycobacterium bovis
PEGQRADGENTESDRA

SEQ ID NO: 182424 - protein, 5 aa, Mycobacterium bovis
PEGRG

SEQ ID NO: 182425 - protein, 9 aa, Mycobacterium bovis
PEGVPGPDR

SEQ ID NO: 182426 - protein, 4 aa, Mycobacterium bovis
PEHA

SEQ ID NO: 182427 - protein, 6 aa, Mycobacterium bovis
PEHGGL

SEQ ID NO: 182428 - protein, 6 aa, Mycobacterium bovis
PEHGPG

SEQ ID NO: 182429 - protein, 9 aa, Mycobacterium bovis
PEHNPGPVL

SEQ ID NO: 182430 - protein, 10 aa, Mycobacterium bovis
PEHPAPAAVE

SEQ ID NO: 182431 - protein, 6 aa, Mycobacterium bovis
PEHPYP

SEQ ID NO: 182432 - protein, 8 aa, Mycobacterium bovis
PEHPYPAG

SEQ ID NO: 182433 - protein, 4 aa, Mycobacterium bovis
PEHQ

SEQ ID NO: 182434 - protein, 21 aa, Mycobacterium bovis
PEHTGAITARSDRADGSARIP

SEQ ID NO: 182435 - protein, 24 aa, Mycobacterium bovis
PEHTPNGSSHRDGVGQPLPEPASR

SEQ ID NO: 182436 - protein, 11 aa, Mycobacterium bovis
PEIAASQATAQ

SEQ ID NO: 182437 - protein, 10 aa, Mycobacterium bovis
PEIPSPAAAL

SEQ ID NO: 182438 - protein, 4 aa, Mycobacterium bovis
PEIS

SEQ ID NO: 182439 - protein, 4 aa, Mycobacterium bovis
PEKA

SEQ ID NO: 182440 - protein, 10 aa, Mycobacterium bovis
PEKGGSTREA

SEQ ID NO: 182441 - protein, 4 aa, Mycobacterium bovis
PEKL

SEQ ID NO: 182442 - protein, 11 aa, Mycobacterium bovis
PEKQARKARET

SEQ ID NO: 182443 - protein, 9 aa, Mycobacterium bovis
PELAGEAGV

SEQ ID NO: 182444 - protein, 7 aa, Mycobacterium bovis
PELAPGR

SEQ ID NO: 182445 - protein, 10 aa, Mycobacterium bovis
PELGPTDDGL

SEQ ID NO: 182446 - protein, 4 aa, Mycobacterium bovis
PELP

SEQ ID NO: 182447 - protein, 11 aa, Mycobacterium bovis
PELPDDADNPL

SEQ ID NO: 182448 - protein, 5 aa, Mycobacterium bovis
PELTP

SEQ ID NO: 182449 - protein, 7 aa, Mycobacterium bovis
PEMPDGS

SEQ ID NO: 182450 - protein, 4 aa, Mycobacterium bovis
PENK

SEQ ID NO: 182451 - protein, 10 aa, Mycobacterium bovis
PENKGEVIPP

SEQ ID NO: 182452 - protein, 7 aa, Mycobacterium bovis
PENPRNV

SEQ ID NO: 182453 - protein, 29 aa, Mycobacterium bovis
PEPAADAAAAAQGVKKRQKAAGPKPRTGS

SEQ ID NO: 182454 - protein, 8 aa, Mycobacterium bovis
PEPAAPTE

SEQ ID NO: 182455 - protein, 8 aa, Mycobacterium bovis
PEPATEDY

SEQ ID NO: 182456 - protein, 6 aa, Mycobacterium bovis
PEPDRA

SEQ ID NO: 182457 - protein, 4 aa, Mycobacterium bovis
PEPI

SEQ ID NO: 182458 - protein, 16 aa, Mycobacterium bovis
PEPLPAPQTPAPVPDV

SEQ ID NO: 182459 - protein, 6 aa, Mycobacterium bovis
PEPNPG

SEQ ID NO: 182460 - protein, 10 aa, Mycobacterium bovis
PEPPHGSPRN

SEQ ID NO: 182461 - protein, 5 aa, Mycobacterium bovis
PEPRL

SEQ ID NO: 182462 - protein, 10 aa, Mycobacterium bovis
PEPRPPQQET

SEQ ID NO: 182463 - protein, 8 aa, Mycobacterium bovis
PEPSHARE

SEQ ID NO: 182464 - protein, 9 aa, Mycobacterium bovis
PEPTGLDEA

SEQ ID NO: 182465 - protein, 4 aa, Mycobacterium bovis
PEPV

SEQ ID NO: 182466 - protein, 5 aa, Mycobacterium bovis
PEPVY

SEQ ID NO: 182467 - protein, 7 aa, Mycobacterium bovis
PEPYPTR

SEQ ID NO: 182468 - protein, 4 aa, Mycobacterium bovis
PEQI

SEQ ID NO: 182469 - protein, 5 aa, Mycobacterium bovis
PEQRR

SEQ ID NO: 182470 - protein, 12 aa, Mycobacterium bovis
PEQSGSVGERAA

SEQ ID NO: 182471 - protein, 4 aa, Mycobacterium bovis
PERA

SEQ ID NO: 182472 - protein, 6 aa, Mycobacterium bovis
PERALS

SEQ ID NO: 182473 - protein, 4 aa, Mycobacterium bovis
PERC

SEQ ID NO: 182474 - protein, 11 aa, Mycobacterium bovis
PERDDDADNPL

SEQ ID NO: 182475 - protein, 16 aa, Mycobacterium bovis
PERDQRMGEAAVIGAW

SEQ ID NO: 182476 - protein, 4 aa, Mycobacterium bovis
PERE

SEQ ID NO: 182477 - protein, 8 aa, Mycobacterium bovis
PERPLPPL

SEQ ID NO: 182478 - protein, 9 aa, Mycobacterium bovis
PERQSSEEL

SEQ ID NO: 182479 - protein, 8 aa, Mycobacterium bovis
PERRRSRH

SEQ ID NO: 182480 - protein, 8 aa, Mycobacterium bovis
PERSEGDA

SEQ ID NO: 182481 - protein, 21 aa, Mycobacterium bovis
PESGTPAAVGYAQESGVPYGQ

SEQ ID NO: 182482 - protein, 4 aa, Mycobacterium bovis
PESQ

SEQ ID NO: 182483 - protein, 9 aa, Mycobacterium bovis
PESQTGKST

SEQ ID NO: 182484 - protein, 5 aa, Mycobacterium bovis
PESTR

SEQ ID NO: 182485 - protein, 8 aa, Mycobacterium bovis
PESYTGTE

SEQ ID NO: 182486 - protein, 16 aa, Mycobacterium bovis
PETDGAEKGPTYNKVR

SEQ ID NO: 182487 - protein, 27 aa, Mycobacterium bovis
PETIEARTDPWDPDSAPTRAQTEAARH

SEQ ID NO: 182488 - protein, 7 aa, Mycobacterium bovis
PETKPGD

SEQ ID NO: 182489 - protein, 8 aa, Mycobacterium bovis
PETQDSDD

SEQ ID NO: 182490 - protein, 5 aa, Mycobacterium bovis
PETRK

SEQ ID NO: 182491 - protein, 6 aa, Mycobacterium bovis
PETRRN

SEQ ID NO: 182492 - protein, 5 aa, Mycobacterium bovis
PETSL

SEQ ID NO: 182493 - protein, 13 aa, Mycobacterium bovis
PETSQTDPTGVGD

SEQ ID NO: 182494 - protein, 6 aa, Mycobacterium bovis
PETTEA

SEQ ID NO: 182495 - protein, 7 aa, Mycobacterium bovis
PETTRAD

SEQ ID NO: 182496 - protein, 9 aa, Mycobacterium bovis
PETVGSSAA

SEQ ID NO: 182497 - protein, 11 aa, Mycobacterium bovis
PETVSTDYDTA

SEQ ID NO: 182498 - protein, 4 aa, Mycobacterium bovis
PEVA

SEQ ID NO: 182499 - protein, 9 aa, Mycobacterium bovis
PEVGDGEAG

SEQ ID NO: 182500 - protein, 4 aa, Mycobacterium bovis
PEVP

SEQ ID NO: 182501 - protein, 18 aa, Mycobacterium bovis
PEVSAYRRSSRAPARGAS

SEQ ID NO: 182502 - protein, 5 aa, Mycobacterium bovis
PEVTN

SEQ ID NO: 182503 - protein, 4 aa, Mycobacterium bovis
PEVY

SEQ ID NO: 182504 - protein, 13 aa, Mycobacterium bovis
PEWSGSESGGRRY

SEQ ID NO: 182505 - protein, 4 aa, Mycobacterium bovis
PEWT

SEQ ID NO: 182506 - protein, 12 aa, Mycobacterium bovis
PEYGPASPGAGF

SEQ ID NO: 182507 - protein, 11 aa, Mycobacterium bovis
PEYSAPECTDP

SEQ ID NO: 182508 - protein, 6 aa, Mycobacterium bovis
PFAGAT

SEQ ID NO: 182509 - protein, 18 aa, Mycobacterium bovis
PFAPPPNTTSPSAAATQL

SEQ ID NO: 182510 - protein, 11 aa, Mycobacterium bovis
PFATAGKLSGA

SEQ ID NO: 182511 - protein, 25 aa, Mycobacterium bovis
PFCPDPAEAAASPVTHAVTSSTDPM

SEQ ID NO: 182512 - protein, 8 aa, Mycobacterium bovis
PFDPRPPM

SEQ ID NO: 182513 - protein, 11 aa, Mycobacterium bovis
PFEPTERGGRL

SEQ ID NO: 182514 - protein, 6 aa, Mycobacterium bovis
PFGAAG

SEQ ID NO: 182515 - protein, 5 aa, Mycobacterium bovis
PFGAH

SEQ ID NO: 182516 - protein, 9 aa, Mycobacterium bovis
PFGATGQAL

SEQ ID NO: 182517 - protein, 12 aa, Mycobacterium bovis
PFGGYKQSGIGR

SEQ ID NO: 182518 - protein, 5 aa, Mycobacterium bovis
PFGSP

SEQ ID NO: 182519 - protein, 11 aa, Mycobacterium bovis
PFGSRNPDTNL

SEQ ID NO: 182520 - protein, 7 aa, Mycobacterium bovis
PFNPGSR

SEQ ID NO: 182521 - protein, 7 aa, Mycobacterium bovis
PFPAPTQ

SEQ ID NO: 182522 - protein, 11 aa, Mycobacterium bovis
PFPSGVQTAEN

SEQ ID NO: 182523 - protein, 17 aa, Mycobacterium bovis
PFSPPGADRQPGRAGQT

SEQ ID NO: 182524 - protein, 4 aa, Mycobacterium bovis
PFST

SEQ ID NO: 182525 - protein, 13 aa, Mycobacterium bovis
PFTPDQQAHREAE

SEQ ID NO: 182526 - protein, 4 aa, Mycobacterium bovis
PGAA

SEQ ID NO: 182527 - protein, 12 aa, Mycobacterium bovis
PGAAEPGADGAG

SEQ ID NO: 182528 - protein, 6 aa, Mycobacterium bovis
PGAAET

SEQ ID NO: 182529 - protein, 18 aa, Mycobacterium bovis
PGAAIGPRRGGECNPAPS

SEQ ID NO: 182530 - protein, 11 aa, Mycobacterium bovis
PGAATGPSRIG

SEQ ID NO: 182531 - protein, 4 aa, Mycobacterium bovis
PGAD

SEQ ID NO: 182532 - protein, 10 aa, Mycobacterium bovis
PGADPTLTTT

SEQ ID NO: 182533 - protein, 4 aa, Mycobacterium bovis
PGAE

SEQ ID NO: 182534 - protein, 8 aa, Mycobacterium bovis
PGAESPRE

SEQ ID NO: 182535 - protein, 8 aa, Mycobacterium bovis
PGAGCTED

SEQ ID NO: 182536 - protein, 8 aa, Mycobacterium bovis
PGAGEHGG

SEQ ID NO: 182537 - protein, 7 aa, Mycobacterium bovis
PGAGGEE

SEQ ID NO: 182538 - protein, 17 aa, Mycobacterium bovis
PGAGGKGGTGGTGGTAH

SEQ ID NO: 182539 - protein, 5 aa, Mycobacterium bovis
PGAGK

SEQ ID NO: 182540 - protein, 6 aa, Mycobacterium bovis
PGAGLE

SEQ ID NO: 182541 - protein, 5 aa, Mycobacterium bovis
PGAGP

SEQ ID NO: 182542 - protein, 11 aa, Mycobacterium bovis
PGAGRPRDPRI

SEQ ID NO: 182543 - protein, 5 aa, Mycobacterium bovis
PGALG

SEQ ID NO: 182544 - protein, 8 aa, Mycobacterium bovis
PGALGDQR

SEQ ID NO: 182545 - protein, 16 aa, Mycobacterium bovis
PGALGGGADDRESPLG

SEQ ID NO: 182546 - protein, 6 aa, Mycobacterium bovis
PGAPAS

SEQ ID NO: 182547 - protein, 9 aa, Mycobacterium bovis
PGAPPSLAG

SEQ ID NO: 182548 - protein, 12 aa, Mycobacterium bovis
PGAPSAPRKVGN

SEQ ID NO: 182549 - protein, 7 aa, Mycobacterium bovis
PGAQGIS

SEQ ID NO: 182550 - protein, 6 aa, Mycobacterium bovis
PGARTA

SEQ ID NO: 182551 - protein, 8 aa, Mycobacterium bovis
PGASDTAR

SEQ ID NO: 182552 - protein, 7 aa, Mycobacterium bovis
PGASPVH

SEQ ID NO: 182553 - protein, 9 aa, Mycobacterium bovis
PGASRGRGL

SEQ ID NO: 182554 - protein, 6 aa, Mycobacterium bovis
PGASSV

SEQ ID NO: 182555 - protein, 17 aa, Mycobacterium bovis
PGASVSSRSVADRPNRK

SEQ ID NO: 182556 - protein, 4 aa, Mycobacterium bovis
PGAT

SEQ ID NO: 182557 - protein, 8 aa, Mycobacterium bovis
PGATTQRH

SEQ ID NO: 182558 - protein, 8 aa, Mycobacterium bovis
PGATVEDA

SEQ ID NO: 182559 - protein, 5 aa, Mycobacterium bovis
PGAVE

SEQ ID NO: 182560 - protein, 9 aa, Mycobacterium bovis
PGCDRPATQ

SEQ ID NO: 182561 - protein, 14 aa, Mycobacterium bovis
PGDAVDSDPLPGPD

SEQ ID NO: 182562 - protein, 5 aa, Mycobacterium bovis
PGDDA

SEQ ID NO: 182563 - protein, 9 aa, Mycobacterium bovis
PGDDGRVTG

SEQ ID NO: 182564 - protein, 22 aa, Mycobacterium bovis
PGDDYRDPEGTDTRNYGGQHGL

SEQ ID NO: 182565 - protein, 5 aa, Mycobacterium bovis
PGDEG

SEQ ID NO: 182566 - protein, 5 aa, Mycobacterium bovis
PGDGA

SEQ ID NO: 182567 - protein, 10 aa, Mycobacterium bovis
PGDGSDTHAV

SEQ ID NO: 182568 - protein, 5 aa, Mycobacterium bovis
PGDHQ

SEQ ID NO: 182569 - protein, 14 aa, Mycobacterium bovis
PGDLGTKGGIRTDV

SEQ ID NO: 182570 - protein, 46 aa, Mycobacterium bovis
PGDLNTGSFNPGSFNTGGFNPGSGNTGYLNTGDYNTGVANTGDVDT

SEQ ID NO: 182571 - protein, 5 aa, Mycobacterium bovis
PGDPA

SEQ ID NO: 182572 - protein, 24 aa, Mycobacterium bovis
PGDPEFGDPLSTAGEGGPRAAARA

SEQ ID NO: 182573 - protein, 8 aa, Mycobacterium bovis
PGDPSLDA

SEQ ID NO: 182574 - protein, 10 aa, Mycobacterium bovis
PGDREVDDKR

SEQ ID NO: 182575 - protein, 9 aa, Mycobacterium bovis
PGDRRAARA

SEQ ID NO: 182576 - protein, 5 aa, Mycobacterium bovis
PGDRV

SEQ ID NO: 182577 - protein, 8 aa, Mycobacterium bovis
PGDTTPGQ

SEQ ID NO: 182578 - protein, 5 aa, Mycobacterium bovis
PGEAA

SEQ ID NO: 182579 - protein, 8 aa, Mycobacterium bovis
PGEAAAAR

SEQ ID NO: 182580 - protein, 5 aa, Mycobacterium bovis
PGEAG

SEQ ID NO: 182581 - protein, 9 aa, Mycobacterium bovis
PGEAGPQAT

SEQ ID NO: 182582 - protein, 10 aa, Mycobacterium bovis
PGEAKNTYGT

SEQ ID NO: 182583 - protein, 7 aa, Mycobacterium bovis
PGEGHNL

SEQ ID NO: 182584 - protein, 4 aa, Mycobacterium bovis
PGEL

SEQ ID NO: 182585 - protein, 6 aa, Mycobacterium bovis
PGEPAA

SEQ ID NO: 182586 - protein, 5 aa, Mycobacterium bovis
PGEPP

SEQ ID NO: 182587 - protein, 12 aa, Mycobacterium bovis
PGEPQSLADDSL

SEQ ID NO: 182588 - protein, 6 aa, Mycobacterium bovis
PGERER

SEQ ID NO: 182589 - protein, 16 aa, Mycobacterium bovis
PGESDGTCGRGEPQAG

SEQ ID NO: 182590 - protein, 5 aa, Mycobacterium bovis
PGESR

SEQ ID NO: 182591 - protein, 6 aa, Mycobacterium bovis
PGESRA

SEQ ID NO: 182592 - protein, 8 aa, Mycobacterium bovis
PGETEEDF

SEQ ID NO: 182593 - protein, 4 aa, Mycobacterium bovis
PGEY

SEQ ID NO: 182594 - protein, 16 aa, Mycobacterium bovis
PGEYTQLTGRAGRRGI

SEQ ID NO: 182595 - protein, 14 aa, Mycobacterium bovis
PGFASSPQSGEDRS

SEQ ID NO: 182596 - protein, 7 aa, Mycobacterium bovis
PGFDKKA

SEQ ID NO: 182597 - protein, 4 aa, Mycobacterium bovis
PGFE

SEQ ID NO: 182598 - protein, 6 aa, Mycobacterium bovis
PGFGEQ

SEQ ID NO: 182599 - protein, 6 aa, Mycobacterium bovis
PGFGKS

SEQ ID NO: 182600 - protein, 6 aa, Mycobacterium bovis
PGFGNT

SEQ ID NO: 182601 - protein, 14 aa, Mycobacterium bovis
PGFGNTTGAPSSGF

SEQ ID NO: 182602 - protein, 14 aa, Mycobacterium bovis
PGFGNTTTAPSSGF

SEQ ID NO: 182603 - protein, 4 aa, Mycobacterium bovis
PGFQ

SEQ ID NO: 182604 - protein, 7 aa, Mycobacterium bovis
PGFSPAT

SEQ ID NO: 182605 - protein, 13 aa, Mycobacterium bovis
PGFTATAPPGDGQ

SEQ ID NO: 182606 - protein, 4 aa, Mycobacterium bovis
PGGA

SEQ ID NO: 182607 - protein, 10 aa, Mycobacterium bovis
PGGAAPEVTV

SEQ ID NO: 182608 - protein, 5 aa, Mycobacterium bovis
PGGDE

SEQ ID NO: 182609 - protein, 11 aa, Mycobacterium bovis
PGGDPHAGHTE

SEQ ID NO: 182610 - protein, 5 aa, Mycobacterium bovis
PGGDR

SEQ ID NO: 182611 - protein, 5 aa, Mycobacterium bovis
PGGDV

SEQ ID NO: 182612 - protein, 5 aa, Mycobacterium bovis
PGGES

SEQ ID NO: 182613 - protein, 7 aa, Mycobacterium bovis
PGGESGF

SEQ ID NO: 182614 - protein, 7 aa, Mycobacterium bovis
PGGESTT

SEQ ID NO: 182615 - protein, 5 aa, Mycobacterium bovis
PGGGD

SEQ ID NO: 182616 - protein, 7 aa, Mycobacterium bovis
PGGGGVT

SEQ ID NO: 182617 - protein, 14 aa, Mycobacterium bovis
PGGHKLDDDTEDQI

SEQ ID NO: 182618 - protein, 6 aa, Mycobacterium bovis
PGGLGR

SEQ ID NO: 182619 - protein, 4 aa, Mycobacterium bovis
PGGM

SEQ ID NO: 182620 - protein, 5 aa, Mycobacterium bovis
PGGMS

SEQ ID NO: 182621 - protein, 11 aa, Mycobacterium bovis
PGGPDDSDYTR

SEQ ID NO: 182622 - protein, 17 aa, Mycobacterium bovis
PGGPGYFNSSTAPSSGF

SEQ ID NO: 182623 - protein, 10 aa, Mycobacterium bovis
PGGPLTAQQV

SEQ ID NO: 182624 - protein, 9 aa, Mycobacterium bovis
PGGPNGEDA

SEQ ID NO: 182625 - protein, 7 aa, Mycobacterium bovis
PGGPRAQ

SEQ ID NO: 182626 - protein, 8 aa, Mycobacterium bovis
PGGQGDDV

SEQ ID NO: 182627 - protein, 8 aa, Mycobacterium bovis
PGGQPPTI

SEQ ID NO: 182628 - protein, 6 aa, Mycobacterium bovis
PGGQTQ

SEQ ID NO: 182629 - protein, 12 aa, Mycobacterium bovis
PGGRAYDEPPVN

SEQ ID NO: 182630 - protein, 15 aa, Mycobacterium bovis
PGGRLRNDEDMTSSV

SEQ ID NO: 182631 - protein, 6 aa, Mycobacterium bovis
PGGSPL

SEQ ID NO: 182632 - protein, 9 aa, Mycobacterium bovis
PGGSSTPLL

SEQ ID NO: 182633 - protein, 17 aa, Mycobacterium bovis
PGGSVRDEEVTEAAAKA

SEQ ID NO: 182634 - protein, 4 aa, Mycobacterium bovis
PGGT

SEQ ID NO: 182635 - protein, 5 aa, Mycobacterium bovis
PGGTA

SEQ ID NO: 182636 - protein, 4 aa, Mycobacterium bovis
PGGV

SEQ ID NO: 182637 - protein, 8 aa, Mycobacterium bovis
PGGVDSPE

SEQ ID NO: 182638 - protein, 9 aa, Mycobacterium bovis
PGGVNSPDD

SEQ ID NO: 182639 - protein, 8 aa, Mycobacterium bovis
PGHAEAGS

SEQ ID NO: 182640 - protein, 7 aa, Mycobacterium bovis
PGHGNTG

SEQ ID NO: 182641 - protein, 5 aa, Mycobacterium bovis
PGHGP

SEQ ID NO: 182642 - protein, 18 aa, Mycobacterium bovis
PGHIPSTSHRRGTGDINR

SEQ ID NO: 182643 - protein, 9 aa, Mycobacterium bovis
PGHPVSGEE

SEQ ID NO: 182644 - protein, 7 aa, Mycobacterium bovis
PGHSAAG

SEQ ID NO: 182645 - protein, 7 aa, Mycobacterium bovis
PGHTPGS

SEQ ID NO: 182646 - protein, 4 aa, Mycobacterium bovis
PGIA

SEQ ID NO: 182647 - protein, 7 aa, Mycobacterium bovis
PGIDTGR

SEQ ID NO: 182648 - protein, 6 aa, Mycobacterium bovis
PGIGKA

SEQ ID NO: 182649 - protein, 9 aa, Mycobacterium bovis
PGIGPKSAQ

SEQ ID NO: 182650 - protein, 5 aa, Mycobacterium bovis
PGIPK

SEQ ID NO: 182651 - protein, 11 aa, Mycobacterium bovis
PGKAGANAADA

SEQ ID NO: 182652 - protein, 7 aa, Mycobacterium bovis
PGKEEFS

SEQ ID NO: 182653 - protein, 6 aa, Mycobacterium bovis
PGKEPW

SEQ ID NO: 182654 - protein, 6 aa, Mycobacterium bovis
PGKPAT

SEQ ID NO: 182655 - protein, 14 aa, Mycobacterium bovis
PGKTKVNPSGGPLA

SEQ ID NO: 182656 - protein, 6 aa, Mycobacterium bovis
PGLAEA

SEQ ID NO: 182657 - protein, 4 aa, Mycobacterium bovis
PGLD

SEQ ID NO: 182658 - protein, 8 aa, Mycobacterium bovis
PGLDDRAS

SEQ ID NO: 182659 - protein, 4 aa, Mycobacterium bovis
PGLG

SEQ ID NO: 182660 - protein, 14 aa, Mycobacterium bovis
PGLGPLPATGRGLR

SEQ ID NO: 182661 - protein, 9 aa, Mycobacterium bovis
PGLGVRPAT

SEQ ID NO: 182662 - protein, 5 aa, Mycobacterium bovis
PGLNS

SEQ ID NO: 182663 - protein, 9 aa, Mycobacterium bovis
PGLPPPPEQ

SEQ ID NO: 182664 - protein, 17 aa, Mycobacterium bovis
PGLQAQREQLRAELART

SEQ ID NO: 182665 - protein, 6 aa, Mycobacterium bovis
PGMPQG

SEQ ID NO: 182666 - protein, 10 aa, Mycobacterium bovis
PGMPRDTPYS

SEQ ID NO: 182667 - protein, 6 aa, Mycobacterium bovis
PGMTMP

SEQ ID NO: 182668 - protein, 8 aa, Mycobacterium bovis
PGNAAVAD

SEQ ID NO: 182669 - protein, 10 aa, Mycobacterium bovis
PGNAGTARIA

SEQ ID NO: 182670 - protein, 9 aa, Mycobacterium bovis
PGNDYAGDQ

SEQ ID NO: 182671 - protein, 5 aa, Mycobacterium bovis
PGNFT

SEQ ID NO: 182672 - protein, 5 aa, Mycobacterium bovis
PGNPV

SEQ ID NO: 182673 - protein, 8 aa, Mycobacterium bovis
PGNRPSTS

SEQ ID NO: 182674 - protein, 29 aa, Mycobacterium bovis
PGNVNTGVGNTGSINTGSFNTGSTNTGSF

SEQ ID NO: 182675 - protein, 6 aa, Mycobacterium bovis
PGPAAY

SEQ ID NO: 182676 - protein, 31 aa, Mycobacterium bovis
PGPAGGLPPSEVGNPNPATVNPANPTPGLAA

SEQ ID NO: 182677 - protein, 5 aa, Mycobacterium bovis
PGPAH

SEQ ID NO: 182678 - protein, 11 aa, Mycobacterium bovis
PGPDAVTPAAD

SEQ ID NO: 182679 - protein, 6 aa, Mycobacterium bovis
PGPDGE

SEQ ID NO: 182680 - protein, 5 aa, Mycobacterium bovis
PGPFT

SEQ ID NO: 182681 - protein, 6 aa, Mycobacterium bovis
PGPGEL

SEQ ID NO: 182682 - protein, 6 aa, Mycobacterium bovis
PGPGGL

SEQ ID NO: 182683 - protein, 7 aa, Mycobacterium bovis
PGPGLTV

SEQ ID NO: 182684 - protein, 18 aa, Mycobacterium bovis
PGPGSEPGESRLYQPGDD

SEQ ID NO: 182685 - protein, 6 aa, Mycobacterium bovis
PGPGSV

SEQ ID NO: 182686 - protein, 4 aa, Mycobacterium bovis
PGPH

SEQ ID NO: 182687 - protein, 6 aa, Mycobacterium bovis
PGPHGP

SEQ ID NO: 182688 - protein, 10 aa, Mycobacterium bovis
PGPHRRTQRS

SEQ ID NO: 182689 - protein, 10 aa, Mycobacterium bovis
PGPLDVAEGD

SEQ ID NO: 182690 - protein, 5 aa, Mycobacterium bovis
PGPLR

SEQ ID NO: 182691 - protein, 6 aa, Mycobacterium bovis
PGPPTI

SEQ ID NO: 182692 - protein, 8 aa, Mycobacterium bovis
PGPPVPTT

SEQ ID NO: 182693 - protein, 4 aa, Mycobacterium bovis
PGPR

SEQ ID NO: 182694 - protein, 5 aa, Mycobacterium bovis
PGPSI

SEQ ID NO: 182695 - protein, 5 aa, Mycobacterium bovis
PGPTD

SEQ ID NO: 182696 - protein, 15 aa, Mycobacterium bovis
PGPTGEQHVAYLKRP

SEQ ID NO: 182697 - protein, 5 aa, Mycobacterium bovis
PGPTL

SEQ ID NO: 182698 - protein, 5 aa, Mycobacterium bovis
PGPVA

SEQ ID NO: 182699 - protein, 11 aa, Mycobacterium bovis
PGPVTSSASAG

SEQ ID NO: 182700 - protein, 9 aa, Mycobacterium bovis
PGQAAAYGA

SEQ ID NO: 182701 - protein, 8 aa, Mycobacterium bovis
PGQAAYNS

SEQ ID NO: 182702 - protein, 12 aa, Mycobacterium bovis
PGQDRQRRAALC

SEQ ID NO: 182703 - protein, 12 aa, Mycobacterium bovis
PGQHDRSGLPPL

SEQ ID NO: 182704 - protein, 6 aa, Mycobacterium bovis
PGQPAL

SEQ ID NO: 182705 - protein, 7 aa, Mycobacterium bovis
PGQPLPT

SEQ ID NO: 182706 - protein, 6 aa, Mycobacterium bovis
PGQQGG

SEQ ID NO: 182707 - protein, 8 aa, Mycobacterium bovis
PGQQGGPL

SEQ ID NO: 182708 - protein, 5 aa, Mycobacterium bovis
PGQRI

SEQ ID NO: 182709 - protein, 4 aa, Mycobacterium bovis
PGQT

SEQ ID NO: 182710 - protein, 5 aa, Mycobacterium bovis
PGQTG

SEQ ID NO: 182711 - protein, 5 aa, Mycobacterium bovis
PGRAD

SEQ ID NO: 182712 - protein, 13 aa, Mycobacterium bovis
PGRAKLSDGSERD

SEQ ID NO: 182713 - protein, 6 aa, Mycobacterium bovis
PGRAMT

SEQ ID NO: 182714 - protein, 12 aa, Mycobacterium bovis
PGRATRGFHNHR

SEQ ID NO: 182715 - protein, 5 aa, Mycobacterium bovis
PGRFG

SEQ ID NO: 182716 - protein, 6 aa, Mycobacterium bovis
PGRGPQ

SEQ ID NO: 182717 - protein, 9 aa, Mycobacterium bovis
PGRGTQPTA

SEQ ID NO: 182718 - protein, 4 aa, Mycobacterium bovis
PGRL

SEQ ID NO: 182719 - protein, 8 aa, Mycobacterium bovis
PGRNAADV

SEQ ID NO: 182720 - protein, 4 aa, Mycobacterium bovis
PGRP

SEQ ID NO: 182721 - protein, 13 aa, Mycobacterium bovis
PGRPAAGSDPDWD

SEQ ID NO: 182722 - protein, 8 aa, Mycobacterium bovis
PGRPAPTL

SEQ ID NO: 182723 - protein, 5 aa, Mycobacterium bovis
PGRPP

SEQ ID NO: 182724 - protein, 7 aa, Mycobacterium bovis
PGRPPRH

SEQ ID NO: 182725 - protein, 8 aa, Mycobacterium bovis
PGRPRPGY

SEQ ID NO: 182726 - protein, 10 aa, Mycobacterium bovis
PGRPSRTPAQ

SEQ ID NO: 182727 - protein, 5 aa, Mycobacterium bovis
PGRRA

SEQ ID NO: 182728 - protein, 6 aa, Mycobacterium bovis
PGRRTD

SEQ ID NO: 182729 - protein, 4 aa, Mycobacterium bovis
PGRS

SEQ ID NO: 182730 - protein, 4 aa, Mycobacterium bovis
PGRT

SEQ ID NO: 182731 - protein, 8 aa, Mycobacterium bovis
PGRTVTEA

SEQ ID NO: 182732 - protein, 12 aa, Mycobacterium bovis
PGRWDEDGEKRI

SEQ ID NO: 182733 - protein, 8 aa, Mycobacterium bovis
PGRYGPYS

SEQ ID NO: 182734 - protein, 4 aa, Mycobacterium bovis
PGSA

SEQ ID NO: 182735 - protein, 22 aa, Mycobacterium bovis
PGSAAPPATDRRRDGFARRSGQ

SEQ ID NO: 182736 - protein, 10 aa, Mycobacterium bovis
PGSADSEGPV

SEQ ID NO: 182737 - protein, 5 aa, Mycobacterium bovis
PGSAT

SEQ ID NO: 182738 - protein, 4 aa, Mycobacterium bovis
PGSG

SEQ ID NO: 182739 - protein, 6 aa, Mycobacterium bovis
PGSGPI

SEQ ID NO: 182740 - protein, 4 aa, Mycobacterium bovis
PGSP

SEQ ID NO: 182741 - protein, 5 aa, Mycobacterium bovis
PGSPD

SEQ ID NO: 182742 - protein, 12 aa, Mycobacterium bovis
PGSPFGERRPSD

SEQ ID NO: 182743 - protein, 9 aa, Mycobacterium bovis
PGSPGGVRD

SEQ ID NO: 182744 - protein, 5 aa, Mycobacterium bovis
PGSRF

SEQ ID NO: 182745 - protein, 13 aa, Mycobacterium bovis
PGSRFAQATRAAG

SEQ ID NO: 182746 - protein, 7 aa, Mycobacterium bovis
PGSRGIT

SEQ ID NO: 182747 - protein, 12 aa, Mycobacterium bovis
PGSRPIDLFGAP

SEQ ID NO: 182748 - protein, 6 aa, Mycobacterium bovis
PGSTDV

SEQ ID NO: 182749 - protein, 5 aa, Mycobacterium bovis
PGSTP

SEQ ID NO: 182750 - protein, 8 aa, Mycobacterium bovis
PGSVEPGA

SEQ ID NO: 182751 - protein, 7 aa, Mycobacterium bovis
PGTAAPL

SEQ ID NO: 182752 - protein, 35 aa, Mycobacterium bovis
PGTAGGGADGANGSAIGQAGGAGGDGGNASTSGGI

SEQ ID NO: 182753 - protein, 5 aa, Mycobacterium bovis
PGTAR

SEQ ID NO: 182754 - protein, 5 aa, Mycobacterium bovis
PGTDF

SEQ ID NO: 182755 - protein, 7 aa, Mycobacterium bovis
PGTDQEY

SEQ ID NO: 182756 - protein, 7 aa, Mycobacterium bovis
PGTEAPA

SEQ ID NO: 182757 - protein, 7 aa, Mycobacterium bovis
PGTGLDE

SEQ ID NO: 182758 - protein, 6 aa, Mycobacterium bovis
PGTGNM

SEQ ID NO: 182759 - protein, 8 aa, Mycobacterium bovis
PGTGRPAV

SEQ ID NO: 182760 - protein, 4 aa, Mycobacterium bovis
PGTL

SEQ ID NO: 182761 - protein, 5 aa, Mycobacterium bovis
PGTMN

SEQ ID NO: 182762 - protein, 8 aa, Mycobacterium bovis
PGTNGQVS

SEQ ID NO: 182763 - protein, 6 aa, Mycobacterium bovis
PGTPGL

SEQ ID NO: 182764 - protein, 12 aa, Mycobacterium bovis
PGTPPGSIGRGA

SEQ ID NO: 182765 - protein, 19 aa, Mycobacterium bovis
PGTQPADAQTATSATVRPL

SEQ ID NO: 182766 - protein, 5 aa, Mycobacterium bovis
PGTSI

SEQ ID NO: 182767 - protein, 9 aa, Mycobacterium bovis
PGTSSSVKG

SEQ ID NO: 182768 - protein, 6 aa, Mycobacterium bovis
PGTTPE

SEQ ID NO: 182769 - protein, 10 aa, Mycobacterium bovis
PGTTSVHSSG

SEQ ID NO: 182770 - protein, 13 aa, Mycobacterium bovis
PGTYSSAGPVGDG

SEQ ID NO: 182771 - protein, 8 aa, Mycobacterium bovis
PGVDPDKD

SEQ ID NO: 182772 - protein, 11 aa, Mycobacterium bovis
PGVDTPAEDGV

SEQ ID NO: 182773 - protein, 5 aa, Mycobacterium bovis
PGVEP

SEQ ID NO: 182774 - protein, 18 aa, Mycobacterium bovis
PGVGSRPPLSTNARPEGV

SEQ ID NO: 182775 - protein, 11 aa, Mycobacterium bovis
PGVGSTTRGAL

SEQ ID NO: 182776 - protein, 11 aa, Mycobacterium bovis
PGVGTRSAPDL

SEQ ID NO: 182777 - protein, 9 aa, Mycobacterium bovis
PGVKPPDVD

SEQ ID NO: 182778 - protein, 16 aa, Mycobacterium bovis
PGVQVSSDAAAARSAA

SEQ ID NO: 182779 - protein, 10 aa, Mycobacterium bovis
PGVSGTTRQT

SEQ ID NO: 182780 - protein, 4 aa, Mycobacterium bovis
PGVT

SEQ ID NO: 182781 - protein, 7 aa, Mycobacterium bovis
PGVTAVE

SEQ ID NO: 182782 - protein, 13 aa, Mycobacterium bovis
PGVTGKPVGNDLA

SEQ ID NO: 182783 - protein, 12 aa, Mycobacterium bovis
PGVTPGDVRDAT

SEQ ID NO: 182784 - protein, 7 aa, Mycobacterium bovis
PGWGSKR

SEQ ID NO: 182785 - protein, 12 aa, Mycobacterium bovis
PGWPTTTASRRP

SEQ ID NO: 182786 - protein, 14 aa, Mycobacterium bovis
PGWSAPPATPQAQT

SEQ ID NO: 182787 - protein, 6 aa, Mycobacterium bovis
PGYTSA

SEQ ID NO: 182788 - protein, 6 aa, Mycobacterium bovis
PHADGP

SEQ ID NO: 182789 - protein, 10 aa, Mycobacterium bovis
PHAETAQPQY

SEQ ID NO: 182790 - protein, 4 aa, Mycobacterium bovis
PHAG

SEQ ID NO: 182791 - protein, 6 aa, Mycobacterium bovis
PHAGAS

SEQ ID NO: 182792 - protein, 10 aa, Mycobacterium bovis
PHAPDTHSPL

SEQ ID NO: 182793 - protein, 8 aa, Mycobacterium bovis
PHASEAAS

SEQ ID NO: 182794 - protein, 5 aa, Mycobacterium bovis
PHDAP

SEQ ID NO: 182795 - protein, 6 aa, Mycobacterium bovis
PHDDKQ

SEQ ID NO: 182796 - protein, 8 aa, Mycobacterium bovis
PHDESPTL

SEQ ID NO: 182797 - protein, 8 aa, Mycobacterium bovis
PHDSPTAR

SEQ ID NO: 182798 - protein, 4 aa, Mycobacterium bovis
PHDV

SEQ ID NO: 182799 - protein, 10 aa, Mycobacterium bovis
PHERNPEVQQ

SEQ ID NO: 182800 - protein, 6 aa, Mycobacterium bovis
PHETGR

SEQ ID NO: 182801 - protein, 14 aa, Mycobacterium bovis
PHGADPATGKPTSE

SEQ ID NO: 182802 - protein, 12 aa, Mycobacterium bovis
PHGELTQDPAAK

SEQ ID NO: 182803 - protein, 7 aa, Mycobacterium bovis
PHGGDAT

SEQ ID NO: 182804 - protein, 4 aa, Mycobacterium bovis
PHGH

SEQ ID NO: 182805 - protein, 7 aa, Mycobacterium bovis
PHGNGET

SEQ ID NO: 182806 - protein, 8 aa, Mycobacterium bovis
PHGTGKTA

SEQ ID NO: 182807 - protein, 11 aa, Mycobacterium bovis
PHGTPDEPKGV

SEQ ID NO: 182808 - protein, 6 aa, Mycobacterium bovis
PHITYQ

SEQ ID NO: 182809 - protein, 6 aa, Mycobacterium bovis
PHKRTG

SEQ ID NO: 182810 - protein, 19 aa, Mycobacterium bovis
PHKTSSRRVEVRSPDSACN

SEQ ID NO: 182811 - protein, 8 aa, Mycobacterium bovis
PHLPPPTR

SEQ ID NO: 182812 - protein, 7 aa, Mycobacterium bovis
PHNPTGA

SEQ ID NO: 182813 - protein, 5 aa, Mycobacterium bovis
PHPID

SEQ ID NO: 182814 - protein, 18 aa, Mycobacterium bovis
PHPPRDAREFRTSTGKAN

SEQ ID NO: 182815 - protein, 4 aa, Mycobacterium bovis
PHPR

SEQ ID NO: 182816 - protein, 4 aa, Mycobacterium bovis
PHPT

SEQ ID NO: 182817 - protein, 8 aa, Mycobacterium bovis
PHPTDGRT

SEQ ID NO: 182818 - protein, 16 aa, Mycobacterium bovis
PHPTSDHGQPRTNTCR

SEQ ID NO: 182819 - protein, 6 aa, Mycobacterium bovis
PHPTSR

SEQ ID NO: 182820 - protein, 7 aa, Mycobacterium bovis
PHQAADG

SEQ ID NO: 182821 - protein, 7 aa, Mycobacterium bovis
PHRGGAV

SEQ ID NO: 182822 - protein, 5 aa, Mycobacterium bovis
PHTAE

SEQ ID NO: 182823 - protein, 10 aa, Mycobacterium bovis
PHTEEPTNWS

SEQ ID NO: 182824 - protein, 16 aa, Mycobacterium bovis
PHTGGQKSVSASGDTL

SEQ ID NO: 182825 - protein, 7 aa, Mycobacterium bovis
PHTPLNE

SEQ ID NO: 182826 - protein, 17 aa, Mycobacterium bovis
PHTTADDPTRYRSQEEV

SEQ ID NO: 182827 - protein, 6 aa, Mycobacterium bovis
PHYGPP

SEQ ID NO: 182828 - protein, 11 aa, Mycobacterium bovis
PIADPVSRTQV

SEQ ID NO: 182829 - protein, 6 aa, Mycobacterium bovis
PIAGAR

SEQ ID NO: 182830 - protein, 6 aa, Mycobacterium bovis
PIASES

SEQ ID NO: 182831 - protein, 18 aa, Mycobacterium bovis
PIATKADNPALPTSPEEI

SEQ ID NO: 182832 - protein, 7 aa, Mycobacterium bovis
PIDQPDY

SEQ ID NO: 182833 - protein, 4 aa, Mycobacterium bovis
PIES

SEQ ID NO: 182834 - protein, 5 aa, Mycobacterium bovis
PIGED

SEQ ID NO: 182835 - protein, 16 aa, Mycobacterium bovis
PIGPACGRRSKGPNHF

SEQ ID NO: 182836 - protein, 5 aa, Mycobacterium bovis
PIGRG

SEQ ID NO: 182837 - protein, 6 aa, Mycobacterium bovis
PIHPSG

SEQ ID NO: 182838 - protein, 7 aa, Mycobacterium bovis
PINIPSP

SEQ ID NO: 182839 - protein, 8 aa, Mycobacterium bovis
PINPSGGL

SEQ ID NO: 182840 - protein, 5 aa, Mycobacterium bovis
PIPDD

SEQ ID NO: 182841 - protein, 13 aa, Mycobacterium bovis
PIPDPDRAGPSTL

SEQ ID NO: 182842 - protein, 140 aa, Mycobacterium bovis
PIPEPLADDEDVDDGPDYVADDSDADDEGQLDRPANRRRRRGRRGRGRGRGEQGGSDGDPVDQQSEPRAQQFTSADAAETDDGDDRDSEDTEAGDNGEDENGSLEAGNRRRRRRRRRKSASGDDNDAALEGPLPDDPPNT

SEQ ID NO: 182843 - protein, 9 aa, Mycobacterium bovis
PIPESGGSR

SEQ ID NO: 182844 - protein, 4 aa, Mycobacterium bovis
PIPG

SEQ ID NO: 182845 - protein, 14 aa, Mycobacterium bovis
PIPPNKPNIREDEA

SEQ ID NO: 182846 - protein, 8 aa, Mycobacterium bovis
PIPRPPSI

SEQ ID NO: 182847 - protein, 10 aa, Mycobacterium bovis
PIPVGTQGGT

SEQ ID NO: 182848 - protein, 4 aa, Mycobacterium bovis
PIQR

SEQ ID NO: 182849 - protein, 15 aa, Mycobacterium bovis
PISHPDTAILAMLLA

SEQ ID NO: 182850 - protein, 10 aa, Mycobacterium bovis
PISPERAEAK

SEQ ID NO: 182851 - protein, 7 aa, Mycobacterium bovis
PISREHA

SEQ ID NO: 182852 - protein, 12 aa, Mycobacterium bovis
PISRQSAEAKLG

SEQ ID NO: 182853 - protein, 5 aa, Mycobacterium bovis
PITAL

SEQ ID NO: 182854 - protein, 5 aa, Mycobacterium bovis
PITDG

SEQ ID NO: 182855 - protein, 7 aa, Mycobacterium bovis
PITDSEA

SEQ ID NO: 182856 - protein, 8 aa, Mycobacterium bovis
PITGTGPA

SEQ ID NO: 182857 - protein, 5 aa, Mycobacterium bovis
PITPA

SEQ ID NO: 182858 - protein, 10 aa, Mycobacterium bovis
PITSSTLTEE

SEQ ID NO: 182859 - protein, 10 aa, Mycobacterium bovis
PKAAAGALSP

SEQ ID NO: 182860 - protein, 13 aa, Mycobacterium bovis
PKAAAKELGPDGA

SEQ ID NO: 182861 - protein, 6 aa, Mycobacterium bovis
PKADGF

SEQ ID NO: 182862 - protein, 8 aa, Mycobacterium bovis
PKADGGGA

SEQ ID NO: 182863 - protein, 10 aa, Mycobacterium bovis
PKAEGTSPHL

SEQ ID NO: 182864 - protein, 10 aa, Mycobacterium bovis
PKAGEPARGI

SEQ ID NO: 182865 - protein, 10 aa, Mycobacterium bovis
PKASTPAPRR

SEQ ID NO: 182866 - protein, 6 aa, Mycobacterium bovis
PKATGA

SEQ ID NO: 182867 - protein, 10 aa, Mycobacterium bovis
PKATPAQTQA

SEQ ID NO: 182868 - protein, 6 aa, Mycobacterium bovis
PKAVPS

SEQ ID NO: 182869 - protein, 4 aa, Mycobacterium bovis
PKAY

SEQ ID NO: 182870 - protein, 11 aa, Mycobacterium bovis
PKDAPTGGDPL

SEQ ID NO: 182871 - protein, 7 aa, Mycobacterium bovis
PKDLSGV

SEQ ID NO: 182872 - protein, 10 aa, Mycobacterium bovis
PKEEVSEQEY

SEQ ID NO: 182873 - protein, 4 aa, Mycobacterium bovis
PKEI

SEQ ID NO: 182874 - protein, 7 aa, Mycobacterium bovis
PKEVGAD

SEQ ID NO: 182875 - protein, 9 aa, Mycobacterium bovis
PKGAAGNTG

SEQ ID NO: 182876 - protein, 10 aa, Mycobacterium bovis
PKGAPGEPIT

SEQ ID NO: 182877 - protein, 14 aa, Mycobacterium bovis
PKGKVDPGETAPVG

SEQ ID NO: 182878 - protein, 9 aa, Mycobacterium bovis
PKGMSEEMT

SEQ ID NO: 182879 - protein, 6 aa, Mycobacterium bovis
PKGPGH

SEQ ID NO: 182880 - protein, 11 aa, Mycobacterium bovis
PKGQARQAAEE

SEQ ID NO: 182881 - protein, 5 aa, Mycobacterium bovis
PKGYQ

SEQ ID NO: 182882 - protein, 4 aa, Mycobacterium bovis
PKHA

SEQ ID NO: 182883 - protein, 9 aa, Mycobacterium bovis
PKKKNGFEL

SEQ ID NO: 182884 - protein, 9 aa, Mycobacterium bovis
PKKSEITER

SEQ ID NO: 182885 - protein, 6 aa, Mycobacterium bovis
PKLGTR

SEQ ID NO: 182886 - protein, 9 aa, Mycobacterium bovis
PKLSAGRVQ

SEQ ID NO: 182887 - protein, 8 aa, Mycobacterium bovis
PKPDYSAM

SEQ ID NO: 182888 - protein, 6 aa, Mycobacterium bovis
PKPIPH

SEQ ID NO: 182889 - protein, 5 aa, Mycobacterium bovis
PKPLR

SEQ ID NO: 182890 - protein, 13 aa, Mycobacterium bovis
PKPLRPGADQTIG

SEQ ID NO: 182891 - protein, 7 aa, Mycobacterium bovis
PKPPFAQ

SEQ ID NO: 182892 - protein, 9 aa, Mycobacterium bovis
PKPRNPRDD

SEQ ID NO: 182893 - protein, 11 aa, Mycobacterium bovis
PKPSDAEEART

SEQ ID NO: 182894 - protein, 9 aa, Mycobacterium bovis
PKRGPDLPA

SEQ ID NO: 182895 - protein, 18 aa, Mycobacterium bovis
PKRPALRPTKAAATTAAT

SEQ ID NO: 182896 - protein, 7 aa, Mycobacterium bovis
PKRRPLD

SEQ ID NO: 182897 - protein, 6 aa, Mycobacterium bovis
PKRRRP

SEQ ID NO: 182898 - protein, 13 aa, Mycobacterium bovis
PKRSPSEGSADNA

SEQ ID NO: 182899 - protein, 7 aa, Mycobacterium bovis
PKSERSE

SEQ ID NO: 182900 - protein, 5 aa, Mycobacterium bovis
PKSGA

SEQ ID NO: 182901 - protein, 7 aa, Mycobacterium bovis
PKSGSIK

SEQ ID NO: 182902 - protein, 9 aa, Mycobacterium bovis
PKSGYPGHA

SEQ ID NO: 182903 - protein, 13 aa, Mycobacterium bovis
PKSNAASPQPFRV

SEQ ID NO: 182904 - protein, 10 aa, Mycobacterium bovis
PKSSDAVTLR

SEQ ID NO: 182905 - protein, 22 aa, Mycobacterium bovis
PKTAAPSISNATVASPAAPGLE

SEQ ID NO: 182906 - protein, 8 aa, Mycobacterium bovis
PKTAETAA

SEQ ID NO: 182907 - protein, 4 aa, Mycobacterium bovis
PKTD

SEQ ID NO: 182908 - protein, 6 aa, Mycobacterium bovis
PKTGAV

SEQ ID NO: 182909 - protein, 5 aa, Mycobacterium bovis
PKTGQ

SEQ ID NO: 182910 - protein, 15 aa, Mycobacterium bovis
PKTKRTKTGYTTDAD

SEQ ID NO: 182911 - protein, 4 aa, Mycobacterium bovis
PKTQ

SEQ ID NO: 182912 - protein, 20 aa, Mycobacterium bovis
PKTRKQSRPGVRTPTARAAG

SEQ ID NO: 182913 - protein, 7 aa, Mycobacterium bovis
PKTRSGK

SEQ ID NO: 182914 - protein, 20 aa, Mycobacterium bovis
PKTSAPTGPRVSIQFRPRDV

SEQ ID NO: 182915 - protein, 10 aa, Mycobacterium bovis
PKVDEDSDVD

SEQ ID NO: 182916 - protein, 7 aa, Mycobacterium bovis
PKVNDRA

SEQ ID NO: 182917 - protein, 10 aa, Mycobacterium bovis
PLAAAEAEGA

SEQ ID NO: 182918 - protein, 5 aa, Mycobacterium bovis
PLAAD

SEQ ID NO: 182919 - protein, 11 aa, Mycobacterium bovis
PLADSTASQAR

SEQ ID NO: 182920 - protein, 7 aa, Mycobacterium bovis
PLAGESL

SEQ ID NO: 182921 - protein, 11 aa, Mycobacterium bovis
PLAGGSELRPI

SEQ ID NO: 182922 - protein, 6 aa, Mycobacterium bovis
PLAGHA

SEQ ID NO: 182923 - protein, 4 aa, Mycobacterium bovis
PLAP

SEQ ID NO: 182924 - protein, 12 aa, Mycobacterium bovis
PLAQPGTGDAGG

SEQ ID NO: 182925 - protein, 4 aa, Mycobacterium bovis
PLAR

SEQ ID NO: 182926 - protein, 14 aa, Mycobacterium bovis
PLASPLGSALGGTP

SEQ ID NO: 182927 - protein, 6 aa, Mycobacterium bovis
PLATDP

SEQ ID NO: 182928 - protein, 8 aa, Mycobacterium bovis
PLCTPSRG

SEQ ID NO: 182929 - protein, 5 aa, Mycobacterium bovis
PLDAH

SEQ ID NO: 182930 - protein, 15 aa, Mycobacterium bovis
PLDAKKSAKTTAAGT

SEQ ID NO: 182931 - protein, 9 aa, Mycobacterium bovis
PLDDERNAA

SEQ ID NO: 182932 - protein, 7 aa, Mycobacterium bovis
PLDDGTA

SEQ ID NO: 182933 - protein, 6 aa, Mycobacterium bovis
PLDDKA

SEQ ID NO: 182934 - protein, 8 aa, Mycobacterium bovis
PLDDPAAH

SEQ ID NO: 182935 - protein, 7 aa, Mycobacterium bovis
PLDPARR

SEQ ID NO: 182936 - protein, 6 aa, Mycobacterium bovis
PLDPDR

SEQ ID NO: 182937 - protein, 5 aa, Mycobacterium bovis
PLDPE

SEQ ID NO: 182938 - protein, 10 aa, Mycobacterium bovis
PLEATKEGRG

SEQ ID NO: 182939 - protein, 6 aa, Mycobacterium bovis
PLEDGT

SEQ ID NO: 182940 - protein, 7 aa, Mycobacterium bovis
PLEGPEA

SEQ ID NO: 182941 - protein, 8 aa, Mycobacterium bovis
PLEPGQQT

SEQ ID NO: 182942 - protein, 14 aa, Mycobacterium bovis
PLEPPGTPDDPDTT

SEQ ID NO: 182943 - protein, 6 aa, Mycobacterium bovis
PLETPA

SEQ ID NO: 182944 - protein, 4 aa, Mycobacterium bovis
PLGA

SEQ ID NO: 182945 - protein, 6 aa, Mycobacterium bovis
PLGAGK

SEQ ID NO: 182946 - protein, 11 aa, Mycobacterium bovis
PLGEQRAGQAD

SEQ ID NO: 182947 - protein, 10 aa, Mycobacterium bovis
PLGGGATGGI

SEQ ID NO: 182948 - protein, 14 aa, Mycobacterium bovis
PLGGPDGGNGGRGG

SEQ ID NO: 182949 - protein, 4 aa, Mycobacterium bovis
PLGP

SEQ ID NO: 182950 - protein, 5 aa, Mycobacterium bovis
PLGRD

SEQ ID NO: 182951 - protein, 13 aa, Mycobacterium bovis
PLGRQAEAAQRAA

SEQ ID NO: 182952 - protein, 4 aa, Mycobacterium bovis
PLGS

SEQ ID NO: 182953 - protein, 14 aa, Mycobacterium bovis
PLGSPGGAAAVGPI

SEQ ID NO: 182954 - protein, 7 aa, Mycobacterium bovis
PLGVGNG

SEQ ID NO: 182955 - protein, 13 aa, Mycobacterium bovis
PLHEGGNAARKSV

SEQ ID NO: 182956 - protein, 8 aa, Mycobacterium bovis
PLHGGAPA

SEQ ID NO: 182957 - protein, 5 aa, Mycobacterium bovis
PLNDP

SEQ ID NO: 182958 - protein, 5 aa, Mycobacterium bovis
PLNGS

SEQ ID NO: 182959 - protein, 8 aa, Mycobacterium bovis
PLNPPAAA

SEQ ID NO: 182960 - protein, 12 aa, Mycobacterium bovis
PLPAGDAARDEA

SEQ ID NO: 182961 - protein, 9 aa, Mycobacterium bovis
PLPAPRVSP

SEQ ID NO: 182962 - protein, 4 aa, Mycobacterium bovis
PLPD

SEQ ID NO: 182963 - protein, 5 aa, Mycobacterium bovis
PLPDG

SEQ ID NO: 182964 - protein, 7 aa, Mycobacterium bovis
PLPEGSG

SEQ ID NO: 182965 - protein, 10 aa, Mycobacterium bovis
PLPGESLPGA

SEQ ID NO: 182966 - protein, 15 aa, Mycobacterium bovis
PLPGSVTPGAAPLPV

SEQ ID NO: 182967 - protein, 12 aa, Mycobacterium bovis
PLPNTAGCRSAA

SEQ ID NO: 182968 - protein, 4 aa, Mycobacterium bovis
PLPP

SEQ ID NO: 182969 - protein, 6 aa, Mycobacterium bovis
PLPPPS

SEQ ID NO: 182970 - protein, 7 aa, Mycobacterium bovis
PLPPRRR

SEQ ID NO: 182971 - protein, 5 aa, Mycobacterium bovis
PLPPV

SEQ ID NO: 182972 - protein, 5 aa, Mycobacterium bovis
PLPTA

SEQ ID NO: 182973 - protein, 5 aa, Mycobacterium bovis
PLPTN

SEQ ID NO: 182974 - protein, 11 aa, Mycobacterium bovis
PLPTSPGYTGN

SEQ ID NO: 182975 - protein, 4 aa, Mycobacterium bovis
PLQR

SEQ ID NO: 182976 - protein, 10 aa, Mycobacterium bovis
PLRDEGESYA

SEQ ID NO: 182977 - protein, 7 aa, Mycobacterium bovis
PLRDGGY

SEQ ID NO: 182978 - protein, 7 aa, Mycobacterium bovis
PLRGSKA

SEQ ID NO: 182979 - protein, 6 aa, Mycobacterium bovis
PLRPDN

SEQ ID NO: 182980 - protein, 10 aa, Mycobacterium bovis
PLRPGPPPTV

SEQ ID NO: 182981 - protein, 10 aa, Mycobacterium bovis
PLRPGSGMPP

SEQ ID NO: 182982 - protein, 8 aa, Mycobacterium bovis
PLRPQERR

SEQ ID NO: 182983 - protein, 4 aa, Mycobacterium bovis
PLRS

SEQ ID NO: 182984 - protein, 9 aa, Mycobacterium bovis
PLSAQEAQA

SEQ ID NO: 182985 - protein, 5 aa, Mycobacterium bovis
PLSAT

SEQ ID NO: 182986 - protein, 7 aa, Mycobacterium bovis
PLSEDDW

SEQ ID NO: 182987 - protein, 8 aa, Mycobacterium bovis
PLSGIGPD

SEQ ID NO: 182988 - protein, 9 aa, Mycobacterium bovis
PLSGRAGGL

SEQ ID NO: 182989 - protein, 12 aa, Mycobacterium bovis
PLSPHPDDPIRM

SEQ ID NO: 182990 - protein, 7 aa, Mycobacterium bovis
PLTAPGS

SEQ ID NO: 182991 - protein, 4 aa, Mycobacterium bovis
PLTP

SEQ ID NO: 182992 - protein, 7 aa, Mycobacterium bovis
PLTPGRM

SEQ ID NO: 182993 - protein, 7 aa, Mycobacterium bovis
PLTPPVK

SEQ ID NO: 182994 - protein, 14 aa, Mycobacterium bovis
PLVPGTPDPVKGAD

SEQ ID NO: 182995 - protein, 13 aa, Mycobacterium bovis
PMDAGRKGQKGIE

SEQ ID NO: 182996 - protein, 6 aa, Mycobacterium bovis
PMDDNP

SEQ ID NO: 182997 - protein, 4 aa, Mycobacterium bovis
PMGP

SEQ ID NO: 182998 - protein, 15 aa, Mycobacterium bovis
PMGSDGGAMGLDPAT

SEQ ID NO: 182999 - protein, 4 aa, Mycobacterium bovis
PMPG

SEQ ID NO: 183000 - protein, 6 aa, Mycobacterium bovis
PMPGQP

SEQ ID NO: 183001 - protein, 11 aa, Mycobacterium bovis
PMPPGAPEGMP

SEQ ID NO: 183002 - protein, 15 aa, Mycobacterium bovis
PMPPTAKNAACPLGP

SEQ ID NO: 183003 - protein, 10 aa, Mycobacterium bovis
PMTDTNTGSY

SEQ ID NO: 183004 - protein, 7 aa, Mycobacterium bovis
PNAAAGN

SEQ ID NO: 183005 - protein, 11 aa, Mycobacterium bovis
PNAADYRKPAP

SEQ ID NO: 183006 - protein, 7 aa, Mycobacterium bovis
PNAAGTA

SEQ ID NO: 183007 - protein, 7 aa, Mycobacterium bovis
PNALTST

SEQ ID NO: 183008 - protein, 19 aa, Mycobacterium bovis
PNAPFGRDPQGQPYTQERY

SEQ ID NO: 183009 - protein, 8 aa, Mycobacterium bovis
PNAPPSSA

SEQ ID NO: 183010 - protein, 5 aa, Mycobacterium bovis
PNAPS

SEQ ID NO: 183011 - protein, 4 aa, Mycobacterium bovis
PNAQ

SEQ ID NO: 183012 - protein, 6 aa, Mycobacterium bovis
PNARPP

SEQ ID NO: 183013 - protein, 9 aa, Mycobacterium bovis
PNASGGTDL

SEQ ID NO: 183014 - protein, 6 aa, Mycobacterium bovis
PNATAE

SEQ ID NO: 183015 - protein, 5 aa, Mycobacterium bovis
PNATE

SEQ ID NO: 183016 - protein, 5 aa, Mycobacterium bovis
PNEGV

SEQ ID NO: 183017 - protein, 5 aa, Mycobacterium bovis
PNGAA

SEQ ID NO: 183018 - protein, 6 aa, Mycobacterium bovis
PNGAAA

SEQ ID NO: 183019 - protein, 8 aa, Mycobacterium bovis
PNGAGKTS

SEQ ID NO: 183020 - protein, 10 aa, Mycobacterium bovis
PNGAGKTTTV

SEQ ID NO: 183021 - protein, 13 aa, Mycobacterium bovis
PNGQTAGIPPPHL

SEQ ID NO: 183022 - protein, 7 aa, Mycobacterium bovis
PNGVGKT

SEQ ID NO: 183023 - protein, 11 aa, Mycobacterium bovis
PNIDGTETPFP

SEQ ID NO: 183024 - protein, 5 aa, Mycobacterium bovis
PNIGG

SEQ ID NO: 183025 - protein, 5 aa, Mycobacterium bovis
PNITG

SEQ ID NO: 183026 - protein, 16 aa, Mycobacterium bovis
PNKGETDRRPPQGEPY

SEQ ID NO: 183027 - protein, 13 aa, Mycobacterium bovis
PNLEGGKERAIED

SEQ ID NO: 183028 - protein, 6 aa, Mycobacterium bovis
PNLKPG

SEQ ID NO: 183029 - protein, 4 aa, Mycobacterium bovis
PNMT

SEQ ID NO: 183030 - protein, 17 aa, Mycobacterium bovis
PNNPERATPAKRPPRLK

SEQ ID NO: 183031 - protein, 12 aa, Mycobacterium bovis
PNNPETGCKSRD

SEQ ID NO: 183032 - protein, 10 aa, Mycobacterium bovis
PNNPSGQSVS

SEQ ID NO: 183033 - protein, 7 aa, Mycobacterium bovis
PNNPTGA

SEQ ID NO: 183034 - protein, 13 aa, Mycobacterium bovis
PNPAKKIERETVR

SEQ ID NO: 183035 - protein, 7 aa, Mycobacterium bovis
PNPAPLK

SEQ ID NO: 183036 - protein, 6 aa, Mycobacterium bovis
PNPDAA

SEQ ID NO: 183037 - protein, 19 aa, Mycobacterium bovis
PNPDAEPDRRGVNPAPTRV

SEQ ID NO: 183038 - protein, 6 aa, Mycobacterium bovis
PNPGLA

SEQ ID NO: 183039 - protein, 8 aa, Mycobacterium bovis
PNPGTAEG

SEQ ID NO: 183040 - protein, 4 aa, Mycobacterium bovis
PNPH

SEQ ID NO: 183041 - protein, 21 aa, Mycobacterium bovis
PNPIEPPTDIAPDPDSTKTWL

SEQ ID NO: 183042 - protein, 4 aa, Mycobacterium bovis
PNPV

SEQ ID NO: 183043 - protein, 5 aa, Mycobacterium bovis
PNPVV

SEQ ID NO: 183044 - protein, 4 aa, Mycobacterium bovis
PNQP

SEQ ID NO: 183045 - protein, 6 aa, Mycobacterium bovis
PNQTEI

SEQ ID NO: 183046 - protein, 5 aa, Mycobacterium bovis
PNRDG

SEQ ID NO: 183047 - protein, 10 aa, Mycobacterium bovis
PNRVGPRKRP

SEQ ID NO: 183048 - protein, 6 aa, Mycobacterium bovis
PNSDGA

SEQ ID NO: 183049 - protein, 6 aa, Mycobacterium bovis
PNSPLA

SEQ ID NO: 183050 - protein, 5 aa, Mycobacterium bovis
PNSTY

SEQ ID NO: 183051 - protein, 6 aa, Mycobacterium bovis
PNTAKL

SEQ ID NO: 183052 - protein, 6 aa, Mycobacterium bovis
PNTMGD

SEQ ID NO: 183053 - protein, 11 aa, Mycobacterium bovis
PNTNTECPPGT

SEQ ID NO: 183054 - protein, 4 aa, Mycobacterium bovis
PNTS

SEQ ID NO: 183055 - protein, 7 aa, Mycobacterium bovis
PNTSSNI

SEQ ID NO: 183056 - protein, 10 aa, Mycobacterium bovis
PNWNPDDKTR

SEQ ID NO: 183057 - protein, 5 aa, Mycobacterium bovis
PPAAP

SEQ ID NO: 183058 - protein, 5 aa, Mycobacterium bovis
PPAAQ

SEQ ID NO: 183059 - protein, 4 aa, Mycobacterium bovis
PPAD

SEQ ID NO: 183060 - protein, 16 aa, Mycobacterium bovis
PPADEPVTNLSGGERR

SEQ ID NO: 183061 - protein, 7 aa, Mycobacterium bovis
PPAETGL

SEQ ID NO: 183062 - protein, 5 aa, Mycobacterium bovis
PPAFA

SEQ ID NO: 183063 - protein, 4 aa, Mycobacterium bovis
PPAG

SEQ ID NO: 183064 - protein, 7 aa, Mycobacterium bovis
PPAGPAA

SEQ ID NO: 183065 - protein, 8 aa, Mycobacterium bovis
PPAGTLSG

SEQ ID NO: 183066 - protein, 10 aa, Mycobacterium bovis
PPAKTGAGTW

SEQ ID NO: 183067 - protein, 8 aa, Mycobacterium bovis
PPANADDT

SEQ ID NO: 183068 - protein, 7 aa, Mycobacterium bovis
PPANNAN

SEQ ID NO: 183069 - protein, 19 aa, Mycobacterium bovis
PPAPAGRGLTAGQQRRRTI

SEQ ID NO: 183070 - protein, 20 aa, Mycobacterium bovis
PPAPPGMTDNPDRRAAGPAA

SEQ ID NO: 183071 - protein, 5 aa, Mycobacterium bovis
PPARR

SEQ ID NO: 183072 - protein, 17 aa, Mycobacterium bovis
PPATLPPGEYRQISGNT

SEQ ID NO: 183073 - protein, 6 aa, Mycobacterium bovis
PPATVG

SEQ ID NO: 183074 - protein, 7 aa, Mycobacterium bovis
PPDAAAR

SEQ ID NO: 183075 - protein, 8 aa, Mycobacterium bovis
PPDAKSRI

SEQ ID NO: 183076 - protein, 19 aa, Mycobacterium bovis
PPDAPTVTSEDVVRALEDD

SEQ ID NO: 183077 - protein, 8 aa, Mycobacterium bovis
PPDDPRVR

SEQ ID NO: 183078 - protein, 13 aa, Mycobacterium bovis
PPDNRPGQPPVGP

SEQ ID NO: 183079 - protein, 10 aa, Mycobacterium bovis
PPDPASRTTY

SEQ ID NO: 183080 - protein, 6 aa, Mycobacterium bovis
PPDPRV

SEQ ID NO: 183081 - protein, 8 aa, Mycobacterium bovis
PPDTELSP

SEQ ID NO: 183082 - protein, 9 aa, Mycobacterium bovis
PPDTPAGQR

SEQ ID NO: 183083 - protein, 7 aa, Mycobacterium bovis
PPEADHD

SEQ ID NO: 183084 - protein, 11 aa, Mycobacterium bovis
PPEGAESVDIS

SEQ ID NO: 183085 - protein, 6 aa, Mycobacterium bovis
PPEGFD

SEQ ID NO: 183086 - protein, 5 aa, Mycobacterium bovis
PPEIT

SEQ ID NO: 183087 - protein, 11 aa, Mycobacterium bovis
PPERQARALPS

SEQ ID NO: 183088 - protein, 5 aa, Mycobacterium bovis
PPERR

SEQ ID NO: 183089 - protein, 5 aa, Mycobacterium bovis
PPERT

SEQ ID NO: 183090 - protein, 5 aa, Mycobacterium bovis
PPESF

SEQ ID NO: 183091 - protein, 4 aa, Mycobacterium bovis
PPFA

SEQ ID NO: 183092 - protein, 4 aa, Mycobacterium bovis
PPFK

SEQ ID NO: 183093 - protein, 9 aa, Mycobacterium bovis
PPGATGVQA

SEQ ID NO: 183094 - protein, 4 aa, Mycobacterium bovis
PPGD

SEQ ID NO: 183095 - protein, 6 aa, Mycobacterium bovis
PPGDGP

SEQ ID NO: 183096 - protein, 6 aa, Mycobacterium bovis
PPGEIG

SEQ ID NO: 183097 - protein, 5 aa, Mycobacterium bovis
PPGEV

SEQ ID NO: 183098 - protein, 14 aa, Mycobacterium bovis
PPGLTDEQAITAAT

SEQ ID NO: 183099 - protein, 6 aa, Mycobacterium bovis
PPGPAQ

SEQ ID NO: 183100 - protein, 6 aa, Mycobacterium bovis
PPGPGF

SEQ ID NO: 183101 - protein, 10 aa, Mycobacterium bovis
PPGQAPDPSR

SEQ ID NO: 183102 - protein, 8 aa, Mycobacterium bovis
PPGQGPWP

SEQ ID NO: 183103 - protein, 4 aa, Mycobacterium bovis
PPGR

SEQ ID NO: 183104 - protein, 5 aa, Mycobacterium bovis
PPGRN

SEQ ID NO: 183105 - protein, 5 aa, Mycobacterium bovis
PPGRS

SEQ ID NO: 183106 - protein, 16 aa, Mycobacterium bovis
PPGRSGKSSRSVRPTW

SEQ ID NO: 183107 - protein, 7 aa, Mycobacterium bovis
PPGSDSV

SEQ ID NO: 183108 - protein, 6 aa, Mycobacterium bovis
PPGSPA

SEQ ID NO: 183109 - protein, 11 aa, Mycobacterium bovis
PPGSTLPPERD

SEQ ID NO: 183110 - protein, 4 aa, Mycobacterium bovis
PPGT

SEQ ID NO: 183111 - protein, 8 aa, Mycobacterium bovis
PPGTDERQ

SEQ ID NO: 183112 - protein, 6 aa, Mycobacterium bovis
PPGTGD

SEQ ID NO: 183113 - protein, 12 aa, Mycobacterium bovis
PPGTGKTTTAEA

SEQ ID NO: 183114 - protein, 8 aa, Mycobacterium bovis
PPGTPAQV

SEQ ID NO: 183115 - protein, 5 aa, Mycobacterium bovis
PPGVD

SEQ ID NO: 183116 - protein, 8 aa, Mycobacterium bovis
PPGVEDGQ

SEQ ID NO: 183117 - protein, 7 aa, Mycobacterium bovis
PPGVGPA

SEQ ID NO: 183118 - protein, 6 aa, Mycobacterium bovis
PPGVRP

SEQ ID NO: 183119 - protein, 13 aa, Mycobacterium bovis
PPGVRRPAGIPAD

SEQ ID NO: 183120 - protein, 15 aa, Mycobacterium bovis
PPGWPGPGALPPHER

SEQ ID NO: 183121 - protein, 5 aa, Mycobacterium bovis
PPGYG

SEQ ID NO: 183122 - protein, 4 aa, Mycobacterium bovis
PPHG

SEQ ID NO: 183123 - protein, 6 aa, Mycobacterium bovis
PPHSSL

SEQ ID NO: 183124 - protein, 6 aa, Mycobacterium bovis
PPHVTP

SEQ ID NO: 183125 - protein, 5 aa, Mycobacterium bovis
PPIAP

SEQ ID NO: 183126 - protein, 5 aa, Mycobacterium bovis
PPIGP

SEQ ID NO: 183127 - protein, 4 aa, Mycobacterium bovis
PPIS

SEQ ID NO: 183128 - protein, 10 aa, Mycobacterium bovis
PPKDEKPEWA

SEQ ID NO: 183129 - protein, 9 aa, Mycobacterium bovis
PPKGLSQEE

SEQ ID NO: 183130 - protein, 4 aa, Mycobacterium bovis
PPKP

SEQ ID NO: 183131 - protein, 10 aa, Mycobacterium bovis
PPLGPDAPPL

SEQ ID NO: 183132 - protein, 6 aa, Mycobacterium bovis
PPLPGP

SEQ ID NO: 183133 - protein, 7 aa, Mycobacterium bovis
PPLPPEY

SEQ ID NO: 183134 - protein, 8 aa, Mycobacterium bovis
PPLPPVPD

SEQ ID NO: 183135 - protein, 19 aa, Mycobacterium bovis
PPLPTGDPAADRDATRAEG

SEQ ID NO: 183136 - protein, 13 aa, Mycobacterium bovis
PPLRTAKSSPTSI

SEQ ID NO: 183137 - protein, 4 aa, Mycobacterium bovis
PPNL

SEQ ID NO: 183138 - protein, 11 aa, Mycobacterium bovis
PPNLAGAAQEA

SEQ ID NO: 183139 - protein, 6 aa, Mycobacterium bovis
PPNLVS

SEQ ID NO: 183140 - protein, 28 aa, Mycobacterium bovis
PPNNSTDAPRYQAAAPTGPIEENLTDED

SEQ ID NO: 183141 - protein, 5 aa, Mycobacterium bovis
PPNPE

SEQ ID NO: 183142 - protein, 7 aa, Mycobacterium bovis
PPNSSWP

SEQ ID NO: 183143 - protein, 16 aa, Mycobacterium bovis
PPNVPQRRGQRRSSTA

SEQ ID NO: 183144 - protein, 5 aa, Mycobacterium bovis
PPNVT

SEQ ID NO: 183145 - protein, 22 aa, Mycobacterium bovis
PPNWAGASPSLAPTVGSASAPL

SEQ ID NO: 183146 - protein, 6 aa, Mycobacterium bovis
PPPAIA

SEQ ID NO: 183147 - protein, 15 aa, Mycobacterium bovis
PPPAPEIPKSSLGAG

SEQ ID NO: 183148 - protein, 6 aa, Mycobacterium bovis
PPPAPR

SEQ ID NO: 183149 - protein, 10 aa, Mycobacterium bovis
PPPDGEPPET

SEQ ID NO: 183150 - protein, 5 aa, Mycobacterium bovis
PPPDP

SEQ ID NO: 183151 - protein, 9 aa, Mycobacterium bovis
PPPGTPDDQ

SEQ ID NO: 183152 - protein, 6 aa, Mycobacterium bovis
PPPGTV

SEQ ID NO: 183153 - protein, 4 aa, Mycobacterium bovis
PPPH

SEQ ID NO: 183154 - protein, 7 aa, Mycobacterium bovis
PPPHGPE

SEQ ID NO: 183155 - protein, 5 aa, Mycobacterium bovis
PPPHW

SEQ ID NO: 183156 - protein, 14 aa, Mycobacterium bovis
PPPLPQAATPTLAA

SEQ ID NO: 183157 - protein, 12 aa, Mycobacterium bovis
PPPNPLDTGSAG

SEQ ID NO: 183158 - protein, 8 aa, Mycobacterium bovis
PPPPQRYP

SEQ ID NO: 183159 - protein, 7 aa, Mycobacterium bovis
PPPQIAA

SEQ ID NO: 183160 - protein, 26 aa, Mycobacterium bovis
PPPRPRPVDGSEIPSVSTESKAMSRE

SEQ ID NO: 183161 - protein, 22 aa, Mycobacterium bovis
PPPSLSRPRREPAAEHKHSPDE

SEQ ID NO: 183162 - protein, 6 aa, Mycobacterium bovis
PPPSVC

SEQ ID NO: 183163 - protein, 6 aa, Mycobacterium bovis
PPPTID

SEQ ID NO: 183164 - protein, 5 aa, Mycobacterium bovis
PPPVR

SEQ ID NO: 183165 - protein, 8 aa, Mycobacterium bovis
PPPYRSDG

SEQ ID NO: 183166 - protein, 6 aa, Mycobacterium bovis
PPQGQD

SEQ ID NO: 183167 - protein, 4 aa, Mycobacterium bovis
PPQM

SEQ ID NO: 183168 - protein, 6 aa, Mycobacterium bovis
PPQRAG

SEQ ID NO: 183169 - protein, 10 aa, Mycobacterium bovis
PPQTAKPAVK

SEQ ID NO: 183170 - protein, 13 aa, Mycobacterium bovis
PPRATNDTDIAGT

SEQ ID NO: 183171 - protein, 4 aa, Mycobacterium bovis
PPRF

SEQ ID NO: 183172 - protein, 7 aa, Mycobacterium bovis
PPRGLTA

SEQ ID NO: 183173 - protein, 10 aa, Mycobacterium bovis
PPRNAPPAAL

SEQ ID NO: 183174 - protein, 9 aa, Mycobacterium bovis
PPRNDPRDA

SEQ ID NO: 183175 - protein, 15 aa, Mycobacterium bovis
PPRPLASTSIPAGGI

SEQ ID NO: 183176 - protein, 25 aa, Mycobacterium bovis
PPRRQPPKTVPPLRRPDVAARLAGS

SEQ ID NO: 183177 - protein, 6 aa, Mycobacterium bovis
PPRSGL

SEQ ID NO: 183178 - protein, 5 aa, Mycobacterium bovis
PPRSW

SEQ ID NO: 183179 - protein, 5 aa, Mycobacterium bovis
PPRTV

SEQ ID NO: 183180 - protein, 13 aa, Mycobacterium bovis
PPRWVQPATMRAA

SEQ ID NO: 183181 - protein, 8 aa, Mycobacterium bovis
PPSAEAAL

SEQ ID NO: 183182 - protein, 10 aa, Mycobacterium bovis
PPSAEPRATG

SEQ ID NO: 183183 - protein, 8 aa, Mycobacterium bovis
PPSAPPVI

SEQ ID NO: 183184 - protein, 10 aa, Mycobacterium bovis
PPSDDPVPPG

SEQ ID NO: 183185 - protein, 15 aa, Mycobacterium bovis
PPSFTARSNEDSAAW

SEQ ID NO: 183186 - protein, 4 aa, Mycobacterium bovis
PPSG

SEQ ID NO: 183187 - protein, 7 aa, Mycobacterium bovis
PPSHTRG

SEQ ID NO: 183188 - protein, 8 aa, Mycobacterium bovis
PPSQDPVY

SEQ ID NO: 183189 - protein, 7 aa, Mycobacterium bovis
PPSWAGQ

SEQ ID NO: 183190 - protein, 5 aa, Mycobacterium bovis
PPSWT

SEQ ID NO: 183191 - protein, 6 aa, Mycobacterium bovis
PPTAEQ

SEQ ID NO: 183192 - protein, 13 aa, Mycobacterium bovis
PPTAPAEPQPTSE

SEQ ID NO: 183193 - protein, 8 aa, Mycobacterium bovis
PPTATPTG

SEQ ID NO: 183194 - protein, 6 aa, Mycobacterium bovis
PPTDRR

SEQ ID NO: 183195 - protein, 9 aa, Mycobacterium bovis
PPTEPLDPS

SEQ ID NO: 183196 - protein, 4 aa, Mycobacterium bovis
PPTG

SEQ ID NO: 183197 - protein, 7 aa, Mycobacterium bovis
PPTGDDA

SEQ ID NO: 183198 - protein, 8 aa, Mycobacterium bovis
PPTGQGDP

SEQ ID NO: 183199 - protein, 17 aa, Mycobacterium bovis
PPTPGFGNTTATPSSGF

SEQ ID NO: 183200 - protein, 15 aa, Mycobacterium bovis
PPTPGIGNSTITPSS

SEQ ID NO: 183201 - protein, 6 aa, Mycobacterium bovis
PPTWTT

SEQ ID NO: 183202 - protein, 11 aa, Mycobacterium bovis
PPVETTSAVQE

SEQ ID NO: 183203 - protein, 4 aa, Mycobacterium bovis
PPVG

SEQ ID NO: 183204 - protein, 11 aa, Mycobacterium bovis
PPVGDVTSPVK

SEQ ID NO: 183205 - protein, 6 aa, Mycobacterium bovis
PPVGSG

SEQ ID NO: 183206 - protein, 15 aa, Mycobacterium bovis
PPVGSSADDLNDKKA

SEQ ID NO: 183207 - protein, 5 aa, Mycobacterium bovis
PPVHP

SEQ ID NO: 183208 - protein, 14 aa, Mycobacterium bovis
PPVPEPRADRSARE

SEQ ID NO: 183209 - protein, 20 aa, Mycobacterium bovis
PPVRRSGGREQHLAQVWRAT

SEQ ID NO: 183210 - protein, 4 aa, Mycobacterium bovis
PPVT

SEQ ID NO: 183211 - protein, 7 aa, Mycobacterium bovis
PPVVNPG

SEQ ID NO: 183212 - protein, 6 aa, Mycobacterium bovis
PPWDPG

SEQ ID NO: 183213 - protein, 5 aa, Mycobacterium bovis
PPYGI

SEQ ID NO: 183214 - protein, 5 aa, Mycobacterium bovis
PPYIP

SEQ ID NO: 183215 - protein, 7 aa, Mycobacterium bovis
PPYNVDS

SEQ ID NO: 183216 - protein, 5 aa, Mycobacterium bovis
PPYPP

SEQ ID NO: 183217 - protein, 14 aa, Mycobacterium bovis
PPYSVGQSSANDLN

SEQ ID NO: 183218 - protein, 11 aa, Mycobacterium bovis
PQADEAANYGG

SEQ ID NO: 183219 - protein, 6 aa, Mycobacterium bovis
PQAGRY

SEQ ID NO: 183220 - protein, 6 aa, Mycobacterium bovis
PQAGVD

SEQ ID NO: 183221 - protein, 9 aa, Mycobacterium bovis
PQALQAPSG

SEQ ID NO: 183222 - protein, 8 aa, Mycobacterium bovis
PQAPAGVR

SEQ ID NO: 183223 - protein, 5 aa, Mycobacterium bovis
PQAQN

SEQ ID NO: 183224 - protein, 12 aa, Mycobacterium bovis
PQAQRAREGEVP

SEQ ID NO: 183225 - protein, 14 aa, Mycobacterium bovis
PQATGASTQPQLSR

SEQ ID NO: 183226 - protein, 5 aa, Mycobacterium bovis
PQDGA

SEQ ID NO: 183227 - protein, 7 aa, Mycobacterium bovis
PQDPEAL

SEQ ID NO: 183228 - protein, 7 aa, Mycobacterium bovis
PQDPKVG

SEQ ID NO: 183229 - protein, 5 aa, Mycobacterium bovis
PQEDR

SEQ ID NO: 183230 - protein, 6 aa, Mycobacterium bovis
PQEGIT

SEQ ID NO: 183231 - protein, 13 aa, Mycobacterium bovis
PQFDEPSINSGGQ

SEQ ID NO: 183232 - protein, 5 aa, Mycobacterium bovis
PQFPG

SEQ ID NO: 183233 - protein, 6 aa, Mycobacterium bovis
PQGALS

SEQ ID NO: 183234 - protein, 10 aa, Mycobacterium bovis
PQGDEQPTDL

SEQ ID NO: 183235 - protein, 19 aa, Mycobacterium bovis
PQGGVTDERSDSVLSDSSP

SEQ ID NO: 183236 - protein, 7 aa, Mycobacterium bovis
PQGRAVH

SEQ ID NO: 183237 - protein, 6 aa, Mycobacterium bovis
PQGREV

SEQ ID NO: 183238 - protein, 7 aa, Mycobacterium bovis
PQGVPDT

SEQ ID NO: 183239 - protein, 4 aa, Mycobacterium bovis
PQHA

SEQ ID NO: 183240 - protein, 15 aa, Mycobacterium bovis
PQHGPVDPLPRRRAD

SEQ ID NO: 183241 - protein, 7 aa, Mycobacterium bovis
PQHPSTH

SEQ ID NO: 183242 - protein, 4 aa, Mycobacterium bovis
PQHR

SEQ ID NO: 183243 - protein, 13 aa, Mycobacterium bovis
PQKAKPPKPVARQ

SEQ ID NO: 183244 - protein, 5 aa, Mycobacterium bovis
PQKVN

SEQ ID NO: 183245 - protein, 12 aa, Mycobacterium bovis
PQLDPGRTGSTA

SEQ ID NO: 183246 - protein, 4 aa, Mycobacterium bovis
PQPA

SEQ ID NO: 183247 - protein, 6 aa, Mycobacterium bovis
PQPAPL

SEQ ID NO: 183248 - protein, 10 aa, Mycobacterium bovis
PQPAQPGGSY

SEQ ID NO: 183249 - protein, 4 aa, Mycobacterium bovis
PQPD

SEQ ID NO: 183250 - protein, 7 aa, Mycobacterium bovis
PQPDPDL

SEQ ID NO: 183251 - protein, 7 aa, Mycobacterium bovis
PQPDRFD

SEQ ID NO: 183252 - protein, 10 aa, Mycobacterium bovis
PQPGPSTSEI

SEQ ID NO: 183253 - protein, 5 aa, Mycobacterium bovis
PQPPN

SEQ ID NO: 183254 - protein, 28 aa, Mycobacterium bovis
PQPPVDAGSLAKASPATHRLALEFYQHR

SEQ ID NO: 183255 - protein, 11 aa, Mycobacterium bovis
PQPRPPRETWE

SEQ ID NO: 183256 - protein, 7 aa, Mycobacterium bovis
PQPVDPE

SEQ ID NO: 183257 - protein, 18 aa, Mycobacterium bovis
PQQLPQVSQGTHPEPVDT

SEQ ID NO: 183258 - protein, 5 aa, Mycobacterium bovis
PQQPT

SEQ ID NO: 183259 - protein, 8 aa, Mycobacterium bovis
PQQTTSAV

SEQ ID NO: 183260 - protein, 7 aa, Mycobacterium bovis
PQRAGSE

SEQ ID NO: 183261 - protein, 5 aa, Mycobacterium bovis
PQRDR

SEQ ID NO: 183262 - protein, 5 aa, Mycobacterium bovis
PQRGR

SEQ ID NO: 183263 - protein, 12 aa, Mycobacterium bovis
PQRPGRGIGEPE

SEQ ID NO: 183264 - protein, 12 aa, Mycobacterium bovis
PQRYRGGPATPT

SEQ ID NO: 183265 - protein, 7 aa, Mycobacterium bovis
PQSAPGR

SEQ ID NO: 183266 - protein, 8 aa, Mycobacterium bovis
PQSDGGPG

SEQ ID NO: 183267 - protein, 5 aa, Mycobacterium bovis
PQSHT

SEQ ID NO: 183268 - protein, 7 aa, Mycobacterium bovis
PQSRGQI

SEQ ID NO: 183269 - protein, 12 aa, Mycobacterium bovis
PQSRYDDAAAFF

SEQ ID NO: 183270 - protein, 7 aa, Mycobacterium bovis
PQTADPV

SEQ ID NO: 183271 - protein, 4 aa, Mycobacterium bovis
PQTD

SEQ ID NO: 183272 - protein, 15 aa, Mycobacterium bovis
PQTGDPDAESPVRGG

SEQ ID NO: 183273 - protein, 6 aa, Mycobacterium bovis
PQTNRL

SEQ ID NO: 183274 - protein, 5 aa, Mycobacterium bovis
PQTNS

SEQ ID NO: 183275 - protein, 10 aa, Mycobacterium bovis
PQTPAGEPVA

SEQ ID NO: 183276 - protein, 10 aa, Mycobacterium bovis
PQTPTAATDE

SEQ ID NO: 183277 - protein, 11 aa, Mycobacterium bovis
PQVKSGSGTEL

SEQ ID NO: 183278 - protein, 5 aa, Mycobacterium bovis
PQYSD

SEQ ID NO: 183279 - protein, 8 aa, Mycobacterium bovis
PRAALPAT

SEQ ID NO: 183280 - protein, 5 aa, Mycobacterium bovis
PRAGM

SEQ ID NO: 183281 - protein, 6 aa, Mycobacterium bovis
PRAKTK

SEQ ID NO: 183282 - protein, 14 aa, Mycobacterium bovis
PRAMSDSRTRYSPE

SEQ ID NO: 183283 - protein, 8 aa, Mycobacterium bovis
PRAPENAT

SEQ ID NO: 183284 - protein, 17 aa, Mycobacterium bovis
PRARAGWDRATGRIPAD

SEQ ID NO: 183285 - protein, 9 aa, Mycobacterium bovis
PRARKPQRR

SEQ ID NO: 183286 - protein, 4 aa, Mycobacterium bovis
PRAT

SEQ ID NO: 183287 - protein, 8 aa, Mycobacterium bovis
PRATAAKF

SEQ ID NO: 183288 - protein, 6 aa, Mycobacterium bovis
PRATEL

SEQ ID NO: 183289 - protein, 6 aa, Mycobacterium bovis
PRDADP

SEQ ID NO: 183290 - protein, 5 aa, Mycobacterium bovis
PRDEW

SEQ ID NO: 183291 - protein, 7 aa, Mycobacterium bovis
PRDPHDA

SEQ ID NO: 183292 - protein, 8 aa, Mycobacterium bovis
PRDRNGTF

SEQ ID NO: 183293 - protein, 14 aa, Mycobacterium bovis
PRDSPLSSGDAAEL

SEQ ID NO: 183294 - protein, 10 aa, Mycobacterium bovis
PREAAAMDPQ

SEQ ID NO: 183295 - protein, 19 aa, Mycobacterium bovis
PREAEQLPMPPPAYGSAEL

SEQ ID NO: 183296 - protein, 7 aa, Mycobacterium bovis
PREAGDA

SEQ ID NO: 183297 - protein, 6 aa, Mycobacterium bovis
PREAPA

SEQ ID NO: 183298 - protein, 11 aa, Mycobacterium bovis
PREASAMDPRQ

SEQ ID NO: 183299 - protein, 8 aa, Mycobacterium bovis
PREGGNED

SEQ ID NO: 183300 - protein, 5 aa, Mycobacterium bovis
PRENA

SEQ ID NO: 183301 - protein, 7 aa, Mycobacterium bovis
PRENPID

SEQ ID NO: 183302 - protein, 4 aa, Mycobacterium bovis
PREQ

SEQ ID NO: 183303 - protein, 5 aa, Mycobacterium bovis
PREQP

SEQ ID NO: 183304 - protein, 5 aa, Mycobacterium bovis
PRGAQ

SEQ ID NO: 183305 - protein, 11 aa, Mycobacterium bovis
PRGCGKTSSAR

SEQ ID NO: 183306 - protein, 6 aa, Mycobacterium bovis
PRGFGE

SEQ ID NO: 183307 - protein, 10 aa, Mycobacterium bovis
PRGGRLPSER

SEQ ID NO: 183308 - protein, 4 aa, Mycobacterium bovis
PRGI

SEQ ID NO: 183309 - protein, 5 aa, Mycobacterium bovis
PRGKL

SEQ ID NO: 183310 - protein, 5 aa, Mycobacterium bovis
PRGMH

SEQ ID NO: 183311 - protein, 11 aa, Mycobacterium bovis
PRGPERLPGNH

SEQ ID NO: 183312 - protein, 4 aa, Mycobacterium bovis
PRGR

SEQ ID NO: 183313 - protein, 7 aa, Mycobacterium bovis
PRGRGPS

SEQ ID NO: 183314 - protein, 15 aa, Mycobacterium bovis
PRGRRTARPSGDDRE

SEQ ID NO: 183315 - protein, 15 aa, Mycobacterium bovis
PRGSAYHHASGPAKA

SEQ ID NO: 183316 - protein, 5 aa, Mycobacterium bovis
PRGVG

SEQ ID NO: 183317 - protein, 16 aa, Mycobacterium bovis
PRGYGNNAWARVALRV

SEQ ID NO: 183318 - protein, 4 aa, Mycobacterium bovis
PRHQ

SEQ ID NO: 183319 - protein, 6 aa, Mycobacterium bovis
PRHQPG

SEQ ID NO: 183320 - protein, 5 aa, Mycobacterium bovis
PRIPA

SEQ ID NO: 183321 - protein, 19 aa, Mycobacterium bovis
PRKGRPSQARRAEEQRPSF

SEQ ID NO: 183322 - protein, 9 aa, Mycobacterium bovis
PRKPGGDLA

SEQ ID NO: 183323 - protein, 13 aa, Mycobacterium bovis
PRKPSRSERRDKS

SEQ ID NO: 183324 - protein, 11 aa, Mycobacterium bovis
PRKSKPSATRR

SEQ ID NO: 183325 - protein, 6 aa, Mycobacterium bovis
PRLDNQ

SEQ ID NO: 183326 - protein, 19 aa, Mycobacterium bovis
PRLGRGGGGQLRPGVWCTG

SEQ ID NO: 183327 - protein, 7 aa, Mycobacterium bovis
PRLNTQQ

SEQ ID NO: 183328 - protein, 23 aa, Mycobacterium bovis
PRLPGPAEQVDGRSLRPRGFSDE

SEQ ID NO: 183329 - protein, 7 aa, Mycobacterium bovis
PRLRARP

SEQ ID NO: 183330 - protein, 12 aa, Mycobacterium bovis
PRLSGASPMTNL

SEQ ID NO: 183331 - protein, 7 aa, Mycobacterium bovis
PRLSPAP

SEQ ID NO: 183332 - protein, 9 aa, Mycobacterium bovis
PRMPPRPRD

SEQ ID NO: 183333 - protein, 4 aa, Mycobacterium bovis
PRMR

SEQ ID NO: 183334 - protein, 6 aa, Mycobacterium bovis
PRMSSD

SEQ ID NO: 183335 - protein, 7 aa, Mycobacterium bovis
PRNPAGK

SEQ ID NO: 183336 - protein, 8 aa, Mycobacterium bovis
PRNPLTGQ

SEQ ID NO: 183337 - protein, 8 aa, Mycobacterium bovis
PRNPYQRA

SEQ ID NO: 183338 - protein, 7 aa, Mycobacterium bovis
PRNTDGE

SEQ ID NO: 183339 - protein, 6 aa, Mycobacterium bovis
PRPARP

SEQ ID NO: 183340 - protein, 7 aa, Mycobacterium bovis
PRPDGTP

SEQ ID NO: 183341 - protein, 6 aa, Mycobacterium bovis
PRPDRE

SEQ ID NO: 183342 - protein, 17 aa, Mycobacterium bovis
PRPDTPAEAVSTPQTRP

SEQ ID NO: 183343 - protein, 6 aa, Mycobacterium bovis
PRPDWP

SEQ ID NO: 183344 - protein, 10 aa, Mycobacterium bovis
PRPEVRARSP

SEQ ID NO: 183345 - protein, 7 aa, Mycobacterium bovis
PRPGDEA

SEQ ID NO: 183346 - protein, 7 aa, Mycobacterium bovis
PRPGNED

SEQ ID NO: 183347 - protein, 7 aa, Mycobacterium bovis
PRPGTPF

SEQ ID NO: 183348 - protein, 7 aa, Mycobacterium bovis
PRPGYGS

SEQ ID NO: 183349 - protein, 6 aa, Mycobacterium bovis
PRPLPG

SEQ ID NO: 183350 - protein, 6 aa, Mycobacterium bovis
PRPQTQ

SEQ ID NO: 183351 - protein, 13 aa, Mycobacterium bovis
PRPRTRPPSDGSS

SEQ ID NO: 183352 - protein, 5 aa, Mycobacterium bovis
PRPRW

SEQ ID NO: 183353 - protein, 14 aa, Mycobacterium bovis
PRPSSRPAAASLPD

SEQ ID NO: 183354 - protein, 5 aa, Mycobacterium bovis
PRPTL

SEQ ID NO: 183355 - protein, 7 aa, Mycobacterium bovis
PRPVEES

SEQ ID NO: 183356 - protein, 7 aa, Mycobacterium bovis
PRPVEGG

SEQ ID NO: 183357 - protein, 8 aa, Mycobacterium bovis
PRQTTADG

SEQ ID NO: 183358 - protein, 7 aa, Mycobacterium bovis
PRRAGGA

SEQ ID NO: 183359 - protein, 24 aa, Mycobacterium bovis
PRRARSSTTREATTGWPPTHRIWP

SEQ ID NO: 183360 - protein, 9 aa, Mycobacterium bovis
PRRASSPFG

SEQ ID NO: 183361 - protein, 9 aa, Mycobacterium bovis
PRRGERDRD

SEQ ID NO: 183362 - protein, 8 aa, Mycobacterium bovis
PRRGIGDR

SEQ ID NO: 183363 - protein, 10 aa, Mycobacterium bovis
PRRGRSKRHR

SEQ ID NO: 183364 - protein, 7 aa, Mycobacterium bovis
PRRGYGQ

SEQ ID NO: 183365 - protein, 7 aa, Mycobacterium bovis
PRRPGTP

SEQ ID NO: 183366 - protein, 10 aa, Mycobacterium bovis
PRRPQGELPA

SEQ ID NO: 183367 - protein, 10 aa, Mycobacterium bovis
PRRTAPDGSN

SEQ ID NO: 183368 - protein, 11 aa, Mycobacterium bovis
PRRTSGGGRRY

SEQ ID NO: 183369 - protein, 7 aa, Mycobacterium bovis
PRSAGRE

SEQ ID NO: 183370 - protein, 6 aa, Mycobacterium bovis
PRSDLE

SEQ ID NO: 183371 - protein, 9 aa, Mycobacterium bovis
PRSEGHRGG

SEQ ID NO: 183372 - protein, 7 aa, Mycobacterium bovis
PRSFTTA

SEQ ID NO: 183373 - protein, 7 aa, Mycobacterium bovis
PRSGGLR

SEQ ID NO: 183374 - protein, 7 aa, Mycobacterium bovis
PRSGRRS

SEQ ID NO: 183375 - protein, 14 aa, Mycobacterium bovis
PRSGRWTPDPSDRA

SEQ ID NO: 183376 - protein, 6 aa, Mycobacterium bovis
PRSGTV

SEQ ID NO: 183377 - protein, 6 aa, Mycobacterium bovis
PRSIRP

SEQ ID NO: 183378 - protein, 6 aa, Mycobacterium bovis
PRSLGY

SEQ ID NO: 183379 - protein, 7 aa, Mycobacterium bovis
PRSMPAE

SEQ ID NO: 183380 - protein, 4 aa, Mycobacterium bovis
PRSP

SEQ ID NO: 183381 - protein, 9 aa, Mycobacterium bovis
PRSTAEAFP

SEQ ID NO: 183382 - protein, 6 aa, Mycobacterium bovis
PRSVEQ

SEQ ID NO: 183383 - protein, 9 aa, Mycobacterium bovis
PRTEPPVPS

SEQ ID NO: 183384 - protein, 4 aa, Mycobacterium bovis
PRTG

SEQ ID NO: 183385 - protein, 8 aa, Mycobacterium bovis
PRTGGRAG

SEQ ID NO: 183386 - protein, 18 aa, Mycobacterium bovis
PRTNKRTDSWGGTPANRR

SEQ ID NO: 183387 - protein, 7 aa, Mycobacterium bovis
PRTPNGK

SEQ ID NO: 183388 - protein, 7 aa, Mycobacterium bovis
PRTQSGK

SEQ ID NO: 183389 - protein, 28 aa, Mycobacterium bovis
PRTSVGKYDKKAIRSRYAEGAYQITEVH

SEQ ID NO: 183390 - protein, 4 aa, Mycobacterium bovis
PRTT

SEQ ID NO: 183391 - protein, 6 aa, Mycobacterium bovis
PRTVNS

SEQ ID NO: 183392 - protein, 4 aa, Mycobacterium bovis
PRVE

SEQ ID NO: 183393 - protein, 10 aa, Mycobacterium bovis
PRVPSAEEMA

SEQ ID NO: 183394 - protein, 8 aa, Mycobacterium bovis
PRVSPPAS

SEQ ID NO: 183395 - protein, 9 aa, Mycobacterium bovis
PRVSPVSDG

SEQ ID NO: 183396 - protein, 5 aa, Mycobacterium bovis
PRWGA

SEQ ID NO: 183397 - protein, 6 aa, Mycobacterium bovis
PRYDSD

SEQ ID NO: 183398 - protein, 23 aa, Mycobacterium bovis
PRYLTSSAATAVGATAVGPSLPA

SEQ ID NO: 183399 - protein, 6 aa, Mycobacterium bovis
PRYPSP

SEQ ID NO: 183400 - protein, 6 aa, Mycobacterium bovis
PRYQGV

SEQ ID NO: 183401 - protein, 7 aa, Mycobacterium bovis
PSAFTED

SEQ ID NO: 183402 - protein, 9 aa, Mycobacterium bovis
PSAGGGGKG

SEQ ID NO: 183403 - protein, 8 aa, Mycobacterium bovis
PSAGKSSL

SEQ ID NO: 183404 - protein, 6 aa, Mycobacterium bovis
PSAGRD

SEQ ID NO: 183405 - protein, 12 aa, Mycobacterium bovis
PSAGSGGGATID

SEQ ID NO: 183406 - protein, 9 aa, Mycobacterium bovis
PSAGSVDGE

SEQ ID NO: 183407 - protein, 9 aa, Mycobacterium bovis
PSALSGADH

SEQ ID NO: 183408 - protein, 4 aa, Mycobacterium bovis
PSAN

SEQ ID NO: 183409 - protein, 6 aa, Mycobacterium bovis
PSAPGQ

SEQ ID NO: 183410 - protein, 16 aa, Mycobacterium bovis
PSAQPVSNRRGKPAIP

SEQ ID NO: 183411 - protein, 7 aa, Mycobacterium bovis
PSASQTD

SEQ ID NO: 183412 - protein, 7 aa, Mycobacterium bovis
PSATHRR

SEQ ID NO: 183413 - protein, 9 aa, Mycobacterium bovis
PSATPRSTE

SEQ ID NO: 183414 - protein, 5 aa, Mycobacterium bovis
PSCGD

SEQ ID NO: 183415 - protein, 24 aa, Mycobacterium bovis
PSCGSTRYSSPPAEHREPTTSAWR

SEQ ID NO: 183416 - protein, 5 aa, Mycobacterium bovis
PSDAP

SEQ ID NO: 183417 - protein, 10 aa, Mycobacterium bovis
PSDDAPQDYV

SEQ ID NO: 183418 - protein, 9 aa, Mycobacterium bovis
PSDDPPPIA

SEQ ID NO: 183419 - protein, 5 aa, Mycobacterium bovis
PSDEQ

SEQ ID NO: 183420 - protein, 11 aa, Mycobacterium bovis
PSDGGWTANGE

SEQ ID NO: 183421 - protein, 14 aa, Mycobacterium bovis
PSDGSGVTPGTGMP

SEQ ID NO: 183422 - protein, 4 aa, Mycobacterium bovis
PSDI

SEQ ID NO: 183423 - protein, 7 aa, Mycobacterium bovis
PSDPLTG

SEQ ID NO: 183424 - protein, 7 aa, Mycobacterium bovis
PSDPSGY

SEQ ID NO: 183425 - protein, 5 aa, Mycobacterium bovis
PSDRP

SEQ ID NO: 183426 - protein, 34 aa, Mycobacterium bovis
PSDSAAQHGRVQPSADLSDDPAHNAAPVAPDPGV

SEQ ID NO: 183427 - protein, 7 aa, Mycobacterium bovis
PSDTRTD

SEQ ID NO: 183428 - protein, 4 aa, Mycobacterium bovis
PSED

SEQ ID NO: 183429 - protein, 15 aa, Mycobacterium bovis
PSEDLADATDAELAG

SEQ ID NO: 183430 - protein, 5 aa, Mycobacterium bovis
PSEGR

SEQ ID NO: 183431 - protein, 5 aa, Mycobacterium bovis
PSELG

SEQ ID NO: 183432 - protein, 5 aa, Mycobacterium bovis
PSEPA

SEQ ID NO: 183433 - protein, 8 aa, Mycobacterium bovis
PSERDPSV

SEQ ID NO: 183434 - protein, 11 aa, Mycobacterium bovis
PSESRKEARIA

SEQ ID NO: 183435 - protein, 15 aa, Mycobacterium bovis
PSETTPSLPECTGAA

SEQ ID NO: 183436 - protein, 5 aa, Mycobacterium bovis
PSETV

SEQ ID NO: 183437 - protein, 6 aa, Mycobacterium bovis
PSGDGM

SEQ ID NO: 183438 - protein, 13 aa, Mycobacterium bovis
PSGELKTKPTQHS

SEQ ID NO: 183439 - protein, 5 aa, Mycobacterium bovis
PSGPA

SEQ ID NO: 183440 - protein, 17 aa, Mycobacterium bovis
PSGQPEGPDAATPPMQP

SEQ ID NO: 183441 - protein, 7 aa, Mycobacterium bovis
PSGRQRT

SEQ ID NO: 183442 - protein, 5 aa, Mycobacterium bovis
PSGRR

SEQ ID NO: 183443 - protein, 7 aa, Mycobacterium bovis
PSGRRRQ

SEQ ID NO: 183444 - protein, 9 aa, Mycobacterium bovis
PSGRRTAKE

SEQ ID NO: 183445 - protein, 4 aa, Mycobacterium bovis
PSGS

SEQ ID NO: 183446 - protein, 16 aa, Mycobacterium bovis
PSGSASNRDAQAAAAA

SEQ ID NO: 183447 - protein, 8 aa, Mycobacterium bovis
PSGSGKST

SEQ ID NO: 183448 - protein, 12 aa, Mycobacterium bovis
PSGSTLDATETV

SEQ ID NO: 183449 - protein, 4 aa, Mycobacterium bovis
PSGT

SEQ ID NO: 183450 - protein, 6 aa, Mycobacterium bovis
PSGTEP

SEQ ID NO: 183451 - protein, 10 aa, Mycobacterium bovis
PSGVGKTELS

SEQ ID NO: 183452 - protein, 5 aa, Mycobacterium bovis
PSGWD

SEQ ID NO: 183453 - protein, 8 aa, Mycobacterium bovis
PSGWRGGG

SEQ ID NO: 183454 - protein, 30 aa, Mycobacterium bovis
PSHNPPSDGGIKYNPPNGGPADTAATTAIA

SEQ ID NO: 183455 - protein, 7 aa, Mycobacterium bovis
PSHPGHE

SEQ ID NO: 183456 - protein, 10 aa, Mycobacterium bovis
PSHPTQGEGP

SEQ ID NO: 183457 - protein, 8 aa, Mycobacterium bovis
PSIAADPA

SEQ ID NO: 183458 - protein, 12 aa, Mycobacterium bovis
PSIEQGNNDSHA

SEQ ID NO: 183459 - protein, 42 aa, Mycobacterium bovis
PSIPTPTPTPAPAPAPTAVTAPTPPPGPPPPPVTAPPPVTGA

SEQ ID NO: 183460 - protein, 4 aa, Mycobacterium bovis
PSIS

SEQ ID NO: 183461 - protein, 7 aa, Mycobacterium bovis
PSKAGTD

SEQ ID NO: 183462 - protein, 22 aa, Mycobacterium bovis
PSKNNPTKGPTSAPSYVRVSDN

SEQ ID NO: 183463 - protein, 13 aa, Mycobacterium bovis
PSKTFNAALEAVQ

SEQ ID NO: 183464 - protein, 10 aa, Mycobacterium bovis
PSLAENADAP

SEQ ID NO: 183465 - protein, 8 aa, Mycobacterium bovis
PSLAGTRV

SEQ ID NO: 183466 - protein, 12 aa, Mycobacterium bovis
PSLAPAGKQAAS

SEQ ID NO: 183467 - protein, 7 aa, Mycobacterium bovis
PSLPAAL

SEQ ID NO: 183468 - protein, 20 aa, Mycobacterium bovis
PSLTITRDGSRDAVSNARPV

SEQ ID NO: 183469 - protein, 5 aa, Mycobacterium bovis
PSLTN

SEQ ID NO: 183470 - protein, 4 aa, Mycobacterium bovis
PSMA

SEQ ID NO: 183471 - protein, 5 aa, Mycobacterium bovis
PSNGV

SEQ ID NO: 183472 - protein, 12 aa, Mycobacterium bovis
PSNPAAYNAASE

SEQ ID NO: 183473 - protein, 6 aa, Mycobacterium bovis
PSNPMQ

SEQ ID NO: 183474 - protein, 8 aa, Mycobacterium bovis
PSNRRSTV

SEQ ID NO: 183475 - protein, 4 aa, Mycobacterium bovis
PSPA

SEQ ID NO: 183476 - protein, 12 aa, Mycobacterium bovis
PSPAEPATTSQV

SEQ ID NO: 183477 - protein, 10 aa, Mycobacterium bovis
PSPATPELPA

SEQ ID NO: 183478 - protein, 6 aa, Mycobacterium bovis
PSPEPW

SEQ ID NO: 183479 - protein, 9 aa, Mycobacterium bovis
PSPGSTTAH

SEQ ID NO: 183480 - protein, 10 aa, Mycobacterium bovis
PSPLGHEERR

SEQ ID NO: 183481 - protein, 9 aa, Mycobacterium bovis
PSPQRLSGP

SEQ ID NO: 183482 - protein, 4 aa, Mycobacterium bovis
PSPS

SEQ ID NO: 183483 - protein, 7 aa, Mycobacterium bovis
PSQAPSD

SEQ ID NO: 183484 - protein, 4 aa, Mycobacterium bovis
PSQI

SEQ ID NO: 183485 - protein, 5 aa, Mycobacterium bovis
PSRAM

SEQ ID NO: 183486 - protein, 7 aa, Mycobacterium bovis
PSRPNSA

SEQ ID NO: 183487 - protein, 7 aa, Mycobacterium bovis
PSRPSGK

SEQ ID NO: 183488 - protein, 8 aa, Mycobacterium bovis
PSRPSPAG

SEQ ID NO: 183489 - protein, 5 aa, Mycobacterium bovis
PSRST

SEQ ID NO: 183490 - protein, 4 aa, Mycobacterium bovis
PSRV

SEQ ID NO: 183491 - protein, 7 aa, Mycobacterium bovis
PSSAGSM

SEQ ID NO: 183492 - protein, 7 aa, Mycobacterium bovis
PSSGPAI

SEQ ID NO: 183493 - protein, 6 aa, Mycobacterium bovis
PSSGRV

SEQ ID NO: 183494 - protein, 7 aa, Mycobacterium bovis
PSSHDAI

SEQ ID NO: 183495 - protein, 9 aa, Mycobacterium bovis
PSSIPADGS

SEQ ID NO: 183496 - protein, 5 aa, Mycobacterium bovis
PSSLD

SEQ ID NO: 183497 - protein, 11 aa, Mycobacterium bovis
PSSLPSSRESA

SEQ ID NO: 183498 - protein, 4 aa, Mycobacterium bovis
PSSP

SEQ ID NO: 183499 - protein, 8 aa, Mycobacterium bovis
PSSTDASE

SEQ ID NO: 183500 - protein, 4 aa, Mycobacterium bovis
PSTC

SEQ ID NO: 183501 - protein, 5 aa, Mycobacterium bovis
PSTMK

SEQ ID NO: 183502 - protein, 6 aa, Mycobacterium bovis
PSTPGD

SEQ ID NO: 183503 - protein, 5 aa, Mycobacterium bovis
PSTPS

SEQ ID NO: 183504 - protein, 6 aa, Mycobacterium bovis
PSTRAS

SEQ ID NO: 183505 - protein, 4 aa, Mycobacterium bovis
PSTV

SEQ ID NO: 183506 - protein, 7 aa, Mycobacterium bovis
PSVMPGP

SEQ ID NO: 183507 - protein, 4 aa, Mycobacterium bovis
PSVP

SEQ ID NO: 183508 - protein, 9 aa, Mycobacterium bovis
PSVRPVTKT

SEQ ID NO: 183509 - protein, 7 aa, Mycobacterium bovis
PSVSPVP

SEQ ID NO: 183510 - protein, 27 aa, Mycobacterium bovis
PSWAAPSTRPVSALSPAGLTTLPGTDV

SEQ ID NO: 183511 - protein, 9 aa, Mycobacterium bovis
PSYDPLDGN

SEQ ID NO: 183512 - protein, 4 aa, Mycobacterium bovis
PSYG

SEQ ID NO: 183513 - protein, 6 aa, Mycobacterium bovis
PSYGGS

SEQ ID NO: 183514 - protein, 7 aa, Mycobacterium bovis
PSYLENP

SEQ ID NO: 183515 - protein, 5 aa, Mycobacterium bovis
PSYPA

SEQ ID NO: 183516 - protein, 6 aa, Mycobacterium bovis
PSYPQD

SEQ ID NO: 183517 - protein, 10 aa, Mycobacterium bovis
PTAAAQAPKG

SEQ ID NO: 183518 - protein, 7 aa, Mycobacterium bovis
PTAANAG

SEQ ID NO: 183519 - protein, 5 aa, Mycobacterium bovis
PTADG

SEQ ID NO: 183520 - protein, 9 aa, Mycobacterium bovis
PTADGTEVT

SEQ ID NO: 183521 - protein, 5 aa, Mycobacterium bovis
PTADQ

SEQ ID NO: 183522 - protein, 6 aa, Mycobacterium bovis
PTAEQA

SEQ ID NO: 183523 - protein, 7 aa, Mycobacterium bovis
PTAEQAR

SEQ ID NO: 183524 - protein, 6 aa, Mycobacterium bovis
PTAGMD

SEQ ID NO: 183525 - protein, 16 aa, Mycobacterium bovis
PTALTTAKRRASDAGV

SEQ ID NO: 183526 - protein, 19 aa, Mycobacterium bovis
PTAQAAPVPAEPADTETER

SEQ ID NO: 183527 - protein, 12 aa, Mycobacterium bovis
PTASQSASATPQ

SEQ ID NO: 183528 - protein, 7 aa, Mycobacterium bovis
PTATATT

SEQ ID NO: 183529 - protein, 5 aa, Mycobacterium bovis
PTDAA

SEQ ID NO: 183530 - protein, 7 aa, Mycobacterium bovis
PTDAKQL

SEQ ID NO: 183531 - protein, 7 aa, Mycobacterium bovis
PTDARRT

SEQ ID NO: 183532 - protein, 4 aa, Mycobacterium bovis
PTDE

SEQ ID NO: 183533 - protein, 18 aa, Mycobacterium bovis
PTDEELADAGLPKATDVT

SEQ ID NO: 183534 - protein, 17 aa, Mycobacterium bovis
PTDFRTAPDAGRRARAR

SEQ ID NO: 183535 - protein, 6 aa, Mycobacterium bovis
PTDKAF

SEQ ID NO: 183536 - protein, 4 aa, Mycobacterium bovis
PTDP

SEQ ID NO: 183537 - protein, 4 aa, Mycobacterium bovis
PTDR

SEQ ID NO: 183538 - protein, 8 aa, Mycobacterium bovis
PTDRIGAD

SEQ ID NO: 183539 - protein, 7 aa, Mycobacterium bovis
PTDSPFR

SEQ ID NO: 183540 - protein, 22 aa, Mycobacterium bovis
PTDTGGTPADRCTPATGGEFPT

SEQ ID NO: 183541 - protein, 4 aa, Mycobacterium bovis
PTEA

SEQ ID NO: 183542 - protein, 7 aa, Mycobacterium bovis
PTEALTG

SEQ ID NO: 183543 - protein, 8 aa, Mycobacterium bovis
PTEPRDPT

SEQ ID NO: 183544 - protein, 4 aa, Mycobacterium bovis
PTES

SEQ ID NO: 183545 - protein, 8 aa, Mycobacterium bovis
PTESESLA

SEQ ID NO: 183546 - protein, 4 aa, Mycobacterium bovis
PTFP

SEQ ID NO: 183547 - protein, 5 aa, Mycobacterium bovis
PTFTD

SEQ ID NO: 183548 - protein, 8 aa, Mycobacterium bovis
PTGAGKTV

SEQ ID NO: 183549 - protein, 7 aa, Mycobacterium bovis
PTGATTY

SEQ ID NO: 183550 - protein, 8 aa, Mycobacterium bovis
PTGDGRVT

SEQ ID NO: 183551 - protein, 20 aa, Mycobacterium bovis
PTGDPPAPEPARADRRGQRT

SEQ ID NO: 183552 - protein, 20 aa, Mycobacterium bovis
PTGDPPRPDPARADRRGQRT

SEQ ID NO: 183553 - protein, 15 aa, Mycobacterium bovis
PTGEPDADYDTYKHH

SEQ ID NO: 183554 - protein, 7 aa, Mycobacterium bovis
PTGEPRA

SEQ ID NO: 183555 - protein, 4 aa, Mycobacterium bovis
PTGP

SEQ ID NO: 183556 - protein, 8 aa, Mycobacterium bovis
PTGPAAEQ

SEQ ID NO: 183557 - protein, 5 aa, Mycobacterium bovis
PTGPV

SEQ ID NO: 183558 - protein, 5 aa, Mycobacterium bovis
PTGQA

SEQ ID NO: 183559 - protein, 9 aa, Mycobacterium bovis
PTGRPTGEW

SEQ ID NO: 183560 - protein, 7 aa, Mycobacterium bovis
PTGSGKT

SEQ ID NO: 183561 - protein, 10 aa, Mycobacterium bovis
PTGSSPRAYY

SEQ ID NO: 183562 - protein, 7 aa, Mycobacterium bovis
PTGSTPV

SEQ ID NO: 183563 - protein, 5 aa, Mycobacterium bovis
PTGSV

SEQ ID NO: 183564 - protein, 12 aa, Mycobacterium bovis
PTGSYRIETGKA

SEQ ID NO: 183565 - protein, 4 aa, Mycobacterium bovis
PTGV

SEQ ID NO: 183566 - protein, 11 aa, Mycobacterium bovis
PTHPSPDDYDR

SEQ ID NO: 183567 - protein, 6 aa, Mycobacterium bovis
PTITGT

SEQ ID NO: 183568 - protein, 12 aa, Mycobacterium bovis
PTITRSTPEGAR

SEQ ID NO: 183569 - protein, 9 aa, Mycobacterium bovis
PTKNPKAAA

SEQ ID NO: 183570 - protein, 4 aa, Mycobacterium bovis
PTLK

SEQ ID NO: 183571 - protein, 4 aa, Mycobacterium bovis
PTLP

SEQ ID NO: 183572 - protein, 7 aa, Mycobacterium bovis
PTLPAGA

SEQ ID NO: 183573 - protein, 7 aa, Mycobacterium bovis
PTLPDDM

SEQ ID NO: 183574 - protein, 8 aa, Mycobacterium bovis
PTLPDGLA

SEQ ID NO: 183575 - protein, 7 aa, Mycobacterium bovis
PTLPEET

SEQ ID NO: 183576 - protein, 6 aa, Mycobacterium bovis
PTLPTA

SEQ ID NO: 183577 - protein, 11 aa, Mycobacterium bovis
PTLPVDGEDPF

SEQ ID NO: 183578 - protein, 4 aa, Mycobacterium bovis
PTLR

SEQ ID NO: 183579 - protein, 6 aa, Mycobacterium bovis
PTLSSA

SEQ ID NO: 183580 - protein, 15 aa, Mycobacterium bovis
PTLTSTALDNRGPRT

SEQ ID NO: 183581 - protein, 5 aa, Mycobacterium bovis
PTNDL

SEQ ID NO: 183582 - protein, 8 aa, Mycobacterium bovis
PTNDNEIT

SEQ ID NO: 183583 - protein, 6 aa, Mycobacterium bovis
PTNDQL

SEQ ID NO: 183584 - protein, 6 aa, Mycobacterium bovis
PTNDVD

SEQ ID NO: 183585 - protein, 12 aa, Mycobacterium bovis
PTNNLDPASREQ

SEQ ID NO: 183586 - protein, 4 aa, Mycobacterium bovis
PTNP

SEQ ID NO: 183587 - protein, 7 aa, Mycobacterium bovis
PTPAECD

SEQ ID NO: 183588 - protein, 7 aa, Mycobacterium bovis
PTPAPLG

SEQ ID NO: 183589 - protein, 10 aa, Mycobacterium bovis
PTPEEAAAAE

SEQ ID NO: 183590 - protein, 8 aa, Mycobacterium bovis
PTPETRER

SEQ ID NO: 183591 - protein, 10 aa, Mycobacterium bovis
PTPHTPASAR

SEQ ID NO: 183592 - protein, 11 aa, Mycobacterium bovis
PTPKARLRPPI

SEQ ID NO: 183593 - protein, 13 aa, Mycobacterium bovis
PTPKTAIDSDGTY

SEQ ID NO: 183594 - protein, 6 aa, Mycobacterium bovis
PTPKTV

SEQ ID NO: 183595 - protein, 9 aa, Mycobacterium bovis
PTPLQPSDR

SEQ ID NO: 183596 - protein, 12 aa, Mycobacterium bovis
PTPRGAQPPRPD

SEQ ID NO: 183597 - protein, 7 aa, Mycobacterium bovis
PTPRPPF

SEQ ID NO: 183598 - protein, 5 aa, Mycobacterium bovis
PTPRT

SEQ ID NO: 183599 - protein, 15 aa, Mycobacterium bovis
PTPRVTANHRGGRRA

SEQ ID NO: 183600 - protein, 12 aa, Mycobacterium bovis
PTPSATATASTA

SEQ ID NO: 183601 - protein, 5 aa, Mycobacterium bovis
PTPTA

SEQ ID NO: 183602 - protein, 5 aa, Mycobacterium bovis
PTPTE

SEQ ID NO: 183603 - protein, 12 aa, Mycobacterium bovis
PTPTKPGRAAPG

SEQ ID NO: 183604 - protein, 4 aa, Mycobacterium bovis
PTPY

SEQ ID NO: 183605 - protein, 15 aa, Mycobacterium bovis
PTQETTPTRGIPSGP

SEQ ID NO: 183606 - protein, 9 aa, Mycobacterium bovis
PTQSGEEEV

SEQ ID NO: 183607 - protein, 4 aa, Mycobacterium bovis
PTQT

SEQ ID NO: 183608 - protein, 7 aa, Mycobacterium bovis
PTQTQAA

SEQ ID NO: 183609 - protein, 14 aa, Mycobacterium bovis
PTRADALTDAARAE

SEQ ID NO: 183610 - protein, 9 aa, Mycobacterium bovis
PTRAEDGCR

SEQ ID NO: 183611 - protein, 6 aa, Mycobacterium bovis
PTRAFA

SEQ ID NO: 183612 - protein, 6 aa, Mycobacterium bovis
PTRAYG

SEQ ID NO: 183613 - protein, 11 aa, Mycobacterium bovis
PTREKAEAELA

SEQ ID NO: 183614 - protein, 4 aa, Mycobacterium bovis
PTRI

SEQ ID NO: 183615 - protein, 6 aa, Mycobacterium bovis
PTRNGR

SEQ ID NO: 183616 - protein, 4 aa, Mycobacterium bovis
PTRP

SEQ ID NO: 183617 - protein, 5 aa, Mycobacterium bovis
PTRPR

SEQ ID NO: 183618 - protein, 4 aa, Mycobacterium bovis
PTRR

SEQ ID NO: 183619 - protein, 6 aa, Mycobacterium bovis
PTRRAR

SEQ ID NO: 183620 - protein, 7 aa, Mycobacterium bovis
PTRRQVD

SEQ ID NO: 183621 - protein, 7 aa, Mycobacterium bovis
PTRYGGV

SEQ ID NO: 183622 - protein, 29 aa, Mycobacterium bovis
PTSAAVSGTALDDGAEPALASDLVVADEH

SEQ ID NO: 183623 - protein, 10 aa, Mycobacterium bovis
PTSAGSADIS

SEQ ID NO: 183624 - protein, 12 aa, Mycobacterium bovis
PTSALDPTTTEK

SEQ ID NO: 183625 - protein, 8 aa, Mycobacterium bovis
PTSATGGI

SEQ ID NO: 183626 - protein, 11 aa, Mycobacterium bovis
PTSDARLPQAV

SEQ ID NO: 183627 - protein, 4 aa, Mycobacterium bovis
PTSG

SEQ ID NO: 183628 - protein, 5 aa, Mycobacterium bovis
PTSGL

SEQ ID NO: 183629 - protein, 10 aa, Mycobacterium bovis
PTSGLDPVNA

SEQ ID NO: 183630 - protein, 5 aa, Mycobacterium bovis
PTSGN

SEQ ID NO: 183631 - protein, 7 aa, Mycobacterium bovis
PTSGNTG

SEQ ID NO: 183632 - protein, 6 aa, Mycobacterium bovis
PTSNIH

SEQ ID NO: 183633 - protein, 4 aa, Mycobacterium bovis
PTSP

SEQ ID NO: 183634 - protein, 13 aa, Mycobacterium bovis
PTSPDDPAVPANR

SEQ ID NO: 183635 - protein, 7 aa, Mycobacterium bovis
PTSSAHI

SEQ ID NO: 183636 - protein, 8 aa, Mycobacterium bovis
PTSTGAAK

SEQ ID NO: 183637 - protein, 7 aa, Mycobacterium bovis
PTTADRD

SEQ ID NO: 183638 - protein, 10 aa, Mycobacterium bovis
PTTAQPPPMA

SEQ ID NO: 183639 - protein, 5 aa, Mycobacterium bovis
PTTAY

SEQ ID NO: 183640 - protein, 15 aa, Mycobacterium bovis
PTTKDRQGNDRGTSY

SEQ ID NO: 183641 - protein, 6 aa, Mycobacterium bovis
PTTPIG

SEQ ID NO: 183642 - protein, 6 aa, Mycobacterium bovis
PTTPLT

SEQ ID NO: 183643 - protein, 7 aa, Mycobacterium bovis
PTTQKAG

SEQ ID NO: 183644 - protein, 7 aa, Mycobacterium bovis
PTTRPQH

SEQ ID NO: 183645 - protein, 4 aa, Mycobacterium bovis
PTTV

SEQ ID NO: 183646 - protein, 9 aa, Mycobacterium bovis
PTVAQSGGD

SEQ ID NO: 183647 - protein, 18 aa, Mycobacterium bovis
PTVLPDPRSARQPDGVHA

SEQ ID NO: 183648 - protein, 4 aa, Mycobacterium bovis
PTVN

SEQ ID NO: 183649 - protein, 9 aa, Mycobacterium bovis
PTVPAGTSR

SEQ ID NO: 183650 - protein, 5 aa, Mycobacterium bovis
PTVRP

SEQ ID NO: 183651 - protein, 4 aa, Mycobacterium bovis
PTVT

SEQ ID NO: 183652 - protein, 13 aa, Mycobacterium bovis
PTVTPVDTAGAGD

SEQ ID NO: 183653 - protein, 15 aa, Mycobacterium bovis
PTWERSGRTERGRDG

SEQ ID NO: 183654 - protein, 5 aa, Mycobacterium bovis
PTYSQ

SEQ ID NO: 183655 - protein, 12 aa, Mycobacterium bovis
PVAGPAELAAGR

SEQ ID NO: 183656 - protein, 5 aa, Mycobacterium bovis
PVANE

SEQ ID NO: 183657 - protein, 4 aa, Mycobacterium bovis
PVAP

SEQ ID NO: 183658 - protein, 8 aa, Mycobacterium bovis
PVAPEHSP

SEQ ID NO: 183659 - protein, 16 aa, Mycobacterium bovis
PVAPPAVGGPLSAEPA

SEQ ID NO: 183660 - protein, 6 aa, Mycobacterium bovis
PVARES

SEQ ID NO: 183661 - protein, 5 aa, Mycobacterium bovis
PVATT

SEQ ID NO: 183662 - protein, 4 aa, Mycobacterium bovis
PVDD

SEQ ID NO: 183663 - protein, 6 aa, Mycobacterium bovis
PVDESR

SEQ ID NO: 183664 - protein, 7 aa, Mycobacterium bovis
PVDGDTG

SEQ ID NO: 183665 - protein, 6 aa, Mycobacterium bovis
PVDPAE

SEQ ID NO: 183666 - protein, 34 aa, Mycobacterium bovis
PVDSAAATGRKSEPGARRGKRSKKSRSEESSDRS

SEQ ID NO: 183667 - protein, 8 aa, Mycobacterium bovis
PVDVPRAE

SEQ ID NO: 183668 - protein, 8 aa, Mycobacterium bovis
PVGAGAGG

SEQ ID NO: 183669 - protein, 5 aa, Mycobacterium bovis
PVGAR

SEQ ID NO: 183670 - protein, 11 aa, Mycobacterium bovis
PVGDDGVAQPT

SEQ ID NO: 183671 - protein, 10 aa, Mycobacterium bovis
PVGDSSDCGT

SEQ ID NO: 183672 - protein, 5 aa, Mycobacterium bovis
PVGPR

SEQ ID NO: 183673 - protein, 6 aa, Mycobacterium bovis
PVGPSA

SEQ ID NO: 183674 - protein, 15 aa, Mycobacterium bovis
PVGRSDSETKGASEG

SEQ ID NO: 183675 - protein, 6 aa, Mycobacterium bovis
PVGSGG

SEQ ID NO: 183676 - protein, 6 aa, Mycobacterium bovis
PVGTAP

SEQ ID NO: 183677 - protein, 16 aa, Mycobacterium bovis
PVKRDPNSSASPAQPF

SEQ ID NO: 183678 - protein, 7 aa, Mycobacterium bovis
PVKSSRA

SEQ ID NO: 183679 - protein, 11 aa, Mycobacterium bovis
PVMPDAGGGGF

SEQ ID NO: 183680 - protein, 6 aa, Mycobacterium bovis
PVNDLS

SEQ ID NO: 183681 - protein, 8 aa, Mycobacterium bovis
PVNPAQLT

SEQ ID NO: 183682 - protein, 7 aa, Mycobacterium bovis
PVNPSGG

SEQ ID NO: 183683 - protein, 8 aa, Mycobacterium bovis
PVNPSGGV

SEQ ID NO: 183684 - protein, 13 aa, Mycobacterium bovis
PVNVSPDADSLIL

SEQ ID NO: 183685 - protein, 4 aa, Mycobacterium bovis
PVPA

SEQ ID NO: 183686 - protein, 13 aa, Mycobacterium bovis
PVPAGTEPGYRPS

SEQ ID NO: 183687 - protein, 22 aa, Mycobacterium bovis
PVPAPAEAPVEASESTGGPRPS

SEQ ID NO: 183688 - protein, 20 aa, Mycobacterium bovis
PVPAPESGAPGDTPATPGID

SEQ ID NO: 183689 - protein, 12 aa, Mycobacterium bovis
PVPDGDYTDDPN

SEQ ID NO: 183690 - protein, 7 aa, Mycobacterium bovis
PVPGAAD

SEQ ID NO: 183691 - protein, 5 aa, Mycobacterium bovis
PVPGP

SEQ ID NO: 183692 - protein, 14 aa, Mycobacterium bovis
PVPGPRDDKYTQGV

SEQ ID NO: 183693 - protein, 19 aa, Mycobacterium bovis
PVPGPVPTSPANNDFKPGF

SEQ ID NO: 183694 - protein, 13 aa, Mycobacterium bovis
PVPNADAPLGPGQ

SEQ ID NO: 183695 - protein, 5 aa, Mycobacterium bovis
PVPPS

SEQ ID NO: 183696 - protein, 7 aa, Mycobacterium bovis
PVPRPER

SEQ ID NO: 183697 - protein, 21 aa, Mycobacterium bovis
PVPSVGAPPAAAGGETPTRSV

SEQ ID NO: 183698 - protein, 5 aa, Mycobacterium bovis
PVPTT

SEQ ID NO: 183699 - protein, 4 aa, Mycobacterium bovis
PVPV

SEQ ID NO: 183700 - protein, 12 aa, Mycobacterium bovis
PVQEDRDRSLRD

SEQ ID NO: 183701 - protein, 7 aa, Mycobacterium bovis
PVQGEAA

SEQ ID NO: 183702 - protein, 7 aa, Mycobacterium bovis
PVQGSHV

SEQ ID NO: 183703 - protein, 6 aa, Mycobacterium bovis
PVQSTA

SEQ ID NO: 183704 - protein, 4 aa, Mycobacterium bovis
PVQT

SEQ ID NO: 183705 - protein, 15 aa, Mycobacterium bovis
PVQTTNASGLAAQSA

SEQ ID NO: 183706 - protein, 14 aa, Mycobacterium bovis
PVREPTDIMRDVAA

SEQ ID NO: 183707 - protein, 12 aa, Mycobacterium bovis
PVRNYRDTSHKP

SEQ ID NO: 183708 - protein, 9 aa, Mycobacterium bovis
PVRRTNPAV

SEQ ID NO: 183709 - protein, 8 aa, Mycobacterium bovis
PVRSTDGR

SEQ ID NO: 183710 - protein, 8 aa, Mycobacterium bovis
PVSARSDA

SEQ ID NO: 183711 - protein, 7 aa, Mycobacterium bovis
PVSERRG

SEQ ID NO: 183712 - protein, 8 aa, Mycobacterium bovis
PVSGEPSL

SEQ ID NO: 183713 - protein, 8 aa, Mycobacterium bovis
PVSGGQPL

SEQ ID NO: 183714 - protein, 12 aa, Mycobacterium bovis
PVSGGVKGAAAA

SEQ ID NO: 183715 - protein, 14 aa, Mycobacterium bovis
PVSPGAQWPATRGT

SEQ ID NO: 183716 - protein, 12 aa, Mycobacterium bovis
PVSPPGTPEGGY

SEQ ID NO: 183717 - protein, 10 aa, Mycobacterium bovis
PVSRDQAADA

SEQ ID NO: 183718 - protein, 10 aa, Mycobacterium bovis
PVSTSDPLCD

SEQ ID NO: 183719 - protein, 4 aa, Mycobacterium bovis
PVSV

SEQ ID NO: 183720 - protein, 11 aa, Mycobacterium bovis
PVTAHKDGTIT

SEQ ID NO: 183721 - protein, 5 aa, Mycobacterium bovis
PVTAT

SEQ ID NO: 183722 - protein, 7 aa, Mycobacterium bovis
PVTDSPA

SEQ ID NO: 183723 - protein, 4 aa, Mycobacterium bovis
PVTG

SEQ ID NO: 183724 - protein, 4 aa, Mycobacterium bovis
PVTP

SEQ ID NO: 183725 - protein, 7 aa, Mycobacterium bovis
PVTPPAL

SEQ ID NO: 183726 - protein, 26 aa, Mycobacterium bovis
PVTTSPAALAGQAAATVSSTVPPLAT

SEQ ID NO: 183727 - protein, 4 aa, Mycobacterium bovis
PWDT

SEQ ID NO: 183728 - protein, 5 aa, Mycobacterium bovis
PWEDP

SEQ ID NO: 183729 - protein, 4 aa, Mycobacterium bovis
PWEG

SEQ ID NO: 183730 - protein, 12 aa, Mycobacterium bovis
PWEPPPLPSTRQ

SEQ ID NO: 183731 - protein, 21 aa, Mycobacterium bovis
PWGPDKITEDGREQLRALGFT

SEQ ID NO: 183732 - protein, 14 aa, Mycobacterium bovis
PWPGADQETPRRAA

SEQ ID NO: 183733 - protein, 12 aa, Mycobacterium bovis
PWPNGNDHTPKR

SEQ ID NO: 183734 - protein, 7 aa, Mycobacterium bovis
PWPPPGR

SEQ ID NO: 183735 - protein, 7 aa, Mycobacterium bovis
PWSNGHT

SEQ ID NO: 183736 - protein, 5 aa, Mycobacterium bovis
PWTGG

SEQ ID NO: 183737 - protein, 13 aa, Mycobacterium bovis
PYALPKSGTKRPW

SEQ ID NO: 183738 - protein, 5 aa, Mycobacterium bovis
PYDDG

SEQ ID NO: 183739 - protein, 9 aa, Mycobacterium bovis
PYDKKNADT

SEQ ID NO: 183740 - protein, 8 aa, Mycobacterium bovis
PYDPSESQ

SEQ ID NO: 183741 - protein, 4 aa, Mycobacterium bovis
PYFG

SEQ ID NO: 183742 - protein, 8 aa, Mycobacterium bovis
PYGEDGTI

SEQ ID NO: 183743 - protein, 6 aa, Mycobacterium bovis
PYGGPD

SEQ ID NO: 183744 - protein, 10 aa, Mycobacterium bovis
PYGNSGPRID

SEQ ID NO: 183745 - protein, 8 aa, Mycobacterium bovis
PYGPVNPD

SEQ ID NO: 183746 - protein, 10 aa, Mycobacterium bovis
PYHGSDAATR

SEQ ID NO: 183747 - protein, 5 aa, Mycobacterium bovis
PYLPP

SEQ ID NO: 183748 - protein, 8 aa, Mycobacterium bovis
PYPGTGRD

SEQ ID NO: 183749 - protein, 30 aa, Mycobacterium bovis
PYPPNYPKMPGEPKRVQPSRDTDLKGGNTS

SEQ ID NO: 183750 - protein, 7 aa, Mycobacterium bovis
PYPRRED

SEQ ID NO: 183751 - protein, 5 aa, Mycobacterium bovis
PYQNI

SEQ ID NO: 183752 - protein, 9 aa, Mycobacterium bovis
PYQPEISQG

SEQ ID NO: 183753 - protein, 4 aa, Mycobacterium bovis
PYQQ

SEQ ID NO: 183754 - protein, 9 aa, Mycobacterium bovis
PYRDDAGHS

SEQ ID NO: 183755 - protein, 13 aa, Mycobacterium bovis
PYSEPRHEQAASG

SEQ ID NO: 183756 - protein, 11 aa, Mycobacterium bovis
PYSRDPRNIAR

SEQ ID NO: 183757 - protein, 5 aa, Mycobacterium bovis
PYTRE

SEQ ID NO: 183758 - protein, 9 aa, Mycobacterium bovis
QAAAQEAQQ

SEQ ID NO: 183759 - protein, 16 aa, Mycobacterium bovis
QAADASAAGDPAGDEY

SEQ ID NO: 183760 - protein, 20 aa, Mycobacterium bovis
QAADDDVKEGDTKDETQDVA

SEQ ID NO: 183761 - protein, 11 aa, Mycobacterium bovis
QAADTAFESRT

SEQ ID NO: 183762 - protein, 7 aa, Mycobacterium bovis
QAAERGL

SEQ ID NO: 183763 - protein, 6 aa, Mycobacterium bovis
QAAGAA

SEQ ID NO: 183764 - protein, 9 aa, Mycobacterium bovis
QAAGADAVH

SEQ ID NO: 183765 - protein, 19 aa, Mycobacterium bovis
QAAGEADKMPKASNATPRE

SEQ ID NO: 183766 - protein, 6 aa, Mycobacterium bovis
QAAGGS

SEQ ID NO: 183767 - protein, 9 aa, Mycobacterium bovis
QAAGLPAAT

SEQ ID NO: 183768 - protein, 5 aa, Mycobacterium bovis
QAAGV

SEQ ID NO: 183769 - protein, 5 aa, Mycobacterium bovis
QAAKL

SEQ ID NO: 183770 - protein, 14 aa, Mycobacterium bovis
QAAKSRSEQLRITP

SEQ ID NO: 183771 - protein, 52 aa, Mycobacterium bovis
QAAPPARARTPLPVPTPRGERPDDGGHAPHRDRRVNQRRRQVGDRRAQRGVD

SEQ ID NO: 183772 - protein, 8 aa, Mycobacterium bovis
QAARDEVG

SEQ ID NO: 183773 - protein, 7 aa, Mycobacterium bovis
QAAREGR

SEQ ID NO: 183774 - protein, 14 aa, Mycobacterium bovis
QAARRGESERGPSR

SEQ ID NO: 183775 - protein, 7 aa, Mycobacterium bovis
QAASGPV

SEQ ID NO: 183776 - protein, 26 aa, Mycobacterium bovis
QAASQATGAAHPGGEPGGAHPGSADD

SEQ ID NO: 183777 - protein, 4 aa, Mycobacterium bovis
QAAY

SEQ ID NO: 183778 - protein, 9 aa, Mycobacterium bovis
QADDPHGTN

SEQ ID NO: 183779 - protein, 4 aa, Mycobacterium bovis
QADG

SEQ ID NO: 183780 - protein, 7 aa, Mycobacterium bovis
QADGHPA

SEQ ID NO: 183781 - protein, 5 aa, Mycobacterium bovis
QADRD

SEQ ID NO: 183782 - protein, 7 aa, Mycobacterium bovis
QADRHGR

SEQ ID NO: 183783 - protein, 7 aa, Mycobacterium bovis
QAEAAYR

SEQ ID NO: 183784 - protein, 7 aa, Mycobacterium bovis
QAEAEGL

SEQ ID NO: 183785 - protein, 8 aa, Mycobacterium bovis
QAEGSGTM

SEQ ID NO: 183786 - protein, 6 aa, Mycobacterium bovis
QAEHPG

SEQ ID NO: 183787 - protein, 7 aa, Mycobacterium bovis
QAEQAAM

SEQ ID NO: 183788 - protein, 16 aa, Mycobacterium bovis
QAEQAASQARAAAAAY

SEQ ID NO: 183789 - protein, 7 aa, Mycobacterium bovis
QAEQQAM

SEQ ID NO: 183790 - protein, 9 aa, Mycobacterium bovis
QAEQTAAQA

SEQ ID NO: 183791 - protein, 8 aa, Mycobacterium bovis
QAERGNKI

SEQ ID NO: 183792 - protein, 10 aa, Mycobacterium bovis
QAESAKAIST

SEQ ID NO: 183793 - protein, 7 aa, Mycobacterium bovis
QAESGAH

SEQ ID NO: 183794 - protein, 7 aa, Mycobacterium bovis
QAETERD

SEQ ID NO: 183795 - protein, 6 aa, Mycobacterium bovis
QAEVDS

SEQ ID NO: 183796 - protein, 5 aa, Mycobacterium bovis
QAFGS

SEQ ID NO: 183797 - protein, 5 aa, Mycobacterium bovis
QAFNT

SEQ ID NO: 183798 - protein, 7 aa, Mycobacterium bovis
QAGAGSL

SEQ ID NO: 183799 - protein, 5 aa, Mycobacterium bovis
QAGAT

SEQ ID NO: 183800 - protein, 7 aa, Mycobacterium bovis
QAGDPEA

SEQ ID NO: 183801 - protein, 12 aa, Mycobacterium bovis
QAGEKGRDSRCE

SEQ ID NO: 183802 - protein, 25 aa, Mycobacterium bovis
QAGGRPGPTNRRKCQTPPAGRCRPT

SEQ ID NO: 183803 - protein, 11 aa, Mycobacterium bovis
QAGKPTSTNPI

SEQ ID NO: 183804 - protein, 6 aa, Mycobacterium bovis
QAGKQA

SEQ ID NO: 183805 - protein, 4 aa, Mycobacterium bovis
QAGL

SEQ ID NO: 183806 - protein, 13 aa, Mycobacterium bovis
QAGSGGTPLPLED

SEQ ID NO: 183807 - protein, 12 aa, Mycobacterium bovis
QAGTDAHDTPAV

SEQ ID NO: 183808 - protein, 16 aa, Mycobacterium bovis
QAGTGSPAPPADPGSP

SEQ ID NO: 183809 - protein, 5 aa, Mycobacterium bovis
QAGYD

SEQ ID NO: 183810 - protein, 7 aa, Mycobacterium bovis
QAHADGG

SEQ ID NO: 183811 - protein, 13 aa, Mycobacterium bovis
QAHEPKDDHPLES

SEQ ID NO: 183812 - protein, 17 aa, Mycobacterium bovis
QAKPTEVAAVIRSRLGP

SEQ ID NO: 183813 - protein, 8 aa, Mycobacterium bovis
QAKSGSGF

SEQ ID NO: 183814 - protein, 11 aa, Mycobacterium bovis
QAKTRSAAHTP

SEQ ID NO: 183815 - protein, 9 aa, Mycobacterium bovis
QALATEHKA

SEQ ID NO: 183816 - protein, 10 aa, Mycobacterium bovis
QALGDKRGIR

SEQ ID NO: 183817 - protein, 6 aa, Mycobacterium bovis
QALKPG

SEQ ID NO: 183818 - protein, 4 aa, Mycobacterium bovis
QALP

SEQ ID NO: 183819 - protein, 11 aa, Mycobacterium bovis
QANEDYTEEFD

SEQ ID NO: 183820 - protein, 8 aa, Mycobacterium bovis
QANGFSPA

SEQ ID NO: 183821 - protein, 7 aa, Mycobacterium bovis
QANKGQA

SEQ ID NO: 183822 - protein, 8 aa, Mycobacterium bovis
QANQRSDE

SEQ ID NO: 183823 - protein, 11 aa, Mycobacterium bovis
QANYAAAKAGI

SEQ ID NO: 183824 - protein, 9 aa, Mycobacterium bovis
QANYAASKA

SEQ ID NO: 183825 - protein, 4 aa, Mycobacterium bovis
QAPA

SEQ ID NO: 183826 - protein, 13 aa, Mycobacterium bovis
QAPARRGRHKNIP

SEQ ID NO: 183827 - protein, 8 aa, Mycobacterium bovis
QAPDAVDG

SEQ ID NO: 183828 - protein, 8 aa, Mycobacterium bovis
QAPDSGNA

SEQ ID NO: 183829 - protein, 6 aa, Mycobacterium bovis
QAPGPV

SEQ ID NO: 183830 - protein, 15 aa, Mycobacterium bovis
QAPGYPTSLNEHPKA

SEQ ID NO: 183831 - protein, 7 aa, Mycobacterium bovis
QAPNQRS

SEQ ID NO: 183832 - protein, 5 aa, Mycobacterium bovis
QAPPA

SEQ ID NO: 183833 - protein, 16 aa, Mycobacterium bovis
QAPPPGAPGGMSSGDI

SEQ ID NO: 183834 - protein, 14 aa, Mycobacterium bovis
QAPQRPAPLPGQDS

SEQ ID NO: 183835 - protein, 20 aa, Mycobacterium bovis
QAPQTEAQPHAASTPPTGTP

SEQ ID NO: 183836 - protein, 10 aa, Mycobacterium bovis
QAPTGSNSQG

SEQ ID NO: 183837 - protein, 6 aa, Mycobacterium bovis
QAPTRA

SEQ ID NO: 183838 - protein, 9 aa, Mycobacterium bovis
QAQGADGLA

SEQ ID NO: 183839 - protein, 8 aa, Mycobacterium bovis
QAQGDHSH

SEQ ID NO: 183840 - protein, 6 aa, Mycobacterium bovis
QAQPAR

SEQ ID NO: 183841 - protein, 4 aa, Mycobacterium bovis
QAQT

SEQ ID NO: 183842 - protein, 7 aa, Mycobacterium bovis
QARAAAA

SEQ ID NO: 183843 - protein, 11 aa, Mycobacterium bovis
QARDKTGTDPV

SEQ ID NO: 183844 - protein, 8 aa, Mycobacterium bovis
QARDTRRE

SEQ ID NO: 183845 - protein, 6 aa, Mycobacterium bovis
QAREPQ

SEQ ID NO: 183846 - protein, 8 aa, Mycobacterium bovis
QARERGEQ

SEQ ID NO: 183847 - protein, 5 aa, Mycobacterium bovis
QARGV

SEQ ID NO: 183848 - protein, 6 aa, Mycobacterium bovis
QARGYR

SEQ ID NO: 183849 - protein, 6 aa, Mycobacterium bovis
QARKDR

SEQ ID NO: 183850 - protein, 6 aa, Mycobacterium bovis
QARQAA

SEQ ID NO: 183851 - protein, 14 aa, Mycobacterium bovis
QARRADSSEFDPDR

SEQ ID NO: 183852 - protein, 10 aa, Mycobacterium bovis
QARREKTTVT

SEQ ID NO: 183853 - protein, 4 aa, Mycobacterium bovis
QARS

SEQ ID NO: 183854 - protein, 5 aa, Mycobacterium bovis
QARSI

SEQ ID NO: 183855 - protein, 7 aa, Mycobacterium bovis
QARTGMG

SEQ ID NO: 183856 - protein, 14 aa, Mycobacterium bovis
QARWRDSAGEEYEA

SEQ ID NO: 183857 - protein, 7 aa, Mycobacterium bovis
QASEAGW

SEQ ID NO: 183858 - protein, 15 aa, Mycobacterium bovis
QASGYVSRTPGEGAP

SEQ ID NO: 183859 - protein, 7 aa, Mycobacterium bovis
QASSGYE

SEQ ID NO: 183860 - protein, 7 aa, Mycobacterium bovis
QASSTYA

SEQ ID NO: 183861 - protein, 6 aa, Mycobacterium bovis
QASTDR

SEQ ID NO: 183862 - protein, 16 aa, Mycobacterium bovis
QATAQRPQQRAAQRRL

SEQ ID NO: 183863 - protein, 9 aa, Mycobacterium bovis
QATDKQLAA

SEQ ID NO: 183864 - protein, 7 aa, Mycobacterium bovis
QATEEIA

SEQ ID NO: 183865 - protein, 6 aa, Mycobacterium bovis
QATGGN

SEQ ID NO: 183866 - protein, 6 aa, Mycobacterium bovis
QATGRG

SEQ ID NO: 183867 - protein, 8 aa, Mycobacterium bovis
QATGTDTF

SEQ ID NO: 183868 - protein, 9 aa, Mycobacterium bovis
QATKARAPF

SEQ ID NO: 183869 - protein, 4 aa, Mycobacterium bovis
QATP

SEQ ID NO: 183870 - protein, 11 aa, Mycobacterium bovis
QATQQECEKRL

SEQ ID NO: 183871 - protein, 12 aa, Mycobacterium bovis
QAVKNSLSRAAK

SEQ ID NO: 183872 - protein, 11 aa, Mycobacterium bovis
QAVQASGDYAS

SEQ ID NO: 183873 - protein, 9 aa, Mycobacterium bovis
QAVSGSGLA

SEQ ID NO: 183874 - protein, 7 aa, Mycobacterium bovis
QAVTDRP

SEQ ID NO: 183875 - protein, 8 aa, Mycobacterium bovis
QAVTPAAR

SEQ ID NO: 183876 - protein, 8 aa, Mycobacterium bovis
QAVTPADA

SEQ ID NO: 183877 - protein, 10 aa, Mycobacterium bovis
QAWQGPASAA

SEQ ID NO: 183878 - protein, 6 aa, Mycobacterium bovis
QAYSSA

SEQ ID NO: 183879 - protein, 8 aa, Mycobacterium bovis
QCGSSQQA

SEQ ID NO: 183880 - protein, 15 aa, Mycobacterium bovis
QDAAAPAEEVDPAAA

SEQ ID NO: 183881 - protein, 8 aa, Mycobacterium bovis
QDAQTARV

SEQ ID NO: 183882 - protein, 5 aa, Mycobacterium bovis
QDCRS

SEQ ID NO: 183883 - protein, 5 aa, Mycobacterium bovis
QDDAV

SEQ ID NO: 183884 - protein, 8 aa, Mycobacterium bovis
QDDEHSVS

SEQ ID NO: 183885 - protein, 4 aa, Mycobacterium bovis
QDDL

SEQ ID NO: 183886 - protein, 5 aa, Mycobacterium bovis
QDDNG

SEQ ID NO: 183887 - protein, 5 aa, Mycobacterium bovis
QDDTR

SEQ ID NO: 183888 - protein, 6 aa, Mycobacterium bovis
QDEDEI

SEQ ID NO: 183889 - protein, 7 aa, Mycobacterium bovis
QDEKDAE

SEQ ID NO: 183890 - protein, 8 aa, Mycobacterium bovis
QDEQLRKR

SEQ ID NO: 183891 - protein, 11 aa, Mycobacterium bovis
QDETNLPEQSK

SEQ ID NO: 183892 - protein, 6 aa, Mycobacterium bovis
QDEVST

SEQ ID NO: 183893 - protein, 4 aa, Mycobacterium bovis
QDEW

SEQ ID NO: 183894 - protein, 11 aa, Mycobacterium bovis
QDFSPPPPRYT

SEQ ID NO: 183895 - protein, 7 aa, Mycobacterium bovis
QDGDEGT

SEQ ID NO: 183896 - protein, 5 aa, Mycobacterium bovis
QDGEA

SEQ ID NO: 183897 - protein, 8 aa, Mycobacterium bovis
QDGGNSYV

SEQ ID NO: 183898 - protein, 5 aa, Mycobacterium bovis
QDGHV

SEQ ID NO: 183899 - protein, 6 aa, Mycobacterium bovis
QDGLPE

SEQ ID NO: 183900 - protein, 9 aa, Mycobacterium bovis
QDGYQDNSG

SEQ ID NO: 183901 - protein, 8 aa, Mycobacterium bovis
QDKHGTAY

SEQ ID NO: 183902 - protein, 11 aa, Mycobacterium bovis
QDKKHRGREPI

SEQ ID NO: 183903 - protein, 4 aa, Mycobacterium bovis
QDLA

SEQ ID NO: 183904 - protein, 8 aa, Mycobacterium bovis
QDLAGKDE

SEQ ID NO: 183905 - protein, 7 aa, Mycobacterium bovis
QDLGDPE

SEQ ID NO: 183906 - protein, 11 aa, Mycobacterium bovis
QDLPPNAATEI

SEQ ID NO: 183907 - protein, 7 aa, Mycobacterium bovis
QDNGPWG

SEQ ID NO: 183908 - protein, 14 aa, Mycobacterium bovis
QDNPRRSVRLSFVE

SEQ ID NO: 183909 - protein, 15 aa, Mycobacterium bovis
QDPDRWTTTPDDEAK

SEQ ID NO: 183910 - protein, 10 aa, Mycobacterium bovis
QDPGKGGGFH

SEQ ID NO: 183911 - protein, 5 aa, Mycobacterium bovis
QDPHE

SEQ ID NO: 183912 - protein, 6 aa, Mycobacterium bovis
QDPKGQ

SEQ ID NO: 183913 - protein, 4 aa, Mycobacterium bovis
QDPM

SEQ ID NO: 183914 - protein, 5 aa, Mycobacterium bovis
QDPRA

SEQ ID NO: 183915 - protein, 7 aa, Mycobacterium bovis
QDPRGDG

SEQ ID NO: 183916 - protein, 4 aa, Mycobacterium bovis
QDPT

SEQ ID NO: 183917 - protein, 9 aa, Mycobacterium bovis
QDPTRGKDR

SEQ ID NO: 183918 - protein, 16 aa, Mycobacterium bovis
QDPTSKMSKSAGTDAG

SEQ ID NO: 183919 - protein, 9 aa, Mycobacterium bovis
QDQGGANGE

SEQ ID NO: 183920 - protein, 16 aa, Mycobacterium bovis
QDQNLQDGPHKDLRRA

SEQ ID NO: 183921 - protein, 5 aa, Mycobacterium bovis
QDRAS

SEQ ID NO: 183922 - protein, 7 aa, Mycobacterium bovis
QDREALE

SEQ ID NO: 183923 - protein, 6 aa, Mycobacterium bovis
QDRGVD

SEQ ID NO: 183924 - protein, 8 aa, Mycobacterium bovis
QDRPPRGK

SEQ ID NO: 183925 - protein, 4 aa, Mycobacterium bovis
QDRR

SEQ ID NO: 183926 - protein, 6 aa, Mycobacterium bovis
QDSNAG

SEQ ID NO: 183927 - protein, 4 aa, Mycobacterium bovis
QDSV

SEQ ID NO: 183928 - protein, 17 aa, Mycobacterium bovis
QDTADRLTNTAKAESDK

SEQ ID NO: 183929 - protein, 17 aa, Mycobacterium bovis
QDTAHGGFGGAPKFPPS

SEQ ID NO: 183930 - protein, 7 aa, Mycobacterium bovis
QDTAKRT

SEQ ID NO: 183931 - protein, 7 aa, Mycobacterium bovis
QDTDESE

SEQ ID NO: 183932 - protein, 5 aa, Mycobacterium bovis
QDTDP

SEQ ID NO: 183933 - protein, 20 aa, Mycobacterium bovis
QDTEKTDARSTVGRYDHTDS

SEQ ID NO: 183934 - protein, 6 aa, Mycobacterium bovis
QDTGHA

SEQ ID NO: 183935 - protein, 5 aa, Mycobacterium bovis
QDTNH

SEQ ID NO: 183936 - protein, 11 aa, Mycobacterium bovis
QDTPPNDQAGL

SEQ ID NO: 183937 - protein, 4 aa, Mycobacterium bovis
QDVA

SEQ ID NO: 183938 - protein, 9 aa, Mycobacterium bovis
QDVADGSFG

SEQ ID NO: 183939 - protein, 7 aa, Mycobacterium bovis
QDVEPSA

SEQ ID NO: 183940 - protein, 6 aa, Mycobacterium bovis
QDVSPG

SEQ ID NO: 183941 - protein, 12 aa, Mycobacterium bovis
QDWDPDQSKLSD

SEQ ID NO: 183942 - protein, 6 aa, Mycobacterium bovis
QEAEDT

SEQ ID NO: 183943 - protein, 5 aa, Mycobacterium bovis
QEAGA

SEQ ID NO: 183944 - protein, 12 aa, Mycobacterium bovis
QEAIEGDRVPGA

SEQ ID NO: 183945 - protein, 5 aa, Mycobacterium bovis
QEAMT

SEQ ID NO: 183946 - protein, 8 aa, Mycobacterium bovis
QEARGLRE

SEQ ID NO: 183947 - protein, 7 aa, Mycobacterium bovis
QEATSGK

SEQ ID NO: 183948 - protein, 9 aa, Mycobacterium bovis
QEDHAELGD

SEQ ID NO: 183949 - protein, 4 aa, Mycobacterium bovis
QEDL

SEQ ID NO: 183950 - protein, 5 aa, Mycobacterium bovis
QEEES

SEQ ID NO: 183951 - protein, 5 aa, Mycobacterium bovis
QEERG

SEQ ID NO: 183952 - protein, 5 aa, Mycobacterium bovis
QEFTT

SEQ ID NO: 183953 - protein, 7 aa, Mycobacterium bovis
QEGGEDV

SEQ ID NO: 183954 - protein, 7 aa, Mycobacterium bovis
QEGIKEQ

SEQ ID NO: 183955 - protein, 7 aa, Mycobacterium bovis
QEGVSDG

SEQ ID NO: 183956 - protein, 6 aa, Mycobacterium bovis
QEHVSG

SEQ ID NO: 183957 - protein, 6 aa, Mycobacterium bovis
QEITGG

SEQ ID NO: 183958 - protein, 7 aa, Mycobacterium bovis
QEKLEPG

SEQ ID NO: 183959 - protein, 15 aa, Mycobacterium bovis
QELADAAGKSGKPTV

SEQ ID NO: 183960 - protein, 5 aa, Mycobacterium bovis
QEPAL

SEQ ID NO: 183961 - protein, 5 aa, Mycobacterium bovis
QEPGA

SEQ ID NO: 183962 - protein, 7 aa, Mycobacterium bovis
QEPIGSK

SEQ ID NO: 183963 - protein, 15 aa, Mycobacterium bovis
QEPNGGERSAIAAPT

SEQ ID NO: 183964 - protein, 4 aa, Mycobacterium bovis
QEPQ

SEQ ID NO: 183965 - protein, 6 aa, Mycobacterium bovis
QEPVRD

SEQ ID NO: 183966 - protein, 4 aa, Mycobacterium bovis
QEPY

SEQ ID NO: 183967 - protein, 5 aa, Mycobacterium bovis
QEQGA

SEQ ID NO: 183968 - protein, 7 aa, Mycobacterium bovis
QERAQKI

SEQ ID NO: 183969 - protein, 6 aa, Mycobacterium bovis
QERGSG

SEQ ID NO: 183970 - protein, 7 aa, Mycobacterium bovis
QERHAAD

SEQ ID NO: 183971 - protein, 4 aa, Mycobacterium bovis
QERP

SEQ ID NO: 183972 - protein, 11 aa, Mycobacterium bovis
QERRAKRAERA

SEQ ID NO: 183973 - protein, 5 aa, Mycobacterium bovis
QESEG

SEQ ID NO: 183974 - protein, 12 aa, Mycobacterium bovis
QESGTTRPIDPW

SEQ ID NO: 183975 - protein, 4 aa, Mycobacterium bovis
QESM

SEQ ID NO: 183976 - protein, 8 aa, Mycobacterium bovis
QETDGSGA

SEQ ID NO: 183977 - protein, 4 aa, Mycobacterium bovis
QETR

SEQ ID NO: 183978 - protein, 10 aa, Mycobacterium bovis
QETRNADVER

SEQ ID NO: 183979 - protein, 10 aa, Mycobacterium bovis
QETRSNRRAA

SEQ ID NO: 183980 - protein, 7 aa, Mycobacterium bovis
QEVADSG

SEQ ID NO: 183981 - protein, 4 aa, Mycobacterium bovis
QFAS

SEQ ID NO: 183982 - protein, 9 aa, Mycobacterium bovis
QFDTSKRRL

SEQ ID NO: 183983 - protein, 4 aa, Mycobacterium bovis
QFGT

SEQ ID NO: 183984 - protein, 5 aa, Mycobacterium bovis
QFPDG

SEQ ID NO: 183985 - protein, 12 aa, Mycobacterium bovis
QFPTSSAVSSEL

SEQ ID NO: 183986 - protein, 5 aa, Mycobacterium bovis
QFSEA

SEQ ID NO: 183987 - protein, 16 aa, Mycobacterium bovis
QGADRPRRTPATVSRR

SEQ ID NO: 183988 - protein, 10 aa, Mycobacterium bovis
QGAEGPGELR

SEQ ID NO: 183989 - protein, 9 aa, Mycobacterium bovis
QGAGHAASG

SEQ ID NO: 183990 - protein, 4 aa, Mycobacterium bovis
QGAI

SEQ ID NO: 183991 - protein, 13 aa, Mycobacterium bovis
QGAKPGEGGQLPG

SEQ ID NO: 183992 - protein, 5 aa, Mycobacterium bovis
QGAPV

SEQ ID NO: 183993 - protein, 8 aa, Mycobacterium bovis
QGARTDLK

SEQ ID NO: 183994 - protein, 8 aa, Mycobacterium bovis
QGASEERI

SEQ ID NO: 183995 - protein, 5 aa, Mycobacterium bovis
QGATA

SEQ ID NO: 183996 - protein, 6 aa, Mycobacterium bovis
QGATAA

SEQ ID NO: 183997 - protein, 13 aa, Mycobacterium bovis
QGAVTSTSGPTSE

SEQ ID NO: 183998 - protein, 7 aa, Mycobacterium bovis
QGCSPDQ

SEQ ID NO: 183999 - protein, 9 aa, Mycobacterium bovis
QGDAPPSGE

SEQ ID NO: 184000 - protein, 5 aa, Mycobacterium bovis
QGDGG

SEQ ID NO: 184001 - protein, 10 aa, Mycobacterium bovis
QGDTGAAAKP

SEQ ID NO: 184002 - protein, 8 aa, Mycobacterium bovis
QGDVRDRA

SEQ ID NO: 184003 - protein, 4 aa, Mycobacterium bovis
QGEA

SEQ ID NO: 184004 - protein, 5 aa, Mycobacterium bovis
QGEAG

SEQ ID NO: 184005 - protein, 7 aa, Mycobacterium bovis
QGERAGI

SEQ ID NO: 184006 - protein, 6 aa, Mycobacterium bovis
QGERNF

SEQ ID NO: 184007 - protein, 13 aa, Mycobacterium bovis
QGEVGPGGGPAGD

SEQ ID NO: 184008 - protein, 12 aa, Mycobacterium bovis
QGFPDEDGPPKM

SEQ ID NO: 184009 - protein, 5 aa, Mycobacterium bovis
QGGAT

SEQ ID NO: 184010 - protein, 16 aa, Mycobacterium bovis
QGGEAPTAASWGAANR

SEQ ID NO: 184011 - protein, 5 aa, Mycobacterium bovis
QGGFD

SEQ ID NO: 184012 - protein, 23 aa, Mycobacterium bovis
QGGFGGARGERPAAPEFPDRHPD

SEQ ID NO: 184013 - protein, 6 aa, Mycobacterium bovis
QGGGIR

SEQ ID NO: 184014 - protein, 5 aa, Mycobacterium bovis
QGGGP

SEQ ID NO: 184015 - protein, 9 aa, Mycobacterium bovis
QGGPGAFTD

SEQ ID NO: 184016 - protein, 5 aa, Mycobacterium bovis
QGGPI

SEQ ID NO: 184017 - protein, 4 aa, Mycobacterium bovis
QGGR

SEQ ID NO: 184018 - protein, 9 aa, Mycobacterium bovis
QGGRRSAAD

SEQ ID NO: 184019 - protein, 9 aa, Mycobacterium bovis
QGHRGGRSV

SEQ ID NO: 184020 - protein, 10 aa, Mycobacterium bovis
QGISSENAKK

SEQ ID NO: 184021 - protein, 4 aa, Mycobacterium bovis
QGIT

SEQ ID NO: 184022 - protein, 8 aa, Mycobacterium bovis
QGKDGKRS

SEQ ID NO: 184023 - protein, 4 aa, Mycobacterium bovis
QGKG

SEQ ID NO: 184024 - protein, 11 aa, Mycobacterium bovis
QGKGTNGDSVP

SEQ ID NO: 184025 - protein, 9 aa, Mycobacterium bovis
QGKPEAAAD

SEQ ID NO: 184026 - protein, 10 aa, Mycobacterium bovis
QGLAGKRRAT

SEQ ID NO: 184027 - protein, 5 aa, Mycobacterium bovis
QGLPA

SEQ ID NO: 184028 - protein, 6 aa, Mycobacterium bovis
QGLPAD

SEQ ID NO: 184029 - protein, 4 aa, Mycobacterium bovis
QGLS

SEQ ID NO: 184030 - protein, 6 aa, Mycobacterium bovis
QGMLSS

SEQ ID NO: 184031 - protein, 7 aa, Mycobacterium bovis
QGNPEGG

SEQ ID NO: 184032 - protein, 6 aa, Mycobacterium bovis
QGNPSN

SEQ ID NO: 184033 - protein, 8 aa, Mycobacterium bovis
QGNRSAAG

SEQ ID NO: 184034 - protein, 9 aa, Mycobacterium bovis
QGPAPAPVT

SEQ ID NO: 184035 - protein, 8 aa, Mycobacterium bovis
QGPGEVTA

SEQ ID NO: 184036 - protein, 7 aa, Mycobacterium bovis
QGPGNKI

SEQ ID NO: 184037 - protein, 4 aa, Mycobacterium bovis
QGPK

SEQ ID NO: 184038 - protein, 6 aa, Mycobacterium bovis
QGPLRG

SEQ ID NO: 184039 - protein, 6 aa, Mycobacterium bovis
QGPNAV

SEQ ID NO: 184040 - protein, 6 aa, Mycobacterium bovis
QGPNGP

SEQ ID NO: 184041 - protein, 10 aa, Mycobacterium bovis
QGPRNRTRTV

SEQ ID NO: 184042 - protein, 7 aa, Mycobacterium bovis
QGPSAES

SEQ ID NO: 184043 - protein, 9 aa, Mycobacterium bovis
QGPTQSPEI

SEQ ID NO: 184044 - protein, 7 aa, Mycobacterium bovis
QGQAGDN

SEQ ID NO: 184045 - protein, 13 aa, Mycobacterium bovis
QGQEPDSPEARAE

SEQ ID NO: 184046 - protein, 6 aa, Mycobacterium bovis
QGQGGS

SEQ ID NO: 184047 - protein, 6 aa, Mycobacterium bovis
QGQKCS

SEQ ID NO: 184048 - protein, 9 aa, Mycobacterium bovis
QGQQAPSGH

SEQ ID NO: 184049 - protein, 7 aa, Mycobacterium bovis
QGRAGSH

SEQ ID NO: 184050 - protein, 11 aa, Mycobacterium bovis
QGRGDAAEQTI

SEQ ID NO: 184051 - protein, 7 aa, Mycobacterium bovis
QGRGLGE

SEQ ID NO: 184052 - protein, 13 aa, Mycobacterium bovis
QGRNTGPTEGPAI

SEQ ID NO: 184053 - protein, 5 aa, Mycobacterium bovis
QGRPL

SEQ ID NO: 184054 - protein, 7 aa, Mycobacterium bovis
QGRQVDD

SEQ ID NO: 184055 - protein, 6 aa, Mycobacterium bovis
QGRSGS

SEQ ID NO: 184056 - protein, 6 aa, Mycobacterium bovis
QGRTAD

SEQ ID NO: 184057 - protein, 7 aa, Mycobacterium bovis
QGRTAED

SEQ ID NO: 184058 - protein, 4 aa, Mycobacterium bovis
QGSA

SEQ ID NO: 184059 - protein, 9 aa, Mycobacterium bovis
QGSAGGHIE

SEQ ID NO: 184060 - protein, 6 aa, Mycobacterium bovis
QGSARC

SEQ ID NO: 184061 - protein, 6 aa, Mycobacterium bovis
QGSDAV

SEQ ID NO: 184062 - protein, 7 aa, Mycobacterium bovis
QGSGGPA

SEQ ID NO: 184063 - protein, 10 aa, Mycobacterium bovis
QGSGKTTLAG

SEQ ID NO: 184064 - protein, 9 aa, Mycobacterium bovis
QGSSRAAFD

SEQ ID NO: 184065 - protein, 10 aa, Mycobacterium bovis
QGSTRTSERE

SEQ ID NO: 184066 - protein, 12 aa, Mycobacterium bovis
QGTAGSTGAPRT

SEQ ID NO: 184067 - protein, 4 aa, Mycobacterium bovis
QGTD

SEQ ID NO: 184068 - protein, 4 aa, Mycobacterium bovis
QGTE

SEQ ID NO: 184069 - protein, 15 aa, Mycobacterium bovis
QGTEAGGHGHGPRST

SEQ ID NO: 184070 - protein, 11 aa, Mycobacterium bovis
QGTGEGATFAR

SEQ ID NO: 184071 - protein, 6 aa, Mycobacterium bovis
QGTMTA

SEQ ID NO: 184072 - protein, 4 aa, Mycobacterium bovis
QGTS

SEQ ID NO: 184073 - protein, 6 aa, Mycobacterium bovis
QGTTST

SEQ ID NO: 184074 - protein, 9 aa, Mycobacterium bovis
QGVEPPRPL

SEQ ID NO: 184075 - protein, 5 aa, Mycobacterium bovis
QGWQP

SEQ ID NO: 184076 - protein, 12 aa, Mycobacterium bovis
QGYGRQKGHTEV

SEQ ID NO: 184077 - protein, 6 aa, Mycobacterium bovis
QGYQAA

SEQ ID NO: 184078 - protein, 5 aa, Mycobacterium bovis
QGYQT

SEQ ID NO: 184079 - protein, 7 aa, Mycobacterium bovis
QHAADGR

SEQ ID NO: 184080 - protein, 7 aa, Mycobacterium bovis
QHAGGPG

SEQ ID NO: 184081 - protein, 20 aa, Mycobacterium bovis
QHDRQDEKDRRLLDKSRYFD

SEQ ID NO: 184082 - protein, 7 aa, Mycobacterium bovis
QHEDARA

SEQ ID NO: 184083 - protein, 8 aa, Mycobacterium bovis
QHEGPGYR

SEQ ID NO: 184084 - protein, 4 aa, Mycobacterium bovis
QHER

SEQ ID NO: 184085 - protein, 11 aa, Mycobacterium bovis
QHFAQTKDADV

SEQ ID NO: 184086 - protein, 5 aa, Mycobacterium bovis
QHGDA

SEQ ID NO: 184087 - protein, 18 aa, Mycobacterium bovis
QHGDAGPDEWAAAPDPLD

SEQ ID NO: 184088 - protein, 8 aa, Mycobacterium bovis
QHGEKRSM

SEQ ID NO: 184089 - protein, 4 aa, Mycobacterium bovis
QHGL

SEQ ID NO: 184090 - protein, 7 aa, Mycobacterium bovis
QHGNKEA

SEQ ID NO: 184091 - protein, 7 aa, Mycobacterium bovis
QHGSKPV

SEQ ID NO: 184092 - protein, 16 aa, Mycobacterium bovis
QHHPRQRGIASGGTTV

SEQ ID NO: 184093 - protein, 4 aa, Mycobacterium bovis
QHQR

SEQ ID NO: 184094 - protein, 5 aa, Mycobacterium bovis
QHSSD

SEQ ID NO: 184095 - protein, 4 aa, Mycobacterium bovis
QHVD

SEQ ID NO: 184096 - protein, 5 aa, Mycobacterium bovis
QIAGA

SEQ ID NO: 184097 - protein, 9 aa, Mycobacterium bovis
QIGAPGAAR

SEQ ID NO: 184098 - protein, 5 aa, Mycobacterium bovis
QIGEH

SEQ ID NO: 184099 - protein, 12 aa, Mycobacterium bovis
QIGPNRPGPKGF

SEQ ID NO: 184100 - protein, 8 aa, Mycobacterium bovis
QIGTPEEL

SEQ ID NO: 184101 - protein, 4 aa, Mycobacterium bovis
QIPD

SEQ ID NO: 184102 - protein, 6 aa, Mycobacterium bovis
QIPTGF

SEQ ID NO: 184103 - protein, 7 aa, Mycobacterium bovis
QIPVPPG

SEQ ID NO: 184104 - protein, 10 aa, Mycobacterium bovis
QISAAGSFGR

SEQ ID NO: 184105 - protein, 7 aa, Mycobacterium bovis
QISDGAS

SEQ ID NO: 184106 - protein, 8 aa, Mycobacterium bovis
QISDPAQR

SEQ ID NO: 184107 - protein, 5 aa, Mycobacterium bovis
QISDT

SEQ ID NO: 184108 - protein, 10 aa, Mycobacterium bovis
QISGGEIGTG

SEQ ID NO: 184109 - protein, 4 aa, Mycobacterium bovis
QISP

SEQ ID NO: 184110 - protein, 73 aa, Mycobacterium bovis
QKAARKARAQVAKATAKRVPAKKAPAKSAANKGAAATKAATKKASPKAKPSESKIAGKDGEASASPSSSAKGR

SEQ ID NO: 184111 - protein, 9 aa, Mycobacterium bovis
QKDEGSMAH

SEQ ID NO: 184112 - protein, 9 aa, Mycobacterium bovis
QKDGPSHAP

SEQ ID NO: 184113 - protein, 5 aa, Mycobacterium bovis
QKDRD

SEQ ID NO: 184114 - protein, 9 aa, Mycobacterium bovis
QKGAPEGQA

SEQ ID NO: 184115 - protein, 6 aa, Mycobacterium bovis
QKGEPV

SEQ ID NO: 184116 - protein, 6 aa, Mycobacterium bovis
QKGTTI

SEQ ID NO: 184117 - protein, 11 aa, Mycobacterium bovis
QKMSKSLRNYP

SEQ ID NO: 184118 - protein, 7 aa, Mycobacterium bovis
QKNQRAQ

SEQ ID NO: 184119 - protein, 10 aa, Mycobacterium bovis
QKPDESERTF

SEQ ID NO: 184120 - protein, 6 aa, Mycobacterium bovis
QKQPDA

SEQ ID NO: 184121 - protein, 9 aa, Mycobacterium bovis
QKRAGQPVS

SEQ ID NO: 184122 - protein, 7 aa, Mycobacterium bovis
QKRPAVG

SEQ ID NO: 184123 - protein, 6 aa, Mycobacterium bovis
QKSASA

SEQ ID NO: 184124 - protein, 15 aa, Mycobacterium bovis
QKSGTQSAGEAVEAA

SEQ ID NO: 184125 - protein, 7 aa, Mycobacterium bovis
QKTERDR

SEQ ID NO: 184126 - protein, 5 aa, Mycobacterium bovis
QKTGA

SEQ ID NO: 184127 - protein, 9 aa, Mycobacterium bovis
QLAGGPLGS

SEQ ID NO: 184128 - protein, 13 aa, Mycobacterium bovis
QLAPRDDAERRKA

SEQ ID NO: 184129 - protein, 5 aa, Mycobacterium bovis
QLARG

SEQ ID NO: 184130 - protein, 7 aa, Mycobacterium bovis
QLASAPR

SEQ ID NO: 184131 - protein, 8 aa, Mycobacterium bovis
QLASTGAR

SEQ ID NO: 184132 - protein, 5 aa, Mycobacterium bovis
QLASV

SEQ ID NO: 184133 - protein, 11 aa, Mycobacterium bovis
QLDAHGDNPAN

SEQ ID NO: 184134 - protein, 10 aa, Mycobacterium bovis
QLDPCQSPRP

SEQ ID NO: 184135 - protein, 5 aa, Mycobacterium bovis
QLEED

SEQ ID NO: 184136 - protein, 6 aa, Mycobacterium bovis
QLEENP

SEQ ID NO: 184137 - protein, 6 aa, Mycobacterium bovis
QLEGPV

SEQ ID NO: 184138 - protein, 16 aa, Mycobacterium bovis
QLEQPAGTLSGGEKTR

SEQ ID NO: 184139 - protein, 16 aa, Mycobacterium bovis
QLGAGHATRVAPDAPN

SEQ ID NO: 184140 - protein, 7 aa, Mycobacterium bovis
QLGARTG

SEQ ID NO: 184141 - protein, 17 aa, Mycobacterium bovis
QLGDPLAADNPPGAVDP

SEQ ID NO: 184142 - protein, 12 aa, Mycobacterium bovis
QLGKKSGRGFYT

SEQ ID NO: 184143 - protein, 7 aa, Mycobacterium bovis
QLGPQSP

SEQ ID NO: 184144 - protein, 9 aa, Mycobacterium bovis
QLGTKGPSL

SEQ ID NO: 184145 - protein, 7 aa, Mycobacterium bovis
QLKPPVE

SEQ ID NO: 184146 - protein, 4 aa, Mycobacterium bovis
QLKS

SEQ ID NO: 184147 - protein, 5 aa, Mycobacterium bovis
QLKTG

SEQ ID NO: 184148 - protein, 6 aa, Mycobacterium bovis
QLNNNR

SEQ ID NO: 184149 - protein, 5 aa, Mycobacterium bovis
QLPDG

SEQ ID NO: 184150 - protein, 6 aa, Mycobacterium bovis
QLPDGT

SEQ ID NO: 184151 - protein, 22 aa, Mycobacterium bovis
QLPDPPALPTRAGGERDRRRST

SEQ ID NO: 184152 - protein, 9 aa, Mycobacterium bovis
QLPEPEQPV

SEQ ID NO: 184153 - protein, 5 aa, Mycobacterium bovis
QLPGA

SEQ ID NO: 184154 - protein, 25 aa, Mycobacterium bovis
QLPKTDPIDPEAPPITPGEKIVTLL

SEQ ID NO: 184155 - protein, 13 aa, Mycobacterium bovis
QLPPDGRPTDLPG

SEQ ID NO: 184156 - protein, 9 aa, Mycobacterium bovis
QLPRTDTGK

SEQ ID NO: 184157 - protein, 6 aa, Mycobacterium bovis
QLPRTG

SEQ ID NO: 184158 - protein, 6 aa, Mycobacterium bovis
QLPTTY

SEQ ID NO: 184159 - protein, 15 aa, Mycobacterium bovis
QLRGRAGRQGDPGSS

SEQ ID NO: 184160 - protein, 6 aa, Mycobacterium bovis
QLRGRN

SEQ ID NO: 184161 - protein, 15 aa, Mycobacterium bovis
QLRGRSGRQGDPGES

SEQ ID NO: 184162 - protein, 15 aa, Mycobacterium bovis
QLRPDAPDCDSGADE

SEQ ID NO: 184163 - protein, 16 aa, Mycobacterium bovis
QLSAAGEGGGQSAARA

SEQ ID NO: 184164 - protein, 5 aa, Mycobacterium bovis
QLSPE

SEQ ID NO: 184165 - protein, 7 aa, Mycobacterium bovis
QLSPTEK

SEQ ID NO: 184166 - protein, 5 aa, Mycobacterium bovis
QLTER

SEQ ID NO: 184167 - protein, 8 aa, Mycobacterium bovis
QLTPPGTA

SEQ ID NO: 184168 - protein, 5 aa, Mycobacterium bovis
QLTRA

SEQ ID NO: 184169 - protein, 8 aa, Mycobacterium bovis
QMAGRGTD

SEQ ID NO: 184170 - protein, 9 aa, Mycobacterium bovis
QMTDKTAPR

SEQ ID NO: 184171 - protein, 10 aa, Mycobacterium bovis
QMTDKTAPRV

SEQ ID NO: 184172 - protein, 4 aa, Mycobacterium bovis
QNAP

SEQ ID NO: 184173 - protein, 5 aa, Mycobacterium bovis
QNAPA

SEQ ID NO: 184174 - protein, 7 aa, Mycobacterium bovis
QNAPAIA

SEQ ID NO: 184175 - protein, 10 aa, Mycobacterium bovis
QNAPAIAATE

SEQ ID NO: 184176 - protein, 11 aa, Mycobacterium bovis
QNAPAIAATEA

SEQ ID NO: 184177 - protein, 6 aa, Mycobacterium bovis
QNAPGV

SEQ ID NO: 184178 - protein, 6 aa, Mycobacterium bovis
QNASGA

SEQ ID NO: 184179 - protein, 6 aa, Mycobacterium bovis
QNATPT

SEQ ID NO: 184180 - protein, 6 aa, Mycobacterium bovis
QNGQGV

SEQ ID NO: 184181 - protein, 5 aa, Mycobacterium bovis
QNIKS

SEQ ID NO: 184182 - protein, 5 aa, Mycobacterium bovis
QNMSN

SEQ ID NO: 184183 - protein, 5 aa, Mycobacterium bovis
QNMTS

SEQ ID NO: 184184 - protein, 6 aa, Mycobacterium bovis
QNNELG

SEQ ID NO: 184185 - protein, 8 aa, Mycobacterium bovis
QNPDAASE

SEQ ID NO: 184186 - protein, 17 aa, Mycobacterium bovis
QNPERGRKLGACHRRRH

SEQ ID NO: 184187 - protein, 8 aa, Mycobacterium bovis
QNPGTNHP

SEQ ID NO: 184188 - protein, 6 aa, Mycobacterium bovis
QNPGVT

SEQ ID NO: 184189 - protein, 6 aa, Mycobacterium bovis
QNPIEY

SEQ ID NO: 184190 - protein, 5 aa, Mycobacterium bovis
QNPRS

SEQ ID NO: 184191 - protein, 8 aa, Mycobacterium bovis
QNPSGPRP

SEQ ID NO: 184192 - protein, 8 aa, Mycobacterium bovis
QNPTGEQE

SEQ ID NO: 184193 - protein, 9 aa, Mycobacterium bovis
QNPTIQGRD

SEQ ID NO: 184194 - protein, 5 aa, Mycobacterium bovis
QNQET

SEQ ID NO: 184195 - protein, 11 aa, Mycobacterium bovis
QNREKAREQRN

SEQ ID NO: 184196 - protein, 7 aa, Mycobacterium bovis
QNRGRDT

SEQ ID NO: 184197 - protein, 11 aa, Mycobacterium bovis
QNRRAELADDR

SEQ ID NO: 184198 - protein, 11 aa, Mycobacterium bovis
QNSGSKTTIAP

SEQ ID NO: 184199 - protein, 11 aa, Mycobacterium bovis
QNSNSASEPDR

SEQ ID NO: 184200 - protein, 4 aa, Mycobacterium bovis
QNSV

SEQ ID NO: 184201 - protein, 10 aa, Mycobacterium bovis
QNTKDAGGTR

SEQ ID NO: 184202 - protein, 6 aa, Mycobacterium bovis
QNTPAI

SEQ ID NO: 184203 - protein, 7 aa, Mycobacterium bovis
QNTPAIA

SEQ ID NO: 184204 - protein, 8 aa, Mycobacterium bovis
QNTPAIAA

SEQ ID NO: 184205 - protein, 11 aa, Mycobacterium bovis
QNTPAIEANQA

SEQ ID NO: 184206 - protein, 5 aa, Mycobacterium bovis
QNTRG

SEQ ID NO: 184207 - protein, 13 aa, Mycobacterium bovis
QNTSAIAAAEAQY

SEQ ID NO: 184208 - protein, 11 aa, Mycobacterium bovis
QPADRSRRART

SEQ ID NO: 184209 - protein, 9 aa, Mycobacterium bovis
QPAEHTDSG

SEQ ID NO: 184210 - protein, 7 aa, Mycobacterium bovis
QPAGPPH

SEQ ID NO: 184211 - protein, 10 aa, Mycobacterium bovis
QPAKNQAVTN

SEQ ID NO: 184212 - protein, 8 aa, Mycobacterium bovis
QPAPETLD

SEQ ID NO: 184213 - protein, 13 aa, Mycobacterium bovis
QPAPTLSGGEAQR

SEQ ID NO: 184214 - protein, 5 aa, Mycobacterium bovis
QPAQW

SEQ ID NO: 184215 - protein, 6 aa, Mycobacterium bovis
QPARTQ

SEQ ID NO: 184216 - protein, 6 aa, Mycobacterium bovis
QPATPQ

SEQ ID NO: 184217 - protein, 6 aa, Mycobacterium bovis
QPATPT

SEQ ID NO: 184218 - protein, 10 aa, Mycobacterium bovis
QPDADGNRPD

SEQ ID NO: 184219 - protein, 5 aa, Mycobacterium bovis
QPDLG

SEQ ID NO: 184220 - protein, 11 aa, Mycobacterium bovis
QPDLSTKARPR

SEQ ID NO: 184221 - protein, 6 aa, Mycobacterium bovis
QPDPSY

SEQ ID NO: 184222 - protein, 4 aa, Mycobacterium bovis
QPDQ

SEQ ID NO: 184223 - protein, 4 aa, Mycobacterium bovis
QPDR

SEQ ID NO: 184224 - protein, 8 aa, Mycobacterium bovis
QPDRDGIA

SEQ ID NO: 184225 - protein, 7 aa, Mycobacterium bovis
QPDTAAI

SEQ ID NO: 184226 - protein, 4 aa, Mycobacterium bovis
QPEA

SEQ ID NO: 184227 - protein, 14 aa, Mycobacterium bovis
QPEATNRRSQLKSD

SEQ ID NO: 184228 - protein, 4 aa, Mycobacterium bovis
QPED

SEQ ID NO: 184229 - protein, 12 aa, Mycobacterium bovis
QPEESLAGRTVS

SEQ ID NO: 184230 - protein, 6 aa, Mycobacterium bovis
QPEHQW

SEQ ID NO: 184231 - protein, 5 aa, Mycobacterium bovis
QPELE

SEQ ID NO: 184232 - protein, 5 aa, Mycobacterium bovis
QPERQ

SEQ ID NO: 184233 - protein, 6 aa, Mycobacterium bovis
QPETGV

SEQ ID NO: 184234 - protein, 11 aa, Mycobacterium bovis
QPETITTEHKE

SEQ ID NO: 184235 - protein, 4 aa, Mycobacterium bovis
QPEV

SEQ ID NO: 184236 - protein, 13 aa, Mycobacterium bovis
QPFAASAPRIGAP

SEQ ID NO: 184237 - protein, 19 aa, Mycobacterium bovis
QPFGGARGSGTNDKAGSPL

SEQ ID NO: 184238 - protein, 12 aa, Mycobacterium bovis
QPFGTGGDPLVD

SEQ ID NO: 184239 - protein, 7 aa, Mycobacterium bovis
QPFPGPG

SEQ ID NO: 184240 - protein, 7 aa, Mycobacterium bovis
QPGASQN

SEQ ID NO: 184241 - protein, 4 aa, Mycobacterium bovis
QPGE

SEQ ID NO: 184242 - protein, 4 aa, Mycobacterium bovis
QPGG

SEQ ID NO: 184243 - protein, 5 aa, Mycobacterium bovis
QPGGH

SEQ ID NO: 184244 - protein, 7 aa, Mycobacterium bovis
QPGGPGG

SEQ ID NO: 184245 - protein, 7 aa, Mycobacterium bovis
QPGHPVT

SEQ ID NO: 184246 - protein, 5 aa, Mycobacterium bovis
QPGLG

SEQ ID NO: 184247 - protein, 6 aa, Mycobacterium bovis
QPGPQN

SEQ ID NO: 184248 - protein, 5 aa, Mycobacterium bovis
QPGQC

SEQ ID NO: 184249 - protein, 7 aa, Mycobacterium bovis
QPGTEGL

SEQ ID NO: 184250 - protein, 15 aa, Mycobacterium bovis
QPGYGHSDKRAEHGQ

SEQ ID NO: 184251 - protein, 9 aa, Mycobacterium bovis
QPHSGAQAN

SEQ ID NO: 184252 - protein, 9 aa, Mycobacterium bovis
QPHTAVRRG

SEQ ID NO: 184253 - protein, 20 aa, Mycobacterium bovis
QPIAPGTPLTAPEYAEQTGL

SEQ ID NO: 184254 - protein, 5 aa, Mycobacterium bovis
QPIPD

SEQ ID NO: 184255 - protein, 8 aa, Mycobacterium bovis
QPISGPGE

SEQ ID NO: 184256 - protein, 5 aa, Mycobacterium bovis
QPKYV

SEQ ID NO: 184257 - protein, 6 aa, Mycobacterium bovis
QPLDPG

SEQ ID NO: 184258 - protein, 12 aa, Mycobacterium bovis
QPLGGKAQFGGQ

SEQ ID NO: 184259 - protein, 11 aa, Mycobacterium bovis
QPLGQDKDGKN

SEQ ID NO: 184260 - protein, 6 aa, Mycobacterium bovis
QPLPST

SEQ ID NO: 184261 - protein, 9 aa, Mycobacterium bovis
QPLSPERAR

SEQ ID NO: 184262 - protein, 6 aa, Mycobacterium bovis
QPLTEQ

SEQ ID NO: 184263 - protein, 11 aa, Mycobacterium bovis
QPNAAARRGVA

SEQ ID NO: 184264 - protein, 6 aa, Mycobacterium bovis
QPNGGS

SEQ ID NO: 184265 - protein, 5 aa, Mycobacterium bovis
QPNGT

SEQ ID NO: 184266 - protein, 4 aa, Mycobacterium bovis
QPNT

SEQ ID NO: 184267 - protein, 6 aa, Mycobacterium bovis
QPPAEG

SEQ ID NO: 184268 - protein, 7 aa, Mycobacterium bovis
QPPATPV

SEQ ID NO: 184269 - protein, 5 aa, Mycobacterium bovis
QPPER

SEQ ID NO: 184270 - protein, 10 aa, Mycobacterium bovis
QPPESYRNDH

SEQ ID NO: 184271 - protein, 11 aa, Mycobacterium bovis
QPPGGSPGRHV

SEQ ID NO: 184272 - protein, 5 aa, Mycobacterium bovis
QPPGL

SEQ ID NO: 184273 - protein, 9 aa, Mycobacterium bovis
QPPHAATSG

SEQ ID NO: 184274 - protein, 7 aa, Mycobacterium bovis
QPPKGLT

SEQ ID NO: 184275 - protein, 6 aa, Mycobacterium bovis
QPPPLT

SEQ ID NO: 184276 - protein, 5 aa, Mycobacterium bovis
QPPSA

SEQ ID NO: 184277 - protein, 12 aa, Mycobacterium bovis
QPPVVPAPAPDA

SEQ ID NO: 184278 - protein, 8 aa, Mycobacterium bovis
QPPYGHGA

SEQ ID NO: 184279 - protein, 15 aa, Mycobacterium bovis
QPQKLSTAALDAAKS

SEQ ID NO: 184280 - protein, 16 aa, Mycobacterium bovis
QPQPAAELPMTQRYFL

SEQ ID NO: 184281 - protein, 9 aa, Mycobacterium bovis
QPQSQPMPV

SEQ ID NO: 184282 - protein, 5 aa, Mycobacterium bovis
QPQTV

SEQ ID NO: 184283 - protein, 7 aa, Mycobacterium bovis
QPQVAPA

SEQ ID NO: 184284 - protein, 7 aa, Mycobacterium bovis
QPRADEP

SEQ ID NO: 184285 - protein, 13 aa, Mycobacterium bovis
QPRNTALDDTDGL

SEQ ID NO: 184286 - protein, 11 aa, Mycobacterium bovis
QPRPPRKLTGQ

SEQ ID NO: 184287 - protein, 20 aa, Mycobacterium bovis
QPRRRGSGRPGFYRPPGRPE

SEQ ID NO: 184288 - protein, 5 aa, Mycobacterium bovis
QPRTR

SEQ ID NO: 184289 - protein, 12 aa, Mycobacterium bovis
QPRVGKKAARRR

SEQ ID NO: 184290 - protein, 7 aa, Mycobacterium bovis
QPRVRPG

SEQ ID NO: 184291 - protein, 7 aa, Mycobacterium bovis
QPSATGR

SEQ ID NO: 184292 - protein, 9 aa, Mycobacterium bovis
QPSNPTAVR

SEQ ID NO: 184293 - protein, 5 aa, Mycobacterium bovis
QPTDG

SEQ ID NO: 184294 - protein, 8 aa, Mycobacterium bovis
QPTDTAGD

SEQ ID NO: 184295 - protein, 8 aa, Mycobacterium bovis
QPTEEARA

SEQ ID NO: 184296 - protein, 8 aa, Mycobacterium bovis
QPTEQTRG

SEQ ID NO: 184297 - protein, 6 aa, Mycobacterium bovis
QPTPAW

SEQ ID NO: 184298 - protein, 7 aa, Mycobacterium bovis
QPTPEEQ

SEQ ID NO: 184299 - protein, 21 aa, Mycobacterium bovis
QPTTIDQTPPTTALSGIGSGG

SEQ ID NO: 184300 - protein, 5 aa, Mycobacterium bovis
QPVPT

SEQ ID NO: 184301 - protein, 8 aa, Mycobacterium bovis
QPVSLSPT

SEQ ID NO: 184302 - protein, 8 aa, Mycobacterium bovis
QPVSSPDV

SEQ ID NO: 184303 - protein, 8 aa, Mycobacterium bovis
QPVYGDDD

SEQ ID NO: 184304 - protein, 13 aa, Mycobacterium bovis
QQADDNAARRVRE

SEQ ID NO: 184305 - protein, 8 aa, Mycobacterium bovis
QQADHGES

SEQ ID NO: 184306 - protein, 14 aa, Mycobacterium bovis
QQAEEAAAKIGAGE

SEQ ID NO: 184307 - protein, 11 aa, Mycobacterium bovis
QQAGHSGSEIT

SEQ ID NO: 184308 - protein, 18 aa, Mycobacterium bovis
QQAIPGTPGGAGDSGSSV

SEQ ID NO: 184309 - protein, 7 aa, Mycobacterium bovis
QQAPNST

SEQ ID NO: 184310 - protein, 8 aa, Mycobacterium bovis
QQATAAPV

SEQ ID NO: 184311 - protein, 20 aa, Mycobacterium bovis
QQATPGKHIRRSGEDVAAGT

SEQ ID NO: 184312 - protein, 7 aa, Mycobacterium bovis
QQDAGVA

SEQ ID NO: 184313 - protein, 4 aa, Mycobacterium bovis
QQDR

SEQ ID NO: 184314 - protein, 6 aa, Mycobacterium bovis
QQEAGK

SEQ ID NO: 184315 - protein, 6 aa, Mycobacterium bovis
QQEASR

SEQ ID NO: 184316 - protein, 8 aa, Mycobacterium bovis
QQEQGTAD

SEQ ID NO: 184317 - protein, 8 aa, Mycobacterium bovis
QQGAVQGV

SEQ ID NO: 184318 - protein, 6 aa, Mycobacterium bovis
QQGERL

SEQ ID NO: 184319 - protein, 6 aa, Mycobacterium bovis
QQHDGD

SEQ ID NO: 184320 - protein, 10 aa, Mycobacterium bovis
QQKAQAADSD

SEQ ID NO: 184321 - protein, 5 aa, Mycobacterium bovis
QQLAD

SEQ ID NO: 184322 - protein, 15 aa, Mycobacterium bovis
QQLANSEVHGQAGGG

SEQ ID NO: 184323 - protein, 7 aa, Mycobacterium bovis
QQLDPQA

SEQ ID NO: 184324 - protein, 12 aa, Mycobacterium bovis
QQLPQTDDQGRT

SEQ ID NO: 184325 - protein, 5 aa, Mycobacterium bovis
QQNGF

SEQ ID NO: 184326 - protein, 5 aa, Mycobacterium bovis
QQPEM

SEQ ID NO: 184327 - protein, 6 aa, Mycobacterium bovis
QQPIDP

SEQ ID NO: 184328 - protein, 6 aa, Mycobacterium bovis
QQPRPA

SEQ ID NO: 184329 - protein, 9 aa, Mycobacterium bovis
QQQADNHAD

SEQ ID NO: 184330 - protein, 7 aa, Mycobacterium bovis
QQRPHDA

SEQ ID NO: 184331 - protein, 13 aa, Mycobacterium bovis
QQRPKTPVELLTI

SEQ ID NO: 184332 - protein, 5 aa, Mycobacterium bovis
QQRSE

SEQ ID NO: 184333 - protein, 5 aa, Mycobacterium bovis
QQRTL

SEQ ID NO: 184334 - protein, 7 aa, Mycobacterium bovis
QQSFEEV

SEQ ID NO: 184335 - protein, 8 aa, Mycobacterium bovis
QQSGNSPM

SEQ ID NO: 184336 - protein, 14 aa, Mycobacterium bovis
QQSQASAGKGGPAM

SEQ ID NO: 184337 - protein, 23 aa, Mycobacterium bovis
QQTDYPSVGPDRPEYEPRGCPRG

SEQ ID NO: 184338 - protein, 10 aa, Mycobacterium bovis
QQTLAGSATG

SEQ ID NO: 184339 - protein, 6 aa, Mycobacterium bovis
QQTQRF

SEQ ID NO: 184340 - protein, 5 aa, Mycobacterium bovis
QQTSD

SEQ ID NO: 184341 - protein, 7 aa, Mycobacterium bovis
QQVGEGH

SEQ ID NO: 184342 - protein, 46 aa, Mycobacterium bovis
QRAAARQGTHSTKTRGEVSGGGRKPYRQKGTGRARQGSTRAPQFTG

SEQ ID NO: 184343 - protein, 12 aa, Mycobacterium bovis
QRADHAEHARRN

SEQ ID NO: 184344 - protein, 13 aa, Mycobacterium bovis
QRADRRSHPAADS

SEQ ID NO: 184345 - protein, 4 aa, Mycobacterium bovis
QRAE

SEQ ID NO: 184346 - protein, 6 aa, Mycobacterium bovis
QRAEAA

SEQ ID NO: 184347 - protein, 7 aa, Mycobacterium bovis
QRAEPDL

SEQ ID NO: 184348 - protein, 9 aa, Mycobacterium bovis
QRAEQAGGE

SEQ ID NO: 184349 - protein, 12 aa, Mycobacterium bovis
QRAEREKQWRSG

SEQ ID NO: 184350 - protein, 5 aa, Mycobacterium bovis
QRAEW

SEQ ID NO: 184351 - protein, 8 aa, Mycobacterium bovis
QRAEWSEQ

SEQ ID NO: 184352 - protein, 13 aa, Mycobacterium bovis
QRAGGGPGAGRLQ

SEQ ID NO: 184353 - protein, 8 aa, Mycobacterium bovis
QRAGTVRP

SEQ ID NO: 184354 - protein, 9 aa, Mycobacterium bovis
QRAGVSEPN

SEQ ID NO: 184355 - protein, 10 aa, Mycobacterium bovis
QRAKRRLPKS

SEQ ID NO: 184356 - protein, 7 aa, Mycobacterium bovis
QRALESE

SEQ ID NO: 184357 - protein, 17 aa, Mycobacterium bovis
QRAPLDDPGAAKGADAD

SEQ ID NO: 184358 - protein, 25 aa, Mycobacterium bovis
QRAQQNAAASTDADRALSTPSGVTE

SEQ ID NO: 184359 - protein, 7 aa, Mycobacterium bovis
QRAVGGA

SEQ ID NO: 184360 - protein, 4 aa, Mycobacterium bovis
QRAY

SEQ ID NO: 184361 - protein, 4 aa, Mycobacterium bovis
QRCE

SEQ ID NO: 184362 - protein, 5 aa, Mycobacterium bovis
QRCPP

SEQ ID NO: 184363 - protein, 8 aa, Mycobacterium bovis
QRDADDTV

SEQ ID NO: 184364 - protein, 21 aa, Mycobacterium bovis
QRDAGHKTCDPAAGGTLTSVL

SEQ ID NO: 184365 - protein, 5 aa, Mycobacterium bovis
QRDPV

SEQ ID NO: 184366 - protein, 12 aa, Mycobacterium bovis
QREGLGPFPTDR

SEQ ID NO: 184367 - protein, 5 aa, Mycobacterium bovis
QRETA

SEQ ID NO: 184368 - protein, 5 aa, Mycobacterium bovis
QREYR

SEQ ID NO: 184369 - protein, 5 aa, Mycobacterium bovis
QRFTP

SEQ ID NO: 184370 - protein, 6 aa, Mycobacterium bovis
QRGDPI

SEQ ID NO: 184371 - protein, 8 aa, Mycobacterium bovis
QRGEDRQR

SEQ ID NO: 184372 - protein, 5 aa, Mycobacterium bovis
QRGHR

SEQ ID NO: 184373 - protein, 4 aa, Mycobacterium bovis
QRGK

SEQ ID NO: 184374 - protein, 9 aa, Mycobacterium bovis
QRGQQTPAP

SEQ ID NO: 184375 - protein, 10 aa, Mycobacterium bovis
QRGRSYARKG

SEQ ID NO: 184376 - protein, 9 aa, Mycobacterium bovis
QRGSGAGGV

SEQ ID NO: 184377 - protein, 9 aa, Mycobacterium bovis
QRGSINPED

SEQ ID NO: 184378 - protein, 4 aa, Mycobacterium bovis
QRGT

SEQ ID NO: 184379 - protein, 4 aa, Mycobacterium bovis
QRGV

SEQ ID NO: 184380 - protein, 5 aa, Mycobacterium bovis
QRHDG

SEQ ID NO: 184381 - protein, 16 aa, Mycobacterium bovis
QRHPELSRTENDAVRA

SEQ ID NO: 184382 - protein, 16 aa, Mycobacterium bovis
QRHPGGTTTQTDAAAG

SEQ ID NO: 184383 - protein, 9 aa, Mycobacterium bovis
QRHQDRGVG

SEQ ID NO: 184384 - protein, 9 aa, Mycobacterium bovis
QRIEKPDHT

SEQ ID NO: 184385 - protein, 6 aa, Mycobacterium bovis
QRKDGA

SEQ ID NO: 184386 - protein, 4 aa, Mycobacterium bovis
QRKR

SEQ ID NO: 184387 - protein, 13 aa, Mycobacterium bovis
QRKSDLRAAEDPI

SEQ ID NO: 184388 - protein, 7 aa, Mycobacterium bovis
QRLASQP

SEQ ID NO: 184389 - protein, 6 aa, Mycobacterium bovis
QRNGER

SEQ ID NO: 184390 - protein, 4 aa, Mycobacterium bovis
QRNP

SEQ ID NO: 184391 - protein, 5 aa, Mycobacterium bovis
QRPAA

SEQ ID NO: 184392 - protein, 17 aa, Mycobacterium bovis
QRPAGNETRWLMVALHI

SEQ ID NO: 184393 - protein, 6 aa, Mycobacterium bovis
QRPDPF

SEQ ID NO: 184394 - protein, 12 aa, Mycobacterium bovis
QRPDPPPPGPGQ

SEQ ID NO: 184395 - protein, 6 aa, Mycobacterium bovis
QRPGEA

SEQ ID NO: 184396 - protein, 6 aa, Mycobacterium bovis
QRPGVG

SEQ ID NO: 184397 - protein, 5 aa, Mycobacterium bovis
QRPND

SEQ ID NO: 184398 - protein, 18 aa, Mycobacterium bovis
QRPPDRRSIESSTGDQAV

SEQ ID NO: 184399 - protein, 10 aa, Mycobacterium bovis
QRPRARAVPR

SEQ ID NO: 184400 - protein, 6 aa, Mycobacterium bovis
QRPRQR

SEQ ID NO: 184401 - protein, 5 aa, Mycobacterium bovis
QRPRV

SEQ ID NO: 184402 - protein, 5 aa, Mycobacterium bovis
QRPSI

SEQ ID NO: 184403 - protein, 5 aa, Mycobacterium bovis
QRPVG

SEQ ID NO: 184404 - protein, 9 aa, Mycobacterium bovis
QRQCPSVRR

SEQ ID NO: 184405 - protein, 20 aa, Mycobacterium bovis
QRQTEPHAEAVSRNRRQQAT

SEQ ID NO: 184406 - protein, 6 aa, Mycobacterium bovis
QRRAGG

SEQ ID NO: 184407 - protein, 5 aa, Mycobacterium bovis
QRRGA

SEQ ID NO: 184408 - protein, 6 aa, Mycobacterium bovis
QRRNGV

SEQ ID NO: 184409 - protein, 6 aa, Mycobacterium bovis
QRRPAD

SEQ ID NO: 184410 - protein, 32 aa, Mycobacterium bovis
QRRQPDDAAGVGGRGAGDRAPQQHGPALEHGG

SEQ ID NO: 184411 - protein, 15 aa, Mycobacterium bovis
QRRRAKADAAARKHA

SEQ ID NO: 184412 - protein, 26 aa, Mycobacterium bovis
QRSADSLRESHGHADRNTQGRGSINE

SEQ ID NO: 184413 - protein, 15 aa, Mycobacterium bovis
QRSASVGSHVAIELH

SEQ ID NO: 184414 - protein, 4 aa, Mycobacterium bovis
QRSE

SEQ ID NO: 184415 - protein, 5 aa, Mycobacterium bovis
QRSGR

SEQ ID NO: 184416 - protein, 13 aa, Mycobacterium bovis
QRSGSVRSGDARR

SEQ ID NO: 184417 - protein, 7 aa, Mycobacterium bovis
QRSGTPA

SEQ ID NO: 184418 - protein, 4 aa, Mycobacterium bovis
QRSI

SEQ ID NO: 184419 - protein, 4 aa, Mycobacterium bovis
QRSP

SEQ ID NO: 184420 - protein, 5 aa, Mycobacterium bovis
QRSRG

SEQ ID NO: 184421 - protein, 9 aa, Mycobacterium bovis
QRSSRDVTT

SEQ ID NO: 184422 - protein, 11 aa, Mycobacterium bovis
QRTAGQSTRSA

SEQ ID NO: 184423 - protein, 4 aa, Mycobacterium bovis
QRTE

SEQ ID NO: 184424 - protein, 19 aa, Mycobacterium bovis
QRTESRGGHTRDDHPGMDP

SEQ ID NO: 184425 - protein, 6 aa, Mycobacterium bovis
QRTQFG

SEQ ID NO: 184426 - protein, 14 aa, Mycobacterium bovis
QRTREGEQDAAAAT

SEQ ID NO: 184427 - protein, 13 aa, Mycobacterium bovis
QRTRERRPDLSHP

SEQ ID NO: 184428 - protein, 6 aa, Mycobacterium bovis
QRTSAR

SEQ ID NO: 184429 - protein, 4 aa, Mycobacterium bovis
QRVG

SEQ ID NO: 184430 - protein, 6 aa, Mycobacterium bovis
QRVGEN

SEQ ID NO: 184431 - protein, 10 aa, Mycobacterium bovis
QRVGTDAATD

SEQ ID NO: 184432 - protein, 23 aa, Mycobacterium bovis
QRWEPPGQFGAARTDTGWPGRSV

SEQ ID NO: 184433 - protein, 5 aa, Mycobacterium bovis
QRWTT

SEQ ID NO: 184434 - protein, 8 aa, Mycobacterium bovis
QRYESSGE

SEQ ID NO: 184435 - protein, 6 aa, Mycobacterium bovis
QSADGM

SEQ ID NO: 184436 - protein, 9 aa, Mycobacterium bovis
QSADPRDAH

SEQ ID NO: 184437 - protein, 16 aa, Mycobacterium bovis
QSADSLARPTAEGAGP

SEQ ID NO: 184438 - protein, 5 aa, Mycobacterium bovis
QSAEA

SEQ ID NO: 184439 - protein, 10 aa, Mycobacterium bovis
QSAERAAERQ

SEQ ID NO: 184440 - protein, 6 aa, Mycobacterium bovis
QSALAA

SEQ ID NO: 184441 - protein, 8 aa, Mycobacterium bovis
QSAPPGAG

SEQ ID NO: 184442 - protein, 5 aa, Mycobacterium bovis
QSATI

SEQ ID NO: 184443 - protein, 6 aa, Mycobacterium bovis
QSAYDI

SEQ ID NO: 184444 - protein, 10 aa, Mycobacterium bovis
QSDEAAPARQ

SEQ ID NO: 184445 - protein, 43 aa, Mycobacterium bovis
QSDGPAALPPLPPSSPRRRPQTHSRARHADDSAPGQHNGPGPG

SEQ ID NO: 184446 - protein, 13 aa, Mycobacterium bovis
QSDQQRATGELRL

SEQ ID NO: 184447 - protein, 6 aa, Mycobacterium bovis
QSDSRT

SEQ ID NO: 184448 - protein, 11 aa, Mycobacterium bovis
QSEAERDGATG

SEQ ID NO: 184449 - protein, 9 aa, Mycobacterium bovis
QSEETEPLC

SEQ ID NO: 184450 - protein, 6 aa, Mycobacterium bovis
QSEPLG

SEQ ID NO: 184451 - protein, 8 aa, Mycobacterium bovis
QSEPQRKA

SEQ ID NO: 184452 - protein, 4 aa, Mycobacterium bovis
QSEV

SEQ ID NO: 184453 - protein, 11 aa, Mycobacterium bovis
QSFRRTAGAQF

SEQ ID NO: 184454 - protein, 12 aa, Mycobacterium bovis
QSGAAPGAGETR

SEQ ID NO: 184455 - protein, 15 aa, Mycobacterium bovis
QSGAGFAEGHPLPAG

SEQ ID NO: 184456 - protein, 7 aa, Mycobacterium bovis
QSGDGPP

SEQ ID NO: 184457 - protein, 6 aa, Mycobacterium bovis
QSGDTV

SEQ ID NO: 184458 - protein, 9 aa, Mycobacterium bovis
QSGETADTL

SEQ ID NO: 184459 - protein, 5 aa, Mycobacterium bovis
QSGGE

SEQ ID NO: 184460 - protein, 8 aa, Mycobacterium bovis
QSGLGPKD

SEQ ID NO: 184461 - protein, 6 aa, Mycobacterium bovis
QSGLRP

SEQ ID NO: 184462 - protein, 7 aa, Mycobacterium bovis
QSGPGHE

SEQ ID NO: 184463 - protein, 13 aa, Mycobacterium bovis
QSGQGEDAATSTL

SEQ ID NO: 184464 - protein, 31 aa, Mycobacterium bovis
QSGQPGQFGSPGADGRGGAGGAGGGGGAGGS

SEQ ID NO: 184465 - protein, 8 aa, Mycobacterium bovis
QSGRRGRV

SEQ ID NO: 184466 - protein, 5 aa, Mycobacterium bovis
QSGSD

SEQ ID NO: 184467 - protein, 10 aa, Mycobacterium bovis
QSGSDGSEVS

SEQ ID NO: 184468 - protein, 8 aa, Mycobacterium bovis
QSGSGKST

SEQ ID NO: 184469 - protein, 11 aa, Mycobacterium bovis
QSGSSGPPGAA

SEQ ID NO: 184470 - protein, 54 aa, Mycobacterium bovis
QSGSTGGGGAGGAGGAGGAGGAGGSGGAGGHGDTTSGKNGSSGTAGFDGNPGQP

SEQ ID NO: 184471 - protein, 13 aa, Mycobacterium bovis
QSGVGRELGPDAP

SEQ ID NO: 184472 - protein, 4 aa, Mycobacterium bovis
QSIQ

SEQ ID NO: 184473 - protein, 5 aa, Mycobacterium bovis
QSKNP

SEQ ID NO: 184474 - protein, 8 aa, Mycobacterium bovis
QSKPCIET

SEQ ID NO: 184475 - protein, 26 aa, Mycobacterium bovis
QSKPGAAGGARGVGGFRESRADCGEQ

SEQ ID NO: 184476 - protein, 5 aa, Mycobacterium bovis
QSKRR

SEQ ID NO: 184477 - protein, 6 aa, Mycobacterium bovis
QSLAPA

SEQ ID NO: 184478 - protein, 4 aa, Mycobacterium bovis
QSLE

SEQ ID NO: 184479 - protein, 8 aa, Mycobacterium bovis
QSLGDPES

SEQ ID NO: 184480 - protein, 12 aa, Mycobacterium bovis
QSLKRSKGQKLP

SEQ ID NO: 184481 - protein, 6 aa, Mycobacterium bovis
QSLPAR

SEQ ID NO: 184482 - protein, 9 aa, Mycobacterium bovis
QSLPGKAIE

SEQ ID NO: 184483 - protein, 8 aa, Mycobacterium bovis
QSLRERAR

SEQ ID NO: 184484 - protein, 5 aa, Mycobacterium bovis
QSMDN

SEQ ID NO: 184485 - protein, 6 aa, Mycobacterium bovis
QSNEAY

SEQ ID NO: 184486 - protein, 6 aa, Mycobacterium bovis
QSPAPK

SEQ ID NO: 184487 - protein, 8 aa, Mycobacterium bovis
QSPGLSSA

SEQ ID NO: 184488 - protein, 16 aa, Mycobacterium bovis
QSPIGRTPRSNPATYT

SEQ ID NO: 184489 - protein, 14 aa, Mycobacterium bovis
QSPVPGETLPGTAQ

SEQ ID NO: 184490 - protein, 6 aa, Mycobacterium bovis
QSRERQ

SEQ ID NO: 184491 - protein, 9 aa, Mycobacterium bovis
QSRGTGSLE

SEQ ID NO: 184492 - protein, 7 aa, Mycobacterium bovis
QSRNEID

SEQ ID NO: 184493 - protein, 6 aa, Mycobacterium bovis
QSRPSH

SEQ ID NO: 184494 - protein, 8 aa, Mycobacterium bovis
QSRRRGIG

SEQ ID NO: 184495 - protein, 16 aa, Mycobacterium bovis
QSRRRKRQPVGAQARR

SEQ ID NO: 184496 - protein, 7 aa, Mycobacterium bovis
QSRSELT

SEQ ID NO: 184497 - protein, 11 aa, Mycobacterium bovis
QSSAQSHDKDL

SEQ ID NO: 184498 - protein, 7 aa, Mycobacterium bovis
QSSARGK

SEQ ID NO: 184499 - protein, 5 aa, Mycobacterium bovis
QSSGM

SEQ ID NO: 184500 - protein, 9 aa, Mycobacterium bovis
QSSKDAAAA

SEQ ID NO: 184501 - protein, 6 aa, Mycobacterium bovis
QSSLPE

SEQ ID NO: 184502 - protein, 13 aa, Mycobacterium bovis
QSSPSASGGRALT

SEQ ID NO: 184503 - protein, 7 aa, Mycobacterium bovis
QSTAGPM

SEQ ID NO: 184504 - protein, 8 aa, Mycobacterium bovis
QSTRGDGR

SEQ ID NO: 184505 - protein, 5 aa, Mycobacterium bovis
QSTRQ

SEQ ID NO: 184506 - protein, 15 aa, Mycobacterium bovis
QSTSHFEDPPEMADD

SEQ ID NO: 184507 - protein, 19 aa, Mycobacterium bovis
QSVPPGVPTAPPAADPQRS

SEQ ID NO: 184508 - protein, 14 aa, Mycobacterium bovis
QSWKAPKPRDDAAA

SEQ ID NO: 184509 - protein, 5 aa, Mycobacterium bovis
QSWSD

SEQ ID NO: 184510 - protein, 4 aa, Mycobacterium bovis
QTAD

SEQ ID NO: 184511 - protein, 10 aa, Mycobacterium bovis
QTAEDAVRNG

SEQ ID NO: 184512 - protein, 11 aa, Mycobacterium bovis
QTAGRGRHGRG

SEQ ID NO: 184513 - protein, 11 aa, Mycobacterium bovis
QTAGTGERSRW

SEQ ID NO: 184514 - protein, 5 aa, Mycobacterium bovis
QTAPV

SEQ ID NO: 184515 - protein, 4 aa, Mycobacterium bovis
QTAR

SEQ ID NO: 184516 - protein, 11 aa, Mycobacterium bovis
QTARRRGSRAH

SEQ ID NO: 184517 - protein, 5 aa, Mycobacterium bovis
QTARS

SEQ ID NO: 184518 - protein, 5 aa, Mycobacterium bovis
QTASL

SEQ ID NO: 184519 - protein, 9 aa, Mycobacterium bovis
QTDAKTGKP

SEQ ID NO: 184520 - protein, 10 aa, Mycobacterium bovis
QTDETGATKR

SEQ ID NO: 184521 - protein, 5 aa, Mycobacterium bovis
QTDSE

SEQ ID NO: 184522 - protein, 16 aa, Mycobacterium bovis
QTEAGTTSPTTSKSRT

SEQ ID NO: 184523 - protein, 5 aa, Mycobacterium bovis
QTEAM

SEQ ID NO: 184524 - protein, 5 aa, Mycobacterium bovis
QTEGA

SEQ ID NO: 184525 - protein, 19 aa, Mycobacterium bovis
QTELSEQRRYSGRGNPGLN

SEQ ID NO: 184526 - protein, 7 aa, Mycobacterium bovis
QTEQEGI

SEQ ID NO: 184527 - protein, 7 aa, Mycobacterium bovis
QTEVPSR

SEQ ID NO: 184528 - protein, 13 aa, Mycobacterium bovis
QTFEGPYGNTGTN

SEQ ID NO: 184529 - protein, 8 aa, Mycobacterium bovis
QTGAPLPT

SEQ ID NO: 184530 - protein, 10 aa, Mycobacterium bovis
QTGEPQSGSE

SEQ ID NO: 184531 - protein, 7 aa, Mycobacterium bovis
QTGGCPH

SEQ ID NO: 184532 - protein, 16 aa, Mycobacterium bovis
QTGGKALADRRMSRLL

SEQ ID NO: 184533 - protein, 9 aa, Mycobacterium bovis
QTGGYSPPT

SEQ ID NO: 184534 - protein, 14 aa, Mycobacterium bovis
QTGIGGLNSGSGNI

SEQ ID NO: 184535 - protein, 5 aa, Mycobacterium bovis
QTGRT

SEQ ID NO: 184536 - protein, 10 aa, Mycobacterium bovis
QTGSKTLKDA

SEQ ID NO: 184537 - protein, 7 aa, Mycobacterium bovis
QTGSTNA

SEQ ID NO: 184538 - protein, 12 aa, Mycobacterium bovis
QTGTHPRTRTEA

SEQ ID NO: 184539 - protein, 5 aa, Mycobacterium bovis
QTGVE

SEQ ID NO: 184540 - protein, 10 aa, Mycobacterium bovis
QTIDETYGSL

SEQ ID NO: 184541 - protein, 5 aa, Mycobacterium bovis
QTKTG

SEQ ID NO: 184542 - protein, 6 aa, Mycobacterium bovis
QTLGGS

SEQ ID NO: 184543 - protein, 5 aa, Mycobacterium bovis
QTLGT

SEQ ID NO: 184544 - protein, 7 aa, Mycobacterium bovis
QTLPPGR

SEQ ID NO: 184545 - protein, 4 aa, Mycobacterium bovis
QTLS

SEQ ID NO: 184546 - protein, 5 aa, Mycobacterium bovis
QTMAG

SEQ ID NO: 184547 - protein, 7 aa, Mycobacterium bovis
QTNDPLG

SEQ ID NO: 184548 - protein, 9 aa, Mycobacterium bovis
QTNDPTAHA

SEQ ID NO: 184549 - protein, 30 aa, Mycobacterium bovis
QTNPGDMSPNVDGPLSPEAPPDREFDNTRR

SEQ ID NO: 184550 - protein, 6 aa, Mycobacterium bovis
QTNYGA

SEQ ID NO: 184551 - protein, 5 aa, Mycobacterium bovis
QTPAD

SEQ ID NO: 184552 - protein, 6 aa, Mycobacterium bovis
QTPDAG

SEQ ID NO: 184553 - protein, 22 aa, Mycobacterium bovis
QTPEKGRNASDRNARETGWFSP

SEQ ID NO: 184554 - protein, 5 aa, Mycobacterium bovis
QTPID

SEQ ID NO: 184555 - protein, 27 aa, Mycobacterium bovis
QTPITSSPTTPPPTTPPEIPTGGTVIS

SEQ ID NO: 184556 - protein, 5 aa, Mycobacterium bovis
QTPMR

SEQ ID NO: 184557 - protein, 6 aa, Mycobacterium bovis
QTPQGF

SEQ ID NO: 184558 - protein, 6 aa, Mycobacterium bovis
QTPVST

SEQ ID NO: 184559 - protein, 5 aa, Mycobacterium bovis
QTPYH

SEQ ID NO: 184560 - protein, 4 aa, Mycobacterium bovis
QTQD

SEQ ID NO: 184561 - protein, 10 aa, Mycobacterium bovis
QTQGQGHETT

SEQ ID NO: 184562 - protein, 5 aa, Mycobacterium bovis
QTQGV

SEQ ID NO: 184563 - protein, 4 aa, Mycobacterium bovis
QTQR

SEQ ID NO: 184564 - protein, 7 aa, Mycobacterium bovis
QTQSEVR

SEQ ID NO: 184565 - protein, 6 aa, Mycobacterium bovis
QTQTPD

SEQ ID NO: 184566 - protein, 4 aa, Mycobacterium bovis
QTRE

SEQ ID NO: 184567 - protein, 9 aa, Mycobacterium bovis
QTREPNAQI

SEQ ID NO: 184568 - protein, 6 aa, Mycobacterium bovis
QTRQRA

SEQ ID NO: 184569 - protein, 6 aa, Mycobacterium bovis
QTRTAK

SEQ ID NO: 184570 - protein, 7 aa, Mycobacterium bovis
QTSAPVT

SEQ ID NO: 184571 - protein, 7 aa, Mycobacterium bovis
QTSVQPP

SEQ ID NO: 184572 - protein, 6 aa, Mycobacterium bovis
QTTPLT

SEQ ID NO: 184573 - protein, 10 aa, Mycobacterium bovis
QTTSFDEDTT

SEQ ID NO: 184574 - protein, 7 aa, Mycobacterium bovis
QTTSTVT

SEQ ID NO: 184575 - protein, 9 aa, Mycobacterium bovis
QTVDDQPGG

SEQ ID NO: 184576 - protein, 20 aa, Mycobacterium bovis
QTVRPSAADRLSAPDSPEAQ

SEQ ID NO: 184577 - protein, 12 aa, Mycobacterium bovis
QTYAKRSTAQLK

SEQ ID NO: 184578 - protein, 6 aa, Mycobacterium bovis
QTYGAE

SEQ ID NO: 184579 - protein, 6 aa, Mycobacterium bovis
QVDADE

SEQ ID NO: 184580 - protein, 13 aa, Mycobacterium bovis
QVDPKTSTASGTV

SEQ ID NO: 184581 - protein, 7 aa, Mycobacterium bovis
QVDQPGT

SEQ ID NO: 184582 - protein, 6 aa, Mycobacterium bovis
QVDSES

SEQ ID NO: 184583 - protein, 11 aa, Mycobacterium bovis
QVEGAGSPTMT

SEQ ID NO: 184584 - protein, 12 aa, Mycobacterium bovis
QVGAGDGGGAHR

SEQ ID NO: 184585 - protein, 11 aa, Mycobacterium bovis
QVGKPAPSVSQ

SEQ ID NO: 184586 - protein, 5 aa, Mycobacterium bovis
QVGTQ

SEQ ID NO: 184587 - protein, 9 aa, Mycobacterium bovis
QVNDRADSA

SEQ ID NO: 184588 - protein, 4 aa, Mycobacterium bovis
QVNQ

SEQ ID NO: 184589 - protein, 9 aa, Mycobacterium bovis
QVPAGQTVP

SEQ ID NO: 184590 - protein, 4 aa, Mycobacterium bovis
QVPE

SEQ ID NO: 184591 - protein, 23 aa, Mycobacterium bovis
QVPGGTSAAIPSASSTPSLPNLG

SEQ ID NO: 184592 - protein, 10 aa, Mycobacterium bovis
QVPGSGGIRG

SEQ ID NO: 184593 - protein, 8 aa, Mycobacterium bovis
QVPGSKSA

SEQ ID NO: 184594 - protein, 15 aa, Mycobacterium bovis
QVPGTRRGGPWTSTT

SEQ ID NO: 184595 - protein, 6 aa, Mycobacterium bovis
QVPSSV

SEQ ID NO: 184596 - protein, 6 aa, Mycobacterium bovis
QVRGTG

SEQ ID NO: 184597 - protein, 7 aa, Mycobacterium bovis
QVRKAQR

SEQ ID NO: 184598 - protein, 6 aa, Mycobacterium bovis
QVRSQN

SEQ ID NO: 184599 - protein, 11 aa, Mycobacterium bovis
QVSPSAPDSLK

SEQ ID NO: 184600 - protein, 10 aa, Mycobacterium bovis
QVSTTNPRVT

SEQ ID NO: 184601 - protein, 9 aa, Mycobacterium bovis
QVTDGDSGL

SEQ ID NO: 184602 - protein, 5 aa, Mycobacterium bovis
QVTKD

SEQ ID NO: 184603 - protein, 4 aa, Mycobacterium bovis
QVTQ

SEQ ID NO: 184604 - protein, 8 aa, Mycobacterium bovis
QVTTQGEG

SEQ ID NO: 184605 - protein, 14 aa, Mycobacterium bovis
QVVGPREGDTPRTR

SEQ ID NO: 184606 - protein, 10 aa, Mycobacterium bovis
QYAKPRSADI

SEQ ID NO: 184607 - protein, 4 aa, Mycobacterium bovis
QYAP

SEQ ID NO: 184608 - protein, 11 aa, Mycobacterium bovis
QYAQRQRAAAE

SEQ ID NO: 184609 - protein, 6 aa, Mycobacterium bovis
QYGPGH

SEQ ID NO: 184610 - protein, 5 aa, Mycobacterium bovis
QYNPG

SEQ ID NO: 184611 - protein, 8 aa, Mycobacterium bovis
QYPDDPGK

SEQ ID NO: 184612 - protein, 6 aa, Mycobacterium bovis
QYPPDE

SEQ ID NO: 184613 - protein, 6 aa, Mycobacterium bovis
QYRPEP

SEQ ID NO: 184614 - protein, 9 aa, Mycobacterium bovis
QYSRTNNAE

SEQ ID NO: 184615 - protein, 19 aa, Mycobacterium bovis
QYTDGSGYSPNLPQGAPPF

SEQ ID NO: 184616 - protein, 6 aa, Mycobacterium bovis
QYYSPD

SEQ ID NO: 184617 - protein, 15 aa, Mycobacterium bovis
RAAAARGCAGTSGLG

SEQ ID NO: 184618 - protein, 18 aa, Mycobacterium bovis
RAAADGQTVRTAEEPKDV

SEQ ID NO: 184619 - protein, 12 aa, Mycobacterium bovis
RAAADLGSSEDL

SEQ ID NO: 184620 - protein, 9 aa, Mycobacterium bovis
RAAAEAEGY

SEQ ID NO: 184621 - protein, 9 aa, Mycobacterium bovis
RAAAEDEEQ

SEQ ID NO: 184622 - protein, 9 aa, Mycobacterium bovis
RAAAENGDA

SEQ ID NO: 184623 - protein, 7 aa, Mycobacterium bovis
RAAAESR

SEQ ID NO: 184624 - protein, 7 aa, Mycobacterium bovis
RAAAPKK

SEQ ID NO: 184625 - protein, 9 aa, Mycobacterium bovis
RAAAPSKRA

SEQ ID NO: 184626 - protein, 14 aa, Mycobacterium bovis
RAAATNAAAGAQRI

SEQ ID NO: 184627 - protein, 6 aa, Mycobacterium bovis
RAAATR

SEQ ID NO: 184628 - protein, 6 aa, Mycobacterium bovis
RAADAD

SEQ ID NO: 184629 - protein, 6 aa, Mycobacterium bovis
RAADDD

SEQ ID NO: 184630 - protein, 4 aa, Mycobacterium bovis
RAAE

SEQ ID NO: 184631 - protein, 9 aa, Mycobacterium bovis
RAAENRTKR

SEQ ID NO: 184632 - protein, 8 aa, Mycobacterium bovis
RAAEQRGV

SEQ ID NO: 184633 - protein, 12 aa, Mycobacterium bovis
RAAETESDNPLI

SEQ ID NO: 184634 - protein, 4 aa, Mycobacterium bovis
RAAG

SEQ ID NO: 184635 - protein, 5 aa, Mycobacterium bovis
RAAGE

SEQ ID NO: 184636 - protein, 9 aa, Mycobacterium bovis
RAAGNRAAR

SEQ ID NO: 184637 - protein, 7 aa, Mycobacterium bovis
RAAGRGA

SEQ ID NO: 184638 - protein, 10 aa, Mycobacterium bovis
RAAGRTRHDA

SEQ ID NO: 184639 - protein, 11 aa, Mycobacterium bovis
RAAGRVDGVRP

SEQ ID NO: 184640 - protein, 5 aa, Mycobacterium bovis
RAAGT

SEQ ID NO: 184641 - protein, 7 aa, Mycobacterium bovis
RAAKPGA

SEQ ID NO: 184642 - protein, 8 aa, Mycobacterium bovis
RAAPADIA

SEQ ID NO: 184643 - protein, 7 aa, Mycobacterium bovis
RAAPNSE

SEQ ID NO: 184644 - protein, 6 aa, Mycobacterium bovis
RAAQAD

SEQ ID NO: 184645 - protein, 6 aa, Mycobacterium bovis
RAAQAG

SEQ ID NO: 184646 - protein, 9 aa, Mycobacterium bovis
RAAQNGAKR

SEQ ID NO: 184647 - protein, 10 aa, Mycobacterium bovis
RAAQNRAKRA

SEQ ID NO: 184648 - protein, 20 aa, Mycobacterium bovis
RAAQNRAKRALAAAAEESEA

SEQ ID NO: 184649 - protein, 8 aa, Mycobacterium bovis
RAAQQSWP

SEQ ID NO: 184650 - protein, 4 aa, Mycobacterium bovis
RAAR

SEQ ID NO: 184651 - protein, 7 aa, Mycobacterium bovis
RAARDNS

SEQ ID NO: 184652 - protein, 8 aa, Mycobacterium bovis
RAASDDGF

SEQ ID NO: 184653 - protein, 15 aa, Mycobacterium bovis
RAASDVPAKYKSQPW

SEQ ID NO: 184654 - protein, 14 aa, Mycobacterium bovis
RAASRSLGNIIDGS

SEQ ID NO: 184655 - protein, 6 aa, Mycobacterium bovis
RAATAA

SEQ ID NO: 184656 - protein, 7 aa, Mycobacterium bovis
RAATAHP

SEQ ID NO: 184657 - protein, 4 aa, Mycobacterium bovis
RAAV

SEQ ID NO: 184658 - protein, 8 aa, Mycobacterium bovis
RADAPDKV

SEQ ID NO: 184659 - protein, 7 aa, Mycobacterium bovis
RADAQRC

SEQ ID NO: 184660 - protein, 11 aa, Mycobacterium bovis
RADASVAREDS

SEQ ID NO: 184661 - protein, 5 aa, Mycobacterium bovis
RADDE

SEQ ID NO: 184662 - protein, 6 aa, Mycobacterium bovis
RADDTA

SEQ ID NO: 184663 - protein, 8 aa, Mycobacterium bovis
RADEIGAG

SEQ ID NO: 184664 - protein, 8 aa, Mycobacterium bovis
RADETVRR

SEQ ID NO: 184665 - protein, 7 aa, Mycobacterium bovis
RADGGEA

SEQ ID NO: 184666 - protein, 12 aa, Mycobacterium bovis
RADGTESAKPSL

SEQ ID NO: 184667 - protein, 7 aa, Mycobacterium bovis
RADGTVQ

SEQ ID NO: 184668 - protein, 9 aa, Mycobacterium bovis
RADHAAQAA

SEQ ID NO: 184669 - protein, 11 aa, Mycobacterium bovis
RADKSGTGSEI

SEQ ID NO: 184670 - protein, 4 aa, Mycobacterium bovis
RADP

SEQ ID NO: 184671 - protein, 8 aa, Mycobacterium bovis
RADRQPEF

SEQ ID NO: 184672 - protein, 4 aa, Mycobacterium bovis
RADT

SEQ ID NO: 184673 - protein, 39 aa, Mycobacterium bovis
RADTGRNRRGGESARTDTNRGDGGHEPASSDLASLPPGH

SEQ ID NO: 184674 - protein, 7 aa, Mycobacterium bovis
RADTSRA

SEQ ID NO: 184675 - protein, 6 aa, Mycobacterium bovis
RADTTV

SEQ ID NO: 184676 - protein, 6 aa, Mycobacterium bovis
RADYPG

SEQ ID NO: 184677 - protein, 14 aa, Mycobacterium bovis
RAEAEAAQQRLDAG

SEQ ID NO: 184678 - protein, 10 aa, Mycobacterium bovis
RAEAGAGAAV

SEQ ID NO: 184679 - protein, 5 aa, Mycobacterium bovis
RAEEP

SEQ ID NO: 184680 - protein, 11 aa, Mycobacterium bovis
RAEGAHNGKGR

SEQ ID NO: 184681 - protein, 7 aa, Mycobacterium bovis
RAEGAKR

SEQ ID NO: 184682 - protein, 7 aa, Mycobacterium bovis
RAEGDPD

SEQ ID NO: 184683 - protein, 5 aa, Mycobacterium bovis
RAEGE

SEQ ID NO: 184684 - protein, 5 aa, Mycobacterium bovis
RAEGI

SEQ ID NO: 184685 - protein, 9 aa, Mycobacterium bovis
RAEGKRGGE

SEQ ID NO: 184686 - protein, 7 aa, Mycobacterium bovis
RAEGLTG

SEQ ID NO: 184687 - protein, 5 aa, Mycobacterium bovis
RAEPD

SEQ ID NO: 184688 - protein, 15 aa, Mycobacterium bovis
RAEQAGAQAEAAAAA

SEQ ID NO: 184689 - protein, 13 aa, Mycobacterium bovis
RAEQTQKNTLGRA

SEQ ID NO: 184690 - protein, 7 aa, Mycobacterium bovis
RAEREQG

SEQ ID NO: 184691 - protein, 7 aa, Mycobacterium bovis
RAERTGE

SEQ ID NO: 184692 - protein, 8 aa, Mycobacterium bovis
RAESGGML

SEQ ID NO: 184693 - protein, 9 aa, Mycobacterium bovis
RAETPQQQQ

SEQ ID NO: 184694 - protein, 10 aa, Mycobacterium bovis
RAFDPSAGKP

SEQ ID NO: 184695 - protein, 6 aa, Mycobacterium bovis
RAFGAG

SEQ ID NO: 184696 - protein, 9 aa, Mycobacterium bovis
RAFKAKKPV

SEQ ID NO: 184697 - protein, 6 aa, Mycobacterium bovis
RAFSGG

SEQ ID NO: 184698 - protein, 5 aa, Mycobacterium bovis
RAGAA

SEQ ID NO: 184699 - protein, 19 aa, Mycobacterium bovis
RAGADAPDSGRVKESAPWS

SEQ ID NO: 184700 - protein, 10 aa, Mycobacterium bovis
RAGAPERAEN

SEQ ID NO: 184701 - protein, 4 aa, Mycobacterium bovis
RAGD

SEQ ID NO: 184702 - protein, 6 aa, Mycobacterium bovis
RAGDGD

SEQ ID NO: 184703 - protein, 19 aa, Mycobacterium bovis
RAGDGDGAVRAKSSPTDPV

SEQ ID NO: 184704 - protein, 28 aa, Mycobacterium bovis
RAGDGGAGGGGGLGGAPGDGGAGGNGGS

SEQ ID NO: 184705 - protein, 8 aa, Mycobacterium bovis
RAGDVQAG

SEQ ID NO: 184706 - protein, 8 aa, Mycobacterium bovis
RAGEAGVG

SEQ ID NO: 184707 - protein, 7 aa, Mycobacterium bovis
RAGEGVS

SEQ ID NO: 184708 - protein, 8 aa, Mycobacterium bovis
RAGEHTES

SEQ ID NO: 184709 - protein, 8 aa, Mycobacterium bovis
RAGEPSEV

SEQ ID NO: 184710 - protein, 9 aa, Mycobacterium bovis
RAGERGALE

SEQ ID NO: 184711 - protein, 17 aa, Mycobacterium bovis
RAGFRTPAPAAGQDEPR

SEQ ID NO: 184712 - protein, 8 aa, Mycobacterium bovis
RAGGKAQI

SEQ ID NO: 184713 - protein, 7 aa, Mycobacterium bovis
RAGGKGH

SEQ ID NO: 184714 - protein, 9 aa, Mycobacterium bovis
RAGGLGAPR

SEQ ID NO: 184715 - protein, 11 aa, Mycobacterium bovis
RAGGNSDATAE

SEQ ID NO: 184716 - protein, 8 aa, Mycobacterium bovis
RAGGTEKI

SEQ ID NO: 184717 - protein, 10 aa, Mycobacterium bovis
RAGGVSAPPF

SEQ ID NO: 184718 - protein, 8 aa, Mycobacterium bovis
RAGHADGN

SEQ ID NO: 184719 - protein, 10 aa, Mycobacterium bovis
RAGHARGKAY

SEQ ID NO: 184720 - protein, 7 aa, Mycobacterium bovis
RAGIDPR

SEQ ID NO: 184721 - protein, 4 aa, Mycobacterium bovis
RAGL

SEQ ID NO: 184722 - protein, 5 aa, Mycobacterium bovis
RAGLT

SEQ ID NO: 184723 - protein, 8 aa, Mycobacterium bovis
RAGNQQAK

SEQ ID NO: 184724 - protein, 7 aa, Mycobacterium bovis
RAGPQTV

SEQ ID NO: 184725 - protein, 6 aa, Mycobacterium bovis
RAGQRH

SEQ ID NO: 184726 - protein, 9 aa, Mycobacterium bovis
RAGRDEPAV

SEQ ID NO: 184727 - protein, 9 aa, Mycobacterium bovis
RAGRDPATA

SEQ ID NO: 184728 - protein, 6 aa, Mycobacterium bovis
RAGREL

SEQ ID NO: 184729 - protein, 6 aa, Mycobacterium bovis
RAGRET

SEQ ID NO: 184730 - protein, 6 aa, Mycobacterium bovis
RAGRKR

SEQ ID NO: 184731 - protein, 9 aa, Mycobacterium bovis
RAGRSRNDQ

SEQ ID NO: 184732 - protein, 18 aa, Mycobacterium bovis
RAGRTPRTVTADRGYGEA

SEQ ID NO: 184733 - protein, 10 aa, Mycobacterium bovis
RAGSGGNGCA

SEQ ID NO: 184734 - protein, 8 aa, Mycobacterium bovis
RAGSGQPL

SEQ ID NO: 184735 - protein, 8 aa, Mycobacterium bovis
RAGSSPLG

SEQ ID NO: 184736 - protein, 5 aa, Mycobacterium bovis
RAGTG

SEQ ID NO: 184737 - protein, 15 aa, Mycobacterium bovis
RAGTRSAPRRRCQRY

SEQ ID NO: 184738 - protein, 14 aa, Mycobacterium bovis
RAGTVKPSRDPRAR

SEQ ID NO: 184739 - protein, 7 aa, Mycobacterium bovis
RAGVGAG

SEQ ID NO: 184740 - protein, 12 aa, Mycobacterium bovis
RAGVKGTSGMRK

SEQ ID NO: 184741 - protein, 5 aa, Mycobacterium bovis
RAGYS

SEQ ID NO: 184742 - protein, 4 aa, Mycobacterium bovis
RAHD

SEQ ID NO: 184743 - protein, 7 aa, Mycobacterium bovis
RAHGTDA

SEQ ID NO: 184744 - protein, 6 aa, Mycobacterium bovis
RAHRPV

SEQ ID NO: 184745 - protein, 7 aa, Mycobacterium bovis
RAHTDRA

SEQ ID NO: 184746 - protein, 8 aa, Mycobacterium bovis
RAIAGPGT

SEQ ID NO: 184747 - protein, 7 aa, Mycobacterium bovis
RAKADAQ

SEQ ID NO: 184748 - protein, 10 aa, Mycobacterium bovis
RAKAGGQRQF

SEQ ID NO: 184749 - protein, 10 aa, Mycobacterium bovis
RAKATAARNI

SEQ ID NO: 184750 - protein, 8 aa, Mycobacterium bovis
RAKGEAAV

SEQ ID NO: 184751 - protein, 4 aa, Mycobacterium bovis
RAKP

SEQ ID NO: 184752 - protein, 15 aa, Mycobacterium bovis
RAKPPLEDAKDQYRA

SEQ ID NO: 184753 - protein, 7 aa, Mycobacterium bovis
RAKSQDT

SEQ ID NO: 184754 - protein, 7 aa, Mycobacterium bovis
RAKYDSA

SEQ ID NO: 184755 - protein, 28 aa, Mycobacterium bovis
RALEGRDGGYRETTSPPTGRGRNVRGSH

SEQ ID NO: 184756 - protein, 12 aa, Mycobacterium bovis
RALPGAESFPEE

SEQ ID NO: 184757 - protein, 13 aa, Mycobacterium bovis
RAMPAATGIPRGG

SEQ ID NO: 184758 - protein, 10 aa, Mycobacterium bovis
RANARTKGRF

SEQ ID NO: 184759 - protein, 11 aa, Mycobacterium bovis
RANDESMPDEA

SEQ ID NO: 184760 - protein, 5 aa, Mycobacterium bovis
RANDF

SEQ ID NO: 184761 - protein, 8 aa, Mycobacterium bovis
RANDTDDA

SEQ ID NO: 184762 - protein, 11 aa, Mycobacterium bovis
RANKDNTDPKR

SEQ ID NO: 184763 - protein, 5 aa, Mycobacterium bovis
RANNR

SEQ ID NO: 184764 - protein, 14 aa, Mycobacterium bovis
RANPDPRAQSKLTG

SEQ ID NO: 184765 - protein, 6 aa, Mycobacterium bovis
RANSYP

SEQ ID NO: 184766 - protein, 11 aa, Mycobacterium bovis
RANTDGRAARR

SEQ ID NO: 184767 - protein, 10 aa, Mycobacterium bovis
RANTEPDAHP

SEQ ID NO: 184768 - protein, 4 aa, Mycobacterium bovis
RANY

SEQ ID NO: 184769 - protein, 4 aa, Mycobacterium bovis
RAPA

SEQ ID NO: 184770 - protein, 8 aa, Mycobacterium bovis
RAPAGPPV

SEQ ID NO: 184771 - protein, 9 aa, Mycobacterium bovis
RAPAGTLPG

SEQ ID NO: 184772 - protein, 8 aa, Mycobacterium bovis
RAPANRPD

SEQ ID NO: 184773 - protein, 7 aa, Mycobacterium bovis
RAPDADA

SEQ ID NO: 184774 - protein, 9 aa, Mycobacterium bovis
RAPDGSPDT

SEQ ID NO: 184775 - protein, 9 aa, Mycobacterium bovis
RAPKPAQGL

SEQ ID NO: 184776 - protein, 9 aa, Mycobacterium bovis
RAPKPGSPV

SEQ ID NO: 184777 - protein, 9 aa, Mycobacterium bovis
RAPNGVRTK

SEQ ID NO: 184778 - protein, 7 aa, Mycobacterium bovis
RAPSRDT

SEQ ID NO: 184779 - protein, 5 aa, Mycobacterium bovis
RAPSV

SEQ ID NO: 184780 - protein, 5 aa, Mycobacterium bovis
RAPTA

SEQ ID NO: 184781 - protein, 6 aa, Mycobacterium bovis
RAPTPP

SEQ ID NO: 184782 - protein, 5 aa, Mycobacterium bovis
RAPVS

SEQ ID NO: 184783 - protein, 4 aa, Mycobacterium bovis
RAQA

SEQ ID NO: 184784 - protein, 9 aa, Mycobacterium bovis
RAQAPAQAA

SEQ ID NO: 184785 - protein, 14 aa, Mycobacterium bovis
RAQARQSVKAATDE

SEQ ID NO: 184786 - protein, 15 aa, Mycobacterium bovis
RAQASDAGPDDDTAR

SEQ ID NO: 184787 - protein, 7 aa, Mycobacterium bovis
RAQATED

SEQ ID NO: 184788 - protein, 13 aa, Mycobacterium bovis
RAQDIGADGPDIL

SEQ ID NO: 184789 - protein, 8 aa, Mycobacterium bovis
RAQGDPPY

SEQ ID NO: 184790 - protein, 5 aa, Mycobacterium bovis
RAQNP

SEQ ID NO: 184791 - protein, 9 aa, Mycobacterium bovis
RAQPARDDK

SEQ ID NO: 184792 - protein, 10 aa, Mycobacterium bovis
RAQPRRDLGR

SEQ ID NO: 184793 - protein, 7 aa, Mycobacterium bovis
RAQQARA

SEQ ID NO: 184794 - protein, 8 aa, Mycobacterium bovis
RAQQTRAE

SEQ ID NO: 184795 - protein, 6 aa, Mycobacterium bovis
RAQREL

SEQ ID NO: 184796 - protein, 5 aa, Mycobacterium bovis
RAQRR

SEQ ID NO: 184797 - protein, 6 aa, Mycobacterium bovis
RAQRRS

SEQ ID NO: 184798 - protein, 7 aa, Mycobacterium bovis
RAQSAQR

SEQ ID NO: 184799 - protein, 29 aa, Mycobacterium bovis
RAQSDGGRIGSRSRSRQKSSKPRGNQAAA

SEQ ID NO: 184800 - protein, 9 aa, Mycobacterium bovis
RAQTGRNGA

SEQ ID NO: 184801 - protein, 7 aa, Mycobacterium bovis
RAQTGVT

SEQ ID NO: 184802 - protein, 6 aa, Mycobacterium bovis
RAQYER

SEQ ID NO: 184803 - protein, 10 aa, Mycobacterium bovis
RARAARAAQP

SEQ ID NO: 184804 - protein, 8 aa, Mycobacterium bovis
RARAEAGA

SEQ ID NO: 184805 - protein, 6 aa, Mycobacterium bovis
RARDAG

SEQ ID NO: 184806 - protein, 10 aa, Mycobacterium bovis
RARDGNESAG

SEQ ID NO: 184807 - protein, 10 aa, Mycobacterium bovis
RARDNARKAG

SEQ ID NO: 184808 - protein, 13 aa, Mycobacterium bovis
RARDRAEANRGAR

SEQ ID NO: 184809 - protein, 4 aa, Mycobacterium bovis
RARE

SEQ ID NO: 184810 - protein, 5 aa, Mycobacterium bovis
RAREL

SEQ ID NO: 184811 - protein, 7 aa, Mycobacterium bovis
RARENRS

SEQ ID NO: 184812 - protein, 15 aa, Mycobacterium bovis
RARGAEVSSALNPAQ

SEQ ID NO: 184813 - protein, 19 aa, Mycobacterium bovis
RARGYDVDKPRNLAKSVTV

SEQ ID NO: 184814 - protein, 7 aa, Mycobacterium bovis
RARHPDS

SEQ ID NO: 184815 - protein, 11 aa, Mycobacterium bovis
RARIERRTRES

SEQ ID NO: 184816 - protein, 16 aa, Mycobacterium bovis
RARKHGDLESGPLKSV

SEQ ID NO: 184817 - protein, 4 aa, Mycobacterium bovis
RARL

SEQ ID NO: 184818 - protein, 10 aa, Mycobacterium bovis
RARPGQTSRK

SEQ ID NO: 184819 - protein, 6 aa, Mycobacterium bovis
RARPPR

SEQ ID NO: 184820 - protein, 5 aa, Mycobacterium bovis
RARQI

SEQ ID NO: 184821 - protein, 5 aa, Mycobacterium bovis
RARRD

SEQ ID NO: 184822 - protein, 11 aa, Mycobacterium bovis
RARREKRTAGE

SEQ ID NO: 184823 - protein, 7 aa, Mycobacterium bovis
RARREPT

SEQ ID NO: 184824 - protein, 5 aa, Mycobacterium bovis
RARRR

SEQ ID NO: 184825 - protein, 16 aa, Mycobacterium bovis
RARRRERDEARRANED

SEQ ID NO: 184826 - protein, 8 aa, Mycobacterium bovis
RARRRGTK

SEQ ID NO: 184827 - protein, 13 aa, Mycobacterium bovis
RARSRCTKGSRRY

SEQ ID NO: 184828 - protein, 6 aa, Mycobacterium bovis
RARSVG

SEQ ID NO: 184829 - protein, 9 aa, Mycobacterium bovis
RASAAAREL

SEQ ID NO: 184830 - protein, 10 aa, Mycobacterium bovis
RASAAERDVT

SEQ ID NO: 184831 - protein, 8 aa, Mycobacterium bovis
RASADRGT

SEQ ID NO: 184832 - protein, 8 aa, Mycobacterium bovis
RASAGVTG

SEQ ID NO: 184833 - protein, 4 aa, Mycobacterium bovis
RASD

SEQ ID NO: 184834 - protein, 14 aa, Mycobacterium bovis
RASDYMRSASAADR

SEQ ID NO: 184835 - protein, 7 aa, Mycobacterium bovis
RASGDPL

SEQ ID NO: 184836 - protein, 8 aa, Mycobacterium bovis
RASGQKDL

SEQ ID NO: 184837 - protein, 12 aa, Mycobacterium bovis
RASKAPRSNPEA

SEQ ID NO: 184838 - protein, 7 aa, Mycobacterium bovis
RASKPGA

SEQ ID NO: 184839 - protein, 4 aa, Mycobacterium bovis
RASL

SEQ ID NO: 184840 - protein, 15 aa, Mycobacterium bovis
RASPKLRRARNPIQA

SEQ ID NO: 184841 - protein, 8 aa, Mycobacterium bovis
RASPSAGA

SEQ ID NO: 184842 - protein, 8 aa, Mycobacterium bovis
RASQTDTE

SEQ ID NO: 184843 - protein, 6 aa, Mycobacterium bovis
RASRGG

SEQ ID NO: 184844 - protein, 9 aa, Mycobacterium bovis
RASRSMQRN

SEQ ID NO: 184845 - protein, 16 aa, Mycobacterium bovis
RASSPSQAITGTGCRP

SEQ ID NO: 184846 - protein, 10 aa, Mycobacterium bovis
RASTPNADPR

SEQ ID NO: 184847 - protein, 9 aa, Mycobacterium bovis
RASTRAQNR

SEQ ID NO: 184848 - protein, 9 aa, Mycobacterium bovis
RASTRTQNR

SEQ ID NO: 184849 - protein, 8 aa, Mycobacterium bovis
RASYERRA

SEQ ID NO: 184850 - protein, 13 aa, Mycobacterium bovis
RATADQIGTQTTQ

SEQ ID NO: 184851 - protein, 5 aa, Mycobacterium bovis
RATAE

SEQ ID NO: 184852 - protein, 23 aa, Mycobacterium bovis
RATALRRAGRSAGPRQLGGRDGE

SEQ ID NO: 184853 - protein, 13 aa, Mycobacterium bovis
RATDDTVRPTEAE

SEQ ID NO: 184854 - protein, 38 aa, Mycobacterium bovis
RATDEQRRIRERANAERKAAALRAQAAKLGAKATKAVA

SEQ ID NO: 184855 - protein, 8 aa, Mycobacterium bovis
RATDGETV

SEQ ID NO: 184856 - protein, 6 aa, Mycobacterium bovis
RATDQS

SEQ ID NO: 184857 - protein, 9 aa, Mycobacterium bovis
RATDTVAGI

SEQ ID NO: 184858 - protein, 10 aa, Mycobacterium bovis
RATEERPSWG

SEQ ID NO: 184859 - protein, 25 aa, Mycobacterium bovis
RATEGAKAKSKGKARRGSQFKVLEH

SEQ ID NO: 184860 - protein, 8 aa, Mycobacterium bovis
RATEGTDI

SEQ ID NO: 184861 - protein, 7 aa, Mycobacterium bovis
RATGPES

SEQ ID NO: 184862 - protein, 6 aa, Mycobacterium bovis
RATGTL

SEQ ID NO: 184863 - protein, 4 aa, Mycobacterium bovis
RATK

SEQ ID NO: 184864 - protein, 23 aa, Mycobacterium bovis
RATPRADLEGSDVPVPAAAFETQ

SEQ ID NO: 184865 - protein, 7 aa, Mycobacterium bovis
RATQADH

SEQ ID NO: 184866 - protein, 5 aa, Mycobacterium bovis
RATRD

SEQ ID NO: 184867 - protein, 9 aa, Mycobacterium bovis
RATRGPASH

SEQ ID NO: 184868 - protein, 9 aa, Mycobacterium bovis
RATRGTDRK

SEQ ID NO: 184869 - protein, 7 aa, Mycobacterium bovis
RATRPGA

SEQ ID NO: 184870 - protein, 6 aa, Mycobacterium bovis
RATSAR

SEQ ID NO: 184871 - protein, 14 aa, Mycobacterium bovis
RATSGDNHLGGDDW

SEQ ID NO: 184872 - protein, 5 aa, Mycobacterium bovis
RATTA

SEQ ID NO: 184873 - protein, 9 aa, Mycobacterium bovis
RATTLNDDE

SEQ ID NO: 184874 - protein, 6 aa, Mycobacterium bovis
RATVGG

SEQ ID NO: 184875 - protein, 12 aa, Mycobacterium bovis
RAVAGETVLAEC

SEQ ID NO: 184876 - protein, 5 aa, Mycobacterium bovis
RAVGA

SEQ ID NO: 184877 - protein, 8 aa, Mycobacterium bovis
RAVGEEAL

SEQ ID NO: 184878 - protein, 14 aa, Mycobacterium bovis
RAVGGGGSTVGPAA

SEQ ID NO: 184879 - protein, 5 aa, Mycobacterium bovis
RAVGP

SEQ ID NO: 184880 - protein, 8 aa, Mycobacterium bovis
RAVPDQDQ

SEQ ID NO: 184881 - protein, 12 aa, Mycobacterium bovis
RAVRDGEQLPRS

SEQ ID NO: 184882 - protein, 6 aa, Mycobacterium bovis
RAVRES

SEQ ID NO: 184883 - protein, 10 aa, Mycobacterium bovis
RAVRRASGRR

SEQ ID NO: 184884 - protein, 14 aa, Mycobacterium bovis
RAVSDGDAVRVGGT

SEQ ID NO: 184885 - protein, 21 aa, Mycobacterium bovis
RAVSGNKVPGYYPLGKTPVPL

SEQ ID NO: 184886 - protein, 8 aa, Mycobacterium bovis
RAYPYEGN

SEQ ID NO: 184887 - protein, 10 aa, Mycobacterium bovis
RCEACTGDGT

SEQ ID NO: 184888 - protein, 7 aa, Mycobacterium bovis
RCGEAGR

SEQ ID NO: 184889 - protein, 7 aa, Mycobacterium bovis
RCGSTGD

SEQ ID NO: 184890 - protein, 12 aa, Mycobacterium bovis
RCPDAGAPRPAV

SEQ ID NO: 184891 - protein, 5 aa, Mycobacterium bovis
RCRRR

SEQ ID NO: 184892 - protein, 13 aa, Mycobacterium bovis
RCSRTDSKASYTQ

SEQ ID NO: 184893 - protein, 6 aa, Mycobacterium bovis
RDAAEA

SEQ ID NO: 184894 - protein, 8 aa, Mycobacterium bovis
RDAAGPLN

SEQ ID NO: 184895 - protein, 8 aa, Mycobacterium bovis
RDAAKCKN

SEQ ID NO: 184896 - protein, 14 aa, Mycobacterium bovis
RDAAKTLGMAVIAP

SEQ ID NO: 184897 - protein, 15 aa, Mycobacterium bovis
RDAASDTWQPPTPRR

SEQ ID NO: 184898 - protein, 8 aa, Mycobacterium bovis
RDAASREV

SEQ ID NO: 184899 - protein, 16 aa, Mycobacterium bovis
RDAATAALDAYQAAAP

SEQ ID NO: 184900 - protein, 4 aa, Mycobacterium bovis
RDAD

SEQ ID NO: 184901 - protein, 10 aa, Mycobacterium bovis
RDADAGELES

SEQ ID NO: 184902 - protein, 5 aa, Mycobacterium bovis
RDADL

SEQ ID NO: 184903 - protein, 7 aa, Mycobacterium bovis
RDAEDAA

SEQ ID NO: 184904 - protein, 8 aa, Mycobacterium bovis
RDAGREVK

SEQ ID NO: 184905 - protein, 6 aa, Mycobacterium bovis
RDAGYD

SEQ ID NO: 184906 - protein, 4 aa, Mycobacterium bovis
RDAH

SEQ ID NO: 184907 - protein, 11 aa, Mycobacterium bovis
RDALSGEGARR

SEQ ID NO: 184908 - protein, 9 aa, Mycobacterium bovis
RDANATANR

SEQ ID NO: 184909 - protein, 6 aa, Mycobacterium bovis
RDAPQR

SEQ ID NO: 184910 - protein, 14 aa, Mycobacterium bovis
RDAPTGRFASLVWM

SEQ ID NO: 184911 - protein, 6 aa, Mycobacterium bovis
RDAQPA

SEQ ID NO: 184912 - protein, 9 aa, Mycobacterium bovis
RDARGQGHS

SEQ ID NO: 184913 - protein, 9 aa, Mycobacterium bovis
RDARPGEVQ

SEQ ID NO: 184914 - protein, 8 aa, Mycobacterium bovis
RDATDDQV

SEQ ID NO: 184915 - protein, 10 aa, Mycobacterium bovis
RDATDEERAE

SEQ ID NO: 184916 - protein, 8 aa, Mycobacterium bovis
RDATGESV

SEQ ID NO: 184917 - protein, 7 aa, Mycobacterium bovis
RDCPEHD

SEQ ID NO: 184918 - protein, 5 aa, Mycobacterium bovis
RDDAA

SEQ ID NO: 184919 - protein, 6 aa, Mycobacterium bovis
RDDAAD

SEQ ID NO: 184920 - protein, 4 aa, Mycobacterium bovis
RDDE

SEQ ID NO: 184921 - protein, 14 aa, Mycobacterium bovis
RDDEFGGSLQNRAK

SEQ ID NO: 184922 - protein, 4 aa, Mycobacterium bovis
RDDF

SEQ ID NO: 184923 - protein, 8 aa, Mycobacterium bovis
RDDLPDGG

SEQ ID NO: 184924 - protein, 8 aa, Mycobacterium bovis
RDDNPHRD

SEQ ID NO: 184925 - protein, 6 aa, Mycobacterium bovis
RDDPAA

SEQ ID NO: 184926 - protein, 8 aa, Mycobacterium bovis
RDDPDEAR

SEQ ID NO: 184927 - protein, 6 aa, Mycobacterium bovis
RDDPLG

SEQ ID NO: 184928 - protein, 13 aa, Mycobacterium bovis
RDDPSQPVASDPY

SEQ ID NO: 184929 - protein, 9 aa, Mycobacterium bovis
RDDPSSVDP

SEQ ID NO: 184930 - protein, 4 aa, Mycobacterium bovis
RDDR

SEQ ID NO: 184931 - protein, 16 aa, Mycobacterium bovis
RDDRGLGTLVCCVIGA

SEQ ID NO: 184932 - protein, 6 aa, Mycobacterium bovis
RDDRIT

SEQ ID NO: 184933 - protein, 6 aa, Mycobacterium bovis
RDDVPE

SEQ ID NO: 184934 - protein, 14 aa, Mycobacterium bovis
RDDYNGRDIHLPVF

SEQ ID NO: 184935 - protein, 7 aa, Mycobacterium bovis
RDEADER

SEQ ID NO: 184936 - protein, 7 aa, Mycobacterium bovis
RDEAPSV

SEQ ID NO: 184937 - protein, 6 aa, Mycobacterium bovis
RDEFAG

SEQ ID NO: 184938 - protein, 5 aa, Mycobacterium bovis
RDEGD

SEQ ID NO: 184939 - protein, 5 aa, Mycobacterium bovis
RDEKH

SEQ ID NO: 184940 - protein, 4 aa, Mycobacterium bovis
RDEL

SEQ ID NO: 184941 - protein, 10 aa, Mycobacterium bovis
RDEPHADAEK

SEQ ID NO: 184942 - protein, 6 aa, Mycobacterium bovis
RDEQGV

SEQ ID NO: 184943 - protein, 6 aa, Mycobacterium bovis
RDERGV

SEQ ID NO: 184944 - protein, 7 aa, Mycobacterium bovis
RDERGVP

SEQ ID NO: 184945 - protein, 8 aa, Mycobacterium bovis
RDERRRRN

SEQ ID NO: 184946 - protein, 10 aa, Mycobacterium bovis
RDERTDNAGF

SEQ ID NO: 184947 - protein, 8 aa, Mycobacterium bovis
RDETDVNP

SEQ ID NO: 184948 - protein, 8 aa, Mycobacterium bovis
RDETRPER

SEQ ID NO: 184949 - protein, 8 aa, Mycobacterium bovis
RDGADEVG

SEQ ID NO: 184950 - protein, 6 aa, Mycobacterium bovis
RDGADP

SEQ ID NO: 184951 - protein, 10 aa, Mycobacterium bovis
RDGAGKGGAI

SEQ ID NO: 184952 - protein, 5 aa, Mycobacterium bovis
RDGAY

SEQ ID NO: 184953 - protein, 9 aa, Mycobacterium bovis
RDGDGNPVQ

SEQ ID NO: 184954 - protein, 16 aa, Mycobacterium bovis
RDGDGPGSHYRNTPET

SEQ ID NO: 184955 - protein, 8 aa, Mycobacterium bovis
RDGDPVRD

SEQ ID NO: 184956 - protein, 6 aa, Mycobacterium bovis
RDGDRD

SEQ ID NO: 184957 - protein, 8 aa, Mycobacterium bovis
RDGEAGGV

SEQ ID NO: 184958 - protein, 7 aa, Mycobacterium bovis
RDGEQGR

SEQ ID NO: 184959 - protein, 6 aa, Mycobacterium bovis
RDGGAD

SEQ ID NO: 184960 - protein, 16 aa, Mycobacterium bovis
RDGGDAGEVTWLSRGV

SEQ ID NO: 184961 - protein, 14 aa, Mycobacterium bovis
RDGGDRYGGKGVQK

SEQ ID NO: 184962 - protein, 6 aa, Mycobacterium bovis
RDGGYT

SEQ ID NO: 184963 - protein, 5 aa, Mycobacterium bovis
RDGIT

SEQ ID NO: 184964 - protein, 8 aa, Mycobacterium bovis
RDGPADLP

SEQ ID NO: 184965 - protein, 6 aa, Mycobacterium bovis
RDGPRP

SEQ ID NO: 184966 - protein, 6 aa, Mycobacterium bovis
RDGPTG

SEQ ID NO: 184967 - protein, 8 aa, Mycobacterium bovis
RDGPTLTK

SEQ ID NO: 184968 - protein, 18 aa, Mycobacterium bovis
RDGQRRHPSDNTDEPARA

SEQ ID NO: 184969 - protein, 9 aa, Mycobacterium bovis
RDGRDDSGF

SEQ ID NO: 184970 - protein, 5 aa, Mycobacterium bovis
RDGRE

SEQ ID NO: 184971 - protein, 10 aa, Mycobacterium bovis
RDGRPALTGE

SEQ ID NO: 184972 - protein, 7 aa, Mycobacterium bovis
RDGRPVT

SEQ ID NO: 184973 - protein, 4 aa, Mycobacterium bovis
RDGS

SEQ ID NO: 184974 - protein, 10 aa, Mycobacterium bovis
RDGSANRPTT

SEQ ID NO: 184975 - protein, 5 aa, Mycobacterium bovis
RDGSD

SEQ ID NO: 184976 - protein, 6 aa, Mycobacterium bovis
RDGSER

SEQ ID NO: 184977 - protein, 12 aa, Mycobacterium bovis
RDGSYDAGERWP

SEQ ID NO: 184978 - protein, 4 aa, Mycobacterium bovis
RDGW

SEQ ID NO: 184979 - protein, 17 aa, Mycobacterium bovis
RDHDPTSATGVSTIGSS

SEQ ID NO: 184980 - protein, 6 aa, Mycobacterium bovis
RDHPSA

SEQ ID NO: 184981 - protein, 4 aa, Mycobacterium bovis
RDIA

SEQ ID NO: 184982 - protein, 7 aa, Mycobacterium bovis
RDIEAGT

SEQ ID NO: 184983 - protein, 7 aa, Mycobacterium bovis
RDIPPEA

SEQ ID NO: 184984 - protein, 11 aa, Mycobacterium bovis
RDITESPSTKL

SEQ ID NO: 184985 - protein, 9 aa, Mycobacterium bovis
RDKAGHSAF

SEQ ID NO: 184986 - protein, 10 aa, Mycobacterium bovis
RDKAVAQGSK

SEQ ID NO: 184987 - protein, 9 aa, Mycobacterium bovis
RDKGGRAVA

SEQ ID NO: 184988 - protein, 17 aa, Mycobacterium bovis
RDKPDPSTYIGSGKAAE

SEQ ID NO: 184989 - protein, 10 aa, Mycobacterium bovis
RDKPRSPEGL

SEQ ID NO: 184990 - protein, 7 aa, Mycobacterium bovis
RDKTATA

SEQ ID NO: 184991 - protein, 8 aa, Mycobacterium bovis
RDLPTAVS

SEQ ID NO: 184992 - protein, 4 aa, Mycobacterium bovis
RDLT

SEQ ID NO: 184993 - protein, 6 aa, Mycobacterium bovis
RDMGGP

SEQ ID NO: 184994 - protein, 10 aa, Mycobacterium bovis
RDNTTAASLK

SEQ ID NO: 184995 - protein, 7 aa, Mycobacterium bovis
RDPDLTP

SEQ ID NO: 184996 - protein, 11 aa, Mycobacterium bovis
RDPDPANVGRQ

SEQ ID NO: 184997 - protein, 4 aa, Mycobacterium bovis
RDPE

SEQ ID NO: 184998 - protein, 14 aa, Mycobacterium bovis
RDPETGEPGQWTQP

SEQ ID NO: 184999 - protein, 4 aa, Mycobacterium bovis
RDPG

SEQ ID NO: 185000 - protein, 9 aa, Mycobacterium bovis
RDPGVPDGR

SEQ ID NO: 185001 - protein, 6 aa, Mycobacterium bovis
RDPHRH

SEQ ID NO: 185002 - protein, 13 aa, Mycobacterium bovis
RDPINTPGPGRTK

SEQ ID NO: 185003 - protein, 4 aa, Mycobacterium bovis
RDPK

SEQ ID NO: 185004 - protein, 21 aa, Mycobacterium bovis
RDPPPRSTPPQPIPEDLSPND

SEQ ID NO: 185005 - protein, 9 aa, Mycobacterium bovis
RDPQPQRRA

SEQ ID NO: 185006 - protein, 8 aa, Mycobacterium bovis
RDPRASGE

SEQ ID NO: 185007 - protein, 24 aa, Mycobacterium bovis
RDPRATERKKYGLKKARKAPQYSK

SEQ ID NO: 185008 - protein, 8 aa, Mycobacterium bovis
RDPRNGRN

SEQ ID NO: 185009 - protein, 6 aa, Mycobacterium bovis
RDPRTK

SEQ ID NO: 185010 - protein, 7 aa, Mycobacterium bovis
RDPRVPN

SEQ ID NO: 185011 - protein, 6 aa, Mycobacterium bovis
RDPSLR

SEQ ID NO: 185012 - protein, 10 aa, Mycobacterium bovis
RDPSPRASNW

SEQ ID NO: 185013 - protein, 6 aa, Mycobacterium bovis
RDPTAL

SEQ ID NO: 185014 - protein, 9 aa, Mycobacterium bovis
RDPYGRTAR

SEQ ID NO: 185015 - protein, 14 aa, Mycobacterium bovis
RDQASASRRATHPV

SEQ ID NO: 185016 - protein, 17 aa, Mycobacterium bovis
RDQDKDGVGSAGIDPDG

SEQ ID NO: 185017 - protein, 8 aa, Mycobacterium bovis
RDQDPDHG

SEQ ID NO: 185018 - protein, 6 aa, Mycobacterium bovis
RDQHPD

SEQ ID NO: 185019 - protein, 5 aa, Mycobacterium bovis
RDQLS

SEQ ID NO: 185020 - protein, 4 aa, Mycobacterium bovis
RDQQ

SEQ ID NO: 185021 - protein, 7 aa, Mycobacterium bovis
RDQTASR

SEQ ID NO: 185022 - protein, 10 aa, Mycobacterium bovis
RDQTGAWDSV

SEQ ID NO: 185023 - protein, 5 aa, Mycobacterium bovis
RDRAR

SEQ ID NO: 185024 - protein, 6 aa, Mycobacterium bovis
RDRDAT

SEQ ID NO: 185025 - protein, 7 aa, Mycobacterium bovis
RDRDGLA

SEQ ID NO: 185026 - protein, 4 aa, Mycobacterium bovis
RDRG

SEQ ID NO: 185027 - protein, 8 aa, Mycobacterium bovis
RDRPAPPI

SEQ ID NO: 185028 - protein, 6 aa, Mycobacterium bovis
RDRPEI

SEQ ID NO: 185029 - protein, 8 aa, Mycobacterium bovis
RDRRDAGR

SEQ ID NO: 185030 - protein, 6 aa, Mycobacterium bovis
RDRRQD

SEQ ID NO: 185031 - protein, 9 aa, Mycobacterium bovis
RDRYTPTPA

SEQ ID NO: 185032 - protein, 5 aa, Mycobacterium bovis
RDSAP

SEQ ID NO: 185033 - protein, 8 aa, Mycobacterium bovis
RDSGDDVS

SEQ ID NO: 185034 - protein, 5 aa, Mycobacterium bovis
RDSLR

SEQ ID NO: 185035 - protein, 4 aa, Mycobacterium bovis
RDSP

SEQ ID NO: 185036 - protein, 5 aa, Mycobacterium bovis
RDSQK

SEQ ID NO: 185037 - protein, 8 aa, Mycobacterium bovis
RDSRANAR

SEQ ID NO: 185038 - protein, 8 aa, Mycobacterium bovis
RDSSPSLA

SEQ ID NO: 185039 - protein, 10 aa, Mycobacterium bovis
RDTADISDRQ

SEQ ID NO: 185040 - protein, 25 aa, Mycobacterium bovis
RDTADPKGAKYGRDGNGELDGTAEE

SEQ ID NO: 185041 - protein, 6 aa, Mycobacterium bovis
RDTAGY

SEQ ID NO: 185042 - protein, 6 aa, Mycobacterium bovis
RDTDGK

SEQ ID NO: 185043 - protein, 12 aa, Mycobacterium bovis
RDTGGSLGGGRR

SEQ ID NO: 185044 - protein, 5 aa, Mycobacterium bovis
RDTGR

SEQ ID NO: 185045 - protein, 5 aa, Mycobacterium bovis
RDTGV

SEQ ID NO: 185046 - protein, 5 aa, Mycobacterium bovis
RDTHG

SEQ ID NO: 185047 - protein, 6 aa, Mycobacterium bovis
RDTHGG

SEQ ID NO: 185048 - protein, 13 aa, Mycobacterium bovis
RDTNGDPVTARGA

SEQ ID NO: 185049 - protein, 9 aa, Mycobacterium bovis
RDTNRGGHD

SEQ ID NO: 185050 - protein, 7 aa, Mycobacterium bovis
RDTPQSL

SEQ ID NO: 185051 - protein, 13 aa, Mycobacterium bovis
RDTQRSRRRHSDV

SEQ ID NO: 185052 - protein, 8 aa, Mycobacterium bovis
RDTRGREI

SEQ ID NO: 185053 - protein, 4 aa, Mycobacterium bovis
RDTT

SEQ ID NO: 185054 - protein, 6 aa, Mycobacterium bovis
RDVGRT

SEQ ID NO: 185055 - protein, 7 aa, Mycobacterium bovis
RDVRDNQ

SEQ ID NO: 185056 - protein, 30 aa, Mycobacterium bovis
RDVSATSQATAQGAGCPAARGGGPSRAVGS

SEQ ID NO: 185057 - protein, 5 aa, Mycobacterium bovis
RDVTG

SEQ ID NO: 185058 - protein, 6 aa, Mycobacterium bovis
RDVTGR

SEQ ID NO: 185059 - protein, 9 aa, Mycobacterium bovis
RDVTTRSAN

SEQ ID NO: 185060 - protein, 7 aa, Mycobacterium bovis
RDYADVP

SEQ ID NO: 185061 - protein, 10 aa, Mycobacterium bovis
RDYAQADRTE

SEQ ID NO: 185062 - protein, 12 aa, Mycobacterium bovis
RDYDPTQKRPSI

SEQ ID NO: 185063 - protein, 4 aa, Mycobacterium bovis
RDYP

SEQ ID NO: 185064 - protein, 6 aa, Mycobacterium bovis
RDYPDT

SEQ ID NO: 185065 - protein, 16 aa, Mycobacterium bovis
REAARNHDTLSSARGV

SEQ ID NO: 185066 - protein, 4 aa, Mycobacterium bovis
READ

SEQ ID NO: 185067 - protein, 10 aa, Mycobacterium bovis
READTAGRLT

SEQ ID NO: 185068 - protein, 4 aa, Mycobacterium bovis
REAE

SEQ ID NO: 185069 - protein, 5 aa, Mycobacterium bovis
REAEP

SEQ ID NO: 185070 - protein, 4 aa, Mycobacterium bovis
REAG

SEQ ID NO: 185071 - protein, 12 aa, Mycobacterium bovis
REAGAAHPRSLG

SEQ ID NO: 185072 - protein, 5 aa, Mycobacterium bovis
REAGE

SEQ ID NO: 185073 - protein, 5 aa, Mycobacterium bovis
REAHG

SEQ ID NO: 185074 - protein, 9 aa, Mycobacterium bovis
REALGDPTA

SEQ ID NO: 185075 - protein, 8 aa, Mycobacterium bovis
REAPWPDS

SEQ ID NO: 185076 - protein, 4 aa, Mycobacterium bovis
REAS

SEQ ID NO: 185077 - protein, 14 aa, Mycobacterium bovis
REASEEAAGTEGRT

SEQ ID NO: 185078 - protein, 28 aa, Mycobacterium bovis
REASHAETTTQAVRDEDREWEGTVGDGL

SEQ ID NO: 185079 - protein, 10 aa, Mycobacterium bovis
REASRAERDR

SEQ ID NO: 185080 - protein, 4 aa, Mycobacterium bovis
REAT

SEQ ID NO: 185081 - protein, 16 aa, Mycobacterium bovis
REATAELADAARTRGV

SEQ ID NO: 185082 - protein, 11 aa, Mycobacterium bovis
REATAMDPQQR

SEQ ID NO: 185083 - protein, 15 aa, Mycobacterium bovis
REATDEELAAESGIP

SEQ ID NO: 185084 - protein, 6 aa, Mycobacterium bovis
REATRS

SEQ ID NO: 185085 - protein, 9 aa, Mycobacterium bovis
REATSIDPQ

SEQ ID NO: 185086 - protein, 11 aa, Mycobacterium bovis
REAYGDTSQLS

SEQ ID NO: 185087 - protein, 5 aa, Mycobacterium bovis
RECGG

SEQ ID NO: 185088 - protein, 5 aa, Mycobacterium bovis
REDEV

SEQ ID NO: 185089 - protein, 5 aa, Mycobacterium bovis
REDGA

SEQ ID NO: 185090 - protein, 14 aa, Mycobacterium bovis
REDGNYSPQLNSET

SEQ ID NO: 185091 - protein, 8 aa, Mycobacterium bovis
REDGQQSI

SEQ ID NO: 185092 - protein, 12 aa, Mycobacterium bovis
REDPPGRARQAN

SEQ ID NO: 185093 - protein, 7 aa, Mycobacterium bovis
REDVERG

SEQ ID NO: 185094 - protein, 9 aa, Mycobacterium bovis
REEAGKTSP

SEQ ID NO: 185095 - protein, 10 aa, Mycobacterium bovis
REEPDPVTAL

SEQ ID NO: 185096 - protein, 6 aa, Mycobacterium bovis
REERPD

SEQ ID NO: 185097 - protein, 7 aa, Mycobacterium bovis
REETWGP

SEQ ID NO: 185098 - protein, 4 aa, Mycobacterium bovis
REEV

SEQ ID NO: 185099 - protein, 5 aa, Mycobacterium bovis
REEWP

SEQ ID NO: 185100 - protein, 4 aa, Mycobacterium bovis
REFK

SEQ ID NO: 185101 - protein, 4 aa, Mycobacterium bovis
REGA

SEQ ID NO: 185102 - protein, 9 aa, Mycobacterium bovis
REGAGDVGY

SEQ ID NO: 185103 - protein, 12 aa, Mycobacterium bovis
REGAKEPATAAA

SEQ ID NO: 185104 - protein, 5 aa, Mycobacterium bovis
REGDA

SEQ ID NO: 185105 - protein, 5 aa, Mycobacterium bovis
REGDN

SEQ ID NO: 185106 - protein, 11 aa, Mycobacterium bovis
REGEDEDLERA

SEQ ID NO: 185107 - protein, 5 aa, Mycobacterium bovis
REGEG

SEQ ID NO: 185108 - protein, 7 aa, Mycobacterium bovis
REGGIND

SEQ ID NO: 185109 - protein, 6 aa, Mycobacterium bovis
REGHTQ

SEQ ID NO: 185110 - protein, 9 aa, Mycobacterium bovis
REGNGRSTR

SEQ ID NO: 185111 - protein, 6 aa, Mycobacterium bovis
REGPAA

SEQ ID NO: 185112 - protein, 8 aa, Mycobacterium bovis
REGRDKVA

SEQ ID NO: 185113 - protein, 5 aa, Mycobacterium bovis
REGRE

SEQ ID NO: 185114 - protein, 5 aa, Mycobacterium bovis
REGRT

SEQ ID NO: 185115 - protein, 9 aa, Mycobacterium bovis
REGSEEYLD

SEQ ID NO: 185116 - protein, 5 aa, Mycobacterium bovis
REGSR

SEQ ID NO: 185117 - protein, 5 aa, Mycobacterium bovis
REGTS

SEQ ID NO: 185118 - protein, 6 aa, Mycobacterium bovis
REGTTT

SEQ ID NO: 185119 - protein, 4 aa, Mycobacterium bovis
REGY

SEQ ID NO: 185120 - protein, 6 aa, Mycobacterium bovis
REHGGG

SEQ ID NO: 185121 - protein, 4 aa, Mycobacterium bovis
REHN

SEQ ID NO: 185122 - protein, 9 aa, Mycobacterium bovis
REHNGADQY

SEQ ID NO: 185123 - protein, 9 aa, Mycobacterium bovis
REKASEGTP

SEQ ID NO: 185124 - protein, 19 aa, Mycobacterium bovis
REKQTSDPPAKKESNGTKM

SEQ ID NO: 185125 - protein, 6 aa, Mycobacterium bovis
RELAGD

SEQ ID NO: 185126 - protein, 8 aa, Mycobacterium bovis
RELDGPNI

SEQ ID NO: 185127 - protein, 8 aa, Mycobacterium bovis
RELQRPDP

SEQ ID NO: 185128 - protein, 8 aa, Mycobacterium bovis
RELSGAER

SEQ ID NO: 185129 - protein, 4 aa, Mycobacterium bovis
RELY

SEQ ID NO: 185130 - protein, 8 aa, Mycobacterium bovis
RENGDTGH

SEQ ID NO: 185131 - protein, 8 aa, Mycobacterium bovis
RENPQRTA

SEQ ID NO: 185132 - protein, 18 aa, Mycobacterium bovis
RENQTDQPASTILLPTSY

SEQ ID NO: 185133 - protein, 12 aa, Mycobacterium bovis
REPDGGGFNPPG

SEQ ID NO: 185134 - protein, 9 aa, Mycobacterium bovis
REPDGNPGQ

SEQ ID NO: 185135 - protein, 6 aa, Mycobacterium bovis
REPDHD

SEQ ID NO: 185136 - protein, 7 aa, Mycobacterium bovis
REPESDA

SEQ ID NO: 185137 - protein, 9 aa, Mycobacterium bovis
REPGLTDPR

SEQ ID NO: 185138 - protein, 8 aa, Mycobacterium bovis
REPGNAGT

SEQ ID NO: 185139 - protein, 6 aa, Mycobacterium bovis
REPIPD

SEQ ID NO: 185140 - protein, 6 aa, Mycobacterium bovis
REPKKE

SEQ ID NO: 185141 - protein, 4 aa, Mycobacterium bovis
REPL

SEQ ID NO: 185142 - protein, 5 aa, Mycobacterium bovis
REPQL

SEQ ID NO: 185143 - protein, 15 aa, Mycobacterium bovis
REPRGPWGPGRPVEA

SEQ ID NO: 185144 - protein, 6 aa, Mycobacterium bovis
REPRPY

SEQ ID NO: 185145 - protein, 20 aa, Mycobacterium bovis
REQADTYMKSGGTEGTQLQG

SEQ ID NO: 185146 - protein, 4 aa, Mycobacterium bovis
REQG

SEQ ID NO: 185147 - protein, 17 aa, Mycobacterium bovis
REQGYDGTWTGDDNIDK

SEQ ID NO: 185148 - protein, 7 aa, Mycobacterium bovis
REQKRPG

SEQ ID NO: 185149 - protein, 11 aa, Mycobacterium bovis
REQLTGDEAHE

SEQ ID NO: 185150 - protein, 5 aa, Mycobacterium bovis
REQPE

SEQ ID NO: 185151 - protein, 15 aa, Mycobacterium bovis
REQPHPSPIVPAWGQ

SEQ ID NO: 185152 - protein, 12 aa, Mycobacterium bovis
REQPLAGVSGAS

SEQ ID NO: 185153 - protein, 14 aa, Mycobacterium bovis
REQTQRRKQQQRTM

SEQ ID NO: 185154 - protein, 6 aa, Mycobacterium bovis
REQVTP

SEQ ID NO: 185155 - protein, 11 aa, Mycobacterium bovis
RERAGNDQRTR

SEQ ID NO: 185156 - protein, 9 aa, Mycobacterium bovis
RERAQRAVS

SEQ ID NO: 185157 - protein, 7 aa, Mycobacterium bovis
RERASAR

SEQ ID NO: 185158 - protein, 8 aa, Mycobacterium bovis
RERASRRV

SEQ ID NO: 185159 - protein, 15 aa, Mycobacterium bovis
RERATDIGAGAVTPA

SEQ ID NO: 185160 - protein, 4 aa, Mycobacterium bovis
RERE

SEQ ID NO: 185161 - protein, 19 aa, Mycobacterium bovis
RERGDETRRYGVVRFTLDV

SEQ ID NO: 185162 - protein, 5 aa, Mycobacterium bovis
RERGV

SEQ ID NO: 185163 - protein, 4 aa, Mycobacterium bovis
RERR

SEQ ID NO: 185164 - protein, 5 aa, Mycobacterium bovis
RERRP

SEQ ID NO: 185165 - protein, 9 aa, Mycobacterium bovis
RERRPDRAI

SEQ ID NO: 185166 - protein, 11 aa, Mycobacterium bovis
RERSGVRQSKE

SEQ ID NO: 185167 - protein, 15 aa, Mycobacterium bovis
RERYGPPKSAPRAYS

SEQ ID NO: 185168 - protein, 8 aa, Mycobacterium bovis
RESDEEMA

SEQ ID NO: 185169 - protein, 9 aa, Mycobacterium bovis
RESEPMARP

SEQ ID NO: 185170 - protein, 11 aa, Mycobacterium bovis
RESGDADAVRA

SEQ ID NO: 185171 - protein, 9 aa, Mycobacterium bovis
RESGGAIGG

SEQ ID NO: 185172 - protein, 7 aa, Mycobacterium bovis
RESNYNA

SEQ ID NO: 185173 - protein, 6 aa, Mycobacterium bovis
RESREG

SEQ ID NO: 185174 - protein, 8 aa, Mycobacterium bovis
RESRGAPW

SEQ ID NO: 185175 - protein, 7 aa, Mycobacterium bovis
RETGPTQ

SEQ ID NO: 185176 - protein, 6 aa, Mycobacterium bovis
RETGSA

SEQ ID NO: 185177 - protein, 6 aa, Mycobacterium bovis
RETKAA

SEQ ID NO: 185178 - protein, 4 aa, Mycobacterium bovis
RETQ

SEQ ID NO: 185179 - protein, 6 aa, Mycobacterium bovis
RETREA

SEQ ID NO: 185180 - protein, 12 aa, Mycobacterium bovis
RETRGTSENVDS

SEQ ID NO: 185181 - protein, 4 aa, Mycobacterium bovis
RETT

SEQ ID NO: 185182 - protein, 7 aa, Mycobacterium bovis
RETTLDV

SEQ ID NO: 185183 - protein, 9 aa, Mycobacterium bovis
REVDRSPAD

SEQ ID NO: 185184 - protein, 8 aa, Mycobacterium bovis
REVNTAGD

SEQ ID NO: 185185 - protein, 7 aa, Mycobacterium bovis
REVTSAI

SEQ ID NO: 185186 - protein, 17 aa, Mycobacterium bovis
REYDPELKPATTKAGIT

SEQ ID NO: 185187 - protein, 8 aa, Mycobacterium bovis
REYEDDDQ

SEQ ID NO: 185188 - protein, 4 aa, Mycobacterium bovis
REYP

SEQ ID NO: 185189 - protein, 8 aa, Mycobacterium bovis
RFANPTPK

SEQ ID NO: 185190 - protein, 5 aa, Mycobacterium bovis
RFATS

SEQ ID NO: 185191 - protein, 4 aa, Mycobacterium bovis
RFEP

SEQ ID NO: 185192 - protein, 6 aa, Mycobacterium bovis
RFGDSD

SEQ ID NO: 185193 - protein, 15 aa, Mycobacterium bovis
RFGPDSSARHRRSGA

SEQ ID NO: 185194 - protein, 6 aa, Mycobacterium bovis
RFPGSE

SEQ ID NO: 185195 - protein, 8 aa, Mycobacterium bovis
RFPNPNDP

SEQ ID NO: 185196 - protein, 22 aa, Mycobacterium bovis
RFPTEPPAAPLPRYPGGTSPRA

SEQ ID NO: 185197 - protein, 6 aa, Mycobacterium bovis
RFPTPE

SEQ ID NO: 185198 - protein, 6 aa, Mycobacterium bovis
RFREAE

SEQ ID NO: 185199 - protein, 5 aa, Mycobacterium bovis
RFRRG

SEQ ID NO: 185200 - protein, 7 aa, Mycobacterium bovis
RFSGGTT

SEQ ID NO: 185201 - protein, 9 aa, Mycobacterium bovis
RFSGSSGQL

SEQ ID NO: 185202 - protein, 16 aa, Mycobacterium bovis
RFSRTASSQPRPPAAT

SEQ ID NO: 185203 - protein, 7 aa, Mycobacterium bovis
RFSTRAE

SEQ ID NO: 185204 - protein, 5 aa, Mycobacterium bovis
RGAAA

SEQ ID NO: 185205 - protein, 11 aa, Mycobacterium bovis
RGAAELDGATA

SEQ ID NO: 185206 - protein, 15 aa, Mycobacterium bovis
RGAAYPATQPNGPSI

SEQ ID NO: 185207 - protein, 4 aa, Mycobacterium bovis
RGAD

SEQ ID NO: 185208 - protein, 13 aa, Mycobacterium bovis
RGADDAALPPVTE

SEQ ID NO: 185209 - protein, 11 aa, Mycobacterium bovis
RGADGELAGPW

SEQ ID NO: 185210 - protein, 8 aa, Mycobacterium bovis
RGADGGTG

SEQ ID NO: 185211 - protein, 5 aa, Mycobacterium bovis
RGADR

SEQ ID NO: 185212 - protein, 10 aa, Mycobacterium bovis
RGAEIGPGTR

SEQ ID NO: 185213 - protein, 9 aa, Mycobacterium bovis
RGAERSAQA

SEQ ID NO: 185214 - protein, 4 aa, Mycobacterium bovis
RGAF

SEQ ID NO: 185215 - protein, 7 aa, Mycobacterium bovis
RGAGDFS

SEQ ID NO: 185216 - protein, 5 aa, Mycobacterium bovis
RGAGM

SEQ ID NO: 185217 - protein, 6 aa, Mycobacterium bovis
RGAGPL

SEQ ID NO: 185218 - protein, 8 aa, Mycobacterium bovis
RGAGTEDA

SEQ ID NO: 185219 - protein, 12 aa, Mycobacterium bovis
RGAGVDDCDQDP

SEQ ID NO: 185220 - protein, 6 aa, Mycobacterium bovis
RGAKAT

SEQ ID NO: 185221 - protein, 32 aa, Mycobacterium bovis
RGAKTRARARHPGEPAGGPPPKPTAGDSKAAP

SEQ ID NO: 185222 - protein, 19 aa, Mycobacterium bovis
RGALEGDPSGSQAADNNRV

SEQ ID NO: 185223 - protein, 9 aa, Mycobacterium bovis
RGAPAYRQR

SEQ ID NO: 185224 - protein, 14 aa, Mycobacterium bovis
RGAQGAEPRSGDGA

SEQ ID NO: 185225 - protein, 5 aa, Mycobacterium bovis
RGARE

SEQ ID NO: 185226 - protein, 24 aa, Mycobacterium bovis
RGARVPTPQRRRPYRPPPRPNSEA

SEQ ID NO: 185227 - protein, 15 aa, Mycobacterium bovis
RGASSAASAASATID

SEQ ID NO: 185228 - protein, 7 aa, Mycobacterium bovis
RGATDAE

SEQ ID NO: 185229 - protein, 8 aa, Mycobacterium bovis
RGATDPTL

SEQ ID NO: 185230 - protein, 5 aa, Mycobacterium bovis
RGATY

SEQ ID NO: 185231 - protein, 6 aa, Mycobacterium bovis
RGCPGQ

SEQ ID NO: 185232 - protein, 13 aa, Mycobacterium bovis
RGDAPDAFDDAAR

SEQ ID NO: 185233 - protein, 9 aa, Mycobacterium bovis
RGDATGVAD

SEQ ID NO: 185234 - protein, 7 aa, Mycobacterium bovis
RGDDPSL

SEQ ID NO: 185235 - protein, 4 aa, Mycobacterium bovis
RGDE

SEQ ID NO: 185236 - protein, 5 aa, Mycobacterium bovis
RGDEI

SEQ ID NO: 185237 - protein, 9 aa, Mycobacterium bovis
RGDERPVPP

SEQ ID NO: 185238 - protein, 9 aa, Mycobacterium bovis
RGDFSTAKR

SEQ ID NO: 185239 - protein, 7 aa, Mycobacterium bovis
RGDGAPE

SEQ ID NO: 185240 - protein, 9 aa, Mycobacterium bovis
RGDGGGLET

SEQ ID NO: 185241 - protein, 11 aa, Mycobacterium bovis
RGDGTITGSAI

SEQ ID NO: 185242 - protein, 4 aa, Mycobacterium bovis
RGDL

SEQ ID NO: 185243 - protein, 11 aa, Mycobacterium bovis
RGDPDSGTAAL

SEQ ID NO: 185244 - protein, 10 aa, Mycobacterium bovis
RGDPGRLAPV

SEQ ID NO: 185245 - protein, 14 aa, Mycobacterium bovis
RGDPPCDDWSPPPI

SEQ ID NO: 185246 - protein, 19 aa, Mycobacterium bovis
RGDPSDNLPGIPGVGEKTA

SEQ ID NO: 185247 - protein, 7 aa, Mycobacterium bovis
RGDRADW

SEQ ID NO: 185248 - protein, 4 aa, Mycobacterium bovis
RGDS

SEQ ID NO: 185249 - protein, 15 aa, Mycobacterium bovis
RGDTEAAAAAQASID

SEQ ID NO: 185250 - protein, 8 aa, Mycobacterium bovis
RGDTGPEL

SEQ ID NO: 185251 - protein, 8 aa, Mycobacterium bovis
RGDTPLPV

SEQ ID NO: 185252 - protein, 5 aa, Mycobacterium bovis
RGDTT

SEQ ID NO: 185253 - protein, 5 aa, Mycobacterium bovis
RGDVG

SEQ ID NO: 185254 - protein, 13 aa, Mycobacterium bovis
RGEAKRTKHPRLG

SEQ ID NO: 185255 - protein, 5 aa, Mycobacterium bovis
RGEAP

SEQ ID NO: 185256 - protein, 8 aa, Mycobacterium bovis
RGEASRRI

SEQ ID NO: 185257 - protein, 5 aa, Mycobacterium bovis
RGEAT

SEQ ID NO: 185258 - protein, 8 aa, Mycobacterium bovis
RGEATEQL

SEQ ID NO: 185259 - protein, 6 aa, Mycobacterium bovis
RGEDES

SEQ ID NO: 185260 - protein, 6 aa, Mycobacterium bovis
RGEEIN

SEQ ID NO: 185261 - protein, 10 aa, Mycobacterium bovis
RGEGLGVPAS

SEQ ID NO: 185262 - protein, 8 aa, Mycobacterium bovis
RGEGLNQD

SEQ ID NO: 185263 - protein, 6 aa, Mycobacterium bovis
RGEIDG

SEQ ID NO: 185264 - protein, 7 aa, Mycobacterium bovis
RGEITRA

SEQ ID NO: 185265 - protein, 6 aa, Mycobacterium bovis
RGELEP

SEQ ID NO: 185266 - protein, 7 aa, Mycobacterium bovis
RGELRGS

SEQ ID NO: 185267 - protein, 10 aa, Mycobacterium bovis
RGELSADDAR

SEQ ID NO: 185268 - protein, 5 aa, Mycobacterium bovis
RGEPA

SEQ ID NO: 185269 - protein, 7 aa, Mycobacterium bovis
RGEPADA

SEQ ID NO: 185270 - protein, 8 aa, Mycobacterium bovis
RGEPTAQD

SEQ ID NO: 185271 - protein, 25 aa, Mycobacterium bovis
RGEPTEPATNPDASPGLRPADGPAS

SEQ ID NO: 185272 - protein, 10 aa, Mycobacterium bovis
RGEPVDSYGV

SEQ ID NO: 185273 - protein, 5 aa, Mycobacterium bovis
RGEPY

SEQ ID NO: 185274 - protein, 16 aa, Mycobacterium bovis
RGESERAERDGDLAKA

SEQ ID NO: 185275 - protein, 25 aa, Mycobacterium bovis
RGESPGEGLPPITTPPWDTKAPKDN

SEQ ID NO: 185276 - protein, 7 aa, Mycobacterium bovis
RGEVRSD

SEQ ID NO: 185277 - protein, 8 aa, Mycobacterium bovis
RGEVSGSQ

SEQ ID NO: 185278 - protein, 5 aa, Mycobacterium bovis
RGFDP

SEQ ID NO: 185279 - protein, 4 aa, Mycobacterium bovis
RGFG

SEQ ID NO: 185280 - protein, 7 aa, Mycobacterium bovis
RGFSDDA

SEQ ID NO: 185281 - protein, 6 aa, Mycobacterium bovis
RGFSSG

SEQ ID NO: 185282 - protein, 6 aa, Mycobacterium bovis
RGFTGD

SEQ ID NO: 185283 - protein, 7 aa, Mycobacterium bovis
RGGADAE

SEQ ID NO: 185284 - protein, 5 aa, Mycobacterium bovis
RGGAE

SEQ ID NO: 185285 - protein, 7 aa, Mycobacterium bovis
RGGAGRT

SEQ ID NO: 185286 - protein, 10 aa, Mycobacterium bovis
RGGAPGTRET

SEQ ID NO: 185287 - protein, 11 aa, Mycobacterium bovis
RGGDDDSEMSD

SEQ ID NO: 185288 - protein, 11 aa, Mycobacterium bovis
RGGEKISPERV

SEQ ID NO: 185289 - protein, 5 aa, Mycobacterium bovis
RGGEY

SEQ ID NO: 185290 - protein, 5 aa, Mycobacterium bovis
RGGGA

SEQ ID NO: 185291 - protein, 15 aa, Mycobacterium bovis
RGGGEATVTGSADTR

SEQ ID NO: 185292 - protein, 10 aa, Mycobacterium bovis
RGGGEYGPGW

SEQ ID NO: 185293 - protein, 6 aa, Mycobacterium bovis
RGGGGS

SEQ ID NO: 185294 - protein, 7 aa, Mycobacterium bovis
RGGGHNV

SEQ ID NO: 185295 - protein, 17 aa, Mycobacterium bovis
RGGGPRGRKALADENGG

SEQ ID NO: 185296 - protein, 7 aa, Mycobacterium bovis
RGGGTYA

SEQ ID NO: 185297 - protein, 12 aa, Mycobacterium bovis
RGGHPRGSPDRI

SEQ ID NO: 185298 - protein, 14 aa, Mycobacterium bovis
RGGHPTPMSSTKAT

SEQ ID NO: 185299 - protein, 10 aa, Mycobacterium bovis
RGGLGNAAGY

SEQ ID NO: 185300 - protein, 4 aa, Mycobacterium bovis
RGGP

SEQ ID NO: 185301 - protein, 6 aa, Mycobacterium bovis
RGGPAT

SEQ ID NO: 185302 - protein, 15 aa, Mycobacterium bovis
RGGPSTGLPTKTEQA

SEQ ID NO: 185303 - protein, 4 aa, Mycobacterium bovis
RGGR

SEQ ID NO: 185304 - protein, 8 aa, Mycobacterium bovis
RGGRPVVD

SEQ ID NO: 185305 - protein, 6 aa, Mycobacterium bovis
RGGRRT

SEQ ID NO: 185306 - protein, 9 aa, Mycobacterium bovis
RGGSAPLHR

SEQ ID NO: 185307 - protein, 20 aa, Mycobacterium bovis
RGGSARPSRPRRGNDLETET

SEQ ID NO: 185308 - protein, 6 aa, Mycobacterium bovis
RGGSGD

SEQ ID NO: 185309 - protein, 8 aa, Mycobacterium bovis
RGGSGSIT

SEQ ID NO: 185310 - protein, 24 aa, Mycobacterium bovis
RGGTGGAGGYGGDGGGGGDGFDGT

SEQ ID NO: 185311 - protein, 8 aa, Mycobacterium bovis
RGGTPDEV

SEQ ID NO: 185312 - protein, 8 aa, Mycobacterium bovis
RGGTPTAY

SEQ ID NO: 185313 - protein, 8 aa, Mycobacterium bovis
RGGYDGRG

SEQ ID NO: 185314 - protein, 9 aa, Mycobacterium bovis
RGHASGPRL

SEQ ID NO: 185315 - protein, 4 aa, Mycobacterium bovis
RGHD

SEQ ID NO: 185316 - protein, 9 aa, Mycobacterium bovis
RGHGRSGGK

SEQ ID NO: 185317 - protein, 14 aa, Mycobacterium bovis
RGHGTDDSEVNPSG

SEQ ID NO: 185318 - protein, 14 aa, Mycobacterium bovis
RGHPNAAGTAIKDR

SEQ ID NO: 185319 - protein, 6 aa, Mycobacterium bovis
RGHRPV

SEQ ID NO: 185320 - protein, 4 aa, Mycobacterium bovis
RGHT

SEQ ID NO: 185321 - protein, 5 aa, Mycobacterium bovis
RGIDD

SEQ ID NO: 185322 - protein, 4 aa, Mycobacterium bovis
RGIG

SEQ ID NO: 185323 - protein, 5 aa, Mycobacterium bovis
RGIGA

SEQ ID NO: 185324 - protein, 8 aa, Mycobacterium bovis
RGIGGRDA

SEQ ID NO: 185325 - protein, 9 aa, Mycobacterium bovis
RGIRPESKF

SEQ ID NO: 185326 - protein, 4 aa, Mycobacterium bovis
RGIT

SEQ ID NO: 185327 - protein, 5 aa, Mycobacterium bovis
RGITP

SEQ ID NO: 185328 - protein, 8 aa, Mycobacterium bovis
RGITPAAA

SEQ ID NO: 185329 - protein, 6 aa, Mycobacterium bovis
RGITRE

SEQ ID NO: 185330 - protein, 9 aa, Mycobacterium bovis
RGKARLKHD

SEQ ID NO: 185331 - protein, 8 aa, Mycobacterium bovis
RGKDAEPL

SEQ ID NO: 185332 - protein, 5 aa, Mycobacterium bovis
RGKES

SEQ ID NO: 185333 - protein, 5 aa, Mycobacterium bovis
RGKGH

SEQ ID NO: 185334 - protein, 8 aa, Mycobacterium bovis
RGKLTPRE

SEQ ID NO: 185335 - protein, 8 aa, Mycobacterium bovis
RGKPIPDL

SEQ ID NO: 185336 - protein, 13 aa, Mycobacterium bovis
RGKPTGPDGEPDW

SEQ ID NO: 185337 - protein, 5 aa, Mycobacterium bovis
RGKSR

SEQ ID NO: 185338 - protein, 12 aa, Mycobacterium bovis
RGKTIRPKTLNQ

SEQ ID NO: 185339 - protein, 4 aa, Mycobacterium bovis
RGKW

SEQ ID NO: 185340 - protein, 7 aa, Mycobacterium bovis
RGLAADG

SEQ ID NO: 185341 - protein, 4 aa, Mycobacterium bovis
RGLD

SEQ ID NO: 185342 - protein, 4 aa, Mycobacterium bovis
RGLG

SEQ ID NO: 185343 - protein, 6 aa, Mycobacterium bovis
RGLGEK

SEQ ID NO: 185344 - protein, 8 aa, Mycobacterium bovis
RGLGRPQR

SEQ ID NO: 185345 - protein, 10 aa, Mycobacterium bovis
RGLNPSETDY

SEQ ID NO: 185346 - protein, 11 aa, Mycobacterium bovis
RGLPAQGDDVD

SEQ ID NO: 185347 - protein, 14 aa, Mycobacterium bovis
RGLPTVSSSDAVQQ

SEQ ID NO: 185348 - protein, 7 aa, Mycobacterium bovis
RGLSSGD

SEQ ID NO: 185349 - protein, 9 aa, Mycobacterium bovis
RGLTPASDY

SEQ ID NO: 185350 - protein, 7 aa, Mycobacterium bovis
RGMSDDA

SEQ ID NO: 185351 - protein, 4 aa, Mycobacterium bovis
RGND

SEQ ID NO: 185352 - protein, 6 aa, Mycobacterium bovis
RGNGDI

SEQ ID NO: 185353 - protein, 7 aa, Mycobacterium bovis
RGNGGTA

SEQ ID NO: 185354 - protein, 5 aa, Mycobacterium bovis
RGNGY

SEQ ID NO: 185355 - protein, 6 aa, Mycobacterium bovis
RGNLDT

SEQ ID NO: 185356 - protein, 9 aa, Mycobacterium bovis
RGNPGPAGY

SEQ ID NO: 185357 - protein, 10 aa, Mycobacterium bovis
RGPATPGSAA

SEQ ID NO: 185358 - protein, 5 aa, Mycobacterium bovis
RGPDE

SEQ ID NO: 185359 - protein, 6 aa, Mycobacterium bovis
RGPGAA

SEQ ID NO: 185360 - protein, 6 aa, Mycobacterium bovis
RGPGGG

SEQ ID NO: 185361 - protein, 11 aa, Mycobacterium bovis
RGPGLRPAGAG

SEQ ID NO: 185362 - protein, 5 aa, Mycobacterium bovis
RGPGN

SEQ ID NO: 185363 - protein, 4 aa, Mycobacterium bovis
RGPL

SEQ ID NO: 185364 - protein, 11 aa, Mycobacterium bovis
RGPLSTEEATT

SEQ ID NO: 185365 - protein, 7 aa, Mycobacterium bovis
RGPNAGS

SEQ ID NO: 185366 - protein, 22 aa, Mycobacterium bovis
RGPNGAGWPQLGQNEQGQDLTP

SEQ ID NO: 185367 - protein, 8 aa, Mycobacterium bovis
RGPNGQDL

SEQ ID NO: 185368 - protein, 9 aa, Mycobacterium bovis
RGPNGSTFN

SEQ ID NO: 185369 - protein, 4 aa, Mycobacterium bovis
RGPR

SEQ ID NO: 185370 - protein, 5 aa, Mycobacterium bovis
RGPSA

SEQ ID NO: 185371 - protein, 6 aa, Mycobacterium bovis
RGPSST

SEQ ID NO: 185372 - protein, 5 aa, Mycobacterium bovis
RGPTG

SEQ ID NO: 185373 - protein, 6 aa, Mycobacterium bovis
RGPTPP

SEQ ID NO: 185374 - protein, 6 aa, Mycobacterium bovis
RGQAGI

SEQ ID NO: 185375 - protein, 5 aa, Mycobacterium bovis
RGQDG

SEQ ID NO: 185376 - protein, 4 aa, Mycobacterium bovis
RGQE

SEQ ID NO: 185377 - protein, 6 aa, Mycobacterium bovis
RGQEAA

SEQ ID NO: 185378 - protein, 8 aa, Mycobacterium bovis
RGQEAAQV

SEQ ID NO: 185379 - protein, 11 aa, Mycobacterium bovis
RGQESSAYWPA

SEQ ID NO: 185380 - protein, 6 aa, Mycobacterium bovis
RGQGKT

SEQ ID NO: 185381 - protein, 8 aa, Mycobacterium bovis
RGQHARSR

SEQ ID NO: 185382 - protein, 10 aa, Mycobacterium bovis
RGQPVSPSTV

SEQ ID NO: 185383 - protein, 12 aa, Mycobacterium bovis
RGQRGGEGPSYE

SEQ ID NO: 185384 - protein, 10 aa, Mycobacterium bovis
RGQRRPATTR

SEQ ID NO: 185385 - protein, 25 aa, Mycobacterium bovis
RGQRTKTNARTRKGPKRTIAGKKKA

SEQ ID NO: 185386 - protein, 7 aa, Mycobacterium bovis
RGRAGHG

SEQ ID NO: 185387 - protein, 8 aa, Mycobacterium bovis
RGRARSVT

SEQ ID NO: 185388 - protein, 10 aa, Mycobacterium bovis
RGRDAKTPPV

SEQ ID NO: 185389 - protein, 5 aa, Mycobacterium bovis
RGRDE

SEQ ID NO: 185390 - protein, 5 aa, Mycobacterium bovis
RGREA

SEQ ID NO: 185391 - protein, 4 aa, Mycobacterium bovis
RGRG

SEQ ID NO: 185392 - protein, 6 aa, Mycobacterium bovis
RGRGPF

SEQ ID NO: 185393 - protein, 6 aa, Mycobacterium bovis
RGRGPV

SEQ ID NO: 185394 - protein, 8 aa, Mycobacterium bovis
RGRGVPAE

SEQ ID NO: 185395 - protein, 9 aa, Mycobacterium bovis
RGRKIDPQW

SEQ ID NO: 185396 - protein, 10 aa, Mycobacterium bovis
RGRPTSEAVE

SEQ ID NO: 185397 - protein, 6 aa, Mycobacterium bovis
RGRQLD

SEQ ID NO: 185398 - protein, 6 aa, Mycobacterium bovis
RGRRAL

SEQ ID NO: 185399 - protein, 10 aa, Mycobacterium bovis
RGRRGSVAAT

SEQ ID NO: 185400 - protein, 8 aa, Mycobacterium bovis
RGRTDDED

SEQ ID NO: 185401 - protein, 7 aa, Mycobacterium bovis
RGRTEAL

SEQ ID NO: 185402 - protein, 6 aa, Mycobacterium bovis
RGRVAG

SEQ ID NO: 185403 - protein, 9 aa, Mycobacterium bovis
RGRVDNDAT

SEQ ID NO: 185404 - protein, 21 aa, Mycobacterium bovis
RGRVPNASVARAQSVPSVGET

SEQ ID NO: 185405 - protein, 13 aa, Mycobacterium bovis
RGRYGPGYIPRST

SEQ ID NO: 185406 - protein, 13 aa, Mycobacterium bovis
RGRYGSAGNKDDR

SEQ ID NO: 185407 - protein, 6 aa, Mycobacterium bovis
RGSAKR

SEQ ID NO: 185408 - protein, 7 aa, Mycobacterium bovis
RGSATGV

SEQ ID NO: 185409 - protein, 16 aa, Mycobacterium bovis
RGSDGAGDKQPGISFV

SEQ ID NO: 185410 - protein, 7 aa, Mycobacterium bovis
RGSDGQW

SEQ ID NO: 185411 - protein, 7 aa, Mycobacterium bovis
RGSDGRV

SEQ ID NO: 185412 - protein, 5 aa, Mycobacterium bovis
RGSDV

SEQ ID NO: 185413 - protein, 15 aa, Mycobacterium bovis
RGSEAVELSGDAADE

SEQ ID NO: 185414 - protein, 7 aa, Mycobacterium bovis
RGSENLC

SEQ ID NO: 185415 - protein, 8 aa, Mycobacterium bovis
RGSEYPQR

SEQ ID NO: 185416 - protein, 8 aa, Mycobacterium bovis
RGSGARSI

SEQ ID NO: 185417 - protein, 7 aa, Mycobacterium bovis
RGSGASF

SEQ ID NO: 185418 - protein, 7 aa, Mycobacterium bovis
RGSGLDW

SEQ ID NO: 185419 - protein, 6 aa, Mycobacterium bovis
RGSGQW

SEQ ID NO: 185420 - protein, 33 aa, Mycobacterium bovis
RGSKTARTRVGRGDGSKGKTAGRGTKGTRARKQ

SEQ ID NO: 185421 - protein, 5 aa, Mycobacterium bovis
RGSMR

SEQ ID NO: 185422 - protein, 7 aa, Mycobacterium bovis
RGSPDTC

SEQ ID NO: 185423 - protein, 9 aa, Mycobacterium bovis
RGSPGNTIN

SEQ ID NO: 185424 - protein, 8 aa, Mycobacterium bovis
RGSPPEFA

SEQ ID NO: 185425 - protein, 13 aa, Mycobacterium bovis
RGSQTSDPVETPV

SEQ ID NO: 185426 - protein, 6 aa, Mycobacterium bovis
RGSRAA

SEQ ID NO: 185427 - protein, 7 aa, Mycobacterium bovis
RGSRGIR

SEQ ID NO: 185428 - protein, 6 aa, Mycobacterium bovis
RGSRHK

SEQ ID NO: 185429 - protein, 5 aa, Mycobacterium bovis
RGSSL

SEQ ID NO: 185430 - protein, 12 aa, Mycobacterium bovis
RGSSSAAKSNEA

SEQ ID NO: 185431 - protein, 24 aa, Mycobacterium bovis
RGSTRKAAKGAASTAAAAEAGGLE

SEQ ID NO: 185432 - protein, 10 aa, Mycobacterium bovis
RGSVPASTQL

SEQ ID NO: 185433 - protein, 5 aa, Mycobacterium bovis
RGSVV

SEQ ID NO: 185434 - protein, 9 aa, Mycobacterium bovis
RGTADFANE

SEQ ID NO: 185435 - protein, 8 aa, Mycobacterium bovis
RGTAETAG

SEQ ID NO: 185436 - protein, 6 aa, Mycobacterium bovis
RGTAEY

SEQ ID NO: 185437 - protein, 11 aa, Mycobacterium bovis
RGTAGRATAHP

SEQ ID NO: 185438 - protein, 9 aa, Mycobacterium bovis
RGTDDGRLA

SEQ ID NO: 185439 - protein, 7 aa, Mycobacterium bovis
RGTDGSA

SEQ ID NO: 185440 - protein, 6 aa, Mycobacterium bovis
RGTDPL

SEQ ID NO: 185441 - protein, 6 aa, Mycobacterium bovis
RGTDQI

SEQ ID NO: 185442 - protein, 7 aa, Mycobacterium bovis
RGTDSLN

SEQ ID NO: 185443 - protein, 8 aa, Mycobacterium bovis
RGTEADRI

SEQ ID NO: 185444 - protein, 8 aa, Mycobacterium bovis
RGTGQPLA

SEQ ID NO: 185445 - protein, 7 aa, Mycobacterium bovis
RGTGSHD

SEQ ID NO: 185446 - protein, 12 aa, Mycobacterium bovis
RGTGTGISASDR

SEQ ID NO: 185447 - protein, 11 aa, Mycobacterium bovis
RGTGVSSDVET

SEQ ID NO: 185448 - protein, 5 aa, Mycobacterium bovis
RGTLG

SEQ ID NO: 185449 - protein, 7 aa, Mycobacterium bovis
RGTNGRI

SEQ ID NO: 185450 - protein, 8 aa, Mycobacterium bovis
RGTPPRLE

SEQ ID NO: 185451 - protein, 8 aa, Mycobacterium bovis
RGTSVNPV

SEQ ID NO: 185452 - protein, 10 aa, Mycobacterium bovis
RGTTQKASRI

SEQ ID NO: 185453 - protein, 10 aa, Mycobacterium bovis
RGTVPGDEDV

SEQ ID NO: 185454 - protein, 5 aa, Mycobacterium bovis
RGVGA

SEQ ID NO: 185455 - protein, 92 aa, Mycobacterium bovis
RGVGGPGGAGGAGGRGGAGGRGGAGGRGGDGGQGGRGGAGGRGGDGGIGGAAGPGGQPGQGGVGGAPGPGGTPGEPGQPGKPGQPGQPGSPG

SEQ ID NO: 185456 - protein, 7 aa, Mycobacterium bovis
RGVGPGD

SEQ ID NO: 185457 - protein, 6 aa, Mycobacterium bovis
RGVKGG

SEQ ID NO: 185458 - protein, 5 aa, Mycobacterium bovis
RGVPA

SEQ ID NO: 185459 - protein, 13 aa, Mycobacterium bovis
RGVPGDKKARSVR

SEQ ID NO: 185460 - protein, 12 aa, Mycobacterium bovis
RGVPKRSGGSGD

SEQ ID NO: 185461 - protein, 7 aa, Mycobacterium bovis
RGVRDGE

SEQ ID NO: 185462 - protein, 7 aa, Mycobacterium bovis
RGVTGGA

SEQ ID NO: 185463 - protein, 4 aa, Mycobacterium bovis
RGWG

SEQ ID NO: 185464 - protein, 5 aa, Mycobacterium bovis
RGYAY

SEQ ID NO: 185465 - protein, 9 aa, Mycobacterium bovis
RGYDGTSIE

SEQ ID NO: 185466 - protein, 11 aa, Mycobacterium bovis
RGYDSDHPRVQ

SEQ ID NO: 185467 - protein, 6 aa, Mycobacterium bovis
RGYDST

SEQ ID NO: 185468 - protein, 12 aa, Mycobacterium bovis
RGYGNTSSRDIA

SEQ ID NO: 185469 - protein, 10 aa, Mycobacterium bovis
RGYGRSSKYR

SEQ ID NO: 185470 - protein, 10 aa, Mycobacterium bovis
RGYSAGDSGV

SEQ ID NO: 185471 - protein, 9 aa, Mycobacterium bovis
RGYSGGEQR

SEQ ID NO: 185472 - protein, 11 aa, Mycobacterium bovis
RGYTSKGPSGL

SEQ ID NO: 185473 - protein, 12 aa, Mycobacterium bovis
RHAGPATAADAG

SEQ ID NO: 185474 - protein, 5 aa, Mycobacterium bovis
RHARG

SEQ ID NO: 185475 - protein, 10 aa, Mycobacterium bovis
RHDAGPADLT

SEQ ID NO: 185476 - protein, 7 aa, Mycobacterium bovis
RHDGGER

SEQ ID NO: 185477 - protein, 12 aa, Mycobacterium bovis
RHDTGYGHRPED

SEQ ID NO: 185478 - protein, 4 aa, Mycobacterium bovis
RHEY

SEQ ID NO: 185479 - protein, 6 aa, Mycobacterium bovis
RHGADD

SEQ ID NO: 185480 - protein, 7 aa, Mycobacterium bovis
RHGDHNH

SEQ ID NO: 185481 - protein, 8 aa, Mycobacterium bovis
RHGETADD

SEQ ID NO: 185482 - protein, 5 aa, Mycobacterium bovis
RHGGS

SEQ ID NO: 185483 - protein, 8 aa, Mycobacterium bovis
RHGGSGYG

SEQ ID NO: 185484 - protein, 8 aa, Mycobacterium bovis
RHGQRGPF

SEQ ID NO: 185485 - protein, 8 aa, Mycobacterium bovis
RHHKQPPL

SEQ ID NO: 185486 - protein, 6 aa, Mycobacterium bovis
RHHTER

SEQ ID NO: 185487 - protein, 4 aa, Mycobacterium bovis
RHPA

SEQ ID NO: 185488 - protein, 6 aa, Mycobacterium bovis
RHPAAE

SEQ ID NO: 185489 - protein, 7 aa, Mycobacterium bovis
RHPDASG

SEQ ID NO: 185490 - protein, 9 aa, Mycobacterium bovis
RHPDRPAGV

SEQ ID NO: 185491 - protein, 6 aa, Mycobacterium bovis
RHPDVQ

SEQ ID NO: 185492 - protein, 6 aa, Mycobacterium bovis
RHPETM

SEQ ID NO: 185493 - protein, 8 aa, Mycobacterium bovis
RHPNATAG

SEQ ID NO: 185494 - protein, 4 aa, Mycobacterium bovis
RHPR

SEQ ID NO: 185495 - protein, 13 aa, Mycobacterium bovis
RHPSRSQVLRDYL

SEQ ID NO: 185496 - protein, 5 aa, Mycobacterium bovis
RHPST

SEQ ID NO: 185497 - protein, 8 aa, Mycobacterium bovis
RHQHSSQR

SEQ ID NO: 185498 - protein, 4 aa, Mycobacterium bovis
RHQN

SEQ ID NO: 185499 - protein, 5 aa, Mycobacterium bovis
RHRGT

SEQ ID NO: 185500 - protein, 8 aa, Mycobacterium bovis
RHRHAGGE

SEQ ID NO: 185501 - protein, 7 aa, Mycobacterium bovis
RHRKRHG

SEQ ID NO: 185502 - protein, 6 aa, Mycobacterium bovis
RHRPGS

SEQ ID NO: 185503 - protein, 14 aa, Mycobacterium bovis
RHRREVENALAVLR

SEQ ID NO: 185504 - protein, 11 aa, Mycobacterium bovis
RHSEPDDEPTR

SEQ ID NO: 185505 - protein, 20 aa, Mycobacterium bovis
RHSETEPLQSINGAVAELRA

SEQ ID NO: 185506 - protein, 15 aa, Mycobacterium bovis
RHSRRGRALPARSRS

SEQ ID NO: 185507 - protein, 15 aa, Mycobacterium bovis
RHTADATVAEARQRA

SEQ ID NO: 185508 - protein, 7 aa, Mycobacterium bovis
RHTDLDP

SEQ ID NO: 185509 - protein, 9 aa, Mycobacterium bovis
RHTGGTEVE

SEQ ID NO: 185510 - protein, 9 aa, Mycobacterium bovis
RHTGKDAGV

SEQ ID NO: 185511 - protein, 5 aa, Mycobacterium bovis
RHTGS

SEQ ID NO: 185512 - protein, 17 aa, Mycobacterium bovis
RIAEETARAEGKPEQAL

SEQ ID NO: 185513 - protein, 7 aa, Mycobacterium bovis
RIARTAP

SEQ ID NO: 185514 - protein, 4 aa, Mycobacterium bovis
RIDP

SEQ ID NO: 185515 - protein, 9 aa, Mycobacterium bovis
RIEPGPGAR

SEQ ID NO: 185516 - protein, 16 aa, Mycobacterium bovis
RIGADAPAPAADPTAH

SEQ ID NO: 185517 - protein, 5 aa, Mycobacterium bovis
RIGDN

SEQ ID NO: 185518 - protein, 7 aa, Mycobacterium bovis
RIGGDQG

SEQ ID NO: 185519 - protein, 6 aa, Mycobacterium bovis
RIGPEY

SEQ ID NO: 185520 - protein, 5 aa, Mycobacterium bovis
RIGPG

SEQ ID NO: 185521 - protein, 5 aa, Mycobacterium bovis
RIGTA

SEQ ID NO: 185522 - protein, 5 aa, Mycobacterium bovis
RIPAD

SEQ ID NO: 185523 - protein, 9 aa, Mycobacterium bovis
RIPEHGDYA

SEQ ID NO: 185524 - protein, 5 aa, Mycobacterium bovis
RIPKG

SEQ ID NO: 185525 - protein, 7 aa, Mycobacterium bovis
RIPQAPN

SEQ ID NO: 185526 - protein, 5 aa, Mycobacterium bovis
RIPQG

SEQ ID NO: 185527 - protein, 4 aa, Mycobacterium bovis
RIQS

SEQ ID NO: 185528 - protein, 5 aa, Mycobacterium bovis
RIRAN

SEQ ID NO: 185529 - protein, 9 aa, Mycobacterium bovis
RISGDTSAA

SEQ ID NO: 185530 - protein, 7 aa, Mycobacterium bovis
RISPSGR

SEQ ID NO: 185531 - protein, 13 aa, Mycobacterium bovis
RISRTDTPKPSPT

SEQ ID NO: 185532 - protein, 7 aa, Mycobacterium bovis
RISSGTH

SEQ ID NO: 185533 - protein, 9 aa, Mycobacterium bovis
RITGDGGTA

SEQ ID NO: 185534 - protein, 4 aa, Mycobacterium bovis
RITP

SEQ ID NO: 185535 - protein, 6 aa, Mycobacterium bovis
RITRAE

SEQ ID NO: 185536 - protein, 4 aa, Mycobacterium bovis
RITT

SEQ ID NO: 185537 - protein, 8 aa, Mycobacterium bovis
RKAAAGSA

SEQ ID NO: 185538 - protein, 15 aa, Mycobacterium bovis
RKAATTRTPESYVQN

SEQ ID NO: 185539 - protein, 5 aa, Mycobacterium bovis
RKAFG

SEQ ID NO: 185540 - protein, 9 aa, Mycobacterium bovis
RKAGDGSAR

SEQ ID NO: 185541 - protein, 6 aa, Mycobacterium bovis
RKAHGD

SEQ ID NO: 185542 - protein, 9 aa, Mycobacterium bovis
RKAKDNRND

SEQ ID NO: 185543 - protein, 6 aa, Mycobacterium bovis
RKAQPL

SEQ ID NO: 185544 - protein, 6 aa, Mycobacterium bovis
RKATEA

SEQ ID NO: 185545 - protein, 6 aa, Mycobacterium bovis
RKATGL

SEQ ID NO: 185546 - protein, 27 aa, Mycobacterium bovis
RKDADTYAAPISRKSVRPRPHRPAGAR

SEQ ID NO: 185547 - protein, 6 aa, Mycobacterium bovis
RKDGPL

SEQ ID NO: 185548 - protein, 8 aa, Mycobacterium bovis
RKDRPEPV

SEQ ID NO: 185549 - protein, 4 aa, Mycobacterium bovis
RKEG

SEQ ID NO: 185550 - protein, 8 aa, Mycobacterium bovis
RKEGAEER

SEQ ID NO: 185551 - protein, 5 aa, Mycobacterium bovis
RKEGK

SEQ ID NO: 185552 - protein, 13 aa, Mycobacterium bovis
RKEPAKTAEAIDS

SEQ ID NO: 185553 - protein, 18 aa, Mycobacterium bovis
RKESRGGHAREDYPNRDD

SEQ ID NO: 185554 - protein, 6 aa, Mycobacterium bovis
RKFGGG

SEQ ID NO: 185555 - protein, 8 aa, Mycobacterium bovis
RKGDADAY

SEQ ID NO: 185556 - protein, 4 aa, Mycobacterium bovis
RKGE

SEQ ID NO: 185557 - protein, 15 aa, Mycobacterium bovis
RKGKPSQDRRAEEHR

SEQ ID NO: 185558 - protein, 6 aa, Mycobacterium bovis
RKGPWQ

SEQ ID NO: 185559 - protein, 6 aa, Mycobacterium bovis
RKGQDT

SEQ ID NO: 185560 - protein, 9 aa, Mycobacterium bovis
RKGRDQDRV

SEQ ID NO: 185561 - protein, 7 aa, Mycobacterium bovis
RKGRIYS

SEQ ID NO: 185562 - protein, 17 aa, Mycobacterium bovis
RKGRNNSPTAAPTDVGS

SEQ ID NO: 185563 - protein, 12 aa, Mycobacterium bovis
RKGWDGFALALV

SEQ ID NO: 185564 - protein, 10 aa, Mycobacterium bovis
RKHAANNPKA

SEQ ID NO: 185565 - protein, 7 aa, Mycobacterium bovis
RKINESR

SEQ ID NO: 185566 - protein, 17 aa, Mycobacterium bovis
RKISDGDKLAGRHGNKG

SEQ ID NO: 185567 - protein, 9 aa, Mycobacterium bovis
RKKGYGTAA

SEQ ID NO: 185568 - protein, 13 aa, Mycobacterium bovis
RKPAKLSGGQRQR

SEQ ID NO: 185569 - protein, 6 aa, Mycobacterium bovis
RKPEIA

SEQ ID NO: 185570 - protein, 7 aa, Mycobacterium bovis
RKPEQLG

SEQ ID NO: 185571 - protein, 11 aa, Mycobacterium bovis
RKPGSVTTTSA

SEQ ID NO: 185572 - protein, 26 aa, Mycobacterium bovis
RKPKPRKRGAHTGAAASGDAVTAPMQ

SEQ ID NO: 185573 - protein, 7 aa, Mycobacterium bovis
RKPNEDH

SEQ ID NO: 185574 - protein, 7 aa, Mycobacterium bovis
RKPNPHL

SEQ ID NO: 185575 - protein, 13 aa, Mycobacterium bovis
RKPSQLSGGQRQR

SEQ ID NO: 185576 - protein, 10 aa, Mycobacterium bovis
RKPTGRKTTA

SEQ ID NO: 185577 - protein, 9 aa, Mycobacterium bovis
RKPTKSPNQ

SEQ ID NO: 185578 - protein, 5 aa, Mycobacterium bovis
RKQMQ

SEQ ID NO: 185579 - protein, 7 aa, Mycobacterium bovis
RKQPGAQ

SEQ ID NO: 185580 - protein, 8 aa, Mycobacterium bovis
RKQSPTKP

SEQ ID NO: 185581 - protein, 7 aa, Mycobacterium bovis
RKRAESS

SEQ ID NO: 185582 - protein, 8 aa, Mycobacterium bovis
RKRDANGA

SEQ ID NO: 185583 - protein, 9 aa, Mycobacterium bovis
RKRGDRDRS

SEQ ID NO: 185584 - protein, 8 aa, Mycobacterium bovis
RKRKEKAL

SEQ ID NO: 185585 - protein, 17 aa, Mycobacterium bovis
RKRPGSPAAQASKRASE

SEQ ID NO: 185586 - protein, 9 aa, Mycobacterium bovis
RKRPPDLAA

SEQ ID NO: 185587 - protein, 6 aa, Mycobacterium bovis
RKRYER

SEQ ID NO: 185588 - protein, 19 aa, Mycobacterium bovis
RKSDREALTRAGSEPPSGD

SEQ ID NO: 185589 - protein, 8 aa, Mycobacterium bovis
RKSPGKDY

SEQ ID NO: 185590 - protein, 5 aa, Mycobacterium bovis
RKSRS

SEQ ID NO: 185591 - protein, 6 aa, Mycobacterium bovis
RKTARR

SEQ ID NO: 185592 - protein, 4 aa, Mycobacterium bovis
RKTD

SEQ ID NO: 185593 - protein, 7 aa, Mycobacterium bovis
RKTGKTA

SEQ ID NO: 185594 - protein, 5 aa, Mycobacterium bovis
RKTTV

SEQ ID NO: 185595 - protein, 7 aa, Mycobacterium bovis
RKTYGKG

SEQ ID NO: 185596 - protein, 6 aa, Mycobacterium bovis
RKVGDQ

SEQ ID NO: 185597 - protein, 12 aa, Mycobacterium bovis
RKVGEAPVNSEE

SEQ ID NO: 185598 - protein, 13 aa, Mycobacterium bovis
RKVTRRRGALSLV

SEQ ID NO: 185599 - protein, 6 aa, Mycobacterium bovis
RKYDPD

SEQ ID NO: 185600 - protein, 4 aa, Mycobacterium bovis
RKYS

SEQ ID NO: 185601 - protein, 15 aa, Mycobacterium bovis
RLAAAPGLPCEIKLV

SEQ ID NO: 185602 - protein, 5 aa, Mycobacterium bovis
RLAAG

SEQ ID NO: 185603 - protein, 5 aa, Mycobacterium bovis
RLAAP

SEQ ID NO: 185604 - protein, 8 aa, Mycobacterium bovis
RLADTTGA

SEQ ID NO: 185605 - protein, 10 aa, Mycobacterium bovis
RLAETSTRAT

SEQ ID NO: 185606 - protein, 5 aa, Mycobacterium bovis
RLAPG

SEQ ID NO: 185607 - protein, 9 aa, Mycobacterium bovis
RLAPKGTGA

SEQ ID NO: 185608 - protein, 6 aa, Mycobacterium bovis
RLARAG

SEQ ID NO: 185609 - protein, 16 aa, Mycobacterium bovis
RLASEKNGVMICTDCA

SEQ ID NO: 185610 - protein, 8 aa, Mycobacterium bovis
RLASGAAR

SEQ ID NO: 185611 - protein, 4 aa, Mycobacterium bovis
RLDN

SEQ ID NO: 185612 - protein, 6 aa, Mycobacterium bovis
RLDNSN

SEQ ID NO: 185613 - protein, 5 aa, Mycobacterium bovis
RLDPD

SEQ ID NO: 185614 - protein, 4 aa, Mycobacterium bovis
RLDR

SEQ ID NO: 185615 - protein, 11 aa, Mycobacterium bovis
RLDTTNHEAAR

SEQ ID NO: 185616 - protein, 5 aa, Mycobacterium bovis
RLEEG

SEQ ID NO: 185617 - protein, 91 aa, Mycobacterium bovis
RLEPTTPHLEPPATPPRPGPQPPRIEPPESGHPAPAPAAKPAPVPANGPLPHSPTESKPPPVDRPAEPVAPSSASAGQPRVSAATTPGTHV

SEQ ID NO: 185618 - protein, 6 aa, Mycobacterium bovis
RLESAR

SEQ ID NO: 185619 - protein, 6 aa, Mycobacterium bovis
RLGAPR

SEQ ID NO: 185620 - protein, 11 aa, Mycobacterium bovis
RLGARTTGYDV

SEQ ID NO: 185621 - protein, 4 aa, Mycobacterium bovis
RLGE

SEQ ID NO: 185622 - protein, 16 aa, Mycobacterium bovis
RLGEPRSNGCSYADSP

SEQ ID NO: 185623 - protein, 14 aa, Mycobacterium bovis
RLGLSGTRAVLDGL

SEQ ID NO: 185624 - protein, 16 aa, Mycobacterium bovis
RLGNASRRRDQGRQRG

SEQ ID NO: 185625 - protein, 4 aa, Mycobacterium bovis
RLGP

SEQ ID NO: 185626 - protein, 13 aa, Mycobacterium bovis
RLGPGGISGPPLA

SEQ ID NO: 185627 - protein, 7 aa, Mycobacterium bovis
RLGPTDA

SEQ ID NO: 185628 - protein, 5 aa, Mycobacterium bovis
RLGRR

SEQ ID NO: 185629 - protein, 8 aa, Mycobacterium bovis
RLNGSRNP

SEQ ID NO: 185630 - protein, 7 aa, Mycobacterium bovis
RLPDAAT

SEQ ID NO: 185631 - protein, 11 aa, Mycobacterium bovis
RLPDGQVKTDR

SEQ ID NO: 185632 - protein, 6 aa, Mycobacterium bovis
RLPDGT

SEQ ID NO: 185633 - protein, 7 aa, Mycobacterium bovis
RLPDGVS

SEQ ID NO: 185634 - protein, 5 aa, Mycobacterium bovis
RLPPA

SEQ ID NO: 185635 - protein, 7 aa, Mycobacterium bovis
RLPPTDL

SEQ ID NO: 185636 - protein, 5 aa, Mycobacterium bovis
RLPRT

SEQ ID NO: 185637 - protein, 6 aa, Mycobacterium bovis
RLPTEA

SEQ ID NO: 185638 - protein, 14 aa, Mycobacterium bovis
RLPTGDDHGGGDTL

SEQ ID NO: 185639 - protein, 15 aa, Mycobacterium bovis
RLQDGEPYLAGTART

SEQ ID NO: 185640 - protein, 5 aa, Mycobacterium bovis
RLRGG

SEQ ID NO: 185641 - protein, 14 aa, Mycobacterium bovis
RLRREPGLTCHTEF

SEQ ID NO: 185642 - protein, 6 aa, Mycobacterium bovis
RLSDKS

SEQ ID NO: 185643 - protein, 4 aa, Mycobacterium bovis
RLSG

SEQ ID NO: 185644 - protein, 6 aa, Mycobacterium bovis
RLSGGQ

SEQ ID NO: 185645 - protein, 9 aa, Mycobacterium bovis
RLSRPDGSV

SEQ ID NO: 185646 - protein, 7 aa, Mycobacterium bovis
RLSRRGR

SEQ ID NO: 185647 - protein, 10 aa, Mycobacterium bovis
RLSSNNAQQE

SEQ ID NO: 185648 - protein, 7 aa, Mycobacterium bovis
RLTADGQ

SEQ ID NO: 185649 - protein, 6 aa, Mycobacterium bovis
RLTDER

SEQ ID NO: 185650 - protein, 9 aa, Mycobacterium bovis
RLTDGHGRT

SEQ ID NO: 185651 - protein, 10 aa, Mycobacterium bovis
RLTDGQGRTV

SEQ ID NO: 185652 - protein, 13 aa, Mycobacterium bovis
RLTENADSTGVDN

SEQ ID NO: 185653 - protein, 5 aa, Mycobacterium bovis
RLTES

SEQ ID NO: 185654 - protein, 7 aa, Mycobacterium bovis
RLTGGQL

SEQ ID NO: 185655 - protein, 8 aa, Mycobacterium bovis
RLTGSSDL

SEQ ID NO: 185656 - protein, 16 aa, Mycobacterium bovis
RLTPPSPKAVAQHLPR

SEQ ID NO: 185657 - protein, 7 aa, Mycobacterium bovis
RLTREEE

SEQ ID NO: 185658 - protein, 6 aa, Mycobacterium bovis
RMAPPE

SEQ ID NO: 185659 - protein, 7 aa, Mycobacterium bovis
RMAQPGD

SEQ ID NO: 185660 - protein, 6 aa, Mycobacterium bovis
RMGDGE

SEQ ID NO: 185661 - protein, 6 aa, Mycobacterium bovis
RMGSKS

SEQ ID NO: 185662 - protein, 4 aa, Mycobacterium bovis
RMPG

SEQ ID NO: 185663 - protein, 5 aa, Mycobacterium bovis
RMRAE

SEQ ID NO: 185664 - protein, 15 aa, Mycobacterium bovis
RNAAGKVSKPQLREL

SEQ ID NO: 185665 - protein, 8 aa, Mycobacterium bovis
RNAAGTPV

SEQ ID NO: 185666 - protein, 10 aa, Mycobacterium bovis
RNAAPSGTAA

SEQ ID NO: 185667 - protein, 5 aa, Mycobacterium bovis
RNADG

SEQ ID NO: 185668 - protein, 9 aa, Mycobacterium bovis
RNADNSIGA

SEQ ID NO: 185669 - protein, 8 aa, Mycobacterium bovis
RNAEDALQ

SEQ ID NO: 185670 - protein, 8 aa, Mycobacterium bovis
RNAESDSG

SEQ ID NO: 185671 - protein, 8 aa, Mycobacterium bovis
RNAGRREK

SEQ ID NO: 185672 - protein, 9 aa, Mycobacterium bovis
RNAKRAVKS

SEQ ID NO: 185673 - protein, 14 aa, Mycobacterium bovis
RNAPLTRPRPGHAD

SEQ ID NO: 185674 - protein, 6 aa, Mycobacterium bovis
RNAQVD

SEQ ID NO: 185675 - protein, 9 aa, Mycobacterium bovis
RNATESGGR

SEQ ID NO: 185676 - protein, 7 aa, Mycobacterium bovis
RNDPDFS

SEQ ID NO: 185677 - protein, 7 aa, Mycobacterium bovis
RNEEDPR

SEQ ID NO: 185678 - protein, 6 aa, Mycobacterium bovis
RNENDP

SEQ ID NO: 185679 - protein, 9 aa, Mycobacterium bovis
RNENGGRRW

SEQ ID NO: 185680 - protein, 8 aa, Mycobacterium bovis
RNEPASYL

SEQ ID NO: 185681 - protein, 9 aa, Mycobacterium bovis
RNGAGKTTT

SEQ ID NO: 185682 - protein, 8 aa, Mycobacterium bovis
RNGDGKSS

SEQ ID NO: 185683 - protein, 11 aa, Mycobacterium bovis
RNGGTMADPGS

SEQ ID NO: 185684 - protein, 15 aa, Mycobacterium bovis
RNGIGTGISASDRAT

SEQ ID NO: 185685 - protein, 9 aa, Mycobacterium bovis
RNGKGQKKL

SEQ ID NO: 185686 - protein, 10 aa, Mycobacterium bovis
RNGPNPVAEV

SEQ ID NO: 185687 - protein, 8 aa, Mycobacterium bovis
RNGPPYSP

SEQ ID NO: 185688 - protein, 8 aa, Mycobacterium bovis
RNGPTKTV

SEQ ID NO: 185689 - protein, 11 aa, Mycobacterium bovis
RNGQTDAAVGA

SEQ ID NO: 185690 - protein, 7 aa, Mycobacterium bovis
RNGSGPV

SEQ ID NO: 185691 - protein, 8 aa, Mycobacterium bovis
RNGTRGAD

SEQ ID NO: 185692 - protein, 7 aa, Mycobacterium bovis
RNKAGSL

SEQ ID NO: 185693 - protein, 8 aa, Mycobacterium bovis
RNKDYSQQ

SEQ ID NO: 185694 - protein, 6 aa, Mycobacterium bovis
RNKPND

SEQ ID NO: 185695 - protein, 7 aa, Mycobacterium bovis
RNKPTTA

SEQ ID NO: 185696 - protein, 6 aa, Mycobacterium bovis
RNKQQR

SEQ ID NO: 185697 - protein, 7 aa, Mycobacterium bovis
RNNGPEL

SEQ ID NO: 185698 - protein, 6 aa, Mycobacterium bovis
RNNIDT

SEQ ID NO: 185699 - protein, 8 aa, Mycobacterium bovis
RNPAIEPA

SEQ ID NO: 185700 - protein, 5 aa, Mycobacterium bovis
RNPAL

SEQ ID NO: 185701 - protein, 10 aa, Mycobacterium bovis
RNPDPDEQTI

SEQ ID NO: 185702 - protein, 4 aa, Mycobacterium bovis
RNPG

SEQ ID NO: 185703 - protein, 5 aa, Mycobacterium bovis
RNPGQ

SEQ ID NO: 185704 - protein, 7 aa, Mycobacterium bovis
RNPKLGA

SEQ ID NO: 185705 - protein, 9 aa, Mycobacterium bovis
RNPLHSDPE

SEQ ID NO: 185706 - protein, 6 aa, Mycobacterium bovis
RNPNPH

SEQ ID NO: 185707 - protein, 6 aa, Mycobacterium bovis
RNPPQA

SEQ ID NO: 185708 - protein, 4 aa, Mycobacterium bovis
RNPQ

SEQ ID NO: 185709 - protein, 7 aa, Mycobacterium bovis
RNQGDRE

SEQ ID NO: 185710 - protein, 11 aa, Mycobacterium bovis
RNRDRASELRS

SEQ ID NO: 185711 - protein, 7 aa, Mycobacterium bovis
RNRHDPR

SEQ ID NO: 185712 - protein, 5 aa, Mycobacterium bovis
RNRPL

SEQ ID NO: 185713 - protein, 8 aa, Mycobacterium bovis
RNRRSATD

SEQ ID NO: 185714 - protein, 4 aa, Mycobacterium bovis
RNRS

SEQ ID NO: 185715 - protein, 5 aa, Mycobacterium bovis
RNSAN

SEQ ID NO: 185716 - protein, 7 aa, Mycobacterium bovis
RNSDKAA

SEQ ID NO: 185717 - protein, 7 aa, Mycobacterium bovis
RNSEGKA

SEQ ID NO: 185718 - protein, 8 aa, Mycobacterium bovis
RNSKESRA

SEQ ID NO: 185719 - protein, 14 aa, Mycobacterium bovis
RNSPDGDEPLPADG

SEQ ID NO: 185720 - protein, 6 aa, Mycobacterium bovis
RNSPQQ

SEQ ID NO: 185721 - protein, 6 aa, Mycobacterium bovis
RNSTLD

SEQ ID NO: 185722 - protein, 4 aa, Mycobacterium bovis
RNTD

SEQ ID NO: 185723 - protein, 24 aa, Mycobacterium bovis
RNTGWSNSGLTNTGAFNAGSLNTG

SEQ ID NO: 185724 - protein, 4 aa, Mycobacterium bovis
RNTL

SEQ ID NO: 185725 - protein, 5 aa, Mycobacterium bovis
RNTPR

SEQ ID NO: 185726 - protein, 5 aa, Mycobacterium bovis
RNTRD

SEQ ID NO: 185727 - protein, 6 aa, Mycobacterium bovis
RNTYAD

SEQ ID NO: 185728 - protein, 12 aa, Mycobacterium bovis
RNYTAPGGGQFT

SEQ ID NO: 185729 - protein, 4 aa, Mycobacterium bovis
RPAA

SEQ ID NO: 185730 - protein, 5 aa, Mycobacterium bovis
RPAAG

SEQ ID NO: 185731 - protein, 7 aa, Mycobacterium bovis
RPAARTD

SEQ ID NO: 185732 - protein, 20 aa, Mycobacterium bovis
RPAAVSDLSGPGKPTLAGRL

SEQ ID NO: 185733 - protein, 8 aa, Mycobacterium bovis
RPADGPPA

SEQ ID NO: 185734 - protein, 5 aa, Mycobacterium bovis
RPADI

SEQ ID NO: 185735 - protein, 11 aa, Mycobacterium bovis
RPADPADVPGG

SEQ ID NO: 185736 - protein, 13 aa, Mycobacterium bovis
RPAEHGPDDPGGV

SEQ ID NO: 185737 - protein, 4 aa, Mycobacterium bovis
RPAG

SEQ ID NO: 185738 - protein, 8 aa, Mycobacterium bovis
RPAGRARS

SEQ ID NO: 185739 - protein, 5 aa, Mycobacterium bovis
RPAGT

SEQ ID NO: 185740 - protein, 6 aa, Mycobacterium bovis
RPAGTR

SEQ ID NO: 185741 - protein, 7 aa, Mycobacterium bovis
RPAITTA

SEQ ID NO: 185742 - protein, 6 aa, Mycobacterium bovis
RPANNL

SEQ ID NO: 185743 - protein, 4 aa, Mycobacterium bovis
RPAP

SEQ ID NO: 185744 - protein, 5 aa, Mycobacterium bovis
RPAPL

SEQ ID NO: 185745 - protein, 8 aa, Mycobacterium bovis
RPAPYSVA

SEQ ID NO: 185746 - protein, 34 aa, Mycobacterium bovis
RPARGRPPAADPDDEDADPGRDGMQEPLVDPLRS

SEQ ID NO: 185747 - protein, 6 aa, Mycobacterium bovis
RPASFG

SEQ ID NO: 185748 - protein, 5 aa, Mycobacterium bovis
RPASW

SEQ ID NO: 185749 - protein, 6 aa, Mycobacterium bovis
RPATAA

SEQ ID NO: 185750 - protein, 6 aa, Mycobacterium bovis
RPATCG

SEQ ID NO: 185751 - protein, 6 aa, Mycobacterium bovis
RPATSR

SEQ ID NO: 185752 - protein, 4 aa, Mycobacterium bovis
RPAV

SEQ ID NO: 185753 - protein, 14 aa, Mycobacterium bovis
RPAYSNADAARQVA

SEQ ID NO: 185754 - protein, 25 aa, Mycobacterium bovis
RPDAASGRRGKPQPSPVAREAAERG

SEQ ID NO: 185755 - protein, 10 aa, Mycobacterium bovis
RPDAGKTGPT

SEQ ID NO: 185756 - protein, 7 aa, Mycobacterium bovis
RPDAGPS

SEQ ID NO: 185757 - protein, 11 aa, Mycobacterium bovis
RPDANLAQGNL

SEQ ID NO: 185758 - protein, 6 aa, Mycobacterium bovis
RPDAPM

SEQ ID NO: 185759 - protein, 7 aa, Mycobacterium bovis
RPDARSA

SEQ ID NO: 185760 - protein, 10 aa, Mycobacterium bovis
RPDDERRNRS

SEQ ID NO: 185761 - protein, 5 aa, Mycobacterium bovis
RPDDT

SEQ ID NO: 185762 - protein, 7 aa, Mycobacterium bovis
RPDERAH

SEQ ID NO: 185763 - protein, 11 aa, Mycobacterium bovis
RPDETGAEPDW

SEQ ID NO: 185764 - protein, 10 aa, Mycobacterium bovis
RPDGSHGDTS

SEQ ID NO: 185765 - protein, 7 aa, Mycobacterium bovis
RPDLPPT

SEQ ID NO: 185766 - protein, 8 aa, Mycobacterium bovis
RPDPRDPT

SEQ ID NO: 185767 - protein, 15 aa, Mycobacterium bovis
RPDPRLGSANAALST

SEQ ID NO: 185768 - protein, 10 aa, Mycobacterium bovis
RPDPVEPTQA

SEQ ID NO: 185769 - protein, 17 aa, Mycobacterium bovis
RPDPVRPVRSAAVSVSS

SEQ ID NO: 185770 - protein, 25 aa, Mycobacterium bovis
RPDPYKGKGVRYEGEQIRRKVGKTG

SEQ ID NO: 185771 - protein, 7 aa, Mycobacterium bovis
RPDRSTT

SEQ ID NO: 185772 - protein, 7 aa, Mycobacterium bovis
RPDSPSV

SEQ ID NO: 185773 - protein, 8 aa, Mycobacterium bovis
RPDSPTAE

SEQ ID NO: 185774 - protein, 7 aa, Mycobacterium bovis
RPDYQPR

SEQ ID NO: 185775 - protein, 6 aa, Mycobacterium bovis
RPEEVA

SEQ ID NO: 185776 - protein, 6 aa, Mycobacterium bovis
RPEEVT

SEQ ID NO: 185777 - protein, 9 aa, Mycobacterium bovis
RPEFQSPDG

SEQ ID NO: 185778 - protein, 8 aa, Mycobacterium bovis
RPEGGWTP

SEQ ID NO: 185779 - protein, 12 aa, Mycobacterium bovis
RPEGNANPEIAT

SEQ ID NO: 185780 - protein, 5 aa, Mycobacterium bovis
RPEIS

SEQ ID NO: 185781 - protein, 4 aa, Mycobacterium bovis
RPEL

SEQ ID NO: 185782 - protein, 11 aa, Mycobacterium bovis
RPENPDRTAGA

SEQ ID NO: 185783 - protein, 4 aa, Mycobacterium bovis
RPEP

SEQ ID NO: 185784 - protein, 7 aa, Mycobacterium bovis
RPEPKRA

SEQ ID NO: 185785 - protein, 6 aa, Mycobacterium bovis
RPEPPS

SEQ ID NO: 185786 - protein, 5 aa, Mycobacterium bovis
RPERF

SEQ ID NO: 185787 - protein, 6 aa, Mycobacterium bovis
RPERHR

SEQ ID NO: 185788 - protein, 8 aa, Mycobacterium bovis
RPERRNAL

SEQ ID NO: 185789 - protein, 6 aa, Mycobacterium bovis
RPERRR

SEQ ID NO: 185790 - protein, 5 aa, Mycobacterium bovis
RPESP

SEQ ID NO: 185791 - protein, 4 aa, Mycobacterium bovis
RPET

SEQ ID NO: 185792 - protein, 12 aa, Mycobacterium bovis
RPETGLRPPRPG

SEQ ID NO: 185793 - protein, 4 aa, Mycobacterium bovis
RPEV

SEQ ID NO: 185794 - protein, 6 aa, Mycobacterium bovis
RPEYGG

SEQ ID NO: 185795 - protein, 12 aa, Mycobacterium bovis
RPFDQPGCPMAA

SEQ ID NO: 185796 - protein, 6 aa, Mycobacterium bovis
RPGAAD

SEQ ID NO: 185797 - protein, 20 aa, Mycobacterium bovis
RPGATEPSDPALLAKIHANS

SEQ ID NO: 185798 - protein, 7 aa, Mycobacterium bovis
RPGAVTR

SEQ ID NO: 185799 - protein, 7 aa, Mycobacterium bovis
RPGDDLS

SEQ ID NO: 185800 - protein, 5 aa, Mycobacterium bovis
RPGDL

SEQ ID NO: 185801 - protein, 9 aa, Mycobacterium bovis
RPGDLSPGD

SEQ ID NO: 185802 - protein, 4 aa, Mycobacterium bovis
RPGE

SEQ ID NO: 185803 - protein, 13 aa, Mycobacterium bovis
RPGEPPTKESAQT

SEQ ID NO: 185804 - protein, 16 aa, Mycobacterium bovis
RPGEPSWPSPFGPGRP

SEQ ID NO: 185805 - protein, 7 aa, Mycobacterium bovis
RPGERNG

SEQ ID NO: 185806 - protein, 5 aa, Mycobacterium bovis
RPGET

SEQ ID NO: 185807 - protein, 15 aa, Mycobacterium bovis
RPGGGAKLARSAGSS

SEQ ID NO: 185808 - protein, 5 aa, Mycobacterium bovis
RPGGL

SEQ ID NO: 185809 - protein, 5 aa, Mycobacterium bovis
RPGGP

SEQ ID NO: 185810 - protein, 14 aa, Mycobacterium bovis
RPGGTAEPAPTREE

SEQ ID NO: 185811 - protein, 4 aa, Mycobacterium bovis
RPGH

SEQ ID NO: 185812 - protein, 13 aa, Mycobacterium bovis
RPGIPPTRPVQGP

SEQ ID NO: 185813 - protein, 10 aa, Mycobacterium bovis
RPGISTEPEA

SEQ ID NO: 185814 - protein, 7 aa, Mycobacterium bovis
RPGKFGG

SEQ ID NO: 185815 - protein, 14 aa, Mycobacterium bovis
RPGKYAHSHEAGRS

SEQ ID NO: 185816 - protein, 5 aa, Mycobacterium bovis
RPGNQ

SEQ ID NO: 185817 - protein, 7 aa, Mycobacterium bovis
RPGPDAQ

SEQ ID NO: 185818 - protein, 9 aa, Mycobacterium bovis
RPGPEFRPS

SEQ ID NO: 185819 - protein, 10 aa, Mycobacterium bovis
RPGPMDTGPL

SEQ ID NO: 185820 - protein, 15 aa, Mycobacterium bovis
RPGPPPARTGADRTS

SEQ ID NO: 185821 - protein, 6 aa, Mycobacterium bovis
RPGPRR

SEQ ID NO: 185822 - protein, 6 aa, Mycobacterium bovis
RPGPTM

SEQ ID NO: 185823 - protein, 5 aa, Mycobacterium bovis
RPGQI

SEQ ID NO: 185824 - protein, 5 aa, Mycobacterium bovis
RPGQR

SEQ ID NO: 185825 - protein, 5 aa, Mycobacterium bovis
RPGRI

SEQ ID NO: 185826 - protein, 8 aa, Mycobacterium bovis
RPGSDVEE

SEQ ID NO: 185827 - protein, 8 aa, Mycobacterium bovis
RPGSSTFD

SEQ ID NO: 185828 - protein, 6 aa, Mycobacterium bovis
RPGTRY

SEQ ID NO: 185829 - protein, 8 aa, Mycobacterium bovis
RPGVGKST

SEQ ID NO: 185830 - protein, 5 aa, Mycobacterium bovis
RPGYE

SEQ ID NO: 185831 - protein, 9 aa, Mycobacterium bovis
RPHAPTGAQ

SEQ ID NO: 185832 - protein, 29 aa, Mycobacterium bovis
RPHRESAHDPLDGDPATRTQTERGGAERG

SEQ ID NO: 185833 - protein, 12 aa, Mycobacterium bovis
RPHRVTHRKLTR

SEQ ID NO: 185834 - protein, 8 aa, Mycobacterium bovis
RPHSAEEA

SEQ ID NO: 185835 - protein, 6 aa, Mycobacterium bovis
RPHSGT

SEQ ID NO: 185836 - protein, 9 aa, Mycobacterium bovis
RPIGGPDAA

SEQ ID NO: 185837 - protein, 9 aa, Mycobacterium bovis
RPIQDSPGR

SEQ ID NO: 185838 - protein, 13 aa, Mycobacterium bovis
RPITGDDPARPRE

SEQ ID NO: 185839 - protein, 11 aa, Mycobacterium bovis
RPKDDEGGGNA

SEQ ID NO: 185840 - protein, 5 aa, Mycobacterium bovis
RPKPL

SEQ ID NO: 185841 - protein, 10 aa, Mycobacterium bovis
RPKQRNAQTR

SEQ ID NO: 185842 - protein, 8 aa, Mycobacterium bovis
RPKSPADV

SEQ ID NO: 185843 - protein, 10 aa, Mycobacterium bovis
RPKTQRESLG

SEQ ID NO: 185844 - protein, 7 aa, Mycobacterium bovis
RPLDKSR

SEQ ID NO: 185845 - protein, 11 aa, Mycobacterium bovis
RPLGQPRTIPA

SEQ ID NO: 185846 - protein, 5 aa, Mycobacterium bovis
RPLGT

SEQ ID NO: 185847 - protein, 8 aa, Mycobacterium bovis
RPLGYDDS

SEQ ID NO: 185848 - protein, 5 aa, Mycobacterium bovis
RPLNT

SEQ ID NO: 185849 - protein, 6 aa, Mycobacterium bovis
RPLPGR

SEQ ID NO: 185850 - protein, 20 aa, Mycobacterium bovis
RPLTKKPAETRMGSGKGSPE

SEQ ID NO: 185851 - protein, 6 aa, Mycobacterium bovis
RPLTNV

SEQ ID NO: 185852 - protein, 7 aa, Mycobacterium bovis
RPMNPPS

SEQ ID NO: 185853 - protein, 5 aa, Mycobacterium bovis
RPMPG

SEQ ID NO: 185854 - protein, 6 aa, Mycobacterium bovis
RPMTPD

SEQ ID NO: 185855 - protein, 5 aa, Mycobacterium bovis
RPNAG

SEQ ID NO: 185856 - protein, 5 aa, Mycobacterium bovis
RPNDV

SEQ ID NO: 185857 - protein, 8 aa, Mycobacterium bovis
RPNGNLSQ

SEQ ID NO: 185858 - protein, 5 aa, Mycobacterium bovis
RPNNE

SEQ ID NO: 185859 - protein, 9 aa, Mycobacterium bovis
RPNRGDGRM

SEQ ID NO: 185860 - protein, 7 aa, Mycobacterium bovis
RPNRTNR

SEQ ID NO: 185861 - protein, 10 aa, Mycobacterium bovis
RPNTGKSTLT

SEQ ID NO: 185862 - protein, 7 aa, Mycobacterium bovis
RPNTNNV

SEQ ID NO: 185863 - protein, 4 aa, Mycobacterium bovis
RPNV

SEQ ID NO: 185864 - protein, 7 aa, Mycobacterium bovis
RPNVGKS

SEQ ID NO: 185865 - protein, 4 aa, Mycobacterium bovis
RPPA

SEQ ID NO: 185866 - protein, 7 aa, Mycobacterium bovis
RPPAGAP

SEQ ID NO: 185867 - protein, 19 aa, Mycobacterium bovis
RPPAPAALPGTPQARGESI

SEQ ID NO: 185868 - protein, 13 aa, Mycobacterium bovis
RPPDARAESTPWP

SEQ ID NO: 185869 - protein, 5 aa, Mycobacterium bovis
RPPDV

SEQ ID NO: 185870 - protein, 5 aa, Mycobacterium bovis
RPPEL

SEQ ID NO: 185871 - protein, 9 aa, Mycobacterium bovis
RPPGREAYP

SEQ ID NO: 185872 - protein, 7 aa, Mycobacterium bovis
RPPGSDR

SEQ ID NO: 185873 - protein, 7 aa, Mycobacterium bovis
RPPHEEL

SEQ ID NO: 185874 - protein, 9 aa, Mycobacterium bovis
RPPKEGGYG

SEQ ID NO: 185875 - protein, 4 aa, Mycobacterium bovis
RPPM

SEQ ID NO: 185876 - protein, 6 aa, Mycobacterium bovis
RPPPTF

SEQ ID NO: 185877 - protein, 9 aa, Mycobacterium bovis
RPPRASFDA

SEQ ID NO: 185878 - protein, 19 aa, Mycobacterium bovis
RPPRRNASRRINTDQTSTK

SEQ ID NO: 185879 - protein, 7 aa, Mycobacterium bovis
RPPRSTL

SEQ ID NO: 185880 - protein, 20 aa, Mycobacterium bovis
RPPRTRSGAALPRSSDPVTD

SEQ ID NO: 185881 - protein, 4 aa, Mycobacterium bovis
RPPS

SEQ ID NO: 185882 - protein, 5 aa, Mycobacterium bovis
RPPSM

SEQ ID NO: 185883 - protein, 7 aa, Mycobacterium bovis
RPPTNAM

SEQ ID NO: 185884 - protein, 11 aa, Mycobacterium bovis
RPPVPSLEPPY

SEQ ID NO: 185885 - protein, 34 aa, Mycobacterium bovis
RPPVTTPPATPPTPTGPISGAAVTPSSPAAGGSL

SEQ ID NO: 185886 - protein, 13 aa, Mycobacterium bovis
RPQGELDESSRAA

SEQ ID NO: 185887 - protein, 11 aa, Mycobacterium bovis
RPQHPSQSVDH

SEQ ID NO: 185888 - protein, 5 aa, Mycobacterium bovis
RPQPA

SEQ ID NO: 185889 - protein, 14 aa, Mycobacterium bovis
RPQQPKVTDPGSRV

SEQ ID NO: 185890 - protein, 8 aa, Mycobacterium bovis
RPQQPKVV

SEQ ID NO: 185891 - protein, 14 aa, Mycobacterium bovis
RPQQPNVAQPGSRV

SEQ ID NO: 185892 - protein, 9 aa, Mycobacterium bovis
RPQQPNVEL

SEQ ID NO: 185893 - protein, 10 aa, Mycobacterium bovis
RPQSVTGPTG

SEQ ID NO: 185894 - protein, 6 aa, Mycobacterium bovis
RPQVQE

SEQ ID NO: 185895 - protein, 8 aa, Mycobacterium bovis
RPRAGKVD

SEQ ID NO: 185896 - protein, 10 aa, Mycobacterium bovis
RPRAQSRGTA

SEQ ID NO: 185897 - protein, 6 aa, Mycobacterium bovis
RPRDEL

SEQ ID NO: 185898 - protein, 7 aa, Mycobacterium bovis
RPRGAGG

SEQ ID NO: 185899 - protein, 8 aa, Mycobacterium bovis
RPRGAGME

SEQ ID NO: 185900 - protein, 7 aa, Mycobacterium bovis
RPRHPDD

SEQ ID NO: 185901 - protein, 6 aa, Mycobacterium bovis
RPRKSL

SEQ ID NO: 185902 - protein, 12 aa, Mycobacterium bovis
RPRLDNPTDDVR

SEQ ID NO: 185903 - protein, 10 aa, Mycobacterium bovis
RPRPDAPPGA

SEQ ID NO: 185904 - protein, 5 aa, Mycobacterium bovis
RPRPG

SEQ ID NO: 185905 - protein, 7 aa, Mycobacterium bovis
RPRPVTA

SEQ ID NO: 185906 - protein, 4 aa, Mycobacterium bovis
RPRQ

SEQ ID NO: 185907 - protein, 7 aa, Mycobacterium bovis
RPRSEQD

SEQ ID NO: 185908 - protein, 7 aa, Mycobacterium bovis
RPRTQSS

SEQ ID NO: 185909 - protein, 4 aa, Mycobacterium bovis
RPSA

SEQ ID NO: 185910 - protein, 23 aa, Mycobacterium bovis
RPSAIGSQLPDADTLDTRQPPLQ

SEQ ID NO: 185911 - protein, 9 aa, Mycobacterium bovis
RPSDTNTAG

SEQ ID NO: 185912 - protein, 6 aa, Mycobacterium bovis
RPSETA

SEQ ID NO: 185913 - protein, 11 aa, Mycobacterium bovis
RPSGNGPTAIA

SEQ ID NO: 185914 - protein, 8 aa, Mycobacterium bovis
RPSGRGTD

SEQ ID NO: 185915 - protein, 7 aa, Mycobacterium bovis
RPSGTED

SEQ ID NO: 185916 - protein, 10 aa, Mycobacterium bovis
RPSHITNPAG

SEQ ID NO: 185917 - protein, 12 aa, Mycobacterium bovis
RPSNPASHRGKG

SEQ ID NO: 185918 - protein, 11 aa, Mycobacterium bovis
RPSPESGPPVH

SEQ ID NO: 185919 - protein, 17 aa, Mycobacterium bovis
RPSPTSGTLGGVTRATR

SEQ ID NO: 185920 - protein, 5 aa, Mycobacterium bovis
RPSRG

SEQ ID NO: 185921 - protein, 4 aa, Mycobacterium bovis
RPSS

SEQ ID NO: 185922 - protein, 6 aa, Mycobacterium bovis
RPSSGY

SEQ ID NO: 185923 - protein, 6 aa, Mycobacterium bovis
RPSSLN

SEQ ID NO: 185924 - protein, 8 aa, Mycobacterium bovis
RPSSSRDT

SEQ ID NO: 185925 - protein, 6 aa, Mycobacterium bovis
RPSTRR

SEQ ID NO: 185926 - protein, 10 aa, Mycobacterium bovis
RPSTTKTTVT

SEQ ID NO: 185927 - protein, 7 aa, Mycobacterium bovis
RPTADDL

SEQ ID NO: 185928 - protein, 5 aa, Mycobacterium bovis
RPTGE

SEQ ID NO: 185929 - protein, 7 aa, Mycobacterium bovis
RPTGQRD

SEQ ID NO: 185930 - protein, 12 aa, Mycobacterium bovis
RPTGRGGEREIA

SEQ ID NO: 185931 - protein, 9 aa, Mycobacterium bovis
RPTKGGSAL

SEQ ID NO: 185932 - protein, 5 aa, Mycobacterium bovis
RPTLK

SEQ ID NO: 185933 - protein, 8 aa, Mycobacterium bovis
RPTPSANS

SEQ ID NO: 185934 - protein, 7 aa, Mycobacterium bovis
RPTPVAG

SEQ ID NO: 185935 - protein, 6 aa, Mycobacterium bovis
RPTPVL

SEQ ID NO: 185936 - protein, 11 aa, Mycobacterium bovis
RPTYDDAARSQ

SEQ ID NO: 185937 - protein, 13 aa, Mycobacterium bovis
RPVGKASASRPPL

SEQ ID NO: 185938 - protein, 12 aa, Mycobacterium bovis
RPVPGPESEAGP

SEQ ID NO: 185939 - protein, 30 aa, Mycobacterium bovis
RPVRGEGATRSRGPSGPSNRNVSAADDPRR

SEQ ID NO: 185940 - protein, 10 aa, Mycobacterium bovis
RPVSGPHGKA

SEQ ID NO: 185941 - protein, 5 aa, Mycobacterium bovis
RPYDE

SEQ ID NO: 185942 - protein, 4 aa, Mycobacterium bovis
RPYQ

SEQ ID NO: 185943 - protein, 4 aa, Mycobacterium bovis
RPYR

SEQ ID NO: 185944 - protein, 4 aa, Mycobacterium bovis
RQAA

SEQ ID NO: 185945 - protein, 6 aa, Mycobacterium bovis
RQAADE

SEQ ID NO: 185946 - protein, 5 aa, Mycobacterium bovis
RQADG

SEQ ID NO: 185947 - protein, 8 aa, Mycobacterium bovis
RQADWDTG

SEQ ID NO: 185948 - protein, 4 aa, Mycobacterium bovis
RQAG

SEQ ID NO: 185949 - protein, 12 aa, Mycobacterium bovis
RQAGSSLRTAAI

SEQ ID NO: 185950 - protein, 5 aa, Mycobacterium bovis
RQAGY

SEQ ID NO: 185951 - protein, 16 aa, Mycobacterium bovis
RQAGYRPARREGAREG

SEQ ID NO: 185952 - protein, 17 aa, Mycobacterium bovis
RQALADRRAANCCVLSG

SEQ ID NO: 185953 - protein, 126 aa, Mycobacterium bovis
RQANGAPAVDRSAQEHDKGDRPPSSEAPATQGEQTPTEQIDSQSQQVRPERRSATREAGPSGSGERAGTAADDTDNRQGGQQDAKTEERGTDAGGDQGGDQQASGGQQARGDEDGEARQGRRGRRF

SEQ ID NO: 185954 - protein, 9 aa, Mycobacterium bovis
RQASEDEHW

SEQ ID NO: 185955 - protein, 16 aa, Mycobacterium bovis
RQASPGHAFSPDTPWQ

SEQ ID NO: 185956 - protein, 8 aa, Mycobacterium bovis
RQASPGVK

SEQ ID NO: 185957 - protein, 4 aa, Mycobacterium bovis
RQAT

SEQ ID NO: 185958 - protein, 8 aa, Mycobacterium bovis
RQATSQRV

SEQ ID NO: 185959 - protein, 4 aa, Mycobacterium bovis
RQAW

SEQ ID NO: 185960 - protein, 5 aa, Mycobacterium bovis
RQCPP

SEQ ID NO: 185961 - protein, 6 aa, Mycobacterium bovis
RQDEVG

SEQ ID NO: 185962 - protein, 9 aa, Mycobacterium bovis
RQDGSASYD

SEQ ID NO: 185963 - protein, 4 aa, Mycobacterium bovis
RQDL

SEQ ID NO: 185964 - protein, 6 aa, Mycobacterium bovis
RQDNNP

SEQ ID NO: 185965 - protein, 11 aa, Mycobacterium bovis
RQDRTYKPPAA

SEQ ID NO: 185966 - protein, 15 aa, Mycobacterium bovis
RQEAADEAAAQVGDR

SEQ ID NO: 185967 - protein, 6 aa, Mycobacterium bovis
RQESAD

SEQ ID NO: 185968 - protein, 16 aa, Mycobacterium bovis
RQGNSDRRAPKAVKEY

SEQ ID NO: 185969 - protein, 6 aa, Mycobacterium bovis
RQGRSV

SEQ ID NO: 185970 - protein, 16 aa, Mycobacterium bovis
RQGSGGAGRWRGGDGA

SEQ ID NO: 185971 - protein, 6 aa, Mycobacterium bovis
RQGTEA

SEQ ID NO: 185972 - protein, 7 aa, Mycobacterium bovis
RQGYQAE

SEQ ID NO: 185973 - protein, 21 aa, Mycobacterium bovis
RQHASSIRREARSHRKSVKLA

SEQ ID NO: 185974 - protein, 10 aa, Mycobacterium bovis
RQHGAQPASQ

SEQ ID NO: 185975 - protein, 8 aa, Mycobacterium bovis
RQIPAADA

SEQ ID NO: 185976 - protein, 8 aa, Mycobacterium bovis
RQKAQSAQ

SEQ ID NO: 185977 - protein, 8 aa, Mycobacterium bovis
RQKARASQ

SEQ ID NO: 185978 - protein, 9 aa, Mycobacterium bovis
RQLGGQDHP

SEQ ID NO: 185979 - protein, 4 aa, Mycobacterium bovis
RQLP

SEQ ID NO: 185980 - protein, 8 aa, Mycobacterium bovis
RQMSGGGT

SEQ ID NO: 185981 - protein, 6 aa, Mycobacterium bovis
RQNAEH

SEQ ID NO: 185982 - protein, 7 aa, Mycobacterium bovis
RQNAGDV

SEQ ID NO: 185983 - protein, 18 aa, Mycobacterium bovis
RQNDARMEDVRPGKLHAR

SEQ ID NO: 185984 - protein, 5 aa, Mycobacterium bovis
RQNPL

SEQ ID NO: 185985 - protein, 7 aa, Mycobacterium bovis
RQNPRNL

SEQ ID NO: 185986 - protein, 6 aa, Mycobacterium bovis
RQPDGR

SEQ ID NO: 185987 - protein, 9 aa, Mycobacterium bovis
RQPEDGTQH

SEQ ID NO: 185988 - protein, 9 aa, Mycobacterium bovis
RQPEPTEAW

SEQ ID NO: 185989 - protein, 7 aa, Mycobacterium bovis
RQPGGDT

SEQ ID NO: 185990 - protein, 8 aa, Mycobacterium bovis
RQPGKPSW

SEQ ID NO: 185991 - protein, 8 aa, Mycobacterium bovis
RQPGPDPV

SEQ ID NO: 185992 - protein, 25 aa, Mycobacterium bovis
RQPIRPSGRAPAAVTSTAKSPRLRQ

SEQ ID NO: 185993 - protein, 12 aa, Mycobacterium bovis
RQPKFGQRDPRA

SEQ ID NO: 185994 - protein, 4 aa, Mycobacterium bovis
RQPL

SEQ ID NO: 185995 - protein, 5 aa, Mycobacterium bovis
RQPQA

SEQ ID NO: 185996 - protein, 8 aa, Mycobacterium bovis
RQPSYDDI

SEQ ID NO: 185997 - protein, 9 aa, Mycobacterium bovis
RQPTGGAVQ

SEQ ID NO: 185998 - protein, 7 aa, Mycobacterium bovis
RQPTVSG

SEQ ID NO: 185999 - protein, 4 aa, Mycobacterium bovis
RQPV

SEQ ID NO: 186000 - protein, 5 aa, Mycobacterium bovis
RQPVR

SEQ ID NO: 186001 - protein, 5 aa, Mycobacterium bovis
RQPYA

SEQ ID NO: 186002 - protein, 11 aa, Mycobacterium bovis
RQRADDAGGEF

SEQ ID NO: 186003 - protein, 6 aa, Mycobacterium bovis
RQRDAG

SEQ ID NO: 186004 - protein, 6 aa, Mycobacterium bovis
RQRDRV

SEQ ID NO: 186005 - protein, 9 aa, Mycobacterium bovis
RQRDTGAPQ

SEQ ID NO: 186006 - protein, 7 aa, Mycobacterium bovis
RQRGEPQ

SEQ ID NO: 186007 - protein, 6 aa, Mycobacterium bovis
RQRHEA

SEQ ID NO: 186008 - protein, 4 aa, Mycobacterium bovis
RQRP

SEQ ID NO: 186009 - protein, 6 aa, Mycobacterium bovis
RQRREK

SEQ ID NO: 186010 - protein, 8 aa, Mycobacterium bovis
RQRSPRSV

SEQ ID NO: 186011 - protein, 19 aa, Mycobacterium bovis
RQRVAQQETERITTRLAAL

SEQ ID NO: 186012 - protein, 5 aa, Mycobacterium bovis
RQRVD

SEQ ID NO: 186013 - protein, 8 aa, Mycobacterium bovis
RQSCDGCQ

SEQ ID NO: 186014 - protein, 9 aa, Mycobacterium bovis
RQSGPDAPV

SEQ ID NO: 186015 - protein, 9 aa, Mycobacterium bovis
RQSSGKGQV

SEQ ID NO: 186016 - protein, 5 aa, Mycobacterium bovis
RQSYP

SEQ ID NO: 186017 - protein, 8 aa, Mycobacterium bovis
RQTAAPSI

SEQ ID NO: 186018 - protein, 6 aa, Mycobacterium bovis
RQTDPY

SEQ ID NO: 186019 - protein, 6 aa, Mycobacterium bovis
RQTDQR

SEQ ID NO: 186020 - protein, 8 aa, Mycobacterium bovis
RQTGEWKD

SEQ ID NO: 186021 - protein, 5 aa, Mycobacterium bovis
RQTRF

SEQ ID NO: 186022 - protein, 6 aa, Mycobacterium bovis
RQTRHG

SEQ ID NO: 186023 - protein, 7 aa, Mycobacterium bovis
RQTRQTR

SEQ ID NO: 186024 - protein, 6 aa, Mycobacterium bovis
RQVGKT

SEQ ID NO: 186025 - protein, 7 aa, Mycobacterium bovis
RQVPDNG

SEQ ID NO: 186026 - protein, 6 aa, Mycobacterium bovis
RQYGIE

SEQ ID NO: 186027 - protein, 5 aa, Mycobacterium bovis
RRAAG

SEQ ID NO: 186028 - protein, 5 aa, Mycobacterium bovis
RRAAH

SEQ ID NO: 186029 - protein, 5 aa, Mycobacterium bovis
RRAAT

SEQ ID NO: 186030 - protein, 5 aa, Mycobacterium bovis
RRADQ

SEQ ID NO: 186031 - protein, 6 aa, Mycobacterium bovis
RRAEEA

SEQ ID NO: 186032 - protein, 24 aa, Mycobacterium bovis
RRAERERLQAQRPPDVIDHAWVPV

SEQ ID NO: 186033 - protein, 9 aa, Mycobacterium bovis
RRAGAQGVG

SEQ ID NO: 186034 - protein, 11 aa, Mycobacterium bovis
RRAGDEVEAEP

SEQ ID NO: 186035 - protein, 8 aa, Mycobacterium bovis
RRAGETVR

SEQ ID NO: 186036 - protein, 14 aa, Mycobacterium bovis
RRAGEVTSAEGKQQ

SEQ ID NO: 186037 - protein, 10 aa, Mycobacterium bovis
RRAGKRDGKR

SEQ ID NO: 186038 - protein, 12 aa, Mycobacterium bovis
RRANAAKSKRAL

SEQ ID NO: 186039 - protein, 7 aa, Mycobacterium bovis
RRARDLG

SEQ ID NO: 186040 - protein, 26 aa, Mycobacterium bovis
RRARGPAKRPARKAARKVPAKKAAKR

SEQ ID NO: 186041 - protein, 7 aa, Mycobacterium bovis
RRASELG

SEQ ID NO: 186042 - protein, 14 aa, Mycobacterium bovis
RRASGRGPRSLTPE

SEQ ID NO: 186043 - protein, 6 aa, Mycobacterium bovis
RRATRE

SEQ ID NO: 186044 - protein, 5 aa, Mycobacterium bovis
RRAYT

SEQ ID NO: 186045 - protein, 4 aa, Mycobacterium bovis
RRCP

SEQ ID NO: 186046 - protein, 5 aa, Mycobacterium bovis
RRDAH

SEQ ID NO: 186047 - protein, 6 aa, Mycobacterium bovis
RRDDPL

SEQ ID NO: 186048 - protein, 4 aa, Mycobacterium bovis
RRDE

SEQ ID NO: 186049 - protein, 7 aa, Mycobacterium bovis
RRDEARN

SEQ ID NO: 186050 - protein, 15 aa, Mycobacterium bovis
RRDEPFGDYGRQASR

SEQ ID NO: 186051 - protein, 8 aa, Mycobacterium bovis
RRDGADTV

SEQ ID NO: 186052 - protein, 6 aa, Mycobacterium bovis
RRDGDD

SEQ ID NO: 186053 - protein, 13 aa, Mycobacterium bovis
RRDGIDAASEIAS

SEQ ID NO: 186054 - protein, 6 aa, Mycobacterium bovis
RRDGLD

SEQ ID NO: 186055 - protein, 9 aa, Mycobacterium bovis
RRDGSRNGV

SEQ ID NO: 186056 - protein, 5 aa, Mycobacterium bovis
RRDGV

SEQ ID NO: 186057 - protein, 7 aa, Mycobacterium bovis
RRDHPDE

SEQ ID NO: 186058 - protein, 9 aa, Mycobacterium bovis
RRDKATSNI

SEQ ID NO: 186059 - protein, 7 aa, Mycobacterium bovis
RRDKISK

SEQ ID NO: 186060 - protein, 17 aa, Mycobacterium bovis
RRDLGASAAELVDEARS

SEQ ID NO: 186061 - protein, 11 aa, Mycobacterium bovis
RRDLNDPKTIE

SEQ ID NO: 186062 - protein, 7 aa, Mycobacterium bovis
RRDPAAA

SEQ ID NO: 186063 - protein, 9 aa, Mycobacterium bovis
RRDPNRPRA

SEQ ID NO: 186064 - protein, 10 aa, Mycobacterium bovis
RRDSPARGGR

SEQ ID NO: 186065 - protein, 10 aa, Mycobacterium bovis
RRDSPARGSR

SEQ ID NO: 186066 - protein, 10 aa, Mycobacterium bovis
RRDSRYQPGR

SEQ ID NO: 186067 - protein, 7 aa, Mycobacterium bovis
RRDTDGY

SEQ ID NO: 186068 - protein, 8 aa, Mycobacterium bovis
RRDTNGRG

SEQ ID NO: 186069 - protein, 5 aa, Mycobacterium bovis
RREAT

SEQ ID NO: 186070 - protein, 9 aa, Mycobacterium bovis
RREDNDKTR

SEQ ID NO: 186071 - protein, 7 aa, Mycobacterium bovis
RREDYDP

SEQ ID NO: 186072 - protein, 13 aa, Mycobacterium bovis
RREEALETGKDAM

SEQ ID NO: 186073 - protein, 12 aa, Mycobacterium bovis
RREESLHPVGED

SEQ ID NO: 186074 - protein, 5 aa, Mycobacterium bovis
RREGA

SEQ ID NO: 186075 - protein, 8 aa, Mycobacterium bovis
RREHDEAA

SEQ ID NO: 186076 - protein, 11 aa, Mycobacterium bovis
RREKDDVTEVR

SEQ ID NO: 186077 - protein, 7 aa, Mycobacterium bovis
RRENPYH

SEQ ID NO: 186078 - protein, 5 aa, Mycobacterium bovis
RREPE

SEQ ID NO: 186079 - protein, 7 aa, Mycobacterium bovis
RREPEAA

SEQ ID NO: 186080 - protein, 7 aa, Mycobacterium bovis
RREPERK

SEQ ID NO: 186081 - protein, 6 aa, Mycobacterium bovis
RREPGR

SEQ ID NO: 186082 - protein, 5 aa, Mycobacterium bovis
RREQI

SEQ ID NO: 186083 - protein, 4 aa, Mycobacterium bovis
RRFP

SEQ ID NO: 186084 - protein, 7 aa, Mycobacterium bovis
RRFSDEE

SEQ ID NO: 186085 - protein, 5 aa, Mycobacterium bovis
RRFTP

SEQ ID NO: 186086 - protein, 4 aa, Mycobacterium bovis
RRGA

SEQ ID NO: 186087 - protein, 14 aa, Mycobacterium bovis
RRGCEESAASSSTP

SEQ ID NO: 186088 - protein, 4 aa, Mycobacterium bovis
RRGD

SEQ ID NO: 186089 - protein, 9 aa, Mycobacterium bovis
RRGDKRALA

SEQ ID NO: 186090 - protein, 11 aa, Mycobacterium bovis
RRGDRAEGAAE

SEQ ID NO: 186091 - protein, 6 aa, Mycobacterium bovis
RRGELG

SEQ ID NO: 186092 - protein, 5 aa, Mycobacterium bovis
RRGEN

SEQ ID NO: 186093 - protein, 5 aa, Mycobacterium bovis
RRGEV

SEQ ID NO: 186094 - protein, 7 aa, Mycobacterium bovis
RRGGDTV

SEQ ID NO: 186095 - protein, 7 aa, Mycobacterium bovis
RRGGSAM

SEQ ID NO: 186096 - protein, 5 aa, Mycobacterium bovis
RRGGV

SEQ ID NO: 186097 - protein, 5 aa, Mycobacterium bovis
RRGLE

SEQ ID NO: 186098 - protein, 6 aa, Mycobacterium bovis
RRGPAH

SEQ ID NO: 186099 - protein, 13 aa, Mycobacterium bovis
RRGPAVPQRDPPR

SEQ ID NO: 186100 - protein, 9 aa, Mycobacterium bovis
RRGPGGSDT

SEQ ID NO: 186101 - protein, 12 aa, Mycobacterium bovis
RRGPIPRPPTLE

SEQ ID NO: 186102 - protein, 6 aa, Mycobacterium bovis
RRGPNG

SEQ ID NO: 186103 - protein, 6 aa, Mycobacterium bovis
RRGQQD

SEQ ID NO: 186104 - protein, 20 aa, Mycobacterium bovis
RRGRIGTKRSSISDTDYRRD

SEQ ID NO: 186105 - protein, 9 aa, Mycobacterium bovis
RRGRPSTPM

SEQ ID NO: 186106 - protein, 6 aa, Mycobacterium bovis
RRGSGV

SEQ ID NO: 186107 - protein, 7 aa, Mycobacterium bovis
RRGSNVA

SEQ ID NO: 186108 - protein, 9 aa, Mycobacterium bovis
RRGSSVTVS

SEQ ID NO: 186109 - protein, 7 aa, Mycobacterium bovis
RRGSTAE

SEQ ID NO: 186110 - protein, 4 aa, Mycobacterium bovis
RRGT

SEQ ID NO: 186111 - protein, 11 aa, Mycobacterium bovis
RRHEAADQRRV

SEQ ID NO: 186112 - protein, 14 aa, Mycobacterium bovis
RRHRELDGSGTVRG

SEQ ID NO: 186113 - protein, 16 aa, Mycobacterium bovis
RRHTPGGSSGGSAAAV

SEQ ID NO: 186114 - protein, 11 aa, Mycobacterium bovis
RRIEGTGTEVG

SEQ ID NO: 186115 - protein, 10 aa, Mycobacterium bovis
RRIPGSHGHR

SEQ ID NO: 186116 - protein, 9 aa, Mycobacterium bovis
RRKGRLRAQ

SEQ ID NO: 186117 - protein, 26 aa, Mycobacterium bovis
RRKRSSRALPSAARRGRPSVPTARAR

SEQ ID NO: 186118 - protein, 16 aa, Mycobacterium bovis
RRKSEALAASVLPDRT

SEQ ID NO: 186119 - protein, 7 aa, Mycobacterium bovis
RRKTSRN

SEQ ID NO: 186120 - protein, 8 aa, Mycobacterium bovis
RRLDDAQP

SEQ ID NO: 186121 - protein, 9 aa, Mycobacterium bovis
RRLGETAAE

SEQ ID NO: 186122 - protein, 5 aa, Mycobacterium bovis
RRLRQ

SEQ ID NO: 186123 - protein, 9 aa, Mycobacterium bovis
RRNDDEPAE

SEQ ID NO: 186124 - protein, 6 aa, Mycobacterium bovis
RRNDPV

SEQ ID NO: 186125 - protein, 8 aa, Mycobacterium bovis
RRNGDKLS

SEQ ID NO: 186126 - protein, 5 aa, Mycobacterium bovis
RRNGR

SEQ ID NO: 186127 - protein, 9 aa, Mycobacterium bovis
RRNGYRDNG

SEQ ID NO: 186128 - protein, 8 aa, Mycobacterium bovis
RRNLGGAG

SEQ ID NO: 186129 - protein, 8 aa, Mycobacterium bovis
RRNPRDDH

SEQ ID NO: 186130 - protein, 12 aa, Mycobacterium bovis
RRNRARELAQEA

SEQ ID NO: 186131 - protein, 9 aa, Mycobacterium bovis
RRNTAAAEL

SEQ ID NO: 186132 - protein, 7 aa, Mycobacterium bovis
RRPAEPN

SEQ ID NO: 186133 - protein, 7 aa, Mycobacterium bovis
RRPAGVP

SEQ ID NO: 186134 - protein, 15 aa, Mycobacterium bovis
RRPALPGRTKHPRIS

SEQ ID NO: 186135 - protein, 7 aa, Mycobacterium bovis
RRPDELA

SEQ ID NO: 186136 - protein, 44 aa, Mycobacterium bovis
RRPDERPNDHLPQRNSERPEGVRGQRIRDAGDEALTDHRPQSAP

SEQ ID NO: 186137 - protein, 6 aa, Mycobacterium bovis
RRPDGR

SEQ ID NO: 186138 - protein, 4 aa, Mycobacterium bovis
RRPE

SEQ ID NO: 186139 - protein, 5 aa, Mycobacterium bovis
RRPEA

SEQ ID NO: 186140 - protein, 8 aa, Mycobacterium bovis
RRPEGSDD

SEQ ID NO: 186141 - protein, 7 aa, Mycobacterium bovis
RRPENAG

SEQ ID NO: 186142 - protein, 9 aa, Mycobacterium bovis
RRPGDQPGK

SEQ ID NO: 186143 - protein, 10 aa, Mycobacterium bovis
RRPGESPPSI

SEQ ID NO: 186144 - protein, 7 aa, Mycobacterium bovis
RRPGETA

SEQ ID NO: 186145 - protein, 7 aa, Mycobacterium bovis
RRPGGPG

SEQ ID NO: 186146 - protein, 8 aa, Mycobacterium bovis
RRPGHTEA

SEQ ID NO: 186147 - protein, 16 aa, Mycobacterium bovis
RRPKDLATKQAAASVG

SEQ ID NO: 186148 - protein, 14 aa, Mycobacterium bovis
RRPNESASQASNRA

SEQ ID NO: 186149 - protein, 6 aa, Mycobacterium bovis
RRPPAG

SEQ ID NO: 186150 - protein, 9 aa, Mycobacterium bovis
RRPPAGDGW

SEQ ID NO: 186151 - protein, 7 aa, Mycobacterium bovis
RRPPLGQ

SEQ ID NO: 186152 - protein, 5 aa, Mycobacterium bovis
RRPPQ

SEQ ID NO: 186153 - protein, 5 aa, Mycobacterium bovis
RRPPT

SEQ ID NO: 186154 - protein, 4 aa, Mycobacterium bovis
RRPQ

SEQ ID NO: 186155 - protein, 10 aa, Mycobacterium bovis
RRPQRTGEDH

SEQ ID NO: 186156 - protein, 13 aa, Mycobacterium bovis
RRPRELSGGQRQR

SEQ ID NO: 186157 - protein, 8 aa, Mycobacterium bovis
RRPRPTRE

SEQ ID NO: 186158 - protein, 22 aa, Mycobacterium bovis
RRPRRRQIDDTGDATSSKSALA

SEQ ID NO: 186159 - protein, 8 aa, Mycobacterium bovis
RRPRTGPA

SEQ ID NO: 186160 - protein, 12 aa, Mycobacterium bovis
RRPSANSKLGAV

SEQ ID NO: 186161 - protein, 8 aa, Mycobacterium bovis
RRPTALER

SEQ ID NO: 186162 - protein, 20 aa, Mycobacterium bovis
RRPTATADAPTPGARAKAVA

SEQ ID NO: 186163 - protein, 7 aa, Mycobacterium bovis
RRPTDDE

SEQ ID NO: 186164 - protein, 7 aa, Mycobacterium bovis
RRPTDTE

SEQ ID NO: 186165 - protein, 6 aa, Mycobacterium bovis
RRPTTG

SEQ ID NO: 186166 - protein, 18 aa, Mycobacterium bovis
RRPVAPRKGTGRVNGSPR

SEQ ID NO: 186167 - protein, 14 aa, Mycobacterium bovis
RRPVQRQSARAGDP

SEQ ID NO: 186168 - protein, 5 aa, Mycobacterium bovis
RRPVS

SEQ ID NO: 186169 - protein, 6 aa, Mycobacterium bovis
RRPYTY

SEQ ID NO: 186170 - protein, 10 aa, Mycobacterium bovis
RRQAKPGDFD

SEQ ID NO: 186171 - protein, 6 aa, Mycobacterium bovis
RRQASL

SEQ ID NO: 186172 - protein, 4 aa, Mycobacterium bovis
RRQE

SEQ ID NO: 186173 - protein, 4 aa, Mycobacterium bovis
RRQL

SEQ ID NO: 186174 - protein, 5 aa, Mycobacterium bovis
RRQLG

SEQ ID NO: 186175 - protein, 6 aa, Mycobacterium bovis
RRQPAD

SEQ ID NO: 186176 - protein, 11 aa, Mycobacterium bovis
RRQREERKTLG

SEQ ID NO: 186177 - protein, 9 aa, Mycobacterium bovis
RRQTTRSAA

SEQ ID NO: 186178 - protein, 9 aa, Mycobacterium bovis
RRRADGSIE

SEQ ID NO: 186179 - protein, 9 aa, Mycobacterium bovis
RRRAGDTAA

SEQ ID NO: 186180 - protein, 8 aa, Mycobacterium bovis
RRRARAGS

SEQ ID NO: 186181 - protein, 12 aa, Mycobacterium bovis
RRRASGGPAEQT

SEQ ID NO: 186182 - protein, 6 aa, Mycobacterium bovis
RRRDDG

SEQ ID NO: 186183 - protein, 7 aa, Mycobacterium bovis
RRRDPFD

SEQ ID NO: 186184 - protein, 11 aa, Mycobacterium bovis
RRRDRASTQEV

SEQ ID NO: 186185 - protein, 10 aa, Mycobacterium bovis
RRRDRSDAAA

SEQ ID NO: 186186 - protein, 5 aa, Mycobacterium bovis
RRRDT

SEQ ID NO: 186187 - protein, 10 aa, Mycobacterium bovis
RRREKAEQEL

SEQ ID NO: 186188 - protein, 9 aa, Mycobacterium bovis
RRRELTGGR

SEQ ID NO: 186189 - protein, 4 aa, Mycobacterium bovis
RRRG

SEQ ID NO: 186190 - protein, 5 aa, Mycobacterium bovis
RRRGR

SEQ ID NO: 186191 - protein, 4 aa, Mycobacterium bovis
RRRH

SEQ ID NO: 186192 - protein, 5 aa, Mycobacterium bovis
RRRPD

SEQ ID NO: 186193 - protein, 18 aa, Mycobacterium bovis
RRRPTGPPSGSGSGDRAG

SEQ ID NO: 186194 - protein, 20 aa, Mycobacterium bovis
RRRRGQEAVRPPRQPWRLSA

SEQ ID NO: 186195 - protein, 21 aa, Mycobacterium bovis
RRRRPLPTGLGRPSADPSGEL

SEQ ID NO: 186196 - protein, 7 aa, Mycobacterium bovis
RRRRTSK

SEQ ID NO: 186197 - protein, 9 aa, Mycobacterium bovis
RRRSPATRA

SEQ ID NO: 186198 - protein, 8 aa, Mycobacterium bovis
RRRSPEAH

SEQ ID NO: 186199 - protein, 15 aa, Mycobacterium bovis
RRRSPRAHRRHRSTT

SEQ ID NO: 186200 - protein, 4 aa, Mycobacterium bovis
RRRT

SEQ ID NO: 186201 - protein, 9 aa, Mycobacterium bovis
RRRTAENSA

SEQ ID NO: 186202 - protein, 6 aa, Mycobacterium bovis
RRRTNR

SEQ ID NO: 186203 - protein, 7 aa, Mycobacterium bovis
RRRTRQT

SEQ ID NO: 186204 - protein, 7 aa, Mycobacterium bovis
RRRYESA

SEQ ID NO: 186205 - protein, 13 aa, Mycobacterium bovis
RRSAAGPGGNEDS

SEQ ID NO: 186206 - protein, 5 aa, Mycobacterium bovis
RRSAQ

SEQ ID NO: 186207 - protein, 17 aa, Mycobacterium bovis
RRSASAGFTERRENRQK

SEQ ID NO: 186208 - protein, 14 aa, Mycobacterium bovis
RRSAVSAQPGTLGD

SEQ ID NO: 186209 - protein, 7 aa, Mycobacterium bovis
RRSEPEV

SEQ ID NO: 186210 - protein, 18 aa, Mycobacterium bovis
RRSGASTVGAHPSARRSA

SEQ ID NO: 186211 - protein, 10 aa, Mycobacterium bovis
RRSGGKTTDF

SEQ ID NO: 186212 - protein, 10 aa, Mycobacterium bovis
RRSGKPYRTP

SEQ ID NO: 186213 - protein, 13 aa, Mycobacterium bovis
RRSHRAGSCARRN

SEQ ID NO: 186214 - protein, 8 aa, Mycobacterium bovis
RRSPTRGE

SEQ ID NO: 186215 - protein, 4 aa, Mycobacterium bovis
RRSR

SEQ ID NO: 186216 - protein, 5 aa, Mycobacterium bovis
RRSRD

SEQ ID NO: 186217 - protein, 16 aa, Mycobacterium bovis
RRSRPAPETAGEAGDG

SEQ ID NO: 186218 - protein, 10 aa, Mycobacterium bovis
RRSRTHRRTP

SEQ ID NO: 186219 - protein, 7 aa, Mycobacterium bovis
RRSVGQG

SEQ ID NO: 186220 - protein, 5 aa, Mycobacterium bovis
RRSVR

SEQ ID NO: 186221 - protein, 7 aa, Mycobacterium bovis
RRTAEEL

SEQ ID NO: 186222 - protein, 17 aa, Mycobacterium bovis
RRTAESALRASLSPELG

SEQ ID NO: 186223 - protein, 11 aa, Mycobacterium bovis
RRTDAESVAGQ

SEQ ID NO: 186224 - protein, 9 aa, Mycobacterium bovis
RRTDGTTNG

SEQ ID NO: 186225 - protein, 5 aa, Mycobacterium bovis
RRTGA

SEQ ID NO: 186226 - protein, 5 aa, Mycobacterium bovis
RRTGE

SEQ ID NO: 186227 - protein, 9 aa, Mycobacterium bovis
RRTGEKRKL

SEQ ID NO: 186228 - protein, 8 aa, Mycobacterium bovis
RRTGGADA

SEQ ID NO: 186229 - protein, 23 aa, Mycobacterium bovis
RRTGRPPRAVTADRGCGDASVED

SEQ ID NO: 186230 - protein, 6 aa, Mycobacterium bovis
RRTHER

SEQ ID NO: 186231 - protein, 4 aa, Mycobacterium bovis
RRTI

SEQ ID NO: 186232 - protein, 19 aa, Mycobacterium bovis
RRTPASQEEGGEGGEETVT

SEQ ID NO: 186233 - protein, 7 aa, Mycobacterium bovis
RRTPSRL

SEQ ID NO: 186234 - protein, 15 aa, Mycobacterium bovis
RRTRAGLKDPKRPSG

SEQ ID NO: 186235 - protein, 12 aa, Mycobacterium bovis
RRTTDDDMAGRD

SEQ ID NO: 186236 - protein, 6 aa, Mycobacterium bovis
RRTTDG

SEQ ID NO: 186237 - protein, 15 aa, Mycobacterium bovis
RRVDGAREAVDGSIN

SEQ ID NO: 186238 - protein, 26 aa, Mycobacterium bovis
RRVGGRRRGRSGSGRGRGAIDREQSA

SEQ ID NO: 186239 - protein, 9 aa, Mycobacterium bovis
RRVGTYSGG

SEQ ID NO: 186240 - protein, 11 aa, Mycobacterium bovis
RRVPSSEVERV

SEQ ID NO: 186241 - protein, 5 aa, Mycobacterium bovis
RRVTG

SEQ ID NO: 186242 - protein, 22 aa, Mycobacterium bovis
RRYAGQDTAAAAALGAVRPWGT

SEQ ID NO: 186243 - protein, 7 aa, Mycobacterium bovis
RRYDGDE

SEQ ID NO: 186244 - protein, 4 aa, Mycobacterium bovis
RSAA

SEQ ID NO: 186245 - protein, 9 aa, Mycobacterium bovis
RSAAAGDPC

SEQ ID NO: 186246 - protein, 11 aa, Mycobacterium bovis
RSAAGHSAYPG

SEQ ID NO: 186247 - protein, 7 aa, Mycobacterium bovis
RSAAQGR

SEQ ID NO: 186248 - protein, 14 aa, Mycobacterium bovis
RSAASDAGRDPMSI

SEQ ID NO: 186249 - protein, 14 aa, Mycobacterium bovis
RSADFTARPAPDDV

SEQ ID NO: 186250 - protein, 15 aa, Mycobacterium bovis
RSADHPATVWFTATA

SEQ ID NO: 186251 - protein, 8 aa, Mycobacterium bovis
RSAEAAGA

SEQ ID NO: 186252 - protein, 6 aa, Mycobacterium bovis
RSAGLP

SEQ ID NO: 186253 - protein, 9 aa, Mycobacterium bovis
RSAGPPPVV

SEQ ID NO: 186254 - protein, 10 aa, Mycobacterium bovis
RSAGQDPRLD

SEQ ID NO: 186255 - protein, 9 aa, Mycobacterium bovis
RSAGSIKKI

SEQ ID NO: 186256 - protein, 6 aa, Mycobacterium bovis
RSAGSL

SEQ ID NO: 186257 - protein, 8 aa, Mycobacterium bovis
RSAGYDDV

SEQ ID NO: 186258 - protein, 4 aa, Mycobacterium bovis
RSAH

SEQ ID NO: 186259 - protein, 7 aa, Mycobacterium bovis
RSAHSTV

SEQ ID NO: 186260 - protein, 8 aa, Mycobacterium bovis
RSALQSGA

SEQ ID NO: 186261 - protein, 5 aa, Mycobacterium bovis
RSAPP

SEQ ID NO: 186262 - protein, 8 aa, Mycobacterium bovis
RSAPSDAG

SEQ ID NO: 186263 - protein, 8 aa, Mycobacterium bovis
RSAPSDEV

SEQ ID NO: 186264 - protein, 9 aa, Mycobacterium bovis
RSAQARGVS

SEQ ID NO: 186265 - protein, 9 aa, Mycobacterium bovis
RSARHGPAC

SEQ ID NO: 186266 - protein, 9 aa, Mycobacterium bovis
RSASEAISG

SEQ ID NO: 186267 - protein, 13 aa, Mycobacterium bovis
RSATDYDSQQTSL

SEQ ID NO: 186268 - protein, 6 aa, Mycobacterium bovis
RSATPA

SEQ ID NO: 186269 - protein, 12 aa, Mycobacterium bovis
RSATRRGRPTAQ

SEQ ID NO: 186270 - protein, 9 aa, Mycobacterium bovis
RSATTAEQA

SEQ ID NO: 186271 - protein, 14 aa, Mycobacterium bovis
RSAVTDSERDIRYD

SEQ ID NO: 186272 - protein, 4 aa, Mycobacterium bovis
RSCE

SEQ ID NO: 186273 - protein, 8 aa, Mycobacterium bovis
RSDAADID

SEQ ID NO: 186274 - protein, 9 aa, Mycobacterium bovis
RSDEEAQAR

SEQ ID NO: 186275 - protein, 8 aa, Mycobacterium bovis
RSDERGAS

SEQ ID NO: 186276 - protein, 9 aa, Mycobacterium bovis
RSDKPTRIE

SEQ ID NO: 186277 - protein, 13 aa, Mycobacterium bovis
RSDLTSDGLPADA

SEQ ID NO: 186278 - protein, 4 aa, Mycobacterium bovis
RSDP

SEQ ID NO: 186279 - protein, 8 aa, Mycobacterium bovis
RSDPRNAR

SEQ ID NO: 186280 - protein, 7 aa, Mycobacterium bovis
RSDRDAA

SEQ ID NO: 186281 - protein, 5 aa, Mycobacterium bovis
RSDRV

SEQ ID NO: 186282 - protein, 4 aa, Mycobacterium bovis
RSDS

SEQ ID NO: 186283 - protein, 5 aa, Mycobacterium bovis
RSDSD

SEQ ID NO: 186284 - protein, 8 aa, Mycobacterium bovis
RSDSDHHG

SEQ ID NO: 186285 - protein, 6 aa, Mycobacterium bovis
RSDTDL

SEQ ID NO: 186286 - protein, 12 aa, Mycobacterium bovis
RSDTPKAPTRGA

SEQ ID NO: 186287 - protein, 4 aa, Mycobacterium bovis
RSEA

SEQ ID NO: 186288 - protein, 10 aa, Mycobacterium bovis
RSEAKRRVAE

SEQ ID NO: 186289 - protein, 7 aa, Mycobacterium bovis
RSEARNG

SEQ ID NO: 186290 - protein, 4 aa, Mycobacterium bovis
RSEE

SEQ ID NO: 186291 - protein, 7 aa, Mycobacterium bovis
RSEEERE

SEQ ID NO: 186292 - protein, 6 aa, Mycobacterium bovis
RSEGER

SEQ ID NO: 186293 - protein, 6 aa, Mycobacterium bovis
RSENAT

SEQ ID NO: 186294 - protein, 9 aa, Mycobacterium bovis
RSENLTSTG

SEQ ID NO: 186295 - protein, 4 aa, Mycobacterium bovis
RSEP

SEQ ID NO: 186296 - protein, 4 aa, Mycobacterium bovis
RSER

SEQ ID NO: 186297 - protein, 12 aa, Mycobacterium bovis
RSFETREGEKRT

SEQ ID NO: 186298 - protein, 8 aa, Mycobacterium bovis
RSFTGSQA

SEQ ID NO: 186299 - protein, 4 aa, Mycobacterium bovis
RSGA

SEQ ID NO: 186300 - protein, 9 aa, Mycobacterium bovis
RSGAANTAA

SEQ ID NO: 186301 - protein, 5 aa, Mycobacterium bovis
RSGAG

SEQ ID NO: 186302 - protein, 5 aa, Mycobacterium bovis
RSGAL

SEQ ID NO: 186303 - protein, 7 aa, Mycobacterium bovis
RSGAPQG

SEQ ID NO: 186304 - protein, 9 aa, Mycobacterium bovis
RSGDSQASA

SEQ ID NO: 186305 - protein, 10 aa, Mycobacterium bovis
RSGDTAPASL

SEQ ID NO: 186306 - protein, 10 aa, Mycobacterium bovis
RSGDVAPDSV

SEQ ID NO: 186307 - protein, 5 aa, Mycobacterium bovis
RSGEE

SEQ ID NO: 186308 - protein, 9 aa, Mycobacterium bovis
RSGEGSPDD

SEQ ID NO: 186309 - protein, 10 aa, Mycobacterium bovis
RSGEIDPATL

SEQ ID NO: 186310 - protein, 7 aa, Mycobacterium bovis
RSGEPFP

SEQ ID NO: 186311 - protein, 9 aa, Mycobacterium bovis
RSGERKSDV

SEQ ID NO: 186312 - protein, 7 aa, Mycobacterium bovis
RSGETAV

SEQ ID NO: 186313 - protein, 8 aa, Mycobacterium bovis
RSGETEDT

SEQ ID NO: 186314 - protein, 6 aa, Mycobacterium bovis
RSGFGG

SEQ ID NO: 186315 - protein, 5 aa, Mycobacterium bovis
RSGGL

SEQ ID NO: 186316 - protein, 10 aa, Mycobacterium bovis
RSGGPDRKRP

SEQ ID NO: 186317 - protein, 18 aa, Mycobacterium bovis
RSGGRGRPRRASARPGNC

SEQ ID NO: 186318 - protein, 26 aa, Mycobacterium bovis
RSGGSDEATSTGRDARAPDISGHASA

SEQ ID NO: 186319 - protein, 9 aa, Mycobacterium bovis
RSGGSTPTA

SEQ ID NO: 186320 - protein, 9 aa, Mycobacterium bovis
RSGHFSPDE

SEQ ID NO: 186321 - protein, 10 aa, Mycobacterium bovis
RSGLPKVPTS

SEQ ID NO: 186322 - protein, 12 aa, Mycobacterium bovis
RSGNRTNPSGAT

SEQ ID NO: 186323 - protein, 5 aa, Mycobacterium bovis
RSGPP

SEQ ID NO: 186324 - protein, 4 aa, Mycobacterium bovis
RSGQ

SEQ ID NO: 186325 - protein, 6 aa, Mycobacterium bovis
RSGQPV

SEQ ID NO: 186326 - protein, 8 aa, Mycobacterium bovis
RSGQTRDG

SEQ ID NO: 186327 - protein, 8 aa, Mycobacterium bovis
RSGRDRSA

SEQ ID NO: 186328 - protein, 7 aa, Mycobacterium bovis
RSGRISG

SEQ ID NO: 186329 - protein, 6 aa, Mycobacterium bovis
RSGRLK

SEQ ID NO: 186330 - protein, 9 aa, Mycobacterium bovis
RSGRMSDDD

SEQ ID NO: 186331 - protein, 7 aa, Mycobacterium bovis
RSGRRTF

SEQ ID NO: 186332 - protein, 7 aa, Mycobacterium bovis
RSGRVGR

SEQ ID NO: 186333 - protein, 10 aa, Mycobacterium bovis
RSGSTTISTG

SEQ ID NO: 186334 - protein, 7 aa, Mycobacterium bovis
RSGSVDQ

SEQ ID NO: 186335 - protein, 5 aa, Mycobacterium bovis
RSGTD

SEQ ID NO: 186336 - protein, 4 aa, Mycobacterium bovis
RSGY

SEQ ID NO: 186337 - protein, 5 aa, Mycobacterium bovis
RSGYA

SEQ ID NO: 186338 - protein, 4 aa, Mycobacterium bovis
RSHA

SEQ ID NO: 186339 - protein, 8 aa, Mycobacterium bovis
RSHPEELE

SEQ ID NO: 186340 - protein, 19 aa, Mycobacterium bovis
RSHQRSNPDDVTTRAPECA

SEQ ID NO: 186341 - protein, 7 aa, Mycobacterium bovis
RSHTDQA

SEQ ID NO: 186342 - protein, 4 aa, Mycobacterium bovis
RSIG

SEQ ID NO: 186343 - protein, 8 aa, Mycobacterium bovis
RSKAARKV

SEQ ID NO: 186344 - protein, 10 aa, Mycobacterium bovis
RSKAEAGDTD

SEQ ID NO: 186345 - protein, 7 aa, Mycobacterium bovis
RSKALGE

SEQ ID NO: 186346 - protein, 10 aa, Mycobacterium bovis
RSKAPTTDPV

SEQ ID NO: 186347 - protein, 12 aa, Mycobacterium bovis
RSKEDADAGGNL

SEQ ID NO: 186348 - protein, 6 aa, Mycobacterium bovis
RSKSND

SEQ ID NO: 186349 - protein, 8 aa, Mycobacterium bovis
RSKTPVPQ

SEQ ID NO: 186350 - protein, 9 aa, Mycobacterium bovis
RSKTQGRAN

SEQ ID NO: 186351 - protein, 7 aa, Mycobacterium bovis
RSKYASG

SEQ ID NO: 186352 - protein, 4 aa, Mycobacterium bovis
RSLA

SEQ ID NO: 186353 - protein, 11 aa, Mycobacterium bovis
RSLADKTRAAL

SEQ ID NO: 186354 - protein, 6 aa, Mycobacterium bovis
RSLDSA

SEQ ID NO: 186355 - protein, 4 aa, Mycobacterium bovis
RSLG

SEQ ID NO: 186356 - protein, 8 aa, Mycobacterium bovis
RSLHAGEG

SEQ ID NO: 186357 - protein, 6 aa, Mycobacterium bovis
RSLPTA

SEQ ID NO: 186358 - protein, 13 aa, Mycobacterium bovis
RSLREAQSAVEAA

SEQ ID NO: 186359 - protein, 7 aa, Mycobacterium bovis
RSNHGTC

SEQ ID NO: 186360 - protein, 7 aa, Mycobacterium bovis
RSNPALA

SEQ ID NO: 186361 - protein, 9 aa, Mycobacterium bovis
RSNPEDDRA

SEQ ID NO: 186362 - protein, 4 aa, Mycobacterium bovis
RSNR

SEQ ID NO: 186363 - protein, 11 aa, Mycobacterium bovis
RSPAGKQVKVT

SEQ ID NO: 186364 - protein, 7 aa, Mycobacterium bovis
RSPDGAV

SEQ ID NO: 186365 - protein, 10 aa, Mycobacterium bovis
RSPDSSGNPY

SEQ ID NO: 186366 - protein, 5 aa, Mycobacterium bovis
RSPFS

SEQ ID NO: 186367 - protein, 7 aa, Mycobacterium bovis
RSPQGEP

SEQ ID NO: 186368 - protein, 4 aa, Mycobacterium bovis
RSPR

SEQ ID NO: 186369 - protein, 7 aa, Mycobacterium bovis
RSPRTPY

SEQ ID NO: 186370 - protein, 7 aa, Mycobacterium bovis
RSPSRRR

SEQ ID NO: 186371 - protein, 16 aa, Mycobacterium bovis
RSPSSAPEQRSTAQRA

SEQ ID NO: 186372 - protein, 5 aa, Mycobacterium bovis
RSPTG

SEQ ID NO: 186373 - protein, 4 aa, Mycobacterium bovis
RSPW

SEQ ID NO: 186374 - protein, 4 aa, Mycobacterium bovis
RSQE

SEQ ID NO: 186375 - protein, 7 aa, Mycobacterium bovis
RSQFAGP

SEQ ID NO: 186376 - protein, 12 aa, Mycobacterium bovis
RSQPNPKARQTI

SEQ ID NO: 186377 - protein, 11 aa, Mycobacterium bovis
RSQQKAAEAWS

SEQ ID NO: 186378 - protein, 8 aa, Mycobacterium bovis
RSQRGRKI

SEQ ID NO: 186379 - protein, 6 aa, Mycobacterium bovis
RSQVRP

SEQ ID NO: 186380 - protein, 8 aa, Mycobacterium bovis
RSRDPSDL

SEQ ID NO: 186381 - protein, 4 aa, Mycobacterium bovis
RSRE

SEQ ID NO: 186382 - protein, 5 aa, Mycobacterium bovis
RSREE

SEQ ID NO: 186383 - protein, 5 aa, Mycobacterium bovis
RSRGA

SEQ ID NO: 186384 - protein, 15 aa, Mycobacterium bovis
RSRGGDLPESTHAPG

SEQ ID NO: 186385 - protein, 8 aa, Mycobacterium bovis
RSRKSGKN

SEQ ID NO: 186386 - protein, 12 aa, Mycobacterium bovis
RSRLPGQGVTQA

SEQ ID NO: 186387 - protein, 14 aa, Mycobacterium bovis
RSRPALRDQAAGAL

SEQ ID NO: 186388 - protein, 7 aa, Mycobacterium bovis
RSRPDRA

SEQ ID NO: 186389 - protein, 11 aa, Mycobacterium bovis
RSRQLRGPAGP

SEQ ID NO: 186390 - protein, 6 aa, Mycobacterium bovis
RSRSNV

SEQ ID NO: 186391 - protein, 4 aa, Mycobacterium bovis
RSRT

SEQ ID NO: 186392 - protein, 8 aa, Mycobacterium bovis
RSRTRAEL

SEQ ID NO: 186393 - protein, 13 aa, Mycobacterium bovis
RSRVTEPTARSTL

SEQ ID NO: 186394 - protein, 4 aa, Mycobacterium bovis
RSSA

SEQ ID NO: 186395 - protein, 31 aa, Mycobacterium bovis
RSSAAAVRAAPASSDGGSHGASRRRIAQNQR

SEQ ID NO: 186396 - protein, 5 aa, Mycobacterium bovis
RSSEP

SEQ ID NO: 186397 - protein, 6 aa, Mycobacterium bovis
RSSEVA

SEQ ID NO: 186398 - protein, 7 aa, Mycobacterium bovis
RSSGGLA

SEQ ID NO: 186399 - protein, 7 aa, Mycobacterium bovis
RSSGIRS

SEQ ID NO: 186400 - protein, 15 aa, Mycobacterium bovis
RSSGKAIGREARSRG

SEQ ID NO: 186401 - protein, 16 aa, Mycobacterium bovis
RSSGPGGQSVNTTDSA

SEQ ID NO: 186402 - protein, 13 aa, Mycobacterium bovis
RSSHLGTGGMASK

SEQ ID NO: 186403 - protein, 8 aa, Mycobacterium bovis
RSSLTGDA

SEQ ID NO: 186404 - protein, 5 aa, Mycobacterium bovis
RSSNG

SEQ ID NO: 186405 - protein, 5 aa, Mycobacterium bovis
RSSQQ

SEQ ID NO: 186406 - protein, 9 aa, Mycobacterium bovis
RSSRAEPYT

SEQ ID NO: 186407 - protein, 16 aa, Mycobacterium bovis
RSSREVARRGPGRVPD

SEQ ID NO: 186408 - protein, 7 aa, Mycobacterium bovis
RSSVDDR

SEQ ID NO: 186409 - protein, 11 aa, Mycobacterium bovis
RSTAAGSSGKY

SEQ ID NO: 186410 - protein, 7 aa, Mycobacterium bovis
RSTDDTA

SEQ ID NO: 186411 - protein, 6 aa, Mycobacterium bovis
RSTDPA

SEQ ID NO: 186412 - protein, 6 aa, Mycobacterium bovis
RSTEAQ

SEQ ID NO: 186413 - protein, 12 aa, Mycobacterium bovis
RSTFGSPPDKRL

SEQ ID NO: 186414 - protein, 4 aa, Mycobacterium bovis
RSTG

SEQ ID NO: 186415 - protein, 6 aa, Mycobacterium bovis
RSTGDD

SEQ ID NO: 186416 - protein, 8 aa, Mycobacterium bovis
RSTGPANT

SEQ ID NO: 186417 - protein, 13 aa, Mycobacterium bovis
RSTGTSEVASRSE

SEQ ID NO: 186418 - protein, 8 aa, Mycobacterium bovis
RSTHAAAG

SEQ ID NO: 186419 - protein, 9 aa, Mycobacterium bovis
RSTHDPDQV

SEQ ID NO: 186420 - protein, 4 aa, Mycobacterium bovis
RSTL

SEQ ID NO: 186421 - protein, 9 aa, Mycobacterium bovis
RSTNGQAKA

SEQ ID NO: 186422 - protein, 5 aa, Mycobacterium bovis
RSTPG

SEQ ID NO: 186423 - protein, 9 aa, Mycobacterium bovis
RSTPGGSEM

SEQ ID NO: 186424 - protein, 9 aa, Mycobacterium bovis
RSTSELPGE

SEQ ID NO: 186425 - protein, 5 aa, Mycobacterium bovis
RSTTS

SEQ ID NO: 186426 - protein, 7 aa, Mycobacterium bovis
RSTVEDA

SEQ ID NO: 186427 - protein, 6 aa, Mycobacterium bovis
RSVAER

SEQ ID NO: 186428 - protein, 14 aa, Mycobacterium bovis
RSVEGGKPPPDPDD

SEQ ID NO: 186429 - protein, 4 aa, Mycobacterium bovis
RSVR

SEQ ID NO: 186430 - protein, 11 aa, Mycobacterium bovis
RSWPRERTRAK

SEQ ID NO: 186431 - protein, 4 aa, Mycobacterium bovis
RSYT

SEQ ID NO: 186432 - protein, 8 aa, Mycobacterium bovis
RSYTGKPA

SEQ ID NO: 186433 - protein, 8 aa, Mycobacterium bovis
RTAAADDP

SEQ ID NO: 186434 - protein, 14 aa, Mycobacterium bovis
RTAAENGRLAADAP

SEQ ID NO: 186435 - protein, 10 aa, Mycobacterium bovis
RTAAGDTLTS

SEQ ID NO: 186436 - protein, 12 aa, Mycobacterium bovis
RTAASGAAATAA

SEQ ID NO: 186437 - protein, 6 aa, Mycobacterium bovis
RTAATV

SEQ ID NO: 186438 - protein, 7 aa, Mycobacterium bovis
RTADGYA

SEQ ID NO: 186439 - protein, 9 aa, Mycobacterium bovis
RTADPGDAR

SEQ ID NO: 186440 - protein, 8 aa, Mycobacterium bovis
RTADSSQR

SEQ ID NO: 186441 - protein, 5 aa, Mycobacterium bovis
RTAEN

SEQ ID NO: 186442 - protein, 6 aa, Mycobacterium bovis
RTAEQR

SEQ ID NO: 186443 - protein, 7 aa, Mycobacterium bovis
RTAERQA

SEQ ID NO: 186444 - protein, 7 aa, Mycobacterium bovis
RTAERRG

SEQ ID NO: 186445 - protein, 18 aa, Mycobacterium bovis
RTAGGAGVRLDGSTNLGA

SEQ ID NO: 186446 - protein, 12 aa, Mycobacterium bovis
RTAHGDEDHSGP

SEQ ID NO: 186447 - protein, 9 aa, Mycobacterium bovis
RTAHQDVPS

SEQ ID NO: 186448 - protein, 4 aa, Mycobacterium bovis
RTAP

SEQ ID NO: 186449 - protein, 7 aa, Mycobacterium bovis
RTAQPVR

SEQ ID NO: 186450 - protein, 8 aa, Mycobacterium bovis
RTARLEEE

SEQ ID NO: 186451 - protein, 13 aa, Mycobacterium bovis
RTARSASANRGAD

SEQ ID NO: 186452 - protein, 7 aa, Mycobacterium bovis
RTATDTC

SEQ ID NO: 186453 - protein, 10 aa, Mycobacterium bovis
RTATSGRPGG

SEQ ID NO: 186454 - protein, 7 aa, Mycobacterium bovis
RTATTGM

SEQ ID NO: 186455 - protein, 10 aa, Mycobacterium bovis
RTDDGRISQR

SEQ ID NO: 186456 - protein, 9 aa, Mycobacterium bovis
RTDEKLKET

SEQ ID NO: 186457 - protein, 20 aa, Mycobacterium bovis
RTDGRGSRPGCPDRRGTPRD

SEQ ID NO: 186458 - protein, 7 aa, Mycobacterium bovis
RTDNGEE

SEQ ID NO: 186459 - protein, 10 aa, Mycobacterium bovis
RTDPSAPKHN

SEQ ID NO: 186460 - protein, 5 aa, Mycobacterium bovis
RTDRS

SEQ ID NO: 186461 - protein, 8 aa, Mycobacterium bovis
RTDSNDSR

SEQ ID NO: 186462 - protein, 56 aa, Mycobacterium bovis
RTDSRESGKKSKSQTNGSSTSESTKSSGSSGSSGSSESKASGSTEKSTSSTTAAAA

SEQ ID NO: 186463 - protein, 18 aa, Mycobacterium bovis
RTDSSDKVQALDAGADDY

SEQ ID NO: 186464 - protein, 9 aa, Mycobacterium bovis
RTDSTGTRR

SEQ ID NO: 186465 - protein, 8 aa, Mycobacterium bovis
RTDTGESV

SEQ ID NO: 186466 - protein, 5 aa, Mycobacterium bovis
RTEAD

SEQ ID NO: 186467 - protein, 6 aa, Mycobacterium bovis
RTEESR

SEQ ID NO: 186468 - protein, 5 aa, Mycobacterium bovis
RTEGR

SEQ ID NO: 186469 - protein, 11 aa, Mycobacterium bovis
RTEKPTNEQSD

SEQ ID NO: 186470 - protein, 10 aa, Mycobacterium bovis
RTEPPLPGTR

SEQ ID NO: 186471 - protein, 11 aa, Mycobacterium bovis
RTEQEAVRTQT

SEQ ID NO: 186472 - protein, 5 aa, Mycobacterium bovis
RTERH

SEQ ID NO: 186473 - protein, 17 aa, Mycobacterium bovis
RTETGKGASRRARRAGK

SEQ ID NO: 186474 - protein, 6 aa, Mycobacterium bovis
RTGARP

SEQ ID NO: 186475 - protein, 9 aa, Mycobacterium bovis
RTGATEDAD

SEQ ID NO: 186476 - protein, 7 aa, Mycobacterium bovis
RTGDEIH

SEQ ID NO: 186477 - protein, 6 aa, Mycobacterium bovis
RTGDGI

SEQ ID NO: 186478 - protein, 7 aa, Mycobacterium bovis
RTGDPLA

SEQ ID NO: 186479 - protein, 6 aa, Mycobacterium bovis
RTGDQP

SEQ ID NO: 186480 - protein, 7 aa, Mycobacterium bovis
RTGDTHE

SEQ ID NO: 186481 - protein, 8 aa, Mycobacterium bovis
RTGEAPEQ

SEQ ID NO: 186482 - protein, 10 aa, Mycobacterium bovis
RTGEPSGGSL

SEQ ID NO: 186483 - protein, 9 aa, Mycobacterium bovis
RTGEQYPDE

SEQ ID NO: 186484 - protein, 4 aa, Mycobacterium bovis
RTGF

SEQ ID NO: 186485 - protein, 4 aa, Mycobacterium bovis
RTGG

SEQ ID NO: 186486 - protein, 7 aa, Mycobacterium bovis
RTGGDPH

SEQ ID NO: 186487 - protein, 6 aa, Mycobacterium bovis
RTGGEV

SEQ ID NO: 186488 - protein, 8 aa, Mycobacterium bovis
RTGGGAEL

SEQ ID NO: 186489 - protein, 5 aa, Mycobacterium bovis
RTGGL

SEQ ID NO: 186490 - protein, 9 aa, Mycobacterium bovis
RTGGPGAAG

SEQ ID NO: 186491 - protein, 13 aa, Mycobacterium bovis
RTGHRGDALLIGV

SEQ ID NO: 186492 - protein, 6 aa, Mycobacterium bovis
RTGIGG

SEQ ID NO: 186493 - protein, 5 aa, Mycobacterium bovis
RTGIP

SEQ ID NO: 186494 - protein, 7 aa, Mycobacterium bovis
RTGKIGD

SEQ ID NO: 186495 - protein, 5 aa, Mycobacterium bovis
RTGKP

SEQ ID NO: 186496 - protein, 6 aa, Mycobacterium bovis
RTGNAM

SEQ ID NO: 186497 - protein, 9 aa, Mycobacterium bovis
RTGNPTRAA

SEQ ID NO: 186498 - protein, 8 aa, Mycobacterium bovis
RTGPAARA

SEQ ID NO: 186499 - protein, 10 aa, Mycobacterium bovis
RTGPGRGVRR

SEQ ID NO: 186500 - protein, 26 aa, Mycobacterium bovis
RTGQDQYQSARRLTEGETEPTPRPLN

SEQ ID NO: 186501 - protein, 5 aa, Mycobacterium bovis
RTGQP

SEQ ID NO: 186502 - protein, 10 aa, Mycobacterium bovis
RTGQRPAEAA

SEQ ID NO: 186503 - protein, 4 aa, Mycobacterium bovis
RTGR

SEQ ID NO: 186504 - protein, 10 aa, Mycobacterium bovis
RTGRAAQAAQ

SEQ ID NO: 186505 - protein, 9 aa, Mycobacterium bovis
RTGRAGRSG

SEQ ID NO: 186506 - protein, 9 aa, Mycobacterium bovis
RTGRAGRTG

SEQ ID NO: 186507 - protein, 7 aa, Mycobacterium bovis
RTGRTAT

SEQ ID NO: 186508 - protein, 12 aa, Mycobacterium bovis
RTGRTTSPHLQS

SEQ ID NO: 186509 - protein, 30 aa, Mycobacterium bovis
RTGSAELADPARAGGAVSANATDTPRRRRR

SEQ ID NO: 186510 - protein, 9 aa, Mycobacterium bovis
RTGSDGNTF

SEQ ID NO: 186511 - protein, 8 aa, Mycobacterium bovis
RTGSEGRI

SEQ ID NO: 186512 - protein, 9 aa, Mycobacterium bovis
RTGSEGRIS

SEQ ID NO: 186513 - protein, 5 aa, Mycobacterium bovis
RTGTD

SEQ ID NO: 186514 - protein, 12 aa, Mycobacterium bovis
RTHEAPPVPGAP

SEQ ID NO: 186515 - protein, 14 aa, Mycobacterium bovis
RTHGSSSSIGDGAA

SEQ ID NO: 186516 - protein, 7 aa, Mycobacterium bovis
RTHPGTT

SEQ ID NO: 186517 - protein, 19 aa, Mycobacterium bovis
RTHPHNRAHTDTMQNSKPA

SEQ ID NO: 186518 - protein, 5 aa, Mycobacterium bovis
RTHRS

SEQ ID NO: 186519 - protein, 31 aa, Mycobacterium bovis
RTIASRSDRWDASTAKSRDQLDDDNAAQRRG

SEQ ID NO: 186520 - protein, 8 aa, Mycobacterium bovis
RTIKGEQK

SEQ ID NO: 186521 - protein, 7 aa, Mycobacterium bovis
RTIPRDN

SEQ ID NO: 186522 - protein, 25 aa, Mycobacterium bovis
RTKAKQPVDATAKRPSGDDVQVSPE

SEQ ID NO: 186523 - protein, 11 aa, Mycobacterium bovis
RTKDQAGEMSE

SEQ ID NO: 186524 - protein, 13 aa, Mycobacterium bovis
RTKETDLSVPTRR

SEQ ID NO: 186525 - protein, 13 aa, Mycobacterium bovis
RTKEVFTGKTDDE

SEQ ID NO: 186526 - protein, 6 aa, Mycobacterium bovis
RTKGEY

SEQ ID NO: 186527 - protein, 5 aa, Mycobacterium bovis
RTKLT

SEQ ID NO: 186528 - protein, 8 aa, Mycobacterium bovis
RTKQQSDQ

SEQ ID NO: 186529 - protein, 4 aa, Mycobacterium bovis
RTLD

SEQ ID NO: 186530 - protein, 13 aa, Mycobacterium bovis
RTLPGKPVTLNAD

SEQ ID NO: 186531 - protein, 16 aa, Mycobacterium bovis
RTLPGSGAGIIEKRDF

SEQ ID NO: 186532 - protein, 10 aa, Mycobacterium bovis
RTNANGSKGF

SEQ ID NO: 186533 - protein, 8 aa, Mycobacterium bovis
RTNERARL

SEQ ID NO: 186534 - protein, 5 aa, Mycobacterium bovis
RTNNN

SEQ ID NO: 186535 - protein, 7 aa, Mycobacterium bovis
RTNSESI

SEQ ID NO: 186536 - protein, 4 aa, Mycobacterium bovis
RTPA

SEQ ID NO: 186537 - protein, 6 aa, Mycobacterium bovis
RTPAEG

SEQ ID NO: 186538 - protein, 4 aa, Mycobacterium bovis
RTPD

SEQ ID NO: 186539 - protein, 8 aa, Mycobacterium bovis
RTPDGVTI

SEQ ID NO: 186540 - protein, 5 aa, Mycobacterium bovis
RTPEG

SEQ ID NO: 186541 - protein, 8 aa, Mycobacterium bovis
RTPEGRID

SEQ ID NO: 186542 - protein, 9 aa, Mycobacterium bovis
RTPERDGYS

SEQ ID NO: 186543 - protein, 7 aa, Mycobacterium bovis
RTPEYGG

SEQ ID NO: 186544 - protein, 7 aa, Mycobacterium bovis
RTPFHEP

SEQ ID NO: 186545 - protein, 10 aa, Mycobacterium bovis
RTPGDPNALY

SEQ ID NO: 186546 - protein, 14 aa, Mycobacterium bovis
RTPGGSSGGSAAAV

SEQ ID NO: 186547 - protein, 6 aa, Mycobacterium bovis
RTPGRG

SEQ ID NO: 186548 - protein, 6 aa, Mycobacterium bovis
RTPGSD

SEQ ID NO: 186549 - protein, 8 aa, Mycobacterium bovis
RTPNPEAY

SEQ ID NO: 186550 - protein, 7 aa, Mycobacterium bovis
RTPPAGA

SEQ ID NO: 186551 - protein, 7 aa, Mycobacterium bovis
RTPPGAA

SEQ ID NO: 186552 - protein, 14 aa, Mycobacterium bovis
RTPPNIQPGPGQNP

SEQ ID NO: 186553 - protein, 9 aa, Mycobacterium bovis
RTPPYPTAT

SEQ ID NO: 186554 - protein, 7 aa, Mycobacterium bovis
RTPRGRV

SEQ ID NO: 186555 - protein, 6 aa, Mycobacterium bovis
RTPRMA

SEQ ID NO: 186556 - protein, 4 aa, Mycobacterium bovis
RTPS

SEQ ID NO: 186557 - protein, 7 aa, Mycobacterium bovis
RTPSDAA

SEQ ID NO: 186558 - protein, 6 aa, Mycobacterium bovis
RTPTVT

SEQ ID NO: 186559 - protein, 4 aa, Mycobacterium bovis
RTPV

SEQ ID NO: 186560 - protein, 6 aa, Mycobacterium bovis
RTQDAA

SEQ ID NO: 186561 - protein, 8 aa, Mycobacterium bovis
RTQPTQKM

SEQ ID NO: 186562 - protein, 19 aa, Mycobacterium bovis
RTQRTDPDVAPEPIGPPGI

SEQ ID NO: 186563 - protein, 4 aa, Mycobacterium bovis
RTQV

SEQ ID NO: 186564 - protein, 16 aa, Mycobacterium bovis
RTRAGDAHTAGQPGRA

SEQ ID NO: 186565 - protein, 4 aa, Mycobacterium bovis
RTRD

SEQ ID NO: 186566 - protein, 5 aa, Mycobacterium bovis
RTRDR

SEQ ID NO: 186567 - protein, 6 aa, Mycobacterium bovis
RTREAL

SEQ ID NO: 186568 - protein, 12 aa, Mycobacterium bovis
RTREATKQAQTL

SEQ ID NO: 186569 - protein, 6 aa, Mycobacterium bovis
RTRGDQ

SEQ ID NO: 186570 - protein, 5 aa, Mycobacterium bovis
RTRGG

SEQ ID NO: 186571 - protein, 6 aa, Mycobacterium bovis
RTRKAG

SEQ ID NO: 186572 - protein, 17 aa, Mycobacterium bovis
RTRPGRGPGPRPGGSAM

SEQ ID NO: 186573 - protein, 4 aa, Mycobacterium bovis
RTRR

SEQ ID NO: 186574 - protein, 8 aa, Mycobacterium bovis
RTRRPPAF

SEQ ID NO: 186575 - protein, 4 aa, Mycobacterium bovis
RTRS

SEQ ID NO: 186576 - protein, 6 aa, Mycobacterium bovis
RTRSEL

SEQ ID NO: 186577 - protein, 5 aa, Mycobacterium bovis
RTRSN

SEQ ID NO: 186578 - protein, 7 aa, Mycobacterium bovis
RTRSPAA

SEQ ID NO: 186579 - protein, 4 aa, Mycobacterium bovis
RTRT

SEQ ID NO: 186580 - protein, 7 aa, Mycobacterium bovis
RTRTRGE

SEQ ID NO: 186581 - protein, 4 aa, Mycobacterium bovis
RTSD

SEQ ID NO: 186582 - protein, 8 aa, Mycobacterium bovis
RTSDDDMA

SEQ ID NO: 186583 - protein, 10 aa, Mycobacterium bovis
RTSDGPEAVE

SEQ ID NO: 186584 - protein, 6 aa, Mycobacterium bovis
RTSDPD

SEQ ID NO: 186585 - protein, 7 aa, Mycobacterium bovis
RTSDQDM

SEQ ID NO: 186586 - protein, 6 aa, Mycobacterium bovis
RTSESE

SEQ ID NO: 186587 - protein, 10 aa, Mycobacterium bovis
RTSGEERTRV

SEQ ID NO: 186588 - protein, 5 aa, Mycobacterium bovis
RTSGL

SEQ ID NO: 186589 - protein, 11 aa, Mycobacterium bovis
RTSGRAVSSAT

SEQ ID NO: 186590 - protein, 10 aa, Mycobacterium bovis
RTSGRTPNGV

SEQ ID NO: 186591 - protein, 5 aa, Mycobacterium bovis
RTSIR

SEQ ID NO: 186592 - protein, 6 aa, Mycobacterium bovis
RTSKRT

SEQ ID NO: 186593 - protein, 20 aa, Mycobacterium bovis
RTSRKAGTDVDRAAAAADGC

SEQ ID NO: 186594 - protein, 5 aa, Mycobacterium bovis
RTSSA

SEQ ID NO: 186595 - protein, 7 aa, Mycobacterium bovis
RTSSELD

SEQ ID NO: 186596 - protein, 10 aa, Mycobacterium bovis
RTSTPSISRS

SEQ ID NO: 186597 - protein, 6 aa, Mycobacterium bovis
RTTDPD

SEQ ID NO: 186598 - protein, 5 aa, Mycobacterium bovis
RTTGD

SEQ ID NO: 186599 - protein, 5 aa, Mycobacterium bovis
RTTHP

SEQ ID NO: 186600 - protein, 8 aa, Mycobacterium bovis
RTTPDPAR

SEQ ID NO: 186601 - protein, 6 aa, Mycobacterium bovis
RTTPPI

SEQ ID NO: 186602 - protein, 8 aa, Mycobacterium bovis
RTVADPGS

SEQ ID NO: 186603 - protein, 8 aa, Mycobacterium bovis
RTVAPGRE

SEQ ID NO: 186604 - protein, 6 aa, Mycobacterium bovis
RTYPKT

SEQ ID NO: 186605 - protein, 5 aa, Mycobacterium bovis
RTYSA

SEQ ID NO: 186606 - protein, 6 aa, Mycobacterium bovis
RVAGAD

SEQ ID NO: 186607 - protein, 6 aa, Mycobacterium bovis
RVAGGA

SEQ ID NO: 186608 - protein, 9 aa, Mycobacterium bovis
RVAKETGGH

SEQ ID NO: 186609 - protein, 12 aa, Mycobacterium bovis
RVAPGGYEPMGG

SEQ ID NO: 186610 - protein, 6 aa, Mycobacterium bovis
RVAPSG

SEQ ID NO: 186611 - protein, 9 aa, Mycobacterium bovis
RVAQGDSAP

SEQ ID NO: 186612 - protein, 9 aa, Mycobacterium bovis
RVASAADAQ

SEQ ID NO: 186613 - protein, 9 aa, Mycobacterium bovis
RVASDGEPL

SEQ ID NO: 186614 - protein, 7 aa, Mycobacterium bovis
RVATGRD

SEQ ID NO: 186615 - protein, 5 aa, Mycobacterium bovis
RVDEE

SEQ ID NO: 186616 - protein, 6 aa, Mycobacterium bovis
RVDGRS

SEQ ID NO: 186617 - protein, 14 aa, Mycobacterium bovis
RVDPAKDADGLHPT

SEQ ID NO: 186618 - protein, 6 aa, Mycobacterium bovis
RVDPDR

SEQ ID NO: 186619 - protein, 7 aa, Mycobacterium bovis
RVDPQSD

SEQ ID NO: 186620 - protein, 13 aa, Mycobacterium bovis
RVEDPVGSQPQVG

SEQ ID NO: 186621 - protein, 6 aa, Mycobacterium bovis
RVEGAT

SEQ ID NO: 186622 - protein, 10 aa, Mycobacterium bovis
RVERADGSTV

SEQ ID NO: 186623 - protein, 11 aa, Mycobacterium bovis
RVGARADERLR

SEQ ID NO: 186624 - protein, 8 aa, Mycobacterium bovis
RVGDPDEH

SEQ ID NO: 186625 - protein, 14 aa, Mycobacterium bovis
RVGEDDTGLNTGGM

SEQ ID NO: 186626 - protein, 6 aa, Mycobacterium bovis
RVGGAA

SEQ ID NO: 186627 - protein, 7 aa, Mycobacterium bovis
RVGGAER

SEQ ID NO: 186628 - protein, 6 aa, Mycobacterium bovis
RVGGAT

SEQ ID NO: 186629 - protein, 8 aa, Mycobacterium bovis
RVGGMSPN

SEQ ID NO: 186630 - protein, 12 aa, Mycobacterium bovis
RVGHRDAAGQVA

SEQ ID NO: 186631 - protein, 10 aa, Mycobacterium bovis
RVGPGDGAWR

SEQ ID NO: 186632 - protein, 12 aa, Mycobacterium bovis
RVGPGRGSAAGS

SEQ ID NO: 186633 - protein, 9 aa, Mycobacterium bovis
RVGPSTGTN

SEQ ID NO: 186634 - protein, 7 aa, Mycobacterium bovis
RVGSTAA

SEQ ID NO: 186635 - protein, 6 aa, Mycobacterium bovis
RVKRDD

SEQ ID NO: 186636 - protein, 11 aa, Mycobacterium bovis
RVNEKAPKDRD

SEQ ID NO: 186637 - protein, 5 aa, Mycobacterium bovis
RVNPL

SEQ ID NO: 186638 - protein, 7 aa, Mycobacterium bovis
RVPAADD

SEQ ID NO: 186639 - protein, 6 aa, Mycobacterium bovis
RVPDPG

SEQ ID NO: 186640 - protein, 6 aa, Mycobacterium bovis
RVPEPS

SEQ ID NO: 186641 - protein, 8 aa, Mycobacterium bovis
RVPGPDGK

SEQ ID NO: 186642 - protein, 6 aa, Mycobacterium bovis
RVPPAD

SEQ ID NO: 186643 - protein, 8 aa, Mycobacterium bovis
RVPPGPGQ

SEQ ID NO: 186644 - protein, 7 aa, Mycobacterium bovis
RVPPTRP

SEQ ID NO: 186645 - protein, 8 aa, Mycobacterium bovis
RVPRPAPS

SEQ ID NO: 186646 - protein, 12 aa, Mycobacterium bovis
RVPSEREREQLR

SEQ ID NO: 186647 - protein, 5 aa, Mycobacterium bovis
RVQGA

SEQ ID NO: 186648 - protein, 14 aa, Mycobacterium bovis
RVQPSGKGGLRPGV

SEQ ID NO: 186649 - protein, 4 aa, Mycobacterium bovis
RVRE

SEQ ID NO: 186650 - protein, 5 aa, Mycobacterium bovis
RVRGQ

SEQ ID NO: 186651 - protein, 7 aa, Mycobacterium bovis
RVRPGSD

SEQ ID NO: 186652 - protein, 9 aa, Mycobacterium bovis
RVRPRGEDS

SEQ ID NO: 186653 - protein, 5 aa, Mycobacterium bovis
RVRQR

SEQ ID NO: 186654 - protein, 6 aa, Mycobacterium bovis
RVRRTE

SEQ ID NO: 186655 - protein, 8 aa, Mycobacterium bovis
RVRSSEPV

SEQ ID NO: 186656 - protein, 10 aa, Mycobacterium bovis
RVSDSGEGRW

SEQ ID NO: 186657 - protein, 9 aa, Mycobacterium bovis
RVSGPDPVP

SEQ ID NO: 186658 - protein, 9 aa, Mycobacterium bovis
RVSKGGNPL

SEQ ID NO: 186659 - protein, 4 aa, Mycobacterium bovis
RVSN

SEQ ID NO: 186660 - protein, 4 aa, Mycobacterium bovis
RVSP

SEQ ID NO: 186661 - protein, 7 aa, Mycobacterium bovis
RVSPTPV

SEQ ID NO: 186662 - protein, 15 aa, Mycobacterium bovis
RVSRSSALASKATGF

SEQ ID NO: 186663 - protein, 4 aa, Mycobacterium bovis
RVST

SEQ ID NO: 186664 - protein, 5 aa, Mycobacterium bovis
RVTAD

SEQ ID NO: 186665 - protein, 4 aa, Mycobacterium bovis
RVTR

SEQ ID NO: 186666 - protein, 6 aa, Mycobacterium bovis
RVTRAR

SEQ ID NO: 186667 - protein, 5 aa, Mycobacterium bovis
RVTTR

SEQ ID NO: 186668 - protein, 5 aa, Mycobacterium bovis
RVTTS

SEQ ID NO: 186669 - protein, 4 aa, Mycobacterium bovis
RWAS

SEQ ID NO: 186670 - protein, 6 aa, Mycobacterium bovis
RWDPGK

SEQ ID NO: 186671 - protein, 10 aa, Mycobacterium bovis
RWDPTNGQGR

SEQ ID NO: 186672 - protein, 7 aa, Mycobacterium bovis
RWEGSPD

SEQ ID NO: 186673 - protein, 5 aa, Mycobacterium bovis
RWPRA

SEQ ID NO: 186674 - protein, 5 aa, Mycobacterium bovis
RWPSA

SEQ ID NO: 186675 - protein, 4 aa, Mycobacterium bovis
RWQG

SEQ ID NO: 186676 - protein, 16 aa, Mycobacterium bovis
RWRDSGMAGTDQRSQR

SEQ ID NO: 186677 - protein, 16 aa, Mycobacterium bovis
RWTPTWDDDERAAGYA

SEQ ID NO: 186678 - protein, 17 aa, Mycobacterium bovis
RYAAQTSDIPYGPGGRE

SEQ ID NO: 186679 - protein, 7 aa, Mycobacterium bovis
RYAESQH

SEQ ID NO: 186680 - protein, 8 aa, Mycobacterium bovis
RYANPDVT

SEQ ID NO: 186681 - protein, 8 aa, Mycobacterium bovis
RYATGAAR

SEQ ID NO: 186682 - protein, 5 aa, Mycobacterium bovis
RYDAP

SEQ ID NO: 186683 - protein, 6 aa, Mycobacterium bovis
RYEDVR

SEQ ID NO: 186684 - protein, 22 aa, Mycobacterium bovis
RYEEPGSGLNRAARRASGARGR

SEQ ID NO: 186685 - protein, 7 aa, Mycobacterium bovis
RYEGGST

SEQ ID NO: 186686 - protein, 9 aa, Mycobacterium bovis
RYEGPTDPN

SEQ ID NO: 186687 - protein, 9 aa, Mycobacterium bovis
RYGDESRSI

SEQ ID NO: 186688 - protein, 4 aa, Mycobacterium bovis
RYGG

SEQ ID NO: 186689 - protein, 5 aa, Mycobacterium bovis
RYGPD

SEQ ID NO: 186690 - protein, 4 aa, Mycobacterium bovis
RYGQ

SEQ ID NO: 186691 - protein, 8 aa, Mycobacterium bovis
RYGQPGKT

SEQ ID NO: 186692 - protein, 7 aa, Mycobacterium bovis
RYGRTRS

SEQ ID NO: 186693 - protein, 15 aa, Mycobacterium bovis
RYNQARRSGGSTGWP

SEQ ID NO: 186694 - protein, 5 aa, Mycobacterium bovis
RYNRE

SEQ ID NO: 186695 - protein, 5 aa, Mycobacterium bovis
RYPDG

SEQ ID NO: 186696 - protein, 17 aa, Mycobacterium bovis
RYPEAGRATATKSSRHS

SEQ ID NO: 186697 - protein, 6 aa, Mycobacterium bovis
RYPEQR

SEQ ID NO: 186698 - protein, 11 aa, Mycobacterium bovis
RYPGADAPTVD

SEQ ID NO: 186699 - protein, 7 aa, Mycobacterium bovis
RYPGAPR

SEQ ID NO: 186700 - protein, 10 aa, Mycobacterium bovis
RYPGTDRPAL

SEQ ID NO: 186701 - protein, 6 aa, Mycobacterium bovis
RYPHPA

SEQ ID NO: 186702 - protein, 7 aa, Mycobacterium bovis
RYPPDAV

SEQ ID NO: 186703 - protein, 7 aa, Mycobacterium bovis
RYPQSNG

SEQ ID NO: 186704 - protein, 12 aa, Mycobacterium bovis
RYPSTDDVHRAQ

SEQ ID NO: 186705 - protein, 5 aa, Mycobacterium bovis
RYRGD

SEQ ID NO: 186706 - protein, 9 aa, Mycobacterium bovis
RYRPADSAA

SEQ ID NO: 186707 - protein, 13 aa, Mycobacterium bovis
RYSPSIEATSKRG

SEQ ID NO: 186708 - protein, 5 aa, Mycobacterium bovis
RYTDT

SEQ ID NO: 186709 - protein, 5 aa, Mycobacterium bovis
RYTGR

SEQ ID NO: 186710 - protein, 6 aa, Mycobacterium bovis
RYTGRG

SEQ ID NO: 186711 - protein, 8 aa, Mycobacterium bovis
RYTQPTGA

SEQ ID NO: 186712 - protein, 16 aa, Mycobacterium bovis
RYYGDPSNKPNPNLGE

SEQ ID NO: 186713 - protein, 11 aa, Mycobacterium bovis
SAAAAAGRAAP

SEQ ID NO: 186714 - protein, 12 aa, Mycobacterium bovis
SAAAAGQARAAA

SEQ ID NO: 186715 - protein, 14 aa, Mycobacterium bovis
SAAAAGQARAAAAV

SEQ ID NO: 186716 - protein, 9 aa, Mycobacterium bovis
SAAAAPRFH

SEQ ID NO: 186717 - protein, 10 aa, Mycobacterium bovis
SAAADRARGV

SEQ ID NO: 186718 - protein, 16 aa, Mycobacterium bovis
SAAAEGARQSRSAKQQ

SEQ ID NO: 186719 - protein, 12 aa, Mycobacterium bovis
SAAAQAKKAVER

SEQ ID NO: 186720 - protein, 22 aa, Mycobacterium bovis
SAAARAVKGDVEKSLKQFAELY

SEQ ID NO: 186721 - protein, 8 aa, Mycobacterium bovis
SAAARGLT

SEQ ID NO: 186722 - protein, 22 aa, Mycobacterium bovis
SAAASLRYSDPDSVAVENISAA

SEQ ID NO: 186723 - protein, 6 aa, Mycobacterium bovis
SAADAA

SEQ ID NO: 186724 - protein, 10 aa, Mycobacterium bovis
SAADAAEYNE

SEQ ID NO: 186725 - protein, 8 aa, Mycobacterium bovis
SAADEATL

SEQ ID NO: 186726 - protein, 12 aa, Mycobacterium bovis
SAADGESTSQVR

SEQ ID NO: 186727 - protein, 11 aa, Mycobacterium bovis
SAADGPRLHPD

SEQ ID NO: 186728 - protein, 8 aa, Mycobacterium bovis
SAADRQSD

SEQ ID NO: 186729 - protein, 8 aa, Mycobacterium bovis
SAAEADPA

SEQ ID NO: 186730 - protein, 16 aa, Mycobacterium bovis
SAAENLAETASKVGGT

SEQ ID NO: 186731 - protein, 12 aa, Mycobacterium bovis
SAAEPGAAGRHA

SEQ ID NO: 186732 - protein, 9 aa, Mycobacterium bovis
SAAERGPGQ

SEQ ID NO: 186733 - protein, 9 aa, Mycobacterium bovis
SAAETGSHD

SEQ ID NO: 186734 - protein, 16 aa, Mycobacterium bovis
SAAGGEPAGLGARDTL

SEQ ID NO: 186735 - protein, 8 aa, Mycobacterium bovis
SAAGGTER

SEQ ID NO: 186736 - protein, 6 aa, Mycobacterium bovis
SAAGKI

SEQ ID NO: 186737 - protein, 11 aa, Mycobacterium bovis
SAAGNSPIPYN

SEQ ID NO: 186738 - protein, 6 aa, Mycobacterium bovis
SAAGSA

SEQ ID NO: 186739 - protein, 9 aa, Mycobacterium bovis
SAAGSGSQR

SEQ ID NO: 186740 - protein, 17 aa, Mycobacterium bovis
SAAGSYAAAEAANASPM

SEQ ID NO: 186741 - protein, 10 aa, Mycobacterium bovis
SAAHRRETYT

SEQ ID NO: 186742 - protein, 13 aa, Mycobacterium bovis
SAAKGTGAYAGPR

SEQ ID NO: 186743 - protein, 13 aa, Mycobacterium bovis
SAANAAAAAPTTA

SEQ ID NO: 186744 - protein, 8 aa, Mycobacterium bovis
SAAPAYGS

SEQ ID NO: 186745 - protein, 11 aa, Mycobacterium bovis
SAAPEAAPGSL

SEQ ID NO: 186746 - protein, 8 aa, Mycobacterium bovis
SAAPEAEA

SEQ ID NO: 186747 - protein, 10 aa, Mycobacterium bovis
SAAPESLGGD

SEQ ID NO: 186748 - protein, 10 aa, Mycobacterium bovis
SAAPGDPAPN

SEQ ID NO: 186749 - protein, 9 aa, Mycobacterium bovis
SAAPPAELS

SEQ ID NO: 186750 - protein, 7 aa, Mycobacterium bovis
SAAQRAE

SEQ ID NO: 186751 - protein, 15 aa, Mycobacterium bovis
SAARKSGQRRGGGAI

SEQ ID NO: 186752 - protein, 7 aa, Mycobacterium bovis
SAARTIA

SEQ ID NO: 186753 - protein, 5 aa, Mycobacterium bovis
SAASA

SEQ ID NO: 186754 - protein, 8 aa, Mycobacterium bovis
SAASEVDQ

SEQ ID NO: 186755 - protein, 6 aa, Mycobacterium bovis
SAASQG

SEQ ID NO: 186756 - protein, 14 aa, Mycobacterium bovis
SAASSAPASPGRRP

SEQ ID NO: 186757 - protein, 10 aa, Mycobacterium bovis
SAASSKEDRL

SEQ ID NO: 186758 - protein, 10 aa, Mycobacterium bovis
SAASVSWSNP

SEQ ID NO: 186759 - protein, 9 aa, Mycobacterium bovis
SAATDDEGR

SEQ ID NO: 186760 - protein, 13 aa, Mycobacterium bovis
SAATEDDQTYDGA

SEQ ID NO: 186761 - protein, 12 aa, Mycobacterium bovis
SAATELDDDPDI

SEQ ID NO: 186762 - protein, 8 aa, Mycobacterium bovis
SAATGGAF

SEQ ID NO: 186763 - protein, 12 aa, Mycobacterium bovis
SAATGPIPHAPS

SEQ ID NO: 186764 - protein, 24 aa, Mycobacterium bovis
SAATPDTGPDLDNAHGQAETDTEQ

SEQ ID NO: 186765 - protein, 7 aa, Mycobacterium bovis
SAATQGL

SEQ ID NO: 186766 - protein, 5 aa, Mycobacterium bovis
SAATR

SEQ ID NO: 186767 - protein, 20 aa, Mycobacterium bovis
SAAVPDRDGTSHAAPSNAPG

SEQ ID NO: 186768 - protein, 4 aa, Mycobacterium bovis
SAAW

SEQ ID NO: 186769 - protein, 5 aa, Mycobacterium bovis
SACGK

SEQ ID NO: 186770 - protein, 9 aa, Mycobacterium bovis
SACTDGGKG

SEQ ID NO: 186771 - protein, 8 aa, Mycobacterium bovis
SADADNPC

SEQ ID NO: 186772 - protein, 7 aa, Mycobacterium bovis
SADAPVD

SEQ ID NO: 186773 - protein, 5 aa, Mycobacterium bovis
SADDF

SEQ ID NO: 186774 - protein, 8 aa, Mycobacterium bovis
SADDKDAA

SEQ ID NO: 186775 - protein, 19 aa, Mycobacterium bovis
SADDPRAAAEQLRSALTAA

SEQ ID NO: 186776 - protein, 13 aa, Mycobacterium bovis
SADEFASDPARFG

SEQ ID NO: 186777 - protein, 6 aa, Mycobacterium bovis
SADEHL

SEQ ID NO: 186778 - protein, 20 aa, Mycobacterium bovis
SADGATVDLGSPAAQAIWVV

SEQ ID NO: 186779 - protein, 10 aa, Mycobacterium bovis
SADGLTPREQ

SEQ ID NO: 186780 - protein, 7 aa, Mycobacterium bovis
SADGMVR

SEQ ID NO: 186781 - protein, 8 aa, Mycobacterium bovis
SADGSGDL

SEQ ID NO: 186782 - protein, 8 aa, Mycobacterium bovis
SADGSPPY

SEQ ID NO: 186783 - protein, 10 aa, Mycobacterium bovis
SADGSPYATG

SEQ ID NO: 186784 - protein, 7 aa, Mycobacterium bovis
SADGSTV

SEQ ID NO: 186785 - protein, 16 aa, Mycobacterium bovis
SADHPDGLRQTRVGDA

SEQ ID NO: 186786 - protein, 15 aa, Mycobacterium bovis
SADLPEASDDNERTS

SEQ ID NO: 186787 - protein, 4 aa, Mycobacterium bovis
SADN

SEQ ID NO: 186788 - protein, 8 aa, Mycobacterium bovis
SADPHAKP

SEQ ID NO: 186789 - protein, 8 aa, Mycobacterium bovis
SADPPSTA

SEQ ID NO: 186790 - protein, 10 aa, Mycobacterium bovis
SADPSPAAQV

SEQ ID NO: 186791 - protein, 7 aa, Mycobacterium bovis
SADQQAT

SEQ ID NO: 186792 - protein, 9 aa, Mycobacterium bovis
SADRDSARV

SEQ ID NO: 186793 - protein, 6 aa, Mycobacterium bovis
SADREE

SEQ ID NO: 186794 - protein, 10 aa, Mycobacterium bovis
SADSRGQFPG

SEQ ID NO: 186795 - protein, 9 aa, Mycobacterium bovis
SAEALTAQA

SEQ ID NO: 186796 - protein, 7 aa, Mycobacterium bovis
SAEATGI

SEQ ID NO: 186797 - protein, 5 aa, Mycobacterium bovis
SAEDL

SEQ ID NO: 186798 - protein, 4 aa, Mycobacterium bovis
SAEE

SEQ ID NO: 186799 - protein, 13 aa, Mycobacterium bovis
SAEEKPYARRPYP

SEQ ID NO: 186800 - protein, 7 aa, Mycobacterium bovis
SAEETAK

SEQ ID NO: 186801 - protein, 9 aa, Mycobacterium bovis
SAEFPEADL

SEQ ID NO: 186802 - protein, 7 aa, Mycobacterium bovis
SAEGNGN

SEQ ID NO: 186803 - protein, 6 aa, Mycobacterium bovis
SAEGRV

SEQ ID NO: 186804 - protein, 10 aa, Mycobacterium bovis
SAEIERDRRL

SEQ ID NO: 186805 - protein, 4 aa, Mycobacterium bovis
SAEN

SEQ ID NO: 186806 - protein, 6 aa, Mycobacterium bovis
SAEPKV

SEQ ID NO: 186807 - protein, 17 aa, Mycobacterium bovis
SAEQAKWGQKAVEDEGL

SEQ ID NO: 186808 - protein, 6 aa, Mycobacterium bovis
SAEQQD

SEQ ID NO: 186809 - protein, 12 aa, Mycobacterium bovis
SAERAPAGCTDG

SEQ ID NO: 186810 - protein, 7 aa, Mycobacterium bovis
SAETDRA

SEQ ID NO: 186811 - protein, 7 aa, Mycobacterium bovis
SAETISA

SEQ ID NO: 186812 - protein, 7 aa, Mycobacterium bovis
SAEVAGP

SEQ ID NO: 186813 - protein, 6 aa, Mycobacterium bovis
SAEVAS

SEQ ID NO: 186814 - protein, 9 aa, Mycobacterium bovis
SAEVDASYA

SEQ ID NO: 186815 - protein, 6 aa, Mycobacterium bovis
SAFAAK

SEQ ID NO: 186816 - protein, 7 aa, Mycobacterium bovis
SAFGANQ

SEQ ID NO: 186817 - protein, 16 aa, Mycobacterium bovis
SAFGDAARAAQTSFDS

SEQ ID NO: 186818 - protein, 10 aa, Mycobacterium bovis
SAFGNRGPWS

SEQ ID NO: 186819 - protein, 10 aa, Mycobacterium bovis
SAGAGDPDDV

SEQ ID NO: 186820 - protein, 7 aa, Mycobacterium bovis
SAGARGR

SEQ ID NO: 186821 - protein, 10 aa, Mycobacterium bovis
SAGDDAQAAA

SEQ ID NO: 186822 - protein, 22 aa, Mycobacterium bovis
SAGDDGPGRGIGSRSRQQGRPA

SEQ ID NO: 186823 - protein, 8 aa, Mycobacterium bovis
SAGDGRTV

SEQ ID NO: 186824 - protein, 8 aa, Mycobacterium bovis
SAGDLQSV

SEQ ID NO: 186825 - protein, 8 aa, Mycobacterium bovis
SAGDPATL

SEQ ID NO: 186826 - protein, 24 aa, Mycobacterium bovis
SAGEAEEAEPADEGAARAASDEAT

SEQ ID NO: 186827 - protein, 13 aa, Mycobacterium bovis
SAGETGDFRPNPS

SEQ ID NO: 186828 - protein, 8 aa, Mycobacterium bovis
SAGGGGRG

SEQ ID NO: 186829 - protein, 5 aa, Mycobacterium bovis
SAGGH

SEQ ID NO: 186830 - protein, 9 aa, Mycobacterium bovis
SAGGQASSV

SEQ ID NO: 186831 - protein, 7 aa, Mycobacterium bovis
SAGKAIN

SEQ ID NO: 186832 - protein, 5 aa, Mycobacterium bovis
SAGKI

SEQ ID NO: 186833 - protein, 12 aa, Mycobacterium bovis
SAGLGGADGVRV

SEQ ID NO: 186834 - protein, 6 aa, Mycobacterium bovis
SAGLGL

SEQ ID NO: 186835 - protein, 15 aa, Mycobacterium bovis
SAGLKATPGNGHYAA

SEQ ID NO: 186836 - protein, 7 aa, Mycobacterium bovis
SAGNHAQ

SEQ ID NO: 186837 - protein, 4 aa, Mycobacterium bovis
SAGP

SEQ ID NO: 186838 - protein, 7 aa, Mycobacterium bovis
SAGPQRN

SEQ ID NO: 186839 - protein, 4 aa, Mycobacterium bovis
SAGQ

SEQ ID NO: 186840 - protein, 14 aa, Mycobacterium bovis
SAGQAKPCATGAGT

SEQ ID NO: 186841 - protein, 15 aa, Mycobacterium bovis
SAGQPSAGAPEPVRA

SEQ ID NO: 186842 - protein, 9 aa, Mycobacterium bovis
SAGQSTGGG

SEQ ID NO: 186843 - protein, 6 aa, Mycobacterium bovis
SAGQSW

SEQ ID NO: 186844 - protein, 4 aa, Mycobacterium bovis
SAGS

SEQ ID NO: 186845 - protein, 6 aa, Mycobacterium bovis
SAGSET

SEQ ID NO: 186846 - protein, 10 aa, Mycobacterium bovis
SAGSPEVDPD

SEQ ID NO: 186847 - protein, 6 aa, Mycobacterium bovis
SAGSTV

SEQ ID NO: 186848 - protein, 5 aa, Mycobacterium bovis
SAGTA

SEQ ID NO: 186849 - protein, 7 aa, Mycobacterium bovis
SAGTLST

SEQ ID NO: 186850 - protein, 9 aa, Mycobacterium bovis
SAGTPDGSW

SEQ ID NO: 186851 - protein, 5 aa, Mycobacterium bovis
SAGTT

SEQ ID NO: 186852 - protein, 21 aa, Mycobacterium bovis
SAGTYAATEAANSSAAASPLS

SEQ ID NO: 186853 - protein, 16 aa, Mycobacterium bovis
SAGVQARNPKYSSYLP

SEQ ID NO: 186854 - protein, 6 aa, Mycobacterium bovis
SAGVSA

SEQ ID NO: 186855 - protein, 12 aa, Mycobacterium bovis
SAGYATGGMSTA

SEQ ID NO: 186856 - protein, 4 aa, Mycobacterium bovis
SAHA

SEQ ID NO: 186857 - protein, 7 aa, Mycobacterium bovis
SAHEGRR

SEQ ID NO: 186858 - protein, 4 aa, Mycobacterium bovis
SAHG

SEQ ID NO: 186859 - protein, 12 aa, Mycobacterium bovis
SAHGTNAASAAL

SEQ ID NO: 186860 - protein, 7 aa, Mycobacterium bovis
SAHSADG

SEQ ID NO: 186861 - protein, 5 aa, Mycobacterium bovis
SAIEP

SEQ ID NO: 186862 - protein, 15 aa, Mycobacterium bovis
SAISTANAAAAAATT

SEQ ID NO: 186863 - protein, 8 aa, Mycobacterium bovis
SAISTSHG

SEQ ID NO: 186864 - protein, 6 aa, Mycobacterium bovis
SAKGIP

SEQ ID NO: 186865 - protein, 8 aa, Mycobacterium bovis
SAKKNEPD

SEQ ID NO: 186866 - protein, 9 aa, Mycobacterium bovis
SAKLDDGAS

SEQ ID NO: 186867 - protein, 4 aa, Mycobacterium bovis
SAKP

SEQ ID NO: 186868 - protein, 8 aa, Mycobacterium bovis
SAKQDGRN

SEQ ID NO: 186869 - protein, 13 aa, Mycobacterium bovis
SAKRGGGAKNTDK

SEQ ID NO: 186870 - protein, 5 aa, Mycobacterium bovis
SAKSD

SEQ ID NO: 186871 - protein, 16 aa, Mycobacterium bovis
SAKSNMGHSTASAGTV

SEQ ID NO: 186872 - protein, 7 aa, Mycobacterium bovis
SAKTGRA

SEQ ID NO: 186873 - protein, 23 aa, Mycobacterium bovis
SAKVDCGGKKTLKASGSTAQANA

SEQ ID NO: 186874 - protein, 4 aa, Mycobacterium bovis
SALA

SEQ ID NO: 186875 - protein, 11 aa, Mycobacterium bovis
SALPAGRPRMA

SEQ ID NO: 186876 - protein, 27 aa, Mycobacterium bovis
SALPNGPKVSHGGALSPRGDWRAPSDM

SEQ ID NO: 186877 - protein, 7 aa, Mycobacterium bovis
SALPTYN

SEQ ID NO: 186878 - protein, 8 aa, Mycobacterium bovis
SALRDSAP

SEQ ID NO: 186879 - protein, 4 aa, Mycobacterium bovis
SALS

SEQ ID NO: 186880 - protein, 7 aa, Mycobacterium bovis
SALTERQ

SEQ ID NO: 186881 - protein, 6 aa, Mycobacterium bovis
SAMRPQ

SEQ ID NO: 186882 - protein, 12 aa, Mycobacterium bovis
SAMTSSRRDHRE

SEQ ID NO: 186883 - protein, 5 aa, Mycobacterium bovis
SANAN

SEQ ID NO: 186884 - protein, 21 aa, Mycobacterium bovis
SANDPALQPGFESADTAVQAA

SEQ ID NO: 186885 - protein, 11 aa, Mycobacterium bovis
SANEADAAQQF

SEQ ID NO: 186886 - protein, 19 aa, Mycobacterium bovis
SANFGSANIGGNNIGGANT

SEQ ID NO: 186887 - protein, 9 aa, Mycobacterium bovis
SANGLTPQQ

SEQ ID NO: 186888 - protein, 6 aa, Mycobacterium bovis
SANGPL

SEQ ID NO: 186889 - protein, 18 aa, Mycobacterium bovis
SANLGSANLGSANLGNSN

SEQ ID NO: 186890 - protein, 6 aa, Mycobacterium bovis
SANRDN

SEQ ID NO: 186891 - protein, 19 aa, Mycobacterium bovis
SANSAAMATRQETAATAYG

SEQ ID NO: 186892 - protein, 8 aa, Mycobacterium bovis
SANTLGKE

SEQ ID NO: 186893 - protein, 5 aa, Mycobacterium bovis
SAPAA

SEQ ID NO: 186894 - protein, 6 aa, Mycobacterium bovis
SAPAAA

SEQ ID NO: 186895 - protein, 7 aa, Mycobacterium bovis
SAPAAAA

SEQ ID NO: 186896 - protein, 10 aa, Mycobacterium bovis
SAPAGDERNP

SEQ ID NO: 186897 - protein, 25 aa, Mycobacterium bovis
SAPAPAERPAPPAMSGAQRRATEKE

SEQ ID NO: 186898 - protein, 6 aa, Mycobacterium bovis
SAPAVK

SEQ ID NO: 186899 - protein, 5 aa, Mycobacterium bovis
SAPDD

SEQ ID NO: 186900 - protein, 5 aa, Mycobacterium bovis
SAPDG

SEQ ID NO: 186901 - protein, 15 aa, Mycobacterium bovis
SAPDIAGQGIADPTA

SEQ ID NO: 186902 - protein, 12 aa, Mycobacterium bovis
SAPDNSQVRSGD

SEQ ID NO: 186903 - protein, 9 aa, Mycobacterium bovis
SAPDSDPHI

SEQ ID NO: 186904 - protein, 8 aa, Mycobacterium bovis
SAPDVDNP

SEQ ID NO: 186905 - protein, 8 aa, Mycobacterium bovis
SAPGDVAD

SEQ ID NO: 186906 - protein, 16 aa, Mycobacterium bovis
SAPGFGNSTTTPSSGF

SEQ ID NO: 186907 - protein, 6 aa, Mycobacterium bovis
SAPGHG

SEQ ID NO: 186908 - protein, 5 aa, Mycobacterium bovis
SAPGS

SEQ ID NO: 186909 - protein, 7 aa, Mycobacterium bovis
SAPGSQV

SEQ ID NO: 186910 - protein, 7 aa, Mycobacterium bovis
SAPHRAA

SEQ ID NO: 186911 - protein, 6 aa, Mycobacterium bovis
SAPISA

SEQ ID NO: 186912 - protein, 7 aa, Mycobacterium bovis
SAPLDSP

SEQ ID NO: 186913 - protein, 4 aa, Mycobacterium bovis
SAPM

SEQ ID NO: 186914 - protein, 8 aa, Mycobacterium bovis
SAPRPPGA

SEQ ID NO: 186915 - protein, 7 aa, Mycobacterium bovis
SAPRYPV

SEQ ID NO: 186916 - protein, 6 aa, Mycobacterium bovis
SAPSSL

SEQ ID NO: 186917 - protein, 21 aa, Mycobacterium bovis
SAPTRRQVDDSVAAAKSKSAL

SEQ ID NO: 186918 - protein, 8 aa, Mycobacterium bovis
SAPVRDGR

SEQ ID NO: 186919 - protein, 14 aa, Mycobacterium bovis
SAPYEGPPPRAEDL

SEQ ID NO: 186920 - protein, 8 aa, Mycobacterium bovis
SAQAENPG

SEQ ID NO: 186921 - protein, 7 aa, Mycobacterium bovis
SAQAKEE

SEQ ID NO: 186922 - protein, 8 aa, Mycobacterium bovis
SAQARRHR

SEQ ID NO: 186923 - protein, 11 aa, Mycobacterium bovis
SAQEADTAARI

SEQ ID NO: 186924 - protein, 5 aa, Mycobacterium bovis
SAQGS

SEQ ID NO: 186925 - protein, 12 aa, Mycobacterium bovis
SAQGSQGMGGPV

SEQ ID NO: 186926 - protein, 4 aa, Mycobacterium bovis
SAQL

SEQ ID NO: 186927 - protein, 10 aa, Mycobacterium bovis
SAQSRDALTD

SEQ ID NO: 186928 - protein, 22 aa, Mycobacterium bovis
SAQSSAQAVTAQAVGSTVPGPL

SEQ ID NO: 186929 - protein, 9 aa, Mycobacterium bovis
SAQTQVEQQ

SEQ ID NO: 186930 - protein, 4 aa, Mycobacterium bovis
SARA

SEQ ID NO: 186931 - protein, 11 aa, Mycobacterium bovis
SARAAANPTPR

SEQ ID NO: 186932 - protein, 9 aa, Mycobacterium bovis
SARANRGRR

SEQ ID NO: 186933 - protein, 7 aa, Mycobacterium bovis
SARASQT

SEQ ID NO: 186934 - protein, 15 aa, Mycobacterium bovis
SARDCRGGTAPGRVA

SEQ ID NO: 186935 - protein, 9 aa, Mycobacterium bovis
SARGEGRSL

SEQ ID NO: 186936 - protein, 5 aa, Mycobacterium bovis
SARGI

SEQ ID NO: 186937 - protein, 5 aa, Mycobacterium bovis
SARGP

SEQ ID NO: 186938 - protein, 7 aa, Mycobacterium bovis
SARNETE

SEQ ID NO: 186939 - protein, 5 aa, Mycobacterium bovis
SARPD

SEQ ID NO: 186940 - protein, 7 aa, Mycobacterium bovis
SARPDQL

SEQ ID NO: 186941 - protein, 7 aa, Mycobacterium bovis
SARPSDS

SEQ ID NO: 186942 - protein, 6 aa, Mycobacterium bovis
SARQFA

SEQ ID NO: 186943 - protein, 11 aa, Mycobacterium bovis
SARQPGESPEQ

SEQ ID NO: 186944 - protein, 6 aa, Mycobacterium bovis
SARRGD

SEQ ID NO: 186945 - protein, 10 aa, Mycobacterium bovis
SARSSGKNYR

SEQ ID NO: 186946 - protein, 8 aa, Mycobacterium bovis
SARSYRGT

SEQ ID NO: 186947 - protein, 10 aa, Mycobacterium bovis
SARTAPDTAD

SEQ ID NO: 186948 - protein, 11 aa, Mycobacterium bovis
SARTPSPNTVR

SEQ ID NO: 186949 - protein, 4 aa, Mycobacterium bovis
SARV

SEQ ID NO: 186950 - protein, 5 aa, Mycobacterium bovis
SARVG

SEQ ID NO: 186951 - protein, 13 aa, Mycobacterium bovis
SARVTSPEPEATY

SEQ ID NO: 186952 - protein, 20 aa, Mycobacterium bovis
SARYVEPTGAGPLGSGTGFP

SEQ ID NO: 186953 - protein, 11 aa, Mycobacterium bovis
SASANASPDRV

SEQ ID NO: 186954 - protein, 8 aa, Mycobacterium bovis
SASANGAY

SEQ ID NO: 186955 - protein, 8 aa, Mycobacterium bovis
SASDAESA

SEQ ID NO: 186956 - protein, 15 aa, Mycobacterium bovis
SASDRRKDAPAEGTP

SEQ ID NO: 186957 - protein, 4 aa, Mycobacterium bovis
SASE

SEQ ID NO: 186958 - protein, 24 aa, Mycobacterium bovis
SASGEGGYARELTDDERAQQQKAL

SEQ ID NO: 186959 - protein, 15 aa, Mycobacterium bovis
SASGGTVVHTTSRWR

SEQ ID NO: 186960 - protein, 8 aa, Mycobacterium bovis
SASGTLGG

SEQ ID NO: 186961 - protein, 8 aa, Mycobacterium bovis
SASHQRDD

SEQ ID NO: 186962 - protein, 4 aa, Mycobacterium bovis
SASL

SEQ ID NO: 186963 - protein, 5 aa, Mycobacterium bovis
SASLR

SEQ ID NO: 186964 - protein, 4 aa, Mycobacterium bovis
SASN

SEQ ID NO: 186965 - protein, 7 aa, Mycobacterium bovis
SASNENP

SEQ ID NO: 186966 - protein, 8 aa, Mycobacterium bovis
SASNPWGD

SEQ ID NO: 186967 - protein, 13 aa, Mycobacterium bovis
SASPAHTPEPFDS

SEQ ID NO: 186968 - protein, 11 aa, Mycobacterium bovis
SASPEAIDPDR

SEQ ID NO: 186969 - protein, 7 aa, Mycobacterium bovis
SASRDGL

SEQ ID NO: 186970 - protein, 14 aa, Mycobacterium bovis
SASRSGSVKTSELE

SEQ ID NO: 186971 - protein, 9 aa, Mycobacterium bovis
SASTASESI

SEQ ID NO: 186972 - protein, 5 aa, Mycobacterium bovis
SASTR

SEQ ID NO: 186973 - protein, 11 aa, Mycobacterium bovis
SASTRRERPQD

SEQ ID NO: 186974 - protein, 9 aa, Mycobacterium bovis
SASTTRGKA

SEQ ID NO: 186975 - protein, 26 aa, Mycobacterium bovis
SATAAQVASGAQGAKAASAPGAAPAV

SEQ ID NO: 186976 - protein, 7 aa, Mycobacterium bovis
SATAISP

SEQ ID NO: 186977 - protein, 11 aa, Mycobacterium bovis
SATEPSGRKPA

SEQ ID NO: 186978 - protein, 4 aa, Mycobacterium bovis
SATG

SEQ ID NO: 186979 - protein, 4 aa, Mycobacterium bovis
SATH

SEQ ID NO: 186980 - protein, 12 aa, Mycobacterium bovis
SATKKVSKPACV

SEQ ID NO: 186981 - protein, 11 aa, Mycobacterium bovis
SATLGNADTIG

SEQ ID NO: 186982 - protein, 11 aa, Mycobacterium bovis
SATPDAAQQKD

SEQ ID NO: 186983 - protein, 11 aa, Mycobacterium bovis
SATPDGVSERE

SEQ ID NO: 186984 - protein, 6 aa, Mycobacterium bovis
SATPEL

SEQ ID NO: 186985 - protein, 7 aa, Mycobacterium bovis
SATPIYD

SEQ ID NO: 186986 - protein, 5 aa, Mycobacterium bovis
SATQY

SEQ ID NO: 186987 - protein, 8 aa, Mycobacterium bovis
SATSGASG

SEQ ID NO: 186988 - protein, 8 aa, Mycobacterium bovis
SATSMRTG

SEQ ID NO: 186989 - protein, 5 aa, Mycobacterium bovis
SATSV

SEQ ID NO: 186990 - protein, 25 aa, Mycobacterium bovis
SATTTGDAPRTNTTAEQAGSPQPKF

SEQ ID NO: 186991 - protein, 5 aa, Mycobacterium bovis
SATVH

SEQ ID NO: 186992 - protein, 5 aa, Mycobacterium bovis
SATVR

SEQ ID NO: 186993 - protein, 4 aa, Mycobacterium bovis
SAVA

SEQ ID NO: 186994 - protein, 13 aa, Mycobacterium bovis
SAVNSDLDGTPQL

SEQ ID NO: 186995 - protein, 16 aa, Mycobacterium bovis
SAVPAAEKADRGNPGH

SEQ ID NO: 186996 - protein, 5 aa, Mycobacterium bovis
SAVPE

SEQ ID NO: 186997 - protein, 8 aa, Mycobacterium bovis
SAVPIEPD

SEQ ID NO: 186998 - protein, 4 aa, Mycobacterium bovis
SAVS

SEQ ID NO: 186999 - protein, 9 aa, Mycobacterium bovis
SAVSRVDDG

SEQ ID NO: 187000 - protein, 14 aa, Mycobacterium bovis
SAVSTAGAAAAGPT

SEQ ID NO: 187001 - protein, 13 aa, Mycobacterium bovis
SAWPENAAPSTAD

SEQ ID NO: 187002 - protein, 8 aa, Mycobacterium bovis
SAWRKDPD

SEQ ID NO: 187003 - protein, 4 aa, Mycobacterium bovis
SAYN

SEQ ID NO: 187004 - protein, 8 aa, Mycobacterium bovis
SAYPDGIA

SEQ ID NO: 187005 - protein, 8 aa, Mycobacterium bovis
SAYQQATG

SEQ ID NO: 187006 - protein, 13 aa, Mycobacterium bovis
SAYRGERPPTDIT

SEQ ID NO: 187007 - protein, 4 aa, Mycobacterium bovis
SAYV

SEQ ID NO: 187008 - protein, 10 aa, Mycobacterium bovis
SCASTQSVDP

SEQ ID NO: 187009 - protein, 4 aa, Mycobacterium bovis
SCDA

SEQ ID NO: 187010 - protein, 6 aa, Mycobacterium bovis
SCGGSG

SEQ ID NO: 187011 - protein, 7 aa, Mycobacterium bovis
SCPAEKR

SEQ ID NO: 187012 - protein, 7 aa, Mycobacterium bovis
SCPPETK

SEQ ID NO: 187013 - protein, 6 aa, Mycobacterium bovis
SCPPGR

SEQ ID NO: 187014 - protein, 12 aa, Mycobacterium bovis
SCPTAPPPSGRQ

SEQ ID NO: 187015 - protein, 8 aa, Mycobacterium bovis
SDAAQRGA

SEQ ID NO: 187016 - protein, 17 aa, Mycobacterium bovis
SDAAWQAPANDAGEPIP

SEQ ID NO: 187017 - protein, 5 aa, Mycobacterium bovis
SDADP

SEQ ID NO: 187018 - protein, 6 aa, Mycobacterium bovis
SDAEAA

SEQ ID NO: 187019 - protein, 12 aa, Mycobacterium bovis
SDAERAQKRSRL

SEQ ID NO: 187020 - protein, 8 aa, Mycobacterium bovis
SDAERARV

SEQ ID NO: 187021 - protein, 8 aa, Mycobacterium bovis
SDAERDSL

SEQ ID NO: 187022 - protein, 4 aa, Mycobacterium bovis
SDAF

SEQ ID NO: 187023 - protein, 4 aa, Mycobacterium bovis
SDAG

SEQ ID NO: 187024 - protein, 17 aa, Mycobacterium bovis
SDAHQASTTAPPPPGLT

SEQ ID NO: 187025 - protein, 12 aa, Mycobacterium bovis
SDAKAGKDAAEL

SEQ ID NO: 187026 - protein, 8 aa, Mycobacterium bovis
SDAPPVPA

SEQ ID NO: 187027 - protein, 7 aa, Mycobacterium bovis
SDAPVTG

SEQ ID NO: 187028 - protein, 8 aa, Mycobacterium bovis
SDATAVAG

SEQ ID NO: 187029 - protein, 7 aa, Mycobacterium bovis
SDATGRA

SEQ ID NO: 187030 - protein, 8 aa, Mycobacterium bovis
SDATRLAG

SEQ ID NO: 187031 - protein, 24 aa, Mycobacterium bovis
SDATRSRSRDRIRQSESNSPERSI

SEQ ID NO: 187032 - protein, 6 aa, Mycobacterium bovis
SDCTDS

SEQ ID NO: 187033 - protein, 4 aa, Mycobacterium bovis
SDDD

SEQ ID NO: 187034 - protein, 7 aa, Mycobacterium bovis
SDDERPA

SEQ ID NO: 187035 - protein, 18 aa, Mycobacterium bovis
SDDEWNAPTTTPSGPDSY

SEQ ID NO: 187036 - protein, 4 aa, Mycobacterium bovis
SDDG

SEQ ID NO: 187037 - protein, 9 aa, Mycobacterium bovis
SDDLGGGSL

SEQ ID NO: 187038 - protein, 7 aa, Mycobacterium bovis
SDDNVSV

SEQ ID NO: 187039 - protein, 7 aa, Mycobacterium bovis
SDDQPLA

SEQ ID NO: 187040 - protein, 5 aa, Mycobacterium bovis
SDDQV

SEQ ID NO: 187041 - protein, 6 aa, Mycobacterium bovis
SDDTVG

SEQ ID NO: 187042 - protein, 4 aa, Mycobacterium bovis
SDDV

SEQ ID NO: 187043 - protein, 12 aa, Mycobacterium bovis
SDEAGAKSVRNL

SEQ ID NO: 187044 - protein, 12 aa, Mycobacterium bovis
SDEAQPDNSRHP

SEQ ID NO: 187045 - protein, 31 aa, Mycobacterium bovis
SDEEGARRELERGDRHPGWNRGSARAAHADA

SEQ ID NO: 187046 - protein, 5 aa, Mycobacterium bovis
SDEFT

SEQ ID NO: 187047 - protein, 7 aa, Mycobacterium bovis
SDEGKVE

SEQ ID NO: 187048 - protein, 6 aa, Mycobacterium bovis
SDEHPG

SEQ ID NO: 187049 - protein, 4 aa, Mycobacterium bovis
SDES

SEQ ID NO: 187050 - protein, 5 aa, Mycobacterium bovis
SDESA

SEQ ID NO: 187051 - protein, 5 aa, Mycobacterium bovis
SDESL

SEQ ID NO: 187052 - protein, 8 aa, Mycobacterium bovis
SDESMSDS

SEQ ID NO: 187053 - protein, 11 aa, Mycobacterium bovis
SDESTAVGLPT

SEQ ID NO: 187054 - protein, 9 aa, Mycobacterium bovis
SDEYGPIRA

SEQ ID NO: 187055 - protein, 5 aa, Mycobacterium bovis
SDFGS

SEQ ID NO: 187056 - protein, 7 aa, Mycobacterium bovis
SDFSATE

SEQ ID NO: 187057 - protein, 5 aa, Mycobacterium bovis
SDGAA

SEQ ID NO: 187058 - protein, 18 aa, Mycobacterium bovis
SDGAGAQEETDSAEAPQS

SEQ ID NO: 187059 - protein, 12 aa, Mycobacterium bovis
SDGAYADASNQD

SEQ ID NO: 187060 - protein, 8 aa, Mycobacterium bovis
SDGKPAYI

SEQ ID NO: 187061 - protein, 8 aa, Mycobacterium bovis
SDGKPTRI

SEQ ID NO: 187062 - protein, 7 aa, Mycobacterium bovis
SDGNFGN

SEQ ID NO: 187063 - protein, 8 aa, Mycobacterium bovis
SDGPPPYR

SEQ ID NO: 187064 - protein, 8 aa, Mycobacterium bovis
SDGPTATI

SEQ ID NO: 187065 - protein, 7 aa, Mycobacterium bovis
SDGRPHA

SEQ ID NO: 187066 - protein, 7 aa, Mycobacterium bovis
SDGSAPI

SEQ ID NO: 187067 - protein, 9 aa, Mycobacterium bovis
SDGSEARYT

SEQ ID NO: 187068 - protein, 4 aa, Mycobacterium bovis
SDGV

SEQ ID NO: 187069 - protein, 9 aa, Mycobacterium bovis
SDGYEAARR

SEQ ID NO: 187070 - protein, 4 aa, Mycobacterium bovis
SDHE

SEQ ID NO: 187071 - protein, 6 aa, Mycobacterium bovis
SDHPRP

SEQ ID NO: 187072 - protein, 15 aa, Mycobacterium bovis
SDIEASTHQPVTGLH

SEQ ID NO: 187073 - protein, 10 aa, Mycobacterium bovis
SDIRAGRPAV

SEQ ID NO: 187074 - protein, 4 aa, Mycobacterium bovis
SDKP

SEQ ID NO: 187075 - protein, 11 aa, Mycobacterium bovis
SDKTAPKDAGL

SEQ ID NO: 187076 - protein, 14 aa, Mycobacterium bovis
SDLAKGGPVHAQSE

SEQ ID NO: 187077 - protein, 11 aa, Mycobacterium bovis
SDLHGAKDIAG

SEQ ID NO: 187078 - protein, 7 aa, Mycobacterium bovis
SDLSSTD

SEQ ID NO: 187079 - protein, 4 aa, Mycobacterium bovis
SDLT

SEQ ID NO: 187080 - protein, 7 aa, Mycobacterium bovis
SDLTART

SEQ ID NO: 187081 - protein, 10 aa, Mycobacterium bovis
SDLTRQTPCT

SEQ ID NO: 187082 - protein, 7 aa, Mycobacterium bovis
SDMPTTC

SEQ ID NO: 187083 - protein, 5 aa, Mycobacterium bovis
SDMTE

SEQ ID NO: 187084 - protein, 10 aa, Mycobacterium bovis
SDNKQRAKIA

SEQ ID NO: 187085 - protein, 4 aa, Mycobacterium bovis
SDNP

SEQ ID NO: 187086 - protein, 8 aa, Mycobacterium bovis
SDNPGPWK

SEQ ID NO: 187087 - protein, 7 aa, Mycobacterium bovis
SDPAAQR

SEQ ID NO: 187088 - protein, 12 aa, Mycobacterium bovis
SDPAKRKEYDET

SEQ ID NO: 187089 - protein, 5 aa, Mycobacterium bovis
SDPAV

SEQ ID NO: 187090 - protein, 8 aa, Mycobacterium bovis
SDPDEAVE

SEQ ID NO: 187091 - protein, 6 aa, Mycobacterium bovis
SDPDKR

SEQ ID NO: 187092 - protein, 5 aa, Mycobacterium bovis
SDPDV

SEQ ID NO: 187093 - protein, 9 aa, Mycobacterium bovis
SDPETDYTG

SEQ ID NO: 187094 - protein, 5 aa, Mycobacterium bovis
SDPGA

SEQ ID NO: 187095 - protein, 5 aa, Mycobacterium bovis
SDPGL

SEQ ID NO: 187096 - protein, 14 aa, Mycobacterium bovis
SDPGSAPEPQTDPS

SEQ ID NO: 187097 - protein, 15 aa, Mycobacterium bovis
SDPLDGATPSGASSI

SEQ ID NO: 187098 - protein, 6 aa, Mycobacterium bovis
SDPLGD

SEQ ID NO: 187099 - protein, 6 aa, Mycobacterium bovis
SDPNHP

SEQ ID NO: 187100 - protein, 5 aa, Mycobacterium bovis
SDPNW

SEQ ID NO: 187101 - protein, 9 aa, Mycobacterium bovis
SDPPNRPGN

SEQ ID NO: 187102 - protein, 9 aa, Mycobacterium bovis
SDPPTLQEV

SEQ ID NO: 187103 - protein, 5 aa, Mycobacterium bovis
SDPQI

SEQ ID NO: 187104 - protein, 7 aa, Mycobacterium bovis
SDPRRRR

SEQ ID NO: 187105 - protein, 9 aa, Mycobacterium bovis
SDPSDVARV

SEQ ID NO: 187106 - protein, 9 aa, Mycobacterium bovis
SDPSGGHAE

SEQ ID NO: 187107 - protein, 4 aa, Mycobacterium bovis
SDPT

SEQ ID NO: 187108 - protein, 9 aa, Mycobacterium bovis
SDPTVRGQG

SEQ ID NO: 187109 - protein, 9 aa, Mycobacterium bovis
SDQADPRPG

SEQ ID NO: 187110 - protein, 5 aa, Mycobacterium bovis
SDQEH

SEQ ID NO: 187111 - protein, 11 aa, Mycobacterium bovis
SDQGLADRQKV

SEQ ID NO: 187112 - protein, 18 aa, Mycobacterium bovis
SDQRGDRSSDQPTPASVA

SEQ ID NO: 187113 - protein, 5 aa, Mycobacterium bovis
SDQTH

SEQ ID NO: 187114 - protein, 17 aa, Mycobacterium bovis
SDQVRQAKRAQQAEQIR

SEQ ID NO: 187115 - protein, 8 aa, Mycobacterium bovis
SDRAGSDQ

SEQ ID NO: 187116 - protein, 8 aa, Mycobacterium bovis
SDRERAYE

SEQ ID NO: 187117 - protein, 5 aa, Mycobacterium bovis
SDRPD

SEQ ID NO: 187118 - protein, 7 aa, Mycobacterium bovis
SDRPQGI

SEQ ID NO: 187119 - protein, 12 aa, Mycobacterium bovis
SDRQGKVPWTAD

SEQ ID NO: 187120 - protein, 6 aa, Mycobacterium bovis
SDRRPV

SEQ ID NO: 187121 - protein, 17 aa, Mycobacterium bovis
SDSAESAQREIALWFPG

SEQ ID NO: 187122 - protein, 17 aa, Mycobacterium bovis
SDSDPASSDAFSADDYT

SEQ ID NO: 187123 - protein, 7 aa, Mycobacterium bovis
SDSGRAE

SEQ ID NO: 187124 - protein, 5 aa, Mycobacterium bovis
SDSLR

SEQ ID NO: 187125 - protein, 10 aa, Mycobacterium bovis
SDSNTSWPLP

SEQ ID NO: 187126 - protein, 10 aa, Mycobacterium bovis
SDSPDDTTLA

SEQ ID NO: 187127 - protein, 8 aa, Mycobacterium bovis
SDSQAMGR

SEQ ID NO: 187128 - protein, 7 aa, Mycobacterium bovis
SDSRTQA

SEQ ID NO: 187129 - protein, 4 aa, Mycobacterium bovis
SDTD

SEQ ID NO: 187130 - protein, 15 aa, Mycobacterium bovis
SDTDPRKPEELEAEA

SEQ ID NO: 187131 - protein, 5 aa, Mycobacterium bovis
SDTER

SEQ ID NO: 187132 - protein, 7 aa, Mycobacterium bovis
SDTGELG

SEQ ID NO: 187133 - protein, 18 aa, Mycobacterium bovis
SDTHGGGGGRPVTPPPPG

SEQ ID NO: 187134 - protein, 9 aa, Mycobacterium bovis
SDTKAKELG

SEQ ID NO: 187135 - protein, 4 aa, Mycobacterium bovis
SDTR

SEQ ID NO: 187136 - protein, 8 aa, Mycobacterium bovis
SDTRPAAR

SEQ ID NO: 187137 - protein, 5 aa, Mycobacterium bovis
SDTSP

SEQ ID NO: 187138 - protein, 12 aa, Mycobacterium bovis
SDTTLLDAALAG

SEQ ID NO: 187139 - protein, 9 aa, Mycobacterium bovis
SDTTPSNTM

SEQ ID NO: 187140 - protein, 13 aa, Mycobacterium bovis
SDVAGANAQRGLS

SEQ ID NO: 187141 - protein, 10 aa, Mycobacterium bovis
SDVDPADPRL

SEQ ID NO: 187142 - protein, 6 aa, Mycobacterium bovis
SDVDRA

SEQ ID NO: 187143 - protein, 5 aa, Mycobacterium bovis
SDVGY

SEQ ID NO: 187144 - protein, 4 aa, Mycobacterium bovis
SDYD

SEQ ID NO: 187145 - protein, 4 aa, Mycobacterium bovis
SDYL

SEQ ID NO: 187146 - protein, 5 aa, Mycobacterium bovis
SDYSR

SEQ ID NO: 187147 - protein, 24 aa, Mycobacterium bovis
SEAAAAASTPTTALASAGADEVSA

SEQ ID NO: 187148 - protein, 7 aa, Mycobacterium bovis
SEAARQG

SEQ ID NO: 187149 - protein, 4 aa, Mycobacterium bovis
SEAD

SEQ ID NO: 187150 - protein, 4 aa, Mycobacterium bovis
SEAE

SEQ ID NO: 187151 - protein, 8 aa, Mycobacterium bovis
SEAEPPDA

SEQ ID NO: 187152 - protein, 10 aa, Mycobacterium bovis
SEAGAQPKTA

SEQ ID NO: 187153 - protein, 6 aa, Mycobacterium bovis
SEAGDS

SEQ ID NO: 187154 - protein, 15 aa, Mycobacterium bovis
SEAGPGTRLRRIAGR

SEQ ID NO: 187155 - protein, 11 aa, Mycobacterium bovis
SEALGTAADAV

SEQ ID NO: 187156 - protein, 11 aa, Mycobacterium bovis
SEALSTAAAEG

SEQ ID NO: 187157 - protein, 4 aa, Mycobacterium bovis
SEAQ

SEQ ID NO: 187158 - protein, 5 aa, Mycobacterium bovis
SEAQK

SEQ ID NO: 187159 - protein, 19 aa, Mycobacterium bovis
SEASGAAPTHEAPAPPRGL

SEQ ID NO: 187160 - protein, 5 aa, Mycobacterium bovis
SEASV

SEQ ID NO: 187161 - protein, 5 aa, Mycobacterium bovis
SEDEV

SEQ ID NO: 187162 - protein, 6 aa, Mycobacterium bovis
SEDEVE

SEQ ID NO: 187163 - protein, 8 aa, Mycobacterium bovis
SEDGASVD

SEQ ID NO: 187164 - protein, 9 aa, Mycobacterium bovis
SEDGRSGRA

SEQ ID NO: 187165 - protein, 5 aa, Mycobacterium bovis
SEDSQ

SEQ ID NO: 187166 - protein, 4 aa, Mycobacterium bovis
SEEG

SEQ ID NO: 187167 - protein, 11 aa, Mycobacterium bovis
SEEKDEATMAE

SEQ ID NO: 187168 - protein, 4 aa, Mycobacterium bovis
SEEL

SEQ ID NO: 187169 - protein, 8 aa, Mycobacterium bovis
SEESGGSD

SEQ ID NO: 187170 - protein, 10 aa, Mycobacterium bovis
SEFDSAKGSA

SEQ ID NO: 187171 - protein, 7 aa, Mycobacterium bovis
SEFDSNR

SEQ ID NO: 187172 - protein, 9 aa, Mycobacterium bovis
SEGETKRKF

SEQ ID NO: 187173 - protein, 6 aa, Mycobacterium bovis
SEGGAV

SEQ ID NO: 187174 - protein, 5 aa, Mycobacterium bovis
SEGGG

SEQ ID NO: 187175 - protein, 10 aa, Mycobacterium bovis
SEGGGVYSRE

SEQ ID NO: 187176 - protein, 6 aa, Mycobacterium bovis
SEGKDG

SEQ ID NO: 187177 - protein, 15 aa, Mycobacterium bovis
SEGKPTEKHIQIRST

SEQ ID NO: 187178 - protein, 4 aa, Mycobacterium bovis
SEGN

SEQ ID NO: 187179 - protein, 5 aa, Mycobacterium bovis
SEGNS

SEQ ID NO: 187180 - protein, 7 aa, Mycobacterium bovis
SEGPLPQ

SEQ ID NO: 187181 - protein, 6 aa, Mycobacterium bovis
SEGSAG

SEQ ID NO: 187182 - protein, 9 aa, Mycobacterium bovis
SEGSRTGRV

SEQ ID NO: 187183 - protein, 6 aa, Mycobacterium bovis
SEGSVR

SEQ ID NO: 187184 - protein, 5 aa, Mycobacterium bovis
SEGTL

SEQ ID NO: 187185 - protein, 12 aa, Mycobacterium bovis
SEGVGKGISPRS

SEQ ID NO: 187186 - protein, 10 aa, Mycobacterium bovis
SEGVKEDDIR

SEQ ID NO: 187187 - protein, 7 aa, Mycobacterium bovis
SEGWPGE

SEQ ID NO: 187188 - protein, 7 aa, Mycobacterium bovis
SEHAAAR

SEQ ID NO: 187189 - protein, 11 aa, Mycobacterium bovis
SEHAGSGEFSD

SEQ ID NO: 187190 - protein, 8 aa, Mycobacterium bovis
SEHDFQPD

SEQ ID NO: 187191 - protein, 10 aa, Mycobacterium bovis
SEHDSPGEAT

SEQ ID NO: 187192 - protein, 6 aa, Mycobacterium bovis
SEHEYG

SEQ ID NO: 187193 - protein, 15 aa, Mycobacterium bovis
SEHGGAAAVQATRDL

SEQ ID NO: 187194 - protein, 4 aa, Mycobacterium bovis
SEHN

SEQ ID NO: 187195 - protein, 4 aa, Mycobacterium bovis
SEHS

SEQ ID NO: 187196 - protein, 4 aa, Mycobacterium bovis
SEIA

SEQ ID NO: 187197 - protein, 9 aa, Mycobacterium bovis
SEIADKAQH

SEQ ID NO: 187198 - protein, 16 aa, Mycobacterium bovis
SEIPETMPDPDTDDEG

SEQ ID NO: 187199 - protein, 16 aa, Mycobacterium bovis
SEKEEADRKNKVRGGD

SEQ ID NO: 187200 - protein, 6 aa, Mycobacterium bovis
SEKGIT

SEQ ID NO: 187201 - protein, 24 aa, Mycobacterium bovis
SELAGGAWQGPASAAMANAAGPYA

SEQ ID NO: 187202 - protein, 11 aa, Mycobacterium bovis
SELASAGDGGM

SEQ ID NO: 187203 - protein, 8 aa, Mycobacterium bovis
SELGRTQA

SEQ ID NO: 187204 - protein, 10 aa, Mycobacterium bovis
SELGTGRGGP

SEQ ID NO: 187205 - protein, 4 aa, Mycobacterium bovis
SELT

SEQ ID NO: 187206 - protein, 4 aa, Mycobacterium bovis
SENN

SEQ ID NO: 187207 - protein, 5 aa, Mycobacterium bovis
SENNT

SEQ ID NO: 187208 - protein, 6 aa, Mycobacterium bovis
SENPGL

SEQ ID NO: 187209 - protein, 6 aa, Mycobacterium bovis
SEPAGV

SEQ ID NO: 187210 - protein, 4 aa, Mycobacterium bovis
SEPD

SEQ ID NO: 187211 - protein, 8 aa, Mycobacterium bovis
SEPDERGM

SEQ ID NO: 187212 - protein, 10 aa, Mycobacterium bovis
SEPEAGSDLA

SEQ ID NO: 187213 - protein, 6 aa, Mycobacterium bovis
SEPERV

SEQ ID NO: 187214 - protein, 20 aa, Mycobacterium bovis
SEPESGSDLASLRSTASKVD

SEQ ID NO: 187215 - protein, 14 aa, Mycobacterium bovis
SEPEWGGADEPDRP

SEQ ID NO: 187216 - protein, 9 aa, Mycobacterium bovis
SEPGAGTDL

SEQ ID NO: 187217 - protein, 10 aa, Mycobacterium bovis
SEPGDGVPPA

SEQ ID NO: 187218 - protein, 6 aa, Mycobacterium bovis
SEPGSR

SEQ ID NO: 187219 - protein, 5 aa, Mycobacterium bovis
SEPHA

SEQ ID NO: 187220 - protein, 5 aa, Mycobacterium bovis
SEPIR

SEQ ID NO: 187221 - protein, 4 aa, Mycobacterium bovis
SEPM

SEQ ID NO: 187222 - protein, 7 aa, Mycobacterium bovis
SEPNEEL

SEQ ID NO: 187223 - protein, 6 aa, Mycobacterium bovis
SEPPVG

SEQ ID NO: 187224 - protein, 4 aa, Mycobacterium bovis
SEPV

SEQ ID NO: 187225 - protein, 5 aa, Mycobacterium bovis
SEPVT

SEQ ID NO: 187226 - protein, 13 aa, Mycobacterium bovis
SEPYDDDSGWGDV

SEQ ID NO: 187227 - protein, 9 aa, Mycobacterium bovis
SEQALAGQA

SEQ ID NO: 187228 - protein, 17 aa, Mycobacterium bovis
SEQDEYAAASHQKAAAA

SEQ ID NO: 187229 - protein, 7 aa, Mycobacterium bovis
SEQRDPA

SEQ ID NO: 187230 - protein, 9 aa, Mycobacterium bovis
SERDTDAAL

SEQ ID NO: 187231 - protein, 5 aa, Mycobacterium bovis
SEREA

SEQ ID NO: 187232 - protein, 21 aa, Mycobacterium bovis
SEREAGSDAASMRTRAKADGD

SEQ ID NO: 187233 - protein, 12 aa, Mycobacterium bovis
SERGEKLPAAQR

SEQ ID NO: 187234 - protein, 5 aa, Mycobacterium bovis
SERGR

SEQ ID NO: 187235 - protein, 4 aa, Mycobacterium bovis
SERI

SEQ ID NO: 187236 - protein, 7 aa, Mycobacterium bovis
SERIGRP

SEQ ID NO: 187237 - protein, 20 aa, Mycobacterium bovis
SERLPRGADPNTHTKLGRGG

SEQ ID NO: 187238 - protein, 7 aa, Mycobacterium bovis
SERTGSV

SEQ ID NO: 187239 - protein, 6 aa, Mycobacterium bovis
SERVQA

SEQ ID NO: 187240 - protein, 6 aa, Mycobacterium bovis
SERWPG

SEQ ID NO: 187241 - protein, 6 aa, Mycobacterium bovis
SERYTE

SEQ ID NO: 187242 - protein, 6 aa, Mycobacterium bovis
SESAAS

SEQ ID NO: 187243 - protein, 8 aa, Mycobacterium bovis
SESDEPNR

SEQ ID NO: 187244 - protein, 9 aa, Mycobacterium bovis
SESDTPAGM

SEQ ID NO: 187245 - protein, 8 aa, Mycobacterium bovis
SESDTPEL

SEQ ID NO: 187246 - protein, 13 aa, Mycobacterium bovis
SESDTVAHPDPST

SEQ ID NO: 187247 - protein, 9 aa, Mycobacterium bovis
SESEADQAR

SEQ ID NO: 187248 - protein, 5 aa, Mycobacterium bovis
SESER

SEQ ID NO: 187249 - protein, 6 aa, Mycobacterium bovis
SESGAE

SEQ ID NO: 187250 - protein, 9 aa, Mycobacterium bovis
SESGAGNST

SEQ ID NO: 187251 - protein, 8 aa, Mycobacterium bovis
SESLDSEP

SEQ ID NO: 187252 - protein, 6 aa, Mycobacterium bovis
SESLRS

SEQ ID NO: 187253 - protein, 7 aa, Mycobacterium bovis
SESPAAG

SEQ ID NO: 187254 - protein, 6 aa, Mycobacterium bovis
SETFGD

SEQ ID NO: 187255 - protein, 19 aa, Mycobacterium bovis
SETFGSGPRHNDTSDGEAS

SEQ ID NO: 187256 - protein, 7 aa, Mycobacterium bovis
SETGQTV

SEQ ID NO: 187257 - protein, 8 aa, Mycobacterium bovis
SETPSSWD

SEQ ID NO: 187258 - protein, 10 aa, Mycobacterium bovis
SEVAAAGGDD

SEQ ID NO: 187259 - protein, 12 aa, Mycobacterium bovis
SEVKAGRGTPHG

SEQ ID NO: 187260 - protein, 5 aa, Mycobacterium bovis
SEVTG

SEQ ID NO: 187261 - protein, 6 aa, Mycobacterium bovis
SEYAAA

SEQ ID NO: 187262 - protein, 11 aa, Mycobacterium bovis
SEYEDRDGIRR

SEQ ID NO: 187263 - protein, 5 aa, Mycobacterium bovis
SEYGG

SEQ ID NO: 187264 - protein, 7 aa, Mycobacterium bovis
SEYRQAA

SEQ ID NO: 187265 - protein, 5 aa, Mycobacterium bovis
SFAPE

SEQ ID NO: 187266 - protein, 22 aa, Mycobacterium bovis
SFASSGLAKPPEAQANPAVPPN

SEQ ID NO: 187267 - protein, 8 aa, Mycobacterium bovis
SFDPREEP

SEQ ID NO: 187268 - protein, 8 aa, Mycobacterium bovis
SFGGGPVG

SEQ ID NO: 187269 - protein, 7 aa, Mycobacterium bovis
SFGGRGH

SEQ ID NO: 187270 - protein, 15 aa, Mycobacterium bovis
SFGTATPTGSDEEAD

SEQ ID NO: 187271 - protein, 13 aa, Mycobacterium bovis
SFNPGSANTGSVN

SEQ ID NO: 187272 - protein, 16 aa, Mycobacterium bovis
SFNTGVGNSGTGSTGL

SEQ ID NO: 187273 - protein, 12 aa, Mycobacterium bovis
SFPEVPAAQRAE

SEQ ID NO: 187274 - protein, 6 aa, Mycobacterium bovis
SFPPGG

SEQ ID NO: 187275 - protein, 10 aa, Mycobacterium bovis
SFTENADAPI

SEQ ID NO: 187276 - protein, 6 aa, Mycobacterium bovis
SFYTGR

SEQ ID NO: 187277 - protein, 4 aa, Mycobacterium bovis
SGAA

SEQ ID NO: 187278 - protein, 7 aa, Mycobacterium bovis
SGAADPR

SEQ ID NO: 187279 - protein, 11 aa, Mycobacterium bovis
SGAADRDQERY

SEQ ID NO: 187280 - protein, 6 aa, Mycobacterium bovis
SGAAQS

SEQ ID NO: 187281 - protein, 6 aa, Mycobacterium bovis
SGAASV

SEQ ID NO: 187282 - protein, 7 aa, Mycobacterium bovis
SGAATAA

SEQ ID NO: 187283 - protein, 9 aa, Mycobacterium bovis
SGAATPADA

SEQ ID NO: 187284 - protein, 6 aa, Mycobacterium bovis
SGAATV

SEQ ID NO: 187285 - protein, 12 aa, Mycobacterium bovis
SGAAYSAASARQ

SEQ ID NO: 187286 - protein, 5 aa, Mycobacterium bovis
SGADD

SEQ ID NO: 187287 - protein, 7 aa, Mycobacterium bovis
SGADYPD

SEQ ID NO: 187288 - protein, 19 aa, Mycobacterium bovis
SGAEAGTASAKRRVKPGEP

SEQ ID NO: 187289 - protein, 8 aa, Mycobacterium bovis
SGAERVHP

SEQ ID NO: 187290 - protein, 8 aa, Mycobacterium bovis
SGAFEGPQ

SEQ ID NO: 187291 - protein, 4 aa, Mycobacterium bovis
SGAG

SEQ ID NO: 187292 - protein, 11 aa, Mycobacterium bovis
SGAGARARPCG

SEQ ID NO: 187293 - protein, 8 aa, Mycobacterium bovis
SGAGCTNR

SEQ ID NO: 187294 - protein, 5 aa, Mycobacterium bovis
SGAGD

SEQ ID NO: 187295 - protein, 9 aa, Mycobacterium bovis
SGAGGASGF

SEQ ID NO: 187296 - protein, 19 aa, Mycobacterium bovis
SGAGGNIGIGGAPQTGKST

SEQ ID NO: 187297 - protein, 16 aa, Mycobacterium bovis
SGAGGNSGFGNNGSGL

SEQ ID NO: 187298 - protein, 8 aa, Mycobacterium bovis
SGAGGVDA

SEQ ID NO: 187299 - protein, 5 aa, Mycobacterium bovis
SGAGL

SEQ ID NO: 187300 - protein, 7 aa, Mycobacterium bovis
SGAGLSG

SEQ ID NO: 187301 - protein, 5 aa, Mycobacterium bovis
SGAGN

SEQ ID NO: 187302 - protein, 10 aa, Mycobacterium bovis
SGAGNGRLKT

SEQ ID NO: 187303 - protein, 5 aa, Mycobacterium bovis
SGAGP

SEQ ID NO: 187304 - protein, 9 aa, Mycobacterium bovis
SGAGRGTAA

SEQ ID NO: 187305 - protein, 8 aa, Mycobacterium bovis
SGAGSASG

SEQ ID NO: 187306 - protein, 9 aa, Mycobacterium bovis
SGAGSASGF

SEQ ID NO: 187307 - protein, 16 aa, Mycobacterium bovis
SGAGSASGFGNFGGAA

SEQ ID NO: 187308 - protein, 8 aa, Mycobacterium bovis
SGAGSVSG

SEQ ID NO: 187309 - protein, 7 aa, Mycobacterium bovis
SGAGTVG

SEQ ID NO: 187310 - protein, 7 aa, Mycobacterium bovis
SGAKAGS

SEQ ID NO: 187311 - protein, 6 aa, Mycobacterium bovis
SGAKAI

SEQ ID NO: 187312 - protein, 5 aa, Mycobacterium bovis
SGALT

SEQ ID NO: 187313 - protein, 9 aa, Mycobacterium bovis
SGANNNERH

SEQ ID NO: 187314 - protein, 8 aa, Mycobacterium bovis
SGAPAAAM

SEQ ID NO: 187315 - protein, 6 aa, Mycobacterium bovis
SGAPAH

SEQ ID NO: 187316 - protein, 5 aa, Mycobacterium bovis
SGAPE

SEQ ID NO: 187317 - protein, 8 aa, Mycobacterium bovis
SGAPEHRA

SEQ ID NO: 187318 - protein, 5 aa, Mycobacterium bovis
SGASA

SEQ ID NO: 187319 - protein, 8 aa, Mycobacterium bovis
SGASAAAE

SEQ ID NO: 187320 - protein, 13 aa, Mycobacterium bovis
SGASSTTASTGDI

SEQ ID NO: 187321 - protein, 10 aa, Mycobacterium bovis
SGATALSNEA

SEQ ID NO: 187322 - protein, 9 aa, Mycobacterium bovis
SGATEFGAE

SEQ ID NO: 187323 - protein, 7 aa, Mycobacterium bovis
SGATIDG

SEQ ID NO: 187324 - protein, 8 aa, Mycobacterium bovis
SGATMTAA

SEQ ID NO: 187325 - protein, 6 aa, Mycobacterium bovis
SGATNA

SEQ ID NO: 187326 - protein, 8 aa, Mycobacterium bovis
SGATPIGA

SEQ ID NO: 187327 - protein, 8 aa, Mycobacterium bovis
SGATQSMP

SEQ ID NO: 187328 - protein, 8 aa, Mycobacterium bovis
SGATSQRP

SEQ ID NO: 187329 - protein, 10 aa, Mycobacterium bovis
SGCDTEAAQP

SEQ ID NO: 187330 - protein, 8 aa, Mycobacterium bovis
SGCGKSTT

SEQ ID NO: 187331 - protein, 8 aa, Mycobacterium bovis
SGCGKTTS

SEQ ID NO: 187332 - protein, 8 aa, Mycobacterium bovis
SGDAEAQA

SEQ ID NO: 187333 - protein, 6 aa, Mycobacterium bovis
SGDARE

SEQ ID NO: 187334 - protein, 9 aa, Mycobacterium bovis
SGDDPGTVD

SEQ ID NO: 187335 - protein, 6 aa, Mycobacterium bovis
SGDDTV

SEQ ID NO: 187336 - protein, 9 aa, Mycobacterium bovis
SGDEADADI

SEQ ID NO: 187337 - protein, 6 aa, Mycobacterium bovis
SGDGAV

SEQ ID NO: 187338 - protein, 6 aa, Mycobacterium bovis
SGDIAT

SEQ ID NO: 187339 - protein, 8 aa, Mycobacterium bovis
SGDNQQGF

SEQ ID NO: 187340 - protein, 9 aa, Mycobacterium bovis
SGDPDPAHN

SEQ ID NO: 187341 - protein, 6 aa, Mycobacterium bovis
SGDPEV

SEQ ID NO: 187342 - protein, 6 aa, Mycobacterium bovis
SGDPID

SEQ ID NO: 187343 - protein, 8 aa, Mycobacterium bovis
SGDPRGGM

SEQ ID NO: 187344 - protein, 6 aa, Mycobacterium bovis
SGDPSL

SEQ ID NO: 187345 - protein, 13 aa, Mycobacterium bovis
SGDPTGAKKAAQD

SEQ ID NO: 187346 - protein, 4 aa, Mycobacterium bovis
SGDR

SEQ ID NO: 187347 - protein, 11 aa, Mycobacterium bovis
SGDRPNLEQGG

SEQ ID NO: 187348 - protein, 8 aa, Mycobacterium bovis
SGDSAVPR

SEQ ID NO: 187349 - protein, 6 aa, Mycobacterium bovis
SGDSIG

SEQ ID NO: 187350 - protein, 15 aa, Mycobacterium bovis
SGDSQVGIGGTNSGS

SEQ ID NO: 187351 - protein, 9 aa, Mycobacterium bovis
SGDTTKSDN

SEQ ID NO: 187352 - protein, 8 aa, Mycobacterium bovis
SGEAKWGQ

SEQ ID NO: 187353 - protein, 8 aa, Mycobacterium bovis
SGEGGEES

SEQ ID NO: 187354 - protein, 7 aa, Mycobacterium bovis
SGEGRYV

SEQ ID NO: 187355 - protein, 6 aa, Mycobacterium bovis
SGEGVT

SEQ ID NO: 187356 - protein, 12 aa, Mycobacterium bovis
SGEKRTSKEYHV

SEQ ID NO: 187357 - protein, 4 aa, Mycobacterium bovis
SGEL

SEQ ID NO: 187358 - protein, 20 aa, Mycobacterium bovis
SGEQAADAELTDRSTVAAGT

SEQ ID NO: 187359 - protein, 17 aa, Mycobacterium bovis
SGEQRLSGHRGPTGGVS

SEQ ID NO: 187360 - protein, 7 aa, Mycobacterium bovis
SGEQRSS

SEQ ID NO: 187361 - protein, 7 aa, Mycobacterium bovis
SGEQVTV

SEQ ID NO: 187362 - protein, 5 aa, Mycobacterium bovis
SGESL

SEQ ID NO: 187363 - protein, 12 aa, Mycobacterium bovis
SGESPSTASPES

SEQ ID NO: 187364 - protein, 7 aa, Mycobacterium bovis
SGEWDGE

SEQ ID NO: 187365 - protein, 12 aa, Mycobacterium bovis
SGEWTGATGKRI

SEQ ID NO: 187366 - protein, 5 aa, Mycobacterium bovis
SGEYQ

SEQ ID NO: 187367 - protein, 4 aa, Mycobacterium bovis
SGFG

SEQ ID NO: 187368 - protein, 6 aa, Mycobacterium bovis
SGFGGG

SEQ ID NO: 187369 - protein, 7 aa, Mycobacterium bovis
SGFGKST

SEQ ID NO: 187370 - protein, 5 aa, Mycobacterium bovis
SGFGQ

SEQ ID NO: 187371 - protein, 9 aa, Mycobacterium bovis
SGFNNTSTV

SEQ ID NO: 187372 - protein, 7 aa, Mycobacterium bovis
SGFRPGQ

SEQ ID NO: 187373 - protein, 12 aa, Mycobacterium bovis
SGFSCDSASARE

SEQ ID NO: 187374 - protein, 9 aa, Mycobacterium bovis
SGGADLPTQ

SEQ ID NO: 187375 - protein, 6 aa, Mycobacterium bovis
SGGAGA

SEQ ID NO: 187376 - protein, 14 aa, Mycobacterium bovis
SGGAGDRDASEADV

SEQ ID NO: 187377 - protein, 69 aa, Mycobacterium bovis
SGGAGGIGGAGGVGGSGNDGGNGGDGGQGGASGLGIGNGGPGGSGGTGGAGGTGGSAGTGGAGGDGGNA

SEQ ID NO: 187378 - protein, 18 aa, Mycobacterium bovis
SGGAGGNGGTGGANSGSL

SEQ ID NO: 187379 - protein, 28 aa, Mycobacterium bovis
SGGAGGNGGYSLNGTGGDGGTGGAGQIT

SEQ ID NO: 187380 - protein, 26 aa, Mycobacterium bovis
SGGAGGPGGVGNTGTGGLGGDGGAAG

SEQ ID NO: 187381 - protein, 155 aa, Mycobacterium bovis
SGGAGGQGGMGAAGADGVNPTPTGTADAGSTGTDQTLGGNAIGGNGGPGDAGDAMTSGGAGGSGGNAVSTVNGDAVGGEGGKGGEGAYGGAGGAGGSAASIGNAAIGGNGGAGGNAQAPGGVGGAGGEGGDAQVGTNSPSNAEAGNGGSGGNGFD

SEQ ID NO: 187382 - protein, 21 aa, Mycobacterium bovis
SGGAGGSGAAGMAGGNGGAAG

SEQ ID NO: 187383 - protein, 13 aa, Mycobacterium bovis
SGGANACTGPAGF

SEQ ID NO: 187384 - protein, 13 aa, Mycobacterium bovis
SGGANGSAPPAPV

SEQ ID NO: 187385 - protein, 16 aa, Mycobacterium bovis
SGGAQAYAAAEATNFG

SEQ ID NO: 187386 - protein, 9 aa, Mycobacterium bovis
SGGARGMGA

SEQ ID NO: 187387 - protein, 4 aa, Mycobacterium bovis
SGGD

SEQ ID NO: 187388 - protein, 31 aa, Mycobacterium bovis
SGGDGGPGGAGANTAGTGGVGGVGGAGGQGG

SEQ ID NO: 187389 - protein, 4 aa, Mycobacterium bovis
SGGE

SEQ ID NO: 187390 - protein, 9 aa, Mycobacterium bovis
SGGEPARGQ

SEQ ID NO: 187391 - protein, 7 aa, Mycobacterium bovis
SGGERPP

SEQ ID NO: 187392 - protein, 6 aa, Mycobacterium bovis
SGGERQ

SEQ ID NO: 187393 - protein, 28 aa, Mycobacterium bovis
SGGFGGAGGAAAGVGTTGGVGGSGGVGG

SEQ ID NO: 187394 - protein, 10 aa, Mycobacterium bovis
SGGGGGTGGF

SEQ ID NO: 187395 - protein, 7 aa, Mycobacterium bovis
SGGGNRL

SEQ ID NO: 187396 - protein, 6 aa, Mycobacterium bovis
SGGGSV

SEQ ID NO: 187397 - protein, 5 aa, Mycobacterium bovis
SGGHL

SEQ ID NO: 187398 - protein, 15 aa, Mycobacterium bovis
SGGKAVAEVGTGAGV

SEQ ID NO: 187399 - protein, 4 aa, Mycobacterium bovis
SGGL

SEQ ID NO: 187400 - protein, 6 aa, Mycobacterium bovis
SGGLRG

SEQ ID NO: 187401 - protein, 6 aa, Mycobacterium bovis
SGGLSL

SEQ ID NO: 187402 - protein, 5 aa, Mycobacterium bovis
SGGMT

SEQ ID NO: 187403 - protein, 46 aa, Mycobacterium bovis
SGGNGAPGAAGQSGGNGGSAGLWGNGGAGGAGGSGGAAGGNGGNGG

SEQ ID NO: 187404 - protein, 44 aa, Mycobacterium bovis
SGGNGAPGAPGQAGGAGGSAGLLGNGGSGGAGGTGAPGGNGGNA

SEQ ID NO: 187405 - protein, 11 aa, Mycobacterium bovis
SGGNPPGDGSS

SEQ ID NO: 187406 - protein, 8 aa, Mycobacterium bovis
SGGNTYFE

SEQ ID NO: 187407 - protein, 7 aa, Mycobacterium bovis
SGGPFRG

SEQ ID NO: 187408 - protein, 6 aa, Mycobacterium bovis
SGGQPI

SEQ ID NO: 187409 - protein, 18 aa, Mycobacterium bovis
SGGSAPTGDHPTPHPSTS

SEQ ID NO: 187410 - protein, 8 aa, Mycobacterium bovis
SGGSAVNP

SEQ ID NO: 187411 - protein, 9 aa, Mycobacterium bovis
SGGSDRKLS

SEQ ID NO: 187412 - protein, 8 aa, Mycobacterium bovis
SGGTAPAA

SEQ ID NO: 187413 - protein, 12 aa, Mycobacterium bovis
SGGTGGNGGNSI

SEQ ID NO: 187414 - protein, 24 aa, Mycobacterium bovis
SGGTGGVGGAATTTGGVGGAGGNA

SEQ ID NO: 187415 - protein, 15 aa, Mycobacterium bovis
SGGTGISPTDTTPEH

SEQ ID NO: 187416 - protein, 8 aa, Mycobacterium bovis
SGGTPPFD

SEQ ID NO: 187417 - protein, 8 aa, Mycobacterium bovis
SGHRAGNG

SEQ ID NO: 187418 - protein, 11 aa, Mycobacterium bovis
SGHSVQSDQPR

SEQ ID NO: 187419 - protein, 6 aa, Mycobacterium bovis
SGIADP

SEQ ID NO: 187420 - protein, 8 aa, Mycobacterium bovis
SGIDPRDS

SEQ ID NO: 187421 - protein, 7 aa, Mycobacterium bovis
SGIDSST

SEQ ID NO: 187422 - protein, 4 aa, Mycobacterium bovis
SGIG

SEQ ID NO: 187423 - protein, 4 aa, Mycobacterium bovis
SGIN

SEQ ID NO: 187424 - protein, 6 aa, Mycobacterium bovis
SGINPD

SEQ ID NO: 187425 - protein, 5 aa, Mycobacterium bovis
SGIPG

SEQ ID NO: 187426 - protein, 4 aa, Mycobacterium bovis
SGIR

SEQ ID NO: 187427 - protein, 18 aa, Mycobacterium bovis
SGKANRLPDELSGGEQQR

SEQ ID NO: 187428 - protein, 7 aa, Mycobacterium bovis
SGKDTRV

SEQ ID NO: 187429 - protein, 8 aa, Mycobacterium bovis
SGKGEELY

SEQ ID NO: 187430 - protein, 11 aa, Mycobacterium bovis
SGKGGVGKSTV

SEQ ID NO: 187431 - protein, 9 aa, Mycobacterium bovis
SGKKQRGEP

SEQ ID NO: 187432 - protein, 5 aa, Mycobacterium bovis
SGKMT

SEQ ID NO: 187433 - protein, 6 aa, Mycobacterium bovis
SGKNFS

SEQ ID NO: 187434 - protein, 7 aa, Mycobacterium bovis
SGKNTRV

SEQ ID NO: 187435 - protein, 7 aa, Mycobacterium bovis
SGKQIPA

SEQ ID NO: 187436 - protein, 5 aa, Mycobacterium bovis
SGKQL

SEQ ID NO: 187437 - protein, 7 aa, Mycobacterium bovis
SGKTGFT

SEQ ID NO: 187438 - protein, 4 aa, Mycobacterium bovis
SGLA

SEQ ID NO: 187439 - protein, 6 aa, Mycobacterium bovis
SGLDPH

SEQ ID NO: 187440 - protein, 6 aa, Mycobacterium bovis
SGLEAD

SEQ ID NO: 187441 - protein, 8 aa, Mycobacterium bovis
SGLGSSPA

SEQ ID NO: 187442 - protein, 6 aa, Mycobacterium bovis
SGLPAD

SEQ ID NO: 187443 - protein, 11 aa, Mycobacterium bovis
SGLPGGGPEVA

SEQ ID NO: 187444 - protein, 7 aa, Mycobacterium bovis
SGLPKGT

SEQ ID NO: 187445 - protein, 4 aa, Mycobacterium bovis
SGLQ

SEQ ID NO: 187446 - protein, 41 aa, Mycobacterium bovis
SGLQTTGIANSGTLNTGVANTGDHSSGGFNQGSDQSGFFGQ

SEQ ID NO: 187447 - protein, 10 aa, Mycobacterium bovis
SGLRASRNQG

SEQ ID NO: 187448 - protein, 14 aa, Mycobacterium bovis
SGLRGRGGAGFATG

SEQ ID NO: 187449 - protein, 10 aa, Mycobacterium bovis
SGLRSDARVE

SEQ ID NO: 187450 - protein, 9 aa, Mycobacterium bovis
SGLSPDDGL

SEQ ID NO: 187451 - protein, 4 aa, Mycobacterium bovis
SGLT

SEQ ID NO: 187452 - protein, 15 aa, Mycobacterium bovis
SGLTNSGFGNTGTDV

SEQ ID NO: 187453 - protein, 9 aa, Mycobacterium bovis
SGLTPQEAQ

SEQ ID NO: 187454 - protein, 4 aa, Mycobacterium bovis
SGMA

SEQ ID NO: 187455 - protein, 8 aa, Mycobacterium bovis
SGMSNSAA

SEQ ID NO: 187456 - protein, 5 aa, Mycobacterium bovis
SGNAA

SEQ ID NO: 187457 - protein, 6 aa, Mycobacterium bovis
SGNEER

SEQ ID NO: 187458 - protein, 10 aa, Mycobacterium bovis
SGNEGSGNLG

SEQ ID NO: 187459 - protein, 18 aa, Mycobacterium bovis
SGNFGNSNIGSASLGNNN

SEQ ID NO: 187460 - protein, 8 aa, Mycobacterium bovis
SGNIGNGS

SEQ ID NO: 187461 - protein, 8 aa, Mycobacterium bovis
SGNIGSSN

SEQ ID NO: 187462 - protein, 18 aa, Mycobacterium bovis
SGNIGSYNLGGGNLGSYN

SEQ ID NO: 187463 - protein, 5 aa, Mycobacterium bovis
SGNIS

SEQ ID NO: 187464 - protein, 10 aa, Mycobacterium bovis
SGNLGSGNVG

SEQ ID NO: 187465 - protein, 9 aa, Mycobacterium bovis
SGNLRSAQR

SEQ ID NO: 187466 - protein, 9 aa, Mycobacterium bovis
SGNPAHSLA

SEQ ID NO: 187467 - protein, 22 aa, Mycobacterium bovis
SGNPPTRERIQSPTDRARYDDT

SEQ ID NO: 187468 - protein, 5 aa, Mycobacterium bovis
SGNTP

SEQ ID NO: 187469 - protein, 6 aa, Mycobacterium bovis
SGNVSA

SEQ ID NO: 187470 - protein, 5 aa, Mycobacterium bovis
SGPAA

SEQ ID NO: 187471 - protein, 6 aa, Mycobacterium bovis
SGPAAD

SEQ ID NO: 187472 - protein, 6 aa, Mycobacterium bovis
SGPADL

SEQ ID NO: 187473 - protein, 9 aa, Mycobacterium bovis
SGPAGTGKA

SEQ ID NO: 187474 - protein, 7 aa, Mycobacterium bovis
SGPAGYT

SEQ ID NO: 187475 - protein, 22 aa, Mycobacterium bovis
SGPAIPPSGERDAWASNSGVGG

SEQ ID NO: 187476 - protein, 5 aa, Mycobacterium bovis
SGPAT

SEQ ID NO: 187477 - protein, 6 aa, Mycobacterium bovis
SGPATR

SEQ ID NO: 187478 - protein, 4 aa, Mycobacterium bovis
SGPE

SEQ ID NO: 187479 - protein, 6 aa, Mycobacterium bovis
SGPEAV

SEQ ID NO: 187480 - protein, 8 aa, Mycobacterium bovis
SGPERAQS

SEQ ID NO: 187481 - protein, 13 aa, Mycobacterium bovis
SGPFGQGSPTPVP

SEQ ID NO: 187482 - protein, 9 aa, Mycobacterium bovis
SGPGDPGLL

SEQ ID NO: 187483 - protein, 16 aa, Mycobacterium bovis
SGPGGQKAAIASAKLG

SEQ ID NO: 187484 - protein, 6 aa, Mycobacterium bovis
SGPGID

SEQ ID NO: 187485 - protein, 6 aa, Mycobacterium bovis
SGPGYA

SEQ ID NO: 187486 - protein, 4 aa, Mycobacterium bovis
SGPI

SEQ ID NO: 187487 - protein, 5 aa, Mycobacterium bovis
SGPIT

SEQ ID NO: 187488 - protein, 7 aa, Mycobacterium bovis
SGPPAET

SEQ ID NO: 187489 - protein, 4 aa, Mycobacterium bovis
SGPQ

SEQ ID NO: 187490 - protein, 18 aa, Mycobacterium bovis
SGPQPASERRADMDGGDI

SEQ ID NO: 187491 - protein, 25 aa, Mycobacterium bovis
SGPSGRANRNEPSSADQRGMRTSST

SEQ ID NO: 187492 - protein, 16 aa, Mycobacterium bovis
SGPTDAEPPDRPIPGP

SEQ ID NO: 187493 - protein, 8 aa, Mycobacterium bovis
SGPTGGEI

SEQ ID NO: 187494 - protein, 38 aa, Mycobacterium bovis
SGPVGDSGNGGAGGDGGAGVSATDIAGTGGRGGNGGHG

SEQ ID NO: 187495 - protein, 9 aa, Mycobacterium bovis
SGQAREKYE

SEQ ID NO: 187496 - protein, 9 aa, Mycobacterium bovis
SGQAWRAPK

SEQ ID NO: 187497 - protein, 11 aa, Mycobacterium bovis
SGQDSRRGTFS

SEQ ID NO: 187498 - protein, 12 aa, Mycobacterium bovis
SGQEQNPDLTGR

SEQ ID NO: 187499 - protein, 7 aa, Mycobacterium bovis
SGQEVPV

SEQ ID NO: 187500 - protein, 10 aa, Mycobacterium bovis
SGQFRPQPVR

SEQ ID NO: 187501 - protein, 5 aa, Mycobacterium bovis
SGQGG

SEQ ID NO: 187502 - protein, 15 aa, Mycobacterium bovis
SGQIKTGAPARSERV

SEQ ID NO: 187503 - protein, 16 aa, Mycobacterium bovis
SGQLGAALSGAAEEQI

SEQ ID NO: 187504 - protein, 6 aa, Mycobacterium bovis
SGQPEF

SEQ ID NO: 187505 - protein, 10 aa, Mycobacterium bovis
SGQSSGTMAA

SEQ ID NO: 187506 - protein, 4 aa, Mycobacterium bovis
SGRA

SEQ ID NO: 187507 - protein, 23 aa, Mycobacterium bovis
SGRAGVASTTAPPDGQVPDGTNL

SEQ ID NO: 187508 - protein, 18 aa, Mycobacterium bovis
SGRALGAPPTTATAGAHA

SEQ ID NO: 187509 - protein, 4 aa, Mycobacterium bovis
SGRE

SEQ ID NO: 187510 - protein, 6 aa, Mycobacterium bovis
SGREDA

SEQ ID NO: 187511 - protein, 5 aa, Mycobacterium bovis
SGREL

SEQ ID NO: 187512 - protein, 6 aa, Mycobacterium bovis
SGREMT

SEQ ID NO: 187513 - protein, 5 aa, Mycobacterium bovis
SGREP

SEQ ID NO: 187514 - protein, 6 aa, Mycobacterium bovis
SGREPH

SEQ ID NO: 187515 - protein, 5 aa, Mycobacterium bovis
SGRFA

SEQ ID NO: 187516 - protein, 20 aa, Mycobacterium bovis
SGRGDKDVETAAKWFGLLGN

SEQ ID NO: 187517 - protein, 5 aa, Mycobacterium bovis
SGRGR

SEQ ID NO: 187518 - protein, 7 aa, Mycobacterium bovis
SGRGRQL

SEQ ID NO: 187519 - protein, 5 aa, Mycobacterium bovis
SGRGT

SEQ ID NO: 187520 - protein, 32 aa, Mycobacterium bovis
SGRGTDPRLDSNKRVGAAERKAARSRRREHGD

SEQ ID NO: 187521 - protein, 7 aa, Mycobacterium bovis
SGRGYPL

SEQ ID NO: 187522 - protein, 4 aa, Mycobacterium bovis
SGRK

SEQ ID NO: 187523 - protein, 9 aa, Mycobacterium bovis
SGRKDEAAE

SEQ ID NO: 187524 - protein, 5 aa, Mycobacterium bovis
SGRLA

SEQ ID NO: 187525 - protein, 5 aa, Mycobacterium bovis
SGRLD

SEQ ID NO: 187526 - protein, 7 aa, Mycobacterium bovis
SGRPAQH

SEQ ID NO: 187527 - protein, 7 aa, Mycobacterium bovis
SGRPFED

SEQ ID NO: 187528 - protein, 6 aa, Mycobacterium bovis
SGRPGA

SEQ ID NO: 187529 - protein, 9 aa, Mycobacterium bovis
SGRPSELSG

SEQ ID NO: 187530 - protein, 6 aa, Mycobacterium bovis
SGRQIG

SEQ ID NO: 187531 - protein, 4 aa, Mycobacterium bovis
SGRR

SEQ ID NO: 187532 - protein, 8 aa, Mycobacterium bovis
SGRRDPGR

SEQ ID NO: 187533 - protein, 8 aa, Mycobacterium bovis
SGRRGPQA

SEQ ID NO: 187534 - protein, 7 aa, Mycobacterium bovis
SGRRRGK

SEQ ID NO: 187535 - protein, 7 aa, Mycobacterium bovis
SGRSAAE

SEQ ID NO: 187536 - protein, 7 aa, Mycobacterium bovis
SGRSGTA

SEQ ID NO: 187537 - protein, 13 aa, Mycobacterium bovis
SGRSTSEVTEEQI

SEQ ID NO: 187538 - protein, 7 aa, Mycobacterium bovis
SGRTGVS

SEQ ID NO: 187539 - protein, 9 aa, Mycobacterium bovis
SGRTPVTGA

SEQ ID NO: 187540 - protein, 8 aa, Mycobacterium bovis
SGRTSNEA

SEQ ID NO: 187541 - protein, 5 aa, Mycobacterium bovis
SGRVD

SEQ ID NO: 187542 - protein, 11 aa, Mycobacterium bovis
SGRYGDDAANT

SEQ ID NO: 187543 - protein, 9 aa, Mycobacterium bovis
SGSADTETT

SEQ ID NO: 187544 - protein, 10 aa, Mycobacterium bovis
SGSEEDETAW

SEQ ID NO: 187545 - protein, 6 aa, Mycobacterium bovis
SGSEHT

SEQ ID NO: 187546 - protein, 18 aa, Mycobacterium bovis
SGSFNTGIGNTGNTNTGL

SEQ ID NO: 187547 - protein, 18 aa, Mycobacterium bovis
SGSFNTGLGNTGSTNTSL

SEQ ID NO: 187548 - protein, 8 aa, Mycobacterium bovis
SGSGATEL

SEQ ID NO: 187549 - protein, 7 aa, Mycobacterium bovis
SGSGKSS

SEQ ID NO: 187550 - protein, 8 aa, Mycobacterium bovis
SGSGKSSL

SEQ ID NO: 187551 - protein, 35 aa, Mycobacterium bovis
SGSGNIGIGNSGSLNSGIGTSGTINAGLGSAGSLN

SEQ ID NO: 187552 - protein, 6 aa, Mycobacterium bovis
SGSGNV

SEQ ID NO: 187553 - protein, 9 aa, Mycobacterium bovis
SGSGPLRPA

SEQ ID NO: 187554 - protein, 6 aa, Mycobacterium bovis
SGSGPT

SEQ ID NO: 187555 - protein, 7 aa, Mycobacterium bovis
SGSGSSY

SEQ ID NO: 187556 - protein, 4 aa, Mycobacterium bovis
SGSL

SEQ ID NO: 187557 - protein, 8 aa, Mycobacterium bovis
SGSLGNYN

SEQ ID NO: 187558 - protein, 5 aa, Mycobacterium bovis
SGSNN

SEQ ID NO: 187559 - protein, 7 aa, Mycobacterium bovis
SGSPITI

SEQ ID NO: 187560 - protein, 25 aa, Mycobacterium bovis
SGSPPEPGKGRPDTTPEQEVPVTAP

SEQ ID NO: 187561 - protein, 8 aa, Mycobacterium bovis
SGSQPLYN

SEQ ID NO: 187562 - protein, 17 aa, Mycobacterium bovis
SGSRDRSVQWLRLRSTG

SEQ ID NO: 187563 - protein, 6 aa, Mycobacterium bovis
SGSRMR

SEQ ID NO: 187564 - protein, 9 aa, Mycobacterium bovis
SGSSGISGV

SEQ ID NO: 187565 - protein, 15 aa, Mycobacterium bovis
SGSSGTAAAKQEALE

SEQ ID NO: 187566 - protein, 4 aa, Mycobacterium bovis
SGST

SEQ ID NO: 187567 - protein, 9 aa, Mycobacterium bovis
SGSTDDTEI

SEQ ID NO: 187568 - protein, 11 aa, Mycobacterium bovis
SGSTGAPKGAM

SEQ ID NO: 187569 - protein, 10 aa, Mycobacterium bovis
SGSTGEPKGV

SEQ ID NO: 187570 - protein, 10 aa, Mycobacterium bovis
SGSTGSPKAV

SEQ ID NO: 187571 - protein, 15 aa, Mycobacterium bovis
SGSTQLGRDETLQDT

SEQ ID NO: 187572 - protein, 6 aa, Mycobacterium bovis
SGSVSV

SEQ ID NO: 187573 - protein, 16 aa, Mycobacterium bovis
SGSYPPATPCTITAED

SEQ ID NO: 187574 - protein, 8 aa, Mycobacterium bovis
SGTANTGL

SEQ ID NO: 187575 - protein, 6 aa, Mycobacterium bovis
SGTDAA

SEQ ID NO: 187576 - protein, 7 aa, Mycobacterium bovis
SGTDGFN

SEQ ID NO: 187577 - protein, 7 aa, Mycobacterium bovis
SGTDTDW

SEQ ID NO: 187578 - protein, 7 aa, Mycobacterium bovis
SGTEATM

SEQ ID NO: 187579 - protein, 6 aa, Mycobacterium bovis
SGTEPA

SEQ ID NO: 187580 - protein, 5 aa, Mycobacterium bovis
SGTGD

SEQ ID NO: 187581 - protein, 10 aa, Mycobacterium bovis
SGTGDTSGYG

SEQ ID NO: 187582 - protein, 17 aa, Mycobacterium bovis
SGTGNFGIGNSGTGNFG

SEQ ID NO: 187583 - protein, 37 aa, Mycobacterium bovis
SGTGNIGFGNSGTGNWGIGNSGDYNTGIGNTGSTNSG

SEQ ID NO: 187584 - protein, 35 aa, Mycobacterium bovis
SGTGNIGIGNSGIGNTGIGNPGVGNTGLGNSGTGN

SEQ ID NO: 187585 - protein, 16 aa, Mycobacterium bovis
SGTGNIGIGNSGTGNW

SEQ ID NO: 187586 - protein, 17 aa, Mycobacterium bovis
SGTGNIGIGNTGTGNFG

SEQ ID NO: 187587 - protein, 25 aa, Mycobacterium bovis
SGTGNVGFGNSGTANTGFGNAGNVN

SEQ ID NO: 187588 - protein, 36 aa, Mycobacterium bovis
SGTGNVGIGNSGTGNVGIGNTGTGNTGIGNSGNYNT

SEQ ID NO: 187589 - protein, 38 aa, Mycobacterium bovis
SGTGNVGIGNSGTGNWGIGNSGNSYNTGFGNSGDANTG

SEQ ID NO: 187590 - protein, 15 aa, Mycobacterium bovis
SGTGNVGIGNTGTAN

SEQ ID NO: 187591 - protein, 16 aa, Mycobacterium bovis
SGTHDPSKHTGMPDPR

SEQ ID NO: 187592 - protein, 9 aa, Mycobacterium bovis
SGTLAQPVR

SEQ ID NO: 187593 - protein, 6 aa, Mycobacterium bovis
SGTNEQ

SEQ ID NO: 187594 - protein, 5 aa, Mycobacterium bovis
SGTNN

SEQ ID NO: 187595 - protein, 8 aa, Mycobacterium bovis
SGTPGADF

SEQ ID NO: 187596 - protein, 6 aa, Mycobacterium bovis
SGTPGF

SEQ ID NO: 187597 - protein, 7 aa, Mycobacterium bovis
SGTPPSE

SEQ ID NO: 187598 - protein, 13 aa, Mycobacterium bovis
SGTSGAGRAATTD

SEQ ID NO: 187599 - protein, 8 aa, Mycobacterium bovis
SGTSPDGH

SEQ ID NO: 187600 - protein, 11 aa, Mycobacterium bovis
SGTTEPDAGLT

SEQ ID NO: 187601 - protein, 11 aa, Mycobacterium bovis
SGTTGEPKGVG

SEQ ID NO: 187602 - protein, 10 aa, Mycobacterium bovis
SGTTGKPKGI

SEQ ID NO: 187603 - protein, 9 aa, Mycobacterium bovis
SGTTGNPKG

SEQ ID NO: 187604 - protein, 11 aa, Mycobacterium bovis
SGTTGNPKGVE

SEQ ID NO: 187605 - protein, 11 aa, Mycobacterium bovis
SGTTGPPKGVQ

SEQ ID NO: 187606 - protein, 13 aa, Mycobacterium bovis
SGTTGRPKGCQLT

SEQ ID NO: 187607 - protein, 8 aa, Mycobacterium bovis
SGTTGRSK

SEQ ID NO: 187608 - protein, 18 aa, Mycobacterium bovis
SGTTGTPKGARHSGGGIG

SEQ ID NO: 187609 - protein, 17 aa, Mycobacterium bovis
SGTTMRGRGGPNRRPRP

SEQ ID NO: 187610 - protein, 7 aa, Mycobacterium bovis
SGTTNTG

SEQ ID NO: 187611 - protein, 16 aa, Mycobacterium bovis
SGTTNTGIGNSGGNLV

SEQ ID NO: 187612 - protein, 6 aa, Mycobacterium bovis
SGTVES

SEQ ID NO: 187613 - protein, 6 aa, Mycobacterium bovis
SGTVNV

SEQ ID NO: 187614 - protein, 7 aa, Mycobacterium bovis
SGTYRGK

SEQ ID NO: 187615 - protein, 7 aa, Mycobacterium bovis
SGVAPDR

SEQ ID NO: 187616 - protein, 14 aa, Mycobacterium bovis
SGVDEDYHRGESAY

SEQ ID NO: 187617 - protein, 10 aa, Mycobacterium bovis
SGVDSTGMSS

SEQ ID NO: 187618 - protein, 5 aa, Mycobacterium bovis
SGVEV

SEQ ID NO: 187619 - protein, 12 aa, Mycobacterium bovis
SGVGDTGDDVRA

SEQ ID NO: 187620 - protein, 6 aa, Mycobacterium bovis
SGVGES

SEQ ID NO: 187621 - protein, 9 aa, Mycobacterium bovis
SGVGNTDSQ

SEQ ID NO: 187622 - protein, 5 aa, Mycobacterium bovis
SGVNR

SEQ ID NO: 187623 - protein, 6 aa, Mycobacterium bovis
SGVPSF

SEQ ID NO: 187624 - protein, 9 aa, Mycobacterium bovis
SGVQPTGDR

SEQ ID NO: 187625 - protein, 6 aa, Mycobacterium bovis
SGVRGT

SEQ ID NO: 187626 - protein, 4 aa, Mycobacterium bovis
SGVS

SEQ ID NO: 187627 - protein, 10 aa, Mycobacterium bovis
SGVSAAGTTL

SEQ ID NO: 187628 - protein, 8 aa, Mycobacterium bovis
SGVSDATQ

SEQ ID NO: 187629 - protein, 6 aa, Mycobacterium bovis
SGVSRS

SEQ ID NO: 187630 - protein, 8 aa, Mycobacterium bovis
SGVTEPFS

SEQ ID NO: 187631 - protein, 4 aa, Mycobacterium bovis
SGWG

SEQ ID NO: 187632 - protein, 21 aa, Mycobacterium bovis
SGWPRPGRDGTRIRSMLPMAS

SEQ ID NO: 187633 - protein, 6 aa, Mycobacterium bovis
SGYDRD

SEQ ID NO: 187634 - protein, 4 aa, Mycobacterium bovis
SGYE

SEQ ID NO: 187635 - protein, 7 aa, Mycobacterium bovis
SGYGGNA

SEQ ID NO: 187636 - protein, 5 aa, Mycobacterium bovis
SGYKY

SEQ ID NO: 187637 - protein, 16 aa, Mycobacterium bovis
SGYPGNEYDGIDNNAY

SEQ ID NO: 187638 - protein, 6 aa, Mycobacterium bovis
SGYQNY

SEQ ID NO: 187639 - protein, 8 aa, Mycobacterium bovis
SGYSDSEL

SEQ ID NO: 187640 - protein, 8 aa, Mycobacterium bovis
SHAESDAL

SEQ ID NO: 187641 - protein, 6 aa, Mycobacterium bovis
SHAGSW

SEQ ID NO: 187642 - protein, 6 aa, Mycobacterium bovis
SHASAA

SEQ ID NO: 187643 - protein, 8 aa, Mycobacterium bovis
SHATGRQL

SEQ ID NO: 187644 - protein, 4 aa, Mycobacterium bovis
SHDL

SEQ ID NO: 187645 - protein, 7 aa, Mycobacterium bovis
SHDPDGE

SEQ ID NO: 187646 - protein, 5 aa, Mycobacterium bovis
SHDRL

SEQ ID NO: 187647 - protein, 6 aa, Mycobacterium bovis
SHDTDT

SEQ ID NO: 187648 - protein, 11 aa, Mycobacterium bovis
SHDVDGAAAHG

SEQ ID NO: 187649 - protein, 10 aa, Mycobacterium bovis
SHEAESAEPQ

SEQ ID NO: 187650 - protein, 7 aa, Mycobacterium bovis
SHEGGIA

SEQ ID NO: 187651 - protein, 6 aa, Mycobacterium bovis
SHGGDP

SEQ ID NO: 187652 - protein, 9 aa, Mycobacterium bovis
SHGGFEGNA

SEQ ID NO: 187653 - protein, 5 aa, Mycobacterium bovis
SHHPR

SEQ ID NO: 187654 - protein, 17 aa, Mycobacterium bovis
SHKRQRKAAAKAEGKAP

SEQ ID NO: 187655 - protein, 7 aa, Mycobacterium bovis
SHPADNI

SEQ ID NO: 187656 - protein, 9 aa, Mycobacterium bovis
SHPDDVDTP

SEQ ID NO: 187657 - protein, 7 aa, Mycobacterium bovis
SHPDGDD

SEQ ID NO: 187658 - protein, 12 aa, Mycobacterium bovis
SHPDTELSAARD

SEQ ID NO: 187659 - protein, 5 aa, Mycobacterium bovis
SHPET

SEQ ID NO: 187660 - protein, 7 aa, Mycobacterium bovis
SHPEYAT

SEQ ID NO: 187661 - protein, 18 aa, Mycobacterium bovis
SHPGGGQPSSATRPTVGD

SEQ ID NO: 187662 - protein, 5 aa, Mycobacterium bovis
SHPGV

SEQ ID NO: 187663 - protein, 19 aa, Mycobacterium bovis
SHPKAKPETPTAPPKPSGI

SEQ ID NO: 187664 - protein, 6 aa, Mycobacterium bovis
SHPRGP

SEQ ID NO: 187665 - protein, 4 aa, Mycobacterium bovis
SHPS

SEQ ID NO: 187666 - protein, 6 aa, Mycobacterium bovis
SHQPNR

SEQ ID NO: 187667 - protein, 7 aa, Mycobacterium bovis
SHQRQRA

SEQ ID NO: 187668 - protein, 7 aa, Mycobacterium bovis
SHQSGLA

SEQ ID NO: 187669 - protein, 13 aa, Mycobacterium bovis
SHRNTGKACNDPV

SEQ ID NO: 187670 - protein, 14 aa, Mycobacterium bovis
SHSDTRIATWSWGR

SEQ ID NO: 187671 - protein, 7 aa, Mycobacterium bovis
SHTPAPV

SEQ ID NO: 187672 - protein, 7 aa, Mycobacterium bovis
SHTSTHG

SEQ ID NO: 187673 - protein, 4 aa, Mycobacterium bovis
SIAD

SEQ ID NO: 187674 - protein, 11 aa, Mycobacterium bovis
SIADASKAISG

SEQ ID NO: 187675 - protein, 8 aa, Mycobacterium bovis
SIAPESAC

SEQ ID NO: 187676 - protein, 8 aa, Mycobacterium bovis
SIASGSGG

SEQ ID NO: 187677 - protein, 15 aa, Mycobacterium bovis
SIDGRSAAADGSSQW

SEQ ID NO: 187678 - protein, 9 aa, Mycobacterium bovis
SIDSDGQRA

SEQ ID NO: 187679 - protein, 4 aa, Mycobacterium bovis
SIED

SEQ ID NO: 187680 - protein, 5 aa, Mycobacterium bovis
SIEDD

SEQ ID NO: 187681 - protein, 23 aa, Mycobacterium bovis
SIEGIRSASSNPALTLPEDPREI

SEQ ID NO: 187682 - protein, 16 aa, Mycobacterium bovis
SIEPRRASRGRGGRMT

SEQ ID NO: 187683 - protein, 13 aa, Mycobacterium bovis
SIEPTKRRPNQCY

SEQ ID NO: 187684 - protein, 19 aa, Mycobacterium bovis
SIESTAAAVASGSPQLPST

SEQ ID NO: 187685 - protein, 8 aa, Mycobacterium bovis
SIGDDSQL

SEQ ID NO: 187686 - protein, 8 aa, Mycobacterium bovis
SIGEPGTQ

SEQ ID NO: 187687 - protein, 8 aa, Mycobacterium bovis
SIGGSDST

SEQ ID NO: 187688 - protein, 8 aa, Mycobacterium bovis
SIGRTEKI

SEQ ID NO: 187689 - protein, 12 aa, Mycobacterium bovis
SIGSSETGFGGT

SEQ ID NO: 187690 - protein, 5 aa, Mycobacterium bovis
SINTG

SEQ ID NO: 187691 - protein, 8 aa, Mycobacterium bovis
SIPAPGLG

SEQ ID NO: 187692 - protein, 6 aa, Mycobacterium bovis
SIPATA

SEQ ID NO: 187693 - protein, 10 aa, Mycobacterium bovis
SIPGPAGEIP

SEQ ID NO: 187694 - protein, 5 aa, Mycobacterium bovis
SIPGV

SEQ ID NO: 187695 - protein, 22 aa, Mycobacterium bovis
SIPHSGEDSIPPNLFVSAQRAT

SEQ ID NO: 187696 - protein, 10 aa, Mycobacterium bovis
SIPITTSGKI

SEQ ID NO: 187697 - protein, 12 aa, Mycobacterium bovis
SIPITTSGKIRR

SEQ ID NO: 187698 - protein, 6 aa, Mycobacterium bovis
SIPNQL

SEQ ID NO: 187699 - protein, 4 aa, Mycobacterium bovis
SIPT

SEQ ID NO: 187700 - protein, 6 aa, Mycobacterium bovis
SIPTPA

SEQ ID NO: 187701 - protein, 15 aa, Mycobacterium bovis
SIQPVGSPVGNTTIE

SEQ ID NO: 187702 - protein, 15 aa, Mycobacterium bovis
SIQQGGAGGAGGNGG

SEQ ID NO: 187703 - protein, 13 aa, Mycobacterium bovis
SIRPGDPNDPGTV

SEQ ID NO: 187704 - protein, 10 aa, Mycobacterium bovis
SISAAGDHAT

SEQ ID NO: 187705 - protein, 7 aa, Mycobacterium bovis
SISASRR

SEQ ID NO: 187706 - protein, 11 aa, Mycobacterium bovis
SITAPDGRPVN

SEQ ID NO: 187707 - protein, 11 aa, Mycobacterium bovis
SITDGASSRRN

SEQ ID NO: 187708 - protein, 6 aa, Mycobacterium bovis
SITPDE

SEQ ID NO: 187709 - protein, 5 aa, Mycobacterium bovis
SITPL

SEQ ID NO: 187710 - protein, 10 aa, Mycobacterium bovis
SITPPGGESF

SEQ ID NO: 187711 - protein, 8 aa, Mycobacterium bovis
SITSRGPH

SEQ ID NO: 187712 - protein, 4 aa, Mycobacterium bovis
SITT

SEQ ID NO: 187713 - protein, 6 aa, Mycobacterium bovis
SKAALS

SEQ ID NO: 187714 - protein, 9 aa, Mycobacterium bovis
SKADTPDGV

SEQ ID NO: 187715 - protein, 8 aa, Mycobacterium bovis
SKAEIDTT

SEQ ID NO: 187716 - protein, 14 aa, Mycobacterium bovis
SKASPTTKAAATAL

SEQ ID NO: 187717 - protein, 5 aa, Mycobacterium bovis
SKDAR

SEQ ID NO: 187718 - protein, 11 aa, Mycobacterium bovis
SKDSAKPANLT

SEQ ID NO: 187719 - protein, 15 aa, Mycobacterium bovis
SKGEAGTGDVSNATT

SEQ ID NO: 187720 - protein, 8 aa, Mycobacterium bovis
SKGGAEKN

SEQ ID NO: 187721 - protein, 11 aa, Mycobacterium bovis
SKGGGENDYER

SEQ ID NO: 187722 - protein, 15 aa, Mycobacterium bovis
SKGRGYPPAEADERD

SEQ ID NO: 187723 - protein, 7 aa, Mycobacterium bovis
SKHAPTA

SEQ ID NO: 187724 - protein, 6 aa, Mycobacterium bovis
SKHPGD

SEQ ID NO: 187725 - protein, 4 aa, Mycobacterium bovis
SKIE

SEQ ID NO: 187726 - protein, 7 aa, Mycobacterium bovis
SKIRGRE

SEQ ID NO: 187727 - protein, 5 aa, Mycobacterium bovis
SKKPQ

SEQ ID NO: 187728 - protein, 10 aa, Mycobacterium bovis
SKLEPEDARR

SEQ ID NO: 187729 - protein, 12 aa, Mycobacterium bovis
SKLESGDLSHTE

SEQ ID NO: 187730 - protein, 4 aa, Mycobacterium bovis
SKLT

SEQ ID NO: 187731 - protein, 7 aa, Mycobacterium bovis
SKLTPAD

SEQ ID NO: 187732 - protein, 18 aa, Mycobacterium bovis
SKPEPASTGAASAAQLSG

SEQ ID NO: 187733 - protein, 4 aa, Mycobacterium bovis
SKPG

SEQ ID NO: 187734 - protein, 8 aa, Mycobacterium bovis
SKPGTYGA

SEQ ID NO: 187735 - protein, 12 aa, Mycobacterium bovis
SKPNPKTATNAG

SEQ ID NO: 187736 - protein, 8 aa, Mycobacterium bovis
SKPPQRGL

SEQ ID NO: 187737 - protein, 8 aa, Mycobacterium bovis
SKPTGIPP

SEQ ID NO: 187738 - protein, 32 aa, Mycobacterium bovis
SKPVSPDAPARHGAAGQRRSSNPTRSLKAAAG

SEQ ID NO: 187739 - protein, 5 aa, Mycobacterium bovis
SKQPG

SEQ ID NO: 187740 - protein, 4 aa, Mycobacterium bovis
SKQV

SEQ ID NO: 187741 - protein, 6 aa, Mycobacterium bovis
SKRGGG

SEQ ID NO: 187742 - protein, 6 aa, Mycobacterium bovis
SKRSAV

SEQ ID NO: 187743 - protein, 9 aa, Mycobacterium bovis
SKRSTRMTA

SEQ ID NO: 187744 - protein, 7 aa, Mycobacterium bovis
SKRYGAG

SEQ ID NO: 187745 - protein, 5 aa, Mycobacterium bovis
SKSHS

SEQ ID NO: 187746 - protein, 6 aa, Mycobacterium bovis
SKSIRG

SEQ ID NO: 187747 - protein, 15 aa, Mycobacterium bovis
SKSNRTDSAQLGDHP

SEQ ID NO: 187748 - protein, 8 aa, Mycobacterium bovis
SKSPHWTG

SEQ ID NO: 187749 - protein, 7 aa, Mycobacterium bovis
SKSPRCT

SEQ ID NO: 187750 - protein, 16 aa, Mycobacterium bovis
SKSRDFADDPQRAAAV

SEQ ID NO: 187751 - protein, 8 aa, Mycobacterium bovis
SKSSSLAG

SEQ ID NO: 187752 - protein, 5 aa, Mycobacterium bovis
SKTAT

SEQ ID NO: 187753 - protein, 8 aa, Mycobacterium bovis
SKTGERAR

SEQ ID NO: 187754 - protein, 19 aa, Mycobacterium bovis
SKTGRPWNSTPEDSNYDPC

SEQ ID NO: 187755 - protein, 7 aa, Mycobacterium bovis
SKTPEQE

SEQ ID NO: 187756 - protein, 7 aa, Mycobacterium bovis
SKTQQDA

SEQ ID NO: 187757 - protein, 6 aa, Mycobacterium bovis
SKTRNH

SEQ ID NO: 187758 - protein, 6 aa, Mycobacterium bovis
SKVGTV

SEQ ID NO: 187759 - protein, 6 aa, Mycobacterium bovis
SKVSDK

SEQ ID NO: 187760 - protein, 7 aa, Mycobacterium bovis
SKYRGEF

SEQ ID NO: 187761 - protein, 11 aa, Mycobacterium bovis
SLAAAKSKSAL

SEQ ID NO: 187762 - protein, 13 aa, Mycobacterium bovis
SLAGNADQGSEDP

SEQ ID NO: 187763 - protein, 67 aa, Mycobacterium bovis
SLAGRGDEESGEPAAELAEQAGDQPPTDLDDTAQADFEDTEDTDEDEDELDADEDLEDLDDEDLDED

SEQ ID NO: 187764 - protein, 10 aa, Mycobacterium bovis
SLAGSGVLTG

SEQ ID NO: 187765 - protein, 5 aa, Mycobacterium bovis
SLAGT

SEQ ID NO: 187766 - protein, 6 aa, Mycobacterium bovis
SLAGTQ

SEQ ID NO: 187767 - protein, 11 aa, Mycobacterium bovis
SLASRECPQPA

SEQ ID NO: 187768 - protein, 5 aa, Mycobacterium bovis
SLATD

SEQ ID NO: 187769 - protein, 11 aa, Mycobacterium bovis
SLDAAGDARPP

SEQ ID NO: 187770 - protein, 8 aa, Mycobacterium bovis
SLDAASKS

SEQ ID NO: 187771 - protein, 4 aa, Mycobacterium bovis
SLDG

SEQ ID NO: 187772 - protein, 7 aa, Mycobacterium bovis
SLDPRDP

SEQ ID NO: 187773 - protein, 8 aa, Mycobacterium bovis
SLDQGGPC

SEQ ID NO: 187774 - protein, 8 aa, Mycobacterium bovis
SLDSHGRT

SEQ ID NO: 187775 - protein, 9 aa, Mycobacterium bovis
SLDTGEQTV

SEQ ID NO: 187776 - protein, 4 aa, Mycobacterium bovis
SLEA

SEQ ID NO: 187777 - protein, 5 aa, Mycobacterium bovis
SLERA

SEQ ID NO: 187778 - protein, 4 aa, Mycobacterium bovis
SLGD

SEQ ID NO: 187779 - protein, 7 aa, Mycobacterium bovis
SLGGGTA

SEQ ID NO: 187780 - protein, 8 aa, Mycobacterium bovis
SLGPETSK

SEQ ID NO: 187781 - protein, 8 aa, Mycobacterium bovis
SLGPGSMS

SEQ ID NO: 187782 - protein, 6 aa, Mycobacterium bovis
SLGRPA

SEQ ID NO: 187783 - protein, 7 aa, Mycobacterium bovis
SLGSAPR

SEQ ID NO: 187784 - protein, 7 aa, Mycobacterium bovis
SLGSDNA

SEQ ID NO: 187785 - protein, 6 aa, Mycobacterium bovis
SLHGDT

SEQ ID NO: 187786 - protein, 5 aa, Mycobacterium bovis
SLHNS

SEQ ID NO: 187787 - protein, 11 aa, Mycobacterium bovis
SLHPPSDQVRS

SEQ ID NO: 187788 - protein, 5 aa, Mycobacterium bovis
SLNAG

SEQ ID NO: 187789 - protein, 14 aa, Mycobacterium bovis
SLNASQAQADPDGK

SEQ ID NO: 187790 - protein, 6 aa, Mycobacterium bovis
SLNDQD

SEQ ID NO: 187791 - protein, 14 aa, Mycobacterium bovis
SLNEAAPDADRFRR

SEQ ID NO: 187792 - protein, 10 aa, Mycobacterium bovis
SLNSGAGNTG

SEQ ID NO: 187793 - protein, 5 aa, Mycobacterium bovis
SLPAD

SEQ ID NO: 187794 - protein, 9 aa, Mycobacterium bovis
SLPASQRDE

SEQ ID NO: 187795 - protein, 5 aa, Mycobacterium bovis
SLPDA

SEQ ID NO: 187796 - protein, 10 aa, Mycobacterium bovis
SLPEEAKSMA

SEQ ID NO: 187797 - protein, 4 aa, Mycobacterium bovis
SLPN

SEQ ID NO: 187798 - protein, 22 aa, Mycobacterium bovis
SLPPADDVGAGRRAVERLRGGI

SEQ ID NO: 187799 - protein, 6 aa, Mycobacterium bovis
SLPPAH

SEQ ID NO: 187800 - protein, 7 aa, Mycobacterium bovis
SLPPGNQ

SEQ ID NO: 187801 - protein, 10 aa, Mycobacterium bovis
SLPQAEPTAP

SEQ ID NO: 187802 - protein, 12 aa, Mycobacterium bovis
SLPSSRPSPHHT

SEQ ID NO: 187803 - protein, 8 aa, Mycobacterium bovis
SLPTDDEL

SEQ ID NO: 187804 - protein, 6 aa, Mycobacterium bovis
SLPTPF

SEQ ID NO: 187805 - protein, 60 aa, Mycobacterium bovis
SLPTPNGGAGGNGGTGSNGGAPGPAGAPGPTTGGNAGSQGIGGDGGNGGDGGKGGDGADA

SEQ ID NO: 187806 - protein, 5 aa, Mycobacterium bovis
SLQDK

SEQ ID NO: 187807 - protein, 4 aa, Mycobacterium bovis
SLQT

SEQ ID NO: 187808 - protein, 4 aa, Mycobacterium bovis
SLRE

SEQ ID NO: 187809 - protein, 9 aa, Mycobacterium bovis
SLREGQASL

SEQ ID NO: 187810 - protein, 5 aa, Mycobacterium bovis
SLRHP

SEQ ID NO: 187811 - protein, 10 aa, Mycobacterium bovis
SLRPARQRLP

SEQ ID NO: 187812 - protein, 6 aa, Mycobacterium bovis
SLRRPQ

SEQ ID NO: 187813 - protein, 7 aa, Mycobacterium bovis
SLRRTDD

SEQ ID NO: 187814 - protein, 8 aa, Mycobacterium bovis
SLRTEGRQ

SEQ ID NO: 187815 - protein, 4 aa, Mycobacterium bovis
SLSD

SEQ ID NO: 187816 - protein, 6 aa, Mycobacterium bovis
SLSDEE

SEQ ID NO: 187817 - protein, 9 aa, Mycobacterium bovis
SLSEDPPVT

SEQ ID NO: 187818 - protein, 10 aa, Mycobacterium bovis
SLSPYGPPVT

SEQ ID NO: 187819 - protein, 6 aa, Mycobacterium bovis
SLSSDE

SEQ ID NO: 187820 - protein, 6 aa, Mycobacterium bovis
SLTENE

SEQ ID NO: 187821 - protein, 10 aa, Mycobacterium bovis
SLTGHAKGGA

SEQ ID NO: 187822 - protein, 8 aa, Mycobacterium bovis
SLTGSATY

SEQ ID NO: 187823 - protein, 6 aa, Mycobacterium bovis
SLTQAA

SEQ ID NO: 187824 - protein, 9 aa, Mycobacterium bovis
SLTQVGSSG

SEQ ID NO: 187825 - protein, 10 aa, Mycobacterium bovis
SLTTKGTDAI

SEQ ID NO: 187826 - protein, 8 aa, Mycobacterium bovis
SLYPSSPD

SEQ ID NO: 187827 - protein, 6 aa, Mycobacterium bovis
SMDAGG

SEQ ID NO: 187828 - protein, 7 aa, Mycobacterium bovis
SMGDSEF

SEQ ID NO: 187829 - protein, 10 aa, Mycobacterium bovis
SMGQENDGLD

SEQ ID NO: 187830 - protein, 8 aa, Mycobacterium bovis
SMHTGGRV

SEQ ID NO: 187831 - protein, 7 aa, Mycobacterium bovis
SMPKRGV

SEQ ID NO: 187832 - protein, 6 aa, Mycobacterium bovis
SMPYKS

SEQ ID NO: 187833 - protein, 17 aa, Mycobacterium bovis
SMRDGKAAIAGRSRNQA

SEQ ID NO: 187834 - protein, 13 aa, Mycobacterium bovis
SMWPPGRQRSRAS

SEQ ID NO: 187835 - protein, 7 aa, Mycobacterium bovis
SNAAGLG

SEQ ID NO: 187836 - protein, 8 aa, Mycobacterium bovis
SNAGAGTA

SEQ ID NO: 187837 - protein, 5 aa, Mycobacterium bovis
SNAGG

SEQ ID NO: 187838 - protein, 7 aa, Mycobacterium bovis
SNASAQR

SEQ ID NO: 187839 - protein, 6 aa, Mycobacterium bovis
SNASDA

SEQ ID NO: 187840 - protein, 11 aa, Mycobacterium bovis
SNDDGTGTADP

SEQ ID NO: 187841 - protein, 7 aa, Mycobacterium bovis
SNDSVPQ

SEQ ID NO: 187842 - protein, 6 aa, Mycobacterium bovis
SNEAKA

SEQ ID NO: 187843 - protein, 12 aa, Mycobacterium bovis
SNEIGQLYQAVG

SEQ ID NO: 187844 - protein, 8 aa, Mycobacterium bovis
SNEPAGEG

SEQ ID NO: 187845 - protein, 5 aa, Mycobacterium bovis
SNEPT

SEQ ID NO: 187846 - protein, 5 aa, Mycobacterium bovis
SNERL

SEQ ID NO: 187847 - protein, 9 aa, Mycobacterium bovis
SNGDHTHGT

SEQ ID NO: 187848 - protein, 19 aa, Mycobacterium bovis
SNGDKPKVALPDTQLGSHS

SEQ ID NO: 187849 - protein, 29 aa, Mycobacterium bovis
SNGGAGGAGGFGVSGSAGGNGGTGGDGGI

SEQ ID NO: 187850 - protein, 28 aa, Mycobacterium bovis
SNGLGASVKRREDTHKMAEANRAFAHYR

SEQ ID NO: 187851 - protein, 5 aa, Mycobacterium bovis
SNGMN

SEQ ID NO: 187852 - protein, 15 aa, Mycobacterium bovis
SNHGGNNLDGTPASI

SEQ ID NO: 187853 - protein, 7 aa, Mycobacterium bovis
SNIPDGQ

SEQ ID NO: 187854 - protein, 5 aa, Mycobacterium bovis
SNLPD

SEQ ID NO: 187855 - protein, 7 aa, Mycobacterium bovis
SNMSETT

SEQ ID NO: 187856 - protein, 5 aa, Mycobacterium bovis
SNNRE

SEQ ID NO: 187857 - protein, 5 aa, Mycobacterium bovis
SNPAI

SEQ ID NO: 187858 - protein, 6 aa, Mycobacterium bovis
SNPATI

SEQ ID NO: 187859 - protein, 15 aa, Mycobacterium bovis
SNPGTSIKDKGATRE

SEQ ID NO: 187860 - protein, 5 aa, Mycobacterium bovis
SNPNI

SEQ ID NO: 187861 - protein, 16 aa, Mycobacterium bovis
SNPNQKATEDYISGRF

SEQ ID NO: 187862 - protein, 7 aa, Mycobacterium bovis
SNPTHRA

SEQ ID NO: 187863 - protein, 5 aa, Mycobacterium bovis
SNPVR

SEQ ID NO: 187864 - protein, 7 aa, Mycobacterium bovis
SNQVPAT

SEQ ID NO: 187865 - protein, 4 aa, Mycobacterium bovis
SNRA

SEQ ID NO: 187866 - protein, 6 aa, Mycobacterium bovis
SNREEM

SEQ ID NO: 187867 - protein, 15 aa, Mycobacterium bovis
SNRGVAGIDGTVSTA

SEQ ID NO: 187868 - protein, 7 aa, Mycobacterium bovis
SNRQYGA

SEQ ID NO: 187869 - protein, 7 aa, Mycobacterium bovis
SNRSRDL

SEQ ID NO: 187870 - protein, 5 aa, Mycobacterium bovis
SNRVD

SEQ ID NO: 187871 - protein, 15 aa, Mycobacterium bovis
SNSRRRTSDGGWEPG

SEQ ID NO: 187872 - protein, 10 aa, Mycobacterium bovis
SNSSATMARP

SEQ ID NO: 187873 - protein, 5 aa, Mycobacterium bovis
SNTDG

SEQ ID NO: 187874 - protein, 15 aa, Mycobacterium bovis
SNTRERMSSPVRNNV

SEQ ID NO: 187875 - protein, 6 aa, Mycobacterium bovis
SNTRGD

SEQ ID NO: 187876 - protein, 7 aa, Mycobacterium bovis
SNVQGDR

SEQ ID NO: 187877 - protein, 8 aa, Mycobacterium bovis
SNVTGTSV

SEQ ID NO: 187878 - protein, 11 aa, Mycobacterium bovis
SPAASSLNGPI

SEQ ID NO: 187879 - protein, 4 aa, Mycobacterium bovis
SPAD

SEQ ID NO: 187880 - protein, 6 aa, Mycobacterium bovis
SPAEQA

SEQ ID NO: 187881 - protein, 6 aa, Mycobacterium bovis
SPAFTA

SEQ ID NO: 187882 - protein, 9 aa, Mycobacterium bovis
SPAGEQVSG

SEQ ID NO: 187883 - protein, 11 aa, Mycobacterium bovis
SPAGQDRSSLQ

SEQ ID NO: 187884 - protein, 12 aa, Mycobacterium bovis
SPAGRRKSAGRR

SEQ ID NO: 187885 - protein, 7 aa, Mycobacterium bovis
SPAHADG

SEQ ID NO: 187886 - protein, 5 aa, Mycobacterium bovis
SPAKA

SEQ ID NO: 187887 - protein, 9 aa, Mycobacterium bovis
SPAKETREF

SEQ ID NO: 187888 - protein, 6 aa, Mycobacterium bovis
SPALGA

SEQ ID NO: 187889 - protein, 5 aa, Mycobacterium bovis
SPALQ

SEQ ID NO: 187890 - protein, 5 aa, Mycobacterium bovis
SPAND

SEQ ID NO: 187891 - protein, 5 aa, Mycobacterium bovis
SPANE

SEQ ID NO: 187892 - protein, 13 aa, Mycobacterium bovis
SPANPTGTVIPPE

SEQ ID NO: 187893 - protein, 5 aa, Mycobacterium bovis
SPAPC

SEQ ID NO: 187894 - protein, 5 aa, Mycobacterium bovis
SPAPI

SEQ ID NO: 187895 - protein, 17 aa, Mycobacterium bovis
SPAPSPRPPATSTEGVS

SEQ ID NO: 187896 - protein, 5 aa, Mycobacterium bovis
SPAPT

SEQ ID NO: 187897 - protein, 7 aa, Mycobacterium bovis
SPAQIAD

SEQ ID NO: 187898 - protein, 5 aa, Mycobacterium bovis
SPAQL

SEQ ID NO: 187899 - protein, 13 aa, Mycobacterium bovis
SPARASALEESNY

SEQ ID NO: 187900 - protein, 11 aa, Mycobacterium bovis
SPASISSGTYS

SEQ ID NO: 187901 - protein, 9 aa, Mycobacterium bovis
SPASNAVTG

SEQ ID NO: 187902 - protein, 7 aa, Mycobacterium bovis
SPASWTS

SEQ ID NO: 187903 - protein, 13 aa, Mycobacterium bovis
SPAVRAGADERGL

SEQ ID NO: 187904 - protein, 13 aa, Mycobacterium bovis
SPDCGREGSYRDT

SEQ ID NO: 187905 - protein, 9 aa, Mycobacterium bovis
SPDEVEGGM

SEQ ID NO: 187906 - protein, 6 aa, Mycobacterium bovis
SPDGGL

SEQ ID NO: 187907 - protein, 12 aa, Mycobacterium bovis
SPDGKNHGTRSL

SEQ ID NO: 187908 - protein, 6 aa, Mycobacterium bovis
SPDGQA

SEQ ID NO: 187909 - protein, 6 aa, Mycobacterium bovis
SPDIES

SEQ ID NO: 187910 - protein, 8 aa, Mycobacterium bovis
SPDKPEKL

SEQ ID NO: 187911 - protein, 6 aa, Mycobacterium bovis
SPDLAG

SEQ ID NO: 187912 - protein, 7 aa, Mycobacterium bovis
SPDPGPV

SEQ ID NO: 187913 - protein, 8 aa, Mycobacterium bovis
SPDQRQER

SEQ ID NO: 187914 - protein, 15 aa, Mycobacterium bovis
SPDRLADQLSTVAVR

SEQ ID NO: 187915 - protein, 7 aa, Mycobacterium bovis
SPDSAIG

SEQ ID NO: 187916 - protein, 8 aa, Mycobacterium bovis
SPDSARGR

SEQ ID NO: 187917 - protein, 25 aa, Mycobacterium bovis
SPDTAAEIGAADGEAVTVSTSRGSI

SEQ ID NO: 187918 - protein, 9 aa, Mycobacterium bovis
SPEADTAGM

SEQ ID NO: 187919 - protein, 8 aa, Mycobacterium bovis
SPEDEDRE

SEQ ID NO: 187920 - protein, 7 aa, Mycobacterium bovis
SPEDEKA

SEQ ID NO: 187921 - protein, 11 aa, Mycobacterium bovis
SPEEYTGKRTH

SEQ ID NO: 187922 - protein, 6 aa, Mycobacterium bovis
SPEFGS

SEQ ID NO: 187923 - protein, 5 aa, Mycobacterium bovis
SPEFQ

SEQ ID NO: 187924 - protein, 6 aa, Mycobacterium bovis
SPENAR

SEQ ID NO: 187925 - protein, 9 aa, Mycobacterium bovis
SPEPKPCEG

SEQ ID NO: 187926 - protein, 16 aa, Mycobacterium bovis
SPEPTSQPAAEPTRVT

SEQ ID NO: 187927 - protein, 7 aa, Mycobacterium bovis
SPEQEQA

SEQ ID NO: 187928 - protein, 5 aa, Mycobacterium bovis
SPERL

SEQ ID NO: 187929 - protein, 8 aa, Mycobacterium bovis
SPERLSGR

SEQ ID NO: 187930 - protein, 9 aa, Mycobacterium bovis
SPETTTGGK

SEQ ID NO: 187931 - protein, 5 aa, Mycobacterium bovis
SPEWT

SEQ ID NO: 187932 - protein, 6 aa, Mycobacterium bovis
SPFGQG

SEQ ID NO: 187933 - protein, 6 aa, Mycobacterium bovis
SPFSKP

SEQ ID NO: 187934 - protein, 7 aa, Mycobacterium bovis
SPGDGRI

SEQ ID NO: 187935 - protein, 4 aa, Mycobacterium bovis
SPGG

SEQ ID NO: 187936 - protein, 8 aa, Mycobacterium bovis
SPGGESNV

SEQ ID NO: 187937 - protein, 6 aa, Mycobacterium bovis
SPGGGF

SEQ ID NO: 187938 - protein, 9 aa, Mycobacterium bovis
SPGGRTGGN

SEQ ID NO: 187939 - protein, 8 aa, Mycobacterium bovis
SPGGSDAS

SEQ ID NO: 187940 - protein, 7 aa, Mycobacterium bovis
SPGGSIS

SEQ ID NO: 187941 - protein, 5 aa, Mycobacterium bovis
SPGKG

SEQ ID NO: 187942 - protein, 4 aa, Mycobacterium bovis
SPGL

SEQ ID NO: 187943 - protein, 6 aa, Mycobacterium bovis
SPGMAR

SEQ ID NO: 187944 - protein, 13 aa, Mycobacterium bovis
SPGMTDRSPRAAI

SEQ ID NO: 187945 - protein, 6 aa, Mycobacterium bovis
SPGNSY

SEQ ID NO: 187946 - protein, 5 aa, Mycobacterium bovis
SPGPH

SEQ ID NO: 187947 - protein, 10 aa, Mycobacterium bovis
SPGQARRKIA

SEQ ID NO: 187948 - protein, 6 aa, Mycobacterium bovis
SPGQHS

SEQ ID NO: 187949 - protein, 6 aa, Mycobacterium bovis
SPGQSL

SEQ ID NO: 187950 - protein, 8 aa, Mycobacterium bovis
SPGRDTPI

SEQ ID NO: 187951 - protein, 7 aa, Mycobacterium bovis
SPGRRNN

SEQ ID NO: 187952 - protein, 4 aa, Mycobacterium bovis
SPGV

SEQ ID NO: 187953 - protein, 6 aa, Mycobacterium bovis
SPGVDT

SEQ ID NO: 187954 - protein, 10 aa, Mycobacterium bovis
SPGVERPLTS

SEQ ID NO: 187955 - protein, 4 aa, Mycobacterium bovis
SPHL

SEQ ID NO: 187956 - protein, 8 aa, Mycobacterium bovis
SPHNRNAL

SEQ ID NO: 187957 - protein, 6 aa, Mycobacterium bovis
SPHPAA

SEQ ID NO: 187958 - protein, 7 aa, Mycobacterium bovis
SPHPAEF

SEQ ID NO: 187959 - protein, 8 aa, Mycobacterium bovis
SPHPSAGI

SEQ ID NO: 187960 - protein, 10 aa, Mycobacterium bovis
SPHPSPLSAS

SEQ ID NO: 187961 - protein, 4 aa, Mycobacterium bovis
SPHV

SEQ ID NO: 187962 - protein, 11 aa, Mycobacterium bovis
SPIEPPARPDG

SEQ ID NO: 187963 - protein, 6 aa, Mycobacterium bovis
SPIGKR

SEQ ID NO: 187964 - protein, 6 aa, Mycobacterium bovis
SPIGTG

SEQ ID NO: 187965 - protein, 9 aa, Mycobacterium bovis
SPIKSGEPL

SEQ ID NO: 187966 - protein, 8 aa, Mycobacterium bovis
SPKDAEGI

SEQ ID NO: 187967 - protein, 8 aa, Mycobacterium bovis
SPKGSATL

SEQ ID NO: 187968 - protein, 8 aa, Mycobacterium bovis
SPKHAETA

SEQ ID NO: 187969 - protein, 17 aa, Mycobacterium bovis
SPKNPDNWTFTPNGPPV

SEQ ID NO: 187970 - protein, 11 aa, Mycobacterium bovis
SPKTARLGAQE

SEQ ID NO: 187971 - protein, 4 aa, Mycobacterium bovis
SPLA

SEQ ID NO: 187972 - protein, 12 aa, Mycobacterium bovis
SPLAADAVTASP

SEQ ID NO: 187973 - protein, 14 aa, Mycobacterium bovis
SPLAEGSHADGSAI

SEQ ID NO: 187974 - protein, 11 aa, Mycobacterium bovis
SPLPETPETGV

SEQ ID NO: 187975 - protein, 6 aa, Mycobacterium bovis
SPLPVD

SEQ ID NO: 187976 - protein, 5 aa, Mycobacterium bovis
SPLRD

SEQ ID NO: 187977 - protein, 5 aa, Mycobacterium bovis
SPLSE

SEQ ID NO: 187978 - protein, 8 aa, Mycobacterium bovis
SPLSGNPG

SEQ ID NO: 187979 - protein, 6 aa, Mycobacterium bovis
SPLSSA

SEQ ID NO: 187980 - protein, 14 aa, Mycobacterium bovis
SPLTPDHVNPERPW

SEQ ID NO: 187981 - protein, 4 aa, Mycobacterium bovis
SPMP

SEQ ID NO: 187982 - protein, 12 aa, Mycobacterium bovis
SPMSADAAQPLA

SEQ ID NO: 187983 - protein, 7 aa, Mycobacterium bovis
SPNADEN

SEQ ID NO: 187984 - protein, 6 aa, Mycobacterium bovis
SPNARA

SEQ ID NO: 187985 - protein, 12 aa, Mycobacterium bovis
SPNGGDKPTGEL

SEQ ID NO: 187986 - protein, 7 aa, Mycobacterium bovis
SPPAPAE

SEQ ID NO: 187987 - protein, 4 aa, Mycobacterium bovis
SPPD

SEQ ID NO: 187988 - protein, 8 aa, Mycobacterium bovis
SPPEQLPD

SEQ ID NO: 187989 - protein, 4 aa, Mycobacterium bovis
SPPF

SEQ ID NO: 187990 - protein, 9 aa, Mycobacterium bovis
SPPKAGKTT

SEQ ID NO: 187991 - protein, 4 aa, Mycobacterium bovis
SPPL

SEQ ID NO: 187992 - protein, 5 aa, Mycobacterium bovis
SPPPH

SEQ ID NO: 187993 - protein, 5 aa, Mycobacterium bovis
SPPPL

SEQ ID NO: 187994 - protein, 5 aa, Mycobacterium bovis
SPPPV

SEQ ID NO: 187995 - protein, 7 aa, Mycobacterium bovis
SPPQAQW

SEQ ID NO: 187996 - protein, 5 aa, Mycobacterium bovis
SPPQL

SEQ ID NO: 187997 - protein, 9 aa, Mycobacterium bovis
SPPRGAGGA

SEQ ID NO: 187998 - protein, 7 aa, Mycobacterium bovis
SPPRHGL

SEQ ID NO: 187999 - protein, 7 aa, Mycobacterium bovis
SPPRTAR

SEQ ID NO: 188000 - protein, 4 aa, Mycobacterium bovis
SPPV

SEQ ID NO: 188001 - protein, 4 aa, Mycobacterium bovis
SPQA

SEQ ID NO: 188002 - protein, 5 aa, Mycobacterium bovis
SPQAF

SEQ ID NO: 188003 - protein, 9 aa, Mycobacterium bovis
SPQALTNQA

SEQ ID NO: 188004 - protein, 6 aa, Mycobacterium bovis
SPQHEY

SEQ ID NO: 188005 - protein, 8 aa, Mycobacterium bovis
SPQPSAAV

SEQ ID NO: 188006 - protein, 11 aa, Mycobacterium bovis
SPQPSSPRLPD

SEQ ID NO: 188007 - protein, 4 aa, Mycobacterium bovis
SPQQ

SEQ ID NO: 188008 - protein, 7 aa, Mycobacterium bovis
SPQRSYP

SEQ ID NO: 188009 - protein, 7 aa, Mycobacterium bovis
SPQSIRD

SEQ ID NO: 188010 - protein, 6 aa, Mycobacterium bovis
SPQSTV

SEQ ID NO: 188011 - protein, 14 aa, Mycobacterium bovis
SPQSTVIGGTSDTV

SEQ ID NO: 188012 - protein, 7 aa, Mycobacterium bovis
SPRAGQA

SEQ ID NO: 188013 - protein, 5 aa, Mycobacterium bovis
SPRDA

SEQ ID NO: 188014 - protein, 7 aa, Mycobacterium bovis
SPRDGER

SEQ ID NO: 188015 - protein, 8 aa, Mycobacterium bovis
SPREGRDD

SEQ ID NO: 188016 - protein, 6 aa, Mycobacterium bovis
SPRGAT

SEQ ID NO: 188017 - protein, 15 aa, Mycobacterium bovis
SPRGRITRTYREAEN

SEQ ID NO: 188018 - protein, 4 aa, Mycobacterium bovis
SPRH

SEQ ID NO: 188019 - protein, 13 aa, Mycobacterium bovis
SPRLRSPLGASRP

SEQ ID NO: 188020 - protein, 11 aa, Mycobacterium bovis
SPRPRWPPNAA

SEQ ID NO: 188021 - protein, 27 aa, Mycobacterium bovis
SPRPSATSSAHTPTAGSTNQASSTHYG

SEQ ID NO: 188022 - protein, 6 aa, Mycobacterium bovis
SPRQTV

SEQ ID NO: 188023 - protein, 4 aa, Mycobacterium bovis
SPRR

SEQ ID NO: 188024 - protein, 6 aa, Mycobacterium bovis
SPRRGQ

SEQ ID NO: 188025 - protein, 5 aa, Mycobacterium bovis
SPRYG

SEQ ID NO: 188026 - protein, 34 aa, Mycobacterium bovis
SPSEHPYGSSRAGSKYQGQRGPTPSRSCQNFIRS

SEQ ID NO: 188027 - protein, 7 aa, Mycobacterium bovis
SPSMTQH

SEQ ID NO: 188028 - protein, 8 aa, Mycobacterium bovis
SPSNPTGR

SEQ ID NO: 188029 - protein, 4 aa, Mycobacterium bovis
SPSP

SEQ ID NO: 188030 - protein, 15 aa, Mycobacterium bovis
SPSQALRSARPHPFA

SEQ ID NO: 188031 - protein, 13 aa, Mycobacterium bovis
SPSRSRPHRAEAR

SEQ ID NO: 188032 - protein, 12 aa, Mycobacterium bovis
SPSSGGGRPQPW

SEQ ID NO: 188033 - protein, 4 aa, Mycobacterium bovis
SPST

SEQ ID NO: 188034 - protein, 6 aa, Mycobacterium bovis
SPTDRR

SEQ ID NO: 188035 - protein, 9 aa, Mycobacterium bovis
SPTEQQRLR

SEQ ID NO: 188036 - protein, 10 aa, Mycobacterium bovis
SPTETVSGPM

SEQ ID NO: 188037 - protein, 7 aa, Mycobacterium bovis
SPTGTPH

SEQ ID NO: 188038 - protein, 5 aa, Mycobacterium bovis
SPTHN

SEQ ID NO: 188039 - protein, 8 aa, Mycobacterium bovis
SPTHPEAT

SEQ ID NO: 188040 - protein, 7 aa, Mycobacterium bovis
SPTKARK

SEQ ID NO: 188041 - protein, 9 aa, Mycobacterium bovis
SPTKEFNEH

SEQ ID NO: 188042 - protein, 5 aa, Mycobacterium bovis
SPTLQ

SEQ ID NO: 188043 - protein, 9 aa, Mycobacterium bovis
SPTPAAAGR

SEQ ID NO: 188044 - protein, 5 aa, Mycobacterium bovis
SPTPV

SEQ ID NO: 188045 - protein, 4 aa, Mycobacterium bovis
SPTR

SEQ ID NO: 188046 - protein, 19 aa, Mycobacterium bovis
SPTRRIDDSYANGYANSKW

SEQ ID NO: 188047 - protein, 8 aa, Mycobacterium bovis
SPTSGSGC

SEQ ID NO: 188048 - protein, 8 aa, Mycobacterium bovis
SPTTPTTA

SEQ ID NO: 188049 - protein, 11 aa, Mycobacterium bovis
SPVADTTVTVD

SEQ ID NO: 188050 - protein, 7 aa, Mycobacterium bovis
SPVDSGN

SEQ ID NO: 188051 - protein, 9 aa, Mycobacterium bovis
SPVENPPPY

SEQ ID NO: 188052 - protein, 4 aa, Mycobacterium bovis
SPVG

SEQ ID NO: 188053 - protein, 5 aa, Mycobacterium bovis
SPVGA

SEQ ID NO: 188054 - protein, 5 aa, Mycobacterium bovis
SPVGP

SEQ ID NO: 188055 - protein, 6 aa, Mycobacterium bovis
SPVGRF

SEQ ID NO: 188056 - protein, 8 aa, Mycobacterium bovis
SPVGRRSG

SEQ ID NO: 188057 - protein, 11 aa, Mycobacterium bovis
SPVRPEGNAEQ

SEQ ID NO: 188058 - protein, 5 aa, Mycobacterium bovis
SPVVE

SEQ ID NO: 188059 - protein, 13 aa, Mycobacterium bovis
SPWQRASNENSNG

SEQ ID NO: 188060 - protein, 5 aa, Mycobacterium bovis
SPYDA

SEQ ID NO: 188061 - protein, 8 aa, Mycobacterium bovis
SPYRTPQT

SEQ ID NO: 188062 - protein, 6 aa, Mycobacterium bovis
SPYTDD

SEQ ID NO: 188063 - protein, 6 aa, Mycobacterium bovis
SPYVGT

SEQ ID NO: 188064 - protein, 4 aa, Mycobacterium bovis
SQAA

SEQ ID NO: 188065 - protein, 6 aa, Mycobacterium bovis
SQAADR

SEQ ID NO: 188066 - protein, 9 aa, Mycobacterium bovis
SQAARPTGA

SEQ ID NO: 188067 - protein, 14 aa, Mycobacterium bovis
SQAGAAVGTDAQRI

SEQ ID NO: 188068 - protein, 8 aa, Mycobacterium bovis
SQAGFDPG

SEQ ID NO: 188069 - protein, 8 aa, Mycobacterium bovis
SQAGQPPE

SEQ ID NO: 188070 - protein, 4 aa, Mycobacterium bovis
SQAH

SEQ ID NO: 188071 - protein, 7 aa, Mycobacterium bovis
SQANVSG

SEQ ID NO: 188072 - protein, 8 aa, Mycobacterium bovis
SQAPGTTT

SEQ ID NO: 188073 - protein, 7 aa, Mycobacterium bovis
SQAPHAH

SEQ ID NO: 188074 - protein, 9 aa, Mycobacterium bovis
SQARAAQQG

SEQ ID NO: 188075 - protein, 10 aa, Mycobacterium bovis
SQAVDPNVTP

SEQ ID NO: 188076 - protein, 16 aa, Mycobacterium bovis
SQDAARSAPEAGDAAP

SEQ ID NO: 188077 - protein, 10 aa, Mycobacterium bovis
SQDAASVRRA

SEQ ID NO: 188078 - protein, 8 aa, Mycobacterium bovis
SQDAREFA

SEQ ID NO: 188079 - protein, 6 aa, Mycobacterium bovis
SQDEGV

SEQ ID NO: 188080 - protein, 14 aa, Mycobacterium bovis
SQDELTRRVTALTS

SEQ ID NO: 188081 - protein, 4 aa, Mycobacterium bovis
SQDH

SEQ ID NO: 188082 - protein, 4 aa, Mycobacterium bovis
SQDI

SEQ ID NO: 188083 - protein, 13 aa, Mycobacterium bovis
SQFDGYTSGAAKD

SEQ ID NO: 188084 - protein, 7 aa, Mycobacterium bovis
SQFEKPE

SEQ ID NO: 188085 - protein, 5 aa, Mycobacterium bovis
SQGAV

SEQ ID NO: 188086 - protein, 4 aa, Mycobacterium bovis
SQGH

SEQ ID NO: 188087 - protein, 4 aa, Mycobacterium bovis
SQGT

SEQ ID NO: 188088 - protein, 8 aa, Mycobacterium bovis
SQGTTAHS

SEQ ID NO: 188089 - protein, 6 aa, Mycobacterium bovis
SQHALS

SEQ ID NO: 188090 - protein, 11 aa, Mycobacterium bovis
SQHPRPGGAPP

SEQ ID NO: 188091 - protein, 9 aa, Mycobacterium bovis
SQHTEQAPP

SEQ ID NO: 188092 - protein, 12 aa, Mycobacterium bovis
SQKLTEEAADKL

SEQ ID NO: 188093 - protein, 14 aa, Mycobacterium bovis
SQLGGAGGLGDAVG

SEQ ID NO: 188094 - protein, 6 aa, Mycobacterium bovis
SQLHDT

SEQ ID NO: 188095 - protein, 5 aa, Mycobacterium bovis
SQLNS

SEQ ID NO: 188096 - protein, 6 aa, Mycobacterium bovis
SQLRGR

SEQ ID NO: 188097 - protein, 6 aa, Mycobacterium bovis
SQLSDR

SEQ ID NO: 188098 - protein, 8 aa, Mycobacterium bovis
SQNADKVE

SEQ ID NO: 188099 - protein, 8 aa, Mycobacterium bovis
SQNRAEEA

SEQ ID NO: 188100 - protein, 8 aa, Mycobacterium bovis
SQNRTSDL

SEQ ID NO: 188101 - protein, 7 aa, Mycobacterium bovis
SQPAFPG

SEQ ID NO: 188102 - protein, 5 aa, Mycobacterium bovis
SQPDL

SEQ ID NO: 188103 - protein, 9 aa, Mycobacterium bovis
SQPDNGTGR

SEQ ID NO: 188104 - protein, 19 aa, Mycobacterium bovis
SQPDPDTPALTGDRTARIA

SEQ ID NO: 188105 - protein, 8 aa, Mycobacterium bovis
SQPDTGEL

SEQ ID NO: 188106 - protein, 9 aa, Mycobacterium bovis
SQPDTGEQA

SEQ ID NO: 188107 - protein, 5 aa, Mycobacterium bovis
SQPGA

SEQ ID NO: 188108 - protein, 8 aa, Mycobacterium bovis
SQPGGPLK

SEQ ID NO: 188109 - protein, 6 aa, Mycobacterium bovis
SQPPTL

SEQ ID NO: 188110 - protein, 7 aa, Mycobacterium bovis
SQPPWRP

SEQ ID NO: 188111 - protein, 9 aa, Mycobacterium bovis
SQPQRRSRA

SEQ ID NO: 188112 - protein, 6 aa, Mycobacterium bovis
SQPSAG

SEQ ID NO: 188113 - protein, 5 aa, Mycobacterium bovis
SQPTL

SEQ ID NO: 188114 - protein, 6 aa, Mycobacterium bovis
SQPTMT

SEQ ID NO: 188115 - protein, 11 aa, Mycobacterium bovis
SQQDTSDDGLG

SEQ ID NO: 188116 - protein, 8 aa, Mycobacterium bovis
SQQDVSDT

SEQ ID NO: 188117 - protein, 6 aa, Mycobacterium bovis
SQQRGT

SEQ ID NO: 188118 - protein, 5 aa, Mycobacterium bovis
SQRAQ

SEQ ID NO: 188119 - protein, 5 aa, Mycobacterium bovis
SQRDD

SEQ ID NO: 188120 - protein, 9 aa, Mycobacterium bovis
SQRGGERDL

SEQ ID NO: 188121 - protein, 5 aa, Mycobacterium bovis
SQRGT

SEQ ID NO: 188122 - protein, 19 aa, Mycobacterium bovis
SQRLQPLKPTRGCSAPTDR

SEQ ID NO: 188123 - protein, 4 aa, Mycobacterium bovis
SQRR

SEQ ID NO: 188124 - protein, 7 aa, Mycobacterium bovis
SQRRAQR

SEQ ID NO: 188125 - protein, 10 aa, Mycobacterium bovis
SQRSRNRHVG

SEQ ID NO: 188126 - protein, 4 aa, Mycobacterium bovis
SQSA

SEQ ID NO: 188127 - protein, 6 aa, Mycobacterium bovis
SQSATI

SEQ ID NO: 188128 - protein, 9 aa, Mycobacterium bovis
SQSSPDPIA

SEQ ID NO: 188129 - protein, 12 aa, Mycobacterium bovis
SQSTEQITGFSE

SEQ ID NO: 188130 - protein, 9 aa, Mycobacterium bovis
SQSYPGASM

SEQ ID NO: 188131 - protein, 11 aa, Mycobacterium bovis
SQTDTLDPNRT

SEQ ID NO: 188132 - protein, 7 aa, Mycobacterium bovis
SQTEEEV

SEQ ID NO: 188133 - protein, 10 aa, Mycobacterium bovis
SQTESEQMKE

SEQ ID NO: 188134 - protein, 6 aa, Mycobacterium bovis
SQTSAK

SEQ ID NO: 188135 - protein, 7 aa, Mycobacterium bovis
SQTSRSA

SEQ ID NO: 188136 - protein, 6 aa, Mycobacterium bovis
SQVDLT

SEQ ID NO: 188137 - protein, 6 aa, Mycobacterium bovis
SQVPDD

SEQ ID NO: 188138 - protein, 7 aa, Mycobacterium bovis
SQVSAAS

SEQ ID NO: 188139 - protein, 17 aa, Mycobacterium bovis
SQYAPTAGPYFSHGNLV

SEQ ID NO: 188140 - protein, 6 aa, Mycobacterium bovis
SQYTRG

SEQ ID NO: 188141 - protein, 8 aa, Mycobacterium bovis
SRAAGERG

SEQ ID NO: 188142 - protein, 9 aa, Mycobacterium bovis
SRAAGPAGQ

SEQ ID NO: 188143 - protein, 7 aa, Mycobacterium bovis
SRADDSV

SEQ ID NO: 188144 - protein, 8 aa, Mycobacterium bovis
SRADERDQ

SEQ ID NO: 188145 - protein, 11 aa, Mycobacterium bovis
SRAELGRDEAR

SEQ ID NO: 188146 - protein, 15 aa, Mycobacterium bovis
SRAETGDTLSDKAEP

SEQ ID NO: 188147 - protein, 4 aa, Mycobacterium bovis
SRAF

SEQ ID NO: 188148 - protein, 16 aa, Mycobacterium bovis
SRAGDDAERSDAEERR

SEQ ID NO: 188149 - protein, 6 aa, Mycobacterium bovis
SRAGGR

SEQ ID NO: 188150 - protein, 10 aa, Mycobacterium bovis
SRAGKRAGKR

SEQ ID NO: 188151 - protein, 6 aa, Mycobacterium bovis
SRAGKV

SEQ ID NO: 188152 - protein, 5 aa, Mycobacterium bovis
SRAHP

SEQ ID NO: 188153 - protein, 4 aa, Mycobacterium bovis
SRAK

SEQ ID NO: 188154 - protein, 5 aa, Mycobacterium bovis
SRANA

SEQ ID NO: 188155 - protein, 7 aa, Mycobacterium bovis
SRAQAAQ

SEQ ID NO: 188156 - protein, 4 aa, Mycobacterium bovis
SRAR

SEQ ID NO: 188157 - protein, 9 aa, Mycobacterium bovis
SRARRPTST

SEQ ID NO: 188158 - protein, 20 aa, Mycobacterium bovis
SRARSRCTKGSRRYRERTTE

SEQ ID NO: 188159 - protein, 8 aa, Mycobacterium bovis
SRATADRR

SEQ ID NO: 188160 - protein, 16 aa, Mycobacterium bovis
SRCTKGSRRYRERTTE

SEQ ID NO: 188161 - protein, 16 aa, Mycobacterium bovis
SRCTKGSRRYRERTTQ

SEQ ID NO: 188162 - protein, 4 aa, Mycobacterium bovis
SRDD

SEQ ID NO: 188163 - protein, 9 aa, Mycobacterium bovis
SRDDEASLT

SEQ ID NO: 188164 - protein, 9 aa, Mycobacterium bovis
SRDEGATVA

SEQ ID NO: 188165 - protein, 10 aa, Mycobacterium bovis
SRDGHDGEDL

SEQ ID NO: 188166 - protein, 15 aa, Mycobacterium bovis
SRDGNTAYRAGRDIQ

SEQ ID NO: 188167 - protein, 9 aa, Mycobacterium bovis
SRDGPSRAY

SEQ ID NO: 188168 - protein, 8 aa, Mycobacterium bovis
SRDNTGDV

SEQ ID NO: 188169 - protein, 4 aa, Mycobacterium bovis
SRDP

SEQ ID NO: 188170 - protein, 9 aa, Mycobacterium bovis
SRDPERHPG

SEQ ID NO: 188171 - protein, 4 aa, Mycobacterium bovis
SRDR

SEQ ID NO: 188172 - protein, 8 aa, Mycobacterium bovis
SRDTGRIQ

SEQ ID NO: 188173 - protein, 6 aa, Mycobacterium bovis
SRDTTK

SEQ ID NO: 188174 - protein, 5 aa, Mycobacterium bovis
SREAR

SEQ ID NO: 188175 - protein, 7 aa, Mycobacterium bovis
SREEQDR

SEQ ID NO: 188176 - protein, 18 aa, Mycobacterium bovis
SREGVRAAADALSNGHPV

SEQ ID NO: 188177 - protein, 6 aa, Mycobacterium bovis
SREPDP

SEQ ID NO: 188178 - protein, 5 aa, Mycobacterium bovis
SREPI

SEQ ID NO: 188179 - protein, 6 aa, Mycobacterium bovis
SREPIG

SEQ ID NO: 188180 - protein, 6 aa, Mycobacterium bovis
SREPRQ

SEQ ID NO: 188181 - protein, 7 aa, Mycobacterium bovis
SREQTGA

SEQ ID NO: 188182 - protein, 6 aa, Mycobacterium bovis
SREQVP

SEQ ID NO: 188183 - protein, 7 aa, Mycobacterium bovis
SRESIGV

SEQ ID NO: 188184 - protein, 17 aa, Mycobacterium bovis
SRFSSSNLPKSSRRISG

SEQ ID NO: 188185 - protein, 4 aa, Mycobacterium bovis
SRGA

SEQ ID NO: 188186 - protein, 21 aa, Mycobacterium bovis
SRGAQKQADEIRRARETKSVR

SEQ ID NO: 188187 - protein, 9 aa, Mycobacterium bovis
SRGARGPYR

SEQ ID NO: 188188 - protein, 4 aa, Mycobacterium bovis
SRGD

SEQ ID NO: 188189 - protein, 7 aa, Mycobacterium bovis
SRGDQSQ

SEQ ID NO: 188190 - protein, 5 aa, Mycobacterium bovis
SRGEA

SEQ ID NO: 188191 - protein, 9 aa, Mycobacterium bovis
SRGEGHARS

SEQ ID NO: 188192 - protein, 5 aa, Mycobacterium bovis
SRGEH

SEQ ID NO: 188193 - protein, 9 aa, Mycobacterium bovis
SRGERFDTP

SEQ ID NO: 188194 - protein, 5 aa, Mycobacterium bovis
SRGFR

SEQ ID NO: 188195 - protein, 7 aa, Mycobacterium bovis
SRGFSTG

SEQ ID NO: 188196 - protein, 9 aa, Mycobacterium bovis
SRGGDGGVG

SEQ ID NO: 188197 - protein, 6 aa, Mycobacterium bovis
SRGGRP

SEQ ID NO: 188198 - protein, 13 aa, Mycobacterium bovis
SRGGRPDLAGDSL

SEQ ID NO: 188199 - protein, 15 aa, Mycobacterium bovis
SRGGSPKAEAASVPS

SEQ ID NO: 188200 - protein, 6 aa, Mycobacterium bovis
SRGHAT

SEQ ID NO: 188201 - protein, 4 aa, Mycobacterium bovis
SRGL

SEQ ID NO: 188202 - protein, 7 aa, Mycobacterium bovis
SRGNPTV

SEQ ID NO: 188203 - protein, 6 aa, Mycobacterium bovis
SRGPEY

SEQ ID NO: 188204 - protein, 11 aa, Mycobacterium bovis
SRGPIDPTASV

SEQ ID NO: 188205 - protein, 11 aa, Mycobacterium bovis
SRGPKATGALR

SEQ ID NO: 188206 - protein, 5 aa, Mycobacterium bovis
SRGPQ

SEQ ID NO: 188207 - protein, 4 aa, Mycobacterium bovis
SRGR

SEQ ID NO: 188208 - protein, 7 aa, Mycobacterium bovis
SRGRGGY

SEQ ID NO: 188209 - protein, 5 aa, Mycobacterium bovis
SRGSM

SEQ ID NO: 188210 - protein, 8 aa, Mycobacterium bovis
SRGSWRGR

SEQ ID NO: 188211 - protein, 9 aa, Mycobacterium bovis
SRGVGGRRR

SEQ ID NO: 188212 - protein, 7 aa, Mycobacterium bovis
SRGYPRA

SEQ ID NO: 188213 - protein, 9 aa, Mycobacterium bovis
SRGYRGQRS

SEQ ID NO: 188214 - protein, 11 aa, Mycobacterium bovis
SRHDLGNPGGY

SEQ ID NO: 188215 - protein, 28 aa, Mycobacterium bovis
SRHGIGRRTGLPGSPTRGPANSITSAGQ

SEQ ID NO: 188216 - protein, 10 aa, Mycobacterium bovis
SRHGQGGERI

SEQ ID NO: 188217 - protein, 4 aa, Mycobacterium bovis
SRIG

SEQ ID NO: 188218 - protein, 5 aa, Mycobacterium bovis
SRKKT

SEQ ID NO: 188219 - protein, 4 aa, Mycobacterium bovis
SRKL

SEQ ID NO: 188220 - protein, 8 aa, Mycobacterium bovis
SRKLPPSV

SEQ ID NO: 188221 - protein, 8 aa, Mycobacterium bovis
SRKQAAGT

SEQ ID NO: 188222 - protein, 14 aa, Mycobacterium bovis
SRKSQSAGSGPSAI

SEQ ID NO: 188223 - protein, 10 aa, Mycobacterium bovis
SRLDDAGRAT

SEQ ID NO: 188224 - protein, 5 aa, Mycobacterium bovis
SRLDP

SEQ ID NO: 188225 - protein, 5 aa, Mycobacterium bovis
SRLET

SEQ ID NO: 188226 - protein, 6 aa, Mycobacterium bovis
SRLPDQ

SEQ ID NO: 188227 - protein, 4 aa, Mycobacterium bovis
SRLT

SEQ ID NO: 188228 - protein, 6 aa, Mycobacterium bovis
SRLTDP

SEQ ID NO: 188229 - protein, 5 aa, Mycobacterium bovis
SRNAP

SEQ ID NO: 188230 - protein, 12 aa, Mycobacterium bovis
SRNGAGPAPDAP

SEQ ID NO: 188231 - protein, 5 aa, Mycobacterium bovis
SRNIG

SEQ ID NO: 188232 - protein, 12 aa, Mycobacterium bovis
SRNPITGANEPF

SEQ ID NO: 188233 - protein, 10 aa, Mycobacterium bovis
SRNPSQFTDE

SEQ ID NO: 188234 - protein, 9 aa, Mycobacterium bovis
SRNSGDKPE

SEQ ID NO: 188235 - protein, 8 aa, Mycobacterium bovis
SRNSSNSV

SEQ ID NO: 188236 - protein, 11 aa, Mycobacterium bovis
SRNSTTINPGT

SEQ ID NO: 188237 - protein, 78 aa, Mycobacterium bovis
SRPAKDQRSAKSSRARRTEASKAASKVGATAPAKKAAAKAPAKKAPASSGVKKTPAKKAPAKKAPAKASETSAAKGGS

SEQ ID NO: 188238 - protein, 10 aa, Mycobacterium bovis
SRPAKTARRP

SEQ ID NO: 188239 - protein, 9 aa, Mycobacterium bovis
SRPALPDLP

SEQ ID NO: 188240 - protein, 5 aa, Mycobacterium bovis
SRPAV

SEQ ID NO: 188241 - protein, 8 aa, Mycobacterium bovis
SRPAVSAE

SEQ ID NO: 188242 - protein, 7 aa, Mycobacterium bovis
SRPDFDH

SEQ ID NO: 188243 - protein, 18 aa, Mycobacterium bovis
SRPDTLPPRVPGTAGNTA

SEQ ID NO: 188244 - protein, 6 aa, Mycobacterium bovis
SRPEDR

SEQ ID NO: 188245 - protein, 13 aa, Mycobacterium bovis
SRPESDSVEVTYD

SEQ ID NO: 188246 - protein, 5 aa, Mycobacterium bovis
SRPGS

SEQ ID NO: 188247 - protein, 10 aa, Mycobacterium bovis
SRPGSVTEGT

SEQ ID NO: 188248 - protein, 6 aa, Mycobacterium bovis
SRPLNR

SEQ ID NO: 188249 - protein, 6 aa, Mycobacterium bovis
SRPNGE

SEQ ID NO: 188250 - protein, 9 aa, Mycobacterium bovis
SRPPRQVPG

SEQ ID NO: 188251 - protein, 5 aa, Mycobacterium bovis
SRPRA

SEQ ID NO: 188252 - protein, 10 aa, Mycobacterium bovis
SRPRDSRRPC

SEQ ID NO: 188253 - protein, 12 aa, Mycobacterium bovis
SRPRTTRGARPE

SEQ ID NO: 188254 - protein, 5 aa, Mycobacterium bovis
SRPVI

SEQ ID NO: 188255 - protein, 7 aa, Mycobacterium bovis
SRQDHGL

SEQ ID NO: 188256 - protein, 6 aa, Mycobacterium bovis
SRQGLA

SEQ ID NO: 188257 - protein, 7 aa, Mycobacterium bovis
SRQLPDN

SEQ ID NO: 188258 - protein, 21 aa, Mycobacterium bovis
SRQRSRSPGARPTGRDTPETA

SEQ ID NO: 188259 - protein, 6 aa, Mycobacterium bovis
SRRAER

SEQ ID NO: 188260 - protein, 6 aa, Mycobacterium bovis
SRRATM

SEQ ID NO: 188261 - protein, 6 aa, Mycobacterium bovis
SRRDAA

SEQ ID NO: 188262 - protein, 6 aa, Mycobacterium bovis
SRRDIP

SEQ ID NO: 188263 - protein, 10 aa, Mycobacterium bovis
SRRDPDGPYG

SEQ ID NO: 188264 - protein, 8 aa, Mycobacterium bovis
SRREPDRR

SEQ ID NO: 188265 - protein, 15 aa, Mycobacterium bovis
SRRGGRGWVVPAGGA

SEQ ID NO: 188266 - protein, 6 aa, Mycobacterium bovis
SRRGRT

SEQ ID NO: 188267 - protein, 4 aa, Mycobacterium bovis
SRRL

SEQ ID NO: 188268 - protein, 5 aa, Mycobacterium bovis
SRRNP

SEQ ID NO: 188269 - protein, 9 aa, Mycobacterium bovis
SRRPDRPGV

SEQ ID NO: 188270 - protein, 5 aa, Mycobacterium bovis
SRRRR

SEQ ID NO: 188271 - protein, 10 aa, Mycobacterium bovis
SRRRRGPETT

SEQ ID NO: 188272 - protein, 8 aa, Mycobacterium bovis
SRRSFSTT

SEQ ID NO: 188273 - protein, 13 aa, Mycobacterium bovis
SRRTRSSKDVSTA

SEQ ID NO: 188274 - protein, 9 aa, Mycobacterium bovis
SRSASDEVT

SEQ ID NO: 188275 - protein, 6 aa, Mycobacterium bovis
SRSDTY

SEQ ID NO: 188276 - protein, 14 aa, Mycobacterium bovis
SRSGADTFGSDGGE

SEQ ID NO: 188277 - protein, 6 aa, Mycobacterium bovis
SRSGIA

SEQ ID NO: 188278 - protein, 6 aa, Mycobacterium bovis
SRSGNT

SEQ ID NO: 188279 - protein, 8 aa, Mycobacterium bovis
SRSGPPQV

SEQ ID NO: 188280 - protein, 11 aa, Mycobacterium bovis
SRSGRDVTAEY

SEQ ID NO: 188281 - protein, 11 aa, Mycobacterium bovis
SRSIDQRSGVS

SEQ ID NO: 188282 - protein, 14 aa, Mycobacterium bovis
SRSPGGRQSRKPSR

SEQ ID NO: 188283 - protein, 10 aa, Mycobacterium bovis
SRSQPSQKAL

SEQ ID NO: 188284 - protein, 15 aa, Mycobacterium bovis
SRSSAGGTIGHSTTS

SEQ ID NO: 188285 - protein, 6 aa, Mycobacterium bovis
SRSTCS

SEQ ID NO: 188286 - protein, 7 aa, Mycobacterium bovis
SRTDDGL

SEQ ID NO: 188287 - protein, 8 aa, Mycobacterium bovis
SRTNGIAD

SEQ ID NO: 188288 - protein, 8 aa, Mycobacterium bovis
SRTNGPCR

SEQ ID NO: 188289 - protein, 5 aa, Mycobacterium bovis
SRTNY

SEQ ID NO: 188290 - protein, 4 aa, Mycobacterium bovis
SRTP

SEQ ID NO: 188291 - protein, 9 aa, Mycobacterium bovis
SRTPGNGQV

SEQ ID NO: 188292 - protein, 6 aa, Mycobacterium bovis
SRTPPD

SEQ ID NO: 188293 - protein, 6 aa, Mycobacterium bovis
SRTRGY

SEQ ID NO: 188294 - protein, 12 aa, Mycobacterium bovis
SRTRTGGSATAI

SEQ ID NO: 188295 - protein, 8 aa, Mycobacterium bovis
SRTSGASL

SEQ ID NO: 188296 - protein, 18 aa, Mycobacterium bovis
SRTTAYSGGARNHAVIPA

SEQ ID NO: 188297 - protein, 6 aa, Mycobacterium bovis
SRTTHT

SEQ ID NO: 188298 - protein, 6 aa, Mycobacterium bovis
SRVQGA

SEQ ID NO: 188299 - protein, 5 aa, Mycobacterium bovis
SRVRA

SEQ ID NO: 188300 - protein, 13 aa, Mycobacterium bovis
SRVRARQAAEARV

SEQ ID NO: 188301 - protein, 9 aa, Mycobacterium bovis
SRVTGSDLG

SEQ ID NO: 188302 - protein, 18 aa, Mycobacterium bovis
SRWADAEANRRPDQPQLW

SEQ ID NO: 188303 - protein, 7 aa, Mycobacterium bovis
SRWEPSR

SEQ ID NO: 188304 - protein, 13 aa, Mycobacterium bovis
SRYPNQLSGGQRQ

SEQ ID NO: 188305 - protein, 7 aa, Mycobacterium bovis
SRYRGDF

SEQ ID NO: 188306 - protein, 6 aa, Mycobacterium bovis
SRYRSN

SEQ ID NO: 188307 - protein, 9 aa, Mycobacterium bovis
SRYSGQPTF

SEQ ID NO: 188308 - protein, 9 aa, Mycobacterium bovis
SSAADDPTL

SEQ ID NO: 188309 - protein, 31 aa, Mycobacterium bovis
SSAAKGSESQTDTSELDKRSETFVRATRGIH

SEQ ID NO: 188310 - protein, 11 aa, Mycobacterium bovis
SSADALRQTAQ

SEQ ID NO: 188311 - protein, 11 aa, Mycobacterium bovis
SSADQKADLDR

SEQ ID NO: 188312 - protein, 11 aa, Mycobacterium bovis
SSADQKPDLDR

SEQ ID NO: 188313 - protein, 11 aa, Mycobacterium bovis
SSADQKSDLDR

SEQ ID NO: 188314 - protein, 8 aa, Mycobacterium bovis
SSADQKVD

SEQ ID NO: 188315 - protein, 10 aa, Mycobacterium bovis
SSADQRSDLD

SEQ ID NO: 188316 - protein, 10 aa, Mycobacterium bovis
SSADVERSES

SEQ ID NO: 188317 - protein, 13 aa, Mycobacterium bovis
SSADYSGTTPVGS

SEQ ID NO: 188318 - protein, 5 aa, Mycobacterium bovis
SSAEQ

SEQ ID NO: 188319 - protein, 16 aa, Mycobacterium bovis
SSAESGGSPGRADRRQ

SEQ ID NO: 188320 - protein, 6 aa, Mycobacterium bovis
SSAEYG

SEQ ID NO: 188321 - protein, 7 aa, Mycobacterium bovis
SSAFEQG

SEQ ID NO: 188322 - protein, 7 aa, Mycobacterium bovis
SSAGAPV

SEQ ID NO: 188323 - protein, 23 aa, Mycobacterium bovis
SSAHPKADLTDPEKQILSLQVTV

SEQ ID NO: 188324 - protein, 5 aa, Mycobacterium bovis
SSAID

SEQ ID NO: 188325 - protein, 9 aa, Mycobacterium bovis
SSAIGNSGF

SEQ ID NO: 188326 - protein, 7 aa, Mycobacterium bovis
SSANTRD

SEQ ID NO: 188327 - protein, 9 aa, Mycobacterium bovis
SSAQSHDEQ

SEQ ID NO: 188328 - protein, 12 aa, Mycobacterium bovis
SSARASSGSSGN

SEQ ID NO: 188329 - protein, 6 aa, Mycobacterium bovis
SSARNR

SEQ ID NO: 188330 - protein, 10 aa, Mycobacterium bovis
SSASDGREYS

SEQ ID NO: 188331 - protein, 11 aa, Mycobacterium bovis
SSASKSKVIAD

SEQ ID NO: 188332 - protein, 8 aa, Mycobacterium bovis
SSATGSRL

SEQ ID NO: 188333 - protein, 9 aa, Mycobacterium bovis
SSATTEAES

SEQ ID NO: 188334 - protein, 9 aa, Mycobacterium bovis
SSATTRSRP

SEQ ID NO: 188335 - protein, 4 aa, Mycobacterium bovis
SSAV

SEQ ID NO: 188336 - protein, 10 aa, Mycobacterium bovis
SSAVGREVGR

SEQ ID NO: 188337 - protein, 10 aa, Mycobacterium bovis
SSDASPEEIK

SEQ ID NO: 188338 - protein, 8 aa, Mycobacterium bovis
SSDGSPPY

SEQ ID NO: 188339 - protein, 7 aa, Mycobacterium bovis
SSDGVGT

SEQ ID NO: 188340 - protein, 4 aa, Mycobacterium bovis
SSDL

SEQ ID NO: 188341 - protein, 10 aa, Mycobacterium bovis
SSDNGRPGAL

SEQ ID NO: 188342 - protein, 17 aa, Mycobacterium bovis
SSDPAAGSGVEPSTPGL

SEQ ID NO: 188343 - protein, 7 aa, Mycobacterium bovis
SSDSRDI

SEQ ID NO: 188344 - protein, 4 aa, Mycobacterium bovis
SSDV

SEQ ID NO: 188345 - protein, 4 aa, Mycobacterium bovis
SSDY

SEQ ID NO: 188346 - protein, 5 aa, Mycobacterium bovis
SSEAI

SEQ ID NO: 188347 - protein, 6 aa, Mycobacterium bovis
SSEDAM

SEQ ID NO: 188348 - protein, 8 aa, Mycobacterium bovis
SSEEDEPV

SEQ ID NO: 188349 - protein, 18 aa, Mycobacterium bovis
SSEPVEDQTRSRLTAATP

SEQ ID NO: 188350 - protein, 5 aa, Mycobacterium bovis
SSERF

SEQ ID NO: 188351 - protein, 6 aa, Mycobacterium bovis
SSFAPT

SEQ ID NO: 188352 - protein, 7 aa, Mycobacterium bovis
SSFGSVT

SEQ ID NO: 188353 - protein, 9 aa, Mycobacterium bovis
SSFPGDPAD

SEQ ID NO: 188354 - protein, 4 aa, Mycobacterium bovis
SSFR

SEQ ID NO: 188355 - protein, 16 aa, Mycobacterium bovis
SSFRGSDKRGGANGGR

SEQ ID NO: 188356 - protein, 6 aa, Mycobacterium bovis
SSFSGT

SEQ ID NO: 188357 - protein, 7 aa, Mycobacterium bovis
SSFTGYD

SEQ ID NO: 188358 - protein, 8 aa, Mycobacterium bovis
SSGAALTD

SEQ ID NO: 188359 - protein, 8 aa, Mycobacterium bovis
SSGAGTGW

SEQ ID NO: 188360 - protein, 6 aa, Mycobacterium bovis
SSGDLS

SEQ ID NO: 188361 - protein, 6 aa, Mycobacterium bovis
SSGDPG

SEQ ID NO: 188362 - protein, 6 aa, Mycobacterium bovis
SSGGEL

SEQ ID NO: 188363 - protein, 6 aa, Mycobacterium bovis
SSGGTC

SEQ ID NO: 188364 - protein, 6 aa, Mycobacterium bovis
SSGGYA

SEQ ID NO: 188365 - protein, 6 aa, Mycobacterium bovis
SSGHHH

SEQ ID NO: 188366 - protein, 15 aa, Mycobacterium bovis
SSGKGGQGVNTTDSA

SEQ ID NO: 188367 - protein, 14 aa, Mycobacterium bovis
SSGKPGRDPEAGRY

SEQ ID NO: 188368 - protein, 13 aa, Mycobacterium bovis
SSGKRDPGELSTR

SEQ ID NO: 188369 - protein, 5 aa, Mycobacterium bovis
SSGLG

SEQ ID NO: 188370 - protein, 23 aa, Mycobacterium bovis
SSGLGSTAPAISAGASQAGSVGG

SEQ ID NO: 188371 - protein, 20 aa, Mycobacterium bovis
SSGPAPDPMHEPPPDNVDEP

SEQ ID NO: 188372 - protein, 9 aa, Mycobacterium bovis
SSGPGPGPL

SEQ ID NO: 188373 - protein, 9 aa, Mycobacterium bovis
SSGPGPGPV

SEQ ID NO: 188374 - protein, 20 aa, Mycobacterium bovis
SSGQAPSTVAASGPLPTADR

SEQ ID NO: 188375 - protein, 7 aa, Mycobacterium bovis
SSGRGAL

SEQ ID NO: 188376 - protein, 4 aa, Mycobacterium bovis
SSGT

SEQ ID NO: 188377 - protein, 12 aa, Mycobacterium bovis
SSGTTGRPKGIK

SEQ ID NO: 188378 - protein, 11 aa, Mycobacterium bovis
SSGYNAEAAAP

SEQ ID NO: 188379 - protein, 6 aa, Mycobacterium bovis
SSHGTH

SEQ ID NO: 188380 - protein, 14 aa, Mycobacterium bovis
SSHPAANARTSTVA

SEQ ID NO: 188381 - protein, 5 aa, Mycobacterium bovis
SSIAP

SEQ ID NO: 188382 - protein, 8 aa, Mycobacterium bovis
SSIEDPAD

SEQ ID NO: 188383 - protein, 13 aa, Mycobacterium bovis
SSIENGDIGSAQV

SEQ ID NO: 188384 - protein, 17 aa, Mycobacterium bovis
SSIGAPDTAAAARPTTS

SEQ ID NO: 188385 - protein, 7 aa, Mycobacterium bovis
SSIGSGV

SEQ ID NO: 188386 - protein, 5 aa, Mycobacterium bovis
SSITQ

SEQ ID NO: 188387 - protein, 6 aa, Mycobacterium bovis
SSITSE

SEQ ID NO: 188388 - protein, 4 aa, Mycobacterium bovis
SSKE

SEQ ID NO: 188389 - protein, 7 aa, Mycobacterium bovis
SSKEPGR

SEQ ID NO: 188390 - protein, 5 aa, Mycobacterium bovis
SSKEW

SEQ ID NO: 188391 - protein, 9 aa, Mycobacterium bovis
SSLADTLRD

SEQ ID NO: 188392 - protein, 5 aa, Mycobacterium bovis
SSLER

SEQ ID NO: 188393 - protein, 8 aa, Mycobacterium bovis
SSLGGTTT

SEQ ID NO: 188394 - protein, 4 aa, Mycobacterium bovis
SSLP

SEQ ID NO: 188395 - protein, 5 aa, Mycobacterium bovis
SSLSD

SEQ ID NO: 188396 - protein, 9 aa, Mycobacterium bovis
SSLTNNRSR

SEQ ID NO: 188397 - protein, 11 aa, Mycobacterium bovis
SSMGNSGFQNY

SEQ ID NO: 188398 - protein, 5 aa, Mycobacterium bovis
SSNAA

SEQ ID NO: 188399 - protein, 5 aa, Mycobacterium bovis
SSNAG

SEQ ID NO: 188400 - protein, 9 aa, Mycobacterium bovis
SSNGQPEIT

SEQ ID NO: 188401 - protein, 9 aa, Mycobacterium bovis
SSNGSGTSK

SEQ ID NO: 188402 - protein, 6 aa, Mycobacterium bovis
SSNTEP

SEQ ID NO: 188403 - protein, 10 aa, Mycobacterium bovis
SSNTVSTANE

SEQ ID NO: 188404 - protein, 7 aa, Mycobacterium bovis
SSPAGAA

SEQ ID NO: 188405 - protein, 6 aa, Mycobacterium bovis
SSPDAM

SEQ ID NO: 188406 - protein, 10 aa, Mycobacterium bovis
SSPDATERAA

SEQ ID NO: 188407 - protein, 26 aa, Mycobacterium bovis
SSPDFGADQGRLGCPPANDAEGIGVS

SEQ ID NO: 188408 - protein, 9 aa, Mycobacterium bovis
SSPGAFGES

SEQ ID NO: 188409 - protein, 6 aa, Mycobacterium bovis
SSPGLA

SEQ ID NO: 188410 - protein, 7 aa, Mycobacterium bovis
SSPGPYE

SEQ ID NO: 188411 - protein, 10 aa, Mycobacterium bovis
SSPGSGKTTV

SEQ ID NO: 188412 - protein, 5 aa, Mycobacterium bovis
SSPGY

SEQ ID NO: 188413 - protein, 14 aa, Mycobacterium bovis
SSPKPPPGTPGGAA

SEQ ID NO: 188414 - protein, 4 aa, Mycobacterium bovis
SSPL

SEQ ID NO: 188415 - protein, 9 aa, Mycobacterium bovis
SSPNTPGLR

SEQ ID NO: 188416 - protein, 9 aa, Mycobacterium bovis
SSPSTPHRE

SEQ ID NO: 188417 - protein, 13 aa, Mycobacterium bovis
SSPVAADSRGLGS

SEQ ID NO: 188418 - protein, 15 aa, Mycobacterium bovis
SSPWWGGEDTGYASN

SEQ ID NO: 188419 - protein, 4 aa, Mycobacterium bovis
SSQL

SEQ ID NO: 188420 - protein, 5 aa, Mycobacterium bovis
SSQLD

SEQ ID NO: 188421 - protein, 6 aa, Mycobacterium bovis
SSQLED

SEQ ID NO: 188422 - protein, 19 aa, Mycobacterium bovis
SSQSGPKDAGPSPADASAA

SEQ ID NO: 188423 - protein, 4 aa, Mycobacterium bovis
SSRA

SEQ ID NO: 188424 - protein, 6 aa, Mycobacterium bovis
SSRDRV

SEQ ID NO: 188425 - protein, 6 aa, Mycobacterium bovis
SSREPY

SEQ ID NO: 188426 - protein, 12 aa, Mycobacterium bovis
SSRFRKPLNPQK

SEQ ID NO: 188427 - protein, 6 aa, Mycobacterium bovis
SSRRGE

SEQ ID NO: 188428 - protein, 9 aa, Mycobacterium bovis
SSRRTAGDT

SEQ ID NO: 188429 - protein, 11 aa, Mycobacterium bovis
SSRSGPAPQSL

SEQ ID NO: 188430 - protein, 17 aa, Mycobacterium bovis
SSRTGTLATIGPDGQPH

SEQ ID NO: 188431 - protein, 5 aa, Mycobacterium bovis
SSRTV

SEQ ID NO: 188432 - protein, 4 aa, Mycobacterium bovis
SSSA

SEQ ID NO: 188433 - protein, 9 aa, Mycobacterium bovis
SSSATASRL

SEQ ID NO: 188434 - protein, 5 aa, Mycobacterium bovis
SSSDQ

SEQ ID NO: 188435 - protein, 13 aa, Mycobacterium bovis
SSSGAIGNSGLAN

SEQ ID NO: 188436 - protein, 9 aa, Mycobacterium bovis
SSSGPVPSG

SEQ ID NO: 188437 - protein, 6 aa, Mycobacterium bovis
SSSGRL

SEQ ID NO: 188438 - protein, 4 aa, Mycobacterium bovis
SSSL

SEQ ID NO: 188439 - protein, 21 aa, Mycobacterium bovis
SSSLSGDRRTYQQEPGNAAEA

SEQ ID NO: 188440 - protein, 6 aa, Mycobacterium bovis
SSSMGA

SEQ ID NO: 188441 - protein, 6 aa, Mycobacterium bovis
SSSPRV

SEQ ID NO: 188442 - protein, 16 aa, Mycobacterium bovis
SSSRALDPTRFERPST

SEQ ID NO: 188443 - protein, 9 aa, Mycobacterium bovis
SSTEQALPT

SEQ ID NO: 188444 - protein, 7 aa, Mycobacterium bovis
SSTPERL

SEQ ID NO: 188445 - protein, 7 aa, Mycobacterium bovis
SSTQDQI

SEQ ID NO: 188446 - protein, 6 aa, Mycobacterium bovis
SSTRGL

SEQ ID NO: 188447 - protein, 10 aa, Mycobacterium bovis
SSTSTLQGAG

SEQ ID NO: 188448 - protein, 8 aa, Mycobacterium bovis
SSTTARSN

SEQ ID NO: 188449 - protein, 11 aa, Mycobacterium bovis
SSTVAVSGERQ

SEQ ID NO: 188450 - protein, 5 aa, Mycobacterium bovis
SSVAE

SEQ ID NO: 188451 - protein, 13 aa, Mycobacterium bovis
SSVAGYSDSPSVE

SEQ ID NO: 188452 - protein, 9 aa, Mycobacterium bovis
SSVDPDQAS

SEQ ID NO: 188453 - protein, 11 aa, Mycobacterium bovis
SSVTGGQRRFG

SEQ ID NO: 188454 - protein, 6 aa, Mycobacterium bovis
SSWGDY

SEQ ID NO: 188455 - protein, 14 aa, Mycobacterium bovis
SSYGTGTGKDAITS

SEQ ID NO: 188456 - protein, 13 aa, Mycobacterium bovis
SSYTPAPATAGRS

SEQ ID NO: 188457 - protein, 6 aa, Mycobacterium bovis
STAAAV

SEQ ID NO: 188458 - protein, 12 aa, Mycobacterium bovis
STAAGGGGRQPR

SEQ ID NO: 188459 - protein, 18 aa, Mycobacterium bovis
STAAPATTAGATALEGSG

SEQ ID NO: 188460 - protein, 8 aa, Mycobacterium bovis
STAASSVG

SEQ ID NO: 188461 - protein, 6 aa, Mycobacterium bovis
STADEG

SEQ ID NO: 188462 - protein, 5 aa, Mycobacterium bovis
STADS

SEQ ID NO: 188463 - protein, 4 aa, Mycobacterium bovis
STAE

SEQ ID NO: 188464 - protein, 14 aa, Mycobacterium bovis
STAEKAKLSKDAGA

SEQ ID NO: 188465 - protein, 6 aa, Mycobacterium bovis
STAESH

SEQ ID NO: 188466 - protein, 20 aa, Mycobacterium bovis
STAGTGYTYTTRKNRRNDPD

SEQ ID NO: 188467 - protein, 17 aa, Mycobacterium bovis
STAKPGAAGRHASTLER

SEQ ID NO: 188468 - protein, 10 aa, Mycobacterium bovis
STALTGTAGL

SEQ ID NO: 188469 - protein, 8 aa, Mycobacterium bovis
STAMTGAA

SEQ ID NO: 188470 - protein, 4 aa, Mycobacterium bovis
STAN

SEQ ID NO: 188471 - protein, 7 aa, Mycobacterium bovis
STANPLE

SEQ ID NO: 188472 - protein, 4 aa, Mycobacterium bovis
STAQ

SEQ ID NO: 188473 - protein, 4 aa, Mycobacterium bovis
STAR

SEQ ID NO: 188474 - protein, 11 aa, Mycobacterium bovis
STARDTFNRRR

SEQ ID NO: 188475 - protein, 8 aa, Mycobacterium bovis
STATSRYA

SEQ ID NO: 188476 - protein, 15 aa, Mycobacterium bovis
STDARPEELKSRGVR

SEQ ID NO: 188477 - protein, 8 aa, Mycobacterium bovis
STDASGRY

SEQ ID NO: 188478 - protein, 12 aa, Mycobacterium bovis
STDCRQRAEQSR

SEQ ID NO: 188479 - protein, 4 aa, Mycobacterium bovis
STDG

SEQ ID NO: 188480 - protein, 26 aa, Mycobacterium bovis
STDGKPSDAAATDPPDLNADEPAGSL

SEQ ID NO: 188481 - protein, 4 aa, Mycobacterium bovis
STDL

SEQ ID NO: 188482 - protein, 13 aa, Mycobacterium bovis
STDLTARAREGKL

SEQ ID NO: 188483 - protein, 8 aa, Mycobacterium bovis
STDPVPGD

SEQ ID NO: 188484 - protein, 8 aa, Mycobacterium bovis
STDPVRKQ

SEQ ID NO: 188485 - protein, 21 aa, Mycobacterium bovis
STDRENAAALGPDDEDVPDTG

SEQ ID NO: 188486 - protein, 6 aa, Mycobacterium bovis
STDSND

SEQ ID NO: 188487 - protein, 12 aa, Mycobacterium bovis
STDTDETGRHTA

SEQ ID NO: 188488 - protein, 7 aa, Mycobacterium bovis
STDTTID

SEQ ID NO: 188489 - protein, 4 aa, Mycobacterium bovis
STEA

SEQ ID NO: 188490 - protein, 11 aa, Mycobacterium bovis
STEEGQGVPKT

SEQ ID NO: 188491 - protein, 8 aa, Mycobacterium bovis
STEGDRSM

SEQ ID NO: 188492 - protein, 4 aa, Mycobacterium bovis
STEI

SEQ ID NO: 188493 - protein, 8 aa, Mycobacterium bovis
STEPVAGA

SEQ ID NO: 188494 - protein, 4 aa, Mycobacterium bovis
STER

SEQ ID NO: 188495 - protein, 7 aa, Mycobacterium bovis
STFGGNP

SEQ ID NO: 188496 - protein, 6 aa, Mycobacterium bovis
STGADV

SEQ ID NO: 188497 - protein, 11 aa, Mycobacterium bovis
STGCHPAGGAT

SEQ ID NO: 188498 - protein, 13 aa, Mycobacterium bovis
STGDSGKGADVDK

SEQ ID NO: 188499 - protein, 8 aa, Mycobacterium bovis
STGEPDRS

SEQ ID NO: 188500 - protein, 8 aa, Mycobacterium bovis
STGEPIAP

SEQ ID NO: 188501 - protein, 11 aa, Mycobacterium bovis
STGGEFTPGSE

SEQ ID NO: 188502 - protein, 7 aa, Mycobacterium bovis
STGGGAS

SEQ ID NO: 188503 - protein, 7 aa, Mycobacterium bovis
STGGTWQ

SEQ ID NO: 188504 - protein, 13 aa, Mycobacterium bovis
STGGWDDDGNPVH

SEQ ID NO: 188505 - protein, 30 aa, Mycobacterium bovis
STGIANTGDYNTGSFNAGDTNTGGFNPGGI

SEQ ID NO: 188506 - protein, 4 aa, Mycobacterium bovis
STGL

SEQ ID NO: 188507 - protein, 8 aa, Mycobacterium bovis
STGLAGRI

SEQ ID NO: 188508 - protein, 6 aa, Mycobacterium bovis
STGLRR

SEQ ID NO: 188509 - protein, 15 aa, Mycobacterium bovis
STGNTSASAAAYAAR

SEQ ID NO: 188510 - protein, 7 aa, Mycobacterium bovis
STGPAEI

SEQ ID NO: 188511 - protein, 9 aa, Mycobacterium bovis
STGPDHDKE

SEQ ID NO: 188512 - protein, 4 aa, Mycobacterium bovis
STGQ

SEQ ID NO: 188513 - protein, 5 aa, Mycobacterium bovis
STGRS

SEQ ID NO: 188514 - protein, 13 aa, Mycobacterium bovis
STGSTAKTIADTG

SEQ ID NO: 188515 - protein, 8 aa, Mycobacterium bovis
STGSVPYS

SEQ ID NO: 188516 - protein, 6 aa, Mycobacterium bovis
STGTPH

SEQ ID NO: 188517 - protein, 6 aa, Mycobacterium bovis
STGTQE

SEQ ID NO: 188518 - protein, 5 aa, Mycobacterium bovis
STGVD

SEQ ID NO: 188519 - protein, 5 aa, Mycobacterium bovis
STGVG

SEQ ID NO: 188520 - protein, 4 aa, Mycobacterium bovis
STGY

SEQ ID NO: 188521 - protein, 6 aa, Mycobacterium bovis
STHEAN

SEQ ID NO: 188522 - protein, 6 aa, Mycobacterium bovis
STHPAS

SEQ ID NO: 188523 - protein, 7 aa, Mycobacterium bovis
STHVEPG

SEQ ID NO: 188524 - protein, 8 aa, Mycobacterium bovis
STIGTGTK

SEQ ID NO: 188525 - protein, 10 aa, Mycobacterium bovis
STINPDQPID

SEQ ID NO: 188526 - protein, 6 aa, Mycobacterium bovis
STKAGL

SEQ ID NO: 188527 - protein, 10 aa, Mycobacterium bovis
STKASDVASD

SEQ ID NO: 188528 - protein, 4 aa, Mycobacterium bovis
STKV

SEQ ID NO: 188529 - protein, 7 aa, Mycobacterium bovis
STLATQR

SEQ ID NO: 188530 - protein, 10 aa, Mycobacterium bovis
STLQDDGDSV

SEQ ID NO: 188531 - protein, 4 aa, Mycobacterium bovis
STLR

SEQ ID NO: 188532 - protein, 16 aa, Mycobacterium bovis
STLSAANAAALAPTTG

SEQ ID NO: 188533 - protein, 10 aa, Mycobacterium bovis
STLSGGQRRR

SEQ ID NO: 188534 - protein, 7 aa, Mycobacterium bovis
STMPGGY

SEQ ID NO: 188535 - protein, 5 aa, Mycobacterium bovis
STNLP

SEQ ID NO: 188536 - protein, 14 aa, Mycobacterium bovis
STNRKLDKAASKGV

SEQ ID NO: 188537 - protein, 4 aa, Mycobacterium bovis
STNT

SEQ ID NO: 188538 - protein, 5 aa, Mycobacterium bovis
STPAY

SEQ ID NO: 188539 - protein, 6 aa, Mycobacterium bovis
STPEQT

SEQ ID NO: 188540 - protein, 10 aa, Mycobacterium bovis
STPESLTATR

SEQ ID NO: 188541 - protein, 4 aa, Mycobacterium bovis
STPG

SEQ ID NO: 188542 - protein, 5 aa, Mycobacterium bovis
STPGL

SEQ ID NO: 188543 - protein, 10 aa, Mycobacterium bovis
STPKTTGVNQ

SEQ ID NO: 188544 - protein, 9 aa, Mycobacterium bovis
STPMPPGED

SEQ ID NO: 188545 - protein, 5 aa, Mycobacterium bovis
STPPI

SEQ ID NO: 188546 - protein, 9 aa, Mycobacterium bovis
STPPTIPHS

SEQ ID NO: 188547 - protein, 7 aa, Mycobacterium bovis
STPRAAR

SEQ ID NO: 188548 - protein, 5 aa, Mycobacterium bovis
STPRR

SEQ ID NO: 188549 - protein, 9 aa, Mycobacterium bovis
STPTGSTAY

SEQ ID NO: 188550 - protein, 7 aa, Mycobacterium bovis
STPTRSA

SEQ ID NO: 188551 - protein, 6 aa, Mycobacterium bovis
STPVAG

SEQ ID NO: 188552 - protein, 7 aa, Mycobacterium bovis
STPVKTD

SEQ ID NO: 188553 - protein, 8 aa, Mycobacterium bovis
STPWPGGE

SEQ ID NO: 188554 - protein, 6 aa, Mycobacterium bovis
STQAGD

SEQ ID NO: 188555 - protein, 6 aa, Mycobacterium bovis
STQDPS

SEQ ID NO: 188556 - protein, 10 aa, Mycobacterium bovis
STQHAAALGD

SEQ ID NO: 188557 - protein, 20 aa, Mycobacterium bovis
STQQRSQDGKYELTPKGDNT

SEQ ID NO: 188558 - protein, 5 aa, Mycobacterium bovis
STRAA

SEQ ID NO: 188559 - protein, 6 aa, Mycobacterium bovis
STRESF

SEQ ID NO: 188560 - protein, 6 aa, Mycobacterium bovis
STRGDL

SEQ ID NO: 188561 - protein, 5 aa, Mycobacterium bovis
STRMP

SEQ ID NO: 188562 - protein, 4 aa, Mycobacterium bovis
STRP

SEQ ID NO: 188563 - protein, 10 aa, Mycobacterium bovis
STRPDHREQA

SEQ ID NO: 188564 - protein, 13 aa, Mycobacterium bovis
STRQHSDEGPYTI

SEQ ID NO: 188565 - protein, 4 aa, Mycobacterium bovis
STRR

SEQ ID NO: 188566 - protein, 18 aa, Mycobacterium bovis
STRSEETKADVGNQVSSM

SEQ ID NO: 188567 - protein, 14 aa, Mycobacterium bovis
STRSNSALSKTDNR

SEQ ID NO: 188568 - protein, 5 aa, Mycobacterium bovis
STRSV

SEQ ID NO: 188569 - protein, 5 aa, Mycobacterium bovis
STRTE

SEQ ID NO: 188570 - protein, 6 aa, Mycobacterium bovis
STRTGQ

SEQ ID NO: 188571 - protein, 5 aa, Mycobacterium bovis
STRTR

SEQ ID NO: 188572 - protein, 8 aa, Mycobacterium bovis
STRVPAGA

SEQ ID NO: 188573 - protein, 9 aa, Mycobacterium bovis
STSAPSSGF

SEQ ID NO: 188574 - protein, 4 aa, Mycobacterium bovis
STSG

SEQ ID NO: 188575 - protein, 15 aa, Mycobacterium bovis
STSITDGQPLATPQV

SEQ ID NO: 188576 - protein, 8 aa, Mycobacterium bovis
STSRRPAD

SEQ ID NO: 188577 - protein, 13 aa, Mycobacterium bovis
STSSARSANERES

SEQ ID NO: 188578 - protein, 6 aa, Mycobacterium bovis
STSSDG

SEQ ID NO: 188579 - protein, 7 aa, Mycobacterium bovis
STSTKDL

SEQ ID NO: 188580 - protein, 8 aa, Mycobacterium bovis
STSTTELQ

SEQ ID NO: 188581 - protein, 9 aa, Mycobacterium bovis
STTAGVAAS

SEQ ID NO: 188582 - protein, 6 aa, Mycobacterium bovis
STTARM

SEQ ID NO: 188583 - protein, 10 aa, Mycobacterium bovis
STTGDTTWEN

SEQ ID NO: 188584 - protein, 4 aa, Mycobacterium bovis
STTH

SEQ ID NO: 188585 - protein, 19 aa, Mycobacterium bovis
STTHAQLSPAEQLATGVSP

SEQ ID NO: 188586 - protein, 12 aa, Mycobacterium bovis
STTHKTLGGPRG

SEQ ID NO: 188587 - protein, 5 aa, Mycobacterium bovis
STTHL

SEQ ID NO: 188588 - protein, 4 aa, Mycobacterium bovis
STTI

SEQ ID NO: 188589 - protein, 20 aa, Mycobacterium bovis
STTLAENGVTPSAGRREVPA

SEQ ID NO: 188590 - protein, 14 aa, Mycobacterium bovis
STTSLPETPRGERN

SEQ ID NO: 188591 - protein, 9 aa, Mycobacterium bovis
STTTPSSGF

SEQ ID NO: 188592 - protein, 11 aa, Mycobacterium bovis
STTTTSGERPK

SEQ ID NO: 188593 - protein, 4 aa, Mycobacterium bovis
STTV

SEQ ID NO: 188594 - protein, 5 aa, Mycobacterium bovis
STTVE

SEQ ID NO: 188595 - protein, 4 aa, Mycobacterium bovis
STVD

SEQ ID NO: 188596 - protein, 6 aa, Mycobacterium bovis
STVEQA

SEQ ID NO: 188597 - protein, 5 aa, Mycobacterium bovis
STWDR

SEQ ID NO: 188598 - protein, 7 aa, Mycobacterium bovis
SVADAER

SEQ ID NO: 188599 - protein, 9 aa, Mycobacterium bovis
SVADDAGLA

SEQ ID NO: 188600 - protein, 15 aa, Mycobacterium bovis
SVADDEPGTPAAASL

SEQ ID NO: 188601 - protein, 8 aa, Mycobacterium bovis
SVADDSGL

SEQ ID NO: 188602 - protein, 9 aa, Mycobacterium bovis
SVADSSQSA

SEQ ID NO: 188603 - protein, 12 aa, Mycobacterium bovis
SVAHADAPGRVR

SEQ ID NO: 188604 - protein, 5 aa, Mycobacterium bovis
SVAKT

SEQ ID NO: 188605 - protein, 7 aa, Mycobacterium bovis
SVAPTGT

SEQ ID NO: 188606 - protein, 9 aa, Mycobacterium bovis
SVATEDGAA

SEQ ID NO: 188607 - protein, 8 aa, Mycobacterium bovis
SVDDGKST

SEQ ID NO: 188608 - protein, 8 aa, Mycobacterium bovis
SVDENHTH

SEQ ID NO: 188609 - protein, 6 aa, Mycobacterium bovis
SVDGGQ

SEQ ID NO: 188610 - protein, 8 aa, Mycobacterium bovis
SVDPESKS

SEQ ID NO: 188611 - protein, 8 aa, Mycobacterium bovis
SVDPPRSF

SEQ ID NO: 188612 - protein, 6 aa, Mycobacterium bovis
SVDPRR

SEQ ID NO: 188613 - protein, 6 aa, Mycobacterium bovis
SVDPSR

SEQ ID NO: 188614 - protein, 5 aa, Mycobacterium bovis
SVDSS

SEQ ID NO: 188615 - protein, 4 aa, Mycobacterium bovis
SVEA

SEQ ID NO: 188616 - protein, 11 aa, Mycobacterium bovis
SVEGEPKPLPN

SEQ ID NO: 188617 - protein, 4 aa, Mycobacterium bovis
SVEP

SEQ ID NO: 188618 - protein, 5 aa, Mycobacterium bovis
SVEPA

SEQ ID NO: 188619 - protein, 6 aa, Mycobacterium bovis
SVEPAQ

SEQ ID NO: 188620 - protein, 23 aa, Mycobacterium bovis
SVEPMAAKSPAAAATASGTVTTN

SEQ ID NO: 188621 - protein, 6 aa, Mycobacterium bovis
SVEPPI

SEQ ID NO: 188622 - protein, 6 aa, Mycobacterium bovis
SVERSE

SEQ ID NO: 188623 - protein, 8 aa, Mycobacterium bovis
SVESDTDL

SEQ ID NO: 188624 - protein, 13 aa, Mycobacterium bovis
SVETNGKGCSGGV

SEQ ID NO: 188625 - protein, 11 aa, Mycobacterium bovis
SVGADSGPRYG

SEQ ID NO: 188626 - protein, 5 aa, Mycobacterium bovis
SVGAT

SEQ ID NO: 188627 - protein, 6 aa, Mycobacterium bovis
SVGGQG

SEQ ID NO: 188628 - protein, 4 aa, Mycobacterium bovis
SVGN

SEQ ID NO: 188629 - protein, 6 aa, Mycobacterium bovis
SVGPYG

SEQ ID NO: 188630 - protein, 5 aa, Mycobacterium bovis
SVGQQ

SEQ ID NO: 188631 - protein, 7 aa, Mycobacterium bovis
SVGRGRH

SEQ ID NO: 188632 - protein, 6 aa, Mycobacterium bovis
SVHNSQ

SEQ ID NO: 188633 - protein, 7 aa, Mycobacterium bovis
SVHPNGA

SEQ ID NO: 188634 - protein, 15 aa, Mycobacterium bovis
SVKARSKANSNVPTP

SEQ ID NO: 188635 - protein, 9 aa, Mycobacterium bovis
SVKGPKGTL

SEQ ID NO: 188636 - protein, 4 aa, Mycobacterium bovis
SVND

SEQ ID NO: 188637 - protein, 6 aa, Mycobacterium bovis
SVNGNA

SEQ ID NO: 188638 - protein, 5 aa, Mycobacterium bovis
SVNPA

SEQ ID NO: 188639 - protein, 8 aa, Mycobacterium bovis
SVPEPREL

SEQ ID NO: 188640 - protein, 5 aa, Mycobacterium bovis
SVPGA

SEQ ID NO: 188641 - protein, 7 aa, Mycobacterium bovis
SVPGETM

SEQ ID NO: 188642 - protein, 12 aa, Mycobacterium bovis
SVPGPVSDYTGQ

SEQ ID NO: 188643 - protein, 6 aa, Mycobacterium bovis
SVPLPD

SEQ ID NO: 188644 - protein, 5 aa, Mycobacterium bovis
SVPPQ

SEQ ID NO: 188645 - protein, 5 aa, Mycobacterium bovis
SVQEI

SEQ ID NO: 188646 - protein, 6 aa, Mycobacterium bovis
SVQNYP

SEQ ID NO: 188647 - protein, 8 aa, Mycobacterium bovis
SVQTGYEG

SEQ ID NO: 188648 - protein, 7 aa, Mycobacterium bovis
SVSAPEA

SEQ ID NO: 188649 - protein, 10 aa, Mycobacterium bovis
SVSDDDDTTR

SEQ ID NO: 188650 - protein, 9 aa, Mycobacterium bovis
SVSDNKKTV

SEQ ID NO: 188651 - protein, 5 aa, Mycobacterium bovis
SVSGA

SEQ ID NO: 188652 - protein, 8 aa, Mycobacterium bovis
SVSGGHVG

SEQ ID NO: 188653 - protein, 7 aa, Mycobacterium bovis
SVTDEYR

SEQ ID NO: 188654 - protein, 13 aa, Mycobacterium bovis
SVTDTKTTQPAAV

SEQ ID NO: 188655 - protein, 8 aa, Mycobacterium bovis
SVTEGHPD

SEQ ID NO: 188656 - protein, 23 aa, Mycobacterium bovis
SVTGARSKGAVIGGSSRSTSDAI

SEQ ID NO: 188657 - protein, 6 aa, Mycobacterium bovis
SVTGPV

SEQ ID NO: 188658 - protein, 11 aa, Mycobacterium bovis
SVTIDSGQSSS

SEQ ID NO: 188659 - protein, 6 aa, Mycobacterium bovis
SVTPQA

SEQ ID NO: 188660 - protein, 4 aa, Mycobacterium bovis
SVTR

SEQ ID NO: 188661 - protein, 7 aa, Mycobacterium bovis
SVTSELT

SEQ ID NO: 188662 - protein, 12 aa, Mycobacterium bovis
SVTSGFGNKGTG

SEQ ID NO: 188663 - protein, 10 aa, Mycobacterium bovis
SVTSNTRADA

SEQ ID NO: 188664 - protein, 13 aa, Mycobacterium bovis
SVVETERPEPLAA

SEQ ID NO: 188665 - protein, 6 aa, Mycobacterium bovis
SVYGDA

SEQ ID NO: 188666 - protein, 7 aa, Mycobacterium bovis
SWEYTGD

SEQ ID NO: 188667 - protein, 4 aa, Mycobacterium bovis
SWGI

SEQ ID NO: 188668 - protein, 11 aa, Mycobacterium bovis
SWNSGTANTGL

SEQ ID NO: 188669 - protein, 10 aa, Mycobacterium bovis
SWPGTAAREA

SEQ ID NO: 188670 - protein, 7 aa, Mycobacterium bovis
SWQGRSS

SEQ ID NO: 188671 - protein, 6 aa, Mycobacterium bovis
SWRDDA

SEQ ID NO: 188672 - protein, 7 aa, Mycobacterium bovis
SWTEPKG

SEQ ID NO: 188673 - protein, 5 aa, Mycobacterium bovis
SYAGQ

SEQ ID NO: 188674 - protein, 21 aa, Mycobacterium bovis
SYAPGKPGEAGEQERRALNDA

SEQ ID NO: 188675 - protein, 15 aa, Mycobacterium bovis
SYDGQGCSISQAATS

SEQ ID NO: 188676 - protein, 7 aa, Mycobacterium bovis
SYDGSAA

SEQ ID NO: 188677 - protein, 7 aa, Mycobacterium bovis
SYDRVSR

SEQ ID NO: 188678 - protein, 6 aa, Mycobacterium bovis
SYETTF

SEQ ID NO: 188679 - protein, 10 aa, Mycobacterium bovis
SYGADTAEVD

SEQ ID NO: 188680 - protein, 6 aa, Mycobacterium bovis
SYGAGN

SEQ ID NO: 188681 - protein, 5 aa, Mycobacterium bovis
SYGAP

SEQ ID NO: 188682 - protein, 6 aa, Mycobacterium bovis
SYGFSG

SEQ ID NO: 188683 - protein, 5 aa, Mycobacterium bovis
SYGGA

SEQ ID NO: 188684 - protein, 6 aa, Mycobacterium bovis
SYGPIG

SEQ ID NO: 188685 - protein, 10 aa, Mycobacterium bovis
SYGPPTEHDH

SEQ ID NO: 188686 - protein, 7 aa, Mycobacterium bovis
SYGPTEA

SEQ ID NO: 188687 - protein, 6 aa, Mycobacterium bovis
SYGSAR

SEQ ID NO: 188688 - protein, 5 aa, Mycobacterium bovis
SYGTL

SEQ ID NO: 188689 - protein, 6 aa, Mycobacterium bovis
SYHSRT

SEQ ID NO: 188690 - protein, 8 aa, Mycobacterium bovis
SYKVTGTA

SEQ ID NO: 188691 - protein, 23 aa, Mycobacterium bovis
SYNTGSFNAGDTNTGGFNPGGVN

SEQ ID NO: 188692 - protein, 5 aa, Mycobacterium bovis
SYPAS

SEQ ID NO: 188693 - protein, 5 aa, Mycobacterium bovis
SYPDE

SEQ ID NO: 188694 - protein, 8 aa, Mycobacterium bovis
SYPDGHTA

SEQ ID NO: 188695 - protein, 4 aa, Mycobacterium bovis
SYPE

SEQ ID NO: 188696 - protein, 8 aa, Mycobacterium bovis
SYPEAEGI

SEQ ID NO: 188697 - protein, 8 aa, Mycobacterium bovis
SYPQSLKR

SEQ ID NO: 188698 - protein, 6 aa, Mycobacterium bovis
SYPRSA

SEQ ID NO: 188699 - protein, 9 aa, Mycobacterium bovis
SYQTKTDRQ

SEQ ID NO: 188700 - protein, 4 aa, Mycobacterium bovis
SYRG

SEQ ID NO: 188701 - protein, 19 aa, Mycobacterium bovis
SYRGPRDDSSEATKAAEAS

SEQ ID NO: 188702 - protein, 5 aa, Mycobacterium bovis
SYRGR

SEQ ID NO: 188703 - protein, 25 aa, Mycobacterium bovis
SYRRGGRHRNGRFTKADTWAAYEVV

SEQ ID NO: 188704 - protein, 8 aa, Mycobacterium bovis
SYRTDSPG

SEQ ID NO: 188705 - protein, 8 aa, Mycobacterium bovis
SYSDRPGT

SEQ ID NO: 188706 - protein, 7 aa, Mycobacterium bovis
SYSEDGD

SEQ ID NO: 188707 - protein, 14 aa, Mycobacterium bovis
SYTAEDGVISIRPK

SEQ ID NO: 188708 - protein, 5 aa, Mycobacterium bovis
SYTEG

SEQ ID NO: 188709 - protein, 9 aa, Mycobacterium bovis
TAAAADGTM

SEQ ID NO: 188710 - protein, 10 aa, Mycobacterium bovis
TAAAEAKRQN

SEQ ID NO: 188711 - protein, 7 aa, Mycobacterium bovis
TAAAEGA

SEQ ID NO: 188712 - protein, 6 aa, Mycobacterium bovis
TAAARH

SEQ ID NO: 188713 - protein, 6 aa, Mycobacterium bovis
TAAATT

SEQ ID NO: 188714 - protein, 7 aa, Mycobacterium bovis
TAADALD

SEQ ID NO: 188715 - protein, 7 aa, Mycobacterium bovis
TAADDAA

SEQ ID NO: 188716 - protein, 6 aa, Mycobacterium bovis
TAADGL

SEQ ID NO: 188717 - protein, 15 aa, Mycobacterium bovis
TAADGPHKRERASDL

SEQ ID NO: 188718 - protein, 11 aa, Mycobacterium bovis
TAADGSRRRAF

SEQ ID NO: 188719 - protein, 14 aa, Mycobacterium bovis
TAADPTISQTLKGG

SEQ ID NO: 188720 - protein, 11 aa, Mycobacterium bovis
TAADSSPALAS

SEQ ID NO: 188721 - protein, 15 aa, Mycobacterium bovis
TAAEASAAANGRSLP

SEQ ID NO: 188722 - protein, 6 aa, Mycobacterium bovis
TAAEDA

SEQ ID NO: 188723 - protein, 9 aa, Mycobacterium bovis
TAAEPIPGA

SEQ ID NO: 188724 - protein, 11 aa, Mycobacterium bovis
TAAESQAGAAR

SEQ ID NO: 188725 - protein, 4 aa, Mycobacterium bovis
TAAG

SEQ ID NO: 188726 - protein, 10 aa, Mycobacterium bovis
TAAGANSDTR

SEQ ID NO: 188727 - protein, 18 aa, Mycobacterium bovis
TAAGAYGSAEAANASPLQ

SEQ ID NO: 188728 - protein, 7 aa, Mycobacterium bovis
TAAGDAV

SEQ ID NO: 188729 - protein, 12 aa, Mycobacterium bovis
TAAGGASDQGPL

SEQ ID NO: 188730 - protein, 8 aa, Mycobacterium bovis
TAAGGNAA

SEQ ID NO: 188731 - protein, 8 aa, Mycobacterium bovis
TAAGHQQG

SEQ ID NO: 188732 - protein, 12 aa, Mycobacterium bovis
TAAGLGPDGKRW

SEQ ID NO: 188733 - protein, 11 aa, Mycobacterium bovis
TAAGNGAAAEE

SEQ ID NO: 188734 - protein, 8 aa, Mycobacterium bovis
TAAGQRHR

SEQ ID NO: 188735 - protein, 22 aa, Mycobacterium bovis
TAAGQSAHANYTGAVATNLGMW

SEQ ID NO: 188736 - protein, 10 aa, Mycobacterium bovis
TAAGSAEATV

SEQ ID NO: 188737 - protein, 8 aa, Mycobacterium bovis
TAAGSAVS

SEQ ID NO: 188738 - protein, 7 aa, Mycobacterium bovis
TAAGSEV

SEQ ID NO: 188739 - protein, 7 aa, Mycobacterium bovis
TAAGTGV

SEQ ID NO: 188740 - protein, 7 aa, Mycobacterium bovis
TAAGTSC

SEQ ID NO: 188741 - protein, 6 aa, Mycobacterium bovis
TAAHEP

SEQ ID NO: 188742 - protein, 19 aa, Mycobacterium bovis
TAAHTNRSATPVASEGPAV

SEQ ID NO: 188743 - protein, 12 aa, Mycobacterium bovis
TAALKGSPQRRG

SEQ ID NO: 188744 - protein, 9 aa, Mycobacterium bovis
TAANQDGHT

SEQ ID NO: 188745 - protein, 7 aa, Mycobacterium bovis
TAAPGDY

SEQ ID NO: 188746 - protein, 9 aa, Mycobacterium bovis
TAAPHGAAG

SEQ ID NO: 188747 - protein, 8 aa, Mycobacterium bovis
TAAPPVSR

SEQ ID NO: 188748 - protein, 6 aa, Mycobacterium bovis
TAAPTA

SEQ ID NO: 188749 - protein, 6 aa, Mycobacterium bovis
TAAQEQ

SEQ ID NO: 188750 - protein, 5 aa, Mycobacterium bovis
TAARQ

SEQ ID NO: 188751 - protein, 7 aa, Mycobacterium bovis
TAARYGH

SEQ ID NO: 188752 - protein, 9 aa, Mycobacterium bovis
TAASVNQAR

SEQ ID NO: 188753 - protein, 9 aa, Mycobacterium bovis
TAATDDEVD

SEQ ID NO: 188754 - protein, 6 aa, Mycobacterium bovis
TAATEL

SEQ ID NO: 188755 - protein, 7 aa, Mycobacterium bovis
TAATGAA

SEQ ID NO: 188756 - protein, 13 aa, Mycobacterium bovis
TAATNGSPSGNAE

SEQ ID NO: 188757 - protein, 4 aa, Mycobacterium bovis
TADA

SEQ ID NO: 188758 - protein, 10 aa, Mycobacterium bovis
TADDGPTARR

SEQ ID NO: 188759 - protein, 5 aa, Mycobacterium bovis
TADEA

SEQ ID NO: 188760 - protein, 8 aa, Mycobacterium bovis
TADFTGTT

SEQ ID NO: 188761 - protein, 4 aa, Mycobacterium bovis
TADG

SEQ ID NO: 188762 - protein, 13 aa, Mycobacterium bovis
TADGACCPVLVPD

SEQ ID NO: 188763 - protein, 8 aa, Mycobacterium bovis
TADGDLRP

SEQ ID NO: 188764 - protein, 8 aa, Mycobacterium bovis
TADGKEIA

SEQ ID NO: 188765 - protein, 9 aa, Mycobacterium bovis
TADGTGREV

SEQ ID NO: 188766 - protein, 7 aa, Mycobacterium bovis
TADLADA

SEQ ID NO: 188767 - protein, 4 aa, Mycobacterium bovis
TADP

SEQ ID NO: 188768 - protein, 10 aa, Mycobacterium bovis
TADPAAPDLA

SEQ ID NO: 188769 - protein, 6 aa, Mycobacterium bovis
TADPFG

SEQ ID NO: 188770 - protein, 7 aa, Mycobacterium bovis
TADPGSV

SEQ ID NO: 188771 - protein, 11 aa, Mycobacterium bovis
TADPHSVTDEQ

SEQ ID NO: 188772 - protein, 6 aa, Mycobacterium bovis
TADRDD

SEQ ID NO: 188773 - protein, 6 aa, Mycobacterium bovis
TADREG

SEQ ID NO: 188774 - protein, 10 aa, Mycobacterium bovis
TADTSREEVG

SEQ ID NO: 188775 - protein, 12 aa, Mycobacterium bovis
TAEAEASNDVPT

SEQ ID NO: 188776 - protein, 9 aa, Mycobacterium bovis
TAEAGRSAA

SEQ ID NO: 188777 - protein, 8 aa, Mycobacterium bovis
TAEARQVD

SEQ ID NO: 188778 - protein, 6 aa, Mycobacterium bovis
TAEDTR

SEQ ID NO: 188779 - protein, 8 aa, Mycobacterium bovis
TAEEAKDY

SEQ ID NO: 188780 - protein, 28 aa, Mycobacterium bovis
TAEERANAVRGRADSLRRAAAAEREARV

SEQ ID NO: 188781 - protein, 5 aa, Mycobacterium bovis
TAEEY

SEQ ID NO: 188782 - protein, 7 aa, Mycobacterium bovis
TAEGLGE

SEQ ID NO: 188783 - protein, 9 aa, Mycobacterium bovis
TAEGTAKPF

SEQ ID NO: 188784 - protein, 6 aa, Mycobacterium bovis
TAEIPT

SEQ ID NO: 188785 - protein, 4 aa, Mycobacterium bovis
TAEL

SEQ ID NO: 188786 - protein, 4 aa, Mycobacterium bovis
TAEP

SEQ ID NO: 188787 - protein, 10 aa, Mycobacterium bovis
TAEPGRDPIS

SEQ ID NO: 188788 - protein, 16 aa, Mycobacterium bovis
TAEPVAAHKTEDARDP

SEQ ID NO: 188789 - protein, 4 aa, Mycobacterium bovis
TAEQ

SEQ ID NO: 188790 - protein, 5 aa, Mycobacterium bovis
TAEQA

SEQ ID NO: 188791 - protein, 6 aa, Mycobacterium bovis
TAEQRG

SEQ ID NO: 188792 - protein, 8 aa, Mycobacterium bovis
TAERGGQV

SEQ ID NO: 188793 - protein, 6 aa, Mycobacterium bovis
TAESCT

SEQ ID NO: 188794 - protein, 6 aa, Mycobacterium bovis
TAEVGD

SEQ ID NO: 188795 - protein, 5 aa, Mycobacterium bovis
TAEWS

SEQ ID NO: 188796 - protein, 5 aa, Mycobacterium bovis
TAFGT

SEQ ID NO: 188797 - protein, 26 aa, Mycobacterium bovis
TAFSDPARVAPRDITTTTNSLGATTT

SEQ ID NO: 188798 - protein, 7 aa, Mycobacterium bovis
TAFTDGE

SEQ ID NO: 188799 - protein, 7 aa, Mycobacterium bovis
TAGAAQA

SEQ ID NO: 188800 - protein, 10 aa, Mycobacterium bovis
TAGADTSVGA

SEQ ID NO: 188801 - protein, 16 aa, Mycobacterium bovis
TAGAGAARTTLARRTS

SEQ ID NO: 188802 - protein, 7 aa, Mycobacterium bovis
TAGAGSP

SEQ ID NO: 188803 - protein, 6 aa, Mycobacterium bovis
TAGAQF

SEQ ID NO: 188804 - protein, 10 aa, Mycobacterium bovis
TAGASAPPRL

SEQ ID NO: 188805 - protein, 21 aa, Mycobacterium bovis
TAGDLEGADEDAHIADPRAGL

SEQ ID NO: 188806 - protein, 7 aa, Mycobacterium bovis
TAGEGAR

SEQ ID NO: 188807 - protein, 6 aa, Mycobacterium bovis
TAGEPV

SEQ ID NO: 188808 - protein, 6 aa, Mycobacterium bovis
TAGERA

SEQ ID NO: 188809 - protein, 4 aa, Mycobacterium bovis
TAGG

SEQ ID NO: 188810 - protein, 7 aa, Mycobacterium bovis
TAGGLAS

SEQ ID NO: 188811 - protein, 6 aa, Mycobacterium bovis
TAGITD

SEQ ID NO: 188812 - protein, 5 aa, Mycobacterium bovis
TAGLG

SEQ ID NO: 188813 - protein, 9 aa, Mycobacterium bovis
TAGNEKRRD

SEQ ID NO: 188814 - protein, 11 aa, Mycobacterium bovis
TAGPDTDDAAA

SEQ ID NO: 188815 - protein, 8 aa, Mycobacterium bovis
TAGPGGFE

SEQ ID NO: 188816 - protein, 9 aa, Mycobacterium bovis
TAGPGITNG

SEQ ID NO: 188817 - protein, 9 aa, Mycobacterium bovis
TAGPGRAPK

SEQ ID NO: 188818 - protein, 13 aa, Mycobacterium bovis
TAGPGSAWQGPAA

SEQ ID NO: 188819 - protein, 13 aa, Mycobacterium bovis
TAGPWESEQTHDS

SEQ ID NO: 188820 - protein, 6 aa, Mycobacterium bovis
TAGQAA

SEQ ID NO: 188821 - protein, 13 aa, Mycobacterium bovis
TAGQAEQAGMQAR

SEQ ID NO: 188822 - protein, 16 aa, Mycobacterium bovis
TAGQARPCGTDGSVGT

SEQ ID NO: 188823 - protein, 7 aa, Mycobacterium bovis
TAGQATA

SEQ ID NO: 188824 - protein, 14 aa, Mycobacterium bovis
TAGQGSAAKLATAL

SEQ ID NO: 188825 - protein, 11 aa, Mycobacterium bovis
TAGRSDLKTVP

SEQ ID NO: 188826 - protein, 16 aa, Mycobacterium bovis
TAGRTTLTGEGLQHAD

SEQ ID NO: 188827 - protein, 32 aa, Mycobacterium bovis
TAGSAVTAAPAETAARAARAARAACSASPVAP

SEQ ID NO: 188828 - protein, 7 aa, Mycobacterium bovis
TAGSPEK

SEQ ID NO: 188829 - protein, 6 aa, Mycobacterium bovis
TAGSRL

SEQ ID NO: 188830 - protein, 6 aa, Mycobacterium bovis
TAGSTN

SEQ ID NO: 188831 - protein, 8 aa, Mycobacterium bovis
TAGSVGRN

SEQ ID NO: 188832 - protein, 6 aa, Mycobacterium bovis
TAGTAT

SEQ ID NO: 188833 - protein, 5 aa, Mycobacterium bovis
TAGVH

SEQ ID NO: 188834 - protein, 21 aa, Mycobacterium bovis
TAGYDEPAVSRTYAAPGAAEC

SEQ ID NO: 188835 - protein, 5 aa, Mycobacterium bovis
TAHAA

SEQ ID NO: 188836 - protein, 8 aa, Mycobacterium bovis
TAHAQGAR

SEQ ID NO: 188837 - protein, 12 aa, Mycobacterium bovis
TAHPQRDPHTGE

SEQ ID NO: 188838 - protein, 13 aa, Mycobacterium bovis
TAIPPDASYEPKW

SEQ ID NO: 188839 - protein, 9 aa, Mycobacterium bovis
TAIRGEPPK

SEQ ID NO: 188840 - protein, 7 aa, Mycobacterium bovis
TAIRPSY

SEQ ID NO: 188841 - protein, 4 aa, Mycobacterium bovis
TAKA

SEQ ID NO: 188842 - protein, 9 aa, Mycobacterium bovis
TAKDGPLEQ

SEQ ID NO: 188843 - protein, 7 aa, Mycobacterium bovis
TAKEQNV

SEQ ID NO: 188844 - protein, 8 aa, Mycobacterium bovis
TAKFGQPE

SEQ ID NO: 188845 - protein, 18 aa, Mycobacterium bovis
TAKGRRPSWNAAAPGAVA

SEQ ID NO: 188846 - protein, 15 aa, Mycobacterium bovis
TAKPAEGADPRSGRW

SEQ ID NO: 188847 - protein, 15 aa, Mycobacterium bovis
TAKPGAFRRPNGQAF

SEQ ID NO: 188848 - protein, 6 aa, Mycobacterium bovis
TAKPYF

SEQ ID NO: 188849 - protein, 10 aa, Mycobacterium bovis
TAKSAARAYG

SEQ ID NO: 188850 - protein, 8 aa, Mycobacterium bovis
TALDPSAP

SEQ ID NO: 188851 - protein, 9 aa, Mycobacterium bovis
TALELGPSG

SEQ ID NO: 188852 - protein, 8 aa, Mycobacterium bovis
TALGAGAA

SEQ ID NO: 188853 - protein, 6 aa, Mycobacterium bovis
TALGNP

SEQ ID NO: 188854 - protein, 10 aa, Mycobacterium bovis
TALGTGRGEE

SEQ ID NO: 188855 - protein, 7 aa, Mycobacterium bovis
TALPGAN

SEQ ID NO: 188856 - protein, 5 aa, Mycobacterium bovis
TAMRE

SEQ ID NO: 188857 - protein, 19 aa, Mycobacterium bovis
TANDPQYQAELPEGSDTSV

SEQ ID NO: 188858 - protein, 6 aa, Mycobacterium bovis
TANGKP

SEQ ID NO: 188859 - protein, 8 aa, Mycobacterium bovis
TANKARPI

SEQ ID NO: 188860 - protein, 7 aa, Mycobacterium bovis
TANNPAF

SEQ ID NO: 188861 - protein, 5 aa, Mycobacterium bovis
TANPT

SEQ ID NO: 188862 - protein, 4 aa, Mycobacterium bovis
TANR

SEQ ID NO: 188863 - protein, 8 aa, Mycobacterium bovis
TANWPQGQ

SEQ ID NO: 188864 - protein, 8 aa, Mycobacterium bovis
TAPAEASS

SEQ ID NO: 188865 - protein, 10 aa, Mycobacterium bovis
TAPAPHHTRP

SEQ ID NO: 188866 - protein, 6 aa, Mycobacterium bovis
TAPATV

SEQ ID NO: 188867 - protein, 4 aa, Mycobacterium bovis
TAPD

SEQ ID NO: 188868 - protein, 9 aa, Mycobacterium bovis
TAPEGKTMG

SEQ ID NO: 188869 - protein, 8 aa, Mycobacterium bovis
TAPEHGKG

SEQ ID NO: 188870 - protein, 10 aa, Mycobacterium bovis
TAPERAPSME

SEQ ID NO: 188871 - protein, 7 aa, Mycobacterium bovis
TAPETVT

SEQ ID NO: 188872 - protein, 12 aa, Mycobacterium bovis
TAPEYSRSSEYC

SEQ ID NO: 188873 - protein, 6 aa, Mycobacterium bovis
TAPGEL

SEQ ID NO: 188874 - protein, 8 aa, Mycobacterium bovis
TAPGFSDE

SEQ ID NO: 188875 - protein, 11 aa, Mycobacterium bovis
TAPGGAPTPVA

SEQ ID NO: 188876 - protein, 14 aa, Mycobacterium bovis
TAPGGPGGAGGAGG

SEQ ID NO: 188877 - protein, 7 aa, Mycobacterium bovis
TAPGGRT

SEQ ID NO: 188878 - protein, 15 aa, Mycobacterium bovis
TAPGKSQIGGASNAG

SEQ ID NO: 188879 - protein, 6 aa, Mycobacterium bovis
TAPGSA

SEQ ID NO: 188880 - protein, 32 aa, Mycobacterium bovis
TAPKPSFSAPVSGAGRFGSARPSPTRSGASRR

SEQ ID NO: 188881 - protein, 9 aa, Mycobacterium bovis
TAPKSNAVT

SEQ ID NO: 188882 - protein, 5 aa, Mycobacterium bovis
TAPKY

SEQ ID NO: 188883 - protein, 9 aa, Mycobacterium bovis
TAPMEPADP

SEQ ID NO: 188884 - protein, 23 aa, Mycobacterium bovis
TAPPASSGPSTTHDDEDITTATE

SEQ ID NO: 188885 - protein, 7 aa, Mycobacterium bovis
TAPPGIT

SEQ ID NO: 188886 - protein, 8 aa, Mycobacterium bovis
TAPQAPDL

SEQ ID NO: 188887 - protein, 7 aa, Mycobacterium bovis
TAPRVAA

SEQ ID NO: 188888 - protein, 9 aa, Mycobacterium bovis
TAPSATTLP

SEQ ID NO: 188889 - protein, 7 aa, Mycobacterium bovis
TAPTDSA

SEQ ID NO: 188890 - protein, 18 aa, Mycobacterium bovis
TAPTESAQRSNPGQLVRQ

SEQ ID NO: 188891 - protein, 9 aa, Mycobacterium bovis
TAPTNGAAG

SEQ ID NO: 188892 - protein, 4 aa, Mycobacterium bovis
TAPV

SEQ ID NO: 188893 - protein, 9 aa, Mycobacterium bovis
TAPVPGLTT

SEQ ID NO: 188894 - protein, 14 aa, Mycobacterium bovis
TAQDINDNHRNSRY

SEQ ID NO: 188895 - protein, 9 aa, Mycobacterium bovis
TAQQAARHA

SEQ ID NO: 188896 - protein, 6 aa, Mycobacterium bovis
TAQQDD

SEQ ID NO: 188897 - protein, 7 aa, Mycobacterium bovis
TAQRDRA

SEQ ID NO: 188898 - protein, 5 aa, Mycobacterium bovis
TAQRG

SEQ ID NO: 188899 - protein, 5 aa, Mycobacterium bovis
TAQTR

SEQ ID NO: 188900 - protein, 4 aa, Mycobacterium bovis
TARA

SEQ ID NO: 188901 - protein, 5 aa, Mycobacterium bovis
TARAA

SEQ ID NO: 188902 - protein, 16 aa, Mycobacterium bovis
TARAEGAAAGAKAAAA

SEQ ID NO: 188903 - protein, 5 aa, Mycobacterium bovis
TARDR

SEQ ID NO: 188904 - protein, 7 aa, Mycobacterium bovis
TARDRNG

SEQ ID NO: 188905 - protein, 7 aa, Mycobacterium bovis
TAREAAG

SEQ ID NO: 188906 - protein, 6 aa, Mycobacterium bovis
TAREPH

SEQ ID NO: 188907 - protein, 13 aa, Mycobacterium bovis
TARGEPELARDDA

SEQ ID NO: 188908 - protein, 14 aa, Mycobacterium bovis
TARGGDDESAVDAQ

SEQ ID NO: 188909 - protein, 6 aa, Mycobacterium bovis
TARGGS

SEQ ID NO: 188910 - protein, 9 aa, Mycobacterium bovis
TARGQPAAV

SEQ ID NO: 188911 - protein, 9 aa, Mycobacterium bovis
TARKKPPFG

SEQ ID NO: 188912 - protein, 9 aa, Mycobacterium bovis
TARPPSGFG

SEQ ID NO: 188913 - protein, 14 aa, Mycobacterium bovis
TARPYPPVADQRGA

SEQ ID NO: 188914 - protein, 9 aa, Mycobacterium bovis
TARQSGGQL

SEQ ID NO: 188915 - protein, 15 aa, Mycobacterium bovis
TARQTPGSTPSSSPG

SEQ ID NO: 188916 - protein, 4 aa, Mycobacterium bovis
TARR

SEQ ID NO: 188917 - protein, 6 aa, Mycobacterium bovis
TARRRK

SEQ ID NO: 188918 - protein, 15 aa, Mycobacterium bovis
TARSAQLAGEQLSRG

SEQ ID NO: 188919 - protein, 7 aa, Mycobacterium bovis
TARTGGV

SEQ ID NO: 188920 - protein, 4 aa, Mycobacterium bovis
TASA

SEQ ID NO: 188921 - protein, 6 aa, Mycobacterium bovis
TASAAA

SEQ ID NO: 188922 - protein, 10 aa, Mycobacterium bovis
TASADGDGIA

SEQ ID NO: 188923 - protein, 8 aa, Mycobacterium bovis
TASADPPV

SEQ ID NO: 188924 - protein, 5 aa, Mycobacterium bovis
TASAE

SEQ ID NO: 188925 - protein, 20 aa, Mycobacterium bovis
TASAEYDKEAADLSDEKLRK

SEQ ID NO: 188926 - protein, 8 aa, Mycobacterium bovis
TASAKGKE

SEQ ID NO: 188927 - protein, 10 aa, Mycobacterium bovis
TASAKSPLAR

SEQ ID NO: 188928 - protein, 15 aa, Mycobacterium bovis
TASASAAHDRLGGPG

SEQ ID NO: 188929 - protein, 9 aa, Mycobacterium bovis
TASFAEQRQ

SEQ ID NO: 188930 - protein, 16 aa, Mycobacterium bovis
TASGDNASGSGRPWDR

SEQ ID NO: 188931 - protein, 8 aa, Mycobacterium bovis
TASGHTPA

SEQ ID NO: 188932 - protein, 8 aa, Mycobacterium bovis
TASGQPVT

SEQ ID NO: 188933 - protein, 7 aa, Mycobacterium bovis
TASGSAR

SEQ ID NO: 188934 - protein, 6 aa, Mycobacterium bovis
TASGTR

SEQ ID NO: 188935 - protein, 4 aa, Mycobacterium bovis
TASH

SEQ ID NO: 188936 - protein, 4 aa, Mycobacterium bovis
TASL

SEQ ID NO: 188937 - protein, 7 aa, Mycobacterium bovis
TASLGDR

SEQ ID NO: 188938 - protein, 11 aa, Mycobacterium bovis
TASQGVAGATT

SEQ ID NO: 188939 - protein, 11 aa, Mycobacterium bovis
TASRHSYSAGA

SEQ ID NO: 188940 - protein, 5 aa, Mycobacterium bovis
TASRI

SEQ ID NO: 188941 - protein, 11 aa, Mycobacterium bovis
TASRMSPEAKR

SEQ ID NO: 188942 - protein, 13 aa, Mycobacterium bovis
TASTRAAKAQLRS

SEQ ID NO: 188943 - protein, 8 aa, Mycobacterium bovis
TATAASYS

SEQ ID NO: 188944 - protein, 8 aa, Mycobacterium bovis
TATAGDDV

SEQ ID NO: 188945 - protein, 9 aa, Mycobacterium bovis
TATAGTDSL

SEQ ID NO: 188946 - protein, 7 aa, Mycobacterium bovis
TATAHPA

SEQ ID NO: 188947 - protein, 6 aa, Mycobacterium bovis
TATALR

SEQ ID NO: 188948 - protein, 5 aa, Mycobacterium bovis
TATDG

SEQ ID NO: 188949 - protein, 8 aa, Mycobacterium bovis
TATDPDGN

SEQ ID NO: 188950 - protein, 4 aa, Mycobacterium bovis
TATE

SEQ ID NO: 188951 - protein, 5 aa, Mycobacterium bovis
TATEI

SEQ ID NO: 188952 - protein, 9 aa, Mycobacterium bovis
TATGATPHN

SEQ ID NO: 188953 - protein, 8 aa, Mycobacterium bovis
TATGIAGT

SEQ ID NO: 188954 - protein, 7 aa, Mycobacterium bovis
TATGPGE

SEQ ID NO: 188955 - protein, 8 aa, Mycobacterium bovis
TATGPTEV

SEQ ID NO: 188956 - protein, 7 aa, Mycobacterium bovis
TATIDGQ

SEQ ID NO: 188957 - protein, 5 aa, Mycobacterium bovis
TATLA

SEQ ID NO: 188958 - protein, 11 aa, Mycobacterium bovis
TATNDDQLGPL

SEQ ID NO: 188959 - protein, 5 aa, Mycobacterium bovis
TATNL

SEQ ID NO: 188960 - protein, 19 aa, Mycobacterium bovis
TATNQDGRTETLTMPSEDA

SEQ ID NO: 188961 - protein, 4 aa, Mycobacterium bovis
TATP

SEQ ID NO: 188962 - protein, 8 aa, Mycobacterium bovis
TATPEAFN

SEQ ID NO: 188963 - protein, 7 aa, Mycobacterium bovis
TATPRAY

SEQ ID NO: 188964 - protein, 5 aa, Mycobacterium bovis
TATPV

SEQ ID NO: 188965 - protein, 4 aa, Mycobacterium bovis
TATR

SEQ ID NO: 188966 - protein, 15 aa, Mycobacterium bovis
TATRRVNTIAELARR

SEQ ID NO: 188967 - protein, 12 aa, Mycobacterium bovis
TATSDGQVYSFA

SEQ ID NO: 188968 - protein, 7 aa, Mycobacterium bovis
TATSGAD

SEQ ID NO: 188969 - protein, 7 aa, Mycobacterium bovis
TATTAGM

SEQ ID NO: 188970 - protein, 21 aa, Mycobacterium bovis
TATTAPETNGPPPDPDDDPPP

SEQ ID NO: 188971 - protein, 7 aa, Mycobacterium bovis
TATTGGK

SEQ ID NO: 188972 - protein, 7 aa, Mycobacterium bovis
TATTPDL

SEQ ID NO: 188973 - protein, 8 aa, Mycobacterium bovis
TATTRDVN

SEQ ID NO: 188974 - protein, 9 aa, Mycobacterium bovis
TATVDRRDT

SEQ ID NO: 188975 - protein, 4 aa, Mycobacterium bovis
TAVA

SEQ ID NO: 188976 - protein, 6 aa, Mycobacterium bovis
TAVAEN

SEQ ID NO: 188977 - protein, 5 aa, Mycobacterium bovis
TAVRD

SEQ ID NO: 188978 - protein, 8 aa, Mycobacterium bovis
TAVRDGDD

SEQ ID NO: 188979 - protein, 10 aa, Mycobacterium bovis
TAVRTPSGYR

SEQ ID NO: 188980 - protein, 4 aa, Mycobacterium bovis
TAVS

SEQ ID NO: 188981 - protein, 4 aa, Mycobacterium bovis
TAVT

SEQ ID NO: 188982 - protein, 14 aa, Mycobacterium bovis
TAVTGRVQNNGQSC

SEQ ID NO: 188983 - protein, 5 aa, Mycobacterium bovis
TAYGQ

SEQ ID NO: 188984 - protein, 8 aa, Mycobacterium bovis
TCAGPEPN

SEQ ID NO: 188985 - protein, 11 aa, Mycobacterium bovis
TCDPPPVQRPH

SEQ ID NO: 188986 - protein, 10 aa, Mycobacterium bovis
TCERPTEPVA

SEQ ID NO: 188987 - protein, 18 aa, Mycobacterium bovis
TCGPAHGPLPADLGSHPS

SEQ ID NO: 188988 - protein, 17 aa, Mycobacterium bovis
TCPPESGPATESLPKSW

SEQ ID NO: 188989 - protein, 7 aa, Mycobacterium bovis
TCPSSDG

SEQ ID NO: 188990 - protein, 7 aa, Mycobacterium bovis
TCRETPD

SEQ ID NO: 188991 - protein, 7 aa, Mycobacterium bovis
TCRPDNT

SEQ ID NO: 188992 - protein, 13 aa, Mycobacterium bovis
TDAADTGLSDASA

SEQ ID NO: 188993 - protein, 7 aa, Mycobacterium bovis
TDAAESR

SEQ ID NO: 188994 - protein, 24 aa, Mycobacterium bovis
TDAARTVNQAAGAMASQPPPPGSL

SEQ ID NO: 188995 - protein, 10 aa, Mycobacterium bovis
TDADNPGPTL

SEQ ID NO: 188996 - protein, 7 aa, Mycobacterium bovis
TDADPGR

SEQ ID NO: 188997 - protein, 7 aa, Mycobacterium bovis
TDADREA

SEQ ID NO: 188998 - protein, 5 aa, Mycobacterium bovis
TDAEG

SEQ ID NO: 188999 - protein, 7 aa, Mycobacterium bovis
TDAEPRW

SEQ ID NO: 189000 - protein, 6 aa, Mycobacterium bovis
TDAESQ

SEQ ID NO: 189001 - protein, 5 aa, Mycobacterium bovis
TDAET

SEQ ID NO: 189002 - protein, 7 aa, Mycobacterium bovis
TDAGRRI

SEQ ID NO: 189003 - protein, 10 aa, Mycobacterium bovis
TDAGVAPGRR

SEQ ID NO: 189004 - protein, 4 aa, Mycobacterium bovis
TDAH

SEQ ID NO: 189005 - protein, 8 aa, Mycobacterium bovis
TDAKGRRY

SEQ ID NO: 189006 - protein, 9 aa, Mycobacterium bovis
TDANGAEQE

SEQ ID NO: 189007 - protein, 5 aa, Mycobacterium bovis
TDANQ

SEQ ID NO: 189008 - protein, 10 aa, Mycobacterium bovis
TDAQRDSEES

SEQ ID NO: 189009 - protein, 9 aa, Mycobacterium bovis
TDARGSYVP

SEQ ID NO: 189010 - protein, 8 aa, Mycobacterium bovis
TDARPDLA

SEQ ID NO: 189011 - protein, 8 aa, Mycobacterium bovis
TDARPERV

SEQ ID NO: 189012 - protein, 10 aa, Mycobacterium bovis
TDARRHTRAE

SEQ ID NO: 189013 - protein, 10 aa, Mycobacterium bovis
TDATPSQREI

SEQ ID NO: 189014 - protein, 8 aa, Mycobacterium bovis
TDATQAAL

SEQ ID NO: 189015 - protein, 8 aa, Mycobacterium bovis
TDATYTQT

SEQ ID NO: 189016 - protein, 8 aa, Mycobacterium bovis
TDAYEQGR

SEQ ID NO: 189017 - protein, 5 aa, Mycobacterium bovis
TDDAR

SEQ ID NO: 189018 - protein, 6 aa, Mycobacterium bovis
TDDARE

SEQ ID NO: 189019 - protein, 5 aa, Mycobacterium bovis
TDDDR

SEQ ID NO: 189020 - protein, 4 aa, Mycobacterium bovis
TDDG

SEQ ID NO: 189021 - protein, 8 aa, Mycobacterium bovis
TDDGDRAT

SEQ ID NO: 189022 - protein, 11 aa, Mycobacterium bovis
TDDGLSGEEGT

SEQ ID NO: 189023 - protein, 34 aa, Mycobacterium bovis
TDDLQSPRSAPAAHDENADGITGGTRDDSAPNSR

SEQ ID NO: 189024 - protein, 4 aa, Mycobacterium bovis
TDDP

SEQ ID NO: 189025 - protein, 13 aa, Mycobacterium bovis
TDDPADRFAPGTR

SEQ ID NO: 189026 - protein, 15 aa, Mycobacterium bovis
TDDPSNDGVLPAPVD

SEQ ID NO: 189027 - protein, 5 aa, Mycobacterium bovis
TDDQV

SEQ ID NO: 189028 - protein, 8 aa, Mycobacterium bovis
TDDRGDPV

SEQ ID NO: 189029 - protein, 6 aa, Mycobacterium bovis
TDDSGN

SEQ ID NO: 189030 - protein, 5 aa, Mycobacterium bovis
TDDTK

SEQ ID NO: 189031 - protein, 5 aa, Mycobacterium bovis
TDEED

SEQ ID NO: 189032 - protein, 5 aa, Mycobacterium bovis
TDEHG

SEQ ID NO: 189033 - protein, 9 aa, Mycobacterium bovis
TDEPGLTPG

SEQ ID NO: 189034 - protein, 7 aa, Mycobacterium bovis
TDEQKAR

SEQ ID NO: 189035 - protein, 5 aa, Mycobacterium bovis
TDERG

SEQ ID NO: 189036 - protein, 7 aa, Mycobacterium bovis
TDETTTQ

SEQ ID NO: 189037 - protein, 6 aa, Mycobacterium bovis
TDEVGQ

SEQ ID NO: 189038 - protein, 7 aa, Mycobacterium bovis
TDFDDAD

SEQ ID NO: 189039 - protein, 4 aa, Mycobacterium bovis
TDFG

SEQ ID NO: 189040 - protein, 11 aa, Mycobacterium bovis
TDFPGGDSDEM

SEQ ID NO: 189041 - protein, 14 aa, Mycobacterium bovis
TDFSGSDRGGYRDL

SEQ ID NO: 189042 - protein, 7 aa, Mycobacterium bovis
TDGATER

SEQ ID NO: 189043 - protein, 10 aa, Mycobacterium bovis
TDGDQGGGNP

SEQ ID NO: 189044 - protein, 6 aa, Mycobacterium bovis
TDGDSE

SEQ ID NO: 189045 - protein, 14 aa, Mycobacterium bovis
TDGEPLDEDARPRQ

SEQ ID NO: 189046 - protein, 7 aa, Mycobacterium bovis
TDGEQEF

SEQ ID NO: 189047 - protein, 23 aa, Mycobacterium bovis
TDGETNASLRKGDDVASITDERA

SEQ ID NO: 189048 - protein, 7 aa, Mycobacterium bovis
TDGHARR

SEQ ID NO: 189049 - protein, 4 aa, Mycobacterium bovis
TDGL

SEQ ID NO: 189050 - protein, 6 aa, Mycobacterium bovis
TDGPAA

SEQ ID NO: 189051 - protein, 6 aa, Mycobacterium bovis
TDGPRL

SEQ ID NO: 189052 - protein, 9 aa, Mycobacterium bovis
TDGPSAQAA

SEQ ID NO: 189053 - protein, 4 aa, Mycobacterium bovis
TDGQ

SEQ ID NO: 189054 - protein, 11 aa, Mycobacterium bovis
TDGQGGLQERR

SEQ ID NO: 189055 - protein, 7 aa, Mycobacterium bovis
TDGRKRR

SEQ ID NO: 189056 - protein, 16 aa, Mycobacterium bovis
TDGRYRTQAASQAPDL

SEQ ID NO: 189057 - protein, 4 aa, Mycobacterium bovis
TDGS

SEQ ID NO: 189058 - protein, 6 aa, Mycobacterium bovis
TDGSRI

SEQ ID NO: 189059 - protein, 8 aa, Mycobacterium bovis
TDGTADTK

SEQ ID NO: 189060 - protein, 5 aa, Mycobacterium bovis
TDGVG

SEQ ID NO: 189061 - protein, 13 aa, Mycobacterium bovis
TDHPDADTEETAS

SEQ ID NO: 189062 - protein, 6 aa, Mycobacterium bovis
TDHPGY

SEQ ID NO: 189063 - protein, 5 aa, Mycobacterium bovis
TDHQP

SEQ ID NO: 189064 - protein, 7 aa, Mycobacterium bovis
TDHRPVT

SEQ ID NO: 189065 - protein, 11 aa, Mycobacterium bovis
TDIEGANAAGL

SEQ ID NO: 189066 - protein, 6 aa, Mycobacterium bovis
TDKADI

SEQ ID NO: 189067 - protein, 5 aa, Mycobacterium bovis
TDKGM

SEQ ID NO: 189068 - protein, 11 aa, Mycobacterium bovis
TDKGQAEAVRS

SEQ ID NO: 189069 - protein, 8 aa, Mycobacterium bovis
TDKRDLST

SEQ ID NO: 189070 - protein, 7 aa, Mycobacterium bovis
TDLDPDL

SEQ ID NO: 189071 - protein, 6 aa, Mycobacterium bovis
TDLGGI

SEQ ID NO: 189072 - protein, 4 aa, Mycobacterium bovis
TDLP

SEQ ID NO: 189073 - protein, 9 aa, Mycobacterium bovis
TDLTDRVGE

SEQ ID NO: 189074 - protein, 19 aa, Mycobacterium bovis
TDMDDGNAAELKAVVCSCA

SEQ ID NO: 189075 - protein, 8 aa, Mycobacterium bovis
TDNALPPL

SEQ ID NO: 189076 - protein, 4 aa, Mycobacterium bovis
TDND

SEQ ID NO: 189077 - protein, 5 aa, Mycobacterium bovis
TDNDA

SEQ ID NO: 189078 - protein, 15 aa, Mycobacterium bovis
TDNGEDQRSDSGEGV

SEQ ID NO: 189079 - protein, 8 aa, Mycobacterium bovis
TDNPDSIV

SEQ ID NO: 189080 - protein, 7 aa, Mycobacterium bovis
TDNPNPA

SEQ ID NO: 189081 - protein, 6 aa, Mycobacterium bovis
TDNQKQ

SEQ ID NO: 189082 - protein, 31 aa, Mycobacterium bovis
TDNRDARGDREGRRRDSGRGSRERDGEKSNY

SEQ ID NO: 189083 - protein, 6 aa, Mycobacterium bovis
TDPAAN

SEQ ID NO: 189084 - protein, 12 aa, Mycobacterium bovis
TDPAGETPSVGA

SEQ ID NO: 189085 - protein, 7 aa, Mycobacterium bovis
TDPAGFT

SEQ ID NO: 189086 - protein, 13 aa, Mycobacterium bovis
TDPAKSRPLFGPG

SEQ ID NO: 189087 - protein, 6 aa, Mycobacterium bovis
TDPARV

SEQ ID NO: 189088 - protein, 4 aa, Mycobacterium bovis
TDPD

SEQ ID NO: 189089 - protein, 12 aa, Mycobacterium bovis
TDPDAAAPHVAE

SEQ ID NO: 189090 - protein, 9 aa, Mycobacterium bovis
TDPDAPKHK

SEQ ID NO: 189091 - protein, 7 aa, Mycobacterium bovis
TDPDELP

SEQ ID NO: 189092 - protein, 5 aa, Mycobacterium bovis
TDPDS

SEQ ID NO: 189093 - protein, 6 aa, Mycobacterium bovis
TDPDSR

SEQ ID NO: 189094 - protein, 18 aa, Mycobacterium bovis
TDPEAPPGSGKPEPFGDD

SEQ ID NO: 189095 - protein, 8 aa, Mycobacterium bovis
TDPEEVGA

SEQ ID NO: 189096 - protein, 9 aa, Mycobacterium bovis
TDPEKGAQG

SEQ ID NO: 189097 - protein, 6 aa, Mycobacterium bovis
TDPESV

SEQ ID NO: 189098 - protein, 4 aa, Mycobacterium bovis
TDPH

SEQ ID NO: 189099 - protein, 9 aa, Mycobacterium bovis
TDPNAAKHK

SEQ ID NO: 189100 - protein, 10 aa, Mycobacterium bovis
TDPNATPRHQ

SEQ ID NO: 189101 - protein, 6 aa, Mycobacterium bovis
TDPNGY

SEQ ID NO: 189102 - protein, 9 aa, Mycobacterium bovis
TDPPATRQA

SEQ ID NO: 189103 - protein, 13 aa, Mycobacterium bovis
TDPPKLKKQEKHD

SEQ ID NO: 189104 - protein, 17 aa, Mycobacterium bovis
TDPPPTAGEHNAVFLAR

SEQ ID NO: 189105 - protein, 5 aa, Mycobacterium bovis
TDPQE

SEQ ID NO: 189106 - protein, 5 aa, Mycobacterium bovis
TDPQG

SEQ ID NO: 189107 - protein, 7 aa, Mycobacterium bovis
TDPQYQS

SEQ ID NO: 189108 - protein, 5 aa, Mycobacterium bovis
TDPRR

SEQ ID NO: 189109 - protein, 9 aa, Mycobacterium bovis
TDPSAAKHR

SEQ ID NO: 189110 - protein, 15 aa, Mycobacterium bovis
TDPSGASLAYSGDTG

SEQ ID NO: 189111 - protein, 15 aa, Mycobacterium bovis
TDPTESLTHLVSGSA

SEQ ID NO: 189112 - protein, 8 aa, Mycobacterium bovis
TDPTNGTR

SEQ ID NO: 189113 - protein, 6 aa, Mycobacterium bovis
TDPTQL

SEQ ID NO: 189114 - protein, 8 aa, Mycobacterium bovis
TDPVASEK

SEQ ID NO: 189115 - protein, 6 aa, Mycobacterium bovis
TDPVHT

SEQ ID NO: 189116 - protein, 13 aa, Mycobacterium bovis
TDPVPTGGDDPHK

SEQ ID NO: 189117 - protein, 9 aa, Mycobacterium bovis
TDQAADDVL

SEQ ID NO: 189118 - protein, 4 aa, Mycobacterium bovis
TDQD

SEQ ID NO: 189119 - protein, 5 aa, Mycobacterium bovis
TDQPC

SEQ ID NO: 189120 - protein, 6 aa, Mycobacterium bovis
TDQRAH

SEQ ID NO: 189121 - protein, 5 aa, Mycobacterium bovis
TDRAE

SEQ ID NO: 189122 - protein, 21 aa, Mycobacterium bovis
TDRALSAKGLEDAVHRAISEG

SEQ ID NO: 189123 - protein, 6 aa, Mycobacterium bovis
TDRDDP

SEQ ID NO: 189124 - protein, 9 aa, Mycobacterium bovis
TDRDSVGGN

SEQ ID NO: 189125 - protein, 5 aa, Mycobacterium bovis
TDRGD

SEQ ID NO: 189126 - protein, 6 aa, Mycobacterium bovis
TDRGRP

SEQ ID NO: 189127 - protein, 6 aa, Mycobacterium bovis
TDRKLT

SEQ ID NO: 189128 - protein, 4 aa, Mycobacterium bovis
TDRL

SEQ ID NO: 189129 - protein, 5 aa, Mycobacterium bovis
TDRLR

SEQ ID NO: 189130 - protein, 5 aa, Mycobacterium bovis
TDRNG

SEQ ID NO: 189131 - protein, 4 aa, Mycobacterium bovis
TDRP

SEQ ID NO: 189132 - protein, 7 aa, Mycobacterium bovis
TDRPDAR

SEQ ID NO: 189133 - protein, 9 aa, Mycobacterium bovis
TDRPGSSKY

SEQ ID NO: 189134 - protein, 7 aa, Mycobacterium bovis
TDRPTQV

SEQ ID NO: 189135 - protein, 18 aa, Mycobacterium bovis
TDRQAARQGVGGEVLAYV

SEQ ID NO: 189136 - protein, 12 aa, Mycobacterium bovis
TDRQRSSSAGGL

SEQ ID NO: 189137 - protein, 9 aa, Mycobacterium bovis
TDRRPEFGH

SEQ ID NO: 189138 - protein, 8 aa, Mycobacterium bovis
TDRRTRQS

SEQ ID NO: 189139 - protein, 9 aa, Mycobacterium bovis
TDRSTRDER

SEQ ID NO: 189140 - protein, 11 aa, Mycobacterium bovis
TDSARARTVGR

SEQ ID NO: 189141 - protein, 7 aa, Mycobacterium bovis
TDSDAVD

SEQ ID NO: 189142 - protein, 10 aa, Mycobacterium bovis
TDSGKIDRAE

SEQ ID NO: 189143 - protein, 9 aa, Mycobacterium bovis
TDSGKSAAR

SEQ ID NO: 189144 - protein, 7 aa, Mycobacterium bovis
TDSGRRA

SEQ ID NO: 189145 - protein, 8 aa, Mycobacterium bovis
TDSKDSTR

SEQ ID NO: 189146 - protein, 4 aa, Mycobacterium bovis
TDSM

SEQ ID NO: 189147 - protein, 8 aa, Mycobacterium bovis
TDSPGAEA

SEQ ID NO: 189148 - protein, 5 aa, Mycobacterium bovis
TDSPR

SEQ ID NO: 189149 - protein, 5 aa, Mycobacterium bovis
TDSQL

SEQ ID NO: 189150 - protein, 7 aa, Mycobacterium bovis
TDTASAY

SEQ ID NO: 189151 - protein, 9 aa, Mycobacterium bovis
TDTATARAE

SEQ ID NO: 189152 - protein, 14 aa, Mycobacterium bovis
TDTDGDGTADGASS

SEQ ID NO: 189153 - protein, 6 aa, Mycobacterium bovis
TDTEAG

SEQ ID NO: 189154 - protein, 4 aa, Mycobacterium bovis
TDTG

SEQ ID NO: 189155 - protein, 21 aa, Mycobacterium bovis
TDTGAAPGLDSLPPAASEAEA

SEQ ID NO: 189156 - protein, 6 aa, Mycobacterium bovis
TDTGQR

SEQ ID NO: 189157 - protein, 6 aa, Mycobacterium bovis
TDTGRQ

SEQ ID NO: 189158 - protein, 5 aa, Mycobacterium bovis
TDTLE

SEQ ID NO: 189159 - protein, 7 aa, Mycobacterium bovis
TDTPPEA

SEQ ID NO: 189160 - protein, 5 aa, Mycobacterium bovis
TDTQR

SEQ ID NO: 189161 - protein, 8 aa, Mycobacterium bovis
TDTTAAQR

SEQ ID NO: 189162 - protein, 5 aa, Mycobacterium bovis
TDVAS

SEQ ID NO: 189163 - protein, 7 aa, Mycobacterium bovis
TDYPAAA

SEQ ID NO: 189164 - protein, 14 aa, Mycobacterium bovis
TDYTAGASSSGSGA

SEQ ID NO: 189165 - protein, 8 aa, Mycobacterium bovis
TDYTPPNK

SEQ ID NO: 189166 - protein, 5 aa, Mycobacterium bovis
TEAAG

SEQ ID NO: 189167 - protein, 5 aa, Mycobacterium bovis
TEAGA

SEQ ID NO: 189168 - protein, 12 aa, Mycobacterium bovis
TEAGASVDPAEL

SEQ ID NO: 189169 - protein, 13 aa, Mycobacterium bovis
TEAGGEPDARYEI

SEQ ID NO: 189170 - protein, 8 aa, Mycobacterium bovis
TEAGRHSG

SEQ ID NO: 189171 - protein, 12 aa, Mycobacterium bovis
TEAGVSEPTLPR

SEQ ID NO: 189172 - protein, 9 aa, Mycobacterium bovis
TEAIGETQI

SEQ ID NO: 189173 - protein, 11 aa, Mycobacterium bovis
TEAKDYQREDL

SEQ ID NO: 189174 - protein, 11 aa, Mycobacterium bovis
TEAKVRGYQPG

SEQ ID NO: 189175 - protein, 6 aa, Mycobacterium bovis
TEALPG

SEQ ID NO: 189176 - protein, 4 aa, Mycobacterium bovis
TEAR

SEQ ID NO: 189177 - protein, 9 aa, Mycobacterium bovis
TEARPAALG

SEQ ID NO: 189178 - protein, 5 aa, Mycobacterium bovis
TEASR

SEQ ID NO: 189179 - protein, 12 aa, Mycobacterium bovis
TEASRRADNPAL

SEQ ID NO: 189180 - protein, 11 aa, Mycobacterium bovis
TEATNHPGGYA

SEQ ID NO: 189181 - protein, 6 aa, Mycobacterium bovis
TEDARV

SEQ ID NO: 189182 - protein, 8 aa, Mycobacterium bovis
TEDATSAM

SEQ ID NO: 189183 - protein, 11 aa, Mycobacterium bovis
TEDDDGNRFSD

SEQ ID NO: 189184 - protein, 5 aa, Mycobacterium bovis
TEDDP

SEQ ID NO: 189185 - protein, 14 aa, Mycobacterium bovis
TEDEAPNTKGGMDK

SEQ ID NO: 189186 - protein, 5 aa, Mycobacterium bovis
TEDKY

SEQ ID NO: 189187 - protein, 7 aa, Mycobacterium bovis
TEDPAAS

SEQ ID NO: 189188 - protein, 9 aa, Mycobacterium bovis
TEDPPTDQI

SEQ ID NO: 189189 - protein, 7 aa, Mycobacterium bovis
TEDQSEG

SEQ ID NO: 189190 - protein, 8 aa, Mycobacterium bovis
TEDRADKG

SEQ ID NO: 189191 - protein, 8 aa, Mycobacterium bovis
TEDTGAAQ

SEQ ID NO: 189192 - protein, 7 aa, Mycobacterium bovis
TEEAREA

SEQ ID NO: 189193 - protein, 6 aa, Mycobacterium bovis
TEEGHT

SEQ ID NO: 189194 - protein, 8 aa, Mycobacterium bovis
TEELEEAS

SEQ ID NO: 189195 - protein, 5 aa, Mycobacterium bovis
TEEPA

SEQ ID NO: 189196 - protein, 5 aa, Mycobacterium bovis
TEEPE

SEQ ID NO: 189197 - protein, 6 aa, Mycobacterium bovis
TEEQKQ

SEQ ID NO: 189198 - protein, 6 aa, Mycobacterium bovis
TEEQRD

SEQ ID NO: 189199 - protein, 8 aa, Mycobacterium bovis
TEETGAQI

SEQ ID NO: 189200 - protein, 4 aa, Mycobacterium bovis
TEEV

SEQ ID NO: 189201 - protein, 15 aa, Mycobacterium bovis
TEEVSGKQARELSDD

SEQ ID NO: 189202 - protein, 6 aa, Mycobacterium bovis
TEFARR

SEQ ID NO: 189203 - protein, 8 aa, Mycobacterium bovis
TEFDTSAP

SEQ ID NO: 189204 - protein, 6 aa, Mycobacterium bovis
TEGADG

SEQ ID NO: 189205 - protein, 10 aa, Mycobacterium bovis
TEGAGGGHAP

SEQ ID NO: 189206 - protein, 4 aa, Mycobacterium bovis
TEGL

SEQ ID NO: 189207 - protein, 12 aa, Mycobacterium bovis
TEGPATPPQTPT

SEQ ID NO: 189208 - protein, 4 aa, Mycobacterium bovis
TEGV

SEQ ID NO: 189209 - protein, 8 aa, Mycobacterium bovis
TEHTPDGE

SEQ ID NO: 189210 - protein, 9 aa, Mycobacterium bovis
TEKAASKAI

SEQ ID NO: 189211 - protein, 9 aa, Mycobacterium bovis
TEKGSQRHA

SEQ ID NO: 189212 - protein, 8 aa, Mycobacterium bovis
TEKQAASW

SEQ ID NO: 189213 - protein, 26 aa, Mycobacterium bovis
TEKQGGSDVRAGTTQATPNADGSYSL

SEQ ID NO: 189214 - protein, 11 aa, Mycobacterium bovis
TELAEHDQSDH

SEQ ID NO: 189215 - protein, 14 aa, Mycobacterium bovis
TELDAESPQGRRLE

SEQ ID NO: 189216 - protein, 6 aa, Mycobacterium bovis
TELGNP

SEQ ID NO: 189217 - protein, 5 aa, Mycobacterium bovis
TELPA

SEQ ID NO: 189218 - protein, 26 aa, Mycobacterium bovis
TELSRRGGQNVYSPAAETTVTAVASY

SEQ ID NO: 189219 - protein, 4 aa, Mycobacterium bovis
TEMP

SEQ ID NO: 189220 - protein, 4 aa, Mycobacterium bovis
TENE

SEQ ID NO: 189221 - protein, 6 aa, Mycobacterium bovis
TENPAG

SEQ ID NO: 189222 - protein, 7 aa, Mycobacterium bovis
TENSHGI

SEQ ID NO: 189223 - protein, 5 aa, Mycobacterium bovis
TEPAA

SEQ ID NO: 189224 - protein, 7 aa, Mycobacterium bovis
TEPAPVT

SEQ ID NO: 189225 - protein, 9 aa, Mycobacterium bovis
TEPEAGTDL

SEQ ID NO: 189226 - protein, 5 aa, Mycobacterium bovis
TEPEQ

SEQ ID NO: 189227 - protein, 19 aa, Mycobacterium bovis
TEPGAGSDAGSTRTTARLE

SEQ ID NO: 189228 - protein, 13 aa, Mycobacterium bovis
TEPGGGSDLQNMS

SEQ ID NO: 189229 - protein, 10 aa, Mycobacterium bovis
TEPGGGSDVG

SEQ ID NO: 189230 - protein, 17 aa, Mycobacterium bovis
TEPGSGVRAQRDDLSAS

SEQ ID NO: 189231 - protein, 13 aa, Mycobacterium bovis
TEPGTGSDLQGIT

SEQ ID NO: 189232 - protein, 4 aa, Mycobacterium bovis
TEPI

SEQ ID NO: 189233 - protein, 5 aa, Mycobacterium bovis
TEPIP

SEQ ID NO: 189234 - protein, 28 aa, Mycobacterium bovis
TEPLPPPAPPPTTPTVTTPTVATATTAG

SEQ ID NO: 189235 - protein, 5 aa, Mycobacterium bovis
TEPNH

SEQ ID NO: 189236 - protein, 9 aa, Mycobacterium bovis
TEPPPTAGS

SEQ ID NO: 189237 - protein, 32 aa, Mycobacterium bovis
TEPPQTTNHGQLGAQSSAVAQTAATAAGGNLQ

SEQ ID NO: 189238 - protein, 10 aa, Mycobacterium bovis
TEPQGGSDPG

SEQ ID NO: 189239 - protein, 6 aa, Mycobacterium bovis
TEPQTV

SEQ ID NO: 189240 - protein, 5 aa, Mycobacterium bovis
TEPRK

SEQ ID NO: 189241 - protein, 6 aa, Mycobacterium bovis
TEPSAD

SEQ ID NO: 189242 - protein, 4 aa, Mycobacterium bovis
TEPV

SEQ ID NO: 189243 - protein, 11 aa, Mycobacterium bovis
TEQEADRALKA

SEQ ID NO: 189244 - protein, 5 aa, Mycobacterium bovis
TEQRN

SEQ ID NO: 189245 - protein, 7 aa, Mycobacterium bovis
TEQTGGL

SEQ ID NO: 189246 - protein, 6 aa, Mycobacterium bovis
TEQVPE

SEQ ID NO: 189247 - protein, 6 aa, Mycobacterium bovis
TERAPI

SEQ ID NO: 189248 - protein, 6 aa, Mycobacterium bovis
TERATA

SEQ ID NO: 189249 - protein, 25 aa, Mycobacterium bovis
TERGATRADDRISEAGMEDRKRQGY

SEQ ID NO: 189250 - protein, 12 aa, Mycobacterium bovis
TERGSDYAGSLP

SEQ ID NO: 189251 - protein, 4 aa, Mycobacterium bovis
TERP

SEQ ID NO: 189252 - protein, 9 aa, Mycobacterium bovis
TERPEEDSF

SEQ ID NO: 189253 - protein, 4 aa, Mycobacterium bovis
TERQ

SEQ ID NO: 189254 - protein, 5 aa, Mycobacterium bovis
TERQR

SEQ ID NO: 189255 - protein, 5 aa, Mycobacterium bovis
TERTA

SEQ ID NO: 189256 - protein, 4 aa, Mycobacterium bovis
TERV

SEQ ID NO: 189257 - protein, 11 aa, Mycobacterium bovis
TERVSTPGENL

SEQ ID NO: 189258 - protein, 4 aa, Mycobacterium bovis
TESG

SEQ ID NO: 189259 - protein, 7 aa, Mycobacterium bovis
TESGPFR

SEQ ID NO: 189260 - protein, 8 aa, Mycobacterium bovis
TESPELSA

SEQ ID NO: 189261 - protein, 7 aa, Mycobacterium bovis
TETADEW

SEQ ID NO: 189262 - protein, 8 aa, Mycobacterium bovis
TETAGHDR

SEQ ID NO: 189263 - protein, 7 aa, Mycobacterium bovis
TETAKRL

SEQ ID NO: 189264 - protein, 8 aa, Mycobacterium bovis
TETGARGL

SEQ ID NO: 189265 - protein, 9 aa, Mycobacterium bovis
TETGETHTI

SEQ ID NO: 189266 - protein, 5 aa, Mycobacterium bovis
TETGS

SEQ ID NO: 189267 - protein, 8 aa, Mycobacterium bovis
TETGSSLA

SEQ ID NO: 189268 - protein, 10 aa, Mycobacterium bovis
TETKASEGVI

SEQ ID NO: 189269 - protein, 6 aa, Mycobacterium bovis
TETKSP

SEQ ID NO: 189270 - protein, 4 aa, Mycobacterium bovis
TETL

SEQ ID NO: 189271 - protein, 8 aa, Mycobacterium bovis
TEVPTGEQ

SEQ ID NO: 189272 - protein, 5 aa, Mycobacterium bovis
TEVTA

SEQ ID NO: 189273 - protein, 4 aa, Mycobacterium bovis
TEWA

SEQ ID NO: 189274 - protein, 10 aa, Mycobacterium bovis
TEYGGGGLSP

SEQ ID NO: 189275 - protein, 10 aa, Mycobacterium bovis
TFADPSALDG

SEQ ID NO: 189276 - protein, 14 aa, Mycobacterium bovis
TFDAEGSRKKLPSV

SEQ ID NO: 189277 - protein, 6 aa, Mycobacterium bovis
TFDGSA

SEQ ID NO: 189278 - protein, 7 aa, Mycobacterium bovis
TFDSGDP

SEQ ID NO: 189279 - protein, 8 aa, Mycobacterium bovis
TFDSGDPE

SEQ ID NO: 189280 - protein, 4 aa, Mycobacterium bovis
TFEH

SEQ ID NO: 189281 - protein, 4 aa, Mycobacterium bovis
TFGA

SEQ ID NO: 189282 - protein, 9 aa, Mycobacterium bovis
TFGGEPNTQ

SEQ ID NO: 189283 - protein, 10 aa, Mycobacterium bovis
TFGPYSPGQA

SEQ ID NO: 189284 - protein, 11 aa, Mycobacterium bovis
TFGSRQEEAQR

SEQ ID NO: 189285 - protein, 5 aa, Mycobacterium bovis
TFGST

SEQ ID NO: 189286 - protein, 15 aa, Mycobacterium bovis
TFPDGTKLVTVHQPI

SEQ ID NO: 189287 - protein, 9 aa, Mycobacterium bovis
TFPSSSPDE

SEQ ID NO: 189288 - protein, 14 aa, Mycobacterium bovis
TFPTNSQLTNESAA

SEQ ID NO: 189289 - protein, 4 aa, Mycobacterium bovis
TFQQ

SEQ ID NO: 189290 - protein, 6 aa, Mycobacterium bovis
TFTAPA

SEQ ID NO: 189291 - protein, 12 aa, Mycobacterium bovis
TFTSDTTREALR

SEQ ID NO: 189292 - protein, 15 aa, Mycobacterium bovis
TFTTGYSGVGGNMPQ

SEQ ID NO: 189293 - protein, 7 aa, Mycobacterium bovis
TGAADGY

SEQ ID NO: 189294 - protein, 8 aa, Mycobacterium bovis
TGAAKPGD

SEQ ID NO: 189295 - protein, 8 aa, Mycobacterium bovis
TGAAQAAA

SEQ ID NO: 189296 - protein, 7 aa, Mycobacterium bovis
TGAAQGC

SEQ ID NO: 189297 - protein, 7 aa, Mycobacterium bovis
TGAAQRA

SEQ ID NO: 189298 - protein, 16 aa, Mycobacterium bovis
TGAATSVQRDRGSRSR

SEQ ID NO: 189299 - protein, 8 aa, Mycobacterium bovis
TGADLSAA

SEQ ID NO: 189300 - protein, 9 aa, Mycobacterium bovis
TGADTDPTV

SEQ ID NO: 189301 - protein, 4 aa, Mycobacterium bovis
TGAE

SEQ ID NO: 189302 - protein, 6 aa, Mycobacterium bovis
TGAEEA

SEQ ID NO: 189303 - protein, 9 aa, Mycobacterium bovis
TGAEGPRGV

SEQ ID NO: 189304 - protein, 6 aa, Mycobacterium bovis
TGAEHP

SEQ ID NO: 189305 - protein, 13 aa, Mycobacterium bovis
TGAGAPDPDSPEL

SEQ ID NO: 189306 - protein, 16 aa, Mycobacterium bovis
TGAGGASGFGNFGGAN

SEQ ID NO: 189307 - protein, 11 aa, Mycobacterium bovis
TGAGGGSGFGN

SEQ ID NO: 189308 - protein, 16 aa, Mycobacterium bovis
TGAGGGSGFSNTGAGM

SEQ ID NO: 189309 - protein, 12 aa, Mycobacterium bovis
TGAGGGSGIGNL

SEQ ID NO: 189310 - protein, 11 aa, Mycobacterium bovis
TGAGQAALPGA

SEQ ID NO: 189311 - protein, 9 aa, Mycobacterium bovis
TGAGSDEDL

SEQ ID NO: 189312 - protein, 18 aa, Mycobacterium bovis
TGAGTASGFGNVGGNTSG

SEQ ID NO: 189313 - protein, 6 aa, Mycobacterium bovis
TGAKND

SEQ ID NO: 189314 - protein, 12 aa, Mycobacterium bovis
TGAKTSQPRTTS

SEQ ID NO: 189315 - protein, 16 aa, Mycobacterium bovis
TGANAAGATDAGATDA

SEQ ID NO: 189316 - protein, 13 aa, Mycobacterium bovis
TGAPDAGAQGDDG

SEQ ID NO: 189317 - protein, 7 aa, Mycobacterium bovis
TGAPGYS

SEQ ID NO: 189318 - protein, 5 aa, Mycobacterium bovis
TGAQQ

SEQ ID NO: 189319 - protein, 5 aa, Mycobacterium bovis
TGAQT

SEQ ID NO: 189320 - protein, 27 aa, Mycobacterium bovis
TGARGGDVVTGDGPYEAADLDEQGPFP

SEQ ID NO: 189321 - protein, 5 aa, Mycobacterium bovis
TGAST

SEQ ID NO: 189322 - protein, 10 aa, Mycobacterium bovis
TGAYDDADPV

SEQ ID NO: 189323 - protein, 8 aa, Mycobacterium bovis
TGCAGEPQ

SEQ ID NO: 189324 - protein, 5 aa, Mycobacterium bovis
TGCHQ

SEQ ID NO: 189325 - protein, 4 aa, Mycobacterium bovis
TGCR

SEQ ID NO: 189326 - protein, 14 aa, Mycobacterium bovis
TGDAAAGERTPEQT

SEQ ID NO: 189327 - protein, 5 aa, Mycobacterium bovis
TGDAT

SEQ ID NO: 189328 - protein, 14 aa, Mycobacterium bovis
TGDDAERSDEKERR

SEQ ID NO: 189329 - protein, 10 aa, Mycobacterium bovis
TGDDGRPSKV

SEQ ID NO: 189330 - protein, 11 aa, Mycobacterium bovis
TGDDGTTGLSD

SEQ ID NO: 189331 - protein, 6 aa, Mycobacterium bovis
TGDEQR

SEQ ID NO: 189332 - protein, 13 aa, Mycobacterium bovis
TGDFNTGSSNTGF

SEQ ID NO: 189333 - protein, 11 aa, Mycobacterium bovis
TGDISNASPLD

SEQ ID NO: 189334 - protein, 5 aa, Mycobacterium bovis
TGDMT

SEQ ID NO: 189335 - protein, 17 aa, Mycobacterium bovis
TGDNQSGIGGLNSGTGN

SEQ ID NO: 189336 - protein, 26 aa, Mycobacterium bovis
TGDPCSPNSAASGKYGERPASVSTGD

SEQ ID NO: 189337 - protein, 7 aa, Mycobacterium bovis
TGDPEAF

SEQ ID NO: 189338 - protein, 21 aa, Mycobacterium bovis
TGDPLRDASGRVRRVPDGEPG

SEQ ID NO: 189339 - protein, 4 aa, Mycobacterium bovis
TGDQ

SEQ ID NO: 189340 - protein, 7 aa, Mycobacterium bovis
TGDQLQG

SEQ ID NO: 189341 - protein, 7 aa, Mycobacterium bovis
TGDRSAQ

SEQ ID NO: 189342 - protein, 6 aa, Mycobacterium bovis
TGDSDV

SEQ ID NO: 189343 - protein, 5 aa, Mycobacterium bovis
TGDSE

SEQ ID NO: 189344 - protein, 12 aa, Mycobacterium bovis
TGDSNGKAPTAV

SEQ ID NO: 189345 - protein, 8 aa, Mycobacterium bovis
TGDSNLGI

SEQ ID NO: 189346 - protein, 6 aa, Mycobacterium bovis
TGDTAT

SEQ ID NO: 189347 - protein, 7 aa, Mycobacterium bovis
TGDVNTG

SEQ ID NO: 189348 - protein, 7 aa, Mycobacterium bovis
TGDYNTG

SEQ ID NO: 189349 - protein, 15 aa, Mycobacterium bovis
TGDYNTGMANTGNIN

SEQ ID NO: 189350 - protein, 16 aa, Mycobacterium bovis
TGDYNTGVANTGNVNT

SEQ ID NO: 189351 - protein, 9 aa, Mycobacterium bovis
TGDYQEPGL

SEQ ID NO: 189352 - protein, 4 aa, Mycobacterium bovis
TGEA

SEQ ID NO: 189353 - protein, 4 aa, Mycobacterium bovis
TGED

SEQ ID NO: 189354 - protein, 4 aa, Mycobacterium bovis
TGEE

SEQ ID NO: 189355 - protein, 10 aa, Mycobacterium bovis
TGEEDRPGAV

SEQ ID NO: 189356 - protein, 14 aa, Mycobacterium bovis
TGEEELQSSEAKVG

SEQ ID NO: 189357 - protein, 5 aa, Mycobacterium bovis
TGEEF

SEQ ID NO: 189358 - protein, 13 aa, Mycobacterium bovis
TGEESDDESLGGA

SEQ ID NO: 189359 - protein, 5 aa, Mycobacterium bovis
TGEEY

SEQ ID NO: 189360 - protein, 11 aa, Mycobacterium bovis
TGEGKGKSTAA

SEQ ID NO: 189361 - protein, 8 aa, Mycobacterium bovis
TGEGKTLA

SEQ ID NO: 189362 - protein, 12 aa, Mycobacterium bovis
TGEGRKDTVTAR

SEQ ID NO: 189363 - protein, 9 aa, Mycobacterium bovis
TGEGTTGLG

SEQ ID NO: 189364 - protein, 5 aa, Mycobacterium bovis
TGEKL

SEQ ID NO: 189365 - protein, 4 aa, Mycobacterium bovis
TGEL

SEQ ID NO: 189366 - protein, 4 aa, Mycobacterium bovis
TGEP

SEQ ID NO: 189367 - protein, 12 aa, Mycobacterium bovis
TGEPARSVCSAA

SEQ ID NO: 189368 - protein, 8 aa, Mycobacterium bovis
TGEPGERN

SEQ ID NO: 189369 - protein, 6 aa, Mycobacterium bovis
TGEPIL

SEQ ID NO: 189370 - protein, 11 aa, Mycobacterium bovis
TGEQSEAARRS

SEQ ID NO: 189371 - protein, 7 aa, Mycobacterium bovis
TGERGSG

SEQ ID NO: 189372 - protein, 8 aa, Mycobacterium bovis
TGESGGQL

SEQ ID NO: 189373 - protein, 7 aa, Mycobacterium bovis
TGETTTG

SEQ ID NO: 189374 - protein, 4 aa, Mycobacterium bovis
TGFA

SEQ ID NO: 189375 - protein, 10 aa, Mycobacterium bovis
TGFANQGDIA

SEQ ID NO: 189376 - protein, 24 aa, Mycobacterium bovis
TGFGNSGQANTGIGNAGDFNTGNF

SEQ ID NO: 189377 - protein, 5 aa, Mycobacterium bovis
TGFPE

SEQ ID NO: 189378 - protein, 6 aa, Mycobacterium bovis
TGFTEA

SEQ ID NO: 189379 - protein, 7 aa, Mycobacterium bovis
TGFTPGK

SEQ ID NO: 189380 - protein, 24 aa, Mycobacterium bovis
TGGAGGAGGVGTAGAGGAGGAGGS

SEQ ID NO: 189381 - protein, 72 aa, Mycobacterium bovis
TGGAGGDGGVGGDGGIGAQGGSGGNGGNGGIGADGMANQDGDGGDGGNGGDGGAGGAGGVGGNGGTGGAGGL

SEQ ID NO: 189382 - protein, 15 aa, Mycobacterium bovis
TGGAGVQGRTADVSR

SEQ ID NO: 189383 - protein, 6 aa, Mycobacterium bovis
TGGAQG

SEQ ID NO: 189384 - protein, 9 aa, Mycobacterium bovis
TGGASGIGL

SEQ ID NO: 189385 - protein, 6 aa, Mycobacterium bovis
TGGATN

SEQ ID NO: 189386 - protein, 5 aa, Mycobacterium bovis
TGGCP

SEQ ID NO: 189387 - protein, 9 aa, Mycobacterium bovis
TGGDATRIS

SEQ ID NO: 189388 - protein, 31 aa, Mycobacterium bovis
TGGDGGDGVPPAPGGQGGKGGLIGLPGQNGQ

SEQ ID NO: 189389 - protein, 4 aa, Mycobacterium bovis
TGGE

SEQ ID NO: 189390 - protein, 8 aa, Mycobacterium bovis
TGGENTTS

SEQ ID NO: 189391 - protein, 5 aa, Mycobacterium bovis
TGGEP

SEQ ID NO: 189392 - protein, 5 aa, Mycobacterium bovis
TGGET

SEQ ID NO: 189393 - protein, 4 aa, Mycobacterium bovis
TGGF

SEQ ID NO: 189394 - protein, 6 aa, Mycobacterium bovis
TGGFTP

SEQ ID NO: 189395 - protein, 11 aa, Mycobacterium bovis
TGGGDTSPGAA

SEQ ID NO: 189396 - protein, 8 aa, Mycobacterium bovis
TGGGRGLG

SEQ ID NO: 189397 - protein, 8 aa, Mycobacterium bovis
TGGGSGIG

SEQ ID NO: 189398 - protein, 6 aa, Mycobacterium bovis
TGGHLG

SEQ ID NO: 189399 - protein, 6 aa, Mycobacterium bovis
TGGKHR

SEQ ID NO: 189400 - protein, 6 aa, Mycobacterium bovis
TGGKPY

SEQ ID NO: 189401 - protein, 4 aa, Mycobacterium bovis
TGGN

SEQ ID NO: 189402 - protein, 25 aa, Mycobacterium bovis
TGGNGGTGGIATGAGGIGGAGGAGG

SEQ ID NO: 189403 - protein, 11 aa, Mycobacterium bovis
TGGPGTGKTTT

SEQ ID NO: 189404 - protein, 8 aa, Mycobacterium bovis
TGGPSSGF

SEQ ID NO: 189405 - protein, 5 aa, Mycobacterium bovis
TGGPV

SEQ ID NO: 189406 - protein, 4 aa, Mycobacterium bovis
TGGQ

SEQ ID NO: 189407 - protein, 11 aa, Mycobacterium bovis
TGGQPPSEAQV

SEQ ID NO: 189408 - protein, 4 aa, Mycobacterium bovis
TGGS

SEQ ID NO: 189409 - protein, 19 aa, Mycobacterium bovis
TGGSGRMYKTTSNAHTLTG

SEQ ID NO: 189410 - protein, 6 aa, Mycobacterium bovis
TGGTGK

SEQ ID NO: 189411 - protein, 5 aa, Mycobacterium bovis
TGGTI

SEQ ID NO: 189412 - protein, 7 aa, Mycobacterium bovis
TGGTIGA

SEQ ID NO: 189413 - protein, 5 aa, Mycobacterium bovis
TGGTR

SEQ ID NO: 189414 - protein, 14 aa, Mycobacterium bovis
TGGTTGKPKGVIGT

SEQ ID NO: 189415 - protein, 12 aa, Mycobacterium bovis
TGHAQRPGDPTL

SEQ ID NO: 189416 - protein, 7 aa, Mycobacterium bovis
TGHEGAE

SEQ ID NO: 189417 - protein, 20 aa, Mycobacterium bovis
TGHEGGAGTVHANNPGEVPA

SEQ ID NO: 189418 - protein, 6 aa, Mycobacterium bovis
TGHEPI

SEQ ID NO: 189419 - protein, 10 aa, Mycobacterium bovis
TGHGDSTTIG

SEQ ID NO: 189420 - protein, 9 aa, Mycobacterium bovis
TGHPDSPEE

SEQ ID NO: 189421 - protein, 6 aa, Mycobacterium bovis
TGHRAN

SEQ ID NO: 189422 - protein, 5 aa, Mycobacterium bovis
TGHTT

SEQ ID NO: 189423 - protein, 13 aa, Mycobacterium bovis
TGIANPGSYNTGS

SEQ ID NO: 189424 - protein, 11 aa, Mycobacterium bovis
TGIANTGDVDT

SEQ ID NO: 189425 - protein, 14 aa, Mycobacterium bovis
TGIDPTKLRGSATG

SEQ ID NO: 189426 - protein, 12 aa, Mycobacterium bovis
TGIEPEKTTPAH

SEQ ID NO: 189427 - protein, 11 aa, Mycobacterium bovis
TGIGNSGDYNT

SEQ ID NO: 189428 - protein, 8 aa, Mycobacterium bovis
TGISKSEV

SEQ ID NO: 189429 - protein, 14 aa, Mycobacterium bovis
TGKAHGAALGDDEV

SEQ ID NO: 189430 - protein, 10 aa, Mycobacterium bovis
TGKAPPAARA

SEQ ID NO: 189431 - protein, 4 aa, Mycobacterium bovis
TGKE

SEQ ID NO: 189432 - protein, 5 aa, Mycobacterium bovis
TGKLA

SEQ ID NO: 189433 - protein, 6 aa, Mycobacterium bovis
TGKLER

SEQ ID NO: 189434 - protein, 4 aa, Mycobacterium bovis
TGKN

SEQ ID NO: 189435 - protein, 15 aa, Mycobacterium bovis
TGKPAELDRDEPRRV

SEQ ID NO: 189436 - protein, 8 aa, Mycobacterium bovis
TGKPGKHK

SEQ ID NO: 189437 - protein, 10 aa, Mycobacterium bovis
TGKPPHGPAA

SEQ ID NO: 189438 - protein, 10 aa, Mycobacterium bovis
TGKPTPAGYA

SEQ ID NO: 189439 - protein, 13 aa, Mycobacterium bovis
TGKRESKSRPGEG

SEQ ID NO: 189440 - protein, 4 aa, Mycobacterium bovis
TGKV

SEQ ID NO: 189441 - protein, 4 aa, Mycobacterium bovis
TGLA

SEQ ID NO: 189442 - protein, 7 aa, Mycobacterium bovis
TGLAEEN

SEQ ID NO: 189443 - protein, 13 aa, Mycobacterium bovis
TGLANAGSYNTGS

SEQ ID NO: 189444 - protein, 8 aa, Mycobacterium bovis
TGLGAQAG

SEQ ID NO: 189445 - protein, 12 aa, Mycobacterium bovis
TGLNRNGVGPAQ

SEQ ID NO: 189446 - protein, 22 aa, Mycobacterium bovis
TGLNTKQVGASRNSFKHYVATA

SEQ ID NO: 189447 - protein, 4 aa, Mycobacterium bovis
TGLQ

SEQ ID NO: 189448 - protein, 9 aa, Mycobacterium bovis
TGLRAGRNG

SEQ ID NO: 189449 - protein, 6 aa, Mycobacterium bovis
TGLREH

SEQ ID NO: 189450 - protein, 5 aa, Mycobacterium bovis
TGLTD

SEQ ID NO: 189451 - protein, 8 aa, Mycobacterium bovis
TGMAPQPR

SEQ ID NO: 189452 - protein, 5 aa, Mycobacterium bovis
TGMGR

SEQ ID NO: 189453 - protein, 8 aa, Mycobacterium bovis
TGMGRSTA

SEQ ID NO: 189454 - protein, 20 aa, Mycobacterium bovis
TGMIGDPRDVGERSLNEADT

SEQ ID NO: 189455 - protein, 6 aa, Mycobacterium bovis
TGMTDE

SEQ ID NO: 189456 - protein, 18 aa, Mycobacterium bovis
TGMTTGTPAAAGAQALSA

SEQ ID NO: 189457 - protein, 7 aa, Mycobacterium bovis
TGNAPLT

SEQ ID NO: 189458 - protein, 6 aa, Mycobacterium bovis
TGNDGD

SEQ ID NO: 189459 - protein, 8 aa, Mycobacterium bovis
TGNESPAE

SEQ ID NO: 189460 - protein, 5 aa, Mycobacterium bovis
TGNFG

SEQ ID NO: 189461 - protein, 32 aa, Mycobacterium bovis
TGNGGTGGAGGTGTGNQLVGGEGGAGGAGGNA

SEQ ID NO: 189462 - protein, 6 aa, Mycobacterium bovis
TGNGQI

SEQ ID NO: 189463 - protein, 14 aa, Mycobacterium bovis
TGNNTYKAVQRSAG

SEQ ID NO: 189464 - protein, 10 aa, Mycobacterium bovis
TGNPNRPDGG

SEQ ID NO: 189465 - protein, 6 aa, Mycobacterium bovis
TGNTEE

SEQ ID NO: 189466 - protein, 5 aa, Mycobacterium bovis
TGNTH

SEQ ID NO: 189467 - protein, 17 aa, Mycobacterium bovis
TGNTNTGIANSGNVNTG

SEQ ID NO: 189468 - protein, 10 aa, Mycobacterium bovis
TGNYNSKTAR

SEQ ID NO: 189469 - protein, 6 aa, Mycobacterium bovis
TGPAEM

SEQ ID NO: 189470 - protein, 4 aa, Mycobacterium bovis
TGPD

SEQ ID NO: 189471 - protein, 5 aa, Mycobacterium bovis
TGPDD

SEQ ID NO: 189472 - protein, 8 aa, Mycobacterium bovis
TGPDGMGK

SEQ ID NO: 189473 - protein, 7 aa, Mycobacterium bovis
TGPDGQP

SEQ ID NO: 189474 - protein, 6 aa, Mycobacterium bovis
TGPEAE

SEQ ID NO: 189475 - protein, 10 aa, Mycobacterium bovis
TGPEVTGPGE

SEQ ID NO: 189476 - protein, 9 aa, Mycobacterium bovis
TGPFPPTTF

SEQ ID NO: 189477 - protein, 11 aa, Mycobacterium bovis
TGPGDVPPQNI

SEQ ID NO: 189478 - protein, 6 aa, Mycobacterium bovis
TGPGES

SEQ ID NO: 189479 - protein, 7 aa, Mycobacterium bovis
TGPGGER

SEQ ID NO: 189480 - protein, 10 aa, Mycobacterium bovis
TGPGPGTTGE

SEQ ID NO: 189481 - protein, 5 aa, Mycobacterium bovis
TGPGQ

SEQ ID NO: 189482 - protein, 6 aa, Mycobacterium bovis
TGPHAL

SEQ ID NO: 189483 - protein, 4 aa, Mycobacterium bovis
TGPI

SEQ ID NO: 189484 - protein, 13 aa, Mycobacterium bovis
TGPPVELADATHR

SEQ ID NO: 189485 - protein, 10 aa, Mycobacterium bovis
TGPQRSTVKA

SEQ ID NO: 189486 - protein, 5 aa, Mycobacterium bovis
TGPTV

SEQ ID NO: 189487 - protein, 4 aa, Mycobacterium bovis
TGPV

SEQ ID NO: 189488 - protein, 15 aa, Mycobacterium bovis
TGPVPGARVVSAPTE

SEQ ID NO: 189489 - protein, 8 aa, Mycobacterium bovis
TGPWTGPA

SEQ ID NO: 189490 - protein, 4 aa, Mycobacterium bovis
TGPY

SEQ ID NO: 189491 - protein, 7 aa, Mycobacterium bovis
TGPYTDE

SEQ ID NO: 189492 - protein, 11 aa, Mycobacterium bovis
TGQADDVDGIP

SEQ ID NO: 189493 - protein, 8 aa, Mycobacterium bovis
TGQAGELP

SEQ ID NO: 189494 - protein, 8 aa, Mycobacterium bovis
TGQAPAAY

SEQ ID NO: 189495 - protein, 15 aa, Mycobacterium bovis
TGQAPPGPPASGPCA

SEQ ID NO: 189496 - protein, 11 aa, Mycobacterium bovis
TGQEESRRDGI

SEQ ID NO: 189497 - protein, 8 aa, Mycobacterium bovis
TGQGEGDV

SEQ ID NO: 189498 - protein, 5 aa, Mycobacterium bovis
TGQGG

SEQ ID NO: 189499 - protein, 5 aa, Mycobacterium bovis
TGQGY

SEQ ID NO: 189500 - protein, 7 aa, Mycobacterium bovis
TGQHHGP

SEQ ID NO: 189501 - protein, 4 aa, Mycobacterium bovis
TGQP

SEQ ID NO: 189502 - protein, 10 aa, Mycobacterium bovis
TGQPAEAAQP

SEQ ID NO: 189503 - protein, 7 aa, Mycobacterium bovis
TGQPRAV

SEQ ID NO: 189504 - protein, 10 aa, Mycobacterium bovis
TGQRSRGPSK

SEQ ID NO: 189505 - protein, 6 aa, Mycobacterium bovis
TGQSDF

SEQ ID NO: 189506 - protein, 32 aa, Mycobacterium bovis
TGRAFRSPVEPGSGWPGDPATPQTPVAADAAQ

SEQ ID NO: 189507 - protein, 10 aa, Mycobacterium bovis
TGRDAAVPTP

SEQ ID NO: 189508 - protein, 17 aa, Mycobacterium bovis
TGRDGASGVRRLTSEDR

SEQ ID NO: 189509 - protein, 10 aa, Mycobacterium bovis
TGRDPTQPRD

SEQ ID NO: 189510 - protein, 8 aa, Mycobacterium bovis
TGREADDL

SEQ ID NO: 189511 - protein, 15 aa, Mycobacterium bovis
TGRGHRIGAPDETNF

SEQ ID NO: 189512 - protein, 30 aa, Mycobacterium bovis
TGRHRRSAAQANSPSEQVRPAPKPLELSSS

SEQ ID NO: 189513 - protein, 9 aa, Mycobacterium bovis
TGRPPGAEA

SEQ ID NO: 189514 - protein, 5 aa, Mycobacterium bovis
TGRPY

SEQ ID NO: 189515 - protein, 6 aa, Mycobacterium bovis
TGRPYQ

SEQ ID NO: 189516 - protein, 6 aa, Mycobacterium bovis
TGRRRP

SEQ ID NO: 189517 - protein, 4 aa, Mycobacterium bovis
TGRS

SEQ ID NO: 189518 - protein, 12 aa, Mycobacterium bovis
TGRSGPGAGRTA

SEQ ID NO: 189519 - protein, 6 aa, Mycobacterium bovis
TGRWRN

SEQ ID NO: 189520 - protein, 5 aa, Mycobacterium bovis
TGRYS

SEQ ID NO: 189521 - protein, 6 aa, Mycobacterium bovis
TGSAGA

SEQ ID NO: 189522 - protein, 9 aa, Mycobacterium bovis
TGSDEDISR

SEQ ID NO: 189523 - protein, 7 aa, Mycobacterium bovis
TGSEATV

SEQ ID NO: 189524 - protein, 7 aa, Mycobacterium bovis
TGSEPVR

SEQ ID NO: 189525 - protein, 4 aa, Mycobacterium bovis
TGSF

SEQ ID NO: 189526 - protein, 5 aa, Mycobacterium bovis
TGSGA

SEQ ID NO: 189527 - protein, 6 aa, Mycobacterium bovis
TGSGAD

SEQ ID NO: 189528 - protein, 8 aa, Mycobacterium bovis
TGSGADAD

SEQ ID NO: 189529 - protein, 9 aa, Mycobacterium bovis
TGSGAPTAN

SEQ ID NO: 189530 - protein, 18 aa, Mycobacterium bovis
TGSGDPQKFDPDASRETL

SEQ ID NO: 189531 - protein, 10 aa, Mycobacterium bovis
TGSGKGGTKY

SEQ ID NO: 189532 - protein, 12 aa, Mycobacterium bovis
TGSGTSSNMNTN

SEQ ID NO: 189533 - protein, 7 aa, Mycobacterium bovis
TGSIGTQ

SEQ ID NO: 189534 - protein, 9 aa, Mycobacterium bovis
TGSNPKAKR

SEQ ID NO: 189535 - protein, 10 aa, Mycobacterium bovis
TGSPADPATL

SEQ ID NO: 189536 - protein, 8 aa, Mycobacterium bovis
TGSPGCAH

SEQ ID NO: 189537 - protein, 10 aa, Mycobacterium bovis
TGSPRIGPRR

SEQ ID NO: 189538 - protein, 8 aa, Mycobacterium bovis
TGSSLSDL

SEQ ID NO: 189539 - protein, 9 aa, Mycobacterium bovis
TGSTTHGAR

SEQ ID NO: 189540 - protein, 9 aa, Mycobacterium bovis
TGSVQPARV

SEQ ID NO: 189541 - protein, 5 aa, Mycobacterium bovis
TGSYE

SEQ ID NO: 189542 - protein, 9 aa, Mycobacterium bovis
TGSYNTGGF

SEQ ID NO: 189543 - protein, 18 aa, Mycobacterium bovis
TGSYNTGLANSGDVNTGG

SEQ ID NO: 189544 - protein, 22 aa, Mycobacterium bovis
TGTAPSSEHKDAVKRAATSTWP

SEQ ID NO: 189545 - protein, 5 aa, Mycobacterium bovis
TGTAS

SEQ ID NO: 189546 - protein, 6 aa, Mycobacterium bovis
TGTDEL

SEQ ID NO: 189547 - protein, 7 aa, Mycobacterium bovis
TGTDKPG

SEQ ID NO: 189548 - protein, 15 aa, Mycobacterium bovis
TGTESIESVKHSDGS

SEQ ID NO: 189549 - protein, 13 aa, Mycobacterium bovis
TGTGKTSNKTGNG

SEQ ID NO: 189550 - protein, 11 aa, Mycobacterium bovis
TGTGNSLNARH

SEQ ID NO: 189551 - protein, 16 aa, Mycobacterium bovis
TGTMEASSRGASDADG

SEQ ID NO: 189552 - protein, 15 aa, Mycobacterium bovis
TGTPKSDRTGTGTRS

SEQ ID NO: 189553 - protein, 9 aa, Mycobacterium bovis
TGTPSGAAG

SEQ ID NO: 189554 - protein, 9 aa, Mycobacterium bovis
TGTQGEPMS

SEQ ID NO: 189555 - protein, 9 aa, Mycobacterium bovis
TGTREYGRT

SEQ ID NO: 189556 - protein, 8 aa, Mycobacterium bovis
TGTRNTGA

SEQ ID NO: 189557 - protein, 4 aa, Mycobacterium bovis
TGTS

SEQ ID NO: 189558 - protein, 9 aa, Mycobacterium bovis
TGTSAQLDT

SEQ ID NO: 189559 - protein, 10 aa, Mycobacterium bovis
TGTSGKTTTT

SEQ ID NO: 189560 - protein, 4 aa, Mycobacterium bovis
TGTT

SEQ ID NO: 189561 - protein, 5 aa, Mycobacterium bovis
TGTTH

SEQ ID NO: 189562 - protein, 8 aa, Mycobacterium bovis
TGTTVSPP

SEQ ID NO: 189563 - protein, 10 aa, Mycobacterium bovis
TGTVTAASEW

SEQ ID NO: 189564 - protein, 20 aa, Mycobacterium bovis
TGTWSTEGAYDEQDYAETEQ

SEQ ID NO: 189565 - protein, 6 aa, Mycobacterium bovis
TGVDDA

SEQ ID NO: 189566 - protein, 14 aa, Mycobacterium bovis
TGVDPKNLDDITTD

SEQ ID NO: 189567 - protein, 9 aa, Mycobacterium bovis
TGVEPTDDA

SEQ ID NO: 189568 - protein, 9 aa, Mycobacterium bovis
TGVGAGGTA

SEQ ID NO: 189569 - protein, 12 aa, Mycobacterium bovis
TGVKDRASVNTE

SEQ ID NO: 189570 - protein, 4 aa, Mycobacterium bovis
TGVP

SEQ ID NO: 189571 - protein, 10 aa, Mycobacterium bovis
TGVSERDKHN

SEQ ID NO: 189572 - protein, 11 aa, Mycobacterium bovis
TGVSGSGKSTL

SEQ ID NO: 189573 - protein, 10 aa, Mycobacterium bovis
TGWDADGGYA

SEQ ID NO: 189574 - protein, 17 aa, Mycobacterium bovis
TGWDPSAADRLTGNADA

SEQ ID NO: 189575 - protein, 5 aa, Mycobacterium bovis
TGWSE

SEQ ID NO: 189576 - protein, 7 aa, Mycobacterium bovis
TGYDRTY

SEQ ID NO: 189577 - protein, 15 aa, Mycobacterium bovis
TGYDTATGAGSAYDR

SEQ ID NO: 189578 - protein, 5 aa, Mycobacterium bovis
TGYND

SEQ ID NO: 189579 - protein, 4 aa, Mycobacterium bovis
TGYR

SEQ ID NO: 189580 - protein, 9 aa, Mycobacterium bovis
TGYSEETTQ

SEQ ID NO: 189581 - protein, 9 aa, Mycobacterium bovis
THAEQGRLS

SEQ ID NO: 189582 - protein, 7 aa, Mycobacterium bovis
THAGPGG

SEQ ID NO: 189583 - protein, 6 aa, Mycobacterium bovis
THDGTC

SEQ ID NO: 189584 - protein, 4 aa, Mycobacterium bovis
THDP

SEQ ID NO: 189585 - protein, 5 aa, Mycobacterium bovis
THDSG

SEQ ID NO: 189586 - protein, 7 aa, Mycobacterium bovis
THDVNST

SEQ ID NO: 189587 - protein, 7 aa, Mycobacterium bovis
THENTRR

SEQ ID NO: 189588 - protein, 6 aa, Mycobacterium bovis
THGDGE

SEQ ID NO: 189589 - protein, 5 aa, Mycobacterium bovis
THGDT

SEQ ID NO: 189590 - protein, 6 aa, Mycobacterium bovis
THGGQL

SEQ ID NO: 189591 - protein, 10 aa, Mycobacterium bovis
THGGRRGTGM

SEQ ID NO: 189592 - protein, 8 aa, Mycobacterium bovis
THGKTTTT

SEQ ID NO: 189593 - protein, 17 aa, Mycobacterium bovis
THGRPTDRNAHPHRDAA

SEQ ID NO: 189594 - protein, 7 aa, Mycobacterium bovis
THGTGTV

SEQ ID NO: 189595 - protein, 8 aa, Mycobacterium bovis
THKYPNET

SEQ ID NO: 189596 - protein, 13 aa, Mycobacterium bovis
THNDTDASASSGK

SEQ ID NO: 189597 - protein, 17 aa, Mycobacterium bovis
THPATTTHRAMGPEGRA

SEQ ID NO: 189598 - protein, 5 aa, Mycobacterium bovis
THPEE

SEQ ID NO: 189599 - protein, 9 aa, Mycobacterium bovis
THPGSGHTT

SEQ ID NO: 189600 - protein, 14 aa, Mycobacterium bovis
THPNYPDRHEPSHP

SEQ ID NO: 189601 - protein, 6 aa, Mycobacterium bovis
THPRTR

SEQ ID NO: 189602 - protein, 14 aa, Mycobacterium bovis
THPVNKYTPNKYRR

SEQ ID NO: 189603 - protein, 12 aa, Mycobacterium bovis
THRARSGPRVGV

SEQ ID NO: 189604 - protein, 8 aa, Mycobacterium bovis
THSDDPEL

SEQ ID NO: 189605 - protein, 5 aa, Mycobacterium bovis
THSPD

SEQ ID NO: 189606 - protein, 9 aa, Mycobacterium bovis
THSQTSGWS

SEQ ID NO: 189607 - protein, 7 aa, Mycobacterium bovis
THTGDGT

SEQ ID NO: 189608 - protein, 13 aa, Mycobacterium bovis
THTYSDSTVGPFD

SEQ ID NO: 189609 - protein, 6 aa, Mycobacterium bovis
THVEQT

SEQ ID NO: 189610 - protein, 11 aa, Mycobacterium bovis
TIAGPASPAAN

SEQ ID NO: 189611 - protein, 12 aa, Mycobacterium bovis
TIDDPDAPALSD

SEQ ID NO: 189612 - protein, 4 aa, Mycobacterium bovis
TIDP

SEQ ID NO: 189613 - protein, 7 aa, Mycobacterium bovis
TIDQPDH

SEQ ID NO: 189614 - protein, 7 aa, Mycobacterium bovis
TIDRPSA

SEQ ID NO: 189615 - protein, 10 aa, Mycobacterium bovis
TIGDEGDSQL

SEQ ID NO: 189616 - protein, 10 aa, Mycobacterium bovis
TIGGGGNGQS

SEQ ID NO: 189617 - protein, 20 aa, Mycobacterium bovis
TIGNASSLHTSGRSARRRIE

SEQ ID NO: 189618 - protein, 13 aa, Mycobacterium bovis
TIGPDGSLRTQSG

SEQ ID NO: 189619 - protein, 7 aa, Mycobacterium bovis
TIGPGGV

SEQ ID NO: 189620 - protein, 4 aa, Mycobacterium bovis
TIGR

SEQ ID NO: 189621 - protein, 9 aa, Mycobacterium bovis
TIGSQASTC

SEQ ID NO: 189622 - protein, 7 aa, Mycobacterium bovis
TIPAQTR

SEQ ID NO: 189623 - protein, 6 aa, Mycobacterium bovis
TIPDKG

SEQ ID NO: 189624 - protein, 4 aa, Mycobacterium bovis
TIPE

SEQ ID NO: 189625 - protein, 10 aa, Mycobacterium bovis
TIRTGRANPG

SEQ ID NO: 189626 - protein, 6 aa, Mycobacterium bovis
TISDPE

SEQ ID NO: 189627 - protein, 5 aa, Mycobacterium bovis
TISGV

SEQ ID NO: 189628 - protein, 7 aa, Mycobacterium bovis
TKAKDRG

SEQ ID NO: 189629 - protein, 4 aa, Mycobacterium bovis
TKAL

SEQ ID NO: 189630 - protein, 9 aa, Mycobacterium bovis
TKANADPRS

SEQ ID NO: 189631 - protein, 7 aa, Mycobacterium bovis
TKAYDGL

SEQ ID NO: 189632 - protein, 7 aa, Mycobacterium bovis
TKCPDGQ

SEQ ID NO: 189633 - protein, 13 aa, Mycobacterium bovis
TKDTPTKPLTDAE

SEQ ID NO: 189634 - protein, 8 aa, Mycobacterium bovis
TKDWSQAK

SEQ ID NO: 189635 - protein, 6 aa, Mycobacterium bovis
TKEQAE

SEQ ID NO: 189636 - protein, 4 aa, Mycobacterium bovis
TKFH

SEQ ID NO: 189637 - protein, 4 aa, Mycobacterium bovis
TKGG

SEQ ID NO: 189638 - protein, 8 aa, Mycobacterium bovis
TKGNTQRW

SEQ ID NO: 189639 - protein, 13 aa, Mycobacterium bovis
TKGPQGKRLGKTT

SEQ ID NO: 189640 - protein, 5 aa, Mycobacterium bovis
TKHAR

SEQ ID NO: 189641 - protein, 7 aa, Mycobacterium bovis
TKKQGND

SEQ ID NO: 189642 - protein, 5 aa, Mycobacterium bovis
TKLPG

SEQ ID NO: 189643 - protein, 11 aa, Mycobacterium bovis
TKLRDSPVAGR

SEQ ID NO: 189644 - protein, 8 aa, Mycobacterium bovis
TKLRSRAD

SEQ ID NO: 189645 - protein, 7 aa, Mycobacterium bovis
TKLTGYT

SEQ ID NO: 189646 - protein, 10 aa, Mycobacterium bovis
TKMTPAPTQP

SEQ ID NO: 189647 - protein, 9 aa, Mycobacterium bovis
TKNATKLRG

SEQ ID NO: 189648 - protein, 8 aa, Mycobacterium bovis
TKNGAPAA

SEQ ID NO: 189649 - protein, 6 aa, Mycobacterium bovis
TKNSEV

SEQ ID NO: 189650 - protein, 10 aa, Mycobacterium bovis
TKNSGGKMTR

SEQ ID NO: 189651 - protein, 10 aa, Mycobacterium bovis
TKPAASVTAT

SEQ ID NO: 189652 - protein, 5 aa, Mycobacterium bovis
TKPDA

SEQ ID NO: 189653 - protein, 32 aa, Mycobacterium bovis
TKPDLTPVTDADRAVESDVRQTLGRDRPGDGV

SEQ ID NO: 189654 - protein, 9 aa, Mycobacterium bovis
TKPEDAAES

SEQ ID NO: 189655 - protein, 12 aa, Mycobacterium bovis
TKPGTTTPHTEF

SEQ ID NO: 189656 - protein, 7 aa, Mycobacterium bovis
TKPSTSD

SEQ ID NO: 189657 - protein, 8 aa, Mycobacterium bovis
TKPTRPDL

SEQ ID NO: 189658 - protein, 6 aa, Mycobacterium bovis
TKPYSA

SEQ ID NO: 189659 - protein, 13 aa, Mycobacterium bovis
TKQHSAEYQSQAP

SEQ ID NO: 189660 - protein, 5 aa, Mycobacterium bovis
TKRAN

SEQ ID NO: 189661 - protein, 10 aa, Mycobacterium bovis
TKRGARKSYT

SEQ ID NO: 189662 - protein, 5 aa, Mycobacterium bovis
TKRGC

SEQ ID NO: 189663 - protein, 10 aa, Mycobacterium bovis
TKSDQTPWYE

SEQ ID NO: 189664 - protein, 7 aa, Mycobacterium bovis
TKSGGRL

SEQ ID NO: 189665 - protein, 6 aa, Mycobacterium bovis
TKTCTG

SEQ ID NO: 189666 - protein, 10 aa, Mycobacterium bovis
TKTTARGVQT

SEQ ID NO: 189667 - protein, 5 aa, Mycobacterium bovis
TKTVP

SEQ ID NO: 189668 - protein, 17 aa, Mycobacterium bovis
TKVGEEIAKETLVVGGA

SEQ ID NO: 189669 - protein, 10 aa, Mycobacterium bovis
TKVPPPAADY

SEQ ID NO: 189670 - protein, 9 aa, Mycobacterium bovis
TKVSRSAED

SEQ ID NO: 189671 - protein, 5 aa, Mycobacterium bovis
TLAGR

SEQ ID NO: 189672 - protein, 7 aa, Mycobacterium bovis
TLANATG

SEQ ID NO: 189673 - protein, 8 aa, Mycobacterium bovis
TLAPSTAT

SEQ ID NO: 189674 - protein, 8 aa, Mycobacterium bovis
TLARDGGR

SEQ ID NO: 189675 - protein, 10 aa, Mycobacterium bovis
TLDGDQTAEF

SEQ ID NO: 189676 - protein, 4 aa, Mycobacterium bovis
TLDP

SEQ ID NO: 189677 - protein, 9 aa, Mycobacterium bovis
TLDPDGSHT

SEQ ID NO: 189678 - protein, 9 aa, Mycobacterium bovis
TLDRPGRPL

SEQ ID NO: 189679 - protein, 6 aa, Mycobacterium bovis
TLERTG

SEQ ID NO: 189680 - protein, 10 aa, Mycobacterium bovis
TLETAQAAGV

SEQ ID NO: 189681 - protein, 9 aa, Mycobacterium bovis
TLGAGTPAV

SEQ ID NO: 189682 - protein, 4 aa, Mycobacterium bovis
TLGE

SEQ ID NO: 189683 - protein, 4 aa, Mycobacterium bovis
TLGG

SEQ ID NO: 189684 - protein, 7 aa, Mycobacterium bovis
TLGGGRS

SEQ ID NO: 189685 - protein, 5 aa, Mycobacterium bovis
TLGNE

SEQ ID NO: 189686 - protein, 5 aa, Mycobacterium bovis
TLGPI

SEQ ID NO: 189687 - protein, 6 aa, Mycobacterium bovis
TLGPKG

SEQ ID NO: 189688 - protein, 7 aa, Mycobacterium bovis
TLGPKGR

SEQ ID NO: 189689 - protein, 10 aa, Mycobacterium bovis
TLGTAERRSL

SEQ ID NO: 189690 - protein, 6 aa, Mycobacterium bovis
TLMNSG

SEQ ID NO: 189691 - protein, 5 aa, Mycobacterium bovis
TLNET

SEQ ID NO: 189692 - protein, 12 aa, Mycobacterium bovis
TLNGSAADVHRR

SEQ ID NO: 189693 - protein, 5 aa, Mycobacterium bovis
TLPAD

SEQ ID NO: 189694 - protein, 9 aa, Mycobacterium bovis
TLPAEPAKT

SEQ ID NO: 189695 - protein, 5 aa, Mycobacterium bovis
TLPAG

SEQ ID NO: 189696 - protein, 10 aa, Mycobacterium bovis
TLPAGPAGRW

SEQ ID NO: 189697 - protein, 8 aa, Mycobacterium bovis
TLPAPDTD

SEQ ID NO: 189698 - protein, 23 aa, Mycobacterium bovis
TLPEDDDHPYRTGPWRPQTTEWD

SEQ ID NO: 189699 - protein, 16 aa, Mycobacterium bovis
TLPGDSADDAAARDTA

SEQ ID NO: 189700 - protein, 5 aa, Mycobacterium bovis
TLPKS

SEQ ID NO: 189701 - protein, 6 aa, Mycobacterium bovis
TLPPGA

SEQ ID NO: 189702 - protein, 14 aa, Mycobacterium bovis
TLPPGATTGDARAE

SEQ ID NO: 189703 - protein, 17 aa, Mycobacterium bovis
TLPPGLGDAQAAAVTTA

SEQ ID NO: 189704 - protein, 19 aa, Mycobacterium bovis
TLPPGTALTPLGRDQARAF

SEQ ID NO: 189705 - protein, 6 aa, Mycobacterium bovis
TLPPSQ

SEQ ID NO: 189706 - protein, 9 aa, Mycobacterium bovis
TLPSGTDRD

SEQ ID NO: 189707 - protein, 4 aa, Mycobacterium bovis
TLQA

SEQ ID NO: 189708 - protein, 7 aa, Mycobacterium bovis
TLQGDAA

SEQ ID NO: 189709 - protein, 20 aa, Mycobacterium bovis
TLQRGQAALTGPVARGDAAA

SEQ ID NO: 189710 - protein, 7 aa, Mycobacterium bovis
TLQRPPT

SEQ ID NO: 189711 - protein, 4 aa, Mycobacterium bovis
TLRG

SEQ ID NO: 189712 - protein, 9 aa, Mycobacterium bovis
TLRPEGTAG

SEQ ID NO: 189713 - protein, 7 aa, Mycobacterium bovis
TLRQGDR

SEQ ID NO: 189714 - protein, 9 aa, Mycobacterium bovis
TLRQNSPGA

SEQ ID NO: 189715 - protein, 9 aa, Mycobacterium bovis
TLRSSGAAL

SEQ ID NO: 189716 - protein, 10 aa, Mycobacterium bovis
TLSADPDDAE

SEQ ID NO: 189717 - protein, 7 aa, Mycobacterium bovis
TLSEETT

SEQ ID NO: 189718 - protein, 7 aa, Mycobacterium bovis
TLSERAD

SEQ ID NO: 189719 - protein, 8 aa, Mycobacterium bovis
TLSGAPKV

SEQ ID NO: 189720 - protein, 15 aa, Mycobacterium bovis
TLSGSTLATQSVPPV

SEQ ID NO: 189721 - protein, 6 aa, Mycobacterium bovis
TLSPDD

SEQ ID NO: 189722 - protein, 7 aa, Mycobacterium bovis
TLSPDED

SEQ ID NO: 189723 - protein, 5 aa, Mycobacterium bovis
TLSTG

SEQ ID NO: 189724 - protein, 8 aa, Mycobacterium bovis
TLTDSARG

SEQ ID NO: 189725 - protein, 6 aa, Mycobacterium bovis
TLTGAQ

SEQ ID NO: 189726 - protein, 13 aa, Mycobacterium bovis
TLTGSEPAGQSVG

SEQ ID NO: 189727 - protein, 8 aa, Mycobacterium bovis
TLTPDDDA

SEQ ID NO: 189728 - protein, 9 aa, Mycobacterium bovis
TLTPDQAAG

SEQ ID NO: 189729 - protein, 7 aa, Mycobacterium bovis
TLTPSRL

SEQ ID NO: 189730 - protein, 7 aa, Mycobacterium bovis
TLTRRDQ

SEQ ID NO: 189731 - protein, 4 aa, Mycobacterium bovis
TLVP

SEQ ID NO: 189732 - protein, 6 aa, Mycobacterium bovis
TLYDAG

SEQ ID NO: 189733 - protein, 7 aa, Mycobacterium bovis
TMASGQQ

SEQ ID NO: 189734 - protein, 10 aa, Mycobacterium bovis
TMPNQGSSNK

SEQ ID NO: 189735 - protein, 4 aa, Mycobacterium bovis
TMPP

SEQ ID NO: 189736 - protein, 9 aa, Mycobacterium bovis
TMPRRAPAL

SEQ ID NO: 189737 - protein, 9 aa, Mycobacterium bovis
TMPYPTTDA

SEQ ID NO: 189738 - protein, 14 aa, Mycobacterium bovis
TMQDGEGSGVAPTD

SEQ ID NO: 189739 - protein, 13 aa, Mycobacterium bovis
TMQSAQRDEKELG

SEQ ID NO: 189740 - protein, 12 aa, Mycobacterium bovis
TMRATASPGSLD

SEQ ID NO: 189741 - protein, 9 aa, Mycobacterium bovis
TMSRPPDAH

SEQ ID NO: 189742 - protein, 14 aa, Mycobacterium bovis
TMSTSEADGVTGGV

SEQ ID NO: 189743 - protein, 30 aa, Mycobacterium bovis
TNAATTPTRGVVGQGGDHTPGTVPPSGPRV

SEQ ID NO: 189744 - protein, 12 aa, Mycobacterium bovis
TNADSASPGVSD

SEQ ID NO: 189745 - protein, 7 aa, Mycobacterium bovis
TNAGKSS

SEQ ID NO: 189746 - protein, 10 aa, Mycobacterium bovis
TNAGNGGSAR

SEQ ID NO: 189747 - protein, 6 aa, Mycobacterium bovis
TNAQRT

SEQ ID NO: 189748 - protein, 5 aa, Mycobacterium bovis
TNATA

SEQ ID NO: 189749 - protein, 5 aa, Mycobacterium bovis
TNDDG

SEQ ID NO: 189750 - protein, 22 aa, Mycobacterium bovis
TNDGASSRAKGHRSAAPGRRKI

SEQ ID NO: 189751 - protein, 4 aa, Mycobacterium bovis
TNDL

SEQ ID NO: 189752 - protein, 6 aa, Mycobacterium bovis
TNEARQ

SEQ ID NO: 189753 - protein, 6 aa, Mycobacterium bovis
TNEEGD

SEQ ID NO: 189754 - protein, 6 aa, Mycobacterium bovis
TNEGLR

SEQ ID NO: 189755 - protein, 5 aa, Mycobacterium bovis
TNGAR

SEQ ID NO: 189756 - protein, 10 aa, Mycobacterium bovis
TNGIGVGSSD

SEQ ID NO: 189757 - protein, 17 aa, Mycobacterium bovis
TNGTSGAVRQPGSSNPS

SEQ ID NO: 189758 - protein, 8 aa, Mycobacterium bovis
TNGWTREG

SEQ ID NO: 189759 - protein, 4 aa, Mycobacterium bovis
TNGY

SEQ ID NO: 189760 - protein, 12 aa, Mycobacterium bovis
TNIGHTGGAAGI

SEQ ID NO: 189761 - protein, 7 aa, Mycobacterium bovis
TNLSPKD

SEQ ID NO: 189762 - protein, 9 aa, Mycobacterium bovis
TNMRSSTAD

SEQ ID NO: 189763 - protein, 10 aa, Mycobacterium bovis
TNNDDPAGAC

SEQ ID NO: 189764 - protein, 6 aa, Mycobacterium bovis
TNNLPD

SEQ ID NO: 189765 - protein, 10 aa, Mycobacterium bovis
TNNPLPDPEY

SEQ ID NO: 189766 - protein, 6 aa, Mycobacterium bovis
TNNTAR

SEQ ID NO: 189767 - protein, 8 aa, Mycobacterium bovis
TNPARPRA

SEQ ID NO: 189768 - protein, 4 aa, Mycobacterium bovis
TNPD

SEQ ID NO: 189769 - protein, 10 aa, Mycobacterium bovis
TNPDAAAHQQ

SEQ ID NO: 189770 - protein, 13 aa, Mycobacterium bovis
TNPESSGAKKHRG

SEQ ID NO: 189771 - protein, 7 aa, Mycobacterium bovis
TNPGQGV

SEQ ID NO: 189772 - protein, 7 aa, Mycobacterium bovis
TNPGTIG

SEQ ID NO: 189773 - protein, 6 aa, Mycobacterium bovis
TNPKGE

SEQ ID NO: 189774 - protein, 9 aa, Mycobacterium bovis
TNPLSGHGA

SEQ ID NO: 189775 - protein, 7 aa, Mycobacterium bovis
TNPNEAL

SEQ ID NO: 189776 - protein, 5 aa, Mycobacterium bovis
TNPPI

SEQ ID NO: 189777 - protein, 6 aa, Mycobacterium bovis
TNPPLD

SEQ ID NO: 189778 - protein, 12 aa, Mycobacterium bovis
TNPTENMETEAT

SEQ ID NO: 189779 - protein, 9 aa, Mycobacterium bovis
TNPVADSPV

SEQ ID NO: 189780 - protein, 11 aa, Mycobacterium bovis
TNRDGETTRHA

SEQ ID NO: 189781 - protein, 6 aa, Mycobacterium bovis
TNRQRA

SEQ ID NO: 189782 - protein, 8 aa, Mycobacterium bovis
TNRRNPGA

SEQ ID NO: 189783 - protein, 6 aa, Mycobacterium bovis
TNRYGT

SEQ ID NO: 189784 - protein, 10 aa, Mycobacterium bovis
TNSDGSPTGG

SEQ ID NO: 189785 - protein, 5 aa, Mycobacterium bovis
TNSEH

SEQ ID NO: 189786 - protein, 11 aa, Mycobacterium bovis
TNSPLRDGEHA

SEQ ID NO: 189787 - protein, 9 aa, Mycobacterium bovis
TNSQGGSSI

SEQ ID NO: 189788 - protein, 18 aa, Mycobacterium bovis
TNTGFANSGNINTGGFNA

SEQ ID NO: 189789 - protein, 4 aa, Mycobacterium bovis
TNTI

SEQ ID NO: 189790 - protein, 10 aa, Mycobacterium bovis
TNTSATGDLD

SEQ ID NO: 189791 - protein, 4 aa, Mycobacterium bovis
TNVE

SEQ ID NO: 189792 - protein, 7 aa, Mycobacterium bovis
TNYSAAK

SEQ ID NO: 189793 - protein, 5 aa, Mycobacterium bovis
TPAAL

SEQ ID NO: 189794 - protein, 13 aa, Mycobacterium bovis
TPAATLPRSRRIP

SEQ ID NO: 189795 - protein, 8 aa, Mycobacterium bovis
TPADGSAP

SEQ ID NO: 189796 - protein, 12 aa, Mycobacterium bovis
TPAGPDTADTAA

SEQ ID NO: 189797 - protein, 10 aa, Mycobacterium bovis
TPAIATTESQ

SEQ ID NO: 189798 - protein, 6 aa, Mycobacterium bovis
TPAITT

SEQ ID NO: 189799 - protein, 12 aa, Mycobacterium bovis
TPALGKTGAPNR

SEQ ID NO: 189800 - protein, 11 aa, Mycobacterium bovis
TPANITGPGPI

SEQ ID NO: 189801 - protein, 5 aa, Mycobacterium bovis
TPAPD

SEQ ID NO: 189802 - protein, 32 aa, Mycobacterium bovis
TPAPGPNGSNSDGDSERASQDVRDTAARHGRA

SEQ ID NO: 189803 - protein, 10 aa, Mycobacterium bovis
TPAQLGGVSP

SEQ ID NO: 189804 - protein, 6 aa, Mycobacterium bovis
TPAQTG

SEQ ID NO: 189805 - protein, 4 aa, Mycobacterium bovis
TPAR

SEQ ID NO: 189806 - protein, 4 aa, Mycobacterium bovis
TPAT

SEQ ID NO: 189807 - protein, 6 aa, Mycobacterium bovis
TPATRA

SEQ ID NO: 189808 - protein, 6 aa, Mycobacterium bovis
TPATRH

SEQ ID NO: 189809 - protein, 4 aa, Mycobacterium bovis
TPAV

SEQ ID NO: 189810 - protein, 5 aa, Mycobacterium bovis
TPDAV

SEQ ID NO: 189811 - protein, 6 aa, Mycobacterium bovis
TPDDDQ

SEQ ID NO: 189812 - protein, 5 aa, Mycobacterium bovis
TPDDG

SEQ ID NO: 189813 - protein, 8 aa, Mycobacterium bovis
TPDDHKAL

SEQ ID NO: 189814 - protein, 6 aa, Mycobacterium bovis
TPDERR

SEQ ID NO: 189815 - protein, 7 aa, Mycobacterium bovis
TPDGSRS

SEQ ID NO: 189816 - protein, 5 aa, Mycobacterium bovis
TPDQP

SEQ ID NO: 189817 - protein, 4 aa, Mycobacterium bovis
TPDR

SEQ ID NO: 189818 - protein, 20 aa, Mycobacterium bovis
TPDRSIDEQAQEVIDLLESS

SEQ ID NO: 189819 - protein, 6 aa, Mycobacterium bovis
TPDSDR

SEQ ID NO: 189820 - protein, 9 aa, Mycobacterium bovis
TPDSSRYWP

SEQ ID NO: 189821 - protein, 5 aa, Mycobacterium bovis
TPDVR

SEQ ID NO: 189822 - protein, 10 aa, Mycobacterium bovis
TPEAIDPDKA

SEQ ID NO: 189823 - protein, 7 aa, Mycobacterium bovis
TPEAPGI

SEQ ID NO: 189824 - protein, 12 aa, Mycobacterium bovis
TPEEVARQAADN

SEQ ID NO: 189825 - protein, 6 aa, Mycobacterium bovis
TPEEVE

SEQ ID NO: 189826 - protein, 13 aa, Mycobacterium bovis
TPEFADRQRRTLS

SEQ ID NO: 189827 - protein, 6 aa, Mycobacterium bovis
TPEGPN

SEQ ID NO: 189828 - protein, 7 aa, Mycobacterium bovis
TPEHTAR

SEQ ID NO: 189829 - protein, 8 aa, Mycobacterium bovis
TPEPPERW

SEQ ID NO: 189830 - protein, 7 aa, Mycobacterium bovis
TPEQRHR

SEQ ID NO: 189831 - protein, 6 aa, Mycobacterium bovis
TPERAG

SEQ ID NO: 189832 - protein, 10 aa, Mycobacterium bovis
TPETNGEDNR

SEQ ID NO: 189833 - protein, 6 aa, Mycobacterium bovis
TPETPL

SEQ ID NO: 189834 - protein, 5 aa, Mycobacterium bovis
TPEVA

SEQ ID NO: 189835 - protein, 8 aa, Mycobacterium bovis
TPEYPLGQ

SEQ ID NO: 189836 - protein, 4 aa, Mycobacterium bovis
TPFD

SEQ ID NO: 189837 - protein, 5 aa, Mycobacterium bovis
TPFND

SEQ ID NO: 189838 - protein, 14 aa, Mycobacterium bovis
TPGADGPADAAGLG

SEQ ID NO: 189839 - protein, 13 aa, Mycobacterium bovis
TPGAEPRAPGGYG

SEQ ID NO: 189840 - protein, 20 aa, Mycobacterium bovis
TPGARSEQADTIAKWIAKRW

SEQ ID NO: 189841 - protein, 9 aa, Mycobacterium bovis
TPGASEAIR

SEQ ID NO: 189842 - protein, 6 aa, Mycobacterium bovis
TPGATI

SEQ ID NO: 189843 - protein, 5 aa, Mycobacterium bovis
TPGCT

SEQ ID NO: 189844 - protein, 5 aa, Mycobacterium bovis
TPGDL

SEQ ID NO: 189845 - protein, 5 aa, Mycobacterium bovis
TPGDM

SEQ ID NO: 189846 - protein, 8 aa, Mycobacterium bovis
TPGDPALA

SEQ ID NO: 189847 - protein, 6 aa, Mycobacterium bovis
TPGDRS

SEQ ID NO: 189848 - protein, 12 aa, Mycobacterium bovis
TPGFGNSTGGLS

SEQ ID NO: 189849 - protein, 17 aa, Mycobacterium bovis
TPGGGGYGPASTSARRR

SEQ ID NO: 189850 - protein, 7 aa, Mycobacterium bovis
TPGHSPG

SEQ ID NO: 189851 - protein, 7 aa, Mycobacterium bovis
TPGHTAD

SEQ ID NO: 189852 - protein, 7 aa, Mycobacterium bovis
TPGQNNV

SEQ ID NO: 189853 - protein, 7 aa, Mycobacterium bovis
TPGQQDR

SEQ ID NO: 189854 - protein, 16 aa, Mycobacterium bovis
TPGRSPADTQDSVGGG

SEQ ID NO: 189855 - protein, 14 aa, Mycobacterium bovis
TPGRTDASQEQTDV

SEQ ID NO: 189856 - protein, 8 aa, Mycobacterium bovis
TPGSGKTS

SEQ ID NO: 189857 - protein, 11 aa, Mycobacterium bovis
TPGTALPPPTG

SEQ ID NO: 189858 - protein, 4 aa, Mycobacterium bovis
TPGY

SEQ ID NO: 189859 - protein, 8 aa, Mycobacterium bovis
TPHGKIDE

SEQ ID NO: 189860 - protein, 6 aa, Mycobacterium bovis
TPHGQT

SEQ ID NO: 189861 - protein, 15 aa, Mycobacterium bovis
TPHPASAAPISGGTD

SEQ ID NO: 189862 - protein, 10 aa, Mycobacterium bovis
TPHPGEPGSQ

SEQ ID NO: 189863 - protein, 16 aa, Mycobacterium bovis
TPHSMKAADSKPARTV

SEQ ID NO: 189864 - protein, 11 aa, Mycobacterium bovis
TPIAPADLPGR

SEQ ID NO: 189865 - protein, 20 aa, Mycobacterium bovis
TPIGAQPVPDADPIDDGDSL

SEQ ID NO: 189866 - protein, 14 aa, Mycobacterium bovis
TPIGPAGATTVPAG

SEQ ID NO: 189867 - protein, 5 aa, Mycobacterium bovis
TPIPR

SEQ ID NO: 189868 - protein, 6 aa, Mycobacterium bovis
TPISQS

SEQ ID NO: 189869 - protein, 4 aa, Mycobacterium bovis
TPKL

SEQ ID NO: 189870 - protein, 10 aa, Mycobacterium bovis
TPKRGDRTVT

SEQ ID NO: 189871 - protein, 7 aa, Mycobacterium bovis
TPLADTA

SEQ ID NO: 189872 - protein, 16 aa, Mycobacterium bovis
TPLANPGNLDSRRRAA

SEQ ID NO: 189873 - protein, 5 aa, Mycobacterium bovis
TPLED

SEQ ID NO: 189874 - protein, 4 aa, Mycobacterium bovis
TPLP

SEQ ID NO: 189875 - protein, 5 aa, Mycobacterium bovis
TPLPP

SEQ ID NO: 189876 - protein, 5 aa, Mycobacterium bovis
TPLSN

SEQ ID NO: 189877 - protein, 15 aa, Mycobacterium bovis
TPLSPNGSSGAGGLP

SEQ ID NO: 189878 - protein, 8 aa, Mycobacterium bovis
TPLSTDEL

SEQ ID NO: 189879 - protein, 7 aa, Mycobacterium bovis
TPLTEEQ

SEQ ID NO: 189880 - protein, 6 aa, Mycobacterium bovis
TPLTEG

SEQ ID NO: 189881 - protein, 5 aa, Mycobacterium bovis
TPMPI

SEQ ID NO: 189882 - protein, 15 aa, Mycobacterium bovis
TPNAASTGDSAKNTI

SEQ ID NO: 189883 - protein, 10 aa, Mycobacterium bovis
TPNPHATAEQ

SEQ ID NO: 189884 - protein, 4 aa, Mycobacterium bovis
TPNR

SEQ ID NO: 189885 - protein, 18 aa, Mycobacterium bovis
TPNSESDPRYDSAGVPTF

SEQ ID NO: 189886 - protein, 6 aa, Mycobacterium bovis
TPPALT

SEQ ID NO: 189887 - protein, 7 aa, Mycobacterium bovis
TPPARPV

SEQ ID NO: 189888 - protein, 6 aa, Mycobacterium bovis
TPPARQ

SEQ ID NO: 189889 - protein, 6 aa, Mycobacterium bovis
TPPEER

SEQ ID NO: 189890 - protein, 14 aa, Mycobacterium bovis
TPPGTVKGIPQKPM

SEQ ID NO: 189891 - protein, 6 aa, Mycobacterium bovis
TPPIPD

SEQ ID NO: 189892 - protein, 5 aa, Mycobacterium bovis
TPPPQ

SEQ ID NO: 189893 - protein, 6 aa, Mycobacterium bovis
TPPPTW

SEQ ID NO: 189894 - protein, 6 aa, Mycobacterium bovis
TPPQAK

SEQ ID NO: 189895 - protein, 5 aa, Mycobacterium bovis
TPPQP

SEQ ID NO: 189896 - protein, 12 aa, Mycobacterium bovis
TPPRPDAATRAG

SEQ ID NO: 189897 - protein, 9 aa, Mycobacterium bovis
TPPSGAPPD

SEQ ID NO: 189898 - protein, 6 aa, Mycobacterium bovis
TPPSRN

SEQ ID NO: 189899 - protein, 12 aa, Mycobacterium bovis
TPPVGASQPGLF

SEQ ID NO: 189900 - protein, 8 aa, Mycobacterium bovis
TPQAREAV

SEQ ID NO: 189901 - protein, 6 aa, Mycobacterium bovis
TPQDVG

SEQ ID NO: 189902 - protein, 7 aa, Mycobacterium bovis
TPQERAD

SEQ ID NO: 189903 - protein, 4 aa, Mycobacterium bovis
TPQG

SEQ ID NO: 189904 - protein, 6 aa, Mycobacterium bovis
TPQGTL

SEQ ID NO: 189905 - protein, 8 aa, Mycobacterium bovis
TPQKIGEY

SEQ ID NO: 189906 - protein, 8 aa, Mycobacterium bovis
TPQPATPL

SEQ ID NO: 189907 - protein, 8 aa, Mycobacterium bovis
TPQPQASI

SEQ ID NO: 189908 - protein, 10 aa, Mycobacterium bovis
TPQQATAGGV

SEQ ID NO: 189909 - protein, 8 aa, Mycobacterium bovis
TPQQGRTL

SEQ ID NO: 189910 - protein, 6 aa, Mycobacterium bovis
TPQQPG

SEQ ID NO: 189911 - protein, 5 aa, Mycobacterium bovis
TPQQQ

SEQ ID NO: 189912 - protein, 9 aa, Mycobacterium bovis
TPQRAPGYE

SEQ ID NO: 189913 - protein, 9 aa, Mycobacterium bovis
TPQSRRELA

SEQ ID NO: 189914 - protein, 5 aa, Mycobacterium bovis
TPQSY

SEQ ID NO: 189915 - protein, 4 aa, Mycobacterium bovis
TPQV

SEQ ID NO: 189916 - protein, 4 aa, Mycobacterium bovis
TPRA

SEQ ID NO: 189917 - protein, 7 aa, Mycobacterium bovis
TPRAGGA

SEQ ID NO: 189918 - protein, 13 aa, Mycobacterium bovis
TPRDTRRTPADAM

SEQ ID NO: 189919 - protein, 5 aa, Mycobacterium bovis
TPRGA

SEQ ID NO: 189920 - protein, 12 aa, Mycobacterium bovis
TPRGKQKNGSLH

SEQ ID NO: 189921 - protein, 4 aa, Mycobacterium bovis
TPRI

SEQ ID NO: 189922 - protein, 4 aa, Mycobacterium bovis
TPRM

SEQ ID NO: 189923 - protein, 9 aa, Mycobacterium bovis
TPRPAPTVA

SEQ ID NO: 189924 - protein, 6 aa, Mycobacterium bovis
TPRRPA

SEQ ID NO: 189925 - protein, 10 aa, Mycobacterium bovis
TPSAGTPEAP

SEQ ID NO: 189926 - protein, 7 aa, Mycobacterium bovis
TPSASDL

SEQ ID NO: 189927 - protein, 9 aa, Mycobacterium bovis
TPSDGQVAT

SEQ ID NO: 189928 - protein, 8 aa, Mycobacterium bovis
TPSDTRAD

SEQ ID NO: 189929 - protein, 5 aa, Mycobacterium bovis
TPSGA

SEQ ID NO: 189930 - protein, 11 aa, Mycobacterium bovis
TPSGGSIPEYN

SEQ ID NO: 189931 - protein, 26 aa, Mycobacterium bovis
TPSLTKNAGVPTTDQPQKGKDFTSDQ

SEQ ID NO: 189932 - protein, 11 aa, Mycobacterium bovis
TPSPANQPPVR

SEQ ID NO: 189933 - protein, 10 aa, Mycobacterium bovis
TPSPGTPEGP

SEQ ID NO: 189934 - protein, 11 aa, Mycobacterium bovis
TPSPGTSEGPW

SEQ ID NO: 189935 - protein, 9 aa, Mycobacterium bovis
TPSRERVES

SEQ ID NO: 189936 - protein, 8 aa, Mycobacterium bovis
TPSVDPPL

SEQ ID NO: 189937 - protein, 8 aa, Mycobacterium bovis
TPTADAAD

SEQ ID NO: 189938 - protein, 17 aa, Mycobacterium bovis
TPTAGPSLRRPAASTAA

SEQ ID NO: 189939 - protein, 5 aa, Mycobacterium bovis
TPTAS

SEQ ID NO: 189940 - protein, 11 aa, Mycobacterium bovis
TPTDDNLYQTS

SEQ ID NO: 189941 - protein, 5 aa, Mycobacterium bovis
TPTDN

SEQ ID NO: 189942 - protein, 6 aa, Mycobacterium bovis
TPTGED

SEQ ID NO: 189943 - protein, 6 aa, Mycobacterium bovis
TPTGPL

SEQ ID NO: 189944 - protein, 15 aa, Mycobacterium bovis
TPTGSRHRSGAPPHL

SEQ ID NO: 189945 - protein, 5 aa, Mycobacterium bovis
TPTKW

SEQ ID NO: 189946 - protein, 7 aa, Mycobacterium bovis
TPTSGMP

SEQ ID NO: 189947 - protein, 9 aa, Mycobacterium bovis
TPTSNGSDE

SEQ ID NO: 189948 - protein, 13 aa, Mycobacterium bovis
TPTTRSPLTQPTV

SEQ ID NO: 189949 - protein, 5 aa, Mycobacterium bovis
TPTTV

SEQ ID NO: 189950 - protein, 5 aa, Mycobacterium bovis
TPTVC

SEQ ID NO: 189951 - protein, 5 aa, Mycobacterium bovis
TPVGN

SEQ ID NO: 189952 - protein, 9 aa, Mycobacterium bovis
TPVGVAGSS

SEQ ID NO: 189953 - protein, 5 aa, Mycobacterium bovis
TPVNG

SEQ ID NO: 189954 - protein, 5 aa, Mycobacterium bovis
TPVQA

SEQ ID NO: 189955 - protein, 6 aa, Mycobacterium bovis
TPVQTP

SEQ ID NO: 189956 - protein, 13 aa, Mycobacterium bovis
TPWPTNGRQVPRR

SEQ ID NO: 189957 - protein, 7 aa, Mycobacterium bovis
TPYPPAR

SEQ ID NO: 189958 - protein, 4 aa, Mycobacterium bovis
TQAA

SEQ ID NO: 189959 - protein, 5 aa, Mycobacterium bovis
TQAAA

SEQ ID NO: 189960 - protein, 5 aa, Mycobacterium bovis
TQAAT

SEQ ID NO: 189961 - protein, 7 aa, Mycobacterium bovis
TQAENEG

SEQ ID NO: 189962 - protein, 5 aa, Mycobacterium bovis
TQALA

SEQ ID NO: 189963 - protein, 12 aa, Mycobacterium bovis
TQAPEEVDPDAT

SEQ ID NO: 189964 - protein, 10 aa, Mycobacterium bovis
TQAPSGSGYA

SEQ ID NO: 189965 - protein, 4 aa, Mycobacterium bovis
TQAQ

SEQ ID NO: 189966 - protein, 5 aa, Mycobacterium bovis
TQDAR

SEQ ID NO: 189967 - protein, 6 aa, Mycobacterium bovis
TQDGEG

SEQ ID NO: 189968 - protein, 7 aa, Mycobacterium bovis
TQDGPLT

SEQ ID NO: 189969 - protein, 4 aa, Mycobacterium bovis
TQEA

SEQ ID NO: 189970 - protein, 12 aa, Mycobacterium bovis
TQEHTESRHAET

SEQ ID NO: 189971 - protein, 7 aa, Mycobacterium bovis
TQEKAEL

SEQ ID NO: 189972 - protein, 5 aa, Mycobacterium bovis
TQEQA

SEQ ID NO: 189973 - protein, 14 aa, Mycobacterium bovis
TQETASGNIEKPRI

SEQ ID NO: 189974 - protein, 7 aa, Mycobacterium bovis
TQETNSI

SEQ ID NO: 189975 - protein, 6 aa, Mycobacterium bovis
TQGAWT

SEQ ID NO: 189976 - protein, 6 aa, Mycobacterium bovis
TQGEVG

SEQ ID NO: 189977 - protein, 8 aa, Mycobacterium bovis
TQGHQTDA

SEQ ID NO: 189978 - protein, 7 aa, Mycobacterium bovis
TQGHTQS

SEQ ID NO: 189979 - protein, 5 aa, Mycobacterium bovis
TQGNT

SEQ ID NO: 189980 - protein, 6 aa, Mycobacterium bovis
TQGTDQ

SEQ ID NO: 189981 - protein, 4 aa, Mycobacterium bovis
TQGV

SEQ ID NO: 189982 - protein, 5 aa, Mycobacterium bovis
TQGYT

SEQ ID NO: 189983 - protein, 12 aa, Mycobacterium bovis
TQIADGGTIAAL

SEQ ID NO: 189984 - protein, 10 aa, Mycobacterium bovis
TQIDDSRISQ

SEQ ID NO: 189985 - protein, 6 aa, Mycobacterium bovis
TQIDPN

SEQ ID NO: 189986 - protein, 12 aa, Mycobacterium bovis
TQIGTGRQRFEQ

SEQ ID NO: 189987 - protein, 6 aa, Mycobacterium bovis
TQIPGT

SEQ ID NO: 189988 - protein, 9 aa, Mycobacterium bovis
TQKPSDLTS

SEQ ID NO: 189989 - protein, 6 aa, Mycobacterium bovis
TQLPTG

SEQ ID NO: 189990 - protein, 17 aa, Mycobacterium bovis
TQNGELSAQYAEAASEV

SEQ ID NO: 189991 - protein, 14 aa, Mycobacterium bovis
TQNGRGELAATEHA

SEQ ID NO: 189992 - protein, 8 aa, Mycobacterium bovis
TQPDTASL

SEQ ID NO: 189993 - protein, 7 aa, Mycobacterium bovis
TQPDVAE

SEQ ID NO: 189994 - protein, 16 aa, Mycobacterium bovis
TQPHTSSGRVPTEKGY

SEQ ID NO: 189995 - protein, 4 aa, Mycobacterium bovis
TQPR

SEQ ID NO: 189996 - protein, 17 aa, Mycobacterium bovis
TQPRSGDVTTAADSINS

SEQ ID NO: 189997 - protein, 4 aa, Mycobacterium bovis
TQPS

SEQ ID NO: 189998 - protein, 7 aa, Mycobacterium bovis
TQQTAAP

SEQ ID NO: 189999 - protein, 5 aa, Mycobacterium bovis
TQRAH

SEQ ID NO: 190000 - protein, 5 aa, Mycobacterium bovis
TQRVR

SEQ ID NO: 190001 - protein, 4 aa, Mycobacterium bovis
TQSM

SEQ ID NO: 190002 - protein, 8 aa, Mycobacterium bovis
TQSPGTVA

SEQ ID NO: 190003 - protein, 5 aa, Mycobacterium bovis
TQSRV

SEQ ID NO: 190004 - protein, 7 aa, Mycobacterium bovis
TQSVGDE

SEQ ID NO: 190005 - protein, 6 aa, Mycobacterium bovis
TQTADG

SEQ ID NO: 190006 - protein, 11 aa, Mycobacterium bovis
TQTDGIGKRFD

SEQ ID NO: 190007 - protein, 9 aa, Mycobacterium bovis
TQTGTGPTV

SEQ ID NO: 190008 - protein, 9 aa, Mycobacterium bovis
TQTPSGPVA

SEQ ID NO: 190009 - protein, 10 aa, Mycobacterium bovis
TQTPSRLTTP

SEQ ID NO: 190010 - protein, 4 aa, Mycobacterium bovis
TQTQ

SEQ ID NO: 190011 - protein, 7 aa, Mycobacterium bovis
TQTRPQI

SEQ ID NO: 190012 - protein, 7 aa, Mycobacterium bovis
TQTSQSG

SEQ ID NO: 190013 - protein, 28 aa, Mycobacterium bovis
TQTSRLSTTLRADEQAHRITPSREPDDG

SEQ ID NO: 190014 - protein, 10 aa, Mycobacterium bovis
TQVGTKHDAT

SEQ ID NO: 190015 - protein, 4 aa, Mycobacterium bovis
TRAA

SEQ ID NO: 190016 - protein, 9 aa, Mycobacterium bovis
TRAADPPAM

SEQ ID NO: 190017 - protein, 8 aa, Mycobacterium bovis
TRAATAYG

SEQ ID NO: 190018 - protein, 7 aa, Mycobacterium bovis
TRADADQ

SEQ ID NO: 190019 - protein, 10 aa, Mycobacterium bovis
TRADGERRPG

SEQ ID NO: 190020 - protein, 17 aa, Mycobacterium bovis
TRADGSIGLAPTAKEVT

SEQ ID NO: 190021 - protein, 6 aa, Mycobacterium bovis
TRAERR

SEQ ID NO: 190022 - protein, 5 aa, Mycobacterium bovis
TRAES

SEQ ID NO: 190023 - protein, 23 aa, Mycobacterium bovis
TRAGRPPGTVTADRGYGEKRVED

SEQ ID NO: 190024 - protein, 4 aa, Mycobacterium bovis
TRAP

SEQ ID NO: 190025 - protein, 7 aa, Mycobacterium bovis
TRAQRVT

SEQ ID NO: 190026 - protein, 15 aa, Mycobacterium bovis
TRASTRGDGRTGEDV

SEQ ID NO: 190027 - protein, 6 aa, Mycobacterium bovis
TRASVD

SEQ ID NO: 190028 - protein, 6 aa, Mycobacterium bovis
TRATAS

SEQ ID NO: 190029 - protein, 9 aa, Mycobacterium bovis
TRATKGRAR

SEQ ID NO: 190030 - protein, 8 aa, Mycobacterium bovis
TRDAAGNG

SEQ ID NO: 190031 - protein, 5 aa, Mycobacterium bovis
TRDDA

SEQ ID NO: 190032 - protein, 6 aa, Mycobacterium bovis
TRDEFD

SEQ ID NO: 190033 - protein, 11 aa, Mycobacterium bovis
TRDEPHADADR

SEQ ID NO: 190034 - protein, 22 aa, Mycobacterium bovis
TRDGDRGHRWPEPPEERAGQRL

SEQ ID NO: 190035 - protein, 6 aa, Mycobacterium bovis
TRDPLG

SEQ ID NO: 190036 - protein, 7 aa, Mycobacterium bovis
TRDRARD

SEQ ID NO: 190037 - protein, 12 aa, Mycobacterium bovis
TRDRRSQAQEEH

SEQ ID NO: 190038 - protein, 5 aa, Mycobacterium bovis
TRDTG

SEQ ID NO: 190039 - protein, 11 aa, Mycobacterium bovis
TRDTRTEAEQR

SEQ ID NO: 190040 - protein, 8 aa, Mycobacterium bovis
TRDVPAER

SEQ ID NO: 190041 - protein, 14 aa, Mycobacterium bovis
TREATYYSRSRAEQ

SEQ ID NO: 190042 - protein, 6 aa, Mycobacterium bovis
TREGRA

SEQ ID NO: 190043 - protein, 10 aa, Mycobacterium bovis
TREPNSGIRD

SEQ ID NO: 190044 - protein, 6 aa, Mycobacterium bovis
TREQAR

SEQ ID NO: 190045 - protein, 6 aa, Mycobacterium bovis
TRERRD

SEQ ID NO: 190046 - protein, 8 aa, Mycobacterium bovis
TRESEHSL

SEQ ID NO: 190047 - protein, 11 aa, Mycobacterium bovis
TRFKPAKAKEI

SEQ ID NO: 190048 - protein, 5 aa, Mycobacterium bovis
TRFQP

SEQ ID NO: 190049 - protein, 5 aa, Mycobacterium bovis
TRGAE

SEQ ID NO: 190050 - protein, 8 aa, Mycobacterium bovis
TRGDTAEE

SEQ ID NO: 190051 - protein, 8 aa, Mycobacterium bovis
TRGEVGQP

SEQ ID NO: 190052 - protein, 6 aa, Mycobacterium bovis
TRGGRV

SEQ ID NO: 190053 - protein, 10 aa, Mycobacterium bovis
TRGKPSAEQL

SEQ ID NO: 190054 - protein, 4 aa, Mycobacterium bovis
TRGP

SEQ ID NO: 190055 - protein, 15 aa, Mycobacterium bovis
TRGPGDSDRAPGADY

SEQ ID NO: 190056 - protein, 10 aa, Mycobacterium bovis
TRGQDAADTI

SEQ ID NO: 190057 - protein, 5 aa, Mycobacterium bovis
TRGRS

SEQ ID NO: 190058 - protein, 13 aa, Mycobacterium bovis
TRGSGPGSARTFP

SEQ ID NO: 190059 - protein, 8 aa, Mycobacterium bovis
TRGTRPAL

SEQ ID NO: 190060 - protein, 7 aa, Mycobacterium bovis
TRGVDDR

SEQ ID NO: 190061 - protein, 13 aa, Mycobacterium bovis
TRGVGSGAPGFSP

SEQ ID NO: 190062 - protein, 18 aa, Mycobacterium bovis
TRKGVEDAGGTYQPHPAE

SEQ ID NO: 190063 - protein, 5 aa, Mycobacterium bovis
TRKPF

SEQ ID NO: 190064 - protein, 25 aa, Mycobacterium bovis
TRKPPAEPDLAKAGAHSAGGPEPAA

SEQ ID NO: 190065 - protein, 4 aa, Mycobacterium bovis
TRLP

SEQ ID NO: 190066 - protein, 6 aa, Mycobacterium bovis
TRLSGQ

SEQ ID NO: 190067 - protein, 10 aa, Mycobacterium bovis
TRMENPAGTV

SEQ ID NO: 190068 - protein, 7 aa, Mycobacterium bovis
TRNASTG

SEQ ID NO: 190069 - protein, 17 aa, Mycobacterium bovis
TRNDEPERASRPFDKDR

SEQ ID NO: 190070 - protein, 9 aa, Mycobacterium bovis
TRNDKGKFT

SEQ ID NO: 190071 - protein, 6 aa, Mycobacterium bovis
TRNGQA

SEQ ID NO: 190072 - protein, 5 aa, Mycobacterium bovis
TRPAL

SEQ ID NO: 190073 - protein, 22 aa, Mycobacterium bovis
TRPARNDREEPSSARGAATTGV

SEQ ID NO: 190074 - protein, 7 aa, Mycobacterium bovis
TRPDAGS

SEQ ID NO: 190075 - protein, 7 aa, Mycobacterium bovis
TRPDGTE

SEQ ID NO: 190076 - protein, 5 aa, Mycobacterium bovis
TRPGG

SEQ ID NO: 190077 - protein, 9 aa, Mycobacterium bovis
TRPGGNKKR

SEQ ID NO: 190078 - protein, 16 aa, Mycobacterium bovis
TRPGVGYPRTYEDQER

SEQ ID NO: 190079 - protein, 14 aa, Mycobacterium bovis
TRPNPDDPTGRSTM

SEQ ID NO: 190080 - protein, 6 aa, Mycobacterium bovis
TRPTIG

SEQ ID NO: 190081 - protein, 6 aa, Mycobacterium bovis
TRPTLR

SEQ ID NO: 190082 - protein, 4 aa, Mycobacterium bovis
TRQI

SEQ ID NO: 190083 - protein, 8 aa, Mycobacterium bovis
TRRAEARA

SEQ ID NO: 190084 - protein, 6 aa, Mycobacterium bovis
TRRDGT

SEQ ID NO: 190085 - protein, 17 aa, Mycobacterium bovis
TRRGTATRCPVSTSPGV

SEQ ID NO: 190086 - protein, 4 aa, Mycobacterium bovis
TRRT

SEQ ID NO: 190087 - protein, 8 aa, Mycobacterium bovis
TRSGDLDP

SEQ ID NO: 190088 - protein, 11 aa, Mycobacterium bovis
TRSGSSGWTTH

SEQ ID NO: 190089 - protein, 4 aa, Mycobacterium bovis
TRSN

SEQ ID NO: 190090 - protein, 7 aa, Mycobacterium bovis
TRSNRHT

SEQ ID NO: 190091 - protein, 4 aa, Mycobacterium bovis
TRSP

SEQ ID NO: 190092 - protein, 7 aa, Mycobacterium bovis
TRSRPGD

SEQ ID NO: 190093 - protein, 8 aa, Mycobacterium bovis
TRSTPEKS

SEQ ID NO: 190094 - protein, 13 aa, Mycobacterium bovis
TRSYRDAKSNTEV

SEQ ID NO: 190095 - protein, 4 aa, Mycobacterium bovis
TRTA

SEQ ID NO: 190096 - protein, 7 aa, Mycobacterium bovis
TRTAAPP

SEQ ID NO: 190097 - protein, 6 aa, Mycobacterium bovis
TRTDRI

SEQ ID NO: 190098 - protein, 9 aa, Mycobacterium bovis
TRTGDGYGG

SEQ ID NO: 190099 - protein, 9 aa, Mycobacterium bovis
TRTKTRPYL

SEQ ID NO: 190100 - protein, 21 aa, Mycobacterium bovis
TRTPGGKGANQAVAAARAGAQ

SEQ ID NO: 190101 - protein, 17 aa, Mycobacterium bovis
TRTVDGGWAGGYGTSKW

SEQ ID NO: 190102 - protein, 8 aa, Mycobacterium bovis
TRVEQRTD

SEQ ID NO: 190103 - protein, 19 aa, Mycobacterium bovis
TRVGGYGKLPADTHPSGGC

SEQ ID NO: 190104 - protein, 10 aa, Mycobacterium bovis
TRVGSGPFPT

SEQ ID NO: 190105 - protein, 6 aa, Mycobacterium bovis
TRVKPG

SEQ ID NO: 190106 - protein, 8 aa, Mycobacterium bovis
TRVPPQRR

SEQ ID NO: 190107 - protein, 8 aa, Mycobacterium bovis
TRVSSSVG

SEQ ID NO: 190108 - protein, 8 aa, Mycobacterium bovis
TRYEGPTG

SEQ ID NO: 190109 - protein, 9 aa, Mycobacterium bovis
TRYGDGSVA

SEQ ID NO: 190110 - protein, 13 aa, Mycobacterium bovis
TRYPPDGVSADSV

SEQ ID NO: 190111 - protein, 5 aa, Mycobacterium bovis
TRYTA

SEQ ID NO: 190112 - protein, 6 aa, Mycobacterium bovis
TSAETI

SEQ ID NO: 190113 - protein, 9 aa, Mycobacterium bovis
TSAEVTEST

SEQ ID NO: 190114 - protein, 8 aa, Mycobacterium bovis
TSAGGDPV

SEQ ID NO: 190115 - protein, 5 aa, Mycobacterium bovis
TSAGI

SEQ ID NO: 190116 - protein, 6 aa, Mycobacterium bovis
TSAGPL

SEQ ID NO: 190117 - protein, 9 aa, Mycobacterium bovis
TSAGRHPDS

SEQ ID NO: 190118 - protein, 7 aa, Mycobacterium bovis
TSAKGEQ

SEQ ID NO: 190119 - protein, 5 aa, Mycobacterium bovis
TSAPA

SEQ ID NO: 190120 - protein, 16 aa, Mycobacterium bovis
TSAPAGDTFPTAAPRS

SEQ ID NO: 190121 - protein, 8 aa, Mycobacterium bovis
TSAPGPRH

SEQ ID NO: 190122 - protein, 13 aa, Mycobacterium bovis
TSAQAKAAADQAR

SEQ ID NO: 190123 - protein, 18 aa, Mycobacterium bovis
TSARSARSLATTHPEAGH

SEQ ID NO: 190124 - protein, 8 aa, Mycobacterium bovis
TSASASRL

SEQ ID NO: 190125 - protein, 17 aa, Mycobacterium bovis
TSASSYADTEAANAVVT

SEQ ID NO: 190126 - protein, 5 aa, Mycobacterium bovis
TSATE

SEQ ID NO: 190127 - protein, 8 aa, Mycobacterium bovis
TSATPARA

SEQ ID NO: 190128 - protein, 8 aa, Mycobacterium bovis
TSATTQAA

SEQ ID NO: 190129 - protein, 8 aa, Mycobacterium bovis
TSAVDSRR

SEQ ID NO: 190130 - protein, 4 aa, Mycobacterium bovis
TSCG

SEQ ID NO: 190131 - protein, 4 aa, Mycobacterium bovis
TSCS

SEQ ID NO: 190132 - protein, 8 aa, Mycobacterium bovis
TSDDGTSI

SEQ ID NO: 190133 - protein, 4 aa, Mycobacterium bovis
TSDE

SEQ ID NO: 190134 - protein, 5 aa, Mycobacterium bovis
TSDGA

SEQ ID NO: 190135 - protein, 7 aa, Mycobacterium bovis
TSDGSTL

SEQ ID NO: 190136 - protein, 8 aa, Mycobacterium bovis
TSDGTHND

SEQ ID NO: 190137 - protein, 11 aa, Mycobacterium bovis
TSDLSTPAVNS

SEQ ID NO: 190138 - protein, 9 aa, Mycobacterium bovis
TSDMPPAVP

SEQ ID NO: 190139 - protein, 7 aa, Mycobacterium bovis
TSDPDEL

SEQ ID NO: 190140 - protein, 9 aa, Mycobacterium bovis
TSDPPAHTR

SEQ ID NO: 190141 - protein, 7 aa, Mycobacterium bovis
TSDPQEL

SEQ ID NO: 190142 - protein, 8 aa, Mycobacterium bovis
TSDPTDAA

SEQ ID NO: 190143 - protein, 14 aa, Mycobacterium bovis
TSDVGRPKVESAAE

SEQ ID NO: 190144 - protein, 13 aa, Mycobacterium bovis
TSEDPYDLTREPE

SEQ ID NO: 190145 - protein, 9 aa, Mycobacterium bovis
TSEEDETAW

SEQ ID NO: 190146 - protein, 8 aa, Mycobacterium bovis
TSEEERAR

SEQ ID NO: 190147 - protein, 6 aa, Mycobacterium bovis
TSEERQ

SEQ ID NO: 190148 - protein, 5 aa, Mycobacterium bovis
TSEGV

SEQ ID NO: 190149 - protein, 8 aa, Mycobacterium bovis
TSEKIGQS

SEQ ID NO: 190150 - protein, 6 aa, Mycobacterium bovis
TSERYT

SEQ ID NO: 190151 - protein, 11 aa, Mycobacterium bovis
TSEVYGSSPHD

SEQ ID NO: 190152 - protein, 7 aa, Mycobacterium bovis
TSFDTGA

SEQ ID NO: 190153 - protein, 6 aa, Mycobacterium bovis
TSFGPK

SEQ ID NO: 190154 - protein, 7 aa, Mycobacterium bovis
TSGAGGL

SEQ ID NO: 190155 - protein, 6 aa, Mycobacterium bovis
TSGAIE

SEQ ID NO: 190156 - protein, 6 aa, Mycobacterium bovis
TSGANG

SEQ ID NO: 190157 - protein, 9 aa, Mycobacterium bovis
TSGATDAKQ

SEQ ID NO: 190158 - protein, 4 aa, Mycobacterium bovis
TSGD

SEQ ID NO: 190159 - protein, 13 aa, Mycobacterium bovis
TSGDGTRPLTGAP

SEQ ID NO: 190160 - protein, 8 aa, Mycobacterium bovis
TSGDHRLD

SEQ ID NO: 190161 - protein, 8 aa, Mycobacterium bovis
TSGDPRAA

SEQ ID NO: 190162 - protein, 7 aa, Mycobacterium bovis
TSGDSGD

SEQ ID NO: 190163 - protein, 6 aa, Mycobacterium bovis
TSGEQR

SEQ ID NO: 190164 - protein, 18 aa, Mycobacterium bovis
TSGGGAYAAAEAAATSPL

SEQ ID NO: 190165 - protein, 7 aa, Mycobacterium bovis
TSGGGLQ

SEQ ID NO: 190166 - protein, 5 aa, Mycobacterium bovis
TSGGV

SEQ ID NO: 190167 - protein, 4 aa, Mycobacterium bovis
TSGL

SEQ ID NO: 190168 - protein, 6 aa, Mycobacterium bovis
TSGNSM

SEQ ID NO: 190169 - protein, 17 aa, Mycobacterium bovis
TSGPALQQNLVAVMEGR

SEQ ID NO: 190170 - protein, 8 aa, Mycobacterium bovis
TSGPGATN

SEQ ID NO: 190171 - protein, 6 aa, Mycobacterium bovis
TSGPGF

SEQ ID NO: 190172 - protein, 11 aa, Mycobacterium bovis
TSGPGFGHTRN

SEQ ID NO: 190173 - protein, 9 aa, Mycobacterium bovis
TSGPYTDTD

SEQ ID NO: 190174 - protein, 5 aa, Mycobacterium bovis
TSGQL

SEQ ID NO: 190175 - protein, 5 aa, Mycobacterium bovis
TSGRA

SEQ ID NO: 190176 - protein, 6 aa, Mycobacterium bovis
TSGRAE

SEQ ID NO: 190177 - protein, 5 aa, Mycobacterium bovis
TSGSK

SEQ ID NO: 190178 - protein, 9 aa, Mycobacterium bovis
TSGSSSGFK

SEQ ID NO: 190179 - protein, 9 aa, Mycobacterium bovis
TSGSTRAPA

SEQ ID NO: 190180 - protein, 10 aa, Mycobacterium bovis
TSGSTRAPAG

SEQ ID NO: 190181 - protein, 10 aa, Mycobacterium bovis
TSGSTRPPVG

SEQ ID NO: 190182 - protein, 9 aa, Mycobacterium bovis
TSGSTRTPA

SEQ ID NO: 190183 - protein, 10 aa, Mycobacterium bovis
TSGSTRTPAG

SEQ ID NO: 190184 - protein, 5 aa, Mycobacterium bovis
TSGTI

SEQ ID NO: 190185 - protein, 10 aa, Mycobacterium bovis
TSGTTAYPKG

SEQ ID NO: 190186 - protein, 11 aa, Mycobacterium bovis
TSGTTGPPKGA

SEQ ID NO: 190187 - protein, 9 aa, Mycobacterium bovis
TSGTTGQPK

SEQ ID NO: 190188 - protein, 9 aa, Mycobacterium bovis
TSHDGRYTR

SEQ ID NO: 190189 - protein, 8 aa, Mycobacterium bovis
TSHGKHRT

SEQ ID NO: 190190 - protein, 20 aa, Mycobacterium bovis
TSHPSTRKSRVGPGASEAPL

SEQ ID NO: 190191 - protein, 6 aa, Mycobacterium bovis
TSHRNY

SEQ ID NO: 190192 - protein, 8 aa, Mycobacterium bovis
TSIAPANP

SEQ ID NO: 190193 - protein, 5 aa, Mycobacterium bovis
TSIED

SEQ ID NO: 190194 - protein, 9 aa, Mycobacterium bovis
TSKAEPTAR

SEQ ID NO: 190195 - protein, 7 aa, Mycobacterium bovis
TSKLDEE

SEQ ID NO: 190196 - protein, 11 aa, Mycobacterium bovis
TSKPGQPPETV

SEQ ID NO: 190197 - protein, 11 aa, Mycobacterium bovis
TSKSADGKRVV

SEQ ID NO: 190198 - protein, 7 aa, Mycobacterium bovis
TSLAGGT

SEQ ID NO: 190199 - protein, 5 aa, Mycobacterium bovis
TSLED

SEQ ID NO: 190200 - protein, 7 aa, Mycobacterium bovis
TSLGTGE

SEQ ID NO: 190201 - protein, 10 aa, Mycobacterium bovis
TSLPAGATKA

SEQ ID NO: 190202 - protein, 6 aa, Mycobacterium bovis
TSLPGR

SEQ ID NO: 190203 - protein, 9 aa, Mycobacterium bovis
TSLRDGSHH

SEQ ID NO: 190204 - protein, 17 aa, Mycobacterium bovis
TSLSAANATAAASTTSV

SEQ ID NO: 190205 - protein, 21 aa, Mycobacterium bovis
TSLSGEPKPPPQKKPKLPPPA

SEQ ID NO: 190206 - protein, 6 aa, Mycobacterium bovis
TSMEQG

SEQ ID NO: 190207 - protein, 9 aa, Mycobacterium bovis
TSMRDRGSP

SEQ ID NO: 190208 - protein, 5 aa, Mycobacterium bovis
TSMTN

SEQ ID NO: 190209 - protein, 14 aa, Mycobacterium bovis
TSNARRAYGLGWMR

SEQ ID NO: 190210 - protein, 19 aa, Mycobacterium bovis
TSNPEGAAVQNAAADGRSV

SEQ ID NO: 190211 - protein, 6 aa, Mycobacterium bovis
TSNTAG

SEQ ID NO: 190212 - protein, 8 aa, Mycobacterium bovis
TSNTEKVP

SEQ ID NO: 190213 - protein, 8 aa, Mycobacterium bovis
TSPAGARY

SEQ ID NO: 190214 - protein, 7 aa, Mycobacterium bovis
TSPANPE

SEQ ID NO: 190215 - protein, 7 aa, Mycobacterium bovis
TSPDPAN

SEQ ID NO: 190216 - protein, 5 aa, Mycobacterium bovis
TSPEA

SEQ ID NO: 190217 - protein, 10 aa, Mycobacterium bovis
TSPEPFGAGT

SEQ ID NO: 190218 - protein, 5 aa, Mycobacterium bovis
TSPFG

SEQ ID NO: 190219 - protein, 5 aa, Mycobacterium bovis
TSPGS

SEQ ID NO: 190220 - protein, 8 aa, Mycobacterium bovis
TSPNPELR

SEQ ID NO: 190221 - protein, 9 aa, Mycobacterium bovis
TSPPKGPNW

SEQ ID NO: 190222 - protein, 5 aa, Mycobacterium bovis
TSPSA

SEQ ID NO: 190223 - protein, 11 aa, Mycobacterium bovis
TSPTARGGWRE

SEQ ID NO: 190224 - protein, 8 aa, Mycobacterium bovis
TSPTNESK

SEQ ID NO: 190225 - protein, 6 aa, Mycobacterium bovis
TSPWPE

SEQ ID NO: 190226 - protein, 8 aa, Mycobacterium bovis
TSPWPTDD

SEQ ID NO: 190227 - protein, 7 aa, Mycobacterium bovis
TSQCTGD

SEQ ID NO: 190228 - protein, 15 aa, Mycobacterium bovis
TSQPLPAPSPGKDCS

SEQ ID NO: 190229 - protein, 4 aa, Mycobacterium bovis
TSQR

SEQ ID NO: 190230 - protein, 8 aa, Mycobacterium bovis
TSRDLTEN

SEQ ID NO: 190231 - protein, 15 aa, Mycobacterium bovis
TSRERHSHKAAKQRA

SEQ ID NO: 190232 - protein, 5 aa, Mycobacterium bovis
TSRGA

SEQ ID NO: 190233 - protein, 8 aa, Mycobacterium bovis
TSRLPADN

SEQ ID NO: 190234 - protein, 7 aa, Mycobacterium bovis
TSRRDGK

SEQ ID NO: 190235 - protein, 16 aa, Mycobacterium bovis
TSRRGIAEEKPEAYKD

SEQ ID NO: 190236 - protein, 8 aa, Mycobacterium bovis
TSRRPVPI

SEQ ID NO: 190237 - protein, 4 aa, Mycobacterium bovis
TSRS

SEQ ID NO: 190238 - protein, 19 aa, Mycobacterium bovis
TSRWPSGIKDGAEFVIPTM

SEQ ID NO: 190239 - protein, 10 aa, Mycobacterium bovis
TSSDALRQTA

SEQ ID NO: 190240 - protein, 8 aa, Mycobacterium bovis
TSSEAGLV

SEQ ID NO: 190241 - protein, 7 aa, Mycobacterium bovis
TSSETVN

SEQ ID NO: 190242 - protein, 22 aa, Mycobacterium bovis
TSSGAGLQGSVGQGNYSAAKAG

SEQ ID NO: 190243 - protein, 8 aa, Mycobacterium bovis
TSSGDRVD

SEQ ID NO: 190244 - protein, 13 aa, Mycobacterium bovis
TSSGIRTSDGVEH

SEQ ID NO: 190245 - protein, 8 aa, Mycobacterium bovis
TSSGTPAM

SEQ ID NO: 190246 - protein, 20 aa, Mycobacterium bovis
TSSNPTAGGAAVGSGIGPTR

SEQ ID NO: 190247 - protein, 10 aa, Mycobacterium bovis
TSSPEELGNI

SEQ ID NO: 190248 - protein, 9 aa, Mycobacterium bovis
TSSPPPGPV

SEQ ID NO: 190249 - protein, 9 aa, Mycobacterium bovis
TSSRAPLGR

SEQ ID NO: 190250 - protein, 5 aa, Mycobacterium bovis
TSSSR

SEQ ID NO: 190251 - protein, 9 aa, Mycobacterium bovis
TSSSSGTYG

SEQ ID NO: 190252 - protein, 7 aa, Mycobacterium bovis
TSSTQRP

SEQ ID NO: 190253 - protein, 4 aa, Mycobacterium bovis
TSTA

SEQ ID NO: 190254 - protein, 8 aa, Mycobacterium bovis
TSTADANI

SEQ ID NO: 190255 - protein, 15 aa, Mycobacterium bovis
TSTAGAYASAEAANV

SEQ ID NO: 190256 - protein, 5 aa, Mycobacterium bovis
TSTAW

SEQ ID NO: 190257 - protein, 8 aa, Mycobacterium bovis
TSTDGIAT

SEQ ID NO: 190258 - protein, 4 aa, Mycobacterium bovis
TSTK

SEQ ID NO: 190259 - protein, 4 aa, Mycobacterium bovis
TSTL

SEQ ID NO: 190260 - protein, 5 aa, Mycobacterium bovis
TSTPR

SEQ ID NO: 190261 - protein, 6 aa, Mycobacterium bovis
TSTQSD

SEQ ID NO: 190262 - protein, 12 aa, Mycobacterium bovis
TSTRDDRVHPGH

SEQ ID NO: 190263 - protein, 9 aa, Mycobacterium bovis
TSTRPQTTR

SEQ ID NO: 190264 - protein, 11 aa, Mycobacterium bovis
TSTRQSRKGAI

SEQ ID NO: 190265 - protein, 10 aa, Mycobacterium bovis
TSTRTPVQAA

SEQ ID NO: 190266 - protein, 6 aa, Mycobacterium bovis
TSTTKS

SEQ ID NO: 190267 - protein, 8 aa, Mycobacterium bovis
TSTTRSEQ

SEQ ID NO: 190268 - protein, 6 aa, Mycobacterium bovis
TSTTWP

SEQ ID NO: 190269 - protein, 9 aa, Mycobacterium bovis
TSVAAASNT

SEQ ID NO: 190270 - protein, 4 aa, Mycobacterium bovis
TSVD

SEQ ID NO: 190271 - protein, 5 aa, Mycobacterium bovis
TSVER

SEQ ID NO: 190272 - protein, 4 aa, Mycobacterium bovis
TSVG

SEQ ID NO: 190273 - protein, 7 aa, Mycobacterium bovis
TSVGPDL

SEQ ID NO: 190274 - protein, 6 aa, Mycobacterium bovis
TSVGST

SEQ ID NO: 190275 - protein, 7 aa, Mycobacterium bovis
TSYATHN

SEQ ID NO: 190276 - protein, 7 aa, Mycobacterium bovis
TSYGRSS

SEQ ID NO: 190277 - protein, 6 aa, Mycobacterium bovis
TSYPKR

SEQ ID NO: 190278 - protein, 6 aa, Mycobacterium bovis
TSYTGQ

SEQ ID NO: 190279 - protein, 9 aa, Mycobacterium bovis
TSYTNDGKP

SEQ ID NO: 190280 - protein, 16 aa, Mycobacterium bovis
TTAAAAFDQPARDTLA

SEQ ID NO: 190281 - protein, 5 aa, Mycobacterium bovis
TTADG

SEQ ID NO: 190282 - protein, 12 aa, Mycobacterium bovis
TTADTTPESAAD

SEQ ID NO: 190283 - protein, 15 aa, Mycobacterium bovis
TTAEQLGARGGSNGG

SEQ ID NO: 190284 - protein, 4 aa, Mycobacterium bovis
TTAG

SEQ ID NO: 190285 - protein, 9 aa, Mycobacterium bovis
TTAGDDLAS

SEQ ID NO: 190286 - protein, 11 aa, Mycobacterium bovis
TTAGDGSSAIA

SEQ ID NO: 190287 - protein, 12 aa, Mycobacterium bovis
TTAGNAAVTVLI

SEQ ID NO: 190288 - protein, 10 aa, Mycobacterium bovis
TTAGSDAKRE

SEQ ID NO: 190289 - protein, 5 aa, Mycobacterium bovis
TTAGT

SEQ ID NO: 190290 - protein, 4 aa, Mycobacterium bovis
TTAN

SEQ ID NO: 190291 - protein, 8 aa, Mycobacterium bovis
TTANGVEG

SEQ ID NO: 190292 - protein, 5 aa, Mycobacterium bovis
TTAPA

SEQ ID NO: 190293 - protein, 18 aa, Mycobacterium bovis
TTAPATNPASASAVQAKD

SEQ ID NO: 190294 - protein, 10 aa, Mycobacterium bovis
TTAPGNGAAL

SEQ ID NO: 190295 - protein, 5 aa, Mycobacterium bovis
TTARE

SEQ ID NO: 190296 - protein, 6 aa, Mycobacterium bovis
TTARGI

SEQ ID NO: 190297 - protein, 16 aa, Mycobacterium bovis
TTASGGAGGAGGAGGM

SEQ ID NO: 190298 - protein, 9 aa, Mycobacterium bovis
TTASKNPKE

SEQ ID NO: 190299 - protein, 5 aa, Mycobacterium bovis
TTASQ

SEQ ID NO: 190300 - protein, 8 aa, Mycobacterium bovis
TTATLNDG

SEQ ID NO: 190301 - protein, 6 aa, Mycobacterium bovis
TTATPV

SEQ ID NO: 190302 - protein, 7 aa, Mycobacterium bovis
TTATRDI

SEQ ID NO: 190303 - protein, 7 aa, Mycobacterium bovis
TTATTPD

SEQ ID NO: 190304 - protein, 10 aa, Mycobacterium bovis
TTCQQRSVET

SEQ ID NO: 190305 - protein, 12 aa, Mycobacterium bovis
TTDAEAELRRGR

SEQ ID NO: 190306 - protein, 7 aa, Mycobacterium bovis
TTDDGTG

SEQ ID NO: 190307 - protein, 4 aa, Mycobacterium bovis
TTDE

SEQ ID NO: 190308 - protein, 10 aa, Mycobacterium bovis
TTDEGSQRVS

SEQ ID NO: 190309 - protein, 6 aa, Mycobacterium bovis
TTDETH

SEQ ID NO: 190310 - protein, 5 aa, Mycobacterium bovis
TTDIR

SEQ ID NO: 190311 - protein, 14 aa, Mycobacterium bovis
TTDKASGIAQDPND

SEQ ID NO: 190312 - protein, 7 aa, Mycobacterium bovis
TTDNDAN

SEQ ID NO: 190313 - protein, 7 aa, Mycobacterium bovis
TTDPIEG

SEQ ID NO: 190314 - protein, 8 aa, Mycobacterium bovis
TTDPSSGF

SEQ ID NO: 190315 - protein, 9 aa, Mycobacterium bovis
TTDPTSLTE

SEQ ID NO: 190316 - protein, 5 aa, Mycobacterium bovis
TTDQR

SEQ ID NO: 190317 - protein, 9 aa, Mycobacterium bovis
TTDQSAAKK

SEQ ID NO: 190318 - protein, 5 aa, Mycobacterium bovis
TTDRG

SEQ ID NO: 190319 - protein, 12 aa, Mycobacterium bovis
TTDTRRTPTELR

SEQ ID NO: 190320 - protein, 17 aa, Mycobacterium bovis
TTEDESAGSGGLPPDDV

SEQ ID NO: 190321 - protein, 15 aa, Mycobacterium bovis
TTEDPANGFRPDTGR

SEQ ID NO: 190322 - protein, 6 aa, Mycobacterium bovis
TTEDSA

SEQ ID NO: 190323 - protein, 7 aa, Mycobacterium bovis
TTEGERQ

SEQ ID NO: 190324 - protein, 5 aa, Mycobacterium bovis
TTEHR

SEQ ID NO: 190325 - protein, 4 aa, Mycobacterium bovis
TTEL

SEQ ID NO: 190326 - protein, 7 aa, Mycobacterium bovis
TTENPSF

SEQ ID NO: 190327 - protein, 9 aa, Mycobacterium bovis
TTEPAEYDQ

SEQ ID NO: 190328 - protein, 6 aa, Mycobacterium bovis
TTEPIA

SEQ ID NO: 190329 - protein, 5 aa, Mycobacterium bovis
TTEPR

SEQ ID NO: 190330 - protein, 7 aa, Mycobacterium bovis
TTEQAKQ

SEQ ID NO: 190331 - protein, 4 aa, Mycobacterium bovis
TTGA

SEQ ID NO: 190332 - protein, 18 aa, Mycobacterium bovis
TTGADKYATAEADNIKTF

SEQ ID NO: 190333 - protein, 8 aa, Mycobacterium bovis
TTGADTPV

SEQ ID NO: 190334 - protein, 5 aa, Mycobacterium bovis
TTGEP

SEQ ID NO: 190335 - protein, 6 aa, Mycobacterium bovis
TTGFPK

SEQ ID NO: 190336 - protein, 13 aa, Mycobacterium bovis
TTGGAPMRPPRPP

SEQ ID NO: 190337 - protein, 5 aa, Mycobacterium bovis
TTGGI

SEQ ID NO: 190338 - protein, 17 aa, Mycobacterium bovis
TTGGRTTGNDATPPDAI

SEQ ID NO: 190339 - protein, 5 aa, Mycobacterium bovis
TTGLG

SEQ ID NO: 190340 - protein, 4 aa, Mycobacterium bovis
TTGN

SEQ ID NO: 190341 - protein, 11 aa, Mycobacterium bovis
TTGNLSPGRAQ

SEQ ID NO: 190342 - protein, 9 aa, Mycobacterium bovis
TTGPKPLVQ

SEQ ID NO: 190343 - protein, 8 aa, Mycobacterium bovis
TTGPLGQG

SEQ ID NO: 190344 - protein, 7 aa, Mycobacterium bovis
TTGPSSG

SEQ ID NO: 190345 - protein, 11 aa, Mycobacterium bovis
TTGRKTGQPRV

SEQ ID NO: 190346 - protein, 5 aa, Mycobacterium bovis
TTGSG

SEQ ID NO: 190347 - protein, 6 aa, Mycobacterium bovis
TTGSSG

SEQ ID NO: 190348 - protein, 7 aa, Mycobacterium bovis
TTGTHGN

SEQ ID NO: 190349 - protein, 4 aa, Mycobacterium bovis
TTGV

SEQ ID NO: 190350 - protein, 8 aa, Mycobacterium bovis
TTGYGSAV

SEQ ID NO: 190351 - protein, 18 aa, Mycobacterium bovis
TTHGGHANATNHPDGGAE

SEQ ID NO: 190352 - protein, 5 aa, Mycobacterium bovis
TTHIT

SEQ ID NO: 190353 - protein, 17 aa, Mycobacterium bovis
TTHTTHPPQTPHPPEPH

SEQ ID NO: 190354 - protein, 10 aa, Mycobacterium bovis
TTIGDEDRNF

SEQ ID NO: 190355 - protein, 21 aa, Mycobacterium bovis
TTIPTKRSETFTTADDNQPSV

SEQ ID NO: 190356 - protein, 5 aa, Mycobacterium bovis
TTIQA

SEQ ID NO: 190357 - protein, 9 aa, Mycobacterium bovis
TTIYGGTSE

SEQ ID NO: 190358 - protein, 6 aa, Mycobacterium bovis
TTKTFT

SEQ ID NO: 190359 - protein, 7 aa, Mycobacterium bovis
TTLGRTG

SEQ ID NO: 190360 - protein, 15 aa, Mycobacterium bovis
TTNSGEPGTTKGEAE

SEQ ID NO: 190361 - protein, 10 aa, Mycobacterium bovis
TTNTEEQALD

SEQ ID NO: 190362 - protein, 9 aa, Mycobacterium bovis
TTNTTDLSG

SEQ ID NO: 190363 - protein, 10 aa, Mycobacterium bovis
TTPAAATPPV

SEQ ID NO: 190364 - protein, 5 aa, Mycobacterium bovis
TTPAD

SEQ ID NO: 190365 - protein, 5 aa, Mycobacterium bovis
TTPAN

SEQ ID NO: 190366 - protein, 6 aa, Mycobacterium bovis
TTPART

SEQ ID NO: 190367 - protein, 4 aa, Mycobacterium bovis
TTPD

SEQ ID NO: 190368 - protein, 17 aa, Mycobacterium bovis
TTPDGDYQTYKANDGGY

SEQ ID NO: 190369 - protein, 4 aa, Mycobacterium bovis
TTPE

SEQ ID NO: 190370 - protein, 6 aa, Mycobacterium bovis
TTPEDY

SEQ ID NO: 190371 - protein, 7 aa, Mycobacterium bovis
TTPERTA

SEQ ID NO: 190372 - protein, 11 aa, Mycobacterium bovis
TTPMGGDPDSA

SEQ ID NO: 190373 - protein, 4 aa, Mycobacterium bovis
TTPP

SEQ ID NO: 190374 - protein, 5 aa, Mycobacterium bovis
TTPPL

SEQ ID NO: 190375 - protein, 5 aa, Mycobacterium bovis
TTPQC

SEQ ID NO: 190376 - protein, 9 aa, Mycobacterium bovis
TTQERDQWD

SEQ ID NO: 190377 - protein, 4 aa, Mycobacterium bovis
TTQQ

SEQ ID NO: 190378 - protein, 4 aa, Mycobacterium bovis
TTQS

SEQ ID NO: 190379 - protein, 7 aa, Mycobacterium bovis
TTRGDGV

SEQ ID NO: 190380 - protein, 9 aa, Mycobacterium bovis
TTRGSQLTP

SEQ ID NO: 190381 - protein, 7 aa, Mycobacterium bovis
TTRLPRD

SEQ ID NO: 190382 - protein, 7 aa, Mycobacterium bovis
TTRRGDA

SEQ ID NO: 190383 - protein, 4 aa, Mycobacterium bovis
TTRS

SEQ ID NO: 190384 - protein, 10 aa, Mycobacterium bovis
TTRSGALTGP

SEQ ID NO: 190385 - protein, 7 aa, Mycobacterium bovis
TTRTADQ

SEQ ID NO: 190386 - protein, 8 aa, Mycobacterium bovis
TTRTERHR

SEQ ID NO: 190387 - protein, 7 aa, Mycobacterium bovis
TTSDPYV

SEQ ID NO: 190388 - protein, 8 aa, Mycobacterium bovis
TTSEHHKP

SEQ ID NO: 190389 - protein, 5 aa, Mycobacterium bovis
TTSFE

SEQ ID NO: 190390 - protein, 5 aa, Mycobacterium bovis
TTSGM

SEQ ID NO: 190391 - protein, 4 aa, Mycobacterium bovis
TTSL

SEQ ID NO: 190392 - protein, 13 aa, Mycobacterium bovis
TTSPNRHAGSTAM

SEQ ID NO: 190393 - protein, 10 aa, Mycobacterium bovis
TTSPQDARTI

SEQ ID NO: 190394 - protein, 14 aa, Mycobacterium bovis
TTSQAPRVDEGRAE

SEQ ID NO: 190395 - protein, 4 aa, Mycobacterium bovis
TTTA

SEQ ID NO: 190396 - protein, 12 aa, Mycobacterium bovis
TTTAAGERSHGR

SEQ ID NO: 190397 - protein, 6 aa, Mycobacterium bovis
TTTDLD

SEQ ID NO: 190398 - protein, 12 aa, Mycobacterium bovis
TTTEPKARALRP

SEQ ID NO: 190399 - protein, 4 aa, Mycobacterium bovis
TTTG

SEQ ID NO: 190400 - protein, 5 aa, Mycobacterium bovis
TTTGD

SEQ ID NO: 190401 - protein, 5 aa, Mycobacterium bovis
TTTGL

SEQ ID NO: 190402 - protein, 14 aa, Mycobacterium bovis
TTTIRSAKSSSSAV

SEQ ID NO: 190403 - protein, 11 aa, Mycobacterium bovis
TTTPKKPNSAL

SEQ ID NO: 190404 - protein, 4 aa, Mycobacterium bovis
TTTT

SEQ ID NO: 190405 - protein, 4 aa, Mycobacterium bovis
TTVD

SEQ ID NO: 190406 - protein, 9 aa, Mycobacterium bovis
TTVPGPEGE

SEQ ID NO: 190407 - protein, 7 aa, Mycobacterium bovis
TTVQGSG

SEQ ID NO: 190408 - protein, 9 aa, Mycobacterium bovis
TTVQPGPLA

SEQ ID NO: 190409 - protein, 4 aa, Mycobacterium bovis
TTVT

SEQ ID NO: 190410 - protein, 9 aa, Mycobacterium bovis
TTVTGEVPA

SEQ ID NO: 190411 - protein, 7 aa, Mycobacterium bovis
TTVYPGS

SEQ ID NO: 190412 - protein, 6 aa, Mycobacterium bovis
TTYEST

SEQ ID NO: 190413 - protein, 4 aa, Mycobacterium bovis
TTYP

SEQ ID NO: 190414 - protein, 8 aa, Mycobacterium bovis
TTYSPLPA

SEQ ID NO: 190415 - protein, 5 aa, Mycobacterium bovis
TVAGA

SEQ ID NO: 190416 - protein, 6 aa, Mycobacterium bovis
TVAGGG

SEQ ID NO: 190417 - protein, 9 aa, Mycobacterium bovis
TVAGRKEEF

SEQ ID NO: 190418 - protein, 12 aa, Mycobacterium bovis
TVASQTRAVGER

SEQ ID NO: 190419 - protein, 10 aa, Mycobacterium bovis
TVATPRDAQD

SEQ ID NO: 190420 - protein, 14 aa, Mycobacterium bovis
TVDAPGKAQAKSMA

SEQ ID NO: 190421 - protein, 11 aa, Mycobacterium bovis
TVDDAAGEAYD

SEQ ID NO: 190422 - protein, 6 aa, Mycobacterium bovis
TVDDTT

SEQ ID NO: 190423 - protein, 21 aa, Mycobacterium bovis
TVDGEDIPNAAAEGLSHEVGS

SEQ ID NO: 190424 - protein, 20 aa, Mycobacterium bovis
TVDPNSSTTALTGSTEEGQF

SEQ ID NO: 190425 - protein, 9 aa, Mycobacterium bovis
TVDPQPGED

SEQ ID NO: 190426 - protein, 11 aa, Mycobacterium bovis
TVDQPNPSTRF

SEQ ID NO: 190427 - protein, 9 aa, Mycobacterium bovis
TVDRDGVSG

SEQ ID NO: 190428 - protein, 19 aa, Mycobacterium bovis
TVDTPRTETNGKRGGNHNA

SEQ ID NO: 190429 - protein, 8 aa, Mycobacterium bovis
TVESGASV

SEQ ID NO: 190430 - protein, 7 aa, Mycobacterium bovis
TVESGSQ

SEQ ID NO: 190431 - protein, 5 aa, Mycobacterium bovis
TVGDI

SEQ ID NO: 190432 - protein, 13 aa, Mycobacterium bovis
TVGGAAPGGGAAA

SEQ ID NO: 190433 - protein, 7 aa, Mycobacterium bovis
TVGGDAD

SEQ ID NO: 190434 - protein, 9 aa, Mycobacterium bovis
TVGGSGAIN

SEQ ID NO: 190435 - protein, 9 aa, Mycobacterium bovis
TVGPAPGQY

SEQ ID NO: 190436 - protein, 6 aa, Mycobacterium bovis
TVGPAR

SEQ ID NO: 190437 - protein, 5 aa, Mycobacterium bovis
TVGPT

SEQ ID NO: 190438 - protein, 9 aa, Mycobacterium bovis
TVGSIGPGS

SEQ ID NO: 190439 - protein, 12 aa, Mycobacterium bovis
TVGSPGQGNYSA

SEQ ID NO: 190440 - protein, 12 aa, Mycobacterium bovis
TVGVTTSGTFSP

SEQ ID NO: 190441 - protein, 4 aa, Mycobacterium bovis
TVHP

SEQ ID NO: 190442 - protein, 11 aa, Mycobacterium bovis
TVNSRGATTTT

SEQ ID NO: 190443 - protein, 11 aa, Mycobacterium bovis
TVPATDHSGRQ

SEQ ID NO: 190444 - protein, 10 aa, Mycobacterium bovis
TVPGDTAAEH

SEQ ID NO: 190445 - protein, 8 aa, Mycobacterium bovis
TVPGPSGT

SEQ ID NO: 190446 - protein, 11 aa, Mycobacterium bovis
TVPGSKSQTNR

SEQ ID NO: 190447 - protein, 5 aa, Mycobacterium bovis
TVPPP

SEQ ID NO: 190448 - protein, 6 aa, Mycobacterium bovis
TVPRGG

SEQ ID NO: 190449 - protein, 4 aa, Mycobacterium bovis
TVPS

SEQ ID NO: 190450 - protein, 13 aa, Mycobacterium bovis
TVPVGSAPTPSGW

SEQ ID NO: 190451 - protein, 6 aa, Mycobacterium bovis
TVPVGT

SEQ ID NO: 190452 - protein, 12 aa, Mycobacterium bovis
TVRARSDATAVG

SEQ ID NO: 190453 - protein, 5 aa, Mycobacterium bovis
TVRDG

SEQ ID NO: 190454 - protein, 13 aa, Mycobacterium bovis
TVSAPERGPECGE

SEQ ID NO: 190455 - protein, 19 aa, Mycobacterium bovis
TVSAPGSGRGPNPGNVSVS

SEQ ID NO: 190456 - protein, 7 aa, Mycobacterium bovis
TVSNAEE

SEQ ID NO: 190457 - protein, 5 aa, Mycobacterium bovis
TVSRS

SEQ ID NO: 190458 - protein, 23 aa, Mycobacterium bovis
TVTDRSTGGSRQQRAARLGQAQG

SEQ ID NO: 190459 - protein, 4 aa, Mycobacterium bovis
TVTE

SEQ ID NO: 190460 - protein, 6 aa, Mycobacterium bovis
TVTGTS

SEQ ID NO: 190461 - protein, 13 aa, Mycobacterium bovis
TVTSGAAPAGVPG

SEQ ID NO: 190462 - protein, 5 aa, Mycobacterium bovis
TVTSR

SEQ ID NO: 190463 - protein, 25 aa, Mycobacterium bovis
TVTTATGEGYRHSSYRDVGQRAGQL

SEQ ID NO: 190464 - protein, 11 aa, Mycobacterium bovis
TWQDKGSSYLP

SEQ ID NO: 190465 - protein, 25 aa, Mycobacterium bovis
TWRDPSRSIQPNQLGQPHRGPASSP

SEQ ID NO: 190466 - protein, 13 aa, Mycobacterium bovis
TWRPETDLAKTSE

SEQ ID NO: 190467 - protein, 5 aa, Mycobacterium bovis
TWRTR

SEQ ID NO: 190468 - protein, 4 aa, Mycobacterium bovis
TYAS

SEQ ID NO: 190469 - protein, 5 aa, Mycobacterium bovis
TYASS

SEQ ID NO: 190470 - protein, 13 aa, Mycobacterium bovis
TYDTASAAASARG

SEQ ID NO: 190471 - protein, 8 aa, Mycobacterium bovis
TYEASSRK

SEQ ID NO: 190472 - protein, 10 aa, Mycobacterium bovis
TYEGREKEVG

SEQ ID NO: 190473 - protein, 7 aa, Mycobacterium bovis
TYEPETS

SEQ ID NO: 190474 - protein, 18 aa, Mycobacterium bovis
TYEPSRTHWTPDPGAFSG

SEQ ID NO: 190475 - protein, 8 aa, Mycobacterium bovis
TYESPGDL

SEQ ID NO: 190476 - protein, 7 aa, Mycobacterium bovis
TYGDGGN

SEQ ID NO: 190477 - protein, 4 aa, Mycobacterium bovis
TYGG

SEQ ID NO: 190478 - protein, 12 aa, Mycobacterium bovis
TYGGGDWGRTPH

SEQ ID NO: 190479 - protein, 6 aa, Mycobacterium bovis
TYGHGG

SEQ ID NO: 190480 - protein, 4 aa, Mycobacterium bovis
TYGQ

SEQ ID NO: 190481 - protein, 10 aa, Mycobacterium bovis
TYGQGRPAEQ

SEQ ID NO: 190482 - protein, 11 aa, Mycobacterium bovis
TYGTLSEGERK

SEQ ID NO: 190483 - protein, 6 aa, Mycobacterium bovis
TYGTNN

SEQ ID NO: 190484 - protein, 8 aa, Mycobacterium bovis
TYGTYDDS

SEQ ID NO: 190485 - protein, 7 aa, Mycobacterium bovis
TYKPYGP

SEQ ID NO: 190486 - protein, 15 aa, Mycobacterium bovis
TYNEPNTNLTSPETT

SEQ ID NO: 190487 - protein, 10 aa, Mycobacterium bovis
TYPGPGGTIG

SEQ ID NO: 190488 - protein, 4 aa, Mycobacterium bovis
TYPL

SEQ ID NO: 190489 - protein, 9 aa, Mycobacterium bovis
TYPSLDPQG

SEQ ID NO: 190490 - protein, 8 aa, Mycobacterium bovis
TYQTASAK

SEQ ID NO: 190491 - protein, 4 aa, Mycobacterium bovis
TYRD

SEQ ID NO: 190492 - protein, 11 aa, Mycobacterium bovis
TYRDDADTEHR

SEQ ID NO: 190493 - protein, 7 aa, Mycobacterium bovis
TYSDGRV

SEQ ID NO: 190494 - protein, 6 aa, Mycobacterium bovis
TYSPTG

SEQ ID NO: 190495 - protein, 9 aa, Mycobacterium bovis
TYTPGDSLR

SEQ ID NO: 190496 - protein, 12 aa, Mycobacterium bovis
TYTSGTTGPPKA

SEQ ID NO: 190497 - protein, 19 aa, Mycobacterium bovis
VAAAPRTPGRDGEVAPSEQ

SEQ ID NO: 190498 - protein, 7 aa, Mycobacterium bovis
VAAGDNR

SEQ ID NO: 190499 - protein, 7 aa, Mycobacterium bovis
VAAGRAG

SEQ ID NO: 190500 - protein, 10 aa, Mycobacterium bovis
VAAGTEEAAR

SEQ ID NO: 190501 - protein, 6 aa, Mycobacterium bovis
VAAPDR

SEQ ID NO: 190502 - protein, 9 aa, Mycobacterium bovis
VAAPDRPRI

SEQ ID NO: 190503 - protein, 7 aa, Mycobacterium bovis
VAASPND

SEQ ID NO: 190504 - protein, 14 aa, Mycobacterium bovis
VAATGGALSTNGHA

SEQ ID NO: 190505 - protein, 8 aa, Mycobacterium bovis
VADAGSPS

SEQ ID NO: 190506 - protein, 8 aa, Mycobacterium bovis
VADDTRQR

SEQ ID NO: 190507 - protein, 6 aa, Mycobacterium bovis
VADEIE

SEQ ID NO: 190508 - protein, 4 aa, Mycobacterium bovis
VADG

SEQ ID NO: 190509 - protein, 6 aa, Mycobacterium bovis
VADGDA

SEQ ID NO: 190510 - protein, 8 aa, Mycobacterium bovis
VADGDTVY

SEQ ID NO: 190511 - protein, 13 aa, Mycobacterium bovis
VADGGLGSLLGGA

SEQ ID NO: 190512 - protein, 7 aa, Mycobacterium bovis
VADGYPD

SEQ ID NO: 190513 - protein, 4 aa, Mycobacterium bovis
VADP

SEQ ID NO: 190514 - protein, 12 aa, Mycobacterium bovis
VADREAPAARVS

SEQ ID NO: 190515 - protein, 7 aa, Mycobacterium bovis
VAEADRE

SEQ ID NO: 190516 - protein, 20 aa, Mycobacterium bovis
VAEAPKTAGLPGTEGQYRSD

SEQ ID NO: 190517 - protein, 22 aa, Mycobacterium bovis
VAEAQKPAARNALRDTPLDPER

SEQ ID NO: 190518 - protein, 7 aa, Mycobacterium bovis
VAEDTGA

SEQ ID NO: 190519 - protein, 8 aa, Mycobacterium bovis
VAEGNAKL

SEQ ID NO: 190520 - protein, 8 aa, Mycobacterium bovis
VAEGRSDA

SEQ ID NO: 190521 - protein, 4 aa, Mycobacterium bovis
VAEH

SEQ ID NO: 190522 - protein, 20 aa, Mycobacterium bovis
VAEPEPNGQPDVEEVPDELT

SEQ ID NO: 190523 - protein, 10 aa, Mycobacterium bovis
VAEPGQSLAD

SEQ ID NO: 190524 - protein, 24 aa, Mycobacterium bovis
VAEPGSAGPIAGADRKRLISRIQV

SEQ ID NO: 190525 - protein, 14 aa, Mycobacterium bovis
VAEPTAPRSGDNPL

SEQ ID NO: 190526 - protein, 7 aa, Mycobacterium bovis
VAERAAT

SEQ ID NO: 190527 - protein, 6 aa, Mycobacterium bovis
VAERAG

SEQ ID NO: 190528 - protein, 9 aa, Mycobacterium bovis
VAEREPGVA

SEQ ID NO: 190529 - protein, 10 aa, Mycobacterium bovis
VAERGKAGLD

SEQ ID NO: 190530 - protein, 7 aa, Mycobacterium bovis
VAERTDE

SEQ ID NO: 190531 - protein, 11 aa, Mycobacterium bovis
VAESGGGRGAI

SEQ ID NO: 190532 - protein, 12 aa, Mycobacterium bovis
VAGAGRGSVAAA

SEQ ID NO: 190533 - protein, 6 aa, Mycobacterium bovis
VAGDGA

SEQ ID NO: 190534 - protein, 9 aa, Mycobacterium bovis
VAGDNAADV

SEQ ID NO: 190535 - protein, 14 aa, Mycobacterium bovis
VAGEGAAAPPVDVS

SEQ ID NO: 190536 - protein, 7 aa, Mycobacterium bovis
VAGEIDA

SEQ ID NO: 190537 - protein, 7 aa, Mycobacterium bovis
VAGNPPY

SEQ ID NO: 190538 - protein, 13 aa, Mycobacterium bovis
VAGPHGGSAVATN

SEQ ID NO: 190539 - protein, 10 aa, Mycobacterium bovis
VAGQPSMHGT

SEQ ID NO: 190540 - protein, 12 aa, Mycobacterium bovis
VAGRPAGPPIRL

SEQ ID NO: 190541 - protein, 8 aa, Mycobacterium bovis
VAGRSEAN

SEQ ID NO: 190542 - protein, 9 aa, Mycobacterium bovis
VAGSDGAEA

SEQ ID NO: 190543 - protein, 12 aa, Mycobacterium bovis
VAGSYPPGTRPD

SEQ ID NO: 190544 - protein, 4 aa, Mycobacterium bovis
VAGT

SEQ ID NO: 190545 - protein, 9 aa, Mycobacterium bovis
VAKPGPGQR

SEQ ID NO: 190546 - protein, 10 aa, Mycobacterium bovis
VANAGSYNTG

SEQ ID NO: 190547 - protein, 6 aa, Mycobacterium bovis
VANSDG

SEQ ID NO: 190548 - protein, 7 aa, Mycobacterium bovis
VANTPQS

SEQ ID NO: 190549 - protein, 4 aa, Mycobacterium bovis
VAPA

SEQ ID NO: 190550 - protein, 9 aa, Mycobacterium bovis
VAPAAQRVR

SEQ ID NO: 190551 - protein, 6 aa, Mycobacterium bovis
VAPADK

SEQ ID NO: 190552 - protein, 14 aa, Mycobacterium bovis
VAPAQELAKRFTDF

SEQ ID NO: 190553 - protein, 6 aa, Mycobacterium bovis
VAPDGV

SEQ ID NO: 190554 - protein, 10 aa, Mycobacterium bovis
VAPDHQNTKR

SEQ ID NO: 190555 - protein, 14 aa, Mycobacterium bovis
VAPGSGDGTGPAVH

SEQ ID NO: 190556 - protein, 12 aa, Mycobacterium bovis
VAPKDKHAARDN

SEQ ID NO: 190557 - protein, 10 aa, Mycobacterium bovis
VAPPPPTPIT

SEQ ID NO: 190558 - protein, 8 aa, Mycobacterium bovis
VAPQPMSS

SEQ ID NO: 190559 - protein, 8 aa, Mycobacterium bovis
VAPQTDRV

SEQ ID NO: 190560 - protein, 4 aa, Mycobacterium bovis
VAPR

SEQ ID NO: 190561 - protein, 6 aa, Mycobacterium bovis
VAPSPQ

SEQ ID NO: 190562 - protein, 11 aa, Mycobacterium bovis
VAPTDAGGQQF

SEQ ID NO: 190563 - protein, 7 aa, Mycobacterium bovis
VAPTEAT

SEQ ID NO: 190564 - protein, 7 aa, Mycobacterium bovis
VAPTREN

SEQ ID NO: 190565 - protein, 5 aa, Mycobacterium bovis
VAQGR

SEQ ID NO: 190566 - protein, 4 aa, Mycobacterium bovis
VARA

SEQ ID NO: 190567 - protein, 13 aa, Mycobacterium bovis
VAREARRAPELAG

SEQ ID NO: 190568 - protein, 7 aa, Mycobacterium bovis
VARESRD

SEQ ID NO: 190569 - protein, 4 aa, Mycobacterium bovis
VARG

SEQ ID NO: 190570 - protein, 11 aa, Mycobacterium bovis
VARGGGRTSYR

SEQ ID NO: 190571 - protein, 28 aa, Mycobacterium bovis
VARKTQKSETEAPREPAPVSDEKQTDVA

SEQ ID NO: 190572 - protein, 11 aa, Mycobacterium bovis
VARNPRTGETV

SEQ ID NO: 190573 - protein, 26 aa, Mycobacterium bovis
VARPDTQDALNADRSAKLSRPVTGDE

SEQ ID NO: 190574 - protein, 8 aa, Mycobacterium bovis
VARRGPAG

SEQ ID NO: 190575 - protein, 6 aa, Mycobacterium bovis
VARRQA

SEQ ID NO: 190576 - protein, 8 aa, Mycobacterium bovis
VARSRSDA

SEQ ID NO: 190577 - protein, 31 aa, Mycobacterium bovis
VASAGLAAGDPAHGSVGQGNFGGGDVGAGDV

SEQ ID NO: 190578 - protein, 6 aa, Mycobacterium bovis
VASATT

SEQ ID NO: 190579 - protein, 9 aa, Mycobacterium bovis
VASDSATET

SEQ ID NO: 190580 - protein, 9 aa, Mycobacterium bovis
VASGNGKGQ

SEQ ID NO: 190581 - protein, 9 aa, Mycobacterium bovis
VASPAPGEL

SEQ ID NO: 190582 - protein, 7 aa, Mycobacterium bovis
VASPGVA

SEQ ID NO: 190583 - protein, 9 aa, Mycobacterium bovis
VASPTAASA

SEQ ID NO: 190584 - protein, 13 aa, Mycobacterium bovis
VASSLGKGLTASS

SEQ ID NO: 190585 - protein, 9 aa, Mycobacterium bovis
VASSPDRAR

SEQ ID NO: 190586 - protein, 22 aa, Mycobacterium bovis
VASTSSSPWGQPLSVGLRRRWR

SEQ ID NO: 190587 - protein, 7 aa, Mycobacterium bovis
VASTVGR

SEQ ID NO: 190588 - protein, 19 aa, Mycobacterium bovis
VATDTPESLTNSGKNPEVE

SEQ ID NO: 190589 - protein, 4 aa, Mycobacterium bovis
VATQ

SEQ ID NO: 190590 - protein, 23 aa, Mycobacterium bovis
VATQPAWGTGEQAAQPLNGSTSR

SEQ ID NO: 190591 - protein, 11 aa, Mycobacterium bovis
VATQQATDSYH

SEQ ID NO: 190592 - protein, 9 aa, Mycobacterium bovis
VATRADNPL

SEQ ID NO: 190593 - protein, 7 aa, Mycobacterium bovis
VATRSAA

SEQ ID NO: 190594 - protein, 6 aa, Mycobacterium bovis
VDADGG

SEQ ID NO: 190595 - protein, 5 aa, Mycobacterium bovis
VDADT

SEQ ID NO: 190596 - protein, 10 aa, Mycobacterium bovis
VDADTGAATV

SEQ ID NO: 190597 - protein, 7 aa, Mycobacterium bovis
VDADTYQ

SEQ ID NO: 190598 - protein, 7 aa, Mycobacterium bovis
VDAEGRR

SEQ ID NO: 190599 - protein, 16 aa, Mycobacterium bovis
VDAKGRSRNVSDGYRR

SEQ ID NO: 190600 - protein, 13 aa, Mycobacterium bovis
VDAPPGSGLGSSS

SEQ ID NO: 190601 - protein, 7 aa, Mycobacterium bovis
VDAPRDA

SEQ ID NO: 190602 - protein, 4 aa, Mycobacterium bovis
VDAR

SEQ ID NO: 190603 - protein, 8 aa, Mycobacterium bovis
VDASDDGL

SEQ ID NO: 190604 - protein, 8 aa, Mycobacterium bovis
VDATGRFA

SEQ ID NO: 190605 - protein, 12 aa, Mycobacterium bovis
VDDATAKGAKVI

SEQ ID NO: 190606 - protein, 6 aa, Mycobacterium bovis
VDDERN

SEQ ID NO: 190607 - protein, 12 aa, Mycobacterium bovis
VDDGADPQAAEH

SEQ ID NO: 190608 - protein, 8 aa, Mycobacterium bovis
VDDGPTAL

SEQ ID NO: 190609 - protein, 5 aa, Mycobacterium bovis
VDDPA

SEQ ID NO: 190610 - protein, 9 aa, Mycobacterium bovis
VDDPAGIQG

SEQ ID NO: 190611 - protein, 5 aa, Mycobacterium bovis
VDDPD

SEQ ID NO: 190612 - protein, 6 aa, Mycobacterium bovis
VDDPGI

SEQ ID NO: 190613 - protein, 7 aa, Mycobacterium bovis
VDDPHID

SEQ ID NO: 190614 - protein, 8 aa, Mycobacterium bovis
VDDPTGDA

SEQ ID NO: 190615 - protein, 5 aa, Mycobacterium bovis
VDDQV

SEQ ID NO: 190616 - protein, 7 aa, Mycobacterium bovis
VDEDAAR

SEQ ID NO: 190617 - protein, 6 aa, Mycobacterium bovis
VDEIPD

SEQ ID NO: 190618 - protein, 17 aa, Mycobacterium bovis
VDENAGSSLPYSSTEQS

SEQ ID NO: 190619 - protein, 5 aa, Mycobacterium bovis
VDEPL

SEQ ID NO: 190620 - protein, 5 aa, Mycobacterium bovis
VDEQT

SEQ ID NO: 190621 - protein, 8 aa, Mycobacterium bovis
VDEQTGVE

SEQ ID NO: 190622 - protein, 7 aa, Mycobacterium bovis
VDESNAR

SEQ ID NO: 190623 - protein, 6 aa, Mycobacterium bovis
VDESNL

SEQ ID NO: 190624 - protein, 15 aa, Mycobacterium bovis
VDESTTRTAIAEVTA

SEQ ID NO: 190625 - protein, 12 aa, Mycobacterium bovis
VDETGRKRYPTL

SEQ ID NO: 190626 - protein, 14 aa, Mycobacterium bovis
VDETPAAESAEPIT

SEQ ID NO: 190627 - protein, 6 aa, Mycobacterium bovis
VDETSV

SEQ ID NO: 190628 - protein, 5 aa, Mycobacterium bovis
VDGAG

SEQ ID NO: 190629 - protein, 8 aa, Mycobacterium bovis
VDGAGAPI

SEQ ID NO: 190630 - protein, 7 aa, Mycobacterium bovis
VDGAGRR

SEQ ID NO: 190631 - protein, 13 aa, Mycobacterium bovis
VDGAKRPPKPIPV

SEQ ID NO: 190632 - protein, 8 aa, Mycobacterium bovis
VDGEEPPR

SEQ ID NO: 190633 - protein, 9 aa, Mycobacterium bovis
VDGERLSSR

SEQ ID NO: 190634 - protein, 6 aa, Mycobacterium bovis
VDGGDY

SEQ ID NO: 190635 - protein, 6 aa, Mycobacterium bovis
VDGGGK

SEQ ID NO: 190636 - protein, 8 aa, Mycobacterium bovis
VDGGPGMY

SEQ ID NO: 190637 - protein, 6 aa, Mycobacterium bovis
VDGGTE

SEQ ID NO: 190638 - protein, 7 aa, Mycobacterium bovis
VDGHDER

SEQ ID NO: 190639 - protein, 10 aa, Mycobacterium bovis
VDGKTKEDLG

SEQ ID NO: 190640 - protein, 7 aa, Mycobacterium bovis
VDGNDVE

SEQ ID NO: 190641 - protein, 8 aa, Mycobacterium bovis
VDGNTEAG

SEQ ID NO: 190642 - protein, 4 aa, Mycobacterium bovis
VDGP

SEQ ID NO: 190643 - protein, 6 aa, Mycobacterium bovis
VDGPDE

SEQ ID NO: 190644 - protein, 5 aa, Mycobacterium bovis
VDGQP

SEQ ID NO: 190645 - protein, 6 aa, Mycobacterium bovis
VDGQYD

SEQ ID NO: 190646 - protein, 5 aa, Mycobacterium bovis
VDGRA

SEQ ID NO: 190647 - protein, 9 aa, Mycobacterium bovis
VDGRPRRAA

SEQ ID NO: 190648 - protein, 7 aa, Mycobacterium bovis
VDGRTYA

SEQ ID NO: 190649 - protein, 9 aa, Mycobacterium bovis
VDGSDYPNL

SEQ ID NO: 190650 - protein, 5 aa, Mycobacterium bovis
VDGYH

SEQ ID NO: 190651 - protein, 6 aa, Mycobacterium bovis
VDHDPA

SEQ ID NO: 190652 - protein, 7 aa, Mycobacterium bovis
VDHETGR

SEQ ID NO: 190653 - protein, 4 aa, Mycobacterium bovis
VDLG

SEQ ID NO: 190654 - protein, 8 aa, Mycobacterium bovis
VDNAPGAR

SEQ ID NO: 190655 - protein, 4 aa, Mycobacterium bovis
VDND

SEQ ID NO: 190656 - protein, 5 aa, Mycobacterium bovis
VDNDG

SEQ ID NO: 190657 - protein, 5 aa, Mycobacterium bovis
VDNDP

SEQ ID NO: 190658 - protein, 8 aa, Mycobacterium bovis
VDNGGHEL

SEQ ID NO: 190659 - protein, 10 aa, Mycobacterium bovis
VDNPPGTGKI

SEQ ID NO: 190660 - protein, 12 aa, Mycobacterium bovis
VDPAALQATRDS

SEQ ID NO: 190661 - protein, 9 aa, Mycobacterium bovis
VDPAGRPIT

SEQ ID NO: 190662 - protein, 5 aa, Mycobacterium bovis
VDPAT

SEQ ID NO: 190663 - protein, 6 aa, Mycobacterium bovis
VDPDDI

SEQ ID NO: 190664 - protein, 11 aa, Mycobacterium bovis
VDPDGPVSVQP

SEQ ID NO: 190665 - protein, 9 aa, Mycobacterium bovis
VDPDSTPPM

SEQ ID NO: 190666 - protein, 5 aa, Mycobacterium bovis
VDPED

SEQ ID NO: 190667 - protein, 63 aa, Mycobacterium bovis
VDPEPEPDPPGGGQSANEPASQPNSRSKSTEPGAPSSMGDDPPRPASPRLRSSPRPSAPPSKI

SEQ ID NO: 190668 - protein, 15 aa, Mycobacterium bovis
VDPGEGLREFAFAPL

SEQ ID NO: 190669 - protein, 7 aa, Mycobacterium bovis
VDPGRAR

SEQ ID NO: 190670 - protein, 16 aa, Mycobacterium bovis
VDPGRLAATLAPPDVP

SEQ ID NO: 190671 - protein, 4 aa, Mycobacterium bovis
VDPN

SEQ ID NO: 190672 - protein, 6 aa, Mycobacterium bovis
VDPNAD

SEQ ID NO: 190673 - protein, 5 aa, Mycobacterium bovis
VDPNE

SEQ ID NO: 190674 - protein, 12 aa, Mycobacterium bovis
VDPQPSAGQQGP

SEQ ID NO: 190675 - protein, 16 aa, Mycobacterium bovis
VDPRGDDSLPLRPWWQ

SEQ ID NO: 190676 - protein, 9 aa, Mycobacterium bovis
VDPSGWAAY

SEQ ID NO: 190677 - protein, 5 aa, Mycobacterium bovis
VDPVD

SEQ ID NO: 190678 - protein, 5 aa, Mycobacterium bovis
VDPYN

SEQ ID NO: 190679 - protein, 7 aa, Mycobacterium bovis
VDQPASD

SEQ ID NO: 190680 - protein, 6 aa, Mycobacterium bovis
VDQPGT

SEQ ID NO: 190681 - protein, 9 aa, Mycobacterium bovis
VDQPPHEPI

SEQ ID NO: 190682 - protein, 10 aa, Mycobacterium bovis
VDQPPQTTRA

SEQ ID NO: 190683 - protein, 10 aa, Mycobacterium bovis
VDQRGWSSRA

SEQ ID NO: 190684 - protein, 6 aa, Mycobacterium bovis
VDQTGV

SEQ ID NO: 190685 - protein, 6 aa, Mycobacterium bovis
VDRARE

SEQ ID NO: 190686 - protein, 5 aa, Mycobacterium bovis
VDRDD

SEQ ID NO: 190687 - protein, 8 aa, Mycobacterium bovis
VDRDDPRV

SEQ ID NO: 190688 - protein, 8 aa, Mycobacterium bovis
VDRDRRPG

SEQ ID NO: 190689 - protein, 9 aa, Mycobacterium bovis
VDREPTGDG

SEQ ID NO: 190690 - protein, 15 aa, Mycobacterium bovis
VDRKDYNSFGSRRGN

SEQ ID NO: 190691 - protein, 10 aa, Mycobacterium bovis
VDRPPSQRFT

SEQ ID NO: 190692 - protein, 7 aa, Mycobacterium bovis
VDRYGNQ

SEQ ID NO: 190693 - protein, 11 aa, Mycobacterium bovis
VDSADANDQFA

SEQ ID NO: 190694 - protein, 9 aa, Mycobacterium bovis
VDSDGTPAY

SEQ ID NO: 190695 - protein, 11 aa, Mycobacterium bovis
VDSEKGESDAA

SEQ ID NO: 190696 - protein, 6 aa, Mycobacterium bovis
VDSGRE

SEQ ID NO: 190697 - protein, 7 aa, Mycobacterium bovis
VDSQYDT

SEQ ID NO: 190698 - protein, 4 aa, Mycobacterium bovis
VDSS

SEQ ID NO: 190699 - protein, 14 aa, Mycobacterium bovis
VDSTAPTSSVQPRA

SEQ ID NO: 190700 - protein, 9 aa, Mycobacterium bovis
VDSTTAATL

SEQ ID NO: 190701 - protein, 8 aa, Mycobacterium bovis
VDTDGDGR

SEQ ID NO: 190702 - protein, 11 aa, Mycobacterium bovis
VDTDGLADTEH

SEQ ID NO: 190703 - protein, 7 aa, Mycobacterium bovis
VDTDGSE

SEQ ID NO: 190704 - protein, 5 aa, Mycobacterium bovis
VDTDH

SEQ ID NO: 190705 - protein, 6 aa, Mycobacterium bovis
VDTGTR

SEQ ID NO: 190706 - protein, 6 aa, Mycobacterium bovis
VDTNRS

SEQ ID NO: 190707 - protein, 7 aa, Mycobacterium bovis
VDTPAEV

SEQ ID NO: 190708 - protein, 5 aa, Mycobacterium bovis
VDTRG

SEQ ID NO: 190709 - protein, 4 aa, Mycobacterium bovis
VDVD

SEQ ID NO: 190710 - protein, 12 aa, Mycobacterium bovis
VDVDPTGATVTD

SEQ ID NO: 190711 - protein, 5 aa, Mycobacterium bovis
VDVPE

SEQ ID NO: 190712 - protein, 19 aa, Mycobacterium bovis
VDVSPEERRRIAETGFYAY

SEQ ID NO: 190713 - protein, 5 aa, Mycobacterium bovis
VEADG

SEQ ID NO: 190714 - protein, 13 aa, Mycobacterium bovis
VEAEPAAGAGEQV

SEQ ID NO: 190715 - protein, 4 aa, Mycobacterium bovis
VEAG

SEQ ID NO: 190716 - protein, 15 aa, Mycobacterium bovis
VEAGEATTQNGRAQQ

SEQ ID NO: 190717 - protein, 11 aa, Mycobacterium bovis
VEAGGAAADEL

SEQ ID NO: 190718 - protein, 12 aa, Mycobacterium bovis
VEAGNADQFDTL

SEQ ID NO: 190719 - protein, 4 aa, Mycobacterium bovis
VEAP

SEQ ID NO: 190720 - protein, 11 aa, Mycobacterium bovis
VEASSGSTAVS

SEQ ID NO: 190721 - protein, 9 aa, Mycobacterium bovis
VEATGNRGK

SEQ ID NO: 190722 - protein, 15 aa, Mycobacterium bovis
VEATRQGKSYTLTGT

SEQ ID NO: 190723 - protein, 13 aa, Mycobacterium bovis
VEATSAEQIAEDA

SEQ ID NO: 190724 - protein, 8 aa, Mycobacterium bovis
VEDADEDS

SEQ ID NO: 190725 - protein, 9 aa, Mycobacterium bovis
VEDAQRREL

SEQ ID NO: 190726 - protein, 7 aa, Mycobacterium bovis
VEDPARQ

SEQ ID NO: 190727 - protein, 6 aa, Mycobacterium bovis
VEDPEW

SEQ ID NO: 190728 - protein, 8 aa, Mycobacterium bovis
VEDSSDVS

SEQ ID NO: 190729 - protein, 6 aa, Mycobacterium bovis
VEDTEG

SEQ ID NO: 190730 - protein, 8 aa, Mycobacterium bovis
VEEFRDTE

SEQ ID NO: 190731 - protein, 4 aa, Mycobacterium bovis
VEEG

SEQ ID NO: 190732 - protein, 22 aa, Mycobacterium bovis
VEELGRSGVGVAESGASYAARD

SEQ ID NO: 190733 - protein, 7 aa, Mycobacterium bovis
VEEPTSA

SEQ ID NO: 190734 - protein, 6 aa, Mycobacterium bovis
VEGGEN

SEQ ID NO: 190735 - protein, 11 aa, Mycobacterium bovis
VEGGNKQLEEL

SEQ ID NO: 190736 - protein, 15 aa, Mycobacterium bovis
VEGGSAVTTGERVSA

SEQ ID NO: 190737 - protein, 11 aa, Mycobacterium bovis
VEGNATGASTY

SEQ ID NO: 190738 - protein, 9 aa, Mycobacterium bovis
VEGPTDDPD

SEQ ID NO: 190739 - protein, 4 aa, Mycobacterium bovis
VEGQ

SEQ ID NO: 190740 - protein, 17 aa, Mycobacterium bovis
VEGSAGASAPTVDDVGD

SEQ ID NO: 190741 - protein, 6 aa, Mycobacterium bovis
VEGSGG

SEQ ID NO: 190742 - protein, 10 aa, Mycobacterium bovis
VEGSTRLSQT

SEQ ID NO: 190743 - protein, 7 aa, Mycobacterium bovis
VEHRDRQ

SEQ ID NO: 190744 - protein, 8 aa, Mycobacterium bovis
VEITERDG

SEQ ID NO: 190745 - protein, 9 aa, Mycobacterium bovis
VEKDPENPT

SEQ ID NO: 190746 - protein, 4 aa, Mycobacterium bovis
VEKL

SEQ ID NO: 190747 - protein, 13 aa, Mycobacterium bovis
VEKPKVKLPPRPL

SEQ ID NO: 190748 - protein, 11 aa, Mycobacterium bovis
VELGSRNERPM

SEQ ID NO: 190749 - protein, 11 aa, Mycobacterium bovis
VELTSSTEERV

SEQ ID NO: 190750 - protein, 6 aa, Mycobacterium bovis
VENSPG

SEQ ID NO: 190751 - protein, 6 aa, Mycobacterium bovis
VEPAPT

SEQ ID NO: 190752 - protein, 21 aa, Mycobacterium bovis
VEPASIEQAGSQAGYPAPPLQ

SEQ ID NO: 190753 - protein, 6 aa, Mycobacterium bovis
VEPDPG

SEQ ID NO: 190754 - protein, 16 aa, Mycobacterium bovis
VEPDPRVSGVPSTKGA

SEQ ID NO: 190755 - protein, 6 aa, Mycobacterium bovis
VEPGAP

SEQ ID NO: 190756 - protein, 8 aa, Mycobacterium bovis
VEPKYPQA

SEQ ID NO: 190757 - protein, 9 aa, Mycobacterium bovis
VEPPPSTLA

SEQ ID NO: 190758 - protein, 5 aa, Mycobacterium bovis
VEPPR

SEQ ID NO: 190759 - protein, 7 aa, Mycobacterium bovis
VEPSPHR

SEQ ID NO: 190760 - protein, 6 aa, Mycobacterium bovis
VEPSRK

SEQ ID NO: 190761 - protein, 6 aa, Mycobacterium bovis
VEPSVA

SEQ ID NO: 190762 - protein, 7 aa, Mycobacterium bovis
VEPTTGT

SEQ ID NO: 190763 - protein, 4 aa, Mycobacterium bovis
VEPV

SEQ ID NO: 190764 - protein, 8 aa, Mycobacterium bovis
VEQADGEC

SEQ ID NO: 190765 - protein, 4 aa, Mycobacterium bovis
VEQG

SEQ ID NO: 190766 - protein, 11 aa, Mycobacterium bovis
VEQGDSEEVFG

SEQ ID NO: 190767 - protein, 4 aa, Mycobacterium bovis
VEQT

SEQ ID NO: 190768 - protein, 6 aa, Mycobacterium bovis
VEQTRS

SEQ ID NO: 190769 - protein, 12 aa, Mycobacterium bovis
VEQTSKDRGHDY

SEQ ID NO: 190770 - protein, 4 aa, Mycobacterium bovis
VERA

SEQ ID NO: 190771 - protein, 7 aa, Mycobacterium bovis
VERYGAS

SEQ ID NO: 190772 - protein, 5 aa, Mycobacterium bovis
VESAG

SEQ ID NO: 190773 - protein, 8 aa, Mycobacterium bovis
VESAGAEG

SEQ ID NO: 190774 - protein, 4 aa, Mycobacterium bovis
VESE

SEQ ID NO: 190775 - protein, 5 aa, Mycobacterium bovis
VESGG

SEQ ID NO: 190776 - protein, 11 aa, Mycobacterium bovis
VESGNLSVNSH

SEQ ID NO: 190777 - protein, 7 aa, Mycobacterium bovis
VESGRLD

SEQ ID NO: 190778 - protein, 10 aa, Mycobacterium bovis
VESGTPTPQA

SEQ ID NO: 190779 - protein, 5 aa, Mycobacterium bovis
VESPQ

SEQ ID NO: 190780 - protein, 14 aa, Mycobacterium bovis
VESPTGTTRHPPGN

SEQ ID NO: 190781 - protein, 4 aa, Mycobacterium bovis
VESQ

SEQ ID NO: 190782 - protein, 7 aa, Mycobacterium bovis
VESTPEV

SEQ ID NO: 190783 - protein, 10 aa, Mycobacterium bovis
VETAQRRGEI

SEQ ID NO: 190784 - protein, 12 aa, Mycobacterium bovis
VETENEETPAGS

SEQ ID NO: 190785 - protein, 14 aa, Mycobacterium bovis
VETGDGYPPPAYPP

SEQ ID NO: 190786 - protein, 5 aa, Mycobacterium bovis
VETGR

SEQ ID NO: 190787 - protein, 8 aa, Mycobacterium bovis
VETGTPVT

SEQ ID NO: 190788 - protein, 9 aa, Mycobacterium bovis
VETNSEPRM

SEQ ID NO: 190789 - protein, 23 aa, Mycobacterium bovis
VETPTPRNAAGAALTSLADSADR

SEQ ID NO: 190790 - protein, 6 aa, Mycobacterium bovis
VETPTT

SEQ ID NO: 190791 - protein, 8 aa, Mycobacterium bovis
VETTAGDM

SEQ ID NO: 190792 - protein, 8 aa, Mycobacterium bovis
VETTPGGG

SEQ ID NO: 190793 - protein, 20 aa, Mycobacterium bovis
VEVEGSAKPACVAESIVRYV

SEQ ID NO: 190794 - protein, 6 aa, Mycobacterium bovis
VEYEQD

SEQ ID NO: 190795 - protein, 4 aa, Mycobacterium bovis
VGAA

SEQ ID NO: 190796 - protein, 13 aa, Mycobacterium bovis
VGAAAGGEFDRGD

SEQ ID NO: 190797 - protein, 4 aa, Mycobacterium bovis
VGAD

SEQ ID NO: 190798 - protein, 13 aa, Mycobacterium bovis
VGADEDDIKATYD

SEQ ID NO: 190799 - protein, 10 aa, Mycobacterium bovis
VGAESTRHAS

SEQ ID NO: 190800 - protein, 7 aa, Mycobacterium bovis
VGAGEWP

SEQ ID NO: 190801 - protein, 6 aa, Mycobacterium bovis
VGAGKT

SEQ ID NO: 190802 - protein, 21 aa, Mycobacterium bovis
VGAGNVGSYNVGGGNIGGNNV

SEQ ID NO: 190803 - protein, 6 aa, Mycobacterium bovis
VGAGQT

SEQ ID NO: 190804 - protein, 9 aa, Mycobacterium bovis
VGAGSGKQI

SEQ ID NO: 190805 - protein, 6 aa, Mycobacterium bovis
VGAGTG

SEQ ID NO: 190806 - protein, 9 aa, Mycobacterium bovis
VGAGYGPGH

SEQ ID NO: 190807 - protein, 6 aa, Mycobacterium bovis
VGAKPG

SEQ ID NO: 190808 - protein, 8 aa, Mycobacterium bovis
VGAKRQAT

SEQ ID NO: 190809 - protein, 4 aa, Mycobacterium bovis
VGAN

SEQ ID NO: 190810 - protein, 9 aa, Mycobacterium bovis
VGAPDQRGL

SEQ ID NO: 190811 - protein, 8 aa, Mycobacterium bovis
VGAPNSGW

SEQ ID NO: 190812 - protein, 12 aa, Mycobacterium bovis
VGAPPTCGGERR

SEQ ID NO: 190813 - protein, 8 aa, Mycobacterium bovis
VGAPSSGI

SEQ ID NO: 190814 - protein, 10 aa, Mycobacterium bovis
VGASAGNARS

SEQ ID NO: 190815 - protein, 11 aa, Mycobacterium bovis
VGASEPPVAAT

SEQ ID NO: 190816 - protein, 10 aa, Mycobacterium bovis
VGATAADEAA

SEQ ID NO: 190817 - protein, 11 aa, Mycobacterium bovis
VGATATGRLPA

SEQ ID NO: 190818 - protein, 14 aa, Mycobacterium bovis
VGATEGATNRKIEN

SEQ ID NO: 190819 - protein, 6 aa, Mycobacterium bovis
VGATSE

SEQ ID NO: 190820 - protein, 5 aa, Mycobacterium bovis
VGATY

SEQ ID NO: 190821 - protein, 7 aa, Mycobacterium bovis
VGDARAT

SEQ ID NO: 190822 - protein, 4 aa, Mycobacterium bovis
VGDD

SEQ ID NO: 190823 - protein, 11 aa, Mycobacterium bovis
VGDDPAAVAAN

SEQ ID NO: 190824 - protein, 8 aa, Mycobacterium bovis
VGDEPELT

SEQ ID NO: 190825 - protein, 12 aa, Mycobacterium bovis
VGDESGEVGPGD

SEQ ID NO: 190826 - protein, 7 aa, Mycobacterium bovis
VGDGAND

SEQ ID NO: 190827 - protein, 11 aa, Mycobacterium bovis
VGDGVDPNRVG

SEQ ID NO: 190828 - protein, 4 aa, Mycobacterium bovis
VGDP

SEQ ID NO: 190829 - protein, 5 aa, Mycobacterium bovis
VGDPA

SEQ ID NO: 190830 - protein, 12 aa, Mycobacterium bovis
VGDPPRLGEPGP

SEQ ID NO: 190831 - protein, 9 aa, Mycobacterium bovis
VGDQGGDIA

SEQ ID NO: 190832 - protein, 8 aa, Mycobacterium bovis
VGDQTAER

SEQ ID NO: 190833 - protein, 17 aa, Mycobacterium bovis
VGDRRTQNQPGTTDEYP

SEQ ID NO: 190834 - protein, 14 aa, Mycobacterium bovis
VGDTNTGGFNPGDI

SEQ ID NO: 190835 - protein, 17 aa, Mycobacterium bovis
VGDTNTGSYNPGDTNTG

SEQ ID NO: 190836 - protein, 6 aa, Mycobacterium bovis
VGEENA

SEQ ID NO: 190837 - protein, 4 aa, Mycobacterium bovis
VGEG

SEQ ID NO: 190838 - protein, 7 aa, Mycobacterium bovis
VGEGDLA

SEQ ID NO: 190839 - protein, 11 aa, Mycobacterium bovis
VGEGNVGNGNV

SEQ ID NO: 190840 - protein, 6 aa, Mycobacterium bovis
VGEHAE

SEQ ID NO: 190841 - protein, 15 aa, Mycobacterium bovis
VGEPEPAGRPADPPF

SEQ ID NO: 190842 - protein, 16 aa, Mycobacterium bovis
VGEPPDGAEAWVQWPR

SEQ ID NO: 190843 - protein, 5 aa, Mycobacterium bovis
VGERR

SEQ ID NO: 190844 - protein, 7 aa, Mycobacterium bovis
VGESENV

SEQ ID NO: 190845 - protein, 15 aa, Mycobacterium bovis
VGESESGSDRAPASQ

SEQ ID NO: 190846 - protein, 12 aa, Mycobacterium bovis
VGESREQEASAK

SEQ ID NO: 190847 - protein, 7 aa, Mycobacterium bovis
VGESTDV

SEQ ID NO: 190848 - protein, 15 aa, Mycobacterium bovis
VGETRSYTVPNGSTV

SEQ ID NO: 190849 - protein, 8 aa, Mycobacterium bovis
VGGAAAEA

SEQ ID NO: 190850 - protein, 26 aa, Mycobacterium bovis
VGGAGAAGGDATSGTGGFGGAGGSAR

SEQ ID NO: 190851 - protein, 22 aa, Mycobacterium bovis
VGGAGGAGGAATETGGIGGAGG

SEQ ID NO: 190852 - protein, 12 aa, Mycobacterium bovis
VGGAGGAGGNAS

SEQ ID NO: 190853 - protein, 25 aa, Mycobacterium bovis
VGGAGGHGGGASVGTGGSGGAGGDG

SEQ ID NO: 190854 - protein, 6 aa, Mycobacterium bovis
VGGAKN

SEQ ID NO: 190855 - protein, 12 aa, Mycobacterium bovis
VGGAKPPPRGGL

SEQ ID NO: 190856 - protein, 6 aa, Mycobacterium bovis
VGGANN

SEQ ID NO: 190857 - protein, 5 aa, Mycobacterium bovis
VGGAR

SEQ ID NO: 190858 - protein, 7 aa, Mycobacterium bovis
VGGDGAE

SEQ ID NO: 190859 - protein, 10 aa, Mycobacterium bovis
VGGDSAGGNL

SEQ ID NO: 190860 - protein, 11 aa, Mycobacterium bovis
VGGDSGDDGTI

SEQ ID NO: 190861 - protein, 5 aa, Mycobacterium bovis
VGGEL

SEQ ID NO: 190862 - protein, 6 aa, Mycobacterium bovis
VGGFSE

SEQ ID NO: 190863 - protein, 12 aa, Mycobacterium bovis
VGGGDPAGNPTL

SEQ ID NO: 190864 - protein, 16 aa, Mycobacterium bovis
VGGGNLGNANNGLGNI

SEQ ID NO: 190865 - protein, 15 aa, Mycobacterium bovis
VGGGNVGNANNGLAN

SEQ ID NO: 190866 - protein, 6 aa, Mycobacterium bovis
VGGGQI

SEQ ID NO: 190867 - protein, 31 aa, Mycobacterium bovis
VGGGSRHRPGAGTRSRAGHRRGSRLGGRPGR

SEQ ID NO: 190868 - protein, 6 aa, Mycobacterium bovis
VGGGTD

SEQ ID NO: 190869 - protein, 9 aa, Mycobacterium bovis
VGGHDPHEL

SEQ ID NO: 190870 - protein, 14 aa, Mycobacterium bovis
VGGKTGINTDAGKN

SEQ ID NO: 190871 - protein, 5 aa, Mycobacterium bovis
VGGLP

SEQ ID NO: 190872 - protein, 8 aa, Mycobacterium bovis
VGGMGGTG

SEQ ID NO: 190873 - protein, 30 aa, Mycobacterium bovis
VGGPRSDAALAASSGRTATTKAMGKGSTQH

SEQ ID NO: 190874 - protein, 6 aa, Mycobacterium bovis
VGGPST

SEQ ID NO: 190875 - protein, 9 aa, Mycobacterium bovis
VGGPTTSIG

SEQ ID NO: 190876 - protein, 18 aa, Mycobacterium bovis
VGGQPADRNAANRSRGSK

SEQ ID NO: 190877 - protein, 34 aa, Mycobacterium bovis
VGGRLGGNGQIGVAGQGAVGAGVGAGVGGQAGIA

SEQ ID NO: 190878 - protein, 13 aa, Mycobacterium bovis
VGGSGAAVVNCAT

SEQ ID NO: 190879 - protein, 8 aa, Mycobacterium bovis
VGGSTEAP

SEQ ID NO: 190880 - protein, 13 aa, Mycobacterium bovis
VGGTGGVGGATGL

SEQ ID NO: 190881 - protein, 7 aa, Mycobacterium bovis
VGGVGGD

SEQ ID NO: 190882 - protein, 6 aa, Mycobacterium bovis
VGHGPS

SEQ ID NO: 190883 - protein, 9 aa, Mycobacterium bovis
VGKAPNIAA

SEQ ID NO: 190884 - protein, 7 aa, Mycobacterium bovis
VGKPEQN

SEQ ID NO: 190885 - protein, 9 aa, Mycobacterium bovis
VGKPVPGNS

SEQ ID NO: 190886 - protein, 18 aa, Mycobacterium bovis
VGKTPSATAALAREILLS

SEQ ID NO: 190887 - protein, 10 aa, Mycobacterium bovis
VGLANAGSTV

SEQ ID NO: 190888 - protein, 4 aa, Mycobacterium bovis
VGLP

SEQ ID NO: 190889 - protein, 16 aa, Mycobacterium bovis
VGLSTKTERHRPGQPL

SEQ ID NO: 190890 - protein, 29 aa, Mycobacterium bovis
VGNGNTGDYNLGNGNLGNANFGGGNGSAF

SEQ ID NO: 190891 - protein, 7 aa, Mycobacterium bovis
VGNGNVG

SEQ ID NO: 190892 - protein, 7 aa, Mycobacterium bovis
VGNHEDD

SEQ ID NO: 190893 - protein, 11 aa, Mycobacterium bovis
VGNIGNDNIGN

SEQ ID NO: 190894 - protein, 4 aa, Mycobacterium bovis
VGNP

SEQ ID NO: 190895 - protein, 7 aa, Mycobacterium bovis
VGNTGNY

SEQ ID NO: 190896 - protein, 10 aa, Mycobacterium bovis
VGNTNTGNFN

SEQ ID NO: 190897 - protein, 6 aa, Mycobacterium bovis
VGPASL

SEQ ID NO: 190898 - protein, 4 aa, Mycobacterium bovis
VGPD

SEQ ID NO: 190899 - protein, 12 aa, Mycobacterium bovis
VGPDGLGNSPKH

SEQ ID NO: 190900 - protein, 8 aa, Mycobacterium bovis
VGPEGKPL

SEQ ID NO: 190901 - protein, 9 aa, Mycobacterium bovis
VGPEMPSGV

SEQ ID NO: 190902 - protein, 10 aa, Mycobacterium bovis
VGPETNPLEQ

SEQ ID NO: 190903 - protein, 4 aa, Mycobacterium bovis
VGPG

SEQ ID NO: 190904 - protein, 6 aa, Mycobacterium bovis
VGPGVS

SEQ ID NO: 190905 - protein, 12 aa, Mycobacterium bovis
VGPGVTAADTAI

SEQ ID NO: 190906 - protein, 8 aa, Mycobacterium bovis
VGPKQTAL

SEQ ID NO: 190907 - protein, 6 aa, Mycobacterium bovis
VGPMDN

SEQ ID NO: 190908 - protein, 10 aa, Mycobacterium bovis
VGPNGAGKSS

SEQ ID NO: 190909 - protein, 11 aa, Mycobacterium bovis
VGPNGSGKSNV

SEQ ID NO: 190910 - protein, 7 aa, Mycobacterium bovis
VGPPPTH

SEQ ID NO: 190911 - protein, 11 aa, Mycobacterium bovis
VGPPSDPAAQI

SEQ ID NO: 190912 - protein, 10 aa, Mycobacterium bovis
VGPQSGDPYR

SEQ ID NO: 190913 - protein, 12 aa, Mycobacterium bovis
VGPRQGATATQE

SEQ ID NO: 190914 - protein, 12 aa, Mycobacterium bovis
VGQHRKQPIGAA

SEQ ID NO: 190915 - protein, 7 aa, Mycobacterium bovis
VGQPGNR

SEQ ID NO: 190916 - protein, 8 aa, Mycobacterium bovis
VGQPGSVG

SEQ ID NO: 190917 - protein, 6 aa, Mycobacterium bovis
VGQRDQ

SEQ ID NO: 190918 - protein, 29 aa, Mycobacterium bovis
VGRDSTRGLGAGADPEVGRKAAEDAKDEI

SEQ ID NO: 190919 - protein, 8 aa, Mycobacterium bovis
VGRGGDDT

SEQ ID NO: 190920 - protein, 5 aa, Mycobacterium bovis
VGRID

SEQ ID NO: 190921 - protein, 12 aa, Mycobacterium bovis
VGRNGGSAVSSH

SEQ ID NO: 190922 - protein, 11 aa, Mycobacterium bovis
VGRNPATIERS

SEQ ID NO: 190923 - protein, 6 aa, Mycobacterium bovis
VGRPRA

SEQ ID NO: 190924 - protein, 6 aa, Mycobacterium bovis
VGRPYP

SEQ ID NO: 190925 - protein, 5 aa, Mycobacterium bovis
VGRRK

SEQ ID NO: 190926 - protein, 4 aa, Mycobacterium bovis
VGRS

SEQ ID NO: 190927 - protein, 8 aa, Mycobacterium bovis
VGRSRERG

SEQ ID NO: 190928 - protein, 4 aa, Mycobacterium bovis
VGRT

SEQ ID NO: 190929 - protein, 9 aa, Mycobacterium bovis
VGSADDLTQ

SEQ ID NO: 190930 - protein, 8 aa, Mycobacterium bovis
VGSAGGRV

SEQ ID NO: 190931 - protein, 10 aa, Mycobacterium bovis
VGSAGTVTTL

SEQ ID NO: 190932 - protein, 12 aa, Mycobacterium bovis
VGSASGHGAQSD

SEQ ID NO: 190933 - protein, 5 aa, Mycobacterium bovis
VGSDG

SEQ ID NO: 190934 - protein, 7 aa, Mycobacterium bovis
VGSEEAD

SEQ ID NO: 190935 - protein, 7 aa, Mycobacterium bovis
VGSEQAY

SEQ ID NO: 190936 - protein, 5 aa, Mycobacterium bovis
VGSER

SEQ ID NO: 190937 - protein, 11 aa, Mycobacterium bovis
VGSGDAAISTI

SEQ ID NO: 190938 - protein, 6 aa, Mycobacterium bovis
VGSGNI

SEQ ID NO: 190939 - protein, 16 aa, Mycobacterium bovis
VGSGNVGHGNIGDSNV

SEQ ID NO: 190940 - protein, 12 aa, Mycobacterium bovis
VGSGPVGSIPTP

SEQ ID NO: 190941 - protein, 13 aa, Mycobacterium bovis
VGSGSGAGDGYHG

SEQ ID NO: 190942 - protein, 26 aa, Mycobacterium bovis
VGSNNVGLGNTGNGNIGFGNTGNGNI

SEQ ID NO: 190943 - protein, 7 aa, Mycobacterium bovis
VGSPTGT

SEQ ID NO: 190944 - protein, 10 aa, Mycobacterium bovis
VGSQSPAVGQ

SEQ ID NO: 190945 - protein, 6 aa, Mycobacterium bovis
VGSSAA

SEQ ID NO: 190946 - protein, 10 aa, Mycobacterium bovis
VGSSDPRLPG

SEQ ID NO: 190947 - protein, 18 aa, Mycobacterium bovis
VGSSGFQNGGSNNSGLQN

SEQ ID NO: 190948 - protein, 5 aa, Mycobacterium bovis
VGSYT

SEQ ID NO: 190949 - protein, 4 aa, Mycobacterium bovis
VGTA

SEQ ID NO: 190950 - protein, 9 aa, Mycobacterium bovis
VGTAPPPLT

SEQ ID NO: 190951 - protein, 4 aa, Mycobacterium bovis
VGTD

SEQ ID NO: 190952 - protein, 10 aa, Mycobacterium bovis
VGTDSGGAAA

SEQ ID NO: 190953 - protein, 4 aa, Mycobacterium bovis
VGTF

SEQ ID NO: 190954 - protein, 9 aa, Mycobacterium bovis
VGTGGDGVN

SEQ ID NO: 190955 - protein, 20 aa, Mycobacterium bovis
VGTGSGPNSGFGNAGTNNSG

SEQ ID NO: 190956 - protein, 7 aa, Mycobacterium bovis
VGTNPRE

SEQ ID NO: 190957 - protein, 12 aa, Mycobacterium bovis
VGTNPTFSGRTR

SEQ ID NO: 190958 - protein, 7 aa, Mycobacterium bovis
VGTPAEV

SEQ ID NO: 190959 - protein, 14 aa, Mycobacterium bovis
VGTPEIATEAGVTR

SEQ ID NO: 190960 - protein, 10 aa, Mycobacterium bovis
VGTPNEVATE

SEQ ID NO: 190961 - protein, 18 aa, Mycobacterium bovis
VGTRVQHGDAETAPLPNP

SEQ ID NO: 190962 - protein, 6 aa, Mycobacterium bovis
VGTTTA

SEQ ID NO: 190963 - protein, 4 aa, Mycobacterium bovis
VGVD

SEQ ID NO: 190964 - protein, 25 aa, Mycobacterium bovis
VGVGESGASYLAGDAAAAATYGVVG

SEQ ID NO: 190965 - protein, 9 aa, Mycobacterium bovis
VGVQPSGVE

SEQ ID NO: 190966 - protein, 6 aa, Mycobacterium bovis
VGVTAN

SEQ ID NO: 190967 - protein, 5 aa, Mycobacterium bovis
VGYTP

SEQ ID NO: 190968 - protein, 7 aa, Mycobacterium bovis
VHGGREN

SEQ ID NO: 190969 - protein, 7 aa, Mycobacterium bovis
VHGPGGA

SEQ ID NO: 190970 - protein, 4 aa, Mycobacterium bovis
VHNP

SEQ ID NO: 190971 - protein, 7 aa, Mycobacterium bovis
VHPGGPT

SEQ ID NO: 190972 - protein, 6 aa, Mycobacterium bovis
VHPGGV

SEQ ID NO: 190973 - protein, 16 aa, Mycobacterium bovis
VHQGEGVAAGKRDQRD

SEQ ID NO: 190974 - protein, 6 aa, Mycobacterium bovis
VHRPTD

SEQ ID NO: 190975 - protein, 20 aa, Mycobacterium bovis
VHSGQRRTDVTTTLGPGATV

SEQ ID NO: 190976 - protein, 8 aa, Mycobacterium bovis
VHTPDGPS

SEQ ID NO: 190977 - protein, 10 aa, Mycobacterium bovis
VHTSPREVAG

SEQ ID NO: 190978 - protein, 4 aa, Mycobacterium bovis
VINR

SEQ ID NO: 190979 - protein, 6 aa, Mycobacterium bovis
VITEEE

SEQ ID NO: 190980 - protein, 12 aa, Mycobacterium bovis
VKAGDGVINPDG

SEQ ID NO: 190981 - protein, 9 aa, Mycobacterium bovis
VKAGPGERV

SEQ ID NO: 190982 - protein, 12 aa, Mycobacterium bovis
VKAHDEDSVAGI

SEQ ID NO: 190983 - protein, 27 aa, Mycobacterium bovis
VKDGRNAGGAGANPNSTDAARIPETAA

SEQ ID NO: 190984 - protein, 6 aa, Mycobacterium bovis
VKDGYG

SEQ ID NO: 190985 - protein, 8 aa, Mycobacterium bovis
VKESNPYN

SEQ ID NO: 190986 - protein, 9 aa, Mycobacterium bovis
VKGDPSAAV

SEQ ID NO: 190987 - protein, 7 aa, Mycobacterium bovis
VKGDPTE

SEQ ID NO: 190988 - protein, 7 aa, Mycobacterium bovis
VKGSQLG

SEQ ID NO: 190989 - protein, 6 aa, Mycobacterium bovis
VKGTNA

SEQ ID NO: 190990 - protein, 11 aa, Mycobacterium bovis
VKGVTEETTTG

SEQ ID NO: 190991 - protein, 8 aa, Mycobacterium bovis
VKKPETIN

SEQ ID NO: 190992 - protein, 11 aa, Mycobacterium bovis
VKPATAVSDTT

SEQ ID NO: 190993 - protein, 13 aa, Mycobacterium bovis
VKPGGHFDAQHFA

SEQ ID NO: 190994 - protein, 6 aa, Mycobacterium bovis
VKPGRA

SEQ ID NO: 190995 - protein, 4 aa, Mycobacterium bovis
VKPP

SEQ ID NO: 190996 - protein, 8 aa, Mycobacterium bovis
VKPPPSEG

SEQ ID NO: 190997 - protein, 9 aa, Mycobacterium bovis
VKPTSVPAF

SEQ ID NO: 190998 - protein, 6 aa, Mycobacterium bovis
VKPTVA

SEQ ID NO: 190999 - protein, 6 aa, Mycobacterium bovis
VKQHAR

SEQ ID NO: 191000 - protein, 5 aa, Mycobacterium bovis
VKRAE

SEQ ID NO: 191001 - protein, 37 aa, Mycobacterium bovis
VKRGADRKTGPGPAGGREARKGTGHPAGEQPRDGVLV

SEQ ID NO: 191002 - protein, 16 aa, Mycobacterium bovis
VKRGADRKTGPGPAGW

SEQ ID NO: 191003 - protein, 37 aa, Mycobacterium bovis
VKRGADRKTGPRPAGGCEARKGSSPKAAEQPRDGVQV

SEQ ID NO: 191004 - protein, 37 aa, Mycobacterium bovis
VKRGADRKTRPGRAGGREARKGSSRKAAEQPRDGVQV

SEQ ID NO: 191005 - protein, 6 aa, Mycobacterium bovis
VKRGKT

SEQ ID NO: 191006 - protein, 9 aa, Mycobacterium bovis
VKRNSPALR

SEQ ID NO: 191007 - protein, 5 aa, Mycobacterium bovis
VKRPE

SEQ ID NO: 191008 - protein, 7 aa, Mycobacterium bovis
VKSGETH

SEQ ID NO: 191009 - protein, 4 aa, Mycobacterium bovis
VKTP

SEQ ID NO: 191010 - protein, 14 aa, Mycobacterium bovis
VLGDPTTATAAEGR

SEQ ID NO: 191011 - protein, 10 aa, Mycobacterium bovis
VLGPGTSPLG

SEQ ID NO: 191012 - protein, 7 aa, Mycobacterium bovis
VLPGGSD

SEQ ID NO: 191013 - protein, 24 aa, Mycobacterium bovis
VLPPPTMPSGPGPFGLPIPNPNYH

SEQ ID NO: 191014 - protein, 5 aa, Mycobacterium bovis
VLPTA

SEQ ID NO: 191015 - protein, 12 aa, Mycobacterium bovis
VLSGDTANEGTQ

SEQ ID NO: 191016 - protein, 8 aa, Mycobacterium bovis
VLSGTTSD

SEQ ID NO: 191017 - protein, 13 aa, Mycobacterium bovis
VMPGGTTAHPDRD

SEQ ID NO: 191018 - protein, 10 aa, Mycobacterium bovis
VNAEPDSRPA

SEQ ID NO: 191019 - protein, 6 aa, Mycobacterium bovis
VNAEQQ

SEQ ID NO: 191020 - protein, 6 aa, Mycobacterium bovis
VNAKNV

SEQ ID NO: 191021 - protein, 7 aa, Mycobacterium bovis
VNAPDGT

SEQ ID NO: 191022 - protein, 9 aa, Mycobacterium bovis
VNDDGAEPD

SEQ ID NO: 191023 - protein, 5 aa, Mycobacterium bovis
VNDPG

SEQ ID NO: 191024 - protein, 14 aa, Mycobacterium bovis
VNDSRGGSKKRKGM

SEQ ID NO: 191025 - protein, 6 aa, Mycobacterium bovis
VNEGQG

SEQ ID NO: 191026 - protein, 6 aa, Mycobacterium bovis
VNEPPE

SEQ ID NO: 191027 - protein, 33 aa, Mycobacterium bovis
VNFGNGNTGDTNFGSGNLGSGNIGFGNKGSHNI

SEQ ID NO: 191028 - protein, 9 aa, Mycobacterium bovis
VNGDYAAGN

SEQ ID NO: 191029 - protein, 9 aa, Mycobacterium bovis
VNGGNRTVP

SEQ ID NO: 191030 - protein, 93 aa, Mycobacterium bovis
VNGGVGGAGGHGGDPGVGGAGGQGGSGSTPGANGAPGNTPTSGGNGGNGGRGADATGFGQTGASGGRGGDGGLVGNGGAGGAGGNGSKGLPGL

SEQ ID NO: 191031 - protein, 4 aa, Mycobacterium bovis
VNGR

SEQ ID NO: 191032 - protein, 9 aa, Mycobacterium bovis
VNGSRRPSA

SEQ ID NO: 191033 - protein, 6 aa, Mycobacterium bovis
VNGTAS

SEQ ID NO: 191034 - protein, 47 aa, Mycobacterium bovis
VNKASRSGGFGSGSRPAPAQTSSASGDDPWGSAPASGSFGGGDDEPP

SEQ ID NO: 191035 - protein, 7 aa, Mycobacterium bovis
VNKNGMP

SEQ ID NO: 191036 - protein, 13 aa, Mycobacterium bovis
VNMSQSSNDTFPT

SEQ ID NO: 191037 - protein, 5 aa, Mycobacterium bovis
VNPDP

SEQ ID NO: 191038 - protein, 14 aa, Mycobacterium bovis
VNPEPSAKREQTDE

SEQ ID NO: 191039 - protein, 12 aa, Mycobacterium bovis
VNPPGANQREIA

SEQ ID NO: 191040 - protein, 6 aa, Mycobacterium bovis
VNPPGR

SEQ ID NO: 191041 - protein, 10 aa, Mycobacterium bovis
VNPPLREASD

SEQ ID NO: 191042 - protein, 9 aa, Mycobacterium bovis
VNPQRSLSR

SEQ ID NO: 191043 - protein, 4 aa, Mycobacterium bovis
VNQT

SEQ ID NO: 191044 - protein, 6 aa, Mycobacterium bovis
VNRAGT

SEQ ID NO: 191045 - protein, 9 aa, Mycobacterium bovis
VNRDGQPEK

SEQ ID NO: 191046 - protein, 8 aa, Mycobacterium bovis
VNRTPEEG

SEQ ID NO: 191047 - protein, 4 aa, Mycobacterium bovis
VNSN

SEQ ID NO: 191048 - protein, 6 aa, Mycobacterium bovis
VNSPGW

SEQ ID NO: 191049 - protein, 17 aa, Mycobacterium bovis
VNSSPARFDQKKADALN

SEQ ID NO: 191050 - protein, 11 aa, Mycobacterium bovis
VNSSQGGGSKD

SEQ ID NO: 191051 - protein, 16 aa, Mycobacterium bovis
VNSYASAEAANASPLQ

SEQ ID NO: 191052 - protein, 25 aa, Mycobacterium bovis
VNTANRQGKRKRTRTGYGKRKSTKR

SEQ ID NO: 191053 - protein, 6 aa, Mycobacterium bovis
VNTPPS

SEQ ID NO: 191054 - protein, 5 aa, Mycobacterium bovis
VNTQR

SEQ ID NO: 191055 - protein, 6 aa, Mycobacterium bovis
VPAAAQ

SEQ ID NO: 191056 - protein, 5 aa, Mycobacterium bovis
VPADM

SEQ ID NO: 191057 - protein, 14 aa, Mycobacterium bovis
VPADTANLREGADL

SEQ ID NO: 191058 - protein, 12 aa, Mycobacterium bovis
VPAGDPSKGQLR

SEQ ID NO: 191059 - protein, 8 aa, Mycobacterium bovis
VPAGGEDD

SEQ ID NO: 191060 - protein, 29 aa, Mycobacterium bovis
VPAGQGSMGNNGEPGGPASQAPSSGKPVA

SEQ ID NO: 191061 - protein, 7 aa, Mycobacterium bovis
VPANEPV

SEQ ID NO: 191062 - protein, 19 aa, Mycobacterium bovis
VPAPENGFNTRPAEAHDHD

SEQ ID NO: 191063 - protein, 13 aa, Mycobacterium bovis
VPAPEPAAETTRG

SEQ ID NO: 191064 - protein, 9 aa, Mycobacterium bovis
VPAPGGRRE

SEQ ID NO: 191065 - protein, 14 aa, Mycobacterium bovis
VPAPPVAPAAEPAE

SEQ ID NO: 191066 - protein, 10 aa, Mycobacterium bovis
VPAPTPRRPL

SEQ ID NO: 191067 - protein, 20 aa, Mycobacterium bovis
VPAPVSDRRPLPERDPAPSR

SEQ ID NO: 191068 - protein, 12 aa, Mycobacterium bovis
VPAQTEQQRNDA

SEQ ID NO: 191069 - protein, 10 aa, Mycobacterium bovis
VPAREQTRAG

SEQ ID NO: 191070 - protein, 15 aa, Mycobacterium bovis
VPARPRRVRKPGEPL

SEQ ID NO: 191071 - protein, 9 aa, Mycobacterium bovis
VPARTGRQH

SEQ ID NO: 191072 - protein, 8 aa, Mycobacterium bovis
VPASTDYE

SEQ ID NO: 191073 - protein, 4 aa, Mycobacterium bovis
VPAT

SEQ ID NO: 191074 - protein, 10 aa, Mycobacterium bovis
VPATKGNTRR

SEQ ID NO: 191075 - protein, 7 aa, Mycobacterium bovis
VPDDDLG

SEQ ID NO: 191076 - protein, 4 aa, Mycobacterium bovis
VPDE

SEQ ID NO: 191077 - protein, 16 aa, Mycobacterium bovis
VPDETGLGADAARARE

SEQ ID NO: 191078 - protein, 8 aa, Mycobacterium bovis
VPDGAGTV

SEQ ID NO: 191079 - protein, 10 aa, Mycobacterium bovis
VPDGDGPRKV

SEQ ID NO: 191080 - protein, 5 aa, Mycobacterium bovis
VPDGG

SEQ ID NO: 191081 - protein, 8 aa, Mycobacterium bovis
VPDNGGRL

SEQ ID NO: 191082 - protein, 6 aa, Mycobacterium bovis
VPDPAA

SEQ ID NO: 191083 - protein, 9 aa, Mycobacterium bovis
VPDPAPGKN

SEQ ID NO: 191084 - protein, 5 aa, Mycobacterium bovis
VPDPQ

SEQ ID NO: 191085 - protein, 7 aa, Mycobacterium bovis
VPDSGLR

SEQ ID NO: 191086 - protein, 5 aa, Mycobacterium bovis
VPDST

SEQ ID NO: 191087 - protein, 4 aa, Mycobacterium bovis
VPEA

SEQ ID NO: 191088 - protein, 7 aa, Mycobacterium bovis
VPEEDGP

SEQ ID NO: 191089 - protein, 6 aa, Mycobacterium bovis
VPEKPR

SEQ ID NO: 191090 - protein, 4 aa, Mycobacterium bovis
VPER

SEQ ID NO: 191091 - protein, 12 aa, Mycobacterium bovis
VPERGPAGCGGL

SEQ ID NO: 191092 - protein, 6 aa, Mycobacterium bovis
VPESLR

SEQ ID NO: 191093 - protein, 8 aa, Mycobacterium bovis
VPETGPDA

SEQ ID NO: 191094 - protein, 6 aa, Mycobacterium bovis
VPETLK

SEQ ID NO: 191095 - protein, 20 aa, Mycobacterium bovis
VPFPDSATGARGRQGSPARV

SEQ ID NO: 191096 - protein, 18 aa, Mycobacterium bovis
VPFPTGPRPDVRRADDHE

SEQ ID NO: 191097 - protein, 4 aa, Mycobacterium bovis
VPGA

SEQ ID NO: 191098 - protein, 6 aa, Mycobacterium bovis
VPGAAR

SEQ ID NO: 191099 - protein, 5 aa, Mycobacterium bovis
VPGAC

SEQ ID NO: 191100 - protein, 5 aa, Mycobacterium bovis
VPGAD

SEQ ID NO: 191101 - protein, 6 aa, Mycobacterium bovis
VPGAGD

SEQ ID NO: 191102 - protein, 6 aa, Mycobacterium bovis
VPGAPK

SEQ ID NO: 191103 - protein, 6 aa, Mycobacterium bovis
VPGARE

SEQ ID NO: 191104 - protein, 16 aa, Mycobacterium bovis
VPGASGTVLRWSAPLS

SEQ ID NO: 191105 - protein, 7 aa, Mycobacterium bovis
VPGATAP

SEQ ID NO: 191106 - protein, 13 aa, Mycobacterium bovis
VPGDDWPAYTQDD

SEQ ID NO: 191107 - protein, 8 aa, Mycobacterium bovis
VPGDRSTE

SEQ ID NO: 191108 - protein, 4 aa, Mycobacterium bovis
VPGE

SEQ ID NO: 191109 - protein, 6 aa, Mycobacterium bovis
VPGFTG

SEQ ID NO: 191110 - protein, 7 aa, Mycobacterium bovis
VPGGDIK

SEQ ID NO: 191111 - protein, 9 aa, Mycobacterium bovis
VPGGEPAAL

SEQ ID NO: 191112 - protein, 5 aa, Mycobacterium bovis
VPGGG

SEQ ID NO: 191113 - protein, 7 aa, Mycobacterium bovis
VPGGLSA

SEQ ID NO: 191114 - protein, 11 aa, Mycobacterium bovis
VPGGNGVTPID

SEQ ID NO: 191115 - protein, 12 aa, Mycobacterium bovis
VPGGSGGGSAAA

SEQ ID NO: 191116 - protein, 4 aa, Mycobacterium bovis
VPGH

SEQ ID NO: 191117 - protein, 5 aa, Mycobacterium bovis
VPGPE

SEQ ID NO: 191118 - protein, 13 aa, Mycobacterium bovis
VPGPEDHPDSGDS

SEQ ID NO: 191119 - protein, 6 aa, Mycobacterium bovis
VPGPGL

SEQ ID NO: 191120 - protein, 9 aa, Mycobacterium bovis
VPGPNGETW

SEQ ID NO: 191121 - protein, 6 aa, Mycobacterium bovis
VPGPPF

SEQ ID NO: 191122 - protein, 6 aa, Mycobacterium bovis
VPGPQA

SEQ ID NO: 191123 - protein, 8 aa, Mycobacterium bovis
VPGPREPR

SEQ ID NO: 191124 - protein, 6 aa, Mycobacterium bovis
VPGPVD

SEQ ID NO: 191125 - protein, 4 aa, Mycobacterium bovis
VPGQ

SEQ ID NO: 191126 - protein, 5 aa, Mycobacterium bovis
VPGRR

SEQ ID NO: 191127 - protein, 6 aa, Mycobacterium bovis
VPGRTG

SEQ ID NO: 191128 - protein, 4 aa, Mycobacterium bovis
VPGS

SEQ ID NO: 191129 - protein, 6 aa, Mycobacterium bovis
VPGSAS

SEQ ID NO: 191130 - protein, 10 aa, Mycobacterium bovis
VPGVGKSTAI

SEQ ID NO: 191131 - protein, 8 aa, Mycobacterium bovis
VPHGESGK

SEQ ID NO: 191132 - protein, 4 aa, Mycobacterium bovis
VPHT

SEQ ID NO: 191133 - protein, 15 aa, Mycobacterium bovis
VPIDRTNADSAQGAL

SEQ ID NO: 191134 - protein, 4 aa, Mycobacterium bovis
VPIN

SEQ ID NO: 191135 - protein, 13 aa, Mycobacterium bovis
VPKEGEQPNQRQK

SEQ ID NO: 191136 - protein, 8 aa, Mycobacterium bovis
VPKGTADG

SEQ ID NO: 191137 - protein, 5 aa, Mycobacterium bovis
VPLDD

SEQ ID NO: 191138 - protein, 6 aa, Mycobacterium bovis
VPLPTE

SEQ ID NO: 191139 - protein, 13 aa, Mycobacterium bovis
VPLPTSPGYTGNT

SEQ ID NO: 191140 - protein, 19 aa, Mycobacterium bovis
VPNDGGRVIDPGTGEPVPG

SEQ ID NO: 191141 - protein, 8 aa, Mycobacterium bovis
VPNDGKGA

SEQ ID NO: 191142 - protein, 16 aa, Mycobacterium bovis
VPNETNRKKNRQAGLD

SEQ ID NO: 191143 - protein, 8 aa, Mycobacterium bovis
VPNPRPLD

SEQ ID NO: 191144 - protein, 13 aa, Mycobacterium bovis
VPNQGRRGEPGPP

SEQ ID NO: 191145 - protein, 7 aa, Mycobacterium bovis
VPNRESA

SEQ ID NO: 191146 - protein, 4 aa, Mycobacterium bovis
VPNT

SEQ ID NO: 191147 - protein, 8 aa, Mycobacterium bovis
VPPAKTDE

SEQ ID NO: 191148 - protein, 12 aa, Mycobacterium bovis
VPPAPASKKVAR

SEQ ID NO: 191149 - protein, 12 aa, Mycobacterium bovis
VPPDTLASDAER

SEQ ID NO: 191150 - protein, 8 aa, Mycobacterium bovis
VPPETTGF

SEQ ID NO: 191151 - protein, 4 aa, Mycobacterium bovis
VPPG

SEQ ID NO: 191152 - protein, 21 aa, Mycobacterium bovis
VPPGDMPGGTAAADAAHTEDK

SEQ ID NO: 191153 - protein, 7 aa, Mycobacterium bovis
VPPGPGE

SEQ ID NO: 191154 - protein, 7 aa, Mycobacterium bovis
VPPGPGQ

SEQ ID NO: 191155 - protein, 9 aa, Mycobacterium bovis
VPPHDPASY

SEQ ID NO: 191156 - protein, 5 aa, Mycobacterium bovis
VPPIA

SEQ ID NO: 191157 - protein, 5 aa, Mycobacterium bovis
VPPIN

SEQ ID NO: 191158 - protein, 8 aa, Mycobacterium bovis
VPPNTGNL

SEQ ID NO: 191159 - protein, 4 aa, Mycobacterium bovis
VPPP

SEQ ID NO: 191160 - protein, 12 aa, Mycobacterium bovis
VPPPKGEPDAPL

SEQ ID NO: 191161 - protein, 13 aa, Mycobacterium bovis
VPPPQGDAEAPTR

SEQ ID NO: 191162 - protein, 7 aa, Mycobacterium bovis
VPPPRNT

SEQ ID NO: 191163 - protein, 13 aa, Mycobacterium bovis
VPPRGTRPTTDRV

SEQ ID NO: 191164 - protein, 4 aa, Mycobacterium bovis
VPPS

SEQ ID NO: 191165 - protein, 16 aa, Mycobacterium bovis
VPPSAPTTKPTDGKPV

SEQ ID NO: 191166 - protein, 5 aa, Mycobacterium bovis
VPPSV

SEQ ID NO: 191167 - protein, 19 aa, Mycobacterium bovis
VPPSVPVKSADDKPVVTKS

SEQ ID NO: 191168 - protein, 11 aa, Mycobacterium bovis
VPPSWASATPA

SEQ ID NO: 191169 - protein, 4 aa, Mycobacterium bovis
VPPT

SEQ ID NO: 191170 - protein, 32 aa, Mycobacterium bovis
VPPTGSPGGGLPADTAAQLTSAGREAAALSGD

SEQ ID NO: 191171 - protein, 6 aa, Mycobacterium bovis
VPQPET

SEQ ID NO: 191172 - protein, 8 aa, Mycobacterium bovis
VPQQGHSV

SEQ ID NO: 191173 - protein, 20 aa, Mycobacterium bovis
VPQRTQRRQVPSCPSSRRQH

SEQ ID NO: 191174 - protein, 4 aa, Mycobacterium bovis
VPRA

SEQ ID NO: 191175 - protein, 13 aa, Mycobacterium bovis
VPRADDADSDVPR

SEQ ID NO: 191176 - protein, 50 aa, Mycobacterium bovis
VPRAGDKAGNSQDGGSGSTEIKGIDGSTRLEAKRQRRRDGRDAGRRRPPV

SEQ ID NO: 191177 - protein, 9 aa, Mycobacterium bovis
VPRDYDPAY

SEQ ID NO: 191178 - protein, 11 aa, Mycobacterium bovis
VPRGKAPIADV

SEQ ID NO: 191179 - protein, 8 aa, Mycobacterium bovis
VPRGRKEA

SEQ ID NO: 191180 - protein, 6 aa, Mycobacterium bovis
VPSAST

SEQ ID NO: 191181 - protein, 4 aa, Mycobacterium bovis
VPSD

SEQ ID NO: 191182 - protein, 9 aa, Mycobacterium bovis
VPSGEQSSL

SEQ ID NO: 191183 - protein, 5 aa, Mycobacterium bovis
VPSGS

SEQ ID NO: 191184 - protein, 8 aa, Mycobacterium bovis
VPSPGPTR

SEQ ID NO: 191185 - protein, 9 aa, Mycobacterium bovis
VPSPPAEIA

SEQ ID NO: 191186 - protein, 7 aa, Mycobacterium bovis
VPSPTAA

SEQ ID NO: 191187 - protein, 6 aa, Mycobacterium bovis
VPSRVS

SEQ ID NO: 191188 - protein, 17 aa, Mycobacterium bovis
VPSTPGRVTDTAEGAKA

SEQ ID NO: 191189 - protein, 4 aa, Mycobacterium bovis
VPTA

SEQ ID NO: 191190 - protein, 8 aa, Mycobacterium bovis
VPTASTTA

SEQ ID NO: 191191 - protein, 6 aa, Mycobacterium bovis
VPTATS

SEQ ID NO: 191192 - protein, 11 aa, Mycobacterium bovis
VPTDDSSLGAL

SEQ ID NO: 191193 - protein, 4 aa, Mycobacterium bovis
VPTG

SEQ ID NO: 191194 - protein, 5 aa, Mycobacterium bovis
VPTGD

SEQ ID NO: 191195 - protein, 6 aa, Mycobacterium bovis
VPTIET

SEQ ID NO: 191196 - protein, 4 aa, Mycobacterium bovis
VPTP

SEQ ID NO: 191197 - protein, 6 aa, Mycobacterium bovis
VPTPDN

SEQ ID NO: 191198 - protein, 6 aa, Mycobacterium bovis
VPTRDG

SEQ ID NO: 191199 - protein, 5 aa, Mycobacterium bovis
VPTTG

SEQ ID NO: 191200 - protein, 10 aa, Mycobacterium bovis
VPVPGDTGGA

SEQ ID NO: 191201 - protein, 7 aa, Mycobacterium bovis
VPVPGRT

SEQ ID NO: 191202 - protein, 6 aa, Mycobacterium bovis
VPWSSE

SEQ ID NO: 191203 - protein, 39 aa, Mycobacterium bovis
VQARANAEALAEGGGVPAYAADETTPTPTTTPKTAHPSR

SEQ ID NO: 191204 - protein, 10 aa, Mycobacterium bovis
VQARRTAPDT

SEQ ID NO: 191205 - protein, 9 aa, Mycobacterium bovis
VQATDNPLK

SEQ ID NO: 191206 - protein, 7 aa, Mycobacterium bovis
VQDEGSQ

SEQ ID NO: 191207 - protein, 5 aa, Mycobacterium bovis
VQDGK

SEQ ID NO: 191208 - protein, 5 aa, Mycobacterium bovis
VQDPY

SEQ ID NO: 191209 - protein, 7 aa, Mycobacterium bovis
VQDRNGP

SEQ ID NO: 191210 - protein, 7 aa, Mycobacterium bovis
VQEGDDV

SEQ ID NO: 191211 - protein, 6 aa, Mycobacterium bovis
VQGEPV

SEQ ID NO: 191212 - protein, 20 aa, Mycobacterium bovis
VQGGRPEALGGLGGAASSQL

SEQ ID NO: 191213 - protein, 14 aa, Mycobacterium bovis
VQGPETDHLLALAG

SEQ ID NO: 191214 - protein, 10 aa, Mycobacterium bovis
VQGPVSKVST

SEQ ID NO: 191215 - protein, 14 aa, Mycobacterium bovis
VQHEPSAHAAAADV

SEQ ID NO: 191216 - protein, 17 aa, Mycobacterium bovis
VQKDATQISAESGLQPM

SEQ ID NO: 191217 - protein, 7 aa, Mycobacterium bovis
VQKGHDV

SEQ ID NO: 191218 - protein, 8 aa, Mycobacterium bovis
VQKTSYDL

SEQ ID NO: 191219 - protein, 9 aa, Mycobacterium bovis
VQNEKNTKQ

SEQ ID NO: 191220 - protein, 9 aa, Mycobacterium bovis
VQPEGDRGQ

SEQ ID NO: 191221 - protein, 5 aa, Mycobacterium bovis
VQPEL

SEQ ID NO: 191222 - protein, 5 aa, Mycobacterium bovis
VQPGE

SEQ ID NO: 191223 - protein, 7 aa, Mycobacterium bovis
VQPGVGR

SEQ ID NO: 191224 - protein, 12 aa, Mycobacterium bovis
VQPHSGATANAA

SEQ ID NO: 191225 - protein, 12 aa, Mycobacterium bovis
VQPPEPENFDPE

SEQ ID NO: 191226 - protein, 7 aa, Mycobacterium bovis
VQPTSDS

SEQ ID NO: 191227 - protein, 4 aa, Mycobacterium bovis
VQQG

SEQ ID NO: 191228 - protein, 33 aa, Mycobacterium bovis
VQQGGDGGAGGTGSTNANDGTATGGKGGEGGVG

SEQ ID NO: 191229 - protein, 8 aa, Mycobacterium bovis
VQRARAAQ

SEQ ID NO: 191230 - protein, 21 aa, Mycobacterium bovis
VQRDPTAAGKRHAAQARAARP

SEQ ID NO: 191231 - protein, 6 aa, Mycobacterium bovis
VQRESG

SEQ ID NO: 191232 - protein, 7 aa, Mycobacterium bovis
VQRNPNS

SEQ ID NO: 191233 - protein, 16 aa, Mycobacterium bovis
VQRPSSDDELGGPASP

SEQ ID NO: 191234 - protein, 9 aa, Mycobacterium bovis
VQRPSTGDA

SEQ ID NO: 191235 - protein, 6 aa, Mycobacterium bovis
VQRQQT

SEQ ID NO: 191236 - protein, 10 aa, Mycobacterium bovis
VQRSSRYPGG

SEQ ID NO: 191237 - protein, 15 aa, Mycobacterium bovis
VQSEHDELTRSTHAE

SEQ ID NO: 191238 - protein, 9 aa, Mycobacterium bovis
VQSSRPEDY

SEQ ID NO: 191239 - protein, 7 aa, Mycobacterium bovis
VQTATEE

SEQ ID NO: 191240 - protein, 5 aa, Mycobacterium bovis
VQTES

SEQ ID NO: 191241 - protein, 13 aa, Mycobacterium bovis
VQTGTARGDDDLA

SEQ ID NO: 191242 - protein, 7 aa, Mycobacterium bovis
VQTNARL

SEQ ID NO: 191243 - protein, 23 aa, Mycobacterium bovis
VQTPARNLPPPDERDNPTHYCPK

SEQ ID NO: 191244 - protein, 7 aa, Mycobacterium bovis
VQTPYRK

SEQ ID NO: 191245 - protein, 5 aa, Mycobacterium bovis
VQTRE

SEQ ID NO: 191246 - protein, 6 aa, Mycobacterium bovis
VQWGPG

SEQ ID NO: 191247 - protein, 6 aa, Mycobacterium bovis
VQYNPK

SEQ ID NO: 191248 - protein, 8 aa, Mycobacterium bovis
VRAAEQLG

SEQ ID NO: 191249 - protein, 9 aa, Mycobacterium bovis
VRADAESLA

SEQ ID NO: 191250 - protein, 10 aa, Mycobacterium bovis
VRAEAAESYD

SEQ ID NO: 191251 - protein, 7 aa, Mycobacterium bovis
VRAGAGD

SEQ ID NO: 191252 - protein, 8 aa, Mycobacterium bovis
VRAGASAN

SEQ ID NO: 191253 - protein, 5 aa, Mycobacterium bovis
VRANR

SEQ ID NO: 191254 - protein, 10 aa, Mycobacterium bovis
VRASEQDAAA

SEQ ID NO: 191255 - protein, 10 aa, Mycobacterium bovis
VRATPDARVS

SEQ ID NO: 191256 - protein, 5 aa, Mycobacterium bovis
VRATS

SEQ ID NO: 191257 - protein, 10 aa, Mycobacterium bovis
VRDAENSEDV

SEQ ID NO: 191258 - protein, 4 aa, Mycobacterium bovis
VRDG

SEQ ID NO: 191259 - protein, 5 aa, Mycobacterium bovis
VRDGS

SEQ ID NO: 191260 - protein, 7 aa, Mycobacterium bovis
VRDGTGV

SEQ ID NO: 191261 - protein, 6 aa, Mycobacterium bovis
VRDPYG

SEQ ID NO: 191262 - protein, 8 aa, Mycobacterium bovis
VRDQDVGN

SEQ ID NO: 191263 - protein, 5 aa, Mycobacterium bovis
VREAH

SEQ ID NO: 191264 - protein, 21 aa, Mycobacterium bovis
VREGGPSAGRRHHPGGNGAPL

SEQ ID NO: 191265 - protein, 11 aa, Mycobacterium bovis
VREKADPATLH

SEQ ID NO: 191266 - protein, 14 aa, Mycobacterium bovis
VREPSTPGSGIPKS

SEQ ID NO: 191267 - protein, 29 aa, Mycobacterium bovis
VRGDGGVGMASGDGGLSTGAAGASAEGGL

SEQ ID NO: 191268 - protein, 14 aa, Mycobacterium bovis
VRGDGGVLKNSENS

SEQ ID NO: 191269 - protein, 5 aa, Mycobacterium bovis
VRGEG

SEQ ID NO: 191270 - protein, 7 aa, Mycobacterium bovis
VRGEGGR

SEQ ID NO: 191271 - protein, 5 aa, Mycobacterium bovis
VRGGD

SEQ ID NO: 191272 - protein, 8 aa, Mycobacterium bovis
VRGKVGDA

SEQ ID NO: 191273 - protein, 7 aa, Mycobacterium bovis
VRGLTGK

SEQ ID NO: 191274 - protein, 7 aa, Mycobacterium bovis
VRGNATR

SEQ ID NO: 191275 - protein, 6 aa, Mycobacterium bovis
VRGNTQ

SEQ ID NO: 191276 - protein, 6 aa, Mycobacterium bovis
VRGPDG

SEQ ID NO: 191277 - protein, 7 aa, Mycobacterium bovis
VRGQPGD

SEQ ID NO: 191278 - protein, 7 aa, Mycobacterium bovis
VRGRDKA

SEQ ID NO: 191279 - protein, 7 aa, Mycobacterium bovis
VRGREDS

SEQ ID NO: 191280 - protein, 13 aa, Mycobacterium bovis
VRGRGAESAAPLG

SEQ ID NO: 191281 - protein, 5 aa, Mycobacterium bovis
VRGSD

SEQ ID NO: 191282 - protein, 11 aa, Mycobacterium bovis
VRHGSGKGGDY

SEQ ID NO: 191283 - protein, 4 aa, Mycobacterium bovis
VRKA

SEQ ID NO: 191284 - protein, 6 aa, Mycobacterium bovis
VRNYDG

SEQ ID NO: 191285 - protein, 7 aa, Mycobacterium bovis
VRPDLDG

SEQ ID NO: 191286 - protein, 5 aa, Mycobacterium bovis
VRPEE

SEQ ID NO: 191287 - protein, 9 aa, Mycobacterium bovis
VRPENAASR

SEQ ID NO: 191288 - protein, 7 aa, Mycobacterium bovis
VRPETAA

SEQ ID NO: 191289 - protein, 7 aa, Mycobacterium bovis
VRPGKGE

SEQ ID NO: 191290 - protein, 14 aa, Mycobacterium bovis
VRPHEPAYDPEPDS

SEQ ID NO: 191291 - protein, 4 aa, Mycobacterium bovis
VRPI

SEQ ID NO: 191292 - protein, 9 aa, Mycobacterium bovis
VRPKDDPLG

SEQ ID NO: 191293 - protein, 9 aa, Mycobacterium bovis
VRPNGAERA

SEQ ID NO: 191294 - protein, 5 aa, Mycobacterium bovis
VRPNT

SEQ ID NO: 191295 - protein, 7 aa, Mycobacterium bovis
VRPPAAD

SEQ ID NO: 191296 - protein, 16 aa, Mycobacterium bovis
VRPPRDPGSHCCLAVN

SEQ ID NO: 191297 - protein, 5 aa, Mycobacterium bovis
VRPPV

SEQ ID NO: 191298 - protein, 6 aa, Mycobacterium bovis
VRPTPI

SEQ ID NO: 191299 - protein, 10 aa, Mycobacterium bovis
VRQPGKTGEE

SEQ ID NO: 191300 - protein, 12 aa, Mycobacterium bovis
VRQSKVGDTVTS

SEQ ID NO: 191301 - protein, 9 aa, Mycobacterium bovis
VRRDRSGKH

SEQ ID NO: 191302 - protein, 13 aa, Mycobacterium bovis
VRRGAPSANAQWG

SEQ ID NO: 191303 - protein, 17 aa, Mycobacterium bovis
VRRGDPRLGEGGVPTDR

SEQ ID NO: 191304 - protein, 37 aa, Mycobacterium bovis
VRRGSGNIATEDALTNDETAAAITAGQQIADEEVDAG

SEQ ID NO: 191305 - protein, 4 aa, Mycobacterium bovis
VRRP

SEQ ID NO: 191306 - protein, 9 aa, Mycobacterium bovis
VRRRPSRGL

SEQ ID NO: 191307 - protein, 16 aa, Mycobacterium bovis
VRRSRAGVSDPNRPTG

SEQ ID NO: 191308 - protein, 8 aa, Mycobacterium bovis
VRRSTAES

SEQ ID NO: 191309 - protein, 4 aa, Mycobacterium bovis
VRSD

SEQ ID NO: 191310 - protein, 11 aa, Mycobacterium bovis
VRSDGSSMQKK

SEQ ID NO: 191311 - protein, 8 aa, Mycobacterium bovis
VRSDQPGH

SEQ ID NO: 191312 - protein, 7 aa, Mycobacterium bovis
VRSEREL

SEQ ID NO: 191313 - protein, 15 aa, Mycobacterium bovis
VRSGEPTARLTGPPG

SEQ ID NO: 191314 - protein, 14 aa, Mycobacterium bovis
VRSGQRAAAEVAAL

SEQ ID NO: 191315 - protein, 12 aa, Mycobacterium bovis
VRSIPDSVPPPR

SEQ ID NO: 191316 - protein, 7 aa, Mycobacterium bovis
VRSQAAG

SEQ ID NO: 191317 - protein, 5 aa, Mycobacterium bovis
VRSRT

SEQ ID NO: 191318 - protein, 7 aa, Mycobacterium bovis
VRSSADA

SEQ ID NO: 191319 - protein, 11 aa, Mycobacterium bovis
VRSTASSPVSY

SEQ ID NO: 191320 - protein, 9 aa, Mycobacterium bovis
VRSTDRTGV

SEQ ID NO: 191321 - protein, 20 aa, Mycobacterium bovis
VRSTNRAGGLEGGMTNGQPL

SEQ ID NO: 191322 - protein, 4 aa, Mycobacterium bovis
VRTA

SEQ ID NO: 191323 - protein, 8 aa, Mycobacterium bovis
VRTANSEI

SEQ ID NO: 191324 - protein, 12 aa, Mycobacterium bovis
VRTDPDAPKHAG

SEQ ID NO: 191325 - protein, 12 aa, Mycobacterium bovis
VRTDSSLDSNLH

SEQ ID NO: 191326 - protein, 8 aa, Mycobacterium bovis
VRTGDRRM

SEQ ID NO: 191327 - protein, 7 aa, Mycobacterium bovis
VRTGEAP

SEQ ID NO: 191328 - protein, 7 aa, Mycobacterium bovis
VRTGGGV

SEQ ID NO: 191329 - protein, 7 aa, Mycobacterium bovis
VRTPTTT

SEQ ID NO: 191330 - protein, 4 aa, Mycobacterium bovis
VRTS

SEQ ID NO: 191331 - protein, 11 aa, Mycobacterium bovis
VRVGPDSDTSE

SEQ ID NO: 191332 - protein, 16 aa, Mycobacterium bovis
VRVNTQPDPALPGPDG

SEQ ID NO: 191333 - protein, 11 aa, Mycobacterium bovis
VRVTSKKRDDL

SEQ ID NO: 191334 - protein, 10 aa, Mycobacterium bovis
VRYDRDGDQH

SEQ ID NO: 191335 - protein, 7 aa, Mycobacterium bovis
VSAAGTA

SEQ ID NO: 191336 - protein, 9 aa, Mycobacterium bovis
VSAASAAVA

SEQ ID NO: 191337 - protein, 8 aa, Mycobacterium bovis
VSADDEPK

SEQ ID NO: 191338 - protein, 8 aa, Mycobacterium bovis
VSADNPVE

SEQ ID NO: 191339 - protein, 6 aa, Mycobacterium bovis
VSADTT

SEQ ID NO: 191340 - protein, 8 aa, Mycobacterium bovis
VSAEGTRD

SEQ ID NO: 191341 - protein, 11 aa, Mycobacterium bovis
VSAGGGLGGVG

SEQ ID NO: 191342 - protein, 10 aa, Mycobacterium bovis
VSAGPGTRAN

SEQ ID NO: 191343 - protein, 10 aa, Mycobacterium bovis
VSAGSRESME

SEQ ID NO: 191344 - protein, 22 aa, Mycobacterium bovis
VSAGYGNNGDVQSGINNTNSGG

SEQ ID NO: 191345 - protein, 14 aa, Mycobacterium bovis
VSANPTVGSSHGPH

SEQ ID NO: 191346 - protein, 9 aa, Mycobacterium bovis
VSAPEGKRK

SEQ ID NO: 191347 - protein, 8 aa, Mycobacterium bovis
VSAPGGLP

SEQ ID NO: 191348 - protein, 5 aa, Mycobacterium bovis
VSAQS

SEQ ID NO: 191349 - protein, 23 aa, Mycobacterium bovis
VSARHQARRRRRAAAKERGNADE

SEQ ID NO: 191350 - protein, 7 aa, Mycobacterium bovis
VSASAQT

SEQ ID NO: 191351 - protein, 15 aa, Mycobacterium bovis
VSASDPYRGQPDARL

SEQ ID NO: 191352 - protein, 5 aa, Mycobacterium bovis
VSATA

SEQ ID NO: 191353 - protein, 17 aa, Mycobacterium bovis
VSATTTDGLGLTGRGEG

SEQ ID NO: 191354 - protein, 7 aa, Mycobacterium bovis
VSCAPRD

SEQ ID NO: 191355 - protein, 9 aa, Mycobacterium bovis
VSDDGSTAR

SEQ ID NO: 191356 - protein, 12 aa, Mycobacterium bovis
VSDEDKSQRRDE

SEQ ID NO: 191357 - protein, 9 aa, Mycobacterium bovis
VSDEDPLAE

SEQ ID NO: 191358 - protein, 6 aa, Mycobacterium bovis
VSDNER

SEQ ID NO: 191359 - protein, 7 aa, Mycobacterium bovis
VSDPAHV

SEQ ID NO: 191360 - protein, 10 aa, Mycobacterium bovis
VSDPGGPVTA

SEQ ID NO: 191361 - protein, 5 aa, Mycobacterium bovis
VSDQP

SEQ ID NO: 191362 - protein, 5 aa, Mycobacterium bovis
VSDRA

SEQ ID NO: 191363 - protein, 6 aa, Mycobacterium bovis
VSDSAS

SEQ ID NO: 191364 - protein, 19 aa, Mycobacterium bovis
VSEAGGFHDPELESSREQL

SEQ ID NO: 191365 - protein, 6 aa, Mycobacterium bovis
VSEDKR

SEQ ID NO: 191366 - protein, 7 aa, Mycobacterium bovis
VSEPERK

SEQ ID NO: 191367 - protein, 8 aa, Mycobacterium bovis
VSERPGVY

SEQ ID NO: 191368 - protein, 6 aa, Mycobacterium bovis
VSESTA

SEQ ID NO: 191369 - protein, 17 aa, Mycobacterium bovis
VSESTAADNFDEMSPDA

SEQ ID NO: 191370 - protein, 5 aa, Mycobacterium bovis
VSETG

SEQ ID NO: 191371 - protein, 5 aa, Mycobacterium bovis
VSEYG

SEQ ID NO: 191372 - protein, 10 aa, Mycobacterium bovis
VSEYNGDPAW

SEQ ID NO: 191373 - protein, 8 aa, Mycobacterium bovis
VSGAAADL

SEQ ID NO: 191374 - protein, 11 aa, Mycobacterium bovis
VSGADIDAPQI

SEQ ID NO: 191375 - protein, 6 aa, Mycobacterium bovis
VSGAGG

SEQ ID NO: 191376 - protein, 7 aa, Mycobacterium bovis
VSGAGGG

SEQ ID NO: 191377 - protein, 7 aa, Mycobacterium bovis
VSGDADR

SEQ ID NO: 191378 - protein, 7 aa, Mycobacterium bovis
VSGEAEL

SEQ ID NO: 191379 - protein, 5 aa, Mycobacterium bovis
VSGER

SEQ ID NO: 191380 - protein, 5 aa, Mycobacterium bovis
VSGET

SEQ ID NO: 191381 - protein, 4 aa, Mycobacterium bovis
VSGG

SEQ ID NO: 191382 - protein, 8 aa, Mycobacterium bovis
VSGGAPLG

SEQ ID NO: 191383 - protein, 10 aa, Mycobacterium bovis
VSGGRADPAM

SEQ ID NO: 191384 - protein, 5 aa, Mycobacterium bovis
VSGGT

SEQ ID NO: 191385 - protein, 7 aa, Mycobacterium bovis
VSGGYTR

SEQ ID NO: 191386 - protein, 10 aa, Mycobacterium bovis
VSGKTAARVA

SEQ ID NO: 191387 - protein, 8 aa, Mycobacterium bovis
VSGLRGSE

SEQ ID NO: 191388 - protein, 28 aa, Mycobacterium bovis
VSGPGRKPVMGETGGAHRIESAKAGKLT

SEQ ID NO: 191389 - protein, 9 aa, Mycobacterium bovis
VSGPGSARV

SEQ ID NO: 191390 - protein, 11 aa, Mycobacterium bovis
VSGPVSGPNED

SEQ ID NO: 191391 - protein, 4 aa, Mycobacterium bovis
VSGQ

SEQ ID NO: 191392 - protein, 8 aa, Mycobacterium bovis
VSGSARTA

SEQ ID NO: 191393 - protein, 8 aa, Mycobacterium bovis
VSGSGPDR

SEQ ID NO: 191394 - protein, 4 aa, Mycobacterium bovis
VSGV

SEQ ID NO: 191395 - protein, 16 aa, Mycobacterium bovis
VSGVDDAGVERVKVTS

SEQ ID NO: 191396 - protein, 9 aa, Mycobacterium bovis
VSGYDEAAG

SEQ ID NO: 191397 - protein, 5 aa, Mycobacterium bovis
VSHKP

SEQ ID NO: 191398 - protein, 7 aa, Mycobacterium bovis
VSIDGQT

SEQ ID NO: 191399 - protein, 10 aa, Mycobacterium bovis
VSIGGSGSYY

SEQ ID NO: 191400 - protein, 4 aa, Mycobacterium bovis
VSKA

SEQ ID NO: 191401 - protein, 6 aa, Mycobacterium bovis
VSKVSE

SEQ ID NO: 191402 - protein, 7 aa, Mycobacterium bovis
VSLPPGT

SEQ ID NO: 191403 - protein, 8 aa, Mycobacterium bovis
VSLRGGQS

SEQ ID NO: 191404 - protein, 6 aa, Mycobacterium bovis
VSNAGG

SEQ ID NO: 191405 - protein, 5 aa, Mycobacterium bovis
VSNDA

SEQ ID NO: 191406 - protein, 5 aa, Mycobacterium bovis
VSNDI

SEQ ID NO: 191407 - protein, 11 aa, Mycobacterium bovis
VSNQHTASRRR

SEQ ID NO: 191408 - protein, 7 aa, Mycobacterium bovis
VSPARAA

SEQ ID NO: 191409 - protein, 9 aa, Mycobacterium bovis
VSPDAAPGM

SEQ ID NO: 191410 - protein, 8 aa, Mycobacterium bovis
VSPEGLPA

SEQ ID NO: 191411 - protein, 8 aa, Mycobacterium bovis
VSPEQAVP

SEQ ID NO: 191412 - protein, 5 aa, Mycobacterium bovis
VSPEY

SEQ ID NO: 191413 - protein, 6 aa, Mycobacterium bovis
VSPNPD

SEQ ID NO: 191414 - protein, 10 aa, Mycobacterium bovis
VSPNPGGVGP

SEQ ID NO: 191415 - protein, 10 aa, Mycobacterium bovis
VSPNQPPETV

SEQ ID NO: 191416 - protein, 17 aa, Mycobacterium bovis
VSPPPPGLYTSGPALQP

SEQ ID NO: 191417 - protein, 6 aa, Mycobacterium bovis
VSPQNA

SEQ ID NO: 191418 - protein, 5 aa, Mycobacterium bovis
VSPSF

SEQ ID NO: 191419 - protein, 7 aa, Mycobacterium bovis
VSPTITP

SEQ ID NO: 191420 - protein, 8 aa, Mycobacterium bovis
VSRERAAE

SEQ ID NO: 191421 - protein, 9 aa, Mycobacterium bovis
VSRRPANPE

SEQ ID NO: 191422 - protein, 4 aa, Mycobacterium bovis
VSRT

SEQ ID NO: 191423 - protein, 5 aa, Mycobacterium bovis
VSRTQ

SEQ ID NO: 191424 - protein, 8 aa, Mycobacterium bovis
VSRYGGGE

SEQ ID NO: 191425 - protein, 8 aa, Mycobacterium bovis
VSSNPEAY

SEQ ID NO: 191426 - protein, 8 aa, Mycobacterium bovis
VSSRDEQI

SEQ ID NO: 191427 - protein, 7 aa, Mycobacterium bovis
VSSSESV

SEQ ID NO: 191428 - protein, 6 aa, Mycobacterium bovis
VSSTEI

SEQ ID NO: 191429 - protein, 11 aa, Mycobacterium bovis
VSTKAASTHAG

SEQ ID NO: 191430 - protein, 12 aa, Mycobacterium bovis
VSTNPYATGPAR

SEQ ID NO: 191431 - protein, 19 aa, Mycobacterium bovis
VSTPARALSKPGDRESPDA

SEQ ID NO: 191432 - protein, 9 aa, Mycobacterium bovis
VSTPTELES

SEQ ID NO: 191433 - protein, 8 aa, Mycobacterium bovis
VSTRSQIS

SEQ ID NO: 191434 - protein, 7 aa, Mycobacterium bovis
VSTTRAK

SEQ ID NO: 191435 - protein, 21 aa, Mycobacterium bovis
VSTTTGPGIPVDPSITRNFAG

SEQ ID NO: 191436 - protein, 10 aa, Mycobacterium bovis
VSVPERNQPW

SEQ ID NO: 191437 - protein, 9 aa, Mycobacterium bovis
VSVPGAPGV

SEQ ID NO: 191438 - protein, 5 aa, Mycobacterium bovis
VSYPT

SEQ ID NO: 191439 - protein, 9 aa, Mycobacterium bovis
VSYTSEGRL

SEQ ID NO: 191440 - protein, 6 aa, Mycobacterium bovis
VTAAGD

SEQ ID NO: 191441 - protein, 5 aa, Mycobacterium bovis
VTAAQ

SEQ ID NO: 191442 - protein, 10 aa, Mycobacterium bovis
VTADTDAAMT

SEQ ID NO: 191443 - protein, 4 aa, Mycobacterium bovis
VTAE

SEQ ID NO: 191444 - protein, 7 aa, Mycobacterium bovis
VTAEAEV

SEQ ID NO: 191445 - protein, 10 aa, Mycobacterium bovis
VTAGAPPDEF

SEQ ID NO: 191446 - protein, 4 aa, Mycobacterium bovis
VTAP

SEQ ID NO: 191447 - protein, 7 aa, Mycobacterium bovis
VTAPAGF

SEQ ID NO: 191448 - protein, 5 aa, Mycobacterium bovis
VTAPI

SEQ ID NO: 191449 - protein, 4 aa, Mycobacterium bovis
VTAS

SEQ ID NO: 191450 - protein, 10 aa, Mycobacterium bovis
VTASGKQRSR

SEQ ID NO: 191451 - protein, 5 aa, Mycobacterium bovis
VTASL

SEQ ID NO: 191452 - protein, 6 aa, Mycobacterium bovis
VTASYN

SEQ ID NO: 191453 - protein, 14 aa, Mycobacterium bovis
VTATGEEDHSEIDG

SEQ ID NO: 191454 - protein, 6 aa, Mycobacterium bovis
VTATTT

SEQ ID NO: 191455 - protein, 9 aa, Mycobacterium bovis
VTDAPDGTR

SEQ ID NO: 191456 - protein, 8 aa, Mycobacterium bovis
VTDGQTID

SEQ ID NO: 191457 - protein, 5 aa, Mycobacterium bovis
VTDKP

SEQ ID NO: 191458 - protein, 7 aa, Mycobacterium bovis
VTDPDSF

SEQ ID NO: 191459 - protein, 4 aa, Mycobacterium bovis
VTDQ

SEQ ID NO: 191460 - protein, 9 aa, Mycobacterium bovis
VTDQRSRAT

SEQ ID NO: 191461 - protein, 7 aa, Mycobacterium bovis
VTDSTGL

SEQ ID NO: 191462 - protein, 17 aa, Mycobacterium bovis
VTDTADGPQWSLLGGDT

SEQ ID NO: 191463 - protein, 22 aa, Mycobacterium bovis
VTDTRTSRTFAEQAARQAQAQA

SEQ ID NO: 191464 - protein, 5 aa, Mycobacterium bovis
VTDTT

SEQ ID NO: 191465 - protein, 29 aa, Mycobacterium bovis
VTDTTASGTNCPPPPRAAARRASSPGESP

SEQ ID NO: 191466 - protein, 5 aa, Mycobacterium bovis
VTEAA

SEQ ID NO: 191467 - protein, 10 aa, Mycobacterium bovis
VTEDEATGAA

SEQ ID NO: 191468 - protein, 6 aa, Mycobacterium bovis
VTEETA

SEQ ID NO: 191469 - protein, 7 aa, Mycobacterium bovis
VTEETTG

SEQ ID NO: 191470 - protein, 8 aa, Mycobacterium bovis
VTEGGSED

SEQ ID NO: 191471 - protein, 4 aa, Mycobacterium bovis
VTEQ

SEQ ID NO: 191472 - protein, 11 aa, Mycobacterium bovis
VTESQGRVHTS

SEQ ID NO: 191473 - protein, 9 aa, Mycobacterium bovis
VTEVDPKDR

SEQ ID NO: 191474 - protein, 7 aa, Mycobacterium bovis
VTGDIGP

SEQ ID NO: 191475 - protein, 5 aa, Mycobacterium bovis
VTGED

SEQ ID NO: 191476 - protein, 6 aa, Mycobacterium bovis
VTGEDV

SEQ ID NO: 191477 - protein, 11 aa, Mycobacterium bovis
VTGEPVAPSSL

SEQ ID NO: 191478 - protein, 8 aa, Mycobacterium bovis
VTGERSGR

SEQ ID NO: 191479 - protein, 7 aa, Mycobacterium bovis
VTGGRIP

SEQ ID NO: 191480 - protein, 5 aa, Mycobacterium bovis
VTGLK

SEQ ID NO: 191481 - protein, 34 aa, Mycobacterium bovis
VTGNGGSGNSGTSAAAANPNSDNTASIADRGTSA

SEQ ID NO: 191482 - protein, 9 aa, Mycobacterium bovis
VTGNPANTN

SEQ ID NO: 191483 - protein, 7 aa, Mycobacterium bovis
VTGPDEY

SEQ ID NO: 191484 - protein, 8 aa, Mycobacterium bovis
VTGPDGPV

SEQ ID NO: 191485 - protein, 8 aa, Mycobacterium bovis
VTGPGEGA

SEQ ID NO: 191486 - protein, 5 aa, Mycobacterium bovis
VTGRE

SEQ ID NO: 191487 - protein, 19 aa, Mycobacterium bovis
VTGSGRVGIGPSGDEPGFQ

SEQ ID NO: 191488 - protein, 10 aa, Mycobacterium bovis
VTGSSTVASL

SEQ ID NO: 191489 - protein, 5 aa, Mycobacterium bovis
VTGTD

SEQ ID NO: 191490 - protein, 10 aa, Mycobacterium bovis
VTGTGVGGRI

SEQ ID NO: 191491 - protein, 15 aa, Mycobacterium bovis
VTGTTGTAADAKKEI

SEQ ID NO: 191492 - protein, 4 aa, Mycobacterium bovis
VTKG

SEQ ID NO: 191493 - protein, 6 aa, Mycobacterium bovis
VTKPYP

SEQ ID NO: 191494 - protein, 8 aa, Mycobacterium bovis
VTKQAAQK

SEQ ID NO: 191495 - protein, 6 aa, Mycobacterium bovis
VTKSGL

SEQ ID NO: 191496 - protein, 5 aa, Mycobacterium bovis
VTKTA

SEQ ID NO: 191497 - protein, 6 aa, Mycobacterium bovis
VTLTPG

SEQ ID NO: 191498 - protein, 7 aa, Mycobacterium bovis
VTNTEGR

SEQ ID NO: 191499 - protein, 12 aa, Mycobacterium bovis
VTNTGDRSGADV

SEQ ID NO: 191500 - protein, 4 aa, Mycobacterium bovis
VTPA

SEQ ID NO: 191501 - protein, 7 aa, Mycobacterium bovis
VTPADFG

SEQ ID NO: 191502 - protein, 8 aa, Mycobacterium bovis
VTPADSPL

SEQ ID NO: 191503 - protein, 9 aa, Mycobacterium bovis
VTPAHDPND

SEQ ID NO: 191504 - protein, 13 aa, Mycobacterium bovis
VTPEGRIQVARVA

SEQ ID NO: 191505 - protein, 11 aa, Mycobacterium bovis
VTPEQAGAHPT

SEQ ID NO: 191506 - protein, 6 aa, Mycobacterium bovis
VTPGGT

SEQ ID NO: 191507 - protein, 12 aa, Mycobacterium bovis
VTPKGETELTPE

SEQ ID NO: 191508 - protein, 6 aa, Mycobacterium bovis
VTPKYP

SEQ ID NO: 191509 - protein, 7 aa, Mycobacterium bovis
VTPNPGA

SEQ ID NO: 191510 - protein, 11 aa, Mycobacterium bovis
VTPRRASSGYR

SEQ ID NO: 191511 - protein, 5 aa, Mycobacterium bovis
VTPRT

SEQ ID NO: 191512 - protein, 6 aa, Mycobacterium bovis
VTPSPA

SEQ ID NO: 191513 - protein, 9 aa, Mycobacterium bovis
VTPVDSKGR

SEQ ID NO: 191514 - protein, 5 aa, Mycobacterium bovis
VTQPG

SEQ ID NO: 191515 - protein, 7 aa, Mycobacterium bovis
VTRNGEQ

SEQ ID NO: 191516 - protein, 7 aa, Mycobacterium bovis
VTRPDET

SEQ ID NO: 191517 - protein, 6 aa, Mycobacterium bovis
VTRPDG

SEQ ID NO: 191518 - protein, 8 aa, Mycobacterium bovis
VTRPGQYE

SEQ ID NO: 191519 - protein, 9 aa, Mycobacterium bovis
VTRRGGREG

SEQ ID NO: 191520 - protein, 8 aa, Mycobacterium bovis
VTSAGTGN

SEQ ID NO: 191521 - protein, 11 aa, Mycobacterium bovis
VTSALSSSHGL

SEQ ID NO: 191522 - protein, 6 aa, Mycobacterium bovis
VTSDTA

SEQ ID NO: 191523 - protein, 10 aa, Mycobacterium bovis
VTSGPALERA

SEQ ID NO: 191524 - protein, 8 aa, Mycobacterium bovis
VTSPADPE

SEQ ID NO: 191525 - protein, 12 aa, Mycobacterium bovis
VTSPAGPVTTRR

SEQ ID NO: 191526 - protein, 8 aa, Mycobacterium bovis
VTSPDGEL

SEQ ID NO: 191527 - protein, 5 aa, Mycobacterium bovis
VTSPG

SEQ ID NO: 191528 - protein, 10 aa, Mycobacterium bovis
VTSPGGTTAA

SEQ ID NO: 191529 - protein, 7 aa, Mycobacterium bovis
VTSPGRL

SEQ ID NO: 191530 - protein, 12 aa, Mycobacterium bovis
VTSPYPAPGGGY

SEQ ID NO: 191531 - protein, 10 aa, Mycobacterium bovis
VTSRGYPPSI

SEQ ID NO: 191532 - protein, 10 aa, Mycobacterium bovis
VTSTSGPGIS

SEQ ID NO: 191533 - protein, 7 aa, Mycobacterium bovis
VTTDAGD

SEQ ID NO: 191534 - protein, 20 aa, Mycobacterium bovis
VTTDHISPAGAIKPGTPAAR

SEQ ID NO: 191535 - protein, 4 aa, Mycobacterium bovis
VTTG

SEQ ID NO: 191536 - protein, 6 aa, Mycobacterium bovis
VTTGPK

SEQ ID NO: 191537 - protein, 7 aa, Mycobacterium bovis
VTTGRRR

SEQ ID NO: 191538 - protein, 7 aa, Mycobacterium bovis
VTTKGGN

SEQ ID NO: 191539 - protein, 7 aa, Mycobacterium bovis
VTTSGDR

SEQ ID NO: 191540 - protein, 7 aa, Mycobacterium bovis
VTTSTGK

SEQ ID NO: 191541 - protein, 7 aa, Mycobacterium bovis
VTTTGGP

SEQ ID NO: 191542 - protein, 7 aa, Mycobacterium bovis
VTTVDSG

SEQ ID NO: 191543 - protein, 18 aa, Mycobacterium bovis
VTTYGSAGHGPAATSDAE

SEQ ID NO: 191544 - protein, 15 aa, Mycobacterium bovis
VTVTSEPAAGGRADE

SEQ ID NO: 191545 - protein, 21 aa, Mycobacterium bovis
VTYKNGDPTIDNLGAGNRINK

SEQ ID NO: 191546 - protein, 14 aa, Mycobacterium bovis
VTYPPATSEDLGET

SEQ ID NO: 191547 - protein, 9 aa, Mycobacterium bovis
VVDEGGRRV

SEQ ID NO: 191548 - protein, 7 aa, Mycobacterium bovis
VVDPATG

SEQ ID NO: 191549 - protein, 4 aa, Mycobacterium bovis
VVGE

SEQ ID NO: 191550 - protein, 7 aa, Mycobacterium bovis
VVKSSNG

SEQ ID NO: 191551 - protein, 5 aa, Mycobacterium bovis
VVNPD

SEQ ID NO: 191552 - protein, 13 aa, Mycobacterium bovis
VVPATADTSSQLT

SEQ ID NO: 191553 - protein, 12 aa, Mycobacterium bovis
VVPPAEEDDPAE

SEQ ID NO: 191554 - protein, 7 aa, Mycobacterium bovis
VVPPEEI

SEQ ID NO: 191555 - protein, 8 aa, Mycobacterium bovis
VVSSDGAR

SEQ ID NO: 191556 - protein, 5 aa, Mycobacterium bovis
VVTDR

SEQ ID NO: 191557 - protein, 5 aa, Mycobacterium bovis
VVTDT

SEQ ID NO: 191558 - protein, 5 aa, Mycobacterium bovis
VWTTD

SEQ ID NO: 191559 - protein, 4 aa, Mycobacterium bovis
VYGN

SEQ ID NO: 191560 - protein, 20 aa, Mycobacterium bovis
VYGSETAMAPRVGSSAEDDG

SEQ ID NO: 191561 - protein, 9 aa, Mycobacterium bovis
WAAGAQRGQ

SEQ ID NO: 191562 - protein, 10 aa, Mycobacterium bovis
WAPHGGESRV

SEQ ID NO: 191563 - protein, 16 aa, Mycobacterium bovis
WAPPTSVAASADHGES

SEQ ID NO: 191564 - protein, 11 aa, Mycobacterium bovis
WAPSTGSTVSW

SEQ ID NO: 191565 - protein, 13 aa, Mycobacterium bovis
WARRGDPAPGGIG

SEQ ID NO: 191566 - protein, 5 aa, Mycobacterium bovis
WASAA

SEQ ID NO: 191567 - protein, 8 aa, Mycobacterium bovis
WDDPQGVP

SEQ ID NO: 191568 - protein, 9 aa, Mycobacterium bovis
WDGEGPGED

SEQ ID NO: 191569 - protein, 17 aa, Mycobacterium bovis
WDGPQAGAATAEISPTG

SEQ ID NO: 191570 - protein, 6 aa, Mycobacterium bovis
WDPAEL

SEQ ID NO: 191571 - protein, 9 aa, Mycobacterium bovis
WDPKAQRPE

SEQ ID NO: 191572 - protein, 11 aa, Mycobacterium bovis
WDRPDSPDPLG

SEQ ID NO: 191573 - protein, 6 aa, Mycobacterium bovis
WEAPDP

SEQ ID NO: 191574 - protein, 9 aa, Mycobacterium bovis
WEPSADGEW

SEQ ID NO: 191575 - protein, 11 aa, Mycobacterium bovis
WEQPESPKPLG

SEQ ID NO: 191576 - protein, 6 aa, Mycobacterium bovis
WERSGW

SEQ ID NO: 191577 - protein, 10 aa, Mycobacterium bovis
WESRDETSAA

SEQ ID NO: 191578 - protein, 13 aa, Mycobacterium bovis
WGAPPADPVDDDA

SEQ ID NO: 191579 - protein, 4 aa, Mycobacterium bovis
WGDP

SEQ ID NO: 191580 - protein, 5 aa, Mycobacterium bovis
WGGPP

SEQ ID NO: 191581 - protein, 4 aa, Mycobacterium bovis
WGGR

SEQ ID NO: 191582 - protein, 7 aa, Mycobacterium bovis
WGGTRNG

SEQ ID NO: 191583 - protein, 4 aa, Mycobacterium bovis
WGGV

SEQ ID NO: 191584 - protein, 6 aa, Mycobacterium bovis
WGPAGA

SEQ ID NO: 191585 - protein, 8 aa, Mycobacterium bovis
WGPAQGGV

SEQ ID NO: 191586 - protein, 12 aa, Mycobacterium bovis
WGPTGTKPRGPS

SEQ ID NO: 191587 - protein, 5 aa, Mycobacterium bovis
WGQPN

SEQ ID NO: 191588 - protein, 13 aa, Mycobacterium bovis
WGQTGPRSQQAGH

SEQ ID NO: 191589 - protein, 8 aa, Mycobacterium bovis
WGRAASPV

SEQ ID NO: 191590 - protein, 16 aa, Mycobacterium bovis
WGSGEATADHGADRTA

SEQ ID NO: 191591 - protein, 36 aa, Mycobacterium bovis
WGSGGSGGTGGQGGVGGGKSGDGGTGGIGGAGGGGG

SEQ ID NO: 191592 - protein, 8 aa, Mycobacterium bovis
WGSGPGKL

SEQ ID NO: 191593 - protein, 10 aa, Mycobacterium bovis
WGSSPTSSGK

SEQ ID NO: 191594 - protein, 7 aa, Mycobacterium bovis
WGSTPAA

SEQ ID NO: 191595 - protein, 36 aa, Mycobacterium bovis
WGTEEPTDTYANLGGQTLRPAPVGAYPAGASACGAE

SEQ ID NO: 191596 - protein, 11 aa, Mycobacterium bovis
WGTGPAPDPRL

SEQ ID NO: 191597 - protein, 14 aa, Mycobacterium bovis
WGTPQEHRRRVLEA

SEQ ID NO: 191598 - protein, 13 aa, Mycobacterium bovis
WGYTPKGATGVPT

SEQ ID NO: 191599 - protein, 8 aa, Mycobacterium bovis
WKKPGTSD

SEQ ID NO: 191600 - protein, 14 aa, Mycobacterium bovis
WKPDQYANPEGPAS

SEQ ID NO: 191601 - protein, 9 aa, Mycobacterium bovis
WKPKPDTDV

SEQ ID NO: 191602 - protein, 17 aa, Mycobacterium bovis
WKQDPPSPMPGDPKDMT

SEQ ID NO: 191603 - protein, 9 aa, Mycobacterium bovis
WKQKDYDEY

SEQ ID NO: 191604 - protein, 7 aa, Mycobacterium bovis
WKRSPEE

SEQ ID NO: 191605 - protein, 7 aa, Mycobacterium bovis
WNEDGSA

SEQ ID NO: 191606 - protein, 4 aa, Mycobacterium bovis
WNGT

SEQ ID NO: 191607 - protein, 7 aa, Mycobacterium bovis
WNGTDER

SEQ ID NO: 191608 - protein, 6 aa, Mycobacterium bovis
WNPPVT

SEQ ID NO: 191609 - protein, 14 aa, Mycobacterium bovis
WNQAPSALLGGGSG

SEQ ID NO: 191610 - protein, 16 aa, Mycobacterium bovis
WNSGSGNSGLFNSGTN

SEQ ID NO: 191611 - protein, 7 aa, Mycobacterium bovis
WNSGTAN

SEQ ID NO: 191612 - protein, 7 aa, Mycobacterium bovis
WNSGTGN

SEQ ID NO: 191613 - protein, 10 aa, Mycobacterium bovis
WNSGTGNSGL

SEQ ID NO: 191614 - protein, 7 aa, Mycobacterium bovis
WNTEARQ

SEQ ID NO: 191615 - protein, 17 aa, Mycobacterium bovis
WPADPSQHHRIAESRAC

SEQ ID NO: 191616 - protein, 8 aa, Mycobacterium bovis
WPAPSGEH

SEQ ID NO: 191617 - protein, 11 aa, Mycobacterium bovis
WPDHSRDQARR

SEQ ID NO: 191618 - protein, 9 aa, Mycobacterium bovis
WPDNASLDK

SEQ ID NO: 191619 - protein, 7 aa, Mycobacterium bovis
WPDPPGL

SEQ ID NO: 191620 - protein, 13 aa, Mycobacterium bovis
WPDRPRRRLTTPA

SEQ ID NO: 191621 - protein, 18 aa, Mycobacterium bovis
WPERPSPPYPEGKPVEIN

SEQ ID NO: 191622 - protein, 6 aa, Mycobacterium bovis
WPGENR

SEQ ID NO: 191623 - protein, 9 aa, Mycobacterium bovis
WPGSSDRNF

SEQ ID NO: 191624 - protein, 9 aa, Mycobacterium bovis
WPKTSGSRG

SEQ ID NO: 191625 - protein, 9 aa, Mycobacterium bovis
WPPAAGRAS

SEQ ID NO: 191626 - protein, 7 aa, Mycobacterium bovis
WPPATTE

SEQ ID NO: 191627 - protein, 4 aa, Mycobacterium bovis
WPPE

SEQ ID NO: 191628 - protein, 12 aa, Mycobacterium bovis
WPPKITPPKGIE

SEQ ID NO: 191629 - protein, 6 aa, Mycobacterium bovis
WPPPQT

SEQ ID NO: 191630 - protein, 8 aa, Mycobacterium bovis
WPPSGARA

SEQ ID NO: 191631 - protein, 13 aa, Mycobacterium bovis
WPPSSLSGRLAGR

SEQ ID NO: 191632 - protein, 11 aa, Mycobacterium bovis
WPRNPGSPAER

SEQ ID NO: 191633 - protein, 7 aa, Mycobacterium bovis
WPSGGGG

SEQ ID NO: 191634 - protein, 14 aa, Mycobacterium bovis
WPTGPAAGAQPPLV

SEQ ID NO: 191635 - protein, 4 aa, Mycobacterium bovis
WPTP

SEQ ID NO: 191636 - protein, 10 aa, Mycobacterium bovis
WPTTDPDDHA

SEQ ID NO: 191637 - protein, 12 aa, Mycobacterium bovis
WPTTGRPRRAGV

SEQ ID NO: 191638 - protein, 15 aa, Mycobacterium bovis
WQGASSSAMAAAAAP

SEQ ID NO: 191639 - protein, 7 aa, Mycobacterium bovis
WQGDTGI

SEQ ID NO: 191640 - protein, 15 aa, Mycobacterium bovis
WQGEAQPLSDAGPTG

SEQ ID NO: 191641 - protein, 4 aa, Mycobacterium bovis
WQNG

SEQ ID NO: 191642 - protein, 23 aa, Mycobacterium bovis
WQNTGSEGAAPAGVPGPEAGAQL

SEQ ID NO: 191643 - protein, 5 aa, Mycobacterium bovis
WQPGD

SEQ ID NO: 191644 - protein, 13 aa, Mycobacterium bovis
WQQAQQPDASGAA

SEQ ID NO: 191645 - protein, 12 aa, Mycobacterium bovis
WQRDPKQLGRLG

SEQ ID NO: 191646 - protein, 4 aa, Mycobacterium bovis
WRAP

SEQ ID NO: 191647 - protein, 6 aa, Mycobacterium bovis
WRESRR

SEQ ID NO: 191648 - protein, 7 aa, Mycobacterium bovis
WRGETGE

SEQ ID NO: 191649 - protein, 8 aa, Mycobacterium bovis
WRNDDGGE

SEQ ID NO: 191650 - protein, 6 aa, Mycobacterium bovis
WRSAPE

SEQ ID NO: 191651 - protein, 4 aa, Mycobacterium bovis
WSDP

SEQ ID NO: 191652 - protein, 4 aa, Mycobacterium bovis
WSDS

SEQ ID NO: 191653 - protein, 10 aa, Mycobacterium bovis
WSGKRNPNAR

SEQ ID NO: 191654 - protein, 4 aa, Mycobacterium bovis
WSGY

SEQ ID NO: 191655 - protein, 8 aa, Mycobacterium bovis
WSPATQHT

SEQ ID NO: 191656 - protein, 7 aa, Mycobacterium bovis
WSPDGKP

SEQ ID NO: 191657 - protein, 7 aa, Mycobacterium bovis
WSQDKVS

SEQ ID NO: 191658 - protein, 13 aa, Mycobacterium bovis
WSSDPTRPVGRGT

SEQ ID NO: 191659 - protein, 6 aa, Mycobacterium bovis
WSTAEN

SEQ ID NO: 191660 - protein, 9 aa, Mycobacterium bovis
WSTDPRSRV

SEQ ID NO: 191661 - protein, 17 aa, Mycobacterium bovis
WSTGSSIMPQKKNPDIA

SEQ ID NO: 191662 - protein, 11 aa, Mycobacterium bovis
WTDEHGTRPLA

SEQ ID NO: 191663 - protein, 14 aa, Mycobacterium bovis
WTDPAQRARDIERS

SEQ ID NO: 191664 - protein, 7 aa, Mycobacterium bovis
WTDPETG

SEQ ID NO: 191665 - protein, 12 aa, Mycobacterium bovis
WTETRTGSYGQS

SEQ ID NO: 191666 - protein, 6 aa, Mycobacterium bovis
WTGAGG

SEQ ID NO: 191667 - protein, 6 aa, Mycobacterium bovis
WTGGRG

SEQ ID NO: 191668 - protein, 14 aa, Mycobacterium bovis
WTGNSTLEDCDTTS

SEQ ID NO: 191669 - protein, 7 aa, Mycobacterium bovis
WTNRSGT

SEQ ID NO: 191670 - protein, 7 aa, Mycobacterium bovis
WTPEGRL

SEQ ID NO: 191671 - protein, 9 aa, Mycobacterium bovis
WTRDETEQR

SEQ ID NO: 191672 - protein, 4 aa, Mycobacterium bovis
WVPQ

SEQ ID NO: 191673 - protein, 11 aa, Mycobacterium bovis
YAASGTPEVGR

SEQ ID NO: 191674 - protein, 7 aa, Mycobacterium bovis
YAASQRS

SEQ ID NO: 191675 - protein, 6 aa, Mycobacterium bovis
YAASSY

SEQ ID NO: 191676 - protein, 10 aa, Mycobacterium bovis
YAATPQDAYE

SEQ ID NO: 191677 - protein, 4 aa, Mycobacterium bovis
YAAY

SEQ ID NO: 191678 - protein, 16 aa, Mycobacterium bovis
YADEPDEVGGPPIEEA

SEQ ID NO: 191679 - protein, 11 aa, Mycobacterium bovis
YADGNLPKGRL

SEQ ID NO: 191680 - protein, 16 aa, Mycobacterium bovis
YADRGEAFATAVRAVI

SEQ ID NO: 191681 - protein, 7 aa, Mycobacterium bovis
YAEEAGI

SEQ ID NO: 191682 - protein, 6 aa, Mycobacterium bovis
YAEEPE

SEQ ID NO: 191683 - protein, 16 aa, Mycobacterium bovis
YAEGSSSTGGGGAYQG

SEQ ID NO: 191684 - protein, 6 aa, Mycobacterium bovis
YAEPGQ

SEQ ID NO: 191685 - protein, 27 aa, Mycobacterium bovis
YAESGGQIADEGTISGTGSSEAARAAV

SEQ ID NO: 191686 - protein, 9 aa, Mycobacterium bovis
YAETEEEAD

SEQ ID NO: 191687 - protein, 4 aa, Mycobacterium bovis
YAGA

SEQ ID NO: 191688 - protein, 5 aa, Mycobacterium bovis
YAGGM

SEQ ID NO: 191689 - protein, 8 aa, Mycobacterium bovis
YAGPGSAS

SEQ ID NO: 191690 - protein, 9 aa, Mycobacterium bovis
YAGPGSGPL

SEQ ID NO: 191691 - protein, 5 aa, Mycobacterium bovis
YAGPP

SEQ ID NO: 191692 - protein, 7 aa, Mycobacterium bovis
YAGRAGD

SEQ ID NO: 191693 - protein, 6 aa, Mycobacterium bovis
YAGTRQ

SEQ ID NO: 191694 - protein, 7 aa, Mycobacterium bovis
YAHNPQY

SEQ ID NO: 191695 - protein, 4 aa, Mycobacterium bovis
YAKA

SEQ ID NO: 191696 - protein, 8 aa, Mycobacterium bovis
YANARDDY

SEQ ID NO: 191697 - protein, 12 aa, Mycobacterium bovis
YANQRQSFGQPI

SEQ ID NO: 191698 - protein, 5 aa, Mycobacterium bovis
YAPAR

SEQ ID NO: 191699 - protein, 7 aa, Mycobacterium bovis
YAPDSDM

SEQ ID NO: 191700 - protein, 10 aa, Mycobacterium bovis
YAPERARRSD

SEQ ID NO: 191701 - protein, 5 aa, Mycobacterium bovis
YAPGD

SEQ ID NO: 191702 - protein, 9 aa, Mycobacterium bovis
YAPKSALGH

SEQ ID NO: 191703 - protein, 11 aa, Mycobacterium bovis
YAPKSPERTRL

SEQ ID NO: 191704 - protein, 5 aa, Mycobacterium bovis
YAPNG

SEQ ID NO: 191705 - protein, 6 aa, Mycobacterium bovis
YAPNRT

SEQ ID NO: 191706 - protein, 5 aa, Mycobacterium bovis
YAPPD

SEQ ID NO: 191707 - protein, 7 aa, Mycobacterium bovis
YAPRRQK

SEQ ID NO: 191708 - protein, 12 aa, Mycobacterium bovis
YAPTSRFGTPDD

SEQ ID NO: 191709 - protein, 5 aa, Mycobacterium bovis
YARDG

SEQ ID NO: 191710 - protein, 26 aa, Mycobacterium bovis
YARGEGGFGGKRGPSGSDVAPERAPD

SEQ ID NO: 191711 - protein, 15 aa, Mycobacterium bovis
YARQSKSADYPSCTP

SEQ ID NO: 191712 - protein, 6 aa, Mycobacterium bovis
YASGGW

SEQ ID NO: 191713 - protein, 4 aa, Mycobacterium bovis
YASK

SEQ ID NO: 191714 - protein, 11 aa, Mycobacterium bovis
YASSADGRRRR

SEQ ID NO: 191715 - protein, 9 aa, Mycobacterium bovis
YASTDADDP

SEQ ID NO: 191716 - protein, 6 aa, Mycobacterium bovis
YASTTA

SEQ ID NO: 191717 - protein, 7 aa, Mycobacterium bovis
YATAGSQ

SEQ ID NO: 191718 - protein, 4 aa, Mycobacterium bovis
YATD

SEQ ID NO: 191719 - protein, 6 aa, Mycobacterium bovis
YDAASE

SEQ ID NO: 191720 - protein, 14 aa, Mycobacterium bovis
YDAPFPDKTYQAGA

SEQ ID NO: 191721 - protein, 11 aa, Mycobacterium bovis
YDATKQSFLGS

SEQ ID NO: 191722 - protein, 5 aa, Mycobacterium bovis
YDATL

SEQ ID NO: 191723 - protein, 8 aa, Mycobacterium bovis
YDDEGVAA

SEQ ID NO: 191724 - protein, 4 aa, Mycobacterium bovis
YDDG

SEQ ID NO: 191725 - protein, 6 aa, Mycobacterium bovis
YDDGSI

SEQ ID NO: 191726 - protein, 12 aa, Mycobacterium bovis
YDEGDSFDQSAA

SEQ ID NO: 191727 - protein, 14 aa, Mycobacterium bovis
YDGDQHRSDRGRYV

SEQ ID NO: 191728 - protein, 14 aa, Mycobacterium bovis
YDGDVQSDTVAQGY

SEQ ID NO: 191729 - protein, 4 aa, Mycobacterium bovis
YDGR

SEQ ID NO: 191730 - protein, 12 aa, Mycobacterium bovis
YDGSTAGQDDAT

SEQ ID NO: 191731 - protein, 9 aa, Mycobacterium bovis
YDGTPGTIA

SEQ ID NO: 191732 - protein, 5 aa, Mycobacterium bovis
YDPAN

SEQ ID NO: 191733 - protein, 6 aa, Mycobacterium bovis
YDPDAL

SEQ ID NO: 191734 - protein, 7 aa, Mycobacterium bovis
YDPDGDS

SEQ ID NO: 191735 - protein, 6 aa, Mycobacterium bovis
YDPDNT

SEQ ID NO: 191736 - protein, 13 aa, Mycobacterium bovis
YDPDPDAEGKTYT

SEQ ID NO: 191737 - protein, 7 aa, Mycobacterium bovis
YDPDPEL

SEQ ID NO: 191738 - protein, 12 aa, Mycobacterium bovis
YDPDPSASGRMT

SEQ ID NO: 191739 - protein, 11 aa, Mycobacterium bovis
YDPEPGVPGRT

SEQ ID NO: 191740 - protein, 12 aa, Mycobacterium bovis
YDPHPAIKAPVA

SEQ ID NO: 191741 - protein, 7 aa, Mycobacterium bovis
YDPNRTA

SEQ ID NO: 191742 - protein, 9 aa, Mycobacterium bovis
YDREEQTEG

SEQ ID NO: 191743 - protein, 10 aa, Mycobacterium bovis
YDRGPSAPSL

SEQ ID NO: 191744 - protein, 4 aa, Mycobacterium bovis
YDRR

SEQ ID NO: 191745 - protein, 6 aa, Mycobacterium bovis
YDSEEA

SEQ ID NO: 191746 - protein, 8 aa, Mycobacterium bovis
YDSEPADV

SEQ ID NO: 191747 - protein, 30 aa, Mycobacterium bovis
YDTPPPPIERGSQFSQDADPRYADIGGGPL

SEQ ID NO: 191748 - protein, 4 aa, Mycobacterium bovis
YDTS

SEQ ID NO: 191749 - protein, 18 aa, Mycobacterium bovis
YEAAQKARESRRNQQQTV

SEQ ID NO: 191750 - protein, 9 aa, Mycobacterium bovis
YEAGGIAKH

SEQ ID NO: 191751 - protein, 9 aa, Mycobacterium bovis
YEAGPTAAL

SEQ ID NO: 191752 - protein, 11 aa, Mycobacterium bovis
YEDGDGPESRF

SEQ ID NO: 191753 - protein, 8 aa, Mycobacterium bovis
YEDGNAAT

SEQ ID NO: 191754 - protein, 10 aa, Mycobacterium bovis
YEDRNSQHRL

SEQ ID NO: 191755 - protein, 10 aa, Mycobacterium bovis
YEDTSSVVGP

SEQ ID NO: 191756 - protein, 9 aa, Mycobacterium bovis
YEEAGEQEA

SEQ ID NO: 191757 - protein, 9 aa, Mycobacterium bovis
YEEDSRAEV

SEQ ID NO: 191758 - protein, 6 aa, Mycobacterium bovis
YEETSS

SEQ ID NO: 191759 - protein, 8 aa, Mycobacterium bovis
YEGEDAAR

SEQ ID NO: 191760 - protein, 14 aa, Mycobacterium bovis
YEGLTTPQIRESEP

SEQ ID NO: 191761 - protein, 7 aa, Mycobacterium bovis
YEGPQTA

SEQ ID NO: 191762 - protein, 15 aa, Mycobacterium bovis
YEHPGDPRQPDNTRR

SEQ ID NO: 191763 - protein, 8 aa, Mycobacterium bovis
YEKEGNAR

SEQ ID NO: 191764 - protein, 4 aa, Mycobacterium bovis
YEKS

SEQ ID NO: 191765 - protein, 10 aa, Mycobacterium bovis
YENGGLPTNE

SEQ ID NO: 191766 - protein, 4 aa, Mycobacterium bovis
YENQ

SEQ ID NO: 191767 - protein, 5 aa, Mycobacterium bovis
YENTR

SEQ ID NO: 191768 - protein, 11 aa, Mycobacterium bovis
YEPDSEGNRQR

SEQ ID NO: 191769 - protein, 26 aa, Mycobacterium bovis
YEPPPRNIPPCGQSSHAARRPHTPQL

SEQ ID NO: 191770 - protein, 6 aa, Mycobacterium bovis
YEPRDP

SEQ ID NO: 191771 - protein, 5 aa, Mycobacterium bovis
YEQGD

SEQ ID NO: 191772 - protein, 6 aa, Mycobacterium bovis
YEQHPL

SEQ ID NO: 191773 - protein, 7 aa, Mycobacterium bovis
YEQPRQE

SEQ ID NO: 191774 - protein, 4 aa, Mycobacterium bovis
YERA

SEQ ID NO: 191775 - protein, 10 aa, Mycobacterium bovis
YERAGSAHAP

SEQ ID NO: 191776 - protein, 14 aa, Mycobacterium bovis
YERRPANAPAVQGQ

SEQ ID NO: 191777 - protein, 7 aa, Mycobacterium bovis
YERRSGE

SEQ ID NO: 191778 - protein, 9 aa, Mycobacterium bovis
YESAQPVAD

SEQ ID NO: 191779 - protein, 10 aa, Mycobacterium bovis
YESRTAPVEG

SEQ ID NO: 191780 - protein, 6 aa, Mycobacterium bovis
YESRVG

SEQ ID NO: 191781 - protein, 9 aa, Mycobacterium bovis
YETDTDTEL

SEQ ID NO: 191782 - protein, 12 aa, Mycobacterium bovis
YETGAGGSAPKH

SEQ ID NO: 191783 - protein, 8 aa, Mycobacterium bovis
YETPDPEI

SEQ ID NO: 191784 - protein, 6 aa, Mycobacterium bovis
YETTSG

SEQ ID NO: 191785 - protein, 24 aa, Mycobacterium bovis
YFGTGGGGGVGGDGAPGGDGGAGP

SEQ ID NO: 191786 - protein, 4 aa, Mycobacterium bovis
YFTG

SEQ ID NO: 191787 - protein, 4 aa, Mycobacterium bovis
YGAD

SEQ ID NO: 191788 - protein, 10 aa, Mycobacterium bovis
YGADPQRAAR

SEQ ID NO: 191789 - protein, 7 aa, Mycobacterium bovis
YGADTET

SEQ ID NO: 191790 - protein, 9 aa, Mycobacterium bovis
YGAESEAGR

SEQ ID NO: 191791 - protein, 8 aa, Mycobacterium bovis
YGAGPCSG

SEQ ID NO: 191792 - protein, 8 aa, Mycobacterium bovis
YGDAQEAL

SEQ ID NO: 191793 - protein, 11 aa, Mycobacterium bovis
YGDEPTATQEQ

SEQ ID NO: 191794 - protein, 5 aa, Mycobacterium bovis
YGDGR

SEQ ID NO: 191795 - protein, 9 aa, Mycobacterium bovis
YGDPDNPDD

SEQ ID NO: 191796 - protein, 11 aa, Mycobacterium bovis
YGEDEGGEEDL

SEQ ID NO: 191797 - protein, 4 aa, Mycobacterium bovis
YGEK

SEQ ID NO: 191798 - protein, 12 aa, Mycobacterium bovis
YGEPDHSRGPFP

SEQ ID NO: 191799 - protein, 9 aa, Mycobacterium bovis
YGETKPPEL

SEQ ID NO: 191800 - protein, 27 aa, Mycobacterium bovis
YGGAGGLGGAATGAGGTGGTGGVGAGG

SEQ ID NO: 191801 - protein, 8 aa, Mycobacterium bovis
YGGDQEHR

SEQ ID NO: 191802 - protein, 15 aa, Mycobacterium bovis
YGGGEDRRTVALLAV

SEQ ID NO: 191803 - protein, 9 aa, Mycobacterium bovis
YGGGSSVVG

SEQ ID NO: 191804 - protein, 10 aa, Mycobacterium bovis
YGGHDAGAPK

SEQ ID NO: 191805 - protein, 12 aa, Mycobacterium bovis
YGGNGPHGSRPG

SEQ ID NO: 191806 - protein, 9 aa, Mycobacterium bovis
YGGQLSGEL

SEQ ID NO: 191807 - protein, 4 aa, Mycobacterium bovis
YGGR

SEQ ID NO: 191808 - protein, 10 aa, Mycobacterium bovis
YGGRDESKFD

SEQ ID NO: 191809 - protein, 4 aa, Mycobacterium bovis
YGGT

SEQ ID NO: 191810 - protein, 9 aa, Mycobacterium bovis
YGGTEIKYN

SEQ ID NO: 191811 - protein, 7 aa, Mycobacterium bovis
YGKGSNA

SEQ ID NO: 191812 - protein, 15 aa, Mycobacterium bovis
YGKRKVGADKAVSTG

SEQ ID NO: 191813 - protein, 4 aa, Mycobacterium bovis
YGKT

SEQ ID NO: 191814 - protein, 12 aa, Mycobacterium bovis
YGLGKGQGESPC

SEQ ID NO: 191815 - protein, 5 aa, Mycobacterium bovis
YGMTG

SEQ ID NO: 191816 - protein, 6 aa, Mycobacterium bovis
YGNAGS

SEQ ID NO: 191817 - protein, 7 aa, Mycobacterium bovis
YGNDGPC

SEQ ID NO: 191818 - protein, 6 aa, Mycobacterium bovis
YGNEAA

SEQ ID NO: 191819 - protein, 10 aa, Mycobacterium bovis
YGNPAEPDTA

SEQ ID NO: 191820 - protein, 7 aa, Mycobacterium bovis
YGNPEAT

SEQ ID NO: 191821 - protein, 5 aa, Mycobacterium bovis
YGNPT

SEQ ID NO: 191822 - protein, 11 aa, Mycobacterium bovis
YGNRDTGGLQG

SEQ ID NO: 191823 - protein, 4 aa, Mycobacterium bovis
YGPA

SEQ ID NO: 191824 - protein, 11 aa, Mycobacterium bovis
YGPDGQRRGEG

SEQ ID NO: 191825 - protein, 5 aa, Mycobacterium bovis
YGPDR

SEQ ID NO: 191826 - protein, 7 aa, Mycobacterium bovis
YGPERNI

SEQ ID NO: 191827 - protein, 14 aa, Mycobacterium bovis
YGPGTRRTPRRGTP

SEQ ID NO: 191828 - protein, 6 aa, Mycobacterium bovis
YGPHPA

SEQ ID NO: 191829 - protein, 6 aa, Mycobacterium bovis
YGPPAS

SEQ ID NO: 191830 - protein, 19 aa, Mycobacterium bovis
YGPPPDPRLTSTTITPDPG

SEQ ID NO: 191831 - protein, 16 aa, Mycobacterium bovis
YGPRTGGKSKVSGSLR

SEQ ID NO: 191832 - protein, 8 aa, Mycobacterium bovis
YGPTTGDR

SEQ ID NO: 191833 - protein, 4 aa, Mycobacterium bovis
YGQD

SEQ ID NO: 191834 - protein, 11 aa, Mycobacterium bovis
YGQNPQAACDG

SEQ ID NO: 191835 - protein, 8 aa, Mycobacterium bovis
YGQVGDGR

SEQ ID NO: 191836 - protein, 6 aa, Mycobacterium bovis
YGRRSR

SEQ ID NO: 191837 - protein, 9 aa, Mycobacterium bovis
YGSPDPSSV

SEQ ID NO: 191838 - protein, 9 aa, Mycobacterium bovis
YGSPPLTNR

SEQ ID NO: 191839 - protein, 11 aa, Mycobacterium bovis
YGSRDSQEQLD

SEQ ID NO: 191840 - protein, 12 aa, Mycobacterium bovis
YGSRSTPVSGGA

SEQ ID NO: 191841 - protein, 6 aa, Mycobacterium bovis
YGSTEA

SEQ ID NO: 191842 - protein, 6 aa, Mycobacterium bovis
YGSTTV

SEQ ID NO: 191843 - protein, 5 aa, Mycobacterium bovis
YGTDG

SEQ ID NO: 191844 - protein, 6 aa, Mycobacterium bovis
YGTGHT

SEQ ID NO: 191845 - protein, 10 aa, Mycobacterium bovis
YGTGSKQERL

SEQ ID NO: 191846 - protein, 18 aa, Mycobacterium bovis
YGTQAPGPAPPGMRVPPS

SEQ ID NO: 191847 - protein, 8 aa, Mycobacterium bovis
YGTSSPSG

SEQ ID NO: 191848 - protein, 5 aa, Mycobacterium bovis
YGTTA

SEQ ID NO: 191849 - protein, 5 aa, Mycobacterium bovis
YGVKR

SEQ ID NO: 191850 - protein, 5 aa, Mycobacterium bovis
YGVPA

SEQ ID NO: 191851 - protein, 16 aa, Mycobacterium bovis
YGVTPDQLRDALDAIA

SEQ ID NO: 191852 - protein, 6 aa, Mycobacterium bovis
YGVTPK

SEQ ID NO: 191853 - protein, 5 aa, Mycobacterium bovis
YHEQE

SEQ ID NO: 191854 - protein, 4 aa, Mycobacterium bovis
YHER

SEQ ID NO: 191855 - protein, 4 aa, Mycobacterium bovis
YHTS

SEQ ID NO: 191856 - protein, 15 aa, Mycobacterium bovis
YKAPAETQAQRIAIT

SEQ ID NO: 191857 - protein, 5 aa, Mycobacterium bovis
YKDTA

SEQ ID NO: 191858 - protein, 13 aa, Mycobacterium bovis
YKMPGGTPSSPGL

SEQ ID NO: 191859 - protein, 5 aa, Mycobacterium bovis
YKSPR

SEQ ID NO: 191860 - protein, 6 aa, Mycobacterium bovis
YKSYRG

SEQ ID NO: 191861 - protein, 19 aa, Mycobacterium bovis
YLDPEAAAAGAAAVAGQGR

SEQ ID NO: 191862 - protein, 12 aa, Mycobacterium bovis
YLNGDSRASGWI

SEQ ID NO: 191863 - protein, 8 aa, Mycobacterium bovis
YLPDTATA

SEQ ID NO: 191864 - protein, 5 aa, Mycobacterium bovis
YLPGP

SEQ ID NO: 191865 - protein, 10 aa, Mycobacterium bovis
YLPPGTKPRW

SEQ ID NO: 191866 - protein, 20 aa, Mycobacterium bovis
YLSGPAPEYPDGDTRGERMG

SEQ ID NO: 191867 - protein, 11 aa, Mycobacterium bovis
YNAERQRRGGE

SEQ ID NO: 191868 - protein, 9 aa, Mycobacterium bovis
YNANPDSMR

SEQ ID NO: 191869 - protein, 4 aa, Mycobacterium bovis
YNGL

SEQ ID NO: 191870 - protein, 9 aa, Mycobacterium bovis
YNKGGPTVT

SEQ ID NO: 191871 - protein, 11 aa, Mycobacterium bovis
YNNASPASGRI

SEQ ID NO: 191872 - protein, 9 aa, Mycobacterium bovis
YNPEQAKRE

SEQ ID NO: 191873 - protein, 6 aa, Mycobacterium bovis
YNPQRE

SEQ ID NO: 191874 - protein, 6 aa, Mycobacterium bovis
YNQDND

SEQ ID NO: 191875 - protein, 4 aa, Mycobacterium bovis
YNTA

SEQ ID NO: 191876 - protein, 9 aa, Mycobacterium bovis
YPAGSAGRF

SEQ ID NO: 191877 - protein, 6 aa, Mycobacterium bovis
YPANSV

SEQ ID NO: 191878 - protein, 5 aa, Mycobacterium bovis
YPAQA

SEQ ID NO: 191879 - protein, 19 aa, Mycobacterium bovis
YPAVNTSEIGKGAGIAGPG

SEQ ID NO: 191880 - protein, 8 aa, Mycobacterium bovis
YPDAADEP

SEQ ID NO: 191881 - protein, 6 aa, Mycobacterium bovis
YPDGSQ

SEQ ID NO: 191882 - protein, 5 aa, Mycobacterium bovis
YPDRR

SEQ ID NO: 191883 - protein, 8 aa, Mycobacterium bovis
YPDRRSGE

SEQ ID NO: 191884 - protein, 8 aa, Mycobacterium bovis
YPDSQVGT

SEQ ID NO: 191885 - protein, 5 aa, Mycobacterium bovis
YPEDI

SEQ ID NO: 191886 - protein, 6 aa, Mycobacterium bovis
YPEEVP

SEQ ID NO: 191887 - protein, 5 aa, Mycobacterium bovis
YPEHG

SEQ ID NO: 191888 - protein, 4 aa, Mycobacterium bovis
YPEL

SEQ ID NO: 191889 - protein, 8 aa, Mycobacterium bovis
YPEPSPGA

SEQ ID NO: 191890 - protein, 4 aa, Mycobacterium bovis
YPER

SEQ ID NO: 191891 - protein, 8 aa, Mycobacterium bovis
YPGADEAL

SEQ ID NO: 191892 - protein, 7 aa, Mycobacterium bovis
YPGAPGQ

SEQ ID NO: 191893 - protein, 5 aa, Mycobacterium bovis
YPGEP

SEQ ID NO: 191894 - protein, 5 aa, Mycobacterium bovis
YPGET

SEQ ID NO: 191895 - protein, 4 aa, Mycobacterium bovis
YPGG

SEQ ID NO: 191896 - protein, 7 aa, Mycobacterium bovis
YPGGKAL

SEQ ID NO: 191897 - protein, 6 aa, Mycobacterium bovis
YPGQVR

SEQ ID NO: 191898 - protein, 6 aa, Mycobacterium bovis
YPGSSE

SEQ ID NO: 191899 - protein, 6 aa, Mycobacterium bovis
YPGVGP

SEQ ID NO: 191900 - protein, 4 aa, Mycobacterium bovis
YPHS

SEQ ID NO: 191901 - protein, 11 aa, Mycobacterium bovis
YPIPGNDDAIR

SEQ ID NO: 191902 - protein, 9 aa, Mycobacterium bovis
YPKTSGGRG

SEQ ID NO: 191903 - protein, 5 aa, Mycobacterium bovis
YPLPE

SEQ ID NO: 191904 - protein, 10 aa, Mycobacterium bovis
YPLPGATGYP

SEQ ID NO: 191905 - protein, 12 aa, Mycobacterium bovis
YPLPSNGDLTPW

SEQ ID NO: 191906 - protein, 6 aa, Mycobacterium bovis
YPLSTA

SEQ ID NO: 191907 - protein, 19 aa, Mycobacterium bovis
YPNLGEPALPPGDPTSPVR

SEQ ID NO: 191908 - protein, 7 aa, Mycobacterium bovis
YPNYPAP

SEQ ID NO: 191909 - protein, 8 aa, Mycobacterium bovis
YPPDDQLA

SEQ ID NO: 191910 - protein, 8 aa, Mycobacterium bovis
YPPEEAQT

SEQ ID NO: 191911 - protein, 5 aa, Mycobacterium bovis
YPPRL

SEQ ID NO: 191912 - protein, 12 aa, Mycobacterium bovis
YPPSGGSRAIEG

SEQ ID NO: 191913 - protein, 4 aa, Mycobacterium bovis
YPQE

SEQ ID NO: 191914 - protein, 8 aa, Mycobacterium bovis
YPQGTTAR

SEQ ID NO: 191915 - protein, 13 aa, Mycobacterium bovis
YPQPMAPAAAAEH

SEQ ID NO: 191916 - protein, 11 aa, Mycobacterium bovis
YPQTETEPANC

SEQ ID NO: 191917 - protein, 8 aa, Mycobacterium bovis
YPRGTETL

SEQ ID NO: 191918 - protein, 5 aa, Mycobacterium bovis
YPSGE

SEQ ID NO: 191919 - protein, 8 aa, Mycobacterium bovis
YPSPEEER

SEQ ID NO: 191920 - protein, 15 aa, Mycobacterium bovis
YPTGGGSARCDGVDV

SEQ ID NO: 191921 - protein, 5 aa, Mycobacterium bovis
YPTRA

SEQ ID NO: 191922 - protein, 4 aa, Mycobacterium bovis
YPTT

SEQ ID NO: 191923 - protein, 17 aa, Mycobacterium bovis
YPTTTEAQDSALSPRGY

SEQ ID NO: 191924 - protein, 10 aa, Mycobacterium bovis
YQETLTDPSY

SEQ ID NO: 191925 - protein, 9 aa, Mycobacterium bovis
YQGAATGVG

SEQ ID NO: 191926 - protein, 24 aa, Mycobacterium bovis
YQGKEAAEAGTGGRGGESGSPSTS

SEQ ID NO: 191927 - protein, 5 aa, Mycobacterium bovis
YQGRG

SEQ ID NO: 191928 - protein, 7 aa, Mycobacterium bovis
YQKERVS

SEQ ID NO: 191929 - protein, 9 aa, Mycobacterium bovis
YQKPHPPIG

SEQ ID NO: 191930 - protein, 9 aa, Mycobacterium bovis
YQNSRKRAV

SEQ ID NO: 191931 - protein, 5 aa, Mycobacterium bovis
YQPAM

SEQ ID NO: 191932 - protein, 9 aa, Mycobacterium bovis
YQPDGTSIT

SEQ ID NO: 191933 - protein, 12 aa, Mycobacterium bovis
YQPGPAPAVNPR

SEQ ID NO: 191934 - protein, 8 aa, Mycobacterium bovis
YQPSGGRP

SEQ ID NO: 191935 - protein, 5 aa, Mycobacterium bovis
YQPTL

SEQ ID NO: 191936 - protein, 5 aa, Mycobacterium bovis
YQQGL

SEQ ID NO: 191937 - protein, 4 aa, Mycobacterium bovis
YQQY

SEQ ID NO: 191938 - protein, 5 aa, Mycobacterium bovis
YQRRD

SEQ ID NO: 191939 - protein, 7 aa, Mycobacterium bovis
YQSDGQT

SEQ ID NO: 191940 - protein, 9 aa, Mycobacterium bovis
YQSRQDPAV

SEQ ID NO: 191941 - protein, 4 aa, Mycobacterium bovis
YQSS

SEQ ID NO: 191942 - protein, 8 aa, Mycobacterium bovis
YQSSPVPG

SEQ ID NO: 191943 - protein, 6 aa, Mycobacterium bovis
YQSSTT

SEQ ID NO: 191944 - protein, 7 aa, Mycobacterium bovis
YQTLSTQ

SEQ ID NO: 191945 - protein, 6 aa, Mycobacterium bovis
YQTRSE

SEQ ID NO: 191946 - protein, 9 aa, Mycobacterium bovis
YQTTQVSER

SEQ ID NO: 191947 - protein, 7 aa, Mycobacterium bovis
YRAGSSA

SEQ ID NO: 191948 - protein, 6 aa, Mycobacterium bovis
YRAQPD

SEQ ID NO: 191949 - protein, 11 aa, Mycobacterium bovis
YRDASGKPQIA

SEQ ID NO: 191950 - protein, 5 aa, Mycobacterium bovis
YRDDA

SEQ ID NO: 191951 - protein, 12 aa, Mycobacterium bovis
YRDDAKGPSASV

SEQ ID NO: 191952 - protein, 10 aa, Mycobacterium bovis
YRDEARPRAG

SEQ ID NO: 191953 - protein, 6 aa, Mycobacterium bovis
YRDGDL

SEQ ID NO: 191954 - protein, 4 aa, Mycobacterium bovis
YRDS

SEQ ID NO: 191955 - protein, 13 aa, Mycobacterium bovis
YRDYGRGSGHPAR

SEQ ID NO: 191956 - protein, 13 aa, Mycobacterium bovis
YREQGAFEGPPPW

SEQ ID NO: 191957 - protein, 4 aa, Mycobacterium bovis
YRGA

SEQ ID NO: 191958 - protein, 10 aa, Mycobacterium bovis
YRGGPPEGWQ

SEQ ID NO: 191959 - protein, 5 aa, Mycobacterium bovis
YRGQE

SEQ ID NO: 191960 - protein, 8 aa, Mycobacterium bovis
YRGQSSQA

SEQ ID NO: 191961 - protein, 8 aa, Mycobacterium bovis
YRGSARDH

SEQ ID NO: 191962 - protein, 24 aa, Mycobacterium bovis
YRNADETKKGLDHNARNDPRNPSP

SEQ ID NO: 191963 - protein, 9 aa, Mycobacterium bovis
YRPDPATGA

SEQ ID NO: 191964 - protein, 9 aa, Mycobacterium bovis
YRPKRPGSY

SEQ ID NO: 191965 - protein, 20 aa, Mycobacterium bovis
YRPPDAARRHNGGKPRRKHV

SEQ ID NO: 191966 - protein, 9 aa, Mycobacterium bovis
YRPSGGGAT

SEQ ID NO: 191967 - protein, 6 aa, Mycobacterium bovis
YRPSHE

SEQ ID NO: 191968 - protein, 13 aa, Mycobacterium bovis
YRPSVSADLPPSA

SEQ ID NO: 191969 - protein, 10 aa, Mycobacterium bovis
YRRATDGSEA

SEQ ID NO: 191970 - protein, 6 aa, Mycobacterium bovis
YRREGK

SEQ ID NO: 191971 - protein, 4 aa, Mycobacterium bovis
YRRR

SEQ ID NO: 191972 - protein, 6 aa, Mycobacterium bovis
YRRSKD

SEQ ID NO: 191973 - protein, 11 aa, Mycobacterium bovis
YRSDDPTDADR

SEQ ID NO: 191974 - protein, 4 aa, Mycobacterium bovis
YRSE

SEQ ID NO: 191975 - protein, 8 aa, Mycobacterium bovis
YRSSHRGI

SEQ ID NO: 191976 - protein, 6 aa, Mycobacterium bovis
YRSTPQ

SEQ ID NO: 191977 - protein, 5 aa, Mycobacterium bovis
YRSTQ

SEQ ID NO: 191978 - protein, 6 aa, Mycobacterium bovis
YRTGIG

SEQ ID NO: 191979 - protein, 9 aa, Mycobacterium bovis
YRTSGDSPI

SEQ ID NO: 191980 - protein, 17 aa, Mycobacterium bovis
YRVGPDSAGADPGPACY

SEQ ID NO: 191981 - protein, 30 aa, Mycobacterium bovis
YSANPNPFGVSPQPPKPATAAWINPPTPDP

SEQ ID NO: 191982 - protein, 4 aa, Mycobacterium bovis
YSAR

SEQ ID NO: 191983 - protein, 7 aa, Mycobacterium bovis
YSATEDS

SEQ ID NO: 191984 - protein, 8 aa, Mycobacterium bovis
YSATSGSV

SEQ ID NO: 191985 - protein, 4 aa, Mycobacterium bovis
YSCP

SEQ ID NO: 191986 - protein, 7 aa, Mycobacterium bovis
YSDGRPH

SEQ ID NO: 191987 - protein, 19 aa, Mycobacterium bovis
YSDPGMDGPTIARATEAAL

SEQ ID NO: 191988 - protein, 6 aa, Mycobacterium bovis
YSDTQS

SEQ ID NO: 191989 - protein, 8 aa, Mycobacterium bovis
YSEEEPTT

SEQ ID NO: 191990 - protein, 6 aa, Mycobacterium bovis
YSELSD

SEQ ID NO: 191991 - protein, 20 aa, Mycobacterium bovis
YSEPGAGSDLASVATTAELD

SEQ ID NO: 191992 - protein, 8 aa, Mycobacterium bovis
YSGADHAT

SEQ ID NO: 191993 - protein, 9 aa, Mycobacterium bovis
YSGAGSAPM

SEQ ID NO: 191994 - protein, 4 aa, Mycobacterium bovis
YSGD

SEQ ID NO: 191995 - protein, 6 aa, Mycobacterium bovis
YSGEDE

SEQ ID NO: 191996 - protein, 18 aa, Mycobacterium bovis
YSGPDEGPASPAERPPYR

SEQ ID NO: 191997 - protein, 9 aa, Mycobacterium bovis
YSGPGSRPL

SEQ ID NO: 191998 - protein, 4 aa, Mycobacterium bovis
YSGR

SEQ ID NO: 191999 - protein, 4 aa, Mycobacterium bovis
YSGT

SEQ ID NO: 192000 - protein, 8 aa, Mycobacterium bovis
YSKDGQIT

SEQ ID NO: 192001 - protein, 9 aa, Mycobacterium bovis
YSKSKGQPL

SEQ ID NO: 192002 - protein, 7 aa, Mycobacterium bovis
YSNTGEG

SEQ ID NO: 192003 - protein, 6 aa, Mycobacterium bovis
YSPDRD

SEQ ID NO: 192004 - protein, 7 aa, Mycobacterium bovis
YSPYENV

SEQ ID NO: 192005 - protein, 6 aa, Mycobacterium bovis
YSQTDL

SEQ ID NO: 192006 - protein, 9 aa, Mycobacterium bovis
YSSDPERHE

SEQ ID NO: 192007 - protein, 5 aa, Mycobacterium bovis
YSSGG

SEQ ID NO: 192008 - protein, 9 aa, Mycobacterium bovis
YSSTSTRDI

SEQ ID NO: 192009 - protein, 11 aa, Mycobacterium bovis
YSTAAERVGSA

SEQ ID NO: 192010 - protein, 5 aa, Mycobacterium bovis
YSTNN

SEQ ID NO: 192011 - protein, 8 aa, Mycobacterium bovis
YSTPESPV

SEQ ID NO: 192012 - protein, 6 aa, Mycobacterium bovis
YSTPHA

SEQ ID NO: 192013 - protein, 43 aa, Mycobacterium bovis
YTANGSGAGISEFNGNQTDFGGSDVPLSKDEAAAAQRRCGSPA

SEQ ID NO: 192014 - protein, 15 aa, Mycobacterium bovis
YTASGDAQVDETAAE

SEQ ID NO: 192015 - protein, 7 aa, Mycobacterium bovis
YTATEAT

SEQ ID NO: 192016 - protein, 4 aa, Mycobacterium bovis
YTDA

SEQ ID NO: 192017 - protein, 8 aa, Mycobacterium bovis
YTDPDGAK

SEQ ID NO: 192018 - protein, 10 aa, Mycobacterium bovis
YTDVTSPTEL

SEQ ID NO: 192019 - protein, 4 aa, Mycobacterium bovis
YTES

SEQ ID NO: 192020 - protein, 10 aa, Mycobacterium bovis
YTGAAQAAGA

SEQ ID NO: 192021 - protein, 5 aa, Mycobacterium bovis
YTGAY

SEQ ID NO: 192022 - protein, 8 aa, Mycobacterium bovis
YTGDDGRT

SEQ ID NO: 192023 - protein, 12 aa, Mycobacterium bovis
YTGGPDPLAPPV

SEQ ID NO: 192024 - protein, 8 aa, Mycobacterium bovis
YTGPGAGS

SEQ ID NO: 192025 - protein, 5 aa, Mycobacterium bovis
YTKEH

SEQ ID NO: 192026 - protein, 17 aa, Mycobacterium bovis
YTKRGGDYVSVGPAEKI

SEQ ID NO: 192027 - protein, 13 aa, Mycobacterium bovis
YTPNGARTTGAGH

SEQ ID NO: 192028 - protein, 13 aa, Mycobacterium bovis
YTSAGRTKETAED

SEQ ID NO: 192029 - protein, 9 aa, Mycobacterium bovis
YTSGQPDPD

SEQ ID NO: 192030 - protein, 7 aa, Mycobacterium bovis
YTSPEDF

SEQ ID NO: 192031 - protein, 4 aa, Mycobacterium bovis
YTTE

SEQ ID NO: 192032 - protein, 7 aa, Mycobacterium bovis
YTTTSEQ

SEQ ID NO: 192033 - protein, 7 aa, Mycobacterium bovis
YVGENKE

SEQ ID NO: 192034 - protein, 4 aa, Mycobacterium bovis
YVKR

SEQ ID NO: 192035 - protein, 5 aa, Mycobacterium bovis
YVPDD

SEQ ID NO: 192036 - protein, 14 aa, Mycobacterium bovis
YVPEDDDERNLKQA

SEQ ID NO: 192037 - protein, 6 aa, Mycobacterium bovis
YVPEKD

SEQ ID NO: 192038 - protein, 6 aa, Mycobacterium bovis
YVTPDD

SEQ ID NO: 192039 - protein, 9 aa, Mycobacterium bovis
YYAATPQGL

SEQ ID NO: 192040 - protein, 10 aa, Mycobacterium bovis
YYATADPDTF

SEQ ID NO: 192041 - protein, 21 aa, Mycobacterium bovis
YYPEAPGGRPGGRSIEPKPFN

SEQ ID NO: 192042 - protein, 6 aa, Mycobacterium bovis
YYPETN

SEQ ID NO: 192043 - protein, 8 aa, Mycobacterium bovis
YYPKRPAG

SEQ ID NO: 192044 - protein, 14 aa, Mycobacterium bovis
YYQPPDKRLYRKGQ

SEQ ID NO: 192045 - protein, 9 aa, Mycobacterium bovis
YYTDSSRTI

SEQ ID NO: 192046 - protein, 22 aa, Mycobacterium bovis
AAAAADPGPPTRPAHNAAGVSP

SEQ ID NO: 192047 - protein, 10 aa, Mycobacterium bovis
AAAAAKAPSL

SEQ ID NO: 192048 - protein, 5 aa, Mycobacterium bovis
AAAAY

SEQ ID NO: 192049 - protein, 8 aa, Mycobacterium bovis
AAAPPTLP

SEQ ID NO: 192050 - protein, 19 aa, Mycobacterium bovis
AADDDHDHDHDHGGEPTPL

SEQ ID NO: 192051 - protein, 7 aa, Mycobacterium bovis
AADGTPL

SEQ ID NO: 192052 - protein, 7 aa, Mycobacterium bovis
AADGTRH

SEQ ID NO: 192053 - protein, 11 aa, Mycobacterium bovis
AAEDDCPPPGY

SEQ ID NO: 192054 - protein, 8 aa, Mycobacterium bovis
AAGADEVS

SEQ ID NO: 192055 - protein, 11 aa, Mycobacterium bovis
AAGADPHSAIP

SEQ ID NO: 192056 - protein, 5 aa, Mycobacterium bovis
AAGAR

SEQ ID NO: 192057 - protein, 30 aa, Mycobacterium bovis
AAGGAGGIGGDGGTLTAGGIGGAGGAGGNA

SEQ ID NO: 192058 - protein, 29 aa, Mycobacterium bovis
AAGGAGGSGGSSPDGGGGAGGIGGDGGTL

SEQ ID NO: 192059 - protein, 5 aa, Mycobacterium bovis
AAGRS

SEQ ID NO: 192060 - protein, 15 aa, Mycobacterium bovis
AAHPTAGDASLPDDR

SEQ ID NO: 192061 - protein, 4 aa, Mycobacterium bovis
AAHS

SEQ ID NO: 192062 - protein, 9 aa, Mycobacterium bovis
AAIGETDEY

SEQ ID NO: 192063 - protein, 8 aa, Mycobacterium bovis
AAKRGERV

SEQ ID NO: 192064 - protein, 7 aa, Mycobacterium bovis
AAKRGLA

SEQ ID NO: 192065 - protein, 15 aa, Mycobacterium bovis
AALDDAADESANPVP

SEQ ID NO: 192066 - protein, 9 aa, Mycobacterium bovis
AANTDDGRS

SEQ ID NO: 192067 - protein, 18 aa, Mycobacterium bovis
AAPVAGPEVAANRAGRQA

SEQ ID NO: 192068 - protein, 7 aa, Mycobacterium bovis
AAQVGTE

SEQ ID NO: 192069 - protein, 14 aa, Mycobacterium bovis
AARAAGASAQAKAV

SEQ ID NO: 192070 - protein, 21 aa, Mycobacterium bovis
AARRAAEGAAGVPAARRGRGL

SEQ ID NO: 192071 - protein, 6 aa, Mycobacterium bovis
AARSGQ

SEQ ID NO: 192072 - protein, 4 aa, Mycobacterium bovis
AAST

SEQ ID NO: 192073 - protein, 30 aa, Mycobacterium bovis
AATAAKSGANDPQPPEVAGQPPSSARPARR

SEQ ID NO: 192074 - protein, 11 aa, Mycobacterium bovis
AATSAGSTLGE

SEQ ID NO: 192075 - protein, 4 aa, Mycobacterium bovis
AAVD

SEQ ID NO: 192076 - protein, 5 aa, Mycobacterium bovis
AAVDA

SEQ ID NO: 192077 - protein, 8 aa, Mycobacterium bovis
AAYPDERY

SEQ ID NO: 192078 - protein, 8 aa, Mycobacterium bovis
ACSSGSEA

SEQ ID NO: 192079 - protein, 15 aa, Mycobacterium bovis
ADDANAVCVQALVAV

SEQ ID NO: 192080 - protein, 8 aa, Mycobacterium bovis
ADDATGYQ

SEQ ID NO: 192081 - protein, 4 aa, Mycobacterium bovis
ADDG

SEQ ID NO: 192082 - protein, 5 aa, Mycobacterium bovis
ADDGR

SEQ ID NO: 192083 - protein, 9 aa, Mycobacterium bovis
ADGASSRQY

SEQ ID NO: 192084 - protein, 5 aa, Mycobacterium bovis
ADGNL

SEQ ID NO: 192085 - protein, 6 aa, Mycobacterium bovis
ADGQPV

SEQ ID NO: 192086 - protein, 8 aa, Mycobacterium bovis
ADGSLPAD

SEQ ID NO: 192087 - protein, 4 aa, Mycobacterium bovis
ADND

SEQ ID NO: 192088 - protein, 7 aa, Mycobacterium bovis
ADPETPP

SEQ ID NO: 192089 - protein, 8 aa, Mycobacterium bovis
ADPTRSAH

SEQ ID NO: 192090 - protein, 6 aa, Mycobacterium bovis
ADRAGR

SEQ ID NO: 192091 - protein, 6 aa, Mycobacterium bovis
ADRSRP

SEQ ID NO: 192092 - protein, 7 aa, Mycobacterium bovis
ADRTDAP

SEQ ID NO: 192093 - protein, 5 aa, Mycobacterium bovis
ADTAA

SEQ ID NO: 192094 - protein, 12 aa, Mycobacterium bovis
ADTTELSDAEPV

SEQ ID NO: 192095 - protein, 11 aa, Mycobacterium bovis
ADWAGPTKERY

SEQ ID NO: 192096 - protein, 7 aa, Mycobacterium bovis
AEAQERF

SEQ ID NO: 192097 - protein, 7 aa, Mycobacterium bovis
AEDEVST

SEQ ID NO: 192098 - protein, 11 aa, Mycobacterium bovis
AEEIAADGTPA

SEQ ID NO: 192099 - protein, 4 aa, Mycobacterium bovis
AEGW

SEQ ID NO: 192100 - protein, 5 aa, Mycobacterium bovis
AEIPQ

SEQ ID NO: 192101 - protein, 9 aa, Mycobacterium bovis
AEITTTAGP

SEQ ID NO: 192102 - protein, 8 aa, Mycobacterium bovis
AEPAELDA

SEQ ID NO: 192103 - protein, 9 aa, Mycobacterium bovis
AEPATPAEL

SEQ ID NO: 192104 - protein, 11 aa, Mycobacterium bovis
AESDDADAVAA

SEQ ID NO: 192105 - protein, 8 aa, Mycobacterium bovis
AETGQPPT

SEQ ID NO: 192106 - protein, 13 aa, Mycobacterium bovis
AETRARRRNAQNV

SEQ ID NO: 192107 - protein, 10 aa, Mycobacterium bovis
AEVDASDDRM

SEQ ID NO: 192108 - protein, 6 aa, Mycobacterium bovis
AGADHP

SEQ ID NO: 192109 - protein, 14 aa, Mycobacterium bovis
AGCGDRLARGDQAC

SEQ ID NO: 192110 - protein, 7 aa, Mycobacterium bovis
AGDDGDT

SEQ ID NO: 192111 - protein, 5 aa, Mycobacterium bovis
AGDDV

SEQ ID NO: 192112 - protein, 52 aa, Mycobacterium bovis
AGDGGAGGHGGDPGLGGAGGAGGGVGRRRCSRGGQWSGGRQRRAGQRRQRRQ

SEQ ID NO: 192113 - protein, 9 aa, Mycobacterium bovis
AGDGPSRRF

SEQ ID NO: 192114 - protein, 8 aa, Mycobacterium bovis
AGDKPIRV

SEQ ID NO: 192115 - protein, 8 aa, Mycobacterium bovis
AGDRPKAG

SEQ ID NO: 192116 - protein, 5 aa, Mycobacterium bovis
AGEPH

SEQ ID NO: 192117 - protein, 11 aa, Mycobacterium bovis
AGGDGGAGGNA

SEQ ID NO: 192118 - protein, 11 aa, Mycobacterium bovis
AGGEGGSGGHS

SEQ ID NO: 192119 - protein, 8 aa, Mycobacterium bovis
AGGGGSIG

SEQ ID NO: 192120 - protein, 4 aa, Mycobacterium bovis
AGGL

SEQ ID NO: 192121 - protein, 13 aa, Mycobacterium bovis
AGGPGATGRSYSD

SEQ ID NO: 192122 - protein, 6 aa, Mycobacterium bovis
AGGTGD

SEQ ID NO: 192123 - protein, 471 aa, Mycobacterium bovis
AGGTGGAAGDGGQGGQGGAGGGAGGQGGAGGAGGTGGNGGNITGGTAGTAGAAGNGGAAGKGGAGGQGGTGGGTGGQGGAGGDGGAGGTGGDRTVGGGTVPAGSGGQGGNAGGGGAGGQGGADGGSGGDGGDAGTGGNGGNGGNRNSGNGTGGAGGNGGGGANGGAGGAGGSGGGTGGNGGAGGDAGDAGNGGNGNGTGNGGNGGNGGIAGMGGNGGAGTGSGNGGNGGSGGNGGNAGMGGNSGTGSGDGGAGGNGGAAGTGGTGGDGGLTGTGGTGGSGGTGGDGGNGGNGGNGADNTANMTAQAGGDGGNGGDGGFGGGAGAGGGGLTAGANGTGGQGGAGGDGGNGGTGGNGGTGGEGGEVGGAGGTGGAAGNGGDGGTGGTGGGDGGAGTTGGKGGTGGNGSGTGSGGTGGDGGTGGGGGNGGTGWNGGKGDTGSGGGAGDGGKAPAGGTGGAGGDGGAGGKGGSGG

SEQ ID NO: 192124 - protein, 9 aa, Mycobacterium bovis
AGHRERGVK

SEQ ID NO: 192125 - protein, 8 aa, Mycobacterium bovis
AGIQRAKR

SEQ ID NO: 192126 - protein, 6 aa, Mycobacterium bovis
AGLNLR

SEQ ID NO: 192127 - protein, 8 aa, Mycobacterium bovis
AGMDTDGV

SEQ ID NO: 192128 - protein, 5 aa, Mycobacterium bovis
AGMTT

SEQ ID NO: 192129 - protein, 58 aa, Mycobacterium bovis
AGNGGTGGAGGKADIANSLGDNATVTGGNGGTGGDGGSALGTGGAGGAGGLGGHGGAG

SEQ ID NO: 192130 - protein, 16 aa, Mycobacterium bovis
AGPEPAPPKPPTPPMP

SEQ ID NO: 192131 - protein, 6 aa, Mycobacterium bovis
AGPGDY

SEQ ID NO: 192132 - protein, 8 aa, Mycobacterium bovis
AGPGRVSR

SEQ ID NO: 192133 - protein, 6 aa, Mycobacterium bovis
AGPSAQ

SEQ ID NO: 192134 - protein, 10 aa, Mycobacterium bovis
AGRAKLDHSY

SEQ ID NO: 192135 - protein, 4 aa, Mycobacterium bovis
AGRS

SEQ ID NO: 192136 - protein, 7 aa, Mycobacterium bovis
AGRVRAE

SEQ ID NO: 192137 - protein, 18 aa, Mycobacterium bovis
AGSCASAETTADAPPQAL

SEQ ID NO: 192138 - protein, 25 aa, Mycobacterium bovis
AGSDTPGRCQPAGHGRATGHGGTPA

SEQ ID NO: 192139 - protein, 5 aa, Mycobacterium bovis
AGSEV

SEQ ID NO: 192140 - protein, 4 aa, Mycobacterium bovis
AGSF

SEQ ID NO: 192141 - protein, 6 aa, Mycobacterium bovis
AGSSQI

SEQ ID NO: 192142 - protein, 8 aa, Mycobacterium bovis
AGTANELT

SEQ ID NO: 192143 - protein, 11 aa, Mycobacterium bovis
AGTASDEAGAG

SEQ ID NO: 192144 - protein, 23 aa, Mycobacterium bovis
AGTGGAGASTKAGGTGGTGGNGG

SEQ ID NO: 192145 - protein, 164 aa, Mycobacterium bovis
AGTNPTPIGTAAPGSDGVNQIGNGGNTDLTGGAGGDGNAGSTTVNGGNGGTGGAARNSSGGTGNSFGGAGGAGGDGANGGDGGAGGEALTEGGATAVSGAGGKGGNAEASGGAGGNGGKGGFAQATTSVTGGNGGNGGNGHDSTAPGGAGGSGGVGGDGGRGGL

SEQ ID NO: 192146 - protein, 21 aa, Mycobacterium bovis
AGTPSQAAIEADTRSAGQRHH

SEQ ID NO: 192147 - protein, 6 aa, Mycobacterium bovis
AHPDNR

SEQ ID NO: 192148 - protein, 7 aa, Mycobacterium bovis
AHPGRPD

SEQ ID NO: 192149 - protein, 6 aa, Mycobacterium bovis
AHPGVN

SEQ ID NO: 192150 - protein, 10 aa, Mycobacterium bovis
AIDGKANDAV

SEQ ID NO: 192151 - protein, 4 aa, Mycobacterium bovis
AIPD

SEQ ID NO: 192152 - protein, 6 aa, Mycobacterium bovis
AKAATR

SEQ ID NO: 192153 - protein, 10 aa, Mycobacterium bovis
AKEGTDDQRA

SEQ ID NO: 192154 - protein, 10 aa, Mycobacterium bovis
AKTPDDRTQI

SEQ ID NO: 192155 - protein, 10 aa, Mycobacterium bovis
ALADGPEGSA

SEQ ID NO: 192156 - protein, 25 aa, Mycobacterium bovis
ALASDGPPKYQRAAKGSVADEAEPR

SEQ ID NO: 192157 - protein, 4 aa, Mycobacterium bovis
ALEQ

SEQ ID NO: 192158 - protein, 13 aa, Mycobacterium bovis
ALNEGSGSNPPRG

SEQ ID NO: 192159 - protein, 12 aa, Mycobacterium bovis
ALPDGVSQATVG

SEQ ID NO: 192160 - protein, 4 aa, Mycobacterium bovis
ALRA

SEQ ID NO: 192161 - protein, 31 aa, Mycobacterium bovis
ALRSSGSARPDEDVPAPNRRGNRLPRDERRG

SEQ ID NO: 192162 - protein, 10 aa, Mycobacterium bovis
ALSSVQGEYG

SEQ ID NO: 192163 - protein, 8 aa, Mycobacterium bovis
ALTDGALS

SEQ ID NO: 192164 - protein, 6 aa, Mycobacterium bovis
AMKPPV

SEQ ID NO: 192165 - protein, 15 aa, Mycobacterium bovis
AMRERSELARKGIAR

SEQ ID NO: 192166 - protein, 5 aa, Mycobacterium bovis
AMTAR

SEQ ID NO: 192167 - protein, 6 aa, Mycobacterium bovis
ANAEIP

SEQ ID NO: 192168 - protein, 10 aa, Mycobacterium bovis
ANGAGGNPVA

SEQ ID NO: 192169 - protein, 7 aa, Mycobacterium bovis
ANIGSSN

SEQ ID NO: 192170 - protein, 8 aa, Mycobacterium bovis
ANPQHHRR

SEQ ID NO: 192171 - protein, 4 aa, Mycobacterium bovis
ANRE

SEQ ID NO: 192172 - protein, 17 aa, Mycobacterium bovis
ANRGPAAISSGSNSGRV

SEQ ID NO: 192173 - protein, 13 aa, Mycobacterium bovis
ANSAAAAQTTAVA

SEQ ID NO: 192174 - protein, 8 aa, Mycobacterium bovis
ANSGAGVL

SEQ ID NO: 192175 - protein, 8 aa, Mycobacterium bovis
ANVDPASD

SEQ ID NO: 192176 - protein, 6 aa, Mycobacterium bovis
ANVGNT

SEQ ID NO: 192177 - protein, 8 aa, Mycobacterium bovis
APAGPSAV

SEQ ID NO: 192178 - protein, 8 aa, Mycobacterium bovis
APAGRNWT

SEQ ID NO: 192179 - protein, 17 aa, Mycobacterium bovis
APAPFEEPLPPEATDQW

SEQ ID NO: 192180 - protein, 5 aa, Mycobacterium bovis
APDDS

SEQ ID NO: 192181 - protein, 5 aa, Mycobacterium bovis
APDET

SEQ ID NO: 192182 - protein, 10 aa, Mycobacterium bovis
APEASEEPES

SEQ ID NO: 192183 - protein, 7 aa, Mycobacterium bovis
APEMTSA

SEQ ID NO: 192184 - protein, 8 aa, Mycobacterium bovis
APEMTSAG

SEQ ID NO: 192185 - protein, 5 aa, Mycobacterium bovis
APEYS

SEQ ID NO: 192186 - protein, 4 aa, Mycobacterium bovis
APHE

SEQ ID NO: 192187 - protein, 4 aa, Mycobacterium bovis
APNG

SEQ ID NO: 192188 - protein, 4 aa, Mycobacterium bovis
APPD

SEQ ID NO: 192189 - protein, 5 aa, Mycobacterium bovis
APPGP

SEQ ID NO: 192190 - protein, 10 aa, Mycobacterium bovis
APPTEASAAL

SEQ ID NO: 192191 - protein, 7 aa, Mycobacterium bovis
APRSPAD

SEQ ID NO: 192192 - protein, 8 aa, Mycobacterium bovis
APSKSGLT

SEQ ID NO: 192193 - protein, 15 aa, Mycobacterium bovis
APSLPTPVPHNEKPQ

SEQ ID NO: 192194 - protein, 8 aa, Mycobacterium bovis
APTTGGPY

SEQ ID NO: 192195 - protein, 10 aa, Mycobacterium bovis
AQADAQSGKV

SEQ ID NO: 192196 - protein, 107 aa, Mycobacterium bovis
AQDGGQGGTGGTGGNAGAGGTGFTQGADGNAGNGGDGGVGGNGGNGADNTTTAAAGTTGGAGGAGGAGGTGGTGGAAGTGTGGQQGNGGNGGNGGTGGKGGTGGAGM

SEQ ID NO: 192197 - protein, 538 aa, Mycobacterium bovis
AQDGGQGGTGGTGGNAGAGGTGFTQGADGNAGNGGDGGVGGNGGNGADNTTTAAAGTTGGDGGAGGAGGTGGTGGAAGTGTGGQQGNGGNGGNGGTGGKGGTGGDGALAGSSGGAGGKGGNGGDAGKAGTGSAPGTAGTGGDGGKGGNGGIGAAGTTGPVGTGASGGTGGSGGAGGTGGDGGAANGGTAGAGGAGGNGGKGGDGGAGVTSSTAGNSGGAGGSGGKGGDAGAGGAGATPGANGIAGNGGDGGDGAAGAVGISGATGAGDGGHGGTGGAGGNGGTGGAGGSGIDGVGGGTGGTGGNGGNGAIGGAGGDAGGSGNSGGNGGTGGKGGNAGAGGAAGSNGGTVGANGTGGDGGNGGAAGAATAGSNGGAGTGSAGGNGGTGGRGGSGGAGGDGIGGVGGGKGGNGADGEVGGAGGAGGSGPNTSPGGNGGQGGQGGSGGAGGAAGAGGAGGGANGTAGNGGQGGAGGTGGAGAASSATNGGSGGAGGTGGAGGTGGAGGDGVGGAGGGNGGHGGDAGDGGNGANGNNRSSGS

SEQ ID NO: 192198 - protein, 116 aa, Mycobacterium bovis
AQDRTGGTGTGQSRGAGGFGGVGQAGGKGWDGGPIGNGQVGEQHGAGQLGSTDGNPGVAGAAHGSGVSASHGSGATGAAGVADPGGSGAGVGSAAGNGTGAGSADAVGGAGTGTDI

SEQ ID NO: 192199 - protein, 4 aa, Mycobacterium bovis
AQGQ

SEQ ID NO: 192200 - protein, 4 aa, Mycobacterium bovis
AQGR

SEQ ID NO: 192201 - protein, 11 aa, Mycobacterium bovis
AQPQPGQSAPS

SEQ ID NO: 192202 - protein, 11 aa, Mycobacterium bovis
AQPTAANDPIY

SEQ ID NO: 192203 - protein, 14 aa, Mycobacterium bovis
AQPTQGTTPSSKLG

SEQ ID NO: 192204 - protein, 7 aa, Mycobacterium bovis
AQQRESF

SEQ ID NO: 192205 - protein, 7 aa, Mycobacterium bovis
AQRRDPD

SEQ ID NO: 192206 - protein, 5 aa, Mycobacterium bovis
AQTHV

SEQ ID NO: 192207 - protein, 6 aa, Mycobacterium bovis
ARAPRV

SEQ ID NO: 192208 - protein, 25 aa, Mycobacterium bovis
ARARPNGGGPISRPTSGWHQQPKTR

SEQ ID NO: 192209 - protein, 18 aa, Mycobacterium bovis
ARARPRGSSAAHPSPHRR

SEQ ID NO: 192210 - protein, 4 aa, Mycobacterium bovis
ARDL

SEQ ID NO: 192211 - protein, 8 aa, Mycobacterium bovis
ARDRGKPV

SEQ ID NO: 192212 - protein, 18 aa, Mycobacterium bovis
ARDTATVGGMASTNAGGL

SEQ ID NO: 192213 - protein, 32 aa, Mycobacterium bovis
ARESATRLGPPAGGLAAANTPNPVVRLFRRSS

SEQ ID NO: 192214 - protein, 5 aa, Mycobacterium bovis
ARGDE

SEQ ID NO: 192215 - protein, 7 aa, Mycobacterium bovis
ARGGEPA

SEQ ID NO: 192216 - protein, 6 aa, Mycobacterium bovis
ARGGIK

SEQ ID NO: 192217 - protein, 24 aa, Mycobacterium bovis
ARHSEETPVTKGKRTFQPNNRRRA

SEQ ID NO: 192218 - protein, 8 aa, Mycobacterium bovis
ARLDESVP

SEQ ID NO: 192219 - protein, 6 aa, Mycobacterium bovis
ARPTPW

SEQ ID NO: 192220 - protein, 8 aa, Mycobacterium bovis
ARRTGATR

SEQ ID NO: 192221 - protein, 9 aa, Mycobacterium bovis
ARRTGRTRS

SEQ ID NO: 192222 - protein, 10 aa, Mycobacterium bovis
ARSREDHRTL

SEQ ID NO: 192223 - protein, 8 aa, Mycobacterium bovis
ARTESRGC

SEQ ID NO: 192224 - protein, 8 aa, Mycobacterium bovis
ARYSDDQS

SEQ ID NO: 192225 - protein, 11 aa, Mycobacterium bovis
ASAGSGADGTY

SEQ ID NO: 192226 - protein, 12 aa, Mycobacterium bovis
ASAPQTTPAPPI

SEQ ID NO: 192227 - protein, 5 aa, Mycobacterium bovis
ASDAL

SEQ ID NO: 192228 - protein, 5 aa, Mycobacterium bovis
ASFNS

SEQ ID NO: 192229 - protein, 25 aa, Mycobacterium bovis
ASGGAGGSGGSSLTDSGGIGGVGGA

SEQ ID NO: 192230 - protein, 6 aa, Mycobacterium bovis
ASPLAD

SEQ ID NO: 192231 - protein, 10 aa, Mycobacterium bovis
ASRAVSASLA

SEQ ID NO: 192232 - protein, 4 aa, Mycobacterium bovis
ASRG

SEQ ID NO: 192233 - protein, 6 aa, Mycobacterium bovis
ASRPAD

SEQ ID NO: 192234 - protein, 7 aa, Mycobacterium bovis
ASRTRLH

SEQ ID NO: 192235 - protein, 10 aa, Mycobacterium bovis
ASSAPSEPYG

SEQ ID NO: 192236 - protein, 6 aa, Mycobacterium bovis
ASSGIG

SEQ ID NO: 192237 - protein, 6 aa, Mycobacterium bovis
ASSIEA

SEQ ID NO: 192238 - protein, 7 aa, Mycobacterium bovis
ASTDDVR

SEQ ID NO: 192239 - protein, 8 aa, Mycobacterium bovis
ATAGTPRR

SEQ ID NO: 192240 - protein, 6 aa, Mycobacterium bovis
ATATPL

SEQ ID NO: 192241 - protein, 11 aa, Mycobacterium bovis
ATATSTPARIR

SEQ ID NO: 192242 - protein, 8 aa, Mycobacterium bovis
ATECKDRS

SEQ ID NO: 192243 - protein, 5 aa, Mycobacterium bovis
ATEPD

SEQ ID NO: 192244 - protein, 12 aa, Mycobacterium bovis
ATGATAPRGSHA

SEQ ID NO: 192245 - protein, 5 aa, Mycobacterium bovis
ATGLT

SEQ ID NO: 192246 - protein, 4 aa, Mycobacterium bovis
ATGN

SEQ ID NO: 192247 - protein, 5 aa, Mycobacterium bovis
ATGVS

SEQ ID NO: 192248 - protein, 15 aa, Mycobacterium bovis
ATKTNDVAGDGTTTA

SEQ ID NO: 192249 - protein, 12 aa, Mycobacterium bovis
ATMPGGGATPAL

SEQ ID NO: 192250 - protein, 4 aa, Mycobacterium bovis
ATNT

SEQ ID NO: 192251 - protein, 9 aa, Mycobacterium bovis
ATPDKRSTT

SEQ ID NO: 192252 - protein, 14 aa, Mycobacterium bovis
ATPGPYELSQSGGE

SEQ ID NO: 192253 - protein, 7 aa, Mycobacterium bovis
ATQESEM

SEQ ID NO: 192254 - protein, 4 aa, Mycobacterium bovis
ATQI

SEQ ID NO: 192255 - protein, 13 aa, Mycobacterium bovis
ATRSSGQDSAGYG

SEQ ID NO: 192256 - protein, 10 aa, Mycobacterium bovis
ATSPAPGTAN

SEQ ID NO: 192257 - protein, 7 aa, Mycobacterium bovis
ATSQRKI

SEQ ID NO: 192258 - protein, 12 aa, Mycobacterium bovis
ATTNPAGSTGDG

SEQ ID NO: 192259 - protein, 7 aa, Mycobacterium bovis
ATVTTAD

SEQ ID NO: 192260 - protein, 6 aa, Mycobacterium bovis
ATWTEP

SEQ ID NO: 192261 - protein, 13 aa, Mycobacterium bovis
AVKPGTPGIQPKG

SEQ ID NO: 192262 - protein, 13 aa, Mycobacterium bovis
AVRAGATAQEAAE

SEQ ID NO: 192263 - protein, 5 aa, Mycobacterium bovis
AVSAG

SEQ ID NO: 192264 - protein, 5 aa, Mycobacterium bovis
AVSEK

SEQ ID NO: 192265 - protein, 8 aa, Mycobacterium bovis
AYPRDAER

SEQ ID NO: 192266 - protein, 6 aa, Mycobacterium bovis
CANGPR

SEQ ID NO: 192267 - protein, 7 aa, Mycobacterium bovis
CDPDGNR

SEQ ID NO: 192268 - protein, 5 aa, Mycobacterium bovis
CGAPA

SEQ ID NO: 192269 - protein, 8 aa, Mycobacterium bovis
CGASRGRV

SEQ ID NO: 192270 - protein, 8 aa, Mycobacterium bovis
CQGPPTRY

SEQ ID NO: 192271 - protein, 12 aa, Mycobacterium bovis
CRPDASPGSPEW

SEQ ID NO: 192272 - protein, 19 aa, Mycobacterium bovis
CRPGNATLRTSPRPADHRR

SEQ ID NO: 192273 - protein, 10 aa, Mycobacterium bovis
CRTEGRGESP

SEQ ID NO: 192274 - protein, 8 aa, Mycobacterium bovis
DAAPGLAA

SEQ ID NO: 192275 - protein, 9 aa, Mycobacterium bovis
DADAEDMGR

SEQ ID NO: 192276 - protein, 10 aa, Mycobacterium bovis
DADEVTAAAR

SEQ ID NO: 192277 - protein, 12 aa, Mycobacterium bovis
DADSYSSPTPCD

SEQ ID NO: 192278 - protein, 5 aa, Mycobacterium bovis
DAEVP

SEQ ID NO: 192279 - protein, 7 aa, Mycobacterium bovis
DAGETGW

SEQ ID NO: 192280 - protein, 5 aa, Mycobacterium bovis
DAGLP

SEQ ID NO: 192281 - protein, 14 aa, Mycobacterium bovis
DAGPKNVKTQIQGD

SEQ ID NO: 192282 - protein, 5 aa, Mycobacterium bovis
DAGPT

SEQ ID NO: 192283 - protein, 5 aa, Mycobacterium bovis
DAPAR

SEQ ID NO: 192284 - protein, 10 aa, Mycobacterium bovis
DAPGGGLGGS

SEQ ID NO: 192285 - protein, 22 aa, Mycobacterium bovis
DAPTRATTSRVDSDLDAQSPAA

SEQ ID NO: 192286 - protein, 8 aa, Mycobacterium bovis
DAQGRAVR

SEQ ID NO: 192287 - protein, 13 aa, Mycobacterium bovis
DARPIRKGRLGKP

SEQ ID NO: 192288 - protein, 11 aa, Mycobacterium bovis
DASADGYVRGE

SEQ ID NO: 192289 - protein, 5 aa, Mycobacterium bovis
DASAL

SEQ ID NO: 192290 - protein, 4 aa, Mycobacterium bovis
DAVE

SEQ ID NO: 192291 - protein, 6 aa, Mycobacterium bovis
DDADAE

SEQ ID NO: 192292 - protein, 9 aa, Mycobacterium bovis
DDALKRKAS

SEQ ID NO: 192293 - protein, 8 aa, Mycobacterium bovis
DDDDRTRL

SEQ ID NO: 192294 - protein, 6 aa, Mycobacterium bovis
DDFAPG

SEQ ID NO: 192295 - protein, 12 aa, Mycobacterium bovis
DDFGDGPTTPMV

SEQ ID NO: 192296 - protein, 9 aa, Mycobacterium bovis
DDGSGRTYQ

SEQ ID NO: 192297 - protein, 6 aa, Mycobacterium bovis
DDKERA

SEQ ID NO: 192298 - protein, 5 aa, Mycobacterium bovis
DDPEY

SEQ ID NO: 192299 - protein, 9 aa, Mycobacterium bovis
DDVAGSDSA

SEQ ID NO: 192300 - protein, 17 aa, Mycobacterium bovis
DDVTGQDGSGDGTDPRT

SEQ ID NO: 192301 - protein, 15 aa, Mycobacterium bovis
DEEERRQRPAPATMQ

SEQ ID NO: 192302 - protein, 4 aa, Mycobacterium bovis
DELT

SEQ ID NO: 192303 - protein, 7 aa, Mycobacterium bovis
DEPDAER

SEQ ID NO: 192304 - protein, 9 aa, Mycobacterium bovis
DEQTGAESV

SEQ ID NO: 192305 - protein, 5 aa, Mycobacterium bovis
DESDQ

SEQ ID NO: 192306 - protein, 8 aa, Mycobacterium bovis
DESQLPAA

SEQ ID NO: 192307 - protein, 4 aa, Mycobacterium bovis
DETG

SEQ ID NO: 192308 - protein, 5 aa, Mycobacterium bovis
DFPQT

SEQ ID NO: 192309 - protein, 8 aa, Mycobacterium bovis
DGAASGLR

SEQ ID NO: 192310 - protein, 8 aa, Mycobacterium bovis
DGAGPGSE

SEQ ID NO: 192311 - protein, 9 aa, Mycobacterium bovis
DGEREAEGV

SEQ ID NO: 192312 - protein, 16 aa, Mycobacterium bovis
DGERGRARTQREQRAK

SEQ ID NO: 192313 - protein, 5 aa, Mycobacterium bovis
DGFGP

SEQ ID NO: 192314 - protein, 77 aa, Mycobacterium bovis
DGGAGGAGGVGGTGGSGAPGGGGGAGGDGGAANTDSAGSSRKAFGGDGGVGGDGASALGTGGEGGIGGQGGNGGAGG

SEQ ID NO: 192315 - protein, 9 aa, Mycobacterium bovis
DGGDPSQAR

SEQ ID NO: 192316 - protein, 5 aa, Mycobacterium bovis
DGGEE

SEQ ID NO: 192317 - protein, 5 aa, Mycobacterium bovis
DGGNT

SEQ ID NO: 192318 - protein, 14 aa, Mycobacterium bovis
DGGQGGPGGNAGTV

SEQ ID NO: 192319 - protein, 9 aa, Mycobacterium bovis
DGPCTDDGE

SEQ ID NO: 192320 - protein, 6 aa, Mycobacterium bovis
DGPHAH

SEQ ID NO: 192321 - protein, 12 aa, Mycobacterium bovis
DGRARCTPTDAA

SEQ ID NO: 192322 - protein, 11 aa, Mycobacterium bovis
DGRVPNPGEFA

SEQ ID NO: 192323 - protein, 13 aa, Mycobacterium bovis
DHATASVNPPPEV

SEQ ID NO: 192324 - protein, 7 aa, Mycobacterium bovis
DHDQTDR

SEQ ID NO: 192325 - protein, 5 aa, Mycobacterium bovis
DHPGV

SEQ ID NO: 192326 - protein, 4 aa, Mycobacterium bovis
DHPT

SEQ ID NO: 192327 - protein, 20 aa, Mycobacterium bovis
DHRPAPPETEAALVPVQATL

SEQ ID NO: 192328 - protein, 9 aa, Mycobacterium bovis
DHRSYAGTV

SEQ ID NO: 192329 - protein, 5 aa, Mycobacterium bovis
DITPV

SEQ ID NO: 192330 - protein, 5 aa, Mycobacterium bovis
DKENN

SEQ ID NO: 192331 - protein, 18 aa, Mycobacterium bovis
DKGKQAAARITEATPGAE

SEQ ID NO: 192332 - protein, 5 aa, Mycobacterium bovis
DKNAA

SEQ ID NO: 192333 - protein, 4 aa, Mycobacterium bovis
DKNP

SEQ ID NO: 192334 - protein, 6 aa, Mycobacterium bovis
DKPDDV

SEQ ID NO: 192335 - protein, 7 aa, Mycobacterium bovis
DKSGDAE

SEQ ID NO: 192336 - protein, 10 aa, Mycobacterium bovis
DKSNRPASAE

SEQ ID NO: 192337 - protein, 8 aa, Mycobacterium bovis
DLDPRRRT

SEQ ID NO: 192338 - protein, 9 aa, Mycobacterium bovis
DLPAGSLDG

SEQ ID NO: 192339 - protein, 5 aa, Mycobacterium bovis
DLRGP

SEQ ID NO: 192340 - protein, 8 aa, Mycobacterium bovis
DNGDPANR

SEQ ID NO: 192341 - protein, 11 aa, Mycobacterium bovis
DNLAGSPEIVP

SEQ ID NO: 192342 - protein, 6 aa, Mycobacterium bovis
DNTYPG

SEQ ID NO: 192343 - protein, 6 aa, Mycobacterium bovis
DNVAGK

SEQ ID NO: 192344 - protein, 26 aa, Mycobacterium bovis
DNVKNSKQVGQFGGTVSRTRANVEIN

SEQ ID NO: 192345 - protein, 8 aa, Mycobacterium bovis
DPALREHP

SEQ ID NO: 192346 - protein, 10 aa, Mycobacterium bovis
DPATGEAVPR

SEQ ID NO: 192347 - protein, 6 aa, Mycobacterium bovis
DPDAVG

SEQ ID NO: 192348 - protein, 17 aa, Mycobacterium bovis
DPDSGGHFGGPSGWGGR

SEQ ID NO: 192349 - protein, 6 aa, Mycobacterium bovis
DPELEP

SEQ ID NO: 192350 - protein, 22 aa, Mycobacterium bovis
DPKVDDGPSSDANLSAPLTPQQ

SEQ ID NO: 192351 - protein, 10 aa, Mycobacterium bovis
DPLPPTPRRE

SEQ ID NO: 192352 - protein, 5 aa, Mycobacterium bovis
DPLTR

SEQ ID NO: 192353 - protein, 8 aa, Mycobacterium bovis
DPQGESPL

SEQ ID NO: 192354 - protein, 6 aa, Mycobacterium bovis
DPQYAP

SEQ ID NO: 192355 - protein, 4 aa, Mycobacterium bovis
DPRS

SEQ ID NO: 192356 - protein, 14 aa, Mycobacterium bovis
DPVDPVDPVDPVDP

SEQ ID NO: 192357 - protein, 6 aa, Mycobacterium bovis
DPYAGT

SEQ ID NO: 192358 - protein, 8 aa, Mycobacterium bovis
DQAGNADP

SEQ ID NO: 192359 - protein, 5 aa, Mycobacterium bovis
DQDHS

SEQ ID NO: 192360 - protein, 5 aa, Mycobacterium bovis
DQENP

SEQ ID NO: 192361 - protein, 14 aa, Mycobacterium bovis
DQGERKVRDHPDFP

SEQ ID NO: 192362 - protein, 5 aa, Mycobacterium bovis
DQIAG

SEQ ID NO: 192363 - protein, 12 aa, Mycobacterium bovis
DQPNLGGSGGYS

SEQ ID NO: 192364 - protein, 5 aa, Mycobacterium bovis
DQPTG

SEQ ID NO: 192365 - protein, 7 aa, Mycobacterium bovis
DRAGVSK

SEQ ID NO: 192366 - protein, 6 aa, Mycobacterium bovis
DRDNPY

SEQ ID NO: 192367 - protein, 5 aa, Mycobacterium bovis
DRDRD

SEQ ID NO: 192368 - protein, 7 aa, Mycobacterium bovis
DRGTRAA

SEQ ID NO: 192369 - protein, 6 aa, Mycobacterium bovis
DRIEAD

SEQ ID NO: 192370 - protein, 12 aa, Mycobacterium bovis
DRNPTGSIKDRP

SEQ ID NO: 192371 - protein, 7 aa, Mycobacterium bovis
DRVDPSS

SEQ ID NO: 192372 - protein, 12 aa, Mycobacterium bovis
DRVPADEPNPEQ

SEQ ID NO: 192373 - protein, 5 aa, Mycobacterium bovis
DSDVA

SEQ ID NO: 192374 - protein, 5 aa, Mycobacterium bovis
DSEGC

SEQ ID NO: 192375 - protein, 6 aa, Mycobacterium bovis
DSERPL

SEQ ID NO: 192376 - protein, 7 aa, Mycobacterium bovis
DSGTEST

SEQ ID NO: 192377 - protein, 5 aa, Mycobacterium bovis
DSGYP

SEQ ID NO: 192378 - protein, 5 aa, Mycobacterium bovis
DSIPT

SEQ ID NO: 192379 - protein, 7 aa, Mycobacterium bovis
DSITDKD

SEQ ID NO: 192380 - protein, 21 aa, Mycobacterium bovis
DSNSWVPNKPDAATPVIPGPV

SEQ ID NO: 192381 - protein, 5 aa, Mycobacterium bovis
DSYRL

SEQ ID NO: 192382 - protein, 6 aa, Mycobacterium bovis
DTEHPD

SEQ ID NO: 192383 - protein, 7 aa, Mycobacterium bovis
DTKADLP

SEQ ID NO: 192384 - protein, 7 aa, Mycobacterium bovis
DTPDEAP

SEQ ID NO: 192385 - protein, 4 aa, Mycobacterium bovis
DTPE

SEQ ID NO: 192386 - protein, 6 aa, Mycobacterium bovis
DTPRSR

SEQ ID NO: 192387 - protein, 10 aa, Mycobacterium bovis
DVDPKGPAAC

SEQ ID NO: 192388 - protein, 25 aa, Mycobacterium bovis
DVNTGNFNTGNYNTGSFNAGNYNTG

SEQ ID NO: 192389 - protein, 7 aa, Mycobacterium bovis
DVPWDAD

SEQ ID NO: 192390 - protein, 5 aa, Mycobacterium bovis
DVQGY

SEQ ID NO: 192391 - protein, 11 aa, Mycobacterium bovis
DYSRRKHTEAG

SEQ ID NO: 192392 - protein, 9 aa, Mycobacterium bovis
EAAAGPHDA

SEQ ID NO: 192393 - protein, 6 aa, Mycobacterium bovis
EAASDI

SEQ ID NO: 192394 - protein, 8 aa, Mycobacterium bovis
EAGDPAGQ

SEQ ID NO: 192395 - protein, 6 aa, Mycobacterium bovis
EAGHGD

SEQ ID NO: 192396 - protein, 9 aa, Mycobacterium bovis
EAGKARWAA

SEQ ID NO: 192397 - protein, 6 aa, Mycobacterium bovis
EAGPRV

SEQ ID NO: 192398 - protein, 4 aa, Mycobacterium bovis
EAPT

SEQ ID NO: 192399 - protein, 9 aa, Mycobacterium bovis
EAQRTHQAL

SEQ ID NO: 192400 - protein, 18 aa, Mycobacterium bovis
EARAAARARGQDAGRGRV

SEQ ID NO: 192401 - protein, 8 aa, Mycobacterium bovis
EATAGSGF

SEQ ID NO: 192402 - protein, 6 aa, Mycobacterium bovis
EDGREG

SEQ ID NO: 192403 - protein, 6 aa, Mycobacterium bovis
EDKGMR

SEQ ID NO: 192404 - protein, 6 aa, Mycobacterium bovis
EDRPAL

SEQ ID NO: 192405 - protein, 10 aa, Mycobacterium bovis
EEASDTAAAN

SEQ ID NO: 192406 - protein, 5 aa, Mycobacterium bovis
EESLA

SEQ ID NO: 192407 - protein, 13 aa, Mycobacterium bovis
EETDNAEDKPETL

SEQ ID NO: 192408 - protein, 5 aa, Mycobacterium bovis
EETLQ

SEQ ID NO: 192409 - protein, 8 aa, Mycobacterium bovis
EFDRSGGD

SEQ ID NO: 192410 - protein, 6 aa, Mycobacterium bovis
EFPNTR

SEQ ID NO: 192411 - protein, 5 aa, Mycobacterium bovis
EGADL

SEQ ID NO: 192412 - protein, 6 aa, Mycobacterium bovis
EGEPGD

SEQ ID NO: 192413 - protein, 50 aa, Mycobacterium bovis
EGEPPPAPDPAGPQPNEGLPPPGVSPPAESNLTVGPPSRPIQQARGGESL

SEQ ID NO: 192414 - protein, 8 aa, Mycobacterium bovis
EGIGGHES

SEQ ID NO: 192415 - protein, 5 aa, Mycobacterium bovis
EGKPA

SEQ ID NO: 192416 - protein, 7 aa, Mycobacterium bovis
EGMEESQ

SEQ ID NO: 192417 - protein, 7 aa, Mycobacterium bovis
EGNDAMT

SEQ ID NO: 192418 - protein, 5 aa, Mycobacterium bovis
EGPTV

SEQ ID NO: 192419 - protein, 5 aa, Mycobacterium bovis
EGRDA

SEQ ID NO: 192420 - protein, 8 aa, Mycobacterium bovis
EGRPSTDA

SEQ ID NO: 192421 - protein, 5 aa, Mycobacterium bovis
EGTFT

SEQ ID NO: 192422 - protein, 4 aa, Mycobacterium bovis
EGTM

SEQ ID NO: 192423 - protein, 9 aa, Mycobacterium bovis
EGVDEPTKS

SEQ ID NO: 192424 - protein, 7 aa, Mycobacterium bovis
EGVSASA

SEQ ID NO: 192425 - protein, 5 aa, Mycobacterium bovis
EHGYP

SEQ ID NO: 192426 - protein, 6 aa, Mycobacterium bovis
EHRQPR

SEQ ID NO: 192427 - protein, 10 aa, Mycobacterium bovis
EIGPSPAEAD

SEQ ID NO: 192428 - protein, 9 aa, Mycobacterium bovis
EIPNPLRGQ

SEQ ID NO: 192429 - protein, 12 aa, Mycobacterium bovis
EKPDSGSVKVGE

SEQ ID NO: 192430 - protein, 5 aa, Mycobacterium bovis
ELAPS

SEQ ID NO: 192431 - protein, 7 aa, Mycobacterium bovis
ELKAADS

SEQ ID NO: 192432 - protein, 16 aa, Mycobacterium bovis
ELPKGYPVSSAPYGSA

SEQ ID NO: 192433 - protein, 7 aa, Mycobacterium bovis
ELRSKPG

SEQ ID NO: 192434 - protein, 10 aa, Mycobacterium bovis
EMGGNASLKR

SEQ ID NO: 192435 - protein, 15 aa, Mycobacterium bovis
ENAVPTAELVKVAGR

SEQ ID NO: 192436 - protein, 13 aa, Mycobacterium bovis
ENFRPDMRDSRND

SEQ ID NO: 192437 - protein, 23 aa, Mycobacterium bovis
ENQGDVDPQSITGATATATHGTG

SEQ ID NO: 192438 - protein, 4 aa, Mycobacterium bovis
ENTR

SEQ ID NO: 192439 - protein, 13 aa, Mycobacterium bovis
EPALETPESPVET

SEQ ID NO: 192440 - protein, 6 aa, Mycobacterium bovis
EPDGHA

SEQ ID NO: 192441 - protein, 6 aa, Mycobacterium bovis
EPFTPE

SEQ ID NO: 192442 - protein, 6 aa, Mycobacterium bovis
EPLPVP

SEQ ID NO: 192443 - protein, 5 aa, Mycobacterium bovis
EPNEG

SEQ ID NO: 192444 - protein, 4 aa, Mycobacterium bovis
EPPG

SEQ ID NO: 192445 - protein, 6 aa, Mycobacterium bovis
EPPGAA

SEQ ID NO: 192446 - protein, 6 aa, Mycobacterium bovis
EPQPYP

SEQ ID NO: 192447 - protein, 7 aa, Mycobacterium bovis
EPRPITS

SEQ ID NO: 192448 - protein, 8 aa, Mycobacterium bovis
EPTGRNLN

SEQ ID NO: 192449 - protein, 12 aa, Mycobacterium bovis
EPTLPVDGSTGY

SEQ ID NO: 192450 - protein, 7 aa, Mycobacterium bovis
EPTPAER

SEQ ID NO: 192451 - protein, 8 aa, Mycobacterium bovis
EPVGDRRT

SEQ ID NO: 192452 - protein, 106 aa, Mycobacterium bovis
EPVKRTATKSPAASASGAKTGAKRTAAKSASGSPPAKRATKPAARSVKPASAPQDTTTSTIPKRKTRAAAKSAAAKAPSARGHATKPRAPKDAQHEAATDPEDALD

SEQ ID NO: 192453 - protein, 12 aa, Mycobacterium bovis
EPVPERGDAARN

SEQ ID NO: 192454 - protein, 7 aa, Mycobacterium bovis
EQAARGL

SEQ ID NO: 192455 - protein, 4 aa, Mycobacterium bovis
EQVR

SEQ ID NO: 192456 - protein, 8 aa, Mycobacterium bovis
ERADAPLR

SEQ ID NO: 192457 - protein, 11 aa, Mycobacterium bovis
ERANSVRSDGG

SEQ ID NO: 192458 - protein, 7 aa, Mycobacterium bovis
ERGRNGE

SEQ ID NO: 192459 - protein, 7 aa, Mycobacterium bovis
ERGTGDE

SEQ ID NO: 192460 - protein, 4 aa, Mycobacterium bovis
ERGY

SEQ ID NO: 192461 - protein, 6 aa, Mycobacterium bovis
ERLGGD

SEQ ID NO: 192462 - protein, 5 aa, Mycobacterium bovis
ERPHA

SEQ ID NO: 192463 - protein, 15 aa, Mycobacterium bovis
ERPHPYSTPGRKRGA

SEQ ID NO: 192464 - protein, 4 aa, Mycobacterium bovis
ERRE

SEQ ID NO: 192465 - protein, 16 aa, Mycobacterium bovis
ERRQKSRQTRASRDAL

SEQ ID NO: 192466 - protein, 6 aa, Mycobacterium bovis
ERRTTV

SEQ ID NO: 192467 - protein, 4 aa, Mycobacterium bovis
ERSS

SEQ ID NO: 192468 - protein, 14 aa, Mycobacterium bovis
ERVEPGRGRPGRPP

SEQ ID NO: 192469 - protein, 4 aa, Mycobacterium bovis
ESAG

SEQ ID NO: 192470 - protein, 11 aa, Mycobacterium bovis
ESGLRASAKGY

SEQ ID NO: 192471 - protein, 34 aa, Mycobacterium bovis
ESMSRQAGGRAGDSGGGVGLRGPGETKIETDRRR

SEQ ID NO: 192472 - protein, 9 aa, Mycobacterium bovis
ESPRRSPRR

SEQ ID NO: 192473 - protein, 4 aa, Mycobacterium bovis
ESQA

SEQ ID NO: 192474 - protein, 5 aa, Mycobacterium bovis
ESQEA

SEQ ID NO: 192475 - protein, 10 aa, Mycobacterium bovis
ESTAARVDYP

SEQ ID NO: 192476 - protein, 14 aa, Mycobacterium bovis
ESTEQARAELANEP

SEQ ID NO: 192477 - protein, 14 aa, Mycobacterium bovis
ESTSWPGVTRPTNI

SEQ ID NO: 192478 - protein, 5 aa, Mycobacterium bovis
ETFAR

SEQ ID NO: 192479 - protein, 5 aa, Mycobacterium bovis
ETSPR

SEQ ID NO: 192480 - protein, 9 aa, Mycobacterium bovis
EVEGDPECQ

SEQ ID NO: 192481 - protein, 8 aa, Mycobacterium bovis
EVQNGTDV

SEQ ID NO: 192482 - protein, 12 aa, Mycobacterium bovis
EVSSPDEGNCVG

SEQ ID NO: 192483 - protein, 8 aa, Mycobacterium bovis
EVSTRTPV

SEQ ID NO: 192484 - protein, 19 aa, Mycobacterium bovis
EVTAPNSEDGVARVLERWW

SEQ ID NO: 192485 - protein, 6 aa, Mycobacterium bovis
FADQPN

SEQ ID NO: 192486 - protein, 9 aa, Mycobacterium bovis
FANSGPAVG

SEQ ID NO: 192487 - protein, 14 aa, Mycobacterium bovis
FAPGGGSGGNGGNG

SEQ ID NO: 192488 - protein, 12 aa, Mycobacterium bovis
FDPADRSEPGHW

SEQ ID NO: 192489 - protein, 4 aa, Mycobacterium bovis
FEDG

SEQ ID NO: 192490 - protein, 4 aa, Mycobacterium bovis
FENG

SEQ ID NO: 192491 - protein, 4 aa, Mycobacterium bovis
FERA

SEQ ID NO: 192492 - protein, 29 aa, Mycobacterium bovis
FGAEPGVAPMSDNSSYRGGQGQGRPDEYY

SEQ ID NO: 192493 - protein, 9 aa, Mycobacterium bovis
FGNTGSGNI

SEQ ID NO: 192494 - protein, 6 aa, Mycobacterium bovis
FGPEDY

SEQ ID NO: 192495 - protein, 8 aa, Mycobacterium bovis
FGPSARTR

SEQ ID NO: 192496 - protein, 6 aa, Mycobacterium bovis
FGRGSN

SEQ ID NO: 192497 - protein, 15 aa, Mycobacterium bovis
FGSGGAGGNGGVGQG

SEQ ID NO: 192498 - protein, 4 aa, Mycobacterium bovis
FNPP

SEQ ID NO: 192499 - protein, 7 aa, Mycobacterium bovis
FNRPDQL

SEQ ID NO: 192500 - protein, 16 aa, Mycobacterium bovis
FPEKELAEPPPGSGLK

SEQ ID NO: 192501 - protein, 11 aa, Mycobacterium bovis
FQTRSTKPGGR

SEQ ID NO: 192502 - protein, 12 aa, Mycobacterium bovis
FTGTEDQPAAVE

SEQ ID NO: 192503 - protein, 9 aa, Mycobacterium bovis
GAAGADSRV

SEQ ID NO: 192504 - protein, 30 aa, Mycobacterium bovis
GAAGGAGGAGGEGLASAGGDGGAGGDGGNA

SEQ ID NO: 192505 - protein, 5 aa, Mycobacterium bovis
GADAI

SEQ ID NO: 192506 - protein, 22 aa, Mycobacterium bovis
GADLGPEHRPSAASGPDTTEAD

SEQ ID NO: 192507 - protein, 5 aa, Mycobacterium bovis
GAESG

SEQ ID NO: 192508 - protein, 7 aa, Mycobacterium bovis
GAGAGAA

SEQ ID NO: 192509 - protein, 6 aa, Mycobacterium bovis
GAGARW

SEQ ID NO: 192510 - protein, 79 aa, Mycobacterium bovis
GAGGAGGYSNIGAGGAGGAGGNAGMLSGSGGSGGTGGASGAAKGGVGGNGGTAGVFGNGGDGGAGGFGAGTGGNGGVGG

SEQ ID NO: 192511 - protein, 25 aa, Mycobacterium bovis
GAGGTGGAGGSLGPGAGGAGGNGGL

SEQ ID NO: 192512 - protein, 28 aa, Mycobacterium bovis
GAGGTGGHGGFADSSFGGVGGAGGAGGL

SEQ ID NO: 192513 - protein, 29 aa, Mycobacterium bovis
GAGGTGGSGGGGATTGGDGGAGGNAGTLS

SEQ ID NO: 192514 - protein, 28 aa, Mycobacterium bovis
GAGGTGGSGGHGTPAAVPGGAGGAGGNA

SEQ ID NO: 192515 - protein, 4 aa, Mycobacterium bovis
GAGL

SEQ ID NO: 192516 - protein, 12 aa, Mycobacterium bovis
GAGNRAGDGFDG

SEQ ID NO: 192517 - protein, 8 aa, Mycobacterium bovis
GAGPESHD

SEQ ID NO: 192518 - protein, 4 aa, Mycobacterium bovis
GAKG

SEQ ID NO: 192519 - protein, 5 aa, Mycobacterium bovis
GALPG

SEQ ID NO: 192520 - protein, 6 aa, Mycobacterium bovis
GAPDSV

SEQ ID NO: 192521 - protein, 5 aa, Mycobacterium bovis
GAPQG

SEQ ID NO: 192522 - protein, 7 aa, Mycobacterium bovis
GAREDLP

SEQ ID NO: 192523 - protein, 13 aa, Mycobacterium bovis
GARKPHKSTVQKV

SEQ ID NO: 192524 - protein, 30 aa, Mycobacterium bovis
GASPAAPAQAAAAVGQAAAEAAAGDGIRSA

SEQ ID NO: 192525 - protein, 16 aa, Mycobacterium bovis
GASQLRDASAAQRQQR

SEQ ID NO: 192526 - protein, 8 aa, Mycobacterium bovis
GATPENAA

SEQ ID NO: 192527 - protein, 5 aa, Mycobacterium bovis
GATVT

SEQ ID NO: 192528 - protein, 9 aa, Mycobacterium bovis
GAWQGPSAA

SEQ ID NO: 192529 - protein, 13 aa, Mycobacterium bovis
GDASGATSCLRGE

SEQ ID NO: 192530 - protein, 7 aa, Mycobacterium bovis
GDDGTRI

SEQ ID NO: 192531 - protein, 10 aa, Mycobacterium bovis
GDGAAGAGYA

SEQ ID NO: 192532 - protein, 21 aa, Mycobacterium bovis
GDGGAGEDGTTPGGNGGAGGV

SEQ ID NO: 192533 - protein, 32 aa, Mycobacterium bovis
GDGGDGGPGDSGGPGGSGGTGGTLAGQNGSPG

SEQ ID NO: 192534 - protein, 65 aa, Mycobacterium bovis
GDGGNGGAGGQGGAGRGGSPGGGGGVGGHGGAGGDAGMNGGGGTGGQGGNGAAGGAGWSPDSDLK

SEQ ID NO: 192535 - protein, 14 aa, Mycobacterium bovis
GDIGGAGGGVSGHR

SEQ ID NO: 192536 - protein, 7 aa, Mycobacterium bovis
GDPGGGA

SEQ ID NO: 192537 - protein, 10 aa, Mycobacterium bovis
GDPNGAAAGD

SEQ ID NO: 192538 - protein, 5 aa, Mycobacterium bovis
GDPVI

SEQ ID NO: 192539 - protein, 6 aa, Mycobacterium bovis
GDPVTA

SEQ ID NO: 192540 - protein, 12 aa, Mycobacterium bovis
GDQLPEKTYPLT

SEQ ID NO: 192541 - protein, 10 aa, Mycobacterium bovis
GDVPLRPTTT

SEQ ID NO: 192542 - protein, 5 aa, Mycobacterium bovis
GDYDD

SEQ ID NO: 192543 - protein, 4 aa, Mycobacterium bovis
GEAE

SEQ ID NO: 192544 - protein, 9 aa, Mycobacterium bovis
GEAGADYNV

SEQ ID NO: 192545 - protein, 25 aa, Mycobacterium bovis
GEAGPGPSYLDPGSGGPENDFTNRN

SEQ ID NO: 192546 - protein, 4 aa, Mycobacterium bovis
GEDI

SEQ ID NO: 192547 - protein, 12 aa, Mycobacterium bovis
GEESKQALDRLI

SEQ ID NO: 192548 - protein, 4 aa, Mycobacterium bovis
GEGN

SEQ ID NO: 192549 - protein, 8 aa, Mycobacterium bovis
GEKSASDM

SEQ ID NO: 192550 - protein, 9 aa, Mycobacterium bovis
GELAGPDFG

SEQ ID NO: 192551 - protein, 5 aa, Mycobacterium bovis
GEPDV

SEQ ID NO: 192552 - protein, 7 aa, Mycobacterium bovis
GFANTGT

SEQ ID NO: 192553 - protein, 9 aa, Mycobacterium bovis
GFDAAAPSA

SEQ ID NO: 192554 - protein, 62 aa, Mycobacterium bovis
GFGSAGGAGGAGGNGGAGGKAGLYGNGGDGGAGGDGATSGKGGAGGNAGKAGGTAGAGGAGG

SEQ ID NO: 192555 - protein, 6 aa, Mycobacterium bovis
GFGSTE

SEQ ID NO: 192556 - protein, 5 aa, Mycobacterium bovis
GFSNG

SEQ ID NO: 192557 - protein, 12 aa, Mycobacterium bovis
GFSNLGSGVSGF

SEQ ID NO: 192558 - protein, 24 aa, Mycobacterium bovis
GGAGGAGGAAPTGNGGAGGNGGDA

SEQ ID NO: 192559 - protein, 53 aa, Mycobacterium bovis
GGAGGAGGFGRTTGGIGGTGGNAGLLNGSGGAGGAGGAAITGPGGTGGAGGIP

SEQ ID NO: 192560 - protein, 9 aa, Mycobacterium bovis
GGAGGAGGG

SEQ ID NO: 192561 - protein, 10 aa, Mycobacterium bovis
GGAGGDGGGA

SEQ ID NO: 192562 - protein, 50 aa, Mycobacterium bovis
GGAGGSGAAGVNGGAGGNGGAGGLIGNGGAGGAGGVASSGIGGSGGAGGN

SEQ ID NO: 192563 - protein, 5 aa, Mycobacterium bovis
GGAGM

SEQ ID NO: 192564 - protein, 7 aa, Mycobacterium bovis
GGATETA

SEQ ID NO: 192565 - protein, 9 aa, Mycobacterium bovis
GGDATGAEV

SEQ ID NO: 192566 - protein, 6 aa, Mycobacterium bovis
GGGDQW

SEQ ID NO: 192567 - protein, 18 aa, Mycobacterium bovis
GGGGGAGGVGGNGGAAGS

SEQ ID NO: 192568 - protein, 8 aa, Mycobacterium bovis
GGGTAGHV

SEQ ID NO: 192569 - protein, 37 aa, Mycobacterium bovis
GGIGGAGGTPGLIGNGGNGGNGGASAVTGGNGGIGGT

SEQ ID NO: 192570 - protein, 9 aa, Mycobacterium bovis
GGIRDDESL

SEQ ID NO: 192571 - protein, 24 aa, Mycobacterium bovis
GGLTGRRDGGSGDSPTERSERVSE

SEQ ID NO: 192572 - protein, 9 aa, Mycobacterium bovis
GGNNVGGAN

SEQ ID NO: 192573 - protein, 14 aa, Mycobacterium bovis
GGNVSSEHGVGSRK

SEQ ID NO: 192574 - protein, 5 aa, Mycobacterium bovis
GGPAG

SEQ ID NO: 192575 - protein, 8 aa, Mycobacterium bovis
GGPRGGGV

SEQ ID NO: 192576 - protein, 6 aa, Mycobacterium bovis
GGSELD

SEQ ID NO: 192577 - protein, 9 aa, Mycobacterium bovis
GGSGALAGH

SEQ ID NO: 192578 - protein, 4 aa, Mycobacterium bovis
GGSN

SEQ ID NO: 192579 - protein, 20 aa, Mycobacterium bovis
GGSVNGHSDDSSGDAKQAAP

SEQ ID NO: 192580 - protein, 13 aa, Mycobacterium bovis
GGTISTTAGPDGV

SEQ ID NO: 192581 - protein, 4 aa, Mycobacterium bovis
GGTT

SEQ ID NO: 192582 - protein, 5 aa, Mycobacterium bovis
GGTTE

SEQ ID NO: 192583 - protein, 24 aa, Mycobacterium bovis
GGVGGSGGAGSSGGAGGAGGAGGL

SEQ ID NO: 192584 - protein, 6 aa, Mycobacterium bovis
GGVSSL

SEQ ID NO: 192585 - protein, 4 aa, Mycobacterium bovis
GHDR

SEQ ID NO: 192586 - protein, 7 aa, Mycobacterium bovis
GIGPEVT

SEQ ID NO: 192587 - protein, 6 aa, Mycobacterium bovis
GIPAAT

SEQ ID NO: 192588 - protein, 8 aa, Mycobacterium bovis
GKAAPDDV

SEQ ID NO: 192589 - protein, 12 aa, Mycobacterium bovis
GKAGSQTEYGSA

SEQ ID NO: 192590 - protein, 7 aa, Mycobacterium bovis
GKDGNAG

SEQ ID NO: 192591 - protein, 7 aa, Mycobacterium bovis
GKGTQAV

SEQ ID NO: 192592 - protein, 6 aa, Mycobacterium bovis
GKLTNT

SEQ ID NO: 192593 - protein, 18 aa, Mycobacterium bovis
GKQARDKRQDMARRDAQR

SEQ ID NO: 192594 - protein, 26 aa, Mycobacterium bovis
GKRIQAAGGAVRTRVGDRSRAAGRRA

SEQ ID NO: 192595 - protein, 4 aa, Mycobacterium bovis
GKRT

SEQ ID NO: 192596 - protein, 7 aa, Mycobacterium bovis
GLAKPAG

SEQ ID NO: 192597 - protein, 16 aa, Mycobacterium bovis
GLAPGPLLSDGQLHER

SEQ ID NO: 192598 - protein, 8 aa, Mycobacterium bovis
GLASGNCY

SEQ ID NO: 192599 - protein, 6 aa, Mycobacterium bovis
GLEPAS

SEQ ID NO: 192600 - protein, 6 aa, Mycobacterium bovis
GLPDGE

SEQ ID NO: 192601 - protein, 9 aa, Mycobacterium bovis
GLPSGEAAA

SEQ ID NO: 192602 - protein, 5 aa, Mycobacterium bovis
GLTNG

SEQ ID NO: 192603 - protein, 38 aa, Mycobacterium bovis
GMSASASAQRKAPQPDSAAAAAAAAAVRDQARARRRRR

SEQ ID NO: 192604 - protein, 12 aa, Mycobacterium bovis
GNDRKPDESCAR

SEQ ID NO: 192605 - protein, 6 aa, Mycobacterium bovis
GNEDGV

SEQ ID NO: 192606 - protein, 12 aa, Mycobacterium bovis
GNGGDGGTGGTL

SEQ ID NO: 192607 - protein, 46 aa, Mycobacterium bovis
GNGGNGAAGGPNQAGGAGGNAGLIGNGGAGGAGGVGAVGGNGGTGD

SEQ ID NO: 192608 - protein, 10 aa, Mycobacterium bovis
GNNSQKSRDL

SEQ ID NO: 192609 - protein, 6 aa, Mycobacterium bovis
GNPGLS

SEQ ID NO: 192610 - protein, 4 aa, Mycobacterium bovis
GNQD

SEQ ID NO: 192611 - protein, 14 aa, Mycobacterium bovis
GNQRNTGSTTRPQR

SEQ ID NO: 192612 - protein, 10 aa, Mycobacterium bovis
GNRTSDQPRP

SEQ ID NO: 192613 - protein, 7 aa, Mycobacterium bovis
GNTGNNN

SEQ ID NO: 192614 - protein, 39 aa, Mycobacterium bovis
GNTGSGNIGNNNIGNNNIGSGNTGTGNIGTGNTGSGNLG

SEQ ID NO: 192615 - protein, 5 aa, Mycobacterium bovis
GNTNN

SEQ ID NO: 192616 - protein, 11 aa, Mycobacterium bovis
GPADRQRRQRR

SEQ ID NO: 192617 - protein, 6 aa, Mycobacterium bovis
GPASTN

SEQ ID NO: 192618 - protein, 7 aa, Mycobacterium bovis
GPDAADP

SEQ ID NO: 192619 - protein, 20 aa, Mycobacterium bovis
GPDIRDPQPLGKAARELAKK

SEQ ID NO: 192620 - protein, 9 aa, Mycobacterium bovis
GPDPDDEGD

SEQ ID NO: 192621 - protein, 9 aa, Mycobacterium bovis
GPGGSLTGS

SEQ ID NO: 192622 - protein, 19 aa, Mycobacterium bovis
GPGPGPGAGVDRPILEVPV

SEQ ID NO: 192623 - protein, 5 aa, Mycobacterium bovis
GPGVT

SEQ ID NO: 192624 - protein, 8 aa, Mycobacterium bovis
GPIRPTSA

SEQ ID NO: 192625 - protein, 4 aa, Mycobacterium bovis
GPRF

SEQ ID NO: 192626 - protein, 7 aa, Mycobacterium bovis
GPSGDTW

SEQ ID NO: 192627 - protein, 7 aa, Mycobacterium bovis
GPSPADQ

SEQ ID NO: 192628 - protein, 8 aa, Mycobacterium bovis
GPSRERSI

SEQ ID NO: 192629 - protein, 4 aa, Mycobacterium bovis
GPST

SEQ ID NO: 192630 - protein, 5 aa, Mycobacterium bovis
GPTEQ

SEQ ID NO: 192631 - protein, 6 aa, Mycobacterium bovis
GPTISA

SEQ ID NO: 192632 - protein, 7 aa, Mycobacterium bovis
GPVPDTS

SEQ ID NO: 192633 - protein, 21 aa, Mycobacterium bovis
GQAGGQAVAESVTGQVNPSGR

SEQ ID NO: 192634 - protein, 9 aa, Mycobacterium bovis
GQFDPTTMG

SEQ ID NO: 192635 - protein, 6 aa, Mycobacterium bovis
GQNTPA

SEQ ID NO: 192636 - protein, 6 aa, Mycobacterium bovis
GQPARE

SEQ ID NO: 192637 - protein, 6 aa, Mycobacterium bovis
GQRPRN

SEQ ID NO: 192638 - protein, 11 aa, Mycobacterium bovis
GRAAAAGDELD

SEQ ID NO: 192639 - protein, 28 aa, Mycobacterium bovis
GRAGKAAAAHAAAAGRSRATSSATWPEP

SEQ ID NO: 192640 - protein, 55 aa, Mycobacterium bovis
GRAGSDGGVGAGGAGGAGGAGGTGGEGGTGGDGKTTDGNPGMGGSPGSAGQPGQP

SEQ ID NO: 192641 - protein, 7 aa, Mycobacterium bovis
GRDPRAA

SEQ ID NO: 192642 - protein, 8 aa, Mycobacterium bovis
GREAGRTE

SEQ ID NO: 192643 - protein, 4 aa, Mycobacterium bovis
GRHR

SEQ ID NO: 192644 - protein, 5 aa, Mycobacterium bovis
GRKPK

SEQ ID NO: 192645 - protein, 5 aa, Mycobacterium bovis
GRLGG

SEQ ID NO: 192646 - protein, 8 aa, Mycobacterium bovis
GRNATTAG

SEQ ID NO: 192647 - protein, 4 aa, Mycobacterium bovis
GRPH

SEQ ID NO: 192648 - protein, 11 aa, Mycobacterium bovis
GRVRGQRWGPR

SEQ ID NO: 192649 - protein, 4 aa, Mycobacterium bovis
GSAP

SEQ ID NO: 192650 - protein, 17 aa, Mycobacterium bovis
GSAVPSPNVSPTPRRRA

SEQ ID NO: 192651 - protein, 7 aa, Mycobacterium bovis
GSGGVGG

SEQ ID NO: 192652 - protein, 5 aa, Mycobacterium bovis
GSGHS

SEQ ID NO: 192653 - protein, 4 aa, Mycobacterium bovis
GSGI

SEQ ID NO: 192654 - protein, 59 aa, Mycobacterium bovis
GSGNFGSQNLGSGNIGSTNVGSGNIGSTNVGSGNIGSTNVGSGNIGDTNFGNGNNGNFN

SEQ ID NO: 192655 - protein, 6 aa, Mycobacterium bovis
GSHKGP

SEQ ID NO: 192656 - protein, 8 aa, Mycobacterium bovis
GSLAPQQP

SEQ ID NO: 192657 - protein, 11 aa, Mycobacterium bovis
GSLPPRRDRSR

SEQ ID NO: 192658 - protein, 13 aa, Mycobacterium bovis
GSPGAPETRANSA

SEQ ID NO: 192659 - protein, 7 aa, Mycobacterium bovis
GSPRPTL

SEQ ID NO: 192660 - protein, 6 aa, Mycobacterium bovis
GSREAG

SEQ ID NO: 192661 - protein, 10 aa, Mycobacterium bovis
GSSDVANPRG

SEQ ID NO: 192662 - protein, 9 aa, Mycobacterium bovis
GSSPRPYGG

SEQ ID NO: 192663 - protein, 26 aa, Mycobacterium bovis
GSSRGSSWSGPSSVGSCGSGSKCADA

SEQ ID NO: 192664 - protein, 5 aa, Mycobacterium bovis
GSTPC

SEQ ID NO: 192665 - protein, 4 aa, Mycobacterium bovis
GSTW

SEQ ID NO: 192666 - protein, 9 aa, Mycobacterium bovis
GTAPSPYGP

SEQ ID NO: 192667 - protein, 6 aa, Mycobacterium bovis
GTGPAL

SEQ ID NO: 192668 - protein, 11 aa, Mycobacterium bovis
GTIGAQGESAD

SEQ ID NO: 192669 - protein, 8 aa, Mycobacterium bovis
GTLPPGRL

SEQ ID NO: 192670 - protein, 7 aa, Mycobacterium bovis
GTMSGMQ

SEQ ID NO: 192671 - protein, 15 aa, Mycobacterium bovis
GTPHTTTGSATASAT

SEQ ID NO: 192672 - protein, 10 aa, Mycobacterium bovis
GTPPGRGGSA

SEQ ID NO: 192673 - protein, 7 aa, Mycobacterium bovis
GTQEGGA

SEQ ID NO: 192674 - protein, 15 aa, Mycobacterium bovis
GTQSLSDAQRATDAL

SEQ ID NO: 192675 - protein, 7 aa, Mycobacterium bovis
GTRAHSA

SEQ ID NO: 192676 - protein, 8 aa, Mycobacterium bovis
GTRGPLTD

SEQ ID NO: 192677 - protein, 9 aa, Mycobacterium bovis
GTTTERHDQ

SEQ ID NO: 192678 - protein, 8 aa, Mycobacterium bovis
GVAADAAG

SEQ ID NO: 192679 - protein, 6 aa, Mycobacterium bovis
GVGGAG

SEQ ID NO: 192680 - protein, 25 aa, Mycobacterium bovis
GVGGAGGFTNGSALGGAGGAGGAGG

SEQ ID NO: 192681 - protein, 5 aa, Mycobacterium bovis
GVGGI

SEQ ID NO: 192682 - protein, 7 aa, Mycobacterium bovis
GVGPEKS

SEQ ID NO: 192683 - protein, 17 aa, Mycobacterium bovis
GVPARNEPPSDPSAPIP

SEQ ID NO: 192684 - protein, 18 aa, Mycobacterium bovis
GVTGEGAGPPVRRAPART

SEQ ID NO: 192685 - protein, 5 aa, Mycobacterium bovis
GWQPI

SEQ ID NO: 192686 - protein, 10 aa, Mycobacterium bovis
GYAGPDPVAR

SEQ ID NO: 192687 - protein, 7 aa, Mycobacterium bovis
GYPTDHR

SEQ ID NO: 192688 - protein, 5 aa, Mycobacterium bovis
HAAAT

SEQ ID NO: 192689 - protein, 6 aa, Mycobacterium bovis
HADRSI

SEQ ID NO: 192690 - protein, 4 aa, Mycobacterium bovis
HAEY

SEQ ID NO: 192691 - protein, 11 aa, Mycobacterium bovis
HAPGTAARGQH

SEQ ID NO: 192692 - protein, 4 aa, Mycobacterium bovis
HARQ

SEQ ID NO: 192693 - protein, 16 aa, Mycobacterium bovis
HDGRTARVPGDEITST

SEQ ID NO: 192694 - protein, 24 aa, Mycobacterium bovis
HDKPSPAPSAPTFTSQQISDAKEN

SEQ ID NO: 192695 - protein, 8 aa, Mycobacterium bovis
HEETEGTL

SEQ ID NO: 192696 - protein, 19 aa, Mycobacterium bovis
HEVSRADTVSVPRAPTQAE

SEQ ID NO: 192697 - protein, 12 aa, Mycobacterium bovis
HGDRFESAAHSR

SEQ ID NO: 192698 - protein, 8 aa, Mycobacterium bovis
HGGDGGNA

SEQ ID NO: 192699 - protein, 11 aa, Mycobacterium bovis
HGGGTARLRGR

SEQ ID NO: 192700 - protein, 6 aa, Mycobacterium bovis
HGGPEA

SEQ ID NO: 192701 - protein, 8 aa, Mycobacterium bovis
HGPTTPPF

SEQ ID NO: 192702 - protein, 7 aa, Mycobacterium bovis
HGQPRTN

SEQ ID NO: 192703 - protein, 12 aa, Mycobacterium bovis
HGVPDSVARSGG

SEQ ID NO: 192704 - protein, 4 aa, Mycobacterium bovis
HLAP

SEQ ID NO: 192705 - protein, 5 aa, Mycobacterium bovis
HMGSD

SEQ ID NO: 192706 - protein, 4 aa, Mycobacterium bovis
HNAG

SEQ ID NO: 192707 - protein, 4 aa, Mycobacterium bovis
HPDG

SEQ ID NO: 192708 - protein, 6 aa, Mycobacterium bovis
HPKEEP

SEQ ID NO: 192709 - protein, 6 aa, Mycobacterium bovis
HPQDRA

SEQ ID NO: 192710 - protein, 8 aa, Mycobacterium bovis
HQQDSRGT

SEQ ID NO: 192711 - protein, 4 aa, Mycobacterium bovis
HQYP

SEQ ID NO: 192712 - protein, 9 aa, Mycobacterium bovis
HSDGSDGAE

SEQ ID NO: 192713 - protein, 8 aa, Mycobacterium bovis
HSRSSGRF

SEQ ID NO: 192714 - protein, 5 aa, Mycobacterium bovis
HTSKT

SEQ ID NO: 192715 - protein, 8 aa, Mycobacterium bovis
IAEPDTAD

SEQ ID NO: 192716 - protein, 7 aa, Mycobacterium bovis
IANPRER

SEQ ID NO: 192717 - protein, 9 aa, Mycobacterium bovis
IAPAPDAVT

SEQ ID NO: 192718 - protein, 5 aa, Mycobacterium bovis
IASAD

SEQ ID NO: 192719 - protein, 5 aa, Mycobacterium bovis
IASEQ

SEQ ID NO: 192720 - protein, 9 aa, Mycobacterium bovis
IDESPPGDY

SEQ ID NO: 192721 - protein, 8 aa, Mycobacterium bovis
IDQTETPV

SEQ ID NO: 192722 - protein, 4 aa, Mycobacterium bovis
IEEK

SEQ ID NO: 192723 - protein, 8 aa, Mycobacterium bovis
IEGPPGHR

SEQ ID NO: 192724 - protein, 6 aa, Mycobacterium bovis
IEPGAH

SEQ ID NO: 192725 - protein, 4 aa, Mycobacterium bovis
IGDG

SEQ ID NO: 192726 - protein, 6 aa, Mycobacterium bovis
IGGQED

SEQ ID NO: 192727 - protein, 12 aa, Mycobacterium bovis
IGGTGGTGGNAG

SEQ ID NO: 192728 - protein, 14 aa, Mycobacterium bovis
IGNGGDGGNSVQTD

SEQ ID NO: 192729 - protein, 27 aa, Mycobacterium bovis
IGNGGNGGAAGVSGDGTPGTGGNGGYA

SEQ ID NO: 192730 - protein, 6 aa, Mycobacterium bovis
IGPGYG

SEQ ID NO: 192731 - protein, 5 aa, Mycobacterium bovis
IGPPI

SEQ ID NO: 192732 - protein, 4 aa, Mycobacterium bovis
IGPR

SEQ ID NO: 192733 - protein, 39 aa, Mycobacterium bovis
IGRKSATRKSKGAKGKSGKKSKKGTRGPTPPKVKSPFGV

SEQ ID NO: 192734 - protein, 14 aa, Mycobacterium bovis
IGSKRSPLHTPEQA

SEQ ID NO: 192735 - protein, 14 aa, Mycobacterium bovis
IGVPPGSRGCANYT

SEQ ID NO: 192736 - protein, 8 aa, Mycobacterium bovis
INGVARDD

SEQ ID NO: 192737 - protein, 11 aa, Mycobacterium bovis
IPAYGNQRTKW

SEQ ID NO: 192738 - protein, 6 aa, Mycobacterium bovis
IPLDDN

SEQ ID NO: 192739 - protein, 7 aa, Mycobacterium bovis
IPPQADA

SEQ ID NO: 192740 - protein, 5 aa, Mycobacterium bovis
IREEV

SEQ ID NO: 192741 - protein, 17 aa, Mycobacterium bovis
ISGGAPLAGGDAQLPHG

SEQ ID NO: 192742 - protein, 6 aa, Mycobacterium bovis
ISPQDT

SEQ ID NO: 192743 - protein, 4 aa, Mycobacterium bovis
ISPR

SEQ ID NO: 192744 - protein, 10 aa, Mycobacterium bovis
ISTANGAAAL

SEQ ID NO: 192745 - protein, 11 aa, Mycobacterium bovis
ISVGPSETVDA

SEQ ID NO: 192746 - protein, 9 aa, Mycobacterium bovis
ITDVNGGGQ

SEQ ID NO: 192747 - protein, 14 aa, Mycobacterium bovis
ITPTAVATTDGASH

SEQ ID NO: 192748 - protein, 8 aa, Mycobacterium bovis
KAAARDRV

SEQ ID NO: 192749 - protein, 6 aa, Mycobacterium bovis
KAANAL

SEQ ID NO: 192750 - protein, 9 aa, Mycobacterium bovis
KAAPGGDRE

SEQ ID NO: 192751 - protein, 4 aa, Mycobacterium bovis
KACP

SEQ ID NO: 192752 - protein, 12 aa, Mycobacterium bovis
KADAPSGTAART

SEQ ID NO: 192753 - protein, 11 aa, Mycobacterium bovis
KAPSNAERGTK

SEQ ID NO: 192754 - protein, 7 aa, Mycobacterium bovis
KARKTSL

SEQ ID NO: 192755 - protein, 14 aa, Mycobacterium bovis
KASSTPTGSPSSGV

SEQ ID NO: 192756 - protein, 6 aa, Mycobacterium bovis
KATGDP

SEQ ID NO: 192757 - protein, 5 aa, Mycobacterium bovis
KDDAI

SEQ ID NO: 192758 - protein, 6 aa, Mycobacterium bovis
KDGDDA

SEQ ID NO: 192759 - protein, 7 aa, Mycobacterium bovis
KDGIEEA

SEQ ID NO: 192760 - protein, 9 aa, Mycobacterium bovis
KDGTLGGPN

SEQ ID NO: 192761 - protein, 13 aa, Mycobacterium bovis
KDHRDGARGRGRG

SEQ ID NO: 192762 - protein, 12 aa, Mycobacterium bovis
KDPRSSVTRTAT

SEQ ID NO: 192763 - protein, 23 aa, Mycobacterium bovis
KEGEAGEDEVGRAEKDLDKTTHQ

SEQ ID NO: 192764 - protein, 16 aa, Mycobacterium bovis
KGRRGRSPARPNAPIG

SEQ ID NO: 192765 - protein, 6 aa, Mycobacterium bovis
KIAEDG

SEQ ID NO: 192766 - protein, 5 aa, Mycobacterium bovis
KLPSV

SEQ ID NO: 192767 - protein, 12 aa, Mycobacterium bovis
KMPSQTPPEPPT

SEQ ID NO: 192768 - protein, 11 aa, Mycobacterium bovis
KNTRPTSETAE

SEQ ID NO: 192769 - protein, 5 aa, Mycobacterium bovis
KPEAI

SEQ ID NO: 192770 - protein, 7 aa, Mycobacterium bovis
KPELDRD

SEQ ID NO: 192771 - protein, 11 aa, Mycobacterium bovis
KPISPTKTRTR

SEQ ID NO: 192772 - protein, 4 aa, Mycobacterium bovis
KPVA

SEQ ID NO: 192773 - protein, 7 aa, Mycobacterium bovis
KRHWPTS

SEQ ID NO: 192774 - protein, 8 aa, Mycobacterium bovis
KRSPELSH

SEQ ID NO: 192775 - protein, 5 aa, Mycobacterium bovis
KSAVM

SEQ ID NO: 192776 - protein, 9 aa, Mycobacterium bovis
KSPPARARR

SEQ ID NO: 192777 - protein, 4 aa, Mycobacterium bovis
KSYP

SEQ ID NO: 192778 - protein, 6 aa, Mycobacterium bovis
KTHADS

SEQ ID NO: 192779 - protein, 8 aa, Mycobacterium bovis
KTSDDGMD

SEQ ID NO: 192780 - protein, 7 aa, Mycobacterium bovis
KTTDADI

SEQ ID NO: 192781 - protein, 10 aa, Mycobacterium bovis
KVDPAADPAV

SEQ ID NO: 192782 - protein, 5 aa, Mycobacterium bovis
KYPDD

SEQ ID NO: 192783 - protein, 5 aa, Mycobacterium bovis
KYRDT

SEQ ID NO: 192784 - protein, 8 aa, Mycobacterium bovis
LAGDDESN

SEQ ID NO: 192785 - protein, 5 aa, Mycobacterium bovis
LANGR

SEQ ID NO: 192786 - protein, 8 aa, Mycobacterium bovis
LAQEKTGE

SEQ ID NO: 192787 - protein, 7 aa, Mycobacterium bovis
LASRGVP

SEQ ID NO: 192788 - protein, 12 aa, Mycobacterium bovis
LATDPQARQRRE

SEQ ID NO: 192789 - protein, 9 aa, Mycobacterium bovis
LDPDEPTYD

SEQ ID NO: 192790 - protein, 8 aa, Mycobacterium bovis
LDPGAGEN

SEQ ID NO: 192791 - protein, 6 aa, Mycobacterium bovis
LDPGKL

SEQ ID NO: 192792 - protein, 13 aa, Mycobacterium bovis
LDPTGYLNAAVLF

SEQ ID NO: 192793 - protein, 5 aa, Mycobacterium bovis
LDSEG

SEQ ID NO: 192794 - protein, 9 aa, Mycobacterium bovis
LDSSTADFN

SEQ ID NO: 192795 - protein, 4 aa, Mycobacterium bovis
LEGD

SEQ ID NO: 192796 - protein, 18 aa, Mycobacterium bovis
LEGTGEVQTPLSGDAARR

SEQ ID NO: 192797 - protein, 6 aa, Mycobacterium bovis
LENRNP

SEQ ID NO: 192798 - protein, 23 aa, Mycobacterium bovis
LEPQAAPAPFEPPTAGSSLPTRI

SEQ ID NO: 192799 - protein, 15 aa, Mycobacterium bovis
LESKKISKTQAVTSN

SEQ ID NO: 192800 - protein, 6 aa, Mycobacterium bovis
LFDPDS

SEQ ID NO: 192801 - protein, 4 aa, Mycobacterium bovis
LGEE

SEQ ID NO: 192802 - protein, 5 aa, Mycobacterium bovis
LGESA

SEQ ID NO: 192803 - protein, 182 aa, Mycobacterium bovis
LGNPGLDGGTGGNGGAGGSGGAWAGNGGTGGAGGTGGVGGTGGSGSDGVNGSSAGADGHPGGTGGVGGTGGKGGDGGDGGAAPNGVAGSQGPGGAGGDGGTGGVGGNGGRGIDGADGATAGARGQDGGAGGAGGKGGRGGTGGPGGAGPAGTTGSQGAGGNGGSGGTGGDPGDGGNGANGSV

SEQ ID NO: 192804 - protein, 6 aa, Mycobacterium bovis
LGPART

SEQ ID NO: 192805 - protein, 11 aa, Mycobacterium bovis
LGRAPSTVSRE

SEQ ID NO: 192806 - protein, 4 aa, Mycobacterium bovis
LGTT

SEQ ID NO: 192807 - protein, 21 aa, Mycobacterium bovis
LKASNAAAAVPTTGVVPPAAD

SEQ ID NO: 192808 - protein, 8 aa, Mycobacterium bovis
LKKDTAEA

SEQ ID NO: 192809 - protein, 9 aa, Mycobacterium bovis
LNDNNSRSK

SEQ ID NO: 192810 - protein, 7 aa, Mycobacterium bovis
LNPRTRE

SEQ ID NO: 192811 - protein, 10 aa, Mycobacterium bovis
LNTPADNDHQ

SEQ ID NO: 192812 - protein, 9 aa, Mycobacterium bovis
LNVNGSSLA

SEQ ID NO: 192813 - protein, 6 aa, Mycobacterium bovis
LPDRQR

SEQ ID NO: 192814 - protein, 6 aa, Mycobacterium bovis
LPEDEQ

SEQ ID NO: 192815 - protein, 6 aa, Mycobacterium bovis
LPGGDT

SEQ ID NO: 192816 - protein, 6 aa, Mycobacterium bovis
LPGPRL

SEQ ID NO: 192817 - protein, 9 aa, Mycobacterium bovis
LPLGTPKQR

SEQ ID NO: 192818 - protein, 12 aa, Mycobacterium bovis
LPPDPASRDICG

SEQ ID NO: 192819 - protein, 7 aa, Mycobacterium bovis
LPPNPDT

SEQ ID NO: 192820 - protein, 6 aa, Mycobacterium bovis
LPRAGT

SEQ ID NO: 192821 - protein, 10 aa, Mycobacterium bovis
LQKTPKSLPP

SEQ ID NO: 192822 - protein, 15 aa, Mycobacterium bovis
LRAAAAGSFEQASDH

SEQ ID NO: 192823 - protein, 4 aa, Mycobacterium bovis
LRQE

SEQ ID NO: 192824 - protein, 11 aa, Mycobacterium bovis
LRRGKDRRKVH

SEQ ID NO: 192825 - protein, 7 aa, Mycobacterium bovis
LSDPSGY

SEQ ID NO: 192826 - protein, 7 aa, Mycobacterium bovis
LSEERKV

SEQ ID NO: 192827 - protein, 29 aa, Mycobacterium bovis
LSPPSQTTKPGGLAAQSAAVGSAAATAAV

SEQ ID NO: 192828 - protein, 7 aa, Mycobacterium bovis
LSPTRPV

SEQ ID NO: 192829 - protein, 19 aa, Mycobacterium bovis
LSRARGAAAEALTGYREPK

SEQ ID NO: 192830 - protein, 6 aa, Mycobacterium bovis
LSSPID

SEQ ID NO: 192831 - protein, 9 aa, Mycobacterium bovis
LSTPPTLAQ

SEQ ID NO: 192832 - protein, 56 aa, Mycobacterium bovis
LTARGGSAPTPAAAAPAGAGGAGPAATRPAAQQTPAVPAAAAGSAIPGLPPGLPPG

SEQ ID NO: 192833 - protein, 9 aa, Mycobacterium bovis
LTEAERTGL

SEQ ID NO: 192834 - protein, 5 aa, Mycobacterium bovis
LTGTH

SEQ ID NO: 192835 - protein, 10 aa, Mycobacterium bovis
LTSRPGGGGW

SEQ ID NO: 192836 - protein, 11 aa, Mycobacterium bovis
LVPEDRAGDHA

SEQ ID NO: 192837 - protein, 38 aa, Mycobacterium bovis
MAAPGAAVASAAAPASAPAASTVASATPAPPPAPGAAG

SEQ ID NO: 192838 - protein, 14 aa, Mycobacterium bovis
MEGSPEGHNFPQSQ

SEQ ID NO: 192839 - protein, 11 aa, Mycobacterium bovis
MEPKSAATEAY

SEQ ID NO: 192840 - protein, 18 aa, Mycobacterium bovis
MGEQDPGATPSGSPIVTV

SEQ ID NO: 192841 - protein, 11 aa, Mycobacterium bovis
MGGDGGDGGEA

SEQ ID NO: 192842 - protein, 4 aa, Mycobacterium bovis
MHGP

SEQ ID NO: 192843 - protein, 4 aa, Mycobacterium bovis
MKTG

SEQ ID NO: 192844 - protein, 7 aa, Mycobacterium bovis
MPTGREE

SEQ ID NO: 192845 - protein, 6 aa, Mycobacterium bovis
MPTRED

SEQ ID NO: 192846 - protein, 4 aa, Mycobacterium bovis
MRSG

SEQ ID NO: 192847 - protein, 7 aa, Mycobacterium bovis
MSGTDSN

SEQ ID NO: 192848 - protein, 94 aa, Mycobacterium bovis
MTANSPAGSPFGAAPSAPSHSTTTSGPPTAPTPTSPFGTAPMPPGPPPPGTVSPPLPPSAPAVGVGGPSVPAAGMPPAAAAATAPLSPQSLGQS

SEQ ID NO: 192849 - protein, 13 aa, Mycobacterium bovis
NAAHGATSSEITP

SEQ ID NO: 192850 - protein, 8 aa, Mycobacterium bovis
NADGSAAQ

SEQ ID NO: 192851 - protein, 5 aa, Mycobacterium bovis
NADGT

SEQ ID NO: 192852 - protein, 14 aa, Mycobacterium bovis
NAGNLAAANPTTAV

SEQ ID NO: 192853 - protein, 7 aa, Mycobacterium bovis
NAGSGIN

SEQ ID NO: 192854 - protein, 9 aa, Mycobacterium bovis
NAPASTSPL

SEQ ID NO: 192855 - protein, 12 aa, Mycobacterium bovis
NARRAHAPTRTS

SEQ ID NO: 192856 - protein, 4 aa, Mycobacterium bovis
NAST

SEQ ID NO: 192857 - protein, 6 aa, Mycobacterium bovis
NDPTEL

SEQ ID NO: 192858 - protein, 11 aa, Mycobacterium bovis
NDRANATATRL

SEQ ID NO: 192859 - protein, 9 aa, Mycobacterium bovis
NEDGQYAYY

SEQ ID NO: 192860 - protein, 8 aa, Mycobacterium bovis
NEHTPGIS

SEQ ID NO: 192861 - protein, 7 aa, Mycobacterium bovis
NESRTAK

SEQ ID NO: 192862 - protein, 64 aa, Mycobacterium bovis
NETTGRDGGDGGDGGYGGWGGAGGNGGAGGSAPAGEVGNRGVGGDGGDGGSGGDAGNGGLGGDG

SEQ ID NO: 192863 - protein, 15 aa, Mycobacterium bovis
NGADGTAANPNGQAG

SEQ ID NO: 192864 - protein, 4 aa, Mycobacterium bovis
NGDV

SEQ ID NO: 192865 - protein, 5 aa, Mycobacterium bovis
NGEGI

SEQ ID NO: 192866 - protein, 20 aa, Mycobacterium bovis
NGGAGGAGGFGANGGTGGNG

SEQ ID NO: 192867 - protein, 14 aa, Mycobacterium bovis
NGGAGGAGSAGTGV

SEQ ID NO: 192868 - protein, 52 aa, Mycobacterium bovis
NGGAGGSGAAGVNGGAGGNGGAGGLIGNGGAGGAGGRASTGTGGAGGAGGAA

SEQ ID NO: 192869 - protein, 25 aa, Mycobacterium bovis
NGGAGGSGGLGGDAGTGGAGGNGGL

SEQ ID NO: 192870 - protein, 14 aa, Mycobacterium bovis
NGGAGGSGGPTQIP

SEQ ID NO: 192871 - protein, 10 aa, Mycobacterium bovis
NGGAGGSGGS

SEQ ID NO: 192872 - protein, 70 aa, Mycobacterium bovis
NGGAGGVGGTAGAGGTGGSGGAGGAGGAGGGGTNSGPGAAFGGNGNTGGNGGNGGAPGALGGKGGSGGLI

SEQ ID NO: 192873 - protein, 9 aa, Mycobacterium bovis
NGGGPRGTD

SEQ ID NO: 192874 - protein, 22 aa, Mycobacterium bovis
NGGNGGNGGKAGGTPGAGGTSG

SEQ ID NO: 192875 - protein, 23 aa, Mycobacterium bovis
NGGNGGSGATGTNGGDGGDGGAG

SEQ ID NO: 192876 - protein, 20 aa, Mycobacterium bovis
NGGNGGSGGIGAGKAGVGGV

SEQ ID NO: 192877 - protein, 13 aa, Mycobacterium bovis
NGGVGGSGGNATL

SEQ ID NO: 192878 - protein, 14 aa, Mycobacterium bovis
NGNVGFGNSGLGAG

SEQ ID NO: 192879 - protein, 4 aa, Mycobacterium bovis
NGPA

SEQ ID NO: 192880 - protein, 12 aa, Mycobacterium bovis
NGRGTRRGRTAG

SEQ ID NO: 192881 - protein, 8 aa, Mycobacterium bovis
NGSLAGGT

SEQ ID NO: 192882 - protein, 5 aa, Mycobacterium bovis
NGSPY

SEQ ID NO: 192883 - protein, 10 aa, Mycobacterium bovis
NGTANGKAAL

SEQ ID NO: 192884 - protein, 7 aa, Mycobacterium bovis
NGTTVAA

SEQ ID NO: 192885 - protein, 7 aa, Mycobacterium bovis
NHAEPKQ

SEQ ID NO: 192886 - protein, 6 aa, Mycobacterium bovis
NIEEGG

SEQ ID NO: 192887 - protein, 4 aa, Mycobacterium bovis
NMNE

SEQ ID NO: 192888 - protein, 9 aa, Mycobacterium bovis
NNPTSTVVG

SEQ ID NO: 192889 - protein, 11 aa, Mycobacterium bovis
NPAAEQPAATL

SEQ ID NO: 192890 - protein, 8 aa, Mycobacterium bovis
NPEDPGSA

SEQ ID NO: 192891 - protein, 4 aa, Mycobacterium bovis
NPGL

SEQ ID NO: 192892 - protein, 13 aa, Mycobacterium bovis
NPLRDKRDKRLPR

SEQ ID NO: 192893 - protein, 5 aa, Mycobacterium bovis
NPRAR

SEQ ID NO: 192894 - protein, 4 aa, Mycobacterium bovis
NPRY

SEQ ID NO: 192895 - protein, 20 aa, Mycobacterium bovis
NPSPPGEDGRGRNTTIKERQ

SEQ ID NO: 192896 - protein, 6 aa, Mycobacterium bovis
NPTNTA

SEQ ID NO: 192897 - protein, 5 aa, Mycobacterium bovis
NQPGV

SEQ ID NO: 192898 - protein, 7 aa, Mycobacterium bovis
NRGTDAL

SEQ ID NO: 192899 - protein, 7 aa, Mycobacterium bovis
NRLDTAG

SEQ ID NO: 192900 - protein, 8 aa, Mycobacterium bovis
NRLRTKDS

SEQ ID NO: 192901 - protein, 47 aa, Mycobacterium bovis
NSAAQARKAVGTGVRKKTPEPDSAEAPAAAAAPEEQVQPQRRRRPKI

SEQ ID NO: 192902 - protein, 22 aa, Mycobacterium bovis
NSAQRDARNSRDESARASDTDR

SEQ ID NO: 192903 - protein, 9 aa, Mycobacterium bovis
NSDAQRSDA

SEQ ID NO: 192904 - protein, 21 aa, Mycobacterium bovis
NSPDSTPSATSPAPAPSPTPP

SEQ ID NO: 192905 - protein, 10 aa, Mycobacterium bovis
NSQPAQRTRH

SEQ ID NO: 192906 - protein, 8 aa, Mycobacterium bovis
NTGHRGQR

SEQ ID NO: 192907 - protein, 8 aa, Mycobacterium bovis
NTPTDTIS

SEQ ID NO: 192908 - protein, 4 aa, Mycobacterium bovis
NTRM

SEQ ID NO: 192909 - protein, 9 aa, Mycobacterium bovis
NTSGQPDPD

SEQ ID NO: 192910 - protein, 7 aa, Mycobacterium bovis
NTSTGTT

SEQ ID NO: 192911 - protein, 9 aa, Mycobacterium bovis
NTTTPARTA

SEQ ID NO: 192912 - protein, 4 aa, Mycobacterium bovis
NYSG

SEQ ID NO: 192913 - protein, 7 aa, Mycobacterium bovis
PAADPVS

SEQ ID NO: 192914 - protein, 7 aa, Mycobacterium bovis
PAEATGA

SEQ ID NO: 192915 - protein, 4 aa, Mycobacterium bovis
PAFA

SEQ ID NO: 192916 - protein, 4 aa, Mycobacterium bovis
PAFG

SEQ ID NO: 192917 - protein, 9 aa, Mycobacterium bovis
PAGAGPELE

SEQ ID NO: 192918 - protein, 5 aa, Mycobacterium bovis
PAGPA

SEQ ID NO: 192919 - protein, 7 aa, Mycobacterium bovis
PAGTPTM

SEQ ID NO: 192920 - protein, 22 aa, Mycobacterium bovis
PAGTTAATAVGEAGLPRRGTPD

SEQ ID NO: 192921 - protein, 6 aa, Mycobacterium bovis
PALRSG

SEQ ID NO: 192922 - protein, 7 aa, Mycobacterium bovis
PANDPNT

SEQ ID NO: 192923 - protein, 15 aa, Mycobacterium bovis
PAPDRLEHDADEAWR

SEQ ID NO: 192924 - protein, 5 aa, Mycobacterium bovis
PAPTA

SEQ ID NO: 192925 - protein, 11 aa, Mycobacterium bovis
PASNRRLTDYD

SEQ ID NO: 192926 - protein, 6 aa, Mycobacterium bovis
PATQRD

SEQ ID NO: 192927 - protein, 4 aa, Mycobacterium bovis
PAVN

SEQ ID NO: 192928 - protein, 16 aa, Mycobacterium bovis
PAVTEPPQPIPFSGPA

SEQ ID NO: 192929 - protein, 7 aa, Mycobacterium bovis
PCRATTA

SEQ ID NO: 192930 - protein, 15 aa, Mycobacterium bovis
PDAASRGVVDAPEDA

SEQ ID NO: 192931 - protein, 7 aa, Mycobacterium bovis
PDADGVL

SEQ ID NO: 192932 - protein, 21 aa, Mycobacterium bovis
PDAPPGTERFGPQPAQPAAGP

SEQ ID NO: 192933 - protein, 9 aa, Mycobacterium bovis
PDDAAHSEW

SEQ ID NO: 192934 - protein, 6 aa, Mycobacterium bovis
PDDHTV

SEQ ID NO: 192935 - protein, 4 aa, Mycobacterium bovis
PDGG

SEQ ID NO: 192936 - protein, 8 aa, Mycobacterium bovis
PDGPPGVS

SEQ ID NO: 192937 - protein, 4 aa, Mycobacterium bovis
PDGS

SEQ ID NO: 192938 - protein, 8 aa, Mycobacterium bovis
PDLPGPLS

SEQ ID NO: 192939 - protein, 19 aa, Mycobacterium bovis
PDPVVSTTTPDDADAAAAG

SEQ ID NO: 192940 - protein, 9 aa, Mycobacterium bovis
PDQPQPYGE

SEQ ID NO: 192941 - protein, 9 aa, Mycobacterium bovis
PDRDPRSCS

SEQ ID NO: 192942 - protein, 7 aa, Mycobacterium bovis
PDRESEL

SEQ ID NO: 192943 - protein, 8 aa, Mycobacterium bovis
PDSKSSKS

SEQ ID NO: 192944 - protein, 6 aa, Mycobacterium bovis
PDSPEA

SEQ ID NO: 192945 - protein, 5 aa, Mycobacterium bovis
PDSSS

SEQ ID NO: 192946 - protein, 23 aa, Mycobacterium bovis
PDWGPPPGEDPVTSTVASDRGAG

SEQ ID NO: 192947 - protein, 4 aa, Mycobacterium bovis
PDYE

SEQ ID NO: 192948 - protein, 9 aa, Mycobacterium bovis
PEGACPGPF

SEQ ID NO: 192949 - protein, 4 aa, Mycobacterium bovis
PENV

SEQ ID NO: 192950 - protein, 4 aa, Mycobacterium bovis
PERI

SEQ ID NO: 192951 - protein, 5 aa, Mycobacterium bovis
PESAT

SEQ ID NO: 192952 - protein, 6 aa, Mycobacterium bovis
PETGER

SEQ ID NO: 192953 - protein, 14 aa, Mycobacterium bovis
PFSGIGKPEPLQGE

SEQ ID NO: 192954 - protein, 17 aa, Mycobacterium bovis
PFSTPEKAQRYQTENYR

SEQ ID NO: 192955 - protein, 5 aa, Mycobacterium bovis
PGAMP

SEQ ID NO: 192956 - protein, 10 aa, Mycobacterium bovis
PGARNAAPLQ

SEQ ID NO: 192957 - protein, 10 aa, Mycobacterium bovis
PGARRQIPTE

SEQ ID NO: 192958 - protein, 4 aa, Mycobacterium bovis
PGCG

SEQ ID NO: 192959 - protein, 5 aa, Mycobacterium bovis
PGFVG

SEQ ID NO: 192960 - protein, 7 aa, Mycobacterium bovis
PGGEPTR

SEQ ID NO: 192961 - protein, 13 aa, Mycobacterium bovis
PGLPEPAEQVDGR

SEQ ID NO: 192962 - protein, 15 aa, Mycobacterium bovis
PGLSQPSDVLPADDG

SEQ ID NO: 192963 - protein, 12 aa, Mycobacterium bovis
PGPEDGSVPVPV

SEQ ID NO: 192964 - protein, 28 aa, Mycobacterium bovis
PGPEPATSGKRAPLDESPRHEKLDGGAG

SEQ ID NO: 192965 - protein, 10 aa, Mycobacterium bovis
PGPSFPSYGS

SEQ ID NO: 192966 - protein, 10 aa, Mycobacterium bovis
PGQTAELYPG

SEQ ID NO: 192967 - protein, 10 aa, Mycobacterium bovis
PGSDPIPRRS

SEQ ID NO: 192968 - protein, 9 aa, Mycobacterium bovis
PGVESNDGD

SEQ ID NO: 192969 - protein, 4 aa, Mycobacterium bovis
PHGN

SEQ ID NO: 192970 - protein, 4 aa, Mycobacterium bovis
PHIP

SEQ ID NO: 192971 - protein, 5 aa, Mycobacterium bovis
PHPVG

SEQ ID NO: 192972 - protein, 7 aa, Mycobacterium bovis
PHTRTQD

SEQ ID NO: 192973 - protein, 5 aa, Mycobacterium bovis
PIDAR

SEQ ID NO: 192974 - protein, 13 aa, Mycobacterium bovis
PITDDDATNPLTE

SEQ ID NO: 192975 - protein, 4 aa, Mycobacterium bovis
PKLE

SEQ ID NO: 192976 - protein, 7 aa, Mycobacterium bovis
PKPRGWS

SEQ ID NO: 192977 - protein, 7 aa, Mycobacterium bovis
PKYPNDP

SEQ ID NO: 192978 - protein, 8 aa, Mycobacterium bovis
PLDESDRR

SEQ ID NO: 192979 - protein, 5 aa, Mycobacterium bovis
PLHKG

SEQ ID NO: 192980 - protein, 18 aa, Mycobacterium bovis
PLPTGPDAAPACPTGGAG

SEQ ID NO: 192981 - protein, 16 aa, Mycobacterium bovis
PLTDDQRTQVEEVTNE

SEQ ID NO: 192982 - protein, 5 aa, Mycobacterium bovis
PNAAP

SEQ ID NO: 192983 - protein, 19 aa, Mycobacterium bovis
PNEPDYPPPPGGPPPPADI

SEQ ID NO: 192984 - protein, 5 aa, Mycobacterium bovis
PNGDL

SEQ ID NO: 192985 - protein, 7 aa, Mycobacterium bovis
PPDREPA

SEQ ID NO: 192986 - protein, 4 aa, Mycobacterium bovis
PPGA

SEQ ID NO: 192987 - protein, 4 aa, Mycobacterium bovis
PPGI

SEQ ID NO: 192988 - protein, 8 aa, Mycobacterium bovis
PPGQSGQL

SEQ ID NO: 192989 - protein, 4 aa, Mycobacterium bovis
PPQG

SEQ ID NO: 192990 - protein, 5 aa, Mycobacterium bovis
PPSLL

SEQ ID NO: 192991 - protein, 5 aa, Mycobacterium bovis
PPSRT

SEQ ID NO: 192992 - protein, 6 aa, Mycobacterium bovis
PPTDRA

SEQ ID NO: 192993 - protein, 10 aa, Mycobacterium bovis
PPTLPARSSM

SEQ ID NO: 192994 - protein, 15 aa, Mycobacterium bovis
PPTPGIGNTTTVPSS

SEQ ID NO: 192995 - protein, 4 aa, Mycobacterium bovis
PQDP

SEQ ID NO: 192996 - protein, 5 aa, Mycobacterium bovis
PQPGW

SEQ ID NO: 192997 - protein, 8 aa, Mycobacterium bovis
PQRTGDPL

SEQ ID NO: 192998 - protein, 4 aa, Mycobacterium bovis
PQTR

SEQ ID NO: 192999 - protein, 18 aa, Mycobacterium bovis
PQYSNPEPAGTATITGYR

SEQ ID NO: 193000 - protein, 54 aa, Mycobacterium bovis; identical to SEQ ID NO: 155741

SEQ ID NO: 193001 - protein, 8 aa, Mycobacterium bovis
PRENGREA

SEQ ID NO: 193002 - protein, 5 aa, Mycobacterium bovis
PRNQA

SEQ ID NO: 193003 - protein, 14 aa, Mycobacterium bovis
PRRGDTPGLSSTAA

SEQ ID NO: 193004 - protein, 12 aa, Mycobacterium bovis
PRRQDTSRRAAQ

SEQ ID NO: 193005 - protein, 8 aa, Mycobacterium bovis
PRRRTDRR

SEQ ID NO: 193006 - protein, 11 aa, Mycobacterium bovis
PRWDDGRDGPH

SEQ ID NO: 193007 - protein, 17 aa, Mycobacterium bovis
PSGTRGNGKLSMRRQSE

SEQ ID NO: 193008 - protein, 4 aa, Mycobacterium bovis
PSQP

SEQ ID NO: 193009 - protein, 15 aa, Mycobacterium bovis
PSRTAGRAAAGGHPC

SEQ ID NO: 193010 - protein, 22 aa, Mycobacterium bovis
PTGPADGESGPPTLGPRMGSAT

SEQ ID NO: 193011 - protein, 4 aa, Mycobacterium bovis
PTGR

SEQ ID NO: 193012 - protein, 10 aa, Mycobacterium bovis
PTGTRCGTRH

SEQ ID NO: 193013 - protein, 9 aa, Mycobacterium bovis
PTLSSKQKW

SEQ ID NO: 193014 - protein, 5 aa, Mycobacterium bovis
PTPSH

SEQ ID NO: 193015 - protein, 5 aa, Mycobacterium bovis
PTRRF

SEQ ID NO: 193016 - protein, 12 aa, Mycobacterium bovis
PTRSHTGAAQGG

SEQ ID NO: 193017 - protein, 11 aa, Mycobacterium bovis
PTSVADDFTRP

SEQ ID NO: 193018 - protein, 6 aa, Mycobacterium bovis
PVAGSR

SEQ ID NO: 193019 - protein, 5 aa, Mycobacterium bovis
PVASP

SEQ ID NO: 193020 - protein, 10 aa, Mycobacterium bovis
PVASRVNGKV

SEQ ID NO: 193021 - protein, 5 aa, Mycobacterium bovis
PVATP

SEQ ID NO: 193022 - protein, 5 aa, Mycobacterium bovis
PVPDK

SEQ ID NO: 193023 - protein, 13 aa, Mycobacterium bovis
PVSGGAAAAAKGE

SEQ ID NO: 193024 - protein, 10 aa, Mycobacterium bovis
PVVPGANDNL

SEQ ID NO: 193025 - protein, 10 aa, Mycobacterium bovis
QADTAAARQA

SEQ ID NO: 193026 - protein, 5 aa, Mycobacterium bovis
QAEQI

SEQ ID NO: 193027 - protein, 4 aa, Mycobacterium bovis
QAND

SEQ ID NO: 193028 - protein, 4 aa, Mycobacterium bovis
QANP

SEQ ID NO: 193029 - protein, 4 aa, Mycobacterium bovis
QATV

SEQ ID NO: 193030 - protein, 5 aa, Mycobacterium bovis
QDELA

SEQ ID NO: 193031 - protein, 7 aa, Mycobacterium bovis
QDGRSIQ

SEQ ID NO: 193032 - protein, 24 aa, Mycobacterium bovis
QDKGYAVPDYPADPNTDQEKAIKE

SEQ ID NO: 193033 - protein, 5 aa, Mycobacterium bovis
QDLTG

SEQ ID NO: 193034 - protein, 7 aa, Mycobacterium bovis
QDRDLGN

SEQ ID NO: 193035 - protein, 6 aa, Mycobacterium bovis
QDRTGG

SEQ ID NO: 193036 - protein, 8 aa, Mycobacterium bovis
QDTSATCP

SEQ ID NO: 193037 - protein, 17 aa, Mycobacterium bovis
QFRRGKPSPLKAAADEA

SEQ ID NO: 193038 - protein, 12 aa, Mycobacterium bovis
QFRTSGDTIAAN

SEQ ID NO: 193039 - protein, 5 aa, Mycobacterium bovis
QFTTP

SEQ ID NO: 193040 - protein, 9 aa, Mycobacterium bovis
QGAAWTPAD

SEQ ID NO: 193041 - protein, 9 aa, Mycobacterium bovis
QGERRAAYN

SEQ ID NO: 193042 - protein, 6 aa, Mycobacterium bovis
QGGRTS

SEQ ID NO: 193043 - protein, 10 aa, Mycobacterium bovis
QGHPQRKDYP

SEQ ID NO: 193044 - protein, 10 aa, Mycobacterium bovis
QGIANTGNNN

SEQ ID NO: 193045 - protein, 15 aa, Mycobacterium bovis
QGNPAQQRYPPWPAS

SEQ ID NO: 193046 - protein, 6 aa, Mycobacterium bovis
QGNSIT

SEQ ID NO: 193047 - protein, 7 aa, Mycobacterium bovis
QGPELAP

SEQ ID NO: 193048 - protein, 9 aa, Mycobacterium bovis
QGRDTSGRL

SEQ ID NO: 193049 - protein, 9 aa, Mycobacterium bovis
QGYSDSQGI

SEQ ID NO: 193050 - protein, 16 aa, Mycobacterium bovis
QHESRQARCGEAEPSN

SEQ ID NO: 193051 - protein, 23 aa, Mycobacterium bovis
QHSAGACSDTLATGGTVELQEIR

SEQ ID NO: 193052 - protein, 5 aa, Mycobacterium bovis
QIAAS

SEQ ID NO: 193053 - protein, 11 aa, Mycobacterium bovis
QKKKAQDEYGA

SEQ ID NO: 193054 - protein, 6 aa, Mycobacterium bovis
QLAGPT

SEQ ID NO: 193055 - protein, 16 aa, Mycobacterium bovis
QLATGSWQGPASAAMT

SEQ ID NO: 193056 - protein, 11 aa, Mycobacterium bovis
QLDSTGPGQAI

SEQ ID NO: 193057 - protein, 5 aa, Mycobacterium bovis
QLVET

SEQ ID NO: 193058 - protein, 5 aa, Mycobacterium bovis
QMGAE

SEQ ID NO: 193059 - protein, 9 aa, Mycobacterium bovis
QNDPRSTYK

SEQ ID NO: 193060 - protein, 5 aa, Mycobacterium bovis
QNPYL

SEQ ID NO: 193061 - protein, 10 aa, Mycobacterium bovis
QNRASGAEIG

SEQ ID NO: 193062 - protein, 13 aa, Mycobacterium bovis
QNSGTAFSGAVQS

SEQ ID NO: 193063 - protein, 10 aa, Mycobacterium bovis
QPAVGQDDRG

SEQ ID NO: 193064 - protein, 14 aa, Mycobacterium bovis
QPPAGSFSPGGHDA

SEQ ID NO: 193065 - protein, 17 aa, Mycobacterium bovis
QPTDPRTLPPDAPDDRK

SEQ ID NO: 193066 - protein, 12 aa, Mycobacterium bovis
QQGNPPDAPQLA

SEQ ID NO: 193067 - protein, 7 aa, Mycobacterium bovis
QQNSAGR

SEQ ID NO: 193068 - protein, 9 aa, Mycobacterium bovis
QRESAPVDV

SEQ ID NO: 193069 - protein, 18 aa, Mycobacterium bovis
QRNSKTAGASVGDLATDP

SEQ ID NO: 193070 - protein, 9 aa, Mycobacterium bovis
QRPDSETDW

SEQ ID NO: 193071 - protein, 4 aa, Mycobacterium bovis
QRPN

SEQ ID NO: 193072 - protein, 15 aa, Mycobacterium bovis
QRPQPTDPAGTPCPH

SEQ ID NO: 193073 - protein, 6 aa, Mycobacterium bovis
QRRDHR

SEQ ID NO: 193074 - protein, 5 aa, Mycobacterium bovis
QRRSL

SEQ ID NO: 193075 - protein, 5 aa, Mycobacterium bovis
QRSSI

SEQ ID NO: 193076 - protein, 16 aa, Mycobacterium bovis
QSAARREWGQLFAHAA

SEQ ID NO: 193077 - protein, 8 aa, Mycobacterium bovis
QSAETTRV

SEQ ID NO: 193078 - protein, 4 aa, Mycobacterium bovis
QSGK

SEQ ID NO: 193079 - protein, 10 aa, Mycobacterium bovis
QSIPGPSNLG

SEQ ID NO: 193080 - protein, 6 aa, Mycobacterium bovis
QSSNGP

SEQ ID NO: 193081 - protein, 17 aa, Mycobacterium bovis
QTAPTSPNNQHRAATSI

SEQ ID NO: 193082 - protein, 22 aa, Mycobacterium bovis
QTIERTDADERVDDGTGSDTPK

SEQ ID NO: 193083 - protein, 6 aa, Mycobacterium bovis
QTPTPP

SEQ ID NO: 193084 - protein, 9 aa, Mycobacterium bovis
QTRDLSNEA

SEQ ID NO: 193085 - protein, 8 aa, Mycobacterium bovis
QTSDEVTV

SEQ ID NO: 193086 - protein, 6 aa, Mycobacterium bovis
QTSESL

SEQ ID NO: 193087 - protein, 5 aa, Mycobacterium bovis
QTSKT

SEQ ID NO: 193088 - protein, 6 aa, Mycobacterium bovis
QVETDS

SEQ ID NO: 193089 - protein, 5 aa, Mycobacterium bovis
QVHNE

SEQ ID NO: 193090 - protein, 6 aa, Mycobacterium bovis
QVPPDR

SEQ ID NO: 193091 - protein, 5 aa, Mycobacterium bovis
QVSGI

SEQ ID NO: 193092 - protein, 11 aa, Mycobacterium bovis
QYEHGRDTAPV

SEQ ID NO: 193093 - protein, 10 aa, Mycobacterium bovis
RAAGEPGEHK

SEQ ID NO: 193094 - protein, 7 aa, Mycobacterium bovis
RAAQTDW

SEQ ID NO: 193095 - protein, 10 aa, Mycobacterium bovis
RAATTAPAGV

SEQ ID NO: 193096 - protein, 4 aa, Mycobacterium bovis
RADD

SEQ ID NO: 193097 - protein, 5 aa, Mycobacterium bovis
RADEA

SEQ ID NO: 193098 - protein, 6 aa, Mycobacterium bovis
RAEPSV

SEQ ID NO: 193099 - protein, 6 aa, Mycobacterium bovis
RAGDGV

SEQ ID NO: 193100 - protein, 7 aa, Mycobacterium bovis
RAGDREA

SEQ ID NO: 193101 - protein, 7 aa, Mycobacterium bovis
RAGGRRP

SEQ ID NO: 193102 - protein, 32 aa, Mycobacterium bovis
RAGTAGGAGRGPVGGIGGAGGVGGAGGAAGAV

SEQ ID NO: 193103 - protein, 12 aa, Mycobacterium bovis
RAIKQGTELAAR

SEQ ID NO: 193104 - protein, 8 aa, Mycobacterium bovis
RAPGSTLA

SEQ ID NO: 193105 - protein, 15 aa, Mycobacterium bovis
RASGPDSGGKARFVP

SEQ ID NO: 193106 - protein, 12 aa, Mycobacterium bovis
RASHDASEGKHN

SEQ ID NO: 193107 - protein, 9 aa, Mycobacterium bovis
RATGAAEAI

SEQ ID NO: 193108 - protein, 8 aa, Mycobacterium bovis
RAVPPYES

SEQ ID NO: 193109 - protein, 9 aa, Mycobacterium bovis
RDERTDNAG

SEQ ID NO: 193110 - protein, 12 aa, Mycobacterium bovis
RDESDRHGDGPL

SEQ ID NO: 193111 - protein, 8 aa, Mycobacterium bovis
RDGEWTTN

SEQ ID NO: 193112 - protein, 4 aa, Mycobacterium bovis
RDPN

SEQ ID NO: 193113 - protein, 6 aa, Mycobacterium bovis
RDPRDA

SEQ ID NO: 193114 - protein, 16 aa, Mycobacterium bovis
RDRDEQRPVLSRRTDD

SEQ ID NO: 193115 - protein, 5 aa, Mycobacterium bovis
RDSDE

SEQ ID NO: 193116 - protein, 5 aa, Mycobacterium bovis
RDTED

SEQ ID NO: 193117 - protein, 5 aa, Mycobacterium bovis
RDVAA

SEQ ID NO: 193118 - protein, 12 aa, Mycobacterium bovis
REAAATANRAGV

SEQ ID NO: 193119 - protein, 4 aa, Mycobacterium bovis
REEE

SEQ ID NO: 193120 - protein, 4 aa, Mycobacterium bovis
REEY

SEQ ID NO: 193121 - protein, 7 aa, Mycobacterium bovis
REGGHSR

SEQ ID NO: 193122 - protein, 8 aa, Mycobacterium bovis
RELRNNTA

SEQ ID NO: 193123 - protein, 4 aa, Mycobacterium bovis
REPP

SEQ ID NO: 193124 - protein, 5 aa, Mycobacterium bovis
RERPV

SEQ ID NO: 193125 - protein, 7 aa, Mycobacterium bovis
RETGYTR

SEQ ID NO: 193126 - protein, 6 aa, Mycobacterium bovis
RFPDPK

SEQ ID NO: 193127 - protein, 9 aa, Mycobacterium bovis
RGAPGGPQH

SEQ ID NO: 193128 - protein, 24 aa, Mycobacterium bovis
RGATAPRPADAASPSCGSSPSADS

SEQ ID NO: 193129 - protein, 7 aa, Mycobacterium bovis
RGDHPNH

SEQ ID NO: 193130 - protein, 9 aa, Mycobacterium bovis
RGDQKNASL

SEQ ID NO: 193131 - protein, 7 aa, Mycobacterium bovis
RGDTTPM

SEQ ID NO: 193132 - protein, 8 aa, Mycobacterium bovis
RGEQPGPM

SEQ ID NO: 193133 - protein, 4 aa, Mycobacterium bovis
RGGL

SEQ ID NO: 193134 - protein, 5 aa, Mycobacterium bovis
RGGVG

SEQ ID NO: 193135 - protein, 6 aa, Mycobacterium bovis
RGGVRG

SEQ ID NO: 193136 - protein, 35 aa, Mycobacterium bovis
RGHRNRTRRPRVSGRLGGPPHGQVGRAGRQNPRRR

SEQ ID NO: 193137 - protein, 13 aa, Mycobacterium bovis
RGSTATSSSETIT

SEQ ID NO: 193138 - protein, 12 aa, Mycobacterium bovis
RGTVNPDVETHP

SEQ ID NO: 193139 - protein, 8 aa, Mycobacterium bovis
RGWETDGG

SEQ ID NO: 193140 - protein, 5 aa, Mycobacterium bovis
RHGGT

SEQ ID NO: 193141 - protein, 6 aa, Mycobacterium bovis
RHPGTS

SEQ ID NO: 193142 - protein, 7 aa, Mycobacterium bovis
RITSPDE

SEQ ID NO: 193143 - protein, 7 aa, Mycobacterium bovis
RKDGVEA

SEQ ID NO: 193144 - protein, 6 aa, Mycobacterium bovis
RKEGNR

SEQ ID NO: 193145 - protein, 13 aa, Mycobacterium bovis
RKPKDLSGGQRQR

SEQ ID NO: 193146 - protein, 4 aa, Mycobacterium bovis
RKTK

SEQ ID NO: 193147 - protein, 8 aa, Mycobacterium bovis
RLADEGIG

SEQ ID NO: 193148 - protein, 6 aa, Mycobacterium bovis
RLATSS

SEQ ID NO: 193149 - protein, 29 aa, Mycobacterium bovis
RLDKPGGGLSGGSSSGCASHGQSPCNPTC

SEQ ID NO: 193150 - protein, 4 aa, Mycobacterium bovis
RLDP

SEQ ID NO: 193151 - protein, 12 aa, Mycobacterium bovis
RLGGSDEADHDR

SEQ ID NO: 193152 - protein, 6 aa, Mycobacterium bovis
RLSDSP

SEQ ID NO: 193153 - protein, 7 aa, Mycobacterium bovis
RNGTRLD

SEQ ID NO: 193154 - protein, 6 aa, Mycobacterium bovis
RNTPGV

SEQ ID NO: 193155 - protein, 7 aa, Mycobacterium bovis
RNTTRDE

SEQ ID NO: 193156 - protein, 4 aa, Mycobacterium bovis
RNTV

SEQ ID NO: 193157 - protein, 10 aa, Mycobacterium bovis
RPADTGPATI

SEQ ID NO: 193158 - protein, 5 aa, Mycobacterium bovis
RPDGQ

SEQ ID NO: 193159 - protein, 10 aa, Mycobacterium bovis
RPGAKTVTAL

SEQ ID NO: 193160 - protein, 12 aa, Mycobacterium bovis
RPGIGASTPHQY

SEQ ID NO: 193161 - protein, 8 aa, Mycobacterium bovis
RPGRRRPR

SEQ ID NO: 193162 - protein, 4 aa, Mycobacterium bovis
RPHP

SEQ ID NO: 193163 - protein, 33 aa, Mycobacterium bovis
RPKTPRGDGNLHPESPYARNASNVSSDPKPREG

SEQ ID NO: 193164 - protein, 26 aa, Mycobacterium bovis
RPPGCSPTPAPTTKSATALSATAHRN

SEQ ID NO: 193165 - protein, 19 aa, Mycobacterium bovis
RPPQVKSPHRGPLRTGRTH

SEQ ID NO: 193166 - protein, 4 aa, Mycobacterium bovis
RPPV

SEQ ID NO: 193167 - protein, 7 aa, Mycobacterium bovis
RPQSNHA

SEQ ID NO: 193168 - protein, 20 aa, Mycobacterium bovis
RPSGSPGPPRTSASWSPSGA

SEQ ID NO: 193169 - protein, 22 aa, Mycobacterium bovis
RPSHGGYGIPPNGMTTSITPSI

SEQ ID NO: 193170 - protein, 7 aa, Mycobacterium bovis
RPTSEAE

SEQ ID NO: 193171 - protein, 5 aa, Mycobacterium bovis
RQAEP

SEQ ID NO: 193172 - protein, 7 aa, Mycobacterium bovis
RQEDADA

SEQ ID NO: 193173 - protein, 9 aa, Mycobacterium bovis
RQLPGEGVT

SEQ ID NO: 193174 - protein, 4 aa, Mycobacterium bovis
RRAA

SEQ ID NO: 193175 - protein, 7 aa, Mycobacterium bovis
RRAPGPS

SEQ ID NO: 193176 - protein, 4 aa, Mycobacterium bovis
RREH

SEQ ID NO: 193177 - protein, 4 aa, Mycobacterium bovis
RREP

SEQ ID NO: 193178 - protein, 8 aa, Mycobacterium bovis
RRGARFST

SEQ ID NO: 193179 - protein, 5 aa, Mycobacterium bovis
RRGDR

SEQ ID NO: 193180 - protein, 9 aa, Mycobacterium bovis
RRGWGSGGA

SEQ ID NO: 193181 - protein, 9 aa, Mycobacterium bovis
RRKRMSKKK

SEQ ID NO: 193182 - protein, 9 aa, Mycobacterium bovis
RRLSPQDRR

SEQ ID NO: 193183 - protein, 12 aa, Mycobacterium bovis
RRNSRRDGQYRP

SEQ ID NO: 193184 - protein, 6 aa, Mycobacterium bovis
RRPVSV

SEQ ID NO: 193185 - protein, 9 aa, Mycobacterium bovis
RRRGGDPVS

SEQ ID NO: 193186 - protein, 17 aa, Mycobacterium bovis
RRRGRDSGHLGQPGPWG

SEQ ID NO: 193187 - protein, 5 aa, Mycobacterium bovis
RRRRA

SEQ ID NO: 193188 - protein, 6 aa, Mycobacterium bovis
RSAAEA

SEQ ID NO: 193189 - protein, 7 aa, Mycobacterium bovis
RSADDSH

SEQ ID NO: 193190 - protein, 12 aa, Mycobacterium bovis
RSDEQPKPTPGW

SEQ ID NO: 193191 - protein, 11 aa, Mycobacterium bovis
RSDGERSRRPR

SEQ ID NO: 193192 - protein, 5 aa, Mycobacterium bovis
RSGPL

SEQ ID NO: 193193 - protein, 14 aa, Mycobacterium bovis
RSGRDHSPASSGAG

SEQ ID NO: 193194 - protein, 9 aa, Mycobacterium bovis
RSHDGQLAT

SEQ ID NO: 193195 - protein, 6 aa, Mycobacterium bovis
RSNVDD

SEQ ID NO: 193196 - protein, 13 aa, Mycobacterium bovis
RSPDRDRAGQASI

SEQ ID NO: 193197 - protein, 7 aa, Mycobacterium bovis
RSQDPAV

SEQ ID NO: 193198 - protein, 7 aa, Mycobacterium bovis
RSRNSTD

SEQ ID NO: 193199 - protein, 6 aa, Mycobacterium bovis
RSSDTA

SEQ ID NO: 193200 - protein, 9 aa, Mycobacterium bovis
RSSGGDSGA

SEQ ID NO: 193201 - protein, 8 aa, Mycobacterium bovis
RSTDPDGR

SEQ ID NO: 193202 - protein, 7 aa, Mycobacterium bovis
RSTTPHH

SEQ ID NO: 193203 - protein, 4 aa, Mycobacterium bovis
RSVS

SEQ ID NO: 193204 - protein, 4 aa, Mycobacterium bovis
RSYR

SEQ ID NO: 193205 - protein, 6 aa, Mycobacterium bovis
RTDRNS

SEQ ID NO: 193206 - protein, 8 aa, Mycobacterium bovis
RTETPRTT

SEQ ID NO: 193207 - protein, 11 aa, Mycobacterium bovis
RTPAGGGDAHN

SEQ ID NO: 193208 - protein, 6 aa, Mycobacterium bovis
RTTDKP

SEQ ID NO: 193209 - protein, 12 aa, Mycobacterium bovis
RVAPAERCQTPQ

SEQ ID NO: 193210 - protein, 6 aa, Mycobacterium bovis
RVDQGR

SEQ ID NO: 193211 - protein, 11 aa, Mycobacterium bovis
RVGQPEPANMP

SEQ ID NO: 193212 - protein, 7 aa, Mycobacterium bovis
RVPDGED

SEQ ID NO: 193213 - protein, 10 aa, Mycobacterium bovis
RVTGLSGQRY

SEQ ID NO: 193214 - protein, 5 aa, Mycobacterium bovis
RVTPD

SEQ ID NO: 193215 - protein, 14 aa, Mycobacterium bovis
RYAPPPPYPAPDPF

SEQ ID NO: 193216 - protein, 6 aa, Mycobacterium bovis
RYPVSG

SEQ ID NO: 193217 - protein, 5 aa, Mycobacterium bovis
SAADH

SEQ ID NO: 193218 - protein, 9 aa, Mycobacterium bovis
SAAEPGAAG

SEQ ID NO: 193219 - protein, 4 aa, Mycobacterium bovis
SAAG

SEQ ID NO: 193220 - protein, 17 aa, Mycobacterium bovis
SAAPTDPSSSSTDSPVD

SEQ ID NO: 193221 - protein, 7 aa, Mycobacterium bovis
SADPTTI

SEQ ID NO: 193222 - protein, 15 aa, Mycobacterium bovis
SAETEAAAAGAAPAL

SEQ ID NO: 193223 - protein, 12 aa, Mycobacterium bovis
SAIEANPRQPRQ

SEQ ID NO: 193224 - protein, 5 aa, Mycobacterium bovis
SAMSK

SEQ ID NO: 193225 - protein, 8 aa, Mycobacterium bovis
SANRGPSV

SEQ ID NO: 193226 - protein, 7 aa, Mycobacterium bovis
SAPSASV

SEQ ID NO: 193227 - protein, 5 aa, Mycobacterium bovis
SAPVR

SEQ ID NO: 193228 - protein, 5 aa, Mycobacterium bovis
SARRG

SEQ ID NO: 193229 - protein, 12 aa, Mycobacterium bovis
SATTKSTTTTSC

SEQ ID NO: 193230 - protein, 9 aa, Mycobacterium bovis
SAVDDASER

SEQ ID NO: 193231 - protein, 6 aa, Mycobacterium bovis
SAVSQR

SEQ ID NO: 193232 - protein, 8 aa, Mycobacterium bovis
SCDGGLGK

SEQ ID NO: 193233 - protein, 7 aa, Mycobacterium bovis
SDAGVDS

SEQ ID NO: 193234 - protein, 5 aa, Mycobacterium bovis
SDDTS

SEQ ID NO: 193235 - protein, 8 aa, Mycobacterium bovis
SDGDFGGD

SEQ ID NO: 193236 - protein, 9 aa, Mycobacterium bovis
SDGSSAPAV

SEQ ID NO: 193237 - protein, 4 aa, Mycobacterium bovis
SDHG

SEQ ID NO: 193238 - protein, 8 aa, Mycobacterium bovis
SDNKPSDV

SEQ ID NO: 193239 - protein, 5 aa, Mycobacterium bovis
SDPEG

SEQ ID NO: 193240 - protein, 4 aa, Mycobacterium bovis
SDSL

SEQ ID NO: 193241 - protein, 37 aa, Mycobacterium bovis
SDTPETTTASRSADRSTNPKTAKHPKSATKPTVPTPA

SEQ ID NO: 193242 - protein, 5 aa, Mycobacterium bovis
SEAAD

SEQ ID NO: 193243 - protein, 4 aa, Mycobacterium bovis
SEDG

SEQ ID NO: 193244 - protein, 5 aa, Mycobacterium bovis
SEEQL

SEQ ID NO: 193245 - protein, 5 aa, Mycobacterium bovis
SEGDD

SEQ ID NO: 193246 - protein, 5 aa, Mycobacterium bovis
SEGGI

SEQ ID NO: 193247 - protein, 9 aa, Mycobacterium bovis
SEIAESGAA

SEQ ID NO: 193248 - protein, 8 aa, Mycobacterium bovis
SELPPPLH

SEQ ID NO: 193249 - protein, 4 aa, Mycobacterium bovis
SESL

SEQ ID NO: 193250 - protein, 12 aa, Mycobacterium bovis
SETSAEAAARHE

SEQ ID NO: 193251 - protein, 16 aa, Mycobacterium bovis
SFGSVTSGLAGQSWQG

SEQ ID NO: 193252 - protein, 13 aa, Mycobacterium bovis
SFSRGAREEAERI

SEQ ID NO: 193253 - protein, 5 aa, Mycobacterium bovis
SGAKD

SEQ ID NO: 193254 - protein, 4 aa, Mycobacterium bovis
SGAQ

SEQ ID NO: 193255 - protein, 23 aa, Mycobacterium bovis
SGATASGAAPLSAAELEKLFLAL

SEQ ID NO: 193256 - protein, 13 aa, Mycobacterium bovis
SGATSRFKRFRLS

SEQ ID NO: 193257 - protein, 5 aa, Mycobacterium bovis
SGDAL

SEQ ID NO: 193258 - protein, 6 aa, Mycobacterium bovis
SGDTPL

SEQ ID NO: 193259 - protein, 6 aa, Mycobacterium bovis
SGEYAA

SEQ ID NO: 193260 - protein, 7 aa, Mycobacterium bovis
SGGATVT

SEQ ID NO: 193261 - protein, 6 aa, Mycobacterium bovis
SGGGPY

SEQ ID NO: 193262 - protein, 26 aa, Mycobacterium bovis
SGGNGGSGGAGLTAGGDGGDGGNAGS

SEQ ID NO: 193263 - protein, 10 aa, Mycobacterium bovis
SGGSGGAGGF

SEQ ID NO: 193264 - protein, 24 aa, Mycobacterium bovis
SGGTGGSGGFGLDTGGAGGRGGDA

SEQ ID NO: 193265 - protein, 4 aa, Mycobacterium bovis
SGIP

SEQ ID NO: 193266 - protein, 7 aa, Mycobacterium bovis
SGLPNQT

SEQ ID NO: 193267 - protein, 6 aa, Mycobacterium bovis
SGSGSS

SEQ ID NO: 193268 - protein, 12 aa, Mycobacterium bovis
SGVGAKDRMPTP

SEQ ID NO: 193269 - protein, 5 aa, Mycobacterium bovis
SGYRY

SEQ ID NO: 193270 - protein, 11 aa, Mycobacterium bovis
SIARSEGKSVG

SEQ ID NO: 193271 - protein, 4 aa, Mycobacterium bovis
SIHN

SEQ ID NO: 193272 - protein, 9 aa, Mycobacterium bovis
SISGTAPSR

SEQ ID NO: 193273 - protein, 11 aa, Mycobacterium bovis
SKGEPLSDHSP

SEQ ID NO: 193274 - protein, 7 aa, Mycobacterium bovis
SKGGYEA

SEQ ID NO: 193275 - protein, 13 aa, Mycobacterium bovis
SKYPYTPDGNREF

SEQ ID NO: 193276 - protein, 6 aa, Mycobacterium bovis
SLDAEY

SEQ ID NO: 193277 - protein, 5 aa, Mycobacterium bovis
SLDAS

SEQ ID NO: 193278 - protein, 19 aa, Mycobacterium bovis
SLGRPDYRDDPSPAHQPGS

SEQ ID NO: 193279 - protein, 6 aa, Mycobacterium bovis
SLPPGV

SEQ ID NO: 193280 - protein, 8 aa, Mycobacterium bovis
SLSGTPAV

SEQ ID NO: 193281 - protein, 11 aa, Mycobacterium bovis
SMTTNGVSHSR

SEQ ID NO: 193282 - protein, 4 aa, Mycobacterium bovis
SNDG

SEQ ID NO: 193283 - protein, 6 aa, Mycobacterium bovis
SNGIGS

SEQ ID NO: 193284 - protein, 5 aa, Mycobacterium bovis
SNLHT

SEQ ID NO: 193285 - protein, 4 aa, Mycobacterium bovis
SNSD

SEQ ID NO: 193286 - protein, 9 aa, Mycobacterium bovis
SPASTPSEF

SEQ ID NO: 193287 - protein, 5 aa, Mycobacterium bovis
SPDLE

SEQ ID NO: 193288 - protein, 13 aa, Mycobacterium bovis
SPGFDATSPAKLG

SEQ ID NO: 193289 - protein, 10 aa, Mycobacterium bovis
SPGSRSDIGG

SEQ ID NO: 193290 - protein, 5 aa, Mycobacterium bovis
SPITK

SEQ ID NO: 193291 - protein, 7 aa, Mycobacterium bovis
SPKQFDG

SEQ ID NO: 193292 - protein, 20 aa, Mycobacterium bovis
SPLGGSASSLAAIPGASVPQ

SEQ ID NO: 193293 - protein, 8 aa, Mycobacterium bovis
SPNSPLGG

SEQ ID NO: 193294 - protein, 13 aa, Mycobacterium bovis
SPSEDAREMRQNS

SEQ ID NO: 193295 - protein, 18 aa, Mycobacterium bovis
SPSEKTRPGLAARPSTTC

SEQ ID NO: 193296 - protein, 13 aa, Mycobacterium bovis
SPSPSKRRTASRA

SEQ ID NO: 193297 - protein, 6 aa, Mycobacterium bovis
SPTWDP

SEQ ID NO: 193298 - protein, 11 aa, Mycobacterium bovis
SQGKAASYRAA

SEQ ID NO: 193299 - protein, 6 aa, Mycobacterium bovis
SQHAGS

SEQ ID NO: 193300 - protein, 4 aa, Mycobacterium bovis
SQSP

SEQ ID NO: 193301 - protein, 12 aa, Mycobacterium bovis
SRASEIAPNTTD

SEQ ID NO: 193302 - protein, 14 aa, Mycobacterium bovis
SRCSRAGAEALRQG

SEQ ID NO: 193303 - protein, 7 aa, Mycobacterium bovis
SRDAEAP

SEQ ID NO: 193304 - protein, 13 aa, Mycobacterium bovis
SREAARRTLNRPG

SEQ ID NO: 193305 - protein, 8 aa, Mycobacterium bovis
SRKVAEGR

SEQ ID NO: 193306 - protein, 13 aa, Mycobacterium bovis
SRQHRVPDHAPSR

SEQ ID NO: 193307 - protein, 12 aa, Mycobacterium bovis
SRSAGSSVRMGR

SEQ ID NO: 193308 - protein, 17 aa, Mycobacterium bovis
SRSPGLNESSHMSGRIP

SEQ ID NO: 193309 - protein, 5 aa, Mycobacterium bovis
SRSPV

SEQ ID NO: 193310 - protein, 8 aa, Mycobacterium bovis
SRSQLSPR

SEQ ID NO: 193311 - protein, 5 aa, Mycobacterium bovis
SRTTV

SEQ ID NO: 193312 - protein, 9 aa, Mycobacterium bovis
SSGPGPGSV

SEQ ID NO: 193313 - protein, 7 aa, Mycobacterium bovis
SSGREAD

SEQ ID NO: 193314 - protein, 49 aa, Mycobacterium bovis
SSGTPGEDGGNGGAGGAGGAGGAHAGDGGAGGAGGNGGAGGAGGNGAHG

SEQ ID NO: 193315 - protein, 5 aa, Mycobacterium bovis
SSPHP

SEQ ID NO: 193316 - protein, 9 aa, Mycobacterium bovis
SSPSASPKL

SEQ ID NO: 193317 - protein, 21 aa, Mycobacterium bovis
SSSRSRTPLRPPVAPSEGVAA

SEQ ID NO: 193318 - protein, 8 aa, Mycobacterium bovis
SSSTDPAI

SEQ ID NO: 193319 - protein, 8 aa, Mycobacterium bovis
SSTEQQTT

SEQ ID NO: 193320 - protein, 13 aa, Mycobacterium bovis
SSTGAPPKKVGNS

SEQ ID NO: 193321 - protein, 27 aa, Mycobacterium bovis
SSVSASVSASAATSSIRESQRQQSLTT

SEQ ID NO: 193322 - protein, 6 aa, Mycobacterium bovis
STGNGN

SEQ ID NO: 193323 - protein, 12 aa, Mycobacterium bovis
STHDTKRGEDVR

SEQ ID NO: 193324 - protein, 12 aa, Mycobacterium bovis
STLDPLRAELGG

SEQ ID NO: 193325 - protein, 35 aa, Mycobacterium bovis
STLGYGGNGGNGVNGGAGGTGGKAGVFGAPGQNGL

SEQ ID NO: 193326 - protein, 10 aa, Mycobacterium bovis
STNSAQLHTD

SEQ ID NO: 193327 - protein, 11 aa, Mycobacterium bovis
STPGRPQGRGK

SEQ ID NO: 193328 - protein, 7 aa, Mycobacterium bovis
STTTWSG

SEQ ID NO: 193329 - protein, 6 aa, Mycobacterium bovis
STVQDR

SEQ ID NO: 193330 - protein, 6 aa, Mycobacterium bovis
SVGHAG

SEQ ID NO: 193331 - protein, 6 aa, Mycobacterium bovis
SVMAPT

SEQ ID NO: 193332 - protein, 9 aa, Mycobacterium bovis
SVTSRNKVA

SEQ ID NO: 193333 - protein, 17 aa, Mycobacterium bovis
SWDPDRDAPGSAEPGDR

SEQ ID NO: 193334 - protein, 5 aa, Mycobacterium bovis
SWPNP

SEQ ID NO: 193335 - protein, 6 aa, Mycobacterium bovis
TAAHPC

SEQ ID NO: 193336 - protein, 12 aa, Mycobacterium bovis
TAANAAAAVPTS

SEQ ID NO: 193337 - protein, 5 aa, Mycobacterium bovis
TADQP

SEQ ID NO: 193338 - protein, 4 aa, Mycobacterium bovis
TAEF

SEQ ID NO: 193339 - protein, 11 aa, Mycobacterium bovis
TAGAQDARIEE

SEQ ID NO: 193340 - protein, 14 aa, Mycobacterium bovis
TAGGAGGAGGAGGL

SEQ ID NO: 193341 - protein, 5 aa, Mycobacterium bovis
TAGLQ

SEQ ID NO: 193342 - protein, 9 aa, Mycobacterium bovis
TAITPDEGA

SEQ ID NO: 193343 - protein, 9 aa, Mycobacterium bovis
TAKDPDGAP

SEQ ID NO: 193344 - protein, 16 aa, Mycobacterium bovis
TALRTPSTWMTRATAT

SEQ ID NO: 193345 - protein, 10 aa, Mycobacterium bovis
TAPAPQGPWS

SEQ ID NO: 193346 - protein, 12 aa, Mycobacterium bovis
TAPAVPNGQPVK

SEQ ID NO: 193347 - protein, 5 aa, Mycobacterium bovis
TARAQ

SEQ ID NO: 193348 - protein, 8 aa, Mycobacterium bovis
TARREAVA

SEQ ID NO: 193349 - protein, 4 aa, Mycobacterium bovis
TATG

SEQ ID NO: 193350 - protein, 8 aa, Mycobacterium bovis
TATTPAGR

SEQ ID NO: 193351 - protein, 11 aa, Mycobacterium bovis
TAVANRSGTEP

SEQ ID NO: 193352 - protein, 10 aa, Mycobacterium bovis
TDAERADHRE

SEQ ID NO: 193353 - protein, 6 aa, Mycobacterium bovis
TDKDWR

SEQ ID NO: 193354 - protein, 7 aa, Mycobacterium bovis
TDPGGEI

SEQ ID NO: 193355 - protein, 10 aa, Mycobacterium bovis
TDPNLSRPRV

SEQ ID NO: 193356 - protein, 7 aa, Mycobacterium bovis
TDTPSTI

SEQ ID NO: 193357 - protein, 7 aa, Mycobacterium bovis
TDTVGNP

SEQ ID NO: 193358 - protein, 4 aa, Mycobacterium bovis
TEAA

SEQ ID NO: 193359 - protein, 7 aa, Mycobacterium bovis
TEAAQSR

SEQ ID NO: 193360 - protein, 9 aa, Mycobacterium bovis
TEDSDGRTR

SEQ ID NO: 193361 - protein, 5 aa, Mycobacterium bovis
TEEAN

SEQ ID NO: 193362 - protein, 5 aa, Mycobacterium bovis
TEHRG

SEQ ID NO: 193363 - protein, 10 aa, Mycobacterium bovis
TEPTSPQDAW

SEQ ID NO: 193364 - protein, 6 aa, Mycobacterium bovis
TETDDR

SEQ ID NO: 193365 - protein, 9 aa, Mycobacterium bovis
TFPGASKAV

SEQ ID NO: 193366 - protein, 15 aa, Mycobacterium bovis
TGAGGTGGNGGTAGL

SEQ ID NO: 193367 - protein, 8 aa, Mycobacterium bovis
TGATARES

SEQ ID NO: 193368 - protein, 14 aa, Mycobacterium bovis
TGDFRRGSISENYR

SEQ ID NO: 193369 - protein, 14 aa, Mycobacterium bovis
TGGAGGAGGAGGNA

SEQ ID NO: 193370 - protein, 24 aa, Mycobacterium bovis
TGGTGGAGGVGTTGTGGDGGAGGA

SEQ ID NO: 193371 - protein, 5 aa, Mycobacterium bovis
TGGTQ

SEQ ID NO: 193372 - protein, 6 aa, Mycobacterium bovis
TGGVGK

SEQ ID NO: 193373 - protein, 14 aa, Mycobacterium bovis
TGKTPVSKDDAQQH

SEQ ID NO: 193374 - protein, 26 aa, Mycobacterium bovis
TGLTDQPDLSQLGDQANDTTGSSETV

SEQ ID NO: 193375 - protein, 10 aa, Mycobacterium bovis
TGPDSPNKTL

SEQ ID NO: 193376 - protein, 21 aa, Mycobacterium bovis
TGPERGEAATHSPVRWTGGRD

SEQ ID NO: 193377 - protein, 5 aa, Mycobacterium bovis
TGPEV

SEQ ID NO: 193378 - protein, 4 aa, Mycobacterium bovis
TGPT

SEQ ID NO: 193379 - protein, 8 aa, Mycobacterium bovis
TGPVGGEV

SEQ ID NO: 193380 - protein, 7 aa, Mycobacterium bovis
TGSTETG

SEQ ID NO: 193381 - protein, 5 aa, Mycobacterium bovis
TGSTG

SEQ ID NO: 193382 - protein, 10 aa, Mycobacterium bovis
TGSTPGAFDS

SEQ ID NO: 193383 - protein, 7 aa, Mycobacterium bovis
TGTGGAS

SEQ ID NO: 193384 - protein, 15 aa, Mycobacterium bovis
TGTPTLPNSGDDESA

SEQ ID NO: 193385 - protein, 4 aa, Mycobacterium bovis
THRR

SEQ ID NO: 193386 - protein, 9 aa, Mycobacterium bovis
THSTTPQLA

SEQ ID NO: 193387 - protein, 5 aa, Mycobacterium bovis
TKATG

SEQ ID NO: 193388 - protein, 7 aa, Mycobacterium bovis
TKDPEKF

SEQ ID NO: 193389 - protein, 8 aa, Mycobacterium bovis
TKKKESEI

SEQ ID NO: 193390 - protein, 7 aa, Mycobacterium bovis
TKLGETY

SEQ ID NO: 193391 - protein, 5 aa, Mycobacterium bovis
TMDPT

SEQ ID NO: 193392 - protein, 5 aa, Mycobacterium bovis
TNASR

SEQ ID NO: 193393 - protein, 12 aa, Mycobacterium bovis
TNATRHQHDAAA

SEQ ID NO: 193394 - protein, 15 aa, Mycobacterium bovis
TNQANPVPGDPTGDL

SEQ ID NO: 193395 - protein, 12 aa, Mycobacterium bovis
TNTGGGPTTNAN

SEQ ID NO: 193396 - protein, 5 aa, Mycobacterium bovis
TPAGR

SEQ ID NO: 193397 - protein, 10 aa, Mycobacterium bovis
TPATPPATLT

SEQ ID NO: 193398 - protein, 5 aa, Mycobacterium bovis
TPEHG

SEQ ID NO: 193399 - protein, 4 aa, Mycobacterium bovis
TPES

SEQ ID NO: 193400 - protein, 11 aa, Mycobacterium bovis
TPGHADFGGEV

SEQ ID NO: 193401 - protein, 5 aa, Mycobacterium bovis
TPGRA

SEQ ID NO: 193402 - protein, 7 aa, Mycobacterium bovis
TPLPPSR

SEQ ID NO: 193403 - protein, 5 aa, Mycobacterium bovis
TPPAE

SEQ ID NO: 193404 - protein, 10 aa, Mycobacterium bovis
TPQERADPKI

SEQ ID NO: 193405 - protein, 6 aa, Mycobacterium bovis
TPTSGF

SEQ ID NO: 193406 - protein, 5 aa, Mycobacterium bovis
TPTSK

SEQ ID NO: 193407 - protein, 4 aa, Mycobacterium bovis
TPTV

SEQ ID NO: 193408 - protein, 18 aa, Mycobacterium bovis
TPVANPQQVSVPEGGTVG

SEQ ID NO: 193409 - protein, 8 aa, Mycobacterium bovis
TQADVDAG

SEQ ID NO: 193410 - protein, 15 aa, Mycobacterium bovis
TQASVPPQGARKHPH

SEQ ID NO: 193411 - protein, 6 aa, Mycobacterium bovis
TQPQHR

SEQ ID NO: 193412 - protein, 13 aa, Mycobacterium bovis
TQSPYPGGGPIPE

SEQ ID NO: 193413 - protein, 5 aa, Mycobacterium bovis
TRDAV

SEQ ID NO: 193414 - protein, 5 aa, Mycobacterium bovis
TRFNA

SEQ ID NO: 193415 - protein, 20 aa, Mycobacterium bovis
TRGGDGQGAPFGADVPTPRL

SEQ ID NO: 193416 - protein, 17 aa, Mycobacterium bovis
TSAEAAQTQTRIALRSR

SEQ ID NO: 193417 - protein, 5 aa, Mycobacterium bovis
TSATD

SEQ ID NO: 193418 - protein, 5 aa, Mycobacterium bovis
TSDRC

SEQ ID NO: 193419 - protein, 5 aa, Mycobacterium bovis
TSEAA

SEQ ID NO: 193420 - protein, 4 aa, Mycobacterium bovis
TSGG

SEQ ID NO: 193421 - protein, 14 aa, Mycobacterium bovis
TSGGGAYAAAEAAA

SEQ ID NO: 193422 - protein, 6 aa, Mycobacterium bovis
TSPRAH

SEQ ID NO: 193423 - protein, 9 aa, Mycobacterium bovis
TSPTSWEQA

SEQ ID NO: 193424 - protein, 4 aa, Mycobacterium bovis
TSRY

SEQ ID NO: 193425 - protein, 8 aa, Mycobacterium bovis
TTAAQQTL

SEQ ID NO: 193426 - protein, 6 aa, Mycobacterium bovis
TTDAST

SEQ ID NO: 193427 - protein, 8 aa, Mycobacterium bovis
TTERNPVP

SEQ ID NO: 193428 - protein, 7 aa, Mycobacterium bovis
TTHRETP

SEQ ID NO: 193429 - protein, 14 aa, Mycobacterium bovis
TTKIEDKDGNPVDP

SEQ ID NO: 193430 - protein, 18 aa, Mycobacterium bovis
TTPERDRARRDRDHHPWS

SEQ ID NO: 193431 - protein, 5 aa, Mycobacterium bovis
TTPNS

SEQ ID NO: 193432 - protein, 5 aa, Mycobacterium bovis
TTPVT

SEQ ID NO: 193433 - protein, 7 aa, Mycobacterium bovis
TTSAKEA

SEQ ID NO: 193434 - protein, 5 aa, Mycobacterium bovis
TTTQA

SEQ ID NO: 193435 - protein, 6 aa, Mycobacterium bovis
TVASRP

SEQ ID NO: 193436 - protein, 4 aa, Mycobacterium bovis
TVDG

SEQ ID NO: 193437 - protein, 8 aa, Mycobacterium bovis
TVEGGESL

SEQ ID NO: 193438 - protein, 12 aa, Mycobacterium bovis
TVERSGLSADDV

SEQ ID NO: 193439 - protein, 5 aa, Mycobacterium bovis
TVPEH

SEQ ID NO: 193440 - protein, 12 aa, Mycobacterium bovis
TVQDSSPVAGQL

SEQ ID NO: 193441 - protein, 11 aa, Mycobacterium bovis
TVRARSDATAV

SEQ ID NO: 193442 - protein, 12 aa, Mycobacterium bovis
TVTSEANRARRV

SEQ ID NO: 193443 - protein, 4 aa, Mycobacterium bovis
TYPG

SEQ ID NO: 193444 - protein, 9 aa, Mycobacterium bovis
VAGAGRSTF

SEQ ID NO: 193445 - protein, 11 aa, Mycobacterium bovis
VAPTRGPDAIS

SEQ ID NO: 193446 - protein, 8 aa, Mycobacterium bovis
VARQTPQQ

SEQ ID NO: 193447 - protein, 6 aa, Mycobacterium bovis
VARTGL

SEQ ID NO: 193448 - protein, 36 aa, Mycobacterium bovis
VASGRVAGRRRSWSGPGPDIRDPQPLGKAARELAKK

SEQ ID NO: 193449 - protein, 11 aa, Mycobacterium bovis
VASTGSLAGIT

SEQ ID NO: 193450 - protein, 12 aa, Mycobacterium bovis
VDEAAQSEPLTP

SEQ ID NO: 193451 - protein, 10 aa, Mycobacterium bovis
VDHTGRYRGR

SEQ ID NO: 193452 - protein, 8 aa, Mycobacterium bovis
VDPGSIPD

SEQ ID NO: 193453 - protein, 4 aa, Mycobacterium bovis
VDRR

SEQ ID NO: 193454 - protein, 15 aa, Mycobacterium bovis
VDSAPAQRLGSTGSP

SEQ ID NO: 193455 - protein, 16 aa, Mycobacterium bovis
VEAPKAYAEAALSLLV

SEQ ID NO: 193456 - protein, 11 aa, Mycobacterium bovis
VEEASDTAAAN

SEQ ID NO: 193457 - protein, 7 aa, Mycobacterium bovis
VERGKAA

SEQ ID NO: 193458 - protein, 4 aa, Mycobacterium bovis
VERQ

SEQ ID NO: 193459 - protein, 14 aa, Mycobacterium bovis
VERSGDRSAPYAAP

SEQ ID NO: 193460 - protein, 8 aa, Mycobacterium bovis
VESPSQAA

SEQ ID NO: 193461 - protein, 7 aa, Mycobacterium bovis
VETKDQV

SEQ ID NO: 193462 - protein, 8 aa, Mycobacterium bovis
VGDDKDKA

SEQ ID NO: 193463 - protein, 11 aa, Mycobacterium bovis
VGDGQARIRTT

SEQ ID NO: 193464 - protein, 41 aa, Mycobacterium bovis
VGGAGGAGGNAAGLSGAGGAGGAGGFGETAGDGGAGGNAGL

SEQ ID NO: 193465 - protein, 7 aa, Mycobacterium bovis
VGGEPRR

SEQ ID NO: 193466 - protein, 14 aa, Mycobacterium bovis
VGKPAAQEGSEPWV

SEQ ID NO: 193467 - protein, 12 aa, Mycobacterium bovis
VGLGASARERNI

SEQ ID NO: 193468 - protein, 6 aa, Mycobacterium bovis
VGPGVT

SEQ ID NO: 193469 - protein, 4 aa, Mycobacterium bovis
VGPN

SEQ ID NO: 193470 - protein, 8 aa, Mycobacterium bovis
VKQYAGDL

SEQ ID NO: 193471 - protein, 14 aa, Mycobacterium bovis
VLPSKEGAHETREA

SEQ ID NO: 193472 - protein, 217 aa, Mycobacterium bovis
VNGGNGGNGGNGDHALSGNGAAGGNGGNGGNGSLRGSGGAGGHGGNGGNASRGMGGDGGTGGAGGNAGQIGNGGAGGNGGDGGTGSDGNPGAITGSGGRGGDGGVGGQGGSVAGDGADGGRGGAGGTGGTGLRGTTGATGATGTFDAGADGHGGNGGTGGVGGTGGAGGGGGNGGAGGKALSPTGNNGSQGAGGDGGAGGAGGTGGTGGDGGRGAHG

SEQ ID NO: 193473 - protein, 6 aa, Mycobacterium bovis
VNSGQA

SEQ ID NO: 193474 - protein, 9 aa, Mycobacterium bovis
VPDPGGAAF

SEQ ID NO: 193475 - protein, 4 aa, Mycobacterium bovis
VPEQ

SEQ ID NO: 193476 - protein, 14 aa, Mycobacterium bovis
VPGYHAPPDRTAGV

SEQ ID NO: 193477 - protein, 13 aa, Mycobacterium bovis
VPLSSGSFGDATG

SEQ ID NO: 193478 - protein, 5 aa, Mycobacterium bovis
VPPAV

SEQ ID NO: 193479 - protein, 12 aa, Mycobacterium bovis
VPRGPLAAASAA

SEQ ID NO: 193480 - protein, 4 aa, Mycobacterium bovis
VPTQ

SEQ ID NO: 193481 - protein, 28 aa, Mycobacterium bovis
VQKRSSYKESPGGRKEALRRSRATGTIT

SEQ ID NO: 193482 - protein, 7 aa, Mycobacterium bovis
VQTADGA

SEQ ID NO: 193483 - protein, 25 aa, Mycobacterium bovis
VRPGHGPIPTGRKPRGANDRAPLPK

SEQ ID NO: 193484 - protein, 9 aa, Mycobacterium bovis
VRPGSAEEV

SEQ ID NO: 193485 - protein, 10 aa, Mycobacterium bovis
VRPPTPSRRL

SEQ ID NO: 193486 - protein, 9 aa, Mycobacterium bovis
VRRDNTGYD

SEQ ID NO: 193487 - protein, 5 aa, Mycobacterium bovis
VSESV

SEQ ID NO: 193488 - protein, 8 aa, Mycobacterium bovis
VSETHDTK

SEQ ID NO: 193489 - protein, 8 aa, Mycobacterium bovis
VSKDNGQT

SEQ ID NO: 193490 - protein, 5 aa, Mycobacterium bovis
VSPGT

SEQ ID NO: 193491 - protein, 6 aa, Mycobacterium bovis
VSQPTI

SEQ ID NO: 193492 - protein, 10 aa, Mycobacterium bovis
VSRAAARKRA

SEQ ID NO: 193493 - protein, 11 aa, Mycobacterium bovis
VSSHDGPDAGR

SEQ ID NO: 193494 - protein, 13 aa, Mycobacterium bovis
VSSRRRKGRRTLS

SEQ ID NO: 193495 - protein, 11 aa, Mycobacterium bovis
VTAGERPGRGA

SEQ ID NO: 193496 - protein, 11 aa, Mycobacterium bovis
VTDDPADPSTI

SEQ ID NO: 193497 - protein, 8 aa, Mycobacterium bovis
VTGGSANY

SEQ ID NO: 193498 - protein, 7 aa, Mycobacterium bovis
VTGRGAG

SEQ ID NO: 193499 - protein, 9 aa, Mycobacterium bovis
VTKYRQGDR

SEQ ID NO: 193500 - protein, 7 aa, Mycobacterium bovis
VTRRGYG

SEQ ID NO: 193501 - protein, 20 aa, Mycobacterium bovis
VTSGDASNRYSGSPVRQPGF

SEQ ID NO: 193502 - protein, 7 aa, Mycobacterium bovis
VTSGQRR

SEQ ID NO: 193503 - protein, 6 aa, Mycobacterium bovis
VTTDPD

SEQ ID NO: 193504 - protein, 4 aa, Mycobacterium bovis
VVPP

SEQ ID NO: 193505 - protein, 13 aa, Mycobacterium bovis
WADGGPTSAHNGL

SEQ ID NO: 193506 - protein, 9 aa, Mycobacterium bovis
WKPPHPLSD

SEQ ID NO: 193507 - protein, 11 aa, Mycobacterium bovis
WLGPSSAGMAA

SEQ ID NO: 193508 - protein, 4 aa, Mycobacterium bovis
WQGV

SEQ ID NO: 193509 - protein, 22 aa, Mycobacterium bovis
WTGSGQRRWRRSPPTGRYRSNS

SEQ ID NO: 193510 - protein, 5 aa, Mycobacterium bovis
WTTDV

SEQ ID NO: 193511 - protein, 13 aa, Mycobacterium bovis
YAAATSQTKGLTF

SEQ ID NO: 193512 - protein, 16 aa, Mycobacterium bovis
YAEADPTADVEGYDAA

SEQ ID NO: 193513 - protein, 6 aa, Mycobacterium bovis
YAERAS

SEQ ID NO: 193514 - protein, 6 aa, Mycobacterium bovis
YAPGHE

SEQ ID NO: 193515 - protein, 252 aa, Mycobacterium bovis
YARPQEDPRGGPDPQGGSDPRGGYPPETGGYPPQPGYPRPRHPGQGDYPEQIGYPDQGGYPEQRGYPDQRGYQDQGRGYPDQGQGGYPPPYEQRPPVSPGPAAGYGAPGYDQGYRQSGGCGPSPGGGQPGYGGYGEYGRGPARHEEGSYVPSGPPGPPEQRPAYPDQGGYDQGYQQGATTYGRQDYGGGADYTRYTESPQVPGYAPQGGGYAEPAGRDYDYGQSGAPDYGQPAPGGYSGYGQGGYGSAGTSV

SEQ ID NO: 193516 - protein, 6 aa, Mycobacterium bovis
YERPKA

SEQ ID NO: 193517 - protein, 11 aa, Mycobacterium bovis
YESPPLPLGPD

SEQ ID NO: 193518 - protein, 10 aa, Mycobacterium bovis
YGETQAQSVS

SEQ ID NO: 193519 - protein, 7 aa, Mycobacterium bovis
YGNEAPK

SEQ ID NO: 193520 - protein, 10 aa, Mycobacterium bovis
YGQPGQTERA

SEQ ID NO: 193521 - protein, 10 aa, Mycobacterium bovis
YGSSASSSGV

SEQ ID NO: 193522 - protein, 6 aa, Mycobacterium bovis
YHQSTG

SEQ ID NO: 193523 - protein, 9 aa, Mycobacterium bovis
YKSSARPAL

SEQ ID NO: 193524 - protein, 13 aa, Mycobacterium bovis
YNADGSLRKPGQD

SEQ ID NO: 193525 - protein, 4 aa, Mycobacterium bovis
YNDA

SEQ ID NO: 193526 - protein, 7 aa, Mycobacterium bovis
YNTGSFN

SEQ ID NO: 193527 - protein, 8 aa, Mycobacterium bovis
YPATAEES

SEQ ID NO: 193528 - protein, 11 aa, Mycobacterium bovis
YPPGRGPHTSA

SEQ ID NO: 193529 - protein, 5 aa, Mycobacterium bovis
YPPPA

SEQ ID NO: 193530 - protein, 12 aa, Mycobacterium bovis
YPSALATDHHHG

SEQ ID NO: 193531 - protein, 5 aa, Mycobacterium bovis
YRDRG

SEQ ID NO: 193532 - protein, 7 aa, Mycobacterium bovis
YRNGERG

SEQ ID NO: 193533 - protein, 7 aa, Mycobacterium bovis
YSSPPRF

SEQ ID NO: 193534 - protein, 5 aa, Mycobacterium bovis
YTPTA

SEQ ID NO: 193535 - protein, 4 aa, Mycobacterium bovis
YTTD

SEQ ID NO: 193536 - protein, 22 aa, Mycobacterium bovis
AAAESAISAETEAAAAGAAPAL

SEQ ID NO: 193537 - protein, 6 aa, Mycobacterium bovis
AAAGAR

SEQ ID NO: 193538 - protein, 8 aa, Mycobacterium bovis
AAAGVGKG

SEQ ID NO: 193539 - protein, 7 aa, Mycobacterium bovis
AAASARR

SEQ ID NO: 193540 - protein, 16 aa, Mycobacterium bovis
AAASGLYRGQQRRRRP

SEQ ID NO: 193541 - protein, 4 aa, Mycobacterium bovis
AAAT

SEQ ID NO: 193542 - protein, 5 aa, Mycobacterium bovis
AAAVN

SEQ ID NO: 193543 - protein, 7 aa, Mycobacterium bovis
AADEVST

SEQ ID NO: 193544 - protein, 5 aa, Mycobacterium bovis
AADSG

SEQ ID NO: 193545 - protein, 6 aa, Mycobacterium bovis
AAEAET

SEQ ID NO: 193546 - protein, 8 aa, Mycobacterium bovis
AAEDEVST

SEQ ID NO: 193547 - protein, 4 aa, Mycobacterium bovis
AAEQ

SEQ ID NO: 193548 - protein, 12 aa, Mycobacterium bovis
AAGADPHSAIPG

SEQ ID NO: 193549 - protein, 17 aa, Mycobacterium bovis
AAGAGRRGQRTDPQPAV

SEQ ID NO: 193550 - protein, 14 aa, Mycobacterium bovis
AAGGAGGPGGAGGL

SEQ ID NO: 193551 - protein, 40 aa, Mycobacterium bovis
AAGGAGGSGGSSPDGGGGAGGIGGDGGTLFGSGGAGGVGG

SEQ ID NO: 193552 - protein, 8 aa, Mycobacterium bovis
AAGPGASA

SEQ ID NO: 193553 - protein, 7 aa, Mycobacterium bovis
AAGVGKG

SEQ ID NO: 193554 - protein, 14 aa, Mycobacterium bovis
AAGYQGTAKDSSHH

SEQ ID NO: 193555 - protein, 14 aa, Mycobacterium bovis
AAHPTTGDASLPDD

SEQ ID NO: 193556 - protein, 4 aa, Mycobacterium bovis
AAIP

SEQ ID NO: 193557 - protein, 8 aa, Mycobacterium bovis
AAKRGLAN

SEQ ID NO: 193558 - protein, 13 aa, Mycobacterium bovis
AAKSDGGRNNQAG

SEQ ID NO: 193559 - protein, 16 aa, Mycobacterium bovis
AALDDAADESANPVPR

SEQ ID NO: 193560 - protein, 7 aa, Mycobacterium bovis
AALDSEG

SEQ ID NO: 193561 - protein, 11 aa, Mycobacterium bovis
AANKQKQELDE

SEQ ID NO: 193562 - protein, 5 aa, Mycobacterium bovis
AANRE

SEQ ID NO: 193563 - protein, 4 aa, Mycobacterium bovis
AAPA

SEQ ID NO: 193564 - protein, 9 aa, Mycobacterium bovis
AAPAGRNWT

SEQ ID NO: 193565 - protein, 6 aa, Mycobacterium bovis
AAPPGP

SEQ ID NO: 193566 - protein, 4 aa, Mycobacterium bovis
AAPY

SEQ ID NO: 193567 - protein, 7 aa, Mycobacterium bovis
AAQGNYA

SEQ ID NO: 193568 - protein, 15 aa, Mycobacterium bovis
AAQTKQTATQARAAA

SEQ ID NO: 193569 - protein, 12 aa, Mycobacterium bovis
AARAAGASVQAK

SEQ ID NO: 193570 - protein, 55 aa, Mycobacterium bovis
AARGGSAPTPAAAAPAGAGGAGPAATRPAAQQTPAVPAAAAGSAIPGLPPGLPPG

SEQ ID NO: 193571 - protein, 7 aa, Mycobacterium bovis
AASASVG

SEQ ID NO: 193572 - protein, 7 aa, Mycobacterium bovis
AATADAG

SEQ ID NO: 193573 - protein, 7 aa, Mycobacterium bovis
AATRPNL

SEQ ID NO: 193574 - protein, 160 aa, Mycobacterium bovis
AATTGGAGGNGGAGGFASTGLGGPGGAGGPGGAGDFASGVGGVGGAGGDGGAGGVGGFGGQGGIGGEGRTGGNGGSGGDGGGGISLGGQGGNGGFGGAGGNGGIGTDAGGAGGAGGAGGNGGSSKSTTTGNAGSGGAGGNGGTGLNGAGGAGGAGGNAGV

SEQ ID NO: 193575 - protein, 13 aa, Mycobacterium bovis
AATTPDQPQPYGE

SEQ ID NO: 193576 - protein, 6 aa, Mycobacterium bovis
AAVDAG

SEQ ID NO: 193577 - protein, 4 aa, Mycobacterium bovis
ACEQ

SEQ ID NO: 193578 - protein, 10 aa, Mycobacterium bovis
ADAAGGDECG

SEQ ID NO: 193579 - protein, 6 aa, Mycobacterium bovis
ADASAL

SEQ ID NO: 193580 - protein, 9 aa, Mycobacterium bovis
ADDATGYQA

SEQ ID NO: 193581 - protein, 9 aa, Mycobacterium bovis
ADDRGEAKR

SEQ ID NO: 193582 - protein, 10 aa, Mycobacterium bovis
ADDSALTAEA

SEQ ID NO: 193583 - protein, 15 aa, Mycobacterium bovis
ADGDGGNRGRQSRVR

SEQ ID NO: 193584 - protein, 12 aa, Mycobacterium bovis
ADHSINRLRLRK

SEQ ID NO: 193585 - protein, 21 aa, Mycobacterium bovis
ADLGPEHRPSAASGPDTTEAD

SEQ ID NO: 193586 - protein, 16 aa, Mycobacterium bovis
ADPARGPGRYHRTGEP

SEQ ID NO: 193587 - protein, 9 aa, Mycobacterium bovis
ADPGAGNLA

SEQ ID NO: 193588 - protein, 5 aa, Mycobacterium bovis
ADRGS

SEQ ID NO: 193589 - protein, 6 aa, Mycobacterium bovis
ADRIQS

SEQ ID NO: 193590 - protein, 9 aa, Mycobacterium bovis
ADRSEPGHW

SEQ ID NO: 193591 - protein, 6 aa, Mycobacterium bovis
ADTALD

SEQ ID NO: 193592 - protein, 6 aa, Mycobacterium bovis
ADTIGA

SEQ ID NO: 193593 - protein, 10 aa, Mycobacterium bovis
ADWAGPTKER

SEQ ID NO: 193594 - protein, 4 aa, Mycobacterium bovis
ADWP

SEQ ID NO: 193595 - protein, 15 aa, Mycobacterium bovis
AEADPTADVEGYDAA

SEQ ID NO: 193596 - protein, 7 aa, Mycobacterium bovis
AEAHREY

SEQ ID NO: 193597 - protein, 10 aa, Mycobacterium bovis
AEDDCPPPGY

SEQ ID NO: 193598 - protein, 24 aa, Mycobacterium bovis
AEEASGAQLAPGTEPSPAPLGQPR

SEQ ID NO: 193599 - protein, 12 aa, Mycobacterium bovis
AEEIAADGTPAH

SEQ ID NO: 193600 - protein, 23 aa, Mycobacterium bovis
AEEMTGRHATTATSFSITDQSCA

SEQ ID NO: 193601 - protein, 5 aa, Mycobacterium bovis
AEGEP

SEQ ID NO: 193602 - protein, 8 aa, Mycobacterium bovis
AEGMEESQ

SEQ ID NO: 193603 - protein, 6 aa, Mycobacterium bovis
AEGRDA

SEQ ID NO: 193604 - protein, 16 aa, Mycobacterium bovis
AEIQRSDAEIPGKQRR

SEQ ID NO: 193605 - protein, 4 aa, Mycobacterium bovis
AELD

SEQ ID NO: 193606 - protein, 10 aa, Mycobacterium bovis
AELPQTSTAA

SEQ ID NO: 193607 - protein, 9 aa, Mycobacterium bovis
AEPAELDAD

SEQ ID NO: 193608 - protein, 36 aa, Mycobacterium bovis
AEPAGPAPTPTSPAPPAAPGSPVEPAGPAGPAGPAV

SEQ ID NO: 193609 - protein, 9 aa, Mycobacterium bovis
AEPHYRPSA

SEQ ID NO: 193610 - protein, 23 aa, Mycobacterium bovis
AEPTSHDPDSGGHFGGPSGWGGR

SEQ ID NO: 193611 - protein, 4 aa, Mycobacterium bovis
AERG

SEQ ID NO: 193612 - protein, 10 aa, Mycobacterium bovis
AESDDADAVA

SEQ ID NO: 193613 - protein, 6 aa, Mycobacterium bovis
AESLNA

SEQ ID NO: 193614 - protein, 9 aa, Mycobacterium bovis
AETGQPPTI

SEQ ID NO: 193615 - protein, 14 aa, Mycobacterium bovis
AETRARRRNAQNVA

SEQ ID NO: 193616 - protein, 27 aa, Mycobacterium bovis
AFGGDGGNGSDGVAAGSGGGTGGAGGG

SEQ ID NO: 193617 - protein, 4 aa, Mycobacterium bovis
AGAA

SEQ ID NO: 193618 - protein, 115 aa, Mycobacterium bovis
AGAGGQGGLGGQGGNGGGSTGGNGGLGGAGGGGGNAPDGGFGGNGGKGGQGGIGGGTQSATGLGGDGGDGGDGGNGGNSGAKAGGAGGKGQAGQPNSGTEPGFGGDGGLGGAGAT

SEQ ID NO: 193619 - protein, 4 aa, Mycobacterium bovis
AGAP

SEQ ID NO: 193620 - protein, 9 aa, Mycobacterium bovis
AGASGYAGG

SEQ ID NO: 193621 - protein, 14 aa, Mycobacterium bovis
AGDDEPDGDDTPPW

SEQ ID NO: 193622 - protein, 7 aa, Mycobacterium bovis
AGDDESN

SEQ ID NO: 193623 - protein, 6 aa, Mycobacterium bovis
AGDDGD

SEQ ID NO: 193624 - protein, 30 aa, Mycobacterium bovis
AGDGGAGGHGGDPGLGGAGGAGGGGGRRAA

SEQ ID NO: 193625 - protein, 5 aa, Mycobacterium bovis
AGEAV

SEQ ID NO: 193626 - protein, 4 aa, Mycobacterium bovis
AGEE

SEQ ID NO: 193627 - protein, 20 aa, Mycobacterium bovis
AGEPPSPEPAASKPPTPPMP

SEQ ID NO: 193628 - protein, 7 aa, Mycobacterium bovis
AGESGTM

SEQ ID NO: 193629 - protein, 25 aa, Mycobacterium bovis
AGGAGGLGGQGNHTGGHGGAGGSAG

SEQ ID NO: 193630 - protein, 24 aa, Mycobacterium bovis
AGGAGGSGGGGSVAGDGGAGGNAG

SEQ ID NO: 193631 - protein, 7 aa, Mycobacterium bovis
AGGDAEG

SEQ ID NO: 193632 - protein, 119 aa, Mycobacterium bovis
AGGDGSGTFNAQANKGGDGGAGGVGGAGGTGGTGGVGADGGRGGDSGRGGDGGNAGHGGAAQFSGRGAYGGEGGSGGAGGNAGGAGTGGTAGSGGAGGFGGNGADGGNGGNGGNGGFGG

SEQ ID NO: 193633 - protein, 25 aa, Mycobacterium bovis
AGGGAGGAGGSGNNVGGAGGAGGVG

SEQ ID NO: 193634 - protein, 7 aa, Mycobacterium bovis
AGGGLAS

SEQ ID NO: 193635 - protein, 14 aa, Mycobacterium bovis
AGGGTALDDVDGTD

SEQ ID NO: 193636 - protein, 12 aa, Mycobacterium bovis
AGGPGATGRSYS

SEQ ID NO: 193637 - protein, 7 aa, Mycobacterium bovis
AGGSELD

SEQ ID NO: 193638 - protein, 599 aa, Mycobacterium bovis
AGGTGGAAGDGGQGGQGGAGGGAGGQGGAGGAGGTGGNGGNITGGTAGTAGAAGNGGAAGKGGAGGQGGTGGGTGGQGGAGGDGGAGGTGGDRTVGGGTVPAGSGGQGGNAGGGGAGGQGGADGGSGGDGGDAGTGGNGGNGGNRNSGNGTGGAGGNGGGGANGGAGGAGGSGGGTGGNGGAGGDAGDAGNGGNGNGTGNGGNGGNGGIAGMGGNGGAGTGSGNGGNGGSGGNGGNAGMGGNSGTGSGDGGAGGNGGAAGTGGTGGDGGLTGTGGTGGSGGTGGDGGNGGNGGNGADNTANMTAQAGGDGGNGGDGGFGGGAGAGGGGLTAGANGTGGQGGAGGDGGNGAIGGHGPLTDDPGGNGGTGGNGGTGGTGGAGIGSLGGGTGGDGGNGGTGGNGGTGGEGGEVGGAGGTGGAAGNGGDGGTGGTGGGDGGAGGTGGTGGTGGLGDPRVGGSGGDGGTGGSGGAAGNGGNGGNAGAGGNGNGGTGGAGGIGGTGGNGGDAEPGVPPGAGGAGGAGTTGGKGGTGGNGSGTGSGGTGGDGGTGGGGGNGGTGWNGGKGDTGSGGGAGDGGKAPAGGTGGAGGDGGAGGKGGSGG

SEQ ID NO: 193639 - protein, 224 aa, Mycobacterium bovis
AGHGGNGGNGGNSGNSTGVAGLAGGAAGAGGNGGGTSSAAGHGGSGGNGGSGGSGGSGTTGGAGAAGGNGGAGAGGGSLSTGQSGGHGGSGGAGGNGGAGSAGNGGAGGAGGNGGAGGNGGGGDAGNAGSGGNGGKGGDGVGPGSTGGAGGKGGAGANGGSSNGNARGGNAGNGGHGGAGGSGDTGGAGGAGGQGGFGGTGGSGSGIGGGAGGNGGNGGAGGTG

SEQ ID NO: 193640 - protein, 11 aa, Mycobacterium bovis
AGIGDRCTEAT

SEQ ID NO: 193641 - protein, 14 aa, Mycobacterium bovis
AGIGGAGGNGGNAG

SEQ ID NO: 193642 - protein, 10 aa, Mycobacterium bovis
AGIQRAKRTR

SEQ ID NO: 193643 - protein, 5 aa, Mycobacterium bovis
AGKYA

SEQ ID NO: 193644 - protein, 5 aa, Mycobacterium bovis
AGLNL

SEQ ID NO: 193645 - protein, 8 aa, Mycobacterium bovis
AGMDTGGV

SEQ ID NO: 193646 - protein, 76 aa, Mycobacterium bovis
AGNGGTGGAGGNGGTGGAGAPGGAGGAGGKADIANSLGDNATVTGGNGGTGGDGGSALGTGGAGGAGGLGGHGGAG

SEQ ID NO: 193647 - protein, 6 aa, Mycobacterium bovis
AGNGRY

SEQ ID NO: 193648 - protein, 8 aa, Mycobacterium bovis
AGNPDYAP

SEQ ID NO: 193649 - protein, 54 aa, Mycobacterium bovis
AGPAPTPTESQLAPPRPPTPQTPTGAPQQPESPAPHVPSHGPHQPRRTAPAPPW

SEQ ID NO: 193650 - protein, 21 aa, Mycobacterium bovis
AGPGLDPRRNQSPAHEPHPAG

SEQ ID NO: 193651 - protein, 19 aa, Mycobacterium bovis
AGPLGSTSRAGHRSYGGVA

SEQ ID NO: 193652 - protein, 4 aa, Mycobacterium bovis
AGPT

SEQ ID NO: 193653 - protein, 6 aa, Mycobacterium bovis
AGPTEQ

SEQ ID NO: 193654 - protein, 7 aa, Mycobacterium bovis
AGRAKLD

SEQ ID NO: 193655 - protein, 12 aa, Mycobacterium bovis
AGRVRGQRWGPR

SEQ ID NO: 193656 - protein, 6 aa, Mycobacterium bovis
AGRWSP

SEQ ID NO: 193657 - protein, 17 aa, Mycobacterium bovis
AGSCASAETTADAPTQA

SEQ ID NO: 193658 - protein, 6 aa, Mycobacterium bovis
AGSEVS

SEQ ID NO: 193659 - protein, 8 aa, Mycobacterium bovis
AGSNRYAD

SEQ ID NO: 193660 - protein, 14 aa, Mycobacterium bovis
AGSPGAPETRANSA

SEQ ID NO: 193661 - protein, 13 aa, Mycobacterium bovis
AGSSAVVGAVVGP

SEQ ID NO: 193662 - protein, 7 aa, Mycobacterium bovis
AGSSQIQ

SEQ ID NO: 193663 - protein, 164 aa, Mycobacterium bovis
AGTNPTPIGTAAPGSDGVNQIGNGGNTDLTGGAGGDGNAGSTTVNGGNGGTGGAARNSSGGTGNSFGGAGGAGGDGANGGDGGAGGEALTEGGATAVSGAGGKGGNAEASGGAGGNGGKGGFAQATTSVTGGNGGNGGNGHDSNAPGGAGGSGGVGGDGGRGGL

SEQ ID NO: 193664 - protein, 5 aa, Mycobacterium bovis
AGTQF

SEQ ID NO: 193665 - protein, 9 aa, Mycobacterium bovis
AGTRGPLTD

SEQ ID NO: 193666 - protein, 6 aa, Mycobacterium bovis
AHPTGE

SEQ ID NO: 193667 - protein, 8 aa, Mycobacterium bovis
AIGETDEY

SEQ ID NO: 193668 - protein, 5 aa, Mycobacterium bovis
AIPDD

SEQ ID NO: 193669 - protein, 6 aa, Mycobacterium bovis
AISGGA

SEQ ID NO: 193670 - protein, 8 aa, Mycobacterium bovis
AITPDEGA

SEQ ID NO: 193671 - protein, 5 aa, Mycobacterium bovis
AKAAT

SEQ ID NO: 193672 - protein, 16 aa, Mycobacterium bovis
AKEGTDDQRARLLPGA

SEQ ID NO: 193673 - protein, 12 aa, Mycobacterium bovis
AKRRDATQLLEV

SEQ ID NO: 193674 - protein, 10 aa, Mycobacterium bovis
AKTDQSLGTS

SEQ ID NO: 193675 - protein, 7 aa, Mycobacterium bovis
AKTHADS

SEQ ID NO: 193676 - protein, 5 aa, Mycobacterium bovis
AKTNN

SEQ ID NO: 193677 - protein, 9 aa, Mycobacterium bovis
ALAQEKTGE

SEQ ID NO: 193678 - protein, 21 aa, Mycobacterium bovis
ALASAAPAGPAARAATAAPAG

SEQ ID NO: 193679 - protein, 5 aa, Mycobacterium bovis
ALEGD

SEQ ID NO: 193680 - protein, 17 aa, Mycobacterium bovis
ALGEPGEHSLPASTPIT

SEQ ID NO: 193681 - protein, 14 aa, Mycobacterium bovis
ALNEGSGSNPPRGV

SEQ ID NO: 193682 - protein, 5 aa, Mycobacterium bovis
ALPNL

SEQ ID NO: 193683 - protein, 16 aa, Mycobacterium bovis
AMRERSELARKGIARA

SEQ ID NO: 193684 - protein, 498 aa, Mycobacterium bovis
ANGDPGFAGGKGGNGGIGGAAVTGGVAGDGGTGGKGGTGGAGGAGNDAGSTGNPGGKGGDGGIGGAGGAGGAAGTGNGGHAGNTGDGGDGGTGGNGGNGTGGVNGADNTLNPDTPGGAGEPGGAGGAGGAGGAAGGPGGTGGTGGNGGNAGNNSTNAPVGGEGGAGGDGGAGGAGGAANGGTAGSQGTGGVGGDGGAGGNGGGGKAGTGNSGNFGVDGEAGFSGGAGGNGGVGGAAGANGGTGGSGGNGGDGGAGGIGGAGGNGIPGTGTEPAGGTGAKGGDGGDGGAGGAGGNAGGAGGNGGAGGQGGNAGQGGAGGAGGNAVIPGDGVGKAPHGGAGGSGGDGGKGGQGGSGGTGGSGAPIGGGAGGTGGSGGHAGKGGAGGIGAQGTTITVPGNGGNAGDGGNGGGGGAGGTGGDGATGTPAGNGGNGGNAGDGGNGGSGDFGGNTTSGASGSGGNGGNAGTAGSGGAGGTGGTGLSGGNGGNGGDGGNGAHGTV

SEQ ID NO: 193685 - protein, 510 aa, Mycobacterium bovis
ANGDPGFAGGKGGNGGIGGAAVTGGVAGDGGTGGKGGTGGAGGAGNDAGSTGNPGGKGGDGGIGGAGGAGGAAGTGNGGHAGNTGDGGDGGTGGNGGNGTGGVNGADNTLNPDTPGGAGEPGGAGGAGGAGGAAGGPGGTGGTGGNGGNGGNGGNGGNAGNNSTNAPVGGEGGAGGDGGAGGAGGAANGGTAGSQGTGGVGGDGGAGGNGGGGKAGTGNSGNFGVDGEAGFSGGAGGNGGVGGAAGANGGTGGSGGNGGDGGAGGIGGAGGNGIPGTGTEPAGGTGAKGGDGGDGGAGGAGGNAGGAGGNGGAGGQGGNAGQGGAGGAGGNAVIPGDGVGKAPHGGAGGSGGDGGKGGQGGSGGTGGSGAPIGGGAGGTGGSGGHAGKGGAGGIGAQGTTITVPGNGGNAGDGGNGGGGGAGGTGGDGATGTPAGNGGDGGNGGNAGDGGNGGSGDFGGNTTSGASGSGGNGGNAGTAGSGGAGGTGGTGLSGGNGGNGGDGGNGAHGTV

SEQ ID NO: 193686 - protein, 510 aa, Mycobacterium bovis
ANGDPGFAGGKGGNGGIGGAAVTGGVAGDGGTGGKGGTGGAGGAGNDAGSTGNPGGKGGDGGIGGAGGAGGAAGTGNGGHAGNTGDGGDGGTGGNGGNGTGGVNGADNTLNPDTPGGAGEPGGAGGAGGAGGAAGGPGGTGGTGGNGGNGGNGGNGGNAGNNSTNAPVGGEGGAGGDGGAGGAGGAANGGTAGSQGTGGVGGNGGAGGNGGGGKAGTGNSGNFGVDGEAGFSGGAGGNGGVGGAAGANGGTGGSGGNGGDGGAGGIGGAGGNGIPGTGTEPAGGTGAKGGDGGDGGAGGAGGNAGGAGGNGGAGGQGGNAGQGGAGGAGGNAVIPGDGVGKAPHGGAGGSGGDGGKGGQGGSGGTGGSGAPIGGGAGGTGGSGGHAGKGGAGGIGAQGTTITVPGNGGNAGDGGNGGGGGAGGTGGDGATGTPAGNGGDGGNGGNAGDGGNGGSGDFGGNTTSGASGSGGNGGNAGTAGSGGAGGTGGTGLSGGNGGNGGDGGNGAHGTV

SEQ ID NO: 193687 - protein, 14 aa, Mycobacterium bovis
ANGGVGGSGGNATL

SEQ ID NO: 193688 - protein, 6 aa, Mycobacterium bovis
ANGKSV

SEQ ID NO: 193689 - protein, 19 aa, Mycobacterium bovis
ANGNNGDVNFGGGNTGDFN

SEQ ID NO: 193690 - protein, 31 aa, Mycobacterium bovis
ANPAPGDNAARKTGRGGARQSPQSRVQRVAT

SEQ ID NO: 193691 - protein, 4 aa, Mycobacterium bovis
ANQR

SEQ ID NO: 193692 - protein, 21 aa, Mycobacterium bovis
ANSAAAAQTTAVAAAGADEVS

SEQ ID NO: 193693 - protein, 6 aa, Mycobacterium bovis
APDETT

SEQ ID NO: 193694 - protein, 8 aa, Mycobacterium bovis
APDGGPAQ

SEQ ID NO: 193695 - protein, 4 aa, Mycobacterium bovis
APDH

SEQ ID NO: 193696 - protein, 20 aa, Mycobacterium bovis
APDPVVSTTTPDDADAAAAG

SEQ ID NO: 193697 - protein, 5 aa, Mycobacterium bovis
APENV

SEQ ID NO: 193698 - protein, 12 aa, Mycobacterium bovis
APEYSSAQRALS

SEQ ID NO: 193699 - protein, 34 aa, Mycobacterium bovis
APGACNPDDQTPLVDDTPDADAVRRDTRSQAQRH

SEQ ID NO: 193700 - protein, 14 aa, Mycobacterium bovis
APGAIGGAGGPAGL

SEQ ID NO: 193701 - protein, 15 aa, Mycobacterium bovis
APGDDGDGLNPFAPD

SEQ ID NO: 193702 - protein, 14 aa, Mycobacterium bovis
APGSGGAAAAAKGE

SEQ ID NO: 193703 - protein, 4 aa, Mycobacterium bovis
APHS

SEQ ID NO: 193704 - protein, 10 aa, Mycobacterium bovis
APPLTDEQRT

SEQ ID NO: 193705 - protein, 17 aa, Mycobacterium bovis
APPPPPPPPPPPPPTPM

SEQ ID NO: 193706 - protein, 23 aa, Mycobacterium bovis
APPTEASAALEPALETPESPVET

SEQ ID NO: 193707 - protein, 12 aa, Mycobacterium bovis
APQLSSSDGRGP

SEQ ID NO: 193708 - protein, 7 aa, Mycobacterium bovis
APSSLPA

SEQ ID NO: 193709 - protein, 6 aa, Mycobacterium bovis
APTHRS

SEQ ID NO: 193710 - protein, 4 aa, Mycobacterium bovis
APVA

SEQ ID NO: 193711 - protein, 6 aa, Mycobacterium bovis
APVAGS

SEQ ID NO: 193712 - protein, 5 aa, Mycobacterium bovis
APVDP

SEQ ID NO: 193713 - protein, 6 aa, Mycobacterium bovis
AQAEQI

SEQ ID NO: 193714 - protein, 538 aa, Mycobacterium bovis
AQDGGQGGTGGTGGNAGAGGTGFTQGADGNAGNGGDGGVGGNGGNGADNTTTAAAGTTGGAGGAGGAGGTGGTGGAAGTGTGGQQGNGGNGGNGGTGGKGGTGGDGALAGSSGGAGGKGGNGGDAGKAGTGSAPGTAGTGGDGGKGGNGGIGAAGTTGPVGTGASGGTGGSGGAGGTGGDGGAANGGTAGAGGAGGNGGKGGDGGAGVTSSTAGNSGGAGGSGGKGGDAGAGGAGATPGANGIAGNGGDGGDGAAGAVGISGATGAGDGGHGGTGGAGGNGGTGGAGGSGIDGVGGGTGGTGGNGGNGAIGGAGGDAGGSGNSGGNGGTGGKGGNAGAGGAAGSNGGTVGANGTGGDGGNGGAAGAATAGSNGGAGTGSAGGNGGTGGRGGSGGAGGDGIGGVGGGKGGNGADGEVGGAGGAGGSGPNTSPGGNGGQGGQGGSGGAGGAAGAGGAGGGANGTAGNGGQGGAGGTGGAGAASSATNGGSGGAGGTGGAGGTGGAGGDGVGGAGGGNGGHGGDAGDGGNGANGNNRSSGS

SEQ ID NO: 193715 - protein, 6 aa, Mycobacterium bovis
AQEAGN

SEQ ID NO: 193716 - protein, 19 aa, Mycobacterium bovis
AQEVSDDSPALAQPAVPNY

SEQ ID NO: 193717 - protein, 6 aa, Mycobacterium bovis
AQGEEI

SEQ ID NO: 193718 - protein, 7 aa, Mycobacterium bovis
AQGESMD

SEQ ID NO: 193719 - protein, 8 aa, Mycobacterium bovis
AQGPELAP

SEQ ID NO: 193720 - protein, 10 aa, Mycobacterium bovis
AQGYSDSQGI

SEQ ID NO: 193721 - protein, 8 aa, Mycobacterium bovis
AQQRESFG

SEQ ID NO: 193722 - protein, 15 aa, Mycobacterium bovis
AQRGAQCGQREKSCR

SEQ ID NO: 193723 - protein, 113 aa, Mycobacterium bovis
AQRLPAEGPAVKRGVGASAAKKVAKKAPAKKATKAAKKAATKAPAKKAATKAPAKKAVKATKSPAKKVTKAVKKTAVKASVRKAATKAPAKKAAAKRPATKAPAKKATARRGR

SEQ ID NO: 193724 - protein, 8 aa, Mycobacterium bovis
AQRRDPDA

SEQ ID NO: 193725 - protein, 10 aa, Mycobacterium bovis
AQRYQTENYR

SEQ ID NO: 193726 - protein, 14 aa, Mycobacterium bovis
AQTGPTAKLSSAPM

SEQ ID NO: 193727 - protein, 5 aa, Mycobacterium bovis
AQVPA

SEQ ID NO: 193728 - protein, 8 aa, Mycobacterium bovis
ARAAQTDW

SEQ ID NO: 193729 - protein, 17 aa, Mycobacterium bovis
ARARPRGSSAAHPSPHR

SEQ ID NO: 193730 - protein, 19 aa, Mycobacterium bovis
ARDAATAAASARQRGRGDA

SEQ ID NO: 193731 - protein, 52 aa, Mycobacterium bovis
ARDEGAGASPGQQPGGGVPAQAMDTGAGARPAASPLAAPVDPSTPAPSTTTT

SEQ ID NO: 193732 - protein, 4 aa, Mycobacterium bovis
ARER

SEQ ID NO: 193733 - protein, 28 aa, Mycobacterium bovis
ARESATRLGPPAGGLAAANTPNPSGAAI

SEQ ID NO: 193734 - protein, 12 aa, Mycobacterium bovis
ARGHRRDGSAGR

SEQ ID NO: 193735 - protein, 7 aa, Mycobacterium bovis
ARMPNNA

SEQ ID NO: 193736 - protein, 18 aa, Mycobacterium bovis
ARPRSSGIGWRGRISLPL

SEQ ID NO: 193737 - protein, 7 aa, Mycobacterium bovis
ARQTPQQ

SEQ ID NO: 193738 - protein, 6 aa, Mycobacterium bovis
ARRRRA

SEQ ID NO: 193739 - protein, 7 aa, Mycobacterium bovis
ARSPTEE

SEQ ID NO: 193740 - protein, 12 aa, Mycobacterium bovis
ARSREDHRTLGT

SEQ ID NO: 193741 - protein, 12 aa, Mycobacterium bovis
ARSSADPHPTTG

SEQ ID NO: 193742 - protein, 9 aa, Mycobacterium bovis
ARSTQHDAA

SEQ ID NO: 193743 - protein, 10 aa, Mycobacterium bovis
ARTQREQRAK

SEQ ID NO: 193744 - protein, 8 aa, Mycobacterium bovis
ASAAENYG

SEQ ID NO: 193745 - protein, 13 aa, Mycobacterium bovis
ASAEKPATEQAEP

SEQ ID NO: 193746 - protein, 10 aa, Mycobacterium bovis
ASAGSGADGA

SEQ ID NO: 193747 - protein, 7 aa, Mycobacterium bovis
ASAIQGN

SEQ ID NO: 193748 - protein, 4 aa, Mycobacterium bovis
ASDA

SEQ ID NO: 193749 - protein, 4 aa, Mycobacterium bovis
ASDP

SEQ ID NO: 193750 - protein, 6 aa, Mycobacterium bovis
ASDPEG

SEQ ID NO: 193751 - protein, 11 aa, Mycobacterium bovis
ASENPAELAPG

SEQ ID NO: 193752 - protein, 7 aa, Mycobacterium bovis
ASEQGRG

SEQ ID NO: 193753 - protein, 6 aa, Mycobacterium bovis
ASFNSV

SEQ ID NO: 193754 - protein, 27 aa, Mycobacterium bovis
ASFPPAPASANLPKPNGQTPPPTSDDL

SEQ ID NO: 193755 - protein, 26 aa, Mycobacterium bovis
ASGGAGGAGGSGGTGGAGGTGGAGGL

SEQ ID NO: 193756 - protein, 10 aa, Mycobacterium bovis
ASGGSGGFGG

SEQ ID NO: 193757 - protein, 7 aa, Mycobacterium bovis
ASGYAGG

SEQ ID NO: 193758 - protein, 7 aa, Mycobacterium bovis
ASLPSGG

SEQ ID NO: 193759 - protein, 5 aa, Mycobacterium bovis
ASPDG

SEQ ID NO: 193760 - protein, 15 aa, Mycobacterium bovis
ASQSDAPVGAPRQFR

SEQ ID NO: 193761 - protein, 13 aa, Mycobacterium bovis
ASRAVSASLARAN

SEQ ID NO: 193762 - protein, 7 aa, Mycobacterium bovis
ASRETVN

SEQ ID NO: 193763 - protein, 14 aa, Mycobacterium bovis
ASRTRLHASTDDVR

SEQ ID NO: 193764 - protein, 5 aa, Mycobacterium bovis
ASSIG

SEQ ID NO: 193765 - protein, 5 aa, Mycobacterium bovis
ASTEE

SEQ ID NO: 193766 - protein, 6 aa, Mycobacterium bovis
ATADQP

SEQ ID NO: 193767 - protein, 5 aa, Mycobacterium bovis
ATATP

SEQ ID NO: 193768 - protein, 12 aa, Mycobacterium bovis
ATDDAPAEPPRA

SEQ ID NO: 193769 - protein, 4 aa, Mycobacterium bovis
ATDM

SEQ ID NO: 193770 - protein, 7 aa, Mycobacterium bovis
ATDNPVG

SEQ ID NO: 193771 - protein, 6 aa, Mycobacterium bovis
ATDTGS

SEQ ID NO: 193772 - protein, 7 aa, Mycobacterium bovis
ATECKDR

SEQ ID NO: 193773 - protein, 22 aa, Mycobacterium bovis
ATEVTAATAGGAAPADKAVSVP

SEQ ID NO: 193774 - protein, 11 aa, Mycobacterium bovis
ATGATAPLGSH

SEQ ID NO: 193775 - protein, 15 aa, Mycobacterium bovis
ATGDFRRGSISENYR

SEQ ID NO: 193776 - protein, 27 aa, Mycobacterium bovis
ATGLTDQPDLSQLGDQANDTTGSSETV

SEQ ID NO: 193777 - protein, 5 aa, Mycobacterium bovis
ATGNK

SEQ ID NO: 193778 - protein, 8 aa, Mycobacterium bovis
ATGSTETG

SEQ ID NO: 193779 - protein, 16 aa, Mycobacterium bovis
ATKTNDVAGDGTTTAT

SEQ ID NO: 193780 - protein, 6 aa, Mycobacterium bovis
ATMDPT

SEQ ID NO: 193781 - protein, 10 aa, Mycobacterium bovis
ATPDKRSTTV

SEQ ID NO: 193782 - protein, 6 aa, Mycobacterium bovis
ATPEES

SEQ ID NO: 193783 - protein, 7 aa, Mycobacterium bovis
ATPGDGW

SEQ ID NO: 193784 - protein, 14 aa, Mycobacterium bovis
ATPGPYELSQTGGE

SEQ ID NO: 193785 - protein, 21 aa, Mycobacterium bovis
ATPPPAPPSLRRAPASTSPRL

SEQ ID NO: 193786 - protein, 10 aa, Mycobacterium bovis
ATRPPRPGRR

SEQ ID NO: 193787 - protein, 14 aa, Mycobacterium bovis
ATRSSGQDSAGYGR

SEQ ID NO: 193788 - protein, 7 aa, Mycobacterium bovis
ATSAKEA

SEQ ID NO: 193789 - protein, 8 aa, Mycobacterium bovis
ATSQRKID

SEQ ID NO: 193790 - protein, 5 aa, Mycobacterium bovis
ATSRY

SEQ ID NO: 193791 - protein, 10 aa, Mycobacterium bovis
ATSTPDGTPH

SEQ ID NO: 193792 - protein, 7 aa, Mycobacterium bovis
ATSTRFG

SEQ ID NO: 193793 - protein, 12 aa, Mycobacterium bovis
ATTGRSAAATAA

SEQ ID NO: 193794 - protein, 21 aa, Mycobacterium bovis
ATTPASPPETAPQAVPKSPSG

SEQ ID NO: 193795 - protein, 6 aa, Mycobacterium bovis
ATTPNS

SEQ ID NO: 193796 - protein, 4 aa, Mycobacterium bovis
AVGG

SEQ ID NO: 193797 - protein, 40 aa, Mycobacterium bovis
AVGGDGGNGGNGGHGGDGTTGGAGGKGGNGSSGAASGSGV

SEQ ID NO: 193798 - protein, 15 aa, Mycobacterium bovis
AVGVTQSARPGLDTE

SEQ ID NO: 193799 - protein, 8 aa, Mycobacterium bovis
AVPGTDTM

SEQ ID NO: 193800 - protein, 8 aa, Mycobacterium bovis
AVRGRGGL

SEQ ID NO: 193801 - protein, 15 aa, Mycobacterium bovis
AVSGNSGVDPDQAAR

SEQ ID NO: 193802 - protein, 18 aa, Mycobacterium bovis
AVTAGTAGAEVTADAVPV

SEQ ID NO: 193803 - protein, 6 aa, Mycobacterium bovis
AVTATN

SEQ ID NO: 193804 - protein, 13 aa, Mycobacterium bovis
AWGGSGSEAYQGV

SEQ ID NO: 193805 - protein, 12 aa, Mycobacterium bovis
CAQPQPGQSAPS

SEQ ID NO: 193806 - protein, 7 aa, Mycobacterium bovis
CESASGV

SEQ ID NO: 193807 - protein, 9 aa, Mycobacterium bovis
CGASRGRVA

SEQ ID NO: 193808 - protein, 8 aa, Mycobacterium bovis
CGDRSAAV

SEQ ID NO: 193809 - protein, 18 aa, Mycobacterium bovis
CGGPGAQIAAEGAENAGP

SEQ ID NO: 193810 - protein, 11 aa, Mycobacterium bovis
CNDQGDPPYQG

SEQ ID NO: 193811 - protein, 6 aa, Mycobacterium bovis
CPSSAI

SEQ ID NO: 193812 - protein, 7 aa, Mycobacterium bovis
CQNPPQL

SEQ ID NO: 193813 - protein, 11 aa, Mycobacterium bovis
CRGGGAVTSRD

SEQ ID NO: 193814 - protein, 22 aa, Mycobacterium bovis
CRNTTDHHHDDETTNITNQLVQ

SEQ ID NO: 193815 - protein, 6 aa, Mycobacterium bovis
CRSGPL

SEQ ID NO: 193816 - protein, 7 aa, Mycobacterium bovis
CSSGSEA

SEQ ID NO: 193817 - protein, 25 aa, Mycobacterium bovis
CTSPRSRNRSFGERLGRGETLQSAG

SEQ ID NO: 193818 - protein, 6 aa, Mycobacterium bovis
DAAESV

SEQ ID NO: 193819 - protein, 22 aa, Mycobacterium bovis
DAARRAAEGAAGVPAARRGRGL

SEQ ID NO: 193820 - protein, 8 aa, Mycobacterium bovis
DADAEDMG

SEQ ID NO: 193821 - protein, 6 aa, Mycobacterium bovis
DADPRK

SEQ ID NO: 193822 - protein, 10 aa, Mycobacterium bovis
DAEITTTAGP

SEQ ID NO: 193823 - protein, 5 aa, Mycobacterium bovis
DAEPV

SEQ ID NO: 193824 - protein, 6 aa, Mycobacterium bovis
DAEVPA

SEQ ID NO: 193825 - protein, 9 aa, Mycobacterium bovis
DAGETGGEG

SEQ ID NO: 193826 - protein, 15 aa, Mycobacterium bovis
DAGPKNVKTQIQGDE

SEQ ID NO: 193827 - protein, 6 aa, Mycobacterium bovis
DAGPTL

SEQ ID NO: 193828 - protein, 31 aa, Mycobacterium bovis
DAHRDESAGLDRGDPGQDVDRDLQRRVVGPM

SEQ ID NO: 193829 - protein, 5 aa, Mycobacterium bovis
DALEQ

SEQ ID NO: 193830 - protein, 7 aa, Mycobacterium bovis
DAPDEAP

SEQ ID NO: 193831 - protein, 12 aa, Mycobacterium bovis
DAPGRAPGRKSV

SEQ ID NO: 193832 - protein, 15 aa, Mycobacterium bovis
DAPHGSKQANTGGSI

SEQ ID NO: 193833 - protein, 8 aa, Mycobacterium bovis
DARPDRLP

SEQ ID NO: 193834 - protein, 11 aa, Mycobacterium bovis
DARPIRKGRLG

SEQ ID NO: 193835 - protein, 12 aa, Mycobacterium bovis
DASADGYVRGEG

SEQ ID NO: 193836 - protein, 7 aa, Mycobacterium bovis
DATATEL

SEQ ID NO: 193837 - protein, 10 aa, Mycobacterium bovis
DATDKDRTRV

SEQ ID NO: 193838 - protein, 10 aa, Mycobacterium bovis
DDGSGRTYQL

SEQ ID NO: 193839 - protein, 13 aa, Mycobacterium bovis
DDIPESGKMTGRS

SEQ ID NO: 193840 - protein, 7 aa, Mycobacterium bovis
DDKERAE

SEQ ID NO: 193841 - protein, 9 aa, Mycobacterium bovis
DDLDPRRRT

SEQ ID NO: 193842 - protein, 7 aa, Mycobacterium bovis
DDNQPRA

SEQ ID NO: 193843 - protein, 6 aa, Mycobacterium bovis
DDPEYP

SEQ ID NO: 193844 - protein, 7 aa, Mycobacterium bovis
DDVPDEV

SEQ ID NO: 193845 - protein, 6 aa, Mycobacterium bovis
DDVRAA

SEQ ID NO: 193846 - protein, 8 aa, Mycobacterium bovis
DDYTTTQA

SEQ ID NO: 193847 - protein, 8 aa, Mycobacterium bovis
DEKSASDM

SEQ ID NO: 193848 - protein, 8 aa, Mycobacterium bovis
DEPDAERF

SEQ ID NO: 193849 - protein, 8 aa, Mycobacterium bovis
DEPRPITS

SEQ ID NO: 193850 - protein, 7 aa, Mycobacterium bovis
DEQDREL

SEQ ID NO: 193851 - protein, 7 aa, Mycobacterium bovis
DERTRSH

SEQ ID NO: 193852 - protein, 14 aa, Mycobacterium bovis
DERVDDGTGSDTPK

SEQ ID NO: 193853 - protein, 7 aa, Mycobacterium bovis
DESQLPA

SEQ ID NO: 193854 - protein, 17 aa, Mycobacterium bovis
DGASQLRDASAAQRQQR

SEQ ID NO: 193855 - protein, 172 aa, Mycobacterium bovis
DGEPGGDGGDGGDGGWGRPGGQGGFGSTSGAHGKAGFGAPGGDGGDGGNGGHGGDGNGSFADAGDGGPGGNGGNGGLGGAGRDGGAPGGDGGDGGTGGSGGFGAPPPRSIGGGDGGDGGRGGDGGRGAGGLTSGGVGSSGESGGSGNGRGDPGSGGSGGEGGEGGPSISVNV

SEQ ID NO: 193856 - protein, 172 aa, Mycobacterium bovis
DGEPGGDGGDGGDGGWGRPGGQGGFGSTSGAHGKAGFSAPGGDGGDGGNGGHGGDGNGSFADAGDGGPGGNGGNGGLGGAGRDGGAPGGDGGDGGTGGSGGFGAPPPRSIGGGDGGDGGRGGDGGRGAGGLTSGGVGSSGESGGSGNGRGDPGSGGSGGEGGEGGPSISVNV

SEQ ID NO: 193857 - protein, 7 aa, Mycobacterium bovis
DGFGSTE

SEQ ID NO: 193858 - protein, 76 aa, Mycobacterium bovis
DGGAGGAGGVGGTGGSGAPGGGGAGGDGGAANTDSAGSSRKAFGGDGGVGGDGASALGTGGEGGIGGQGGNGGAGG

SEQ ID NO: 193859 - protein, 6 aa, Mycobacterium bovis
DGGGAV

SEQ ID NO: 193860 - protein, 10 aa, Mycobacterium bovis
DGGKPTQVHR

SEQ ID NO: 193861 - protein, 43 aa, Mycobacterium bovis
DGGNGGAGGAGGIGGDGATGGPGEAAATLASRGLTAQTPRQNP

SEQ ID NO: 193862 - protein, 4 aa, Mycobacterium bovis
DGID

SEQ ID NO: 193863 - protein, 6 aa, Mycobacterium bovis
DGLPGV

SEQ ID NO: 193864 - protein, 10 aa, Mycobacterium bovis
DGPCTDDGEM

SEQ ID NO: 193865 - protein, 7 aa, Mycobacterium bovis
DGPPPGQ

SEQ ID NO: 193866 - protein, 12 aa, Mycobacterium bovis
DGRVPNPGEFAD

SEQ ID NO: 193867 - protein, 9 aa, Mycobacterium bovis
DGSLAPQQP

SEQ ID NO: 193868 - protein, 7 aa, Mycobacterium bovis
DGSREAG

SEQ ID NO: 193869 - protein, 12 aa, Mycobacterium bovis
DHRDGARGRGRG

SEQ ID NO: 193870 - protein, 8 aa, Mycobacterium bovis
DHRSYAGT

SEQ ID NO: 193871 - protein, 6 aa, Mycobacterium bovis
DIASEQ

SEQ ID NO: 193872 - protein, 5 aa, Mycobacterium bovis
DIGPR

SEQ ID NO: 193873 - protein, 16 aa, Mycobacterium bovis
DINTGGFNGGNVNTGF

SEQ ID NO: 193874 - protein, 6 aa, Mycobacterium bovis
DKENNV

SEQ ID NO: 193875 - protein, 19 aa, Mycobacterium bovis
DKGKQAAARITEATPGAEV

SEQ ID NO: 193876 - protein, 8 aa, Mycobacterium bovis
DKLPLGGG

SEQ ID NO: 193877 - protein, 4 aa, Mycobacterium bovis
DKNA

SEQ ID NO: 193878 - protein, 7 aa, Mycobacterium bovis
DKNAAAQ

SEQ ID NO: 193879 - protein, 7 aa, Mycobacterium bovis
DLTDSGR

SEQ ID NO: 193880 - protein, 12 aa, Mycobacterium bovis
DLVPEDRAGDHA

SEQ ID NO: 193881 - protein, 7 aa, Mycobacterium bovis
DNDDSVD

SEQ ID NO: 193882 - protein, 8 aa, Mycobacterium bovis
DNDDSVDA

SEQ ID NO: 193883 - protein, 12 aa, Mycobacterium bovis
DNDMHDGSIAQG

SEQ ID NO: 193884 - protein, 4 aa, Mycobacterium bovis
DNEH

SEQ ID NO: 193885 - protein, 12 aa, Mycobacterium bovis
DNLAGSPEIVPN

SEQ ID NO: 193886 - protein, 10 aa, Mycobacterium bovis
DNTPSGSTVA

SEQ ID NO: 193887 - protein, 13 aa, Mycobacterium bovis
DNYTGHVERGKAA

SEQ ID NO: 193888 - protein, 5 aa, Mycobacterium bovis
DPAFA

SEQ ID NO: 193889 - protein, 5 aa, Mycobacterium bovis
DPARR

SEQ ID NO: 193890 - protein, 9 aa, Mycobacterium bovis
DPDEDAGTA

SEQ ID NO: 193891 - protein, 8 aa, Mycobacterium bovis
DPDEPTYD

SEQ ID NO: 193892 - protein, 15 aa, Mycobacterium bovis
DPFSGIGKPEPLQGE

SEQ ID NO: 193893 - protein, 5 aa, Mycobacterium bovis
DPGAL

SEQ ID NO: 193894 - protein, 4 aa, Mycobacterium bovis
DPGF

SEQ ID NO: 193895 - protein, 6 aa, Mycobacterium bovis
DPIDAR

SEQ ID NO: 193896 - protein, 14 aa, Mycobacterium bovis
DPITDDDATNPLTE

SEQ ID NO: 193897 - protein, 11 aa, Mycobacterium bovis
DPRSREQRRAD

SEQ ID NO: 193898 - protein, 9 aa, Mycobacterium bovis
DPSADSTTT

SEQ ID NO: 193899 - protein, 26 aa, Mycobacterium bovis
DPSYRLKTTTAEQIASRADPWDPGSV

SEQ ID NO: 193900 - protein, 12 aa, Mycobacterium bovis
DPTSVADDFTRP

SEQ ID NO: 193901 - protein, 7 aa, Mycobacterium bovis
DPYAGTP

SEQ ID NO: 193902 - protein, 16 aa, Mycobacterium bovis
DQAGNADPMVREWRLM

SEQ ID NO: 193903 - protein, 6 aa, Mycobacterium bovis
DQDELA

SEQ ID NO: 193904 - protein, 6 aa, Mycobacterium bovis
DQENPL

SEQ ID NO: 193905 - protein, 4 aa, Mycobacterium bovis
DQPP

SEQ ID NO: 193906 - protein, 13 aa, Mycobacterium bovis
DQVESTAGSLQGQ

SEQ ID NO: 193907 - protein, 10 aa, Mycobacterium bovis
DRANATATRL

SEQ ID NO: 193908 - protein, 25 aa, Mycobacterium bovis
DRARPNGGGPISRPTSGWHQQPKTR

SEQ ID NO: 193909 - protein, 5 aa, Mycobacterium bovis
DRDNP

SEQ ID NO: 193910 - protein, 4 aa, Mycobacterium bovis
DREL

SEQ ID NO: 193911 - protein, 14 aa, Mycobacterium bovis
DRKPKDLSGGQRQR

SEQ ID NO: 193912 - protein, 4 aa, Mycobacterium bovis
DRNS

SEQ ID NO: 193913 - protein, 10 aa, Mycobacterium bovis
DRRGWGSGGA

SEQ ID NO: 193914 - protein, 10 aa, Mycobacterium bovis
DRVGRQSGAT

SEQ ID NO: 193915 - protein, 4 aa, Mycobacterium bovis
DSAA

SEQ ID NO: 193916 - protein, 5 aa, Mycobacterium bovis
DSAAA

SEQ ID NO: 193917 - protein, 7 aa, Mycobacterium bovis
DSERPLS

SEQ ID NO: 193918 - protein, 7 aa, Mycobacterium bovis
DSHGSSW

SEQ ID NO: 193919 - protein, 14 aa, Mycobacterium bovis
DSKYPYTPDGNREF

SEQ ID NO: 193920 - protein, 18 aa, Mycobacterium bovis
DSNDTSVAGGAAGADSRV

SEQ ID NO: 193921 - protein, 14 aa, Mycobacterium bovis
DSPRPRLPADHPGV

SEQ ID NO: 193922 - protein, 9 aa, Mycobacterium bovis
DSTSGFQNI

SEQ ID NO: 193923 - protein, 4 aa, Mycobacterium bovis
DSWD

SEQ ID NO: 193924 - protein, 5 aa, Mycobacterium bovis
DTAEF

SEQ ID NO: 193925 - protein, 5 aa, Mycobacterium bovis
DTEAA

SEQ ID NO: 193926 - protein, 7 aa, Mycobacterium bovis
DTEHPDE

SEQ ID NO: 193927 - protein, 6 aa, Mycobacterium bovis
DTENAY

SEQ ID NO: 193928 - protein, 9 aa, Mycobacterium bovis
DTPDGDEAL

SEQ ID NO: 193929 - protein, 5 aa, Mycobacterium bovis
DTPRS

SEQ ID NO: 193930 - protein, 16 aa, Mycobacterium bovis
DTPTGLTCPYTTPLDV

SEQ ID NO: 193931 - protein, 8 aa, Mycobacterium bovis
DTRDAATS

SEQ ID NO: 193932 - protein, 19 aa, Mycobacterium bovis
DVDPPGPAQAGRRRRAIAM

SEQ ID NO: 193933 - protein, 8 aa, Mycobacterium bovis
DVNPPGDE

SEQ ID NO: 193934 - protein, 35 aa, Mycobacterium bovis
DVNTGGFNPGSYNTGNFNTGNYNTGSFNAGNYNTG

SEQ ID NO: 193935 - protein, 6 aa, Mycobacterium bovis
DVSESV

SEQ ID NO: 193936 - protein, 6 aa, Mycobacterium bovis
DVSSQT

SEQ ID NO: 193937 - protein, 5 aa, Mycobacterium bovis
DWQGV

SEQ ID NO: 193938 - protein, 4 aa, Mycobacterium bovis
DYSV

SEQ ID NO: 193939 - protein, 7 aa, Mycobacterium bovis
EAASDID

SEQ ID NO: 193940 - protein, 12 aa, Mycobacterium bovis
EADSYSSPTPCD

SEQ ID NO: 193941 - protein, 8 aa, Mycobacterium bovis
EAEAQERF

SEQ ID NO: 193942 - protein, 4 aa, Mycobacterium bovis
EAEE

SEQ ID NO: 193943 - protein, 5 aa, Mycobacterium bovis
EAEGW

SEQ ID NO: 193944 - protein, 5 aa, Mycobacterium bovis
EAGGL

SEQ ID NO: 193945 - protein, 8 aa, Mycobacterium bovis
EAGKARWA

SEQ ID NO: 193946 - protein, 4 aa, Mycobacterium bovis
EAIG

SEQ ID NO: 193947 - protein, 4 aa, Mycobacterium bovis
EAPS

SEQ ID NO: 193948 - protein, 6 aa, Mycobacterium bovis
EAPTGW

SEQ ID NO: 193949 - protein, 5 aa, Mycobacterium bovis
EAPTH

SEQ ID NO: 193950 - protein, 7 aa, Mycobacterium bovis
EAQRERR

SEQ ID NO: 193951 - protein, 8 aa, Mycobacterium bovis
EAQRERRK

SEQ ID NO: 193952 - protein, 10 aa, Mycobacterium bovis
EAQRTHQALT

SEQ ID NO: 193953 - protein, 4 aa, Mycobacterium bovis
EARS

SEQ ID NO: 193954 - protein, 15 aa, Mycobacterium bovis
EATAGPAAPAASAPL

SEQ ID NO: 193955 - protein, 5 aa, Mycobacterium bovis
EATHR

SEQ ID NO: 193956 - protein, 4 aa, Mycobacterium bovis
EDAR

SEQ ID NO: 193957 - protein, 10 aa, Mycobacterium bovis
EDDGSSRNQI

SEQ ID NO: 193958 - protein, 10 aa, Mycobacterium bovis
EDDPRTLAQR

SEQ ID NO: 193959 - protein, 7 aa, Mycobacterium bovis
EDGREGD

SEQ ID NO: 193960 - protein, 7 aa, Mycobacterium bovis
EDKGMRD

SEQ ID NO: 193961 - protein, 7 aa, Mycobacterium bovis
EDRPALK

SEQ ID NO: 193962 - protein, 15 aa, Mycobacterium bovis
EDYDRVPADEPNPEQ

SEQ ID NO: 193963 - protein, 4 aa, Mycobacterium bovis
EEGE

SEQ ID NO: 193964 - protein, 4 aa, Mycobacterium bovis
EENA

SEQ ID NO: 193965 - protein, 4 aa, Mycobacterium bovis
EEPP

SEQ ID NO: 193966 - protein, 4 aa, Mycobacterium bovis
EEQL

SEQ ID NO: 193967 - protein, 9 aa, Mycobacterium bovis
EFGPSARTR

SEQ ID NO: 193968 - protein, 7 aa, Mycobacterium bovis
EFPNTRM

SEQ ID NO: 193969 - protein, 6 aa, Mycobacterium bovis
EGADLR

SEQ ID NO: 193970 - protein, 14 aa, Mycobacterium bovis
EGAGPPVRRAPART

SEQ ID NO: 193971 - protein, 7 aa, Mycobacterium bovis
EGEPGDR

SEQ ID NO: 193972 - protein, 9 aa, Mycobacterium bovis
EGIGGHESF

SEQ ID NO: 193973 - protein, 7 aa, Mycobacterium bovis
EGKQSLT

SEQ ID NO: 193974 - protein, 4 aa, Mycobacterium bovis
EGLQ

SEQ ID NO: 193975 - protein, 14 aa, Mycobacterium bovis
EGQSAVKTAKTIDQ

SEQ ID NO: 193976 - protein, 7 aa, Mycobacterium bovis
EGRPSTD

SEQ ID NO: 193977 - protein, 7 aa, Mycobacterium bovis
EHRQPRV

SEQ ID NO: 193978 - protein, 8 aa, Mycobacterium bovis
EIAESGAA

SEQ ID NO: 193979 - protein, 7 aa, Mycobacterium bovis
EIPLDDN

SEQ ID NO: 193980 - protein, 6 aa, Mycobacterium bovis
EIREEV

SEQ ID NO: 193981 - protein, 4 aa, Mycobacterium bovis
EKSY

SEQ ID NO: 193982 - protein, 6 aa, Mycobacterium bovis
ELAPSN

SEQ ID NO: 193983 - protein, 8 aa, Mycobacterium bovis
ELKAADSL

SEQ ID NO: 193984 - protein, 7 aa, Mycobacterium bovis
ELKSTGF

SEQ ID NO: 193985 - protein, 5 aa, Mycobacterium bovis
ENTRR

SEQ ID NO: 193986 - protein, 9 aa, Mycobacterium bovis
EPDGPPGVS

SEQ ID NO: 193987 - protein, 9 aa, Mycobacterium bovis
EPDSKSSKS

SEQ ID NO: 193988 - protein, 7 aa, Mycobacterium bovis
EPLPVPT

SEQ ID NO: 193989 - protein, 4 aa, Mycobacterium bovis
EPLT

SEQ ID NO: 193990 - protein, 6 aa, Mycobacterium bovis
EPNDGH

SEQ ID NO: 193991 - protein, 4 aa, Mycobacterium bovis
EPNE

SEQ ID NO: 193992 - protein, 15 aa, Mycobacterium bovis
EPPVEDGEYRQTPAE

SEQ ID NO: 193993 - protein, 9 aa, Mycobacterium bovis
EPSQHEELP

SEQ ID NO: 193994 - protein, 9 aa, Mycobacterium bovis
EPTGRNLNA

SEQ ID NO: 193995 - protein, 10 aa, Mycobacterium bovis
EQLASSDPGV

SEQ ID NO: 193996 - protein, 4 aa, Mycobacterium bovis
EQTV

SEQ ID NO: 193997 - protein, 6 aa, Mycobacterium bovis
EQVDGR

SEQ ID NO: 193998 - protein, 7 aa, Mycobacterium bovis
EQVPPDR

SEQ ID NO: 193999 - protein, 5 aa, Mycobacterium bovis
EQVRT

SEQ ID NO: 194000 - protein, 4 aa, Mycobacterium bovis
ERAS

SEQ ID NO: 194001 - protein, 9 aa, Mycobacterium bovis
ERAVPPYES

SEQ ID NO: 194002 - protein, 11 aa, Mycobacterium bovis
ERDGRTDPFGQ

SEQ ID NO: 194003 - protein, 4 aa, Mycobacterium bovis
ERGA

SEQ ID NO: 194004 - protein, 7 aa, Mycobacterium bovis
ERGYDGA

SEQ ID NO: 194005 - protein, 6 aa, Mycobacterium bovis
ERHGGT

SEQ ID NO: 194006 - protein, 4 aa, Mycobacterium bovis
ERLA

SEQ ID NO: 194007 - protein, 7 aa, Mycobacterium bovis
ERLGGDG

SEQ ID NO: 194008 - protein, 16 aa, Mycobacterium bovis
ERPHPYSTPGRKRGAQ

SEQ ID NO: 194009 - protein, 5 aa, Mycobacterium bovis
ERPKA

SEQ ID NO: 194010 - protein, 14 aa, Mycobacterium bovis
ERREALSSVQGEYG

SEQ ID NO: 194011 - protein, 5 aa, Mycobacterium bovis
ERRTT

SEQ ID NO: 194012 - protein, 5 aa, Mycobacterium bovis
ERVRP

SEQ ID NO: 194013 - protein, 16 aa, Mycobacterium bovis
ESDTPNKLRATPTRGS

SEQ ID NO: 194014 - protein, 22 aa, Mycobacterium bovis
ESEANANTGTCESSVSEAAPPK

SEQ ID NO: 194015 - protein, 10 aa, Mycobacterium bovis
ESEKDRRLAE

SEQ ID NO: 194016 - protein, 4 aa, Mycobacterium bovis
ESEL

SEQ ID NO: 194017 - protein, 11 aa, Mycobacterium bovis
ESGVPTFRDDK

SEQ ID NO: 194018 - protein, 25 aa, Mycobacterium bovis
ESLHESGTSDRADAAAHRDAIGSYT

SEQ ID NO: 194019 - protein, 34 aa, Mycobacterium bovis; identical to SEQ ID NO: 34018

SEQ ID NO: 194020 - protein, 7 aa, Mycobacterium bovis
ESNMAST

SEQ ID NO: 194021 - protein, 10 aa, Mycobacterium bovis
ESPRRSPRRQ

SEQ ID NO: 194022 - protein, 17 aa, Mycobacterium bovis
ESTAARVDYPAGRVRAE

SEQ ID NO: 194023 - protein, 15 aa, Mycobacterium bovis
ESTSWPGVTRPTNIG

SEQ ID NO: 194024 - protein, 8 aa, Mycobacterium bovis
ESVPLPDD

SEQ ID NO: 194025 - protein, 10 aa, Mycobacterium bovis
ETHGKPPTRR

SEQ ID NO: 194026 - protein, 8 aa, Mycobacterium bovis
ETHPSEPN

SEQ ID NO: 194027 - protein, 12 aa, Mycobacterium bovis
ETPDSGSVKVGE

SEQ ID NO: 194028 - protein, 7 aa, Mycobacterium bovis
ETPSQAA

SEQ ID NO: 194029 - protein, 9 aa, Mycobacterium bovis
EVQNGTDVG

SEQ ID NO: 194030 - protein, 7 aa, Mycobacterium bovis
EVSADGL

SEQ ID NO: 194031 - protein, 8 aa, Mycobacterium bovis
EVSADGLR

SEQ ID NO: 194032 - protein, 7 aa, Mycobacterium bovis
EVSQPTI

SEQ ID NO: 194033 - protein, 15 aa, Mycobacterium bovis
EVSSPDEGNCVGPTI

SEQ ID NO: 194034 - protein, 8 aa, Mycobacterium bovis
EYEPGQPG

SEQ ID NO: 194035 - protein, 7 aa, Mycobacterium bovis
FADQPNA

SEQ ID NO: 194036 - protein, 8 aa, Mycobacterium bovis
FANSGPAV

SEQ ID NO: 194037 - protein, 4 aa, Mycobacterium bovis
FAPG

SEQ ID NO: 194038 - protein, 17 aa, Mycobacterium bovis
FASTGTGGAGGTGGAGG

SEQ ID NO: 194039 - protein, 8 aa, Mycobacterium bovis
FDRGTRAA

SEQ ID NO: 194040 - protein, 9 aa, Mycobacterium bovis
FERTPNGGV

SEQ ID NO: 194041 - protein, 4 aa, Mycobacterium bovis
FEYP

SEQ ID NO: 194042 - protein, 8 aa, Mycobacterium bovis
FGGGNNGT

SEQ ID NO: 194043 - protein, 9 aa, Mycobacterium bovis
FGNTGTNNV

SEQ ID NO: 194044 - protein, 13 aa, Mycobacterium bovis
FGQTGGSGGAAGL

SEQ ID NO: 194045 - protein, 9 aa, Mycobacterium bovis
FGSSGEGLA

SEQ ID NO: 194046 - protein, 8 aa, Mycobacterium bovis
FGTQEGGA

SEQ ID NO: 194047 - protein, 7 aa, Mycobacterium bovis
FHPGGAT

SEQ ID NO: 194048 - protein, 6 aa, Mycobacterium bovis
FNKPGT

SEQ ID NO: 194049 - protein, 10 aa, Mycobacterium bovis
FNPTTKTQAA

SEQ ID NO: 194050 - protein, 13 aa, Mycobacterium bovis
FNTGFGNGGNTNF

SEQ ID NO: 194051 - protein, 16 aa, Mycobacterium bovis
FPEKKLAEPPPGSGLK

SEQ ID NO: 194052 - protein, 5 aa, Mycobacterium bovis
FPRGA

SEQ ID NO: 194053 - protein, 5 aa, Mycobacterium bovis
FREPP

SEQ ID NO: 194054 - protein, 203 aa, Mycobacterium bovis
FSNGSNGGTGGTGGVGGTGGDGGNAGTGAGDPGKGGTGGTGGSGGAGGSGGANFNGGTGGTGGTGGTGGKGGMGGIAGDGGPGGDGGNAGVGGKGGTNGNGGSGGTGGTGGPGGSGGAPTGSGTGGKGGAGGDGGDGADGGAATGVGDGGDGGNGGNGGNGGTGVGSPGGLGGAGGTGGLGGAGAGGGADGDDGDDGQPGNNG

SEQ ID NO: 194055 - protein, 11 aa, Mycobacterium bovis
FSNLGSGVSGF

SEQ ID NO: 194056 - protein, 9 aa, Mycobacterium bovis
FTRAPQNSV

SEQ ID NO: 194057 - protein, 8 aa, Mycobacterium bovis
GAAAKGDV

SEQ ID NO: 194058 - protein, 8 aa, Mycobacterium bovis
GAAGTAAQ

SEQ ID NO: 194059 - protein, 17 aa, Mycobacterium bovis
GAANAPAAAAQGAAQGL

SEQ ID NO: 194060 - protein, 6 aa, Mycobacterium bovis
GAARSA

SEQ ID NO: 194061 - protein, 13 aa, Mycobacterium bovis
GAATAAAAAQTTG

SEQ ID NO: 194062 - protein, 5 aa, Mycobacterium bovis
GAATD

SEQ ID NO: 194063 - protein, 8 aa, Mycobacterium bovis
GAAWTPAD

SEQ ID NO: 194064 - protein, 11 aa, Mycobacterium bovis
GADPELKSTGF

SEQ ID NO: 194065 - protein, 6 aa, Mycobacterium bovis
GAEPAQ

SEQ ID NO: 194066 - protein, 4 aa, Mycobacterium bovis
GAGA

SEQ ID NO: 194067 - protein, 11 aa, Mycobacterium bovis
GAGGAGGDSAV

SEQ ID NO: 194068 - protein, 9 aa, Mycobacterium bovis
GAGGGGSIG

SEQ ID NO: 194069 - protein, 9 aa, Mycobacterium bovis
GAGGNGGDA

SEQ ID NO: 194070 - protein, 69 aa, Mycobacterium bovis
GAGGQGGDGGAGGAGADADQPGATGGTGFAGGAGGAGGAGGSSGAGGTNGSGGAGGTGGQGGAGGAGIS

SEQ ID NO: 194071 - protein, 71 aa, Mycobacterium bovis
GAGGTGGSGGGGATTGGDGGAGGAGGFGRTTGGIGGTGGNAGLLNGSGGAGGAGGAAITGPGGTGGAGGIP

SEQ ID NO: 194072 - protein, 5 aa, Mycobacterium bovis
GAGLG

SEQ ID NO: 194073 - protein, 13 aa, Mycobacterium bovis
GAGNRAGDGFDGA

SEQ ID NO: 194074 - protein, 7 aa, Mycobacterium bovis
GAGPELE

SEQ ID NO: 194075 - protein, 15 aa, Mycobacterium bovis
GANAPASTNPLHTAQ

SEQ ID NO: 194076 - protein, 6 aa, Mycobacterium bovis
GAPATS

SEQ ID NO: 194077 - protein, 14 aa, Mycobacterium bovis
GAPDSGNGGTDHPT

SEQ ID NO: 194078 - protein, 4 aa, Mycobacterium bovis
GAPI

SEQ ID NO: 194079 - protein, 6 aa, Mycobacterium bovis
GAQPAT

SEQ ID NO: 194080 - protein, 17 aa, Mycobacterium bovis
GASADQSRGVADGKPAD

SEQ ID NO: 194081 - protein, 30 aa, Mycobacterium bovis
GASPAAPAQAAAAVGQAAAEAAAGDGMRSA

SEQ ID NO: 194082 - protein, 8 aa, Mycobacterium bovis
GASRETVN

SEQ ID NO: 194083 - protein, 4 aa, Mycobacterium bovis
GASS

SEQ ID NO: 194084 - protein, 13 aa, Mycobacterium bovis
GASSVRLVNQTGY

SEQ ID NO: 194085 - protein, 7 aa, Mycobacterium bovis
GATGGTQ

SEQ ID NO: 194086 - protein, 13 aa, Mycobacterium bovis
GATMPGGGATPAL

SEQ ID NO: 194087 - protein, 16 aa, Mycobacterium bovis
GCQGDPSAAELPDVGD

SEQ ID NO: 194088 - protein, 13 aa, Mycobacterium bovis
GDASGATSCPRGE

SEQ ID NO: 194089 - protein, 9 aa, Mycobacterium bovis
GDDLGKTAR

SEQ ID NO: 194090 - protein, 6 aa, Mycobacterium bovis
GDDPYG

SEQ ID NO: 194091 - protein, 26 aa, Mycobacterium bovis
GDGGAGGAGGAATTGTGGAGGAGGKA

SEQ ID NO: 194092 - protein, 27 aa, Mycobacterium bovis
GDGGAGGAGGAGEDGTTPGGNGGAGGV

SEQ ID NO: 194093 - protein, 87 aa, Mycobacterium bovis
GDGGAGGAGGMGSTGGTGGGGGFGGGTGGNGGNGHAGGAGGSGGTAGLLGSGGTGGDGGNGGLGAGSGAKGNGGNGGDGGKGGDAQL

SEQ ID NO: 194094 - protein, 64 aa, Mycobacterium bovis
GDGGNGGAGGQGGAAGGSPGGGGGVGGHGGAGGDAGMNGGGGTGGQGGNGAAGGAGWSPDSDLK

SEQ ID NO: 194095 - protein, 20 aa, Mycobacterium bovis
GDGNLGSGNVGSTNLGSGNF

SEQ ID NO: 194096 - protein, 6 aa, Mycobacterium bovis
GDGQIG

SEQ ID NO: 194097 - protein, 9 aa, Mycobacterium bovis
GDGSTNPIR

SEQ ID NO: 194098 - protein, 4 aa, Mycobacterium bovis
GDGT

SEQ ID NO: 194099 - protein, 21 aa, Mycobacterium bovis
GDHRPAPPETEAALVPVQATL

SEQ ID NO: 194100 - protein, 15 aa, Mycobacterium bovis
GDIGGAGGGVSGHRG

SEQ ID NO: 194101 - protein, 12 aa, Mycobacterium bovis
GDLDDRGRYRQS

SEQ ID NO: 194102 - protein, 9 aa, Mycobacterium bovis
GDLTGEAAQ

SEQ ID NO: 194103 - protein, 7 aa, Mycobacterium bovis
GDPATSG

SEQ ID NO: 194104 - protein, 11 aa, Mycobacterium bovis
GDQLPEKTYPL

SEQ ID NO: 194105 - protein, 14 aa, Mycobacterium bovis
GDSNTGFANAGNVN

SEQ ID NO: 194106 - protein, 6 aa, Mycobacterium bovis
GDSYRL

SEQ ID NO: 194107 - protein, 5 aa, Mycobacterium bovis
GDTRE

SEQ ID NO: 194108 - protein, 4 aa, Mycobacterium bovis
GDVH

SEQ ID NO: 194109 - protein, 41 aa, Mycobacterium bovis
GDVNTGIGSTVDQPGSVSGFGNTGTSVSGFNNSGNLTSGFG

SEQ ID NO: 194110 - protein, 10 aa, Mycobacterium bovis
GEAGADYNVG

SEQ ID NO: 194111 - protein, 4 aa, Mycobacterium bovis
GEDH

SEQ ID NO: 194112 - protein, 12 aa, Mycobacterium bovis
GEFSAHRNSGES

SEQ ID NO: 194113 - protein, 10 aa, Mycobacterium bovis
GELAGPDFGS

SEQ ID NO: 194114 - protein, 4 aa, Mycobacterium bovis
GENT

SEQ ID NO: 194115 - protein, 4 aa, Mycobacterium bovis
GEPN

SEQ ID NO: 194116 - protein, 53 aa, Mycobacterium bovis
GEPPPAPSRPSASPAEPPTRPAPQHSRRARRGHRYRTDTERNVGKVATGPSIQ

SEQ ID NO: 194117 - protein, 5 aa, Mycobacterium bovis
GEPTI

SEQ ID NO: 194118 - protein, 17 aa, Mycobacterium bovis
GEQAPGATPSGSPIVTV

SEQ ID NO: 194119 - protein, 15 aa, Mycobacterium bovis
GEQLGPSADPGDGPA

SEQ ID NO: 194120 - protein, 9 aa, Mycobacterium bovis
GETKLGETY

SEQ ID NO: 194121 - protein, 52 aa, Mycobacterium bovis
GFGGAGGAGGASDTGAGGNGGAGGKAGLYGNGGDGGAGGDGATSGKGGAGGN

SEQ ID NO: 194122 - protein, 9 aa, Mycobacterium bovis
GFGNNGNNN

SEQ ID NO: 194123 - protein, 10 aa, Mycobacterium bovis
GFGNTGSGNI

SEQ ID NO: 194124 - protein, 9 aa, Mycobacterium bovis
GGAGGAGGA

SEQ ID NO: 194125 - protein, 25 aa, Mycobacterium bovis
GGAGGAGGAVTGTGATGGSGGAGGG

SEQ ID NO: 194126 - protein, 26 aa, Mycobacterium bovis
GGAGGAGGSGGSGAAGGAGGAGGAGG

SEQ ID NO: 194127 - protein, 15 aa, Mycobacterium bovis
GGAGGAGGSSGIGGF

SEQ ID NO: 194128 - protein, 103 aa, Mycobacterium bovis
GGAGGTGGAGLAGANGVNPTPGPAASTGDSPADVSGIGDQTGGDGGTGGHGTAGTPTGGTGGDGATATAGSGKATGGAGGDGGTAAAGGGGGNGGDGGVAQGD

SEQ ID NO: 194129 - protein, 5 aa, Mycobacterium bovis
GGAGL

SEQ ID NO: 194130 - protein, 7 aa, Mycobacterium bovis
GGANYPR

SEQ ID NO: 194131 - protein, 12 aa, Mycobacterium bovis
GGASAAAAALPS

SEQ ID NO: 194132 - protein, 6 aa, Mycobacterium bovis
GGFATT

SEQ ID NO: 194133 - protein, 6 aa, Mycobacterium bovis
GGFEGA

SEQ ID NO: 194134 - protein, 12 aa, Mycobacterium bovis
GGFGGAGGGGAV

SEQ ID NO: 194135 - protein, 5 aa, Mycobacterium bovis
GGGDQ

SEQ ID NO: 194136 - protein, 13 aa, Mycobacterium bovis
GGGGTDVEPYSSQ

SEQ ID NO: 194137 - protein, 12 aa, Mycobacterium bovis
GGGGTGAGQEAL

SEQ ID NO: 194138 - protein, 4 aa, Mycobacterium bovis
GGGL

SEQ ID NO: 194139 - protein, 20 aa, Mycobacterium bovis
GGGTGGSGVSGGAGGDGGAG

SEQ ID NO: 194140 - protein, 6 aa, Mycobacterium bovis
GGIDSP

SEQ ID NO: 194141 - protein, 24 aa, Mycobacterium bovis
GGIGGAGGFGGFRGGEGGAGGAGG

SEQ ID NO: 194142 - protein, 6 aa, Mycobacterium bovis
GGMPPM

SEQ ID NO: 194143 - protein, 4 aa, Mycobacterium bovis
GGMR

SEQ ID NO: 194144 - protein, 4 aa, Mycobacterium bovis
GGNE

SEQ ID NO: 194145 - protein, 9 aa, Mycobacterium bovis
GGNGGSAGW

SEQ ID NO: 194146 - protein, 11 aa, Mycobacterium bovis
GGNGGVGGTSV

SEQ ID NO: 194147 - protein, 10 aa, Mycobacterium bovis
GGNNVGGANA

SEQ ID NO: 194148 - protein, 9 aa, Mycobacterium bovis
GGNSNSGSF

SEQ ID NO: 194149 - protein, 11 aa, Mycobacterium bovis
GGPGDSGAPVT

SEQ ID NO: 194150 - protein, 6 aa, Mycobacterium bovis
GGPRGG

SEQ ID NO: 194151 - protein, 4 aa, Mycobacterium bovis
GGTF

SEQ ID NO: 194152 - protein, 10 aa, Mycobacterium bovis
GGTTQADVDA

SEQ ID NO: 194153 - protein, 26 aa, Mycobacterium bovis
GGVGGTGGGAGSGGTGGVGGTGGAGG

SEQ ID NO: 194154 - protein, 5 aa, Mycobacterium bovis
GHDRG

SEQ ID NO: 194155 - protein, 12 aa, Mycobacterium bovis
GHTDRPAGSLDG

SEQ ID NO: 194156 - protein, 8 aa, Mycobacterium bovis
GIANPRER

SEQ ID NO: 194157 - protein, 25 aa, Mycobacterium bovis
GIGGNTGSFNSGNLNTGFGNAGDLN

SEQ ID NO: 194158 - protein, 13 aa, Mycobacterium bovis
GINDDTIEQAAEA

SEQ ID NO: 194159 - protein, 7 aa, Mycobacterium bovis
GINGTIP

SEQ ID NO: 194160 - protein, 10 aa, Mycobacterium bovis
GIPVDDPDGY

SEQ ID NO: 194161 - protein, 14 aa, Mycobacterium bovis
GITDNDPATATNRR

SEQ ID NO: 194162 - protein, 6 aa, Mycobacterium bovis
GKADTV

SEQ ID NO: 194163 - protein, 177 aa, Mycobacterium bovis
GKGGDGGNGDHGGPATNPGSGSRGGAGGSGGNGGAGGNATGSGGKGGAGGNGGDGSFGATSGPASIGVTGAPGGNGGKGGAGGSNPNGSGGDGGKGGNGGAGGNGGSIGANSGIVGGSGGAGGAGGAGGNGSLSSGEGGKGGDGGHGGDGVGGNSSVTQGGSGGGGGAGGAGGSGFF

SEQ ID NO: 194164 - protein, 40 aa, Mycobacterium bovis
GKGGFGGDGGQGGPNGGGTVGTVAGGGGNGGVGGRGGDGV

SEQ ID NO: 194165 - protein, 4 aa, Mycobacterium bovis
GKLA

SEQ ID NO: 194166 - protein, 13 aa, Mycobacterium bovis
GKPAAQEGSEPWV

SEQ ID NO: 194167 - protein, 6 aa, Mycobacterium bovis
GKTQAK

SEQ ID NO: 194168 - protein, 16 aa, Mycobacterium bovis
GKVDKDWDADATKGIP

SEQ ID NO: 194169 - protein, 26 aa, Mycobacterium bovis
GLAGGAGGGGGQGFDTGGAGGPGGDA

SEQ ID NO: 194170 - protein, 12 aa, Mycobacterium bovis
GLAGGSGQAWQG

SEQ ID NO: 194171 - protein, 16 aa, Mycobacterium bovis
GLAPGPLLGDGQLHER

SEQ ID NO: 194172 - protein, 4 aa, Mycobacterium bovis
GLAT

SEQ ID NO: 194173 - protein, 7 aa, Mycobacterium bovis
GLEPASP

SEQ ID NO: 194174 - protein, 15 aa, Mycobacterium bovis
GLGDQTDIGPMRRRD

SEQ ID NO: 194175 - protein, 8 aa, Mycobacterium bovis
GLPSGEAA

SEQ ID NO: 194176 - protein, 11 aa, Mycobacterium bovis
GLQKTPKSLPP

SEQ ID NO: 194177 - protein, 25 aa, Mycobacterium bovis
GMAPPGSGTWPPRSCPKPPRSWTST

SEQ ID NO: 194178 - protein, 48 aa, Mycobacterium bovis
GMAPPGSGTWPPRSCPKPPRSWTSTTLASTSTTSPASSHPPSANTTVT

SEQ ID NO: 194179 - protein, 16 aa, Mycobacterium bovis
GNGADGTAANPNGQAG

SEQ ID NO: 194180 - protein, 11 aa, Mycobacterium bovis
GNGGAGGSGGS

SEQ ID NO: 194181 - protein, 84 aa, Mycobacterium bovis
GNGGEVGVGGKGGAGGVSANPALNGSAGANGTAPTSGGNGGNGGAGATPTVAGENGGAGGNGGHGGSVGNGGAGGAGGNGVAGT

SEQ ID NO: 194182 - protein, 46 aa, Mycobacterium bovis
GNGGNGAAGGPNQAGGAGGNAGLIGNGGAGGAGGVGAVGGNGGTGG

SEQ ID NO: 194183 - protein, 23 aa, Mycobacterium bovis
GNGGNGGNAGKAGGTAGAGGAGG

SEQ ID NO: 194184 - protein, 5 aa, Mycobacterium bovis
GNGQI

SEQ ID NO: 194185 - protein, 5 aa, Mycobacterium bovis
GNGYY

SEQ ID NO: 194186 - protein, 9 aa, Mycobacterium bovis
GNNSQKSRD

SEQ ID NO: 194187 - protein, 7 aa, Mycobacterium bovis
GNPKNIR

SEQ ID NO: 194188 - protein, 8 aa, Mycobacterium bovis
GNRLDTAG

SEQ ID NO: 194189 - protein, 7 aa, Mycobacterium bovis
GNSGNNN

SEQ ID NO: 194190 - protein, 9 aa, Mycobacterium bovis
GNTGSGNFG

SEQ ID NO: 194191 - protein, 39 aa, Mycobacterium bovis
GNTGSGNIGNNNIGNNNIGSGNTGTGNIGSGNTGSGNLG

SEQ ID NO: 194192 - protein, 13 aa, Mycobacterium bovis
GNVGFGNSGLGAG

SEQ ID NO: 194193 - protein, 38 aa, Mycobacterium bovis
GPAPITPPASAAPAVTAAPAERPEPAGPAERPAPEAPA

SEQ ID NO: 194194 - protein, 5 aa, Mycobacterium bovis
GPAVN

SEQ ID NO: 194195 - protein, 7 aa, Mycobacterium bovis
GPDPVAR

SEQ ID NO: 194196 - protein, 27 aa, Mycobacterium bovis
GPEPATSGKRAPLDESPRHEKLDGGAG

SEQ ID NO: 194197 - protein, 5 aa, Mycobacterium bovis
GPEVT

SEQ ID NO: 194198 - protein, 5 aa, Mycobacterium bovis
GPGAA

SEQ ID NO: 194199 - protein, 10 aa, Mycobacterium bovis
GPGGSLTGSA

SEQ ID NO: 194200 - protein, 17 aa, Mycobacterium bovis
GPGPGAGVDRPILEVPV

SEQ ID NO: 194201 - protein, 6 aa, Mycobacterium bovis
GPGVTE

SEQ ID NO: 194202 - protein, 9 aa, Mycobacterium bovis
GPIRPTSAA

SEQ ID NO: 194203 - protein, 4 aa, Mycobacterium bovis
GPIT

SEQ ID NO: 194204 - protein, 5 aa, Mycobacterium bovis
GPLPV

SEQ ID NO: 194205 - protein, 25 aa, Mycobacterium bovis
GPMAHGKKRRGHRSSGVAAGVTGPA

SEQ ID NO: 194206 - protein, 16 aa, Mycobacterium bovis
GPNEIPSVRTNPRARG

SEQ ID NO: 194207 - protein, 5 aa, Mycobacterium bovis
GPNLA

SEQ ID NO: 194208 - protein, 9 aa, Mycobacterium bovis
GPNQPPPGI

SEQ ID NO: 194209 - protein, 7 aa, Mycobacterium bovis
GPQRTPA

SEQ ID NO: 194210 - protein, 5 aa, Mycobacterium bovis
GPRHI

SEQ ID NO: 194211 - protein, 16 aa, Mycobacterium bovis
GPSDVVGRAGPDRAHT

SEQ ID NO: 194212 - protein, 22 aa, Mycobacterium bovis
GPSGDTWSWGPSDAAQRVTGSA

SEQ ID NO: 194213 - protein, 7 aa, Mycobacterium bovis
GPSRERS

SEQ ID NO: 194214 - protein, 5 aa, Mycobacterium bovis
GPSTT

SEQ ID NO: 194215 - protein, 7 aa, Mycobacterium bovis
GPTRHPV

SEQ ID NO: 194216 - protein, 7 aa, Mycobacterium bovis
GQAGGQA

SEQ ID NO: 194217 - protein, 8 aa, Mycobacterium bovis
GQFDPTTM

SEQ ID NO: 194218 - protein, 9 aa, Mycobacterium bovis
GQGRPDEYY

SEQ ID NO: 194219 - protein, 11 aa, Mycobacterium bovis
GQLAGTANELT

SEQ ID NO: 194220 - protein, 7 aa, Mycobacterium bovis
GQPAREV

SEQ ID NO: 194221 - protein, 4 aa, Mycobacterium bovis
GQRY

SEQ ID NO: 194222 - protein, 6 aa, Mycobacterium bovis
GQVHNE

SEQ ID NO: 194223 - protein, 12 aa, Mycobacterium bovis
GRAAAAGDELDT

SEQ ID NO: 194224 - protein, 26 aa, Mycobacterium bovis
GRADGAHPDVGEAAKPIHQYRDRDTF

SEQ ID NO: 194225 - protein, 7 aa, Mycobacterium bovis
GRAFTSG

SEQ ID NO: 194226 - protein, 8 aa, Mycobacterium bovis
GRAPRTDD

SEQ ID NO: 194227 - protein, 8 aa, Mycobacterium bovis
GRDPRAAA

SEQ ID NO: 194228 - protein, 10 aa, Mycobacterium bovis
GRGIPTGTCP

SEQ ID NO: 194229 - protein, 9 aa, Mycobacterium bovis
GRKGDGRIE

SEQ ID NO: 194230 - protein, 6 aa, Mycobacterium bovis
GRKPSR

SEQ ID NO: 194231 - protein, 7 aa, Mycobacterium bovis
GRNATTV

SEQ ID NO: 194232 - protein, 10 aa, Mycobacterium bovis
GRPEYPTPVG

SEQ ID NO: 194233 - protein, 14 aa, Mycobacterium bovis
GRQDKAKQTPCPGY

SEQ ID NO: 194234 - protein, 5 aa, Mycobacterium bovis
GRRAA

SEQ ID NO: 194235 - protein, 9 aa, Mycobacterium bovis
GRRRAGARV

SEQ ID NO: 194236 - protein, 17 aa, Mycobacterium bovis
GRRTRARRADRHHPAHR

SEQ ID NO: 194237 - protein, 19 aa, Mycobacterium bovis
GRSASKGIAGTSPGTSTRL

SEQ ID NO: 194238 - protein, 9 aa, Mycobacterium bovis
GRSGPEQAA

SEQ ID NO: 194239 - protein, 5 aa, Mycobacterium bovis
GRSNG

SEQ ID NO: 194240 - protein, 17 aa, Mycobacterium bovis
GRSPGRDSGGRKVPESP

SEQ ID NO: 194241 - protein, 7 aa, Mycobacterium bovis
GRVATAA

SEQ ID NO: 194242 - protein, 5 aa, Mycobacterium bovis
GRVSR

SEQ ID NO: 194243 - protein, 9 aa, Mycobacterium bovis
GSAARPRAV

SEQ ID NO: 194244 - protein, 6 aa, Mycobacterium bovis
GSDEQF

SEQ ID NO: 194245 - protein, 5 aa, Mycobacterium bovis
GSEDG

SEQ ID NO: 194246 - protein, 5 aa, Mycobacterium bovis
GSGAP

SEQ ID NO: 194247 - protein, 5 aa, Mycobacterium bovis
GSGNF

SEQ ID NO: 194248 - protein, 49 aa, Mycobacterium bovis
GSGNFGSQNLGSGNIGSTNVGSGNIGSTNVGSGNIGDTNFGNGNNGNFN

SEQ ID NO: 194249 - protein, 27 aa, Mycobacterium bovis
GSGNIGGTNVGSGNVGGTNLGSGNYGS

SEQ ID NO: 194250 - protein, 35 aa, Mycobacterium bovis
GSGNTGTGNAGSGNTGDYNPGSGNFGSGNFGSGNI

SEQ ID NO: 194251 - protein, 7 aa, Mycobacterium bovis
GSLAGGT

SEQ ID NO: 194252 - protein, 7 aa, Mycobacterium bovis
GSLPPGV

SEQ ID NO: 194253 - protein, 14 aa, Mycobacterium bovis
GSPGFDATSPAKLG

SEQ ID NO: 194254 - protein, 6 aa, Mycobacterium bovis
GSRAAT

SEQ ID NO: 194255 - protein, 4 aa, Mycobacterium bovis
GSTG

SEQ ID NO: 194256 - protein, 7 aa, Mycobacterium bovis
GSYRTDG

SEQ ID NO: 194257 - protein, 7 aa, Mycobacterium bovis
GTAAHPC

SEQ ID NO: 194258 - protein, 4 aa, Mycobacterium bovis
GTAD

SEQ ID NO: 194259 - protein, 41 aa, Mycobacterium bovis
GTAMPDTNVAPAYRSSVSASVSASAATSSIRESQRQQSLTT

SEQ ID NO: 194260 - protein, 16 aa, Mycobacterium bovis
GTAPTGATPARPSAER

SEQ ID NO: 194261 - protein, 5 aa, Mycobacterium bovis
GTATA

SEQ ID NO: 194262 - protein, 8 aa, Mycobacterium bovis
GTDARTRA

SEQ ID NO: 194263 - protein, 14 aa, Mycobacterium bovis
GTFGTNGAGGTGGL

SEQ ID NO: 194264 - protein, 16 aa, Mycobacterium bovis
GTGGKGGNGGNGGAGM

SEQ ID NO: 194265 - protein, 12 aa, Mycobacterium bovis
GTIGAQGESADG

SEQ ID NO: 194266 - protein, 19 aa, Mycobacterium bovis
GTPRRPLTSSNGLSTDMGG

SEQ ID NO: 194267 - protein, 4 aa, Mycobacterium bovis
GTPV

SEQ ID NO: 194268 - protein, 10 aa, Mycobacterium bovis
GTQPTGTENH

SEQ ID NO: 194269 - protein, 5 aa, Mycobacterium bovis
GTQVS

SEQ ID NO: 194270 - protein, 8 aa, Mycobacterium bovis
GTRAHSAR

SEQ ID NO: 194271 - protein, 7 aa, Mycobacterium bovis
GTRDGDL

SEQ ID NO: 194272 - protein, 9 aa, Mycobacterium bovis
GTTAAQQTL

SEQ ID NO: 194273 - protein, 15 aa, Mycobacterium bovis
GTTKIEDKDGNPVDP

SEQ ID NO: 194274 - protein, 26 aa, Mycobacterium bovis
GTYGPGYHSDSTRTYSIGEPDSDVAQ

SEQ ID NO: 194275 - protein, 9 aa, Mycobacterium bovis
GVAADAASL

SEQ ID NO: 194276 - protein, 8 aa, Mycobacterium bovis
GVEQPDKH

SEQ ID NO: 194277 - protein, 12 aa, Mycobacterium bovis
GVETHPPNRHES

SEQ ID NO: 194278 - protein, 7 aa, Mycobacterium bovis
GVGGAGG

SEQ ID NO: 194279 - protein, 9 aa, Mycobacterium bovis
GVNGRRKAG

SEQ ID NO: 194280 - protein, 5 aa, Mycobacterium bovis
GVPEI

SEQ ID NO: 194281 - protein, 10 aa, Mycobacterium bovis
GVPRDPDPLH

SEQ ID NO: 194282 - protein, 9 aa, Mycobacterium bovis
GVSSPGRHP

SEQ ID NO: 194283 - protein, 37 aa, Mycobacterium bovis
GVSTGAASGAGGRFGSKPTASGPAAAFGSKPASSALA

SEQ ID NO: 194284 - protein, 11 aa, Mycobacterium bovis
GVTAEQVDAAA

SEQ ID NO: 194285 - protein, 6 aa, Mycobacterium bovis
GVTSGR

SEQ ID NO: 194286 - protein, 5 aa, Mycobacterium bovis
GVVPP

SEQ ID NO: 194287 - protein, 19 aa, Mycobacterium bovis
GYDKSWADGRGASPADRRH

SEQ ID NO: 194288 - protein, 14 aa, Mycobacterium bovis
GYPTDHRAAQVGTE

SEQ ID NO: 194289 - protein, 5 aa, Mycobacterium bovis
GYQDL

SEQ ID NO: 194290 - protein, 5 aa, Mycobacterium bovis
GYTTD

SEQ ID NO: 194291 - protein, 19 aa, Mycobacterium bovis
GYTTTGSIDDAVASLRAAL

SEQ ID NO: 194292 - protein, 59 aa, Mycobacterium bovis
HAAAQPDSITAATTGGRRRKRAAPDLDATQKSLRPAAKGPKVKKVKPQKPKATKPPKVV

SEQ ID NO: 194293 - protein, 5 aa, Mycobacterium bovis
HADPA

SEQ ID NO: 194294 - protein, 6 aa, Mycobacterium bovis
HAEPKQ

SEQ ID NO: 194295 - protein, 11 aa, Mycobacterium bovis
HAPEASEEPES

SEQ ID NO: 194296 - protein, 6 aa, Mycobacterium bovis
HAPTDP

SEQ ID NO: 194297 - protein, 5 aa, Mycobacterium bovis
HARQA

SEQ ID NO: 194298 - protein, 16 aa, Mycobacterium bovis
HDGRTARVRGDEITST

SEQ ID NO: 194299 - protein, 6 aa, Mycobacterium bovis
HDKNGD

SEQ ID NO: 194300 - protein, 6 aa, Mycobacterium bovis
HDTVSG

SEQ ID NO: 194301 - protein, 8 aa, Mycobacterium bovis
HEDPSGPV

SEQ ID NO: 194302 - protein, 9 aa, Mycobacterium bovis
HEETEGTLG

SEQ ID NO: 194303 - protein, 6 aa, Mycobacterium bovis
HEHTGE

SEQ ID NO: 194304 - protein, 7 aa, Mycobacterium bovis
HERAGSG

SEQ ID NO: 194305 - protein, 6 aa, Mycobacterium bovis
HGDRFE

SEQ ID NO: 194306 - protein, 4 aa, Mycobacterium bovis
HGHT

SEQ ID NO: 194307 - protein, 7 aa, Mycobacterium bovis
HGKASGQ

SEQ ID NO: 194308 - protein, 26 aa, Mycobacterium bovis
HGNAGGVNVGSGNAGLANTGDFNSGG

SEQ ID NO: 194309 - protein, 16 aa, Mycobacterium bovis
HGPRRHGRRGILTACG

SEQ ID NO: 194310 - protein, 13 aa, Mycobacterium bovis
HGVPDSVARSGGL

SEQ ID NO: 194311 - protein, 14 aa, Mycobacterium bovis
HGYPVTDKARDGRW

SEQ ID NO: 194312 - protein, 25 aa, Mycobacterium bovis
HHRRQDRRRGGLGPGPAPSPSHRAG

SEQ ID NO: 194313 - protein, 4 aa, Mycobacterium bovis
HNVA

SEQ ID NO: 194314 - protein, 24 aa, Mycobacterium bovis
HPAAKRARAQPRRPVKRADETETV

SEQ ID NO: 194315 - protein, 5 aa, Mycobacterium bovis
HPDGF

SEQ ID NO: 194316 - protein, 9 aa, Mycobacterium bovis
HPDHPSRSA

SEQ ID NO: 194317 - protein, 5 aa, Mycobacterium bovis
HPGDL

SEQ ID NO: 194318 - protein, 7 aa, Mycobacterium bovis
HPKEEPS

SEQ ID NO: 194319 - protein, 5 aa, Mycobacterium bovis
HPRDL

SEQ ID NO: 194320 - protein, 12 aa, Mycobacterium bovis
HPRHQTRRGRAC

SEQ ID NO: 194321 - protein, 5 aa, Mycobacterium bovis
HPSIE

SEQ ID NO: 194322 - protein, 10 aa, Mycobacterium bovis
HQGERRAAYN

SEQ ID NO: 194323 - protein, 4 aa, Mycobacterium bovis
HQHS

SEQ ID NO: 194324 - protein, 5 aa, Mycobacterium bovis
HQSTG

SEQ ID NO: 194325 - protein, 5 aa, Mycobacterium bovis
HRKGD

SEQ ID NO: 194326 - protein, 10 aa, Mycobacterium bovis
HSDGSDGAEH

SEQ ID NO: 194327 - protein, 4 aa, Mycobacterium bovis
HSEW

SEQ ID NO: 194328 - protein, 6 aa, Mycobacterium bovis
HSGPEA

SEQ ID NO: 194329 - protein, 9 aa, Mycobacterium bovis
HSRSSGRFG

SEQ ID NO: 194330 - protein, 7 aa, Mycobacterium bovis
HTATDAA

SEQ ID NO: 194331 - protein, 9 aa, Mycobacterium bovis
HTKKKESEI

SEQ ID NO: 194332 - protein, 7 aa, Mycobacterium bovis
HTTRDTS

SEQ ID NO: 194333 - protein, 4 aa, Mycobacterium bovis
HTVA

SEQ ID NO: 194334 - protein, 4 aa, Mycobacterium bovis
HVTD

SEQ ID NO: 194335 - protein, 7 aa, Mycobacterium bovis
HVTPPQT

SEQ ID NO: 194336 - protein, 9 aa, Mycobacterium bovis
IAEPDTADR

SEQ ID NO: 194337 - protein, 42 aa, Mycobacterium bovis
IANSGNNLAGISNSGDDSSGAVNSGSQNSGAFNAGVGLSGFF

SEQ ID NO: 194338 - protein, 9 aa, Mycobacterium bovis
IAPAGPSAV

SEQ ID NO: 194339 - protein, 11 aa, Mycobacterium bovis
IATERAGKPVQ

SEQ ID NO: 194340 - protein, 6 aa, Mycobacterium bovis
IDESDQ

SEQ ID NO: 194341 - protein, 8 aa, Mycobacterium bovis
IDGAQQAS

SEQ ID NO: 194342 - protein, 41 aa, Mycobacterium bovis
IDPVQPGANPRNVQTPQSHPAQSTPTTTSTPPGKPRRQSTA

SEQ ID NO: 194343 - protein, 9 aa, Mycobacterium bovis
IDQTETPVV

SEQ ID NO: 194344 - protein, 14 aa, Mycobacterium bovis
IEPPEEVFAAPPSA

SEQ ID NO: 194345 - protein, 9 aa, Mycobacterium bovis
IERDDEGLA

SEQ ID NO: 194346 - protein, 4 aa, Mycobacterium bovis
IGGQ

SEQ ID NO: 194347 - protein, 11 aa, Mycobacterium bovis
IGGTGGTGGNR

SEQ ID NO: 194348 - protein, 23 aa, Mycobacterium bovis
IGNGGNGGAGGTGAAGGAGGNGG

SEQ ID NO: 194349 - protein, 17 aa, Mycobacterium bovis
IGNGGNGGNGGKGGTGL

SEQ ID NO: 194350 - protein, 23 aa, Mycobacterium bovis
IGNGGNGGSGGMGDAPGGTGVGG

SEQ ID NO: 194351 - protein, 33 aa, Mycobacterium bovis
IGNGGNGGSGGTSVATGGAGNGGAGGAGGGAGL

SEQ ID NO: 194352 - protein, 7 aa, Mycobacterium bovis
IGPDPSF

SEQ ID NO: 194353 - protein, 6 aa, Mycobacterium bovis
IGPGPH

SEQ ID NO: 194354 - protein, 7 aa, Mycobacterium bovis
IGPGYGA

SEQ ID NO: 194355 - protein, 6 aa, Mycobacterium bovis
IGPPVP

SEQ ID NO: 194356 - protein, 9 aa, Mycobacterium bovis
IGPSPAEAD

SEQ ID NO: 194357 - protein, 40 aa, Mycobacterium bovis
IGRKSATRKSKGAKGKSGKKSKKGTRGPTPPKVKSPFGVP

SEQ ID NO: 194358 - protein, 4 aa, Mycobacterium bovis
IGSG

SEQ ID NO: 194359 - protein, 15 aa, Mycobacterium bovis
IGVPPGSRGCANYTR

SEQ ID NO: 194360 - protein, 22 aa, Mycobacterium bovis
INGTGGAGGSRGQISGNPGTPG

SEQ ID NO: 194361 - protein, 6 aa, Mycobacterium bovis
IPAGPA

SEQ ID NO: 194362 - protein, 4 aa, Mycobacterium bovis
ISAR

SEQ ID NO: 194363 - protein, 19 aa, Mycobacterium bovis
ISEAGQAMASTEGNVTGMF

SEQ ID NO: 194364 - protein, 13 aa, Mycobacterium bovis
ISGDRKPSAHASY

SEQ ID NO: 194365 - protein, 5 aa, Mycobacterium bovis
ISPRS

SEQ ID NO: 194366 - protein, 22 aa, Mycobacterium bovis
ISQTAQQAAQSAQGGSGPMPAQ

SEQ ID NO: 194367 - protein, 11 aa, Mycobacterium bovis
ISTANGAAALP

SEQ ID NO: 194368 - protein, 8 aa, Mycobacterium bovis
ISTSSNTE

SEQ ID NO: 194369 - protein, 12 aa, Mycobacterium bovis
ITNPANRHAAER

SEQ ID NO: 194370 - protein, 8 aa, Mycobacterium bovis
ITSPKSGV

SEQ ID NO: 194371 - protein, 5 aa, Mycobacterium bovis
KACPD

SEQ ID NO: 194372 - protein, 12 aa, Mycobacterium bovis
KAEAPSGTAART

SEQ ID NO: 194373 - protein, 24 aa, Mycobacterium bovis
KAGNGGAGGNGGAAGNGGGGAAGD

SEQ ID NO: 194374 - protein, 9 aa, Mycobacterium bovis
KATAGTPRR

SEQ ID NO: 194375 - protein, 6 aa, Mycobacterium bovis
KATRDE

SEQ ID NO: 194376 - protein, 6 aa, Mycobacterium bovis
KDGIEE

SEQ ID NO: 194377 - protein, 22 aa, Mycobacterium bovis
KEGEAGEDEVGRAEKDLDKTTH

SEQ ID NO: 194378 - protein, 8 aa, Mycobacterium bovis
KGARYGPV

SEQ ID NO: 194379 - protein, 10 aa, Mycobacterium bovis
KGGAGKTTLT

SEQ ID NO: 194380 - protein, 7 aa, Mycobacterium bovis
KGPNGDL

SEQ ID NO: 194381 - protein, 17 aa, Mycobacterium bovis
KGRRGRSPARPNAPIGA

SEQ ID NO: 194382 - protein, 7 aa, Mycobacterium bovis
KHADRSI

SEQ ID NO: 194383 - protein, 7 aa, Mycobacterium bovis
KIAEDGE

SEQ ID NO: 194384 - protein, 5 aa, Mycobacterium bovis
KKKHG

SEQ ID NO: 194385 - protein, 6 aa, Mycobacterium bovis
KLTTAG

SEQ ID NO: 194386 - protein, 8 aa, Mycobacterium bovis
KNERGEAE

SEQ ID NO: 194387 - protein, 15 aa, Mycobacterium bovis
KPDCPSGAGNDERAA

SEQ ID NO: 194388 - protein, 5 aa, Mycobacterium bovis
KPDDV

SEQ ID NO: 194389 - protein, 6 aa, Mycobacterium bovis
KPEAID

SEQ ID NO: 194390 - protein, 7 aa, Mycobacterium bovis
KPGKPWR

SEQ ID NO: 194391 - protein, 10 aa, Mycobacterium bovis
KPHKSTVQKV

SEQ ID NO: 194392 - protein, 17 aa, Mycobacterium bovis
KPPSRFGYGTSGRRANV

SEQ ID NO: 194393 - protein, 8 aa, Mycobacterium bovis
KPRNAGLR

SEQ ID NO: 194394 - protein, 7 aa, Mycobacterium bovis
KPSPVTA

SEQ ID NO: 194395 - protein, 6 aa, Mycobacterium bovis
KPVPDK

SEQ ID NO: 194396 - protein, 8 aa, Mycobacterium bovis
KQEFPSSE

SEQ ID NO: 194397 - protein, 4 aa, Mycobacterium bovis
KQNV

SEQ ID NO: 194398 - protein, 13 aa, Mycobacterium bovis
KRAIKQGTELAAR

SEQ ID NO: 194399 - protein, 11 aa, Mycobacterium bovis
KRERGIDAPGP

SEQ ID NO: 194400 - protein, 6 aa, Mycobacterium bovis
KRLGTT

SEQ ID NO: 194401 - protein, 13 aa, Mycobacterium bovis
KRLPSTAQGAAAV

SEQ ID NO: 194402 - protein, 7 aa, Mycobacterium bovis
KRRPPGQ

SEQ ID NO: 194403 - protein, 7 aa, Mycobacterium bovis
KSAGKWP

SEQ ID NO: 194404 - protein, 8 aa, Mycobacterium bovis
KSSARPAL

SEQ ID NO: 194405 - protein, 7 aa, Mycobacterium bovis
KSTPAMT

SEQ ID NO: 194406 - protein, 19 aa, Mycobacterium bovis
KTAEREHTPTATATTPSVA

SEQ ID NO: 194407 - protein, 6 aa, Mycobacterium bovis
KTAGLQ

SEQ ID NO: 194408 - protein, 16 aa, Mycobacterium bovis
KTGYATNAPPITDIWG

SEQ ID NO: 194409 - protein, 5 aa, Mycobacterium bovis
KTNRA

SEQ ID NO: 194410 - protein, 6 aa, Mycobacterium bovis
KTPPEL

SEQ ID NO: 194411 - protein, 8 aa, Mycobacterium bovis
KTSDDDMD

SEQ ID NO: 194412 - protein, 4 aa, Mycobacterium bovis
KTSI

SEQ ID NO: 194413 - protein, 8 aa, Mycobacterium bovis
KTTDADIE

SEQ ID NO: 194414 - protein, 13 aa, Mycobacterium bovis
KTVTSEANRARRV

SEQ ID NO: 194415 - protein, 6 aa, Mycobacterium bovis
KVAQPS

SEQ ID NO: 194416 - protein, 5 aa, Mycobacterium bovis
LADAG

SEQ ID NO: 194417 - protein, 7 aa, Mycobacterium bovis
LADEGIG

SEQ ID NO: 194418 - protein, 9 aa, Mycobacterium bovis
LADGPEGSA

SEQ ID NO: 194419 - protein, 16 aa, Mycobacterium bovis
LAGESGADDLRRRRCR

SEQ ID NO: 194420 - protein, 11 aa, Mycobacterium bovis
LAGGDAQLPHG

SEQ ID NO: 194421 - protein, 9 aa, Mycobacterium bovis
LAGPTRGAP

SEQ ID NO: 194422 - protein, 22 aa, Mycobacterium bovis
LAGTPSQAAIEADTRSAGQRHH

SEQ ID NO: 194423 - protein, 11 aa, Mycobacterium bovis
LAKTPDDRTQI

SEQ ID NO: 194424 - protein, 6 aa, Mycobacterium bovis
LAPHGL

SEQ ID NO: 194425 - protein, 29 aa, Mycobacterium bovis
LAPPTRPAPTEPPPSPSPQRNSGRRAERR

SEQ ID NO: 194426 - protein, 5 aa, Mycobacterium bovis
LARDG

SEQ ID NO: 194427 - protein, 13 aa, Mycobacterium bovis
LATDPQARQRRER

SEQ ID NO: 194428 - protein, 6 aa, Mycobacterium bovis
LATEPD

SEQ ID NO: 194429 - protein, 7 aa, Mycobacterium bovis
LDESDRR

SEQ ID NO: 194430 - protein, 16 aa, Mycobacterium bovis
LDGSDRRNSGGGATRM

SEQ ID NO: 194431 - protein, 7 aa, Mycobacterium bovis
LDPELEP

SEQ ID NO: 194432 - protein, 7 aa, Mycobacterium bovis
LDPGKLP

SEQ ID NO: 194433 - protein, 4 aa, Mycobacterium bovis
LDSD

SEQ ID NO: 194434 - protein, 12 aa, Mycobacterium bovis
LDSRDQGAADRR

SEQ ID NO: 194435 - protein, 10 aa, Mycobacterium bovis
LDSSTADFNG

SEQ ID NO: 194436 - protein, 6 aa, Mycobacterium bovis
LERAEN

SEQ ID NO: 194437 - protein, 17 aa, Mycobacterium bovis
LERRQKSRQTRASRDAL

SEQ ID NO: 194438 - protein, 6 aa, Mycobacterium bovis
LETGDR

SEQ ID NO: 194439 - protein, 10 aa, Mycobacterium bovis
LFDPDSALRA

SEQ ID NO: 194440 - protein, 8 aa, Mycobacterium bovis
LGANGATL

SEQ ID NO: 194441 - protein, 6 aa, Mycobacterium bovis
LGESAA

SEQ ID NO: 194442 - protein, 8 aa, Mycobacterium bovis
LGGATETA

SEQ ID NO: 194443 - protein, 11 aa, Mycobacterium bovis
LGGGLGANSRH

SEQ ID NO: 194444 - protein, 15 aa, Mycobacterium bovis
LGGGNTGNANLGGGN

SEQ ID NO: 194445 - protein, 7 aa, Mycobacterium bovis
LGGRELG

SEQ ID NO: 194446 - protein, 5 aa, Mycobacterium bovis
LGGSN

SEQ ID NO: 194447 - protein, 27 aa, Mycobacterium bovis
LGNGGNGGNGGTGTSAGSPGAGGAGGS

SEQ ID NO: 194448 - protein, 179 aa, Mycobacterium bovis
LGNPGLDGGTGGNGGAGGSGGAWAGNGGTGGAGGTGGVGGTGGSGSDGVNGSSAGADGHPGGTGGVGGTGGKGGDGGDGGAAPNGVAGSQGPGGAGGDGGTGGVGGNGGRGIDGADGATAGARGQDGGAGGKGGRGGTGGPGGAGPAGTTGSQGAGGNGGSGGTGGDPGDGGNGANGSV

SEQ ID NO: 194449 - protein, 4 aa, Mycobacterium bovis
LGPD

SEQ ID NO: 194450 - protein, 10 aa, Mycobacterium bovis
LGPDPDDEGD

SEQ ID NO: 194451 - protein, 10 aa, Mycobacterium bovis
LGRAASVGSL

SEQ ID NO: 194452 - protein, 4 aa, Mycobacterium bovis
LGRP

SEQ ID NO: 194453 - protein, 15 aa, Mycobacterium bovis
LGSATSSQLPSTSPS

SEQ ID NO: 194454 - protein, 4 aa, Mycobacterium bovis
LGTP

SEQ ID NO: 194455 - protein, 6 aa, Mycobacterium bovis
LGTTSR

SEQ ID NO: 194456 - protein, 7 aa, Mycobacterium bovis
LIGGQED

SEQ ID NO: 194457 - protein, 7 aa, Mycobacterium bovis
LKKDTAE

SEQ ID NO: 194458 - protein, 25 aa, Mycobacterium bovis
LNGDPKVDDGPSSDANLSAPLTPQQ

SEQ ID NO: 194459 - protein, 65 aa, Mycobacterium bovis
LNGGNGGIGGNGGSAAGTGGDGGKGGNGGAGANGQDFSASANGANGGQGGNGGNGGIGGKGGDAF

SEQ ID NO: 194460 - protein, 8 aa, Mycobacterium bovis
LNPSPLGY

SEQ ID NO: 194461 - protein, 17 aa, Mycobacterium bovis
LNSGTGNIGFGNSGNNN

SEQ ID NO: 194462 - protein, 11 aa, Mycobacterium bovis
LNVNGSSLAAG

SEQ ID NO: 194463 - protein, 12 aa, Mycobacterium bovis
LPASNRRLTDYD

SEQ ID NO: 194464 - protein, 12 aa, Mycobacterium bovis
LPATARDPRVEN

SEQ ID NO: 194465 - protein, 4 aa, Mycobacterium bovis
LPDD

SEQ ID NO: 194466 - protein, 4 aa, Mycobacterium bovis
LPDP

SEQ ID NO: 194467 - protein, 6 aa, Mycobacterium bovis
LPEEPW

SEQ ID NO: 194468 - protein, 5 aa, Mycobacterium bovis
LPEET

SEQ ID NO: 194469 - protein, 9 aa, Mycobacterium bovis
LPETRDAAK

SEQ ID NO: 194470 - protein, 98 aa, Mycobacterium bovis
LPGGGTVGNPGTGGNGGNGGNAGVGGTGGKAGTGSLTGLDGTDGITPNGGNGGNGGNGGKGGTAGNGSGAAGGNGGNGGSGLNGGDAGNGGNGGGALN

SEQ ID NO: 194471 - protein, 4 aa, Mycobacterium bovis
LPGP

SEQ ID NO: 194472 - protein, 15 aa, Mycobacterium bovis
LPKGYPVSSAPYGSA

SEQ ID NO: 194473 - protein, 8 aa, Mycobacterium bovis
LPKPNNQT

SEQ ID NO: 194474 - protein, 6 aa, Mycobacterium bovis
LPPAAN

SEQ ID NO: 194475 - protein, 10 aa, Mycobacterium bovis
LPPAVKARAS

SEQ ID NO: 194476 - protein, 8 aa, Mycobacterium bovis
LPPNPDTH

SEQ ID NO: 194477 - protein, 4 aa, Mycobacterium bovis
LPPQ

SEQ ID NO: 194478 - protein, 13 aa, Mycobacterium bovis
LPRRQDTSRRAAQ

SEQ ID NO: 194479 - protein, 16 aa, Mycobacterium bovis
LPSDTDLDTPGPQRSL

SEQ ID NO: 194480 - protein, 9 aa, Mycobacterium bovis
LRGPHRRRP

SEQ ID NO: 194481 - protein, 12 aa, Mycobacterium bovis
LRRGKDRRKVHY

SEQ ID NO: 194482 - protein, 6 aa, Mycobacterium bovis
LRSKPG

SEQ ID NO: 194483 - protein, 10 aa, Mycobacterium bovis
LRSTGDPRRV

SEQ ID NO: 194484 - protein, 7 aa, Mycobacterium bovis
LSAAAAK

SEQ ID NO: 194485 - protein, 6 aa, Mycobacterium bovis
LSDPRN

SEQ ID NO: 194486 - protein, 29 aa, Mycobacterium bovis
LSPPSQTTNPGGLAAQSAAVGSAAATAAV

SEQ ID NO: 194487 - protein, 20 aa, Mycobacterium bovis
LSRARGAAAEALTGYREPKP

SEQ ID NO: 194488 - protein, 11 aa, Mycobacterium bovis
LSSAEKGAAAS

SEQ ID NO: 194489 - protein, 8 aa, Mycobacterium bovis
LSSGREAD

SEQ ID NO: 194490 - protein, 13 aa, Mycobacterium bovis
LTAANAAAAVPTS

SEQ ID NO: 194491 - protein, 11 aa, Mycobacterium bovis
LTAFDSNRSGG

SEQ ID NO: 194492 - protein, 32 aa, Mycobacterium bovis
LTQAGANSGFGNLGTGNSGWGNSDPSGTGNSG

SEQ ID NO: 194493 - protein, 10 aa, Mycobacterium bovis
LTRTASNMNA

SEQ ID NO: 194494 - protein, 13 aa, Mycobacterium bovis
LTSDRTPERRRRG

SEQ ID NO: 194495 - protein, 10 aa, Mycobacterium bovis
LTSTAGPGCR

SEQ ID NO: 194496 - protein, 13 aa, Mycobacterium bovis
LTTGGPGAAGGDA

SEQ ID NO: 194497 - protein, 15 aa, Mycobacterium bovis
LVDPPSSLDCRVPFP

SEQ ID NO: 194498 - protein, 9 aa, Mycobacterium bovis
MASTDAAAQ

SEQ ID NO: 194499 - protein, 7 aa, Mycobacterium bovis
MEAPDDM

SEQ ID NO: 194500 - protein, 14 aa, Mycobacterium bovis
MEGSPERHNFPQSQ

SEQ ID NO: 194501 - protein, 9 aa, Mycobacterium bovis
MGTQPHPVG

SEQ ID NO: 194502 - protein, 5 aa, Mycobacterium bovis
MHGPA

SEQ ID NO: 194503 - protein, 5 aa, Mycobacterium bovis
MKTGD

SEQ ID NO: 194504 - protein, 10 aa, Mycobacterium bovis
MNTTTPARTA

SEQ ID NO: 194505 - protein, 6 aa, Mycobacterium bovis
MPDSSS

SEQ ID NO: 194506 - protein, 9 aa, Mycobacterium bovis
MPRGGPDAS

SEQ ID NO: 194507 - protein, 6 aa, Mycobacterium bovis
MSAGLG

SEQ ID NO: 194508 - protein, 39 aa, Mycobacterium bovis
MTANSPAGSPFGAAPSAPSHSTTTSGPPTAPTPTSPFGT

SEQ ID NO: 194509 - protein, 7 aa, Mycobacterium bovis
MTINGDP

SEQ ID NO: 194510 - protein, 16 aa, Mycobacterium bovis
MTPPTPTPEAAHNPTM

SEQ ID NO: 194511 - protein, 14 aa, Mycobacterium bovis
MTSDPGVAQRATAR

SEQ ID NO: 194512 - protein, 10 aa, Mycobacterium bovis
NAAAAVPTTG

SEQ ID NO: 194513 - protein, 13 aa, Mycobacterium bovis
NAAHGAASSEITP

SEQ ID NO: 194514 - protein, 9 aa, Mycobacterium bovis
NADGSAAQM

SEQ ID NO: 194515 - protein, 6 aa, Mycobacterium bovis
NADGTT

SEQ ID NO: 194516 - protein, 14 aa, Mycobacterium bovis
NAKNRPGAGFVPVP

SEQ ID NO: 194517 - protein, 8 aa, Mycobacterium bovis
NASAQDQL

SEQ ID NO: 194518 - protein, 6 aa, Mycobacterium bovis
NASDAL

SEQ ID NO: 194519 - protein, 9 aa, Mycobacterium bovis
NASDNNAGD

SEQ ID NO: 194520 - protein, 6 aa, Mycobacterium bovis
NCETPA

SEQ ID NO: 194521 - protein, 6 aa, Mycobacterium bovis
NDGAVV

SEQ ID NO: 194522 - protein, 4 aa, Mycobacterium bovis
NEGL

SEQ ID NO: 194523 - protein, 63 aa, Mycobacterium bovis
NETTGRDGDGGDGGYGGWGGAGGNGGAGGSAPAGEVGNRGVGGDGGDGGSGGDAGNGGLGGDG

SEQ ID NO: 194524 - protein, 13 aa, Mycobacterium bovis
NFNQGIANTGNNN

SEQ ID NO: 194525 - protein, 8 aa, Mycobacterium bovis
NFPPKRHK

SEQ ID NO: 194526 - protein, 16 aa, Mycobacterium bovis
NGANGAPGSGAPGGHG

SEQ ID NO: 194527 - protein, 5 aa, Mycobacterium bovis
NGDVD

SEQ ID NO: 194528 - protein, 4 aa, Mycobacterium bovis
NGEG

SEQ ID NO: 194529 - protein, 6 aa, Mycobacterium bovis
NGFSNG

SEQ ID NO: 194530 - protein, 17 aa, Mycobacterium bovis
NGGAGGFGANGGTGGNG

SEQ ID NO: 194531 - protein, 49 aa, Mycobacterium bovis
NGGAGGSGAAGVNGGAGGNGGAGGLIGNGGAGGAGGRASTGTGGAGGAA

SEQ ID NO: 194532 - protein, 125 aa, Mycobacterium bovis
NGGAGGVGGTAGAGGTGGSGGAGGAGGAGGGGTNSGPGAAFGGNGNTGGNGGNGGAPGALGGKGGSGGLIGRAGSDGGVGAGGAGGAGGAGGTGGEGGTGGDGKTTDGNPGMGGSPGSAGQPGQP

SEQ ID NO: 194533 - protein, 28 aa, Mycobacterium bovis
NGGGAGGAGGSGVSGGAGGEGGAGGAGG

SEQ ID NO: 194534 - protein, 10 aa, Mycobacterium bovis
NGGHTWPGGR

SEQ ID NO: 194535 - protein, 10 aa, Mycobacterium bovis
NGHTYTTHPG

SEQ ID NO: 194536 - protein, 4 aa, Mycobacterium bovis
NGKV

SEQ ID NO: 194537 - protein, 20 aa, Mycobacterium bovis
NGNIGLNGATGGIGSTTLTN

SEQ ID NO: 194538 - protein, 5 aa, Mycobacterium bovis
NGPLQ

SEQ ID NO: 194539 - protein, 4 aa, Mycobacterium bovis
NGRP

SEQ ID NO: 194540 - protein, 5 aa, Mycobacterium bovis
NGSDM

SEQ ID NO: 194541 - protein, 10 aa, Mycobacterium bovis
NGSGNGEPTG

SEQ ID NO: 194542 - protein, 9 aa, Mycobacterium bovis
NGTANGKAA

SEQ ID NO: 194543 - protein, 4 aa, Mycobacterium bovis
NGTG

SEQ ID NO: 194544 - protein, 13 aa, Mycobacterium bovis
NGTTVAAASSIEA

SEQ ID NO: 194545 - protein, 4 aa, Mycobacterium bovis
NGYT

SEQ ID NO: 194546 - protein, 6 aa, Mycobacterium bovis
NHGGVQ

SEQ ID NO: 194547 - protein, 11 aa, Mycobacterium bovis
NHRGHGTELGQ

SEQ ID NO: 194548 - protein, 4 aa, Mycobacterium bovis
NIAS

SEQ ID NO: 194549 - protein, 7 aa, Mycobacterium bovis
NIEEGGS

SEQ ID NO: 194550 - protein, 6 aa, Mycobacterium bovis
NKEQGA

SEQ ID NO: 194551 - protein, 10 aa, Mycobacterium bovis
NLTEAERTGL

SEQ ID NO: 194552 - protein, 4 aa, Mycobacterium bovis
NNAA

SEQ ID NO: 194553 - protein, 10 aa, Mycobacterium bovis
NPAAEQPAAT

SEQ ID NO: 194554 - protein, 12 aa, Mycobacterium bovis
NPEPTPLSGSAT

SEQ ID NO: 194555 - protein, 5 aa, Mycobacterium bovis
NPSRP

SEQ ID NO: 194556 - protein, 13 aa, Mycobacterium bovis
NPWDDSAHPLTDD

SEQ ID NO: 194557 - protein, 9 aa, Mycobacterium bovis
NRASGAEIG

SEQ ID NO: 194558 - protein, 8 aa, Mycobacterium bovis
NRGTDALI

SEQ ID NO: 194559 - protein, 13 aa, Mycobacterium bovis
NRQPLRPAQPPDL

SEQ ID NO: 194560 - protein, 8 aa, Mycobacterium bovis
NRRPTGQR

SEQ ID NO: 194561 - protein, 46 aa, Mycobacterium bovis
NSAAQARKAVGTGVRKKTPEPDSAEAPAAAAAPEEQVQPQRRRRPK

SEQ ID NO: 194562 - protein, 5 aa, Mycobacterium bovis
NSGQA

SEQ ID NO: 194563 - protein, 12 aa, Mycobacterium bovis
NSGTAFSGAVQS

SEQ ID NO: 194564 - protein, 5 aa, Mycobacterium bovis
NSGTN

SEQ ID NO: 194565 - protein, 12 aa, Mycobacterium bovis
NSMTTNGVSHSR

SEQ ID NO: 194566 - protein, 12 aa, Mycobacterium bovis
NTGFGSAGNGNV

SEQ ID NO: 194567 - protein, 14 aa, Mycobacterium bovis
NTGNGNSGFSNAGP

SEQ ID NO: 194568 - protein, 5 aa, Mycobacterium bovis
NTLTG

SEQ ID NO: 194569 - protein, 7 aa, Mycobacterium bovis
NVDPASD

SEQ ID NO: 194570 - protein, 5 aa, Mycobacterium bovis
NYSGI

SEQ ID NO: 194571 - protein, 16 aa, Mycobacterium bovis
PAAATAAVTPPALNTG

SEQ ID NO: 194572 - protein, 22 aa, Mycobacterium bovis
PAAPTAPAAPAAPADKAAPGVL

SEQ ID NO: 194573 - protein, 10 aa, Mycobacterium bovis
PADRQRRQRR

SEQ ID NO: 194574 - protein, 7 aa, Mycobacterium bovis
PADTAAR

SEQ ID NO: 194575 - protein, 17 aa, Mycobacterium bovis
PAGADEVSAQAATAFTS

SEQ ID NO: 194576 - protein, 20 aa, Mycobacterium bovis
PAGPPRVGQPSWNPQRASSM

SEQ ID NO: 194577 - protein, 26 aa, Mycobacterium bovis
PAGQRRRLPGKPAIDDRALAGASRSA

SEQ ID NO: 194578 - protein, 8 aa, Mycobacterium bovis
PAGSGGSV

SEQ ID NO: 194579 - protein, 8 aa, Mycobacterium bovis
PANDPNTA

SEQ ID NO: 194580 - protein, 11 aa, Mycobacterium bovis
PAPDRLEHDAD

SEQ ID NO: 194581 - protein, 16 aa, Mycobacterium bovis
PAPFEEPLPPEATDQW

SEQ ID NO: 194582 - protein, 5 aa, Mycobacterium bovis
PASTN

SEQ ID NO: 194583 - protein, 7 aa, Mycobacterium bovis
PATAPGG

SEQ ID NO: 194584 - protein, 7 aa, Mycobacterium bovis
PATAQGI

SEQ ID NO: 194585 - protein, 9 aa, Mycobacterium bovis
PATGETVPR

SEQ ID NO: 194586 - protein, 4 aa, Mycobacterium bovis
PATI

SEQ ID NO: 194587 - protein, 7 aa, Mycobacterium bovis
PATLPAT

SEQ ID NO: 194588 - protein, 7 aa, Mycobacterium bovis
PATLPES

SEQ ID NO: 194589 - protein, 7 aa, Mycobacterium bovis
PATWTEP

SEQ ID NO: 194590 - protein, 4 aa, Mycobacterium bovis
PAVE

SEQ ID NO: 194591 - protein, 9 aa, Mycobacterium bovis
PAVGQDDRG

SEQ ID NO: 194592 - protein, 27 aa, Mycobacterium bovis
PCRGHGAAGRRTAPGAGLPRRAQRGVC

SEQ ID NO: 194593 - protein, 16 aa, Mycobacterium bovis
PDAASRGVVDAPEDAL

SEQ ID NO: 194594 - protein, 7 aa, Mycobacterium bovis
PDAPTGC

SEQ ID NO: 194595 - protein, 5 aa, Mycobacterium bovis
PDAVE

SEQ ID NO: 194596 - protein, 5 aa, Mycobacterium bovis
PDAVG

SEQ ID NO: 194597 - protein, 5 aa, Mycobacterium bovis
PDGKE

SEQ ID NO: 194598 - protein, 7 aa, Mycobacterium bovis
PDPQYAP

SEQ ID NO: 194599 - protein, 5 aa, Mycobacterium bovis
PDPTE

SEQ ID NO: 194600 - protein, 6 aa, Mycobacterium bovis
PDRQRH

SEQ ID NO: 194601 - protein, 5 aa, Mycobacterium bovis
PDRSA

SEQ ID NO: 194602 - protein, 4 aa, Mycobacterium bovis
PDRV

SEQ ID NO: 194603 - protein, 8 aa, Mycobacterium bovis
PDSPPTDE

SEQ ID NO: 194604 - protein, 10 aa, Mycobacterium bovis
PEAAAGPHDA

SEQ ID NO: 194605 - protein, 4 aa, Mycobacterium bovis
PEAE

SEQ ID NO: 194606 - protein, 5 aa, Mycobacterium bovis
PEDEQ

SEQ ID NO: 194607 - protein, 4 aa, Mycobacterium bovis
PEDR

SEQ ID NO: 194608 - protein, 5 aa, Mycobacterium bovis
PEESQ

SEQ ID NO: 194609 - protein, 10 aa, Mycobacterium bovis
PEGACPGPFG

SEQ ID NO: 194610 - protein, 8 aa, Mycobacterium bovis
PEHGSAST

SEQ ID NO: 194611 - protein, 5 aa, Mycobacterium bovis
PEMPE

SEQ ID NO: 194612 - protein, 4 aa, Mycobacterium bovis
PEPG

SEQ ID NO: 194613 - protein, 7 aa, Mycobacterium bovis
PEPQPVN

SEQ ID NO: 194614 - protein, 7 aa, Mycobacterium bovis
PEPQPYP

SEQ ID NO: 194615 - protein, 4 aa, Mycobacterium bovis
PEPW

SEQ ID NO: 194616 - protein, 19 aa, Mycobacterium bovis
PEQQAENLTTGISAGTGNR

SEQ ID NO: 194617 - protein, 24 aa, Mycobacterium bovis
PERAPAARSLDAASTSRPCGPGWT

SEQ ID NO: 194618 - protein, 5 aa, Mycobacterium bovis
PERID

SEQ ID NO: 194619 - protein, 5 aa, Mycobacterium bovis
PESQL

SEQ ID NO: 194620 - protein, 7 aa, Mycobacterium bovis
PETGERT

SEQ ID NO: 194621 - protein, 12 aa, Mycobacterium bovis
PEVAANRAGRQA

SEQ ID NO: 194622 - protein, 36 aa, Mycobacterium bovis
PFSSPQQTTNPAGLAAQNAAVTQAATNSAGNTPTAL

SEQ ID NO: 194623 - protein, 19 aa, Mycobacterium bovis
PGAPTGGDDGDAPPGNSLR

SEQ ID NO: 194624 - protein, 5 aa, Mycobacterium bovis
PGATQ

SEQ ID NO: 194625 - protein, 45 aa, Mycobacterium bovis
PGEDGGNGGAGGAGGAGGAHAGDGGAGGAGGNGGAGGAGGNGAHG

SEQ ID NO: 194626 - protein, 10 aa, Mycobacterium bovis
PGETRRDPIQ

SEQ ID NO: 194627 - protein, 4 aa, Mycobacterium bovis
PGFG

SEQ ID NO: 194628 - protein, 11 aa, Mycobacterium bovis
PGPEDGSVPVP

SEQ ID NO: 194629 - protein, 4 aa, Mycobacterium bovis
PGPF

SEQ ID NO: 194630 - protein, 14 aa, Mycobacterium bovis
PGPNGPEPDPRTAP

SEQ ID NO: 194631 - protein, 9 aa, Mycobacterium bovis
PGPSFPSYG

SEQ ID NO: 194632 - protein, 14 aa, Mycobacterium bovis
PGRPPAAKADETRK

SEQ ID NO: 194633 - protein, 7 aa, Mycobacterium bovis
PGSHQDN

SEQ ID NO: 194634 - protein, 10 aa, Mycobacterium bovis
PGSSPRPYGG

SEQ ID NO: 194635 - protein, 9 aa, Mycobacterium bovis
PGTGSDNDY

SEQ ID NO: 194636 - protein, 10 aa, Mycobacterium bovis
PGVESNDGDA

SEQ ID NO: 194637 - protein, 7 aa, Mycobacterium bovis
PHAPADR

SEQ ID NO: 194638 - protein, 9 aa, Mycobacterium bovis
PHPAPPRLR

SEQ ID NO: 194639 - protein, 19 aa, Mycobacterium bovis
PHTDEGGERRNVPVSVVAA

SEQ ID NO: 194640 - protein, 4 aa, Mycobacterium bovis
PHTP

SEQ ID NO: 194641 - protein, 17 aa, Mycobacterium bovis
PIAPSLPTPVPHNEKPQ

SEQ ID NO: 194642 - protein, 9 aa, Mycobacterium bovis
PKPQNYPGL

SEQ ID NO: 194643 - protein, 5 aa, Mycobacterium bovis
PLGPD

SEQ ID NO: 194644 - protein, 7 aa, Mycobacterium bovis
PLPPTGP

SEQ ID NO: 194645 - protein, 4 aa, Mycobacterium bovis
PLSD

SEQ ID NO: 194646 - protein, 17 aa, Mycobacterium bovis
PLTDDQRTQVEEVTNEA

SEQ ID NO: 194647 - protein, 6 aa, Mycobacterium bovis
PNAAPH

SEQ ID NO: 194648 - protein, 9 aa, Mycobacterium bovis
PNNGFPGTS

SEQ ID NO: 194649 - protein, 10 aa, Mycobacterium bovis
PNNPTSTVVG

SEQ ID NO: 194650 - protein, 17 aa, Mycobacterium bovis
PPAVTEPPQPIPFSGPA

SEQ ID NO: 194651 - protein, 6 aa, Mycobacterium bovis
PPEINS

SEQ ID NO: 194652 - protein, 6 aa, Mycobacterium bovis
PPGAMP

SEQ ID NO: 194653 - protein, 5 aa, Mycobacterium bovis
PPKTD

SEQ ID NO: 194654 - protein, 6 aa, Mycobacterium bovis
PPLGQQ

SEQ ID NO: 194655 - protein, 8 aa, Mycobacterium bovis
PPNESRLR

SEQ ID NO: 194656 - protein, 7 aa, Mycobacterium bovis
PPPDEPN

SEQ ID NO: 194657 - protein, 4 aa, Mycobacterium bovis
PPPF

SEQ ID NO: 194658 - protein, 4 aa, Mycobacterium bovis
PPRL

SEQ ID NO: 194659 - protein, 14 aa, Mycobacterium bovis
PPSAIEANPRQPRQ

SEQ ID NO: 194660 - protein, 16 aa, Mycobacterium bovis
PPSRTKRARSRIRPPE

SEQ ID NO: 194661 - protein, 14 aa, Mycobacterium bovis
PPTEGKSTTNRDEG

SEQ ID NO: 194662 - protein, 12 aa, Mycobacterium bovis
PPTGHPLIPLGQ

SEQ ID NO: 194663 - protein, 4 aa, Mycobacterium bovis
PPTW

SEQ ID NO: 194664 - protein, 6 aa, Mycobacterium bovis
PPVATP

SEQ ID NO: 194665 - protein, 4 aa, Mycobacterium bovis
PQPG

SEQ ID NO: 194666 - protein, 5 aa, Mycobacterium bovis
PQRFR

SEQ ID NO: 194667 - protein, 9 aa, Mycobacterium bovis
PQRTGDPLQ

SEQ ID NO: 194668 - protein, 4 aa, Mycobacterium bovis
PQSV

SEQ ID NO: 194669 - protein, 5 aa, Mycobacterium bovis
PQTRV

SEQ ID NO: 194670 - protein, 7 aa, Mycobacterium bovis
PQVETDS

SEQ ID NO: 194671 - protein, 22 aa, Mycobacterium bovis
PQYSNPEPAGTATITGYRADND

SEQ ID NO: 194672 - protein, 5 aa, Mycobacterium bovis
PRGGV

SEQ ID NO: 194673 - protein, 6 aa, Mycobacterium bovis
PRNQAP

SEQ ID NO: 194674 - protein, 8 aa, Mycobacterium bovis
PRQEDADA

SEQ ID NO: 194675 - protein, 6 aa, Mycobacterium bovis
PRSPAD

SEQ ID NO: 194676 - protein, 4 aa, Mycobacterium bovis
PRSV

SEQ ID NO: 194677 - protein, 12 aa, Mycobacterium bovis
PRTTISPGTPTK

SEQ ID NO: 194678 - protein, 13 aa, Mycobacterium bovis
PSAAAQLADTTDQ

SEQ ID NO: 194679 - protein, 13 aa, Mycobacterium bovis
PSAIEANPRQPRQ

SEQ ID NO: 194680 - protein, 4 aa, Mycobacterium bovis
PSAL

SEQ ID NO: 194681 - protein, 5 aa, Mycobacterium bovis
PSGDD

SEQ ID NO: 194682 - protein, 10 aa, Mycobacterium bovis
PSGRALESRP

SEQ ID NO: 194683 - protein, 9 aa, Mycobacterium bovis
PSNAERGTK

SEQ ID NO: 194684 - protein, 10 aa, Mycobacterium bovis
PSPLSSGSAK

SEQ ID NO: 194685 - protein, 10 aa, Mycobacterium bovis
PSTDSIEPVQ

SEQ ID NO: 194686 - protein, 14 aa, Mycobacterium bovis
PSWATPSSTPVSAL

SEQ ID NO: 194687 - protein, 14 aa, Mycobacterium bovis
PTADGPLPKSRSPV

SEQ ID NO: 194688 - protein, 5 aa, Mycobacterium bovis
PTGRR

SEQ ID NO: 194689 - protein, 9 aa, Mycobacterium bovis
PTGSIKDRP

SEQ ID NO: 194690 - protein, 14 aa, Mycobacterium bovis
PTPGIGNTTTVPSS

SEQ ID NO: 194691 - protein, 4 aa, Mycobacterium bovis
PTRD

SEQ ID NO: 194692 - protein, 4 aa, Mycobacterium bovis
PTRG

SEQ ID NO: 194693 - protein, 7 aa, Mycobacterium bovis
PTSWEQA

SEQ ID NO: 194694 - protein, 5 aa, Mycobacterium bovis
PVTEK

SEQ ID NO: 194695 - protein, 19 aa, Mycobacterium bovis
PVTGQKLPGYETTWRVAVG

SEQ ID NO: 194696 - protein, 5 aa, Mycobacterium bovis
PWTTT

SEQ ID NO: 194697 - protein, 10 aa, Mycobacterium bovis
QAAVAQTGLT

SEQ ID NO: 194698 - protein, 9 aa, Mycobacterium bovis
QADAQSGKV

SEQ ID NO: 194699 - protein, 11 aa, Mycobacterium bovis
QADTAAARQAA

SEQ ID NO: 194700 - protein, 8 aa, Mycobacterium bovis
QAETSNGA

SEQ ID NO: 194701 - protein, 8 aa, Mycobacterium bovis
QAGSQYFP

SEQ ID NO: 194702 - protein, 5 aa, Mycobacterium bovis
QANPR

SEQ ID NO: 194703 - protein, 8 aa, Mycobacterium bovis
QAPDAPDW

SEQ ID NO: 194704 - protein, 5 aa, Mycobacterium bovis
QARPV

SEQ ID NO: 194705 - protein, 9 aa, Mycobacterium bovis
QARQQDQER

SEQ ID NO: 194706 - protein, 9 aa, Mycobacterium bovis
QASRDVSAA

SEQ ID NO: 194707 - protein, 11 aa, Mycobacterium bovis
QAYQAASAQAA

SEQ ID NO: 194708 - protein, 23 aa, Mycobacterium bovis
QDKGYAVPDYPADPNTDQEKAIK

SEQ ID NO: 194709 - protein, 13 aa, Mycobacterium bovis
QDLTRHTDTPSTI

SEQ ID NO: 194710 - protein, 4 aa, Mycobacterium bovis
QDPL

SEQ ID NO: 194711 - protein, 10 aa, Mycobacterium bovis
QDRPEGSRAT

SEQ ID NO: 194712 - protein, 7 aa, Mycobacterium bovis
QDRTGGF

SEQ ID NO: 194713 - protein, 114 aa, Mycobacterium bovis
QDRTGGTGTGQSRGAGGFGGVGQAGGKGWDGGPIGNGQVGEQHGAGQLGSTDGNPGVAGAAHGSGVSASHGSGATGAAGVADPGGSGAGVGSAAGNGTGAGSADAVGGAGTGRD

SEQ ID NO: 194714 - protein, 5 aa, Mycobacterium bovis
QEAGQ

SEQ ID NO: 194715 - protein, 8 aa, Mycobacterium bovis
QEGVSASA

SEQ ID NO: 194716 - protein, 4 aa, Mycobacterium bovis
QEPD

SEQ ID NO: 194717 - protein, 223 aa, Mycobacterium bovis
QGAGGAGGNGGNVGVAGQGGAGGKGAIPAMKGATGADGTAPTSGGDGGNGGNGASPTVAGGNGGDGGKGGSGGNVGNGGNGGAGGNGAAGQAGTPGPTSGDSGTSGTDGGAGGNGGAGGAGGTLAGHGGNGGKGVNGGQGGIGGAGERGADGAGPNANGANGENGGSGGNGGDGGAGGNGGAGGKAQAAGYTDGATGTGGDGGNGGDGGKAGDGGAGANGLNS

SEQ ID NO: 194718 - protein, 6 aa, Mycobacterium bovis
QGESMD

SEQ ID NO: 194719 - protein, 11 aa, Mycobacterium bovis
QGHPQRKDYPL

SEQ ID NO: 194720 - protein, 4 aa, Mycobacterium bovis
QGRG

SEQ ID NO: 194721 - protein, 9 aa, Mycobacterium bovis
QGRTTGNSC

SEQ ID NO: 194722 - protein, 13 aa, Mycobacterium bovis
QGSQLAQRECPRP

SEQ ID NO: 194723 - protein, 23 aa, Mycobacterium bovis
QHAPPQQVRQRTGIGQVGSDVDP

SEQ ID NO: 194724 - protein, 8 aa, Mycobacterium bovis
QHRAATSI

SEQ ID NO: 194725 - protein, 4 aa, Mycobacterium bovis
QKAN

SEQ ID NO: 194726 - protein, 14 aa, Mycobacterium bovis
QKYDPSRVMFSGLN

SEQ ID NO: 194727 - protein, 7 aa, Mycobacterium bovis
QLAGPTV

SEQ ID NO: 194728 - protein, 20 aa, Mycobacterium bovis
QLATGSWQGPASAAMTGAAA

SEQ ID NO: 194729 - protein, 18 aa, Mycobacterium bovis
QLDSTGPGQAYQPGDTVL

SEQ ID NO: 194730 - protein, 6 aa, Mycobacterium bovis
QLVETG

SEQ ID NO: 194731 - protein, 9 aa, Mycobacterium bovis
QNASPIAQT

SEQ ID NO: 194732 - protein, 15 aa, Mycobacterium bovis
QNDPRSTYKFGPEDY

SEQ ID NO: 194733 - protein, 27 aa, Mycobacterium bovis
QNLGAGPQREHRHRQGRRHGAQSQSGV

SEQ ID NO: 194734 - protein, 8 aa, Mycobacterium bovis
QPDADGVL

SEQ ID NO: 194735 - protein, 4 aa, Mycobacterium bovis
QPGV

SEQ ID NO: 194736 - protein, 13 aa, Mycobacterium bovis
QPPAPIAVSGTDS

SEQ ID NO: 194737 - protein, 6 aa, Mycobacterium bovis
QPPARY

SEQ ID NO: 194738 - protein, 4 aa, Mycobacterium bovis
QPRL

SEQ ID NO: 194739 - protein, 10 aa, Mycobacterium bovis
QPTAANDPIY

SEQ ID NO: 194740 - protein, 11 aa, Mycobacterium bovis
QQGNPPDAPQL

SEQ ID NO: 194741 - protein, 112 aa, Mycobacterium bovis
QRLPAEGPAVKRGVGASAAKKVAKKAPAKKATKAAKKAATKAPAKKAATKAPAKKAVKATKSPAKKVTKAVKKTAVKASVRKAATKAPAKKAAAKRPATKAPAKKATARRGR

SEQ ID NO: 194742 - protein, 121 aa, Mycobacterium bovis
QRLPAEGPAVKRGVGASAAKKVAKKAPAKKATKAAKKAATKAPARKAATKAPAKKAATKAPAKKAVKATKSPAKKVTKAVKKTAVKASVRKAATKAPAKKAAAKRPATKAPAKKATARRGR

SEQ ID NO: 194743 - protein, 19 aa, Mycobacterium bovis
QRNSKTAGASVGDLATDPD

SEQ ID NO: 194744 - protein, 9 aa, Mycobacterium bovis
QRPASPRLR

SEQ ID NO: 194745 - protein, 9 aa, Mycobacterium bovis
QRPDYSETD

SEQ ID NO: 194746 - protein, 6 aa, Mycobacterium bovis
QRPTPP

SEQ ID NO: 194747 - protein, 17 aa, Mycobacterium bovis
QRQPDHVDGSRDAGLGR

SEQ ID NO: 194748 - protein, 7 aa, Mycobacterium bovis
QRRPVSV

SEQ ID NO: 194749 - protein, 12 aa, Mycobacterium bovis
QRRQDEAMRPRT

SEQ ID NO: 194750 - protein, 20 aa, Mycobacterium bovis
QRRRPREPREQDAESHDLSS

SEQ ID NO: 194751 - protein, 6 aa, Mycobacterium bovis
QRSSIG

SEQ ID NO: 194752 - protein, 6 aa, Mycobacterium bovis
QSAAAE

SEQ ID NO: 194753 - protein, 7 aa, Mycobacterium bovis
QSAETTR

SEQ ID NO: 194754 - protein, 7 aa, Mycobacterium bovis
QSSNGPL

SEQ ID NO: 194755 - protein, 8 aa, Mycobacterium bovis
QTAELYPG

SEQ ID NO: 194756 - protein, 4 aa, Mycobacterium bovis
QTAL

SEQ ID NO: 194757 - protein, 4 aa, Mycobacterium bovis
QTDK

SEQ ID NO: 194758 - protein, 5 aa, Mycobacterium bovis
QTGEP

SEQ ID NO: 194759 - protein, 9 aa, Mycobacterium bovis
QTSDEVTVE

SEQ ID NO: 194760 - protein, 7 aa, Mycobacterium bovis
QTSESLA

SEQ ID NO: 194761 - protein, 6 aa, Mycobacterium bovis
QTSKTS

SEQ ID NO: 194762 - protein, 16 aa, Mycobacterium bovis
QVGNRALGDRPSQYLT

SEQ ID NO: 194763 - protein, 7 aa, Mycobacterium bovis
QVNPSGR

SEQ ID NO: 194764 - protein, 6 aa, Mycobacterium bovis
QVSGIA

SEQ ID NO: 194765 - protein, 5 aa, Mycobacterium bovis
QYDDY

SEQ ID NO: 194766 - protein, 12 aa, Mycobacterium bovis
QYEHGRDTAPVV

SEQ ID NO: 194767 - protein, 17 aa, Mycobacterium bovis
RAAASGLYRGQQRRRRP

SEQ ID NO: 194768 - protein, 18 aa, Mycobacterium bovis
RAAGAKAGISVKPGTPLE

SEQ ID NO: 194769 - protein, 9 aa, Mycobacterium bovis
RAATTAPAG

SEQ ID NO: 194770 - protein, 15 aa, Mycobacterium bovis
RAEQRRRGREAEEEL

SEQ ID NO: 194771 - protein, 10 aa, Mycobacterium bovis
RAGAEALRQG

SEQ ID NO: 194772 - protein, 7 aa, Mycobacterium bovis
RAGDGVR

SEQ ID NO: 194773 - protein, 4 aa, Mycobacterium bovis
RAGR

SEQ ID NO: 194774 - protein, 32 aa, Mycobacterium bovis
RAGTAGGAGGGPAGGIGGAGGVGGAGGAAGAV

SEQ ID NO: 194775 - protein, 33 aa, Mycobacterium bovis
RAGTAGGAGGGPAGGIGGAGGVGGAGGAAGAVT

SEQ ID NO: 194776 - protein, 32 aa, Mycobacterium bovis
RAGTAGGAGGGPAGGIGGTGGVGGAGGAAGAV

SEQ ID NO: 194777 - protein, 33 aa, Mycobacterium bovis
RAGTAGGAGRGPVGGIGGAGGVGGAGGAAGAVT

SEQ ID NO: 194778 - protein, 6 aa, Mycobacterium bovis
RAMTAR

SEQ ID NO: 194779 - protein, 18 aa, Mycobacterium bovis
RANGGSGSAANASREEQI

SEQ ID NO: 194780 - protein, 6 aa, Mycobacterium bovis
RAPGPS

SEQ ID NO: 194781 - protein, 9 aa, Mycobacterium bovis
RARDRGKPV

SEQ ID NO: 194782 - protein, 20 aa, Mycobacterium bovis
RARGGAHGAASDGMAHRIRF

SEQ ID NO: 194783 - protein, 17 aa, Mycobacterium bovis
RARPRGSSAAHPSPHRR

SEQ ID NO: 194784 - protein, 9 aa, Mycobacterium bovis
RARSDATAV

SEQ ID NO: 194785 - protein, 10 aa, Mycobacterium bovis
RASDRYNQEG

SEQ ID NO: 194786 - protein, 4 aa, Mycobacterium bovis
RAST

SEQ ID NO: 194787 - protein, 10 aa, Mycobacterium bovis
RATGAAEAIE

SEQ ID NO: 194788 - protein, 8 aa, Mycobacterium bovis
RATSTRFG

SEQ ID NO: 194789 - protein, 28 aa, Mycobacterium bovis
RCPPEGPSKGSSGGSSQGPPDGAAAGFG

SEQ ID NO: 194790 - protein, 6 aa, Mycobacterium bovis
RDAGLP

SEQ ID NO: 194791 - protein, 8 aa, Mycobacterium bovis
RDEAPADL

SEQ ID NO: 194792 - protein, 13 aa, Mycobacterium bovis
RDESDRHGDGPLD

SEQ ID NO: 194793 - protein, 6 aa, Mycobacterium bovis
RDGCPS

SEQ ID NO: 194794 - protein, 9 aa, Mycobacterium bovis
RDGQNRSSI

SEQ ID NO: 194795 - protein, 12 aa, Mycobacterium bovis
RDGRHDNKAPLT

SEQ ID NO: 194796 - protein, 4 aa, Mycobacterium bovis
RDNG

SEQ ID NO: 194797 - protein, 5 aa, Mycobacterium bovis
RDPNA

SEQ ID NO: 194798 - protein, 12 aa, Mycobacterium bovis
RDPTPPGGPHGI

SEQ ID NO: 194799 - protein, 28 aa, Mycobacterium bovis
RDQHPGPAHQRPSPPSRPRTAGNPWLAR

SEQ ID NO: 194800 - protein, 6 aa, Mycobacterium bovis
RDRREG

SEQ ID NO: 194801 - protein, 5 aa, Mycobacterium bovis
RDRRW

SEQ ID NO: 194802 - protein, 4 aa, Mycobacterium bovis
RDSD

SEQ ID NO: 194803 - protein, 6 aa, Mycobacterium bovis
RDTEDL

SEQ ID NO: 194804 - protein, 12 aa, Mycobacterium bovis
REAAGPGHRRRR

SEQ ID NO: 194805 - protein, 9 aa, Mycobacterium bovis
REAEDQGQG

SEQ ID NO: 194806 - protein, 5 aa, Mycobacterium bovis
REAEE

SEQ ID NO: 194807 - protein, 5 aa, Mycobacterium bovis
REEEA

SEQ ID NO: 194808 - protein, 7 aa, Mycobacterium bovis
RELRNNT

SEQ ID NO: 194809 - protein, 19 aa, Mycobacterium bovis
RESASQALPGLLERLPALL

SEQ ID NO: 194810 - protein, 4 aa, Mycobacterium bovis
RFNA

SEQ ID NO: 194811 - protein, 5 aa, Mycobacterium bovis
RFPPE

SEQ ID NO: 194812 - protein, 11 aa, Mycobacterium bovis
RGDPNGAAAGD

SEQ ID NO: 194813 - protein, 4 aa, Mycobacterium bovis
RGDR

SEQ ID NO: 194814 - protein, 9 aa, Mycobacterium bovis
RGEQPGPME

SEQ ID NO: 194815 - protein, 10 aa, Mycobacterium bovis
RGERSMKSPG

SEQ ID NO: 194816 - protein, 7 aa, Mycobacterium bovis
RGGVRGY

SEQ ID NO: 194817 - protein, 6 aa, Mycobacterium bovis
RGHNGE

SEQ ID NO: 194818 - protein, 8 aa, Mycobacterium bovis
RGHRGDRL

SEQ ID NO: 194819 - protein, 19 aa, Mycobacterium bovis
RGKQARDKRQDMARRDAQR

SEQ ID NO: 194820 - protein, 6 aa, Mycobacterium bovis
RGVKQE

SEQ ID NO: 194821 - protein, 6 aa, Mycobacterium bovis
RGYGYG

SEQ ID NO: 194822 - protein, 7 aa, Mycobacterium bovis
RHPGTSQ

SEQ ID NO: 194823 - protein, 10 aa, Mycobacterium bovis
RHPPTRQDEA

SEQ ID NO: 194824 - protein, 6 aa, Mycobacterium bovis
RKDGVE

SEQ ID NO: 194825 - protein, 7 aa, Mycobacterium bovis
RKKSDHL

SEQ ID NO: 194826 - protein, 7 aa, Mycobacterium bovis
RKPDGRV

SEQ ID NO: 194827 - protein, 6 aa, Mycobacterium bovis
RKPPIE

SEQ ID NO: 194828 - protein, 7 aa, Mycobacterium bovis
RKRQGAD

SEQ ID NO: 194829 - protein, 31 aa, Mycobacterium bovis; identical to SEQ ID NO: 155393

SEQ ID NO: 194830 - protein, 7 aa, Mycobacterium bovis
RLATSST

SEQ ID NO: 194831 - protein, 15 aa, Mycobacterium bovis
RLDKPGGGLSGGQQQ

SEQ ID NO: 194832 - protein, 16 aa, Mycobacterium bovis
RLESKKISKTQAVTSN

SEQ ID NO: 194833 - protein, 13 aa, Mycobacterium bovis
RLGGSDEADHDRV

SEQ ID NO: 194834 - protein, 5 aa, Mycobacterium bovis
RLRPP

SEQ ID NO: 194835 - protein, 7 aa, Mycobacterium bovis
RLSDSPF

SEQ ID NO: 194836 - protein, 9 aa, Mycobacterium bovis
RLSPASRHI

SEQ ID NO: 194837 - protein, 9 aa, Mycobacterium bovis
RLTGGDTIR

SEQ ID NO: 194838 - protein, 8 aa, Mycobacterium bovis
RMRPPRPA

SEQ ID NO: 194839 - protein, 6 aa, Mycobacterium bovis
RNHPGH

SEQ ID NO: 194840 - protein, 7 aa, Mycobacterium bovis
RNTPGVT

SEQ ID NO: 194841 - protein, 8 aa, Mycobacterium bovis
RNTSTGTT

SEQ ID NO: 194842 - protein, 10 aa, Mycobacterium bovis
RPAATPPGPL

SEQ ID NO: 194843 - protein, 10 aa, Mycobacterium bovis
RPDRDPRSCS

SEQ ID NO: 194844 - protein, 4 aa, Mycobacterium bovis
RPGR

SEQ ID NO: 194845 - protein, 9 aa, Mycobacterium bovis
RPGSGREAT

SEQ ID NO: 194846 - protein, 7 aa, Mycobacterium bovis
RPGTYNE

SEQ ID NO: 194847 - protein, 10 aa, Mycobacterium bovis
RPKTPPPADA

SEQ ID NO: 194848 - protein, 19 aa, Mycobacterium bovis
RPKTPRGDGNADGGQVGAG

SEQ ID NO: 194849 - protein, 9 aa, Mycobacterium bovis
RPRRGRPRA

SEQ ID NO: 194850 - protein, 8 aa, Mycobacterium bovis
RPSHGGYG

SEQ ID NO: 194851 - protein, 5 aa, Mycobacterium bovis
RPSVL

SEQ ID NO: 194852 - protein, 18 aa, Mycobacterium bovis
RPTAPSPSHTNTLGTAPN

SEQ ID NO: 194853 - protein, 7 aa, Mycobacterium bovis
RPTPGRA

SEQ ID NO: 194854 - protein, 4 aa, Mycobacterium bovis
RQAD

SEQ ID NO: 194855 - protein, 6 aa, Mycobacterium bovis
RQAGPI

SEQ ID NO: 194856 - protein, 10 aa, Mycobacterium bovis
RQLPGEGVTR

SEQ ID NO: 194857 - protein, 9 aa, Mycobacterium bovis
RQQDGRSIQ

SEQ ID NO: 194858 - protein, 17 aa, Mycobacterium bovis
RQRRAARQKAERGHPNW

SEQ ID NO: 194859 - protein, 5 aa, Mycobacterium bovis
RRADD

SEQ ID NO: 194860 - protein, 4 aa, Mycobacterium bovis
RRCA

SEQ ID NO: 194861 - protein, 26 aa, Mycobacterium bovis
RRCSATEDRAPATVATPSSADPTASR

SEQ ID NO: 194862 - protein, 4 aa, Mycobacterium bovis
RRDL

SEQ ID NO: 194863 - protein, 5 aa, Mycobacterium bovis
RREPY

SEQ ID NO: 194864 - protein, 9 aa, Mycobacterium bovis
RRGARFSTA

SEQ ID NO: 194865 - protein, 21 aa, Mycobacterium bovis
RRGRPGTPKQRPPTPGPILPT

SEQ ID NO: 194866 - protein, 14 aa, Mycobacterium bovis
RRGSTATSSSETIT

SEQ ID NO: 194867 - protein, 14 aa, Mycobacterium bovis
RRLTEANDSPAGEA

SEQ ID NO: 194868 - protein, 8 aa, Mycobacterium bovis
RRNPRGSY

SEQ ID NO: 194869 - protein, 9 aa, Mycobacterium bovis
RRPAEATGA

SEQ ID NO: 194870 - protein, 6 aa, Mycobacterium bovis
RRSASV

SEQ ID NO: 194871 - protein, 12 aa, Mycobacterium bovis
RRSVAPASGAVP

SEQ ID NO: 194872 - protein, 4 aa, Mycobacterium bovis
RRTL

SEQ ID NO: 194873 - protein, 20 aa, Mycobacterium bovis
RRVPRQRRQRINRQAPPRLR

SEQ ID NO: 194874 - protein, 5 aa, Mycobacterium bovis
RSDDG

SEQ ID NO: 194875 - protein, 12 aa, Mycobacterium bovis
RSDGERSRRPRE

SEQ ID NO: 194876 - protein, 11 aa, Mycobacterium bovis
RSDTGRGSRYD

SEQ ID NO: 194877 - protein, 9 aa, Mycobacterium bovis
RSGQASTIE

SEQ ID NO: 194878 - protein, 7 aa, Mycobacterium bovis
RSHDGQL

SEQ ID NO: 194879 - protein, 17 aa, Mycobacterium bovis
RSIRPSASSGSGKAKTV

SEQ ID NO: 194880 - protein, 5 aa, Mycobacterium bovis
RSLNA

SEQ ID NO: 194881 - protein, 5 aa, Mycobacterium bovis
RSLPE

SEQ ID NO: 194882 - protein, 5 aa, Mycobacterium bovis
RSQDP

SEQ ID NO: 194883 - protein, 8 aa, Mycobacterium bovis
RSQGNESA

SEQ ID NO: 194884 - protein, 8 aa, Mycobacterium bovis
RSRGGAHS

SEQ ID NO: 194885 - protein, 9 aa, Mycobacterium bovis
RSRKVAEGR

SEQ ID NO: 194886 - protein, 5 aa, Mycobacterium bovis
RSSDT

SEQ ID NO: 194887 - protein, 4 aa, Mycobacterium bovis
RSSM

SEQ ID NO: 194888 - protein, 12 aa, Mycobacterium bovis
RSTAEAWLSLLD

SEQ ID NO: 194889 - protein, 16 aa, Mycobacterium bovis
RSTSEQVHADLGVTPL

SEQ ID NO: 194890 - protein, 9 aa, Mycobacterium bovis
RSWRNTEPA

SEQ ID NO: 194891 - protein, 26 aa, Mycobacterium bovis
RTARPASAPPAVTEATAGTAVTVGTA

SEQ ID NO: 194892 - protein, 6 aa, Mycobacterium bovis
RTEADV

SEQ ID NO: 194893 - protein, 10 aa, Mycobacterium bovis
RTGPPQSTSW

SEQ ID NO: 194894 - protein, 9 aa, Mycobacterium bovis
RTGSGRCNR

SEQ ID NO: 194895 - protein, 6 aa, Mycobacterium bovis
RTKNNP

SEQ ID NO: 194896 - protein, 16 aa, Mycobacterium bovis
RTPKALPDGVSQATVG

SEQ ID NO: 194897 - protein, 5 aa, Mycobacterium bovis
RTPST

SEQ ID NO: 194898 - protein, 5 aa, Mycobacterium bovis
RTRAA

SEQ ID NO: 194899 - protein, 5 aa, Mycobacterium bovis
RTRYP

SEQ ID NO: 194900 - protein, 10 aa, Mycobacterium bovis
RVCTSSGSPM

SEQ ID NO: 194901 - protein, 13 aa, Mycobacterium bovis
RVDSDLDAQSPAA

SEQ ID NO: 194902 - protein, 6 aa, Mycobacterium bovis
RVPDGE

SEQ ID NO: 194903 - protein, 7 aa, Mycobacterium bovis
RVPGDDT

SEQ ID NO: 194904 - protein, 10 aa, Mycobacterium bovis
RWAPPYAEAG

SEQ ID NO: 194905 - protein, 14 aa, Mycobacterium bovis
RYAAATSQTKGLTF

SEQ ID NO: 194906 - protein, 15 aa, Mycobacterium bovis
RYAPPPPYPAPDPFE

SEQ ID NO: 194907 - protein, 5 aa, Mycobacterium bovis
RYEGD

SEQ ID NO: 194908 - protein, 21 aa, Mycobacterium bovis
SAAASRHRKPTHPTTIATSAQ

SEQ ID NO: 194909 - protein, 6 aa, Mycobacterium bovis
SAADHD

SEQ ID NO: 194910 - protein, 15 aa, Mycobacterium bovis
SAAEPGAAGRHASDR

SEQ ID NO: 194911 - protein, 6 aa, Mycobacterium bovis
SAAHSR

SEQ ID NO: 194912 - protein, 7 aa, Mycobacterium bovis
SADGGVP

SEQ ID NO: 194913 - protein, 5 aa, Mycobacterium bovis
SADGL

SEQ ID NO: 194914 - protein, 6 aa, Mycobacterium bovis
SADGYR

SEQ ID NO: 194915 - protein, 4 aa, Mycobacterium bovis
SAER

SEQ ID NO: 194916 - protein, 4 aa, Mycobacterium bovis
SAGD

SEQ ID NO: 194917 - protein, 18 aa, Mycobacterium bovis
SAGLRAAAAGSFEQASDH

SEQ ID NO: 194918 - protein, 11 aa, Mycobacterium bovis
SAGRAGSIGPM

SEQ ID NO: 194919 - protein, 5 aa, Mycobacterium bovis
SAIPA

SEQ ID NO: 194920 - protein, 25 aa, Mycobacterium bovis
SALDAQPDPHLSGDEPPSRPLTPET

SEQ ID NO: 194921 - protein, 4 aa, Mycobacterium bovis
SAMS

SEQ ID NO: 194922 - protein, 8 aa, Mycobacterium bovis
SANIGSSN

SEQ ID NO: 194923 - protein, 8 aa, Mycobacterium bovis
SANRDPSV

SEQ ID NO: 194924 - protein, 13 aa, Mycobacterium bovis
SAPLDSQAAAQVA

SEQ ID NO: 194925 - protein, 6 aa, Mycobacterium bovis
SAPPGY

SEQ ID NO: 194926 - protein, 8 aa, Mycobacterium bovis
SAPSASVD

SEQ ID NO: 194927 - protein, 5 aa, Mycobacterium bovis
SAPTF

SEQ ID NO: 194928 - protein, 26 aa, Mycobacterium bovis
SAQPSASPPAPTGGSNESTTQPAASW

SEQ ID NO: 194929 - protein, 4 aa, Mycobacterium bovis
SARN

SEQ ID NO: 194930 - protein, 6 aa, Mycobacterium bovis
SARRGT

SEQ ID NO: 194931 - protein, 7 aa, Mycobacterium bovis
SATDPHA

SEQ ID NO: 194932 - protein, 4 aa, Mycobacterium bovis
SAVM

SEQ ID NO: 194933 - protein, 6 aa, Mycobacterium bovis
SCAAGT

SEQ ID NO: 194934 - protein, 7 aa, Mycobacterium bovis
SDAPEYS

SEQ ID NO: 194935 - protein, 9 aa, Mycobacterium bovis
SDDDDRTRL

SEQ ID NO: 194936 - protein, 4 aa, Mycobacterium bovis
SDFD

SEQ ID NO: 194937 - protein, 9 aa, Mycobacterium bovis
SDGDFGGDL

SEQ ID NO: 194938 - protein, 6 aa, Mycobacterium bovis
SDGFGP

SEQ ID NO: 194939 - protein, 5 aa, Mycobacterium bovis
SDHGD

SEQ ID NO: 194940 - protein, 26 aa, Mycobacterium bovis
SDPDDGNSTPKNRPHGSNSLSTTQLH

SEQ ID NO: 194941 - protein, 11 aa, Mycobacterium bovis
SDPNDRASAEQ

SEQ ID NO: 194942 - protein, 6 aa, Mycobacterium bovis
SDSDVA

SEQ ID NO: 194943 - protein, 6 aa, Mycobacterium bovis
SDSGRA

SEQ ID NO: 194944 - protein, 10 aa, Mycobacterium bovis
SDSLNDKELR

SEQ ID NO: 194945 - protein, 37 aa, Mycobacterium bovis
SDTPETTTASRSADRSTNPKTAKHPKSAAKPTVPTPA

SEQ ID NO: 194946 - protein, 6 aa, Mycobacterium bovis
SEAADK

SEQ ID NO: 194947 - protein, 5 aa, Mycobacterium bovis
SEEVE

SEQ ID NO: 194948 - protein, 6 aa, Mycobacterium bovis
SEGKGL

SEQ ID NO: 194949 - protein, 10 aa, Mycobacterium bovis
SEKGDSGGPV

SEQ ID NO: 194950 - protein, 6 aa, Mycobacterium bovis
SEMSDE

SEQ ID NO: 194951 - protein, 5 aa, Mycobacterium bovis
SEPHD

SEQ ID NO: 194952 - protein, 7 aa, Mycobacterium bovis
SEPPLSA

SEQ ID NO: 194953 - protein, 4 aa, Mycobacterium bovis
SEQC

SEQ ID NO: 194954 - protein, 11 aa, Mycobacterium bovis
SEVTKYRQGDR

SEQ ID NO: 194955 - protein, 17 aa, Mycobacterium bovis
SFGSVTSGLAGQSWQGA

SEQ ID NO: 194956 - protein, 12 aa, Mycobacterium bovis
SFSRGARQEAER

SEQ ID NO: 194957 - protein, 35 aa, Mycobacterium bovis
SGAGLTTLDGTDVAEHGTPGLPGVPAGTDKRASGV

SEQ ID NO: 194958 - protein, 16 aa, Mycobacterium bovis
SGAHASYSGGPGETDY

SEQ ID NO: 194959 - protein, 6 aa, Mycobacterium bovis
SGAKDQ

SEQ ID NO: 194960 - protein, 6 aa, Mycobacterium bovis
SGDALS

SEQ ID NO: 194961 - protein, 15 aa, Mycobacterium bovis
SGDGNTGFGNAGDVN

SEQ ID NO: 194962 - protein, 14 aa, Mycobacterium bovis
SGDGNTGFGNAGNI

SEQ ID NO: 194963 - protein, 9 aa, Mycobacterium bovis
SGDGTDPRT

SEQ ID NO: 194964 - protein, 13 aa, Mycobacterium bovis
SGDPITDVNGGGQ

SEQ ID NO: 194965 - protein, 10 aa, Mycobacterium bovis
SGDTANEGTQ

SEQ ID NO: 194966 - protein, 7 aa, Mycobacterium bovis
SGDTPLL

SEQ ID NO: 194967 - protein, 6 aa, Mycobacterium bovis
SGESGL

SEQ ID NO: 194968 - protein, 7 aa, Mycobacterium bovis
SGEYAAS

SEQ ID NO: 194969 - protein, 8 aa, Mycobacterium bovis
SGFANTGT

SEQ ID NO: 194970 - protein, 10 aa, Mycobacterium bovis
SGFDAAAPSA

SEQ ID NO: 194971 - protein, 8 aa, Mycobacterium bovis
SGFGGGGH

SEQ ID NO: 194972 - protein, 49 aa, Mycobacterium bovis
SGGAGGAGGSGRTDLGGAGGAGGKAGLIGNGGNGGAGGAGGAGGPGGAA

SEQ ID NO: 194973 - protein, 30 aa, Mycobacterium bovis
SGGAGGSGGAAGTFGDTGNSGGAGGAGGKA

SEQ ID NO: 194974 - protein, 30 aa, Mycobacterium bovis
SGGAGGSGGAGGFANGSTGGAGGAGGGAGL

SEQ ID NO: 194975 - protein, 7 aa, Mycobacterium bovis
SGGGPRV

SEQ ID NO: 194976 - protein, 31 aa, Mycobacterium bovis
SGGSGNGRGDPGSGGSGGEGGEGGPSISVNV

SEQ ID NO: 194977 - protein, 24 aa, Mycobacterium bovis
SGGTGGSGGFGKDTGGAGGRGGDA

SEQ ID NO: 194978 - protein, 10 aa, Mycobacterium bovis
SGGVGGAGGF

SEQ ID NO: 194979 - protein, 6 aa, Mycobacterium bovis
SGHAAR

SEQ ID NO: 194980 - protein, 8 aa, Mycobacterium bovis
SGHQPDGY

SEQ ID NO: 194981 - protein, 7 aa, Mycobacterium bovis
SGIPAAT

SEQ ID NO: 194982 - protein, 13 aa, Mycobacterium bovis
SGISVGPSETVDA

SEQ ID NO: 194983 - protein, 5 aa, Mycobacterium bovis
SGITG

SEQ ID NO: 194984 - protein, 5 aa, Mycobacterium bovis
SGLNP

SEQ ID NO: 194985 - protein, 6 aa, Mycobacterium bovis
SGLTNG

SEQ ID NO: 194986 - protein, 50 aa, Mycobacterium bovis
SGNGGTGGGGGTAGAGGQGGNGNSGIDPGNGGQGADTGNAGNGGHGGSAA

SEQ ID NO: 194987 - protein, 18 aa, Mycobacterium bovis
SGNIGNTNFGNGNQGNLN

SEQ ID NO: 194988 - protein, 4 aa, Mycobacterium bovis
SGNM

SEQ ID NO: 194989 - protein, 8 aa, Mycobacterium bovis
SGNSNEGF

SEQ ID NO: 194990 - protein, 19 aa, Mycobacterium bovis
SGPHGADPHHGYSDRELRE

SEQ ID NO: 194991 - protein, 4 aa, Mycobacterium bovis
SGPY

SEQ ID NO: 194992 - protein, 13 aa, Mycobacterium bovis
SGQAVTASATDHP

SEQ ID NO: 194993 - protein, 6 aa, Mycobacterium bovis
SGTDSN

SEQ ID NO: 194994 - protein, 5 aa, Mycobacterium bovis
SGTGI

SEQ ID NO: 194995 - protein, 5 aa, Mycobacterium bovis
SGTVP

SEQ ID NO: 194996 - protein, 41 aa, Mycobacterium bovis
SGVASTGIANSGNASSGVANSGDNSSGAFNQGDNQAGFFGQ

SEQ ID NO: 194997 - protein, 10 aa, Mycobacterium bovis
SHPDQAIASG

SEQ ID NO: 194998 - protein, 5 aa, Mycobacterium bovis
SHQYP

SEQ ID NO: 194999 - protein, 54 aa, Mycobacterium bovis
SHRRPPSGSMRPRARGRGRTHARTRARSHGGTARRGGRRPCARDTGRRSRRHRR

SEQ ID NO: 195000 - protein, 6 aa, Mycobacterium bovis
SKSALR

SEQ ID NO: 195001 - protein, 5 aa, Mycobacterium bovis
SLDAE

SEQ ID NO: 195002 - protein, 4 aa, Mycobacterium bovis
SLNA

SEQ ID NO: 195003 - protein, 11 aa, Mycobacterium bovis
SLNTPADNDHQ

SEQ ID NO: 195004 - protein, 17 aa, Mycobacterium bovis
SMRTNSNQLRSYVAWTP

SEQ ID NO: 195005 - protein, 23 aa, Mycobacterium bovis
SMSPKDVDDLATQQDVDDGQSIE

SEQ ID NO: 195006 - protein, 7 aa, Mycobacterium bovis
SNDPTEL

SEQ ID NO: 195007 - protein, 7 aa, Mycobacterium bovis
SNGIGSD

SEQ ID NO: 195008 - protein, 6 aa, Mycobacterium bovis
SNMAST

SEQ ID NO: 195009 - protein, 5 aa, Mycobacterium bovis
SNPVA

SEQ ID NO: 195010 - protein, 6 aa, Mycobacterium bovis
SNVDTD

SEQ ID NO: 195011 - protein, 5 aa, Mycobacterium bovis
SPADQ

SEQ ID NO: 195012 - protein, 6 aa, Mycobacterium bovis
SPDEKY

SEQ ID NO: 195013 - protein, 11 aa, Mycobacterium bovis
SPHGVSAGGSR

SEQ ID NO: 195014 - protein, 4 aa, Mycobacterium bovis
SPHP

SEQ ID NO: 195015 - protein, 8 aa, Mycobacterium bovis
SPKQFDGV

SEQ ID NO: 195016 - protein, 18 aa, Mycobacterium bovis
SPLDPTSGDPLHPAPPRL

SEQ ID NO: 195017 - protein, 5 aa, Mycobacterium bovis
SPPML

SEQ ID NO: 195018 - protein, 5 aa, Mycobacterium bovis
SPRAH

SEQ ID NO: 195019 - protein, 14 aa, Mycobacterium bovis
SPSEDAREMRQNSP

SEQ ID NO: 195020 - protein, 4 aa, Mycobacterium bovis
SPSV

SEQ ID NO: 195021 - protein, 4 aa, Mycobacterium bovis
SPTD

SEQ ID NO: 195022 - protein, 17 aa, Mycobacterium bovis
SPTWDPRARGWWSEDPG

SEQ ID NO: 195023 - protein, 5 aa, Mycobacterium bovis
SQHAG

SEQ ID NO: 195024 - protein, 11 aa, Mycobacterium bovis
SQSIPGPSNLG

SEQ ID NO: 195025 - protein, 8 aa, Mycobacterium bovis
SRAAETAE

SEQ ID NO: 195026 - protein, 13 aa, Mycobacterium bovis
SRASEIAPNTTDG

SEQ ID NO: 195027 - protein, 13 aa, Mycobacterium bovis
SRDESARASDTDR

SEQ ID NO: 195028 - protein, 12 aa, Mycobacterium bovis
SREAARRTLNRP

SEQ ID NO: 195029 - protein, 6 aa, Mycobacterium bovis
SRETVN

SEQ ID NO: 195030 - protein, 6 aa, Mycobacterium bovis
SRGGVG

SEQ ID NO: 195031 - protein, 13 aa, Mycobacterium bovis
SRHPQQETTCRRV

SEQ ID NO: 195032 - protein, 9 aa, Mycobacterium bovis
SRKPGRKHQ

SEQ ID NO: 195033 - protein, 8 aa, Mycobacterium bovis
SRRREEGL

SEQ ID NO: 195034 - protein, 17 aa, Mycobacterium bovis
SRSPGLNESSHMSGRVP

SEQ ID NO: 195035 - protein, 11 aa, Mycobacterium bovis
SRSRASDDPEF

SEQ ID NO: 195036 - protein, 16 aa, Mycobacterium bovis
SRSSSTRLQTVSWCQR

SEQ ID NO: 195037 - protein, 19 aa, Mycobacterium bovis
SRVAARRRAGQRAESRQHP

SEQ ID NO: 195038 - protein, 9 aa, Mycobacterium bovis
SSDFKTGPA

SEQ ID NO: 195039 - protein, 6 aa, Mycobacterium bovis
SSDRAT

SEQ ID NO: 195040 - protein, 10 aa, Mycobacterium bovis
SSHDGPDAGR

SEQ ID NO: 195041 - protein, 19 aa, Mycobacterium bovis
SSPGKLPTAQGYYCTSIRC

SEQ ID NO: 195042 - protein, 14 aa, Mycobacterium bovis
SSQAQLDDDPHRSA

SEQ ID NO: 195043 - protein, 8 aa, Mycobacterium bovis
SSSDGRGP

SEQ ID NO: 195044 - protein, 9 aa, Mycobacterium bovis
SSSTDPAIA

SEQ ID NO: 195045 - protein, 75 aa, Mycobacterium bovis
SSSTSSGPPTAPTPTSPFGTAPMPPGPPPPGTVSPPLPPSAPAVGVGGPSVPAAGMPPAAAAATAPLSPQSLGQS

SEQ ID NO: 195046 - protein, 7 aa, Mycobacterium bovis
SSVGHAG

SEQ ID NO: 195047 - protein, 15 aa, Mycobacterium bovis
STAGGAGGAGGAGGL

SEQ ID NO: 195048 - protein, 8 aa, Mycobacterium bovis
STEQHGPH

SEQ ID NO: 195049 - protein, 8 aa, Mycobacterium bovis
STKPENVP

SEQ ID NO: 195050 - protein, 32 aa, Mycobacterium bovis
STLGYGGNGVNGGAGGTGGKAGVFGAPGQNGL

SEQ ID NO: 195051 - protein, 23 aa, Mycobacterium bovis
STPASNPAQPRPTREQNRRSGSC

SEQ ID NO: 195052 - protein, 5 aa, Mycobacterium bovis
STRSS

SEQ ID NO: 195053 - protein, 9 aa, Mycobacterium bovis
STSRQSDWG

SEQ ID NO: 195054 - protein, 8 aa, Mycobacterium bovis
STTGADSH

SEQ ID NO: 195055 - protein, 6 aa, Mycobacterium bovis
STTPHH

SEQ ID NO: 195056 - protein, 6 aa, Mycobacterium bovis
SVDPDR

SEQ ID NO: 195057 - protein, 11 aa, Mycobacterium bovis
SVGGQPSQATQ

SEQ ID NO: 195058 - protein, 5 aa, Mycobacterium bovis
SVGPT

SEQ ID NO: 195059 - protein, 7 aa, Mycobacterium bovis
SVMAPTA

SEQ ID NO: 195060 - protein, 18 aa, Mycobacterium bovis
SVNGHSDDSSGDAKQAAP

SEQ ID NO: 195061 - protein, 4 aa, Mycobacterium bovis
SVRS

SEQ ID NO: 195062 - protein, 13 aa, Mycobacterium bovis
SYPSALATDHHHG

SEQ ID NO: 195063 - protein, 14 aa, Mycobacterium bovis
TAATAATPGPAGMA

SEQ ID NO: 195064 - protein, 13 aa, Mycobacterium bovis
TACPKGVDPAGAI

SEQ ID NO: 195065 - protein, 11 aa, Mycobacterium bovis
TADAEEALGGA

SEQ ID NO: 195066 - protein, 9 aa, Mycobacterium bovis
TADPVAGSR

SEQ ID NO: 195067 - protein, 5 aa, Mycobacterium bovis
TADTH

SEQ ID NO: 195068 - protein, 6 aa, Mycobacterium bovis
TAGGDL

SEQ ID NO: 195069 - protein, 7 aa, Mycobacterium bovis
TAHPGVN

SEQ ID NO: 195070 - protein, 9 aa, Mycobacterium bovis
TANSGAGVL

SEQ ID NO: 195071 - protein, 19 aa, Mycobacterium bovis
TAPAGAATGVTSRADAHSQ

SEQ ID NO: 195072 - protein, 9 aa, Mycobacterium bovis
TAQQRTSLA

SEQ ID NO: 195073 - protein, 6 aa, Mycobacterium bovis
TARAQE

SEQ ID NO: 195074 - protein, 4 aa, Mycobacterium bovis
TARQ

SEQ ID NO: 195075 - protein, 13 aa, Mycobacterium bovis
TARRGPPTRGLPK

SEQ ID NO: 195076 - protein, 5 aa, Mycobacterium bovis
TATGL

SEQ ID NO: 195077 - protein, 6 aa, Mycobacterium bovis
TATGLT

SEQ ID NO: 195078 - protein, 12 aa, Mycobacterium bovis
TATTNPRHSDAH

SEQ ID NO: 195079 - protein, 10 aa, Mycobacterium bovis
TAVAHSGDDA

SEQ ID NO: 195080 - protein, 5 aa, Mycobacterium bovis
TCPVN

SEQ ID NO: 195081 - protein, 9 aa, Mycobacterium bovis
TDDSDGRTR

SEQ ID NO: 195082 - protein, 108 aa, Mycobacterium bovis
TDEPVKRTATKSPAASASGAKTGAKRTAAKSASGSPPAKRATKPAARSVKPASAPQDTTTSTIPKRKTRAAAKSAAAKAPSARGHATKPRAPKDAQHEAATDPEDALD

SEQ ID NO: 195083 - protein, 8 aa, Mycobacterium bovis
TDGDPVTA

SEQ ID NO: 195084 - protein, 4 aa, Mycobacterium bovis
TDGE

SEQ ID NO: 195085 - protein, 7 aa, Mycobacterium bovis
TDKDWRE

SEQ ID NO: 195086 - protein, 9 aa, Mycobacterium bovis
TDMTTGSRR

SEQ ID NO: 195087 - protein, 40 aa, Mycobacterium bovis
TDPNLSRPRVAATAAKSGANDPQPPEVAGQPPSSARPARR

SEQ ID NO: 195088 - protein, 26 aa, Mycobacterium bovis
TDPTDSCGGRDRPGQLPCAPLDYHRH

SEQ ID NO: 195089 - protein, 7 aa, Mycobacterium bovis
TDSVSPQ

SEQ ID NO: 195090 - protein, 6 aa, Mycobacterium bovis
TEADER

SEQ ID NO: 195091 - protein, 4 aa, Mycobacterium bovis
TEIG

SEQ ID NO: 195092 - protein, 9 aa, Mycobacterium bovis
TEPTSPQDA

SEQ ID NO: 195093 - protein, 15 aa, Mycobacterium bovis
TERFGPQPAQPAAGP

SEQ ID NO: 195094 - protein, 5 aa, Mycobacterium bovis
TESLG

SEQ ID NO: 195095 - protein, 4 aa, Mycobacterium bovis
TFAR

SEQ ID NO: 195096 - protein, 8 aa, Mycobacterium bovis
TGCSPDAA

SEQ ID NO: 195097 - protein, 7 aa, Mycobacterium bovis
TGDLPTI

SEQ ID NO: 195098 - protein, 8 aa, Mycobacterium bovis
TGETCGTV

SEQ ID NO: 195099 - protein, 12 aa, Mycobacterium bovis
TGFGNSGAGNTG

SEQ ID NO: 195100 - protein, 4 aa, Mycobacterium bovis
TGGG

SEQ ID NO: 195101 - protein, 27 aa, Mycobacterium bovis
TGKRIQAAGGAVRTRVGDRSRAAGRRA

SEQ ID NO: 195102 - protein, 15 aa, Mycobacterium bovis
TGKTPVSKDDAQQHA

SEQ ID NO: 195103 - protein, 8 aa, Mycobacterium bovis
TGLAKPAG

SEQ ID NO: 195104 - protein, 5 aa, Mycobacterium bovis
TGPAL

SEQ ID NO: 195105 - protein, 6 aa, Mycobacterium bovis
TGPEVT

SEQ ID NO: 195106 - protein, 11 aa, Mycobacterium bovis
TGRRTGADQRA

SEQ ID NO: 195107 - protein, 12 aa, Mycobacterium bovis
TGSITKIYLRAT

SEQ ID NO: 195108 - protein, 6 aa, Mycobacterium bovis
TGSRDY

SEQ ID NO: 195109 - protein, 9 aa, Mycobacterium bovis
TGTAGYAGG

SEQ ID NO: 195110 - protein, 4 aa, Mycobacterium bovis
TGTH

SEQ ID NO: 195111 - protein, 6 aa, Mycobacterium bovis
TGTSDQ

SEQ ID NO: 195112 - protein, 6 aa, Mycobacterium bovis
THPEPK

SEQ ID NO: 195113 - protein, 7 aa, Mycobacterium bovis
THPQDRA

SEQ ID NO: 195114 - protein, 6 aa, Mycobacterium bovis
THRETP

SEQ ID NO: 195115 - protein, 19 aa, Mycobacterium bovis
THRRRAAPTTLIPDGRTPG

SEQ ID NO: 195116 - protein, 11 aa, Mycobacterium bovis
TISTTAGPDGV

SEQ ID NO: 195117 - protein, 6 aa, Mycobacterium bovis
TKADLP

SEQ ID NO: 195118 - protein, 5 aa, Mycobacterium bovis
TKDQV

SEQ ID NO: 195119 - protein, 9 aa, Mycobacterium bovis
TKGRPGLGR

SEQ ID NO: 195120 - protein, 11 aa, Mycobacterium bovis
TKVDPAADPAV

SEQ ID NO: 195121 - protein, 23 aa, Mycobacterium bovis
TLASTSTTSPASSHPPSANTTVT

SEQ ID NO: 195122 - protein, 7 aa, Mycobacterium bovis
TLPPGRL

SEQ ID NO: 195123 - protein, 16 aa, Mycobacterium bovis
TNATRHQHDAAAAAVD

SEQ ID NO: 195124 - protein, 14 aa, Mycobacterium bovis
TNDDQGDQGDVQPA

SEQ ID NO: 195125 - protein, 21 aa, Mycobacterium bovis
TNPSPPGEDGRGRNTTIKERQ

SEQ ID NO: 195126 - protein, 4 aa, Mycobacterium bovis
TPAA

SEQ ID NO: 195127 - protein, 5 aa, Mycobacterium bovis
TPAAE

SEQ ID NO: 195128 - protein, 5 aa, Mycobacterium bovis
TPAFG

SEQ ID NO: 195129 - protein, 14 aa, Mycobacterium bovis
TPDPEPDPPATHAP

SEQ ID NO: 195130 - protein, 6 aa, Mycobacterium bovis
TPEHGN

SEQ ID NO: 195131 - protein, 12 aa, Mycobacterium bovis
TPGHADFGGEVE

SEQ ID NO: 195132 - protein, 4 aa, Mycobacterium bovis
TPIT

SEQ ID NO: 195133 - protein, 4 aa, Mycobacterium bovis
TPPA

SEQ ID NO: 195134 - protein, 9 aa, Mycobacterium bovis
TPQERADPK

SEQ ID NO: 195135 - protein, 4 aa, Mycobacterium bovis
TPRD

SEQ ID NO: 195136 - protein, 12 aa, Mycobacterium bovis
TPSPASDTDTVT

SEQ ID NO: 195137 - protein, 6 aa, Mycobacterium bovis
TPTRRF

SEQ ID NO: 195138 - protein, 6 aa, Mycobacterium bovis
TPTSKV

SEQ ID NO: 195139 - protein, 11 aa, Mycobacterium bovis
TPVTADSALNR

SEQ ID NO: 195140 - protein, 15 aa, Mycobacterium bovis
TQASVPPQGGRKHPH

SEQ ID NO: 195141 - protein, 5 aa, Mycobacterium bovis
TQPRH

SEQ ID NO: 195142 - protein, 14 aa, Mycobacterium bovis
TQSPYPGGGPIPEK

SEQ ID NO: 195143 - protein, 14 aa, Mycobacterium bovis
TQYTESGNALDQSM

SEQ ID NO: 195144 - protein, 6 aa, Mycobacterium bovis
TRAFDG

SEQ ID NO: 195145 - protein, 8 aa, Mycobacterium bovis
TRDLSNEA

SEQ ID NO: 195146 - protein, 9 aa, Mycobacterium bovis
TREQDPDRA

SEQ ID NO: 195147 - protein, 19 aa, Mycobacterium bovis
TRGGDGQGAPFGADVPTPR

SEQ ID NO: 195148 - protein, 6 aa, Mycobacterium bovis
TRNPGF

SEQ ID NO: 195149 - protein, 7 aa, Mycobacterium bovis
TRNRPGH

SEQ ID NO: 195150 - protein, 16 aa, Mycobacterium bovis
TRPRPPQGNQPPASRI

SEQ ID NO: 195151 - protein, 8 aa, Mycobacterium bovis
TRPSEPGV

SEQ ID NO: 195152 - protein, 8 aa, Mycobacterium bovis
TRPSGLPG

SEQ ID NO: 195153 - protein, 9 aa, Mycobacterium bovis
TRRDLPQSP

SEQ ID NO: 195154 - protein, 17 aa, Mycobacterium bovis
TSAEAAQTQTRIALKSR

SEQ ID NO: 195155 - protein, 8 aa, Mycobacterium bovis
TSAGAAAR

SEQ ID NO: 195156 - protein, 5 aa, Mycobacterium bovis
TSDGQ

SEQ ID NO: 195157 - protein, 7 aa, Mycobacterium bovis
TSEGAEA

SEQ ID NO: 195158 - protein, 5 aa, Mycobacterium bovis
TSESL

SEQ ID NO: 195159 - protein, 9 aa, Mycobacterium bovis
TSGDTIAAN

SEQ ID NO: 195160 - protein, 8 aa, Mycobacterium bovis
TSGQPDPD

SEQ ID NO: 195161 - protein, 10 aa, Mycobacterium bovis
TSGSPSEATS

SEQ ID NO: 195162 - protein, 10 aa, Mycobacterium bovis
TSNYREDSDT

SEQ ID NO: 195163 - protein, 15 aa, Mycobacterium bovis
TSPGEVAGEGSPDPF

SEQ ID NO: 195164 - protein, 14 aa, Mycobacterium bovis
TSPSPSKRRTASRA

SEQ ID NO: 195165 - protein, 4 aa, Mycobacterium bovis
TSQL

SEQ ID NO: 195166 - protein, 9 aa, Mycobacterium bovis
TSSSPGTLG

SEQ ID NO: 195167 - protein, 9 aa, Mycobacterium bovis
TSTATGREA

SEQ ID NO: 195168 - protein, 35 aa, Mycobacterium bovis
TSTGGSGGFGGNGAASAASGADGGAGGAGGNGGAG

SEQ ID NO: 195169 - protein, 17 aa, Mycobacterium bovis
TTALRTPSTWMTRATAT

SEQ ID NO: 195170 - protein, 9 aa, Mycobacterium bovis
TTATNTPFV

SEQ ID NO: 195171 - protein, 5 aa, Mycobacterium bovis
TTDAS

SEQ ID NO: 195172 - protein, 9 aa, Mycobacterium bovis
TTGAASNGC

SEQ ID NO: 195173 - protein, 10 aa, Mycobacterium bovis
TTKSRSNVDD

SEQ ID NO: 195174 - protein, 11 aa, Mycobacterium bovis
TTQLGETAAEL

SEQ ID NO: 195175 - protein, 6 aa, Mycobacterium bovis
TTQQAE

SEQ ID NO: 195176 - protein, 10 aa, Mycobacterium bovis
TTSAAARQLT

SEQ ID NO: 195177 - protein, 12 aa, Mycobacterium bovis
TTWQRESAPVDV

SEQ ID NO: 195178 - protein, 7 aa, Mycobacterium bovis
TVSPGAT

SEQ ID NO: 195179 - protein, 4 aa, Mycobacterium bovis
TVTD

SEQ ID NO: 195180 - protein, 12 aa, Mycobacterium bovis
TWPAPTAPTPVR

SEQ ID NO: 195181 - protein, 5 aa, Mycobacterium bovis
TYPGT

SEQ ID NO: 195182 - protein, 12 aa, Mycobacterium bovis
VADSTDDTIEVD

SEQ ID NO: 195183 - protein, 13 aa, Mycobacterium bovis
VANSRRRPVHPGQ

SEQ ID NO: 195184 - protein, 10 aa, Mycobacterium bovis
VAPRGGGHSY

SEQ ID NO: 195185 - protein, 11 aa, Mycobacterium bovis
VDADEVTAAAR

SEQ ID NO: 195186 - protein, 17 aa, Mycobacterium bovis
VDDLATQQDVDDGQSIE

SEQ ID NO: 195187 - protein, 11 aa, Mycobacterium bovis
VDDQSRARAAL

SEQ ID NO: 195188 - protein, 10 aa, Mycobacterium bovis
VDEQTGAESV

SEQ ID NO: 195189 - protein, 14 aa, Mycobacterium bovis
VDHATASVNPPPEV

SEQ ID NO: 195190 - protein, 18 aa, Mycobacterium bovis
VDRGPPARIAAAGSRRRG

SEQ ID NO: 195191 - protein, 7 aa, Mycobacterium bovis
VEATGSA

SEQ ID NO: 195192 - protein, 11 aa, Mycobacterium bovis
VEEGPPPPLPA

SEQ ID NO: 195193 - protein, 51 aa, Mycobacterium bovis
VEGEPPPAPDPAGPQPNEGLPPPGVSPPAESNLTVGPPSRPIQQARGGESL

SEQ ID NO: 195194 - protein, 7 aa, Mycobacterium bovis
VEGGESL

SEQ ID NO: 195195 - protein, 8 aa, Mycobacterium bovis
VEGGGNQD

SEQ ID NO: 195196 - protein, 4 aa, Mycobacterium bovis
VEPD

SEQ ID NO: 195197 - protein, 15 aa, Mycobacterium bovis
VERSGDRSAPYAAPR

SEQ ID NO: 195198 - protein, 15 aa, Mycobacterium bovis
VERVEPGRGRPGRPP

SEQ ID NO: 195199 - protein, 5 aa, Mycobacterium bovis
VETSR

SEQ ID NO: 195200 - protein, 10 aa, Mycobacterium bovis
VEVEGDPECQ

SEQ ID NO: 195201 - protein, 5 aa, Mycobacterium bovis
VGAPL

SEQ ID NO: 195202 - protein, 8 aa, Mycobacterium bovis
VGASTANG

SEQ ID NO: 195203 - protein, 9 aa, Mycobacterium bovis
VGDDKDKAA

SEQ ID NO: 195204 - protein, 10 aa, Mycobacterium bovis
VGDGGLPAEL

SEQ ID NO: 195205 - protein, 10 aa, Mycobacterium bovis
VGDGQARIRT

SEQ ID NO: 195206 - protein, 8 aa, Mycobacterium bovis
VGDPGGGA

SEQ ID NO: 195207 - protein, 5 aa, Mycobacterium bovis
VGEDA

SEQ ID NO: 195208 - protein, 38 aa, Mycobacterium bovis
VGGAGGNAAGLSGAGGAGGAGGFGETAGDGGAGGNAGL

SEQ ID NO: 195209 - protein, 7 aa, Mycobacterium bovis
VGGEPGS

SEQ ID NO: 195210 - protein, 6 aa, Mycobacterium bovis
VGKSGR

SEQ ID NO: 195211 - protein, 11 aa, Mycobacterium bovis
VGPGETVAPPV

SEQ ID NO: 195212 - protein, 5 aa, Mycobacterium bovis
VGPGV

SEQ ID NO: 195213 - protein, 4 aa, Mycobacterium bovis
VGRE

SEQ ID NO: 195214 - protein, 7 aa, Mycobacterium bovis
VKDGDDA

SEQ ID NO: 195215 - protein, 15 aa, Mycobacterium bovis
VNAGNLAAANPTTAV

SEQ ID NO: 195216 - protein, 8 aa, Mycobacterium bovis
VNAGSGIN

SEQ ID NO: 195217 - protein, 5 aa, Mycobacterium bovis
VNDKR

SEQ ID NO: 195218 - protein, 8 aa, Mycobacterium bovis
VNESRTAK

SEQ ID NO: 195219 - protein, 217 aa, Mycobacterium bovis
VNGGNGGNGGNGDHALSGNGAAGGNGGNGGNGSLRGSGGAGGHGGNGGNASRGMGGDGGTGGAGGNAGQIGNGGAGGNGGDGGTGSDGNPGAITGSGGRGGDGGVGGQGGSVAGDGADGGRGGAGGTGGTGLRGTTGATGATGTFDAGADGHGGNGGTGGVGGTGGAGGGGGNGGAGGKALSPTGNNGSQGAGGDGGAGGTGGTGGTGGDGGRGAHG

SEQ ID NO: 195220 - protein, 7 aa, Mycobacterium bovis
VPAYSGA

SEQ ID NO: 195221 - protein, 15 aa, Mycobacterium bovis
VPGYHAPPDRTAGVA

SEQ ID NO: 195222 - protein, 12 aa, Mycobacterium bovis
VPLSSGSFGDAT

SEQ ID NO: 195223 - protein, 4 aa, Mycobacterium bovis
VPND

SEQ ID NO: 195224 - protein, 12 aa, Mycobacterium bovis
VPPEPPPSKLSP

SEQ ID NO: 195225 - protein, 5 aa, Mycobacterium bovis
VPPGA

SEQ ID NO: 195226 - protein, 4 aa, Mycobacterium bovis
VPRE

SEQ ID NO: 195227 - protein, 11 aa, Mycobacterium bovis
VPRGPLAAASA

SEQ ID NO: 195228 - protein, 10 aa, Mycobacterium bovis
VPTARSDAPL

SEQ ID NO: 195229 - protein, 6 aa, Mycobacterium bovis
VPWDAD

SEQ ID NO: 195230 - protein, 13 aa, Mycobacterium bovis
VQEAAATANRAGV

SEQ ID NO: 195231 - protein, 28 aa, Mycobacterium bovis
VQKRSSYKKSPGGRKEALRRSRATGTIT

SEQ ID NO: 195232 - protein, 4 aa, Mycobacterium bovis
VQPG

SEQ ID NO: 195233 - protein, 6 aa, Mycobacterium bovis
VQTADG

SEQ ID NO: 195234 - protein, 4 aa, Mycobacterium bovis
VQTG

SEQ ID NO: 195235 - protein, 7 aa, Mycobacterium bovis
VQTRREH

SEQ ID NO: 195236 - protein, 11 aa, Mycobacterium bovis
VRPPTPSRRLP

SEQ ID NO: 195237 - protein, 12 aa, Mycobacterium bovis
VRTPAGGGDAHN

SEQ ID NO: 195238 - protein, 20 aa, Mycobacterium bovis
VSAEGGAAAVTGDDDSLDEH

SEQ ID NO: 195239 - protein, 4 aa, Mycobacterium bovis
VSAG

SEQ ID NO: 195240 - protein, 4 aa, Mycobacterium bovis
VSAS

SEQ ID NO: 195241 - protein, 10 aa, Mycobacterium bovis
VSDGSSAPAV

SEQ ID NO: 195242 - protein, 8 aa, Mycobacterium bovis
VSGERQGY

SEQ ID NO: 195243 - protein, 6 aa, Mycobacterium bovis
VSPGTL

SEQ ID NO: 195244 - protein, 11 aa, Mycobacterium bovis
VSRAAARKRAE

SEQ ID NO: 195245 - protein, 12 aa, Mycobacterium bovis
VTAGERPGRGGV

SEQ ID NO: 195246 - protein, 9 aa, Mycobacterium bovis
VTAGSTALT

SEQ ID NO: 195247 - protein, 18 aa, Mycobacterium bovis
VTAPNSEDGVARVLERWW

SEQ ID NO: 195248 - protein, 12 aa, Mycobacterium bovis
VTDDPADPSTIV

SEQ ID NO: 195249 - protein, 9 aa, Mycobacterium bovis
VTDNSGRER

SEQ ID NO: 195250 - protein, 5 aa, Mycobacterium bovis
VTGGH

SEQ ID NO: 195251 - protein, 13 aa, Mycobacterium bovis
VTGPADPAQQQCT

SEQ ID NO: 195252 - protein, 5 aa, Mycobacterium bovis
VTPAT

SEQ ID NO: 195253 - protein, 7 aa, Mycobacterium bovis
VVPPAAD

SEQ ID NO: 195254 - protein, 10 aa, Mycobacterium bovis
VYGADDPAAA

SEQ ID NO: 195255 - protein, 14 aa, Mycobacterium bovis
WADGGPTSAHNGLG

SEQ ID NO: 195256 - protein, 4 aa, Mycobacterium bovis
WGGP

SEQ ID NO: 195257 - protein, 23 aa, Mycobacterium bovis
WGNGRGRGCRCGRGDRGGDRRDR

SEQ ID NO: 195258 - protein, 9 aa, Mycobacterium bovis
WGPGESPGT

SEQ ID NO: 195259 - protein, 10 aa, Mycobacterium bovis
WGPLSAPKLE

SEQ ID NO: 195260 - protein, 8 aa, Mycobacterium bovis
WGRDPDTM

SEQ ID NO: 195261 - protein, 13 aa, Mycobacterium bovis
WKTRKNAKGDTEW

SEQ ID NO: 195262 - protein, 12 aa, Mycobacterium bovis
WLGPSSAGMAAA

SEQ ID NO: 195263 - protein, 5 aa, Mycobacterium bovis
WPGAG

SEQ ID NO: 195264 - protein, 9 aa, Mycobacterium bovis
WPLGPTHPS

SEQ ID NO: 195265 - protein, 4 aa, Mycobacterium bovis
WQPI

SEQ ID NO: 195266 - protein, 4 aa, Mycobacterium bovis
WSNP

SEQ ID NO: 195267 - protein, 4 aa, Mycobacterium bovis
WTTD

SEQ ID NO: 195268 - protein, 252 aa, Mycobacterium bovis
YARPQEDPRGGPDPQGGSDPRGGYPPETGGYPPQPGYPRPRHPGQGDYPEQIGYPDQGGYPEQRGYPDQRGHQDQGRGYPDQGQGGYPPPYEQRPPVSPGPAAGYGAPGYDQGYRQSGGCGPSPGGGQPGYGGYGEYGRGPARHEEGSYVPSGPPGPPEQRPAYPDQGGYDQGYQQGATTYGRQDYGGGADYTRYTESPQVPGYAPQGGGYAEPAGRDYDYGQSGAPDYGQPAPGGYSGYGQGGYGSAGTSV

SEQ ID NO: 195269 - protein, 8 aa, Mycobacterium bovis
YDATTGRV

SEQ ID NO: 195270 - protein, 4 aa, Mycobacterium bovis
YDES

SEQ ID NO: 195271 - protein, 5 aa, Mycobacterium bovis
YDPRS

SEQ ID NO: 195272 - protein, 8 aa, Mycobacterium bovis
YDQPATTV

SEQ ID NO: 195273 - protein, 8 aa, Mycobacterium bovis
YGDDGTRI

SEQ ID NO: 195274 - protein, 11 aa, Mycobacterium bovis
YGPVRGADDGR

SEQ ID NO: 195275 - protein, 9 aa, Mycobacterium bovis
YGQPGQTER

SEQ ID NO: 195276 - protein, 9 aa, Mycobacterium bovis
YGSSTSSSG

SEQ ID NO: 195277 - protein, 11 aa, Mycobacterium bovis
YNTGSFNAGSF

SEQ ID NO: 195278 - protein, 24 aa, Mycobacterium bovis
YPGNDPLRDARPIEQDDDQGAGSP

SEQ ID NO: 195279 - protein, 14 aa, Mycobacterium bovis
YPPPPGGPPPPADI

SEQ ID NO: 195280 - protein, 19 aa, Mycobacterium bovis
YPQAEAPKAYAEAALSLLV

SEQ ID NO: 195281 - protein, 7 aa, Mycobacterium bovis
YPRDAER

SEQ ID NO: 195282 - protein, 15 aa, Mycobacterium bovis
YPTGTTTSGNQKSHC

SEQ ID NO: 195283 - protein, 8 aa, Mycobacterium bovis
YQSDTESP

SEQ ID NO: 195284 - protein, 4 aa, Mycobacterium bovis
YRDT

SEQ ID NO: 195285 - protein, 6 aa, Mycobacterium bovis
YRNGER

SEQ ID NO: 195286 - protein, 37 aa, Mycobacterium bovis
YRRSRDGCDWGSRGDRGSRRDRGSRGDRGSRRDRGSR

SEQ ID NO: 195287 - protein, 8 aa, Mycobacterium bovis
YSGPGPNS

SEQ ID NO: 195288 - protein, 23 aa, Mycobacterium bovis
YSPAERPDRIPPTDPLGDHRRRH

SEQ ID NO: 195289 - protein, 4 aa, Mycobacterium bovis
YSPE

SEQ ID NO: 195290 - protein, 9 aa, Mycobacterium bovis
YSPNSPLGG

SEQ ID NO: 195291 - protein, 12 aa, Mycobacterium bovis
YSQIDDGAAGVF

SEQ ID NO: 195292 - protein, 17 aa, Mycobacterium bovis
YSRADEEQQQALSSQMG

SEQ ID NO: 195293 - protein, 8 aa, Mycobacterium bovis
YSSPQTDF

SEQ ID NO: 195294 - protein, 17 aa, Mycobacterium bovis
YTPNPNDAPGGPLVERA

SEQ ID NO: 195295 - protein, 23 aa, Mycobacterium bovis
AEDGAGWLAFFRDLVARGLSGVA

SEQ ID NO: 195296 - protein, 18 aa, Mycobacterium bovis
GIDVGGGLGPFTVFPDGY

SEQ ID NO: 195297 - protein, 24 aa, Mycobacterium bovis
MGAEADALCGAGYRERSDERSNQR

SEQ ID NO: 195298 - protein, 31 aa, Mycobacterium bovis
AIPKLRQGSYFPDWLLQRRKRAERALTSVVA

SEQ ID NO: 195299 - protein, 23 aa, Mycobacterium bovis
FTVFPDGYSLPAIPLGIDVGGGL

SEQ ID NO: 195300 - protein, 17 aa, Mycobacterium bovis
IEGRRYLGLEVLTRARA

SEQ ID NO: 195301 - protein, 20 aa, Mycobacterium bovis
DLLAFTAFPKQIWRQIWSNN

SEQ ID NO: 195302 - protein, 18 aa, Mycobacterium bovis
FPKQIWRQIWSNNPQERL

SEQ ID NO: 195303 - protein, 20 aa, Mycobacterium bovis
GRRYLGLEVLTRARAALTST

SEQ ID NO: 195304 - protein, 28 aa, Mycobacterium bovis
LMAATPKPSWPWVRTLLHSIYDQPDAES

SEQ ID NO: 195305 - protein, 23 aa, Mycobacterium bovis
LTSVVATCYLLGVSTRRMERLVE

SEQ ID NO: 195306 - protein, 20 aa, Mycobacterium bovis
AVTIPGFAINPFGLDVPLSG

SEQ ID NO: 195307 - protein, 27 aa, Mycobacterium bovis
GATLPAAAWQRCRTHYAANLMAATPKP

SEQ ID NO: 195308 - protein, 22 aa, Mycobacterium bovis
PGAAGRHGLDWVAIASAAEPGA

SEQ ID NO: 195309 - protein, 19 aa, Mycobacterium bovis
FSAASAFQSVVWGLTVGSW

SEQ ID NO: 195310 - protein, 29 aa, Mycobacterium bovis
KGGTGGAGMNSLDPLLAAQDGGQGGTGGT

SEQ ID NO: 195311 - protein, 24 aa, Mycobacterium bovis
PDELARYAQRVMDWLHPDGDLTDT

SEQ ID NO: 195312 - protein, 23 aa, Mycobacterium bovis
TPQARATFEAVLAKLAAPGATNP

SEQ ID NO: 195313 - protein, 27 aa, Mycobacterium bovis
AATSPLLAPINEFFLANTGRPLIGNGA

SEQ ID NO: 195314 - protein, 24 aa, Mycobacterium bovis
AAWFPSAEHLASWVRLCPGNHESA

SEQ ID NO: 195315 - protein, 17 aa, Mycobacterium bovis
AGPDRIAQILAELATLF

SEQ ID NO: 195316 - protein, 27 aa, Mycobacterium bovis
AGPFDNWPLGWGFDHFWGFPSGAAGQY

SEQ ID NO: 195317 - protein, 18 aa, Mycobacterium bovis
AGVGLAIGLFSPALLASA

SEQ ID NO: 195318 - protein, 22 aa, Mycobacterium bovis
AVGSLRSGECDLALAGGVTVNA

SEQ ID NO: 195319 - protein, 20 aa, Mycobacterium bovis
AVTIPGFAINPFGLNVPLSG

SEQ ID NO: 195320 - protein, 18 aa, Mycobacterium bovis
DAIQCADPFHVVAWATEA

SEQ ID NO: 195321 - protein, 24 aa, Mycobacterium bovis
DASLRLVAPGGVFLEMGKTDIRDP

SEQ ID NO: 195322 - protein, 27 aa, Mycobacterium bovis
DEQFSCWRIKLPHVEAAKFDAALQSHL

SEQ ID NO: 195323 - protein, 21 aa, Mycobacterium bovis
DEVFAHVAAVFGVDAEVAEDI

SEQ ID NO: 195324 - protein, 18 aa, Mycobacterium bovis
DGLYRLTPTTGRTHQLRV

SEQ ID NO: 195325 - protein, 24 aa, Mycobacterium bovis
DRDHIAGAIKLDWRTDLQDPVKRD

SEQ ID NO: 195326 - protein, 18 aa, Mycobacterium bovis
EALERAGIDPTGLRGSAT

SEQ ID NO: 195327 - protein, 23 aa, Mycobacterium bovis
ELTERPDLFPAWDSMSEAQKRLF

SEQ ID NO: 195328 - protein, 20 aa, Mycobacterium bovis
ESERRYLLCDATFEAWFERD

SEQ ID NO: 195329 - protein, 19 aa, Mycobacterium bovis
EVIAAAATDLASLESSIAA

SEQ ID NO: 195330 - protein, 22 aa, Mycobacterium bovis
FDDHHALMCRLHLAHLDQLDAM

SEQ ID NO: 195331 - protein, 18 aa, Mycobacterium bovis
FDDTVAWLAVACSKTAVC

SEQ ID NO: 195332 - protein, 25 aa, Mycobacterium bovis
FGLELIWGIEDCRNMSARLERDLLA

SEQ ID NO: 195333 - protein, 19 aa, Mycobacterium bovis
FGSVCEFPGPYPGYSAVRP

SEQ ID NO: 195334 - protein, 19 aa, Mycobacterium bovis
GMSRLSGYLTPQARATFEA

SEQ ID NO: 195335 - protein, 21 aa, Mycobacterium bovis
GRGSQWAGMGRQLLADEPAFA

SEQ ID NO: 195336 - protein, 17 aa, Mycobacterium bovis
HLHGLATQLMDWLHPDG

SEQ ID NO: 195337 - protein, 23 aa, Mycobacterium bovis
HPYRVRHLLDRYGSLISDVLAMA

SEQ ID NO: 195338 - protein, 18 aa, Mycobacterium bovis
IAQILAELATLFGDGVLR

SEQ ID NO: 195339 - protein, 17 aa, Mycobacterium bovis
LALPRLVRSRIVKRRGH

SEQ ID NO: 195340 - protein, 24 aa, Mycobacterium bovis
LAPHLVKPLPFLFPLTKRWWERPY

SEQ ID NO: 195341 - protein, 18 aa, Mycobacterium bovis
LTGAPWVGAASLSMVAAA

SEQ ID NO: 195342 - protein, 18 aa, Mycobacterium bovis
PAQRHFTRAGALRLSPGL

SEQ ID NO: 195343 - protein, 18 aa, Mycobacterium bovis
PIASELILPIAVAVQNRI

SEQ ID NO: 195344 - protein, 18 aa, Mycobacterium bovis
PTHGPTVVAVPWARHHAG

SEQ ID NO: 195345 - protein, 18 aa, Mycobacterium bovis
PVTIPGFAINPFGLDVPL

SEQ ID NO: 195346 - protein, 17 aa, Mycobacterium bovis
PVVPRREAGWAGPVVPW

SEQ ID NO: 195347 - protein, 19 aa, Mycobacterium bovis
QKRLFARQMEVFAGFSENA

SEQ ID NO: 195348 - protein, 31 aa, Mycobacterium bovis
RAGALRLSPGLKRSSLIGGIRYYDTVVDDAR

SEQ ID NO: 195349 - protein, 17 aa, Mycobacterium bovis
RAGVSSFGISGTNAHVI

SEQ ID NO: 195350 - protein, 19 aa, Mycobacterium bovis
RGAAWGAGVGLAIGLFSPA

SEQ ID NO: 195351 - protein, 19 aa, Mycobacterium bovis
RGITMGKQEFDGMSRISGL

SEQ ID NO: 195352 - protein, 23 aa, Mycobacterium bovis
RTEKSVMFVIPWGSHWIIGTTDT

SEQ ID NO: 195353 - protein, 28 aa, Mycobacterium bovis
RTRLPLPQRRFGGVVGRTMAESVGDWSI

SEQ ID NO: 195354 - protein, 18 aa, Mycobacterium bovis
RTRRAGVSSFGISGTNAH

SEQ ID NO: 195355 - protein, 17 aa, Mycobacterium bovis
RVNCPTHGPTVVAVPWA

SEQ ID NO: 195356 - protein, 25 aa, Mycobacterium bovis
SGVAVSPVTGLVFVTNFDSNTVSVI

SEQ ID NO: 195357 - protein, 18 aa, Mycobacterium bovis
SSLVALHMAVGSLRSGEC

SEQ ID NO: 195358 - protein, 24 aa, Mycobacterium bovis
SVACQEFITQLGRNFQVIYEQANA

SEQ ID NO: 195359 - protein, 24 aa, Mycobacterium bovis
TASKGKWDTLRAMGFDDDHISDSR

SEQ ID NO: 195360 - protein, 19 aa, Mycobacterium bovis
TAVCELMRIAWRTVGAIVA

SEQ ID NO: 195361 - protein, 17 aa, Mycobacterium bovis
TGNWGVFNSGSYNTGIG

SEQ ID NO: 195362 - protein, 23 aa, Mycobacterium bovis
TKRLASPAQRIMLYAKDRGCSRP

SEQ ID NO: 195363 - protein, 29 aa, Mycobacterium bovis
TMHMAGARHCARLRGAIVGKSKSDVIDAE

SEQ ID NO: 195364 - protein, 28 aa, Mycobacterium bovis
TPDRVDVVLRSKVDAAWHLHELTRDLDV

SEQ ID NO: 195365 - protein, 17 aa, Mycobacterium bovis
TQLSGILNRGAGISGVY

SEQ ID NO: 195366 - protein, 24 aa, Mycobacterium bovis
TYLARAPVAPGLALPRLVRSRIVK

SEQ ID NO: 195367 - protein, 21 aa, Mycobacterium bovis
VEMRNRLKSATGLSLSPTLIF

SEQ ID NO: 195368 - protein, 25 aa, Mycobacterium bovis
VQARPGCRPSLAELDSFVRSEIAGY

SEQ ID NO: 195369 - protein, 17 aa, Mycobacterium bovis
VRSRIVKRRGHLQAVCE

SEQ ID NO: 195370 - protein, 24 aa, Mycobacterium bovis
WPGPTGERADWWWYEPFQPQPPPI

SEQ ID NO: 195371 - protein, 22 aa, Mycobacterium bovis
YPGVRYRAFDLFEAGPDRIAQI

SEQ ID NO: 195372 - protein, 18 aa, Mycobacterium bovis
AADITVLCVVAAPEGIAA

SEQ ID NO: 195373 - protein, 18 aa, Mycobacterium bovis
AAMQGRIAMYHALGEGVS

SEQ ID NO: 195374 - protein, 25 aa, Mycobacterium bovis
AFQSVVWGLTVGSWIGSSAGLMVAA

SEQ ID NO: 195375 - protein, 19 aa, Mycobacterium bovis
AGEMLELAGIHGRDPAQTL

SEQ ID NO: 195376 - protein, 17 aa, Mycobacterium bovis
AHGKGHFNIEDWDAILA

SEQ ID NO: 195377 - protein, 21 aa, Mycobacterium bovis
ALYRVAFECAQDLAADSVVYA

SEQ ID NO: 195378 - protein, 17 aa, Mycobacterium bovis
ASVGSLSVPPAWAAANQ

SEQ ID NO: 195379 - protein, 26 aa, Mycobacterium bovis
ATLPAAAWQRCRTHYAANLMAATPKP

SEQ ID NO: 195380 - protein, 25 aa, Mycobacterium bovis
AVIPRTRLAFVGALGPWGPLATPDI

SEQ ID NO: 195381 - protein, 18 aa, Mycobacterium bovis
CALADAFELEEFGVVGHS

SEQ ID NO: 195382 - protein, 17 aa, Mycobacterium bovis
DAGDEWEAFLGKDDDLY

SEQ ID NO: 195383 - protein, 18 aa, Mycobacterium bovis
DAPCEPVPIRTPLAETVG

SEQ ID NO: 195384 - protein, 22 aa, Mycobacterium bovis
DCTGLLPLASVAAMQGRIAMYH

SEQ ID NO: 195385 - protein, 25 aa, Mycobacterium bovis
DEQMSALLMAIVWRGMDRGEIARWT

SEQ ID NO: 195386 - protein, 19 aa, Mycobacterium bovis
DGGFQLGRLAAILRDKRIP

SEQ ID NO: 195387 - protein, 21 aa, Mycobacterium bovis
DKRIPLELCPSSNVQTGAVAS

SEQ ID NO: 195388 - protein, 28 aa, Mycobacterium bovis
DRLGCGCGRADCAAGKRPAAPPVVIHLI

SEQ ID NO: 195389 - protein, 18 aa, Mycobacterium bovis
EHRSCAKAQALVAERGFE

SEQ ID NO: 195390 - protein, 17 aa, Mycobacterium bovis
EIARWTAAMLASGARLD

SEQ ID NO: 195391 - protein, 21 aa, Mycobacterium bovis
ELKPDPWLADVCREEMQRLGR

SEQ ID NO: 195392 - protein, 21 aa, Mycobacterium bovis
ELQTRMFACFAAGALAAGCEY

SEQ ID NO: 195393 - protein, 24 aa, Mycobacterium bovis
EPMTARFLSVVLRRIRGMRSDTRE

SEQ ID NO: 195394 - protein, 25 aa, Mycobacterium bovis
FGAARAELAGGWSIRDSPPQVRPLI

SEQ ID NO: 195395 - protein, 24 aa, Mycobacterium bovis
FRAALRELTLLLIYEATRDAPCEP

SEQ ID NO: 195396 - protein, 19 aa, Mycobacterium bovis
FVKIFCRRSTGVVIGGVVV

SEQ ID NO: 195397 - protein, 17 aa, Mycobacterium bovis
GADRLGCGCGRADCAAG

SEQ ID NO: 195398 - protein, 23 aa, Mycobacterium bovis
GDRDFWLQVGIDPIQIMTGTATF

SEQ ID NO: 195399 - protein, 17 aa, Mycobacterium bovis
GGNAGAGGTGFTQGADG

SEQ ID NO: 195400 - protein, 23 aa, Mycobacterium bovis
GGRLSDAAIDWVVKAYTDGRVAD

SEQ ID NO: 195401 - protein, 25 aa, Mycobacterium bovis
GLRTELRRAPHLGFHIDFDDAKISL

SEQ ID NO: 195402 - protein, 24 aa, Mycobacterium bovis
GSALLFPSLCHFSGGIPAPEADPP

SEQ ID NO: 195403 - protein, 19 aa, Mycobacterium bovis
GSGPLVVGVCAEYDALPGI

SEQ ID NO: 195404 - protein, 24 aa, Mycobacterium bovis
GVTRFKSEAAFACHAAVAPIPVWS

SEQ ID NO: 195405 - protein, 17 aa, Mycobacterium bovis
HAAVAPHLGVNAADAVT

SEQ ID NO: 195406 - protein, 17 aa, Mycobacterium bovis
HACGHNIIAASAVGTAL

SEQ ID NO: 195407 - protein, 21 aa, Mycobacterium bovis
HATAIMWAREQFGLELIWGIE

SEQ ID NO: 195408 - protein, 25 aa, Mycobacterium bovis
HDVAVVLGSGWLPAVAALGSPTTVL

SEQ ID NO: 195409 - protein, 20 aa, Mycobacterium bovis
HPFDLLARARFRVTVNTDNR

SEQ ID NO: 195410 - protein, 27 aa, Mycobacterium bovis
HTKRLASPAQRIMLFANDRGCTKPGCD

SEQ ID NO: 195411 - protein, 17 aa, Mycobacterium bovis
IGAHRVLVLAGRIHAYE

SEQ ID NO: 195412 - protein, 22 aa, Mycobacterium bovis
KPTAPYAAAVREWEKLERFVES

SEQ ID NO: 195413 - protein, 24 aa, Mycobacterium bovis
KRAALRCLKRRLARTVFQALRTVH

SEQ ID NO: 195414 - protein, 18 aa, Mycobacterium bovis
LAASRLRYARAMRERLPK

SEQ ID NO: 195415 - protein, 27 aa, Mycobacterium bovis
LEESFAERGVRLFKNARAASVTRTGAG

SEQ ID NO: 195416 - protein, 17 aa, Mycobacterium bovis
LLISRGAADITVLCVVA

SEQ ID NO: 195417 - protein, 26 aa, Mycobacterium bovis
LRDGTAMDRFRWLVAAQGGDLSKPLP

SEQ ID NO: 195418 - protein, 17 aa, Mycobacterium bovis
LSMGVQVIAGRGELIDS

SEQ ID NO: 195419 - protein, 20 aa, Mycobacterium bovis
LVKTFWGWRDQQLPDGTLIL

SEQ ID NO: 195420 - protein, 24 aa, Mycobacterium bovis
LVSTAAADAARIGSAINTANTAAA

SEQ ID NO: 195421 - protein, 17 aa, Mycobacterium bovis
MGVQVIAGRGELIDSTP

SEQ ID NO: 195422 - protein, 20 aa, Mycobacterium bovis
NAGAGGTGFTQGADGNAGNG

SEQ ID NO: 195423 - protein, 28 aa, Mycobacterium bovis
NARFTIHAGEAFGLPSIHEAIAFCGADR

SEQ ID NO: 195424 - protein, 18 aa, Mycobacterium bovis
PATVLDIAGQVGYDDLPA

SEQ ID NO: 195425 - protein, 18 aa, Mycobacterium bovis
PELAFAEHRSCAKAQALV

SEQ ID NO: 195426 - protein, 19 aa, Mycobacterium bovis
PELLACLQRLEVERRRQGA

SEQ ID NO: 195427 - protein, 21 aa, Mycobacterium bovis
PELPVGVRLIFQAAEELMPGG

SEQ ID NO: 195428 - protein, 18 aa, Mycobacterium bovis
PPAVAPWPGPTGERADWW

SEQ ID NO: 195429 - protein, 18 aa, Mycobacterium bovis
PVTIPGFAINPFGLNVPL

SEQ ID NO: 195430 - protein, 23 aa, Mycobacterium bovis
QAISALLLPLAIEHTLQYRRGVP

SEQ ID NO: 195431 - protein, 27 aa, Mycobacterium bovis
QLVALGELFAYRWSRCGGREEWVMDTM

SEQ ID NO: 195432 - protein, 23 aa, Mycobacterium bovis
QVEKEAFALLALQHPVSGELREI

SEQ ID NO: 195433 - protein, 27 aa, Mycobacterium bovis
RCYLDDRPIFLGRNGRISVFGSERALA

SEQ ID NO: 195434 - protein, 25 aa, Mycobacterium bovis
RFAPELHISCGLSFDDVVDTVLTGF

SEQ ID NO: 195435 - protein, 27 aa, Mycobacterium bovis
RLSLSAGDRYTLWAPRWRDAGDEWEAF

SEQ ID NO: 195436 - protein, 24 aa, Mycobacterium bovis
RLTKPPLLVPVLRAGLGMVDEAHA

SEQ ID NO: 195437 - protein, 17 aa, Mycobacterium bovis
RNFRDWPADVCALADAF

SEQ ID NO: 195438 - protein, 18 aa, Mycobacterium bovis
RRAAQVIADRTGIGEHDV

SEQ ID NO: 195439 - protein, 17 aa, Mycobacterium bovis
RRLARTVFQALRTVHQP

SEQ ID NO: 195440 - protein, 22 aa, Mycobacterium bovis
RTSAINRLRWLVHELDPERAPA

SEQ ID NO: 195441 - protein, 19 aa, Mycobacterium bovis
RWNSIAEVIGRSWDDVLAA

SEQ ID NO: 195442 - protein, 22 aa, Mycobacterium bovis
SCAKAQALVAERGFEITTAAGG

SEQ ID NO: 195443 - protein, 20 aa, Mycobacterium bovis
SELILPIAVAVQNRITVNEL

SEQ ID NO: 195444 - protein, 19 aa, Mycobacterium bovis
SPIRLRTVAATVFTRPEIA

SEQ ID NO: 195445 - protein, 17 aa, Mycobacterium bovis
TAGHATAIMWAREQFGL

SEQ ID NO: 195446 - protein, 17 aa, Mycobacterium bovis
TRDAPCEPVPIRTPLAE

SEQ ID NO: 195447 - protein, 17 aa, Mycobacterium bovis
TRKNAHGDTEWLPPPHL

SEQ ID NO: 195448 - protein, 18 aa, Mycobacterium bovis
TVAATVFTRPEIAAVGVP

SEQ ID NO: 195449 - protein, 19 aa, Mycobacterium bovis
VESLPLIASSIMSKKLAEG

SEQ ID NO: 195450 - protein, 26 aa, Mycobacterium bovis
VGLAAWRLGAGRSRPGARVQHGAGVR

SEQ ID NO: 195451 - protein, 18 aa, Mycobacterium bovis
VGVCAEYDALPGIGHACG

SEQ ID NO: 195452 - protein, 17 aa, Mycobacterium bovis
VQVIAGRGELIDSTPGL

SEQ ID NO: 195453 - protein, 18 aa, Mycobacterium bovis
VYVLSGLVDDFADGPDAV

SEQ ID NO: 195454 - protein, 17 aa, Mycobacterium bovis
WEAFLGKDDDLYGFESV

SEQ ID NO: 195455 - protein, 20 aa, Mycobacterium bovis
WPADVCALADAFELEEFGVV

SEQ ID NO: 195456 - protein, 17 aa, Mycobacterium bovis
WTAAMLASGARLDFTDL

SEQ ID NO: 195457 - protein, 17 aa, Mycobacterium bovis
AAADPAAVWATHFPSTD

SEQ ID NO: 195458 - protein, 17 aa, Mycobacterium bovis
AAAEVLAAAGFSVLLLP

SEQ ID NO: 195459 - protein, 17 aa, Mycobacterium bovis
AAGALAAGCEYEIDEAA

SEQ ID NO: 195460 - protein, 26 aa, Mycobacterium bovis
AAGNYAQRLFPGMRVKYVSTEEFTND

SEQ ID NO: 195461 - protein, 20 aa, Mycobacterium bovis
AAMVEKGRRVLLVDLDPQGC

SEQ ID NO: 195462 - protein, 22 aa, Mycobacterium bovis
AARPHVHPVRMIAGAAGLCAVA

SEQ ID NO: 195463 - protein, 20 aa, Mycobacterium bovis
AAYRRRLCRESAKARNVDRV

SEQ ID NO: 195464 - protein, 17 aa, Mycobacterium bovis
AGALVVLVDGELAWFLE

SEQ ID NO: 195465 - protein, 21 aa, Mycobacterium bovis
AGAPEVSGWLDGLRAAKRALV

SEQ ID NO: 195466 - protein, 17 aa, Mycobacterium bovis
AGGEQWCDAEVLRILRR

SEQ ID NO: 195467 - protein, 25 aa, Mycobacterium bovis
AGSGPMLAAAAAWDGLAAELGLAAE

SEQ ID NO: 195468 - protein, 17 aa, Mycobacterium bovis
AHAARPHVHPVRMIAGA

SEQ ID NO: 195469 - protein, 23 aa, Mycobacterium bovis
AHRRAHGLPAISLGWGLWDQASA

SEQ ID NO: 195470 - protein, 18 aa, Mycobacterium bovis
AIDAERWLAEHAATGEAD

SEQ ID NO: 195471 - protein, 18 aa, Mycobacterium bovis
AKQPKFEFNHVINNDDVA

SEQ ID NO: 195472 - protein, 20 aa, Mycobacterium bovis
ALEVSGRLLLAGSSRRLAWW

SEQ ID NO: 195473 - protein, 24 aa, Mycobacterium bovis
ALPEEFRMAVYYADVEGFPYKEIA

SEQ ID NO: 195474 - protein, 19 aa, Mycobacterium bovis
AMYLCRELTDLSLPKIGQA

SEQ ID NO: 195475 - protein, 24 aa, Mycobacterium bovis
ARVALRAGFAFVRRICEQDGTVFD

SEQ ID NO: 195476 - protein, 27 aa, Mycobacterium bovis
AVRPRSCAALPRILRDNGYVTGAFGKW

SEQ ID NO: 195477 - protein, 17 aa, Mycobacterium bovis
AVTEIRAALTALGMLDH

SEQ ID NO: 195478 - protein, 23 aa, Mycobacterium bovis
AYARRILGWRVASTMATSMVLDA

SEQ ID NO: 195479 - protein, 24 aa, Mycobacterium bovis
AYKTGRGSIRMRGVVEVEEDSRGR

SEQ ID NO: 195480 - protein, 22 aa, Mycobacterium bovis
CAREVAEVVAPVLGWTAADIDR

SEQ ID NO: 195481 - protein, 17 aa, Mycobacterium bovis
CGHMGPPADPECALDTL

SEQ ID NO: 195482 - protein, 24 aa, Mycobacterium bovis
CNRCPVTTECLSWALNTGQDSGVW

SEQ ID NO: 195483 - protein, 18 aa, Mycobacterium bovis
DACAHALLDAISRLPQIP

SEQ ID NO: 195484 - protein, 18 aa, Mycobacterium bovis
DAEFPKFRQLLPTEHTAV

SEQ ID NO: 195485 - protein, 20 aa, Mycobacterium bovis
DEFRASKIMLDRARNNDKIR

SEQ ID NO: 195486 - protein, 19 aa, Mycobacterium bovis
DGGQGWPAAALGPAQRAVA

SEQ ID NO: 195487 - protein, 23 aa, Mycobacterium bovis
DGVLRPLPVTTFDVRRAPAALRY

SEQ ID NO: 195488 - protein, 17 aa, Mycobacterium bovis
DGYEWSQVYEKSEPLGL

SEQ ID NO: 195489 - protein, 25 aa, Mycobacterium bovis
DLMRRLREDPPRRLAGFPATVTDIG

SEQ ID NO: 195490 - protein, 24 aa, Mycobacterium bovis
DLRTRVQTFLARRQLFDPALLAQA

SEQ ID NO: 195491 - protein, 17 aa, Mycobacterium bovis
DPLVVAWPARIRPDGRV

SEQ ID NO: 195492 - protein, 18 aa, Mycobacterium bovis
DPQGCLTFSLGQDPDKLP

SEQ ID NO: 195493 - protein, 17 aa, Mycobacterium bovis
DPSRRTSCLSGLGYPAS

SEQ ID NO: 195494 - protein, 25 aa, Mycobacterium bovis
DRCAVGIPTVSGWRMLSGDETGWLL

SEQ ID NO: 195495 - protein, 17 aa, Mycobacterium bovis
DRHPGWHALRKIAARIT

SEQ ID NO: 195496 - protein, 17 aa, Mycobacterium bovis
DRRRGRLVGALIVDDDS

SEQ ID NO: 195497 - protein, 24 aa, Mycobacterium bovis
DTRAGRRLWVYGRAGQGCRRCGTL

SEQ ID NO: 195498 - protein, 23 aa, Mycobacterium bovis
EAELKAALWELIWAGRVTGDTFA

SEQ ID NO: 195499 - protein, 25 aa, Mycobacterium bovis
EAPARAYNPLFIWGESGLGKTHLLH

SEQ ID NO: 195500 - protein, 21 aa, Mycobacterium bovis
EDAGRCQRGYFIESLGGAQFA

SEQ ID NO: 195501 - protein, 23 aa, Mycobacterium bovis
EDSRGRTSLVITELPYQVNHDNF

SEQ ID NO: 195502 - protein, 25 aa, Mycobacterium bovis
EDVELATARWVDWFNHRRLYQYCGD

SEQ ID NO: 195503 - protein, 17 aa, Mycobacterium bovis
EEVRNCFADMAKVAIAL

SEQ ID NO: 195504 - protein, 26 aa, Mycobacterium bovis
EFEKEAWLSMVMLEWGSCGQVATAVP

SEQ ID NO: 195505 - protein, 19 aa, Mycobacterium bovis
EGIAWRFRTGSPWRDLPAE

SEQ ID NO: 195506 - protein, 24 aa, Mycobacterium bovis
ELIEAIKLVALVADRGAQVRMEFA

SEQ ID NO: 195507 - protein, 21 aa, Mycobacterium bovis
ELRERAVRMVAEIRGQHDSEW

SEQ ID NO: 195508 - protein, 24 aa, Mycobacterium bovis
EPLQRPGRRRVLTIANQKGGVGKT

SEQ ID NO: 195509 - protein, 22 aa, Mycobacterium bovis
EQMWAADVAAMVGYHGGASAAA

SEQ ID NO: 195510 - protein, 20 aa, Mycobacterium bovis
EQQWLPRIAAHLGVASPVPV

SEQ ID NO: 195511 - protein, 19 aa, Mycobacterium bovis
ERIKALIGTKCRGDRAPEG

SEQ ID NO: 195512 - protein, 25 aa, Mycobacterium bovis
ETMVKAYAGFRSFRHGTNLKAWLYR

SEQ ID NO: 195513 - protein, 19 aa, Mycobacterium bovis
EVEIKRDGYEWSQVYEKSE

SEQ ID NO: 195514 - protein, 18 aa, Mycobacterium bovis
EVLDALQELTRLAVHQKT

SEQ ID NO: 195515 - protein, 22 aa, Mycobacterium bovis
EVLRILRRRSLAALRAQAEPVS

SEQ ID NO: 195516 - protein, 25 aa, Mycobacterium bovis
EVPGAMARLGVWSGDGLQLDLHQPT

SEQ ID NO: 195517 - protein, 20 aa, Mycobacterium bovis
FDKPYLLAMANAGPGTNGSQ

SEQ ID NO: 195518 - protein, 19 aa, Mycobacterium bovis
FRESAARALLLPRRHPGRR

SEQ ID NO: 195519 - protein, 20 aa, Mycobacterium bovis
FTAPHFASAWAHASNTPLQW

SEQ ID NO: 195520 - protein, 17 aa, Mycobacterium bovis
FVSGVLPTAPVSAVADP

SEQ ID NO: 195521 - protein, 21 aa, Mycobacterium bovis
FVWPRFRRRGLARGLLSTLAR

SEQ ID NO: 195522 - protein, 20 aa, Mycobacterium bovis
GAIGRHIHDPYALYDALAQE

SEQ ID NO: 195523 - protein, 18 aa, Mycobacterium bovis
GCRMGICQSCVVDLVEGH

SEQ ID NO: 195524 - protein, 23 aa, Mycobacterium bovis
GDPSVDLIIAWNLLSAPARAQFR

SEQ ID NO: 195525 - protein, 17 aa, Mycobacterium bovis
GDTEWLPPPHLDHGQPR

SEQ ID NO: 195526 - protein, 17 aa, Mycobacterium bovis
GDTFAPVRAVLGGAGTR

SEQ ID NO: 195527 - protein, 29 aa, Mycobacterium bovis
GEISRGVLFPKHRTDLLGCAVSVQRMLAG

SEQ ID NO: 195528 - protein, 23 aa, Mycobacterium bovis
GESFGARRRLALSTVGASGATAG

SEQ ID NO: 195529 - protein, 21 aa, Mycobacterium bovis
GGKVTAWRYIRAAVRAVLACT

SEQ ID NO: 195530 - protein, 20 aa, Mycobacterium bovis
GGLTPILCLTKTDLAPAEPF

SEQ ID NO: 195531 - protein, 24 aa, Mycobacterium bovis
GNTEVKSFVQKVCNEQLTHWFEAN

SEQ ID NO: 195532 - protein, 27 aa, Mycobacterium bovis
GPDELKARFSRPLAFGTAGLRGHLRGG

SEQ ID NO: 195533 - protein, 26 aa, Mycobacterium bovis
GQQVGPRVARRFGRVLLELGGNNAAI

SEQ ID NO: 195534 - protein, 17 aa, Mycobacterium bovis
GQVIGCGRTTRQINRRL

SEQ ID NO: 195535 - protein, 18 aa, Mycobacterium bovis
GRPDRRITAMRARELGRT

SEQ ID NO: 195536 - protein, 25 aa, Mycobacterium bovis
GRVRSQFTHCIDIAPTVLAAIGLPE

SEQ ID NO: 195537 - protein, 19 aa, Mycobacterium bovis
GRWGCVLGGRPDRRITAMR

SEQ ID NO: 195538 - protein, 24 aa, Mycobacterium bovis
GSDAWKAYMRRATNTVNYSSELPL

SEQ ID NO: 195539 - protein, 20 aa, Mycobacterium bovis
GSWLTMIRLAKCGPWHRGGW

SEQ ID NO: 195540 - protein, 22 aa, Mycobacterium bovis
HFFVCSTHDLILFFTTQGRVYR

SEQ ID NO: 195541 - protein, 18 aa, Mycobacterium bovis
HGDLSRFNILTAQGRLTG

SEQ ID NO: 195542 - protein, 23 aa, Mycobacterium bovis
HGGLRYLEQLEFGLVREALYERE

SEQ ID NO: 195543 - protein, 24 aa, Mycobacterium bovis
HGTNLKAWLYRILTNTYINSYRKK

SEQ ID NO: 195544 - protein, 19 aa, Mycobacterium bovis
HLEACPGCLRHYGLEERIK

SEQ ID NO: 195545 - protein, 18 aa, Mycobacterium bovis
HNPFRVFTSMLAIEDRRY

SEQ ID NO: 195546 - protein, 25 aa, Mycobacterium bovis
HPYFPRLRLELDKGLGWKAEVEAAL

SEQ ID NO: 195547 - protein, 23 aa, Mycobacterium bovis
HRDRTCVVPGCGATRGLHAHHIR

SEQ ID NO: 195548 - protein, 24 aa, Mycobacterium bovis
HRLLETWHPLGVVGVITAFNFPVA

SEQ ID NO: 195549 - protein, 19 aa, Mycobacterium bovis
HRVGFGSVCEFPGPYPGYS

SEQ ID NO: 195550 - protein, 24 aa, Mycobacterium bovis
HTNRGDIKIALFGNHAPKTVANFV

SEQ ID NO: 195551 - protein, 17 aa, Mycobacterium bovis
IAAALAVQGLKTLVIDL

SEQ ID NO: 195552 - protein, 17 aa, Mycobacterium bovis
IALRADMDALPMAERTG

SEQ ID NO: 195553 - protein, 20 aa, Mycobacterium bovis
IASNTLWPRTMVATAAVQNL

SEQ ID NO: 195554 - protein, 26 aa, Mycobacterium bovis
ICGPETLRSLYFLSSRVSGGSPHAIR

SEQ ID NO: 195555 - protein, 21 aa, Mycobacterium bovis
IDERALAIGLRVMVNIIEQAA

SEQ ID NO: 195556 - protein, 18 aa, Mycobacterium bovis
IDIAPTVLAAIGLPEPTH

SEQ ID NO: 195557 - protein, 23 aa, Mycobacterium bovis
IDIDARPAVLLVIPADTPDKLAV

SEQ ID NO: 195558 - protein, 24 aa, Mycobacterium bovis
IIGRIKDLLIVYGRNHSPDDIEAT

SEQ ID NO: 195559 - protein, 28 aa, Mycobacterium bovis
ILLEKKWLRPTAYMMAKYGMTLCALGIA

SEQ ID NO: 195560 - protein, 23 aa, Mycobacterium bovis
IQREVVARTGLRDCRVHGRTWDL

SEQ ID NO: 195561 - protein, 22 aa, Mycobacterium bovis
IRLAKCGPWHRGGWDPIPEGLT

SEQ ID NO: 195562 - protein, 26 aa, Mycobacterium bovis
ITEVPMKRFDLMNGIQVRGTYAVSQA

SEQ ID NO: 195563 - protein, 18 aa, Mycobacterium bovis
IVATETFAPILYVLTYDD

SEQ ID NO: 195564 - protein, 19 aa, Mycobacterium bovis
IVGAKGKAALLRELSDVVP

SEQ ID NO: 195565 - protein, 23 aa, Mycobacterium bovis
IVRRPAIAAVRAEYERVVRQRTA

SEQ ID NO: 195566 - protein, 25 aa, Mycobacterium bovis
KFADEFHPELQFDKPYLLAMANAGP

SEQ ID NO: 195567 - protein, 17 aa, Mycobacterium bovis
KHARRCVFWEVDPAILG

SEQ ID NO: 195568 - protein, 20 aa, Mycobacterium bovis
KIGQAFGRDHTTVMYAQRKI

SEQ ID NO: 195569 - protein, 18 aa, Mycobacterium bovis
KLSGKRIIIDPGRGGVDH

SEQ ID NO: 195570 - protein, 31 aa, Mycobacterium bovis
KPVLVDFWATWCGPCKMVAPVLEEIATERAT

SEQ ID NO: 195571 - protein, 17 aa, Mycobacterium bovis
KRIVGAKGKAALLRELS

SEQ ID NO: 195572 - protein, 24 aa, Mycobacterium bovis
KRWWERPYIAAGIFLYDRLGGAKS

SEQ ID NO: 195573 - protein, 18 aa, Mycobacterium bovis
KSLPAVLRVTARTSSGVI

SEQ ID NO: 195574 - protein, 26 aa, Mycobacterium bovis
KTGVWSRLMLDIARWRRRRREELAAL

SEQ ID NO: 195575 - protein, 17 aa, Mycobacterium bovis
KYGMTLCALGIAEEMRA

SEQ ID NO: 195576 - protein, 21 aa, Mycobacterium bovis
LAAAAARAGGAAVQAKAVAGA

SEQ ID NO: 195577 - protein, 18 aa, Mycobacterium bovis
LAAESFGLVTSGLAGGSG

SEQ ID NO: 195578 - protein, 17 aa, Mycobacterium bovis
LAARLLAALAARRDAEL

SEQ ID NO: 195579 - protein, 25 aa, Mycobacterium bovis
LAAVADLFAAFGMLPVGYYDLRTAE

SEQ ID NO: 195580 - protein, 17 aa, Mycobacterium bovis
LAIARPDLQVVLLEPLL

SEQ ID NO: 195581 - protein, 19 aa, Mycobacterium bovis
LAVGRRLRDRYGIDEKPTA

SEQ ID NO: 195582 - protein, 18 aa, Mycobacterium bovis
LDGSLGMRDARERGTDVV

SEQ ID NO: 195583 - protein, 19 aa, Mycobacterium bovis
LDKLTKWSMPLIRPNGRML

SEQ ID NO: 195584 - protein, 18 aa, Mycobacterium bovis
LEAVRKRPGMYIGSTGER

SEQ ID NO: 195585 - protein, 19 aa, Mycobacterium bovis
LELAVRCIVFAAAGTAGQR

SEQ ID NO: 195586 - protein, 18 aa, Mycobacterium bovis
LETLYLIDRIPAWSTNLS

SEQ ID NO: 195587 - protein, 18 aa, Mycobacterium bovis
LGFYTGLVDGHFGLQTHN

SEQ ID NO: 195588 - protein, 19 aa, Mycobacterium bovis
LHHTYSFLGVETYRQVSSE

SEQ ID NO: 195589 - protein, 23 aa, Mycobacterium bovis
LIDCGERWAVFNAGMGVDAEVVA

SEQ ID NO: 195590 - protein, 24 aa, Mycobacterium bovis
LLGALPFDVSRPAALMVPDGVLRA

SEQ ID NO: 195591 - protein, 17 aa, Mycobacterium bovis
LPGVLSRRIDPRNSTVL

SEQ ID NO: 195592 - protein, 19 aa, Mycobacterium bovis
LPQTVPLAFTSYAGMDIGR

SEQ ID NO: 195593 - protein, 17 aa, Mycobacterium bovis
LRAPITDALSRRLGHQI

SEQ ID NO: 195594 - protein, 17 aa, Mycobacterium bovis
LREFSAKAGRQVFKDYV

SEQ ID NO: 195595 - protein, 23 aa, Mycobacterium bovis
LSAGHARALLSLEAGPEAQEELA

SEQ ID NO: 195596 - protein, 18 aa, Mycobacterium bovis
LTRMPTVQVDIGYITNPH

SEQ ID NO: 195597 - protein, 18 aa, Mycobacterium bovis
LVGWRRHIHRYPELGRQE

SEQ ID NO: 195598 - protein, 19 aa, Mycobacterium bovis
MGRATSGVQGMRFNIDDRL

SEQ ID NO: 195599 - protein, 21 aa, Mycobacterium bovis
MLLMRAGREYALKRALAKFSD

SEQ ID NO: 195600 - protein, 31 aa, Mycobacterium bovis
MSRSSPRAGDGFIRLDVDGVVSYASPNALSA

SEQ ID NO: 195601 - protein, 20 aa, Mycobacterium bovis
NEIHAARCGIELAPDTNQQV

SEQ ID NO: 195602 - protein, 19 aa, Mycobacterium bovis
NELCFVSGVLPTAPVSAVA

SEQ ID NO: 195603 - protein, 20 aa, Mycobacterium bovis
NFNAGPALRFMSGNLCHQIE

SEQ ID NO: 195604 - protein, 26 aa, Mycobacterium bovis
PAEGFGWPWSVCRWVAGENPSAAEFV

SEQ ID NO: 195605 - protein, 17 aa, Mycobacterium bovis
PAPPRRKPIQMPGLQDV

SEQ ID NO: 195606 - protein, 21 aa, Mycobacterium bovis
PEGFLSTHLVAGVKPGTIVRL

SEQ ID NO: 195607 - protein, 19 aa, Mycobacterium bovis
PGDVISLGATSWRITEITH

SEQ ID NO: 195608 - protein, 24 aa, Mycobacterium bovis
PGILRVRFGEVEARGVALTPRGRE

SEQ ID NO: 195609 - protein, 20 aa, Mycobacterium bovis
PHPKLPGTVFTAAKELEEAG

SEQ ID NO: 195610 - protein, 29 aa, Mycobacterium bovis
PHSPMAGTGWLPGWRLTFGGEDIGWEGAL

SEQ ID NO: 195611 - protein, 22 aa, Mycobacterium bovis
PISEADLLWDLASRLEGRMAAI

SEQ ID NO: 195612 - protein, 20 aa, Mycobacterium bovis
PNRDPITGVHFVFVSNSSPW

SEQ ID NO: 195613 - protein, 19 aa, Mycobacterium bovis
PRIAAHLGVASPVPVGLGS

SEQ ID NO: 195614 - protein, 20 aa, Mycobacterium bovis
PRNSTVLVWGAVNAGMAANA

SEQ ID NO: 195615 - protein, 18 aa, Mycobacterium bovis
PTGTFTFAELLAHELSVE

SEQ ID NO: 195616 - protein, 21 aa, Mycobacterium bovis
PVEQRAAVVAVDMQGYSIADT

SEQ ID NO: 195617 - protein, 19 aa, Mycobacterium bovis
QAIGVAFGATVDRAPELLH

SEQ ID NO: 195618 - protein, 25 aa, Mycobacterium bovis
QEPTVLPSRFPNLLANGSGGIAVGM

SEQ ID NO: 195619 - protein, 19 aa, Mycobacterium bovis
QMDGSWRVGNRPVRVDHRA

SEQ ID NO: 195620 - protein, 24 aa, Mycobacterium bovis
QTVAALLRLQARRTSNAEGREALI

SEQ ID NO: 195621 - protein, 22 aa, Mycobacterium bovis
QTVWKRHHRWSLDGTCDEVFAH

SEQ ID NO: 195622 - protein, 17 aa, Mycobacterium bovis
QVVSIPTLILFKDGQPV

SEQ ID NO: 195623 - protein, 18 aa, Mycobacterium bovis
QYGKTWRTLAKLSLPDKY

SEQ ID NO: 195624 - protein, 21 aa, Mycobacterium bovis
RAGQGCRRCGTLIAYDTTDER

SEQ ID NO: 195625 - protein, 20 aa, Mycobacterium bovis
RALAKFSDRFDVVIIDCPPS

SEQ ID NO: 195626 - protein, 23 aa, Mycobacterium bovis
RALKEASYRLGARTLYHQFGAPL

SEQ ID NO: 195627 - protein, 22 aa, Mycobacterium bovis
RDFRSWACVDLELHPGRTVFVG

SEQ ID NO: 195628 - protein, 25 aa, Mycobacterium bovis
RGVSSCATCDGFFFRDQDIAVIGGG

SEQ ID NO: 195629 - protein, 17 aa, Mycobacterium bovis
RHLRAPITDALSRRLGH

SEQ ID NO: 195630 - protein, 17 aa, Mycobacterium bovis
RKGKIVVEFGSVDDLAR

SEQ ID NO: 195631 - protein, 23 aa, Mycobacterium bovis
RLLKLPIPVQRRVAAGVLSAGHA

SEQ ID NO: 195632 - protein, 25 aa, Mycobacterium bovis
RNVWSNAVIFCGHFPDGAEKFTKTD

SEQ ID NO: 195633 - protein, 18 aa, Mycobacterium bovis
RRHIHRYPELGRQEYATT

SEQ ID NO: 195634 - protein, 19 aa, Mycobacterium bovis
RRIDPRNSTVLVWGAVNAG

SEQ ID NO: 195635 - protein, 20 aa, Mycobacterium bovis
RRLAGFPATVTDIGDTLILT

SEQ ID NO: 195636 - protein, 17 aa, Mycobacterium bovis
RRLAWWTGALTLGVAKI

SEQ ID NO: 195637 - protein, 18 aa, Mycobacterium bovis
RRNDGVLVCVAQCRPNTG

SEQ ID NO: 195638 - protein, 18 aa, Mycobacterium bovis
RRQLGWSQQAPRLFHYRD

SEQ ID NO: 195639 - protein, 30 aa, Mycobacterium bovis
RRSPHSERLFCIPATIDLAGAEIELVSMVA

SEQ ID NO: 195640 - protein, 21 aa, Mycobacterium bovis
RSRPLITNMIRLLKLPIPVQR

SEQ ID NO: 195641 - protein, 21 aa, Mycobacterium bovis
RSVAGLVAWKMGCSSGNAHTI

SEQ ID NO: 195642 - protein, 17 aa, Mycobacterium bovis
RTLRLDQLIRYYVDHQL

SEQ ID NO: 195643 - protein, 17 aa, Mycobacterium bovis
RTVRPWFDRLLAADDPF

SEQ ID NO: 195644 - protein, 24 aa, Mycobacterium bovis
RVGLRIVIEIKRDAVAKVVINNLY

SEQ ID NO: 195645 - protein, 25 aa, Mycobacterium bovis
RVKGPDFPTAGLIVGSQGTADAYKT

SEQ ID NO: 195646 - protein, 25 aa, Mycobacterium bovis
RVLPLLGGLAVMFGDLPPLPTTARF

SEQ ID NO: 195647 - protein, 20 aa, Mycobacterium bovis
RVPPYAGPPMWFHGDLSRFN

SEQ ID NO: 195648 - protein, 18 aa, Mycobacterium bovis
RWSALPLPEPDSTLRAHY

SEQ ID NO: 195649 - protein, 18 aa, Mycobacterium bovis
SAKAGRQVFKDYVAFPAL

SEQ ID NO: 195650 - protein, 24 aa, Mycobacterium bovis
SATLFIKPGWGFSFDYQPGQYIGI

SEQ ID NO: 195651 - protein, 20 aa, Mycobacterium bovis
SDHRLILEGIAWRFRTGSPW

SEQ ID NO: 195652 - protein, 28 aa, Mycobacterium bovis
SGPFYDGAVFHRVIQGFMIQGGDPTGTG

SEQ ID NO: 195653 - protein, 25 aa, Mycobacterium bovis
SGTEPKLKCYLEIRCAVTGDLPAAR

SEQ ID NO: 195654 - protein, 21 aa, Mycobacterium bovis
SPFAASLLFGYVGAFMYEGDT

SEQ ID NO: 195655 - protein, 24 aa, Mycobacterium bovis
SRAIYKDGWWACARLDKAPWDLSP

SEQ ID NO: 195656 - protein, 27 aa, Mycobacterium bovis
SRRTSCLSGLGYPASTPVLGAQPIDID

SEQ ID NO: 195657 - protein, 19 aa, Mycobacterium bovis
SRSASIGYRASMDVTGPSE

SEQ ID NO: 195658 - protein, 24 aa, Mycobacterium bovis
SYIDYAMSVIVGRALPEVRDGLKP

SEQ ID NO: 195659 - protein, 21 aa, Mycobacterium bovis
TEARLTPLAMEMLREIDEETV

SEQ ID NO: 195660 - protein, 23 aa, Mycobacterium bovis
TEFAELRPRLVYDRDTGTLTARP

SEQ ID NO: 195661 - protein, 18 aa, Mycobacterium bovis
TFAPILYVLTYDDLDEAI

SEQ ID NO: 195662 - protein, 21 aa, Mycobacterium bovis
TFHYPGGLVDFVKHINRTKNA

SEQ ID NO: 195663 - protein, 25 aa, Mycobacterium bovis
TGQLRARFAAGLSAMYAAEVPAYGT

SEQ ID NO: 195664 - protein, 20 aa, Mycobacterium bovis
TGSTVRFWADPAVFETTEYD

SEQ ID NO: 195665 - protein, 23 aa, Mycobacterium bovis
THGHTEWLPPPHLDHGQPRTNTF

SEQ ID NO: 195666 - protein, 25 aa, Mycobacterium bovis
TLEDRLRTRFEWGLITDVQPPELET

SEQ ID NO: 195667 - protein, 18 aa, Mycobacterium bovis
TLTGFKWLARADANLPGT

SEQ ID NO: 195668 - protein, 25 aa, Mycobacterium bovis
TLVRMAQPWSLRYPLVDGQGNFGSP

SEQ ID NO: 195669 - protein, 26 aa, Mycobacterium bovis
TRDQRWKRYNIFNVVWNTILAIGFEW

SEQ ID NO: 195670 - protein, 19 aa, Mycobacterium bovis
TWDLLRLTRMPTVQVDIGY

SEQ ID NO: 195671 - protein, 24 aa, Mycobacterium bovis
VANADFMGGFALWVDEQRHLHHTY

SEQ ID NO: 195672 - protein, 17 aa, Mycobacterium bovis
VASTMATSMVLDAIEQA

SEQ ID NO: 195673 - protein, 22 aa, Mycobacterium bovis
VEHCIIDANFLMDVGFVVVAPH

SEQ ID NO: 195674 - protein, 17 aa, Mycobacterium bovis
VELMARIAQRRVRVAEA

SEQ ID NO: 195675 - protein, 19 aa, Mycobacterium bovis
VHGPLALAVGRRLRDRYGI

SEQ ID NO: 195676 - protein, 17 aa, Mycobacterium bovis
VIAELRRQLGWSQQAPR

SEQ ID NO: 195677 - protein, 24 aa, Mycobacterium bovis
VIIHGWLAFTFELCRQRIMDPSTD

SEQ ID NO: 195678 - protein, 21 aa, Mycobacterium bovis
VIKMVLAMRHELLPATLHVDV

SEQ ID NO: 195679 - protein, 24 aa, Mycobacterium bovis
VITAFNFPVAVWAWNTAVALVCGD

SEQ ID NO: 195680 - protein, 19 aa, Mycobacterium bovis
VKKAYQLLAPESRSASIGY

SEQ ID NO: 195681 - protein, 19 aa, Mycobacterium bovis
VNACLDRLRRAKAHPTAPL

SEQ ID NO: 195682 - protein, 17 aa, Mycobacterium bovis
VRALEAFGRTPAATDLQ

SEQ ID NO: 195683 - protein, 19 aa, Mycobacterium bovis
VRDGLKPVHRRVLYAMFDS

SEQ ID NO: 195684 - protein, 18 aa, Mycobacterium bovis
VRETMTFRAVPDALAVVA

SEQ ID NO: 195685 - protein, 18 aa, Mycobacterium bovis
VREVCDRYDLPYTTGSFL

SEQ ID NO: 195686 - protein, 20 aa, Mycobacterium bovis
VSLGKRKGKIVVEFGSVDDL

SEQ ID NO: 195687 - protein, 22 aa, Mycobacterium bovis
VSWSNPNDWWLVRLLGSITPTE

SEQ ID NO: 195688 - protein, 23 aa, Mycobacterium bovis
VVAAAPYAGWLAAAAARAGGAAV

SEQ ID NO: 195689 - protein, 26 aa, Mycobacterium bovis
VVAANRSAFVQLVLSNVFGQNAPAIA

SEQ ID NO: 195690 - protein, 34 aa, Mycobacterium bovis
VVGEWQLLADLSFADYLMWVRRNDGVLVCVAQCR

SEQ ID NO: 195691 - protein, 23 aa, Mycobacterium bovis
VWNTILAIGFEWGVALQHLEIGK

SEQ ID NO: 195692 - protein, 26 aa, Mycobacterium bovis
WKPSELTPLTALACQALLSRAAADVG

SEQ ID NO: 195693 - protein, 19 aa, Mycobacterium bovis
WLHRIVVNACLDRLRRAKA

SEQ ID NO: 195694 - protein, 21 aa, Mycobacterium bovis
WRSTPAPVRGALVARLGELLT

SEQ ID NO: 195695 - protein, 18 aa, Mycobacterium bovis
WRYIRAAVRAVLACTRRE

SEQ ID NO: 195696 - protein, 25 aa, Mycobacterium bovis
WSARELRGRILGVRRETEDSATLFI

SEQ ID NO: 195697 - protein, 19 aa, Mycobacterium bovis
WSLAGRSVFEHRAVVVGGD

SEQ ID NO: 195698 - protein, 26 aa, Mycobacterium bovis
WSLAVALRLAAYQLLRVDGGEPVLLL

SEQ ID NO: 195699 - protein, 19 aa, Mycobacterium bovis
WTNPDCRFESGLGVFATTS

SEQ ID NO: 195700 - protein, 18 aa, Mycobacterium bovis
WVNRFRWNRCTTGDTRAG

SEQ ID NO: 195701 - protein, 19 aa, Mycobacterium bovis
YGAALPWPASSADGTARPG

SEQ ID NO: 195702 - protein, 26 aa, Mycobacterium bovis
YIGIGLLVDGCWRWRSYSLTSSPAAS

SEQ ID NO: 195703 - protein, 18 aa, Mycobacterium bovis
YIQRAAGVRRCAGSVRVA

SEQ ID NO: 195704 - protein, 17 aa, Mycobacterium bovis
AAAAGARQVVILAAGLD

SEQ ID NO: 195705 - protein, 17 aa, Mycobacterium bovis
AAAAGELASIRSAINAA

SEQ ID NO: 195706 - protein, 18 aa, Mycobacterium bovis
AAAAPYVTWMSGTSAQAK

SEQ ID NO: 195707 - protein, 23 aa, Mycobacterium bovis
AAAAVPYVAWMRATAASAEQAAA

SEQ ID NO: 195708 - protein, 33 aa, Mycobacterium bovis
AAAAWPGVERTWLDGWLLRAGHGAVLAANSAVP

SEQ ID NO: 195709 - protein, 17 aa, Mycobacterium bovis
AAACWRPVLQGRDVVAM

SEQ ID NO: 195710 - protein, 19 aa, Mycobacterium bovis
AAADCLARAVLAGVLNAQP

SEQ ID NO: 195711 - protein, 26 aa, Mycobacterium bovis
AAADEIAELLLKWKKTPQRPVSLPLQ

SEQ ID NO: 195712 - protein, 32 aa, Mycobacterium bovis
AAADEVSTAVAALFSQHAQGYQAAAAQVAAFH

SEQ ID NO: 195713 - protein, 26 aa, Mycobacterium bovis
AAADEVSTAVAALFSSHAQAYQAASA

SEQ ID NO: 195714 - protein, 32 aa, Mycobacterium bovis
AAADEVSTQIAALFGAHARSYQTLSTQAAAFH

SEQ ID NO: 195715 - protein, 19 aa, Mycobacterium bovis
AAADRLCYSYFRSYGLDVT

SEQ ID NO: 195716 - protein, 25 aa, Mycobacterium bovis
AAAEAEYELMWAADVAAMAGYHSGA

SEQ ID NO: 195717 - protein, 24 aa, Mycobacterium bovis
AAAEAFGTAFAMTVPPSLVAANRS

SEQ ID NO: 195718 - protein, 18 aa, Mycobacterium bovis
AAAEAMYEQMWAADVAAM

SEQ ID NO: 195719 - protein, 19 aa, Mycobacterium bovis
AAAEFDYELMWAQDVAAML

SEQ ID NO: 195720 - protein, 26 aa, Mycobacterium bovis
AAAELGERCAFGLQLIAPRLPPFDVP

SEQ ID NO: 195721 - protein, 27 aa, Mycobacterium bovis
AAAELPRIAGMGFDVVYLPPIHPIGKV

SEQ ID NO: 195722 - protein, 20 aa, Mycobacterium bovis
AAAGKRARDVGVRIVYVVDT

SEQ ID NO: 195723 - protein, 26 aa, Mycobacterium bovis
AAAGKRCPPTAFISGRLPAPPAADVT

SEQ ID NO: 195724 - protein, 25 aa, Mycobacterium bovis
AAAGRAAPRLTVWVPVAVNPGAAAH

SEQ ID NO: 195725 - protein, 25 aa, Mycobacterium bovis
AAAGRPGPVPLALGPVHPGGPTLID

SEQ ID NO: 195726 - protein, 26 aa, Mycobacterium bovis
AAAHGGPHYLCLAIHAMVTDDSSRQI

SEQ ID NO: 195727 - protein, 17 aa, Mycobacterium bovis
AAAHPSLPRGALLQIAV

SEQ ID NO: 195728 - protein, 17 aa, Mycobacterium bovis
AAAHVAGALCLPDAAML

SEQ ID NO: 195729 - protein, 21 aa, Mycobacterium bovis
AAAILSARFGPSVLYGVPNFF

SEQ ID NO: 195730 - protein, 23 aa, Mycobacterium bovis
AAAKAAILASIAFHTRVTADDVY

SEQ ID NO: 195731 - protein, 20 aa, Mycobacterium bovis
AAAKAMGIDKLRVIHTGMDP

SEQ ID NO: 195732 - protein, 18 aa, Mycobacterium bovis
AAALALGTQGAWTGSQWL

SEQ ID NO: 195733 - protein, 18 aa, Mycobacterium bovis
AAALPGVVDIVAASRTVL

SEQ ID NO: 195734 - protein, 27 aa, Mycobacterium bovis
AAANSWVDVFAHWRRAQGLPVSAIAWG

SEQ ID NO: 195735 - protein, 18 aa, Mycobacterium bovis
AAAPLALLAPRARLAGAS

SEQ ID NO: 195736 - protein, 20 aa, Mycobacterium bovis
AAAPYAGWLSAAAARAAGAA

SEQ ID NO: 195737 - protein, 23 aa, Mycobacterium bovis
AAAQRLPFLPIRAGLGSSVPQFW

SEQ ID NO: 195738 - protein, 18 aa, Mycobacterium bovis
AAARARARYACFDHACAD

SEQ ID NO: 195739 - protein, 17 aa, Mycobacterium bovis
AAARYAANPERSIAEAH

SEQ ID NO: 195740 - protein, 24 aa, Mycobacterium bovis
AAASEFRDGLCFVDLAPIADPGMV

SEQ ID NO: 195741 - protein, 18 aa, Mycobacterium bovis
AAASRLAGAYGEHAAAEI

SEQ ID NO: 195742 - protein, 27 aa, Mycobacterium bovis
AAATAWGELAEELLASIASLGSVTSEL

SEQ ID NO: 195743 - protein, 18 aa, Mycobacterium bovis
AAATLDWLQAHGHDDQVR

SEQ ID NO: 195744 - protein, 19 aa, Mycobacterium bovis
AAAVLRFAATEVIPRLAGT

SEQ ID NO: 195745 - protein, 19 aa, Mycobacterium bovis
AAAWRRIRSQVRDWTDLEP

SEQ ID NO: 195746 - protein, 17 aa, Mycobacterium bovis
AACEFKNQVLVKIYNRK

SEQ ID NO: 195747 - protein, 25 aa, Mycobacterium bovis
AACGLRRLIPLYAMVETALAPPPSA

SEQ ID NO: 195748 - protein, 21 aa, Mycobacterium bovis
AADAFEAVRIIARASRVDVTL

SEQ ID NO: 195749 - protein, 31 aa, Mycobacterium bovis
AADALALAICHCWRAPTIARMAEATSRAEAR

SEQ ID NO: 195750 - protein, 24 aa, Mycobacterium bovis
AADDCGFATLWVGEHVVMVDRPAS

SEQ ID NO: 195751 - protein, 22 aa, Mycobacterium bovis
AADELSGLFVPTDVCDEDAVNG

SEQ ID NO: 195752 - protein, 46 aa, Mycobacterium bovis
AADEVSAAMAALFGAHAQEYQRLSAQAAGFHAQFVQALNAGVNSYA

SEQ ID NO: 195753 - protein, 25 aa, Mycobacterium bovis
AADEVSAAMAALFSGHAQAYQALSA

SEQ ID NO: 195754 - protein, 30 aa, Mycobacterium bovis
AADEVSAAVAALFGSYAQSYQAFGAQLSAF

SEQ ID NO: 195755 - protein, 25 aa, Mycobacterium bovis
AADEVSAGIAALFGAQAQSYQAVSA

SEQ ID NO: 195756 - protein, 23 aa, Mycobacterium bovis
AADEVSLLLATQFRTHAATYQTA

SEQ ID NO: 195757 - protein, 20 aa, Mycobacterium bovis
AADFRGWCGEAGFRSFEVIP

SEQ ID NO: 195758 - protein, 25 aa, Mycobacterium bovis
AADGKAKWSAPLGFLAQTPPALTPH

SEQ ID NO: 195759 - protein, 18 aa, Mycobacterium bovis
AADHVWLMSTASYPEMAT

SEQ ID NO: 195760 - protein, 26 aa, Mycobacterium bovis
AADLTNRSTIRWTLHQMVASGVVSVY

SEQ ID NO: 195761 - protein, 17 aa, Mycobacterium bovis
AADVAAMLGYHGEASAV

SEQ ID NO: 195762 - protein, 19 aa, Mycobacterium bovis
AAECRWIRENLGVDVPVHF

SEQ ID NO: 195763 - protein, 25 aa, Mycobacterium bovis
AAEDPRVAGLIARVQLPPSPAGAVQ

SEQ ID NO: 195764 - protein, 24 aa, Mycobacterium bovis
AAEGARLQLLLSRNEIDRAATILA

SEQ ID NO: 195765 - protein, 23 aa, Mycobacterium bovis
AAEGFPSLSCIVLNGGFQLHPAI

SEQ ID NO: 195766 - protein, 18 aa, Mycobacterium bovis
AAEHTQSYVRACHLVGYQ

SEQ ID NO: 195767 - protein, 26 aa, Mycobacterium bovis
AAEILVYGHVPFELVSYVCCYNTETM

SEQ ID NO: 195768 - protein, 17 aa, Mycobacterium bovis
AAELGMAAIYCRDDVGG

SEQ ID NO: 195769 - protein, 24 aa, Mycobacterium bovis
AAEPWEVAATIAFLASDYSSYLTG

SEQ ID NO: 195770 - protein, 17 aa, Mycobacterium bovis
AAERRRYVEVFAAGQGG

SEQ ID NO: 195771 - protein, 22 aa, Mycobacterium bovis
AAEVYKRSLAVFFLSEPPEGFD

SEQ ID NO: 195772 - protein, 20 aa, Mycobacterium bovis
AAFADPYCPTLRAAVTGLPG

SEQ ID NO: 195773 - protein, 18 aa, Mycobacterium bovis
AAFAGRPALLSEMTDDDV

SEQ ID NO: 195774 - protein, 18 aa, Mycobacterium bovis
AAFCDGYAVASGIDPRDS

SEQ ID NO: 195775 - protein, 18 aa, Mycobacterium bovis
AAFEISRDIIAISGDSAT

SEQ ID NO: 195776 - protein, 17 aa, Mycobacterium bovis
AAFEVSQTSRSAPCVLG

SEQ ID NO: 195777 - protein, 17 aa, Mycobacterium bovis
AAFQTVFHVHLHVLPRR

SEQ ID NO: 195778 - protein, 22 aa, Mycobacterium bovis
AAGARFSGGVFACAALAERELT

SEQ ID NO: 195779 - protein, 26 aa, Mycobacterium bovis
AAGDEVSAAIAALFSSHGQQYQAMSA

SEQ ID NO: 195780 - protein, 17 aa, Mycobacterium bovis
AAGEAMMRQALAQLTAA

SEQ ID NO: 195781 - protein, 29 aa, Mycobacterium bovis
AAGGLNWASLPLKLFAGGNAKFWDPADID

SEQ ID NO: 195782 - protein, 22 aa, Mycobacterium bovis
AAGHLPGAVSIPLDELAERLDE

SEQ ID NO: 195783 - protein, 18 aa, Mycobacterium bovis
AAGIGELTFFSKIHYGGG

SEQ ID NO: 195784 - protein, 20 aa, Mycobacterium bovis
AAGIPIRIGVNAGSLDKRFM

SEQ ID NO: 195785 - protein, 24 aa, Mycobacterium bovis
AAGLRSLLAYQWAHPGKQLLFMGQ

SEQ ID NO: 195786 - protein, 18 aa, Mycobacterium bovis
AAGLRVVATIDIGSSVRD

SEQ ID NO: 195787 - protein, 26 aa, Mycobacterium bovis
AAGLSRASSIGALSVPPSWAGQANLV

SEQ ID NO: 195788 - protein, 20 aa, Mycobacterium bovis
AAGLTRSFMAFLIDAYTEDE

SEQ ID NO: 195789 - protein, 18 aa, Mycobacterium bovis
AAGPTMGILAAGADEVSV

SEQ ID NO: 195790 - protein, 21 aa, Mycobacterium bovis
AAGRLRFTTDYDMAADFADVH

SEQ ID NO: 195791 - protein, 24 aa, Mycobacterium bovis
AAGRVAGLIGTIGIRVGGADLPSA

SEQ ID NO: 195792 - protein, 18 aa, Mycobacterium bovis
AAGTPPIYFGFGSTPVQT

SEQ ID NO: 195793 - protein, 23 aa, Mycobacterium bovis
AAGVCFPDLLLTKGEYQLKLTPP

SEQ ID NO: 195794 - protein, 23 aa, Mycobacterium bovis
AAGVRRLVLASSMVVYGQGRYDC

SEQ ID NO: 195795 - protein, 19 aa, Mycobacterium bovis
AAHCPAYFQLLVKALVLPG

SEQ ID NO: 195796 - protein, 23 aa, Mycobacterium bovis
AAHLVHPGDLVILIAYATMDDAR

SEQ ID NO: 195797 - protein, 17 aa, Mycobacterium bovis
AAHPCRRRSVARVGGYR

SEQ ID NO: 195798 - protein, 18 aa, Mycobacterium bovis
AAHTEYDTGLSLSAVCAL

SEQ ID NO: 195799 - protein, 17 aa, Mycobacterium bovis
AAIAVSRRVRTRWINFA

SEQ ID NO: 195800 - protein, 26 aa, Mycobacterium bovis
AAIDLQRYGLTWKWPDVDCAHPLDDG

SEQ ID NO: 195801 - protein, 17 aa, Mycobacterium bovis
AAIDSDAAWQAPANDAG

SEQ ID NO: 195802 - protein, 22 aa, Mycobacterium bovis
AAIEIKSAATLRGRDTRSISRL

SEQ ID NO: 195803 - protein, 18 aa, Mycobacterium bovis
AAILLGDLAQVWADDIVS

SEQ ID NO: 195804 - protein, 17 aa, Mycobacterium bovis
AAIQVMRAPAARNRAYA

SEQ ID NO: 195805 - protein, 17 aa, Mycobacterium bovis
AAIRLIYPREALWRPPV

SEQ ID NO: 195806 - protein, 22 aa, Mycobacterium bovis
AAKAEALKCAKGFRYYAENAEA

SEQ ID NO: 195807 - protein, 28 aa, Mycobacterium bovis
AAKGTFRLAFGIGDFRRDTGFGEDPATL

SEQ ID NO: 195808 - protein, 26 aa, Mycobacterium bovis
AAKPFVRWLTDLCVQLSEVERQIHEI

SEQ ID NO: 195809 - protein, 37 aa, Mycobacterium bovis
AAKQALTEAVLWPLQHPDTFARLGVEPPRGVLLYGPP

SEQ ID NO: 195810 - protein, 26 aa, Mycobacterium bovis
AAKRAFSEPVALNWAADGTDVDFGAL

SEQ ID NO: 195811 - protein, 27 aa, Mycobacterium bovis
AAKVERPDLVIGWWAAPTILEHGTPEQ

SEQ ID NO: 195812 - protein, 17 aa, Mycobacterium bovis
AAKVLEDLGWYVADNLP

SEQ ID NO: 195813 - protein, 27 aa, Mycobacterium bovis
AALAMELGCDAVLLASAVTRAADPPAM

SEQ ID NO: 195814 - protein, 17 aa, Mycobacterium bovis
AALARELVRAGTTFPTD

SEQ ID NO: 195815 - protein, 21 aa, Mycobacterium bovis
AALARRNSDVFQRMQEALNIS

SEQ ID NO: 195816 - protein, 23 aa, Mycobacterium bovis
AALARSRATLVLHLAAAQIDAIV

SEQ ID NO: 195817 - protein, 25 aa, Mycobacterium bovis
AALASRVRKAPGFALLGEKGQSRDL

SEQ ID NO: 195818 - protein, 18 aa, Mycobacterium bovis
AALDFGASFDGVRPHAIR

SEQ ID NO: 195819 - protein, 23 aa, Mycobacterium bovis
AALDIPILQGLCLTSPRDQWCAN

SEQ ID NO: 195820 - protein, 22 aa, Mycobacterium bovis
AALDRFGPPAGDPAWVVKDDRL

SEQ ID NO: 195821 - protein, 18 aa, Mycobacterium bovis
AALDYSALYPAGRLVDAP

SEQ ID NO: 195822 - protein, 23 aa, Mycobacterium bovis
AALEAHPAVLLFSHRSYIDGVVV

SEQ ID NO: 195823 - protein, 22 aa, Mycobacterium bovis
AALELIDWPVALVIATGHILAN

SEQ ID NO: 195824 - protein, 23 aa, Mycobacterium bovis
AALESLYEWMWAQDAAAMAGYYV

SEQ ID NO: 195825 - protein, 30 aa, Mycobacterium bovis
AALEVGRLSEWRATLIVRESACLDVEDRRA

SEQ ID NO: 195826 - protein, 20 aa, Mycobacterium bovis
AALGRYGRLDGVLVASGSNH

SEQ ID NO: 195827 - protein, 19 aa, Mycobacterium bovis
AALGSRLGGHIVQGHVDAT

SEQ ID NO: 195828 - protein, 23 aa, Mycobacterium bovis
AALLPTHCWFEGRGWGFQVYPAL

SEQ ID NO: 195829 - protein, 19 aa, Mycobacterium bovis
AALPDRPATSFVGGRLSGT

SEQ ID NO: 195830 - protein, 24 aa, Mycobacterium bovis
AALPEVACTVWSNLVMTAHLRPGQ

SEQ ID NO: 195831 - protein, 23 aa, Mycobacterium bovis
AALPGCQTLAVFVHALPNIEPER

SEQ ID NO: 195832 - protein, 18 aa, Mycobacterium bovis
AALPKLPSFSLTSTSITD

SEQ ID NO: 195833 - protein, 24 aa, Mycobacterium bovis
AALQRSDLLIALGTRFDDRVTGKL

SEQ ID NO: 195834 - protein, 21 aa, Mycobacterium bovis
AALRAALRASAARSLMNRMAE

SEQ ID NO: 195835 - protein, 20 aa, Mycobacterium bovis
AALREWRGPVLDDLRDFQFV

SEQ ID NO: 195836 - protein, 17 aa, Mycobacterium bovis
AALRNAGKFRRMSQMTW

SEQ ID NO: 195837 - protein, 25 aa, Mycobacterium bovis
AALRRRLLQRFAIEPLAPVRDAEDA

SEQ ID NO: 195838 - protein, 17 aa, Mycobacterium bovis
AALRRVELARPRSVVGK

SEQ ID NO: 195839 - protein, 17 aa, Mycobacterium bovis
AALRVNRSLVLPDPPRH

SEQ ID NO: 195840 - protein, 17 aa, Mycobacterium bovis
AALVGGWNLLAPGHWPM

SEQ ID NO: 195841 - protein, 18 aa, Mycobacterium bovis
AALWKAAGITSPIDEIDA

SEQ ID NO: 195842 - protein, 17 aa, Mycobacterium bovis
AALWRRALTLSGESPST

SEQ ID NO: 195843 - protein, 24 aa, Mycobacterium bovis
AAMAEAVAPYVAWMSAAAAQAEQA

SEQ ID NO: 195844 - protein, 26 aa, Mycobacterium bovis
AAMARTCVDAGWLLSLSGTVSFRNAR

SEQ ID NO: 195845 - protein, 19 aa, Mycobacterium bovis
AAMASRLVGAVLIGRDRAA

SEQ ID NO: 195846 - protein, 18 aa, Mycobacterium bovis
AAMLRRIRLTPAGPDTAD

SEQ ID NO: 195847 - protein, 25 aa, Mycobacterium bovis
AAMRLRPGERHWMAFRQLASDVDAN

SEQ ID NO: 195848 - protein, 18 aa, Mycobacterium bovis
AANALPLQKAQGVVSELA

SEQ ID NO: 195849 - protein, 24 aa, Mycobacterium bovis
AANASPMQAVLDVVNGPTQLLLGR

SEQ ID NO: 195850 - protein, 24 aa, Mycobacterium bovis
AANFRDIMITLGMFTHDALLGGEG

SEQ ID NO: 195851 - protein, 27 aa, Mycobacterium bovis
AANIRRLRRPDPYKGKGVRYEGEQIRR

SEQ ID NO: 195852 - protein, 26 aa, Mycobacterium bovis
AANRARLAAAIGLPGNRVVWMNQVHG

SEQ ID NO: 195853 - protein, 24 aa, Mycobacterium bovis
AANSWLDTFTHWRRAQDLPATSIA

SEQ ID NO: 195854 - protein, 20 aa, Mycobacterium bovis
AAPDLPCEVEVDSLEQLDAV

SEQ ID NO: 195855 - protein, 24 aa, Mycobacterium bovis
AAPDRKRLTLAHELGHLVLHSTNP

SEQ ID NO: 195856 - protein, 24 aa, Mycobacterium bovis
AAPESTCREFAGLVDDVVCATMPT

SEQ ID NO: 195857 - protein, 17 aa, Mycobacterium bovis
AAPGLGLVRVAAELGGD

SEQ ID NO: 195858 - protein, 22 aa, Mycobacterium bovis
AAPGSLLGGLPLAGAGGAGAGP

SEQ ID NO: 195859 - protein, 17 aa, Mycobacterium bovis
AAPKYAEAGIRAIDLTP

SEQ ID NO: 195860 - protein, 17 aa, Mycobacterium bovis
AAPSVGLMQPWRFIRIT

SEQ ID NO: 195861 - protein, 17 aa, Mycobacterium bovis
AAPTLGAGLDWKTSLQE

SEQ ID NO: 195862 - protein, 20 aa, Mycobacterium bovis
AAPYAAWLAAAAVQAEQTAA

SEQ ID NO: 195863 - protein, 17 aa, Mycobacterium bovis
AAPYVAWMSVTAVRAEQ

SEQ ID NO: 195864 - protein, 21 aa, Mycobacterium bovis
AAQAGRLGRYVRARPALDVVD

SEQ ID NO: 195865 - protein, 23 aa, Mycobacterium bovis
AAQASGIRYIGFRHEASAGNAAA

SEQ ID NO: 195866 - protein, 19 aa, Mycobacterium bovis
AAQCLAPGARLVFNAFLAN

SEQ ID NO: 195867 - protein, 22 aa, Mycobacterium bovis
AAQFPFDIIPTLLQGLATLSTQ

SEQ ID NO: 195868 - protein, 20 aa, Mycobacterium bovis
AAQGRAVYCWNVDEYEDIDF

SEQ ID NO: 195869 - protein, 25 aa, Mycobacterium bovis
AAQIRSIPTIMAFKNGKLLFNQAGA

SEQ ID NO: 195870 - protein, 25 aa, Mycobacterium bovis
AAQLGEPWRAVHVGDELPLAELTVR

SEQ ID NO: 195871 - protein, 25 aa, Mycobacterium bovis
AAQRAGLELLAFGGRFVEIGKADVY

SEQ ID NO: 195872 - protein, 23 aa, Mycobacterium bovis
AAQREFTRILGLLPDLHGEVDRW

SEQ ID NO: 195873 - protein, 24 aa, Mycobacterium bovis
AAQRLASCGAREVIVTNTLPIGED

SEQ ID NO: 195874 - protein, 31 aa, Mycobacterium bovis
AAQRRCGSPAWNLPVVFGPIAVTYNLNSVSS

SEQ ID NO: 195875 - protein, 22 aa, Mycobacterium bovis
AAQRRDMMWICRDGDRAKNHLL

SEQ ID NO: 195876 - protein, 19 aa, Mycobacterium bovis
AAQSWDLVRDGVFVGYQLD

SEQ ID NO: 195877 - protein, 17 aa, Mycobacterium bovis
AARAQIRDIRLLRTQAA

SEQ ID NO: 195878 - protein, 18 aa, Mycobacterium bovis
AARFPGPFIYTVHPSKIV

SEQ ID NO: 195879 - protein, 18 aa, Mycobacterium bovis
AARGRTGVLVGGRVTWED

SEQ ID NO: 195880 - protein, 21 aa, Mycobacterium bovis
AARHHRRSFVADRLGTGTAVL

SEQ ID NO: 195881 - protein, 26 aa, Mycobacterium bovis
AARIELRTGGAYRWTVTPGHSAAGTV

SEQ ID NO: 195882 - protein, 19 aa, Mycobacterium bovis
AARILLRSGKPVFLAANKV

SEQ ID NO: 195883 - protein, 25 aa, Mycobacterium bovis
AARKFGCGFAPSGWDSLTKHLQRKG

SEQ ID NO: 195884 - protein, 24 aa, Mycobacterium bovis
AARRADIAIVFAIRAEGEGFDSAD

SEQ ID NO: 195885 - protein, 18 aa, Mycobacterium bovis
AASCGLGHRKGRIAPGYD

SEQ ID NO: 195886 - protein, 18 aa, Mycobacterium bovis
AASDVVAWVRSQLAADGV

SEQ ID NO: 195887 - protein, 19 aa, Mycobacterium bovis
AASIMAIVADIERYPEWNE

SEQ ID NO: 195888 - protein, 22 aa, Mycobacterium bovis
AASLKGLVRVLAFEHPDMRTTL

SEQ ID NO: 195889 - protein, 19 aa, Mycobacterium bovis
AASPFGIDIGIGGAGGHGG

SEQ ID NO: 195890 - protein, 25 aa, Mycobacterium bovis
AASPKETWLRLLLIDAGLPVPTTQI

SEQ ID NO: 195891 - protein, 17 aa, Mycobacterium bovis
AASSLRKAKKLRVRLPL

SEQ ID NO: 195892 - protein, 19 aa, Mycobacterium bovis
AASVGSLSVPPAWAAANQA

SEQ ID NO: 195893 - protein, 22 aa, Mycobacterium bovis
AATEAHYAEMWAQDAAAMYGYA

SEQ ID NO: 195894 - protein, 25 aa, Mycobacterium bovis
AATFGVAYLTAWHSLCEVGRLSPGE

SEQ ID NO: 195895 - protein, 21 aa, Mycobacterium bovis
AATGKPSWFLFDGLVKHDLLT

SEQ ID NO: 195896 - protein, 26 aa, Mycobacterium bovis
AATIKRFADRFARFNLQERVIRPSYG

SEQ ID NO: 195897 - protein, 18 aa, Mycobacterium bovis
AATLERTGYSWGPLSLML

SEQ ID NO: 195898 - protein, 17 aa, Mycobacterium bovis
AATLGPWTLVLDECHHL

SEQ ID NO: 195899 - protein, 18 aa, Mycobacterium bovis
AATLRAGLRERLGVTVAV

SEQ ID NO: 195900 - protein, 21 aa, Mycobacterium bovis
AATQDPRAWAALPRAGAVIFA

SEQ ID NO: 195901 - protein, 17 aa, Mycobacterium bovis
AATRAGFEAGFEADPVL

SEQ ID NO: 195902 - protein, 23 aa, Mycobacterium bovis
AATRLPEAPALVVTADRIAISHR

SEQ ID NO: 195903 - protein, 18 aa, Mycobacterium bovis
AATSVHFVAPQSIDARLA

SEQ ID NO: 195904 - protein, 21 aa, Mycobacterium bovis
AAVAAAAPWLRDGDVVVVTSK

SEQ ID NO: 195905 - protein, 40 aa, Mycobacterium bovis
AAVAANREAFLALIRSNWLGLNAPWIAAVESLYEEYWAAD

SEQ ID NO: 195906 - protein, 21 aa, Mycobacterium bovis
AAVADRCSWRRWWPDLRLQVT

SEQ ID NO: 195907 - protein, 17 aa, Mycobacterium bovis
AAVATDLAGIGSTIGTA

SEQ ID NO: 195908 - protein, 19 aa, Mycobacterium bovis
AAVCGAGGDCGRCRRTLRA

SEQ ID NO: 195909 - protein, 19 aa, Mycobacterium bovis
AAVDSGYYPGQFQVGQTGK

SEQ ID NO: 195910 - protein, 25 aa, Mycobacterium bovis
AAVEEFRFHVGLARAAGNTMLDLFL

SEQ ID NO: 195911 - protein, 26 aa, Mycobacterium bovis
AAVGSDFIICYRLSMADYVAEGQSWD

SEQ ID NO: 195912 - protein, 19 aa, Mycobacterium bovis
AAVKGIMYEDVPGFCKSAT

SEQ ID NO: 195913 - protein, 18 aa, Mycobacterium bovis
AAVLFDIDGVLVLSWRAI

SEQ ID NO: 195914 - protein, 17 aa, Mycobacterium bovis
AAVLLHLGPGLGNGLAN

SEQ ID NO: 195915 - protein, 25 aa, Mycobacterium bovis
AAVNDLRLALGVMLEIGPRGPERLP

SEQ ID NO: 195916 - protein, 24 aa, Mycobacterium bovis
AAVNGFCVGGGIGLVGNSDVIVAS

SEQ ID NO: 195917 - protein, 17 aa, Mycobacterium bovis
AAVRAELAKRGWVPLPQ

SEQ ID NO: 195918 - protein, 18 aa, Mycobacterium bovis
AAVRAWLLSQRRIVTTYA

SEQ ID NO: 195919 - protein, 17 aa, Mycobacterium bovis
AAVRLQIDQPGRLDALN

SEQ ID NO: 195920 - protein, 18 aa, Mycobacterium bovis
AAVRRLGHAAGLRVTTGR

SEQ ID NO: 195921 - protein, 18 aa, Mycobacterium bovis
AAVSFGFGPLLLAGSDPL

SEQ ID NO: 195922 - protein, 19 aa, Mycobacterium bovis
AAVSSFGLGGTNAHVIIEQ

SEQ ID NO: 195923 - protein, 26 aa, Mycobacterium bovis
AAVTGLRYGNQVPLTYPFALTFPSVM

SEQ ID NO: 195924 - protein, 19 aa, Mycobacterium bovis
AAVVGRLRAVVCAPACAVD

SEQ ID NO: 195925 - protein, 30 aa, Mycobacterium bovis
AAYACASAWLDALVGWRRASGLPAAVINWG

SEQ ID NO: 195926 - protein, 17 aa, Mycobacterium bovis
AAYGEWMATPPPTWEDI

SEQ ID NO: 195927 - protein, 17 aa, Mycobacterium bovis
AAYGRYQPLGVILAVMP

SEQ ID NO: 195928 - protein, 25 aa, Mycobacterium bovis
AAYLARAGLRVRLLERLAQTGGAAV

SEQ ID NO: 195929 - protein, 26 aa, Mycobacterium bovis
AAYRQLRYFWSRVIADTGWQLLDSKF

SEQ ID NO: 195930 - protein, 20 aa, Mycobacterium bovis
ACADCGVTVDRMPRVETFGV

SEQ ID NO: 195931 - protein, 25 aa, Mycobacterium bovis
ACAEAFAEFVDWSLVDVLRGAPGAP

SEQ ID NO: 195932 - protein, 18 aa, Mycobacterium bovis
ACALVGRPQLVFLDEPTA

SEQ ID NO: 195933 - protein, 18 aa, Mycobacterium bovis
ACDLQRPAAVNQLQVVGE

SEQ ID NO: 195934 - protein, 24 aa, Mycobacterium bovis
ACDVPSLGWRVYRLVPADEAPGWE

SEQ ID NO: 195935 - protein, 26 aa, Mycobacterium bovis
ACERADAVLVLTEWREFIDLEPADLA

SEQ ID NO: 195936 - protein, 28 aa, Mycobacterium bovis
ACGAIELGIKWLSLYAFSTENWKRSPEE

SEQ ID NO: 195937 - protein, 19 aa, Mycobacterium bovis
ACGKMYTRRGTFLEHAGDF

SEQ ID NO: 195938 - protein, 31 aa, Mycobacterium bovis
ACGQRWPKMRISGPAVRWVMTGWQRLHFRFG

SEQ ID NO: 195939 - protein, 21 aa, Mycobacterium bovis
ACGTLRLADFDKIELSNLNRV

SEQ ID NO: 195940 - protein, 25 aa, Mycobacterium bovis
ACLSEARYGIVWGAMGAARSAWQCA

SEQ ID NO: 195941 - protein, 22 aa, Mycobacterium bovis
ACPSTWPWNLLGWPSINVPAGF

SEQ ID NO: 195942 - protein, 20 aa, Mycobacterium bovis
ACQGFITQLGRNFQVIYEQA

SEQ ID NO: 195943 - protein, 26 aa, Mycobacterium bovis
ACQKWPRRMRKMFLSLIQRQLPEGYD

SEQ ID NO: 195944 - protein, 19 aa, Mycobacterium bovis
ACRPHSGTDLLAGIGGTPE

SEQ ID NO: 195945 - protein, 28 aa, Mycobacterium bovis
ACRRWPKLMRRLLLWEVRRRLGRSVDMS

SEQ ID NO: 195946 - protein, 23 aa, Mycobacterium bovis
ACSGAHRAIVHFYNSTSILQRRV

SEQ ID NO: 195947 - protein, 21 aa, Mycobacterium bovis
ACSSGLTAVHMACRSLHEGES

SEQ ID NO: 195948 - protein, 25 aa, Mycobacterium bovis
ACSTLRLTDLLPYVGPDYLVPKPLH

SEQ ID NO: 195949 - protein, 17 aa, Mycobacterium bovis
ACTHCNQCMATIYRRTH

SEQ ID NO: 195950 - protein, 20 aa, Mycobacterium bovis
ACVLGECLTGAPPYRADSVE

SEQ ID NO: 195951 - protein, 17 aa, Mycobacterium bovis
ACVRATWLKVVPDQLGR

SEQ ID NO: 195952 - protein, 18 aa, Mycobacterium bovis
ADAARALDNFATRWRHGG

SEQ ID NO: 195953 - protein, 18 aa, Mycobacterium bovis
ADAARLAVRMENDGATAW

SEQ ID NO: 195954 - protein, 26 aa, Mycobacterium bovis
ADAARRFPVPIAMFAELIDGARMEID

SEQ ID NO: 195955 - protein, 24 aa, Mycobacterium bovis
ADAAWRAAFDHEQTCVAIIKHANP

SEQ ID NO: 195956 - protein, 21 aa, Mycobacterium bovis
ADADDAPAWWDGTVVEHIRVS

SEQ ID NO: 195957 - protein, 25 aa, Mycobacterium bovis
ADAEFPDAIVVPGFVDMHVHGGGGA

SEQ ID NO: 195958 - protein, 23 aa, Mycobacterium bovis
ADAGRFLTTIKHRLEEGAFEADL

SEQ ID NO: 195959 - protein, 25 aa, Mycobacterium bovis
ADAGSGRYMLRCRVGERIRVCDWLP

SEQ ID NO: 195960 - protein, 23 aa, Mycobacterium bovis
ADAKRLRSIRGREIGYVPQDPMT

SEQ ID NO: 195961 - protein, 24 aa, Mycobacterium bovis
ADALKADGIVGVRLNWRHHGEGGE

SEQ ID NO: 195962 - protein, 26 aa, Mycobacterium bovis
ADAPAAWRRYLEAGILIRDVGIPGYL

SEQ ID NO: 195963 - protein, 22 aa, Mycobacterium bovis
ADARLAQGHPVAWIHGTALRTE

SEQ ID NO: 195964 - protein, 21 aa, Mycobacterium bovis
ADARVGRLLFSTQLANAVITR

SEQ ID NO: 195965 - protein, 35 aa, Mycobacterium bovis
ADARWPSAGNWRYLADYAIGATLAYPERVEYNQDN

SEQ ID NO: 195966 - protein, 25 aa, Mycobacterium bovis
ADATLTRFLGIGVRTVLSQGSYLAR

SEQ ID NO: 195967 - protein, 19 aa, Mycobacterium bovis
ADAVARMAEFGRHVEELVA

SEQ ID NO: 195968 - protein, 19 aa, Mycobacterium bovis
ADDGQAYGFAAAFGAGPSC

SEQ ID NO: 195969 - protein, 20 aa, Mycobacterium bovis
ADDGYPVFVDALVNMRHTLA

SEQ ID NO: 195970 - protein, 23 aa, Mycobacterium bovis
ADDIRLRRMAVFDVLINNADRKG

SEQ ID NO: 195971 - protein, 17 aa, Mycobacterium bovis
ADDRFWLAVGRTRSNAY

SEQ ID NO: 195972 - protein, 24 aa, Mycobacterium bovis
ADDVPRGISFLLNRNRLNVAVSRA

SEQ ID NO: 195973 - protein, 19 aa, Mycobacterium bovis
ADEAPGWELVPGTDIANEH

SEQ ID NO: 195974 - protein, 19 aa, Mycobacterium bovis
ADEPIEFALRLSNAIAAEV

SEQ ID NO: 195975 - protein, 17 aa, Mycobacterium bovis
ADERAAGVLRAHGYPTD

SEQ ID NO: 195976 - protein, 23 aa, Mycobacterium bovis
ADERLRSGVPLGEVVDYLGIPAS

SEQ ID NO: 195977 - protein, 24 aa, Mycobacterium bovis
ADEVSAGIAALFSAHAQEYQALSA

SEQ ID NO: 195978 - protein, 18 aa, Mycobacterium bovis
ADFVPRVRAGLEALGVGK

SEQ ID NO: 195979 - protein, 30 aa, Mycobacterium bovis
ADGASNWYTEFARLAPLMEKDVHYEVDLRK

SEQ ID NO: 195980 - protein, 31 aa, Mycobacterium bovis
ADGDAALALLRAELRPGDVVLVKASNAAGLG

SEQ ID NO: 195981 - protein, 20 aa, Mycobacterium bovis
ADGDHWILNGAKCWITNGGK

SEQ ID NO: 195982 - protein, 26 aa, Mycobacterium bovis
ADGERRPGWVGLPLAGVQTRLVDDDG

SEQ ID NO: 195983 - protein, 25 aa, Mycobacterium bovis
ADGGRAVLVLSDWPAPQAPQSASGE

SEQ ID NO: 195984 - protein, 26 aa, Mycobacterium bovis
ADGKEIAGRLAARIGSGLLVDVVDVR

SEQ ID NO: 195985 - protein, 26 aa, Mycobacterium bovis
ADGLDDCFRLLAGGVRGAVQRQQTLR

SEQ ID NO: 195986 - protein, 21 aa, Mycobacterium bovis
ADGQTGLFCPLDEQIQQAARH

SEQ ID NO: 195987 - protein, 21 aa, Mycobacterium bovis
ADGRAAMLLHVSHAVTDGVGG

SEQ ID NO: 195988 - protein, 17 aa, Mycobacterium bovis
ADGRCKAFAAAADGTGW

SEQ ID NO: 195989 - protein, 18 aa, Mycobacterium bovis
ADGRGECEFIIRLLPDGV

SEQ ID NO: 195990 - protein, 19 aa, Mycobacterium bovis
ADGRRPRILIAKMGQDGHD

SEQ ID NO: 195991 - protein, 35 aa, Mycobacterium bovis
ADGSEYRGCYGLSVAALMKWHLPRLEVLVDAGADM

SEQ ID NO: 195992 - protein, 19 aa, Mycobacterium bovis
ADGSLRHPPVPAVWQDKSV

SEQ ID NO: 195993 - protein, 18 aa, Mycobacterium bovis
ADGSRIVVRGELFTAFVP

SEQ ID NO: 195994 - protein, 24 aa, Mycobacterium bovis
ADGSYSLTGHKWFTSAPMCDIFLV

SEQ ID NO: 195995 - protein, 25 aa, Mycobacterium bovis
ADGVMRWLEEHRRGVAMDSGVVPIV

SEQ ID NO: 195996 - protein, 26 aa, Mycobacterium bovis
ADHCLDLPGLFVWRRYHPSRPSGKAL

SEQ ID NO: 195997 - protein, 17 aa, Mycobacterium bovis
ADHRLPQGVTFIGQPLW

SEQ ID NO: 195998 - protein, 27 aa, Mycobacterium bovis
ADIARYNARCGRTFVLPNEQAAYDACI

SEQ ID NO: 195999 - protein, 21 aa, Mycobacterium bovis
ADIASAVAFLVSDAASWITGE

SEQ ID NO: 196000 - protein, 25 aa, Mycobacterium bovis
ADIDGLRYLDWLAAYSAVNLGHRNP

SEQ ID NO: 196001 - protein, 17 aa, Mycobacterium bovis
ADIDGVLRWADEARARL

SEQ ID NO: 196002 - protein, 23 aa, Mycobacterium bovis
ADIDKRGKISLILVADEDSTAAA

SEQ ID NO: 196003 - protein, 20 aa, Mycobacterium bovis
ADIGARCELLSGARVWPGVF

SEQ ID NO: 196004 - protein, 18 aa, Mycobacterium bovis
ADIGFWCSGSSDYLAGRA

SEQ ID NO: 196005 - protein, 24 aa, Mycobacterium bovis
ADILRPVADRLWYPLWDANIRLDH

SEQ ID NO: 196006 - protein, 17 aa, Mycobacterium bovis
ADIRESIHLRALGRQNP

SEQ ID NO: 196007 - protein, 20 aa, Mycobacterium bovis
ADIRFGSYRLFSLDAAPGPD

SEQ ID NO: 196008 - protein, 18 aa, Mycobacterium bovis
ADISGVYNTGALGLITSA

SEQ ID NO: 196009 - protein, 17 aa, Mycobacterium bovis
ADIWPVIDRDPAVRVVL

SEQ ID NO: 196010 - protein, 21 aa, Mycobacterium bovis
ADLALAGGCAVLLEPHACVAA

SEQ ID NO: 196011 - protein, 19 aa, Mycobacterium bovis
ADLARLGREGVLALSTAEA

SEQ ID NO: 196012 - protein, 18 aa, Mycobacterium bovis
ADLDRLGVEVLLDDRQAS

SEQ ID NO: 196013 - protein, 27 aa, Mycobacterium bovis
ADLFHARVALWFIREVFEVMRATPQHT

SEQ ID NO: 196014 - protein, 21 aa, Mycobacterium bovis
ADLGFPLSIHLEATYGVSAAA

SEQ ID NO: 196015 - protein, 25 aa, Mycobacterium bovis
ADLHAAPSQWSWRPWSLTVDVEPGP

SEQ ID NO: 196016 - protein, 19 aa, Mycobacterium bovis
ADLHMIGKDIIRFHAVYWP

SEQ ID NO: 196017 - protein, 17 aa, Mycobacterium bovis
ADLIEWRRKHEKHIERV

SEQ ID NO: 196018 - protein, 20 aa, Mycobacterium bovis
ADLLGKRLHRVLGPLAHVNL

SEQ ID NO: 196019 - protein, 21 aa, Mycobacterium bovis
ADLPEITHFVAGLGTTGTLMG

SEQ ID NO: 196020 - protein, 21 aa, Mycobacterium bovis
ADLPPAYIAVAGYDPLRDDGI

SEQ ID NO: 196021 - protein, 20 aa, Mycobacterium bovis
ADLQSWLVLITGYDAVSLQP

SEQ ID NO: 196022 - protein, 24 aa, Mycobacterium bovis
ADLRADWPTALGAAGFDPTQPTAW

SEQ ID NO: 196023 - protein, 26 aa, Mycobacterium bovis
ADLRAGLPDGEFFGAIAQLPGASGRI

SEQ ID NO: 196024 - protein, 23 aa, Mycobacterium bovis
ADLRDARLRLAADDLVSRRAERE

SEQ ID NO: 196025 - protein, 21 aa, Mycobacterium bovis
ADLRTDWPTPLTAAGFDPQRP

SEQ ID NO: 196026 - protein, 22 aa, Mycobacterium bovis
ADLSLLGKARKVVVTKDETTIV

SEQ ID NO: 196027 - protein, 30 aa, Mycobacterium bovis
ADLTFADAFTADFFATWGKLAAVRTPTIAA

SEQ ID NO: 196028 - protein, 23 aa, Mycobacterium bovis
ADMLGRAGGLLVDVAIDTVPRGY

SEQ ID NO: 196029 - protein, 20 aa, Mycobacterium bovis
ADMRRMRAAAAKLVETEISD

SEQ ID NO: 196030 - protein, 23 aa, Mycobacterium bovis
ADNPVLCDLILIRAALSPKTARL

SEQ ID NO: 196031 - protein, 29 aa, Mycobacterium bovis
ADPATISAFVVRISCHLRIQNQAADDDVK

SEQ ID NO: 196032 - protein, 17 aa, Mycobacterium bovis
ADPDLIIGRYIPNLVPR

SEQ ID NO: 196033 - protein, 25 aa, Mycobacterium bovis
ADPDRYAAEMAHIIGCEPAEVLRVS

SEQ ID NO: 196034 - protein, 25 aa, Mycobacterium bovis
ADPEVVRALDMLFILHADHEQNCST

SEQ ID NO: 196035 - protein, 18 aa, Mycobacterium bovis
ADPPDRPWNLLAGANALM

SEQ ID NO: 196036 - protein, 22 aa, Mycobacterium bovis
ADPRAPSLFIHRPDALARRIGR

SEQ ID NO: 196037 - protein, 21 aa, Mycobacterium bovis
ADPRVSAILDRPLQAVEHERT

SEQ ID NO: 196038 - protein, 18 aa, Mycobacterium bovis
ADPVSLQSAVGFSALGSE

SEQ ID NO: 196039 - protein, 17 aa, Mycobacterium bovis
ADPVSLQTAAGFSAQGV

SEQ ID NO: 196040 - protein, 19 aa, Mycobacterium bovis
ADQACTDWPVAAAEDDEAR

SEQ ID NO: 196041 - protein, 29 aa, Mycobacterium bovis
ADQARTIRIPVHMVEVINKLGRIQRELLQ

SEQ ID NO: 196042 - protein, 24 aa, Mycobacterium bovis
ADQPLDWFCSFSSAAALVGSPGQG

SEQ ID NO: 196043 - protein, 24 aa, Mycobacterium bovis
ADQRTRVFFCNSGAEANEAAFKLS

SEQ ID NO: 196044 - protein, 26 aa, Mycobacterium bovis
ADRAASYRAAGYWSGRTLDTVLSDAA

SEQ ID NO: 196045 - protein, 17 aa, Mycobacterium bovis
ADRASRVQPGFTIANHN

SEQ ID NO: 196046 - protein, 24 aa, Mycobacterium bovis
ADRGRTGVFSLDARQWFQSFPAVA

SEQ ID NO: 196047 - protein, 21 aa, Mycobacterium bovis
ADRKGGHILCGIDGQVYGVDH

SEQ ID NO: 196048 - protein, 19 aa, Mycobacterium bovis
ADRLYERLLGWLADIQQPR

SEQ ID NO: 196049 - protein, 22 aa, Mycobacterium bovis
ADRRADGELARYVTAKEPWFLD

SEQ ID NO: 196050 - protein, 23 aa, Mycobacterium bovis
ADRRYSAAITRLAPETDVRIVTY

SEQ ID NO: 196051 - protein, 26 aa, Mycobacterium bovis
ADRVAIWSPNTWHWVVACLAIHHAGA

SEQ ID NO: 196052 - protein, 31 aa, Mycobacterium bovis
ADSIVIGGGMCFTFLAAQGFSVGTSLLEDDM

SEQ ID NO: 196053 - protein, 18 aa, Mycobacterium bovis
ADSLGPVRVVVNCAGTGN

SEQ ID NO: 196054 - protein, 27 aa, Mycobacterium bovis
ADSLGWLRDFLRLHTGGLVVISHNVDL

SEQ ID NO: 196055 - protein, 18 aa, Mycobacterium bovis
ADSLSFVLDDAVLTADTV

SEQ ID NO: 196056 - protein, 25 aa, Mycobacterium bovis
ADSRGQFPGRYRLAVLEKLSRVSSR

SEQ ID NO: 196057 - protein, 21 aa, Mycobacterium bovis
ADSSRGALLIHGHLDVVPAEP

SEQ ID NO: 196058 - protein, 17 aa, Mycobacterium bovis
ADTAVDVVIPYDRGDLV

SEQ ID NO: 196059 - protein, 20 aa, Mycobacterium bovis
ADTGLRYTVYPGELSSSVGG

SEQ ID NO: 196060 - protein, 18 aa, Mycobacterium bovis
ADTHPSGGCSRHLAECPA

SEQ ID NO: 196061 - protein, 18 aa, Mycobacterium bovis
ADTLGYISLRGMVAASEQ

SEQ ID NO: 196062 - protein, 23 aa, Mycobacterium bovis
ADTPGLPKMGSFEVMNRTIDIAQ

SEQ ID NO: 196063 - protein, 18 aa, Mycobacterium bovis
ADTWISTDYLFWRDDDGD

SEQ ID NO: 196064 - protein, 19 aa, Mycobacterium bovis
ADVAHPVYLLYGVERTEDL

SEQ ID NO: 196065 - protein, 29 aa, Mycobacterium bovis
ADVALIVGVPMDFRLGFGGVFGSTTQLIV

SEQ ID NO: 196066 - protein, 22 aa, Mycobacterium bovis
ADVEASGLWPGKVVTEVSPAGD

SEQ ID NO: 196067 - protein, 23 aa, Mycobacterium bovis
ADVFELAGLLRRSGEVVAAREGH

SEQ ID NO: 196068 - protein, 19 aa, Mycobacterium bovis
ADVGYRWFASTNQTPMFAF

SEQ ID NO: 196069 - protein, 19 aa, Mycobacterium bovis
ADVHIAIELACPLVYGAAV

SEQ ID NO: 196070 - protein, 22 aa, Mycobacterium bovis
ADVLIAFGRFPIIDDREPQLGM

SEQ ID NO: 196071 - protein, 19 aa, Mycobacterium bovis
ADVLLAHLVLRPFLDAYHI

SEQ ID NO: 196072 - protein, 21 aa, Mycobacterium bovis
ADVPGLIPGASRGRGLGLDFL

SEQ ID NO: 196073 - protein, 18 aa, Mycobacterium bovis
ADVPVLLVCGHRAGRAAV

SEQ ID NO: 196074 - protein, 23 aa, Mycobacterium bovis
ADVRPEVVSFTFGAPPPDVVQRL

SEQ ID NO: 196075 - protein, 21 aa, Mycobacterium bovis
ADVRRELAIRAAVEAATVTDS

SEQ ID NO: 196076 - protein, 23 aa, Mycobacterium bovis
ADVSCLKALLEVRNEIVAAGHTP

SEQ ID NO: 196077 - protein, 17 aa, Mycobacterium bovis
ADVSIIFVPPTFAKDAI

SEQ ID NO: 196078 - protein, 23 aa, Mycobacterium bovis
ADVSLPVVRAFIHRIKERARGAE

SEQ ID NO: 196079 - protein, 20 aa, Mycobacterium bovis
ADVVARFLPYFTDVIVGDLR

SEQ ID NO: 196080 - protein, 22 aa, Mycobacterium bovis
ADVVSAWTGIPAGRLLEGETAK

SEQ ID NO: 196081 - protein, 19 aa, Mycobacterium bovis
ADVYLCGPVAMVDAARTWL

SEQ ID NO: 196082 - protein, 26 aa, Mycobacterium bovis
ADWAEMLMRMYIRWAEQHKYPVEVFD

SEQ ID NO: 196083 - protein, 30 aa, Mycobacterium bovis
ADWLSVKRLAGWLAAAGYCGRAPRPAHRCP

SEQ ID NO: 196084 - protein, 21 aa, Mycobacterium bovis
ADYRVCTPLPRVGEVEDVANL

SEQ ID NO: 196085 - protein, 26 aa, Mycobacterium bovis
AEAANASPLQSAMGAVSASAQTLLSR

SEQ ID NO: 196086 - protein, 19 aa, Mycobacterium bovis
AEAAPVMRAVASVLPGTGA

SEQ ID NO: 196087 - protein, 22 aa, Mycobacterium bovis
AEADLFYSDFVERVAEGRKMTT

SEQ ID NO: 196088 - protein, 19 aa, Mycobacterium bovis
AEAIWEMPPYTGWYQGAQA

SEQ ID NO: 196089 - protein, 25 aa, Mycobacterium bovis
AEAKARRGPLCLGIDPHPELLRGWD

SEQ ID NO: 196090 - protein, 29 aa, Mycobacterium bovis
AEAKLGYPLSRAHTAAIIWSDELDGDHSY

SEQ ID NO: 196091 - protein, 32 aa, Mycobacterium bovis
AEAKYAAKRVRRWMRRRYLLLEVPQLPGRGWV

SEQ ID NO: 196092 - protein, 19 aa, Mycobacterium bovis
AEALAPFGSPLASLAAAAE

SEQ ID NO: 196093 - protein, 17 aa, Mycobacterium bovis
AEALCAALEVVQQADTA

SEQ ID NO: 196094 - protein, 23 aa, Mycobacterium bovis
AEALTSLPGVGVWTAAETTQRVF

SEQ ID NO: 196095 - protein, 20 aa, Mycobacterium bovis
AEANAAFEEARRRFEASWNR

SEQ ID NO: 196096 - protein, 25 aa, Mycobacterium bovis
AEANRWCDSNGFGADDCFAKFISTL

SEQ ID NO: 196097 - protein, 21 aa, Mycobacterium bovis
AEAQGGLLPWAVREYEAQTGR

SEQ ID NO: 196098 - protein, 19 aa, Mycobacterium bovis
AEAQVEQQLLAAINAPTQA

SEQ ID NO: 196099 - protein, 17 aa, Mycobacterium bovis
AEARAILTAGLLGEEVP

SEQ ID NO: 196100 - protein, 19 aa, Mycobacterium bovis
AEASVPVFTVRLADHPSRD

SEQ ID NO: 196101 - protein, 19 aa, Mycobacterium bovis
AEAVLRAAALIGGLDNAAL

SEQ ID NO: 196102 - protein, 23 aa, Mycobacterium bovis
AECLLDRNALIMGYSGVYSSFLK

SEQ ID NO: 196103 - protein, 24 aa, Mycobacterium bovis
AEDDGILMGYGWHRGRDEGQLLLL

SEQ ID NO: 196104 - protein, 21 aa, Mycobacterium bovis
AEDPAREFLPTGGRVLAVFEP

SEQ ID NO: 196105 - protein, 23 aa, Mycobacterium bovis
AEEFFDLIWRLMRFDKHGPLDLI

SEQ ID NO: 196106 - protein, 23 aa, Mycobacterium bovis
AEELASWLSGLRGSRVVLRVPRR

SEQ ID NO: 196107 - protein, 18 aa, Mycobacterium bovis
AEELRYSVIREVLPTRRA

SEQ ID NO: 196108 - protein, 25 aa, Mycobacterium bovis
AEFAELRSAAPIWWNGQDPGKGGGF

SEQ ID NO: 196109 - protein, 18 aa, Mycobacterium bovis
AEFTRIAAGISVSKPRIP

SEQ ID NO: 196110 - protein, 19 aa, Mycobacterium bovis
AEGARLKDAFVYPETMPAW

SEQ ID NO: 196111 - protein, 18 aa, Mycobacterium bovis
AEGARPGWVGSSAGALSG

SEQ ID NO: 196112 - protein, 22 aa, Mycobacterium bovis
AEGDGGWDLTLRNMAKGYPHLT

SEQ ID NO: 196113 - protein, 24 aa, Mycobacterium bovis
AEGELYFPGSPVLSVRGSFAECVL

SEQ ID NO: 196114 - protein, 18 aa, Mycobacterium bovis
AEGLLRYLPPEAQDRLLD

SEQ ID NO: 196115 - protein, 26 aa, Mycobacterium bovis
AEGMGVPARRVTTCEEFADALRAAFA

SEQ ID NO: 196116 - protein, 23 aa, Mycobacterium bovis
AEGRGWHNARVIPYGPIELDPSA

SEQ ID NO: 196117 - protein, 17 aa, Mycobacterium bovis
AEGRKVLAREVDIRDDA

SEQ ID NO: 196118 - protein, 18 aa, Mycobacterium bovis
AEGRLRLPERVQRYLVGR

SEQ ID NO: 196119 - protein, 18 aa, Mycobacterium bovis
AEHAELELALADPALHSN

SEQ ID NO: 196120 - protein, 18 aa, Mycobacterium bovis
AEHLHVHVVPRWGGDANF

SEQ ID NO: 196121 - protein, 28 aa, Mycobacterium bovis
AEHLLAMLKARGSGQWASFSELVADCTA

SEQ ID NO: 196122 - protein, 19 aa, Mycobacterium bovis
AEHPRLGPVRNPWNTDYTA

SEQ ID NO: 196123 - protein, 24 aa, Mycobacterium bovis
AEHPSSGVAFVLGERLGRVDVSEL

SEQ ID NO: 196124 - protein, 18 aa, Mycobacterium bovis
AEHSFPYEIVAKMGEMGL

SEQ ID NO: 196125 - protein, 17 aa, Mycobacterium bovis
AEIAPQWHLRMQAAVQR

SEQ ID NO: 196126 - protein, 19 aa, Mycobacterium bovis
AEIAWLRAELDTAREVIRV

SEQ ID NO: 196127 - protein, 24 aa, Mycobacterium bovis
AEIDARLRLVVGRRGDLADQESLG

SEQ ID NO: 196128 - protein, 18 aa, Mycobacterium bovis
AEIDAVCELIDFWRFNVA

SEQ ID NO: 196129 - protein, 22 aa, Mycobacterium bovis
AEIDMRCLLIVGSSQTRWYSVD

SEQ ID NO: 196130 - protein, 25 aa, Mycobacterium bovis
AEIDNLRAAFTWSRGNGDIAAALQL

SEQ ID NO: 196131 - protein, 20 aa, Mycobacterium bovis
AEIEPALVIMLGEYPGRSMI

SEQ ID NO: 196132 - protein, 17 aa, Mycobacterium bovis
AEIGFPVRRRKDADTYA

SEQ ID NO: 196133 - protein, 17 aa, Mycobacterium bovis
AEIGRIPVDSIYSPVLK

SEQ ID NO: 196134 - protein, 20 aa, Mycobacterium bovis
AEIKRRLPSMYHQFKELAEV

SEQ ID NO: 196135 - protein, 19 aa, Mycobacterium bovis
AEIRALFRSSKVGLIAGCL

SEQ ID NO: 196136 - protein, 18 aa, Mycobacterium bovis
AEIVNAWNLQNHEVTAIV

SEQ ID NO: 196137 - protein, 17 aa, Mycobacterium bovis
AEIYRRSFAVIRAEADL

SEQ ID NO: 196138 - protein, 20 aa, Mycobacterium bovis
AEKLVRARLRREVLIDDGTD

SEQ ID NO: 196139 - protein, 18 aa, Mycobacterium bovis
AELAAAFEKFEKTVARAA

SEQ ID NO: 196140 - protein, 25 aa, Mycobacterium bovis
AELAAAGLHRIRWWTDEAGDFGLSL

SEQ ID NO: 196141 - protein, 18 aa, Mycobacterium bovis
AELAEAFHAAGRCTAEAN

SEQ ID NO: 196142 - protein, 17 aa, Mycobacterium bovis
AELARLAGRLDDATAQR

SEQ ID NO: 196143 - protein, 25 aa, Mycobacterium bovis
AELARSTGWTGLIVHGAVRDAAALR

SEQ ID NO: 196144 - protein, 26 aa, Mycobacterium bovis
AELAYFEVLHELKLIVDLMYEGGLAR

SEQ ID NO: 196145 - protein, 19 aa, Mycobacterium bovis
AELDAGVPARGLNGEAYRG

SEQ ID NO: 196146 - protein, 21 aa, Mycobacterium bovis
AELDFPVPSFAEFWRTGRLEL

SEQ ID NO: 196147 - protein, 17 aa, Mycobacterium bovis
AELEPDFQRAYKELAKQ

SEQ ID NO: 196148 - protein, 21 aa, Mycobacterium bovis
AELFWALRGGGGGNFGVTTSM

SEQ ID NO: 196149 - protein, 25 aa, Mycobacterium bovis
AELGAAMTRLACERASVGDDELAAK

SEQ ID NO: 196150 - protein, 22 aa, Mycobacterium bovis
AELGLPVVVRPSFTMGGLGSGI

SEQ ID NO: 196151 - protein, 18 aa, Mycobacterium bovis
AELGRRHELLSGLVPQIS

SEQ ID NO: 196152 - protein, 25 aa, Mycobacterium bovis
AELKKKPGIHAVHMAGGNKAEIAPT

SEQ ID NO: 196153 - protein, 21 aa, Mycobacterium bovis
AELLPELTLAQRWDLTASELA

SEQ ID NO: 196154 - protein, 19 aa, Mycobacterium bovis
AELLRACGDIDGLERVRFT

SEQ ID NO: 196155 - protein, 18 aa, Mycobacterium bovis
AELLRPLLELVPVHDVAF

SEQ ID NO: 196156 - protein, 17 aa, Mycobacterium bovis
AELLRRAKHSGLSDHQI

SEQ ID NO: 196157 - protein, 20 aa, Mycobacterium bovis
AELLSAVGALAEATRDGVVA

SEQ ID NO: 196158 - protein, 20 aa, Mycobacterium bovis
AELLVPHLAARFGRAARDIA

SEQ ID NO: 196159 - protein, 17 aa, Mycobacterium bovis
AELPALFSQLVAGPIRR

SEQ ID NO: 196160 - protein, 19 aa, Mycobacterium bovis
AELPEHIVIVGSGFIAAEF

SEQ ID NO: 196161 - protein, 20 aa, Mycobacterium bovis
AELPHRCVIDGEIIIATDHG

SEQ ID NO: 196162 - protein, 20 aa, Mycobacterium bovis
AELPLPVGLLKIDVEGLERA

SEQ ID NO: 196163 - protein, 17 aa, Mycobacterium bovis
AELRAKHGLIPEDEALR

SEQ ID NO: 196164 - protein, 19 aa, Mycobacterium bovis
AELRHRLESKIVMTRLADE

SEQ ID NO: 196165 - protein, 24 aa, Mycobacterium bovis
AELSRLRPLPFRLVLDGTEEIVAD

SEQ ID NO: 196166 - protein, 19 aa, Mycobacterium bovis
AELSRLSSPIGLDLGARTP

SEQ ID NO: 196167 - protein, 17 aa, Mycobacterium bovis
AELTWQLRGTAEARQVD

SEQ ID NO: 196168 - protein, 26 aa, Mycobacterium bovis
AELVARVKALLRRRGSTATSSSETIT

SEQ ID NO: 196169 - protein, 29 aa, Mycobacterium bovis
AELVELFKTEALHRLPVKSWDVRHAREAY

SEQ ID NO: 196170 - protein, 24 aa, Mycobacterium bovis
AELVTEHAWRIGVVAQSHATVENL

SEQ ID NO: 196171 - protein, 24 aa, Mycobacterium bovis
AEMARRIDVARVYAHHVVERQLAG

SEQ ID NO: 196172 - protein, 22 aa, Mycobacterium bovis
AEMHARISGLADYFALDELDAI

SEQ ID NO: 196173 - protein, 17 aa, Mycobacterium bovis
AEMLRRNGIPCDDVRKH

SEQ ID NO: 196174 - protein, 17 aa, Mycobacterium bovis
AEMLRWCHEAGIELATV

SEQ ID NO: 196175 - protein, 25 aa, Mycobacterium bovis
AEMRIDPFEMWTQGTNGLGITFYSF

SEQ ID NO: 196176 - protein, 17 aa, Mycobacterium bovis
AEMWAQDAAAMYGYAGS

SEQ ID NO: 196177 - protein, 20 aa, Mycobacterium bovis
AEMWSQDAMAMYGYAGASAA

SEQ ID NO: 196178 - protein, 22 aa, Mycobacterium bovis
AENMARLLIVTRERYHVFRHQQ

SEQ ID NO: 196179 - protein, 22 aa, Mycobacterium bovis
AEPCPMCAAASVLSGVRAIIFG

SEQ ID NO: 196180 - protein, 24 aa, Mycobacterium bovis
AEPEDFVGALIYLLSDASSFYTGQ

SEQ ID NO: 196181 - protein, 17 aa, Mycobacterium bovis
AEPGQVLGLTFTRKAAG

SEQ ID NO: 196182 - protein, 19 aa, Mycobacterium bovis
AEPGWARERGWPQFADRLL

SEQ ID NO: 196183 - protein, 21 aa, Mycobacterium bovis
AEPGWTMFMISHFHYDPVWWN

SEQ ID NO: 196184 - protein, 25 aa, Mycobacterium bovis
AEPLPRTLVWSAAWEMTREAELRAR

SEQ ID NO: 196185 - protein, 17 aa, Mycobacterium bovis
AEPPPNVDIRWSTADLR

SEQ ID NO: 196186 - protein, 17 aa, Mycobacterium bovis
AEPRYLIGRKILTPPAR

SEQ ID NO: 196187 - protein, 17 aa, Mycobacterium bovis
AEPRYRDRIPILIGGGG

SEQ ID NO: 196188 - protein, 25 aa, Mycobacterium bovis
AEPTARRILRHFGIEQHFEVIAGAS

SEQ ID NO: 196189 - protein, 20 aa, Mycobacterium bovis
AEPTAWLFGPEAHGLSAEIA

SEQ ID NO: 196190 - protein, 21 aa, Mycobacterium bovis
AEPTGVAAWQLARMNLARMTH

SEQ ID NO: 196191 - protein, 23 aa, Mycobacterium bovis
AEPVAVVGIGCRFPGDVDGPESF

SEQ ID NO: 196192 - protein, 21 aa, Mycobacterium bovis
AEPYLPLRAVRHLEKGRVVIF

SEQ ID NO: 196193 - protein, 25 aa, Mycobacterium bovis
AEQARFAMRMVRRPVHDPARYDQIW

SEQ ID NO: 196194 - protein, 22 aa, Mycobacterium bovis
AEQEYRPFRALIQAALRHAGAV

SEQ ID NO: 196195 - protein, 27 aa, Mycobacterium bovis
AEQFARVHLDACDRWSVGLSGGPDSLA

SEQ ID NO: 196196 - protein, 22 aa, Mycobacterium bovis
AEQLMPHWMLSLRAADMRRGGT

SEQ ID NO: 196197 - protein, 21 aa, Mycobacterium bovis
AEQRVALDLLLDESVGIVSLG

SEQ ID NO: 196198 - protein, 27 aa, Mycobacterium bovis
AEQVGPMLADWAKWGQARHNYFLRPSD

SEQ ID NO: 196199 - protein, 22 aa, Mycobacterium bovis
AEQVRLPSIYFAHRRKVFQRDG

SEQ ID NO: 196200 - protein, 20 aa, Mycobacterium bovis
AERALALMVNRVRNRVAFGR

SEQ ID NO: 196201 - protein, 19 aa, Mycobacterium bovis
AEREARLQRPLYVMPTKGI

SEQ ID NO: 196202 - protein, 21 aa, Mycobacterium bovis
AERIGALLFEVNRRFGTPVPP

SEQ ID NO: 196203 - protein, 18 aa, Mycobacterium bovis
AERIRRVAERIVATKKQG

SEQ ID NO: 196204 - protein, 28 aa, Mycobacterium bovis
AERLRAGGMGIPAFYTPAGVGTQVADGG

SEQ ID NO: 196205 - protein, 23 aa, Mycobacterium bovis
AERMRHGMYWSGDLAYRDSEGWI

SEQ ID NO: 196206 - protein, 25 aa, Mycobacterium bovis
AERREVWRLLASFRVQPATEVIARR

SEQ ID NO: 196207 - protein, 32 aa, Mycobacterium bovis
AERVNGRIPLPVDWRWPWGEALAVLENTATDV

SEQ ID NO: 196208 - protein, 19 aa, Mycobacterium bovis
AESCTAGLLAARLTDRPGS

SEQ ID NO: 196209 - protein, 23 aa, Mycobacterium bovis
AESFAAACLPYLSWLTQASADCA

SEQ ID NO: 196210 - protein, 19 aa, Mycobacterium bovis
AESGLRFSGTSPDGHLVEF

SEQ ID NO: 196211 - protein, 20 aa, Mycobacterium bovis
AESGRRVRINDLWIAAVAAS

SEQ ID NO: 196212 - protein, 20 aa, Mycobacterium bovis
AESIQHTWFGLSALAERVDA

SEQ ID NO: 196213 - protein, 27 aa, Mycobacterium bovis
AESPRETWLRLLLIRAGFPRPQTQIPV

SEQ ID NO: 196214 - protein, 17 aa, Mycobacterium bovis
AESQWFAAAGCNLVNMT

SEQ ID NO: 196215 - protein, 21 aa, Mycobacterium bovis
AESVAAWLLDHDRPAAVGLVG

SEQ ID NO: 196216 - protein, 22 aa, Mycobacterium bovis
AETALPRLLAALQHAGVTVHLD

SEQ ID NO: 196217 - protein, 21 aa, Mycobacterium bovis
AETARLEGFYESVRRRAGEVT

SEQ ID NO: 196218 - protein, 19 aa, Mycobacterium bovis
AETQPQGWVRLRGEAALVV

SEQ ID NO: 196219 - protein, 18 aa, Mycobacterium bovis
AETRRLLTEAPFGSRNPD

SEQ ID NO: 196220 - protein, 20 aa, Mycobacterium bovis
AETVGPRLGVKASGGIRTAA

SEQ ID NO: 196221 - protein, 19 aa, Mycobacterium bovis
AEVARRLHNKGAKLVLTDL

SEQ ID NO: 196222 - protein, 17 aa, Mycobacterium bovis
AEVDVWFANKIGGADWV

SEQ ID NO: 196223 - protein, 20 aa, Mycobacterium bovis
AEVFCAPEVVEYLRSATDRL

SEQ ID NO: 196224 - protein, 18 aa, Mycobacterium bovis
AEVGPRLFMLSSTSSDAL

SEQ ID NO: 196225 - protein, 25 aa, Mycobacterium bovis
AEVLGNWTGIPVFKLTEAETTRLLR

SEQ ID NO: 196226 - protein, 18 aa, Mycobacterium bovis
AEVRRIEHQVAHEVVAEV

SEQ ID NO: 196227 - protein, 20 aa, Mycobacterium bovis
AEVSGPLLRRKFRPSSAAML

SEQ ID NO: 196228 - protein, 19 aa, Mycobacterium bovis
AEVYLDLVRQVPCVTDVNV

SEQ ID NO: 196229 - protein, 34 aa, Mycobacterium bovis
AEWMNRPHLAAAWEYDWPASRWRQHLNAQLEGTY

SEQ ID NO: 196230 - protein, 19 aa, Mycobacterium bovis
AEYTRVVLINGPRQAGKTT

SEQ ID NO: 196231 - protein, 17 aa, Mycobacterium bovis
AFAEEYGLPIAIKAAHG

SEQ ID NO: 196232 - protein, 23 aa, Mycobacterium bovis
AFAGPRFLMRIAELEMHPLDTRD

SEQ ID NO: 196233 - protein, 19 aa, Mycobacterium bovis
AFANFGFPESHALSFASLV

SEQ ID NO: 196234 - protein, 17 aa, Mycobacterium bovis
AFAPMALAVAKRLHNQG

SEQ ID NO: 196235 - protein, 24 aa, Mycobacterium bovis
AFARAEQAVRCGIDIQDALRNSAK

SEQ ID NO: 196236 - protein, 20 aa, Mycobacterium bovis
AFATMGCLYPNRVFLGVGTG

SEQ ID NO: 196237 - protein, 32 aa, Mycobacterium bovis
AFCSAHPLAKVQVCSRLAATELYRRLREFELD

SEQ ID NO: 196238 - protein, 25 aa, Mycobacterium bovis
AFDRIDERLVVVGLDNTVTYKNGDP

SEQ ID NO: 196239 - protein, 26 aa, Mycobacterium bovis
AFEEARRRFEASWNRENGEHPINDSA

SEQ ID NO: 196240 - protein, 17 aa, Mycobacterium bovis
AFEGKWDGYRLLVEADH

SEQ ID NO: 196241 - protein, 21 aa, Mycobacterium bovis
AFERDRIPLGASVLLVSGRAS

SEQ ID NO: 196242 - protein, 19 aa, Mycobacterium bovis
AFFCVVDLHAITIPQDPEA

SEQ ID NO: 196243 - protein, 23 aa, Mycobacterium bovis
AFGASPRASLGIIAAARSLALVR

SEQ ID NO: 196244 - protein, 17 aa, Mycobacterium bovis
AFGASRFTGIDFSDEAV

SEQ ID NO: 196245 - protein, 18 aa, Mycobacterium bovis
AFGEMFARQGHLGAMPAT

SEQ ID NO: 196246 - protein, 20 aa, Mycobacterium bovis
AFGLARARSAEGDRVGAVRT

SEQ ID NO: 196247 - protein, 26 aa, Mycobacterium bovis
AFGLPSRLRLGVCVTDAGRRNPAVTA

SEQ ID NO: 196248 - protein, 21 aa, Mycobacterium bovis
AFGQRFPDRLFDVGIAEQHAM

SEQ ID NO: 196249 - protein, 17 aa, Mycobacterium bovis
AFHQQFVQTLAGGAGAY

SEQ ID NO: 196250 - protein, 29 aa, Mycobacterium bovis
AFHRPGPRLRYLLAVKACFAVFQTGTPDH

SEQ ID NO: 196251 - protein, 26 aa, Mycobacterium bovis
AFKVDFAIEGDVGWTNPDCRRAGTVH

SEQ ID NO: 196252 - protein, 19 aa, Mycobacterium bovis
AFLATRLGGQWGGAYGTMP

SEQ ID NO: 196253 - protein, 19 aa, Mycobacterium bovis
AFLPFPFDSVIAGGASMAY

SEQ ID NO: 196254 - protein, 18 aa, Mycobacterium bovis
AFPPMAVSVRLADDIDIS

SEQ ID NO: 196255 - protein, 22 aa, Mycobacterium bovis
AFPYVVVTGIAMTTALATDAET

SEQ ID NO: 196256 - protein, 29 aa, Mycobacterium bovis
AFQRIKEPFSRWASLLIHAGEPGAGTRMK

SEQ ID NO: 196257 - protein, 25 aa, Mycobacterium bovis
AFQSVVWGLTVGSWIGSSAGLMAAA

SEQ ID NO: 196258 - protein, 24 aa, Mycobacterium bovis
AFRVLRPGGELIFTDPMQADDVPD

SEQ ID NO: 196259 - protein, 19 aa, Mycobacterium bovis
AFSIVWDGQKLHGLNASGR

SEQ ID NO: 196260 - protein, 23 aa, Mycobacterium bovis
AFTAFPKAHWQKIWSTNPLERIN

SEQ ID NO: 196261 - protein, 24 aa, Mycobacterium bovis
AFTASPFRWLSWLSDSGATMTAAP

SEQ ID NO: 196262 - protein, 19 aa, Mycobacterium bovis
AFTGRPGMFVRASGMALPL

SEQ ID NO: 196263 - protein, 20 aa, Mycobacterium bovis
AFVRSRLAGYLEQMDRVVSR

SEQ ID NO: 196264 - protein, 17 aa, Mycobacterium bovis
AFWSFGGLFLVNSPEQR

SEQ ID NO: 196265 - protein, 19 aa, Mycobacterium bovis
AFYERLRELFAARKSITTF

SEQ ID NO: 196266 - protein, 23 aa, Mycobacterium bovis
AFYLQYFGCRPYFAERVGGFTMR

SEQ ID NO: 196267 - protein, 23 aa, Mycobacterium bovis
AFYQAEIFEIVWSLWNLSRTDID

SEQ ID NO: 196268 - protein, 25 aa, Mycobacterium bovis
AGAARRCPDRPGLIDELGTLTWRQL

SEQ ID NO: 196269 - protein, 18 aa, Mycobacterium bovis
AGADAIYPGYGFLSENPD

SEQ ID NO: 196270 - protein, 26 aa, Mycobacterium bovis
AGAFLRAGAINRILAYVAPILLGGPV

SEQ ID NO: 196271 - protein, 17 aa, Mycobacterium bovis
AGAGIVWAKVNTFGSTA

SEQ ID NO: 196272 - protein, 19 aa, Mycobacterium bovis
AGAITPFALLQLADRGQFF

SEQ ID NO: 196273 - protein, 24 aa, Mycobacterium bovis
AGALWERLTRAVGMDARDAVWQHP

SEQ ID NO: 196274 - protein, 19 aa, Mycobacterium bovis
AGAMPVLTLYGIPHRDCGS

SEQ ID NO: 196275 - protein, 19 aa, Mycobacterium bovis
AGAPAYYTICELLHRHGFA

SEQ ID NO: 196276 - protein, 24 aa, Mycobacterium bovis
AGAPVGCGFITWSLARQPQLLDLA

SEQ ID NO: 196277 - protein, 25 aa, Mycobacterium bovis
AGAQYKKLRDVLGLLRDAYCRHIGV

SEQ ID NO: 196278 - protein, 23 aa, Mycobacterium bovis
AGASFLRRDGSVWTTDKDGIIMA

SEQ ID NO: 196279 - protein, 24 aa, Mycobacterium bovis
AGATYRLVKRSGFVASSTYADMPL

SEQ ID NO: 196280 - protein, 17 aa, Mycobacterium bovis
AGAVHLNKGCYRGQETV

SEQ ID NO: 196281 - protein, 21 aa, Mycobacterium bovis
AGAVLKVIVESAVLLGQSNAH

SEQ ID NO: 196282 - protein, 20 aa, Mycobacterium bovis
AGAVQRLKVGSAKRFTNITR

SEQ ID NO: 196283 - protein, 17 aa, Mycobacterium bovis
AGDDEWCVISIRSDDEW

SEQ ID NO: 196284 - protein, 22 aa, Mycobacterium bovis
AGDFWGGAGSVACQEFITQLGR

SEQ ID NO: 196285 - protein, 25 aa, Mycobacterium bovis
AGDHAAICWPLLVGMAKAKYYLLTC

SEQ ID NO: 196286 - protein, 22 aa, Mycobacterium bovis
AGDKLWARMDIHSVDERFGADI

SEQ ID NO: 196287 - protein, 18 aa, Mycobacterium bovis
AGDLGDWGGPDALADLDP

SEQ ID NO: 196288 - protein, 17 aa, Mycobacterium bovis
AGDRARLAVTIGSRAHA

SEQ ID NO: 196289 - protein, 21 aa, Mycobacterium bovis
AGDSRLVAVLAELDDADTRAA

SEQ ID NO: 196290 - protein, 18 aa, Mycobacterium bovis
AGDTWAAIGVALGITRQA

SEQ ID NO: 196291 - protein, 22 aa, Mycobacterium bovis
AGDVRLLLPMPADWSYAEAAAI

SEQ ID NO: 196292 - protein, 22 aa, Mycobacterium bovis
AGEAILTGWRMLLDEGRLQDGE

SEQ ID NO: 196293 - protein, 20 aa, Mycobacterium bovis
AGELALLRLACEAADAALTD

SEQ ID NO: 196294 - protein, 20 aa, Mycobacterium bovis
AGERGLCAGGDVVAVYHSAR

SEQ ID NO: 196295 - protein, 18 aa, Mycobacterium bovis
AGETGCRIVLPEGADPFV

SEQ ID NO: 196296 - protein, 23 aa, Mycobacterium bovis
AGETLSALALRFYGDAELYRLIA

SEQ ID NO: 196297 - protein, 22 aa, Mycobacterium bovis
AGFEPIELVMGVSVYHVGFQFS

SEQ ID NO: 196298 - protein, 29 aa, Mycobacterium bovis
AGFGVLLPSWWDRRRKLGLVLSAYTPVDG

SEQ ID NO: 196299 - protein, 20 aa, Mycobacterium bovis
AGFHTLKLQTFLTAGPKEAR

SEQ ID NO: 196300 - protein, 21 aa, Mycobacterium bovis
AGFPLGWVHDVVWAPRPIGGP

SEQ ID NO: 196301 - protein, 17 aa, Mycobacterium bovis
AGFRSLGLDGFRLEITS

SEQ ID NO: 196302 - protein, 20 aa, Mycobacterium bovis
AGGAAGLWGAGGGGGNGGNG

SEQ ID NO: 196303 - protein, 24 aa, Mycobacterium bovis
AGGAGGAGGFGFGGAGGAGGLGGK

SEQ ID NO: 196304 - protein, 21 aa, Mycobacterium bovis
AGGAGGILWGNGGNGGSGAPG

SEQ ID NO: 196305 - protein, 25 aa, Mycobacterium bovis
AGGAGGNAGMLFGSGGGGGTGGFGF

SEQ ID NO: 196306 - protein, 24 aa, Mycobacterium bovis
AGGAGGNGGWLYGNGGPGGAAGLG

SEQ ID NO: 196307 - protein, 29 aa, Mycobacterium bovis
AGGAGGRGGKGIDGGFGGDGGNGGSNNGT

SEQ ID NO: 196308 - protein, 20 aa, Mycobacterium bovis
AGGAGGWLSGHSGAHGAMGS

SEQ ID NO: 196309 - protein, 25 aa, Mycobacterium bovis
AGGDCGRCRRTLRAIIAAARLNPTQ

SEQ ID NO: 196310 - protein, 25 aa, Mycobacterium bovis
AGGDGGRGGLLYGDGGAGGAGGNGS

SEQ ID NO: 196311 - protein, 17 aa, Mycobacterium bovis
AGGFGIPVGSGGAGGSR

SEQ ID NO: 196312 - protein, 24 aa, Mycobacterium bovis
AGGGARGLAHFGVYQELTEAGVVI

SEQ ID NO: 196313 - protein, 26 aa, Mycobacterium bovis
AGGGGRGMRVVHELSALPAEVEAARR

SEQ ID NO: 196314 - protein, 24 aa, Mycobacterium bovis
AGGHGGAGGLIWGNGGAGGNGGNG

SEQ ID NO: 196315 - protein, 24 aa, Mycobacterium bovis
AGGHSLLPMMKLRIANPEYLVDIN

SEQ ID NO: 196316 - protein, 19 aa, Mycobacterium bovis
AGGKADIANSLGDNATVTG

SEQ ID NO: 196317 - protein, 23 aa, Mycobacterium bovis
AGGKRFRPLFTVLSAQIGPQPDA

SEQ ID NO: 196318 - protein, 18 aa, Mycobacterium bovis
AGGLLIGNGGAGGVGGTA

SEQ ID NO: 196319 - protein, 19 aa, Mycobacterium bovis
AGGNARLIGDGGRGGNGGE

SEQ ID NO: 196320 - protein, 19 aa, Mycobacterium bovis
AGGNAYLFGSGGAGGQGGM

SEQ ID NO: 196321 - protein, 18 aa, Mycobacterium bovis
AGGRGVGSAENFSVVEAL

SEQ ID NO: 196322 - protein, 18 aa, Mycobacterium bovis
AGGSGGFLSGAAGVSGAD

SEQ ID NO: 196323 - protein, 19 aa, Mycobacterium bovis
AGGSLEIFLTPQLPAPLIQ

SEQ ID NO: 196324 - protein, 19 aa, Mycobacterium bovis
AGGSVRWDPTNGQGRVYYG

SEQ ID NO: 196325 - protein, 28 aa, Mycobacterium bovis
AGGTGGKGGDGFGVFGKGGAGGTGGRGG

SEQ ID NO: 196326 - protein, 17 aa, Mycobacterium bovis
AGGTLWVELTGMGVTWM

SEQ ID NO: 196327 - protein, 18 aa, Mycobacterium bovis
AGGVGGFGVHPALLDAVL

SEQ ID NO: 196328 - protein, 17 aa, Mycobacterium bovis
AGGYGLDPERIWTTVYF

SEQ ID NO: 196329 - protein, 25 aa, Mycobacterium bovis
AGHFELRPGQALVITVPVSDAPYLG

SEQ ID NO: 196330 - protein, 24 aa, Mycobacterium bovis
AGHGRSGFLLAPWTAEQIVSELVS

SEQ ID NO: 196331 - protein, 23 aa, Mycobacterium bovis
AGHPFAATGGRILAQTAKQLAEK

SEQ ID NO: 196332 - protein, 23 aa, Mycobacterium bovis
AGHSRWLSAEAMAARLNDVGVGR

SEQ ID NO: 196333 - protein, 19 aa, Mycobacterium bovis
AGHYGMCGRAYDPRFLFAW

SEQ ID NO: 196334 - protein, 17 aa, Mycobacterium bovis
AGIAAAVHAGRAGAQRG

SEQ ID NO: 196335 - protein, 25 aa, Mycobacterium bovis
AGIDDSWAALRWVGENAAELGGDPS

SEQ ID NO: 196336 - protein, 25 aa, Mycobacterium bovis
AGILDVLDNYAFVRTSGYLPGPHDV

SEQ ID NO: 196337 - protein, 18 aa, Mycobacterium bovis
AGIPLLAGAISKAVLPPI

SEQ ID NO: 196338 - protein, 18 aa, Mycobacterium bovis
AGIRRWLDSPSLMVADMF

SEQ ID NO: 196339 - protein, 19 aa, Mycobacterium bovis
AGITCAVLIPQGKIAMGKL

SEQ ID NO: 196340 - protein, 17 aa, Mycobacterium bovis
AGKRLAPHALEWDAAKH

SEQ ID NO: 196341 - protein, 24 aa, Mycobacterium bovis
AGKRLPVPLFPGFDTLGTLEYITK

SEQ ID NO: 196342 - protein, 17 aa, Mycobacterium bovis
AGLAGLANRIVDAVDSL

SEQ ID NO: 196343 - protein, 17 aa, Mycobacterium bovis
AGLAMLAPIWGYAPLLD

SEQ ID NO: 196344 - protein, 19 aa, Mycobacterium bovis
AGLDGYSAADCVALLREAA

SEQ ID NO: 196345 - protein, 25 aa, Mycobacterium bovis
AGLEAAKPFIAALCTAQQELADAAG

SEQ ID NO: 196346 - protein, 17 aa, Mycobacterium bovis
AGLELLYRMADFCRPDW

SEQ ID NO: 196347 - protein, 27 aa, Mycobacterium bovis
AGLEPDLKWERFITAVRLLAERLGVRQ

SEQ ID NO: 196348 - protein, 24 aa, Mycobacterium bovis
AGLGLRSGLSAGLAHAASAGLGQA

SEQ ID NO: 196349 - protein, 18 aa, Mycobacterium bovis
AGLKAIYLSGWQVAGDAN

SEQ ID NO: 196350 - protein, 27 aa, Mycobacterium bovis
AGLKTSRDAWCYNFSRGALEANIGRTI

SEQ ID NO: 196351 - protein, 18 aa, Mycobacterium bovis
AGLLDYPMHIGARCQSVC

SEQ ID NO: 196352 - protein, 18 aa, Mycobacterium bovis
AGLLRPPAAQRLVSALRS

SEQ ID NO: 196353 - protein, 17 aa, Mycobacterium bovis
AGLPRTMTFKVIKRQLS

SEQ ID NO: 196354 - protein, 24 aa, Mycobacterium bovis
AGLQARLGLDSGKWTHEQMARVAF

SEQ ID NO: 196355 - protein, 17 aa, Mycobacterium bovis
AGLRAAGRVAGLIGTIG

SEQ ID NO: 196356 - protein, 22 aa, Mycobacterium bovis
AGLRICARIAQARPLRDLLGSI

SEQ ID NO: 196357 - protein, 17 aa, Mycobacterium bovis
AGLTLALAADWRVSGDN

SEQ ID NO: 196358 - protein, 17 aa, Mycobacterium bovis
AGLVCAHTGGALPRTRP

SEQ ID NO: 196359 - protein, 17 aa, Mycobacterium bovis
AGLWEWAERLGDEVTLD

SEQ ID NO: 196360 - protein, 23 aa, Mycobacterium bovis
AGMARLAVIAAKVITGRKLSRRP

SEQ ID NO: 196361 - protein, 17 aa, Mycobacterium bovis
AGMEVCCGGILGMGETL

SEQ ID NO: 196362 - protein, 19 aa, Mycobacterium bovis
AGMHPWGKWGNDFTEYGVV

SEQ ID NO: 196363 - protein, 23 aa, Mycobacterium bovis
AGMPERLRLPTARPYPPVADQRG

SEQ ID NO: 196364 - protein, 24 aa, Mycobacterium bovis
AGMPGMPFGTMGGQGFGRAVPQYG

SEQ ID NO: 196365 - protein, 23 aa, Mycobacterium bovis
AGNGGSGGNGFDSFASGGTGGAG

SEQ ID NO: 196366 - protein, 18 aa, Mycobacterium bovis
AGNLVLMVQPPRGFGENP

SEQ ID NO: 196367 - protein, 25 aa, Mycobacterium bovis
AGNPEIRPAHLLMALLTQNDGIAAP

SEQ ID NO: 196368 - protein, 17 aa, Mycobacterium bovis
AGNWKRWYDNNIPIADQ

SEQ ID NO: 196369 - protein, 19 aa, Mycobacterium bovis
AGPADWALLGAALLGVGGS

SEQ ID NO: 196370 - protein, 24 aa, Mycobacterium bovis
AGPAYNTGSAWGYTPKGATGVPTR

SEQ ID NO: 196371 - protein, 18 aa, Mycobacterium bovis
AGPEIGVASTKTFLAQIA

SEQ ID NO: 196372 - protein, 29 aa, Mycobacterium bovis
AGPFGTTIAHGFMTLALLPRLQHQMYTVK

SEQ ID NO: 196373 - protein, 29 aa, Mycobacterium bovis
AGPGECVALLFERCAPAVVAMVAVLKTGA

SEQ ID NO: 196374 - protein, 24 aa, Mycobacterium bovis
AGPLPLQIICDMMGIPKADHQRIF

SEQ ID NO: 196375 - protein, 19 aa, Mycobacterium bovis
AGPRRAAVSSFGLSGTNAH

SEQ ID NO: 196376 - protein, 18 aa, Mycobacterium bovis
AGQACLAHALAHRGDTEA

SEQ ID NO: 196377 - protein, 19 aa, Mycobacterium bovis
AGQFCLANTIAVAPAATNL

SEQ ID NO: 196378 - protein, 28 aa, Mycobacterium bovis
AGQGCAITTRLVVPRARYEEAVAIAAAT

SEQ ID NO: 196379 - protein, 24 aa, Mycobacterium bovis
AGQIAHCLAELVTLDTPTVSILLG

SEQ ID NO: 196380 - protein, 18 aa, Mycobacterium bovis
AGQRFVIDVTVWIDLAEA

SEQ ID NO: 196381 - protein, 21 aa, Mycobacterium bovis
AGRDFTVDWVHLKLNDQAQRT

SEQ ID NO: 196382 - protein, 25 aa, Mycobacterium bovis
AGRGLRCIAPTWPLGAHPKPLRPGA

SEQ ID NO: 196383 - protein, 24 aa, Mycobacterium bovis
AGRHRCVGAAFAIMQIKAIFSVLL

SEQ ID NO: 196384 - protein, 24 aa, Mycobacterium bovis
AGRIGFPAIVGIIADVLHAADQWA

SEQ ID NO: 196385 - protein, 24 aa, Mycobacterium bovis
AGRIPVPVPGFGVWALDSLRRANH

SEQ ID NO: 196386 - protein, 25 aa, Mycobacterium bovis
AGRIVSFDAAGGWNIEEEGYQAVGS

SEQ ID NO: 196387 - protein, 19 aa, Mycobacterium bovis
AGRLHILEVQRLIRFMPKV

SEQ ID NO: 196388 - protein, 26 aa, Mycobacterium bovis
AGRTWHPHQVPAFLAAGYRCITFDNR

SEQ ID NO: 196389 - protein, 17 aa, Mycobacterium bovis
AGRVWVNCYHLYPAHAA

SEQ ID NO: 196390 - protein, 19 aa, Mycobacterium bovis
AGSALQIHGAIAFTWEHDL

SEQ ID NO: 196391 - protein, 17 aa, Mycobacterium bovis
AGSDAAWLRAELNNERG

SEQ ID NO: 196392 - protein, 19 aa, Mycobacterium bovis
AGSDPDWDARVALHRARRP

SEQ ID NO: 196393 - protein, 23 aa, Mycobacterium bovis
AGSEPMSAAAVAWDQLAMELASA

SEQ ID NO: 196394 - protein, 25 aa, Mycobacterium bovis
AGSGPMLAAAAAWDGLADELAVAAS

SEQ ID NO: 196395 - protein, 20 aa, Mycobacterium bovis
AGSLVLLAWGAANRDPRQYE

SEQ ID NO: 196396 - protein, 22 aa, Mycobacterium bovis
AGSNALGLFLGLGGSGGQGGDS

SEQ ID NO: 196397 - protein, 17 aa, Mycobacterium bovis
AGSNNWGLANLGVGNIG

SEQ ID NO: 196398 - protein, 18 aa, Mycobacterium bovis
AGSPEERAAVLGILAELL

SEQ ID NO: 196399 - protein, 25 aa, Mycobacterium bovis
AGSPGAVCRWCGRVDPTLRCVRCGS

SEQ ID NO: 196400 - protein, 20 aa, Mycobacterium bovis
AGSRATHIVVWATLDKSLGR

SEQ ID NO: 196401 - protein, 20 aa, Mycobacterium bovis
AGSVPVELNVSAGFDVTELP

SEQ ID NO: 196402 - protein, 19 aa, Mycobacterium bovis
AGTAVRSGAGAARVAGGSV

SEQ ID NO: 196403 - protein, 19 aa, Mycobacterium bovis
AGTGLAAISWGLAHERMSI

SEQ ID NO: 196404 - protein, 30 aa, Mycobacterium bovis
AGTGNSGNFGVDGEAGFSGGAGGNGGVGGA

SEQ ID NO: 196405 - protein, 17 aa, Mycobacterium bovis
AGTGNWGIGNSGAGNFG

SEQ ID NO: 196406 - protein, 19 aa, Mycobacterium bovis
AGTGVRFTPTLTFTLDTIS

SEQ ID NO: 196407 - protein, 41 aa, Mycobacterium bovis
AGTPRRYGVRWHYRLPVWSDFVEVHWSRWGEAYVTPVEPDL

SEQ ID NO: 196408 - protein, 19 aa, Mycobacterium bovis
AGTSGWWNQGHDVLAGAGS

SEQ ID NO: 196409 - protein, 30 aa, Mycobacterium bovis
AGTSISGFFNFGSLMSGFANFDDEVSGYLN

SEQ ID NO: 196410 - protein, 19 aa, Mycobacterium bovis
AGTTFPTDICEPVAVVGIG

SEQ ID NO: 196411 - protein, 24 aa, Mycobacterium bovis
AGTVARAFLRQALGVEVLSHVISI

SEQ ID NO: 196412 - protein, 17 aa, Mycobacterium bovis
AGTWVKAVAGIRLALSL

SEQ ID NO: 196413 - protein, 19 aa, Mycobacterium bovis
AGVAQCWHQLVGDTGEIVS

SEQ ID NO: 196414 - protein, 20 aa, Mycobacterium bovis
AGVARWTLDTAVAYAKVREQ

SEQ ID NO: 196415 - protein, 22 aa, Mycobacterium bovis
AGVGGAGGFALATTASGGAGGA

SEQ ID NO: 196416 - protein, 18 aa, Mycobacterium bovis
AGVKITWTPIEPTLPSID

SEQ ID NO: 196417 - protein, 25 aa, Mycobacterium bovis
AGVLKGEVKDVLLLDVTPLSLGIET

SEQ ID NO: 196418 - protein, 25 aa, Mycobacterium bovis
AGVLLRYVPLTAKRVTGIVSRGGSI

SEQ ID NO: 196419 - protein, 33 aa, Mycobacterium bovis
AGVMAGAVVSPVWPAPRALGLRAVAATATSASS

SEQ ID NO: 196420 - protein, 20 aa, Mycobacterium bovis
AGVPLKAPVAGIAMGLVSDD

SEQ ID NO: 196421 - protein, 26 aa, Mycobacterium bovis
AGVPYPSLKRMNPWKRFFHNQTKIDE

SEQ ID NO: 196422 - protein, 17 aa, Mycobacterium bovis
AGVRLLGCYHPSQQNMF

SEQ ID NO: 196423 - protein, 17 aa, Mycobacterium bovis
AGVSRVYLAGPEKALGD

SEQ ID NO: 196424 - protein, 20 aa, Mycobacterium bovis
AGVSSFGFGGTNAHVIVEEA

SEQ ID NO: 196425 - protein, 20 aa, Mycobacterium bovis
AGVVCPVHLGIMRGALQTWA

SEQ ID NO: 196426 - protein, 22 aa, Mycobacterium bovis
AGVVRLRFGLTDGQPRTLDEIG

SEQ ID NO: 196427 - protein, 26 aa, Mycobacterium bovis
AGVYPPCSAFEAWFVSAALDDAAFGR

SEQ ID NO: 196428 - protein, 26 aa, Mycobacterium bovis
AGWPNLAAELQLAFQQLLVGDYNAAV

SEQ ID NO: 196429 - protein, 17 aa, Mycobacterium bovis
AGYALAGRHVHVVTIND

SEQ ID NO: 196430 - protein, 25 aa, Mycobacterium bovis
AGYAYFAGRLGDWMRVDGENLGTAP

SEQ ID NO: 196431 - protein, 21 aa, Mycobacterium bovis
AGYEKWRIRFASTAWTSTWRR

SEQ ID NO: 196432 - protein, 17 aa, Mycobacterium bovis
AGYKVPRSLWFVDEVKR

SEQ ID NO: 196433 - protein, 24 aa, Mycobacterium bovis
AGYRGEIKVALINLDPAAPIVVHR

SEQ ID NO: 196434 - protein, 19 aa, Mycobacterium bovis
AGYRLGEMVQVESWSHEWR

SEQ ID NO: 196435 - protein, 17 aa, Mycobacterium bovis
AGYRRFLERRLRETFGF

SEQ ID NO: 196436 - protein, 20 aa, Mycobacterium bovis
AHAAIKRFLTVSTPGSHLIL

SEQ ID NO: 196437 - protein, 25 aa, Mycobacterium bovis
AHAAILPLYYLRRAGIAESDLQVIR

SEQ ID NO: 196438 - protein, 19 aa, Mycobacterium bovis
AHAGIPVTVVPGVTSAIAV

SEQ ID NO: 196439 - protein, 23 aa, Mycobacterium bovis
AHAIPGLRQALGLAEDGTDERAT

SEQ ID NO: 196440 - protein, 18 aa, Mycobacterium bovis
AHALAFAAEGARVVVNDI

SEQ ID NO: 196441 - protein, 20 aa, Mycobacterium bovis
AHATAWYGLHELARIRAGDT

SEQ ID NO: 196442 - protein, 21 aa, Mycobacterium bovis
AHDWGGPVAFIMMLRHPEKVT

SEQ ID NO: 196443 - protein, 18 aa, Mycobacterium bovis
AHFADGWNTFNLTLQGDV

SEQ ID NO: 196444 - protein, 26 aa, Mycobacterium bovis
AHGIDTVVVGWGYGRADFIDKTSTTV

SEQ ID NO: 196445 - protein, 17 aa, Mycobacterium bovis
AHGPYAVGITGEDAQLF

SEQ ID NO: 196446 - protein, 20 aa, Mycobacterium bovis
AHGRRRRARFFGRNVNVPLM

SEQ ID NO: 196447 - protein, 20 aa, Mycobacterium bovis
AHHRESFLYTNFEELCDIFA

SEQ ID NO: 196448 - protein, 27 aa, Mycobacterium bovis
AHLEHPKMPLVPLIDGWETVVEMEAAL

SEQ ID NO: 196449 - protein, 17 aa, Mycobacterium bovis
AHLPRAVRWHRYSLDNG

SEQ ID NO: 196450 - protein, 17 aa, Mycobacterium bovis
AHLRGGELTVRFRPNPE

SEQ ID NO: 196451 - protein, 24 aa, Mycobacterium bovis
AHLRNMAFYNFGLRLLKRARDADR

SEQ ID NO: 196452 - protein, 18 aa, Mycobacterium bovis
AHLRPELGGQGFGQVKLA

SEQ ID NO: 196453 - protein, 19 aa, Mycobacterium bovis
AHLTGNVAMGAFTIPQIDI

SEQ ID NO: 196454 - protein, 17 aa, Mycobacterium bovis
AHNRVHFPRAMFDEPLP

SEQ ID NO: 196455 - protein, 21 aa, Mycobacterium bovis
AHPAMKALVVCIELCSVNAVF

SEQ ID NO: 196456 - protein, 18 aa, Mycobacterium bovis
AHPEPLPPVSGLTIAVER

SEQ ID NO: 196457 - protein, 25 aa, Mycobacterium bovis
AHPQGRISLAIAHRPGERNGVADLC

SEQ ID NO: 196458 - protein, 18 aa, Mycobacterium bovis
AHQLELRASWTATTPDLG

SEQ ID NO: 196459 - protein, 27 aa, Mycobacterium bovis
AHRERLGLPGLRDWLRRQAKAGAGPPE

SEQ ID NO: 196460 - protein, 24 aa, Mycobacterium bovis
AHRFAEAVTAIWHGRVEIDRFNEL

SEQ ID NO: 196461 - protein, 30 aa, Mycobacterium bovis
AHSISPWGTWEWIGPPALGAVLPARGMAKL

SEQ ID NO: 196462 - protein, 25 aa, Mycobacterium bovis
AHSPKRLESELTWIEEHTGGKPYGV

SEQ ID NO: 196463 - protein, 23 aa, Mycobacterium bovis
AHTRPDQLVAMPALPTTPIGKID

SEQ ID NO: 196464 - protein, 18 aa, Mycobacterium bovis
AHTTRARQVLVATEVGML

SEQ ID NO: 196465 - protein, 25 aa, Mycobacterium bovis
AHVGIQLYVKRVFIMGDCDQLMPEY

SEQ ID NO: 196466 - protein, 20 aa, Mycobacterium bovis
AHWKAHKLDLAPVLHEPESA

SEQ ID NO: 196467 - protein, 25 aa, Mycobacterium bovis
AHYHKIHLYDAFGFTESRTVAPGRE

SEQ ID NO: 196468 - protein, 17 aa, Mycobacterium bovis
AIAQLNFANARRNPNAQ

SEQ ID NO: 196469 - protein, 18 aa, Mycobacterium bovis
AIAQTWWSERFIAVLEDI

SEQ ID NO: 196470 - protein, 25 aa, Mycobacterium bovis
AIARFKRLDGYDVRFLTGTDEHGLK

SEQ ID NO: 196471 - protein, 24 aa, Mycobacterium bovis
AIASCPPGRVEVVANYTAFLQLQR

SEQ ID NO: 196472 - protein, 24 aa, Mycobacterium bovis
AIAVAKRGATVFALARNGNALDEL

SEQ ID NO: 196473 - protein, 33 aa, Mycobacterium bovis
AIAYARARGLPVLGLCLGLQCIVIEAARSVGLT

SEQ ID NO: 196474 - protein, 25 aa, Mycobacterium bovis
AICSARTAAQFGIEPRVAMLSYSTG

SEQ ID NO: 196475 - protein, 17 aa, Mycobacterium bovis
AIDDTWLRTGDLGVYLD

SEQ ID NO: 196476 - protein, 28 aa, Mycobacterium bovis
AIDIPAIRPEFSANVAIDSFTVPSIPIP

SEQ ID NO: 196477 - protein, 31 aa, Mycobacterium bovis
AIDLELRYRGLRAPHKIKLGVSGCARECAEA

SEQ ID NO: 196478 - protein, 17 aa, Mycobacterium bovis
AIEDAWAATRWVAEHGR

SEQ ID NO: 196479 - protein, 33 aa, Mycobacterium bovis
AIEELRARFNLRYPLAHLRPFLSTHERDLTMGG

SEQ ID NO: 196480 - protein, 20 aa, Mycobacterium bovis
AIELGRLGGLGVLNGEGLIG

SEQ ID NO: 196481 - protein, 26 aa, Mycobacterium bovis
AIEVYPHPATVALFRLPRALKYKAKP

SEQ ID NO: 196482 - protein, 19 aa, Mycobacterium bovis
AIGCPLINIHHSFLPAFTG

SEQ ID NO: 196483 - protein, 19 aa, Mycobacterium bovis
AIGCVPWLSSEAVAETLLA

SEQ ID NO: 196484 - protein, 30 aa, Mycobacterium bovis
AIGMTIPYAALEIMKLRLTRSAYQQATGLA

SEQ ID NO: 196485 - protein, 17 aa, Mycobacterium bovis
AIGRPRVPVEVNHEPFV

SEQ ID NO: 196486 - protein, 22 aa, Mycobacterium bovis
AIHRRCRRGGDTVRSLIDCQVA

SEQ ID NO: 196487 - protein, 24 aa, Mycobacterium bovis
AIIDSLLRSCPRLTILTTSTEAIG

SEQ ID NO: 196488 - protein, 22 aa, Mycobacterium bovis
AILAGEAHFAIGYTEPEAGTDL

SEQ ID NO: 196489 - protein, 19 aa, Mycobacterium bovis
AILANRLSPALTFGGANLN

SEQ ID NO: 196490 - protein, 18 aa, Mycobacterium bovis
AILTAGLLGEEVPMPVLL

SEQ ID NO: 196491 - protein, 28 aa, Mycobacterium bovis
AINAPFLAALGRPLIGNGADGAPGTGAA

SEQ ID NO: 196492 - protein, 26 aa, Mycobacterium bovis
AINGHVRAGGFGLVGACDMVVAGPES

SEQ ID NO: 196493 - protein, 27 aa, Mycobacterium bovis
AIPGDLGDRFGFCIPDLAVWDNPSAND

SEQ ID NO: 196494 - protein, 19 aa, Mycobacterium bovis
AIQVPPNGLPVILGPDHPI

SEQ ID NO: 196495 - protein, 19 aa, Mycobacterium bovis
AIRADFPILKRIMRGGNPL

SEQ ID NO: 196496 - protein, 19 aa, Mycobacterium bovis
AIRAGDCDLALAGGVCVMG

SEQ ID NO: 196497 - protein, 17 aa, Mycobacterium bovis
AIRARRSLDSAAGWLAP

SEQ ID NO: 196498 - protein, 17 aa, Mycobacterium bovis
AIREWARRNGHNVSTRG

SEQ ID NO: 196499 - protein, 20 aa, Mycobacterium bovis
AIRVAGWIDKLGAVWVEGQL

SEQ ID NO: 196500 - protein, 28 aa, Mycobacterium bovis
AISDELWDLLPGYLIFRSIIPNRPPTQD

SEQ ID NO: 196501 - protein, 23 aa, Mycobacterium bovis
AITGCLIAGVPVVPVPADVGVTE

SEQ ID NO: 196502 - protein, 18 aa, Mycobacterium bovis
AITIGFDAGDGFLGRLRG

SEQ ID NO: 196503 - protein, 18 aa, Mycobacterium bovis
AITKVIWSEYFRRYTDLA

SEQ ID NO: 196504 - protein, 17 aa, Mycobacterium bovis
AITWPEIAASADGSVYV

SEQ ID NO: 196505 - protein, 17 aa, Mycobacterium bovis
AIVGNCYIEIMPMGTRV

SEQ ID NO: 196506 - protein, 19 aa, Mycobacterium bovis
AIYVGSLSVPQGWAEAAPV

SEQ ID NO: 196507 - protein, 19 aa, Mycobacterium bovis
AKAALRYADALIWTPAHLA

SEQ ID NO: 196508 - protein, 19 aa, Mycobacterium bovis
AKADARRKVRDGGEREMRQ

SEQ ID NO: 196509 - protein, 17 aa, Mycobacterium bovis
AKALRDFASQYGVPMEQ

SEQ ID NO: 196510 - protein, 21 aa, Mycobacterium bovis
AKALRSGGVVVVFPGGDYDAY

SEQ ID NO: 196511 - protein, 21 aa, Mycobacterium bovis
AKANEVALILVGHVTKDGAIA

SEQ ID NO: 196512 - protein, 22 aa, Mycobacterium bovis
AKARGANILARIMGASITSDGF

SEQ ID NO: 196513 - protein, 17 aa, Mycobacterium bovis
AKASLGQQVPHPSRLGN

SEQ ID NO: 196514 - protein, 27 aa, Mycobacterium bovis
AKDCIQVLGGIGCTWEHDAHLYLRRAH

SEQ ID NO: 196515 - protein, 17 aa, Mycobacterium bovis
AKDRGLWNLFLSAESGL

SEQ ID NO: 196516 - protein, 18 aa, Mycobacterium bovis
AKEALNFIDVQRVNASYR

SEQ ID NO: 196517 - protein, 29 aa, Mycobacterium bovis
AKEDYFKLGYRGARFAFGYGACPDLEDRA

SEQ ID NO: 196518 - protein, 18 aa, Mycobacterium bovis
AKEEVIHLVPDVNKERGP

SEQ ID NO: 196519 - protein, 19 aa, Mycobacterium bovis
AKEVISIAGRNIFPTEVEL

SEQ ID NO: 196520 - protein, 17 aa, Mycobacterium bovis
AKFASAVSKNPFVGEPI

SEQ ID NO: 196521 - protein, 23 aa, Mycobacterium bovis
AKFGLTEAIAAYSTRLKITPTRV

SEQ ID NO: 196522 - protein, 17 aa, Mycobacterium bovis
AKFLDKRGPGIQQLACR

SEQ ID NO: 196523 - protein, 26 aa, Mycobacterium bovis
AKFRPGPRRRLGVLVDHLVAGSKEAR

SEQ ID NO: 196524 - protein, 27 aa, Mycobacterium bovis
AKGESYPTAMLMVFKLHRDFDIAEALK

SEQ ID NO: 196525 - protein, 18 aa, Mycobacterium bovis
AKGGAAVFQMMGLCQILR

SEQ ID NO: 196526 - protein, 26 aa, Mycobacterium bovis
AKGHDTFCPVGPWIVTDLAPFDPADL

SEQ ID NO: 196527 - protein, 24 aa, Mycobacterium bovis
AKGLEFPVVFVTGWEDGMFPHMRA

SEQ ID NO: 196528 - protein, 24 aa, Mycobacterium bovis
AKKGLEFVRPVAVDLTYIPVVGHA

SEQ ID NO: 196529 - protein, 21 aa, Mycobacterium bovis
AKKPVVTDFCDFRTAEQRERA

SEQ ID NO: 196530 - protein, 19 aa, Mycobacterium bovis
AKLFDEWFPANKLVKLGLR

SEQ ID NO: 196531 - protein, 20 aa, Mycobacterium bovis
AKLGAWGVIASVQPNFDELW

SEQ ID NO: 196532 - protein, 18 aa, Mycobacterium bovis
AKLLHAFGECTVPRVTLV

SEQ ID NO: 196533 - protein, 17 aa, Mycobacterium bovis
AKLPFVRELCRDYQHID

SEQ ID NO: 196534 - protein, 20 aa, Mycobacterium bovis
AKLPTIAAYAYKKSVGQPFL

SEQ ID NO: 196535 - protein, 25 aa, Mycobacterium bovis
AKLQKRLTEELAWVRSGAKARQAKS

SEQ ID NO: 196536 - protein, 20 aa, Mycobacterium bovis
AKLRDELALVIKDLELACDK

SEQ ID NO: 196537 - protein, 17 aa, Mycobacterium bovis
AKLTEWLKLALDEPHLL

SEQ ID NO: 196538 - protein, 21 aa, Mycobacterium bovis
AKMFNCTGWKIGWACGPAELI

SEQ ID NO: 196539 - protein, 20 aa, Mycobacterium bovis
AKMLRLAVDEVFQMQSEARA
